United States Patent 7,888,497 (BIOINFORMATICALLY DETECTABLE GROUP OF NOVEL REGULATORY OLIGONUCLEOTIDES AND USES THEREOF) - sequence listing, part 116

SEQ ID NO: 4911621 - DNA, 22 bp, Homo sapiens
tttggagaaattatttaataaa

SEQ ID NO: 4911622 - DNA, 17 bp, Homo sapiens
tttggatcttgaatgtg

SEQ ID NO: 4911623 - DNA, 14 bp, Homo sapiens
tttggattgtatat

SEQ ID NO: 4911624 - DNA, 14 bp, Homo sapiens
tttggatttgacat

SEQ ID NO: 4911625 - DNA, 16 bp, Homo sapiens
tttggcttaaatatag

SEQ ID NO: 4911626 - DNA, 14 bp, Homo sapiens
tttggcttccatga

SEQ ID NO: 4911627 - DNA, 21 bp, Homo sapiens
tttgggcagcaatttaaatgt

SEQ ID NO: 4911628 - DNA, 23 bp, Homo sapiens
tttggggaagggtttgaattgtt

SEQ ID NO: 4911629 - DNA, 22 bp, Homo sapiens
tttggggacagattcagtcttg

SEQ ID NO: 4911630 - DNA, 20 bp, Homo sapiens
tttgggggtcaggcagccag

SEQ ID NO: 4911631 - DNA, 22 bp, Homo sapiens
tttggggtacccactgctctgg

SEQ ID NO: 4911632 - DNA, 10 bp, Homo sapiens
tttggggtct

SEQ ID NO: 4911633 - DNA, 14 bp, Homo sapiens
tttggtagattaaa

SEQ ID NO: 4911634 - DNA, 22 bp, Homo sapiens
tttggtattacactgtatttgt

SEQ ID NO: 4911635 - DNA, 16 bp, Homo sapiens
tttggtctggactgac

SEQ ID NO: 4911636 - DNA, 17 bp, Homo sapiens
tttggtgcatagaactg

SEQ ID NO: 4911637 - DNA, 15 bp, Homo sapiens
tttggttcctctctg

SEQ ID NO: 4911638 - DNA, 13 bp, Homo sapiens
tttggttctaagg

SEQ ID NO: 4911639 - DNA, 21 bp, Homo sapiens
tttggtttatattttttcagt

SEQ ID NO: 4911640 - DNA, 12 bp, Homo sapiens
tttgtaaatgtt

SEQ ID NO: 4911641 - DNA, 18 bp, Homo sapiens
tttgtaaatgttatttct

SEQ ID NO: 4911642 - DNA, 20 bp, Homo sapiens
tttgtaaatgttatttctgc

SEQ ID NO: 4911643 - DNA, 16 bp, Homo sapiens
tttgtaagagtgtaga

SEQ ID NO: 4911644 - DNA, 17 bp, Homo sapiens
tttgtaagagtgtagaa

SEQ ID NO: 4911645 - DNA, 18 bp, Homo sapiens
tttgtaagagtgtagaag

SEQ ID NO: 4911646 - DNA, 22 bp, Homo sapiens
tttgtaagagtgtagaagcatt

SEQ ID NO: 4911647 - DNA, 21 bp, Homo sapiens
tttgtaagtgctacataaatt

SEQ ID NO: 4911648 - DNA, 15 bp, Homo sapiens
tttgtaatgtgtgaa

SEQ ID NO: 4911649 - DNA, 24 bp, Homo sapiens
tttgtaattaaattatggtattaa

SEQ ID NO: 4911650 - DNA, 19 bp, Homo sapiens
tttgtacatctggcttatt

SEQ ID NO: 4911651 - DNA, 15 bp, Homo sapiens
tttgtactgaaaaat

SEQ ID NO: 4911652 - DNA, 21 bp, Homo sapiens
tttgtaggaaggtctcattct

SEQ ID NO: 4911653 - DNA, 22 bp, Homo sapiens
tttgtaggaaggtctcattctt

SEQ ID NO: 4911654 - DNA, 12 bp, Homo sapiens
tttgtagttttt

SEQ ID NO: 4911655 - DNA, 20 bp, Homo sapiens
tttgtatacatcctgggtaa

SEQ ID NO: 4911656 - DNA, 14 bp, Homo sapiens
tttgtatactttaa

SEQ ID NO: 4911657 - DNA, 20 bp, Homo sapiens
tttgtatctctgaagcatgt

SEQ ID NO: 4911658 - DNA, 23 bp, Homo sapiens
tatgggactcaatgcactgacat

SEQ ID NO: 4911659 - DNA, 15 bp, Homo sapiens
tatgggagccccagg

SEQ ID NO: 4911660 - DNA, 16 bp, Homo sapiens
tatgggagccccaggg

SEQ ID NO: 4911661 - DNA, 16 bp, Homo sapiens
tatgggcattgacaaa

SEQ ID NO: 4911662 - DNA, 20 bp, Homo sapiens
tatggttgatagtttacctg

SEQ ID NO: 4911663 - DNA, 21 bp, Homo sapiens
tatggttgatagtttacctga

SEQ ID NO: 4911664 - DNA, 17 bp, Homo sapiens
tatgtaaagtatgtaaa

SEQ ID NO: 4911665 - DNA, 15 bp, Homo sapiens
tatgtaatgcaaaat

SEQ ID NO: 4911666 - DNA, 14 bp, Homo sapiens
tatgtacaagtgtt

SEQ ID NO: 4911667 - DNA, 14 bp, Homo sapiens
tatgtacaattgtg

SEQ ID NO: 4911668 - DNA, 21 bp, Homo sapiens
tatgtaccatatgatctgttt

SEQ ID NO: 4911669 - DNA, 18 bp, Homo sapiens
tatgtactagtactgtgt

SEQ ID NO: 4911670 - DNA, 21 bp, Homo sapiens
tatgtacttttattttacaca

SEQ ID NO: 4911671 - DNA, 17 bp, Homo sapiens
tatgtagactatataca

SEQ ID NO: 4911672 - DNA, 17 bp, Homo sapiens
tatgtagatatttggct

SEQ ID NO: 4911673 - DNA, 19 bp, Homo sapiens
tatgtatatttttttaatt

SEQ ID NO: 4911674 - DNA, 13 bp, Homo sapiens
tatgtattattta

SEQ ID NO: 4911675 - DNA, 21 bp, Homo sapiens
tatgtattatttataattcct

SEQ ID NO: 4911676 - DNA, 17 bp, Homo sapiens
tatgtccactgtgtata

SEQ ID NO: 4911677 - DNA, 12 bp, Homo sapiens
tatgtctgatgg

SEQ ID NO: 4911678 - DNA, 16 bp, Homo sapiens
tatgtctgtttaagaa

SEQ ID NO: 4911679 - DNA, 21 bp, Homo sapiens
tatgtcttggacactgtacaa

SEQ ID NO: 4911680 - DNA, 17 bp, Homo sapiens
tatgtcttttatatttg

SEQ ID NO: 4911681 - DNA, 20 bp, Homo sapiens
tatgtgacaccaaagccacc

SEQ ID NO: 4911682 - DNA, 19 bp, Homo sapiens
tatgtgacattttacatta

SEQ ID NO: 4911683 - DNA, 22 bp, Homo sapiens
tatgtgagattttttattgcta

SEQ ID NO: 4911684 - DNA, 14 bp, Homo sapiens
tatgtgatctgtct

SEQ ID NO: 4911685 - DNA, 18 bp, Homo sapiens
tatgtgatctgtcttgta

SEQ ID NO: 4911686 - DNA, 16 bp, Homo sapiens
tatgtggttttagatt

SEQ ID NO: 4911687 - DNA, 18 bp, Homo sapiens
tatgtggttttagatttt

SEQ ID NO: 4911688 - DNA, 15 bp, Homo sapiens
tatgtgtgaggagct

SEQ ID NO: 4911689 - DNA, 20 bp, Homo sapiens
tatgtgtgcatgtgtgtata

SEQ ID NO: 4911690 - DNA, 13 bp, Homo sapiens
tatgtgtttactt

SEQ ID NO: 4911691 - DNA, 15 bp, Homo sapiens
tatgttgaatacttt

SEQ ID NO: 4911692 - DNA, 12 bp, Homo sapiens
tatgtttccttg

SEQ ID NO: 4911693 - DNA, 12 bp, Homo sapiens
tatgtttgaata

SEQ ID NO: 4911694 - DNA, 16 bp, Homo sapiens
tatgtttgaatatgga

SEQ ID NO: 4911695 - DNA, 17 bp, Homo sapiens
tatgtttgaatatggac

SEQ ID NO: 4911696 - DNA, 17 bp, Homo sapiens
tatgttttaagaggcag

SEQ ID NO: 4911697 - DNA, 16 bp, Homo sapiens
tatgtttttataaaaa

SEQ ID NO: 4911698 - DNA, 12 bp, Homo sapiens
tattaaaaatat

SEQ ID NO: 4911699 - DNA, 16 bp, Homo sapiens
tattaaaactcagcct

SEQ ID NO: 4911700 - DNA, 18 bp, Homo sapiens
tattaaaatgattgtaaa

SEQ ID NO: 4911701 - DNA, 20 bp, Homo sapiens
tattaaaatgattgtaaaat

SEQ ID NO: 4911702 - DNA, 14 bp, Homo sapiens
tattaaagtgctaa

SEQ ID NO: 4911703 - DNA, 12 bp, Homo sapiens
tattaaatagtt

SEQ ID NO: 4911704 - DNA, 14 bp, Homo sapiens
tattaacaaaagtt

SEQ ID NO: 4911705 - DNA, 12 bp, Homo sapiens
tattaactacat

SEQ ID NO: 4911706 - DNA, 13 bp, Homo sapiens
tattacactgtat

SEQ ID NO: 4911707 - DNA, 21 bp, Homo sapiens
tattacactgtatttgtatct

SEQ ID NO: 4911708 - DNA, 13 bp, Homo sapiens
tattaccagcaag

SEQ ID NO: 4911709 - DNA, 20 bp, Homo sapiens
tattaccagcaagaataaaa

SEQ ID NO: 4911710 - DNA, 21 bp, Homo sapiens
tattaccagcaagaataaaaa

SEQ ID NO: 4911711 - DNA, 21 bp, Homo sapiens
tattaccccctccttcagaca

SEQ ID NO: 4911712 - DNA, 23 bp, Homo sapiens
tattactgtctggttttaacaat

SEQ ID NO: 4911713 - DNA, 23 bp, Homo sapiens
tattacttatttttgacagtgtt

SEQ ID NO: 4911714 - DNA, 23 bp, Homo sapiens
tattagaaattagaaaaaaatta

SEQ ID NO: 4911715 - DNA, 16 bp, Homo sapiens
tattagagcattgaat

SEQ ID NO: 4911716 - DNA, 13 bp, Homo sapiens
tattagttaatat

SEQ ID NO: 4911717 - DNA, 15 bp, Homo sapiens
tattataaatatata

SEQ ID NO: 4911718 - DNA, 22 bp, Homo sapiens
tattataaatatatataaagaa

SEQ ID NO: 4911719 - DNA, 23 bp, Homo sapiens
tattataaatatatataaagaat

SEQ ID NO: 4911720 - DNA, 20 bp, Homo sapiens
tattataggtaatcaatgaa

SEQ ID NO: 4911721 - DNA, 12 bp, Homo sapiens
tattatctttaa

SEQ ID NO: 4911722 - DNA, 14 bp, Homo sapiens
tattattgaaattg

SEQ ID NO: 4911723 - DNA, 15 bp, Homo sapiens
tattattgaaattgt

SEQ ID NO: 4911724 - DNA, 16 bp, Homo sapiens
tattattgaaattgta

SEQ ID NO: 4911725 - DNA, 14 bp, Homo sapiens
tattatttctatta

SEQ ID NO: 4911726 - DNA, 14 bp, Homo sapiens
tattcaaccatgga

SEQ ID NO: 4911727 - DNA, 16 bp, Homo sapiens
tattcaagttattgta

SEQ ID NO: 4911728 - DNA, 12 bp, Homo sapiens
tattcactgggc

SEQ ID NO: 4911729 - DNA, 17 bp, Homo sapiens
tattcagcttcatttgt

SEQ ID NO: 4911730 - DNA, 21 bp, Homo sapiens
tattcagcttcatttgtgtca

SEQ ID NO: 4911731 - DNA, 16 bp, Homo sapiens
tattcatattggaaaa

SEQ ID NO: 4911732 - DNA, 23 bp, Homo sapiens
tattcattcatggaccactgttt

SEQ ID NO: 4911733 - DNA, 19 bp, Homo sapiens
tattcattctgcattgcta

SEQ ID NO: 4911734 - DNA, 22 bp, Homo sapiens
tattcattctgtgatcatttat

SEQ ID NO: 4911735 - DNA, 14 bp, Homo sapiens
tattccaaatgtct

SEQ ID NO: 4911736 - DNA, 16 bp, Homo sapiens
tattccagaatgctgt

SEQ ID NO: 4911737 - DNA, 21 bp, Homo sapiens
tattccagaatgctgtacatc

SEQ ID NO: 4911738 - DNA, 15 bp, Homo sapiens
tattccatatttatt

SEQ ID NO: 4911739 - DNA, 17 bp, Homo sapiens
tattccatatttattca

SEQ ID NO: 4911740 - DNA, 17 bp, Homo sapiens
tattccccattcttcct

SEQ ID NO: 4911741 - DNA, 14 bp, Homo sapiens
tattcctgtatgtt

SEQ ID NO: 4911742 - DNA, 17 bp, Homo sapiens
tattcctgtatgttgtc

SEQ ID NO: 4911743 - DNA, 14 bp, Homo sapiens
tattccttctggcc

SEQ ID NO: 4911744 - DNA, 15 bp, Homo sapiens
tattccttctggcct

SEQ ID NO: 4911745 - DNA, 21 bp, Homo sapiens
tattccttctggcctttcctc

SEQ ID NO: 4911746 - DNA, 16 bp, Homo sapiens
tattccttgatcattt

SEQ ID NO: 4911747 - DNA, 16 bp, Homo sapiens
tattcctttcccttcc

SEQ ID NO: 4911748 - DNA, 17 bp, Homo sapiens
tattcctttcccttcct

SEQ ID NO: 4911749 - DNA, 12 bp, Homo sapiens
tattctaagact

SEQ ID NO: 4911750 - DNA, 21 bp, Homo sapiens
tattctaagacttactctaag

SEQ ID NO: 4911751 - DNA, 13 bp, Homo sapiens
tattctactatac

SEQ ID NO: 4911752 - DNA, 13 bp, Homo sapiens
tattctattaact

SEQ ID NO: 4911753 - DNA, 19 bp, Homo sapiens
tattctattaactttaatt

SEQ ID NO: 4911754 - DNA, 18 bp, Homo sapiens
tattctcttttatctgtt

SEQ ID NO: 4911755 - DNA, 17 bp, Homo sapiens
tattctgagaaaacaag

SEQ ID NO: 4911756 - DNA, 14 bp, Homo sapiens
tattgaatattgtg

SEQ ID NO: 4911757 - DNA, 10 bp, Homo sapiens
tatcccttcc

SEQ ID NO: 4911758 - DNA, 12 bp, Homo sapiens
tatcccttctca

SEQ ID NO: 4911759 - DNA, 13 bp, Homo sapiens
tatcctcactgcc

SEQ ID NO: 4911760 - DNA, 14 bp, Homo sapiens
tatcctgaaatttc

SEQ ID NO: 4911761 - DNA, 23 bp, Homo sapiens
tatcctgacttctaatatcattc

SEQ ID NO: 4911762 - DNA, 16 bp, Homo sapiens
tatcctgtgactgtct

SEQ ID NO: 4911763 - DNA, 23 bp, Homo sapiens
tatcctgtgactgtctcacttaa

SEQ ID NO: 4911764 - DNA, 17 bp, Homo sapiens
tatcctttctaacaaaa

SEQ ID NO: 4911765 - DNA, 14 bp, Homo sapiens
tatcgaaataacaa

SEQ ID NO: 4911766 - DNA, 15 bp, Homo sapiens
tatcgaaataacaat

SEQ ID NO: 4911767 - DNA, 18 bp, Homo sapiens
tatcgaaataacaatgtt

SEQ ID NO: 4911768 - DNA, 22 bp, Homo sapiens
tatcgatgttttattatttcta

SEQ ID NO: 4911769 - DNA, 21 bp, Homo sapiens
tatcgtaaccagccagatcct

SEQ ID NO: 4911770 - DNA, 12 bp, Homo sapiens
tatctaaagttt

SEQ ID NO: 4911771 - DNA, 17 bp, Homo sapiens
tatctaatatatatgaa

SEQ ID NO: 4911772 - DNA, 18 bp, Homo sapiens
tatctaatatatatgaat

SEQ ID NO: 4911773 - DNA, 22 bp, Homo sapiens
tatctacccaagggcagaaagt

SEQ ID NO: 4911774 - DNA, 13 bp, Homo sapiens
tatctatatatgt

SEQ ID NO: 4911775 - DNA, 19 bp, Homo sapiens
tatctattaatatatgtat

SEQ ID NO: 4911776 - DNA, 16 bp, Homo sapiens
tatctattctgagaaa

SEQ ID NO: 4911777 - DNA, 18 bp, Homo sapiens
tatctcagtcatgcataa

SEQ ID NO: 4911778 - DNA, 16 bp, Homo sapiens
tatctctatttaatat

SEQ ID NO: 4911779 - DNA, 12 bp, Homo sapiens
tatctctctgtg

SEQ ID NO: 4911780 - DNA, 13 bp, Homo sapiens
tatctctctgtgc

SEQ ID NO: 4911781 - DNA, 16 bp, Homo sapiens
tatctctgtgtgcaca

SEQ ID NO: 4911782 - DNA, 17 bp, Homo sapiens
tatctctgtgtgcacaa

SEQ ID NO: 4911783 - DNA, 13 bp, Homo sapiens
tatctgaaaactg

SEQ ID NO: 4911784 - DNA, 14 bp, Homo sapiens
tatctgagttgcca

SEQ ID NO: 4911785 - DNA, 19 bp, Homo sapiens
tatctgagttgccaagaca

SEQ ID NO: 4911786 - DNA, 21 bp, Homo sapiens
tatctgagttgccaagacaaa

SEQ ID NO: 4911787 - DNA, 23 bp, Homo sapiens
tatctggccctcgacactcacca

SEQ ID NO: 4911788 - DNA, 16 bp, Homo sapiens
tatctgggcctgggct

SEQ ID NO: 4911789 - DNA, 20 bp, Homo sapiens
tatctgtcatttgagcaggg

SEQ ID NO: 4911790 - DNA, 14 bp, Homo sapiens
tatcttaaatttga

SEQ ID NO: 4911791 - DNA, 19 bp, Homo sapiens
tatcttagatgtttcacac

SEQ ID NO: 4911792 - DNA, 17 bp, Homo sapiens
tatcttccatatttgga

SEQ ID NO: 4911793 - DNA, 20 bp, Homo sapiens
tatcttctcaagttctaaga

SEQ ID NO: 4911794 - DNA, 21 bp, Homo sapiens
tatcttctcaagttctaagat

SEQ ID NO: 4911795 - DNA, 23 bp, Homo sapiens
tatcttggtgaatttttttttcc

SEQ ID NO: 4911796 - DNA, 13 bp, Homo sapiens
tatcttgtgttgt

SEQ ID NO: 4911797 - DNA, 19 bp, Homo sapiens
tatcttttatgtttgaata

SEQ ID NO: 4911798 - DNA, 16 bp, Homo sapiens
tatgaaaactatacaa

SEQ ID NO: 4911799 - DNA, 22 bp, Homo sapiens
tatgaaaactatacaacaaagg

SEQ ID NO: 4911800 - DNA, 19 bp, Homo sapiens
tatgaaaatgagttgtgaa

SEQ ID NO: 4911801 - DNA, 20 bp, Homo sapiens
tatgaaaatgagttgtgaaa

SEQ ID NO: 4911802 - DNA, 14 bp, Homo sapiens
tatgaaagaatata

SEQ ID NO: 4911803 - DNA, 19 bp, Homo sapiens
tatgaaagaatatatttat

SEQ ID NO: 4911804 - DNA, 23 bp, Homo sapiens
tatgaaagatggctgtgcctctg

SEQ ID NO: 4911805 - DNA, 13 bp, Homo sapiens
tatgaagtgcgtg

SEQ ID NO: 4911806 - DNA, 21 bp, Homo sapiens
tatgaagtttaaaacagtatt

SEQ ID NO: 4911807 - DNA, 18 bp, Homo sapiens
tatgaataaagacaccta

SEQ ID NO: 4911808 - DNA, 20 bp, Homo sapiens
tatgaatttaaatataattc

SEQ ID NO: 4911809 - DNA, 23 bp, Homo sapiens
tatgaatttaaatataattctgt

SEQ ID NO: 4911810 - DNA, 19 bp, Homo sapiens
tatgacatcacttgtacaa

SEQ ID NO: 4911811 - DNA, 20 bp, Homo sapiens
tatgacatcacttgtacaaa

SEQ ID NO: 4911812 - DNA, 23 bp, Homo sapiens
tatgacatcacttgtacaaaata

SEQ ID NO: 4911813 - DNA, 24 bp, Homo sapiens
tatgacatcacttgtacaaaataa

SEQ ID NO: 4911814 - DNA, 17 bp, Homo sapiens
tatgacgctgatacata

SEQ ID NO: 4911815 - DNA, 23 bp, Homo sapiens
tatgacgctgatacataactaaa

SEQ ID NO: 4911816 - DNA, 18 bp, Homo sapiens
tatgagcatcctgagccc

SEQ ID NO: 4911817 - DNA, 21 bp, Homo sapiens
tatgagcttccttctgtgaaa

SEQ ID NO: 4911818 - DNA, 13 bp, Homo sapiens
tatgaggaaaggt

SEQ ID NO: 4911819 - DNA, 19 bp, Homo sapiens
tatgaggcaacctgattgt

SEQ ID NO: 4911820 - DNA, 16 bp, Homo sapiens
tatgagtacaaatgcc

SEQ ID NO: 4911821 - DNA, 23 bp, Homo sapiens
tatgagtatacaatatataaaaa

SEQ ID NO: 4911822 - DNA, 14 bp, Homo sapiens
tatgagtctagatg

SEQ ID NO: 4911823 - DNA, 16 bp, Homo sapiens
tatgagtctagatgtt

SEQ ID NO: 4911824 - DNA, 13 bp, Homo sapiens
tatgatatccctg

SEQ ID NO: 4911825 - DNA, 21 bp, Homo sapiens
tatgatcacggctcactgcag

SEQ ID NO: 4911826 - DNA, 23 bp, Homo sapiens
tatgatcacggctcactgcagcc

SEQ ID NO: 4911827 - DNA, 22 bp, Homo sapiens
tatgatgatacaagattagaag

SEQ ID NO: 4911828 - DNA, 22 bp, Homo sapiens
tatgatgatgaaaattttacca

SEQ ID NO: 4911829 - DNA, 17 bp, Homo sapiens
tatgatgtaatctctct

SEQ ID NO: 4911830 - DNA, 15 bp, Homo sapiens
tatgatgtgttgtga

SEQ ID NO: 4911831 - DNA, 18 bp, Homo sapiens
tatgatttaataaaataa

SEQ ID NO: 4911832 - DNA, 18 bp, Homo sapiens
tatgatttatagtttgta

SEQ ID NO: 4911833 - DNA, 21 bp, Homo sapiens
tatgatttcactagaaaagct

SEQ ID NO: 4911834 - DNA, 16 bp, Homo sapiens
tatgattttcataact

SEQ ID NO: 4911835 - DNA, 20 bp, Homo sapiens
tatgattttttaaaagaaat

SEQ ID NO: 4911836 - DNA, 17 bp, Homo sapiens
tatgcaaggaaggaaag

SEQ ID NO: 4911837 - DNA, 17 bp, Homo sapiens
tatgcaatggattttca

SEQ ID NO: 4911838 - DNA, 16 bp, Homo sapiens
tatgcaatttcctttt

SEQ ID NO: 4911839 - DNA, 20 bp, Homo sapiens
tatgcacatatggactctgc

SEQ ID NO: 4911840 - DNA, 18 bp, Homo sapiens
tatgcaccttgtgtctgt

SEQ ID NO: 4911841 - DNA, 20 bp, Homo sapiens
tatgcaccttgtgtctgtac

SEQ ID NO: 4911842 - DNA, 17 bp, Homo sapiens
tatgcagatagaatcaa

SEQ ID NO: 4911843 - DNA, 19 bp, Homo sapiens
tatgcagtgatatggcaga

SEQ ID NO: 4911844 - DNA, 20 bp, Homo sapiens
tatgcatggaaacctgaaaa

SEQ ID NO: 4911845 - DNA, 14 bp, Homo sapiens
tatgccttcttatt

SEQ ID NO: 4911846 - DNA, 19 bp, Homo sapiens
tatgccttcttattgcttt

SEQ ID NO: 4911847 - DNA, 18 bp, Homo sapiens
tatgccttggggaggaca

SEQ ID NO: 4911848 - DNA, 23 bp, Homo sapiens
tatgccttggggaggacaaaact

SEQ ID NO: 4911849 - DNA, 17 bp, Homo sapiens
ggcccctgcccggctgc

SEQ ID NO: 4911850 - DNA, 23 bp, Homo sapiens
ggcccctgggtcagtctggtggg

SEQ ID NO: 4911851 - DNA, 15 bp, Homo sapiens
ggcccgacagcctgg

SEQ ID NO: 4911852 - DNA, 17 bp, Homo sapiens
ggcccgacagcctggca

SEQ ID NO: 4911853 - DNA, 21 bp, Homo sapiens
ggccctaggggtcactgtact

SEQ ID NO: 4911854 - DNA, 21 bp, Homo sapiens
ggccctcatctatgaggaaag

SEQ ID NO: 4911855 - DNA, 15 bp, Homo sapiens
ggccctgccctctcc

SEQ ID NO: 4911856 - DNA, 21 bp, Homo sapiens
ggccctgccctctccttcctt

SEQ ID NO: 4911857 - DNA, 18 bp, Homo sapiens
ggccctgctcctgcagca

SEQ ID NO: 4911858 - DNA, 15 bp, Homo sapiens
ggccctggctctgct

SEQ ID NO: 4911859 - DNA, 18 bp, Homo sapiens
ggccctggctctgctgtc

SEQ ID NO: 4911860 - DNA, 15 bp, Homo sapiens
ggccctgtccctccc

SEQ ID NO: 4911861 - DNA, 16 bp, Homo sapiens
ggccctgtccctccca

SEQ ID NO: 4911862 - DNA, 17 bp, Homo sapiens
ggccctgtccctcccac

SEQ ID NO: 4911863 - DNA, 19 bp, Homo sapiens
ggcccttcctctccactgc

SEQ ID NO: 4911864 - DNA, 23 bp, Homo sapiens
ggcccttcctctccactgccttc

SEQ ID NO: 4911865 - DNA, 21 bp, Homo sapiens
ggcccttgcagttcagcacca

SEQ ID NO: 4911866 - DNA, 16 bp, Homo sapiens
ggccgagggtcctggc

SEQ ID NO: 4911867 - DNA, 19 bp, Homo sapiens
ggccgccccctgcccccca

SEQ ID NO: 4911868 - DNA, 16 bp, Homo sapiens
ggccgctccaccagca

SEQ ID NO: 4911869 - DNA, 14 bp, Homo sapiens
ggcctaaaatcttg

SEQ ID NO: 4911870 - DNA, 18 bp, Homo sapiens
ggcctagcccaccctgct

SEQ ID NO: 4911871 - DNA, 22 bp, Homo sapiens
ggcctagcccaccctgctgcct

SEQ ID NO: 4911872 - DNA, 19 bp, Homo sapiens
ggcctcaaaggcccgctct

SEQ ID NO: 4911873 - DNA, 22 bp, Homo sapiens
ggcctcaagtgattctcctgcc

SEQ ID NO: 4911874 - DNA, 23 bp, Homo sapiens
ggcctcaagtgattctcctgcct

SEQ ID NO: 4911875 - DNA, 15 bp, Homo sapiens
ggcctcacctctacc

SEQ ID NO: 4911876 - DNA, 10 bp, Homo sapiens
ggcctcagaa

SEQ ID NO: 4911877 - DNA, 17 bp, Homo sapiens
ggcctcagctgcctcac

SEQ ID NO: 4911878 - DNA, 13 bp, Homo sapiens
ggcctcagtgcca

SEQ ID NO: 4911879 - DNA, 16 bp, Homo sapiens
ggcctcccaaagtgct

SEQ ID NO: 4911880 - DNA, 23 bp, Homo sapiens
ggcctccctctctcttctgctcc

SEQ ID NO: 4911881 - DNA, 16 bp, Homo sapiens
ggcctcgggacacctg

SEQ ID NO: 4911882 - DNA, 19 bp, Homo sapiens
ggcctctaccacaagggct

SEQ ID NO: 4911883 - DNA, 18 bp, Homo sapiens
ggcctgatgctccctccc

SEQ ID NO: 4911884 - DNA, 20 bp, Homo sapiens
ggcctgatgctccctcccct

SEQ ID NO: 4911885 - DNA, 14 bp, Homo sapiens
ggcctgcctggccc

SEQ ID NO: 4911886 - DNA, 16 bp, Homo sapiens
ggcctggacctgcctc

SEQ ID NO: 4911887 - DNA, 21 bp, Homo sapiens
ggcctggcagggaggtcaggc

SEQ ID NO: 4911888 - DNA, 13 bp, Homo sapiens
ggcctggcattct

SEQ ID NO: 4911889 - DNA, 13 bp, Homo sapiens
taaataaaagaaa

SEQ ID NO: 4911890 - DNA, 13 bp, Homo sapiens
taaataaaccctt

SEQ ID NO: 4911891 - DNA, 12 bp, Homo sapiens
taaataaacttt

SEQ ID NO: 4911892 - DNA, 14 bp, Homo sapiens
taaataagattcta

SEQ ID NO: 4911893 - DNA, 17 bp, Homo sapiens
taaataatgcttcagat

SEQ ID NO: 4911894 - DNA, 18 bp, Homo sapiens
taaatacacaacacacac

SEQ ID NO: 4911895 - DNA, 18 bp, Homo sapiens
taaataccagactgcagg

SEQ ID NO: 4911896 - DNA, 17 bp, Homo sapiens
taaatactgtgtggaac

SEQ ID NO: 4911897 - DNA, 18 bp, Homo sapiens
taaatagagtatatgcac

SEQ ID NO: 4911898 - DNA, 18 bp, Homo sapiens
taaatagagtttgctatt

SEQ ID NO: 4911899 - DNA, 16 bp, Homo sapiens
taaataggagaggatg

SEQ ID NO: 4911900 - DNA, 13 bp, Homo sapiens
taaatataattct

SEQ ID NO: 4911901 - DNA, 16 bp, Homo sapiens
taaatataattctgta

SEQ ID NO: 4911902 - DNA, 16 bp, Homo sapiens
taaatatagattagaa

SEQ ID NO: 4911903 - DNA, 23 bp, Homo sapiens
taaatatagttcctaagaagctt

SEQ ID NO: 4911904 - DNA, 13 bp, Homo sapiens
taaatatatataa

SEQ ID NO: 4911905 - DNA, 15 bp, Homo sapiens
taaatatcttttatg

SEQ ID NO: 4911906 - DNA, 18 bp, Homo sapiens
taaatatcttttatgttt

SEQ ID NO: 4911907 - DNA, 23 bp, Homo sapiens
taaatatcttttatgtttgaata

SEQ ID NO: 4911908 - DNA, 18 bp, Homo sapiens
taaatatgaaccctttgt

SEQ ID NO: 4911909 - DNA, 23 bp, Homo sapiens
taaatatgaaccctttgtttctt

SEQ ID NO: 4911910 - DNA, 16 bp, Homo sapiens
taaatatgcagtgata

SEQ ID NO: 4911911 - DNA, 20 bp, Homo sapiens
taaatatgtacaattgtggg

SEQ ID NO: 4911912 - DNA, 15 bp, Homo sapiens
taaatattctatatg

SEQ ID NO: 4911913 - DNA, 12 bp, Homo sapiens
taaatattgagg

SEQ ID NO: 4911914 - DNA, 21 bp, Homo sapiens
taaatattgaggctttgtgtt

SEQ ID NO: 4911915 - DNA, 18 bp, Homo sapiens
taaatatttgacttgcat

SEQ ID NO: 4911916 - DNA, 19 bp, Homo sapiens
taaatcatattgatgaaaa

SEQ ID NO: 4911917 - DNA, 14 bp, Homo sapiens
taaatcattaatac

SEQ ID NO: 4911918 - DNA, 16 bp, Homo sapiens
taaatctatttattaa

SEQ ID NO: 4911919 - DNA, 20 bp, Homo sapiens
taaatctatttattaatatt

SEQ ID NO: 4911920 - DNA, 14 bp, Homo sapiens
taaatctctaatat

SEQ ID NO: 4911921 - DNA, 18 bp, Homo sapiens
taaatctctaatatggca

SEQ ID NO: 4911922 - DNA, 20 bp, Homo sapiens
taaatctgctggagtttcat

SEQ ID NO: 4911923 - DNA, 21 bp, Homo sapiens
taaatctgttctgggctcttt

SEQ ID NO: 4911924 - DNA, 16 bp, Homo sapiens
tagacaatcattgttt

SEQ ID NO: 4911925 - DNA, 23 bp, Homo sapiens
tagacaatcattgttttgaatat

SEQ ID NO: 4911926 - DNA, 15 bp, Homo sapiens
tagacaattgaggta

SEQ ID NO: 4911927 - DNA, 18 bp, Homo sapiens
tagacaattgaggtaagt

SEQ ID NO: 4911928 - DNA, 13 bp, Homo sapiens
tagacacagataa

SEQ ID NO: 4911929 - DNA, 20 bp, Homo sapiens
tagacaccaaagttctaata

SEQ ID NO: 4911930 - DNA, 15 bp, Homo sapiens
tagacagtttgtaaa

SEQ ID NO: 4911931 - DNA, 17 bp, Homo sapiens
tagacatggaggttcta

SEQ ID NO: 4911932 - DNA, 19 bp, Homo sapiens
tagacatggaggttctaag

SEQ ID NO: 4911933 - DNA, 20 bp, Homo sapiens
tagacatggaggttctaagg

SEQ ID NO: 4911934 - DNA, 21 bp, Homo sapiens
tagacatggaggttctaaggc

SEQ ID NO: 4911935 - DNA, 22 bp, Homo sapiens
tagacatggaggttctaaggcc

SEQ ID NO: 4911936 - DNA, 13 bp, Homo sapiens
tagaccaaggaac

SEQ ID NO: 4911937 - DNA, 22 bp, Homo sapiens
tagactatatacatgtgtgtat

SEQ ID NO: 4911938 - DNA, 17 bp, Homo sapiens
tagactcatcttactgt

SEQ ID NO: 4911939 - DNA, 19 bp, Homo sapiens
tagactcatcttactgtac

SEQ ID NO: 4911940 - DNA, 21 bp, Homo sapiens
tagactcatcttactgtacct

SEQ ID NO: 4911941 - DNA, 16 bp, Homo sapiens
tagactcttcactgtt

SEQ ID NO: 4911942 - DNA, 16 bp, Homo sapiens
tagagaacgcagccct

SEQ ID NO: 4911943 - DNA, 14 bp, Homo sapiens
tagagaagataatt

SEQ ID NO: 4911944 - DNA, 13 bp, Homo sapiens
tagagaaggaccc

SEQ ID NO: 4911945 - DNA, 17 bp, Homo sapiens
tagagacttttttctag

SEQ ID NO: 4911946 - DNA, 23 bp, Homo sapiens
tagagatgctgtaacttaaaata

SEQ ID NO: 4911947 - DNA, 16 bp, Homo sapiens
tagagatttgtctaat

SEQ ID NO: 4911948 - DNA, 20 bp, Homo sapiens
tagagatttgtctaattgca

SEQ ID NO: 4911949 - DNA, 22 bp, Homo sapiens
tagagcaaaattgatgtgttta

SEQ ID NO: 4911950 - DNA, 14 bp, Homo sapiens
tagagccagggtct

SEQ ID NO: 4911951 - DNA, 13 bp, Homo sapiens
tagagcctgcctg

SEQ ID NO: 4911952 - DNA, 20 bp, Homo sapiens
tagaggccagccccacccag

SEQ ID NO: 4911953 - DNA, 23 bp, Homo sapiens
tagagggaggagaatgagcctcg

SEQ ID NO: 4911954 - DNA, 18 bp, Homo sapiens
tagaggtactagaatgct

SEQ ID NO: 4911955 - DNA, 18 bp, Homo sapiens
tagaggtcctctggagcc

SEQ ID NO: 4911956 - DNA, 15 bp, Homo sapiens
tagggtcggaaccca

SEQ ID NO: 4911957 - DNA, 18 bp, Homo sapiens
tagggttgctggagcctg

SEQ ID NO: 4911958 - DNA, 18 bp, Homo sapiens
taggtagaaaaagggtca

SEQ ID NO: 4911959 - DNA, 20 bp, Homo sapiens
taggtctcttctcccagaat

SEQ ID NO: 4911960 - DNA, 16 bp, Homo sapiens
taggtgacagagtgag

SEQ ID NO: 4911961 - DNA, 23 bp, Homo sapiens
taggtgacagagtgagactctgt

SEQ ID NO: 4911962 - DNA, 22 bp, Homo sapiens
taggtgcaatttcaaggttcta

SEQ ID NO: 4911963 - DNA, 17 bp, Homo sapiens
taggttccctgttcttc

SEQ ID NO: 4911964 - DNA, 20 bp, Homo sapiens
taggttccctgttcttcctc

SEQ ID NO: 4911965 - DNA, 21 bp, Homo sapiens
taggttccctgttcttcctcc

SEQ ID NO: 4911966 - DNA, 16 bp, Homo sapiens
taggttctaaagttct

SEQ ID NO: 4911967 - DNA, 18 bp, Homo sapiens
taggttctaaagttctaa

SEQ ID NO: 4911968 - DNA, 20 bp, Homo sapiens
taggttctaaagttctaaga

SEQ ID NO: 4911969 - DNA, 20 bp, Homo sapiens
taggttgccaataatacact

SEQ ID NO: 4911970 - DNA, 15 bp, Homo sapiens
tagtaaatgtctttg

SEQ ID NO: 4911971 - DNA, 19 bp, Homo sapiens
tagtaacttcttatggaat

SEQ ID NO: 4911972 - DNA, 17 bp, Homo sapiens
tagtaagtaattatgca

SEQ ID NO: 4911973 - DNA, 12 bp, Homo sapiens
tagtaatctgta

SEQ ID NO: 4911974 - DNA, 15 bp, Homo sapiens
tagtaatctgtacat

SEQ ID NO: 4911975 - DNA, 19 bp, Homo sapiens
tagtacacttttatgagct

SEQ ID NO: 4911976 - DNA, 17 bp, Homo sapiens
tagtagccctttctgtg

SEQ ID NO: 4911977 - DNA, 23 bp, Homo sapiens
tagtagcgttttttaaatgtata

SEQ ID NO: 4911978 - DNA, 17 bp, Homo sapiens
tagtatcagtgttttaa

SEQ ID NO: 4911979 - DNA, 21 bp, Homo sapiens
tagtatcagtgttttaaattc

SEQ ID NO: 4911980 - DNA, 19 bp, Homo sapiens
tagtatgacgctgatacat

SEQ ID NO: 4911981 - DNA, 21 bp, Homo sapiens
tagtcacatggcctatgcaca

SEQ ID NO: 4911982 - DNA, 19 bp, Homo sapiens
tagtcatttactaaacata

SEQ ID NO: 4911983 - DNA, 13 bp, Homo sapiens
tagtcatttattt

SEQ ID NO: 4911984 - DNA, 21 bp, Homo sapiens
tagtccaaaaagctcctgggg

SEQ ID NO: 4911985 - DNA, 21 bp, Homo sapiens
tagtcccccaactctgagccc

SEQ ID NO: 4911986 - DNA, 15 bp, Homo sapiens
tagtcccttcccctc

SEQ ID NO: 4911987 - DNA, 20 bp, Homo sapiens
tagtcccttcccctccctgg

SEQ ID NO: 4911988 - DNA, 22 bp, Homo sapiens
tagtcccttcccctccctggct

SEQ ID NO: 4911989 - DNA, 10 bp, Homo sapiens
tagtccttgg

SEQ ID NO: 4911990 - DNA, 18 bp, Homo sapiens
tagtgagcagtgagcaga

SEQ ID NO: 4911991 - DNA, 13 bp, Homo sapiens
tagtgatggttcc

SEQ ID NO: 4911992 - DNA, 20 bp, Homo sapiens
tagtgccagaattttaggaa

SEQ ID NO: 4911993 - DNA, 15 bp, Homo sapiens
tagtgctatatatat

SEQ ID NO: 4911994 - DNA, 21 bp, Homo sapiens
tagtgctatatatataaatat

SEQ ID NO: 4911995 - DNA, 20 bp, Homo sapiens
tagtggcttaaaacaacact

SEQ ID NO: 4911996 - DNA, 15 bp, Homo sapiens
tagtggtctttgtaa

SEQ ID NO: 4911997 - DNA, 18 bp, Homo sapiens
tagtgttttaagaaatgt

SEQ ID NO: 4911998 - DNA, 19 bp, Homo sapiens
tagttaagacatgatttcc

SEQ ID NO: 4911999 - DNA, 21 bp, Homo sapiens
tagttaagacatgatttcctt

SEQ ID NO: 4912000 - DNA, 23 bp, Homo sapiens
tagttaatattgtgaagaaaaat

SEQ ID NO: 4912001 - DNA, 12 bp, Homo sapiens
tagttaatttat

SEQ ID NO: 4912002 - DNA, 15 bp, Homo sapiens
tagttaatttatcta

SEQ ID NO: 4912003 - DNA, 22 bp, Homo sapiens
tagttaggaaataaaacctttc

SEQ ID NO: 4912004 - DNA, 15 bp, Homo sapiens
tagttatagtttcag

SEQ ID NO: 4912005 - DNA, 16 bp, Homo sapiens
tagttatagtttcaga

SEQ ID NO: 4912006 - DNA, 20 bp, Homo sapiens
tagttccctctgctcagcca

SEQ ID NO: 4912007 - DNA, 16 bp, Homo sapiens
tagttcctaagaagct

SEQ ID NO: 4912008 - DNA, 21 bp, Homo sapiens
tagttcctaagaagcttctaa

SEQ ID NO: 4912009 - DNA, 12 bp, Homo sapiens
tagttctagaca

SEQ ID NO: 4912010 - DNA, 16 bp, Homo sapiens
tagttctaggcactgt

SEQ ID NO: 4912011 - DNA, 21 bp, Homo sapiens
tagttgccaaatctggctcct

SEQ ID NO: 4912012 - DNA, 17 bp, Homo sapiens
tagttgtctttcctggc

SEQ ID NO: 4912013 - DNA, 22 bp, Homo sapiens
tagtttacctgaataaatggta

SEQ ID NO: 4912014 - DNA, 11 bp, Homo sapiens
tagtttactgt

SEQ ID NO: 4912015 - DNA, 21 bp, Homo sapiens
tagtttgacctcacagtgacc

SEQ ID NO: 4912016 - DNA, 21 bp, Homo sapiens
tagtttgctcatactacattg

SEQ ID NO: 4912017 - DNA, 18 bp, Homo sapiens
tagtttggggcaaaaatc

SEQ ID NO: 4912018 - DNA, 15 bp, Homo sapiens
tagtttgtctatttt

SEQ ID NO: 4912019 - DNA, 18 bp, Homo sapiens
tagtttgtctattttaaa

SEQ ID NO: 4912020 - DNA, 21 bp, Homo sapiens
tagtttgtttaatgtgaactt

SEQ ID NO: 4912021 - DNA, 21 bp, Homo sapiens
tagttttattttatgtttaga

SEQ ID NO: 4912022 - DNA, 15 bp, Homo sapiens
tataaaattaagcaa

SEQ ID NO: 4912023 - DNA, 14 bp, Homo sapiens
tataaacatcacac

SEQ ID NO: 4912024 - DNA, 19 bp, Homo sapiens
tataaactatcagtttgtc

SEQ ID NO: 4912025 - DNA, 22 bp, Homo sapiens
tataaagcgatatacagatgaa

SEQ ID NO: 4912026 - DNA, 19 bp, Homo sapiens
tataaagtacccatctagt

SEQ ID NO: 4912027 - DNA, 23 bp, Homo sapiens
tataaagtacccatctagtactt

SEQ ID NO: 4912028 - DNA, 20 bp, Homo sapiens
tataaatatatataaagaat

SEQ ID NO: 4912029 - DNA, 18 bp, Homo sapiens
tataaatcatattgatga

SEQ ID NO: 4912030 - DNA, 12 bp, Homo sapiens
tataaatgagca

SEQ ID NO: 4912031 - DNA, 13 bp, Homo sapiens
tataaatgagcaa

SEQ ID NO: 4912032 - DNA, 16 bp, Homo sapiens
tataaatgtatataca

SEQ ID NO: 4912033 - DNA, 14 bp, Homo sapiens
tataacagatacat

SEQ ID NO: 4912034 - DNA, 16 bp, Homo sapiens
tataacagatacattt

SEQ ID NO: 4912035 - DNA, 17 bp, Homo sapiens
tataacgtgatacattt

SEQ ID NO: 4912036 - DNA, 20 bp, Homo sapiens
tataacttaaaaatgtaaat

SEQ ID NO: 4912037 - DNA, 12 bp, Homo sapiens
tataagactctc

SEQ ID NO: 4912038 - DNA, 21 bp, Homo sapiens
tacatctggcttattttaatg

SEQ ID NO: 4912039 - DNA, 17 bp, Homo sapiens
tacatcttctgccttag

SEQ ID NO: 4912040 - DNA, 21 bp, Homo sapiens
tacatgaaacagaaacaaaaa

SEQ ID NO: 4912041 - DNA, 19 bp, Homo sapiens
tacatgcaaaaagaaatga

SEQ ID NO: 4912042 - DNA, 14 bp, Homo sapiens
tacatgcagcccat

SEQ ID NO: 4912043 - DNA, 17 bp, Homo sapiens
tacatgcatacaaagag

SEQ ID NO: 4912044 - DNA, 16 bp, Homo sapiens
tacatggcagagtttg

SEQ ID NO: 4912045 - DNA, 19 bp, Homo sapiens
tacatgtaaaacattatct

SEQ ID NO: 4912046 - DNA, 14 bp, Homo sapiens
tacatgtggtttat

SEQ ID NO: 4912047 - DNA, 14 bp, Homo sapiens
tacatgtgtgtata

SEQ ID NO: 4912048 - DNA, 19 bp, Homo sapiens
tacattagcagtttgcttt

SEQ ID NO: 4912049 - DNA, 12 bp, Homo sapiens
tacattagtaaa

SEQ ID NO: 4912050 - DNA, 17 bp, Homo sapiens
tacattagtaaatgtct

SEQ ID NO: 4912051 - DNA, 22 bp, Homo sapiens
tacattgagtagacacatttaa

SEQ ID NO: 4912052 - DNA, 13 bp, Homo sapiens
tacattgttgagc

SEQ ID NO: 4912053 - DNA, 13 bp, Homo sapiens
tacatttaaaatt

SEQ ID NO: 4912054 - DNA, 16 bp, Homo sapiens
tacatttaaagcattg

SEQ ID NO: 4912055 - DNA, 17 bp, Homo sapiens
tacatttatgatttaat

SEQ ID NO: 4912056 - DNA, 18 bp, Homo sapiens
tacatttatgatttaata

SEQ ID NO: 4912057 - DNA, 20 bp, Homo sapiens
tacatttatgatttaataaa

SEQ ID NO: 4912058 - DNA, 22 bp, Homo sapiens
tacatttatgatttaataaaat

SEQ ID NO: 4912059 - DNA, 22 bp, Homo sapiens
tacatttcttagactacattta

SEQ ID NO: 4912060 - DNA, 16 bp, Homo sapiens
tacatttgtgagattc

SEQ ID NO: 4912061 - DNA, 16 bp, Homo sapiens
tacattttgttgtaaa

SEQ ID NO: 4912062 - DNA, 17 bp, Homo sapiens
tacattttgttgtaaaa

SEQ ID NO: 4912063 - DNA, 14 bp, Homo sapiens
tacatttttattta

SEQ ID NO: 4912064 - DNA, 17 bp, Homo sapiens
tacatttttatttatga

SEQ ID NO: 4912065 - DNA, 19 bp, Homo sapiens
tacatttttatttatgaag

SEQ ID NO: 4912066 - DNA, 15 bp, Homo sapiens
taccaaagttttatc

SEQ ID NO: 4912067 - DNA, 18 bp, Homo sapiens
taccaaagttttatcaag

SEQ ID NO: 4912068 - DNA, 13 bp, Homo sapiens
taccaactttctg

SEQ ID NO: 4912069 - DNA, 14 bp, Homo sapiens
taccaactttctgt

SEQ ID NO: 4912070 - DNA, 17 bp, Homo sapiens
taccaactttctgtaaa

SEQ ID NO: 4912071 - DNA, 21 bp, Homo sapiens
taccaagatgccatctgtgtc

SEQ ID NO: 4912072 - DNA, 20 bp, Homo sapiens
taccaagtatagcctatggc

SEQ ID NO: 4912073 - DNA, 19 bp, Homo sapiens
taccaatgcttttatcaaa

SEQ ID NO: 4912074 - DNA, 20 bp, Homo sapiens
taccagcagaaggatttttt

SEQ ID NO: 4912075 - DNA, 21 bp, Homo sapiens
taccagccctggggctgggcc

SEQ ID NO: 4912076 - DNA, 23 bp, Homo sapiens
taccagtctttaaaggcccagcc

SEQ ID NO: 4912077 - DNA, 14 bp, Homo sapiens
taccatatgatctg

SEQ ID NO: 4912078 - DNA, 15 bp, Homo sapiens
taccatatttatcca

SEQ ID NO: 4912079 - DNA, 22 bp, Homo sapiens
taccatatttatccatttgtaa

SEQ ID NO: 4912080 - DNA, 18 bp, Homo sapiens
taccatcagggacaggat

SEQ ID NO: 4912081 - DNA, 20 bp, Homo sapiens
taccatgaacagaaaacatt

SEQ ID NO: 4912082 - DNA, 19 bp, Homo sapiens
taccattaaaactgctttt

SEQ ID NO: 4912083 - DNA, 13 bp, Homo sapiens
taccattcagatc

SEQ ID NO: 4912084 - DNA, 15 bp, Homo sapiens
taccattcagatcac

SEQ ID NO: 4912085 - DNA, 16 bp, Homo sapiens
taccatttcagagagg

SEQ ID NO: 4912086 - DNA, 15 bp, Homo sapiens
taccatttgcctccc

SEQ ID NO: 4912087 - DNA, 23 bp, Homo sapiens
taccattttggggtacccactgc

SEQ ID NO: 4912088 - DNA, 14 bp, Homo sapiens
taccatttttcatt

SEQ ID NO: 4912089 - DNA, 20 bp, Homo sapiens
taccattttttaaggaaaca

SEQ ID NO: 4912090 - DNA, 16 bp, Homo sapiens
tactgttcttgctgct

SEQ ID NO: 4912091 - DNA, 21 bp, Homo sapiens
tactgttcttgctgctagaac

SEQ ID NO: 4912092 - DNA, 13 bp, Homo sapiens
tacttaactattc

SEQ ID NO: 4912093 - DNA, 16 bp, Homo sapiens
tacttaagaatatgct

SEQ ID NO: 4912094 - DNA, 16 bp, Homo sapiens
tacttaagagaaatgg

SEQ ID NO: 4912095 - DNA, 17 bp, Homo sapiens
tacttagcaaaaagtgg

SEQ ID NO: 4912096 - DNA, 21 bp, Homo sapiens
tacttagcatcctaagaaata

SEQ ID NO: 4912097 - DNA, 14 bp, Homo sapiens
tacttatattttcg

SEQ ID NO: 4912098 - DNA, 16 bp, Homo sapiens
tacttatattttcgta

SEQ ID NO: 4912099 - DNA, 17 bp, Homo sapiens
tacttatattttcgtat

SEQ ID NO: 4912100 - DNA, 20 bp, Homo sapiens
tacttatttttgacagtgtt

SEQ ID NO: 4912101 - DNA, 15 bp, Homo sapiens
tacttcctgagtggc

SEQ ID NO: 4912102 - DNA, 21 bp, Homo sapiens
tacttgaacaaaagggtcaga

SEQ ID NO: 4912103 - DNA, 18 bp, Homo sapiens
tacttgagtgtaatgttt

SEQ ID NO: 4912104 - DNA, 19 bp, Homo sapiens
tacttgtggacacagctct

SEQ ID NO: 4912105 - DNA, 20 bp, Homo sapiens
tacttgtttctctgttgtaa

SEQ ID NO: 4912106 - DNA, 18 bp, Homo sapiens
tactttacacaattctta

SEQ ID NO: 4912107 - DNA, 14 bp, Homo sapiens
tactttatcacttt

SEQ ID NO: 4912108 - DNA, 19 bp, Homo sapiens
tactttcctttccccagcc

SEQ ID NO: 4912109 - DNA, 21 bp, Homo sapiens
tactttgtggaccaattattg

SEQ ID NO: 4912110 - DNA, 17 bp, Homo sapiens
tacttttgagtgtgtgt

SEQ ID NO: 4912111 - DNA, 14 bp, Homo sapiens
tactttttttcaca

SEQ ID NO: 4912112 - DNA, 13 bp, Homo sapiens
tagaaaaagggtc

SEQ ID NO: 4912113 - DNA, 14 bp, Homo sapiens
tagaaaaagggtca

SEQ ID NO: 4912114 - DNA, 20 bp, Homo sapiens
tagaaaacaatgcaaaacct

SEQ ID NO: 4912115 - DNA, 21 bp, Homo sapiens
tagaaaaggctaggtacacag

SEQ ID NO: 4912116 - DNA, 17 bp, Homo sapiens
tagaaacatgacactga

SEQ ID NO: 4912117 - DNA, 15 bp, Homo sapiens
tagaaacccaagctc

SEQ ID NO: 4912118 - DNA, 15 bp, Homo sapiens
tagaaaccttaatat

SEQ ID NO: 4912119 - DNA, 21 bp, Homo sapiens
tagaaataaaagtgaatgaaa

SEQ ID NO: 4912120 - DNA, 19 bp, Homo sapiens
tagaaataaaggatgtgat

SEQ ID NO: 4912121 - DNA, 16 bp, Homo sapiens
tagaaataagtggtta

SEQ ID NO: 4912122 - DNA, 22 bp, Homo sapiens
tagaaataagtggttatttctc

SEQ ID NO: 4912123 - DNA, 23 bp, Homo sapiens
tagaaataagtggttatttctca

SEQ ID NO: 4912124 - DNA, 16 bp, Homo sapiens
tagaaataatatgcat

SEQ ID NO: 4912125 - DNA, 19 bp, Homo sapiens
tagaaatgtaacttttgta

SEQ ID NO: 4912126 - DNA, 15 bp, Homo sapiens
tagaaatgtgaatga

SEQ ID NO: 4912127 - DNA, 22 bp, Homo sapiens
tagaaattagaaaaaaattact

SEQ ID NO: 4912128 - DNA, 17 bp, Homo sapiens
tagaacagataatcagt

SEQ ID NO: 4912129 - DNA, 18 bp, Homo sapiens
tagaacttactattcatt

SEQ ID NO: 4912130 - DNA, 12 bp, Homo sapiens
tagaactttttt

SEQ ID NO: 4912131 - DNA, 20 bp, Homo sapiens
tagaacttttttaaataaac

SEQ ID NO: 4912132 - DNA, 21 bp, Homo sapiens
tagaacttttttaaataaact

SEQ ID NO: 4912133 - DNA, 22 bp, Homo sapiens
tagaacttttttaaataaactt

SEQ ID NO: 4912134 - DNA, 18 bp, Homo sapiens
tagaagaagctatgtcaa

SEQ ID NO: 4912135 - DNA, 14 bp, Homo sapiens
tagaagcattcctt

SEQ ID NO: 4912136 - DNA, 16 bp, Homo sapiens
tagaagtcacacagta

SEQ ID NO: 4912137 - DNA, 15 bp, Homo sapiens
tagaagtgcatttct

SEQ ID NO: 4912138 - DNA, 16 bp, Homo sapiens
tagaagtgcatttctg

SEQ ID NO: 4912139 - DNA, 17 bp, Homo sapiens
tagaagtgcatttctga

SEQ ID NO: 4912140 - DNA, 16 bp, Homo sapiens
tagaagtttcccttcc

SEQ ID NO: 4912141 - DNA, 21 bp, Homo sapiens
tagaagtttgtccatttgtaa

SEQ ID NO: 4912142 - DNA, 23 bp, Homo sapiens
tagaagtttgtccatttgtaaaa

SEQ ID NO: 4912143 - DNA, 15 bp, Homo sapiens
tagaatataggtctc

SEQ ID NO: 4912144 - DNA, 15 bp, Homo sapiens
tagaatcaatcagta

SEQ ID NO: 4912145 - DNA, 16 bp, Homo sapiens
tagaatctattttcta

SEQ ID NO: 4912146 - DNA, 22 bp, Homo sapiens
tagaatctattttctatgtact

SEQ ID NO: 4912147 - DNA, 17 bp, Homo sapiens
tagaatgagatctgaat

SEQ ID NO: 4912148 - DNA, 22 bp, Homo sapiens
tagaatggataaaataatgctg

SEQ ID NO: 4912149 - DNA, 17 bp, Homo sapiens
tagaattataagtcaca

SEQ ID NO: 4912150 - DNA, 13 bp, Homo sapiens
tagaattgcattg

SEQ ID NO: 4912151 - DNA, 12 bp, Homo sapiens
tagaattgttat

SEQ ID NO: 4912152 - DNA, 14 bp, Homo sapiens
tagaattgttatag

SEQ ID NO: 4912153 - DNA, 17 bp, Homo sapiens
tagacaagatattgtac

SEQ ID NO: 4912154 - DNA, 13 bp, Homo sapiens
taagaaggcaaaa

SEQ ID NO: 4912155 - DNA, 18 bp, Homo sapiens
taagaaggcaaaaatgta

SEQ ID NO: 4912156 - DNA, 19 bp, Homo sapiens
taagaatatgtttccttgt

SEQ ID NO: 4912157 - DNA, 21 bp, Homo sapiens
taagaatatgtttccttgttt

SEQ ID NO: 4912158 - DNA, 18 bp, Homo sapiens
taagaatgttggtttact

SEQ ID NO: 4912159 - DNA, 19 bp, Homo sapiens
taagacagtcccatcaaaa

SEQ ID NO: 4912160 - DNA, 21 bp, Homo sapiens
taagacataacgtttttcctt

SEQ ID NO: 4912161 - DNA, 16 bp, Homo sapiens
taagacatgatttcct

SEQ ID NO: 4912162 - DNA, 17 bp, Homo sapiens
taagacatgatttcctt

SEQ ID NO: 4912163 - DNA, 14 bp, Homo sapiens
taagacctactgtt

SEQ ID NO: 4912164 - DNA, 17 bp, Homo sapiens
taagacctactgttcta

SEQ ID NO: 4912165 - DNA, 22 bp, Homo sapiens
taagacctactgttctaaagct

SEQ ID NO: 4912166 - DNA, 18 bp, Homo sapiens
taagacttactctaagat

SEQ ID NO: 4912167 - DNA, 20 bp, Homo sapiens
taagacttactctaagatct

SEQ ID NO: 4912168 - DNA, 14 bp, Homo sapiens
taagagaaacttta

SEQ ID NO: 4912169 - DNA, 21 bp, Homo sapiens
taagagaaactttatacatta

SEQ ID NO: 4912170 - DNA, 22 bp, Homo sapiens
taagagaaactttatacattag

SEQ ID NO: 4912171 - DNA, 23 bp, Homo sapiens
taagagaaactttatacattagt

SEQ ID NO: 4912172 - DNA, 12 bp, Homo sapiens
taagagagaaat

SEQ ID NO: 4912173 - DNA, 14 bp, Homo sapiens
taagagagaaatct

SEQ ID NO: 4912174 - DNA, 16 bp, Homo sapiens
taagaggatctcctgt

SEQ ID NO: 4912175 - DNA, 18 bp, Homo sapiens
taagagtccaagaatcca

SEQ ID NO: 4912176 - DNA, 16 bp, Homo sapiens
taagagtgtagaagca

SEQ ID NO: 4912177 - DNA, 18 bp, Homo sapiens
taagagtgtagaagcatt

SEQ ID NO: 4912178 - DNA, 19 bp, Homo sapiens
taagagtgtagaagcattc

SEQ ID NO: 4912179 - DNA, 22 bp, Homo sapiens
taagagtgtagaagcattcctt

SEQ ID NO: 4912180 - DNA, 23 bp, Homo sapiens
taagagtgtagaagcattccttc

SEQ ID NO: 4912181 - DNA, 14 bp, Homo sapiens
taagatcttagatt

SEQ ID NO: 4912182 - DNA, 20 bp, Homo sapiens
taagatcttagattctctgt

SEQ ID NO: 4912183 - DNA, 22 bp, Homo sapiens
taagatgtgatattctaagact

SEQ ID NO: 4912184 - DNA, 22 bp, Homo sapiens
taagattatagattctaaagat

SEQ ID NO: 4912185 - DNA, 23 bp, Homo sapiens
taagattatagattctaaagatt

SEQ ID NO: 4912186 - DNA, 14 bp, Homo sapiens
taagattccagaga

SEQ ID NO: 4912187 - DNA, 21 bp, Homo sapiens
taagattccagagagtggctc

SEQ ID NO: 4912188 - DNA, 12 bp, Homo sapiens
taagattctaac

SEQ ID NO: 4912189 - DNA, 13 bp, Homo sapiens
taagattctaacg

SEQ ID NO: 4912190 - DNA, 12 bp, Homo sapiens
taagattctaat

SEQ ID NO: 4912191 - DNA, 13 bp, Homo sapiens
taagattctaatg

SEQ ID NO: 4912192 - DNA, 21 bp, Homo sapiens
taagattctagatcagatgct

SEQ ID NO: 4912193 - DNA, 15 bp, Homo sapiens
taagatttttctcaa

SEQ ID NO: 4912194 - DNA, 20 bp, Homo sapiens
taagatttttctcaaagttt

SEQ ID NO: 4912195 - DNA, 21 bp, Homo sapiens
taagatttttctcaaagtttt

SEQ ID NO: 4912196 - DNA, 16 bp, Homo sapiens
taagcaaatacttagc

SEQ ID NO: 4912197 - DNA, 21 bp, Homo sapiens
taagcaaatttcaaaagacat

SEQ ID NO: 4912198 - DNA, 20 bp, Homo sapiens
taagcactgaaaaacaacaa

SEQ ID NO: 4912199 - DNA, 24 bp, Homo sapiens
taagcagagaagggcataaaacag

SEQ ID NO: 4912200 - DNA, 14 bp, Homo sapiens
taagcattgcctgg

SEQ ID NO: 4912201 - DNA, 12 bp, Homo sapiens
taagccaaagaa

SEQ ID NO: 4912202 - DNA, 21 bp, Homo sapiens
taagccaaagaaatgaacatt

SEQ ID NO: 4912203 - DNA, 20 bp, Homo sapiens
taagccttttatactgatta

SEQ ID NO: 4912204 - DNA, 23 bp, Homo sapiens
taagcgaatgtgtacaaagtgta

SEQ ID NO: 4912205 - DNA, 15 bp, Homo sapiens
taagctgcagcttcc

SEQ ID NO: 4912206 - DNA, 15 bp, Homo sapiens
taaggaagatatcta

SEQ ID NO: 4912207 - DNA, 21 bp, Homo sapiens
taaggaccgtggccctgccct

SEQ ID NO: 4912208 - DNA, 21 bp, Homo sapiens
taaggacctgaaattccaaag

SEQ ID NO: 4912209 - DNA, 17 bp, Homo sapiens
taaggatactttacatg

SEQ ID NO: 4912210 - DNA, 20 bp, Homo sapiens
taaggatggggttatgaacc

SEQ ID NO: 4912211 - DNA, 17 bp, Homo sapiens
taaggatgtcacagggc

SEQ ID NO: 4912212 - DNA, 14 bp, Homo sapiens
taaggcaggcattg

SEQ ID NO: 4912213 - DNA, 18 bp, Homo sapiens
taaggcctaggattctaa

SEQ ID NO: 4912214 - DNA, 12 bp, Homo sapiens
taaggctctaga

SEQ ID NO: 4912215 - DNA, 19 bp, Homo sapiens
taaggctctatgagtctag

SEQ ID NO: 4912216 - DNA, 22 bp, Homo sapiens
taaggctctatgagtctagatg

SEQ ID NO: 4912217 - DNA, 15 bp, Homo sapiens
taaggctctgagagt

SEQ ID NO: 4912218 - DNA, 15 bp, Homo sapiens
taagggcatgccttg

SEQ ID NO: 4912219 - DNA, 13 bp, Homo sapiens
taagggtgggtgc

SEQ ID NO: 4912220 - DNA, 14 bp, Homo sapiens
taatggaagagaaa

SEQ ID NO: 4912221 - DNA, 17 bp, Homo sapiens
taatggaagagaaatct

SEQ ID NO: 4912222 - DNA, 14 bp, Homo sapiens
taatggattaaatt

SEQ ID NO: 4912223 - DNA, 22 bp, Homo sapiens
taatggattaaatttaattctt

SEQ ID NO: 4912224 - DNA, 16 bp, Homo sapiens
taatggattgttaatt

SEQ ID NO: 4912225 - DNA, 21 bp, Homo sapiens
taatggtctaaaaataaacca

SEQ ID NO: 4912226 - DNA, 14 bp, Homo sapiens
taatgtaaaatgtt

SEQ ID NO: 4912227 - DNA, 17 bp, Homo sapiens
taatgtcacaggcaggt

SEQ ID NO: 4912228 - DNA, 21 bp, Homo sapiens
taatgtcttcatttcattgta

SEQ ID NO: 4912229 - DNA, 22 bp, Homo sapiens
taatgtgaacttgtagctgtaa

SEQ ID NO: 4912230 - DNA, 17 bp, Homo sapiens
taatgttaaatttgtaa

SEQ ID NO: 4912231 - DNA, 18 bp, Homo sapiens
taatgttaaatttgtaag

SEQ ID NO: 4912232 - DNA, 14 bp, Homo sapiens
taatgttaaccaag

SEQ ID NO: 4912233 - DNA, 22 bp, Homo sapiens
taatgttcttatgcaaaatgga

SEQ ID NO: 4912234 - DNA, 15 bp, Homo sapiens
taattaaaaagttaa

SEQ ID NO: 4912235 - DNA, 18 bp, Homo sapiens
taattaaaaagttaatct

SEQ ID NO: 4912236 - DNA, 22 bp, Homo sapiens
taattaaataaatcattaatac

SEQ ID NO: 4912237 - DNA, 23 bp, Homo sapiens
taattaaattttgagttctacat

SEQ ID NO: 4912238 - DNA, 19 bp, Homo sapiens
taattaatttgattaacaa

SEQ ID NO: 4912239 - DNA, 23 bp, Homo sapiens
taattaatttgattaacaaatat

SEQ ID NO: 4912240 - DNA, 15 bp, Homo sapiens
taattagggtacatt

SEQ ID NO: 4912241 - DNA, 18 bp, Homo sapiens
taattagggtacatttat

SEQ ID NO: 4912242 - DNA, 19 bp, Homo sapiens
taattagggtacatttata

SEQ ID NO: 4912243 - DNA, 21 bp, Homo sapiens
taattagggtacatttataat

SEQ ID NO: 4912244 - DNA, 22 bp, Homo sapiens
taattatgggaataattgcttt

SEQ ID NO: 4912245 - DNA, 12 bp, Homo sapiens
taattcactcaa

SEQ ID NO: 4912246 - DNA, 18 bp, Homo sapiens
taattccaatatgatgac

SEQ ID NO: 4912247 - DNA, 17 bp, Homo sapiens
taattccacacctttta

SEQ ID NO: 4912248 - DNA, 19 bp, Homo sapiens
taattcctcaacgtattgt

SEQ ID NO: 4912249 - DNA, 16 bp, Homo sapiens
taattctctttcaaag

SEQ ID NO: 4912250 - DNA, 22 bp, Homo sapiens
taattcttacactgcctgtata

SEQ ID NO: 4912251 - DNA, 14 bp, Homo sapiens
taattgtcatggtt

SEQ ID NO: 4912252 - DNA, 18 bp, Homo sapiens
taattgttgaaattttgc

SEQ ID NO: 4912253 - DNA, 16 bp, Homo sapiens
taattgttgctaatct

SEQ ID NO: 4912254 - DNA, 16 bp, Homo sapiens
taattgttgtttcttt

SEQ ID NO: 4912255 - DNA, 18 bp, Homo sapiens
taattgttttgcactttt

SEQ ID NO: 4912256 - DNA, 13 bp, Homo sapiens
taatttaaagaga

SEQ ID NO: 4912257 - DNA, 21 bp, Homo sapiens
taatttaagagctaaccagtt

SEQ ID NO: 4912258 - DNA, 16 bp, Homo sapiens
taatttagtgatctta

SEQ ID NO: 4912259 - DNA, 14 bp, Homo sapiens
taatttatctaaat

SEQ ID NO: 4912260 - DNA, 21 bp, Homo sapiens
taatttatctaaattaaagcc

SEQ ID NO: 4912261 - DNA, 14 bp, Homo sapiens
taatttattattga

SEQ ID NO: 4912262 - DNA, 17 bp, Homo sapiens
taatttattattgaaat

SEQ ID NO: 4912263 - DNA, 20 bp, Homo sapiens
taatttattattgaaattgt

SEQ ID NO: 4912264 - DNA, 21 bp, Homo sapiens
taatttcaaaaatataactta

SEQ ID NO: 4912265 - DNA, 12 bp, Homo sapiens
taatttcaaaat

SEQ ID NO: 4912266 - DNA, 15 bp, Homo sapiens
taatttcttcaaaat

SEQ ID NO: 4912267 - DNA, 17 bp, Homo sapiens
taatttcttcaaaatgt

SEQ ID NO: 4912268 - DNA, 16 bp, Homo sapiens
tcttcctgcccctctt

SEQ ID NO: 4912269 - DNA, 17 bp, Homo sapiens
tcttcctgcccctcttt

SEQ ID NO: 4912270 - DNA, 21 bp, Homo sapiens
tcttcctgcccctctttctct

SEQ ID NO: 4912271 - DNA, 21 bp, Homo sapiens
tcttcctgttttgtacataga

SEQ ID NO: 4912272 - DNA, 22 bp, Homo sapiens
tcttcctttactttcccttgct

SEQ ID NO: 4912273 - DNA, 16 bp, Homo sapiens
tcttcctttctctttc

SEQ ID NO: 4912274 - DNA, 17 bp, Homo sapiens
tcttcctttctctttct

SEQ ID NO: 4912275 - DNA, 13 bp, Homo sapiens
tcttctaaacttc

SEQ ID NO: 4912276 - DNA, 22 bp, Homo sapiens
tcttctaaacttccccatcttc

SEQ ID NO: 4912277 - DNA, 15 bp, Homo sapiens
tcttctaatttcaaa

SEQ ID NO: 4912278 - DNA, 12 bp, Homo sapiens
tcttctagagtt

SEQ ID NO: 4912279 - DNA, 19 bp, Homo sapiens
tcttctcaagttctaagat

SEQ ID NO: 4912280 - DNA, 12 bp, Homo sapiens
tcttctccactg

SEQ ID NO: 4912281 - DNA, 15 bp, Homo sapiens
tcttctccaggctgt

SEQ ID NO: 4912282 - DNA, 12 bp, Homo sapiens
tcttctcccaga

SEQ ID NO: 4912283 - DNA, 13 bp, Homo sapiens
tcttctcccagaa

SEQ ID NO: 4912284 - DNA, 21 bp, Homo sapiens
tcttctcccagaatcccagcc

SEQ ID NO: 4912285 - DNA, 22 bp, Homo sapiens
tcttctcccagaatcccagccg

SEQ ID NO: 4912286 - DNA, 14 bp, Homo sapiens
tcttctcctttcac

SEQ ID NO: 4912287 - DNA, 12 bp, Homo sapiens
tcttctctgtct

SEQ ID NO: 4912288 - DNA, 13 bp, Homo sapiens
tcttctgaaatga

SEQ ID NO: 4912289 - DNA, 22 bp, Homo sapiens
tcttctgaaatgaaacaaataa

SEQ ID NO: 4912290 - DNA, 13 bp, Homo sapiens
tcttctgccaaga

SEQ ID NO: 4912291 - DNA, 11 bp, Homo sapiens
tcttctgctcc

SEQ ID NO: 4912292 - DNA, 16 bp, Homo sapiens
tcttctgctccaccct

SEQ ID NO: 4912293 - DNA, 19 bp, Homo sapiens
tcttctgctccacccttgg

SEQ ID NO: 4912294 - DNA, 22 bp, Homo sapiens
tcttctgctccacccttggcct

SEQ ID NO: 4912295 - DNA, 12 bp, Homo sapiens
tcttctggctca

SEQ ID NO: 4912296 - DNA, 13 bp, Homo sapiens
tcttctggctcaa

SEQ ID NO: 4912297 - DNA, 20 bp, Homo sapiens
tcttctggggcaggctgggc

SEQ ID NO: 4912298 - DNA, 16 bp, Homo sapiens
tcttcttttggcttcc

SEQ ID NO: 4912299 - DNA, 20 bp, Homo sapiens
tcttgaaattaagaaggcaa

SEQ ID NO: 4912300 - DNA, 19 bp, Homo sapiens
tcttgaaggaaaatgatac

SEQ ID NO: 4912301 - DNA, 14 bp, Homo sapiens
tcttgaatgtcttt

SEQ ID NO: 4912302 - DNA, 18 bp, Homo sapiens
tcttgaatgtggtctcag

SEQ ID NO: 4912303 - DNA, 18 bp, Homo sapiens
tcttgaatttctaaaaaa

SEQ ID NO: 4912304 - DNA, 22 bp, Homo sapiens
tcttgatacccccctctgtctt

SEQ ID NO: 4912305 - DNA, 12 bp, Homo sapiens
tcttgatgacca

SEQ ID NO: 4912306 - DNA, 19 bp, Homo sapiens
tcttgcaatggcagccttg

SEQ ID NO: 4912307 - DNA, 15 bp, Homo sapiens
tctcagcccagaaga

SEQ ID NO: 4912308 - DNA, 20 bp, Homo sapiens
tctcagccttacatttgtga

SEQ ID NO: 4912309 - DNA, 13 bp, Homo sapiens
tctcagctttgag

SEQ ID NO: 4912310 - DNA, 19 bp, Homo sapiens
tctcagctttgagaagcct

SEQ ID NO: 4912311 - DNA, 18 bp, Homo sapiens
tctcaggctggtgggagg

SEQ ID NO: 4912312 - DNA, 17 bp, Homo sapiens
tctcaggggccagagga

SEQ ID NO: 4912313 - DNA, 21 bp, Homo sapiens
tctcagtcatgcataaatatg

SEQ ID NO: 4912314 - DNA, 23 bp, Homo sapiens
tctcagtcatgcataaatatgca

SEQ ID NO: 4912315 - DNA, 15 bp, Homo sapiens
tctcagttggaaata

SEQ ID NO: 4912316 - DNA, 16 bp, Homo sapiens
tctcagtttgtataga

SEQ ID NO: 4912317 - DNA, 16 bp, Homo sapiens
tctcagtttgtgtgtc

SEQ ID NO: 4912318 - DNA, 17 bp, Homo sapiens
tctcagtttgtgtgtct

SEQ ID NO: 4912319 - DNA, 13 bp, Homo sapiens
tctcataaattta

SEQ ID NO: 4912320 - DNA, 20 bp, Homo sapiens
tctcataattcctacagcac

SEQ ID NO: 4912321 - DNA, 15 bp, Homo sapiens
tctcatacctctgac

SEQ ID NO: 4912322 - DNA, 16 bp, Homo sapiens
tctcatacctctgacc

SEQ ID NO: 4912323 - DNA, 14 bp, Homo sapiens
tctcatccccaggg

SEQ ID NO: 4912324 - DNA, 15 bp, Homo sapiens
tctcatccccagggg

SEQ ID NO: 4912325 - DNA, 23 bp, Homo sapiens
tctcatccccagtcccaatgcac

SEQ ID NO: 4912326 - DNA, 16 bp, Homo sapiens
tctcatcctcctggaa

SEQ ID NO: 4912327 - DNA, 22 bp, Homo sapiens
tctcatctgcacccttcttttc

SEQ ID NO: 4912328 - DNA, 19 bp, Homo sapiens
tctcattccaacagtgagt

SEQ ID NO: 4912329 - DNA, 16 bp, Homo sapiens
tctcatttgtcacaca

SEQ ID NO: 4912330 - DNA, 18 bp, Homo sapiens
tctcattttaatgtaaag

SEQ ID NO: 4912331 - DNA, 16 bp, Homo sapiens
tctccaccctgctctc

SEQ ID NO: 4912332 - DNA, 19 bp, Homo sapiens
tctccactgtgcctttgca

SEQ ID NO: 4912333 - DNA, 14 bp, Homo sapiens
tctccagatgtttc

SEQ ID NO: 4912334 - DNA, 15 bp, Homo sapiens
tctccagatgtttcc

SEQ ID NO: 4912335 - DNA, 14 bp, Homo sapiens
tctccagattttta

SEQ ID NO: 4912336 - DNA, 21 bp, Homo sapiens
tctccagctgggctctgcaat

SEQ ID NO: 4912337 - DNA, 13 bp, Homo sapiens
tctccaggaccaa

SEQ ID NO: 4912338 - DNA, 17 bp, Homo sapiens
tctccaggcaccatctc

SEQ ID NO: 4912339 - DNA, 19 bp, Homo sapiens
tctccaggcaccatctccc

SEQ ID NO: 4912340 - DNA, 21 bp, Homo sapiens
tctccatcaccctcttcctgt

SEQ ID NO: 4912341 - DNA, 12 bp, Homo sapiens
tctcccaccctg

SEQ ID NO: 4912342 - DNA, 14 bp, Homo sapiens
tctcccaccctgta

SEQ ID NO: 4912343 - DNA, 16 bp, Homo sapiens
tctcccacgtgggaga

SEQ ID NO: 4912344 - DNA, 15 bp, Homo sapiens
tctcccagaatccca

SEQ ID NO: 4912345 - DNA, 13 bp, Homo sapiens
tctccccacacta

SEQ ID NO: 4912346 - DNA, 23 bp, Homo sapiens
tctccccagcaagtgagagctgg

SEQ ID NO: 4912347 - DNA, 16 bp, Homo sapiens
tctcccgctgctgctg

SEQ ID NO: 4912348 - DNA, 14 bp, Homo sapiens
tctccctgccagag

SEQ ID NO: 4912349 - DNA, 14 bp, Homo sapiens
tctcctactcctga

SEQ ID NO: 4912350 - DNA, 18 bp, Homo sapiens
tctcctataatctgtcaa

SEQ ID NO: 4912351 - DNA, 13 bp, Homo sapiens
tctcctcttgcca

SEQ ID NO: 4912352 - DNA, 17 bp, Homo sapiens
tctcctcttgccactgc

SEQ ID NO: 4912353 - DNA, 22 bp, Homo sapiens
tctcctcttgccactgcctctt

SEQ ID NO: 4912354 - DNA, 14 bp, Homo sapiens
tctcctctttaaaa

SEQ ID NO: 4912355 - DNA, 19 bp, Homo sapiens
tctcctctttaaaacaaaa

SEQ ID NO: 4912356 - DNA, 19 bp, Homo sapiens
tctcctgcctcagcctccc

SEQ ID NO: 4912357 - DNA, 22 bp, Homo sapiens
tctcctgcctcagcctcccaaa

SEQ ID NO: 4912358 - DNA, 17 bp, Homo sapiens
tctgcgtgggtcagaag

SEQ ID NO: 4912359 - DNA, 20 bp, Homo sapiens
tctgctcacatatctgtcat

SEQ ID NO: 4912360 - DNA, 12 bp, Homo sapiens
tctgctcagcca

SEQ ID NO: 4912361 - DNA, 22 bp, Homo sapiens
tctgctcagtaatttgaggaca

SEQ ID NO: 4912362 - DNA, 12 bp, Homo sapiens
tctgctccaccc

SEQ ID NO: 4912363 - DNA, 16 bp, Homo sapiens
tctgctccacccttgg

SEQ ID NO: 4912364 - DNA, 17 bp, Homo sapiens
tctgctccacccttggc

SEQ ID NO: 4912365 - DNA, 21 bp, Homo sapiens
tctgctccacccttggcctgt

SEQ ID NO: 4912366 - DNA, 23 bp, Homo sapiens
tctgctccacccttggcctgtct

SEQ ID NO: 4912367 - DNA, 16 bp, Homo sapiens
tctgctccccagggga

SEQ ID NO: 4912368 - DNA, 19 bp, Homo sapiens
tctgctcgccctcctttct

SEQ ID NO: 4912369 - DNA, 17 bp, Homo sapiens
tctgctgacagacacag

SEQ ID NO: 4912370 - DNA, 22 bp, Homo sapiens
tctgctgacagacacaggcccg

SEQ ID NO: 4912371 - DNA, 23 bp, Homo sapiens
tctgctggcatcaagaggtggga

SEQ ID NO: 4912372 - DNA, 15 bp, Homo sapiens
tctgctgtccccttg

SEQ ID NO: 4912373 - DNA, 17 bp, Homo sapiens
tctgctgtccccttggc

SEQ ID NO: 4912374 - DNA, 13 bp, Homo sapiens
tctgcttcagcct

SEQ ID NO: 4912375 - DNA, 19 bp, Homo sapiens
tctgctttctttgattctc

SEQ ID NO: 4912376 - DNA, 18 bp, Homo sapiens
tctggaagccctggagac

SEQ ID NO: 4912377 - DNA, 13 bp, Homo sapiens
tctggaagtccaa

SEQ ID NO: 4912378 - DNA, 19 bp, Homo sapiens
tctggaatctggagaccag

SEQ ID NO: 4912379 - DNA, 16 bp, Homo sapiens
tctggaatgcagtggt

SEQ ID NO: 4912380 - DNA, 15 bp, Homo sapiens
tctggactcctctgt

SEQ ID NO: 4912381 - DNA, 16 bp, Homo sapiens
tctggactcctctgtc

SEQ ID NO: 4912382 - DNA, 14 bp, Homo sapiens
tctggactgacagc

SEQ ID NO: 4912383 - DNA, 19 bp, Homo sapiens
tctggactgccccagaaaa

SEQ ID NO: 4912384 - DNA, 12 bp, Homo sapiens
tctggagacagc

SEQ ID NO: 4912385 - DNA, 19 bp, Homo sapiens
tctggagaccagggagcct

SEQ ID NO: 4912386 - DNA, 21 bp, Homo sapiens
tctggagaccagggagccttt

SEQ ID NO: 4912387 - DNA, 12 bp, Homo sapiens
tctggagagaaa

SEQ ID NO: 4912388 - DNA, 23 bp, Homo sapiens
tctggagccctaaccccttccag

SEQ ID NO: 4912389 - DNA, 24 bp, Homo sapiens
tctggagtttttgtttggagagca

SEQ ID NO: 4912390 - DNA, 17 bp, Homo sapiens
tctggcctggcctggcc

SEQ ID NO: 4912391 - DNA, 21 bp, Homo sapiens
tctggcctttcctctctcctg

SEQ ID NO: 4912392 - DNA, 18 bp, Homo sapiens
tctggctgactaaatttg

SEQ ID NO: 4912393 - DNA, 18 bp, Homo sapiens
tctggctgtaaggctcta

SEQ ID NO: 4912394 - DNA, 17 bp, Homo sapiens
tctggcttattttaatg

SEQ ID NO: 4912395 - DNA, 21 bp, Homo sapiens
tctggcttattttaatgtgat

SEQ ID NO: 4912396 - DNA, 22 bp, Homo sapiens
tctgggaaatgagaaggcagcc

SEQ ID NO: 4912397 - DNA, 16 bp, Homo sapiens
tctgggaacctcccag

SEQ ID NO: 4912398 - DNA, 17 bp, Homo sapiens
tctgggaacctcccaga

SEQ ID NO: 4912399 - DNA, 18 bp, Homo sapiens
tctgggaacctcccagag

SEQ ID NO: 4912400 - DNA, 14 bp, Homo sapiens
tctgggaagggaag

SEQ ID NO: 4912401 - DNA, 12 bp, Homo sapiens
tctgggacacag

SEQ ID NO: 4912402 - DNA, 13 bp, Homo sapiens
tctgggacacagt

SEQ ID NO: 4912403 - DNA, 14 bp, Homo sapiens
tctgggacacagtt

SEQ ID NO: 4912404 - DNA, 19 bp, Homo sapiens
tctgggctaggtagaaaaa

SEQ ID NO: 4912405 - DNA, 15 bp, Homo sapiens
tctgggctatggaca

SEQ ID NO: 4912406 - DNA, 17 bp, Homo sapiens
tctgggctgctacccag

SEQ ID NO: 4912407 - DNA, 21 bp, Homo sapiens
tctggggaaagacactgcctg

SEQ ID NO: 4912408 - DNA, 14 bp, Homo sapiens
tctggggctctagg

SEQ ID NO: 4912409 - DNA, 13 bp, Homo sapiens
tctgggtcttttg

SEQ ID NO: 4912410 - DNA, 23 bp, Homo sapiens
tctggtcaaagaaagaaagttta

SEQ ID NO: 4912411 - DNA, 14 bp, Homo sapiens
tctggtcccttgca

SEQ ID NO: 4912412 - DNA, 18 bp, Homo sapiens
tctggtccggacactcct

SEQ ID NO: 4912413 - DNA, 17 bp, Homo sapiens
tctggtgatctcccaag

SEQ ID NO: 4912414 - DNA, 16 bp, Homo sapiens
tctggtgcctccagag

SEQ ID NO: 4912415 - DNA, 13 bp, Homo sapiens
tctggttctaaca

SEQ ID NO: 4912416 - DNA, 15 bp, Homo sapiens
tctgtaaactcaaaa

SEQ ID NO: 4912417 - DNA, 14 bp, Homo sapiens
tctgtaatttttca

SEQ ID NO: 4912418 - DNA, 13 bp, Homo sapiens
tctgtacacgtgt

SEQ ID NO: 4912419 - DNA, 19 bp, Homo sapiens
tctgtagattctgtggaac

SEQ ID NO: 4912420 - DNA, 23 bp, Homo sapiens
tctgtagattctgtggaacaagc

SEQ ID NO: 4912421 - DNA, 15 bp, Homo sapiens
tctgtagccactagt

SEQ ID NO: 4912422 - DNA, 15 bp, Homo sapiens
tccaaattgtgcttc

SEQ ID NO: 4912423 - DNA, 23 bp, Homo sapiens
tccaaattgtgcttctccccaga

SEQ ID NO: 4912424 - DNA, 18 bp, Homo sapiens
tccaacaccacagacaca

SEQ ID NO: 4912425 - DNA, 19 bp, Homo sapiens
tccaacaccacagacacac

SEQ ID NO: 4912426 - DNA, 20 bp, Homo sapiens
tccaacaccacagacacaca

SEQ ID NO: 4912427 - DNA, 13 bp, Homo sapiens
tccaaccttccca

SEQ ID NO: 4912428 - DNA, 13 bp, Homo sapiens
tccaactccagca

SEQ ID NO: 4912429 - DNA, 19 bp, Homo sapiens
tccaactgtgttcattaga

SEQ ID NO: 4912430 - DNA, 14 bp, Homo sapiens
tccaagaatccaca

SEQ ID NO: 4912431 - DNA, 16 bp, Homo sapiens
tccaagaatccacatt

SEQ ID NO: 4912432 - DNA, 22 bp, Homo sapiens
tccaagaatccacatttctaaa

SEQ ID NO: 4912433 - DNA, 20 bp, Homo sapiens
tccaagactctagagtccaa

SEQ ID NO: 4912434 - DNA, 23 bp, Homo sapiens
tccaagactctagagtccaaggt

SEQ ID NO: 4912435 - DNA, 19 bp, Homo sapiens
tccaagagggtcctttagt

SEQ ID NO: 4912436 - DNA, 13 bp, Homo sapiens
tccaagattccgg

SEQ ID NO: 4912437 - DNA, 15 bp, Homo sapiens
tccaagattccggat

SEQ ID NO: 4912438 - DNA, 17 bp, Homo sapiens
tccaagattctagatga

SEQ ID NO: 4912439 - DNA, 23 bp, Homo sapiens
tccaagcagcctgagcaactctt

SEQ ID NO: 4912440 - DNA, 22 bp, Homo sapiens
tccaagctaagcactgccactg

SEQ ID NO: 4912441 - DNA, 18 bp, Homo sapiens
tccaagctccatctccac

SEQ ID NO: 4912442 - DNA, 18 bp, Homo sapiens
tccaagctccctgcccca

SEQ ID NO: 4912443 - DNA, 11 bp, Homo sapiens
tccaagctggt

SEQ ID NO: 4912444 - DNA, 21 bp, Homo sapiens
tccaagctggtcccactcagt

SEQ ID NO: 4912445 - DNA, 14 bp, Homo sapiens
tccaaggggcaaat

SEQ ID NO: 4912446 - DNA, 16 bp, Homo sapiens
tccaaggtttaaagag

SEQ ID NO: 4912447 - DNA, 17 bp, Homo sapiens
tccaagtccaataagac

SEQ ID NO: 4912448 - DNA, 15 bp, Homo sapiens
tccaagtttccaaac

SEQ ID NO: 4912449 - DNA, 23 bp, Homo sapiens
tccaatatttctgctttctttga

SEQ ID NO: 4912450 - DNA, 22 bp, Homo sapiens
tccaatcctggctctgtggctt

SEQ ID NO: 4912451 - DNA, 19 bp, Homo sapiens
tccaatctcaaggaatctt

SEQ ID NO: 4912452 - DNA, 16 bp, Homo sapiens
tccaattgttgacagt

SEQ ID NO: 4912453 - DNA, 21 bp, Homo sapiens
tccaattgttgacagttctga

SEQ ID NO: 4912454 - DNA, 14 bp, Homo sapiens
tccaattttctgga

SEQ ID NO: 4912455 - DNA, 22 bp, Homo sapiens
tccacagagagggagagcagag

SEQ ID NO: 4912456 - DNA, 18 bp, Homo sapiens
tccacagcgagggcagct

SEQ ID NO: 4912457 - DNA, 20 bp, Homo sapiens
tccacagcgagggcagctgc

SEQ ID NO: 4912458 - DNA, 21 bp, Homo sapiens
tccacagcgagggcagctgct

SEQ ID NO: 4912459 - DNA, 17 bp, Homo sapiens
tccacaggtctagacta

SEQ ID NO: 4912460 - DNA, 20 bp, Homo sapiens
tccacagttgccaccacctc

SEQ ID NO: 4912461 - DNA, 21 bp, Homo sapiens
tccacagttgccaccacctct

SEQ ID NO: 4912462 - DNA, 13 bp, Homo sapiens
tccacatgctctg

SEQ ID NO: 4912463 - DNA, 22 bp, Homo sapiens
tccaccacctccctcaccaaca

SEQ ID NO: 4912464 - DNA, 15 bp, Homo sapiens
tccacccaaccctat

SEQ ID NO: 4912465 - DNA, 23 bp, Homo sapiens
tccacccaaccctatctcctgac

SEQ ID NO: 4912466 - DNA, 17 bp, Homo sapiens
tccacccacctcagcct

SEQ ID NO: 4912467 - DNA, 18 bp, Homo sapiens
tccacccacctcagcctc

SEQ ID NO: 4912468 - DNA, 12 bp, Homo sapiens
tccaccccatcc

SEQ ID NO: 4912469 - DNA, 13 bp, Homo sapiens
tccacccttggcc

SEQ ID NO: 4912470 - DNA, 14 bp, Homo sapiens
tccacccttggcct

SEQ ID NO: 4912471 - DNA, 15 bp, Homo sapiens
tccacccttggcctg

SEQ ID NO: 4912472 - DNA, 17 bp, Homo sapiens
tccacccttggcctgtc

SEQ ID NO: 4912473 - DNA, 20 bp, Homo sapiens
tccacccttggcctgtctca

SEQ ID NO: 4912474 - DNA, 20 bp, Homo sapiens
tccacctggtactccctctc

SEQ ID NO: 4912475 - DNA, 21 bp, Homo sapiens
tccacctggtactccctctca

SEQ ID NO: 4912476 - DNA, 12 bp, Homo sapiens
tccacctgtggg

SEQ ID NO: 4912477 - DNA, 15 bp, Homo sapiens
tccaccttcccatgc

SEQ ID NO: 4912478 - DNA, 16 bp, Homo sapiens
tccaccttcccatgcc

SEQ ID NO: 4912479 - DNA, 18 bp, Homo sapiens
tccaccttcccatgccct

SEQ ID NO: 4912480 - DNA, 19 bp, Homo sapiens
tccaccttcccatgccctg

SEQ ID NO: 4912481 - DNA, 18 bp, Homo sapiens
tccacgatcctgccaccc

SEQ ID NO: 4912482 - DNA, 17 bp, Homo sapiens
tccactctaccctccca

SEQ ID NO: 4912483 - DNA, 16 bp, Homo sapiens
tccactgcctctgcct

SEQ ID NO: 4912484 - DNA, 13 bp, Homo sapiens
tccactgccttcg

SEQ ID NO: 4912485 - DNA, 16 bp, Homo sapiens
tccactgggcacaact

SEQ ID NO: 4912486 - DNA, 17 bp, Homo sapiens
tccactgtcaccctcca

SEQ ID NO: 4912487 - DNA, 17 bp, Homo sapiens
tccacttcttcctttct

SEQ ID NO: 4912488 - DNA, 20 bp, Homo sapiens
tccacttcttcctttctctt

SEQ ID NO: 4912489 - DNA, 19 bp, Homo sapiens
tccagaagaagagaagctg

SEQ ID NO: 4912490 - DNA, 19 bp, Homo sapiens
tccagaagcctctggctag

SEQ ID NO: 4912491 - DNA, 18 bp, Homo sapiens
tccagaatgctgtacatc

SEQ ID NO: 4912492 - DNA, 18 bp, Homo sapiens
tccagaatttggaaatcc

SEQ ID NO: 4912493 - DNA, 13 bp, Homo sapiens
tccagacatcatg

SEQ ID NO: 4912494 - DNA, 13 bp, Homo sapiens
tccagacccctgg

SEQ ID NO: 4912495 - DNA, 15 bp, Homo sapiens
tccagacccctggct

SEQ ID NO: 4912496 - DNA, 17 bp, Homo sapiens
tccagacccctggcttt

SEQ ID NO: 4912497 - DNA, 23 bp, Homo sapiens
tccagacccctggcttttcactg

SEQ ID NO: 4912498 - DNA, 16 bp, Homo sapiens
tccagagagtggctcc

SEQ ID NO: 4912499 - DNA, 15 bp, Homo sapiens
tccagatcactgcca

SEQ ID NO: 4912500 - DNA, 16 bp, Homo sapiens
tccagatcactgccac

SEQ ID NO: 4912501 - DNA, 17 bp, Homo sapiens
tccagatcactgccaca

SEQ ID NO: 4912502 - DNA, 22 bp, Homo sapiens
tccagattttttacagctgcct

SEQ ID NO: 4912503 - DNA, 16 bp, Homo sapiens
tccagcaacacagcct

SEQ ID NO: 4912504 - DNA, 18 bp, Homo sapiens
tccagcaacttcttctcc

SEQ ID NO: 4912505 - DNA, 19 bp, Homo sapiens
tccagcaacttcttctcca

SEQ ID NO: 4912506 - DNA, 23 bp, Homo sapiens
tccagcagaagacaaaaagacaa

SEQ ID NO: 4912507 - DNA, 15 bp, Homo sapiens
tccagcccacattgg

SEQ ID NO: 4912508 - DNA, 19 bp, Homo sapiens
tccagccgccattgccacc

SEQ ID NO: 4912509 - DNA, 16 bp, Homo sapiens
tccagctcagaaccca

SEQ ID NO: 4912510 - DNA, 19 bp, Homo sapiens
tccagctcagaacccaggg

SEQ ID NO: 4912511 - DNA, 20 bp, Homo sapiens
tccagctcagaacccagggc

SEQ ID NO: 4912512 - DNA, 18 bp, Homo sapiens
tccagctctaataaaaca

SEQ ID NO: 4912513 - DNA, 16 bp, Homo sapiens
tccagctgcaccagag

SEQ ID NO: 4912514 - DNA, 13 bp, Homo sapiens
tccaggacccctg

SEQ ID NO: 4912515 - DNA, 16 bp, Homo sapiens
tccaggcacagctgag

SEQ ID NO: 4912516 - DNA, 22 bp, Homo sapiens
tccaggcacaggatgctgtgtt

SEQ ID NO: 4912517 - DNA, 18 bp, Homo sapiens
tccaggccgcgccctttc

SEQ ID NO: 4912518 - DNA, 20 bp, Homo sapiens
tccaggccgcgccctttccc

SEQ ID NO: 4912519 - DNA, 21 bp, Homo sapiens
tccaggccgcgccctttcccc

SEQ ID NO: 4912520 - DNA, 14 bp, Homo sapiens
tccaggctgtatcc

SEQ ID NO: 4912521 - DNA, 19 bp, Homo sapiens
tccagggggaaggccaagg

SEQ ID NO: 4912522 - DNA, 16 bp, Homo sapiens
tccaggtgttactgta

SEQ ID NO: 4912523 - DNA, 20 bp, Homo sapiens
tccaggttcaacccacagct

SEQ ID NO: 4912524 - DNA, 16 bp, Homo sapiens
tccaggttcagcttgt

SEQ ID NO: 4912525 - DNA, 13 bp, Homo sapiens
tccagtattcttg

SEQ ID NO: 4912526 - DNA, 17 bp, Homo sapiens
tccagtccccctatcct

SEQ ID NO: 4912527 - DNA, 18 bp, Homo sapiens
tccagtccccctatcctt

SEQ ID NO: 4912528 - DNA, 15 bp, Homo sapiens
tccagtgcaaccaca

SEQ ID NO: 4912529 - DNA, 17 bp, Homo sapiens
tccagtgccagcaatga

SEQ ID NO: 4912530 - DNA, 14 bp, Homo sapiens
tccagttaaccaag

SEQ ID NO: 4912531 - DNA, 19 bp, Homo sapiens
tccagttcatgagaatcta

SEQ ID NO: 4912532 - DNA, 21 bp, Homo sapiens
tccccacccctacccctggct

SEQ ID NO: 4912533 - DNA, 19 bp, Homo sapiens
tccccacttgcagccctgt

SEQ ID NO: 4912534 - DNA, 19 bp, Homo sapiens
tccccacttgtccgctggg

SEQ ID NO: 4912535 - DNA, 21 bp, Homo sapiens
tccccacttgtccgctgggtg

SEQ ID NO: 4912536 - DNA, 18 bp, Homo sapiens
tccccagattgcaacagg

SEQ ID NO: 4912537 - DNA, 22 bp, Homo sapiens
tccccagcaagtgagagctggg

SEQ ID NO: 4912538 - DNA, 18 bp, Homo sapiens
tccccagcatcactcccc

SEQ ID NO: 4912539 - DNA, 15 bp, Homo sapiens
tccccagcccagggt

SEQ ID NO: 4912540 - DNA, 13 bp, Homo sapiens
tccccagccccta

SEQ ID NO: 4912541 - DNA, 16 bp, Homo sapiens
tccccagcccctagcc

SEQ ID NO: 4912542 - DNA, 17 bp, Homo sapiens
tccccaggggtcccagc

SEQ ID NO: 4912543 - DNA, 20 bp, Homo sapiens
tccccaggggtcccagccac

SEQ ID NO: 4912544 - DNA, 14 bp, Homo sapiens
tccccatctgggtc

SEQ ID NO: 4912545 - DNA, 17 bp, Homo sapiens
tccccattcttcctagt

SEQ ID NO: 4912546 - DNA, 12 bp, Homo sapiens
tcccccaaagtt

SEQ ID NO: 4912547 - DNA, 20 bp, Homo sapiens
tcccccaacccccaccccac

SEQ ID NO: 4912548 - DNA, 17 bp, Homo sapiens
tcccccaactctgagcc

SEQ ID NO: 4912549 - DNA, 18 bp, Homo sapiens
tcccccaactctgagccc

SEQ ID NO: 4912550 - DNA, 21 bp, Homo sapiens
tcccccaactctgagcccatg

SEQ ID NO: 4912551 - DNA, 20 bp, Homo sapiens
tcccccaccggtccagctgg

SEQ ID NO: 4912552 - DNA, 21 bp, Homo sapiens
tcccccaccggtccagctggc

SEQ ID NO: 4912553 - DNA, 12 bp, Homo sapiens
tcccccatagcc

SEQ ID NO: 4912554 - DNA, 14 bp, Homo sapiens
tcccccatagccac

SEQ ID NO: 4912555 - DNA, 15 bp, Homo sapiens
tcccccatagccacc

SEQ ID NO: 4912556 - DNA, 17 bp, Homo sapiens
tcccccccctgtatagt

SEQ ID NO: 4912557 - DNA, 17 bp, Homo sapiens
tccccctatccttggca

SEQ ID NO: 4912558 - DNA, 16 bp, Homo sapiens
tccccctcagcaagcc

SEQ ID NO: 4912559 - DNA, 13 bp, Homo sapiens
tccccctgcccca

SEQ ID NO: 4912560 - DNA, 14 bp, Homo sapiens
tcatattgtgccaa

SEQ ID NO: 4912561 - DNA, 15 bp, Homo sapiens
tcatattgtgccaat

SEQ ID NO: 4912562 - DNA, 18 bp, Homo sapiens
tcatcaacaaagaaatat

SEQ ID NO: 4912563 - DNA, 19 bp, Homo sapiens
tcatcaacaagatttcctt

SEQ ID NO: 4912564 - DNA, 20 bp, Homo sapiens
tcatcagatggaaatatttt

SEQ ID NO: 4912565 - DNA, 14 bp, Homo sapiens
tcatcagggcctgg

SEQ ID NO: 4912566 - DNA, 11 bp, Homo sapiens
tcatcatcagg

SEQ ID NO: 4912567 - DNA, 16 bp, Homo sapiens
tcatcatcagggcctg

SEQ ID NO: 4912568 - DNA, 22 bp, Homo sapiens
tcatcattgtttctgcatgaat

SEQ ID NO: 4912569 - DNA, 20 bp, Homo sapiens
tcatccaccccatccctccc

SEQ ID NO: 4912570 - DNA, 22 bp, Homo sapiens
tcatcccatctaagctgcagct

SEQ ID NO: 4912571 - DNA, 22 bp, Homo sapiens
tcatcccattaatcatttcccc

SEQ ID NO: 4912572 - DNA, 15 bp, Homo sapiens
tcatccccagtccca

SEQ ID NO: 4912573 - DNA, 19 bp, Homo sapiens
tcatcctgactctgccccc

SEQ ID NO: 4912574 - DNA, 23 bp, Homo sapiens
tcatcctgccttcatggaactca

SEQ ID NO: 4912575 - DNA, 21 bp, Homo sapiens
tcatccttggtctttgtatct

SEQ ID NO: 4912576 - DNA, 21 bp, Homo sapiens
tcatcgaaaattcatttcaca

SEQ ID NO: 4912577 - DNA, 22 bp, Homo sapiens
tcatcgaaaattcatttcacat

SEQ ID NO: 4912578 - DNA, 21 bp, Homo sapiens
tctaatagcgggttactttca

SEQ ID NO: 4912579 - DNA, 12 bp, Homo sapiens
tctaatcaaaag

SEQ ID NO: 4912580 - DNA, 20 bp, Homo sapiens
tctaatttcaaaaatataac

SEQ ID NO: 4912581 - DNA, 16 bp, Homo sapiens
tctaatttttaagcaa

SEQ ID NO: 4912582 - DNA, 23 bp, Homo sapiens
tctacaaagcactagagaatgca

SEQ ID NO: 4912583 - DNA, 20 bp, Homo sapiens
tctacactgcaatcatatgt

SEQ ID NO: 4912584 - DNA, 16 bp, Homo sapiens
tctacagaggccatgg

SEQ ID NO: 4912585 - DNA, 21 bp, Homo sapiens
tctacatgaggaactgtagat

SEQ ID NO: 4912586 - DNA, 15 bp, Homo sapiens
tctacattattgctt

SEQ ID NO: 4912587 - DNA, 14 bp, Homo sapiens
tctacatttcttag

SEQ ID NO: 4912588 - DNA, 19 bp, Homo sapiens
tctaccatgaacagaaaac

SEQ ID NO: 4912589 - DNA, 14 bp, Homo sapiens
tctaccatttcaga

SEQ ID NO: 4912590 - DNA, 15 bp, Homo sapiens
tctacccgttccaaa

SEQ ID NO: 4912591 - DNA, 16 bp, Homo sapiens
tctaccctcccacccc

SEQ ID NO: 4912592 - DNA, 15 bp, Homo sapiens
tctactaattccaca

SEQ ID NO: 4912593 - DNA, 23 bp, Homo sapiens
tctactggtcttgtggaattggg

SEQ ID NO: 4912594 - DNA, 12 bp, Homo sapiens
tctagaaaacca

SEQ ID NO: 4912595 - DNA, 18 bp, Homo sapiens
tctagaacttgaccccct

SEQ ID NO: 4912596 - DNA, 18 bp, Homo sapiens
tctagaagtttcccttcc

SEQ ID NO: 4912597 - DNA, 18 bp, Homo sapiens
tctagacaagatattgta

SEQ ID NO: 4912598 - DNA, 20 bp, Homo sapiens
tctagacaagatattgtaca

SEQ ID NO: 4912599 - DNA, 19 bp, Homo sapiens
tctagacatggaggttcta

SEQ ID NO: 4912600 - DNA, 22 bp, Homo sapiens
tctagacatggaggttctaagg

SEQ ID NO: 4912601 - DNA, 15 bp, Homo sapiens
tctagactttctgtt

SEQ ID NO: 4912602 - DNA, 18 bp, Homo sapiens
tctagagatatatatact

SEQ ID NO: 4912603 - DNA, 20 bp, Homo sapiens
tctagatcagatgctccaag

SEQ ID NO: 4912604 - DNA, 21 bp, Homo sapiens
tctagatcagatgctccaaga

SEQ ID NO: 4912605 - DNA, 14 bp, Homo sapiens
tctagatcataagg

SEQ ID NO: 4912606 - DNA, 21 bp, Homo sapiens
tctagatgaagttttacattg

SEQ ID NO: 4912607 - DNA, 17 bp, Homo sapiens
tctagattcaaaggttc

SEQ ID NO: 4912608 - DNA, 18 bp, Homo sapiens
tctagattcaaaggttct

SEQ ID NO: 4912609 - DNA, 22 bp, Homo sapiens
tctagattcaaaggttctaggt

SEQ ID NO: 4912610 - DNA, 14 bp, Homo sapiens
tctagattctctgg

SEQ ID NO: 4912611 - DNA, 15 bp, Homo sapiens
tctagattgagagaa

SEQ ID NO: 4912612 - DNA, 20 bp, Homo sapiens
tctagcctatttacctgcag

SEQ ID NO: 4912613 - DNA, 23 bp, Homo sapiens
tctaggaccatggttaagagtcc

SEQ ID NO: 4912614 - DNA, 21 bp, Homo sapiens
tctaggcactgtagttctaag

SEQ ID NO: 4912615 - DNA, 24 bp, Homo sapiens
tctaggcactgtagttctaagact

SEQ ID NO: 4912616 - DNA, 22 bp, Homo sapiens
tctagggttgctggagcctgag

SEQ ID NO: 4912617 - DNA, 13 bp, Homo sapiens
tctaggtaatttt

SEQ ID NO: 4912618 - DNA, 15 bp, Homo sapiens
tctaggtttcaaaga

SEQ ID NO: 4912619 - DNA, 16 bp, Homo sapiens
tctagtggtctttgta

SEQ ID NO: 4912620 - DNA, 17 bp, Homo sapiens
tctagtggtctttgtaa

SEQ ID NO: 4912621 - DNA, 21 bp, Homo sapiens
tctagtggtctttgtaagagt

SEQ ID NO: 4912622 - DNA, 22 bp, Homo sapiens
tctagtggtctttgtaagagtg

SEQ ID NO: 4912623 - DNA, 20 bp, Homo sapiens
tattgcaaaatagcatttgt

SEQ ID NO: 4912624 - DNA, 21 bp, Homo sapiens
tattgcaaaggttccaactgt

SEQ ID NO: 4912625 - DNA, 22 bp, Homo sapiens
tattgcaaaggttccaactgta

SEQ ID NO: 4912626 - DNA, 23 bp, Homo sapiens
tattgcaaaggttccaactgtat

SEQ ID NO: 4912627 - DNA, 17 bp, Homo sapiens
tattgcatttatatgta

SEQ ID NO: 4912628 - DNA, 13 bp, Homo sapiens
tattgcccacgct

SEQ ID NO: 4912629 - DNA, 14 bp, Homo sapiens
tattgcccacgctg

SEQ ID NO: 4912630 - DNA, 14 bp, Homo sapiens
tattgcgctgctac

SEQ ID NO: 4912631 - DNA, 18 bp, Homo sapiens
tattgctagtatttgaat

SEQ ID NO: 4912632 - DNA, 18 bp, Homo sapiens
tattgcttagtaaaattt

SEQ ID NO: 4912633 - DNA, 19 bp, Homo sapiens
tattgcttagtaaaattta

SEQ ID NO: 4912634 - DNA, 18 bp, Homo sapiens
tattggaaatggatgcaa

SEQ ID NO: 4912635 - DNA, 19 bp, Homo sapiens
tattggaaatggatgcaaa

SEQ ID NO: 4912636 - DNA, 16 bp, Homo sapiens
tattggtggctttcct

SEQ ID NO: 4912637 - DNA, 18 bp, Homo sapiens
tattggtggctttccttg

SEQ ID NO: 4912638 - DNA, 15 bp, Homo sapiens
tattgtaaacatgtg

SEQ ID NO: 4912639 - DNA, 13 bp, Homo sapiens
tattgtacataaa

SEQ ID NO: 4912640 - DNA, 22 bp, Homo sapiens
tattgtggtaggccttttaaca

SEQ ID NO: 4912641 - DNA, 23 bp, Homo sapiens
tattgtggtaggccttttaacat

SEQ ID NO: 4912642 - DNA, 20 bp, Homo sapiens
tattgttgacaactgtgact

SEQ ID NO: 4912643 - DNA, 17 bp, Homo sapiens
tatttaaactcaagaca

SEQ ID NO: 4912644 - DNA, 14 bp, Homo sapiens
tatttaaagacagg

SEQ ID NO: 4912645 - DNA, 13 bp, Homo sapiens
tatttaagcaaat

SEQ ID NO: 4912646 - DNA, 17 bp, Homo sapiens
tatttaagcaaatactt

SEQ ID NO: 4912647 - DNA, 20 bp, Homo sapiens
tatttaagcctcatatttaa

SEQ ID NO: 4912648 - DNA, 18 bp, Homo sapiens
tatttaaggtagcttcag

SEQ ID NO: 4912649 - DNA, 21 bp, Homo sapiens
tatttaaggtagcttcagcta

SEQ ID NO: 4912650 - DNA, 10 bp, Homo sapiens
tatttaataa

SEQ ID NO: 4912651 - DNA, 11 bp, Homo sapiens
tatttaataac

SEQ ID NO: 4912652 - DNA, 15 bp, Homo sapiens
tatttaataacatta

SEQ ID NO: 4912653 - DNA, 22 bp, Homo sapiens
tatttaatgcattaaacctgtc

SEQ ID NO: 4912654 - DNA, 21 bp, Homo sapiens
tatttaatgccgatatactct

SEQ ID NO: 4912655 - DNA, 23 bp, Homo sapiens
tatttaatttttttgagacagag

SEQ ID NO: 4912656 - DNA, 21 bp, Homo sapiens
tatttagactcatcttactgt

SEQ ID NO: 4912657 - DNA, 18 bp, Homo sapiens
tatttagatataacacta

SEQ ID NO: 4912658 - DNA, 20 bp, Homo sapiens
tatttagttatagtttcaga

SEQ ID NO: 4912659 - DNA, 16 bp, Homo sapiens
tatttataaagaatgt

SEQ ID NO: 4912660 - DNA, 20 bp, Homo sapiens
tatttatacaagattgaaaa

SEQ ID NO: 4912661 - DNA, 15 bp, Homo sapiens
tatttatatgtacat

SEQ ID NO: 4912662 - DNA, 15 bp, Homo sapiens
tatttatatgtactg

SEQ ID NO: 4912663 - DNA, 16 bp, Homo sapiens
tatttatctctattta

SEQ ID NO: 4912664 - DNA, 17 bp, Homo sapiens
tatttatctctatttaa

SEQ ID NO: 4912665 - DNA, 21 bp, Homo sapiens
tatttatctgattaagttgtc

SEQ ID NO: 4912666 - DNA, 12 bp, Homo sapiens
tatttatgaagt

SEQ ID NO: 4912667 - DNA, 15 bp, Homo sapiens
tatttatgaagttta

SEQ ID NO: 4912668 - DNA, 16 bp, Homo sapiens
tatttatgaagtttaa

SEQ ID NO: 4912669 - DNA, 22 bp, Homo sapiens
tatttatgaagtttaaaacagt

SEQ ID NO: 4912670 - DNA, 19 bp, Homo sapiens
tatttatgccttgatgatt

SEQ ID NO: 4912671 - DNA, 18 bp, Homo sapiens
tatttatgtaatgaagta

SEQ ID NO: 4912672 - DNA, 21 bp, Homo sapiens
tatttatgtctatttaagcct

SEQ ID NO: 4912673 - DNA, 15 bp, Homo sapiens
tatttattaaataaa

SEQ ID NO: 4912674 - DNA, 17 bp, Homo sapiens
tatttattaaataaaat

SEQ ID NO: 4912675 - DNA, 19 bp, Homo sapiens
tatttattaatatttaaca

SEQ ID NO: 4912676 - DNA, 14 bp, Homo sapiens
tatttattatttat

SEQ ID NO: 4912677 - DNA, 11 bp, Homo sapiens
tatttatttat

SEQ ID NO: 4912678 - DNA, 14 bp, Homo sapiens
tatttatttatgta

SEQ ID NO: 4912679 - DNA, 18 bp, Homo sapiens
tatttatttatgtacttt

SEQ ID NO: 4912680 - DNA, 21 bp, Homo sapiens
tatttattttcctaaagagag

SEQ ID NO: 4912681 - DNA, 18 bp, Homo sapiens
tatttatttttacaagaa

SEQ ID NO: 4912682 - DNA, 22 bp, Homo sapiens
tatttcacacgctgttctaatg

SEQ ID NO: 4912683 - DNA, 23 bp, Homo sapiens
tatttcagtgtagttaatttatc

SEQ ID NO: 4912684 - DNA, 19 bp, Homo sapiens
tatttccctaaaatacatt

SEQ ID NO: 4912685 - DNA, 20 bp, Homo sapiens
tatttccctaaaatacattt

SEQ ID NO: 4912686 - DNA, 19 bp, Homo sapiens
tatttctcaacaaagcaca

SEQ ID NO: 4912687 - DNA, 21 bp, Homo sapiens
tatttctcaacaaagcacagt

SEQ ID NO: 4912688 - DNA, 16 bp, Homo sapiens
tatttctgtttctcat

SEQ ID NO: 4912689 - DNA, 17 bp, Homo sapiens
tatttctgtttctcata

SEQ ID NO: 4912690 - DNA, 19 bp, Homo sapiens
tatttgaaggttttaagtg

SEQ ID NO: 4912691 - DNA, 16 bp, Homo sapiens
tatttgaattaaaact

SEQ ID NO: 4912692 - DNA, 21 bp, Homo sapiens
tatttgaattaaaacttctta

SEQ ID NO: 4912693 - DNA, 12 bp, Homo sapiens
tatttgaatttt

SEQ ID NO: 4912694 - DNA, 19 bp, Homo sapiens
tatttgaattttaaatcta

SEQ ID NO: 4912695 - DNA, 18 bp, Homo sapiens
tatttgagagttctaaat

SEQ ID NO: 4912696 - DNA, 14 bp, Homo sapiens
tatttgcaacattt

SEQ ID NO: 4912697 - DNA, 23 bp, Homo sapiens
tatttgcagttcacctgcactta

SEQ ID NO: 4912698 - DNA, 15 bp, Homo sapiens
tatttggcttaaata

SEQ ID NO: 4912699 - DNA, 19 bp, Homo sapiens
tatttggcttaaatatagt

SEQ ID NO: 4912700 - DNA, 15 bp, Homo sapiens
tatttgggaagtgaa

SEQ ID NO: 4912701 - DNA, 23 bp, Homo sapiens
tatttgggagggaaaagggaagt

SEQ ID NO: 4912702 - DNA, 15 bp, Homo sapiens
tatttgtatctctga

SEQ ID NO: 4912703 - DNA, 22 bp, Homo sapiens
tatttgtatctctgaagcatgt

SEQ ID NO: 4912704 - DNA, 14 bp, Homo sapiens
tatttgtggaataa

SEQ ID NO: 4912705 - DNA, 13 bp, Homo sapiens
tatttgtgtaata

SEQ ID NO: 4912706 - DNA, 21 bp, Homo sapiens
tatttgtgttttaatttaaac

SEQ ID NO: 4912707 - DNA, 17 bp, Homo sapiens
tatttgttattttcagt

SEQ ID NO: 4912708 - DNA, 22 bp, Homo sapiens
tatttgttcatgtttggtgcat

SEQ ID NO: 4912709 - DNA, 19 bp, Homo sapiens
tattttaaaaaatgaaaat

SEQ ID NO: 4912710 - DNA, 23 bp, Homo sapiens
tattttaaaagccacatagagtg

SEQ ID NO: 4912711 - DNA, 14 bp, Homo sapiens
tattttaatgtgat

SEQ ID NO: 4912712 - DNA, 18 bp, Homo sapiens
tattttacacagaaacac

SEQ ID NO: 4912713 - DNA, 19 bp, Homo sapiens
tattttacacagaaacact

SEQ ID NO: 4912714 - DNA, 23 bp, Homo sapiens
tattttacacagaaacactgcct

SEQ ID NO: 4912715 - DNA, 13 bp, Homo sapiens
tattttaccatac

SEQ ID NO: 4912716 - DNA, 17 bp, Homo sapiens
tattttactattggaat

SEQ ID NO: 4912717 - DNA, 13 bp, Homo sapiens
tattttatgttta

SEQ ID NO: 4912718 - DNA, 19 bp, Homo sapiens
tattttcaacgcagccctg

SEQ ID NO: 4912719 - DNA, 21 bp, Homo sapiens
tattttcaacgcagccctgct

SEQ ID NO: 4912720 - DNA, 12 bp, Homo sapiens
tattttcacaat

SEQ ID NO: 4912721 - DNA, 13 bp, Homo sapiens
tattttcattaca

SEQ ID NO: 4912722 - DNA, 19 bp, Homo sapiens
tattttcccctatcattta

SEQ ID NO: 4912723 - DNA, 12 bp, Homo sapiens
tattttcctaaa

SEQ ID NO: 4912724 - DNA, 21 bp, Homo sapiens
tattttctgtcagatgagaac

SEQ ID NO: 4912725 - DNA, 19 bp, Homo sapiens
tattttcttcatccaactt

SEQ ID NO: 4912726 - DNA, 14 bp, Homo sapiens
tcctcggaaccgct

SEQ ID NO: 4912727 - DNA, 17 bp, Homo sapiens
tcctctatacatctctc

SEQ ID NO: 4912728 - DNA, 20 bp, Homo sapiens
tcctctatacatctctcccc

SEQ ID NO: 4912729 - DNA, 18 bp, Homo sapiens
tcctctcactaaacttta

SEQ ID NO: 4912730 - DNA, 12 bp, Homo sapiens
tcctctccactg

SEQ ID NO: 4912731 - DNA, 14 bp, Homo sapiens
tcctctccactgcc

SEQ ID NO: 4912732 - DNA, 23 bp, Homo sapiens
tcctctcctttgaaacctgctct

SEQ ID NO: 4912733 - DNA, 12 bp, Homo sapiens
tcctctggagcc

SEQ ID NO: 4912734 - DNA, 17 bp, Homo sapiens
tcctctgtccaggcact

SEQ ID NO: 4912735 - DNA, 12 bp, Homo sapiens
tcctctgtctgc

SEQ ID NO: 4912736 - DNA, 14 bp, Homo sapiens
tcctctgtctgccc

SEQ ID NO: 4912737 - DNA, 22 bp, Homo sapiens
tcctctgtttctccttctgaaa

SEQ ID NO: 4912738 - DNA, 20 bp, Homo sapiens
tcctcttcaccccggcaggc

SEQ ID NO: 4912739 - DNA, 13 bp, Homo sapiens
tcctcttctttat

SEQ ID NO: 4912740 - DNA, 17 bp, Homo sapiens
tcctctttaaaacaaaa

SEQ ID NO: 4912741 - DNA, 19 bp, Homo sapiens
tcctctttaaaacaaaaca

SEQ ID NO: 4912742 - DNA, 14 bp, Homo sapiens
tcctgaaatttcag

SEQ ID NO: 4912743 - DNA, 15 bp, Homo sapiens
tcctgaaatttcaga

SEQ ID NO: 4912744 - DNA, 16 bp, Homo sapiens
tcctgaaccgcacagc

SEQ ID NO: 4912745 - DNA, 23 bp, Homo sapiens
tcctgaaccgcacagctcaggag

SEQ ID NO: 4912746 - DNA, 16 bp, Homo sapiens
tcctgacatcacagca

SEQ ID NO: 4912747 - DNA, 23 bp, Homo sapiens
tcctgactcctacctgccctgga

SEQ ID NO: 4912748 - DNA, 22 bp, Homo sapiens
tcctgactctgccccctgctgg

SEQ ID NO: 4912749 - DNA, 20 bp, Homo sapiens
tcctgagatttcctcctggc

SEQ ID NO: 4912750 - DNA, 12 bp, Homo sapiens
tcctgagccccg

SEQ ID NO: 4912751 - DNA, 22 bp, Homo sapiens
tcctgagccccgccctcttcct

SEQ ID NO: 4912752 - DNA, 23 bp, Homo sapiens
tcctgagggaggacctggggcac

SEQ ID NO: 4912753 - DNA, 20 bp, Homo sapiens
tcctgataaagcacagctgt

SEQ ID NO: 4912754 - DNA, 21 bp, Homo sapiens
tcctgataaagcacagctgta

SEQ ID NO: 4912755 - DNA, 18 bp, Homo sapiens
tcctgatggtacaggaaa

SEQ ID NO: 4912756 - DNA, 15 bp, Homo sapiens
tcctgcaattttcta

SEQ ID NO: 4912757 - DNA, 15 bp, Homo sapiens
tcctgcactgtttaa

SEQ ID NO: 4912758 - DNA, 13 bp, Homo sapiens
tcctgccagcccc

SEQ ID NO: 4912759 - DNA, 17 bp, Homo sapiens
tcctgcccctctttctc

SEQ ID NO: 4912760 - DNA, 18 bp, Homo sapiens
tcctgcccctctttctct

SEQ ID NO: 4912761 - DNA, 22 bp, Homo sapiens
tcctgcccgccacacagaccac

SEQ ID NO: 4912762 - DNA, 20 bp, Homo sapiens
gcccatctcggagcatcccg

SEQ ID NO: 4912763 - DNA, 17 bp, Homo sapiens
gcccatgagtccttgaa

SEQ ID NO: 4912764 - DNA, 15 bp, Homo sapiens
gcccatgcccacctg

SEQ ID NO: 4912765 - DNA, 15 bp, Homo sapiens
gcccatgttctgccc

SEQ ID NO: 4912766 - DNA, 18 bp, Homo sapiens
gcccatttcaattctcaa

SEQ ID NO: 4912767 - DNA, 20 bp, Homo sapiens
gcccatttcaattctcaaaa

SEQ ID NO: 4912768 - DNA, 17 bp, Homo sapiens
gccccaaacaaatatgc

SEQ ID NO: 4912769 - DNA, 14 bp, Homo sapiens
gccccaacctgctg

SEQ ID NO: 4912770 - DNA, 18 bp, Homo sapiens
gccccaatccctttatta

SEQ ID NO: 4912771 - DNA, 13 bp, Homo sapiens
gccccaattttct

SEQ ID NO: 4912772 - DNA, 15 bp, Homo sapiens
gccccacccaggagg

SEQ ID NO: 4912773 - DNA, 21 bp, Homo sapiens
gccccaccggcgcgctcttcg

SEQ ID NO: 4912774 - DNA, 18 bp, Homo sapiens
gccccactgatgctgttc

SEQ ID NO: 4912775 - DNA, 23 bp, Homo sapiens
gccccactgatgctgttctcttc

SEQ ID NO: 4912776 - DNA, 15 bp, Homo sapiens
gccccactgccagca

SEQ ID NO: 4912777 - DNA, 17 bp, Homo sapiens
gccccagggtcttccct

SEQ ID NO: 4912778 - DNA, 13 bp, Homo sapiens
gccccagtgccca

SEQ ID NO: 4912779 - DNA, 18 bp, Homo sapiens
gccccagttcaatctccc

SEQ ID NO: 4912780 - DNA, 20 bp, Homo sapiens
gccccatgcctgtccagcct

SEQ ID NO: 4912781 - DNA, 17 bp, Homo sapiens
gccccattctgcctgcc

SEQ ID NO: 4912782 - DNA, 23 bp, Homo sapiens
gccccattctgcctgcccaggcc

SEQ ID NO: 4912783 - DNA, 15 bp, Homo sapiens
gcccccagcccaaag

SEQ ID NO: 4912784 - DNA, 14 bp, Homo sapiens
gcccccagcctatg

SEQ ID NO: 4912785 - DNA, 23 bp, Homo sapiens
gcccccagcctatgagcatcctg

SEQ ID NO: 4912786 - DNA, 13 bp, Homo sapiens
gccccccagctca

SEQ ID NO: 4912787 - DNA, 21 bp, Homo sapiens
gccccctcctctagctgtggg

SEQ ID NO: 4912788 - DNA, 12 bp, Homo sapiens
gccccctcctga

SEQ ID NO: 4912789 - DNA, 13 bp, Homo sapiens
gccccctcctgaa

SEQ ID NO: 4912790 - DNA, 18 bp, Homo sapiens
gccccctgccccccagcc

SEQ ID NO: 4912791 - DNA, 13 bp, Homo sapiens
gccccctgctggc

SEQ ID NO: 4912792 - DNA, 13 bp, Homo sapiens
gccccctggcctc

SEQ ID NO: 4912793 - DNA, 14 bp, Homo sapiens
gccccctggcctct

SEQ ID NO: 4912794 - DNA, 18 bp, Homo sapiens
gccccgaggccttctctg

SEQ ID NO: 4912795 - DNA, 22 bp, Homo sapiens
gccccgaggccttctctgaagg

SEQ ID NO: 4912796 - DNA, 21 bp, Homo sapiens
gccccgcagacctccccagcc

SEQ ID NO: 4912797 - DNA, 15 bp, Homo sapiens
gccccggatcagagc

SEQ ID NO: 4912798 - DNA, 16 bp, Homo sapiens
gccccggatcagagca

SEQ ID NO: 4912799 - DNA, 14 bp, Homo sapiens
gccccggccacctc

SEQ ID NO: 4912800 - DNA, 15 bp, Homo sapiens
gccccggccacctct

SEQ ID NO: 4912801 - DNA, 14 bp, Homo sapiens
gccccggccctggg

SEQ ID NO: 4912802 - DNA, 17 bp, Homo sapiens
gccccggccctgggctc

SEQ ID NO: 4912803 - DNA, 15 bp, Homo sapiens
gcccctagcccagga

SEQ ID NO: 4912804 - DNA, 21 bp, Homo sapiens
gcccctagcccaggagagaga

SEQ ID NO: 4912805 - DNA, 16 bp, Homo sapiens
gcccctcaacctcctg

SEQ ID NO: 4912806 - DNA, 21 bp, Homo sapiens
gcccctcccccaacccccacc

SEQ ID NO: 4912807 - DNA, 22 bp, Homo sapiens
gcccctcccccaacccccaccc

SEQ ID NO: 4912808 - DNA, 14 bp, Homo sapiens
gcccctcccccatc

SEQ ID NO: 4912809 - DNA, 23 bp, Homo sapiens
gcccctcgcctgtggagctcagc

SEQ ID NO: 4912810 - DNA, 14 bp, Homo sapiens
gcccctctcaccaa

SEQ ID NO: 4912811 - DNA, 17 bp, Homo sapiens
gcccctctccttcttag

SEQ ID NO: 4912812 - DNA, 15 bp, Homo sapiens
gcccctctttctctt

SEQ ID NO: 4912813 - DNA, 15 bp, Homo sapiens
gcccctgcagcacgg

SEQ ID NO: 4912814 - DNA, 20 bp, Homo sapiens
gcccctgcatccccttggct

SEQ ID NO: 4912815 - DNA, 12 bp, Homo sapiens
gcccctgcctgc

SEQ ID NO: 4912816 - DNA, 13 bp, Homo sapiens
gcccctgcctgcc

SEQ ID NO: 4912817 - DNA, 15 bp, Homo sapiens
gcccctgcctgccat

SEQ ID NO: 4912818 - DNA, 12 bp, Homo sapiens
gcccctgctggt

SEQ ID NO: 4912819 - DNA, 15 bp, Homo sapiens
gcccctgctggttca

SEQ ID NO: 4912820 - DNA, 19 bp, Homo sapiens
gcccctggacaagcagagg

SEQ ID NO: 4912821 - DNA, 17 bp, Homo sapiens
gccccttccccctccaa

SEQ ID NO: 4912822 - DNA, 12 bp, Homo sapiens
gccccttccctt

SEQ ID NO: 4912823 - DNA, 13 bp, Homo sapiens
gccccttcccttc

SEQ ID NO: 4912824 - DNA, 17 bp, Homo sapiens
gccccttctctccctgc

SEQ ID NO: 4912825 - DNA, 16 bp, Homo sapiens
gcccgacagcctggca

SEQ ID NO: 4912826 - DNA, 22 bp, Homo sapiens
gcccgagctgtttatgttttta

SEQ ID NO: 4912827 - DNA, 13 bp, Homo sapiens
gcccgcacaccct

SEQ ID NO: 4912828 - DNA, 14 bp, Homo sapiens
gcccgcacaccctc

SEQ ID NO: 4912829 - DNA, 22 bp, Homo sapiens
gcccgcacaccctcactctgcc

SEQ ID NO: 4912830 - DNA, 23 bp, Homo sapiens
gcccgcacaccctcactctgcca

SEQ ID NO: 4912831 - DNA, 24 bp, Homo sapiens
gcccgcacaccctcactctgccag

SEQ ID NO: 4912832 - DNA, 15 bp, Homo sapiens
gcccgcacagcagcc

SEQ ID NO: 4912833 - DNA, 16 bp, Homo sapiens
gcccgcccctgcagca

SEQ ID NO: 4912834 - DNA, 20 bp, Homo sapiens
gcccggccgctccaccagca

SEQ ID NO: 4912835 - DNA, 19 bp, Homo sapiens
gcccgggcgcggccagccc

SEQ ID NO: 4912836 - DNA, 18 bp, Homo sapiens
gccctaaccccttccaga

SEQ ID NO: 4912837 - DNA, 14 bp, Homo sapiens
gccctaagggagtg

SEQ ID NO: 4912838 - DNA, 20 bp, Homo sapiens
gccctactccctgcagatgc

SEQ ID NO: 4912839 - DNA, 22 bp, Homo sapiens
gccctactccctgcagatgcca

SEQ ID NO: 4912840 - DNA, 13 bp, Homo sapiens
gccctagagcctg

SEQ ID NO: 4912841 - DNA, 15 bp, Homo sapiens
gccctagagcctgcc

SEQ ID NO: 4912842 - DNA, 18 bp, Homo sapiens
gccctagagcctgcctgg

SEQ ID NO: 4912843 - DNA, 20 bp, Homo sapiens
gccctagagcctgcctggag

SEQ ID NO: 4912844 - DNA, 17 bp, Homo sapiens
gccctatttttgcaatg

SEQ ID NO: 4912845 - DNA, 15 bp, Homo sapiens
gccctcagatgtccc

SEQ ID NO: 4912846 - DNA, 16 bp, Homo sapiens
gccctcagatgtccct

SEQ ID NO: 4912847 - DNA, 18 bp, Homo sapiens
gccctcatggcccctctg

SEQ ID NO: 4912848 - DNA, 17 bp, Homo sapiens
gccctcccctcccctgc

SEQ ID NO: 4912849 - DNA, 18 bp, Homo sapiens
gccctcccctcccctgct

SEQ ID NO: 4912850 - DNA, 21 bp, Homo sapiens
gccctcccctcccctgctgca

SEQ ID NO: 4912851 - DNA, 22 bp, Homo sapiens
gccctcccctcccctgctgcag

SEQ ID NO: 4912852 - DNA, 19 bp, Homo sapiens
gccctccctccccagctcc

SEQ ID NO: 4912853 - DNA, 15 bp, Homo sapiens
gccctccctgcccct

SEQ ID NO: 4912854 - DNA, 18 bp, Homo sapiens
gccctcctgtgctggggg

SEQ ID NO: 4912855 - DNA, 16 bp, Homo sapiens
gccctccttgtccacc

SEQ ID NO: 4912856 - DNA, 17 bp, Homo sapiens
gccctccttgtccaccc

SEQ ID NO: 4912857 - DNA, 14 bp, Homo sapiens
gccctcttcctgac

SEQ ID NO: 4912858 - DNA, 22 bp, Homo sapiens
gccctgaggaaggaggggaagc

SEQ ID NO: 4912859 - DNA, 22 bp, Homo sapiens
gccctgaggtgaaagggagcta

SEQ ID NO: 4912860 - DNA, 17 bp, Homo sapiens
gccctgccctggcaggg

SEQ ID NO: 4912861 - DNA, 15 bp, Homo sapiens
gccctgctcctgcag

SEQ ID NO: 4912862 - DNA, 12 bp, Homo sapiens
gccctgctgccc

SEQ ID NO: 4912863 - DNA, 18 bp, Homo sapiens
gccctgctttgggctgcc

SEQ ID NO: 4912864 - DNA, 20 bp, Homo sapiens
gccctgctttgggctgccct

SEQ ID NO: 4912865 - DNA, 21 bp, Homo sapiens
gccctggcagggtcatcctgt

SEQ ID NO: 4912866 - DNA, 15 bp, Homo sapiens
gccctggctcccaca

SEQ ID NO: 4912867 - DNA, 17 bp, Homo sapiens
gccctgggccacactga

SEQ ID NO: 4912868 - DNA, 17 bp, Homo sapiens
gccagcctggggcctgg

SEQ ID NO: 4912869 - DNA, 19 bp, Homo sapiens
gccagcctggggcctggca

SEQ ID NO: 4912870 - DNA, 21 bp, Homo sapiens
gccagcctggtccatgcaggg

SEQ ID NO: 4912871 - DNA, 12 bp, Homo sapiens
gccagccttctt

SEQ ID NO: 4912872 - DNA, 19 bp, Homo sapiens
gccagccttcttccatccc

SEQ ID NO: 4912873 - DNA, 19 bp, Homo sapiens
gccagctcacagtgctgtg

SEQ ID NO: 4912874 - DNA, 13 bp, Homo sapiens
gccagctccctct

SEQ ID NO: 4912875 - DNA, 14 bp, Homo sapiens
gccagctgcagctg

SEQ ID NO: 4912876 - DNA, 20 bp, Homo sapiens
gccagctgcagctgggctgt

SEQ ID NO: 4912877 - DNA, 22 bp, Homo sapiens
gccagcttggggccaccaaagc

SEQ ID NO: 4912878 - DNA, 17 bp, Homo sapiens
gccaggaagtacttcca

SEQ ID NO: 4912879 - DNA, 19 bp, Homo sapiens
gccaggcaggcgggcgcca

SEQ ID NO: 4912880 - DNA, 22 bp, Homo sapiens
gccaggccagagggagtgacag

SEQ ID NO: 4912881 - DNA, 21 bp, Homo sapiens
gccaggcctctctcacctctc

SEQ ID NO: 4912882 - DNA, 17 bp, Homo sapiens
gccaggctcaggccatg

SEQ ID NO: 4912883 - DNA, 17 bp, Homo sapiens
gccaggctggtctaaaa

SEQ ID NO: 4912884 - DNA, 20 bp, Homo sapiens
gccagggcaatgatgaatga

SEQ ID NO: 4912885 - DNA, 15 bp, Homo sapiens
gccagggcagtgcta

SEQ ID NO: 4912886 - DNA, 18 bp, Homo sapiens
gccagggctgccctgaga

SEQ ID NO: 4912887 - DNA, 17 bp, Homo sapiens
gccagggtctctccctc

SEQ ID NO: 4912888 - DNA, 18 bp, Homo sapiens
gccagggtctctccctca

SEQ ID NO: 4912889 - DNA, 19 bp, Homo sapiens
gccagggtctctccctcag

SEQ ID NO: 4912890 - DNA, 22 bp, Homo sapiens
gccagggtctgtgtgaatgtgg

SEQ ID NO: 4912891 - DNA, 17 bp, Homo sapiens
gccagtattagactgga

SEQ ID NO: 4912892 - DNA, 18 bp, Homo sapiens
gccagtcctgcctggcca

SEQ ID NO: 4912893 - DNA, 19 bp, Homo sapiens
gccagtcctgcctggccag

SEQ ID NO: 4912894 - DNA, 16 bp, Homo sapiens
gccagtgctccaggca

SEQ ID NO: 4912895 - DNA, 18 bp, Homo sapiens
gccagtgtaatcccccag

SEQ ID NO: 4912896 - DNA, 15 bp, Homo sapiens
gccagtgttgcctaa

SEQ ID NO: 4912897 - DNA, 18 bp, Homo sapiens
gccagtgttgcctaagta

SEQ ID NO: 4912898 - DNA, 17 bp, Homo sapiens
gccatataagtttgaag

SEQ ID NO: 4912899 - DNA, 18 bp, Homo sapiens
gccatataagtttgaagg

SEQ ID NO: 4912900 - DNA, 23 bp, Homo sapiens
gccatatataacagatacatttc

SEQ ID NO: 4912901 - DNA, 19 bp, Homo sapiens
gccatattctgttggccag

SEQ ID NO: 4912902 - DNA, 17 bp, Homo sapiens
gccatatttactacctt

SEQ ID NO: 4912903 - DNA, 15 bp, Homo sapiens
gccatcaaaatgctt

SEQ ID NO: 4912904 - DNA, 16 bp, Homo sapiens
gccatcaaaatgcttt

SEQ ID NO: 4912905 - DNA, 18 bp, Homo sapiens
gccatcaaaatgcttttt

SEQ ID NO: 4912906 - DNA, 22 bp, Homo sapiens
gccatcacatgatctgtttttc

SEQ ID NO: 4912907 - DNA, 20 bp, Homo sapiens
gccatccaggttcagcttgt

SEQ ID NO: 4912908 - DNA, 12 bp, Homo sapiens
gccatccctgtg

SEQ ID NO: 4912909 - DNA, 15 bp, Homo sapiens
gccatccctgtgagg

SEQ ID NO: 4912910 - DNA, 21 bp, Homo sapiens
gccatccttgactttgaacta

SEQ ID NO: 4912911 - DNA, 18 bp, Homo sapiens
gccatctgtgtcctggtt

SEQ ID NO: 4912912 - DNA, 16 bp, Homo sapiens
gccatgccaggaacct

SEQ ID NO: 4912913 - DNA, 16 bp, Homo sapiens
gccatgctgggaagac

SEQ ID NO: 4912914 - DNA, 13 bp, Homo sapiens
gccatggagttgt

SEQ ID NO: 4912915 - DNA, 15 bp, Homo sapiens
gccatgggcctcctg

SEQ ID NO: 4912916 - DNA, 15 bp, Homo sapiens
gccatgtacctcccc

SEQ ID NO: 4912917 - DNA, 17 bp, Homo sapiens
gccatgtacctcccctg

SEQ ID NO: 4912918 - DNA, 21 bp, Homo sapiens
gccatgtacctcccctgcctt

SEQ ID NO: 4912919 - DNA, 22 bp, Homo sapiens
gccatgtccaaagaggctgccc

SEQ ID NO: 4912920 - DNA, 14 bp, Homo sapiens
gccatgtgccaggt

SEQ ID NO: 4912921 - DNA, 16 bp, Homo sapiens
gccatgttggccaggc

SEQ ID NO: 4912922 - DNA, 18 bp, Homo sapiens
gccatgttggccaggctg

SEQ ID NO: 4912923 - DNA, 22 bp, Homo sapiens
gccatgttggccaggctggtct

SEQ ID NO: 4912924 - DNA, 22 bp, Homo sapiens
gccattattttctgtcagatga

SEQ ID NO: 4912925 - DNA, 19 bp, Homo sapiens
gccattgatcataaactga

SEQ ID NO: 4912926 - DNA, 13 bp, Homo sapiens
gccattttgtgaa

SEQ ID NO: 4912927 - DNA, 18 bp, Homo sapiens
gccattttgtgaatggat

SEQ ID NO: 4912928 - DNA, 21 bp, Homo sapiens
gcccaagacagatgccccaga

SEQ ID NO: 4912929 - DNA, 18 bp, Homo sapiens
gcccaaggcggcccctcc

SEQ ID NO: 4912930 - DNA, 14 bp, Homo sapiens
gcccaattggagga

SEQ ID NO: 4912931 - DNA, 22 bp, Homo sapiens
gcccacagcacagctccctgcc

SEQ ID NO: 4912932 - DNA, 24 bp, Homo sapiens
gcccacaggaggcaagcaagctct

SEQ ID NO: 4912933 - DNA, 13 bp, Homo sapiens
gcccacaggatca

SEQ ID NO: 4912934 - DNA, 12 bp, Homo sapiens
gcccaccctgct

SEQ ID NO: 4912935 - DNA, 15 bp, Homo sapiens
gcccaccctgctgcc

SEQ ID NO: 4912936 - DNA, 15 bp, Homo sapiens
gcccacctccccacg

SEQ ID NO: 4912937 - DNA, 17 bp, Homo sapiens
gcccacctccccacgcc

SEQ ID NO: 4912938 - DNA, 21 bp, Homo sapiens
gcccacctccccacgccctcc

SEQ ID NO: 4912939 - DNA, 15 bp, Homo sapiens
gcccaccttggctca

SEQ ID NO: 4912940 - DNA, 21 bp, Homo sapiens
gcccacgctggagtgcagtga

SEQ ID NO: 4912941 - DNA, 23 bp, Homo sapiens
gcccacgctggagtgcagtgagc

SEQ ID NO: 4912942 - DNA, 18 bp, Homo sapiens
gcccacggctaagaggct

SEQ ID NO: 4912943 - DNA, 14 bp, Homo sapiens
gcccacttctgcca

SEQ ID NO: 4912944 - DNA, 23 bp, Homo sapiens
gcccacttgtatcctctggttct

SEQ ID NO: 4912945 - DNA, 16 bp, Homo sapiens
gcccagaacttccctg

SEQ ID NO: 4912946 - DNA, 18 bp, Homo sapiens
gcccagaagaaaattctc

SEQ ID NO: 4912947 - DNA, 21 bp, Homo sapiens
gcccagaagaaaattctcctg

SEQ ID NO: 4912948 - DNA, 13 bp, Homo sapiens
gcccagagaacag

SEQ ID NO: 4912949 - DNA, 15 bp, Homo sapiens
gcccagagagggtgg

SEQ ID NO: 4912950 - DNA, 16 bp, Homo sapiens
gcccagagcaggaagc

SEQ ID NO: 4912951 - DNA, 18 bp, Homo sapiens
gcccagagcaggaagcat

SEQ ID NO: 4912952 - DNA, 12 bp, Homo sapiens
gcccagaggtaa

SEQ ID NO: 4912953 - DNA, 16 bp, Homo sapiens
gcccagaggtaacaga

SEQ ID NO: 4912954 - DNA, 18 bp, Homo sapiens
gcccagaggtaacagaac

SEQ ID NO: 4912955 - DNA, 20 bp, Homo sapiens
gcccagaggtaacagaacag

SEQ ID NO: 4912956 - DNA, 20 bp, Homo sapiens
gcccagccaaaccctgtctg

SEQ ID NO: 4912957 - DNA, 21 bp, Homo sapiens
gcccagccaaaccctgtctga

SEQ ID NO: 4912958 - DNA, 14 bp, Homo sapiens
gcccagcccctaga

SEQ ID NO: 4912959 - DNA, 18 bp, Homo sapiens
gcccagcccggaccttgg

SEQ ID NO: 4912960 - DNA, 16 bp, Homo sapiens
gcccagcgctctgcct

SEQ ID NO: 4912961 - DNA, 13 bp, Homo sapiens
gcccaggagagag

SEQ ID NO: 4912962 - DNA, 23 bp, Homo sapiens
gcccaggagagagaaagccaggc

SEQ ID NO: 4912963 - DNA, 16 bp, Homo sapiens
gcccaggcaggtcttg

SEQ ID NO: 4912964 - DNA, 12 bp, Homo sapiens
gcccaggcccct

SEQ ID NO: 4912965 - DNA, 18 bp, Homo sapiens
gcccaggcccctgccacc

SEQ ID NO: 4912966 - DNA, 18 bp, Homo sapiens
gcccaggccggccagcct

SEQ ID NO: 4912967 - DNA, 21 bp, Homo sapiens
gcccaggccggggtggagcat

SEQ ID NO: 4912968 - DNA, 14 bp, Homo sapiens
gcccaggctggcgt

SEQ ID NO: 4912969 - DNA, 20 bp, Homo sapiens
gcccaggctggcgtgcagtg

SEQ ID NO: 4912970 - DNA, 22 bp, Homo sapiens
gcccaggctggcgtgcagtggt

SEQ ID NO: 4912971 - DNA, 14 bp, Homo sapiens
gcccatactcagcc

SEQ ID NO: 4912972 - DNA, 15 bp, Homo sapiens
gcccatactcagcct

SEQ ID NO: 4912973 - DNA, 16 bp, Homo sapiens
gcccatactcagcctg

SEQ ID NO: 4912974 - DNA, 21 bp, Homo sapiens
gcccatactcagcctgctgcc

SEQ ID NO: 4912975 - DNA, 21 bp, Homo sapiens
gcccatcacagggttgggccc

SEQ ID NO: 4912976 - DNA, 22 bp, Homo sapiens
gcccatcacagggttgggccca

SEQ ID NO: 4912977 - DNA, 12 bp, Homo sapiens
gcccatccctgc

SEQ ID NO: 4912978 - DNA, 18 bp, Homo sapiens
gcccatctcggagcatcc

SEQ ID NO: 4912979 - DNA, 22 bp, Homo sapiens
ggagtgtggctgaggaggcctc

SEQ ID NO: 4912980 - DNA, 15 bp, Homo sapiens
ggagttcgaggctgc

SEQ ID NO: 4912981 - DNA, 22 bp, Homo sapiens
ggagttgtcaagtctctgctgg

SEQ ID NO: 4912982 - DNA, 14 bp, Homo sapiens
ggagtttctaaggt

SEQ ID NO: 4912983 - DNA, 20 bp, Homo sapiens
ggataagccactctgtccct

SEQ ID NO: 4912984 - DNA, 22 bp, Homo sapiens
ggatacaacctccctcttgttt

SEQ ID NO: 4912985 - DNA, 15 bp, Homo sapiens
ggataggagcctgct

SEQ ID NO: 4912986 - DNA, 16 bp, Homo sapiens
ggatagtatgagccct

SEQ ID NO: 4912987 - DNA, 20 bp, Homo sapiens
ggatatccttatcagagcta

SEQ ID NO: 4912988 - DNA, 19 bp, Homo sapiens
ggatcacgacgctgcagag

SEQ ID NO: 4912989 - DNA, 21 bp, Homo sapiens
ggatcagatgaactcttagaa

SEQ ID NO: 4912990 - DNA, 21 bp, Homo sapiens
ggatcagtctgattcccaagc

SEQ ID NO: 4912991 - DNA, 18 bp, Homo sapiens
ggatcatcatgcagctca

SEQ ID NO: 4912992 - DNA, 16 bp, Homo sapiens
ggatcatggtgtaata

SEQ ID NO: 4912993 - DNA, 19 bp, Homo sapiens
ggatctgtcacaccagcca

SEQ ID NO: 4912994 - DNA, 14 bp, Homo sapiens
ggatcttgaatgtg

SEQ ID NO: 4912995 - DNA, 18 bp, Homo sapiens
ggatgaatgaggtcccag

SEQ ID NO: 4912996 - DNA, 14 bp, Homo sapiens
ggatgagagcccag

SEQ ID NO: 4912997 - DNA, 19 bp, Homo sapiens
ggatgagagcccagaggta

SEQ ID NO: 4912998 - DNA, 20 bp, Homo sapiens
ggatgagagcccagaggtaa

SEQ ID NO: 4912999 - DNA, 20 bp, Homo sapiens
ggatgattcagaaattggaa

SEQ ID NO: 4913000 - DNA, 21 bp, Homo sapiens
ggatgattcagaaattggaac

SEQ ID NO: 4913001 - DNA, 11 bp, Homo sapiens
ggatgcctcct

SEQ ID NO: 4913002 - DNA, 21 bp, Homo sapiens
ggatggagcccaggcgggagc

SEQ ID NO: 4913003 - DNA, 13 bp, Homo sapiens
ggatgttctggga

SEQ ID NO: 4913004 - DNA, 19 bp, Homo sapiens
ggattacaagcgtgagcca

SEQ ID NO: 4913005 - DNA, 22 bp, Homo sapiens
ggattatttaataacattacct

SEQ ID NO: 4913006 - DNA, 22 bp, Homo sapiens
ggattcattctcataattccta

SEQ ID NO: 4913007 - DNA, 21 bp, Homo sapiens
ggattctgaggccctgcccaa

SEQ ID NO: 4913008 - DNA, 17 bp, Homo sapiens
ggattgctactgtccta

SEQ ID NO: 4913009 - DNA, 23 bp, Homo sapiens
ggattgtaaaaaaaaatgccttt

SEQ ID NO: 4913010 - DNA, 19 bp, Homo sapiens
ggattgttaatttcagtcc

SEQ ID NO: 4913011 - DNA, 18 bp, Homo sapiens
ggatttaaaaactggaac

SEQ ID NO: 4913012 - DNA, 15 bp, Homo sapiens
ggcaaaaccttgcta

SEQ ID NO: 4913013 - DNA, 13 bp, Homo sapiens
ggcaaaattgcaa

SEQ ID NO: 4913014 - DNA, 13 bp, Homo sapiens
ggcaaatataaaa

SEQ ID NO: 4913015 - DNA, 18 bp, Homo sapiens
ggcaaatgacatgcactg

SEQ ID NO: 4913016 - DNA, 18 bp, Homo sapiens
ggcaacccccagcctgct

SEQ ID NO: 4913017 - DNA, 19 bp, Homo sapiens
ggcaagagcccccttgaca

SEQ ID NO: 4913018 - DNA, 22 bp, Homo sapiens
ggcaagagcccccttgacaccg

SEQ ID NO: 4913019 - DNA, 19 bp, Homo sapiens
ggcaagcacctcctgcctc

SEQ ID NO: 4913020 - DNA, 17 bp, Homo sapiens
ggcaaggaaaaagaaaa

SEQ ID NO: 4913021 - DNA, 15 bp, Homo sapiens
ggcaatcaatgttca

SEQ ID NO: 4913022 - DNA, 15 bp, Homo sapiens
ggcaatgctggctgt

SEQ ID NO: 4913023 - DNA, 15 bp, Homo sapiens
ggcacaactgcaata

SEQ ID NO: 4913024 - DNA, 18 bp, Homo sapiens
ggcacaagtcctggatgt

SEQ ID NO: 4913025 - DNA, 15 bp, Homo sapiens
ggcacactctgccag

SEQ ID NO: 4913026 - DNA, 20 bp, Homo sapiens
ggcacagcggagtctgtcct

SEQ ID NO: 4913027 - DNA, 22 bp, Homo sapiens
ggcacagcggagtctgtcctgt

SEQ ID NO: 4913028 - DNA, 17 bp, Homo sapiens
ggcacaggtcgggcgca

SEQ ID NO: 4913029 - DNA, 22 bp, Homo sapiens
ggcacagtccaggaacaagcta

SEQ ID NO: 4913030 - DNA, 18 bp, Homo sapiens
ggcacattgagctgtgca

SEQ ID NO: 4913031 - DNA, 10 bp, Homo sapiens
ggcaccaaag

SEQ ID NO: 4913032 - DNA, 13 bp, Homo sapiens
ggcaccagccagc

SEQ ID NO: 4913033 - DNA, 18 bp, Homo sapiens
ggcacccggcccctgctg

SEQ ID NO: 4913034 - DNA, 19 bp, Homo sapiens
ggcacccggcccctgctgg

SEQ ID NO: 4913035 - DNA, 20 bp, Homo sapiens
ggcacccggcccctgctggt

SEQ ID NO: 4913036 - DNA, 22 bp, Homo sapiens
ggcacccggcccctgctggttc

SEQ ID NO: 4913037 - DNA, 12 bp, Homo sapiens
ggcaccctctgg

SEQ ID NO: 4913038 - DNA, 20 bp, Homo sapiens
ggcaccctctggccgcctag

SEQ ID NO: 4913039 - DNA, 22 bp, Homo sapiens
gctctagggttgctggagcctg

SEQ ID NO: 4913040 - DNA, 14 bp, Homo sapiens
gctctatctctcaa

SEQ ID NO: 4913041 - DNA, 17 bp, Homo sapiens
gctctcccatttcctga

SEQ ID NO: 4913042 - DNA, 17 bp, Homo sapiens
gctctccgaccagacac

SEQ ID NO: 4913043 - DNA, 21 bp, Homo sapiens
gctctcttcctgcccctcttt

SEQ ID NO: 4913044 - DNA, 22 bp, Homo sapiens
gctctcttgccgaggagccagg

SEQ ID NO: 4913045 - DNA, 23 bp, Homo sapiens
gctctcttgccgaggagccaggc

SEQ ID NO: 4913046 - DNA, 17 bp, Homo sapiens
gctctcttttctgtact

SEQ ID NO: 4913047 - DNA, 18 bp, Homo sapiens
gctctgagagtctagatt

SEQ ID NO: 4913048 - DNA, 20 bp, Homo sapiens
gctctgagagtctagattct

SEQ ID NO: 4913049 - DNA, 20 bp, Homo sapiens
gctctgagcaaatgtggctc

SEQ ID NO: 4913050 - DNA, 21 bp, Homo sapiens
gctctgagcaaatgtggctcc

SEQ ID NO: 4913051 - DNA, 20 bp, Homo sapiens
gctctgatcatccactgtgc

SEQ ID NO: 4913052 - DNA, 23 bp, Homo sapiens
gctctgatcatccactgtgccat

SEQ ID NO: 4913053 - DNA, 17 bp, Homo sapiens
gctctgcacccctctgc

SEQ ID NO: 4913054 - DNA, 14 bp, Homo sapiens
gctctgctcctctc

SEQ ID NO: 4913055 - DNA, 15 bp, Homo sapiens
gctctggacaggcat

SEQ ID NO: 4913056 - DNA, 16 bp, Homo sapiens
gctctggacaggcatg

SEQ ID NO: 4913057 - DNA, 22 bp, Homo sapiens
gctctggacaggcatgttctct

SEQ ID NO: 4913058 - DNA, 11 bp, Homo sapiens
gctctgtgctg

SEQ ID NO: 4913059 - DNA, 15 bp, Homo sapiens
gctcttcaggcctcc

SEQ ID NO: 4913060 - DNA, 21 bp, Homo sapiens
gctcttcgcgcccgcccctgc

SEQ ID NO: 4913061 - DNA, 12 bp, Homo sapiens
gctcttctccag

SEQ ID NO: 4913062 - DNA, 21 bp, Homo sapiens
gctcttctcctttcacaacct

SEQ ID NO: 4913063 - DNA, 19 bp, Homo sapiens
gctcttggcaggtactcag

SEQ ID NO: 4913064 - DNA, 22 bp, Homo sapiens
gctcttgtcccacgtgtcttcc

SEQ ID NO: 4913065 - DNA, 22 bp, Homo sapiens
gctcttgtttttattaatttat

SEQ ID NO: 4913066 - DNA, 23 bp, Homo sapiens
gctcttgtttttattaatttata

SEQ ID NO: 4913067 - DNA, 21 bp, Homo sapiens
gctctttgaaatagtctgtgt

SEQ ID NO: 4913068 - DNA, 22 bp, Homo sapiens
gctcttttttgtttgtttcttt

SEQ ID NO: 4913069 - DNA, 21 bp, Homo sapiens
gctgaaaaccatctggcctgg

SEQ ID NO: 4913070 - DNA, 14 bp, Homo sapiens
gctgacagacacag

SEQ ID NO: 4913071 - DNA, 17 bp, Homo sapiens
gctgacagacacaggcc

SEQ ID NO: 4913072 - DNA, 19 bp, Homo sapiens
gctgacagacacaggcccg

SEQ ID NO: 4913073 - DNA, 21 bp, Homo sapiens
gctgacagacacaggcccggc

SEQ ID NO: 4913074 - DNA, 19 bp, Homo sapiens
gctgacatggctctggact

SEQ ID NO: 4913075 - DNA, 15 bp, Homo sapiens
gctgaccaattgtgc

SEQ ID NO: 4913076 - DNA, 16 bp, Homo sapiens
gctgacctgcctctca

SEQ ID NO: 4913077 - DNA, 22 bp, Homo sapiens
gctgacctgcctctcacacaca

SEQ ID NO: 4913078 - DNA, 21 bp, Homo sapiens
gctgactgtactcctcccagg

SEQ ID NO: 4913079 - DNA, 13 bp, Homo sapiens
gctgacttcactt

SEQ ID NO: 4913080 - DNA, 16 bp, Homo sapiens
gctgagaactcctgac

SEQ ID NO: 4913081 - DNA, 20 bp, Homo sapiens
gctgagcctctgctccccag

SEQ ID NO: 4913082 - DNA, 21 bp, Homo sapiens
gctgaggaggcctccatctca

SEQ ID NO: 4913083 - DNA, 17 bp, Homo sapiens
gctgaggtttcaccctt

SEQ ID NO: 4913084 - DNA, 17 bp, Homo sapiens
gctgagtgggagaaggc

SEQ ID NO: 4913085 - DNA, 23 bp, Homo sapiens
gctgatacataactaaatttgat

SEQ ID NO: 4913086 - DNA, 14 bp, Homo sapiens
gctgatacttcatt

SEQ ID NO: 4913087 - DNA, 15 bp, Homo sapiens
gctgatataaattct

SEQ ID NO: 4913088 - DNA, 17 bp, Homo sapiens
gctgatataaattctgt

SEQ ID NO: 4913089 - DNA, 18 bp, Homo sapiens
gctgcagctggacagagg

SEQ ID NO: 4913090 - DNA, 22 bp, Homo sapiens
gctgcaggaatcaaaaattgaa

SEQ ID NO: 4913091 - DNA, 15 bp, Homo sapiens
gctgcaggggctctg

SEQ ID NO: 4913092 - DNA, 20 bp, Homo sapiens
gctgcaggggctctggagag

SEQ ID NO: 4913093 - DNA, 16 bp, Homo sapiens
gctgcagtaggggagg

SEQ ID NO: 4913094 - DNA, 20 bp, Homo sapiens
gctgcagtaggggaggagca

SEQ ID NO: 4913095 - DNA, 19 bp, Homo sapiens
gctgcatcttatagcactt

SEQ ID NO: 4913096 - DNA, 14 bp, Homo sapiens
gctgcatgcctggt

SEQ ID NO: 4913097 - DNA, 22 bp, Homo sapiens
gctgccaaggccagagtggcct

SEQ ID NO: 4913098 - DNA, 21 bp, Homo sapiens
gctgccacaaccagccaggca

SEQ ID NO: 4913099 - DNA, 23 bp, Homo sapiens
gctgccacacttcaggctcttct

SEQ ID NO: 4913100 - DNA, 12 bp, Homo sapiens
gctgccatccag

SEQ ID NO: 4913101 - DNA, 17 bp, Homo sapiens
gctgccatccaggttca

SEQ ID NO: 4913102 - DNA, 16 bp, Homo sapiens
gctgcccaatctccat

SEQ ID NO: 4913103 - DNA, 18 bp, Homo sapiens
gctgcccactgtttctct

SEQ ID NO: 4913104 - DNA, 16 bp, Homo sapiens
gctgccccaacctgct

SEQ ID NO: 4913105 - DNA, 18 bp, Homo sapiens
gctgccccaacctgctga

SEQ ID NO: 4913106 - DNA, 20 bp, Homo sapiens
gctgccccaacctgctgaag

SEQ ID NO: 4913107 - DNA, 20 bp, Homo sapiens
gctgcccccggccccctggt

SEQ ID NO: 4913108 - DNA, 19 bp, Homo sapiens
ggaaatcatcgaaaattca

SEQ ID NO: 4913109 - DNA, 16 bp, Homo sapiens
ggaacaaaaaaaccac

SEQ ID NO: 4913110 - DNA, 14 bp, Homo sapiens
ggaacacacttgga

SEQ ID NO: 4913111 - DNA, 16 bp, Homo sapiens
ggaacagaatgtttta

SEQ ID NO: 4913112 - DNA, 21 bp, Homo sapiens
ggaacagacaacagaagtcat

SEQ ID NO: 4913113 - DNA, 19 bp, Homo sapiens
ggaacagactggaagcaca

SEQ ID NO: 4913114 - DNA, 20 bp, Homo sapiens
ggaacagactggaagcacag

SEQ ID NO: 4913115 - DNA, 22 bp, Homo sapiens
ggaacatcctttgcagggcagc

SEQ ID NO: 4913116 - DNA, 20 bp, Homo sapiens
ggaacccagcagttctgtta

SEQ ID NO: 4913117 - DNA, 20 bp, Homo sapiens
ggaaccgctcacctagagcc

SEQ ID NO: 4913118 - DNA, 13 bp, Homo sapiens
ggaacctcccaga

SEQ ID NO: 4913119 - DNA, 15 bp, Homo sapiens
ggaacctcccagagg

SEQ ID NO: 4913120 - DNA, 23 bp, Homo sapiens
ggaacctctgtctcatcctcctg

SEQ ID NO: 4913121 - DNA, 19 bp, Homo sapiens
ggaacctgaggcctgaagg

SEQ ID NO: 4913122 - DNA, 13 bp, Homo sapiens
ggaaccttgctgt

SEQ ID NO: 4913123 - DNA, 15 bp, Homo sapiens
ggaacgatgtgtctg

SEQ ID NO: 4913124 - DNA, 14 bp, Homo sapiens
ggaactaataaata

SEQ ID NO: 4913125 - DNA, 18 bp, Homo sapiens
ggaactagactgcctggg

SEQ ID NO: 4913126 - DNA, 12 bp, Homo sapiens
ggaactctgaca

SEQ ID NO: 4913127 - DNA, 13 bp, Homo sapiens
ggaactctgacaa

SEQ ID NO: 4913128 - DNA, 14 bp, Homo sapiens
ggaactgtccagag

SEQ ID NO: 4913129 - DNA, 16 bp, Homo sapiens
ggaactgtccagagag

SEQ ID NO: 4913130 - DNA, 14 bp, Homo sapiens
ggaacttcagagat

SEQ ID NO: 4913131 - DNA, 15 bp, Homo sapiens
ggaacttctaatata

SEQ ID NO: 4913132 - DNA, 17 bp, Homo sapiens
ggaagaaaaaaatcttc

SEQ ID NO: 4913133 - DNA, 14 bp, Homo sapiens
ggaagaagcagaga

SEQ ID NO: 4913134 - DNA, 12 bp, Homo sapiens
ggaagagaaatc

SEQ ID NO: 4913135 - DNA, 15 bp, Homo sapiens
ggaagcaccccatgc

SEQ ID NO: 4913136 - DNA, 22 bp, Homo sapiens
ggaagcaccccatgccaaagct

SEQ ID NO: 4913137 - DNA, 20 bp, Homo sapiens
ggaagcattcagagagcagc

SEQ ID NO: 4913138 - DNA, 15 bp, Homo sapiens
ggaagccaaatttat

SEQ ID NO: 4913139 - DNA, 21 bp, Homo sapiens
ggaagccgagctccagagcaa

SEQ ID NO: 4913140 - DNA, 14 bp, Homo sapiens
ggaagcctgcagtc

SEQ ID NO: 4913141 - DNA, 20 bp, Homo sapiens
ggaagcgcgagggcctcaaa

SEQ ID NO: 4913142 - DNA, 14 bp, Homo sapiens
ggaagctgcagctt

SEQ ID NO: 4913143 - DNA, 16 bp, Homo sapiens
ggaaggaggagccgac

SEQ ID NO: 4913144 - DNA, 19 bp, Homo sapiens
ggaaggaggggaagctgca

SEQ ID NO: 4913145 - DNA, 20 bp, Homo sapiens
ggaaggaggggaagctgcag

SEQ ID NO: 4913146 - DNA, 16 bp, Homo sapiens
ggaaggattgtaaaaa

SEQ ID NO: 4913147 - DNA, 23 bp, Homo sapiens
ggaaggattgtaaaaaaaaatgc

SEQ ID NO: 4913148 - DNA, 14 bp, Homo sapiens
ggaaggcagacagc

SEQ ID NO: 4913149 - DNA, 17 bp, Homo sapiens
ggaaggcagacagcagg

SEQ ID NO: 4913150 - DNA, 12 bp, Homo sapiens
ggaagggcagga

SEQ ID NO: 4913151 - DNA, 21 bp, Homo sapiens
ggaagggcaggaaggagagcc

SEQ ID NO: 4913152 - DNA, 19 bp, Homo sapiens
ggaagggggggctacatta

SEQ ID NO: 4913153 - DNA, 18 bp, Homo sapiens
ggaagggtttgtggctgg

SEQ ID NO: 4913154 - DNA, 18 bp, Homo sapiens
ggaagtacatgaatacaa

SEQ ID NO: 4913155 - DNA, 14 bp, Homo sapiens
ggaagtagtccttg

SEQ ID NO: 4913156 - DNA, 20 bp, Homo sapiens
ggaagtgaagactggaagct

SEQ ID NO: 4913157 - DNA, 23 bp, Homo sapiens
ggaagtgaagagggagaagggat

SEQ ID NO: 4913158 - DNA, 23 bp, Homo sapiens
ggaagttcatacctaagtactgt

SEQ ID NO: 4913159 - DNA, 22 bp, Homo sapiens
gccctggtttcactggcccaag

SEQ ID NO: 4913160 - DNA, 13 bp, Homo sapiens
gcccttaccttcc

SEQ ID NO: 4913161 - DNA, 14 bp, Homo sapiens
gcccttaccttccc

SEQ ID NO: 4913162 - DNA, 20 bp, Homo sapiens
gcccttagcagggaaacagc

SEQ ID NO: 4913163 - DNA, 16 bp, Homo sapiens
gcccttagtcccccaa

SEQ ID NO: 4913164 - DNA, 17 bp, Homo sapiens
gcccttagtcccccaac

SEQ ID NO: 4913165 - DNA, 17 bp, Homo sapiens
gcccttattttcaagaa

SEQ ID NO: 4913166 - DNA, 20 bp, Homo sapiens
gcccttattttcaagaaact

SEQ ID NO: 4913167 - DNA, 17 bp, Homo sapiens
gcccttcctctccactg

SEQ ID NO: 4913168 - DNA, 18 bp, Homo sapiens
gcccttcctctccactgc

SEQ ID NO: 4913169 - DNA, 19 bp, Homo sapiens
gcccttgcagttcagcacc

SEQ ID NO: 4913170 - DNA, 14 bp, Homo sapiens
gcccttgggccacc

SEQ ID NO: 4913171 - DNA, 21 bp, Homo sapiens
gccctttccccgacgcccacc

SEQ ID NO: 4913172 - DNA, 22 bp, Homo sapiens
gccctttccccgacgcccaccc

SEQ ID NO: 4913173 - DNA, 13 bp, Homo sapiens
gccctttctgtgt

SEQ ID NO: 4913174 - DNA, 19 bp, Homo sapiens
gccctttgaagcctcagct

SEQ ID NO: 4913175 - DNA, 16 bp, Homo sapiens
gccgagatcacgccac

SEQ ID NO: 4913176 - DNA, 20 bp, Homo sapiens
gccgagatcacgccactgca

SEQ ID NO: 4913177 - DNA, 15 bp, Homo sapiens
gccgaggactttgat

SEQ ID NO: 4913178 - DNA, 18 bp, Homo sapiens
gccgaggagccaggcaac

SEQ ID NO: 4913179 - DNA, 18 bp, Homo sapiens
gccgaggaggtgcctgga

SEQ ID NO: 4913180 - DNA, 16 bp, Homo sapiens
gccgccattgccacca

SEQ ID NO: 4913181 - DNA, 18 bp, Homo sapiens
gccgccattgccaccagg

SEQ ID NO: 4913182 - DNA, 22 bp, Homo sapiens
gccgcctgcactcctcagggca

SEQ ID NO: 4913183 - DNA, 16 bp, Homo sapiens
gccgcgtggtgccatc

SEQ ID NO: 4913184 - DNA, 17 bp, Homo sapiens
gccgcgtttagaccaag

SEQ ID NO: 4913185 - DNA, 17 bp, Homo sapiens
gccgctgtgagcccctg

SEQ ID NO: 4913186 - DNA, 23 bp, Homo sapiens
gccgctgtgagcccctggtcctg

SEQ ID NO: 4913187 - DNA, 19 bp, Homo sapiens
gccggccaatggaaacctc

SEQ ID NO: 4913188 - DNA, 23 bp, Homo sapiens
gccggcgtggcaaatataaaact

SEQ ID NO: 4913189 - DNA, 17 bp, Homo sapiens
gccggctgtgctcagag

SEQ ID NO: 4913190 - DNA, 23 bp, Homo sapiens
gccggggacagaggcctgcccgg

SEQ ID NO: 4913191 - DNA, 14 bp, Homo sapiens
gccgtgccttcagc

SEQ ID NO: 4913192 - DNA, 15 bp, Homo sapiens
gccgtgccttcagct

SEQ ID NO: 4913193 - DNA, 19 bp, Homo sapiens
gccgtgccttcagctctac

SEQ ID NO: 4913194 - DNA, 11 bp, Homo sapiens
gccgtggcttc

SEQ ID NO: 4913195 - DNA, 12 bp, Homo sapiens
gccgtggcttcc

SEQ ID NO: 4913196 - DNA, 13 bp, Homo sapiens
gccgtggcttccc

SEQ ID NO: 4913197 - DNA, 14 bp, Homo sapiens
gccgtgtgagtgtg

SEQ ID NO: 4913198 - DNA, 23 bp, Homo sapiens
gccgtgtgagtgtgacagggcca

SEQ ID NO: 4913199 - DNA, 18 bp, Homo sapiens
gcctaaaactggcctgac

SEQ ID NO: 4913200 - DNA, 23 bp, Homo sapiens
gcctaaaagtgggcttgattctg

SEQ ID NO: 4913201 - DNA, 12 bp, Homo sapiens
gcctaaaatctt

SEQ ID NO: 4913202 - DNA, 18 bp, Homo sapiens
gcctaaatttaatgctgc

SEQ ID NO: 4913203 - DNA, 18 bp, Homo sapiens
gcctaactactagttttt

SEQ ID NO: 4913204 - DNA, 18 bp, Homo sapiens
gcctaagcattgcctggc

SEQ ID NO: 4913205 - DNA, 21 bp, Homo sapiens
gcctaagcattgcctggcctt

SEQ ID NO: 4913206 - DNA, 12 bp, Homo sapiens
gcctaagtatta

SEQ ID NO: 4913207 - DNA, 22 bp, Homo sapiens
gcctaatctcatacctctgacc

SEQ ID NO: 4913208 - DNA, 16 bp, Homo sapiens
gcctacaggagtgagc

SEQ ID NO: 4913209 - DNA, 12 bp, Homo sapiens
gcctagcaagct

SEQ ID NO: 4913210 - DNA, 15 bp, Homo sapiens
gcctagcaagctggc

SEQ ID NO: 4913211 - DNA, 18 bp, Homo sapiens
gcctagcaagctggcctc

SEQ ID NO: 4913212 - DNA, 18 bp, Homo sapiens
gcctaggaccactcagcc

SEQ ID NO: 4913213 - DNA, 23 bp, Homo sapiens
gcctaggaccactcagcccctag

SEQ ID NO: 4913214 - DNA, 12 bp, Homo sapiens
gcctaggattct

SEQ ID NO: 4913215 - DNA, 15 bp, Homo sapiens
gcctagtttttagta

SEQ ID NO: 4913216 - DNA, 16 bp, Homo sapiens
gcctatgagcatcctg

SEQ ID NO: 4913217 - DNA, 20 bp, Homo sapiens
gcctatgagcatcctgagcc

SEQ ID NO: 4913218 - DNA, 21 bp, Homo sapiens
gcctatgagcatcctgagccc

SEQ ID NO: 4913219 - DNA, 14 bp, Homo sapiens
gcctatgcacatat

SEQ ID NO: 4913220 - DNA, 20 bp, Homo sapiens
gcctatgcacatatggactc

SEQ ID NO: 4913221 - DNA, 22 bp, Homo sapiens
gcctatgcacatatggactctg

SEQ ID NO: 4913222 - DNA, 12 bp, Homo sapiens
gcctcaaaatgt

SEQ ID NO: 4913223 - DNA, 14 bp, Homo sapiens
gcctcaaaatgtgt

SEQ ID NO: 4913224 - DNA, 17 bp, Homo sapiens
gcctcaaaggcccgctc

SEQ ID NO: 4913225 - DNA, 14 bp, Homo sapiens
gcctcaacctcctg

SEQ ID NO: 4913226 - DNA, 22 bp, Homo sapiens
gcctcaaggttttaggttctaa

SEQ ID NO: 4913227 - DNA, 20 bp, Homo sapiens
gcctcaagtgattctcctgc

SEQ ID NO: 4913228 - DNA, 21 bp, Homo sapiens
gcctcaagtgattctcctgcc

SEQ ID NO: 4913229 - DNA, 18 bp, Homo sapiens
gcctcacctctacccaaa

SEQ ID NO: 4913230 - DNA, 22 bp, Homo sapiens
gcctcactgatatattttccag

SEQ ID NO: 4913231 - DNA, 16 bp, Homo sapiens
gcctcagcatcctggc

SEQ ID NO: 4913232 - DNA, 20 bp, Homo sapiens
gcctcagctacccactatcc

SEQ ID NO: 4913233 - DNA, 23 bp, Homo sapiens
gcctcagctacccactatccttc

SEQ ID NO: 4913234 - DNA, 19 bp, Homo sapiens
gcctcagctgaatgcctcc

SEQ ID NO: 4913235 - DNA, 12 bp, Homo sapiens
gcctcaggctgc

SEQ ID NO: 4913236 - DNA, 23 bp, Homo sapiens
gcctcagtcctcccctcacagcc

SEQ ID NO: 4913237 - DNA, 15 bp, Homo sapiens
gcctcatatttaaag

SEQ ID NO: 4913238 - DNA, 14 bp, Homo sapiens
gcctccacagcgag

SEQ ID NO: 4913239 - DNA, 21 bp, Homo sapiens
gcctccacagcgagggcagct

SEQ ID NO: 4913240 - DNA, 11 bp, Homo sapiens
gcctccatgct

SEQ ID NO: 4913241 - DNA, 14 bp, Homo sapiens
gcctcccagcctgg

SEQ ID NO: 4913242 - DNA, 20 bp, Homo sapiens
gcctcccgaatagctgggac

SEQ ID NO: 4913243 - DNA, 15 bp, Homo sapiens
gcctcccgagtagct

SEQ ID NO: 4913244 - DNA, 19 bp, Homo sapiens
gcctcccgagtagctggga

SEQ ID NO: 4913245 - DNA, 20 bp, Homo sapiens
gcctcccgagtagctgggac

SEQ ID NO: 4913246 - DNA, 11 bp, Homo sapiens
gcctccctgaa

SEQ ID NO: 4913247 - DNA, 14 bp, Homo sapiens
gcctccggaagctg

SEQ ID NO: 4913248 - DNA, 16 bp, Homo sapiens
gcctcctcacccccag

SEQ ID NO: 4913249 - DNA, 19 bp, Homo sapiens
gcctcctcacccccagctt

SEQ ID NO: 4913250 - DNA, 12 bp, Homo sapiens
gcctcctcatcc

SEQ ID NO: 4913251 - DNA, 19 bp, Homo sapiens
gcctcctcgttcctttctc

SEQ ID NO: 4913252 - DNA, 17 bp, Homo sapiens
gcctcctctgtctgccc

SEQ ID NO: 4913253 - DNA, 21 bp, Homo sapiens
gcctcctcttcaccccggcag

SEQ ID NO: 4913254 - DNA, 14 bp, Homo sapiens
gcctcctgcctgcc

SEQ ID NO: 4913255 - DNA, 17 bp, Homo sapiens
gcctcctgcctgcccct

SEQ ID NO: 4913256 - DNA, 12 bp, Homo sapiens
gcctcctgtggg

SEQ ID NO: 4913257 - DNA, 14 bp, Homo sapiens
gcctcctgtgggga

SEQ ID NO: 4913258 - DNA, 18 bp, Homo sapiens
gcctcctgtgtactgtgt

SEQ ID NO: 4913259 - DNA, 13 bp, Homo sapiens
gccttccttgacc

SEQ ID NO: 4913260 - DNA, 20 bp, Homo sapiens
gccttccttgaccttcctct

SEQ ID NO: 4913261 - DNA, 14 bp, Homo sapiens
gccttctcctcccc

SEQ ID NO: 4913262 - DNA, 19 bp, Homo sapiens
gccttctgacggccctgca

SEQ ID NO: 4913263 - DNA, 20 bp, Homo sapiens
gccttctgacggccctgcaa

SEQ ID NO: 4913264 - DNA, 14 bp, Homo sapiens
gccttctttgaaga

SEQ ID NO: 4913265 - DNA, 15 bp, Homo sapiens
gccttctttgaagaa

SEQ ID NO: 4913266 - DNA, 14 bp, Homo sapiens
gccttgaacctgtg

SEQ ID NO: 4913267 - DNA, 23 bp, Homo sapiens
gccttgcctaaatttaatgctgc

SEQ ID NO: 4913268 - DNA, 16 bp, Homo sapiens
gccttggctcagacat

SEQ ID NO: 4913269 - DNA, 20 bp, Homo sapiens
gccttggctgttggcagtga

SEQ ID NO: 4913270 - DNA, 16 bp, Homo sapiens
gccttgggctgctcct

SEQ ID NO: 4913271 - DNA, 17 bp, Homo sapiens
gccttggggaggacaaa

SEQ ID NO: 4913272 - DNA, 14 bp, Homo sapiens
gcctttatggtttc

SEQ ID NO: 4913273 - DNA, 13 bp, Homo sapiens
gcctttcctctct

SEQ ID NO: 4913274 - DNA, 15 bp, Homo sapiens
gcctttgacatttaa

SEQ ID NO: 4913275 - DNA, 23 bp, Homo sapiens
gcctttgagacagtttcttagct

SEQ ID NO: 4913276 - DNA, 15 bp, Homo sapiens
gcctttgcaaatcag

SEQ ID NO: 4913277 - DNA, 16 bp, Homo sapiens
gcctttggccttggct

SEQ ID NO: 4913278 - DNA, 13 bp, Homo sapiens
gccttttaacatt

SEQ ID NO: 4913279 - DNA, 16 bp, Homo sapiens
gccttttaagaagaaa

SEQ ID NO: 4913280 - DNA, 14 bp, Homo sapiens
gccttttatagcta

SEQ ID NO: 4913281 - DNA, 13 bp, Homo sapiens
gccttttccctct

SEQ ID NO: 4913282 - DNA, 17 bp, Homo sapiens
gccttttctttaacttt

SEQ ID NO: 4913283 - DNA, 13 bp, Homo sapiens
gcgaatccaagct

SEQ ID NO: 4913284 - DNA, 18 bp, Homo sapiens
gcgaatccaagctccctg

SEQ ID NO: 4913285 - DNA, 22 bp, Homo sapiens
gcgaatggactttggaagcagg

SEQ ID NO: 4913286 - DNA, 17 bp, Homo sapiens
gcgacatagcccatccc

SEQ ID NO: 4913287 - DNA, 15 bp, Homo sapiens
gcgaccgccccctcc

SEQ ID NO: 4913288 - DNA, 22 bp, Homo sapiens
gcgaccgccctccgcgaaaata

SEQ ID NO: 4913289 - DNA, 15 bp, Homo sapiens
gcgaccttcctcatc

SEQ ID NO: 4913290 - DNA, 22 bp, Homo sapiens
gcgaccttcctcatccacccca

SEQ ID NO: 4913291 - DNA, 13 bp, Homo sapiens
gcgactaatttca

SEQ ID NO: 4913292 - DNA, 15 bp, Homo sapiens
gcgagcatcccccaa

SEQ ID NO: 4913293 - DNA, 15 bp, Homo sapiens
gcgagccctggtggc

SEQ ID NO: 4913294 - DNA, 15 bp, Homo sapiens
gcgagggcagctgct

SEQ ID NO: 4913295 - DNA, 16 bp, Homo sapiens
gcgagggcagctgcta

SEQ ID NO: 4913296 - DNA, 13 bp, Homo sapiens
gcgatatacagat

SEQ ID NO: 4913297 - DNA, 16 bp, Homo sapiens
gcgatccacctgtctc

SEQ ID NO: 4913298 - DNA, 17 bp, Homo sapiens
gcgatccacctgtctca

SEQ ID NO: 4913299 - DNA, 21 bp, Homo sapiens
gcgatccacctgtctcagcct

SEQ ID NO: 4913300 - DNA, 15 bp, Homo sapiens
gcgatcccacacagg

SEQ ID NO: 4913301 - DNA, 22 bp, Homo sapiens
gcgatctgggttcactgcaacc

SEQ ID NO: 4913302 - DNA, 17 bp, Homo sapiens
gcgattctcctgcctca

SEQ ID NO: 4913303 - DNA, 13 bp, Homo sapiens
gcgattcttctgc

SEQ ID NO: 4913304 - DNA, 17 bp, Homo sapiens
gcgattcttctgcttca

SEQ ID NO: 4913305 - DNA, 18 bp, Homo sapiens
gcgcacacacacacatac

SEQ ID NO: 4913306 - DNA, 20 bp, Homo sapiens
gcgcatccaatctcaaggaa

SEQ ID NO: 4913307 - DNA, 19 bp, Homo sapiens
gcgccagtgtaatccccca

SEQ ID NO: 4913308 - DNA, 13 bp, Homo sapiens
gcgcccacctccc

SEQ ID NO: 4913309 - DNA, 17 bp, Homo sapiens
gcgcccacctccccacg

SEQ ID NO: 4913310 - DNA, 13 bp, Homo sapiens
gcgccccttcccc

SEQ ID NO: 4913311 - DNA, 16 bp, Homo sapiens
gcgcccgcccctgcag

SEQ ID NO: 4913312 - DNA, 17 bp, Homo sapiens
gcgcccgcccctgcagc

SEQ ID NO: 4913313 - DNA, 20 bp, Homo sapiens
gcgcccttggcttctgtgat

SEQ ID NO: 4913314 - DNA, 18 bp, Homo sapiens
gcgccctttccccgacgc

SEQ ID NO: 4913315 - DNA, 15 bp, Homo sapiens
gcgcctacaggagtg

SEQ ID NO: 4913316 - DNA, 18 bp, Homo sapiens
gcgcctacaggagtgagc

SEQ ID NO: 4913317 - DNA, 20 bp, Homo sapiens
gcgcctcaggctgctggggc

SEQ ID NO: 4913318 - DNA, 16 bp, Homo sapiens
gcgcctgtgatgctgg

SEQ ID NO: 4913319 - DNA, 17 bp, Homo sapiens
gcgcctgtgcacacaca

SEQ ID NO: 4913320 - DNA, 13 bp, Homo sapiens
gcgcgcacacaca

SEQ ID NO: 4913321 - DNA, 19 bp, Homo sapiens
gcgcgcacacacacacata

SEQ ID NO: 4913322 - DNA, 17 bp, Homo sapiens
gcgcgctcttcgcgccc

SEQ ID NO: 4913323 - DNA, 23 bp, Homo sapiens
gcgcgctcttcgcgcccgcccct

SEQ ID NO: 4913324 - DNA, 14 bp, Homo sapiens
gcgcggccagcccc

SEQ ID NO: 4913325 - DNA, 23 bp, Homo sapiens
gcggacagccacggccaggccag

SEQ ID NO: 4913326 - DNA, 13 bp, Homo sapiens
gcggaccccagct

SEQ ID NO: 4913327 - DNA, 14 bp, Homo sapiens
gcggaccccagctg

SEQ ID NO: 4913328 - DNA, 20 bp, Homo sapiens
gcggattaatttgcatctga

SEQ ID NO: 4913329 - DNA, 13 bp, Homo sapiens
gcggccagccccg

SEQ ID NO: 4913330 - DNA, 19 bp, Homo sapiens
gcggccagtattagactgg

SEQ ID NO: 4913331 - DNA, 16 bp, Homo sapiens
gcggcccctcccgccc

SEQ ID NO: 4913332 - DNA, 18 bp, Homo sapiens
gcggcgaccgccctccgc

SEQ ID NO: 4913333 - DNA, 22 bp, Homo sapiens
gcgggaggatgttctgggacac

SEQ ID NO: 4913334 - DNA, 19 bp, Homo sapiens
gcgggcggctgggtctgtg

SEQ ID NO: 4913335 - DNA, 17 bp, Homo sapiens
gcggggacagctccttc

SEQ ID NO: 4913336 - DNA, 16 bp, Homo sapiens
gcggtccacccaggag

SEQ ID NO: 4913337 - DNA, 20 bp, Homo sapiens
gcggtctcaggctggtggga

SEQ ID NO: 4913338 - DNA, 14 bp, Homo sapiens
gcgtccagaaatgg

SEQ ID NO: 4913339 - DNA, 16 bp, Homo sapiens
gcgtcttccgcccctg

SEQ ID NO: 4913340 - DNA, 12 bp, Homo sapiens
gattagctttgt

SEQ ID NO: 4913341 - DNA, 19 bp, Homo sapiens
gattataaaattaatcaca

SEQ ID NO: 4913342 - DNA, 14 bp, Homo sapiens
gattatagattcta

SEQ ID NO: 4913343 - DNA, 12 bp, Homo sapiens
gattatcctgag

SEQ ID NO: 4913344 - DNA, 20 bp, Homo sapiens
gattatgtcttttatatttg

SEQ ID NO: 4913345 - DNA, 12 bp, Homo sapiens
gattatttaata

SEQ ID NO: 4913346 - DNA, 14 bp, Homo sapiens
gattatttaataac

SEQ ID NO: 4913347 - DNA, 18 bp, Homo sapiens
gattatttaataacatta

SEQ ID NO: 4913348 - DNA, 14 bp, Homo sapiens
gattattttcatta

SEQ ID NO: 4913349 - DNA, 19 bp, Homo sapiens
gattcaaaggttctaggtt

SEQ ID NO: 4913350 - DNA, 12 bp, Homo sapiens
gattcagaaatt

SEQ ID NO: 4913351 - DNA, 18 bp, Homo sapiens
gattcagattgttatcta

SEQ ID NO: 4913352 - DNA, 13 bp, Homo sapiens
gattcaggaatgt

SEQ ID NO: 4913353 - DNA, 12 bp, Homo sapiens
gattcaggctgc

SEQ ID NO: 4913354 - DNA, 16 bp, Homo sapiens
gattcaggctgcttgg

SEQ ID NO: 4913355 - DNA, 11 bp, Homo sapiens
gattcagtctt

SEQ ID NO: 4913356 - DNA, 13 bp, Homo sapiens
gattcagtcttgc

SEQ ID NO: 4913357 - DNA, 18 bp, Homo sapiens
gattcatgttatatttaa

SEQ ID NO: 4913358 - DNA, 15 bp, Homo sapiens
gattccatgctaagc

SEQ ID NO: 4913359 - DNA, 16 bp, Homo sapiens
gattcccaagctctgc

SEQ ID NO: 4913360 - DNA, 13 bp, Homo sapiens
gattcccagagca

SEQ ID NO: 4913361 - DNA, 19 bp, Homo sapiens
gattcccagagcaaaataa

SEQ ID NO: 4913362 - DNA, 23 bp, Homo sapiens
gattcctctgtattgtgctgatt

SEQ ID NO: 4913363 - DNA, 12 bp, Homo sapiens
gattctaaagat

SEQ ID NO: 4913364 - DNA, 15 bp, Homo sapiens
gattctaatgatgat

SEQ ID NO: 4913365 - DNA, 15 bp, Homo sapiens
gattctaatgtcttc

SEQ ID NO: 4913366 - DNA, 18 bp, Homo sapiens
gattctatagttctagac

SEQ ID NO: 4913367 - DNA, 21 bp, Homo sapiens
gattctatttatatgtacatg

SEQ ID NO: 4913368 - DNA, 15 bp, Homo sapiens
gattctcctgcctca

SEQ ID NO: 4913369 - DNA, 20 bp, Homo sapiens
gattctcctgcctcagcctc

SEQ ID NO: 4913370 - DNA, 22 bp, Homo sapiens
gattctctggctgtaaggctct

SEQ ID NO: 4913371 - DNA, 22 bp, Homo sapiens
gattctctgtgtctaagattct

SEQ ID NO: 4913372 - DNA, 15 bp, Homo sapiens
gattctgtggaacaa

SEQ ID NO: 4913373 - DNA, 23 bp, Homo sapiens
gattcttatgtagcaggaaataa

SEQ ID NO: 4913374 - DNA, 15 bp, Homo sapiens
gattcttctgcttca

SEQ ID NO: 4913375 - DNA, 20 bp, Homo sapiens
gattctttttaaagtgtttc

SEQ ID NO: 4913376 - DNA, 12 bp, Homo sapiens
gattgacctgct

SEQ ID NO: 4913377 - DNA, 19 bp, Homo sapiens
gattgagaaggagagaaag

SEQ ID NO: 4913378 - DNA, 15 bp, Homo sapiens
gattgcaacaggctg

SEQ ID NO: 4913379 - DNA, 14 bp, Homo sapiens
gattgcacattgtt

SEQ ID NO: 4913380 - DNA, 19 bp, Homo sapiens
gattgcggtttacagctat

SEQ ID NO: 4913381 - DNA, 16 bp, Homo sapiens
gattggacggcctgat

SEQ ID NO: 4913382 - DNA, 21 bp, Homo sapiens
gattggattatttaataacat

SEQ ID NO: 4913383 - DNA, 13 bp, Homo sapiens
gattggcatggct

SEQ ID NO: 4913384 - DNA, 16 bp, Homo sapiens
gattggcttgtagaat

SEQ ID NO: 4913385 - DNA, 23 bp, Homo sapiens
gattgggggggccaaaaggaaaa

SEQ ID NO: 4913386 - DNA, 12 bp, Homo sapiens
gattgtaaaata

SEQ ID NO: 4913387 - DNA, 20 bp, Homo sapiens
gattgtaaaatagcttgtat

SEQ ID NO: 4913388 - DNA, 13 bp, Homo sapiens
gattgtaaacttc

SEQ ID NO: 4913389 - DNA, 20 bp, Homo sapiens
gattgtaggtgcaagatgga

SEQ ID NO: 4913390 - DNA, 15 bp, Homo sapiens
gattgttaatttcag

SEQ ID NO: 4913391 - DNA, 15 bp, Homo sapiens
gatttaataaaataa

SEQ ID NO: 4913392 - DNA, 21 bp, Homo sapiens
gatttatagtttgtacatgca

SEQ ID NO: 4913393 - DNA, 16 bp, Homo sapiens
gatttatataaatgta

SEQ ID NO: 4913394 - DNA, 20 bp, Homo sapiens
gatttatttttcagttccaa

SEQ ID NO: 4913395 - DNA, 19 bp, Homo sapiens
gatttcaagaaaaaataaa

SEQ ID NO: 4913396 - DNA, 15 bp, Homo sapiens
gatttcaagatcctc

SEQ ID NO: 4913397 - DNA, 12 bp, Homo sapiens
gatttcccctct

SEQ ID NO: 4913398 - DNA, 13 bp, Homo sapiens
gatttccttgaat

SEQ ID NO: 4913399 - DNA, 15 bp, Homo sapiens
gatttccttgtgcaa

SEQ ID NO: 4913400 - DNA, 14 bp, Homo sapiens
gatttctaatcaaa

SEQ ID NO: 4913401 - DNA, 16 bp, Homo sapiens
gatttctaatcaaaag

SEQ ID NO: 4913402 - DNA, 13 bp, Homo sapiens
gatttgaactcag

SEQ ID NO: 4913403 - DNA, 18 bp, Homo sapiens
gatttgatgctgtttgac

SEQ ID NO: 4913404 - DNA, 23 bp, Homo sapiens
gattttaatggattgttaatttc

SEQ ID NO: 4913405 - DNA, 19 bp, Homo sapiens
gattttcaaagctttttcc

SEQ ID NO: 4913406 - DNA, 14 bp, Homo sapiens
gattttcatgttct

SEQ ID NO: 4913407 - DNA, 15 bp, Homo sapiens
gattttcatgttctt

SEQ ID NO: 4913408 - DNA, 15 bp, Homo sapiens
gattttctggttcta

SEQ ID NO: 4913409 - DNA, 17 bp, Homo sapiens
gattttgaggtaaagat

SEQ ID NO: 4913410 - DNA, 14 bp, Homo sapiens
gcattattctcttt

SEQ ID NO: 4913411 - DNA, 21 bp, Homo sapiens
gcattattctcttttatctgt

SEQ ID NO: 4913412 - DNA, 22 bp, Homo sapiens
gcattattctcttttatctgtt

SEQ ID NO: 4913413 - DNA, 22 bp, Homo sapiens
gcattccttctttgataatgtt

SEQ ID NO: 4913414 - DNA, 16 bp, Homo sapiens
gcattcctttgtcttc

SEQ ID NO: 4913415 - DNA, 21 bp, Homo sapiens
gcattctccccagtgtatgtc

SEQ ID NO: 4913416 - DNA, 12 bp, Homo sapiens
gcattctttccc

SEQ ID NO: 4913417 - DNA, 11 bp, Homo sapiens
gcattgaaatt

SEQ ID NO: 4913418 - DNA, 22 bp, Homo sapiens
gcattgactggtttacaggccc

SEQ ID NO: 4913419 - DNA, 16 bp, Homo sapiens
gcattgctagataaaa

SEQ ID NO: 4913420 - DNA, 17 bp, Homo sapiens
gcatttatcattcttgt

SEQ ID NO: 4913421 - DNA, 16 bp, Homo sapiens
gcatttcataaactaa

SEQ ID NO: 4913422 - DNA, 19 bp, Homo sapiens
gcatttctgaatagaaatg

SEQ ID NO: 4913423 - DNA, 19 bp, Homo sapiens
gcatttgtattttgtgtga

SEQ ID NO: 4913424 - DNA, 15 bp, Homo sapiens
gcatttgtgtcatct

SEQ ID NO: 4913425 - DNA, 18 bp, Homo sapiens
gcattttcaccccaccct

SEQ ID NO: 4913426 - DNA, 19 bp, Homo sapiens
gcatttttatttcagattt

SEQ ID NO: 4913427 - DNA, 18 bp, Homo sapiens
gccaaaaggaaaaagctc

SEQ ID NO: 4913428 - DNA, 19 bp, Homo sapiens
gccaaaaggaaaaagctcc

SEQ ID NO: 4913429 - DNA, 22 bp, Homo sapiens
gccaaacccatgaggcaatgtc

SEQ ID NO: 4913430 - DNA, 14 bp, Homo sapiens
gccaaactgctgga

SEQ ID NO: 4913431 - DNA, 22 bp, Homo sapiens
gcaggagattgagaaggagaga

SEQ ID NO: 4913432 - DNA, 23 bp, Homo sapiens
gcaggagattgagaaggagagaa

SEQ ID NO: 4913433 - DNA, 14 bp, Homo sapiens
gcaggaggattgct

SEQ ID NO: 4913434 - DNA, 15 bp, Homo sapiens
gcaggagtggtgcag

SEQ ID NO: 4913435 - DNA, 13 bp, Homo sapiens
gcaggcagcgcca

SEQ ID NO: 4913436 - DNA, 15 bp, Homo sapiens
gcaggcattgaggaa

SEQ ID NO: 4913437 - DNA, 19 bp, Homo sapiens
gcaggccaaggccttctcc

SEQ ID NO: 4913438 - DNA, 22 bp, Homo sapiens
gcaggccaaggtctgagccaca

SEQ ID NO: 4913439 - DNA, 14 bp, Homo sapiens
gcaggccctgcagt

SEQ ID NO: 4913440 - DNA, 16 bp, Homo sapiens
gcaggcggtggggaga

SEQ ID NO: 4913441 - DNA, 11 bp, Homo sapiens
gcaggctgggc

SEQ ID NO: 4913442 - DNA, 14 bp, Homo sapiens
gcagggaaggcctg

SEQ ID NO: 4913443 - DNA, 16 bp, Homo sapiens
gcagggaaggcctgac

SEQ ID NO: 4913444 - DNA, 15 bp, Homo sapiens
gcagggaatttctat

SEQ ID NO: 4913445 - DNA, 15 bp, Homo sapiens
gcagggaggtcaggc

SEQ ID NO: 4913446 - DNA, 23 bp, Homo sapiens
gcagggcaaatgacatgcactga

SEQ ID NO: 4913447 - DNA, 15 bp, Homo sapiens
gcagggcagccccac

SEQ ID NO: 4913448 - DNA, 14 bp, Homo sapiens
gcagggccaggact

SEQ ID NO: 4913449 - DNA, 19 bp, Homo sapiens
gcagggctcagcggggaca

SEQ ID NO: 4913450 - DNA, 21 bp, Homo sapiens
gcagggctcagcggggacagc

SEQ ID NO: 4913451 - DNA, 13 bp, Homo sapiens
gcagggctggccc

SEQ ID NO: 4913452 - DNA, 19 bp, Homo sapiens
gcaggggctctggagagaa

SEQ ID NO: 4913453 - DNA, 20 bp, Homo sapiens
gcaggggctctggagagaaa

SEQ ID NO: 4913454 - DNA, 15 bp, Homo sapiens
gcaggttggacccca

SEQ ID NO: 4913455 - DNA, 18 bp, Homo sapiens
gcaggttggaccccagag

SEQ ID NO: 4913456 - DNA, 21 bp, Homo sapiens
gcagtagaaataatatgcatt

SEQ ID NO: 4913457 - DNA, 13 bp, Homo sapiens
gcagtccatgcat

SEQ ID NO: 4913458 - DNA, 15 bp, Homo sapiens
gcactagcctttggc

SEQ ID NO: 4913459 - DNA, 16 bp, Homo sapiens
gcactagcctttggct

SEQ ID NO: 4913460 - DNA, 22 bp, Homo sapiens
gcactagcctttggctctggag

SEQ ID NO: 4913461 - DNA, 19 bp, Homo sapiens
gcactcaaccttaagacct

SEQ ID NO: 4913462 - DNA, 17 bp, Homo sapiens
gcactcagaagacactg

SEQ ID NO: 4913463 - DNA, 12 bp, Homo sapiens
gcactccagcct

SEQ ID NO: 4913464 - DNA, 19 bp, Homo sapiens
gcactctgttatttagact

SEQ ID NO: 4913465 - DNA, 17 bp, Homo sapiens
gcactgacccttccaga

SEQ ID NO: 4913466 - DNA, 15 bp, Homo sapiens
gcactgctgcccagc

SEQ ID NO: 4913467 - DNA, 20 bp, Homo sapiens
gcactgctgcccagcctcca

SEQ ID NO: 4913468 - DNA, 19 bp, Homo sapiens
gcactggggagcccgtctc

SEQ ID NO: 4913469 - DNA, 19 bp, Homo sapiens
gcactggtggcccgacagc

SEQ ID NO: 4913470 - DNA, 16 bp, Homo sapiens
gcactgtagttctaag

SEQ ID NO: 4913471 - DNA, 18 bp, Homo sapiens
gcactgttgatgtatctg

SEQ ID NO: 4913472 - DNA, 19 bp, Homo sapiens
gcacttagctatcagaaga

SEQ ID NO: 4913473 - DNA, 18 bp, Homo sapiens
gcacttatttaatgccga

SEQ ID NO: 4913474 - DNA, 21 bp, Homo sapiens
gcacttcagaattccatatct

SEQ ID NO: 4913475 - DNA, 12 bp, Homo sapiens
gcacttccaaaa

SEQ ID NO: 4913476 - DNA, 16 bp, Homo sapiens
gcacttgcagactcta

SEQ ID NO: 4913477 - DNA, 14 bp, Homo sapiens
gcacttgcctgggt

SEQ ID NO: 4913478 - DNA, 20 bp, Homo sapiens
gcacttgtgattatttatta

SEQ ID NO: 4913479 - DNA, 23 bp, Homo sapiens
gcacttgtgattatttattattt

SEQ ID NO: 4913480 - DNA, 16 bp, Homo sapiens
gcactttgaaatacct

SEQ ID NO: 4913481 - DNA, 21 bp, Homo sapiens
gcactttgaaatacctcatgt

SEQ ID NO: 4913482 - DNA, 22 bp, Homo sapiens
gcactttgaaatacctcatgtt

SEQ ID NO: 4913483 - DNA, 23 bp, Homo sapiens
gcactttgaaatacctcatgttt

SEQ ID NO: 4913484 - DNA, 15 bp, Homo sapiens
gcactttgatgtcat

SEQ ID NO: 4913485 - DNA, 21 bp, Homo sapiens
gcagaaagctgtgaacaggct

SEQ ID NO: 4913486 - DNA, 13 bp, Homo sapiens
gcagaacggagcc

SEQ ID NO: 4913487 - DNA, 12 bp, Homo sapiens
gcagaactgcca

SEQ ID NO: 4913488 - DNA, 21 bp, Homo sapiens
gcagaactgccattattttct

SEQ ID NO: 4913489 - DNA, 16 bp, Homo sapiens
gcagaagacaaaaaga

SEQ ID NO: 4913490 - DNA, 21 bp, Homo sapiens
gcagaagacaccagagcagat

SEQ ID NO: 4913491 - DNA, 13 bp, Homo sapiens
gcagaatgttttt

SEQ ID NO: 4913492 - DNA, 17 bp, Homo sapiens
gcagaatgtttttaaaa

SEQ ID NO: 4913493 - DNA, 13 bp, Homo sapiens
gcagacagacaat

SEQ ID NO: 4913494 - DNA, 14 bp, Homo sapiens
gcagacaggaggaa

SEQ ID NO: 4913495 - DNA, 22 bp, Homo sapiens
gcagagaagggcataaaacagc

SEQ ID NO: 4913496 - DNA, 22 bp, Homo sapiens
gcagagaatgaaagggcccaga

SEQ ID NO: 4913497 - DNA, 19 bp, Homo sapiens
gcagagagccattttgtga

SEQ ID NO: 4913498 - DNA, 19 bp, Homo sapiens
gcagagagcggtctcaggc

SEQ ID NO: 4913499 - DNA, 15 bp, Homo sapiens
gcagagcccccagga

SEQ ID NO: 4913500 - DNA, 19 bp, Homo sapiens
gcagaggggtaagagagga

SEQ ID NO: 4913501 - DNA, 23 bp, Homo sapiens
gcagaggtggccagagctgggag

SEQ ID NO: 4913502 - DNA, 20 bp, Homo sapiens
gcagagtttgtgtgttgtct

SEQ ID NO: 4913503 - DNA, 18 bp, Homo sapiens
gcagataatcagcctctt

SEQ ID NO: 4913504 - DNA, 15 bp, Homo sapiens
gcagatgcagagagc

SEQ ID NO: 4913505 - DNA, 16 bp, Homo sapiens
gcagatgccaccctag

SEQ ID NO: 4913506 - DNA, 15 bp, Homo sapiens
gcagcaaaaatataa

SEQ ID NO: 4913507 - DNA, 16 bp, Homo sapiens
gcagcaaaaatataaa

SEQ ID NO: 4913508 - DNA, 18 bp, Homo sapiens
gcagcaaaaatataaaat

SEQ ID NO: 4913509 - DNA, 19 bp, Homo sapiens
gcagcacggacaataaacc

SEQ ID NO: 4913510 - DNA, 15 bp, Homo sapiens
gcagcagcaggtgat

SEQ ID NO: 4913511 - DNA, 15 bp, Homo sapiens
gcagcatttgataat

SEQ ID NO: 4913512 - DNA, 17 bp, Homo sapiens
gcagcccaggccggggt

SEQ ID NO: 4913513 - DNA, 18 bp, Homo sapiens
gcagcccatgcccacctg

SEQ ID NO: 4913514 - DNA, 24 bp, Homo sapiens
gcagccccattctgcctgcccagg

SEQ ID NO: 4913515 - DNA, 14 bp, Homo sapiens
gcagccccgggagg

SEQ ID NO: 4913516 - DNA, 20 bp, Homo sapiens
gcagccgccttccttgacct

SEQ ID NO: 4913517 - DNA, 20 bp, Homo sapiens
gcagcctcaacctcctgggc

SEQ ID NO: 4913518 - DNA, 22 bp, Homo sapiens
gcagcctcaacctcctgggcta

SEQ ID NO: 4913519 - DNA, 23 bp, Homo sapiens
gcagcctgcttcccacctccctg

SEQ ID NO: 4913520 - DNA, 17 bp, Homo sapiens
gcagcgaccgccccctc

SEQ ID NO: 4913521 - DNA, 14 bp, Homo sapiens
gcagctagttttct

SEQ ID NO: 4913522 - DNA, 16 bp, Homo sapiens
gcagctcactacccta

SEQ ID NO: 4913523 - DNA, 21 bp, Homo sapiens
gcagctgatgttggaagagaa

SEQ ID NO: 4913524 - DNA, 19 bp, Homo sapiens
gcagctgcggtccacccag

SEQ ID NO: 4913525 - DNA, 12 bp, Homo sapiens
gcagctgggctg

SEQ ID NO: 4913526 - DNA, 16 bp, Homo sapiens
gcagcttgagggttgg

SEQ ID NO: 4913527 - DNA, 21 bp, Homo sapiens
gcagcttgtgtgcaaaagcag

SEQ ID NO: 4913528 - DNA, 17 bp, Homo sapiens
gcagctttaaactcagg

SEQ ID NO: 4913529 - DNA, 20 bp, Homo sapiens
gcagctttaaactcagggac

SEQ ID NO: 4913530 - DNA, 14 bp, Homo sapiens
gcagctttctagaa

SEQ ID NO: 4913531 - DNA, 13 bp, Homo sapiens
gcaggaaggagag

SEQ ID NO: 4913532 - DNA, 15 bp, Homo sapiens
gcaggaaggagagcc

SEQ ID NO: 4913533 - DNA, 13 bp, Homo sapiens
gcaggaaggcctg

SEQ ID NO: 4913534 - DNA, 14 bp, Homo sapiens
gcaggaaggcctgg

SEQ ID NO: 4913535 - DNA, 19 bp, Homo sapiens
gcaggaatcaaaaattgaa

SEQ ID NO: 4913536 - DNA, 18 bp, Homo sapiens
gcaggagattgagaagga

SEQ ID NO: 4913537 - DNA, 22 bp, Homo sapiens
gatcaatcctttattattattt

SEQ ID NO: 4913538 - DNA, 20 bp, Homo sapiens
gatcaattatagtttctgag

SEQ ID NO: 4913539 - DNA, 15 bp, Homo sapiens
gatcacactatttta

SEQ ID NO: 4913540 - DNA, 16 bp, Homo sapiens
gatcacgccactgcac

SEQ ID NO: 4913541 - DNA, 14 bp, Homo sapiens
gatcacgcctggct

SEQ ID NO: 4913542 - DNA, 12 bp, Homo sapiens
gatcacggctca

SEQ ID NO: 4913543 - DNA, 18 bp, Homo sapiens
gatcactagcctgtcatc

SEQ ID NO: 4913544 - DNA, 16 bp, Homo sapiens
gatcactgaatttata

SEQ ID NO: 4913545 - DNA, 16 bp, Homo sapiens
gatcactgccacactc

SEQ ID NO: 4913546 - DNA, 22 bp, Homo sapiens
gatcagaccttggatcagatga

SEQ ID NO: 4913547 - DNA, 17 bp, Homo sapiens
gatcagatgctccaaga

SEQ ID NO: 4913548 - DNA, 15 bp, Homo sapiens
gatcataagtgaatt

SEQ ID NO: 4913549 - DNA, 17 bp, Homo sapiens
gatcataagtgaattta

SEQ ID NO: 4913550 - DNA, 15 bp, Homo sapiens
gatcatcaacaagat

SEQ ID NO: 4913551 - DNA, 19 bp, Homo sapiens
gatcatccactgtgccatg

SEQ ID NO: 4913552 - DNA, 21 bp, Homo sapiens
gatcatccactgtgccatgtg

SEQ ID NO: 4913553 - DNA, 21 bp, Homo sapiens
gatcatgttgttaaaattatg

SEQ ID NO: 4913554 - DNA, 14 bp, Homo sapiens
gatcattttccccc

SEQ ID NO: 4913555 - DNA, 23 bp, Homo sapiens
gatcattttccccccactctccc

SEQ ID NO: 4913556 - DNA, 16 bp, Homo sapiens
gatccaagctggtccc

SEQ ID NO: 4913557 - DNA, 19 bp, Homo sapiens
gatccaagctggtcccact

SEQ ID NO: 4913558 - DNA, 21 bp, Homo sapiens
gatccaagctggtcccactca

SEQ ID NO: 4913559 - DNA, 16 bp, Homo sapiens
gatccacccaacccta

SEQ ID NO: 4913560 - DNA, 20 bp, Homo sapiens
gatccacccacctcagcctc

SEQ ID NO: 4913561 - DNA, 14 bp, Homo sapiens
gatccacctgtctc

SEQ ID NO: 4913562 - DNA, 22 bp, Homo sapiens
gatccatgagtttgccctggtt

SEQ ID NO: 4913563 - DNA, 15 bp, Homo sapiens
gatcccacacaggct

SEQ ID NO: 4913564 - DNA, 14 bp, Homo sapiens
gatccccaagtgtg

SEQ ID NO: 4913565 - DNA, 20 bp, Homo sapiens
gatccccaagtgtgaacaaa

SEQ ID NO: 4913566 - DNA, 17 bp, Homo sapiens
gatcccctcaggactgc

SEQ ID NO: 4913567 - DNA, 21 bp, Homo sapiens
gatcccctctgtctacaaata

SEQ ID NO: 4913568 - DNA, 13 bp, Homo sapiens
gatcccctgagcc

SEQ ID NO: 4913569 - DNA, 19 bp, Homo sapiens
gatcctaactgaagagaca

SEQ ID NO: 4913570 - DNA, 15 bp, Homo sapiens
gatcctagatcctaa

SEQ ID NO: 4913571 - DNA, 17 bp, Homo sapiens
gatcctcccacctcagc

SEQ ID NO: 4913572 - DNA, 19 bp, Homo sapiens
gatcctcccacctcagcct

SEQ ID NO: 4913573 - DNA, 14 bp, Homo sapiens
gatcctgccaccct

SEQ ID NO: 4913574 - DNA, 17 bp, Homo sapiens
gatcctgccaccctgta

SEQ ID NO: 4913575 - DNA, 18 bp, Homo sapiens
gatcctgccaccctgtag

SEQ ID NO: 4913576 - DNA, 16 bp, Homo sapiens
gatcctgtctttaagg

SEQ ID NO: 4913577 - DNA, 23 bp, Homo sapiens
gatctaaggatgtcacagggcca

SEQ ID NO: 4913578 - DNA, 22 bp, Homo sapiens
gatctcagctttgagaagcctt

SEQ ID NO: 4913579 - DNA, 14 bp, Homo sapiens
gatctccttgccct

SEQ ID NO: 4913580 - DNA, 12 bp, Homo sapiens
gatctcttcctg

SEQ ID NO: 4913581 - DNA, 19 bp, Homo sapiens
gatctgcggatctcagctt

SEQ ID NO: 4913582 - DNA, 18 bp, Homo sapiens
gatctgtcacaccagcca

SEQ ID NO: 4913583 - DNA, 22 bp, Homo sapiens
gatctgtcttgtaatattttgt

SEQ ID NO: 4913584 - DNA, 17 bp, Homo sapiens
gatctgttttgaaggca

SEQ ID NO: 4913585 - DNA, 20 bp, Homo sapiens
gatctgttttgaaggcaaaa

SEQ ID NO: 4913586 - DNA, 13 bp, Homo sapiens
gatcttagattct

SEQ ID NO: 4913587 - DNA, 23 bp, Homo sapiens
gatcttgaatgtggtctcaggat

SEQ ID NO: 4913588 - DNA, 19 bp, Homo sapiens
gatcttggcttactgcagc

SEQ ID NO: 4913589 - DNA, 23 bp, Homo sapiens
gatgaaattttctagactttctg

SEQ ID NO: 4913590 - DNA, 18 bp, Homo sapiens
gatgaactcttagaaatg

SEQ ID NO: 4913591 - DNA, 22 bp, Homo sapiens
gatgaactcttagaaatgaagg

SEQ ID NO: 4913592 - DNA, 17 bp, Homo sapiens
gatgaacttattctgta

SEQ ID NO: 4913593 - DNA, 23 bp, Homo sapiens
gatgaagcaaggaagatatacat

SEQ ID NO: 4913594 - DNA, 16 bp, Homo sapiens
gatgaagttttacatt

SEQ ID NO: 4913595 - DNA, 17 bp, Homo sapiens
gatgaagttttacattg

SEQ ID NO: 4913596 - DNA, 19 bp, Homo sapiens
gatgaatctcccactccag

SEQ ID NO: 4913597 - DNA, 13 bp, Homo sapiens
gatgaatgagaat

SEQ ID NO: 4913598 - DNA, 23 bp, Homo sapiens
gatgaatgaggtcccaggcagag

SEQ ID NO: 4913599 - DNA, 22 bp, Homo sapiens
gatgagaaaggttgaagcacca

SEQ ID NO: 4913600 - DNA, 21 bp, Homo sapiens
gatgagaatttctaaaaagat

SEQ ID NO: 4913601 - DNA, 15 bp, Homo sapiens
gatgagagcccagag

SEQ ID NO: 4913602 - DNA, 20 bp, Homo sapiens
gatgagattggcatggcttt

SEQ ID NO: 4913603 - DNA, 21 bp, Homo sapiens
gatgagcccagccctgttctg

SEQ ID NO: 4913604 - DNA, 22 bp, Homo sapiens
gatgagccttcgtgccccccct

SEQ ID NO: 4913605 - DNA, 16 bp, Homo sapiens
gatgagggatgggcct

SEQ ID NO: 4913606 - DNA, 19 bp, Homo sapiens
gatgagggatgggcctggc

SEQ ID NO: 4913607 - DNA, 18 bp, Homo sapiens
gatgatacaagattagaa

SEQ ID NO: 4913608 - DNA, 22 bp, Homo sapiens
gatgatcaattatagtttctga

SEQ ID NO: 4913609 - DNA, 19 bp, Homo sapiens
gatgatgagaatttctaaa

SEQ ID NO: 4913610 - DNA, 23 bp, Homo sapiens
gatgattaaataagattctaacg

SEQ ID NO: 4913611 - DNA, 15 bp, Homo sapiens
gatgattcagaaatt

SEQ ID NO: 4913612 - DNA, 18 bp, Homo sapiens
gatgcaaagtacaatgtg

SEQ ID NO: 4913613 - DNA, 23 bp, Homo sapiens
gatgcaaagtacaatgtgttttt

SEQ ID NO: 4913614 - DNA, 20 bp, Homo sapiens
gatgcaacacgcatggtcaa

SEQ ID NO: 4913615 - DNA, 14 bp, Homo sapiens
gatgcaaggaccag

SEQ ID NO: 4913616 - DNA, 15 bp, Homo sapiens
gatgcacagagaagc

SEQ ID NO: 4913617 - DNA, 23 bp, Homo sapiens
gatgcaccagcccttagcaggga

SEQ ID NO: 4913618 - DNA, 23 bp, Homo sapiens
gatgcagagagccattttgtgaa

SEQ ID NO: 4913619 - DNA, 22 bp, Homo sapiens
gatgcaggcacttattgtaaat

SEQ ID NO: 4913620 - DNA, 17 bp, Homo sapiens
gatgcagtctcctcttt

SEQ ID NO: 4913621 - DNA, 16 bp, Homo sapiens
gatgccaccctagcca

SEQ ID NO: 4913622 - DNA, 15 bp, Homo sapiens
gatgccatcctcttt

SEQ ID NO: 4913623 - DNA, 17 bp, Homo sapiens
gatgccatctgtgtcct

SEQ ID NO: 4913624 - DNA, 18 bp, Homo sapiens
gatgccatctgtgtcctg

SEQ ID NO: 4913625 - DNA, 21 bp, Homo sapiens
gatgccatctgtgtcctggtt

SEQ ID NO: 4913626 - DNA, 20 bp, Homo sapiens
gatgccattcttccttgcaa

SEQ ID NO: 4913627 - DNA, 12 bp, Homo sapiens
gatgccccagag

SEQ ID NO: 4913628 - DNA, 16 bp, Homo sapiens
gatgccccagagctgt

SEQ ID NO: 4913629 - DNA, 15 bp, Homo sapiens
gatgcctggtggcag

SEQ ID NO: 4913630 - DNA, 19 bp, Homo sapiens
gatgcctggtggcagctgc

SEQ ID NO: 4913631 - DNA, 17 bp, Homo sapiens
gatgctccaagattcta

SEQ ID NO: 4913632 - DNA, 22 bp, Homo sapiens
gatgctccaagattctagatga

SEQ ID NO: 4913633 - DNA, 20 bp, Homo sapiens
gatgctgactgtactcctcc

SEQ ID NO: 4913634 - DNA, 12 bp, Homo sapiens
gatgctgggtgg

SEQ ID NO: 4913635 - DNA, 19 bp, Homo sapiens
gatgctgtaacttaaaata

SEQ ID NO: 4913636 - DNA, 13 bp, Homo sapiens
gatgctgtttgac

SEQ ID NO: 4913637 - DNA, 14 bp, Homo sapiens
gatgctgtttgaca

SEQ ID NO: 4913638 - DNA, 23 bp, Homo sapiens
gatggaaaggattgtaggtgcaa

SEQ ID NO: 4913639 - DNA, 22 bp, Homo sapiens
gatggacagttcacaccctgca

SEQ ID NO: 4913640 - DNA, 18 bp, Homo sapiens
gatggagttcttgtgcca

SEQ ID NO: 4913641 - DNA, 13 bp, Homo sapiens
gatggagtttcta

SEQ ID NO: 4913642 - DNA, 15 bp, Homo sapiens
gatggctcagagggg

SEQ ID NO: 4913643 - DNA, 21 bp, Homo sapiens
gatgggaacgcagatgatcca

SEQ ID NO: 4913644 - DNA, 23 bp, Homo sapiens
gatgggagctcctctcctggagg

SEQ ID NO: 4913645 - DNA, 20 bp, Homo sapiens
gatgggaggaaagagagcag

SEQ ID NO: 4913646 - DNA, 22 bp, Homo sapiens
gatgggcaacccccagcctgct

SEQ ID NO: 4913647 - DNA, 18 bp, Homo sapiens
ctgcaatatttgaatttt

SEQ ID NO: 4913648 - DNA, 16 bp, Homo sapiens
ctgcaatcatatgtga

SEQ ID NO: 4913649 - DNA, 17 bp, Homo sapiens
ctgcaatcatatgtgat

SEQ ID NO: 4913650 - DNA, 15 bp, Homo sapiens
ctgcaatcctgtctt

SEQ ID NO: 4913651 - DNA, 21 bp, Homo sapiens
ctgcaatgggcactgggatga

SEQ ID NO: 4913652 - DNA, 21 bp, Homo sapiens
ctgcaattcaaaagttccaag

SEQ ID NO: 4913653 - DNA, 15 bp, Homo sapiens
ctgcaattcccctct

SEQ ID NO: 4913654 - DNA, 16 bp, Homo sapiens
ctgcaattcccctctg

SEQ ID NO: 4913655 - DNA, 20 bp, Homo sapiens
ctgcaattcccctctgctgc

SEQ ID NO: 4913656 - DNA, 20 bp, Homo sapiens
ctgcaatttcatatgctgta

SEQ ID NO: 4913657 - DNA, 11 bp, Homo sapiens
ctgcacacaag

SEQ ID NO: 4913658 - DNA, 17 bp, Homo sapiens
ctgcacacaagcccaca

SEQ ID NO: 4913659 - DNA, 21 bp, Homo sapiens
ctgcacagtgcatctcagccc

SEQ ID NO: 4913660 - DNA, 22 bp, Homo sapiens
ctgcacatgaatcccacccaca

SEQ ID NO: 4913661 - DNA, 14 bp, Homo sapiens
ctgcacatgtcttg

SEQ ID NO: 4913662 - DNA, 16 bp, Homo sapiens
ctgcacatgtcttgta

SEQ ID NO: 4913663 - DNA, 21 bp, Homo sapiens
ctgcacatgtcttgtacatgt

SEQ ID NO: 4913664 - DNA, 16 bp, Homo sapiens
ctgcaccctggggcct

SEQ ID NO: 4913665 - DNA, 22 bp, Homo sapiens
ctgcaccctggggcctggacct

SEQ ID NO: 4913666 - DNA, 13 bp, Homo sapiens
ctgcacccttctt

SEQ ID NO: 4913667 - DNA, 20 bp, Homo sapiens
ctgcacccttcttttctcat

SEQ ID NO: 4913668 - DNA, 20 bp, Homo sapiens
ctgcactaaagccagcctga

SEQ ID NO: 4913669 - DNA, 16 bp, Homo sapiens
ctgcactatagcctag

SEQ ID NO: 4913670 - DNA, 16 bp, Homo sapiens
cggagcatcccggagg

SEQ ID NO: 4913671 - DNA, 12 bp, Homo sapiens
cggagccccagg

SEQ ID NO: 4913672 - DNA, 12 bp, Homo sapiens
cggaggaaatct

SEQ ID NO: 4913673 - DNA, 17 bp, Homo sapiens
cggaggatagtatgagc

SEQ ID NO: 4913674 - DNA, 22 bp, Homo sapiens
cggaggcatcctacccttttct

SEQ ID NO: 4913675 - DNA, 16 bp, Homo sapiens
cggaggctgcccccgg

SEQ ID NO: 4913676 - DNA, 19 bp, Homo sapiens
cggaggctgcccccggccc

SEQ ID NO: 4913677 - DNA, 22 bp, Homo sapiens
cggaggctgcccccggccccct

SEQ ID NO: 4913678 - DNA, 12 bp, Homo sapiens
cggaggctgtgt

SEQ ID NO: 4913679 - DNA, 16 bp, Homo sapiens
cggaggggcctggcag

SEQ ID NO: 4913680 - DNA, 18 bp, Homo sapiens
cggagtcccaccttggct

SEQ ID NO: 4913681 - DNA, 22 bp, Homo sapiens
cggagtcccaccttggctgcag

SEQ ID NO: 4913682 - DNA, 19 bp, Homo sapiens
cggagtgtgtatgccaaga

SEQ ID NO: 4913683 - DNA, 13 bp, Homo sapiens
cggatcagagcag

SEQ ID NO: 4913684 - DNA, 19 bp, Homo sapiens
cggatcagagcaggacctc

SEQ ID NO: 4913685 - DNA, 22 bp, Homo sapiens
cggatcagagcaggacctccct

SEQ ID NO: 4913686 - DNA, 20 bp, Homo sapiens
cggatcctaagcatctaagt

SEQ ID NO: 4913687 - DNA, 24 bp, Homo sapiens
cggattccaaagagtagaattgca

SEQ ID NO: 4913688 - DNA, 19 bp, Homo sapiens
cggcaactaagcagtccct

SEQ ID NO: 4913689 - DNA, 13 bp, Homo sapiens
cggcaccctctgg

SEQ ID NO: 4913690 - DNA, 15 bp, Homo sapiens
cggcaccctctggcc

SEQ ID NO: 4913691 - DNA, 22 bp, Homo sapiens
cggcagaaaggaaaacctgaag

SEQ ID NO: 4913692 - DNA, 14 bp, Homo sapiens
cggcaggccctgca

SEQ ID NO: 4913693 - DNA, 16 bp, Homo sapiens
cggcaggccctgcagt

SEQ ID NO: 4913694 - DNA, 19 bp, Homo sapiens
cggccaagataggaccttg

SEQ ID NO: 4913695 - DNA, 22 bp, Homo sapiens
cggccagccccggccctgggct

SEQ ID NO: 4913696 - DNA, 24 bp, Homo sapiens
cggccaggccagagggagtgacag

SEQ ID NO: 4913697 - DNA, 22 bp, Homo sapiens
cggccccagcacctcagcctgc

SEQ ID NO: 4913698 - DNA, 22 bp, Homo sapiens
cggcccctgcatccccttggct

SEQ ID NO: 4913699 - DNA, 19 bp, Homo sapiens
cggcccctgctggttcagg

SEQ ID NO: 4913700 - DNA, 18 bp, Homo sapiens
cggccctagcccagcgct

SEQ ID NO: 4913701 - DNA, 19 bp, Homo sapiens
cggccctgcagccagctca

SEQ ID NO: 4913702 - DNA, 23 bp, Homo sapiens
cggcctgatgctccctcccctgc

SEQ ID NO: 4913703 - DNA, 19 bp, Homo sapiens
cggctaatttttatatttt

SEQ ID NO: 4913704 - DNA, 14 bp, Homo sapiens
cggctcactgcagc

SEQ ID NO: 4913705 - DNA, 17 bp, Homo sapiens
cggctcactgcagcctc

SEQ ID NO: 4913706 - DNA, 15 bp, Homo sapiens
cggctccccatgtgt

SEQ ID NO: 4913707 - DNA, 20 bp, Homo sapiens
cggctcgagcagtcctgcct

SEQ ID NO: 4913708 - DNA, 13 bp, Homo sapiens
cggctctgggtgg

SEQ ID NO: 4913709 - DNA, 14 bp, Homo sapiens
cggctgggtctgtg

SEQ ID NO: 4913710 - DNA, 19 bp, Homo sapiens
cggcttcatgccagctact

SEQ ID NO: 4913711 - DNA, 16 bp, Homo sapiens
cgggaaggtcaccagc

SEQ ID NO: 4913712 - DNA, 20 bp, Homo sapiens
cgggaaggtcaccagcacca

SEQ ID NO: 4913713 - DNA, 18 bp, Homo sapiens
cgggacacctgccctgcc

SEQ ID NO: 4913714 - DNA, 20 bp, Homo sapiens
cgggagcggtggccctgtcc

SEQ ID NO: 4913715 - DNA, 23 bp, Homo sapiens
cgggaggatgttctgggacacag

SEQ ID NO: 4913716 - DNA, 14 bp, Homo sapiens
cgggaggcagagtt

SEQ ID NO: 4913717 - DNA, 16 bp, Homo sapiens
cgggagggcggcacag

SEQ ID NO: 4913718 - DNA, 14 bp, Homo sapiens
cgggcaccagccag

SEQ ID NO: 4913719 - DNA, 13 bp, Homo sapiens
acttgaacaaaag

SEQ ID NO: 4913720 - DNA, 16 bp, Homo sapiens
acttgaacaaaagggt

SEQ ID NO: 4913721 - DNA, 17 bp, Homo sapiens
acttgaacaaaatctgt

SEQ ID NO: 4913722 - DNA, 19 bp, Homo sapiens
acttgagatgtatgaaggc

SEQ ID NO: 4913723 - DNA, 15 bp, Homo sapiens
acttgagggcccaga

SEQ ID NO: 4913724 - DNA, 20 bp, Homo sapiens
acttgagggcccagagcagg

SEQ ID NO: 4913725 - DNA, 22 bp, Homo sapiens
acttgagtgtaatgtttgttac

SEQ ID NO: 4913726 - DNA, 19 bp, Homo sapiens
acttgatagcaaacactgg

SEQ ID NO: 4913727 - DNA, 14 bp, Homo sapiens
acttgattaagatt

SEQ ID NO: 4913728 - DNA, 17 bp, Homo sapiens
acttgattaagatttta

SEQ ID NO: 4913729 - DNA, 19 bp, Homo sapiens
acttgattaagattttaca

SEQ ID NO: 4913730 - DNA, 23 bp, Homo sapiens
acttgcagctgatgttggaagag

SEQ ID NO: 4913731 - DNA, 21 bp, Homo sapiens
acttgcatgaagagaagcaat

SEQ ID NO: 4913732 - DNA, 15 bp, Homo sapiens
acttgcatggagcag

SEQ ID NO: 4913733 - DNA, 14 bp, Homo sapiens
acttgcctgggtca

SEQ ID NO: 4913734 - DNA, 15 bp, Homo sapiens
acttggttctgcttc

SEQ ID NO: 4913735 - DNA, 17 bp, Homo sapiens
acttggttctgcttcaa

SEQ ID NO: 4913736 - DNA, 18 bp, Homo sapiens
agaaataaagtttgctta

SEQ ID NO: 4913737 - DNA, 21 bp, Homo sapiens
agaaataaagtttgcttagaa

SEQ ID NO: 4913738 - DNA, 14 bp, Homo sapiens
agaaataatatgca

SEQ ID NO: 4913739 - DNA, 18 bp, Homo sapiens
agaaatataataaaatgt

SEQ ID NO: 4913740 - DNA, 20 bp, Homo sapiens
agaaatataataaaatgtgt

SEQ ID NO: 4913741 - DNA, 13 bp, Homo sapiens
agaaatatgtgag

SEQ ID NO: 4913742 - DNA, 17 bp, Homo sapiens
agaaatcaaagagagaa

SEQ ID NO: 4913743 - DNA, 23 bp, Homo sapiens
agaaatctagtatttcatgctgg

SEQ ID NO: 4913744 - DNA, 15 bp, Homo sapiens
agaaatgaacattcc

SEQ ID NO: 4913745 - DNA, 12 bp, Homo sapiens
agaaatgcagaa

SEQ ID NO: 4913746 - DNA, 13 bp, Homo sapiens
agaaatgtaaact

SEQ ID NO: 4913747 - DNA, 20 bp, Homo sapiens
agaaatgtctaaatgctgaa

SEQ ID NO: 4913748 - DNA, 21 bp, Homo sapiens
agaaatgtcttaatttttgaa

SEQ ID NO: 4913749 - DNA, 21 bp, Homo sapiens
agaaattagaaaaaaattact

SEQ ID NO: 4913750 - DNA, 17 bp, Homo sapiens
agaaattatttaataaa

SEQ ID NO: 4913751 - DNA, 14 bp, Homo sapiens
agaaattctgttaa

SEQ ID NO: 4913752 - DNA, 20 bp, Homo sapiens
agaaattgcatttcctgaca

SEQ ID NO: 4913753 - DNA, 19 bp, Homo sapiens
agaaattggaacagaatgt

SEQ ID NO: 4913754 - DNA, 22 bp, Homo sapiens
agaaattggaacagaatgtttt

SEQ ID NO: 4913755 - DNA, 13 bp, Homo sapiens
agaaatttactat

SEQ ID NO: 4913756 - DNA, 14 bp, Homo sapiens
agaaatttactata

SEQ ID NO: 4913757 - DNA, 15 bp, Homo sapiens
agaaatttactatat

SEQ ID NO: 4913758 - DNA, 17 bp, Homo sapiens
agaaatttctgtgaaac

SEQ ID NO: 4913759 - DNA, 21 bp, Homo sapiens
agaaatttctgtgaaacctgt

SEQ ID NO: 4913760 - DNA, 17 bp, Homo sapiens
agaaatttttatcagtt

SEQ ID NO: 4913761 - DNA, 13 bp, Homo sapiens
agaacaaagctgt

SEQ ID NO: 4913762 - DNA, 14 bp, Homo sapiens
agaacaaagctgtt

SEQ ID NO: 4913763 - DNA, 21 bp, Homo sapiens
agaacaaagctgttaaactgt

SEQ ID NO: 4913764 - DNA, 22 bp, Homo sapiens
agaacaaagctgttaaactgtt

SEQ ID NO: 4913765 - DNA, 21 bp, Homo sapiens
agaacaaaggacagagtatga

SEQ ID NO: 4913766 - DNA, 14 bp, Homo sapiens
agaacaaatattca

SEQ ID NO: 4913767 - DNA, 18 bp, Homo sapiens
agaacactaactcaccag

SEQ ID NO: 4913768 - DNA, 18 bp, Homo sapiens
agaacagcttcaggttat

SEQ ID NO: 4913769 - DNA, 16 bp, Homo sapiens
agaacatcattagaac

SEQ ID NO: 4913770 - DNA, 20 bp, Homo sapiens
agaaccaaaagttttcctga

SEQ ID NO: 4913771 - DNA, 22 bp, Homo sapiens
agaaccaccccggccccctgcc

SEQ ID NO: 4913772 - DNA, 23 bp, Homo sapiens
agaaccaccccggccccctgccc

SEQ ID NO: 4913773 - DNA, 19 bp, Homo sapiens
agaacccagggctctgccc

SEQ ID NO: 4913774 - DNA, 19 bp, Homo sapiens
agaacccctacatgaaaca

SEQ ID NO: 4913775 - DNA, 14 bp, Homo sapiens
agaaccgagcaaag

SEQ ID NO: 4913776 - DNA, 18 bp, Homo sapiens
agaaccgagcaaagatca

SEQ ID NO: 4913777 - DNA, 22 bp, Homo sapiens
agaaccgagcaaagatcaaaat

SEQ ID NO: 4913778 - DNA, 13 bp, Homo sapiens
agaacctcttccc

SEQ ID NO: 4913779 - DNA, 14 bp, Homo sapiens
agaacctcttcccc

SEQ ID NO: 4913780 - DNA, 22 bp, Homo sapiens
agaacgcagccctagagcctgc

SEQ ID NO: 4913781 - DNA, 16 bp, Homo sapiens
agaactaaatgttcta

SEQ ID NO: 4913782 - DNA, 14 bp, Homo sapiens
agaactcactgggg

SEQ ID NO: 4913783 - DNA, 14 bp, Homo sapiens
agaactctgggctg

SEQ ID NO: 4913784 - DNA, 17 bp, Homo sapiens
agaactgccattatttt

SEQ ID NO: 4913785 - DNA, 15 bp, Homo sapiens
agaactgggtaaatg

SEQ ID NO: 4913786 - DNA, 19 bp, Homo sapiens
agaactgtatgtcagacat

SEQ ID NO: 4913787 - DNA, 16 bp, Homo sapiens
agaacttttttaaata

SEQ ID NO: 4913788 - DNA, 18 bp, Homo sapiens
agaacttttttaaataaa

SEQ ID NO: 4913789 - DNA, 21 bp, Homo sapiens
agaacttttttaaataaactt

SEQ ID NO: 4913790 - DNA, 17 bp, Homo sapiens
agaagaaaagagaagaa

SEQ ID NO: 4913791 - DNA, 18 bp, Homo sapiens
agaagaaaagagaagaag

SEQ ID NO: 4913792 - DNA, 17 bp, Homo sapiens
agaagaaaattctcctg

SEQ ID NO: 4913793 - DNA, 19 bp, Homo sapiens
agaagaactatatgtgaat

SEQ ID NO: 4913794 - DNA, 11 bp, Homo sapiens
agaagaagaaa

SEQ ID NO: 4913795 - DNA, 13 bp, Homo sapiens
agaagaagaaaag

SEQ ID NO: 4913796 - DNA, 14 bp, Homo sapiens
agaagaagaaaaga

SEQ ID NO: 4913797 - DNA, 15 bp, Homo sapiens
agaagaagaaaagag

SEQ ID NO: 4913798 - DNA, 14 bp, Homo sapiens
agaagaagaagaaa

SEQ ID NO: 4913799 - DNA, 15 bp, Homo sapiens
agaagaagaagaaaa

SEQ ID NO: 4913800 - DNA, 20 bp, Homo sapiens
agaagaagagaagctgctga

SEQ ID NO: 4913801 - DNA, 13 bp, Homo sapiens
agaagacaaaaag

SEQ ID NO: 4913802 - DNA, 15 bp, Homo sapiens
agaagacaccagagc

SEQ ID NO: 4913803 - DNA, 16 bp, Homo sapiens
agaagacaccagagca

SEQ ID NO: 4913804 - DNA, 19 bp, Homo sapiens
agaagagttgtgcacgcag

SEQ ID NO: 4913805 - DNA, 14 bp, Homo sapiens
agaagataattgtt

SEQ ID NO: 4913806 - DNA, 17 bp, Homo sapiens
agaagataattgttgaa

SEQ ID NO: 4913807 - DNA, 16 bp, Homo sapiens
agaagatgatcagacc

SEQ ID NO: 4913808 - DNA, 24 bp, Homo sapiens
agaagcattccttctttgataatg

SEQ ID NO: 4913809 - DNA, 16 bp, Homo sapiens
agaagccgggaacaga

SEQ ID NO: 4913810 - DNA, 22 bp, Homo sapiens
agaagccgggaacagacaacag

SEQ ID NO: 4913811 - DNA, 23 bp, Homo sapiens
agaagcctctggctagaggccag

SEQ ID NO: 4913812 - DNA, 21 bp, Homo sapiens
agaagctatgtcaagaggctg

SEQ ID NO: 4913813 - DNA, 19 bp, Homo sapiens
agaagctgctccaggcctg

SEQ ID NO: 4913814 - DNA, 14 bp, Homo sapiens
agaagctgttgtac

SEQ ID NO: 4913815 - DNA, 21 bp, Homo sapiens
agaagctgttgtacatttatg

SEQ ID NO: 4913816 - DNA, 22 bp, Homo sapiens
agaagcttctaataaattatac

SEQ ID NO: 4913817 - DNA, 9 bp, Homo sapiens
agaaggaag

SEQ ID NO: 4913818 - DNA, 13 bp, Homo sapiens
agaaggagagaaa

SEQ ID NO: 4913819 - DNA, 18 bp, Homo sapiens
agaaggagagaaagtggg

SEQ ID NO: 4913820 - DNA, 21 bp, Homo sapiens
agaagggataaccctacaccc

SEQ ID NO: 4913821 - DNA, 20 bp, Homo sapiens
agaagggccagtcctgcctg

SEQ ID NO: 4913822 - DNA, 16 bp, Homo sapiens
agaaggggaagcactc

SEQ ID NO: 4913823 - DNA, 18 bp, Homo sapiens
agaaggtggaccttttaa

SEQ ID NO: 4913824 - DNA, 21 bp, Homo sapiens
agaaggtggaccttttaaagt

SEQ ID NO: 4913825 - DNA, 20 bp, Homo sapiens
agaagtagattaagagccat

SEQ ID NO: 4913826 - DNA, 14 bp, Homo sapiens
agaagtcacacagt

SEQ ID NO: 4913827 - DNA, 13 bp, Homo sapiens
agaagtttgtcca

SEQ ID NO: 4913828 - DNA, 15 bp, Homo sapiens
agaagtttgtccatt

SEQ ID NO: 4913829 - DNA, 14 bp, Homo sapiens
agaataagagaaag

SEQ ID NO: 4913830 - DNA, 21 bp, Homo sapiens
agaataattcaattttaaaga

SEQ ID NO: 4913831 - DNA, 22 bp, Homo sapiens
agaatagaaataaaggatgtga

SEQ ID NO: 4913832 - DNA, 15 bp, Homo sapiens
agaatatatatatat

SEQ ID NO: 4913833 - DNA, 13 bp, Homo sapiens
agaatatatttat

SEQ ID NO: 4913834 - DNA, 14 bp, Homo sapiens
agaatatatttatt

SEQ ID NO: 4913835 - DNA, 20 bp, Homo sapiens
agaatatcaagatgattctg

SEQ ID NO: 4913836 - DNA, 15 bp, Homo sapiens
agaatatgtttcctt

SEQ ID NO: 4913837 - DNA, 18 bp, Homo sapiens
agaatatgtttccttgtt

SEQ ID NO: 4913838 - DNA, 12 bp, Homo sapiens
agaatattgtcc

SEQ ID NO: 4913839 - DNA, 17 bp, Homo sapiens
agaatcagagtagaaat

SEQ ID NO: 4913840 - DNA, 22 bp, Homo sapiens
agaatcagcacagataaaaagt

SEQ ID NO: 4913841 - DNA, 14 bp, Homo sapiens
agaatcatacttag

SEQ ID NO: 4913842 - DNA, 19 bp, Homo sapiens
agaatcccaaatttgattg

SEQ ID NO: 4913843 - DNA, 21 bp, Homo sapiens
agaatcctaggctccacccca

SEQ ID NO: 4913844 - DNA, 12 bp, Homo sapiens
agaatctatttt

SEQ ID NO: 4913845 - DNA, 14 bp, Homo sapiens
agaatctattttct

SEQ ID NO: 4913846 - DNA, 21 bp, Homo sapiens
agaatctattttctatgtact

SEQ ID NO: 4913847 - DNA, 16 bp, Homo sapiens
agaatgaaaactcatt

SEQ ID NO: 4913848 - DNA, 12 bp, Homo sapiens
agaatgagcctc

SEQ ID NO: 4913849 - DNA, 13 bp, Homo sapiens
agaatgatttcat

SEQ ID NO: 4913850 - DNA, 22 bp, Homo sapiens
agaatgctgcaggacttgagaa

SEQ ID NO: 4913851 - DNA, 15 bp, Homo sapiens
agaatgctgtacatc

SEQ ID NO: 4913852 - DNA, 14 bp, Homo sapiens
agaatggagaggaa

SEQ ID NO: 4913853 - DNA, 23 bp, Homo sapiens
agaatggataaaataatgctgca

SEQ ID NO: 4913854 - DNA, 17 bp, Homo sapiens
agaatgggaatatttta

SEQ ID NO: 4913855 - DNA, 22 bp, Homo sapiens
agaatgtatctgtgaagtagtt

SEQ ID NO: 4913856 - DNA, 21 bp, Homo sapiens
agaatgttggtttactttcaa

SEQ ID NO: 4913857 - DNA, 19 bp, Homo sapiens
agaattagtgccagaattt

SEQ ID NO: 4913858 - DNA, 21 bp, Homo sapiens
agaattagtgccagaatttta

SEQ ID NO: 4913859 - DNA, 22 bp, Homo sapiens
agaattatataggttgtgcaaa

SEQ ID NO: 4913860 - DNA, 11 bp, Homo sapiens
agaattattta

SEQ ID NO: 4913861 - DNA, 21 bp, Homo sapiens
agaattgaccatctgctttta

SEQ ID NO: 4913862 - DNA, 11 bp, Homo sapiens
agaattgttat

SEQ ID NO: 4913863 - DNA, 17 bp, Homo sapiens
agaatttctaaaaagat

SEQ ID NO: 4913864 - DNA, 21 bp, Homo sapiens
agaatttcttggtaagaagcc

SEQ ID NO: 4913865 - DNA, 22 bp, Homo sapiens
agaatttggaaatcctagtttc

SEQ ID NO: 4913866 - DNA, 14 bp, Homo sapiens
agaattttaggaac

SEQ ID NO: 4913867 - DNA, 12 bp, Homo sapiens
agaattttggaa

SEQ ID NO: 4913868 - DNA, 15 bp, Homo sapiens
agaatttttttgtct

SEQ ID NO: 4913869 - DNA, 16 bp, Homo sapiens
agacaaatatttggag

SEQ ID NO: 4913870 - DNA, 17 bp, Homo sapiens
agacaaatcaacagaag

SEQ ID NO: 4913871 - DNA, 16 bp, Homo sapiens
agacaagatattgtac

SEQ ID NO: 4913872 - DNA, 18 bp, Homo sapiens
agacaagatattgtacat

SEQ ID NO: 4913873 - DNA, 13 bp, Homo sapiens
agacaaggaaata

SEQ ID NO: 4913874 - DNA, 23 bp, Homo sapiens
agacaagtgactgtatctgtgta

SEQ ID NO: 4913875 - DNA, 15 bp, Homo sapiens
agacaagttccatgg

SEQ ID NO: 4913876 - DNA, 15 bp, Homo sapiens
agacaatcattgttt

SEQ ID NO: 4913877 - DNA, 16 bp, Homo sapiens
agacaatcattgtttt

SEQ ID NO: 4913878 - DNA, 17 bp, Homo sapiens
agacaatttgatacata

SEQ ID NO: 4913879 - DNA, 20 bp, Homo sapiens
agacacaactatttttccaa

SEQ ID NO: 4913880 - DNA, 14 bp, Homo sapiens
agacacacacacgc

SEQ ID NO: 4913881 - DNA, 22 bp, Homo sapiens
agacacacacacgcacgcacac

SEQ ID NO: 4913882 - DNA, 12 bp, Homo sapiens
agacacaggccc

SEQ ID NO: 4913883 - DNA, 20 bp, Homo sapiens
agacacaggcccggctccag

SEQ ID NO: 4913884 - DNA, 22 bp, Homo sapiens
agacacaggcccggctccaggc

SEQ ID NO: 4913885 - DNA, 13 bp, Homo sapiens
agacaccaaagtt

SEQ ID NO: 4913886 - DNA, 15 bp, Homo sapiens
agacaccaaagttct

SEQ ID NO: 4913887 - DNA, 16 bp, Homo sapiens
agacaccaaagttcta

SEQ ID NO: 4913888 - DNA, 19 bp, Homo sapiens
agacaccttgacagggcac

SEQ ID NO: 4913889 - DNA, 22 bp, Homo sapiens
agacacgccttcccctcagcca

SEQ ID NO: 4913890 - DNA, 23 bp, Homo sapiens
agacactccccgaagtcttttgt

SEQ ID NO: 4913891 - DNA, 19 bp, Homo sapiens
agacactgaccatccactc

SEQ ID NO: 4913892 - DNA, 16 bp, Homo sapiens
agacactgcctgggct

SEQ ID NO: 4913893 - DNA, 15 bp, Homo sapiens
agacactggcccctc

SEQ ID NO: 4913894 - DNA, 14 bp, Homo sapiens
agacagacacacac

SEQ ID NO: 4913895 - DNA, 17 bp, Homo sapiens
agacagaccctgaaaag

SEQ ID NO: 4913896 - DNA, 19 bp, Homo sapiens
agacagagtctcactgttg

SEQ ID NO: 4913897 - DNA, 21 bp, Homo sapiens
agacagagtctcactgttgcc

SEQ ID NO: 4913898 - DNA, 18 bp, Homo sapiens
agacagcaggcagcgcca

SEQ ID NO: 4913899 - DNA, 18 bp, Homo sapiens
agacagccccagagcagg

SEQ ID NO: 4913900 - DNA, 22 bp, Homo sapiens
agacaggcaagcacctcctgcc

SEQ ID NO: 4913901 - DNA, 15 bp, Homo sapiens
agacagttcaagaaa

SEQ ID NO: 4913902 - DNA, 13 bp, Homo sapiens
agacagtttgtaa

SEQ ID NO: 4913903 - DNA, 14 bp, Homo sapiens
agacagtttgtaaa

SEQ ID NO: 4913904 - DNA, 21 bp, Homo sapiens
agacagtttgtaaatgttatt

SEQ ID NO: 4913905 - DNA, 12 bp, Homo sapiens
agacataaagcc

SEQ ID NO: 4913906 - DNA, 13 bp, Homo sapiens
agacataaagcca

SEQ ID NO: 4913907 - DNA, 19 bp, Homo sapiens
agacataggccatgaaaaa

SEQ ID NO: 4913908 - DNA, 17 bp, Homo sapiens
agacatccatgtttgta

SEQ ID NO: 4913909 - DNA, 22 bp, Homo sapiens
agacatccatgtttgtaaaact

SEQ ID NO: 4913910 - DNA, 15 bp, Homo sapiens
agacatgatttcctt

SEQ ID NO: 4913911 - DNA, 22 bp, Homo sapiens
agacatgatttccttgaatgtg

SEQ ID NO: 4913912 - DNA, 19 bp, Homo sapiens
agacatggaggttctaagg

SEQ ID NO: 4913913 - DNA, 20 bp, Homo sapiens
agacatttgttattttggaa

SEQ ID NO: 4913914 - DNA, 13 bp, Homo sapiens
agaccaaaataaa

SEQ ID NO: 4913915 - DNA, 17 bp, Homo sapiens
agaccaaggcgggagca

SEQ ID NO: 4913916 - DNA, 16 bp, Homo sapiens
agaccacaaaaattga

SEQ ID NO: 4913917 - DNA, 17 bp, Homo sapiens
agacccaccccacctgc

SEQ ID NO: 4913918 - DNA, 18 bp, Homo sapiens
agacccaccccacctgca

SEQ ID NO: 4913919 - DNA, 21 bp, Homo sapiens
agaccccggcttcctttccca

SEQ ID NO: 4913920 - DNA, 15 bp, Homo sapiens
agacccctggctttt

SEQ ID NO: 4913921 - DNA, 14 bp, Homo sapiens
agacccggctgcgt

SEQ ID NO: 4913922 - DNA, 15 bp, Homo sapiens
agaccctctgccacc

SEQ ID NO: 4913923 - DNA, 21 bp, Homo sapiens
agaccctctgccaccagagac

SEQ ID NO: 4913924 - DNA, 14 bp, Homo sapiens
agaccgctctcttt

SEQ ID NO: 4913925 - DNA, 17 bp, Homo sapiens
agaccgctctcttttct

SEQ ID NO: 4913926 - DNA, 22 bp, Homo sapiens
agaccgctctcttttctgtact

SEQ ID NO: 4913927 - DNA, 19 bp, Homo sapiens
agaccgtcctcacccctgt

SEQ ID NO: 4913928 - DNA, 21 bp, Homo sapiens
agaccgtttacctagaagaag

SEQ ID NO: 4913929 - DNA, 18 bp, Homo sapiens
agacctactgttctaaag

SEQ ID NO: 4913930 - DNA, 20 bp, Homo sapiens
agacctccccagcccctagc

SEQ ID NO: 4913931 - DNA, 19 bp, Homo sapiens
agacctgctttttgaaatg

SEQ ID NO: 4913932 - DNA, 23 bp, Homo sapiens
agaccttggatcagatgaactct

SEQ ID NO: 4913933 - DNA, 13 bp, Homo sapiens
agacgacaggcga

SEQ ID NO: 4913934 - DNA, 22 bp, Homo sapiens
agacgccggggacagaggcctg

SEQ ID NO: 4913935 - DNA, 15 bp, Homo sapiens
agacgcctgagctca

SEQ ID NO: 4913936 - DNA, 21 bp, Homo sapiens
agacgtggaacctctgtctca

SEQ ID NO: 4913937 - DNA, 13 bp, Homo sapiens
agactaagaaata

SEQ ID NO: 4913938 - DNA, 17 bp, Homo sapiens
agactaagaaatattcc

SEQ ID NO: 4913939 - DNA, 16 bp, Homo sapiens
agactactattttctt

SEQ ID NO: 4913940 - DNA, 12 bp, Homo sapiens
agactatataca

SEQ ID NO: 4913941 - DNA, 18 bp, Homo sapiens
agactatatacatgtgtg

SEQ ID NO: 4913942 - DNA, 21 bp, Homo sapiens
aactacccttaattacttaaa

SEQ ID NO: 4913943 - DNA, 19 bp, Homo sapiens
aactacgcttgctcatttt

SEQ ID NO: 4913944 - DNA, 15 bp, Homo sapiens
aactactattcaaaa

SEQ ID NO: 4913945 - DNA, 13 bp, Homo sapiens
aactactctttga

SEQ ID NO: 4913946 - DNA, 16 bp, Homo sapiens
aactatacttgaacaa

SEQ ID NO: 4913947 - DNA, 20 bp, Homo sapiens
aactatacttgaacaaaagg

SEQ ID NO: 4913948 - DNA, 14 bp, Homo sapiens
aactatatgtgaat

SEQ ID NO: 4913949 - DNA, 18 bp, Homo sapiens
aactatcctgacttctaa

SEQ ID NO: 4913950 - DNA, 19 bp, Homo sapiens
aactatctggccatattta

SEQ ID NO: 4913951 - DNA, 18 bp, Homo sapiens
aactatcttggtgaattt

SEQ ID NO: 4913952 - DNA, 23 bp, Homo sapiens
aactattcaggagagtagaacag

SEQ ID NO: 4913953 - DNA, 17 bp, Homo sapiens
aactattcgaatgaaaa

SEQ ID NO: 4913954 - DNA, 21 bp, Homo sapiens
aactattgcatttatatgtac

SEQ ID NO: 4913955 - DNA, 13 bp, Homo sapiens
aactcaagacaat

SEQ ID NO: 4913956 - DNA, 14 bp, Homo sapiens
aactcacaaatgat

SEQ ID NO: 4913957 - DNA, 18 bp, Homo sapiens
aactcagaattattttta

SEQ ID NO: 4913958 - DNA, 13 bp, Homo sapiens
aactcagatctgt

SEQ ID NO: 4913959 - DNA, 17 bp, Homo sapiens
aactcagatctgtctga

SEQ ID NO: 4913960 - DNA, 17 bp, Homo sapiens
aactcagggacagagcc

SEQ ID NO: 4913961 - DNA, 18 bp, Homo sapiens
aactcagggacagagcca

SEQ ID NO: 4913962 - DNA, 22 bp, Homo sapiens
aactcagtcattagactcctcc

SEQ ID NO: 4913963 - DNA, 20 bp, Homo sapiens
aactcagtcctgtactctgg

SEQ ID NO: 4913964 - DNA, 17 bp, Homo sapiens
aactcatttttgccata

SEQ ID NO: 4913965 - DNA, 18 bp, Homo sapiens
aactccaaggttcccttg

SEQ ID NO: 4913966 - DNA, 18 bp, Homo sapiens
aactccgcccccagccta

SEQ ID NO: 4913967 - DNA, 18 bp, Homo sapiens
aactcctgagaaatgtta

SEQ ID NO: 4913968 - DNA, 12 bp, Homo sapiens
aactcctggcct

SEQ ID NO: 4913969 - DNA, 11 bp, Homo sapiens
aactccttggc

SEQ ID NO: 4913970 - DNA, 13 bp, Homo sapiens
aactccttggcct

SEQ ID NO: 4913971 - DNA, 15 bp, Homo sapiens
aactctccagtgcct

SEQ ID NO: 4913972 - DNA, 12 bp, Homo sapiens
aactctctccac

SEQ ID NO: 4913973 - DNA, 15 bp, Homo sapiens
aactctgacaagggc

SEQ ID NO: 4913974 - DNA, 17 bp, Homo sapiens
aactctgacaagggctg

SEQ ID NO: 4913975 - DNA, 12 bp, Homo sapiens
aactctgagccc

SEQ ID NO: 4913976 - DNA, 13 bp, Homo sapiens
aactctgagccca

SEQ ID NO: 4913977 - DNA, 14 bp, Homo sapiens
aactctgagcccat

SEQ ID NO: 4913978 - DNA, 17 bp, Homo sapiens
aactcttagaaatgaag

SEQ ID NO: 4913979 - DNA, 14 bp, Homo sapiens
aactgacacaggaa

SEQ ID NO: 4913980 - DNA, 19 bp, Homo sapiens
aactgaccagcctccatgc

SEQ ID NO: 4913981 - DNA, 16 bp, Homo sapiens
aactgaggaattttct

SEQ ID NO: 4913982 - DNA, 14 bp, Homo sapiens
aactgcaaagaaag

SEQ ID NO: 4913983 - DNA, 18 bp, Homo sapiens
agaggaactgtccagaga

SEQ ID NO: 4913984 - DNA, 22 bp, Homo sapiens
agaggaagaatttgttatcagt

SEQ ID NO: 4913985 - DNA, 14 bp, Homo sapiens
agaggaataagaat

SEQ ID NO: 4913986 - DNA, 15 bp, Homo sapiens
agaggaatcctggca

SEQ ID NO: 4913987 - DNA, 18 bp, Homo sapiens
agaggactcgcttgtaaa

SEQ ID NO: 4913988 - DNA, 23 bp, Homo sapiens
agaggactcgcttgtaaatacca

SEQ ID NO: 4913989 - DNA, 14 bp, Homo sapiens
agaggacttttctt

SEQ ID NO: 4913990 - DNA, 12 bp, Homo sapiens
agaggagaggag

SEQ ID NO: 4913991 - DNA, 15 bp, Homo sapiens
agaggagccagacag

SEQ ID NO: 4913992 - DNA, 21 bp, Homo sapiens
agactatatacatgtgtgtat

SEQ ID NO: 4913993 - DNA, 16 bp, Homo sapiens
agactatggagcctgg

SEQ ID NO: 4913994 - DNA, 21 bp, Homo sapiens
agactatggagcctggcacag

SEQ ID NO: 4913995 - DNA, 14 bp, Homo sapiens
agactatttgctta

SEQ ID NO: 4913996 - DNA, 16 bp, Homo sapiens
agactcaaatgttcta

SEQ ID NO: 4913997 - DNA, 17 bp, Homo sapiens
agactcaaatgttctaa

SEQ ID NO: 4913998 - DNA, 20 bp, Homo sapiens
agactcaaatgttctaagtt

SEQ ID NO: 4913999 - DNA, 17 bp, Homo sapiens
agactcattcttctgta

SEQ ID NO: 4914000 - DNA, 15 bp, Homo sapiens
agactcccatgaagc

SEQ ID NO: 4914001 - DNA, 17 bp, Homo sapiens
agactcccatgaagcct

SEQ ID NO: 4914002 - DNA, 19 bp, Homo sapiens
agactcccatgaagccttt

SEQ ID NO: 4914003 - DNA, 23 bp, Homo sapiens
agactcctcctccaaaggccccc

SEQ ID NO: 4914004 - DNA, 15 bp, Homo sapiens
agctaatgggacact

SEQ ID NO: 4914005 - DNA, 19 bp, Homo sapiens
agctaattgggagtccagg

SEQ ID NO: 4914006 - DNA, 13 bp, Homo sapiens
agctaatttgcat

SEQ ID NO: 4914007 - DNA, 14 bp, Homo sapiens
agctaatttgcatt

SEQ ID NO: 4914008 - DNA, 20 bp, Homo sapiens
agctacagctttcttgctcc

SEQ ID NO: 4914009 - DNA, 22 bp, Homo sapiens
agctacagctttcttgctccct

SEQ ID NO: 4914010 - DNA, 22 bp, Homo sapiens
agctacaggaagcaccccatgc

SEQ ID NO: 4914011 - DNA, 17 bp, Homo sapiens
agctacccaaaagagaa

SEQ ID NO: 4914012 - DNA, 19 bp, Homo sapiens
agctacccaaaagagaaaa

SEQ ID NO: 4914013 - DNA, 19 bp, Homo sapiens
agctactgcggaaaaggaa

SEQ ID NO: 4914014 - DNA, 20 bp, Homo sapiens
agctactgtgtgtgtgaatg

SEQ ID NO: 4914015 - DNA, 15 bp, Homo sapiens
agctacttaagagaa

SEQ ID NO: 4914016 - DNA, 15 bp, Homo sapiens
agctacttcctcctc

SEQ ID NO: 4914017 - DNA, 13 bp, Homo sapiens
agctaggaatgaa

SEQ ID NO: 4914018 - DNA, 15 bp, Homo sapiens
agctaggcctggcca

SEQ ID NO: 4914019 - DNA, 16 bp, Homo sapiens
agctaggcctggccag

SEQ ID NO: 4914020 - DNA, 20 bp, Homo sapiens
agctatcagaagaccacaaa

SEQ ID NO: 4914021 - DNA, 17 bp, Homo sapiens
agctatgggagccccag

SEQ ID NO: 4914022 - DNA, 20 bp, Homo sapiens
agctattagccaggatcatg

SEQ ID NO: 4914023 - DNA, 13 bp, Homo sapiens
agctattcctttc

SEQ ID NO: 4914024 - DNA, 15 bp, Homo sapiens
agctcaactttctgt

SEQ ID NO: 4914025 - DNA, 14 bp, Homo sapiens
agctcaatggactg

SEQ ID NO: 4914026 - DNA, 13 bp, Homo sapiens
agctcaccagccc

SEQ ID NO: 4914027 - DNA, 15 bp, Homo sapiens
agctcaccagcccca

SEQ ID NO: 4914028 - DNA, 22 bp, Homo sapiens
agctcaccagccccagtgccca

SEQ ID NO: 4914029 - DNA, 14 bp, Homo sapiens
agctcagaacccag

SEQ ID NO: 4914030 - DNA, 17 bp, Homo sapiens
agctcagcgccagcctg

SEQ ID NO: 4914031 - DNA, 20 bp, Homo sapiens
agctcatagagtcccccctc

SEQ ID NO: 4914032 - DNA, 18 bp, Homo sapiens
agctccactgtcaccctc

SEQ ID NO: 4914033 - DNA, 13 bp, Homo sapiens
agctccagagcaa

SEQ ID NO: 4914034 - DNA, 13 bp, Homo sapiens
agctccagctcac

SEQ ID NO: 4914035 - DNA, 17 bp, Homo sapiens
agctccagctcaccagc

SEQ ID NO: 4914036 - DNA, 21 bp, Homo sapiens
agctccagctcaccagcccca

SEQ ID NO: 4914037 - DNA, 16 bp, Homo sapiens
agctccatctccactc

SEQ ID NO: 4914038 - DNA, 15 bp, Homo sapiens
agctccctaggagac

SEQ ID NO: 4914039 - DNA, 14 bp, Homo sapiens
agctccctgcccca

SEQ ID NO: 4914040 - DNA, 17 bp, Homo sapiens
agctccgcctcccgggt

SEQ ID NO: 4914041 - DNA, 20 bp, Homo sapiens
agctccgctttctacccagc

SEQ ID NO: 4914042 - DNA, 21 bp, Homo sapiens
agctccgctttctacccagcg

SEQ ID NO: 4914043 - DNA, 16 bp, Homo sapiens
agctcctcctcggaac

SEQ ID NO: 4914044 - DNA, 13 bp, Homo sapiens
agctcctctcctg

SEQ ID NO: 4914045 - DNA, 14 bp, Homo sapiens
agctcctctcctgg

SEQ ID NO: 4914046 - DNA, 15 bp, Homo sapiens
agctcctctgtcctg

SEQ ID NO: 4914047 - DNA, 12 bp, Homo sapiens
agctcctgtcct

SEQ ID NO: 4914048 - DNA, 14 bp, Homo sapiens
agctcctgtcctcc

SEQ ID NO: 4914049 - DNA, 15 bp, Homo sapiens
agctcctgtcctccc

SEQ ID NO: 4914050 - DNA, 22 bp, Homo sapiens
agctccttctgtcctactctgt

SEQ ID NO: 4914051 - DNA, 23 bp, Homo sapiens
agctccttctgtcctactctgtg

SEQ ID NO: 4914052 - DNA, 19 bp, Homo sapiens
agctcgaattaagaatatg

SEQ ID NO: 4914053 - DNA, 22 bp, Homo sapiens
agctctaataaaacagctgtct

SEQ ID NO: 4914054 - DNA, 18 bp, Homo sapiens
agctctattgatactctt

SEQ ID NO: 4914055 - DNA, 22 bp, Homo sapiens
agctctgctcctctccccagca

SEQ ID NO: 4914056 - DNA, 16 bp, Homo sapiens
agctctgtcctgggag

SEQ ID NO: 4914057 - DNA, 16 bp, Homo sapiens
agctctgtgttgccat

SEQ ID NO: 4914058 - DNA, 18 bp, Homo sapiens
agctctgtgttgccatgt

SEQ ID NO: 4914059 - DNA, 17 bp, Homo sapiens
agctcttctccaggctg

SEQ ID NO: 4914060 - DNA, 23 bp, Homo sapiens
agctcttgtcctcagtccattta

SEQ ID NO: 4914061 - DNA, 18 bp, Homo sapiens
agctcttttttgtttgtt

SEQ ID NO: 4914062 - DNA, 22 bp, Homo sapiens
agctcttttttgtttgtttctt

SEQ ID NO: 4914063 - DNA, 22 bp, Homo sapiens
agctgaaaacctaagtccttta

SEQ ID NO: 4914064 - DNA, 20 bp, Homo sapiens
agctgaaaatataaaacaaa

SEQ ID NO: 4914065 - DNA, 16 bp, Homo sapiens
agctgagaactcctga

SEQ ID NO: 4914066 - DNA, 18 bp, Homo sapiens
agctgagaactcctgact

SEQ ID NO: 4914067 - DNA, 22 bp, Homo sapiens
agctgatgaacttattctgtag

SEQ ID NO: 4914068 - DNA, 16 bp, Homo sapiens
agctgcaccagagcaa

SEQ ID NO: 4914069 - DNA, 22 bp, Homo sapiens
agctgcaggaatcaaaaattga

SEQ ID NO: 4914070 - DNA, 11 bp, Homo sapiens
agctgccctcc

SEQ ID NO: 4914071 - DNA, 18 bp, Homo sapiens
agctgccgggcctgattt

SEQ ID NO: 4914072 - DNA, 20 bp, Homo sapiens
agctgcctagcaagctggcc

SEQ ID NO: 4914073 - DNA, 15 bp, Homo sapiens
agctgcctgtagtta

SEQ ID NO: 4914074 - DNA, 18 bp, Homo sapiens
agctgcctgtagttagga

SEQ ID NO: 4914075 - DNA, 19 bp, Homo sapiens
agctgcctgtagttaggaa

SEQ ID NO: 4914076 - DNA, 16 bp, Homo sapiens
agctgcctgttcagct

SEQ ID NO: 4914077 - DNA, 22 bp, Homo sapiens
agctgcctgttcagctccagct

SEQ ID NO: 4914078 - DNA, 14 bp, Homo sapiens
agctgccttggctc

SEQ ID NO: 4914079 - DNA, 16 bp, Homo sapiens
agctgccttggctcag

SEQ ID NO: 4914080 - DNA, 17 bp, Homo sapiens
agctgccttggctcaga

SEQ ID NO: 4914081 - DNA, 19 bp, Homo sapiens
agctgccttggctcagaca

SEQ ID NO: 4914082 - DNA, 20 bp, Homo sapiens
agctgccttggctcagacat

SEQ ID NO: 4914083 - DNA, 16 bp, Homo sapiens
agctgcggtccaccca

SEQ ID NO: 4914084 - DNA, 20 bp, Homo sapiens
agctgcggtccacccaggag

SEQ ID NO: 4914085 - DNA, 21 bp, Homo sapiens
agctgcggtccacccaggagc

SEQ ID NO: 4914086 - DNA, 19 bp, Homo sapiens
agctgctatttattttcct

SEQ ID NO: 4914087 - DNA, 16 bp, Homo sapiens
agctgctccaggcctg

SEQ ID NO: 4914088 - DNA, 17 bp, Homo sapiens
agctgctgaccaattgt

SEQ ID NO: 4914089 - DNA, 20 bp, Homo sapiens
agctgctgaccaattgtgct

SEQ ID NO: 4914090 - DNA, 14 bp, Homo sapiens
agctgctggcttgc

SEQ ID NO: 4914091 - DNA, 22 bp, Homo sapiens
agctgcttttgtctatgggact

SEQ ID NO: 4914092 - DNA, 23 bp, Homo sapiens
agctgcttttgtctatgggactc

SEQ ID NO: 4914093 - DNA, 21 bp, Homo sapiens
agctggacagaggggactctg

SEQ ID NO: 4914094 - DNA, 15 bp, Homo sapiens
agctggaccagtggt

SEQ ID NO: 4914095 - DNA, 16 bp, Homo sapiens
agctggactctgcatc

SEQ ID NO: 4914096 - DNA, 15 bp, Homo sapiens
agctggcattacagc

SEQ ID NO: 4914097 - DNA, 20 bp, Homo sapiens
agctggccgagggtcctggc

SEQ ID NO: 4914098 - DNA, 16 bp, Homo sapiens
agctggcctctctagc

SEQ ID NO: 4914099 - DNA, 15 bp, Homo sapiens
agctggcctggacag

SEQ ID NO: 4914100 - DNA, 15 bp, Homo sapiens
agctgggactacagg

SEQ ID NO: 4914101 - DNA, 23 bp, Homo sapiens
agctgggactacaggcacccacc

SEQ ID NO: 4914102 - DNA, 21 bp, Homo sapiens
agctgggcatggtaccagccc

SEQ ID NO: 4914103 - DNA, 15 bp, Homo sapiens
agctgggctctgcaa

SEQ ID NO: 4914104 - DNA, 20 bp, Homo sapiens
agctgggctggggaggacct

SEQ ID NO: 4914105 - DNA, 17 bp, Homo sapiens
agctggtcccactcagt

SEQ ID NO: 4914106 - DNA, 15 bp, Homo sapiens
agctggttagaaatg

SEQ ID NO: 4914107 - DNA, 22 bp, Homo sapiens
agctggtttttagcggagacgg

SEQ ID NO: 4914108 - DNA, 12 bp, Homo sapiens
agctgtaaaacg

SEQ ID NO: 4914109 - DNA, 14 bp, Homo sapiens
agctgtaaaacgct

SEQ ID NO: 4914110 - DNA, 19 bp, Homo sapiens
agctgtacttcgtcttcta

SEQ ID NO: 4914111 - DNA, 23 bp, Homo sapiens
agctgtagtagccctttctgtgt

SEQ ID NO: 4914112 - DNA, 21 bp, Homo sapiens
agctgtcacttcgcgtgccct

SEQ ID NO: 4914113 - DNA, 17 bp, Homo sapiens
agctgtctgctcagaca

SEQ ID NO: 4914114 - DNA, 18 bp, Homo sapiens
agctgtgacttctccagg

SEQ ID NO: 4914115 - DNA, 20 bp, Homo sapiens
agccaatgtctcctcccctt

SEQ ID NO: 4914116 - DNA, 19 bp, Homo sapiens
agccacaaaataaatgttg

SEQ ID NO: 4914117 - DNA, 20 bp, Homo sapiens
agatgagggatgggcctggc

SEQ ID NO: 4914118 - DNA, 19 bp, Homo sapiens
agatgatggatgccaatat

SEQ ID NO: 4914119 - DNA, 12 bp, Homo sapiens
agatgatgtatt

SEQ ID NO: 4914120 - DNA, 22 bp, Homo sapiens
agatgattaaataagattctaa

SEQ ID NO: 4914121 - DNA, 14 bp, Homo sapiens
agatgcaattgttt

SEQ ID NO: 4914122 - DNA, 14 bp, Homo sapiens
agatgcaccagccc

SEQ ID NO: 4914123 - DNA, 19 bp, Homo sapiens
agatgcagagagccatttt

SEQ ID NO: 4914124 - DNA, 23 bp, Homo sapiens
aggcagatctgtgccccatgcct

SEQ ID NO: 4914125 - DNA, 19 bp, Homo sapiens
aggcagccaacctaagcaa

SEQ ID NO: 4914126 - DNA, 22 bp, Homo sapiens
aggcagccccattctgcctgcc

SEQ ID NO: 4914127 - DNA, 21 bp, Homo sapiens
aggcaggcacctagcaattcc

SEQ ID NO: 4914128 - DNA, 13 bp, Homo sapiens
aggcaggcattga

SEQ ID NO: 4914129 - DNA, 14 bp, Homo sapiens
aggcaggcattgag

SEQ ID NO: 4914130 - DNA, 23 bp, Homo sapiens
aggcaggcattgaggaagagtct

SEQ ID NO: 4914131 - DNA, 22 bp, Homo sapiens
aggcagggtctcactctgtcgc

SEQ ID NO: 4914132 - DNA, 14 bp, Homo sapiens
aggcaggtccaggg

SEQ ID NO: 4914133 - DNA, 15 bp, Homo sapiens
agccgccttccttga

SEQ ID NO: 4914134 - DNA, 14 bp, Homo sapiens
agctgttaaactgt

SEQ ID NO: 4914135 - DNA, 16 bp, Homo sapiens
agctgttaaactgtta

SEQ ID NO: 4914136 - DNA, 16 bp, Homo sapiens
agctgttaccattcac

SEQ ID NO: 4914137 - DNA, 20 bp, Homo sapiens
agctgttgtacatttatgat

SEQ ID NO: 4914138 - DNA, 23 bp, Homo sapiens
agctgttgtacatttatgattta

SEQ ID NO: 4914139 - DNA, 17 bp, Homo sapiens
agctgtttatggcctca

SEQ ID NO: 4914140 - DNA, 18 bp, Homo sapiens
agctgtttatggcctcag

SEQ ID NO: 4914141 - DNA, 21 bp, Homo sapiens
agctgtttatggcctcagctg

SEQ ID NO: 4914142 - DNA, 18 bp, Homo sapiens
agctgtttatgtttttat

SEQ ID NO: 4914143 - DNA, 14 bp, Homo sapiens
agctgttttcttct

SEQ ID NO: 4914144 - DNA, 22 bp, Homo sapiens
agcttacatagttttaaactca

SEQ ID NO: 4914145 - DNA, 20 bp, Homo sapiens
agcttaccagaagcttccat

SEQ ID NO: 4914146 - DNA, 13 bp, Homo sapiens
agcttacctgaca

SEQ ID NO: 4914147 - DNA, 21 bp, Homo sapiens
agcttactctgtccatttatc

SEQ ID NO: 4914148 - DNA, 22 bp, Homo sapiens
agcttattcatctgtttttctt

SEQ ID NO: 4914149 - DNA, 21 bp, Homo sapiens
agcttcagaagtttggcaata

SEQ ID NO: 4914150 - DNA, 21 bp, Homo sapiens
agcttcattctccttgttgtt

SEQ ID NO: 4914151 - DNA, 18 bp, Homo sapiens
agcttcatttcctgtgtc

SEQ ID NO: 4914152 - DNA, 17 bp, Homo sapiens
agcttcatttgtgtcaa

SEQ ID NO: 4914153 - DNA, 20 bp, Homo sapiens
agcttcatttgtgtcaatgg

SEQ ID NO: 4914154 - DNA, 17 bp, Homo sapiens
agcttctaccatgaaca

SEQ ID NO: 4914155 - DNA, 14 bp, Homo sapiens
agcttcttaattaa

SEQ ID NO: 4914156 - DNA, 17 bp, Homo sapiens
agcttgaaagttttcag

SEQ ID NO: 4914157 - DNA, 18 bp, Homo sapiens
agcttgagggttgggctg

SEQ ID NO: 4914158 - DNA, 15 bp, Homo sapiens
agcttgctccctgtg

SEQ ID NO: 4914159 - DNA, 16 bp, Homo sapiens
agcttgctccctgtgt

SEQ ID NO: 4914160 - DNA, 21 bp, Homo sapiens
agcttgcttgctttctttttt

SEQ ID NO: 4914161 - DNA, 12 bp, Homo sapiens
agcttgggaatg

SEQ ID NO: 4914162 - DNA, 14 bp, Homo sapiens
agcttgggaatgga

SEQ ID NO: 4914163 - DNA, 22 bp, Homo sapiens
agcttgggagagcccctggggc

SEQ ID NO: 4914164 - DNA, 20 bp, Homo sapiens
agcttgtaaatagctcaggt

SEQ ID NO: 4914165 - DNA, 18 bp, Homo sapiens
agcttgtatgcaatggat

SEQ ID NO: 4914166 - DNA, 20 bp, Homo sapiens
agcttgtgtgcaaaagcagt

SEQ ID NO: 4914167 - DNA, 17 bp, Homo sapiens
agcttgttccctgtctt

SEQ ID NO: 4914168 - DNA, 13 bp, Homo sapiens
agctttacacaca

SEQ ID NO: 4914169 - DNA, 17 bp, Homo sapiens
agctttatgattttcat

SEQ ID NO: 4914170 - DNA, 23 bp, Homo sapiens
agctttatgattttcataactta

SEQ ID NO: 4914171 - DNA, 17 bp, Homo sapiens
agctttcaagtgccttt

SEQ ID NO: 4914172 - DNA, 21 bp, Homo sapiens
agctttgtgtttggtttacat

SEQ ID NO: 4914173 - DNA, 22 bp, Homo sapiens
agctttgtgtttggtttacatt

SEQ ID NO: 4914174 - DNA, 17 bp, Homo sapiens
agcttttattgtataaa

SEQ ID NO: 4914175 - DNA, 20 bp, Homo sapiens
agcttttcaaacaagaatgt

SEQ ID NO: 4914176 - DNA, 15 bp, Homo sapiens
agctttttaaaacat

SEQ ID NO: 4914177 - DNA, 17 bp, Homo sapiens
agctttttaattgttgt

SEQ ID NO: 4914178 - DNA, 17 bp, Homo sapiens
agctttttcctcctgga

SEQ ID NO: 4914179 - DNA, 14 bp, Homo sapiens
aggaaaaagaaaat

SEQ ID NO: 4914180 - DNA, 13 bp, Homo sapiens
aggaaaaagctcc

SEQ ID NO: 4914181 - DNA, 22 bp, Homo sapiens
aggaaaaccaagccgtggcttc

SEQ ID NO: 4914182 - DNA, 16 bp, Homo sapiens
aggaaaacctgaagac

SEQ ID NO: 4914183 - DNA, 10 bp, Homo sapiens
aggaaaagaa

SEQ ID NO: 4914184 - DNA, 13 bp, Homo sapiens
aggaaaagaaaaa

SEQ ID NO: 4914185 - DNA, 15 bp, Homo sapiens
aggaaaagaaaaaaa

SEQ ID NO: 4914186 - DNA, 14 bp, Homo sapiens
aggaaaagctgctg

SEQ ID NO: 4914187 - DNA, 20 bp, Homo sapiens
aggaaaccgcctagtttact

SEQ ID NO: 4914188 - DNA, 22 bp, Homo sapiens
aggaaaccgcctagtttactgt

SEQ ID NO: 4914189 - DNA, 13 bp, Homo sapiens
aggaaactcttat

SEQ ID NO: 4914190 - DNA, 22 bp, Homo sapiens
aggaaactcttatctcagtcat

SEQ ID NO: 4914191 - DNA, 15 bp, Homo sapiens
aggaaacttttaact

SEQ ID NO: 4914192 - DNA, 12 bp, Homo sapiens
aggaaagagagc

SEQ ID NO: 4914193 - DNA, 19 bp, Homo sapiens
aggaaagccccagcactaa

SEQ ID NO: 4914194 - DNA, 19 bp, Homo sapiens
aggaaataaaacctttcaa

SEQ ID NO: 4914195 - DNA, 23 bp, Homo sapiens
aggaacacaggcgctgagtatgg

SEQ ID NO: 4914196 - DNA, 13 bp, Homo sapiens
aggaacagaagga

SEQ ID NO: 4914197 - DNA, 14 bp, Homo sapiens
aggaacagaaggat

SEQ ID NO: 4914198 - DNA, 21 bp, Homo sapiens
aggaacagctatgggagcccc

SEQ ID NO: 4914199 - DNA, 20 bp, Homo sapiens
aggaaccttccttcctgctt

SEQ ID NO: 4914200 - DNA, 18 bp, Homo sapiens
aggaactgggcctgttgc

SEQ ID NO: 4914201 - DNA, 16 bp, Homo sapiens
aggaactgtccagaga

SEQ ID NO: 4914202 - DNA, 18 bp, Homo sapiens
aggaagcaccccatgcca

SEQ ID NO: 4914203 - DNA, 18 bp, Homo sapiens
aggaagcattcagagagc

SEQ ID NO: 4914204 - DNA, 15 bp, Homo sapiens
aggaagccaaattta

SEQ ID NO: 4914205 - DNA, 15 bp, Homo sapiens
aggaaggagagcctg

SEQ ID NO: 4914206 - DNA, 17 bp, Homo sapiens
aggaaggagagcctgct

SEQ ID NO: 4914207 - DNA, 17 bp, Homo sapiens
aggaaggattgtaaaaa

SEQ ID NO: 4914208 - DNA, 20 bp, Homo sapiens
aggaaggggttggattgcaa

SEQ ID NO: 4914209 - DNA, 18 bp, Homo sapiens
aggaagttgacttatagt

SEQ ID NO: 4914210 - DNA, 16 bp, Homo sapiens
aggaataattatttat

SEQ ID NO: 4914211 - DNA, 22 bp, Homo sapiens
aggaataattatttatttaata

SEQ ID NO: 4914212 - DNA, 17 bp, Homo sapiens
aggaatcaagagctgcc

SEQ ID NO: 4914213 - DNA, 20 bp, Homo sapiens
aggaatcaagagctgccctc

SEQ ID NO: 4914214 - DNA, 21 bp, Homo sapiens
aggaatcaagagctgccctcc

SEQ ID NO: 4914215 - DNA, 14 bp, Homo sapiens
aggaatcctggcag

SEQ ID NO: 4914216 - DNA, 13 bp, Homo sapiens
aggaatctttaag

SEQ ID NO: 4914217 - DNA, 23 bp, Homo sapiens
aggaatgaaatcctgcttcagtg

SEQ ID NO: 4914218 - DNA, 16 bp, Homo sapiens
aggaattttctttgtg

SEQ ID NO: 4914219 - DNA, 17 bp, Homo sapiens
aggacaaaacttcttgt

SEQ ID NO: 4914220 - DNA, 18 bp, Homo sapiens
aggacactaaccacgctg

SEQ ID NO: 4914221 - DNA, 21 bp, Homo sapiens
aggacatagaggtatattgga

SEQ ID NO: 4914222 - DNA, 22 bp, Homo sapiens
aggacatagaggtatattggaa

SEQ ID NO: 4914223 - DNA, 13 bp, Homo sapiens
aggacatcagcaa

SEQ ID NO: 4914224 - DNA, 16 bp, Homo sapiens
aggacatgtttttgtt

SEQ ID NO: 4914225 - DNA, 17 bp, Homo sapiens
aggacattgcggacagc

SEQ ID NO: 4914226 - DNA, 18 bp, Homo sapiens
aggacattgcggacagcc

SEQ ID NO: 4914227 - DNA, 19 bp, Homo sapiens
aggacattgcggacagcca

SEQ ID NO: 4914228 - DNA, 17 bp, Homo sapiens
aggaccactcagcccct

SEQ ID NO: 4914229 - DNA, 18 bp, Homo sapiens
aggaccactcagccccta

SEQ ID NO: 4914230 - DNA, 19 bp, Homo sapiens
aggaccactcagcccctag

SEQ ID NO: 4914231 - DNA, 12 bp, Homo sapiens
aggaccaggact

SEQ ID NO: 4914232 - DNA, 17 bp, Homo sapiens
aggaccaggactccctc

SEQ ID NO: 4914233 - DNA, 20 bp, Homo sapiens
aggacccctccatgtgggct

SEQ ID NO: 4914234 - DNA, 17 bp, Homo sapiens
aggacccggaggggcct

SEQ ID NO: 4914235 - DNA, 20 bp, Homo sapiens
aggacccggaggggcctggc

SEQ ID NO: 4914236 - DNA, 18 bp, Homo sapiens
aggaccctaacacagtat

SEQ ID NO: 4914237 - DNA, 23 bp, Homo sapiens
aggaccgtggccctgccctctcc

SEQ ID NO: 4914238 - DNA, 18 bp, Homo sapiens
aggacctcctcttccccc

SEQ ID NO: 4914239 - DNA, 20 bp, Homo sapiens
aggacctgaaattccaaagt

SEQ ID NO: 4914240 - DNA, 22 bp, Homo sapiens
aggacctgaccctactcccttg

SEQ ID NO: 4914241 - DNA, 16 bp, Homo sapiens
aggacctggggcacag

SEQ ID NO: 4914242 - DNA, 23 bp, Homo sapiens
aggacctggggcacagtccagga

SEQ ID NO: 4914243 - DNA, 14 bp, Homo sapiens
aggaccttgggcca

SEQ ID NO: 4914244 - DNA, 22 bp, Homo sapiens
aggactcacaggttggaagaga

SEQ ID NO: 4914245 - DNA, 22 bp, Homo sapiens
agtgagcactaaggtgtgctct

SEQ ID NO: 4914246 - DNA, 14 bp, Homo sapiens
agtgagcctggctc

SEQ ID NO: 4914247 - DNA, 13 bp, Homo sapiens
agtgagctgggca

SEQ ID NO: 4914248 - DNA, 15 bp, Homo sapiens
agtgagtctgtcagc

SEQ ID NO: 4914249 - DNA, 19 bp, Homo sapiens
agtgatatggcagaagaca

SEQ ID NO: 4914250 - DNA, 24 bp, Homo sapiens
agtgatatggcagaagacaccaga

SEQ ID NO: 4914251 - DNA, 18 bp, Homo sapiens
agtgatcctcccacctca

SEQ ID NO: 4914252 - DNA, 22 bp, Homo sapiens
agtgatcctcccacctcagcct

SEQ ID NO: 4914253 - DNA, 19 bp, Homo sapiens
agtgatgggctttctcttt

SEQ ID NO: 4914254 - DNA, 16 bp, Homo sapiens
agtgatgtaccatgaa

SEQ ID NO: 4914255 - DNA, 15 bp, Homo sapiens
agtgattctcctgcc

SEQ ID NO: 4914256 - DNA, 18 bp, Homo sapiens
agtgcaaccacacacctc

SEQ ID NO: 4914257 - DNA, 24 bp, Homo sapiens
agtgcaaccacacacctcaccaga

SEQ ID NO: 4914258 - DNA, 22 bp, Homo sapiens
agtgcaatggtataaatttcaa

SEQ ID NO: 4914259 - DNA, 14 bp, Homo sapiens
agtgcacaaaatga

SEQ ID NO: 4914260 - DNA, 15 bp, Homo sapiens
agtgcacaaaatgaa

SEQ ID NO: 4914261 - DNA, 16 bp, Homo sapiens
agtgcacacagaaata

SEQ ID NO: 4914262 - DNA, 17 bp, Homo sapiens
agtgcacacagaaatat

SEQ ID NO: 4914263 - DNA, 20 bp, Homo sapiens
agtgcacacagaaatatata

SEQ ID NO: 4914264 - DNA, 13 bp, Homo sapiens
agtgcacagctgt

SEQ ID NO: 4914265 - DNA, 18 bp, Homo sapiens
agtgcacggggcacagcg

SEQ ID NO: 4914266 - DNA, 16 bp, Homo sapiens
agtgcatctcagccca

SEQ ID NO: 4914267 - DNA, 12 bp, Homo sapiens
agtaaatgtctt

SEQ ID NO: 4914268 - DNA, 15 bp, Homo sapiens
agtaaatgtctttgt

SEQ ID NO: 4914269 - DNA, 16 bp, Homo sapiens
agtaaatgtctttgta

SEQ ID NO: 4914270 - DNA, 15 bp, Homo sapiens
agtaactattattat

SEQ ID NO: 4914271 - DNA, 12 bp, Homo sapiens
agtaactcattt

SEQ ID NO: 4914272 - DNA, 22 bp, Homo sapiens
agtaactcatttgttaaaatta

SEQ ID NO: 4914273 - DNA, 18 bp, Homo sapiens
agtaacttggctttcatt

SEQ ID NO: 4914274 - DNA, 20 bp, Homo sapiens
agtaactttatgtgtaaata

SEQ ID NO: 4914275 - DNA, 14 bp, Homo sapiens
agtaagtaattatg

SEQ ID NO: 4914276 - DNA, 14 bp, Homo sapiens
agtaagttcagcac

SEQ ID NO: 4914277 - DNA, 16 bp, Homo sapiens
agtaataaactgtgtt

SEQ ID NO: 4914278 - DNA, 17 bp, Homo sapiens
agtaataaactgtgttt

SEQ ID NO: 4914279 - DNA, 11 bp, Homo sapiens
agtaatataat

SEQ ID NO: 4914280 - DNA, 20 bp, Homo sapiens
agtaatataatggaagagaa

SEQ ID NO: 4914281 - DNA, 13 bp, Homo sapiens
agtaatatattct

SEQ ID NO: 4914282 - DNA, 18 bp, Homo sapiens
agtaatatttatatattt

SEQ ID NO: 4914283 - DNA, 15 bp, Homo sapiens
agtaatcaataaaga

SEQ ID NO: 4914284 - DNA, 15 bp, Homo sapiens
agtaatctgtacatt

SEQ ID NO: 4914285 - DNA, 17 bp, Homo sapiens
agtaatgcatacagaaa

SEQ ID NO: 4914286 - DNA, 18 bp, Homo sapiens
agtaatgcatacagaaat

SEQ ID NO: 4914287 - DNA, 20 bp, Homo sapiens
agtaatgcatacagaaatat

SEQ ID NO: 4914288 - DNA, 21 bp, Homo sapiens
agtaatgtggaagaaaatggt

SEQ ID NO: 4914289 - DNA, 23 bp, Homo sapiens
agtaatgtggaagaaaatggttt

SEQ ID NO: 4914290 - DNA, 17 bp, Homo sapiens
agtaatgttattttctt

SEQ ID NO: 4914291 - DNA, 19 bp, Homo sapiens
agtaattatgcactaaata

SEQ ID NO: 4914292 - DNA, 21 bp, Homo sapiens
agtaattatgcactaaatatg

SEQ ID NO: 4914293 - DNA, 20 bp, Homo sapiens
agtaattgacatgtgccagg

SEQ ID NO: 4914294 - DNA, 21 bp, Homo sapiens
agtacaaatgccttaaaatgg

SEQ ID NO: 4914295 - DNA, 14 bp, Homo sapiens
agtacaaattataa

SEQ ID NO: 4914296 - DNA, 20 bp, Homo sapiens
agtacaatgtgtttttctcc

SEQ ID NO: 4914297 - DNA, 21 bp, Homo sapiens
agtacacaataagcaaaaaca

SEQ ID NO: 4914298 - DNA, 16 bp, Homo sapiens
agtacagcatgtgcct

SEQ ID NO: 4914299 - DNA, 22 bp, Homo sapiens
agtaccagcgctctaaaagcac

SEQ ID NO: 4914300 - DNA, 23 bp, Homo sapiens
agtaccagtaggggcttataata

SEQ ID NO: 4914301 - DNA, 18 bp, Homo sapiens
agtacccatctagtactt

SEQ ID NO: 4914302 - DNA, 16 bp, Homo sapiens
agtaccctctcagctc

SEQ ID NO: 4914303 - DNA, 15 bp, Homo sapiens
agtacctgaaaagta

SEQ ID NO: 4914304 - DNA, 19 bp, Homo sapiens
agtacttctccaccctgct

SEQ ID NO: 4914305 - DNA, 20 bp, Homo sapiens
agtacttctccaccctgctc

SEQ ID NO: 4914306 - DNA, 16 bp, Homo sapiens
agtacttgaaaaagta

SEQ ID NO: 4914307 - DNA, 15 bp, Homo sapiens
agtagaaataaaagt

SEQ ID NO: 4914308 - DNA, 19 bp, Homo sapiens
agtagaaataatatgcatt

SEQ ID NO: 4914309 - DNA, 13 bp, Homo sapiens
agtagaacagata

SEQ ID NO: 4914310 - DNA, 18 bp, Homo sapiens
agtagacacatttaagga

SEQ ID NO: 4914311 - DNA, 21 bp, Homo sapiens
agtagatggtgaaatttatta

SEQ ID NO: 4914312 - DNA, 19 bp, Homo sapiens
agtagccctttctgtgtgc

SEQ ID NO: 4914313 - DNA, 18 bp, Homo sapiens
agtagcgttttttaaatg

SEQ ID NO: 4914314 - DNA, 14 bp, Homo sapiens
agtagctgggacta

SEQ ID NO: 4914315 - DNA, 19 bp, Homo sapiens
agtagctgggactacaggc

SEQ ID NO: 4914316 - DNA, 16 bp, Homo sapiens
agtagcttgctccctg

SEQ ID NO: 4914317 - DNA, 17 bp, Homo sapiens
agtagcttgctccctgt

SEQ ID NO: 4914318 - DNA, 19 bp, Homo sapiens
agtagcttgctccctgtgt

SEQ ID NO: 4914319 - DNA, 13 bp, Homo sapiens
agtagtctgctca

SEQ ID NO: 4914320 - DNA, 14 bp, Homo sapiens
agtagtctgctcac

SEQ ID NO: 4914321 - DNA, 18 bp, Homo sapiens
agtagttctgtttggtgt

SEQ ID NO: 4914322 - DNA, 17 bp, Homo sapiens
agtagtttgtataactt

SEQ ID NO: 4914323 - DNA, 13 bp, Homo sapiens
agtataagaaatg

SEQ ID NO: 4914324 - DNA, 18 bp, Homo sapiens
agtataagaaatgcatat

SEQ ID NO: 4914325 - DNA, 18 bp, Homo sapiens
agtataattttttgtaat

SEQ ID NO: 4914326 - DNA, 16 bp, Homo sapiens
agtatacaatatataa

SEQ ID NO: 4914327 - DNA, 17 bp, Homo sapiens
agtatacaatatataaa

SEQ ID NO: 4914328 - DNA, 23 bp, Homo sapiens
agtatacaatatataaaaatata

SEQ ID NO: 4914329 - DNA, 21 bp, Homo sapiens
agtatacagttcaataaactt

SEQ ID NO: 4914330 - DNA, 12 bp, Homo sapiens
agtatcccacat

SEQ ID NO: 4914331 - DNA, 18 bp, Homo sapiens
agtatctatatatgtgta

SEQ ID NO: 4914332 - DNA, 10 bp, Homo sapiens
agtatctcat

SEQ ID NO: 4914333 - DNA, 21 bp, Homo sapiens
agtatctcatcaacaaagaaa

SEQ ID NO: 4914334 - DNA, 22 bp, Homo sapiens
agtatctcatcaacaaagaaat

SEQ ID NO: 4914335 - DNA, 17 bp, Homo sapiens
agtatcttttttcaaaa

SEQ ID NO: 4914336 - DNA, 20 bp, Homo sapiens
agtatgacgctgatacataa

SEQ ID NO: 4914337 - DNA, 21 bp, Homo sapiens
agtatgtaaagtatgtaaaca

SEQ ID NO: 4914338 - DNA, 13 bp, Homo sapiens
agtattaaaacat

SEQ ID NO: 4914339 - DNA, 22 bp, Homo sapiens
agtattaaaacattggattatc

SEQ ID NO: 4914340 - DNA, 23 bp, Homo sapiens
agtattaaaacattggattatcc

SEQ ID NO: 4914341 - DNA, 14 bp, Homo sapiens
agtattcattctgc

SEQ ID NO: 4914342 - DNA, 18 bp, Homo sapiens
agtattcttgtcaaaaaa

SEQ ID NO: 4914343 - DNA, 17 bp, Homo sapiens
agtatttatttatgtac

SEQ ID NO: 4914344 - DNA, 20 bp, Homo sapiens
agtatttatttatgtacttt

SEQ ID NO: 4914345 - DNA, 14 bp, Homo sapiens
agtatttattttgt

SEQ ID NO: 4914346 - DNA, 16 bp, Homo sapiens
agtatttattttgtaa

SEQ ID NO: 4914347 - DNA, 16 bp, Homo sapiens
agtatttcatgctggg

SEQ ID NO: 4914348 - DNA, 22 bp, Homo sapiens
agtatttccacttgttctcagg

SEQ ID NO: 4914349 - DNA, 16 bp, Homo sapiens
agtatttgaattaaaa

SEQ ID NO: 4914350 - DNA, 20 bp, Homo sapiens
agtatttgaattaaaacttc

SEQ ID NO: 4914351 - DNA, 20 bp, Homo sapiens
agtattttgaagtttacatt

SEQ ID NO: 4914352 - DNA, 21 bp, Homo sapiens
agtattttgaagtttacattt

SEQ ID NO: 4914353 - DNA, 22 bp, Homo sapiens
agtcaaatggtaggcatttcct

SEQ ID NO: 4914354 - DNA, 17 bp, Homo sapiens
agtcaatcatttctcac

SEQ ID NO: 4914355 - DNA, 14 bp, Homo sapiens
agtcacatcacagg

SEQ ID NO: 4914356 - DNA, 15 bp, Homo sapiens
agtcacatcacagga

SEQ ID NO: 4914357 - DNA, 13 bp, Homo sapiens
agtcaccaagccc

SEQ ID NO: 4914358 - DNA, 19 bp, Homo sapiens
agtcaccactccattccca

SEQ ID NO: 4914359 - DNA, 20 bp, Homo sapiens
agtcaccctacctgtgcctg

SEQ ID NO: 4914360 - DNA, 13 bp, Homo sapiens
agtcaccttccct

SEQ ID NO: 4914361 - DNA, 23 bp, Homo sapiens
agtcaccttcccttgccactttg

SEQ ID NO: 4914362 - DNA, 19 bp, Homo sapiens
agtcactgccactttgcac

SEQ ID NO: 4914363 - DNA, 20 bp, Homo sapiens
agtcactgccactttgcaca

SEQ ID NO: 4914364 - DNA, 16 bp, Homo sapiens
agtcacttactattgt

SEQ ID NO: 4914365 - DNA, 19 bp, Homo sapiens
agtcacttactattgttgc

SEQ ID NO: 4914366 - DNA, 15 bp, Homo sapiens
agtcagaaaacttta

SEQ ID NO: 4914367 - DNA, 15 bp, Homo sapiens
agtcagtgttgagat

SEQ ID NO: 4914368 - DNA, 14 bp, Homo sapiens
agtcatcatcaggg

SEQ ID NO: 4914369 - DNA, 17 bp, Homo sapiens
agtcatcatcagggcct

SEQ ID NO: 4914370 - DNA, 22 bp, Homo sapiens
agtcatcatcagggcctggggc

SEQ ID NO: 4914371 - DNA, 19 bp, Homo sapiens
agtcatcttgtaatttcca

SEQ ID NO: 4914372 - DNA, 13 bp, Homo sapiens
agtcatgaagccc

SEQ ID NO: 4914373 - DNA, 17 bp, Homo sapiens
agtcatgcataaatatg

SEQ ID NO: 4914374 - DNA, 15 bp, Homo sapiens
agtcatttactaaac

SEQ ID NO: 4914375 - DNA, 18 bp, Homo sapiens
agtcatttactaaacata

SEQ ID NO: 4914376 - DNA, 19 bp, Homo sapiens
agtcatttactaaacatat

SEQ ID NO: 4914377 - DNA, 15 bp, Homo sapiens
agtcatttattttaa

SEQ ID NO: 4914378 - DNA, 22 bp, Homo sapiens
atccactctaccctcccacccc

SEQ ID NO: 4914379 - DNA, 20 bp, Homo sapiens
atccagagggttgtgatttt

SEQ ID NO: 4914380 - DNA, 16 bp, Homo sapiens
atccaggcacagctga

SEQ ID NO: 4914381 - DNA, 16 bp, Homo sapiens
atccataccagctcgc

SEQ ID NO: 4914382 - DNA, 19 bp, Homo sapiens
atccattcccaagaaatgc

SEQ ID NO: 4914383 - DNA, 19 bp, Homo sapiens
atcccaaccagtgccaagg

SEQ ID NO: 4914384 - DNA, 12 bp, Homo sapiens
atcccacacagg

SEQ ID NO: 4914385 - DNA, 23 bp, Homo sapiens
atcccacccacatgtgacacata

SEQ ID NO: 4914386 - DNA, 13 bp, Homo sapiens
atcccagaaatta

SEQ ID NO: 4914387 - DNA, 14 bp, Homo sapiens
atcccagcacctgc

SEQ ID NO: 4914388 - DNA, 22 bp, Homo sapiens
atcccaggacaccacacccagc

SEQ ID NO: 4914389 - DNA, 19 bp, Homo sapiens
atcccaggatgctgggtgg

SEQ ID NO: 4914390 - DNA, 19 bp, Homo sapiens
atcccatgagcctcagcat

SEQ ID NO: 4914391 - DNA, 16 bp, Homo sapiens
atccccaagtgtgaac

SEQ ID NO: 4914392 - DNA, 19 bp, Homo sapiens
atccccaggggtcccagcc

SEQ ID NO: 4914393 - DNA, 21 bp, Homo sapiens
atccccaggggtcccagccac

SEQ ID NO: 4914394 - DNA, 14 bp, Homo sapiens
atccccagtcccaa

SEQ ID NO: 4914395 - DNA, 13 bp, Homo sapiens
atcccccaaagtt

SEQ ID NO: 4914396 - DNA, 13 bp, Homo sapiens
atcccctcaggac

SEQ ID NO: 4914397 - DNA, 16 bp, Homo sapiens
atcccgtgttctcctt

SEQ ID NO: 4914398 - DNA, 21 bp, Homo sapiens
atccctaccccctaagagcca

SEQ ID NO: 4914399 - DNA, 22 bp, Homo sapiens
atccctaccccctaagagccat

SEQ ID NO: 4914400 - DNA, 17 bp, Homo sapiens
atccctcaccttctgag

SEQ ID NO: 4914401 - DNA, 18 bp, Homo sapiens
atccctcaccttctgagt

SEQ ID NO: 4914402 - DNA, 20 bp, Homo sapiens
atccctcgatatttttaaag

SEQ ID NO: 4914403 - DNA, 20 bp, Homo sapiens
atccctgaatcccccttgcc

SEQ ID NO: 4914404 - DNA, 22 bp, Homo sapiens
atccctgaatcccccttgccac

SEQ ID NO: 4914405 - DNA, 19 bp, Homo sapiens
atccctgatcctaactgaa

SEQ ID NO: 4914406 - DNA, 15 bp, Homo sapiens
atccctgcctggtca

SEQ ID NO: 4914407 - DNA, 12 bp, Homo sapiens
atccctgtgagg

SEQ ID NO: 4914408 - DNA, 13 bp, Homo sapiens
atccctgtttaat

SEQ ID NO: 4914409 - DNA, 17 bp, Homo sapiens
atccctgtttaatattt

SEQ ID NO: 4914410 - DNA, 18 bp, Homo sapiens
atccctgtttaatattta

SEQ ID NO: 4914411 - DNA, 21 bp, Homo sapiens
atccctgtttaatatttaaac

SEQ ID NO: 4914412 - DNA, 13 bp, Homo sapiens
atcccttctcaca

SEQ ID NO: 4914413 - DNA, 18 bp, Homo sapiens
atccgccttttgtataca

SEQ ID NO: 4914414 - DNA, 20 bp, Homo sapiens
atccgctctcttcctgcccc

SEQ ID NO: 4914415 - DNA, 20 bp, Homo sapiens
atcctaagacacaaatgcat

SEQ ID NO: 4914416 - DNA, 21 bp, Homo sapiens
atcctaagggtcgaaagctct

SEQ ID NO: 4914417 - DNA, 22 bp, Homo sapiens
atcctaagggtcgaaagctcta

SEQ ID NO: 4914418 - DNA, 23 bp, Homo sapiens
atcctaagggtcgaaagctctag

SEQ ID NO: 4914419 - DNA, 21 bp, Homo sapiens
atcctacaaggcctatgagta

SEQ ID NO: 4914420 - DNA, 15 bp, Homo sapiens
atcctagtttcctct

SEQ ID NO: 4914421 - DNA, 17 bp, Homo sapiens
atcctagtttcctctcc

SEQ ID NO: 4914422 - DNA, 19 bp, Homo sapiens
atcctatcaacaacaaggt

SEQ ID NO: 4914423 - DNA, 16 bp, Homo sapiens
atcctattgttgatgg

SEQ ID NO: 4914424 - DNA, 18 bp, Homo sapiens
atcctcccacctcagcct

SEQ ID NO: 4914425 - DNA, 20 bp, Homo sapiens
atcctcccacctcagcctcc

SEQ ID NO: 4914426 - DNA, 21 bp, Homo sapiens
atcctcctggaaccttgctgt

SEQ ID NO: 4914427 - DNA, 22 bp, Homo sapiens
atcctcctggaaccttgctgtc

SEQ ID NO: 4914428 - DNA, 16 bp, Homo sapiens
atcctctcctttgaaa

SEQ ID NO: 4914429 - DNA, 15 bp, Homo sapiens
atcctgactctgccc

SEQ ID NO: 4914430 - DNA, 19 bp, Homo sapiens
atcctgactctgccccctg

SEQ ID NO: 4914431 - DNA, 13 bp, Homo sapiens
atcctgagccccg

SEQ ID NO: 4914432 - DNA, 20 bp, Homo sapiens
atcctgagccccgccctctt

SEQ ID NO: 4914433 - DNA, 14 bp, Homo sapiens
atcctgccaccctg

SEQ ID NO: 4914434 - DNA, 18 bp, Homo sapiens
atcctgccaccctgtagc

SEQ ID NO: 4914435 - DNA, 13 bp, Homo sapiens
atcctgccagccc

SEQ ID NO: 4914436 - DNA, 21 bp, Homo sapiens
atcctgccagccccacacagc

SEQ ID NO: 4914437 - DNA, 22 bp, Homo sapiens
atcctgccagccccacacagct

SEQ ID NO: 4914438 - DNA, 23 bp, Homo sapiens
atcctgccagccccacacagcta

SEQ ID NO: 4914439 - DNA, 14 bp, Homo sapiens
atcctgcttcagtg

SEQ ID NO: 4914440 - DNA, 19 bp, Homo sapiens
atcctggcacccggcccct

SEQ ID NO: 4914441 - DNA, 23 bp, Homo sapiens
atcctggcacccggcccctgctg

SEQ ID NO: 4914442 - DNA, 12 bp, Homo sapiens
atcctggcagcc

SEQ ID NO: 4914443 - DNA, 19 bp, Homo sapiens
atcctggctctgtggcttg

SEQ ID NO: 4914444 - DNA, 20 bp, Homo sapiens
atcctggggcattaaaaaaa

SEQ ID NO: 4914445 - DNA, 17 bp, Homo sapiens
atcctgtataagcactg

SEQ ID NO: 4914446 - DNA, 18 bp, Homo sapiens
atcctgtctttctgagca

SEQ ID NO: 4914447 - DNA, 13 bp, Homo sapiens
atccttagaggtc

SEQ ID NO: 4914448 - DNA, 21 bp, Homo sapiens
atccttagaggtcctctggag

SEQ ID NO: 4914449 - DNA, 20 bp, Homo sapiens
atccttccaaaaattattat

SEQ ID NO: 4914450 - DNA, 20 bp, Homo sapiens
atccttccaaagaattctta

SEQ ID NO: 4914451 - DNA, 17 bp, Homo sapiens
atccttcctataacttg

SEQ ID NO: 4914452 - DNA, 22 bp, Homo sapiens
atccttcctataacttgatgca

SEQ ID NO: 4914453 - DNA, 15 bp, Homo sapiens
atccttggcaccaaa

SEQ ID NO: 4914454 - DNA, 16 bp, Homo sapiens
atccttggcaccaaag

SEQ ID NO: 4914455 - DNA, 17 bp, Homo sapiens
atccttggtctttgtat

SEQ ID NO: 4914456 - DNA, 17 bp, Homo sapiens
atcctttacgtgtttaa

SEQ ID NO: 4914457 - DNA, 13 bp, Homo sapiens
atcctttctaaca

SEQ ID NO: 4914458 - DNA, 17 bp, Homo sapiens
atcctttgcagggcagc

SEQ ID NO: 4914459 - DNA, 19 bp, Homo sapiens
atcgaaataacaatgttaa

SEQ ID NO: 4914460 - DNA, 23 bp, Homo sapiens
atcgaaataacaatgttaaggaa

SEQ ID NO: 4914461 - DNA, 16 bp, Homo sapiens
atcgatgttttattat

SEQ ID NO: 4914462 - DNA, 16 bp, Homo sapiens
atcgctcgtgtgttct

SEQ ID NO: 4914463 - DNA, 14 bp, Homo sapiens
atcgtttatttcac

SEQ ID NO: 4914464 - DNA, 16 bp, Homo sapiens
atctaaatctatttat

SEQ ID NO: 4914465 - DNA, 18 bp, Homo sapiens
atctaaatctatttatta

SEQ ID NO: 4914466 - DNA, 22 bp, Homo sapiens
atctaaatctatttattaatat

SEQ ID NO: 4914467 - DNA, 14 bp, Homo sapiens
atctaagctgcagc

SEQ ID NO: 4914468 - DNA, 20 bp, Homo sapiens
atctaaggatgtcacagggc

SEQ ID NO: 4914469 - DNA, 15 bp, Homo sapiens
atctaatacctctgt

SEQ ID NO: 4914470 - DNA, 21 bp, Homo sapiens
atctaatagcgggttactttc

SEQ ID NO: 4914471 - DNA, 19 bp, Homo sapiens
atctaatatatatgaataa

SEQ ID NO: 4914472 - DNA, 18 bp, Homo sapiens
atctaatatgtaacaagc

SEQ ID NO: 4914473 - DNA, 16 bp, Homo sapiens
atctaattattttgca

SEQ ID NO: 4914474 - DNA, 15 bp, Homo sapiens
atctactaattccac

SEQ ID NO: 4914475 - DNA, 16 bp, Homo sapiens
atctagtttacagaaa

SEQ ID NO: 4914476 - DNA, 18 bp, Homo sapiens
atctagtttacagaaaaa

SEQ ID NO: 4914477 - DNA, 15 bp, Homo sapiens
atctatatttaacaa

SEQ ID NO: 4914478 - DNA, 13 bp, Homo sapiens
atctatcttccaa

SEQ ID NO: 4914479 - DNA, 13 bp, Homo sapiens
atctatgaggaaa

SEQ ID NO: 4914480 - DNA, 13 bp, Homo sapiens
atctatgatataa

SEQ ID NO: 4914481 - DNA, 18 bp, Homo sapiens
atctattctgagaaaaca

SEQ ID NO: 4914482 - DNA, 17 bp, Homo sapiens
atctatttcacttattt

SEQ ID NO: 4914483 - DNA, 15 bp, Homo sapiens
atctattttctatgt

SEQ ID NO: 4914484 - DNA, 18 bp, Homo sapiens
atctcaatgaagccagct

SEQ ID NO: 4914485 - DNA, 13 bp, Homo sapiens
atctcaccccatc

SEQ ID NO: 4914486 - DNA, 13 bp, Homo sapiens
atctcagctttga

SEQ ID NO: 4914487 - DNA, 22 bp, Homo sapiens
atctcagctttgagaagccttc

SEQ ID NO: 4914488 - DNA, 17 bp, Homo sapiens
atctcataggttgccaa

SEQ ID NO: 4914489 - DNA, 11 bp, Homo sapiens
atcttgtgaaa

SEQ ID NO: 4914490 - DNA, 19 bp, Homo sapiens
atcttgtgctagaatactt

SEQ ID NO: 4914491 - DNA, 22 bp, Homo sapiens
atcttgtgctagaatacttttt

SEQ ID NO: 4914492 - DNA, 16 bp, Homo sapiens
atctttctattccaaa

SEQ ID NO: 4914493 - DNA, 14 bp, Homo sapiens
atctttgcactcca

SEQ ID NO: 4914494 - DNA, 18 bp, Homo sapiens
atctttgcagacaggcaa

SEQ ID NO: 4914495 - DNA, 22 bp, Homo sapiens
atctttgccttgggctgctcct

SEQ ID NO: 4914496 - DNA, 14 bp, Homo sapiens
atctttgtgataat

SEQ ID NO: 4914497 - DNA, 18 bp, Homo sapiens
atcttttaaagtgttact

SEQ ID NO: 4914498 - DNA, 15 bp, Homo sapiens
atcttttatgtttga

SEQ ID NO: 4914499 - DNA, 18 bp, Homo sapiens
atcttttatgtttgaata

SEQ ID NO: 4914500 - DNA, 15 bp, Homo sapiens
atctttttaaagctt

SEQ ID NO: 4914501 - DNA, 17 bp, Homo sapiens
atgaaaactatacaaca

SEQ ID NO: 4914502 - DNA, 17 bp, Homo sapiens
atgaaaagattcttctg

SEQ ID NO: 4914503 - DNA, 12 bp, Homo sapiens
atgaaacacagc

SEQ ID NO: 4914504 - DNA, 20 bp, Homo sapiens
atgaaacactcagttgttca

SEQ ID NO: 4914505 - DNA, 15 bp, Homo sapiens
atgaaagaatatatt

SEQ ID NO: 4914506 - DNA, 18 bp, Homo sapiens
atgaaagaatatatttat

SEQ ID NO: 4914507 - DNA, 13 bp, Homo sapiens
atgaaagattaaa

SEQ ID NO: 4914508 - DNA, 20 bp, Homo sapiens
atgaaagcagggaatttcta

SEQ ID NO: 4914509 - DNA, 15 bp, Homo sapiens
atgaaagggcccaga

SEQ ID NO: 4914510 - DNA, 15 bp, Homo sapiens
atgaaaggtactata

SEQ ID NO: 4914511 - DNA, 20 bp, Homo sapiens
atgaaaggtactatatttgc

SEQ ID NO: 4914512 - DNA, 14 bp, Homo sapiens
atgaaataaagaaa

SEQ ID NO: 4914513 - DNA, 13 bp, Homo sapiens
atgaaatatgcat

SEQ ID NO: 4914514 - DNA, 16 bp, Homo sapiens
atgaaatccttttcct

SEQ ID NO: 4914515 - DNA, 14 bp, Homo sapiens
atgaaatttaaaca

SEQ ID NO: 4914516 - DNA, 15 bp, Homo sapiens
atgaaatttaaacat

SEQ ID NO: 4914517 - DNA, 19 bp, Homo sapiens
atgaaattttctagacttt

SEQ ID NO: 4914518 - DNA, 21 bp, Homo sapiens
atgaaattttctagactttct

SEQ ID NO: 4914519 - DNA, 22 bp, Homo sapiens
atgaaattttctagactttctg

SEQ ID NO: 4914520 - DNA, 23 bp, Homo sapiens
atgaaattttctagactttctgt

SEQ ID NO: 4914521 - DNA, 10 bp, Homo sapiens
atgaacattc

SEQ ID NO: 4914522 - DNA, 18 bp, Homo sapiens
atgaacccttcctgagct

SEQ ID NO: 4914523 - DNA, 12 bp, Homo sapiens
atgaactctgaa

SEQ ID NO: 4914524 - DNA, 17 bp, Homo sapiens
atgaacttattctgtag

SEQ ID NO: 4914525 - DNA, 18 bp, Homo sapiens
atgaacttattctgtaga

SEQ ID NO: 4914526 - DNA, 18 bp, Homo sapiens
atgaagagaagcaatttt

SEQ ID NO: 4914527 - DNA, 18 bp, Homo sapiens
atgaagagcttgctttga

SEQ ID NO: 4914528 - DNA, 16 bp, Homo sapiens
atgaagcaaggaagat

SEQ ID NO: 4914529 - DNA, 16 bp, Homo sapiens
agtgcatttctgaata

SEQ ID NO: 4914530 - DNA, 14 bp, Homo sapiens
agtgccaaatgctc

SEQ ID NO: 4914531 - DNA, 16 bp, Homo sapiens
agtgccaactcctcac

SEQ ID NO: 4914532 - DNA, 13 bp, Homo sapiens
agtgccaaggacc

SEQ ID NO: 4914533 - DNA, 19 bp, Homo sapiens
agtgccactcattcctgta

SEQ ID NO: 4914534 - DNA, 22 bp, Homo sapiens
agtgcctggatcccctctgtct

SEQ ID NO: 4914535 - DNA, 18 bp, Homo sapiens
agtgcgtgtgtagagtta

SEQ ID NO: 4914536 - DNA, 15 bp, Homo sapiens
agtgctatatatata

SEQ ID NO: 4914537 - DNA, 17 bp, Homo sapiens
agtgctatatatataaa

SEQ ID NO: 4914538 - DNA, 19 bp, Homo sapiens
agtgctatatatataaata

SEQ ID NO: 4914539 - DNA, 22 bp, Homo sapiens
agtgctatatatataaatattt

SEQ ID NO: 4914540 - DNA, 20 bp, Homo sapiens
agtgctgagattacaggcat

SEQ ID NO: 4914541 - DNA, 16 bp, Homo sapiens
agtgctgcatcttata

SEQ ID NO: 4914542 - DNA, 14 bp, Homo sapiens
agtgctggctcaca

SEQ ID NO: 4914543 - DNA, 17 bp, Homo sapiens
agtgctggctcacagta

SEQ ID NO: 4914544 - DNA, 21 bp, Homo sapiens
agtgctggctcacagtacagc

SEQ ID NO: 4914545 - DNA, 22 bp, Homo sapiens
agtgctgggatggaggggagtg

SEQ ID NO: 4914546 - DNA, 20 bp, Homo sapiens
agtgctgggattacaggtgt

SEQ ID NO: 4914547 - DNA, 12 bp, Homo sapiens
agtggaaaaaca

SEQ ID NO: 4914548 - DNA, 13 bp, Homo sapiens
agtggaaaaacac

SEQ ID NO: 4914549 - DNA, 19 bp, Homo sapiens
agtggaccttaggccttcc

SEQ ID NO: 4914550 - DNA, 23 bp, Homo sapiens
agtggaccttaggccttcctctc

SEQ ID NO: 4914551 - DNA, 14 bp, Homo sapiens
agtggaggtttgtc

SEQ ID NO: 4914552 - DNA, 21 bp, Homo sapiens
agtggattgtaggtgcaagat

SEQ ID NO: 4914553 - DNA, 14 bp, Homo sapiens
agtggattgtttat

SEQ ID NO: 4914554 - DNA, 14 bp, Homo sapiens
agtggcagctgctt

SEQ ID NO: 4914555 - DNA, 13 bp, Homo sapiens
agtggcctggcca

SEQ ID NO: 4914556 - DNA, 14 bp, Homo sapiens
agtggcctggccag

SEQ ID NO: 4914557 - DNA, 19 bp, Homo sapiens
agtggcctggccaggagct

SEQ ID NO: 4914558 - DNA, 20 bp, Homo sapiens
agtggcctggccaggagctc

SEQ ID NO: 4914559 - DNA, 22 bp, Homo sapiens
agtggcctggccaggagctctt

SEQ ID NO: 4914560 - DNA, 15 bp, Homo sapiens
agtggcgttgggagg

SEQ ID NO: 4914561 - DNA, 23 bp, Homo sapiens
agtggcgttgggagggggagaaa

SEQ ID NO: 4914562 - DNA, 15 bp, Homo sapiens
agtggcgttgttgca

SEQ ID NO: 4914563 - DNA, 17 bp, Homo sapiens
agtggcttcatctgtca

SEQ ID NO: 4914564 - DNA, 19 bp, Homo sapiens
agtgggacagggcatggcc

SEQ ID NO: 4914565 - DNA, 15 bp, Homo sapiens
agtgggacccataga

SEQ ID NO: 4914566 - DNA, 22 bp, Homo sapiens
agtgggacccatagatcttctg

SEQ ID NO: 4914567 - DNA, 14 bp, Homo sapiens
agtgggagaaggca

SEQ ID NO: 4914568 - DNA, 15 bp, Homo sapiens
agtgggagaaggcag

SEQ ID NO: 4914569 - DNA, 19 bp, Homo sapiens
agtgggagaaggcagtgat

SEQ ID NO: 4914570 - DNA, 20 bp, Homo sapiens
agtgggcagagcccccagga

SEQ ID NO: 4914571 - DNA, 16 bp, Homo sapiens
agtggggcagagcctc

SEQ ID NO: 4914572 - DNA, 12 bp, Homo sapiens
agtggggcctgt

SEQ ID NO: 4914573 - DNA, 20 bp, Homo sapiens
agtggggttatctctgtgtt

SEQ ID NO: 4914574 - DNA, 16 bp, Homo sapiens
agtgggtgacaagagc

SEQ ID NO: 4914575 - DNA, 18 bp, Homo sapiens
agtgggtgagatgctgga

SEQ ID NO: 4914576 - DNA, 22 bp, Homo sapiens
agtgggtgagatgctggagaag

SEQ ID NO: 4914577 - DNA, 15 bp, Homo sapiens
agtgggttattctgg

SEQ ID NO: 4914578 - DNA, 18 bp, Homo sapiens
agtgggttattctggagt

SEQ ID NO: 4914579 - DNA, 16 bp, Homo sapiens
agtggtctttgtaaga

SEQ ID NO: 4914580 - DNA, 18 bp, Homo sapiens
agtggtctttgtaagagt

SEQ ID NO: 4914581 - DNA, 21 bp, Homo sapiens
agtggtctttgtaagagtgta

SEQ ID NO: 4914582 - DNA, 22 bp, Homo sapiens
agtggtctttgtaagagtgtag

SEQ ID NO: 4914583 - DNA, 17 bp, Homo sapiens
agtggtgcgatctgggt

SEQ ID NO: 4914584 - DNA, 20 bp, Homo sapiens
agtggtttccacatgctctg

SEQ ID NO: 4914585 - DNA, 22 bp, Homo sapiens
agtggtttgatggtgacttcct

SEQ ID NO: 4914586 - DNA, 13 bp, Homo sapiens
agtgtaaaataag

SEQ ID NO: 4914587 - DNA, 16 bp, Homo sapiens
agtgtacgattcttaa

SEQ ID NO: 4914588 - DNA, 15 bp, Homo sapiens
agtgtagaagcattc

SEQ ID NO: 4914589 - DNA, 17 bp, Homo sapiens
agtgtagaagcattcct

SEQ ID NO: 4914590 - DNA, 17 bp, Homo sapiens
agtgtagttaatttatc

SEQ ID NO: 4914591 - DNA, 16 bp, Homo sapiens
agtgtagtttacagaa

SEQ ID NO: 4914592 - DNA, 17 bp, Homo sapiens
agtgtagtttacagaaa

SEQ ID NO: 4914593 - DNA, 20 bp, Homo sapiens
agtgtatggaaataaatgta

SEQ ID NO: 4914594 - DNA, 14 bp, Homo sapiens
agtgtcccccaggt

SEQ ID NO: 4914595 - DNA, 13 bp, Homo sapiens
agtgtcccctcca

SEQ ID NO: 4914596 - DNA, 14 bp, Homo sapiens
agtgtcccctccac

SEQ ID NO: 4914597 - DNA, 15 bp, Homo sapiens
agtgtcccctccact

SEQ ID NO: 4914598 - DNA, 19 bp, Homo sapiens
agtgtcccctccactgtca

SEQ ID NO: 4914599 - DNA, 13 bp, Homo sapiens
agtgtgaacaaaa

SEQ ID NO: 4914600 - DNA, 16 bp, Homo sapiens
agtgtgacagggccag

SEQ ID NO: 4914601 - DNA, 18 bp, Homo sapiens
agtgtgcatggaggccct

SEQ ID NO: 4914602 - DNA, 14 bp, Homo sapiens
agtgtgtgacattc

SEQ ID NO: 4914603 - DNA, 14 bp, Homo sapiens
agtgtgtgtgtgca

SEQ ID NO: 4914604 - DNA, 20 bp, Homo sapiens
agtgtgtgtgtgcatgtgtg

SEQ ID NO: 4914605 - DNA, 15 bp, Homo sapiens
agtgttcgcttggct

SEQ ID NO: 4914606 - DNA, 19 bp, Homo sapiens
agtgttgaagggaggtggc

SEQ ID NO: 4914607 - DNA, 14 bp, Homo sapiens
agtgttgcctaagt

SEQ ID NO: 4914608 - DNA, 19 bp, Homo sapiens
agtgtttatttttcatatt

SEQ ID NO: 4914609 - DNA, 22 bp, Homo sapiens
agtgtttatttttcatattgtg

SEQ ID NO: 4914610 - DNA, 13 bp, Homo sapiens
agtgtttcagcta

SEQ ID NO: 4914611 - DNA, 20 bp, Homo sapiens
agtgtttcagctaagggaag

SEQ ID NO: 4914612 - DNA, 13 bp, Homo sapiens
agtgtttctgtta

SEQ ID NO: 4914613 - DNA, 22 bp, Homo sapiens
agtgtttgggggacgtttctca

SEQ ID NO: 4914614 - DNA, 14 bp, Homo sapiens
agtgttttaaattc

SEQ ID NO: 4914615 - DNA, 14 bp, Homo sapiens
attacacccaaaga

SEQ ID NO: 4914616 - DNA, 19 bp, Homo sapiens
attacactgtatttgtatc

SEQ ID NO: 4914617 - DNA, 17 bp, Homo sapiens
attacagaggaagttat

SEQ ID NO: 4914618 - DNA, 20 bp, Homo sapiens
attacaggcacctgccacca

SEQ ID NO: 4914619 - DNA, 22 bp, Homo sapiens
attacaggcacctgccaccatg

SEQ ID NO: 4914620 - DNA, 16 bp, Homo sapiens
attacaggtgtgaacc

SEQ ID NO: 4914621 - DNA, 18 bp, Homo sapiens
attaccagcaagaataaa

SEQ ID NO: 4914622 - DNA, 12 bp, Homo sapiens
attactaatttt

SEQ ID NO: 4914623 - DNA, 16 bp, Homo sapiens
attactcctatttttg

SEQ ID NO: 4914624 - DNA, 19 bp, Homo sapiens
attactcctatttttgtaa

SEQ ID NO: 4914625 - DNA, 12 bp, Homo sapiens
attactgggcct

SEQ ID NO: 4914626 - DNA, 12 bp, Homo sapiens
attacttctgct

SEQ ID NO: 4914627 - DNA, 14 bp, Homo sapiens
attacttctgctac

SEQ ID NO: 4914628 - DNA, 16 bp, Homo sapiens
attagaaaaaaattac

SEQ ID NO: 4914629 - DNA, 22 bp, Homo sapiens
attagaaaaaaattactaattt

SEQ ID NO: 4914630 - DNA, 13 bp, Homo sapiens
attagactcctcc

SEQ ID NO: 4914631 - DNA, 16 bp, Homo sapiens
attagactcctcctcc

SEQ ID NO: 4914632 - DNA, 16 bp, Homo sapiens
attagattttatttta

SEQ ID NO: 4914633 - DNA, 20 bp, Homo sapiens
attagattttattttactat

SEQ ID NO: 4914634 - DNA, 19 bp, Homo sapiens
attagcaaggtcatttctt

SEQ ID NO: 4914635 - DNA, 23 bp, Homo sapiens
attagcacagattttaattgtca

SEQ ID NO: 4914636 - DNA, 13 bp, Homo sapiens
attagccaggatc

SEQ ID NO: 4914637 - DNA, 13 bp, Homo sapiens
attagctttgtgt

SEQ ID NO: 4914638 - DNA, 14 bp, Homo sapiens
attagctttgtgtt

SEQ ID NO: 4914639 - DNA, 15 bp, Homo sapiens
attagctttgtgttt

SEQ ID NO: 4914640 - DNA, 21 bp, Homo sapiens
attaggaggctcaacaataaa

SEQ ID NO: 4914641 - DNA, 22 bp, Homo sapiens
attaggaggctcaacaataaaa

SEQ ID NO: 4914642 - DNA, 16 bp, Homo sapiens
attaggatttcatgat

SEQ ID NO: 4914643 - DNA, 15 bp, Homo sapiens
attagggatgcctcc

SEQ ID NO: 4914644 - DNA, 16 bp, Homo sapiens
attagtaaatgcttat

SEQ ID NO: 4914645 - DNA, 16 bp, Homo sapiens
attagtaaatgtcttt

SEQ ID NO: 4914646 - DNA, 18 bp, Homo sapiens
attagttccctgtctctt

SEQ ID NO: 4914647 - DNA, 14 bp, Homo sapiens
attataaacgctta

SEQ ID NO: 4914648 - DNA, 19 bp, Homo sapiens
attataaatatatataaag

SEQ ID NO: 4914649 - DNA, 20 bp, Homo sapiens
attataaatatatataaaga

SEQ ID NO: 4914650 - DNA, 18 bp, Homo sapiens
attatacaaattaaaaag

SEQ ID NO: 4914651 - DNA, 17 bp, Homo sapiens
attatactaacttattt

SEQ ID NO: 4914652 - DNA, 14 bp, Homo sapiens
attatagattctaa

SEQ ID NO: 4914653 - DNA, 17 bp, Homo sapiens
attatagattctaaaga

SEQ ID NO: 4914654 - DNA, 15 bp, Homo sapiens
attatagtttcaagc

SEQ ID NO: 4914655 - DNA, 16 bp, Homo sapiens
attatatatataatat

SEQ ID NO: 4914656 - DNA, 16 bp, Homo sapiens
attatatcaaggtaaa

SEQ ID NO: 4914657 - DNA, 14 bp, Homo sapiens
attatccatattga

SEQ ID NO: 4914658 - DNA, 17 bp, Homo sapiens
attatccatattgagtc

SEQ ID NO: 4914659 - DNA, 21 bp, Homo sapiens
attatcctgaactcttctgca

SEQ ID NO: 4914660 - DNA, 16 bp, Homo sapiens
attatgcactaaatat

SEQ ID NO: 4914661 - DNA, 18 bp, Homo sapiens
attatgcactaaatatga

SEQ ID NO: 4914662 - DNA, 14 bp, Homo sapiens
attatgtaatgcaa

SEQ ID NO: 4914663 - DNA, 17 bp, Homo sapiens
attatgtccactgtgta

SEQ ID NO: 4914664 - DNA, 16 bp, Homo sapiens
attatgtggttttaga

SEQ ID NO: 4914665 - DNA, 13 bp, Homo sapiens
attatgtgtgcat

SEQ ID NO: 4914666 - DNA, 18 bp, Homo sapiens
attattaactacatttat

SEQ ID NO: 4914667 - DNA, 19 bp, Homo sapiens
attattaactacatttatg

SEQ ID NO: 4914668 - DNA, 20 bp, Homo sapiens
attattaactacatttatga

SEQ ID NO: 4914669 - DNA, 15 bp, Homo sapiens
attattatttgtgtt

SEQ ID NO: 4914670 - DNA, 12 bp, Homo sapiens
attattcattta

SEQ ID NO: 4914671 - DNA, 14 bp, Homo sapiens
attattctctttta

SEQ ID NO: 4914672 - DNA, 12 bp, Homo sapiens
attattcttgta

SEQ ID NO: 4914673 - DNA, 13 bp, Homo sapiens
attattcttgtag

SEQ ID NO: 4914674 - DNA, 21 bp, Homo sapiens
attattgaaggaagccaaatt

SEQ ID NO: 4914675 - DNA, 12 bp, Homo sapiens
attattgcatta

SEQ ID NO: 4914676 - DNA, 18 bp, Homo sapiens
attattgctgttgcttga

SEQ ID NO: 4914677 - DNA, 19 bp, Homo sapiens
attattgctgttgcttgaa

SEQ ID NO: 4914678 - DNA, 15 bp, Homo sapiens
attattgcttattgc

SEQ ID NO: 4914679 - DNA, 23 bp, Homo sapiens
attattgtggtaggccttttaac

SEQ ID NO: 4914680 - DNA, 15 bp, Homo sapiens
attatttaataacat

SEQ ID NO: 4914681 - DNA, 18 bp, Homo sapiens
attatttaataacattac

SEQ ID NO: 4914682 - DNA, 12 bp, Homo sapiens
attatttataat

SEQ ID NO: 4914683 - DNA, 20 bp, Homo sapiens
attatttatttctggtaact

SEQ ID NO: 4914684 - DNA, 18 bp, Homo sapiens
attatttgtgtaatagaa

SEQ ID NO: 4914685 - DNA, 15 bp, Homo sapiens
attatttgtgtttta

SEQ ID NO: 4914686 - DNA, 13 bp, Homo sapiens
attattttaaaca

SEQ ID NO: 4914687 - DNA, 14 bp, Homo sapiens
attattttaaacaa

SEQ ID NO: 4914688 - DNA, 22 bp, Homo sapiens
attattttctgtcagatgagaa

SEQ ID NO: 4914689 - DNA, 14 bp, Homo sapiens
attattttcttcat

SEQ ID NO: 4914690 - DNA, 14 bp, Homo sapiens
attattttggggtc

SEQ ID NO: 4914691 - DNA, 17 bp, Homo sapiens
attattttggggtctct

SEQ ID NO: 4914692 - DNA, 21 bp, Homo sapiens
attattttggggtctcttttg

SEQ ID NO: 4914693 - DNA, 17 bp, Homo sapiens
attcaaaagttccaaga

SEQ ID NO: 4914694 - DNA, 22 bp, Homo sapiens
attcaaactggggcctccagaa

SEQ ID NO: 4914695 - DNA, 13 bp, Homo sapiens
attcaaaggttct

SEQ ID NO: 4914696 - DNA, 17 bp, Homo sapiens
attcaaaggttctaggt

SEQ ID NO: 4914697 - DNA, 14 bp, Homo sapiens
attcaaatgggtga

SEQ ID NO: 4914698 - DNA, 21 bp, Homo sapiens
attcaaccatggactttataa

SEQ ID NO: 4914699 - DNA, 14 bp, Homo sapiens
attcaagttattgt

SEQ ID NO: 4914700 - DNA, 21 bp, Homo sapiens
attcaatacaaacaatctctt

SEQ ID NO: 4914701 - DNA, 17 bp, Homo sapiens
attcaatattgacattt

SEQ ID NO: 4914702 - DNA, 19 bp, Homo sapiens
attcaatattgacatttgt

SEQ ID NO: 4914703 - DNA, 13 bp, Homo sapiens
attcacaaacttt

SEQ ID NO: 4914704 - DNA, 14 bp, Homo sapiens
attcacaaactttt

SEQ ID NO: 4914705 - DNA, 16 bp, Homo sapiens
attcacaataaaagct

SEQ ID NO: 4914706 - DNA, 14 bp, Homo sapiens
attcactgggccaa

SEQ ID NO: 4914707 - DNA, 13 bp, Homo sapiens
attcagaaattgg

SEQ ID NO: 4914708 - DNA, 14 bp, Homo sapiens
attcagagagcagc

SEQ ID NO: 4914709 - DNA, 17 bp, Homo sapiens
attcagattgttatcta

SEQ ID NO: 4914710 - DNA, 20 bp, Homo sapiens
attcagcttcatttgtgtca

SEQ ID NO: 4914711 - DNA, 11 bp, Homo sapiens
attcaggctgc

SEQ ID NO: 4914712 - DNA, 13 bp, Homo sapiens
attcaggtatgtt

SEQ ID NO: 4914713 - DNA, 18 bp, Homo sapiens
attcaggtgaaaatgttc

SEQ ID NO: 4914714 - DNA, 16 bp, Homo sapiens
attcagtcttgcctta

SEQ ID NO: 4914715 - DNA, 19 bp, Homo sapiens
attcagtggcgagaaataa

SEQ ID NO: 4914716 - DNA, 14 bp, Homo sapiens
attcagttttcatt

SEQ ID NO: 4914717 - DNA, 18 bp, Homo sapiens
attcatagtaacttctta

SEQ ID NO: 4914718 - DNA, 19 bp, Homo sapiens
attcatagtaacttcttat

SEQ ID NO: 4914719 - DNA, 20 bp, Homo sapiens
attcatctgtttttcttttt

SEQ ID NO: 4914720 - DNA, 22 bp, Homo sapiens
attcatggaccactgtttcttg

SEQ ID NO: 4914721 - DNA, 17 bp, Homo sapiens
attcatgttatatttaa

SEQ ID NO: 4914722 - DNA, 20 bp, Homo sapiens
attcatttcacattaatggt

SEQ ID NO: 4914723 - DNA, 21 bp, Homo sapiens
attccaaagctttattaccag

SEQ ID NO: 4914724 - DNA, 18 bp, Homo sapiens
attccaaagtctctaatt

SEQ ID NO: 4914725 - DNA, 19 bp, Homo sapiens
attccaaagtctctaattc

SEQ ID NO: 4914726 - DNA, 12 bp, Homo sapiens
attgatgtgttt

SEQ ID NO: 4914727 - DNA, 16 bp, Homo sapiens
attgatttgaagaaca

SEQ ID NO: 4914728 - DNA, 13 bp, Homo sapiens
attgatttgcatt

SEQ ID NO: 4914729 - DNA, 15 bp, Homo sapiens
attgcaaaatagcat

SEQ ID NO: 4914730 - DNA, 17 bp, Homo sapiens
attgcaaatcttgaaat

SEQ ID NO: 4914731 - DNA, 16 bp, Homo sapiens
attgcaacaggctggg

SEQ ID NO: 4914732 - DNA, 20 bp, Homo sapiens
attgcagctttatgttcatt

SEQ ID NO: 4914733 - DNA, 17 bp, Homo sapiens
attgcaggtggaactca

SEQ ID NO: 4914734 - DNA, 13 bp, Homo sapiens
attgcataaagca

SEQ ID NO: 4914735 - DNA, 22 bp, Homo sapiens
attgcatcacctctgtaatttt

SEQ ID NO: 4914736 - DNA, 13 bp, Homo sapiens
attgcattctatt

SEQ ID NO: 4914737 - DNA, 18 bp, Homo sapiens
attgcattctattgcctt

SEQ ID NO: 4914738 - DNA, 22 bp, Homo sapiens
attgcattctattgccttcttt

SEQ ID NO: 4914739 - DNA, 22 bp, Homo sapiens
attgcctgtgtatggaaaaacc

SEQ ID NO: 4914740 - DNA, 18 bp, Homo sapiens
attgcggacagccacggc

SEQ ID NO: 4914741 - DNA, 19 bp, Homo sapiens
attgcggacagccacggcc

SEQ ID NO: 4914742 - DNA, 21 bp, Homo sapiens
attgctaatcaccaaaggctc

SEQ ID NO: 4914743 - DNA, 13 bp, Homo sapiens
attgctagtattt

SEQ ID NO: 4914744 - DNA, 15 bp, Homo sapiens
attgctagtatttga

SEQ ID NO: 4914745 - DNA, 17 bp, Homo sapiens
attgctagtatttgaat

SEQ ID NO: 4914746 - DNA, 22 bp, Homo sapiens
attgctatctggaggccttcca

SEQ ID NO: 4914747 - DNA, 15 bp, Homo sapiens
attgctatgttacta

SEQ ID NO: 4914748 - DNA, 23 bp, Homo sapiens
attgctcaagttcattgatgacc

SEQ ID NO: 4914749 - DNA, 16 bp, Homo sapiens
attgctccctaagact

SEQ ID NO: 4914750 - DNA, 12 bp, Homo sapiens
attgctccttga

SEQ ID NO: 4914751 - DNA, 22 bp, Homo sapiens
attgctgaagggcattctttcc

SEQ ID NO: 4914752 - DNA, 14 bp, Homo sapiens
attgctgagcctct

SEQ ID NO: 4914753 - DNA, 15 bp, Homo sapiens
attgctgattttaat

SEQ ID NO: 4914754 - DNA, 17 bp, Homo sapiens
attgctgattttaatgg

SEQ ID NO: 4914755 - DNA, 23 bp, Homo sapiens
attgctgtcaagttcctttgggt

SEQ ID NO: 4914756 - DNA, 15 bp, Homo sapiens
attgctgttgcttga

SEQ ID NO: 4914757 - DNA, 15 bp, Homo sapiens
attgcttagtaaaat

SEQ ID NO: 4914758 - DNA, 16 bp, Homo sapiens
attgcttcctcctccc

SEQ ID NO: 4914759 - DNA, 18 bp, Homo sapiens
attgcttttattttgaaa

SEQ ID NO: 4914760 - DNA, 19 bp, Homo sapiens
attgcttttattttgaaaa

SEQ ID NO: 4914761 - DNA, 14 bp, Homo sapiens
attgcttttttaaa

SEQ ID NO: 4914762 - DNA, 17 bp, Homo sapiens
attgcttttttaaatat

SEQ ID NO: 4914763 - DNA, 21 bp, Homo sapiens
attggacagttgtctagagat

SEQ ID NO: 4914764 - DNA, 16 bp, Homo sapiens
attggacatagatatt

SEQ ID NO: 4914765 - DNA, 22 bp, Homo sapiens
attggacatagatattttcaca

SEQ ID NO: 4914766 - DNA, 13 bp, Homo sapiens
attggaccaggcc

SEQ ID NO: 4914767 - DNA, 21 bp, Homo sapiens
attggagcggtgggcactgtt

SEQ ID NO: 4914768 - DNA, 15 bp, Homo sapiens
attggaggaaagcaa

SEQ ID NO: 4914769 - DNA, 14 bp, Homo sapiens
attggattatttaa

SEQ ID NO: 4914770 - DNA, 17 bp, Homo sapiens
attggcttgtagaattg

SEQ ID NO: 4914771 - DNA, 16 bp, Homo sapiens
attggcttttcatgcg

SEQ ID NO: 4914772 - DNA, 23 bp, Homo sapiens
attgggttcatgatgcagtctcc

SEQ ID NO: 4914773 - DNA, 16 bp, Homo sapiens
attggtggctttcctt

SEQ ID NO: 4914774 - DNA, 18 bp, Homo sapiens
attggtgggattttttgt

SEQ ID NO: 4914775 - DNA, 18 bp, Homo sapiens
attggtgttgtcattgta

SEQ ID NO: 4914776 - DNA, 23 bp, Homo sapiens
attgtaaaaaaaaatgcctttga

SEQ ID NO: 4914777 - DNA, 21 bp, Homo sapiens
attgtaaaatagcttgtatag

SEQ ID NO: 4914778 - DNA, 15 bp, Homo sapiens
attgtaaacatgtgt

SEQ ID NO: 4914779 - DNA, 16 bp, Homo sapiens
attgtaaacatgtgtt

SEQ ID NO: 4914780 - DNA, 13 bp, Homo sapiens
atggaataaaagg

SEQ ID NO: 4914781 - DNA, 16 bp, Homo sapiens
atggaatgctgtgtta

SEQ ID NO: 4914782 - DNA, 21 bp, Homo sapiens
atggaatgctgtgttaaataa

SEQ ID NO: 4914783 - DNA, 14 bp, Homo sapiens
atggaattgatttg

SEQ ID NO: 4914784 - DNA, 20 bp, Homo sapiens
atggacaagaggtacagggt

SEQ ID NO: 4914785 - DNA, 11 bp, Homo sapiens
atggacactcc

SEQ ID NO: 4914786 - DNA, 15 bp, Homo sapiens
atggacactccagtg

SEQ ID NO: 4914787 - DNA, 17 bp, Homo sapiens
atggacactccagtgcc

SEQ ID NO: 4914788 - DNA, 22 bp, Homo sapiens
atggacagttcacaccctgcaa

SEQ ID NO: 4914789 - DNA, 13 bp, Homo sapiens
atggacatggtgg

SEQ ID NO: 4914790 - DNA, 18 bp, Homo sapiens
atggaccactgtttcttg

SEQ ID NO: 4914791 - DNA, 15 bp, Homo sapiens
atggactctgcacat

SEQ ID NO: 4914792 - DNA, 19 bp, Homo sapiens
atggacttatttcttcaaa

SEQ ID NO: 4914793 - DNA, 18 bp, Homo sapiens
atggagactgtctcaaga

SEQ ID NO: 4914794 - DNA, 11 bp, Homo sapiens
atggagccagc

SEQ ID NO: 4914795 - DNA, 15 bp, Homo sapiens
atggagccagctccc

SEQ ID NO: 4914796 - DNA, 18 bp, Homo sapiens
atggagccagctccctct

SEQ ID NO: 4914797 - DNA, 21 bp, Homo sapiens
atggagcctggcacaggactg

SEQ ID NO: 4914798 - DNA, 22 bp, Homo sapiens
atggaggaaaaccaagccgtgg

SEQ ID NO: 4914799 - DNA, 21 bp, Homo sapiens
atggagtagaggtactagaat

SEQ ID NO: 4914800 - DNA, 13 bp, Homo sapiens
atggagtttctaa

SEQ ID NO: 4914801 - DNA, 14 bp, Homo sapiens
atggagtttctaag

SEQ ID NO: 4914802 - DNA, 15 bp, Homo sapiens
atggagtttctaagg

SEQ ID NO: 4914803 - DNA, 18 bp, Homo sapiens
atggataacctatatgat

SEQ ID NO: 4914804 - DNA, 19 bp, Homo sapiens
atggataacctatatgatt

SEQ ID NO: 4914805 - DNA, 14 bp, Homo sapiens
atggatcccgaaga

SEQ ID NO: 4914806 - DNA, 18 bp, Homo sapiens
atggatgattcagaaatt

SEQ ID NO: 4914807 - DNA, 22 bp, Homo sapiens
atggatgcaaagtacaatgtgt

SEQ ID NO: 4914808 - DNA, 17 bp, Homo sapiens
atggatttgttacagcc

SEQ ID NO: 4914809 - DNA, 14 bp, Homo sapiens
atggcaaaaatggc

SEQ ID NO: 4914810 - DNA, 23 bp, Homo sapiens
atggcaagaaagctggtaaacta

SEQ ID NO: 4914811 - DNA, 19 bp, Homo sapiens
atggcaaggactgcaggga

SEQ ID NO: 4914812 - DNA, 23 bp, Homo sapiens
atggcaagttttgatatgagtat

SEQ ID NO: 4914813 - DNA, 16 bp, Homo sapiens
atggcagaagacacca

SEQ ID NO: 4914814 - DNA, 17 bp, Homo sapiens
atggcagaagacaccag

SEQ ID NO: 4914815 - DNA, 19 bp, Homo sapiens
atggcagaagacaccagag

SEQ ID NO: 4914816 - DNA, 20 bp, Homo sapiens
atggcagaagacaccagagc

SEQ ID NO: 4914817 - DNA, 23 bp, Homo sapiens
atggcagagtttgtgtgttgtct

SEQ ID NO: 4914818 - DNA, 14 bp, Homo sapiens
atggccacatttaa

SEQ ID NO: 4914819 - DNA, 15 bp, Homo sapiens
atggccacatttaat

SEQ ID NO: 4914820 - DNA, 22 bp, Homo sapiens
atggccaggtggccactccaga

SEQ ID NO: 4914821 - DNA, 21 bp, Homo sapiens
atggcccggatgctgcttccg

SEQ ID NO: 4914822 - DNA, 13 bp, Homo sapiens
atggcctcagctg

SEQ ID NO: 4914823 - DNA, 18 bp, Homo sapiens
atggcctcagctgcctca

SEQ ID NO: 4914824 - DNA, 22 bp, Homo sapiens
atgagtttgccctggtttcact

SEQ ID NO: 4914825 - DNA, 14 bp, Homo sapiens
atgataacagaact

SEQ ID NO: 4914826 - DNA, 19 bp, Homo sapiens
atgataatagattctcttg

SEQ ID NO: 4914827 - DNA, 17 bp, Homo sapiens
atgatacaagattagaa

SEQ ID NO: 4914828 - DNA, 21 bp, Homo sapiens
atgatcagcatctgtgatggg

SEQ ID NO: 4914829 - DNA, 22 bp, Homo sapiens
atgatccatgagtttgccctgg

SEQ ID NO: 4914830 - DNA, 18 bp, Homo sapiens
atgatctttgcagacagg

SEQ ID NO: 4914831 - DNA, 20 bp, Homo sapiens
atgatgaaaacctacatatt

SEQ ID NO: 4914832 - DNA, 12 bp, Homo sapiens
atgatgaatgag

SEQ ID NO: 4914833 - DNA, 20 bp, Homo sapiens
atgatgagccttcgtgcccc

SEQ ID NO: 4914834 - DNA, 21 bp, Homo sapiens
atgatgcagtctcctctttaa

SEQ ID NO: 4914835 - DNA, 13 bp, Homo sapiens
atgatgtaattga

SEQ ID NO: 4914836 - DNA, 23 bp, Homo sapiens
atgattctaatttttaagcaaaa

SEQ ID NO: 4914837 - DNA, 22 bp, Homo sapiens
atgattctatttatatgtacat

SEQ ID NO: 4914838 - DNA, 15 bp, Homo sapiens
atgattgtaaaatag

SEQ ID NO: 4914839 - DNA, 22 bp, Homo sapiens
atgatttaataaaataattcta

SEQ ID NO: 4914840 - DNA, 20 bp, Homo sapiens
atgatttcactagaaaagct

SEQ ID NO: 4914841 - DNA, 11 bp, Homo sapiens
atgatttttag

SEQ ID NO: 4914842 - DNA, 22 bp, Homo sapiens
atgatttttagatgagattgtt

SEQ ID NO: 4914843 - DNA, 23 bp, Homo sapiens
atgcaaaaggttcactaaagcag

SEQ ID NO: 4914844 - DNA, 11 bp, Homo sapiens
atgcaaaatgg

SEQ ID NO: 4914845 - DNA, 18 bp, Homo sapiens
atgcaaaatttttttaat

SEQ ID NO: 4914846 - DNA, 16 bp, Homo sapiens
atgcaaagtacaatgt

SEQ ID NO: 4914847 - DNA, 17 bp, Homo sapiens
atgcaaagtacaatgtg

SEQ ID NO: 4914848 - DNA, 21 bp, Homo sapiens
atgcaaagttctgtgtttaat

SEQ ID NO: 4914849 - DNA, 18 bp, Homo sapiens
atgcaagagtgattgcag

SEQ ID NO: 4914850 - DNA, 15 bp, Homo sapiens
atgcaaggaccagga

SEQ ID NO: 4914851 - DNA, 16 bp, Homo sapiens
atgcaattcatcccag

SEQ ID NO: 4914852 - DNA, 17 bp, Homo sapiens
atgcaatttcctttttt

SEQ ID NO: 4914853 - DNA, 16 bp, Homo sapiens
atgcacagagaagctg

SEQ ID NO: 4914854 - DNA, 17 bp, Homo sapiens
atgcacagagaagctgg

SEQ ID NO: 4914855 - DNA, 18 bp, Homo sapiens
atgcacagagaagctggg

SEQ ID NO: 4914856 - DNA, 15 bp, Homo sapiens
atgcacagatatact

SEQ ID NO: 4914857 - DNA, 22 bp, Homo sapiens
atgcacagatatactttgtgga

SEQ ID NO: 4914858 - DNA, 21 bp, Homo sapiens
atgcacatccattcccaagaa

SEQ ID NO: 4914859 - DNA, 14 bp, Homo sapiens
atgcaccagccctt

SEQ ID NO: 4914860 - DNA, 13 bp, Homo sapiens
atgcacggcctcg

SEQ ID NO: 4914861 - DNA, 23 bp, Homo sapiens
atgcactgacccttccagacata

SEQ ID NO: 4914862 - DNA, 14 bp, Homo sapiens
atgcagagagccat

SEQ ID NO: 4914863 - DNA, 20 bp, Homo sapiens
atgcagagagccattttgtg

SEQ ID NO: 4914864 - DNA, 16 bp, Homo sapiens
atgcagcaaggccctg

SEQ ID NO: 4914865 - DNA, 17 bp, Homo sapiens
atttaagcctcatattt

SEQ ID NO: 4914866 - DNA, 21 bp, Homo sapiens
atttaagtgcgtgtgtagagt

SEQ ID NO: 4914867 - DNA, 22 bp, Homo sapiens
atttaagtgcgtgtgtagagtt

SEQ ID NO: 4914868 - DNA, 19 bp, Homo sapiens
atttaagttcatattccat

SEQ ID NO: 4914869 - DNA, 20 bp, Homo sapiens
atttaagtttcaaacttact

SEQ ID NO: 4914870 - DNA, 22 bp, Homo sapiens
atttaataaaataattctaaag

SEQ ID NO: 4914871 - DNA, 15 bp, Homo sapiens
atttaataacattac

SEQ ID NO: 4914872 - DNA, 18 bp, Homo sapiens
atttaataacattacctt

SEQ ID NO: 4914873 - DNA, 15 bp, Homo sapiens
atttaatatcttcag

SEQ ID NO: 4914874 - DNA, 22 bp, Homo sapiens
atttaatgataagtaaatgcta

SEQ ID NO: 4914875 - DNA, 15 bp, Homo sapiens
atttaatgtgagttt

SEQ ID NO: 4914876 - DNA, 16 bp, Homo sapiens
atttaatgtgagtttg

SEQ ID NO: 4914877 - DNA, 12 bp, Homo sapiens
atttaattatta

SEQ ID NO: 4914878 - DNA, 18 bp, Homo sapiens
atttacagtccttcaaaa

SEQ ID NO: 4914879 - DNA, 13 bp, Homo sapiens
atttacctgcagg

SEQ ID NO: 4914880 - DNA, 21 bp, Homo sapiens
atttacctgcaggctgagcca

SEQ ID NO: 4914881 - DNA, 16 bp, Homo sapiens
atttactaaacatatg

SEQ ID NO: 4914882 - DNA, 15 bp, Homo sapiens
atttactaagccaca

SEQ ID NO: 4914883 - DNA, 22 bp, Homo sapiens
atttactaagccacaagaaatt

SEQ ID NO: 4914884 - DNA, 22 bp, Homo sapiens
atttagaaaatagagcttttaa

SEQ ID NO: 4914885 - DNA, 22 bp, Homo sapiens
atttagagatgctgtaacttaa

SEQ ID NO: 4914886 - DNA, 21 bp, Homo sapiens
atttaggagtgtgtgacattc

SEQ ID NO: 4914887 - DNA, 19 bp, Homo sapiens
atttagggtactaaattta

SEQ ID NO: 4914888 - DNA, 20 bp, Homo sapiens
atttagggtactaaatttaa

SEQ ID NO: 4914889 - DNA, 16 bp, Homo sapiens
atttagttatagtttc

SEQ ID NO: 4914890 - DNA, 15 bp, Homo sapiens
atttatacaagattg

SEQ ID NO: 4914891 - DNA, 22 bp, Homo sapiens
atttatacaagattgaaaatct

SEQ ID NO: 4914892 - DNA, 18 bp, Homo sapiens
atttatatatgaaaacta

SEQ ID NO: 4914893 - DNA, 22 bp, Homo sapiens
atttatatatgaaaactataca

SEQ ID NO: 4914894 - DNA, 20 bp, Homo sapiens
atttatatggggaatatatt

SEQ ID NO: 4914895 - DNA, 16 bp, Homo sapiens
atttatatgtactgtt

SEQ ID NO: 4914896 - DNA, 13 bp, Homo sapiens
atttatcaaagca

SEQ ID NO: 4914897 - DNA, 16 bp, Homo sapiens
atttatcacacttctg

SEQ ID NO: 4914898 - DNA, 13 bp, Homo sapiens
atttatcattctt

SEQ ID NO: 4914899 - DNA, 21 bp, Homo sapiens
atttatccacaggaaagtgtt

SEQ ID NO: 4914900 - DNA, 19 bp, Homo sapiens
atttatcctgaaatttcag

SEQ ID NO: 4914901 - DNA, 20 bp, Homo sapiens
atttatcctgaaatttcaga

SEQ ID NO: 4914902 - DNA, 19 bp, Homo sapiens
atttatctctatttaatat

SEQ ID NO: 4914903 - DNA, 16 bp, Homo sapiens
atttatctttcaaaga

SEQ ID NO: 4914904 - DNA, 20 bp, Homo sapiens
atttatgagtaactattatt

SEQ ID NO: 4914905 - DNA, 17 bp, Homo sapiens
atttatgatttaataaa

SEQ ID NO: 4914906 - DNA, 22 bp, Homo sapiens
atttatgccttgatgatttaat

SEQ ID NO: 4914907 - DNA, 18 bp, Homo sapiens
atttatgtaatgaagtaa

SEQ ID NO: 4914908 - DNA, 19 bp, Homo sapiens
atttatgtgtgaggagctg

SEQ ID NO: 4914909 - DNA, 22 bp, Homo sapiens
atttatgtgtgaggagctgctg

SEQ ID NO: 4914910 - DNA, 16 bp, Homo sapiens
atttatgttaaaagat

SEQ ID NO: 4914911 - DNA, 23 bp, Homo sapiens
atttattaaaatgattgtaaaat

SEQ ID NO: 4914912 - DNA, 12 bp, Homo sapiens
atttattaatat

SEQ ID NO: 4914913 - DNA, 15 bp, Homo sapiens
atttattaatattta

SEQ ID NO: 4914914 - DNA, 16 bp, Homo sapiens
atttattagttaatat

SEQ ID NO: 4914915 - DNA, 23 bp, Homo sapiens
atttattgattccttttttcaaa

SEQ ID NO: 4914916 - DNA, 22 bp, Homo sapiens
atttattgcagaggatgttcat

SEQ ID NO: 4914917 - DNA, 24 bp, Homo sapiens
atttattgcagaggatgttcataa

SEQ ID NO: 4914918 - DNA, 15 bp, Homo sapiens
atttatttaaagcat

SEQ ID NO: 4914919 - DNA, 13 bp, Homo sapiens
atttatttaataa

SEQ ID NO: 4914920 - DNA, 18 bp, Homo sapiens
atgtactagtgttctgtt

SEQ ID NO: 4914921 - DNA, 22 bp, Homo sapiens
atgtactagtgttctgtttgtt

SEQ ID NO: 4914922 - DNA, 11 bp, Homo sapiens
atgtactgtac

SEQ ID NO: 4914923 - DNA, 14 bp, Homo sapiens
atgtactgtactaa

SEQ ID NO: 4914924 - DNA, 19 bp, Homo sapiens
atgtacttgtttctctgtt

SEQ ID NO: 4914925 - DNA, 16 bp, Homo sapiens
atgtagactatataca

SEQ ID NO: 4914926 - DNA, 15 bp, Homo sapiens
atgtagatatttggc

SEQ ID NO: 4914927 - DNA, 22 bp, Homo sapiens
atgtagattaaggtgatgtgat

SEQ ID NO: 4914928 - DNA, 20 bp, Homo sapiens
atgtagatttgtacaggagt

SEQ ID NO: 4914929 - DNA, 16 bp, Homo sapiens
atgtagcacataaact

SEQ ID NO: 4914930 - DNA, 19 bp, Homo sapiens
atgtagccccctggcctct

SEQ ID NO: 4914931 - DNA, 16 bp, Homo sapiens
atgtagtaattgacat

SEQ ID NO: 4914932 - DNA, 17 bp, Homo sapiens
atgtagtaattgacatg

SEQ ID NO: 4914933 - DNA, 18 bp, Homo sapiens
atgtagtaattgacatgt

SEQ ID NO: 4914934 - DNA, 17 bp, Homo sapiens
atgtagtataaagaaaa

SEQ ID NO: 4914935 - DNA, 18 bp, Homo sapiens
atgtagttgatgtatcca

SEQ ID NO: 4914936 - DNA, 22 bp, Homo sapiens
atgtataaagcaactgttatga

SEQ ID NO: 4914937 - DNA, 18 bp, Homo sapiens
atgtatatacacatatac

SEQ ID NO: 4914938 - DNA, 18 bp, Homo sapiens
atgtatatttttttaatt

SEQ ID NO: 4914939 - DNA, 20 bp, Homo sapiens
atgtatatttttttaattta

SEQ ID NO: 4914940 - DNA, 16 bp, Homo sapiens
atgtatctatttatta

SEQ ID NO: 4914941 - DNA, 14 bp, Homo sapiens
atgtatctgagttg

SEQ ID NO: 4914942 - DNA, 17 bp, Homo sapiens
atgtatctgagttgcca

SEQ ID NO: 4914943 - DNA, 14 bp, Homo sapiens
atgtatctgtgaag

SEQ ID NO: 4914944 - DNA, 20 bp, Homo sapiens
atgtattctagctaatgtaa

SEQ ID NO: 4914945 - DNA, 11 bp, Homo sapiens
atgtattgtaa

SEQ ID NO: 4914946 - DNA, 12 bp, Homo sapiens
atgtatttgttc

SEQ ID NO: 4914947 - DNA, 14 bp, Homo sapiens
atgtatttgttcat

SEQ ID NO: 4914948 - DNA, 15 bp, Homo sapiens
atgtcaagaggctga

SEQ ID NO: 4914949 - DNA, 15 bp, Homo sapiens
atgtcacaggcaggt

SEQ ID NO: 4914950 - DNA, 19 bp, Homo sapiens
atgtcacaggcaggtccag

SEQ ID NO: 4914951 - DNA, 13 bp, Homo sapiens
atgtcacagggcc

SEQ ID NO: 4914952 - DNA, 14 bp, Homo sapiens
atgtcacagggcca

SEQ ID NO: 4914953 - DNA, 19 bp, Homo sapiens
atgtcacgtactgtctgat

SEQ ID NO: 4914954 - DNA, 20 bp, Homo sapiens
atgtcacgtactgtctgatt

SEQ ID NO: 4914955 - DNA, 21 bp, Homo sapiens
atgtcacgtactgtctgattg

SEQ ID NO: 4914956 - DNA, 22 bp, Homo sapiens
atgtcactagaatggataaaat

SEQ ID NO: 4914957 - DNA, 19 bp, Homo sapiens
atgtcaggaacagaaggat

SEQ ID NO: 4914958 - DNA, 12 bp, Homo sapiens
atgtcaggcctg

SEQ ID NO: 4914959 - DNA, 19 bp, Homo sapiens
atgtcaggtcagccaactg

SEQ ID NO: 4914960 - DNA, 16 bp, Homo sapiens
atgtcagtatttcagt

SEQ ID NO: 4914961 - DNA, 13 bp, Homo sapiens
atgtcattaaatg

SEQ ID NO: 4914962 - DNA, 21 bp, Homo sapiens
atgtccaaagaggctgcccct

SEQ ID NO: 4914963 - DNA, 22 bp, Homo sapiens
atgtccaaagaggctgcccctc

SEQ ID NO: 4914964 - DNA, 19 bp, Homo sapiens
atgtccatttatatcattt

SEQ ID NO: 4914965 - DNA, 21 bp, Homo sapiens
atgtcccttgatgcacagaga

SEQ ID NO: 4914966 - DNA, 20 bp, Homo sapiens
caaaactccgcccccagcct

SEQ ID NO: 4914967 - DNA, 21 bp, Homo sapiens
caaaactccgcccccagccta

SEQ ID NO: 4914968 - DNA, 13 bp, Homo sapiens
caaaacttaacat

SEQ ID NO: 4914969 - DNA, 15 bp, Homo sapiens
caaaacttcttgtca

SEQ ID NO: 4914970 - DNA, 17 bp, Homo sapiens
caaaacttcttgtcaga

SEQ ID NO: 4914971 - DNA, 20 bp, Homo sapiens
caaaacttcttgtcagacat

SEQ ID NO: 4914972 - DNA, 20 bp, Homo sapiens
caaaacttggtatttttcag

SEQ ID NO: 4914973 - DNA, 19 bp, Homo sapiens
caaaagaacaagaatttct

SEQ ID NO: 4914974 - DNA, 16 bp, Homo sapiens
caaaagacatgttgta

SEQ ID NO: 4914975 - DNA, 21 bp, Homo sapiens
caaaagacatgttgtaaatta

SEQ ID NO: 4914976 - DNA, 19 bp, Homo sapiens
caaaagagaaaaaaaatta

SEQ ID NO: 4914977 - DNA, 21 bp, Homo sapiens
caaaagcatttatcattcttg

SEQ ID NO: 4914978 - DNA, 13 bp, Homo sapiens
caaaagccttgtg

SEQ ID NO: 4914979 - DNA, 23 bp, Homo sapiens
caaaagccttgtgtatatttgta

SEQ ID NO: 4914980 - DNA, 14 bp, Homo sapiens
caaaaggaaaaagc

SEQ ID NO: 4914981 - DNA, 11 bp, Homo sapiens
caaaagggtca

SEQ ID NO: 4914982 - DNA, 13 bp, Homo sapiens
caaaagggtcaga

SEQ ID NO: 4914983 - DNA, 19 bp, Homo sapiens
caaaaggttcactaaagca

SEQ ID NO: 4914984 - DNA, 22 bp, Homo sapiens
caaaataaaaagtgacacagca

SEQ ID NO: 4914985 - DNA, 14 bp, Homo sapiens
caaaataaatgttg

SEQ ID NO: 4914986 - DNA, 11 bp, Homo sapiens
caaaataattc

SEQ ID NO: 4914987 - DNA, 16 bp, Homo sapiens
caaaatagcatttgtt

SEQ ID NO: 4914988 - DNA, 17 bp, Homo sapiens
caaaatatttgtacata

SEQ ID NO: 4914989 - DNA, 16 bp, Homo sapiens
caaaatcattttaatg

SEQ ID NO: 4914990 - DNA, 19 bp, Homo sapiens
caaaatccttccaaagaat

SEQ ID NO: 4914991 - DNA, 20 bp, Homo sapiens
caaaatccttgcttatgaca

SEQ ID NO: 4914992 - DNA, 13 bp, Homo sapiens
caaaatctgtcca

SEQ ID NO: 4914993 - DNA, 18 bp, Homo sapiens
caaaatgacatcttttta

SEQ ID NO: 4914994 - DNA, 18 bp, Homo sapiens
caaaatgctttttatttc

SEQ ID NO: 4914995 - DNA, 20 bp, Homo sapiens
caaaatgctttttatttctg

SEQ ID NO: 4914996 - DNA, 14 bp, Homo sapiens
caaaatggaacgct

SEQ ID NO: 4914997 - DNA, 12 bp, Homo sapiens
caaaatgtatat

SEQ ID NO: 4914998 - DNA, 21 bp, Homo sapiens
caaaatgttatcttctcaagt

SEQ ID NO: 4914999 - DNA, 16 bp, Homo sapiens
caaaattgatgtgttt

SEQ ID NO: 4915000 - DNA, 16 bp, Homo sapiens
caaaattgcaaatctt

SEQ ID NO: 4915001 - DNA, 17 bp, Homo sapiens
caaaattgcaaatcttg

SEQ ID NO: 4915002 - DNA, 22 bp, Homo sapiens
caaaattgcaaatcttgaaatt

SEQ ID NO: 4915003 - DNA, 20 bp, Homo sapiens
caaaattttagtccaaataa

SEQ ID NO: 4915004 - DNA, 19 bp, Homo sapiens
caaaattttattttgtgct

SEQ ID NO: 4915005 - DNA, 22 bp, Homo sapiens
caaaattttctcattttctttt

SEQ ID NO: 4915006 - DNA, 14 bp, Homo sapiens
caaacaaatatgca

SEQ ID NO: 4915007 - DNA, 20 bp, Homo sapiens
caaacaccttcttattatat

SEQ ID NO: 4915008 - DNA, 20 bp, Homo sapiens
caaacaggatcagttaacta

SEQ ID NO: 4915009 - DNA, 21 bp, Homo sapiens
caaacatcactctgctgctta

SEQ ID NO: 4915010 - DNA, 14 bp, Homo sapiens
caaaccacaactga

SEQ ID NO: 4915011 - DNA, 21 bp, Homo sapiens
caaaccatttttaaagtagaa

SEQ ID NO: 4915012 - DNA, 13 bp, Homo sapiens
caaacccatgagg

SEQ ID NO: 4915013 - DNA, 14 bp, Homo sapiens
catagttttaaact

SEQ ID NO: 4915014 - DNA, 14 bp, Homo sapiens
catataagtttgaa

SEQ ID NO: 4915015 - DNA, 21 bp, Homo sapiens
catataagtttgaaggaaaca

SEQ ID NO: 4915016 - DNA, 23 bp, Homo sapiens
catataagtttgaaggaaacagt

SEQ ID NO: 4915017 - DNA, 20 bp, Homo sapiens
catatagagatgaagtttgt

SEQ ID NO: 4915018 - DNA, 19 bp, Homo sapiens
catatagccattgatcata

SEQ ID NO: 4915019 - DNA, 19 bp, Homo sapiens
catataggtgatgtttgct

SEQ ID NO: 4915020 - DNA, 19 bp, Homo sapiens
catatataacagatacatt

SEQ ID NO: 4915021 - DNA, 20 bp, Homo sapiens
catatataacagatacattt

SEQ ID NO: 4915022 - DNA, 16 bp, Homo sapiens
catatatacaggcata

SEQ ID NO: 4915023 - DNA, 22 bp, Homo sapiens
catatcgctgacttcatggaat

SEQ ID NO: 4915024 - DNA, 13 bp, Homo sapiens
catatctctaatt

SEQ ID NO: 4915025 - DNA, 18 bp, Homo sapiens
caagaaaacaacttcaat

SEQ ID NO: 4915026 - DNA, 16 bp, Homo sapiens
caagaaagctggtaaa

SEQ ID NO: 4915027 - DNA, 13 bp, Homo sapiens
caagaagaaaaag

SEQ ID NO: 4915028 - DNA, 16 bp, Homo sapiens
caagaagtagcagtgt

SEQ ID NO: 4915029 - DNA, 12 bp, Homo sapiens
caagaataaaaa

SEQ ID NO: 4915030 - DNA, 23 bp, Homo sapiens
caagaataattcaattttaaaga

SEQ ID NO: 4915031 - DNA, 18 bp, Homo sapiens
caagaatccacatttcta

SEQ ID NO: 4915032 - DNA, 19 bp, Homo sapiens
caagaatccacatttctaa

SEQ ID NO: 4915033 - DNA, 21 bp, Homo sapiens
caagaatccacatttctaaaa

SEQ ID NO: 4915034 - DNA, 22 bp, Homo sapiens
caagaatccacatttctaaaat

SEQ ID NO: 4915035 - DNA, 22 bp, Homo sapiens
caagaatttcttggtaagaagc

SEQ ID NO: 4915036 - DNA, 23 bp, Homo sapiens
caagaatttcttggtaagaagcc

SEQ ID NO: 4915037 - DNA, 14 bp, Homo sapiens
caagacaaaccaag

SEQ ID NO: 4915038 - DNA, 13 bp, Homo sapiens
caagacaaatcaa

SEQ ID NO: 4915039 - DNA, 15 bp, Homo sapiens
caagacaaatcaaca

SEQ ID NO: 4915040 - DNA, 20 bp, Homo sapiens
caagacaaatcaacagaagc

SEQ ID NO: 4915041 - DNA, 17 bp, Homo sapiens
caagactctagagtcca

SEQ ID NO: 4915042 - DNA, 15 bp, Homo sapiens
caagacttggcaaca

SEQ ID NO: 4915043 - DNA, 13 bp, Homo sapiens
caagagaggatga

SEQ ID NO: 4915044 - DNA, 20 bp, Homo sapiens
caagagagggccatgcaatt

SEQ ID NO: 4915045 - DNA, 17 bp, Homo sapiens
caagagcagcctgtggc

SEQ ID NO: 4915046 - DNA, 18 bp, Homo sapiens
caagagcagcctgtggca

SEQ ID NO: 4915047 - DNA, 14 bp, Homo sapiens
caagagcctgatct

SEQ ID NO: 4915048 - DNA, 19 bp, Homo sapiens
caagagcctgatctcttcc

SEQ ID NO: 4915049 - DNA, 22 bp, Homo sapiens
caagagcctgatctcttcctgt

SEQ ID NO: 4915050 - DNA, 23 bp, Homo sapiens
caagagcctgatctcttcctgtt

SEQ ID NO: 4915051 - DNA, 16 bp, Homo sapiens
caagagctgccctcct

SEQ ID NO: 4915052 - DNA, 18 bp, Homo sapiens
caagagctgccctccttg

SEQ ID NO: 4915053 - DNA, 16 bp, Homo sapiens
caagagggaatccccg

SEQ ID NO: 4915054 - DNA, 22 bp, Homo sapiens
caagagggtcctttagtacctg

SEQ ID NO: 4915055 - DNA, 15 bp, Homo sapiens
caagaggtgggaggg

SEQ ID NO: 4915056 - DNA, 15 bp, Homo sapiens
caagagtctaaagat

SEQ ID NO: 4915057 - DNA, 15 bp, Homo sapiens
caagatattgtacat

SEQ ID NO: 4915058 - DNA, 17 bp, Homo sapiens
caagatattgtacataa

SEQ ID NO: 4915059 - DNA, 21 bp, Homo sapiens
caagatattgtacataaaaga

SEQ ID NO: 4915060 - DNA, 19 bp, Homo sapiens
caagatcctgtctttaagg

SEQ ID NO: 4915061 - DNA, 17 bp, Homo sapiens
caagatgactggggtgg

SEQ ID NO: 4915062 - DNA, 21 bp, Homo sapiens
caagatgagattggcatggct

SEQ ID NO: 4915063 - DNA, 18 bp, Homo sapiens
caagatgccatctgtgtc

SEQ ID NO: 4915064 - DNA, 16 bp, Homo sapiens
caagatggaaaggatt

SEQ ID NO: 4915065 - DNA, 10 bp, Homo sapiens
caagattccg

SEQ ID NO: 4915066 - DNA, 22 bp, Homo sapiens
caagattccggatcctaagcat

SEQ ID NO: 4915067 - DNA, 13 bp, Homo sapiens
caagattctagat

SEQ ID NO: 4915068 - DNA, 19 bp, Homo sapiens
caggtgtgaaccaccacac

SEQ ID NO: 4915069 - DNA, 23 bp, Homo sapiens
caggtgtgagtcaccaagcccag

SEQ ID NO: 4915070 - DNA, 21 bp, Homo sapiens
caggtgtgtccacctgggcat

SEQ ID NO: 4915071 - DNA, 17 bp, Homo sapiens
caggtgttaacattcca

SEQ ID NO: 4915072 - DNA, 20 bp, Homo sapiens
caggtgttaacattccaaga

SEQ ID NO: 4915073 - DNA, 22 bp, Homo sapiens
caggtgttactgtaattcctca

SEQ ID NO: 4915074 - DNA, 16 bp, Homo sapiens
caggttcagtattatg

SEQ ID NO: 4915075 - DNA, 20 bp, Homo sapiens
caggttggaagagaatcacc

SEQ ID NO: 4915076 - DNA, 16 bp, Homo sapiens
caggtttaacatttgc

SEQ ID NO: 4915077 - DNA, 17 bp, Homo sapiens
caggtttgtcatcagat

SEQ ID NO: 4915078 - DNA, 14 bp, Homo sapiens
cagtaaataacagg

SEQ ID NO: 4915079 - DNA, 17 bp, Homo sapiens
cagtaactttatgtgta

SEQ ID NO: 4915080 - DNA, 16 bp, Homo sapiens
cagtaccctctcagct

SEQ ID NO: 4915081 - DNA, 20 bp, Homo sapiens
cagtaccctctcagctccag

SEQ ID NO: 4915082 - DNA, 24 bp, Homo sapiens
cagtaccctctcagctccaggtgg

SEQ ID NO: 4915083 - DNA, 22 bp, Homo sapiens
cagtacttgtgaaacacagctg

SEQ ID NO: 4915084 - DNA, 12 bp, Homo sapiens
cagtagagccag

SEQ ID NO: 4915085 - DNA, 14 bp, Homo sapiens
cagtagagccagct

SEQ ID NO: 4915086 - DNA, 17 bp, Homo sapiens
cagtagagccagcttgg

SEQ ID NO: 4915087 - DNA, 23 bp, Homo sapiens
cagtagaggctatggacagggca

SEQ ID NO: 4915088 - DNA, 16 bp, Homo sapiens
cagtatccactttgca

SEQ ID NO: 4915089 - DNA, 15 bp, Homo sapiens
cagtatcccacatcc

SEQ ID NO: 4915090 - DNA, 16 bp, Homo sapiens
cagtatctatatatgt

SEQ ID NO: 4915091 - DNA, 15 bp, Homo sapiens
cagtatgtattcttt

SEQ ID NO: 4915092 - DNA, 19 bp, Homo sapiens
cagtattaatactaaaata

SEQ ID NO: 4915093 - DNA, 18 bp, Homo sapiens
cagtattacttctgctac

SEQ ID NO: 4915094 - DNA, 13 bp, Homo sapiens
cagtattcttgtc

SEQ ID NO: 4915095 - DNA, 17 bp, Homo sapiens
cagtattttggagaaat

SEQ ID NO: 4915096 - DNA, 18 bp, Homo sapiens
cagtattttggagaaatt

SEQ ID NO: 4915097 - DNA, 15 bp, Homo sapiens
cagtcaaaataattc

SEQ ID NO: 4915098 - DNA, 18 bp, Homo sapiens
cagtcactgccactttgc

SEQ ID NO: 4915099 - DNA, 22 bp, Homo sapiens
cagtcactgccactttgcacat

SEQ ID NO: 4915100 - DNA, 17 bp, Homo sapiens
cagtcatcatcagggcc

SEQ ID NO: 4915101 - DNA, 18 bp, Homo sapiens
cagtcatcatcagggcct

SEQ ID NO: 4915102 - DNA, 14 bp, Homo sapiens
cagtcatgcataaa

SEQ ID NO: 4915103 - DNA, 19 bp, Homo sapiens
cagtcatgcataaatatgc

SEQ ID NO: 4915104 - DNA, 17 bp, Homo sapiens
cagtccaaatgtcctcc

SEQ ID NO: 4915105 - DNA, 17 bp, Homo sapiens
cagtccatttatatatg

SEQ ID NO: 4915106 - DNA, 16 bp, Homo sapiens
cagtcccaatgcacat

SEQ ID NO: 4915107 - DNA, 15 bp, Homo sapiens
cagtcccactgtgca

SEQ ID NO: 4915108 - DNA, 22 bp, Homo sapiens
cagtccccctatccttggcacc

SEQ ID NO: 4915109 - DNA, 20 bp, Homo sapiens
cagtccgtgtggatccaatg

SEQ ID NO: 4915110 - DNA, 20 bp, Homo sapiens
cagtcctcccctcacagcct

SEQ ID NO: 4915111 - DNA, 21 bp, Homo sapiens
cagtcctcccctcacagcctc

SEQ ID NO: 4915112 - DNA, 23 bp, Homo sapiens
cagtcctcccctcacagcctctg

SEQ ID NO: 4915113 - DNA, 21 bp, Homo sapiens
cagtcctctcccaagtccaca

SEQ ID NO: 4915114 - DNA, 17 bp, Homo sapiens
cagtcctgcctcagcct

SEQ ID NO: 4915115 - DNA, 12 bp, Homo sapiens
cagtcctgcctg

SEQ ID NO: 4915116 - DNA, 21 bp, Homo sapiens
cagtcctgcctggccaggcag

SEQ ID NO: 4915117 - DNA, 16 bp, Homo sapiens
cagtcctgctccagaa

SEQ ID NO: 4915118 - DNA, 17 bp, Homo sapiens
cagtcctgtagttttat

SEQ ID NO: 4915119 - DNA, 14 bp, Homo sapiens
cagtcctttgtaaa

SEQ ID NO: 4915120 - DNA, 19 bp, Homo sapiens
cagtctagttgccaaatct

SEQ ID NO: 4915121 - DNA, 12 bp, Homo sapiens
cagtctcctctt

SEQ ID NO: 4915122 - DNA, 15 bp, Homo sapiens
cagtctcctctttaa

SEQ ID NO: 4915123 - DNA, 18 bp, Homo sapiens
cagtctctcttaaagttg

SEQ ID NO: 4915124 - DNA, 16 bp, Homo sapiens
cagtctgaatgctgcc

SEQ ID NO: 4915125 - DNA, 17 bp, Homo sapiens
cagtctggaatgcagtg

SEQ ID NO: 4915126 - DNA, 22 bp, Homo sapiens
cagtcttgaatttctaaaaaac

SEQ ID NO: 4915127 - DNA, 13 bp, Homo sapiens
cagtcttgtgctt

SEQ ID NO: 4915128 - DNA, 17 bp, Homo sapiens
cagtctttaaaggccca

SEQ ID NO: 4915129 - DNA, 14 bp, Homo sapiens
cagtctttttctgt

SEQ ID NO: 4915130 - DNA, 19 bp, Homo sapiens
cagtctttttctgttgtaa

SEQ ID NO: 4915131 - DNA, 12 bp, Homo sapiens
cagtgagcctga

SEQ ID NO: 4915132 - DNA, 15 bp, Homo sapiens
cagtgatatggcaga

SEQ ID NO: 4915133 - DNA, 23 bp, Homo sapiens
cagtgatatggcagaagacacca

SEQ ID NO: 4915134 - DNA, 17 bp, Homo sapiens
cagtgatgggagagtag

SEQ ID NO: 4915135 - DNA, 23 bp, Homo sapiens
cagtgatgtaccatgaaacaaag

SEQ ID NO: 4915136 - DNA, 20 bp, Homo sapiens
cagtgcagggcaaaatattc

SEQ ID NO: 4915137 - DNA, 16 bp, Homo sapiens
cagtgcatctcagccc

SEQ ID NO: 4915138 - DNA, 18 bp, Homo sapiens
cagtgcatctcagcccac

SEQ ID NO: 4915139 - DNA, 12 bp, Homo sapiens
cagtgccaagga

SEQ ID NO: 4915140 - DNA, 17 bp, Homo sapiens
cagtgccagcaatgaca

SEQ ID NO: 4915141 - DNA, 13 bp, Homo sapiens
cagtgcccacagg

SEQ ID NO: 4915142 - DNA, 21 bp, Homo sapiens
cagtgcccacaggatcagtct

SEQ ID NO: 4915143 - DNA, 17 bp, Homo sapiens
cagtgccctcattttat

SEQ ID NO: 4915144 - DNA, 19 bp, Homo sapiens
cagtgccctcattttatgt

SEQ ID NO: 4915145 - DNA, 21 bp, Homo sapiens
cagtgctagtgagctgggcat

SEQ ID NO: 4915146 - DNA, 16 bp, Homo sapiens
cagtgctttaatggca

SEQ ID NO: 4915147 - DNA, 17 bp, Homo sapiens
cagtggattgtttatac

SEQ ID NO: 4915148 - DNA, 16 bp, Homo sapiens
cagtggcagctgcttt

SEQ ID NO: 4915149 - DNA, 19 bp, Homo sapiens
cagtggcttcatctgtcaa

SEQ ID NO: 4915150 - DNA, 16 bp, Homo sapiens
cagtgggacagggcat

SEQ ID NO: 4915151 - DNA, 15 bp, Homo sapiens
cagtggggcctgtgg

SEQ ID NO: 4915152 - DNA, 20 bp, Homo sapiens
cagtggtatgatcacggctc

SEQ ID NO: 4915153 - DNA, 20 bp, Homo sapiens
cagtggtgcgatctgggttc

SEQ ID NO: 4915154 - DNA, 21 bp, Homo sapiens
cagtggtgcgatctgggttca

SEQ ID NO: 4915155 - DNA, 20 bp, Homo sapiens
cagtgtacatagtgtaatgt

SEQ ID NO: 4915156 - DNA, 21 bp, Homo sapiens
cagtgtagttaatttatctaa

SEQ ID NO: 4915157 - DNA, 17 bp, Homo sapiens
cagtgtatggaaataaa

SEQ ID NO: 4915158 - DNA, 17 bp, Homo sapiens
cagtgtcccctccactg

SEQ ID NO: 4915159 - DNA, 23 bp, Homo sapiens
cagtgtgtctaaatttgaatgtt

SEQ ID NO: 4915160 - DNA, 15 bp, Homo sapiens
cagtgttaaatgaaa

SEQ ID NO: 4915161 - DNA, 16 bp, Homo sapiens
cagtgttaaatgaaat

SEQ ID NO: 4915162 - DNA, 13 bp, Homo sapiens
catgggcctggcc

SEQ ID NO: 4915163 - DNA, 12 bp, Homo sapiens
catgggcttcac

SEQ ID NO: 4915164 - DNA, 14 bp, Homo sapiens
catgggcttcactg

SEQ ID NO: 4915165 - DNA, 15 bp, Homo sapiens
catgggcttcactgt

SEQ ID NO: 4915166 - DNA, 18 bp, Homo sapiens
catggggaaaaaaatcat

SEQ ID NO: 4915167 - DNA, 20 bp, Homo sapiens
catggggaaaaaaatcatct

SEQ ID NO: 4915168 - DNA, 15 bp, Homo sapiens
catgggttatgtgta

SEQ ID NO: 4915169 - DNA, 15 bp, Homo sapiens
catggtaccagccct

SEQ ID NO: 4915170 - DNA, 18 bp, Homo sapiens
ccaaaagttttcctgaga

SEQ ID NO: 4915171 - DNA, 12 bp, Homo sapiens
ccaaacatgtat

SEQ ID NO: 4915172 - DNA, 18 bp, Homo sapiens
ccaaacatgtatttatgt

SEQ ID NO: 4915173 - DNA, 13 bp, Homo sapiens
ccaaaccctaggt

SEQ ID NO: 4915174 - DNA, 14 bp, Homo sapiens
ccaaaccctgtctg

SEQ ID NO: 4915175 - DNA, 13 bp, Homo sapiens
ccaaacctcaagt

SEQ ID NO: 4915176 - DNA, 24 bp, Homo sapiens
ccaaactgctggacgtctttcttt

SEQ ID NO: 4915177 - DNA, 16 bp, Homo sapiens
ccaaactgttcaagaa

SEQ ID NO: 4915178 - DNA, 20 bp, Homo sapiens
ccaaagagcacaaacatttt

SEQ ID NO: 4915179 - DNA, 13 bp, Homo sapiens
ccaaagaggctgc

SEQ ID NO: 4915180 - DNA, 17 bp, Homo sapiens
ccaaagaggctgcccct

SEQ ID NO: 4915181 - DNA, 20 bp, Homo sapiens
ccaaagaggctgcccctctc

SEQ ID NO: 4915182 - DNA, 22 bp, Homo sapiens
ccaaagaggctgcccctctcac

SEQ ID NO: 4915183 - DNA, 22 bp, Homo sapiens
ccaaagagtagaattgcattga

SEQ ID NO: 4915184 - DNA, 23 bp, Homo sapiens
ccaaagatgcagccgccttcctt

SEQ ID NO: 4915185 - DNA, 14 bp, Homo sapiens
ccaaagcatggact

SEQ ID NO: 4915186 - DNA, 19 bp, Homo sapiens
ccaaagccaaagctaggcc

SEQ ID NO: 4915187 - DNA, 17 bp, Homo sapiens
ccaaagctaggcctggc

SEQ ID NO: 4915188 - DNA, 19 bp, Homo sapiens
ccaaagctagggtggccct

SEQ ID NO: 4915189 - DNA, 13 bp, Homo sapiens
ccaaagctgccca

SEQ ID NO: 4915190 - DNA, 20 bp, Homo sapiens
ccaaagctgcccactgtttc

SEQ ID NO: 4915191 - DNA, 21 bp, Homo sapiens
ccaaagctgcccactgtttct

SEQ ID NO: 4915192 - DNA, 12 bp, Homo sapiens
ccaaagctttat

SEQ ID NO: 4915193 - DNA, 15 bp, Homo sapiens
ccaaaggaggctggc

SEQ ID NO: 4915194 - DNA, 12 bp, Homo sapiens
ccaaaggctggt

SEQ ID NO: 4915195 - DNA, 21 bp, Homo sapiens
ccaaagggagagttccagagg

SEQ ID NO: 4915196 - DNA, 17 bp, Homo sapiens
ccaaaggggacaggcct

SEQ ID NO: 4915197 - DNA, 23 bp, Homo sapiens
ccaaaggggacaggcctcacctc

SEQ ID NO: 4915198 - DNA, 16 bp, Homo sapiens
ccaaagtctcccttct

SEQ ID NO: 4915199 - DNA, 13 bp, Homo sapiens
ccaaataataaag

SEQ ID NO: 4915200 - DNA, 18 bp, Homo sapiens
ccaaatatagcgttccca

SEQ ID NO: 4915201 - DNA, 20 bp, Homo sapiens
ccaaatcaataagaaggtag

SEQ ID NO: 4915202 - DNA, 15 bp, Homo sapiens
ccaaatccgctctct

SEQ ID NO: 4915203 - DNA, 16 bp, Homo sapiens
ccaaatccgctctctt

SEQ ID NO: 4915204 - DNA, 22 bp, Homo sapiens
ccaaatctcaatgaagccagct

SEQ ID NO: 4915205 - DNA, 11 bp, Homo sapiens
ccaaattattt

SEQ ID NO: 4915206 - DNA, 22 bp, Homo sapiens
ccaaattgctcctaagcttcaa

SEQ ID NO: 4915207 - DNA, 21 bp, Homo sapiens
ccaaattgtgcttctccccag

SEQ ID NO: 4915208 - DNA, 12 bp, Homo sapiens
ccaacaaaccat

SEQ ID NO: 4915209 - DNA, 17 bp, Homo sapiens
ccaacaacatccatgtc

SEQ ID NO: 4915210 - DNA, 16 bp, Homo sapiens
ccaacaccacagacac

SEQ ID NO: 4915211 - DNA, 17 bp, Homo sapiens
ccaacaccacagacaca

SEQ ID NO: 4915212 - DNA, 21 bp, Homo sapiens
ccaacaccacagacacacaca

SEQ ID NO: 4915213 - DNA, 18 bp, Homo sapiens
ccaacagaactaaatgtt

SEQ ID NO: 4915214 - DNA, 12 bp, Homo sapiens
ccaacagccatg

SEQ ID NO: 4915215 - DNA, 13 bp, Homo sapiens
ccaacagccatgc

SEQ ID NO: 4915216 - DNA, 20 bp, Homo sapiens
ccaacagtgagtctgtcagc

SEQ ID NO: 4915217 - DNA, 18 bp, Homo sapiens
ccaaccagtgccaaggac

SEQ ID NO: 4915218 - DNA, 16 bp, Homo sapiens
ccaacccccaccccac

SEQ ID NO: 4915219 - DNA, 19 bp, Homo sapiens
ccaacccccaccccacact

SEQ ID NO: 4915220 - DNA, 19 bp, Homo sapiens
ccaacccccattctcatct

SEQ ID NO: 4915221 - DNA, 14 bp, Homo sapiens
ccaaccctcagagc

SEQ ID NO: 4915222 - DNA, 15 bp, Homo sapiens
ccaaccctcagagcc

SEQ ID NO: 4915223 - DNA, 13 bp, Homo sapiens
ccaaccgacaggc

SEQ ID NO: 4915224 - DNA, 18 bp, Homo sapiens
ccaacgttactcagggct

SEQ ID NO: 4915225 - DNA, 14 bp, Homo sapiens
ccaactccagcaac

SEQ ID NO: 4915226 - DNA, 15 bp, Homo sapiens
ccaactccagcaact

SEQ ID NO: 4915227 - DNA, 12 bp, Homo sapiens
ccaactccagga

SEQ ID NO: 4915228 - DNA, 14 bp, Homo sapiens
ccaactctgagccc

SEQ ID NO: 4915229 - DNA, 22 bp, Homo sapiens
ccaactctgagcccatgttctg

SEQ ID NO: 4915230 - DNA, 16 bp, Homo sapiens
ccaactgggcccaaga

SEQ ID NO: 4915231 - DNA, 13 bp, Homo sapiens
ccaactgtatata

SEQ ID NO: 4915232 - DNA, 13 bp, Homo sapiens
ccaactgtgttgt

SEQ ID NO: 4915233 - DNA, 20 bp, Homo sapiens
ccaactgtgttgtattaaca

SEQ ID NO: 4915234 - DNA, 21 bp, Homo sapiens
ccaactgtgttgtattaacaa

SEQ ID NO: 4915235 - DNA, 23 bp, Homo sapiens
ccaactgtgttgtattaacaaaa

SEQ ID NO: 4915236 - DNA, 20 bp, Homo sapiens
ccaacttgagggcccagagc

SEQ ID NO: 4915237 - DNA, 21 bp, Homo sapiens
ccaacttggttctgcttcaat

SEQ ID NO: 4915238 - DNA, 11 bp, Homo sapiens
ccaacttgtaa

SEQ ID NO: 4915239 - DNA, 17 bp, Homo sapiens
ccaactttctgtaaact

SEQ ID NO: 4915240 - DNA, 18 bp, Homo sapiens
ccaagaatccacatttct

SEQ ID NO: 4915241 - DNA, 13 bp, Homo sapiens
ccaagacaaatca

SEQ ID NO: 4915242 - DNA, 19 bp, Homo sapiens
ccaagacagatgccccaga

SEQ ID NO: 4915243 - DNA, 22 bp, Homo sapiens
ccaagacagatgccccagagct

SEQ ID NO: 4915244 - DNA, 24 bp, Homo sapiens
ccaagacagatgccccagagctgt

SEQ ID NO: 4915245 - DNA, 18 bp, Homo sapiens
ccaagacttggcaacaga

SEQ ID NO: 4915246 - DNA, 20 bp, Homo sapiens
ccaagacttggcaacagaag

SEQ ID NO: 4915247 - DNA, 22 bp, Homo sapiens
ccaagacttggcaacagaagca

SEQ ID NO: 4915248 - DNA, 22 bp, Homo sapiens
ccaagagaaaggcctgcacaca

SEQ ID NO: 4915249 - DNA, 23 bp, Homo sapiens
ccaagagaaaggcctgcacacaa

SEQ ID NO: 4915250 - DNA, 16 bp, Homo sapiens
ccaagccgtggcttcc

SEQ ID NO: 4915251 - DNA, 16 bp, Homo sapiens
ccaagcctccacagcg

SEQ ID NO: 4915252 - DNA, 20 bp, Homo sapiens
ccaagcctccacagcgaggg

SEQ ID NO: 4915253 - DNA, 20 bp, Homo sapiens
ccaagctaagcactgccact

SEQ ID NO: 4915254 - DNA, 17 bp, Homo sapiens
ccaagctccctgcccca

SEQ ID NO: 4915255 - DNA, 13 bp, Homo sapiens
ccaagctctgctc

SEQ ID NO: 4915256 - DNA, 15 bp, Homo sapiens
ccaagctctgctcct

SEQ ID NO: 4915257 - DNA, 17 bp, Homo sapiens
ccaagctctgctcctct

SEQ ID NO: 4915258 - DNA, 20 bp, Homo sapiens
ccaaggacctcctcttcccc

SEQ ID NO: 4915259 - DNA, 22 bp, Homo sapiens
ccaaggacctcctcttccccct

SEQ ID NO: 4915260 - DNA, 15 bp, Homo sapiens
ccaaggactgaggga

SEQ ID NO: 4915261 - DNA, 19 bp, Homo sapiens
ccaaggccagagtggcctg

SEQ ID NO: 4915262 - DNA, 22 bp, Homo sapiens
ccaaggggagtcaccttccctt

SEQ ID NO: 4915263 - DNA, 18 bp, Homo sapiens
ccaaggggtgggccacag

SEQ ID NO: 4915264 - DNA, 16 bp, Homo sapiens
ccaaggttcccttgtg

SEQ ID NO: 4915265 - DNA, 18 bp, Homo sapiens
ccaagtagtctgctcaca

SEQ ID NO: 4915266 - DNA, 16 bp, Homo sapiens
ccaagtgcactttcta

SEQ ID NO: 4915267 - DNA, 17 bp, Homo sapiens
ccaagtgcactttctaa

SEQ ID NO: 4915268 - DNA, 13 bp, Homo sapiens
ccaagtgcgtgcc

SEQ ID NO: 4915269 - DNA, 19 bp, Homo sapiens
ccaatatttctgctttctt

SEQ ID NO: 4915270 - DNA, 13 bp, Homo sapiens
ccaatcagcactg

SEQ ID NO: 4915271 - DNA, 14 bp, Homo sapiens
ccaatcagcactga

SEQ ID NO: 4915272 - DNA, 16 bp, Homo sapiens
ccaatcagcactgaaa

SEQ ID NO: 4915273 - DNA, 18 bp, Homo sapiens
ccaatcagcactgaaaat

SEQ ID NO: 4915274 - DNA, 17 bp, Homo sapiens
ccaatgtaggagctgcc

SEQ ID NO: 4915275 - DNA, 20 bp, Homo sapiens
ccaattattgatatatatta

SEQ ID NO: 4915276 - DNA, 13 bp, Homo sapiens
ccaattcaataca

SEQ ID NO: 4915277 - DNA, 13 bp, Homo sapiens
ccaattttcaaag

SEQ ID NO: 4915278 - DNA, 15 bp, Homo sapiens
ccagcccctagccca

SEQ ID NO: 4915279 - DNA, 20 bp, Homo sapiens
ccaggttcaacccacagcta

SEQ ID NO: 4915280 - DNA, 21 bp, Homo sapiens
ccaggttccccagccgcccac

SEQ ID NO: 4915281 - DNA, 14 bp, Homo sapiens
ccaggttccgaaga

SEQ ID NO: 4915282 - DNA, 20 bp, Homo sapiens
ccagtaggggcttataataa

SEQ ID NO: 4915283 - DNA, 19 bp, Homo sapiens
ccctgcccctcccttcaac

SEQ ID NO: 4915284 - DNA, 11 bp, Homo sapiens
ccctgccctgc

SEQ ID NO: 4915285 - DNA, 12 bp, Homo sapiens
ccctgccctggt

SEQ ID NO: 4915286 - DNA, 9 bp, Homo sapiens
ccctgcctg

SEQ ID NO: 4915287 - DNA, 14 bp, Homo sapiens
ccctgcctgccatg

SEQ ID NO: 4915288 - DNA, 20 bp, Homo sapiens
ccctgcctgccatgtacctc

SEQ ID NO: 4915289 - DNA, 15 bp, Homo sapiens
ccctgcgcctgtgat

SEQ ID NO: 4915290 - DNA, 22 bp, Homo sapiens
ccctgcgcctgtgatgctgggc

SEQ ID NO: 4915291 - DNA, 14 bp, Homo sapiens
ccctgctcctgcag

SEQ ID NO: 4915292 - DNA, 15 bp, Homo sapiens
ccctgctcctgcagc

SEQ ID NO: 4915293 - DNA, 16 bp, Homo sapiens
ccctgctgcaggggct

SEQ ID NO: 4915294 - DNA, 19 bp, Homo sapiens
ccctgctgcaggggctctg

SEQ ID NO: 4915295 - DNA, 11 bp, Homo sapiens
ccctgctgccc

SEQ ID NO: 4915296 - DNA, 20 bp, Homo sapiens
ccctgctgccgcctcccagc

SEQ ID NO: 4915297 - DNA, 23 bp, Homo sapiens
ccctgctgccgcctcccagcctg

SEQ ID NO: 4915298 - DNA, 13 bp, Homo sapiens
ccctgctgccttc

SEQ ID NO: 4915299 - DNA, 15 bp, Homo sapiens
ccctgctggctcttc

SEQ ID NO: 4915300 - DNA, 20 bp, Homo sapiens
ccctgctggctcttctgccc

SEQ ID NO: 4915301 - DNA, 13 bp, Homo sapiens
ccctgctggttca

SEQ ID NO: 4915302 - DNA, 20 bp, Homo sapiens
ccctgctggttcagggttgg

SEQ ID NO: 4915303 - DNA, 23 bp, Homo sapiens
ccctgctttgggctgccctggtg

SEQ ID NO: 4915304 - DNA, 20 bp, Homo sapiens
ccctggaactctatctgggc

SEQ ID NO: 4915305 - DNA, 22 bp, Homo sapiens
ccctggaactctatctgggcct

SEQ ID NO: 4915306 - DNA, 18 bp, Homo sapiens
ccctggagcctccactgc

SEQ ID NO: 4915307 - DNA, 21 bp, Homo sapiens
ccctggagtgtggctgaggag

SEQ ID NO: 4915308 - DNA, 14 bp, Homo sapiens
ccgctctcttcctg

SEQ ID NO: 4915309 - DNA, 15 bp, Homo sapiens
ccgctctcttcctgc

SEQ ID NO: 4915310 - DNA, 14 bp, Homo sapiens
ccgctgctccacgc

SEQ ID NO: 4915311 - DNA, 16 bp, Homo sapiens
ccgctgtaagctcctt

SEQ ID NO: 4915312 - DNA, 18 bp, Homo sapiens
ccgctgtaagctcctttg

SEQ ID NO: 4915313 - DNA, 18 bp, Homo sapiens
ccgctgtgagcccctggt

SEQ ID NO: 4915314 - DNA, 12 bp, Homo sapiens
ccgctttctacc

SEQ ID NO: 4915315 - DNA, 21 bp, Homo sapiens
ccggagattggacggcctgat

SEQ ID NO: 4915316 - DNA, 16 bp, Homo sapiens
ccggaggggcctggca

SEQ ID NO: 4915317 - DNA, 19 bp, Homo sapiens
ccggatcagagcaggacct

SEQ ID NO: 4915318 - DNA, 13 bp, Homo sapiens
ccggcaggccctg

SEQ ID NO: 4915319 - DNA, 18 bp, Homo sapiens
ccggcaggccctgcagtg

SEQ ID NO: 4915320 - DNA, 18 bp, Homo sapiens
ccggccaatggaaacctc

SEQ ID NO: 4915321 - DNA, 14 bp, Homo sapiens
ccggccacctctgc

SEQ ID NO: 4915322 - DNA, 19 bp, Homo sapiens
ccggccccctggtctctgg

SEQ ID NO: 4915323 - DNA, 20 bp, Homo sapiens
ccggccccctggtctctggt

SEQ ID NO: 4915324 - DNA, 14 bp, Homo sapiens
ccggcccctgctgg

SEQ ID NO: 4915325 - DNA, 24 bp, Homo sapiens
ccggccctgggctcggaggctgcc

SEQ ID NO: 4915326 - DNA, 18 bp, Homo sapiens
ccggctaatttttgtaat

SEQ ID NO: 4915327 - DNA, 17 bp, Homo sapiens
ccggctatgggggcact

SEQ ID NO: 4915328 - DNA, 22 bp, Homo sapiens
ccggctatgggggcactgagga

SEQ ID NO: 4915329 - DNA, 19 bp, Homo sapiens
ccggcttcctttcccaagc

SEQ ID NO: 4915330 - DNA, 19 bp, Homo sapiens
ccgggcctggagaactaga

SEQ ID NO: 4915331 - DNA, 19 bp, Homo sapiens
ccgggcgcggccagccccg

SEQ ID NO: 4915332 - DNA, 13 bp, Homo sapiens
ccgggctctctgc

SEQ ID NO: 4915333 - DNA, 16 bp, Homo sapiens
ccggtagggaggcagc

SEQ ID NO: 4915334 - DNA, 15 bp, Homo sapiens
ccggtttctttttaa

SEQ ID NO: 4915335 - DNA, 16 bp, Homo sapiens
ccgtcctcacccctgt

SEQ ID NO: 4915336 - DNA, 23 bp, Homo sapiens
ccgtcctcacccctgtcctcact

SEQ ID NO: 4915337 - DNA, 17 bp, Homo sapiens
ccgtgaaaacggagctg

SEQ ID NO: 4915338 - DNA, 18 bp, Homo sapiens
ccgtgcattagcacagat

SEQ ID NO: 4915339 - DNA, 19 bp, Homo sapiens
ccgtgccaaagtctccctt

SEQ ID NO: 4915340 - DNA, 14 bp, Homo sapiens
ccgtgccgcctgca

SEQ ID NO: 4915341 - DNA, 14 bp, Homo sapiens
ccgtgccttcagct

SEQ ID NO: 4915342 - DNA, 16 bp, Homo sapiens
ccgtggccctgccctc

SEQ ID NO: 4915343 - DNA, 20 bp, Homo sapiens
ccgtggccctgccctctcct

SEQ ID NO: 4915344 - DNA, 15 bp, Homo sapiens
ccgtggcttcccgct

SEQ ID NO: 4915345 - DNA, 20 bp, Homo sapiens
ccgtgtgagtgtgacagggc

SEQ ID NO: 4915346 - DNA, 22 bp, Homo sapiens
ccgtgttgcatgaaggagcagc

SEQ ID NO: 4915347 - DNA, 18 bp, Homo sapiens
ccgttcctgacatcacag

SEQ ID NO: 4915348 - DNA, 22 bp, Homo sapiens
ccgttcctgacatcacagcagc

SEQ ID NO: 4915349 - DNA, 12 bp, Homo sapiens
cctaaaacaaat

SEQ ID NO: 4915350 - DNA, 22 bp, Homo sapiens
cctaaaaggaaatctcacccca

SEQ ID NO: 4915351 - DNA, 11 bp, Homo sapiens
cctaaactgta

SEQ ID NO: 4915352 - DNA, 19 bp, Homo sapiens
cctaaatttaatgctgcct

SEQ ID NO: 4915353 - DNA, 15 bp, Homo sapiens
cctaaccccttccag

SEQ ID NO: 4915354 - DNA, 16 bp, Homo sapiens
cctaaccccttccaga

SEQ ID NO: 4915355 - DNA, 14 bp, Homo sapiens
cctaagaatcagag

SEQ ID NO: 4915356 - DNA, 15 bp, Homo sapiens
cctaagactgtgaca

SEQ ID NO: 4915357 - DNA, 16 bp, Homo sapiens
cctaagcatctaagtt

SEQ ID NO: 4915358 - DNA, 16 bp, Homo sapiens
cctaagcattgcctgg

SEQ ID NO: 4915359 - DNA, 16 bp, Homo sapiens
cctaagccagcctggt

SEQ ID NO: 4915360 - DNA, 16 bp, Homo sapiens
cctaagtactgtaata

SEQ ID NO: 4915361 - DNA, 13 bp, Homo sapiens
cctaagtattaaa

SEQ ID NO: 4915362 - DNA, 13 bp, Homo sapiens
cctaagtctctgt

SEQ ID NO: 4915363 - DNA, 17 bp, Homo sapiens
cctaagtgtcaccccgc

SEQ ID NO: 4915364 - DNA, 22 bp, Homo sapiens
cctaataaacatccttcaagaa

SEQ ID NO: 4915365 - DNA, 22 bp, Homo sapiens
cctaatcagaaatttttatcag

SEQ ID NO: 4915366 - DNA, 18 bp, Homo sapiens
cctaattcgatgaaggct

SEQ ID NO: 4915367 - DNA, 19 bp, Homo sapiens
cctacaagatttagaaaaa

SEQ ID NO: 4915368 - DNA, 12 bp, Homo sapiens
cctacagcacta

SEQ ID NO: 4915369 - DNA, 21 bp, Homo sapiens
cctacagcactactgggtgtc

SEQ ID NO: 4915370 - DNA, 17 bp, Homo sapiens
cctacagctttgatccc

SEQ ID NO: 4915371 - DNA, 18 bp, Homo sapiens
cctacaggagtgagcact

SEQ ID NO: 4915372 - DNA, 21 bp, Homo sapiens
cctacaggcagtctctctctt

SEQ ID NO: 4915373 - DNA, 16 bp, Homo sapiens
cctaccatcagggaca

SEQ ID NO: 4915374 - DNA, 22 bp, Homo sapiens
cctaccatcagggacaggatga

SEQ ID NO: 4915375 - DNA, 13 bp, Homo sapiens
cctacccacacct

SEQ ID NO: 4915376 - DNA, 16 bp, Homo sapiens
cctacccacacctctg

SEQ ID NO: 4915377 - DNA, 19 bp, Homo sapiens
cctacccacacctctgcca

SEQ ID NO: 4915378 - DNA, 16 bp, Homo sapiens
cctaccgagtctcttc

SEQ ID NO: 4915379 - DNA, 17 bp, Homo sapiens
cctaccgagtctcttct

SEQ ID NO: 4915380 - DNA, 20 bp, Homo sapiens
cctaccgagtctcttctcca

SEQ ID NO: 4915381 - DNA, 21 bp, Homo sapiens
cctaccgagtctcttctccac

SEQ ID NO: 4915382 - DNA, 23 bp, Homo sapiens
cctaccgagtctcttctccactg

SEQ ID NO: 4915383 - DNA, 13 bp, Homo sapiens
cctacctgatgga

SEQ ID NO: 4915384 - DNA, 21 bp, Homo sapiens
cctacctgattggtgcaaccc

SEQ ID NO: 4915385 - DNA, 15 bp, Homo sapiens
cctacctgccctgga

SEQ ID NO: 4915386 - DNA, 12 bp, Homo sapiens
cctacctgctct

SEQ ID NO: 4915387 - DNA, 13 bp, Homo sapiens
cctacctgctctc

SEQ ID NO: 4915388 - DNA, 16 bp, Homo sapiens
cctacctgtgcctgac

SEQ ID NO: 4915389 - DNA, 21 bp, Homo sapiens
cgagctgtttatgtttttata

SEQ ID NO: 4915390 - DNA, 12 bp, Homo sapiens
cgaggacaggga

SEQ ID NO: 4915391 - DNA, 17 bp, Homo sapiens
cgaggagccaggcaact

SEQ ID NO: 4915392 - DNA, 23 bp, Homo sapiens
cgaggattttaattttttttagt

SEQ ID NO: 4915393 - DNA, 13 bp, Homo sapiens
cgagggcagctgc

SEQ ID NO: 4915394 - DNA, 14 bp, Homo sapiens
cgagggtcctggct

SEQ ID NO: 4915395 - DNA, 13 bp, Homo sapiens
cgagtagctggga

SEQ ID NO: 4915396 - DNA, 14 bp, Homo sapiens
cgagtagctgggac

SEQ ID NO: 4915397 - DNA, 15 bp, Homo sapiens
cgagtagctgggact

SEQ ID NO: 4915398 - DNA, 18 bp, Homo sapiens
cgagtcaccttccaggac

SEQ ID NO: 4915399 - DNA, 16 bp, Homo sapiens
cgagtctcttctccac

SEQ ID NO: 4915400 - DNA, 20 bp, Homo sapiens
cgatacaccgggcctggaga

SEQ ID NO: 4915401 - DNA, 23 bp, Homo sapiens
cgatacccaggaccaagccacag

SEQ ID NO: 4915402 - DNA, 15 bp, Homo sapiens
cgatatacagatgaa

SEQ ID NO: 4915403 - DNA, 18 bp, Homo sapiens
cgatatacagatgaaaat

SEQ ID NO: 4915404 - DNA, 15 bp, Homo sapiens
cgatatactctagat

SEQ ID NO: 4915405 - DNA, 18 bp, Homo sapiens
cgatcctgccaccctgta

SEQ ID NO: 4915406 - DNA, 14 bp, Homo sapiens
cgatctcccacctt

SEQ ID NO: 4915407 - DNA, 17 bp, Homo sapiens
cgatctcttattttaca

SEQ ID NO: 4915408 - DNA, 14 bp, Homo sapiens
cgatgaaggctgcc

SEQ ID NO: 4915409 - DNA, 12 bp, Homo sapiens
cgattccttctc

SEQ ID NO: 4915410 - DNA, 13 bp, Homo sapiens
cgattccttctct

SEQ ID NO: 4915411 - DNA, 19 bp, Homo sapiens
cgattcttctgcttcagcc

SEQ ID NO: 4915412 - DNA, 21 bp, Homo sapiens
cgattcttctgcttcagcctc

SEQ ID NO: 4915413 - DNA, 14 bp, Homo sapiens
cgatttgtcccagg

SEQ ID NO: 4915414 - DNA, 17 bp, Homo sapiens
cgattttctccagctca

SEQ ID NO: 4915415 - DNA, 11 bp, Homo sapiens
cgcaagctgag

SEQ ID NO: 4915416 - DNA, 22 bp, Homo sapiens
cgcaatgaaaagtcgttttcca

SEQ ID NO: 4915417 - DNA, 13 bp, Homo sapiens
cgcacacacacaa

SEQ ID NO: 4915418 - DNA, 22 bp, Homo sapiens
cgcacacacacacacacacatc

SEQ ID NO: 4915419 - DNA, 16 bp, Homo sapiens
cgcacacacacacata

SEQ ID NO: 4915420 - DNA, 12 bp, Homo sapiens
cgcacagcagcc

SEQ ID NO: 4915421 - DNA, 20 bp, Homo sapiens
cgcacagcagcctgcttccc

SEQ ID NO: 4915422 - DNA, 22 bp, Homo sapiens
cgcaccccgatgtggacctcta

SEQ ID NO: 4915423 - DNA, 19 bp, Homo sapiens
cgcacctaccatcagggac

SEQ ID NO: 4915424 - DNA, 11 bp, Homo sapiens
cgcacgcacac

SEQ ID NO: 4915425 - DNA, 13 bp, Homo sapiens
cgcacgcacacac

SEQ ID NO: 4915426 - DNA, 16 bp, Homo sapiens
cgcacgcacacacaca

SEQ ID NO: 4915427 - DNA, 14 bp, Homo sapiens
cgcactttccactt

SEQ ID NO: 4915428 - DNA, 13 bp, Homo sapiens
cgcagaagccctg

SEQ ID NO: 4915429 - DNA, 16 bp, Homo sapiens
cgcagacctccccagc

SEQ ID NO: 4915430 - DNA, 18 bp, Homo sapiens
cgcagacctccccagccc

SEQ ID NO: 4915431 - DNA, 20 bp, Homo sapiens
cgcagacctccccagcccct

SEQ ID NO: 4915432 - DNA, 17 bp, Homo sapiens
cgcagccctagagcctg

SEQ ID NO: 4915433 - DNA, 18 bp, Homo sapiens
cgcagccctagagcctgc

SEQ ID NO: 4915434 - DNA, 19 bp, Homo sapiens
cgcagccctagagcctgcc

SEQ ID NO: 4915435 - DNA, 22 bp, Homo sapiens
cgcagccctagagcctgcctgg

SEQ ID NO: 4915436 - DNA, 13 bp, Homo sapiens
cgcagccctgctt

SEQ ID NO: 4915437 - DNA, 24 bp, Homo sapiens
cgcagccctgctttgggctgccct

SEQ ID NO: 4915438 - DNA, 23 bp, Homo sapiens
cgcagccctggcagggggcatgc

SEQ ID NO: 4915439 - DNA, 12 bp, Homo sapiens
cgcatccagcaa

SEQ ID NO: 4915440 - DNA, 16 bp, Homo sapiens
cgccattgccaccagg

SEQ ID NO: 4915441 - DNA, 14 bp, Homo sapiens
ccttgctgtcctga

SEQ ID NO: 4915442 - DNA, 22 bp, Homo sapiens
ccttgcttttccctcttttctt

SEQ ID NO: 4915443 - DNA, 16 bp, Homo sapiens
ccttggagagacacag

SEQ ID NO: 4915444 - DNA, 17 bp, Homo sapiens
ccttggagagacacagc

SEQ ID NO: 4915445 - DNA, 16 bp, Homo sapiens
ccttggagcttacata

SEQ ID NO: 4915446 - DNA, 14 bp, Homo sapiens
ccttggcaccaaag

SEQ ID NO: 4915447 - DNA, 16 bp, Homo sapiens
ccttggccggctgtgc

SEQ ID NO: 4915448 - DNA, 21 bp, Homo sapiens
ccttggccggctgtgctcaga

SEQ ID NO: 4915449 - DNA, 11 bp, Homo sapiens
ccttggcctca

SEQ ID NO: 4915450 - DNA, 22 bp, Homo sapiens
ccttggctcaagtcctcttttc

SEQ ID NO: 4915451 - DNA, 18 bp, Homo sapiens
ccttggctcaatcctcta

SEQ ID NO: 4915452 - DNA, 12 bp, Homo sapiens
ccttggctgcag

SEQ ID NO: 4915453 - DNA, 14 bp, Homo sapiens
ccttgggctgctcc

SEQ ID NO: 4915454 - DNA, 17 bp, Homo sapiens
ccttgggctgctcctca

SEQ ID NO: 4915455 - DNA, 18 bp, Homo sapiens
ccttgggctgctcctcat

SEQ ID NO: 4915456 - DNA, 20 bp, Homo sapiens
ccttggggaggacaaaactt

SEQ ID NO: 4915457 - DNA, 19 bp, Homo sapiens
ccttgggtagtgagcagtg

SEQ ID NO: 4915458 - DNA, 16 bp, Homo sapiens
ccttggtctttgtatc

SEQ ID NO: 4915459 - DNA, 21 bp, Homo sapiens
ccttggtctttgtatcttcca

SEQ ID NO: 4915460 - DNA, 15 bp, Homo sapiens
ccttggtggcaagag

SEQ ID NO: 4915461 - DNA, 17 bp, Homo sapiens
ccttggtggcaagagcc

SEQ ID NO: 4915462 - DNA, 16 bp, Homo sapiens
ccttgtcactggtaga

SEQ ID NO: 4915463 - DNA, 16 bp, Homo sapiens
ccttgtccacccacct

SEQ ID NO: 4915464 - DNA, 14 bp, Homo sapiens
ccttgtcctttccc

SEQ ID NO: 4915465 - DNA, 22 bp, Homo sapiens
ccttgtttatcagatacatcac

SEQ ID NO: 4915466 - DNA, 20 bp, Homo sapiens
ccttgttttgaaaacctaaa

SEQ ID NO: 4915467 - DNA, 22 bp, Homo sapiens
cctttacaaaagaaataccttg

SEQ ID NO: 4915468 - DNA, 19 bp, Homo sapiens
cctttacgtgtttaaaaaa

SEQ ID NO: 4915469 - DNA, 15 bp, Homo sapiens
cctttcaaatttcac

SEQ ID NO: 4915470 - DNA, 22 bp, Homo sapiens
cctttcacctttgtgtattttt

SEQ ID NO: 4915471 - DNA, 21 bp, Homo sapiens
cctttccccagcatcactccc

SEQ ID NO: 4915472 - DNA, 22 bp, Homo sapiens
cctttccccagcatcactcccc

SEQ ID NO: 4915473 - DNA, 20 bp, Homo sapiens
cctttccccgacgcccaccc

SEQ ID NO: 4915474 - DNA, 14 bp, Homo sapiens
cctttcccttcctc

SEQ ID NO: 4915475 - DNA, 17 bp, Homo sapiens
cctttcctctctcctgt

SEQ ID NO: 4915476 - DNA, 18 bp, Homo sapiens
cctttccttccatcccta

SEQ ID NO: 4915477 - DNA, 13 bp, Homo sapiens
cctttccttccta

SEQ ID NO: 4915478 - DNA, 12 bp, Homo sapiens
cctttctctttc

SEQ ID NO: 4915479 - DNA, 14 bp, Homo sapiens
cctttctctttctc

SEQ ID NO: 4915480 - DNA, 22 bp, Homo sapiens
cctttctctttctctcttccct

SEQ ID NO: 4915481 - DNA, 17 bp, Homo sapiens
cctttctgccgacccct

SEQ ID NO: 4915482 - DNA, 12 bp, Homo sapiens
cctttctgtgcc

SEQ ID NO: 4915483 - DNA, 11 bp, Homo sapiens
cctttctgtgt

SEQ ID NO: 4915484 - DNA, 23 bp, Homo sapiens
cctttcttgacaaaacctaactt

SEQ ID NO: 4915485 - DNA, 18 bp, Homo sapiens
cctttgcaaatcagtgtt

SEQ ID NO: 4915486 - DNA, 15 bp, Homo sapiens
cctttgcagggcagc

SEQ ID NO: 4915487 - DNA, 16 bp, Homo sapiens
cctttgcgcctgtgac

SEQ ID NO: 4915488 - DNA, 19 bp, Homo sapiens
cctttggctctggagacag

SEQ ID NO: 4915489 - DNA, 23 bp, Homo sapiens
cctttgggcctctgcttctctca

SEQ ID NO: 4915490 - DNA, 20 bp, Homo sapiens
cctttggttctggccagaat

SEQ ID NO: 4915491 - DNA, 14 bp, Homo sapiens
cctttgtttcttgt

SEQ ID NO: 4915492 - DNA, 23 bp, Homo sapiens
cctttgttttgatgtttgtggcc

SEQ ID NO: 4915493 - DNA, 13 bp, Homo sapiens
ccttttaacattt

SEQ ID NO: 4915494 - DNA, 20 bp, Homo sapiens
ccttttaacattttgttctt

SEQ ID NO: 4915495 - DNA, 11 bp, Homo sapiens
ccttttatagc

SEQ ID NO: 4915496 - DNA, 16 bp, Homo sapiens
ccttttatagctatta

SEQ ID NO: 4915497 - DNA, 22 bp, Homo sapiens
ccttttatgtagtaattgacat

SEQ ID NO: 4915498 - DNA, 15 bp, Homo sapiens
ccttttattgacaca

SEQ ID NO: 4915499 - DNA, 21 bp, Homo sapiens
ccttttctattccttctggcc

SEQ ID NO: 4915500 - DNA, 9 bp, Homo sapiens
ccttttctt

SEQ ID NO: 4915501 - DNA, 15 bp, Homo sapiens
ccttttcttttgtta

SEQ ID NO: 4915502 - DNA, 20 bp, Homo sapiens
ccttttcttttgttactgtt

SEQ ID NO: 4915503 - DNA, 23 bp, Homo sapiens
ccttttcttttgttactgttctt

SEQ ID NO: 4915504 - DNA, 23 bp, Homo sapiens
ccttttgaagtagtttgtataac

SEQ ID NO: 4915505 - DNA, 16 bp, Homo sapiens
ccttttgaggagcccc

SEQ ID NO: 4915506 - DNA, 21 bp, Homo sapiens
ccttttgaggagccccagcta

SEQ ID NO: 4915507 - DNA, 21 bp, Homo sapiens
ccttttggtgaaagctgagaa

SEQ ID NO: 4915508 - DNA, 13 bp, Homo sapiens
ccttttggtgtgt

SEQ ID NO: 4915509 - DNA, 20 bp, Homo sapiens
ccttttgtatacatcctggg

SEQ ID NO: 4915510 - DNA, 15 bp, Homo sapiens
cctttttaaaacaca

SEQ ID NO: 4915511 - DNA, 16 bp, Homo sapiens
cctttttatgaggcaa

SEQ ID NO: 4915512 - DNA, 13 bp, Homo sapiens
cctttttatttat

SEQ ID NO: 4915513 - DNA, 16 bp, Homo sapiens
cctttttcctagcctg

SEQ ID NO: 4915514 - DNA, 14 bp, Homo sapiens
cctttttctccagc

SEQ ID NO: 4915515 - DNA, 16 bp, Homo sapiens
cctttttctccagctg

SEQ ID NO: 4915516 - DNA, 13 bp, Homo sapiens
ccttttttaagat

SEQ ID NO: 4915517 - DNA, 20 bp, Homo sapiens
ccttttttaagatttttctc

SEQ ID NO: 4915518 - DNA, 17 bp, Homo sapiens
ccttttttgtcccccaa

SEQ ID NO: 4915519 - DNA, 18 bp, Homo sapiens
cgaaaattcatttcacat

SEQ ID NO: 4915520 - DNA, 17 bp, Homo sapiens
cgaaacacagaaacctt

SEQ ID NO: 4915521 - DNA, 15 bp, Homo sapiens
cgaaacttgttattg

SEQ ID NO: 4915522 - DNA, 19 bp, Homo sapiens
cgaaacttgttattgtgaa

SEQ ID NO: 4915523 - DNA, 23 bp, Homo sapiens
cgaaacttgttattgtgaatgat

SEQ ID NO: 4915524 - DNA, 12 bp, Homo sapiens
cgaaagagagag

SEQ ID NO: 4915525 - DNA, 13 bp, Homo sapiens
cgaaagagagaga

SEQ ID NO: 4915526 - DNA, 22 bp, Homo sapiens
cgaaagagagagaaacaaactt

SEQ ID NO: 4915527 - DNA, 18 bp, Homo sapiens
cgaaagctctagaatctg

SEQ ID NO: 4915528 - DNA, 22 bp, Homo sapiens
cgaaagggacttggaagctccg

SEQ ID NO: 4915529 - DNA, 11 bp, Homo sapiens
cgaaataacaa

SEQ ID NO: 4915530 - DNA, 16 bp, Homo sapiens
cgaaataacaatgtta

SEQ ID NO: 4915531 - DNA, 18 bp, Homo sapiens
cgaacaccctcgaagcgc

SEQ ID NO: 4915532 - DNA, 17 bp, Homo sapiens
cgaagaatggagaggaa

SEQ ID NO: 4915533 - DNA, 11 bp, Homo sapiens
cgaagcgcgcc

SEQ ID NO: 4915534 - DNA, 23 bp, Homo sapiens
cgaagcgcgccactcgcttcccc

SEQ ID NO: 4915535 - DNA, 13 bp, Homo sapiens
cgaaggtgctgga

SEQ ID NO: 4915536 - DNA, 16 bp, Homo sapiens
cgaatccaagctccct

SEQ ID NO: 4915537 - DNA, 18 bp, Homo sapiens
cgaatcccctccctgtca

SEQ ID NO: 4915538 - DNA, 12 bp, Homo sapiens
cgaatggacttt

SEQ ID NO: 4915539 - DNA, 22 bp, Homo sapiens
cgaattaatagcttttattgta

SEQ ID NO: 4915540 - DNA, 13 bp, Homo sapiens
cgacagcctggca

SEQ ID NO: 4915541 - DNA, 14 bp, Homo sapiens
cgacaggccctggc

SEQ ID NO: 4915542 - DNA, 21 bp, Homo sapiens
cgacaggcgagagaggagcca

SEQ ID NO: 4915543 - DNA, 14 bp, Homo sapiens
cgaccacttccagg

SEQ ID NO: 4915544 - DNA, 16 bp, Homo sapiens
cgaccagaggagcctt

SEQ ID NO: 4915545 - DNA, 15 bp, Homo sapiens
cgaccctctgggaac

SEQ ID NO: 4915546 - DNA, 17 bp, Homo sapiens
cgaccctctgggaacct

SEQ ID NO: 4915547 - DNA, 13 bp, Homo sapiens
cgaccgccccctc

SEQ ID NO: 4915548 - DNA, 12 bp, Homo sapiens
cgacgcccaccc

SEQ ID NO: 4915549 - DNA, 16 bp, Homo sapiens
cgactgcacagcggcc

SEQ ID NO: 4915550 - DNA, 19 bp, Homo sapiens
cgagaggccaaaggctggt

SEQ ID NO: 4915551 - DNA, 23 bp, Homo sapiens
cgagcaaagatcaaaataaaaag

SEQ ID NO: 4915552 - DNA, 14 bp, Homo sapiens
cgagcatcccccaa

SEQ ID NO: 4915553 - DNA, 22 bp, Homo sapiens
cctgtcctcccatcccctggac

SEQ ID NO: 4915554 - DNA, 13 bp, Homo sapiens
cctgtctcagcct

SEQ ID NO: 4915555 - DNA, 20 bp, Homo sapiens
cctgtctcatccccaggggt

SEQ ID NO: 4915556 - DNA, 16 bp, Homo sapiens
cctgtctccactgtgc

SEQ ID NO: 4915557 - DNA, 23 bp, Homo sapiens
cctgtctccactgtgcctttgca

SEQ ID NO: 4915558 - DNA, 13 bp, Homo sapiens
cctgtctcctttc

SEQ ID NO: 4915559 - DNA, 17 bp, Homo sapiens
cctgtctgactactttg

SEQ ID NO: 4915560 - DNA, 16 bp, Homo sapiens
cctgtgactgtctcac

SEQ ID NO: 4915561 - DNA, 18 bp, Homo sapiens
cctgtgacttcagctctg

SEQ ID NO: 4915562 - DNA, 12 bp, Homo sapiens
cctgtgcacaca

SEQ ID NO: 4915563 - DNA, 14 bp, Homo sapiens
cctgtgcatgtatg

SEQ ID NO: 4915564 - DNA, 17 bp, Homo sapiens
cctgtgcatgtatgtct

SEQ ID NO: 4915565 - DNA, 15 bp, Homo sapiens
cctgtgcctcctcac

SEQ ID NO: 4915566 - DNA, 15 bp, Homo sapiens
cctgtgcctgaccct

SEQ ID NO: 4915567 - DNA, 14 bp, Homo sapiens
cctgtgctggggga

SEQ ID NO: 4915568 - DNA, 17 bp, Homo sapiens
cctgtggagctcagccc

SEQ ID NO: 4915569 - DNA, 18 bp, Homo sapiens
cctgtggagctcagcccc

SEQ ID NO: 4915570 - DNA, 18 bp, Homo sapiens
cctgtggcatctttgcct

SEQ ID NO: 4915571 - DNA, 17 bp, Homo sapiens
cctgtgggtgtagccag

SEQ ID NO: 4915572 - DNA, 20 bp, Homo sapiens
cctgtgtatggaaaaaccat

SEQ ID NO: 4915573 - DNA, 17 bp, Homo sapiens
cctgtgtccacctgtgg

SEQ ID NO: 4915574 - DNA, 17 bp, Homo sapiens
cctgtgtcttgcaatgg

SEQ ID NO: 4915575 - DNA, 19 bp, Homo sapiens
cctgtgtcttgcaatggca

SEQ ID NO: 4915576 - DNA, 22 bp, Homo sapiens
cctgtgtcttgcaatggcagcc

SEQ ID NO: 4915577 - DNA, 21 bp, Homo sapiens
cctgttcactctacttagcat

SEQ ID NO: 4915578 - DNA, 20 bp, Homo sapiens
cctgttcagctccagctcac

SEQ ID NO: 4915579 - DNA, 23 bp, Homo sapiens
cctgttcagctccagctcaccag

SEQ ID NO: 4915580 - DNA, 16 bp, Homo sapiens
cctgttcttcctccag

SEQ ID NO: 4915581 - DNA, 24 bp, Homo sapiens
cctgttcttcctccagctgcacca

SEQ ID NO: 4915582 - DNA, 15 bp, Homo sapiens
cctgtttttctgggt

SEQ ID NO: 4915583 - DNA, 23 bp, Homo sapiens
ccttaaagaaagtcgaattaata

SEQ ID NO: 4915584 - DNA, 13 bp, Homo sapiens
ccttaacccaagg

SEQ ID NO: 4915585 - DNA, 17 bp, Homo sapiens
ccttaacccaaggagca

SEQ ID NO: 4915586 - DNA, 18 bp, Homo sapiens
ccttaacccaaggagcac

SEQ ID NO: 4915587 - DNA, 20 bp, Homo sapiens
ccttaacccaaggagcacag

SEQ ID NO: 4915588 - DNA, 13 bp, Homo sapiens
ccttacatttgtg

SEQ ID NO: 4915589 - DNA, 16 bp, Homo sapiens
ccttacgctttgtcac

SEQ ID NO: 4915590 - DNA, 15 bp, Homo sapiens
ccttagaaaatgtgt

SEQ ID NO: 4915591 - DNA, 16 bp, Homo sapiens
ccttagaaaatgtgtc

SEQ ID NO: 4915592 - DNA, 15 bp, Homo sapiens
ccttagaacctttct

SEQ ID NO: 4915593 - DNA, 17 bp, Homo sapiens
ccttagaagtcacacag

SEQ ID NO: 4915594 - DNA, 16 bp, Homo sapiens
ccttagaccttccata

SEQ ID NO: 4915595 - DNA, 20 bp, Homo sapiens
ccttagaggtcctctggagc

SEQ ID NO: 4915596 - DNA, 21 bp, Homo sapiens
ccttagcctaaaatccacacc

SEQ ID NO: 4915597 - DNA, 19 bp, Homo sapiens
ccttaggcctacctgatgg

SEQ ID NO: 4915598 - DNA, 15 bp, Homo sapiens
ccttaggccttcctc

SEQ ID NO: 4915599 - DNA, 15 bp, Homo sapiens
ccttagtgggccagg

SEQ ID NO: 4915600 - DNA, 13 bp, Homo sapiens
ccttatcagagct

SEQ ID NO: 4915601 - DNA, 18 bp, Homo sapiens
ccttattttcaagaaact

SEQ ID NO: 4915602 - DNA, 20 bp, Homo sapiens
ccttcagacaccctcaacct

SEQ ID NO: 4915603 - DNA, 21 bp, Homo sapiens
ccttcagtcttgaatttctaa

SEQ ID NO: 4915604 - DNA, 18 bp, Homo sapiens
ccttccaaaaattattat

SEQ ID NO: 4915605 - DNA, 16 bp, Homo sapiens
ccttccactgcctctg

SEQ ID NO: 4915606 - DNA, 17 bp, Homo sapiens
ccttccactgcctctgc

SEQ ID NO: 4915607 - DNA, 21 bp, Homo sapiens
ccttccactgcctctgcctta

SEQ ID NO: 4915608 - DNA, 22 bp, Homo sapiens
ccttccagacatacgaaacaca

SEQ ID NO: 4915609 - DNA, 13 bp, Homo sapiens
ccttccagatcac

SEQ ID NO: 4915610 - DNA, 20 bp, Homo sapiens
ccttccagatcactgccaca

SEQ ID NO: 4915611 - DNA, 17 bp, Homo sapiens
ccttccagctcctgtaa

SEQ ID NO: 4915612 - DNA, 15 bp, Homo sapiens
ccttccagctgctgt

SEQ ID NO: 4915613 - DNA, 14 bp, Homo sapiens
ccttccatacattt

SEQ ID NO: 4915614 - DNA, 19 bp, Homo sapiens
ccttccatccctaccccct

SEQ ID NO: 4915615 - DNA, 19 bp, Homo sapiens
ccttccatgtcgcctctgc

SEQ ID NO: 4915616 - DNA, 20 bp, Homo sapiens
ccttccatgtcgcctctgca

SEQ ID NO: 4915617 - DNA, 17 bp, Homo sapiens
ccttcccaatcagcact

SEQ ID NO: 4915618 - DNA, 19 bp, Homo sapiens
ccttcccaatcagcactga

SEQ ID NO: 4915619 - DNA, 20 bp, Homo sapiens
ccttcccaatcagcactgaa

SEQ ID NO: 4915620 - DNA, 15 bp, Homo sapiens
ccttcccactcaccc

SEQ ID NO: 4915621 - DNA, 17 bp, Homo sapiens
ccttcccactcaccccg

SEQ ID NO: 4915622 - DNA, 15 bp, Homo sapiens
ccttcccatcgctgt

SEQ ID NO: 4915623 - DNA, 15 bp, Homo sapiens
ccttccccagcgtcc

SEQ ID NO: 4915624 - DNA, 21 bp, Homo sapiens
ccttcccccaccggtccagct

SEQ ID NO: 4915625 - DNA, 22 bp, Homo sapiens
ccttcccccaccggtccagctg

SEQ ID NO: 4915626 - DNA, 23 bp, Homo sapiens
ccttcccctcagccacacccagg

SEQ ID NO: 4915627 - DNA, 17 bp, Homo sapiens
ccttcccctccctggct

SEQ ID NO: 4915628 - DNA, 17 bp, Homo sapiens
ccttccctaaagtgatg

SEQ ID NO: 4915629 - DNA, 19 bp, Homo sapiens
ccttcccttgccactttgc

SEQ ID NO: 4915630 - DNA, 19 bp, Homo sapiens
ccttccgaccctctgggaa

SEQ ID NO: 4915631 - DNA, 22 bp, Homo sapiens
ccttccgaccctctgggaacct

SEQ ID NO: 4915632 - DNA, 16 bp, Homo sapiens
ccttccgccccttccc

SEQ ID NO: 4915633 - DNA, 14 bp, Homo sapiens
ccttcctccatcct

SEQ ID NO: 4915634 - DNA, 16 bp, Homo sapiens
ccttcctctccactgc

SEQ ID NO: 4915635 - DNA, 12 bp, Homo sapiens
ccttcctcttcg

SEQ ID NO: 4915636 - DNA, 20 bp, Homo sapiens
ccttcctcttcggccctcag

SEQ ID NO: 4915637 - DNA, 19 bp, Homo sapiens
ccttcctggggcatctggc

SEQ ID NO: 4915638 - DNA, 16 bp, Homo sapiens
ccttcctttctccagg

SEQ ID NO: 4915639 - DNA, 13 bp, Homo sapiens
ccttcgctcctgt

SEQ ID NO: 4915640 - DNA, 18 bp, Homo sapiens
ccttcgctcctgtgtctt

SEQ ID NO: 4915641 - DNA, 22 bp, Homo sapiens
ccttcgtgaacatcccctccca

SEQ ID NO: 4915642 - DNA, 22 bp, Homo sapiens
ccttctctgaacacaggcagct

SEQ ID NO: 4915643 - DNA, 15 bp, Homo sapiens
ccttctgacggccct

SEQ ID NO: 4915644 - DNA, 18 bp, Homo sapiens
ccttctgacggccctgca

SEQ ID NO: 4915645 - DNA, 13 bp, Homo sapiens
ccttctgatgtct

SEQ ID NO: 4915646 - DNA, 22 bp, Homo sapiens
ccttctgtcctactctgtgtca

SEQ ID NO: 4915647 - DNA, 15 bp, Homo sapiens
ccttctgtgaaagta

SEQ ID NO: 4915648 - DNA, 14 bp, Homo sapiens
ccttctgtggctca

SEQ ID NO: 4915649 - DNA, 22 bp, Homo sapiens
ccttcttccatcccaggacacc

SEQ ID NO: 4915650 - DNA, 18 bp, Homo sapiens
ccttctttgataatgtta

SEQ ID NO: 4915651 - DNA, 12 bp, Homo sapiens
ccttcttttgta

SEQ ID NO: 4915652 - DNA, 16 bp, Homo sapiens
ccttctttttcttctt

SEQ ID NO: 4915653 - DNA, 16 bp, Homo sapiens
ccttgaatgctgccag

SEQ ID NO: 4915654 - DNA, 14 bp, Homo sapiens
ccttgacatcagtt

SEQ ID NO: 4915655 - DNA, 13 bp, Homo sapiens
ccttgaccttcct

SEQ ID NO: 4915656 - DNA, 13 bp, Homo sapiens
ccttgcacccctc

SEQ ID NO: 4915657 - DNA, 15 bp, Homo sapiens
ccttgcagctagttt

SEQ ID NO: 4915658 - DNA, 22 bp, Homo sapiens
ccttgcagttcagcaccaccct

SEQ ID NO: 4915659 - DNA, 15 bp, Homo sapiens
ccttgccactttgca

SEQ ID NO: 4915660 - DNA, 23 bp, Homo sapiens
ccttgcctaaatttaatgctgcc

SEQ ID NO: 4915661 - DNA, 22 bp, Homo sapiens
ccttgctctcccctgccctgct

SEQ ID NO: 4915662 - DNA, 17 bp, Homo sapiens
ccttgctggaaaaccca

SEQ ID NO: 4915663 - DNA, 13 bp, Homo sapiens
ccttgctgtcctg

SEQ ID NO: 4915664 - DNA, 21 bp, Homo sapiens
cctggccgcgtttagaccaag

SEQ ID NO: 4915665 - DNA, 19 bp, Homo sapiens
cctggcctggcacacatca

SEQ ID NO: 4915666 - DNA, 13 bp, Homo sapiens
cctggcctggccc

SEQ ID NO: 4915667 - DNA, 14 bp, Homo sapiens
cctggcctggccct

SEQ ID NO: 4915668 - DNA, 16 bp, Homo sapiens
cctggcctggccctgc

SEQ ID NO: 4915669 - DNA, 22 bp, Homo sapiens
cctggcctggccctgccctgag

SEQ ID NO: 4915670 - DNA, 21 bp, Homo sapiens
cctggctccgtccaggagcct

SEQ ID NO: 4915671 - DNA, 23 bp, Homo sapiens
cctggctcctgaggggcatctgc

SEQ ID NO: 4915672 - DNA, 15 bp, Homo sapiens
cctggctctgctgtc

SEQ ID NO: 4915673 - DNA, 17 bp, Homo sapiens
cctggctctgtggcttg

SEQ ID NO: 4915674 - DNA, 20 bp, Homo sapiens
cctggctctgtggcttgcta

SEQ ID NO: 4915675 - DNA, 23 bp, Homo sapiens
cctggctctttcgtcacccttgg

SEQ ID NO: 4915676 - DNA, 17 bp, Homo sapiens
cctggctgagggcagct

SEQ ID NO: 4915677 - DNA, 16 bp, Homo sapiens
cctggcttttcactgc

SEQ ID NO: 4915678 - DNA, 18 bp, Homo sapiens
cctggcttttcactgctg

SEQ ID NO: 4915679 - DNA, 23 bp, Homo sapiens
cctggcttttcactgctggctgc

SEQ ID NO: 4915680 - DNA, 14 bp, Homo sapiens
cctgggccagggtc

SEQ ID NO: 4915681 - DNA, 15 bp, Homo sapiens
cctgggccagggtct

SEQ ID NO: 4915682 - DNA, 15 bp, Homo sapiens
cctgggctcggaggc

SEQ ID NO: 4915683 - DNA, 18 bp, Homo sapiens
cctgggctcggaggctgc

SEQ ID NO: 4915684 - DNA, 21 bp, Homo sapiens
cctgggctcggaggctgcccc

SEQ ID NO: 4915685 - DNA, 16 bp, Homo sapiens
cctggggcctggacct

SEQ ID NO: 4915686 - DNA, 19 bp, Homo sapiens
cctgggggagttttcctct

SEQ ID NO: 4915687 - DNA, 18 bp, Homo sapiens
cctgggggttctttcttc

SEQ ID NO: 4915688 - DNA, 18 bp, Homo sapiens
cctgggtggatcggcctc

SEQ ID NO: 4915689 - DNA, 18 bp, Homo sapiens
cctgggttccaatcctgg

SEQ ID NO: 4915690 - DNA, 20 bp, Homo sapiens
cctggtcacagggcatgccc

SEQ ID NO: 4915691 - DNA, 17 bp, Homo sapiens
cctggtcaggccctggt

SEQ ID NO: 4915692 - DNA, 14 bp, Homo sapiens
cctggtccagggaa

SEQ ID NO: 4915693 - DNA, 13 bp, Homo sapiens
cctggtccatgca

SEQ ID NO: 4915694 - DNA, 14 bp, Homo sapiens
cctggtcctgaggg

SEQ ID NO: 4915695 - DNA, 23 bp, Homo sapiens
cctggtcctgagggtccccacct

SEQ ID NO: 4915696 - DNA, 21 bp, Homo sapiens
cctggtgctgccacacttcag

SEQ ID NO: 4915697 - DNA, 12 bp, Homo sapiens
cctggtggcagc

SEQ ID NO: 4915698 - DNA, 18 bp, Homo sapiens
cctggtggcagtgggagc

SEQ ID NO: 4915699 - DNA, 18 bp, Homo sapiens
cctggtttcactggccca

SEQ ID NO: 4915700 - DNA, 19 bp, Homo sapiens
cctgtaacatactggcctg

SEQ ID NO: 4915701 - DNA, 16 bp, Homo sapiens
cctgtaagaaacagag

SEQ ID NO: 4915702 - DNA, 18 bp, Homo sapiens
cctgtagttgcgtggact

SEQ ID NO: 4915703 - DNA, 21 bp, Homo sapiens
cctgtagttgcgtggactctg

SEQ ID NO: 4915704 - DNA, 19 bp, Homo sapiens
cctgtagttttattttatg

SEQ ID NO: 4915705 - DNA, 13 bp, Homo sapiens
cctgtataagcac

SEQ ID NO: 4915706 - DNA, 14 bp, Homo sapiens
cctgtatactttag

SEQ ID NO: 4915707 - DNA, 14 bp, Homo sapiens
cctgtcacattgca

SEQ ID NO: 4915708 - DNA, 15 bp, Homo sapiens
cctgtcacattgcat

SEQ ID NO: 4915709 - DNA, 16 bp, Homo sapiens
cctgtcccatggacac

SEQ ID NO: 4915710 - DNA, 12 bp, Homo sapiens
cctgtccccgca

SEQ ID NO: 4915711 - DNA, 14 bp, Homo sapiens
cctgtccccgcagc

SEQ ID NO: 4915712 - DNA, 15 bp, Homo sapiens
cctgtccctcccacc

SEQ ID NO: 4915713 - DNA, 16 bp, Homo sapiens
cctgtccctcccacct

SEQ ID NO: 4915714 - DNA, 18 bp, Homo sapiens
cctgtcctaaggaacctt

SEQ ID NO: 4915715 - DNA, 21 bp, Homo sapiens
cctgtcctcactgctccctga

SEQ ID NO: 4915716 - DNA, 22 bp, Homo sapiens
cctgtcctcactgctccctgaa

SEQ ID NO: 4915717 - DNA, 13 bp, Homo sapiens
ctcttctgctcca

SEQ ID NO: 4915718 - DNA, 14 bp, Homo sapiens
ctcttctgctccac

SEQ ID NO: 4915719 - DNA, 21 bp, Homo sapiens
ctcttctggggcaggctgggc

SEQ ID NO: 4915720 - DNA, 13 bp, Homo sapiens
ctcttgacctcag

SEQ ID NO: 4915721 - DNA, 16 bp, Homo sapiens
ctcttgacctcaggtg

SEQ ID NO: 4915722 - DNA, 22 bp, Homo sapiens
ctcttgagctggcctctctagc

SEQ ID NO: 4915723 - DNA, 16 bp, Homo sapiens
ctcttgaggccaggag

SEQ ID NO: 4915724 - DNA, 18 bp, Homo sapiens
ctcttgatacccccctct

SEQ ID NO: 4915725 - DNA, 23 bp, Homo sapiens
ctcttgatacccccctctgtctt

SEQ ID NO: 4915726 - DNA, 22 bp, Homo sapiens
ctcttgccactgcctcttcctc

SEQ ID NO: 4915727 - DNA, 21 bp, Homo sapiens
ctcttgccgaggagccaggca

SEQ ID NO: 4915728 - DNA, 19 bp, Homo sapiens
ctcttgctgtctctgctcg

SEQ ID NO: 4915729 - DNA, 23 bp, Homo sapiens
ctcttgtcccacgtgtcttccac

SEQ ID NO: 4915730 - DNA, 14 bp, Homo sapiens
ctcttgtgctggat

SEQ ID NO: 4915731 - DNA, 20 bp, Homo sapiens
ctcttgtttttattaattta

SEQ ID NO: 4915732 - DNA, 21 bp, Homo sapiens
ctcttgtttttattaatttat

SEQ ID NO: 4915733 - DNA, 13 bp, Homo sapiens
ctctttaaaaaca

SEQ ID NO: 4915734 - DNA, 12 bp, Homo sapiens
ctctttaaaaca

SEQ ID NO: 4915735 - DNA, 17 bp, Homo sapiens
ctctttaaatcaagtcc

SEQ ID NO: 4915736 - DNA, 18 bp, Homo sapiens
ctctttaatgtcacaggc

SEQ ID NO: 4915737 - DNA, 21 bp, Homo sapiens
ctctttaatgtcacaggcagg

SEQ ID NO: 4915738 - DNA, 23 bp, Homo sapiens
ctctttaatgtcacaggcaggtc

SEQ ID NO: 4915739 - DNA, 22 bp, Homo sapiens
ctctttattttcccctatcatt

SEQ ID NO: 4915740 - DNA, 11 bp, Homo sapiens
ctctttcaaag

SEQ ID NO: 4915741 - DNA, 15 bp, Homo sapiens
ctctttcacattgtt

SEQ ID NO: 4915742 - DNA, 16 bp, Homo sapiens
ctctttcgtcaccctt

SEQ ID NO: 4915743 - DNA, 16 bp, Homo sapiens
ctctttctaatgctga

SEQ ID NO: 4915744 - DNA, 18 bp, Homo sapiens
ctgagaagaggagccctc

SEQ ID NO: 4915745 - DNA, 12 bp, Homo sapiens
ctgagactcaca

SEQ ID NO: 4915746 - DNA, 20 bp, Homo sapiens
ctgagactcacaggaaggag

SEQ ID NO: 4915747 - DNA, 20 bp, Homo sapiens
ctgagagaattggctcaata

SEQ ID NO: 4915748 - DNA, 13 bp, Homo sapiens
ctgagagactttt

SEQ ID NO: 4915749 - DNA, 15 bp, Homo sapiens
ctgagagtgtctctg

SEQ ID NO: 4915750 - DNA, 18 bp, Homo sapiens
ctgagatcccctgagccc

SEQ ID NO: 4915751 - DNA, 20 bp, Homo sapiens
ctgagcatactcaacaaaac

SEQ ID NO: 4915752 - DNA, 18 bp, Homo sapiens
ctgagccacagcagcatt

SEQ ID NO: 4915753 - DNA, 16 bp, Homo sapiens
ctgagcccatgttctg

SEQ ID NO: 4915754 - DNA, 23 bp, Homo sapiens
ctgagcccatgttctgcccccag

SEQ ID NO: 4915755 - DNA, 19 bp, Homo sapiens
ctgagccccagggtgccca

SEQ ID NO: 4915756 - DNA, 20 bp, Homo sapiens
ctgagccccagggtgcccag

SEQ ID NO: 4915757 - DNA, 18 bp, Homo sapiens
ctgagccccgcagacctc

SEQ ID NO: 4915758 - DNA, 21 bp, Homo sapiens
ctgagccccgccctcttcctg

SEQ ID NO: 4915759 - DNA, 21 bp, Homo sapiens
ctgagccctactccctgcaga

SEQ ID NO: 4915760 - DNA, 19 bp, Homo sapiens
ctgagcctggcccatagaa

SEQ ID NO: 4915761 - DNA, 22 bp, Homo sapiens
ctgagcctggcccatagaaaca

SEQ ID NO: 4915762 - DNA, 17 bp, Homo sapiens
ctgagccttcagtcttg

SEQ ID NO: 4915763 - DNA, 19 bp, Homo sapiens
ctgagcgcctggatttctg

SEQ ID NO: 4915764 - DNA, 14 bp, Homo sapiens
ctgagcgggaggca

SEQ ID NO: 4915765 - DNA, 11 bp, Homo sapiens
ctgagctttat

SEQ ID NO: 4915766 - DNA, 23 bp, Homo sapiens
ctgaggaatccagacccggctgc

SEQ ID NO: 4915767 - DNA, 15 bp, Homo sapiens
ctgaggacaaagtgg

SEQ ID NO: 4915768 - DNA, 20 bp, Homo sapiens
ctgaggacaaagtggaggag

SEQ ID NO: 4915769 - DNA, 22 bp, Homo sapiens
ctgaggacttaaaatattcctg

SEQ ID NO: 4915770 - DNA, 19 bp, Homo sapiens
ctgaggaggcctccatctc

SEQ ID NO: 4915771 - DNA, 15 bp, Homo sapiens
ctgaggcctccagct

SEQ ID NO: 4915772 - DNA, 22 bp, Homo sapiens
ctgaggctctgacccagtgaga

SEQ ID NO: 4915773 - DNA, 16 bp, Homo sapiens
ctgagggaaagtgcat

SEQ ID NO: 4915774 - DNA, 16 bp, Homo sapiens
ctgagggactctgaag

SEQ ID NO: 4915775 - DNA, 15 bp, Homo sapiens
ctgagggaggacctg

SEQ ID NO: 4915776 - DNA, 23 bp, Homo sapiens
ctgagggcagaaaggttctgccc

SEQ ID NO: 4915777 - DNA, 18 bp, Homo sapiens
ctgaggggcatctgcccc

SEQ ID NO: 4915778 - DNA, 20 bp, Homo sapiens
ctgagggtccccacctggga

SEQ ID NO: 4915779 - DNA, 16 bp, Homo sapiens
ctgagggtctgggcgg

SEQ ID NO: 4915780 - DNA, 17 bp, Homo sapiens
ctgaggtcagggagtgc

SEQ ID NO: 4915781 - DNA, 17 bp, Homo sapiens
ctgaggtgaaagggagc

SEQ ID NO: 4915782 - DNA, 17 bp, Homo sapiens
ctgaggtgcctgtccca

SEQ ID NO: 4915783 - DNA, 14 bp, Homo sapiens
ctgaggtttcaccc

SEQ ID NO: 4915784 - DNA, 19 bp, Homo sapiens
ctgagtcagggcccagagg

SEQ ID NO: 4915785 - DNA, 19 bp, Homo sapiens
ctgagttctggtcaaagaa

SEQ ID NO: 4915786 - DNA, 14 bp, Homo sapiens
ctgagttgccaaga

SEQ ID NO: 4915787 - DNA, 18 bp, Homo sapiens
ctgagttgccaagacaaa

SEQ ID NO: 4915788 - DNA, 18 bp, Homo sapiens
ctgagtttcattctcctg

SEQ ID NO: 4915789 - DNA, 20 bp, Homo sapiens
ctgagtttcattctcctgcc

SEQ ID NO: 4915790 - DNA, 16 bp, Homo sapiens
ctgataaagcacagct

SEQ ID NO: 4915791 - DNA, 23 bp, Homo sapiens
ctgatatctggcctaaaatcttg

SEQ ID NO: 4915792 - DNA, 13 bp, Homo sapiens
ctgatatgggact

SEQ ID NO: 4915793 - DNA, 21 bp, Homo sapiens
ctgatcctaactgaagagaca

SEQ ID NO: 4915794 - DNA, 19 bp, Homo sapiens
ctgatctgcggatctcagc

SEQ ID NO: 4915795 - DNA, 20 bp, Homo sapiens
ctgatgaacttattctgtag

SEQ ID NO: 4915796 - DNA, 17 bp, Homo sapiens
ctgatgagaatactgag

SEQ ID NO: 4915797 - DNA, 19 bp, Homo sapiens
ctgatgccaatactagtca

SEQ ID NO: 4915798 - DNA, 19 bp, Homo sapiens
ctgatgctccctcccctgc

SEQ ID NO: 4915799 - DNA, 23 bp, Homo sapiens
ctgatgctgagattcttcaggct

SEQ ID NO: 4915800 - DNA, 16 bp, Homo sapiens
ctgatgctgttctctt

SEQ ID NO: 4915801 - DNA, 22 bp, Homo sapiens
ctgatggatcccgaagaatgga

SEQ ID NO: 4915802 - DNA, 22 bp, Homo sapiens
ctgatggcacttagctatcaga

SEQ ID NO: 4915803 - DNA, 18 bp, Homo sapiens
ctgatgggcaacccccag

SEQ ID NO: 4915804 - DNA, 24 bp, Homo sapiens
ctgatgggcaacccccagcctgct

SEQ ID NO: 4915805 - DNA, 20 bp, Homo sapiens
ctgatgtacaattaaaaacc

SEQ ID NO: 4915806 - DNA, 19 bp, Homo sapiens
ctgatgtctctaaagcact

SEQ ID NO: 4915807 - DNA, 15 bp, Homo sapiens
ctgattagctttgtg

SEQ ID NO: 4915808 - DNA, 14 bp, Homo sapiens
ctgattatgtcttt

SEQ ID NO: 4915809 - DNA, 13 bp, Homo sapiens
ctgattcactgca

SEQ ID NO: 4915810 - DNA, 18 bp, Homo sapiens
ctgattcactgcatggct

SEQ ID NO: 4915811 - DNA, 19 bp, Homo sapiens
ctgattcccaagctctgct

SEQ ID NO: 4915812 - DNA, 14 bp, Homo sapiens
ctgattctgggatg

SEQ ID NO: 4915813 - DNA, 16 bp, Homo sapiens
ctgattgacctgctcc

SEQ ID NO: 4915814 - DNA, 17 bp, Homo sapiens
ctgattgacctgctccg

SEQ ID NO: 4915815 - DNA, 18 bp, Homo sapiens
ctgattggcttgtagaat

SEQ ID NO: 4915816 - DNA, 20 bp, Homo sapiens
ctgattggcttgtagaattg

SEQ ID NO: 4915817 - DNA, 23 bp, Homo sapiens
ctgattgtggatcttttcattct

SEQ ID NO: 4915818 - DNA, 23 bp, Homo sapiens
ctgatttggtacttttgagtgtg

SEQ ID NO: 4915819 - DNA, 21 bp, Homo sapiens
ctgatttttatgatgatgaaa

SEQ ID NO: 4915820 - DNA, 12 bp, Homo sapiens
ctgcaaaataga

SEQ ID NO: 4915821 - DNA, 23 bp, Homo sapiens
ctgcaaaatttgatgccaggaca

SEQ ID NO: 4915822 - DNA, 15 bp, Homo sapiens
ctgcaaacaaacacc

SEQ ID NO: 4915823 - DNA, 12 bp, Homo sapiens
ctgcaacaggct

SEQ ID NO: 4915824 - DNA, 20 bp, Homo sapiens
ctgcaacctccgcctcttgg

SEQ ID NO: 4915825 - DNA, 20 bp, Homo sapiens
ctgcaagcacatctgcattt

SEQ ID NO: 4915826 - DNA, 13 bp, Homo sapiens
ctgcaagcctgtc

SEQ ID NO: 4915827 - DNA, 17 bp, Homo sapiens
ctgcaaggcccacagga

SEQ ID NO: 4915828 - DNA, 15 bp, Homo sapiens
ctgcaataacttctg

SEQ ID NO: 4915829 - DNA, 16 bp, Homo sapiens
ctctgaactttggaga

SEQ ID NO: 4915830 - DNA, 11 bp, Homo sapiens
ctctgaagcat

SEQ ID NO: 4915831 - DNA, 22 bp, Homo sapiens
ctctgaaggacattgcggacag

SEQ ID NO: 4915832 - DNA, 13 bp, Homo sapiens
ctctgaagtcaca

SEQ ID NO: 4915833 - DNA, 23 bp, Homo sapiens
ctctgaagtcacatcacaggaca

SEQ ID NO: 4915834 - DNA, 14 bp, Homo sapiens
ctctgacaagggct

SEQ ID NO: 4915835 - DNA, 16 bp, Homo sapiens
ctctgacacacagctc

SEQ ID NO: 4915836 - DNA, 19 bp, Homo sapiens
ctctgacacacagctctgt

SEQ ID NO: 4915837 - DNA, 16 bp, Homo sapiens
ctctgacccagtgaga

SEQ ID NO: 4915838 - DNA, 13 bp, Homo sapiens
ctctgacccctcc

SEQ ID NO: 4915839 - DNA, 16 bp, Homo sapiens
ctctgacccctcctca

SEQ ID NO: 4915840 - DNA, 19 bp, Homo sapiens
ctctgacttaagcaaaaga

SEQ ID NO: 4915841 - DNA, 16 bp, Homo sapiens
ctctgagaagaggagc

SEQ ID NO: 4915842 - DNA, 18 bp, Homo sapiens
ctctgagaagaggagccc

SEQ ID NO: 4915843 - DNA, 13 bp, Homo sapiens
ctctgagagtcta

SEQ ID NO: 4915844 - DNA, 19 bp, Homo sapiens
ctctgagagtctagattct

SEQ ID NO: 4915845 - DNA, 22 bp, Homo sapiens
ctctgagagtctagattctctg

SEQ ID NO: 4915846 - DNA, 12 bp, Homo sapiens
ctctgagcccat

SEQ ID NO: 4915847 - DNA, 16 bp, Homo sapiens
ctctgagcgggaggca

SEQ ID NO: 4915848 - DNA, 16 bp, Homo sapiens
ctctgatatgggactg

SEQ ID NO: 4915849 - DNA, 19 bp, Homo sapiens
ctctgatatgggactgagc

SEQ ID NO: 4915850 - DNA, 19 bp, Homo sapiens
ctctgattttcaaagcttt

SEQ ID NO: 4915851 - DNA, 17 bp, Homo sapiens
ctctgcaaaaggagaga

SEQ ID NO: 4915852 - DNA, 15 bp, Homo sapiens
ctctgcaattcccct

SEQ ID NO: 4915853 - DNA, 19 bp, Homo sapiens
ctctgcaattcccctctgc

SEQ ID NO: 4915854 - DNA, 14 bp, Homo sapiens
ctctgcacatgtct

SEQ ID NO: 4915855 - DNA, 16 bp, Homo sapiens
ctctgcacatgtcttg

SEQ ID NO: 4915856 - DNA, 15 bp, Homo sapiens
ctctgcacccctctg

SEQ ID NO: 4915857 - DNA, 12 bp, Homo sapiens
ctctgcagctgc

SEQ ID NO: 4915858 - DNA, 14 bp, Homo sapiens
ctctgcagctgccg

SEQ ID NO: 4915859 - DNA, 13 bp, Homo sapiens
ctcaggggccaga

SEQ ID NO: 4915860 - DNA, 17 bp, Homo sapiens
ctcaggggccagaggaa

SEQ ID NO: 4915861 - DNA, 19 bp, Homo sapiens
ctcaggtcacataaaactt

SEQ ID NO: 4915862 - DNA, 19 bp, Homo sapiens
ctcaggtgatccacccacc

SEQ ID NO: 4915863 - DNA, 23 bp, Homo sapiens
ctcaggtgatccacccacctcag

SEQ ID NO: 4915864 - DNA, 17 bp, Homo sapiens
ctcaggtgtccctgcac

SEQ ID NO: 4915865 - DNA, 19 bp, Homo sapiens
ctcaggtgtccctgcactt

SEQ ID NO: 4915866 - DNA, 23 bp, Homo sapiens
ctcaggtgtccctgcacttgcag

SEQ ID NO: 4915867 - DNA, 15 bp, Homo sapiens
ctcagtcatgcataa

SEQ ID NO: 4915868 - DNA, 22 bp, Homo sapiens
ctcagtcatgcataaatatgca

SEQ ID NO: 4915869 - DNA, 15 bp, Homo sapiens
ctcagtccatagcag

SEQ ID NO: 4915870 - DNA, 15 bp, Homo sapiens
ctcagtccatttata

SEQ ID NO: 4915871 - DNA, 14 bp, Homo sapiens
ctcagtgcagcaat

SEQ ID NO: 4915872 - DNA, 21 bp, Homo sapiens
ctcagtggcttcatctgtcaa

SEQ ID NO: 4915873 - DNA, 15 bp, Homo sapiens
ctcagttcccttggc

SEQ ID NO: 4915874 - DNA, 21 bp, Homo sapiens
ctcataaaaagcctgcaattt

SEQ ID NO: 4915875 - DNA, 15 bp, Homo sapiens
ctcataactcattgt

SEQ ID NO: 4915876 - DNA, 20 bp, Homo sapiens
ctcatatggtctaccagttt

SEQ ID NO: 4915877 - DNA, 13 bp, Homo sapiens
ctcatatttaaag

SEQ ID NO: 4915878 - DNA, 12 bp, Homo sapiens
ctcatattttgt

SEQ ID NO: 4915879 - DNA, 13 bp, Homo sapiens
ctcatattttgta

SEQ ID NO: 4915880 - DNA, 16 bp, Homo sapiens
ctcatattttgtatat

SEQ ID NO: 4915881 - DNA, 15 bp, Homo sapiens
ctcatccaccccatc

SEQ ID NO: 4915882 - DNA, 24 bp, Homo sapiens
ctcatccaccccatccctccccag

SEQ ID NO: 4915883 - DNA, 13 bp, Homo sapiens
ctcatccccaggg

SEQ ID NO: 4915884 - DNA, 23 bp, Homo sapiens
ctcatcctcctggaaccttgctg

SEQ ID NO: 4915885 - DNA, 18 bp, Homo sapiens
ctcatctgcacccttctt

SEQ ID NO: 4915886 - DNA, 13 bp, Homo sapiens
ctcatcttgtgaa

SEQ ID NO: 4915887 - DNA, 17 bp, Homo sapiens
ctcatggcccctctgac

SEQ ID NO: 4915888 - DNA, 15 bp, Homo sapiens
ctcatgtttatgaaa

SEQ ID NO: 4915889 - DNA, 21 bp, Homo sapiens
ctcatgtttatgaaaataaat

SEQ ID NO: 4915890 - DNA, 15 bp, Homo sapiens
ctcattactgggcct

SEQ ID NO: 4915891 - DNA, 18 bp, Homo sapiens
ctcattactgggccttag

SEQ ID NO: 4915892 - DNA, 17 bp, Homo sapiens
ctcattccaacagtgag

SEQ ID NO: 4915893 - DNA, 21 bp, Homo sapiens
ctcattccaccttcccatgcc

SEQ ID NO: 4915894 - DNA, 14 bp, Homo sapiens
ctcccctgccttgc

SEQ ID NO: 4915895 - DNA, 13 bp, Homo sapiens
ctcccctgctgca

SEQ ID NO: 4915896 - DNA, 12 bp, Homo sapiens
ctccccttctct

SEQ ID NO: 4915897 - DNA, 15 bp, Homo sapiens
ctcccgagtagctgg

SEQ ID NO: 4915898 - DNA, 17 bp, Homo sapiens
ctcccgattcccaactg

SEQ ID NO: 4915899 - DNA, 14 bp, Homo sapiens
ctcccgctgctgct

SEQ ID NO: 4915900 - DNA, 15 bp, Homo sapiens
ctcccgctgctgctg

SEQ ID NO: 4915901 - DNA, 19 bp, Homo sapiens
ctcccggaggttgggtggg

SEQ ID NO: 4915902 - DNA, 20 bp, Homo sapiens
ctcccggaggttgggtgggc

SEQ ID NO: 4915903 - DNA, 20 bp, Homo sapiens
ctcccggctatgggggcact

SEQ ID NO: 4915904 - DNA, 21 bp, Homo sapiens
ctcccggtgcccaagaataga

SEQ ID NO: 4915905 - DNA, 17 bp, Homo sapiens
ctccctaagccagcctg

SEQ ID NO: 4915906 - DNA, 21 bp, Homo sapiens
ctccctagccagcacttgtat

SEQ ID NO: 4915907 - DNA, 15 bp, Homo sapiens
ctccctcccctgcca

SEQ ID NO: 4915908 - DNA, 13 bp, Homo sapiens
ctccctcccgcac

SEQ ID NO: 4915909 - DNA, 14 bp, Homo sapiens
ctccctcctcacct

SEQ ID NO: 4915910 - DNA, 16 bp, Homo sapiens
ctccctctctcttctg

SEQ ID NO: 4915911 - DNA, 21 bp, Homo sapiens
ctccctctctcttctgctcca

SEQ ID NO: 4915912 - DNA, 11 bp, Homo sapiens
ctccctcttgt

SEQ ID NO: 4915913 - DNA, 13 bp, Homo sapiens
ctccctgaagcca

SEQ ID NO: 4915914 - DNA, 16 bp, Homo sapiens
ctccctgacccgtcta

SEQ ID NO: 4915915 - DNA, 23 bp, Homo sapiens
ctccctgcagatgccaccctagc

SEQ ID NO: 4915916 - DNA, 13 bp, Homo sapiens
ctccctgccagag

SEQ ID NO: 4915917 - DNA, 14 bp, Homo sapiens
ctccctgccagagg

SEQ ID NO: 4915918 - DNA, 20 bp, Homo sapiens
ctccctgcccctcccttcaa

SEQ ID NO: 4915919 - DNA, 12 bp, Homo sapiens
ctccctggagtg

SEQ ID NO: 4915920 - DNA, 13 bp, Homo sapiens
ctccctgtgtcca

SEQ ID NO: 4915921 - DNA, 21 bp, Homo sapiens
ctccctgtgtccacctgtggg

SEQ ID NO: 4915922 - DNA, 12 bp, Homo sapiens
ctcccttcaacc

SEQ ID NO: 4915923 - DNA, 21 bp, Homo sapiens
ctcccttcaaccattccccat

SEQ ID NO: 4915924 - DNA, 23 bp, Homo sapiens
ctcccttcaaccattccccatgg

SEQ ID NO: 4915925 - DNA, 18 bp, Homo sapiens
ctcccttcagcccccagc

SEQ ID NO: 4915926 - DNA, 20 bp, Homo sapiens
ctcccttccgaccctctggg

SEQ ID NO: 4915927 - DNA, 21 bp, Homo sapiens
ctcccttccgaccctctggga

SEQ ID NO: 4915928 - DNA, 21 bp, Homo sapiens
ctcccttggtggcaagagccc

SEQ ID NO: 4915929 - DNA, 20 bp, Homo sapiens
ctccgcccccagcctatgag

SEQ ID NO: 4915930 - DNA, 14 bp, Homo sapiens
ctccgcccttagtc

SEQ ID NO: 4915931 - DNA, 21 bp, Homo sapiens
ctccgctttctacccagcgag

SEQ ID NO: 4915932 - DNA, 18 bp, Homo sapiens
ctccgtccaggagcctgg

SEQ ID NO: 4915933 - DNA, 13 bp, Homo sapiens
ctcctactcctga

SEQ ID NO: 4915934 - DNA, 15 bp, Homo sapiens
ctcctataatctgtc

SEQ ID NO: 4915935 - DNA, 17 bp, Homo sapiens
ctcctataatctgtcaa

SEQ ID NO: 4915936 - DNA, 22 bp, Homo sapiens
ctcctatcagaagtttctcagc

SEQ ID NO: 4915937 - DNA, 16 bp, Homo sapiens
ctcctatttttgtaaa

SEQ ID NO: 4915938 - DNA, 20 bp, Homo sapiens
ctcctcaatttttgtctcag

SEQ ID NO: 4915939 - DNA, 19 bp, Homo sapiens
ctcctcacacaccctgagg

SEQ ID NO: 4915940 - DNA, 17 bp, Homo sapiens
ctcctcacccccagctt

SEQ ID NO: 4915941 - DNA, 14 bp, Homo sapiens
ctcctcacctctgg

SEQ ID NO: 4915942 - DNA, 22 bp, Homo sapiens
ctcctcacctctggactggcta

SEQ ID NO: 4915943 - DNA, 17 bp, Homo sapiens
ctcctcactgcccgcac

SEQ ID NO: 4915944 - DNA, 18 bp, Homo sapiens
ctcctcactgcccgcaca

SEQ ID NO: 4915945 - DNA, 18 bp, Homo sapiens
ctcctcactggccatccc

SEQ ID NO: 4915946 - DNA, 11 bp, Homo sapiens
ctcctcatgta

SEQ ID NO: 4915947 - DNA, 16 bp, Homo sapiens
ctcctcctctttctct

SEQ ID NO: 4915948 - DNA, 22 bp, Homo sapiens
ctcctcggaaccgctcacctag

SEQ ID NO: 4915949 - DNA, 18 bp, Homo sapiens
ctcctctagctgtggggg

SEQ ID NO: 4915950 - DNA, 15 bp, Homo sapiens
ctcctctccccagca

SEQ ID NO: 4915951 - DNA, 14 bp, Homo sapiens
ctcctctcctggag

SEQ ID NO: 4915952 - DNA, 12 bp, Homo sapiens
ctcctctgtcca

SEQ ID NO: 4915953 - DNA, 16 bp, Homo sapiens
ctcctctgtcctgctt

SEQ ID NO: 4915954 - DNA, 18 bp, Homo sapiens
ctcctctgtcctgcttct

SEQ ID NO: 4915955 - DNA, 20 bp, Homo sapiens
ctcctctgtcctgcttctga

SEQ ID NO: 4915956 - DNA, 20 bp, Homo sapiens
ctcctcttcaccccggcagg

SEQ ID NO: 4915957 - DNA, 22 bp, Homo sapiens
ctcctcttcaccccggcaggcc

SEQ ID NO: 4915958 - DNA, 12 bp, Homo sapiens
ctcctcttgcca

SEQ ID NO: 4915959 - DNA, 19 bp, Homo sapiens
ctcctcttgccactgcctc

SEQ ID NO: 4915960 - DNA, 19 bp, Homo sapiens
ctcctctttaaaacaaaac

SEQ ID NO: 4915961 - DNA, 16 bp, Homo sapiens
ctcctctttctctccc

SEQ ID NO: 4915962 - DNA, 17 bp, Homo sapiens
ctcctctttctctcccc

SEQ ID NO: 4915963 - DNA, 20 bp, Homo sapiens
ctcctctttctctccccaac

SEQ ID NO: 4915964 - DNA, 23 bp, Homo sapiens
ctcctgaaccgcacagctcagga

SEQ ID NO: 4915965 - DNA, 14 bp, Homo sapiens
ctcctgacagaagg

SEQ ID NO: 4915966 - DNA, 15 bp, Homo sapiens
ctcctgacctcaagt

SEQ ID NO: 4915967 - DNA, 14 bp, Homo sapiens
ctcctgcactgttt

SEQ ID NO: 4915968 - DNA, 15 bp, Homo sapiens
ctcctgcactgttta

SEQ ID NO: 4915969 - DNA, 19 bp, Homo sapiens
ctcctgcagcatggtccct

SEQ ID NO: 4915970 - DNA, 19 bp, Homo sapiens
ctcctgcccgccacacaga

SEQ ID NO: 4915971 - DNA, 17 bp, Homo sapiens
ctcctgcctcagcctcc

SEQ ID NO: 4915972 - DNA, 22 bp, Homo sapiens
ctcctgcctcgaactggctgca

SEQ ID NO: 4915973 - DNA, 15 bp, Homo sapiens
ctcaatcaagaaaat

SEQ ID NO: 4915974 - DNA, 20 bp, Homo sapiens
ctcaatggagtatgtctgat

SEQ ID NO: 4915975 - DNA, 13 bp, Homo sapiens
ctcaatgtgaaaa

SEQ ID NO: 4915976 - DNA, 16 bp, Homo sapiens
ctcaatttttgtctca

SEQ ID NO: 4915977 - DNA, 15 bp, Homo sapiens
ctcacacaccctgag

SEQ ID NO: 4915978 - DNA, 17 bp, Homo sapiens
ctcacacaccctgaggt

SEQ ID NO: 4915979 - DNA, 13 bp, Homo sapiens
ctcacaccaaatt

SEQ ID NO: 4915980 - DNA, 16 bp, Homo sapiens
ctcacacctcactctt

SEQ ID NO: 4915981 - DNA, 20 bp, Homo sapiens
ctcacagatgtgactgtata

SEQ ID NO: 4915982 - DNA, 20 bp, Homo sapiens
ctcacagcacatgctggcca

SEQ ID NO: 4915983 - DNA, 21 bp, Homo sapiens
ctcacagcacatgctggccag

SEQ ID NO: 4915984 - DNA, 22 bp, Homo sapiens
ctcacagcacatgctggccagc

SEQ ID NO: 4915985 - DNA, 12 bp, Homo sapiens
ctcacagcctct

SEQ ID NO: 4915986 - DNA, 14 bp, Homo sapiens
ctcacagcctctga

SEQ ID NO: 4915987 - DNA, 18 bp, Homo sapiens
ctcacaggttggaagaga

SEQ ID NO: 4915988 - DNA, 20 bp, Homo sapiens
ctcacagtacagcatgtgcc

SEQ ID NO: 4915989 - DNA, 12 bp, Homo sapiens
ctcacagtgacc

SEQ ID NO: 4915990 - DNA, 14 bp, Homo sapiens
ctcacagtgaccct

SEQ ID NO: 4915991 - DNA, 16 bp, Homo sapiens
ctcacagtgacccttc

SEQ ID NO: 4915992 - DNA, 21 bp, Homo sapiens
ctcacagtgttgcccaggctg

SEQ ID NO: 4915993 - DNA, 15 bp, Homo sapiens
ctcacatttattctg

SEQ ID NO: 4915994 - DNA, 19 bp, Homo sapiens
ctcacatttattctgctca

SEQ ID NO: 4915995 - DNA, 20 bp, Homo sapiens
ctcaccagaattgtgcaaat

SEQ ID NO: 4915996 - DNA, 16 bp, Homo sapiens
ctcaccagccccactg

SEQ ID NO: 4915997 - DNA, 19 bp, Homo sapiens
ctcaccagccccactgcca

SEQ ID NO: 4915998 - DNA, 17 bp, Homo sapiens
ctcaccagccccagtgc

SEQ ID NO: 4915999 - DNA, 21 bp, Homo sapiens
ctcaccagccccagtgcccac

SEQ ID NO: 4916000 - DNA, 14 bp, Homo sapiens
ctcacccccagctt

SEQ ID NO: 4916001 - DNA, 17 bp, Homo sapiens
ctcacccccagctttgc

SEQ ID NO: 4916002 - DNA, 19 bp, Homo sapiens
ctcacccccagctttgcta

SEQ ID NO: 4916003 - DNA, 22 bp, Homo sapiens
ctcacccctgtcctcactgctc

SEQ ID NO: 4916004 - DNA, 12 bp, Homo sapiens
ctcaccgcttcc

SEQ ID NO: 4916005 - DNA, 14 bp, Homo sapiens
ctcacctagagcca

SEQ ID NO: 4916006 - DNA, 15 bp, Homo sapiens
ctcacctagagccag

SEQ ID NO: 4916007 - DNA, 18 bp, Homo sapiens
ctcacctagagccagacc

SEQ ID NO: 4916008 - DNA, 20 bp, Homo sapiens
ctcacctagagccagaccaa

SEQ ID NO: 4916009 - DNA, 18 bp, Homo sapiens
ctcacctctacccaaacc

SEQ ID NO: 4916010 - DNA, 22 bp, Homo sapiens
acagagctgtggaggattgcta

SEQ ID NO: 4916011 - DNA, 15 bp, Homo sapiens
acagaggcagcccca

SEQ ID NO: 4916012 - DNA, 19 bp, Homo sapiens
acagaggcagccccattct

SEQ ID NO: 4916013 - DNA, 21 bp, Homo sapiens
acagaggccatgggcctcctg

SEQ ID NO: 4916014 - DNA, 16 bp, Homo sapiens
acagaggggactctgg

SEQ ID NO: 4916015 - DNA, 12 bp, Homo sapiens
acagagtctcac

SEQ ID NO: 4916016 - DNA, 17 bp, Homo sapiens
acagagtctcactgttg

SEQ ID NO: 4916017 - DNA, 19 bp, Homo sapiens
acagagtgagactctgtct

SEQ ID NO: 4916018 - DNA, 21 bp, Homo sapiens
acagagtgagactctgtctca

SEQ ID NO: 4916019 - DNA, 20 bp, Homo sapiens
acagagttttcactcttatt

SEQ ID NO: 4916020 - DNA, 15 bp, Homo sapiens
acagataataatggg

SEQ ID NO: 4916021 - DNA, 21 bp, Homo sapiens
acagataataatgggtttctt

SEQ ID NO: 4916022 - DNA, 15 bp, Homo sapiens
acagatatactttgt

SEQ ID NO: 4916023 - DNA, 12 bp, Homo sapiens
acagatgaaaat

SEQ ID NO: 4916024 - DNA, 15 bp, Homo sapiens
acagatgaaaatttg

SEQ ID NO: 4916025 - DNA, 14 bp, Homo sapiens
acagatgaatgtat

SEQ ID NO: 4916026 - DNA, 19 bp, Homo sapiens
acagatgatgagaatttct

SEQ ID NO: 4916027 - DNA, 14 bp, Homo sapiens
acagatgccccaga

SEQ ID NO: 4916028 - DNA, 17 bp, Homo sapiens
acagatgccccagagct

SEQ ID NO: 4916029 - DNA, 19 bp, Homo sapiens
acagattcagtcttgcctt

SEQ ID NO: 4916030 - DNA, 24 bp, Homo sapiens
acagattggagagggctctgtgct

SEQ ID NO: 4916031 - DNA, 17 bp, Homo sapiens
acagattttaattgtca

SEQ ID NO: 4916032 - DNA, 18 bp, Homo sapiens
acagattttaattgtcat

SEQ ID NO: 4916033 - DNA, 21 bp, Homo sapiens
acagcaagtagataaatattt

SEQ ID NO: 4916034 - DNA, 18 bp, Homo sapiens
acagcacatgctggccag

SEQ ID NO: 4916035 - DNA, 18 bp, Homo sapiens
acagcactactgggtgtc

SEQ ID NO: 4916036 - DNA, 13 bp, Homo sapiens
acagcagcatttt

SEQ ID NO: 4916037 - DNA, 12 bp, Homo sapiens
acagcagcttca

SEQ ID NO: 4916038 - DNA, 17 bp, Homo sapiens
acagcagcttcaccaga

SEQ ID NO: 4916039 - DNA, 13 bp, Homo sapiens
acagccccagagc

SEQ ID NO: 4916040 - DNA, 14 bp, Homo sapiens
acagccccagagca

SEQ ID NO: 4916041 - DNA, 15 bp, Homo sapiens
acagccccagagcag

SEQ ID NO: 4916042 - DNA, 16 bp, Homo sapiens
acagcctcccaccccc

SEQ ID NO: 4916043 - DNA, 13 bp, Homo sapiens
acagcctcctctg

SEQ ID NO: 4916044 - DNA, 15 bp, Homo sapiens
acagcctcctctgtc

SEQ ID NO: 4916045 - DNA, 18 bp, Homo sapiens
acagcctctgacccctcc

SEQ ID NO: 4916046 - DNA, 22 bp, Homo sapiens
acagcctctgacccctcctcac

SEQ ID NO: 4916047 - DNA, 14 bp, Homo sapiens
acagcctggcacag

SEQ ID NO: 4916048 - DNA, 15 bp, Homo sapiens
acagcctggcacagg

SEQ ID NO: 4916049 - DNA, 17 bp, Homo sapiens
acagcgagggcagctgc

SEQ ID NO: 4916050 - DNA, 15 bp, Homo sapiens
acagcggcccctgca

SEQ ID NO: 4916051 - DNA, 16 bp, Homo sapiens
acagcggcccctgcat

SEQ ID NO: 4916052 - DNA, 16 bp, Homo sapiens
acagcggggccccagg

SEQ ID NO: 4916053 - DNA, 19 bp, Homo sapiens
acagcgtccctagcagtga

SEQ ID NO: 4916054 - DNA, 17 bp, Homo sapiens
acagctaatgggacact

SEQ ID NO: 4916055 - DNA, 22 bp, Homo sapiens
acagctatcgaacttcacaact

SEQ ID NO: 4916056 - DNA, 16 bp, Homo sapiens
acagctatgggagccc

SEQ ID NO: 4916057 - DNA, 17 bp, Homo sapiens
acagctatgggagcccc

SEQ ID NO: 4916058 - DNA, 19 bp, Homo sapiens
acagctcaggaggcgccct

SEQ ID NO: 4916059 - DNA, 18 bp, Homo sapiens
acagctccttctgtccta

SEQ ID NO: 4916060 - DNA, 13 bp, Homo sapiens
acagctctagaca

SEQ ID NO: 4916061 - DNA, 16 bp, Homo sapiens
acagctctgtcctggg

SEQ ID NO: 4916062 - DNA, 17 bp, Homo sapiens
acagctctgtgttgcca

SEQ ID NO: 4916063 - DNA, 19 bp, Homo sapiens
acagctctgtgttgccatg

SEQ ID NO: 4916064 - DNA, 16 bp, Homo sapiens
acagctcttaaatgta

SEQ ID NO: 4916065 - DNA, 16 bp, Homo sapiens
acagctcttctccagg

SEQ ID NO: 4916066 - DNA, 17 bp, Homo sapiens
acagctcttctccaggc

SEQ ID NO: 4916067 - DNA, 19 bp, Homo sapiens
acagctcttctccaggctg

SEQ ID NO: 4916068 - DNA, 15 bp, Homo sapiens
acagctgagagactt

SEQ ID NO: 4916069 - DNA, 16 bp, Homo sapiens
acagctgatacttcat

SEQ ID NO: 4916070 - DNA, 16 bp, Homo sapiens
acagctgcattagaaa

SEQ ID NO: 4916071 - DNA, 20 bp, Homo sapiens
acagctgcattagaaaaaga

SEQ ID NO: 4916072 - DNA, 22 bp, Homo sapiens
acagctgtgttattctttgcgt

SEQ ID NO: 4916073 - DNA, 14 bp, Homo sapiens
acagctgtttaaga

SEQ ID NO: 4916074 - DNA, 15 bp, Homo sapiens
acagctgtttaagat

SEQ ID NO: 4916075 - DNA, 19 bp, Homo sapiens
acagcttcatttcctgtgt

SEQ ID NO: 4916076 - DNA, 21 bp, Homo sapiens
acagctttggggtgtcttttt

SEQ ID NO: 4916077 - DNA, 16 bp, Homo sapiens
acaggaaaagctgctg

SEQ ID NO: 4916078 - DNA, 19 bp, Homo sapiens
acaggaaaagctgctgaca

SEQ ID NO: 4916079 - DNA, 16 bp, Homo sapiens
acaggactgattctgg

SEQ ID NO: 4916080 - DNA, 20 bp, Homo sapiens
acaggatttgaactcagatc

SEQ ID NO: 4916081 - DNA, 19 bp, Homo sapiens
acaggcaaaatccttgctt

SEQ ID NO: 4916082 - DNA, 19 bp, Homo sapiens
acaggcaagcacctcctgc

SEQ ID NO: 4916083 - DNA, 23 bp, Homo sapiens
acaggcaagcacctcctgcctcg

SEQ ID NO: 4916084 - DNA, 17 bp, Homo sapiens
acaggcaatgctggctg

SEQ ID NO: 4916085 - DNA, 19 bp, Homo sapiens
acaggcaatgctggctgtt

SEQ ID NO: 4916086 - DNA, 12 bp, Homo sapiens
acaggcaattcc

SEQ ID NO: 4916087 - DNA, 13 bp, Homo sapiens
acaggcaattccg

SEQ ID NO: 4916088 - DNA, 23 bp, Homo sapiens
acaggcacccaccatcatgtctg

SEQ ID NO: 4916089 - DNA, 15 bp, Homo sapiens
acaggcagatacagg

SEQ ID NO: 4916090 - DNA, 18 bp, Homo sapiens
acaggcagctttctagaa

SEQ ID NO: 4916091 - DNA, 14 bp, Homo sapiens
acaggcaggtccag

SEQ ID NO: 4916092 - DNA, 22 bp, Homo sapiens
acaggcagtctctctcttcctc

SEQ ID NO: 4916093 - DNA, 15 bp, Homo sapiens
acaggcatgttctct

SEQ ID NO: 4916094 - DNA, 18 bp, Homo sapiens
acaggcatgttctctgag

SEQ ID NO: 4916095 - DNA, 17 bp, Homo sapiens
acaggcatttgttcact

SEQ ID NO: 4916096 - DNA, 12 bp, Homo sapiens
acaggccccctt

SEQ ID NO: 4916097 - DNA, 21 bp, Homo sapiens
acaggcccggctccaggctcc

SEQ ID NO: 4916098 - DNA, 17 bp, Homo sapiens
acaggccctgctcctgc

SEQ ID NO: 4916099 - DNA, 20 bp, Homo sapiens
acaggccctgctcctgcagc

SEQ ID NO: 4916100 - DNA, 21 bp, Homo sapiens
acaggccctgctcctgcagca

SEQ ID NO: 4916101 - DNA, 15 bp, Homo sapiens
acaggcccttcctct

SEQ ID NO: 4916102 - DNA, 15 bp, Homo sapiens
acaggcctgaagata

SEQ ID NO: 4916103 - DNA, 12 bp, Homo sapiens
acaggctgggct

SEQ ID NO: 4916104 - DNA, 22 bp, Homo sapiens
acaggctgggcttcagtggcag

SEQ ID NO: 4916105 - DNA, 20 bp, Homo sapiens
acagggatttagacttacta

SEQ ID NO: 4916106 - DNA, 20 bp, Homo sapiens
acagggcacaccgggcactc

SEQ ID NO: 4916107 - DNA, 19 bp, Homo sapiens
acagggccagtggggcctg

SEQ ID NO: 4916108 - DNA, 21 bp, Homo sapiens
acagggccagtggggcctgtg

SEQ ID NO: 4916109 - DNA, 16 bp, Homo sapiens
acaggggaggtgatag

SEQ ID NO: 4916110 - DNA, 22 bp, Homo sapiens
acaggggaggtgatagcattgc

SEQ ID NO: 4916111 - DNA, 18 bp, Homo sapiens
acagggtaactgtgctga

SEQ ID NO: 4916112 - DNA, 19 bp, Homo sapiens
acagggttttgccatgttg

SEQ ID NO: 4916113 - DNA, 23 bp, Homo sapiens
acagggtttttacctgtcacatt

SEQ ID NO: 4916114 - DNA, 15 bp, Homo sapiens
acaggtaatataaaa

SEQ ID NO: 4916115 - DNA, 13 bp, Homo sapiens
acaggtcccacct

SEQ ID NO: 4916116 - DNA, 18 bp, Homo sapiens
acaggtcccacctccagc

SEQ ID NO: 4916117 - DNA, 13 bp, Homo sapiens
acaggtccctccc

SEQ ID NO: 4916118 - DNA, 18 bp, Homo sapiens
acaggtggacacacaagg

SEQ ID NO: 4916119 - DNA, 22 bp, Homo sapiens
acaggtgtgagtcaccaagccc

SEQ ID NO: 4916120 - DNA, 17 bp, Homo sapiens
acaggtgtggtgtaatt

SEQ ID NO: 4916121 - DNA, 17 bp, Homo sapiens
acaaatctgtgtatatt

SEQ ID NO: 4916122 - DNA, 20 bp, Homo sapiens
acaaatctgtgtatattatt

SEQ ID NO: 4916123 - DNA, 14 bp, Homo sapiens
acaaatgtctatca

SEQ ID NO: 4916124 - DNA, 14 bp, Homo sapiens
acaaattaaaaaga

SEQ ID NO: 4916125 - DNA, 16 bp, Homo sapiens
acaaattaaaaagatt

SEQ ID NO: 4916126 - DNA, 13 bp, Homo sapiens
acaaattaatttt

SEQ ID NO: 4916127 - DNA, 18 bp, Homo sapiens
acaacaaaggcaagttaa

SEQ ID NO: 4916128 - DNA, 15 bp, Homo sapiens
acaacaacctggtca

SEQ ID NO: 4916129 - DNA, 13 bp, Homo sapiens
acaacaagagttt

SEQ ID NO: 4916130 - DNA, 12 bp, Homo sapiens
acaacactcaca

SEQ ID NO: 4916131 - DNA, 11 bp, Homo sapiens
acaacagaagt

SEQ ID NO: 4916132 - DNA, 20 bp, Homo sapiens
acaacagctcgatccaaatt

SEQ ID NO: 4916133 - DNA, 22 bp, Homo sapiens
acaacagctcgatccaaattgt

SEQ ID NO: 4916134 - DNA, 16 bp, Homo sapiens
acaacatccatgtcct

SEQ ID NO: 4916135 - DNA, 21 bp, Homo sapiens
acaaccaatttacactgccat

SEQ ID NO: 4916136 - DNA, 22 bp, Homo sapiens
acaacctccattctattttaga

SEQ ID NO: 4916137 - DNA, 20 bp, Homo sapiens
acaacctccctcttgttttg

SEQ ID NO: 4916138 - DNA, 21 bp, Homo sapiens
acaacctccctcttgttttgt

SEQ ID NO: 4916139 - DNA, 16 bp, Homo sapiens
acaactatttttccaa

SEQ ID NO: 4916140 - DNA, 16 bp, Homo sapiens
acaactgacacaggaa

SEQ ID NO: 4916141 - DNA, 15 bp, Homo sapiens
acaactgcaaagaaa

SEQ ID NO: 4916142 - DNA, 21 bp, Homo sapiens
acaactgcctcgaaacacaga

SEQ ID NO: 4916143 - DNA, 22 bp, Homo sapiens
acaactgcctcgaaacacagaa

SEQ ID NO: 4916144 - DNA, 19 bp, Homo sapiens
acaactgtctaactttaga

SEQ ID NO: 4916145 - DNA, 13 bp, Homo sapiens
acaactgtgactg

SEQ ID NO: 4916146 - DNA, 14 bp, Homo sapiens
acaacttagtgtaa

SEQ ID NO: 4916147 - DNA, 17 bp, Homo sapiens
acaacttcaatatccaa

SEQ ID NO: 4916148 - DNA, 15 bp, Homo sapiens
acaagagcactacat

SEQ ID NO: 4916149 - DNA, 21 bp, Homo sapiens
acaagagcactacattcattt

SEQ ID NO: 4916150 - DNA, 20 bp, Homo sapiens
acaagagcagcctgtggcat

SEQ ID NO: 4916151 - DNA, 22 bp, Homo sapiens
acaagagcctgatctcttcctg

SEQ ID NO: 4916152 - DNA, 22 bp, Homo sapiens
acaagagtttatttccaaataa

SEQ ID NO: 4916153 - DNA, 22 bp, Homo sapiens
acaagatattgtacataaaaga

SEQ ID NO: 4916154 - DNA, 16 bp, Homo sapiens
acaagcaagttctgag

SEQ ID NO: 4916155 - DNA, 12 bp, Homo sapiens
acaagccacccc

SEQ ID NO: 4916156 - DNA, 13 bp, Homo sapiens
acaagcccacagc

SEQ ID NO: 4916157 - DNA, 15 bp, Homo sapiens
acaagcccacagcac

SEQ ID NO: 4916158 - DNA, 22 bp, Homo sapiens
acaaggaaatacccttctttta

SEQ ID NO: 4916159 - DNA, 17 bp, Homo sapiens
acaaggattgctactgt

SEQ ID NO: 4916160 - DNA, 21 bp, Homo sapiens
acaaggggctgttacataaca

SEQ ID NO: 4916161 - DNA, 16 bp, Homo sapiens
acaagtatacttatat

SEQ ID NO: 4916162 - DNA, 23 bp, Homo sapiens
acaagtatgaataaagacaccta

SEQ ID NO: 4916163 - DNA, 21 bp, Homo sapiens
acaagtcctggatgttgtgtg

SEQ ID NO: 4916164 - DNA, 15 bp, Homo sapiens
acaagtcctgtgaat

SEQ ID NO: 4916165 - DNA, 13 bp, Homo sapiens
acaagtcttccag

SEQ ID NO: 4916166 - DNA, 18 bp, Homo sapiens
acaagtgactgtatctgt

SEQ ID NO: 4916167 - DNA, 20 bp, Homo sapiens
acaagtgactgtatctgtgt

SEQ ID NO: 4916168 - DNA, 14 bp, Homo sapiens
acaagttttaaata

SEQ ID NO: 4916169 - DNA, 15 bp, Homo sapiens
acaagttttaatgta

SEQ ID NO: 4916170 - DNA, 22 bp, Homo sapiens
acaataatattgttgtataatt

SEQ ID NO: 4916171 - DNA, 23 bp, Homo sapiens
acaataatattgttgtataattt

SEQ ID NO: 4916172 - DNA, 17 bp, Homo sapiens
acaatacagataacatt

SEQ ID NO: 4916173 - DNA, 21 bp, Homo sapiens
acaatataaccacaaagcaca

SEQ ID NO: 4916174 - DNA, 18 bp, Homo sapiens
acaatatataaaaatata

SEQ ID NO: 4916175 - DNA, 12 bp, Homo sapiens
acaatcacactc

SEQ ID NO: 4916176 - DNA, 19 bp, Homo sapiens
acaatcatgaaatatgcat

SEQ ID NO: 4916177 - DNA, 20 bp, Homo sapiens
acaatcattgttttgaatat

SEQ ID NO: 4916178 - DNA, 21 bp, Homo sapiens
acaatcattgttttgaatatt

SEQ ID NO: 4916179 - DNA, 13 bp, Homo sapiens
acaatctcttaaa

SEQ ID NO: 4916180 - DNA, 14 bp, Homo sapiens
acaatctcttaaat

SEQ ID NO: 4916181 - DNA, 12 bp, Homo sapiens
acaatgcaaaac

SEQ ID NO: 4916182 - DNA, 22 bp, Homo sapiens
acaatgcacctagctgtgcaag

SEQ ID NO: 4916183 - DNA, 14 bp, Homo sapiens
acaatgtacacact

SEQ ID NO: 4916184 - DNA, 15 bp, Homo sapiens
acaatgtcagtattt

SEQ ID NO: 4916185 - DNA, 23 bp, Homo sapiens
acaatgtcagtatttcagtgtag

SEQ ID NO: 4916186 - DNA, 21 bp, Homo sapiens
acaatgttaaggaaactctta

SEQ ID NO: 4916187 - DNA, 21 bp, Homo sapiens
acaattgtttggggttgaaaa

SEQ ID NO: 4916188 - DNA, 23 bp, Homo sapiens
acaattgttttaatctgaaattc

SEQ ID NO: 4916189 - DNA, 14 bp, Homo sapiens
acaatttgatacat

SEQ ID NO: 4916190 - DNA, 18 bp, Homo sapiens
acaatttgatacataata

SEQ ID NO: 4916191 - DNA, 21 bp, Homo sapiens
acaatttgatacataataaaa

SEQ ID NO: 4916192 - DNA, 13 bp, Homo sapiens
acaatttttaatg

SEQ ID NO: 4916193 - DNA, 21 bp, Homo sapiens
acacaaaactccgcccccagc

SEQ ID NO: 4916194 - DNA, 19 bp, Homo sapiens
acacaaaccacaactgaca

SEQ ID NO: 4916195 - DNA, 16 bp, Homo sapiens
acacaaactgtaaata

SEQ ID NO: 4916196 - DNA, 19 bp, Homo sapiens
acacaaactgtaaataaaa

SEQ ID NO: 4916197 - DNA, 20 bp, Homo sapiens
acacaaaggaagtgccccct

SEQ ID NO: 4916198 - DNA, 18 bp, Homo sapiens
acacaagcccacagcaca

SEQ ID NO: 4916199 - DNA, 21 bp, Homo sapiens
acacaattggaattgtcttta

SEQ ID NO: 4916200 - DNA, 15 bp, Homo sapiens
acacacacacaaacc

SEQ ID NO: 4916201 - DNA, 15 bp, Homo sapiens
acacacacacacaca

SEQ ID NO: 4916202 - DNA, 15 bp, Homo sapiens
acacacacacacatc

SEQ ID NO: 4916203 - DNA, 14 bp, Homo sapiens
acacacacacgcac

SEQ ID NO: 4916204 - DNA, 13 bp, Homo sapiens
acacacacataca

SEQ ID NO: 4916205 - DNA, 17 bp, Homo sapiens
acacacacatacacgaa

SEQ ID NO: 4916206 - DNA, 19 bp, Homo sapiens
acacacacgcacgcacaca

SEQ ID NO: 4916207 - DNA, 21 bp, Homo sapiens
acacacacgcacgcacacaca

SEQ ID NO: 4916208 - DNA, 16 bp, Homo sapiens
acacacagaaaagcat

SEQ ID NO: 4916209 - DNA, 15 bp, Homo sapiens
acacacagatacaca

SEQ ID NO: 4916210 - DNA, 13 bp, Homo sapiens
acacacagctctg

SEQ ID NO: 4916211 - DNA, 21 bp, Homo sapiens
acacacatataaacatcacac

SEQ ID NO: 4916212 - DNA, 12 bp, Homo sapiens
acacacatgcac

SEQ ID NO: 4916213 - DNA, 17 bp, Homo sapiens
acacacatgcacacaca

SEQ ID NO: 4916214 - DNA, 15 bp, Homo sapiens
acacaccagagccca

SEQ ID NO: 4916215 - DNA, 15 bp, Homo sapiens
acacacctcaccaga

SEQ ID NO: 4916216 - DNA, 19 bp, Homo sapiens
acacagaaaatgttgagaa

SEQ ID NO: 4916217 - DNA, 20 bp, Homo sapiens
acacagaaaatgttgagaat

SEQ ID NO: 4916218 - DNA, 17 bp, Homo sapiens
acacagaaacactgcct

SEQ ID NO: 4916219 - DNA, 18 bp, Homo sapiens
acacagaaacctttttaa

SEQ ID NO: 4916220 - DNA, 12 bp, Homo sapiens
acacagaaatat

SEQ ID NO: 4916221 - DNA, 11 bp, Homo sapiens
acacagaccac

SEQ ID NO: 4916222 - DNA, 22 bp, Homo sapiens
acacagagaagcggatttccag

SEQ ID NO: 4916223 - DNA, 16 bp, Homo sapiens
acacagatacacacac

SEQ ID NO: 4916224 - DNA, 18 bp, Homo sapiens
acacagcctgggccccag

SEQ ID NO: 4916225 - DNA, 21 bp, Homo sapiens
acacagcgtccctagcagtga

SEQ ID NO: 4916226 - DNA, 19 bp, Homo sapiens
acacagctcttctccaggc

SEQ ID NO: 4916227 - DNA, 22 bp, Homo sapiens
acacagctgagagacttttaat

SEQ ID NO: 4916228 - DNA, 18 bp, Homo sapiens
acacagctgttcttctgt

SEQ ID NO: 4916229 - DNA, 18 bp, Homo sapiens
acacaggcccggctccag

SEQ ID NO: 4916230 - DNA, 21 bp, Homo sapiens
acacaggcccggctccaggct

SEQ ID NO: 4916231 - DNA, 24 bp, Homo sapiens
acacaggcccggctccaggctcct

SEQ ID NO: 4916232 - DNA, 23 bp, Homo sapiens
acacagggtgacggtgacaaaga

SEQ ID NO: 4916233 - DNA, 16 bp, Homo sapiens
acacagtattacttct

SEQ ID NO: 4916234 - DNA, 22 bp, Homo sapiens
acacatacagttttatgctctt

SEQ ID NO: 4916235 - DNA, 18 bp, Homo sapiens
acacatagattaatggca

SEQ ID NO: 4916236 - DNA, 20 bp, Homo sapiens
acacatagattaatggcact

SEQ ID NO: 4916237 - DNA, 16 bp, Homo sapiens
acacatccgccttttg

SEQ ID NO: 4916238 - DNA, 23 bp, Homo sapiens
acacatccgccttttgtatacat

SEQ ID NO: 4916239 - DNA, 13 bp, Homo sapiens
acacatgcacaca

SEQ ID NO: 4916240 - DNA, 12 bp, Homo sapiens
acacatttgtac

SEQ ID NO: 4916241 - DNA, 15 bp, Homo sapiens
acacatttttaaatt

SEQ ID NO: 4916242 - DNA, 15 bp, Homo sapiens
acaccaaagttctaa

SEQ ID NO: 4916243 - DNA, 14 bp, Homo sapiens
acaccacacccagc

SEQ ID NO: 4916244 - DNA, 14 bp, Homo sapiens
acaccacagacaca

SEQ ID NO: 4916245 - DNA, 18 bp, Homo sapiens
acaccagagcagatgcag

SEQ ID NO: 4916246 - DNA, 22 bp, Homo sapiens
acaccagagcagatgcagagag

SEQ ID NO: 4916247 - DNA, 12 bp, Homo sapiens
acaccagagccc

SEQ ID NO: 4916248 - DNA, 17 bp, Homo sapiens
acaccagtcacatgacc

SEQ ID NO: 4916249 - DNA, 20 bp, Homo sapiens
acacccaaagaggtatttat

SEQ ID NO: 4916250 - DNA, 20 bp, Homo sapiens
acacccaaagcatggactaa

SEQ ID NO: 4916251 - DNA, 13 bp, Homo sapiens
acacccagcctca

SEQ ID NO: 4916252 - DNA, 23 bp, Homo sapiens
acacccagcctcagtcctcccct

SEQ ID NO: 4916253 - DNA, 20 bp, Homo sapiens
acaccctcactctgccaggg

SEQ ID NO: 4916254 - DNA, 13 bp, Homo sapiens
acaccctcccccg

SEQ ID NO: 4916255 - DNA, 11 bp, Homo sapiens
acaccctgcaa

SEQ ID NO: 4916256 - DNA, 13 bp, Homo sapiens
acaccctgcaagg

SEQ ID NO: 4916257 - DNA, 13 bp, Homo sapiens
acaccctgtactg

SEQ ID NO: 4916258 - DNA, 22 bp, Homo sapiens
acaccctgtactgttctgtgtc

SEQ ID NO: 4916259 - DNA, 15 bp, Homo sapiens
acacccttagaaaat

SEQ ID NO: 4916260 - DNA, 11 bp, Homo sapiens
acacccttcct

SEQ ID NO: 4916261 - DNA, 16 bp, Homo sapiens
acaccgactagccagg

SEQ ID NO: 4916262 - DNA, 20 bp, Homo sapiens
acaccggctggcagggctgg

SEQ ID NO: 4916263 - DNA, 22 bp, Homo sapiens
acacctaaaggtgtatttaaac

SEQ ID NO: 4916264 - DNA, 21 bp, Homo sapiens
acacctactctatcagagaaa

SEQ ID NO: 4916265 - DNA, 18 bp, Homo sapiens
acacctagctttattctt

SEQ ID NO: 4916266 - DNA, 21 bp, Homo sapiens
acacctagctttattcttcag

SEQ ID NO: 4916267 - DNA, 16 bp, Homo sapiens
acacctcactctttat

SEQ ID NO: 4916268 - DNA, 18 bp, Homo sapiens
acacctcactctttatag

SEQ ID NO: 4916269 - DNA, 21 bp, Homo sapiens
acacctcagttcccttggcct

SEQ ID NO: 4916270 - DNA, 12 bp, Homo sapiens
acacctcccagg

SEQ ID NO: 4916271 - DNA, 14 bp, Homo sapiens
acacctctgccaga

SEQ ID NO: 4916272 - DNA, 13 bp, Homo sapiens
acacctgccctgc

SEQ ID NO: 4916273 - DNA, 20 bp, Homo sapiens
acaccttccagctcctgtaa

SEQ ID NO: 4916274 - DNA, 16 bp, Homo sapiens
acacctttaggttctt

SEQ ID NO: 4916275 - DNA, 13 bp, Homo sapiens
acacgaaagagag

SEQ ID NO: 4916276 - DNA, 15 bp, Homo sapiens
acacgcgtgcacaca

SEQ ID NO: 4916277 - DNA, 14 bp, Homo sapiens
acactaaccaaatc

SEQ ID NO: 4916278 - DNA, 18 bp, Homo sapiens
acactaaccaaatctctc

SEQ ID NO: 4916279 - DNA, 15 bp, Homo sapiens
acactaaccacgctg

SEQ ID NO: 4916280 - DNA, 19 bp, Homo sapiens
acactaactcaccagcccc

SEQ ID NO: 4916281 - DNA, 14 bp, Homo sapiens
acactactgagaat

SEQ ID NO: 4916282 - DNA, 16 bp, Homo sapiens
acactccagtgccagc

SEQ ID NO: 4916283 - DNA, 21 bp, Homo sapiens
acactccagtgccagcaatga

SEQ ID NO: 4916284 - DNA, 20 bp, Homo sapiens
acactcctagagaacgcagc

SEQ ID NO: 4916285 - DNA, 16 bp, Homo sapiens
acactgaaaaattata

SEQ ID NO: 4916286 - DNA, 23 bp, Homo sapiens
acactgaccttggagagacacag

SEQ ID NO: 4916287 - DNA, 13 bp, Homo sapiens
acactgacttgag

SEQ ID NO: 4916288 - DNA, 22 bp, Homo sapiens
acactgatgcttagatgttcca

SEQ ID NO: 4916289 - DNA, 12 bp, Homo sapiens
acactgcctggg

SEQ ID NO: 4916290 - DNA, 16 bp, Homo sapiens
acactgcctgggctga

SEQ ID NO: 4916291 - DNA, 16 bp, Homo sapiens
acactgcctgtatact

SEQ ID NO: 4916292 - DNA, 18 bp, Homo sapiens
acactgcctgtatacttt

SEQ ID NO: 4916293 - DNA, 19 bp, Homo sapiens
acactgcctgtatacttta

SEQ ID NO: 4916294 - DNA, 19 bp, Homo sapiens
acactgcctttttatttat

SEQ ID NO: 4916295 - DNA, 22 bp, Homo sapiens
acactgcctttttatttatatg

SEQ ID NO: 4916296 - DNA, 14 bp, Homo sapiens
acactggcccctca

SEQ ID NO: 4916297 - DNA, 17 bp, Homo sapiens
acactggctaaagataa

SEQ ID NO: 4916298 - DNA, 22 bp, Homo sapiens
acactggctaaagataattgct

SEQ ID NO: 4916299 - DNA, 20 bp, Homo sapiens
acactggtgtgacctgaggg

SEQ ID NO: 4916300 - DNA, 21 bp, Homo sapiens
acactgtatttgtatctctga

SEQ ID NO: 4916301 - DNA, 15 bp, Homo sapiens
acactgtgctataaa

SEQ ID NO: 4916302 - DNA, 22 bp, Homo sapiens
acacttcaggctcttctccttt

SEQ ID NO: 4916303 - DNA, 12 bp, Homo sapiens
acacttccagac

SEQ ID NO: 4916304 - DNA, 16 bp, Homo sapiens
acacttgtataaatgt

SEQ ID NO: 4916305 - DNA, 15 bp, Homo sapiens
acagaaaaagacttt

SEQ ID NO: 4916306 - DNA, 12 bp, Homo sapiens
acagaaacaaaa

SEQ ID NO: 4916307 - DNA, 12 bp, Homo sapiens
acagaaacactg

SEQ ID NO: 4916308 - DNA, 14 bp, Homo sapiens
acagaaacactgcc

SEQ ID NO: 4916309 - DNA, 17 bp, Homo sapiens
acagaaacctatcctca

SEQ ID NO: 4916310 - DNA, 20 bp, Homo sapiens
acagaaacctttttaaaaat

SEQ ID NO: 4916311 - DNA, 18 bp, Homo sapiens
acagaaacgcatccagca

SEQ ID NO: 4916312 - DNA, 17 bp, Homo sapiens
acagaaatataataaaa

SEQ ID NO: 4916313 - DNA, 20 bp, Homo sapiens
acagaaatatatatacatat

SEQ ID NO: 4916314 - DNA, 17 bp, Homo sapiens
acagaacagcttcaggt

SEQ ID NO: 4916315 - DNA, 20 bp, Homo sapiens
acagaacagcttcaggttat

SEQ ID NO: 4916316 - DNA, 13 bp, Homo sapiens
acagaacagggtc

SEQ ID NO: 4916317 - DNA, 17 bp, Homo sapiens
acagaacccctacatga

SEQ ID NO: 4916318 - DNA, 14 bp, Homo sapiens
acagaactaaatgt

SEQ ID NO: 4916319 - DNA, 17 bp, Homo sapiens
acagaactaaatgttct

SEQ ID NO: 4916320 - DNA, 20 bp, Homo sapiens
acagaacttgaatgtgtcag

SEQ ID NO: 4916321 - DNA, 12 bp, Homo sapiens
acagaagcattt

SEQ ID NO: 4916322 - DNA, 20 bp, Homo sapiens
acagaagcatttgtattttg

SEQ ID NO: 4916323 - DNA, 21 bp, Homo sapiens
acagaagcatttgtattttgt

SEQ ID NO: 4916324 - DNA, 22 bp, Homo sapiens
acagaagcatttgtattttgtg

SEQ ID NO: 4916325 - DNA, 19 bp, Homo sapiens
acagaagcttcagaagttt

SEQ ID NO: 4916326 - DNA, 13 bp, Homo sapiens
acagaatgtatct

SEQ ID NO: 4916327 - DNA, 20 bp, Homo sapiens
acagaatgtatctgtgaagt

SEQ ID NO: 4916328 - DNA, 20 bp, Homo sapiens
acagaatgttttactgtgaa

SEQ ID NO: 4916329 - DNA, 12 bp, Homo sapiens
acagacacacac

SEQ ID NO: 4916330 - DNA, 16 bp, Homo sapiens
acagacacacacacgc

SEQ ID NO: 4916331 - DNA, 17 bp, Homo sapiens
acagacacacacacgca

SEQ ID NO: 4916332 - DNA, 23 bp, Homo sapiens
acagacacacacacgcacgcaca

SEQ ID NO: 4916333 - DNA, 11 bp, Homo sapiens
acagacacagg

SEQ ID NO: 4916334 - DNA, 14 bp, Homo sapiens
acagacacaggccc

SEQ ID NO: 4916335 - DNA, 17 bp, Homo sapiens
acagacctgctttttga

SEQ ID NO: 4916336 - DNA, 19 bp, Homo sapiens
acagactggaagcacagct

SEQ ID NO: 4916337 - DNA, 21 bp, Homo sapiens
acagactggaagcacagcttc

SEQ ID NO: 4916338 - DNA, 22 bp, Homo sapiens
acagactggaagcacagcttca

SEQ ID NO: 4916339 - DNA, 11 bp, Homo sapiens
acagagaaagt

SEQ ID NO: 4916340 - DNA, 20 bp, Homo sapiens
acagagaagcggatttccag

SEQ ID NO: 4916341 - DNA, 14 bp, Homo sapiens
acagagaagctggg

SEQ ID NO: 4916342 - DNA, 21 bp, Homo sapiens
acagagagggcaccatcacaa

SEQ ID NO: 4916343 - DNA, 20 bp, Homo sapiens
acagagcactaggttcaatt

SEQ ID NO: 4916344 - DNA, 16 bp, Homo sapiens
aatgaaatttaaacat

SEQ ID NO: 4916345 - DNA, 21 bp, Homo sapiens
aatgaacactcttttgcttta

SEQ ID NO: 4916346 - DNA, 22 bp, Homo sapiens
aatgaagcagctttaaacaaat

SEQ ID NO: 4916347 - DNA, 13 bp, Homo sapiens
aatgaagccagct

SEQ ID NO: 4916348 - DNA, 15 bp, Homo sapiens
aatgaatatctatta

SEQ ID NO: 4916349 - DNA, 18 bp, Homo sapiens
aatgaatattttgataat

SEQ ID NO: 4916350 - DNA, 12 bp, Homo sapiens
aatgaatgtcta

SEQ ID NO: 4916351 - DNA, 17 bp, Homo sapiens
aatgaattaaataaacc

SEQ ID NO: 4916352 - DNA, 19 bp, Homo sapiens
aatgacatgcactgaccct

SEQ ID NO: 4916353 - DNA, 12 bp, Homo sapiens
aatgactactta

SEQ ID NO: 4916354 - DNA, 13 bp, Homo sapiens
aatgagaatctac

SEQ ID NO: 4916355 - DNA, 19 bp, Homo sapiens
aatgagactctagggtcca

SEQ ID NO: 4916356 - DNA, 17 bp, Homo sapiens
aatgagaggttcctaag

SEQ ID NO: 4916357 - DNA, 14 bp, Homo sapiens
aatgagcccagaga

SEQ ID NO: 4916358 - DNA, 19 bp, Homo sapiens
aatgagcccagagaacagc

SEQ ID NO: 4916359 - DNA, 19 bp, Homo sapiens
aatgagctattaaaactca

SEQ ID NO: 4916360 - DNA, 19 bp, Homo sapiens
aatgagtctgttgtgtgtc

SEQ ID NO: 4916361 - DNA, 14 bp, Homo sapiens
aatgagttgtgaaa

SEQ ID NO: 4916362 - DNA, 17 bp, Homo sapiens
aatgatcagcatctgtg

SEQ ID NO: 4916363 - DNA, 20 bp, Homo sapiens
aatgatctgcctctaaaagc

SEQ ID NO: 4916364 - DNA, 15 bp, Homo sapiens
aatgatgagtattag

SEQ ID NO: 4916365 - DNA, 12 bp, Homo sapiens
aatgatgataac

SEQ ID NO: 4916366 - DNA, 18 bp, Homo sapiens
aatgatggcaattttgta

SEQ ID NO: 4916367 - DNA, 14 bp, Homo sapiens
aatgattattttca

SEQ ID NO: 4916368 - DNA, 21 bp, Homo sapiens
aatgattattttcattacaat

SEQ ID NO: 4916369 - DNA, 14 bp, Homo sapiens
aatgattgtaaaat

SEQ ID NO: 4916370 - DNA, 13 bp, Homo sapiens
aatgatttcatgc

SEQ ID NO: 4916371 - DNA, 20 bp, Homo sapiens
aatgcaaaatttttttaatc

SEQ ID NO: 4916372 - DNA, 16 bp, Homo sapiens
aatgcaaagttctgtg

SEQ ID NO: 4916373 - DNA, 23 bp, Homo sapiens
aatgcaaagttctgtgtttaatt

SEQ ID NO: 4916374 - DNA, 17 bp, Homo sapiens
aatgcacagatatactt

SEQ ID NO: 4916375 - DNA, 17 bp, Homo sapiens
aatgcacatccattccc

SEQ ID NO: 4916376 - DNA, 19 bp, Homo sapiens
aatgcacctagctgtgcaa

SEQ ID NO: 4916377 - DNA, 20 bp, Homo sapiens
aatgcagcaaggccctgctg

SEQ ID NO: 4916378 - DNA, 23 bp, Homo sapiens
aatgcagcaaggccctgctgccc

SEQ ID NO: 4916379 - DNA, 21 bp, Homo sapiens
aatgcatgaacaagttttaat

SEQ ID NO: 4916380 - DNA, 18 bp, Homo sapiens
aatgcattaaacctgtct

SEQ ID NO: 4916381 - DNA, 19 bp, Homo sapiens
aatgccatttatttattga

SEQ ID NO: 4916382 - DNA, 18 bp, Homo sapiens
aatgcccgtaatgcttag

SEQ ID NO: 4916383 - DNA, 16 bp, Homo sapiens
aatgcccttaaatcat

SEQ ID NO: 4916384 - DNA, 17 bp, Homo sapiens
aatgccttaaaatggaa

SEQ ID NO: 4916385 - DNA, 22 bp, Homo sapiens
aatgccttagaaatgtaaactg

SEQ ID NO: 4916386 - DNA, 12 bp, Homo sapiens
aatgcctttgag

SEQ ID NO: 4916387 - DNA, 16 bp, Homo sapiens
aatgcctttgagacag

SEQ ID NO: 4916388 - DNA, 17 bp, Homo sapiens
aatgcctttgagacagt

SEQ ID NO: 4916389 - DNA, 18 bp, Homo sapiens
aatgcctttgagacagtt

SEQ ID NO: 4916390 - DNA, 15 bp, Homo sapiens
aatgctattgaaaat

SEQ ID NO: 4916391 - DNA, 16 bp, Homo sapiens
aatgctattgaaaatg

SEQ ID NO: 4916392 - DNA, 18 bp, Homo sapiens
aatgctgaaaaaacacct

SEQ ID NO: 4916393 - DNA, 13 bp, Homo sapiens
aatgctgcacttc

SEQ ID NO: 4916394 - DNA, 11 bp, Homo sapiens
aatgctgccag

SEQ ID NO: 4916395 - DNA, 12 bp, Homo sapiens
aatgctgtacat

SEQ ID NO: 4916396 - DNA, 13 bp, Homo sapiens
aatgctgtgttaa

SEQ ID NO: 4916397 - DNA, 17 bp, Homo sapiens
aatgcttaatttctaaa

SEQ ID NO: 4916398 - DNA, 20 bp, Homo sapiens
aatgcttatcatctaaagat

SEQ ID NO: 4916399 - DNA, 11 bp, Homo sapiens
aatgcttcaga

SEQ ID NO: 4916400 - DNA, 16 bp, Homo sapiens
aatgcttcagatatta

SEQ ID NO: 4916401 - DNA, 18 bp, Homo sapiens
aatgcttcagatattatt

SEQ ID NO: 4916402 - DNA, 13 bp, Homo sapiens
aatgcttcattca

SEQ ID NO: 4916403 - DNA, 22 bp, Homo sapiens
aatgcttcattcaatattgaca

SEQ ID NO: 4916404 - DNA, 19 bp, Homo sapiens
aatgctttttatttctgca

SEQ ID NO: 4916405 - DNA, 20 bp, Homo sapiens
aatgctttttatttctgcat

SEQ ID NO: 4916406 - DNA, 18 bp, Homo sapiens
aatggaagagaaatctca

SEQ ID NO: 4916407 - DNA, 22 bp, Homo sapiens
aatggaataaaaggcttgaagc

SEQ ID NO: 4916408 - DNA, 14 bp, Homo sapiens
aatggacatggtgg

SEQ ID NO: 4916409 - DNA, 17 bp, Homo sapiens
aatggactggtttgaga

SEQ ID NO: 4916410 - DNA, 19 bp, Homo sapiens
aatggactggtttgagatt

SEQ ID NO: 4916411 - DNA, 21 bp, Homo sapiens
aatggacttatttcttcaaat

SEQ ID NO: 4916412 - DNA, 20 bp, Homo sapiens
aatggagattcagttttcat

SEQ ID NO: 4916413 - DNA, 14 bp, Homo sapiens
aatggatattatta

SEQ ID NO: 4916414 - DNA, 21 bp, Homo sapiens
aatggattggattatttaata

SEQ ID NO: 4916415 - DNA, 22 bp, Homo sapiens
aatggattggattatttaataa

SEQ ID NO: 4916416 - DNA, 14 bp, Homo sapiens
aatggattgttaat

SEQ ID NO: 4916417 - DNA, 19 bp, Homo sapiens
aatggcactgttgcaaact

SEQ ID NO: 4916418 - DNA, 12 bp, Homo sapiens
aatggcagcctt

SEQ ID NO: 4916419 - DNA, 17 bp, Homo sapiens
aatggccatttgctttt

SEQ ID NO: 4916420 - DNA, 13 bp, Homo sapiens
aatgggacactaa

SEQ ID NO: 4916421 - DNA, 16 bp, Homo sapiens
aatgggaggcctctga

SEQ ID NO: 4916422 - DNA, 20 bp, Homo sapiens
aatgggctcttccaacaagg

SEQ ID NO: 4916423 - DNA, 17 bp, Homo sapiens
aatggtaggcatttcct

SEQ ID NO: 4916424 - DNA, 18 bp, Homo sapiens
aatggtaggcatttccta

SEQ ID NO: 4916425 - DNA, 15 bp, Homo sapiens
aatggtcctgacttt

SEQ ID NO: 4916426 - DNA, 20 bp, Homo sapiens
aatggtgtcagtatccaggc

SEQ ID NO: 4916427 - DNA, 16 bp, Homo sapiens
aatggtttattttgta

SEQ ID NO: 4916428 - DNA, 16 bp, Homo sapiens
aatgtaaactgccata

SEQ ID NO: 4916429 - DNA, 22 bp, Homo sapiens
aatgtaagattatagattctaa

SEQ ID NO: 4916430 - DNA, 15 bp, Homo sapiens
aatgtaccttctttc

SEQ ID NO: 4916431 - DNA, 12 bp, Homo sapiens
aatgtactgaga

SEQ ID NO: 4916432 - DNA, 15 bp, Homo sapiens
aatgtactgagattt

SEQ ID NO: 4916433 - DNA, 19 bp, Homo sapiens
aatgtacttgtttctctgt

SEQ ID NO: 4916434 - DNA, 18 bp, Homo sapiens
aatgtagcgtgtttacat

SEQ ID NO: 4916435 - DNA, 15 bp, Homo sapiens
aatgtagttgatgta

SEQ ID NO: 4916436 - DNA, 16 bp, Homo sapiens
aatgtagttgatgtat

SEQ ID NO: 4916437 - DNA, 19 bp, Homo sapiens
aatgtagttgatgtatcca

SEQ ID NO: 4916438 - DNA, 16 bp, Homo sapiens
aatgtatatacacata

SEQ ID NO: 4916439 - DNA, 19 bp, Homo sapiens
aatgtatatacacatatac

SEQ ID NO: 4916440 - DNA, 16 bp, Homo sapiens
aatgtatcatagaaat

SEQ ID NO: 4916441 - DNA, 19 bp, Homo sapiens
aatgtatcatagaaatgta

SEQ ID NO: 4916442 - DNA, 22 bp, Homo sapiens
aatgtatcatagaaatgtaact

SEQ ID NO: 4916443 - DNA, 19 bp, Homo sapiens
aatgtatgtaatgtgtggt

SEQ ID NO: 4916444 - DNA, 15 bp, Homo sapiens
aatgtatttgttcat

SEQ ID NO: 4916445 - DNA, 18 bp, Homo sapiens
aatgtatttgttcatgtt

SEQ ID NO: 4916446 - DNA, 19 bp, Homo sapiens
aatgtatttgttcatgttt

SEQ ID NO: 4916447 - DNA, 14 bp, Homo sapiens
aatgtatttttcta

SEQ ID NO: 4916448 - DNA, 16 bp, Homo sapiens
aatgtcagtatttcag

SEQ ID NO: 4916449 - DNA, 18 bp, Homo sapiens
aatgtcatatactgccat

SEQ ID NO: 4916450 - DNA, 17 bp, Homo sapiens
aatgtcctccagaagcc

SEQ ID NO: 4916451 - DNA, 21 bp, Homo sapiens
aatgtcctccagaagcctctg

SEQ ID NO: 4916452 - DNA, 15 bp, Homo sapiens
aatgtctaaatgctg

SEQ ID NO: 4916453 - DNA, 17 bp, Homo sapiens
aatgtctaaatgctgaa

SEQ ID NO: 4916454 - DNA, 15 bp, Homo sapiens
aatgtctgctgagga

SEQ ID NO: 4916455 - DNA, 18 bp, Homo sapiens
aatgtcttaatttttgaa

SEQ ID NO: 4916456 - DNA, 15 bp, Homo sapiens
aatgtctttgtaagt

SEQ ID NO: 4916457 - DNA, 13 bp, Homo sapiens
aatgtgaaagcac

SEQ ID NO: 4916458 - DNA, 15 bp, Homo sapiens
aatgtgatgttctaa

SEQ ID NO: 4916459 - DNA, 16 bp, Homo sapiens
aatgtggaagaaaatg

SEQ ID NO: 4916460 - DNA, 22 bp, Homo sapiens
aatgtggcaaggaaaaacaggt

SEQ ID NO: 4916461 - DNA, 12 bp, Homo sapiens
aatgtgtgtatg

SEQ ID NO: 4916462 - DNA, 21 bp, Homo sapiens
aatgtgtgtatgtgtatttat

SEQ ID NO: 4916463 - DNA, 12 bp, Homo sapiens
aatgtgttctcg

SEQ ID NO: 4916464 - DNA, 13 bp, Homo sapiens
aatgttaaatttg

SEQ ID NO: 4916465 - DNA, 12 bp, Homo sapiens
aatgttaagaat

SEQ ID NO: 4916466 - DNA, 22 bp, Homo sapiens
aatgttaaggaaactcttatct

SEQ ID NO: 4916467 - DNA, 16 bp, Homo sapiens
aatgttagtcattgtt

SEQ ID NO: 4916468 - DNA, 17 bp, Homo sapiens
aatgttatcttctcaag

SEQ ID NO: 4916469 - DNA, 23 bp, Homo sapiens
aatgttatcttctcaagttctaa

SEQ ID NO: 4916470 - DNA, 20 bp, Homo sapiens
aatgttattttcttctaagt

SEQ ID NO: 4916471 - DNA, 21 bp, Homo sapiens
aatgttattttcttctaagtg

SEQ ID NO: 4916472 - DNA, 20 bp, Homo sapiens
aatgttctaagtttctaaga

SEQ ID NO: 4916473 - DNA, 22 bp, Homo sapiens
aatgttctaagtttctaagatt

SEQ ID NO: 4916474 - DNA, 19 bp, Homo sapiens
aatgttgaaccaaacctcc

SEQ ID NO: 4916475 - DNA, 18 bp, Homo sapiens
aatgttgagaatcccaaa

SEQ ID NO: 4916476 - DNA, 20 bp, Homo sapiens
aatgtttgacacaattggaa

SEQ ID NO: 4916477 - DNA, 23 bp, Homo sapiens
aatgtttgaggagcatgttttgt

SEQ ID NO: 4916478 - DNA, 18 bp, Homo sapiens
aatgtttgcctctgcctc

SEQ ID NO: 4916479 - DNA, 19 bp, Homo sapiens
aatgtttgcctctgcctct

SEQ ID NO: 4916480 - DNA, 22 bp, Homo sapiens
aatgtttgtctcagttggaaat

SEQ ID NO: 4916481 - DNA, 10 bp, Homo sapiens
aattaaaact

SEQ ID NO: 4916482 - DNA, 14 bp, Homo sapiens
aattaaaacttctt

SEQ ID NO: 4916483 - DNA, 15 bp, Homo sapiens
aattaaaacttctta

SEQ ID NO: 4916484 - DNA, 13 bp, Homo sapiens
aattaagaaggca

SEQ ID NO: 4916485 - DNA, 21 bp, Homo sapiens
aattaagaatatgtttccttg

SEQ ID NO: 4916486 - DNA, 14 bp, Homo sapiens
aattaagttatctt

SEQ ID NO: 4916487 - DNA, 14 bp, Homo sapiens
aattaatagtttgt

SEQ ID NO: 4916488 - DNA, 13 bp, Homo sapiens
aattaatttgatt

SEQ ID NO: 4916489 - DNA, 16 bp, Homo sapiens
aattaatttgattaac

SEQ ID NO: 4916490 - DNA, 21 bp, Homo sapiens
aattaatttgattaacaaata

SEQ ID NO: 4916491 - DNA, 22 bp, Homo sapiens
aattaatttgattaacaaatat

SEQ ID NO: 4916492 - DNA, 12 bp, Homo sapiens
aattaattttac

SEQ ID NO: 4916493 - DNA, 20 bp, Homo sapiens
aattagaaaaaaattactaa

SEQ ID NO: 4916494 - DNA, 17 bp, Homo sapiens
aattaggaagtgattat

SEQ ID NO: 4916495 - DNA, 21 bp, Homo sapiens
aattaggaggctcaacaataa

SEQ ID NO: 4916496 - DNA, 19 bp, Homo sapiens
aattagggtacatttataa

SEQ ID NO: 4916497 - DNA, 21 bp, Homo sapiens
aattagggtacatttataatt

SEQ ID NO: 4916498 - DNA, 21 bp, Homo sapiens
aattataggagccttaatttt

SEQ ID NO: 4916499 - DNA, 21 bp, Homo sapiens
aattatagtttctgaggcttt

SEQ ID NO: 4916500 - DNA, 12 bp, Homo sapiens
aattatatctgt

SEQ ID NO: 4916501 - DNA, 21 bp, Homo sapiens
aattatcctgaactcttctgc

SEQ ID NO: 4916502 - DNA, 17 bp, Homo sapiens
aattatgaatctgattt

SEQ ID NO: 4916503 - DNA, 21 bp, Homo sapiens
aattatgaatctgatttttat

SEQ ID NO: 4916504 - DNA, 12 bp, Homo sapiens
aattatgacaat

SEQ ID NO: 4916505 - DNA, 13 bp, Homo sapiens
aattatgatttgg

SEQ ID NO: 4916506 - DNA, 20 bp, Homo sapiens
aattattaactacatttatg

SEQ ID NO: 4916507 - DNA, 15 bp, Homo sapiens
aattattatttgtgt

SEQ ID NO: 4916508 - DNA, 20 bp, Homo sapiens
aattattgatatatattata

SEQ ID NO: 4916509 - DNA, 19 bp, Homo sapiens
aattatttatttaataaca

SEQ ID NO: 4916510 - DNA, 14 bp, Homo sapiens
aattatttgtgtaa

SEQ ID NO: 4916511 - DNA, 21 bp, Homo sapiens
aattatttgtgtaatagaaaa

SEQ ID NO: 4916512 - DNA, 20 bp, Homo sapiens
aattcaaactggggcctcca

SEQ ID NO: 4916513 - DNA, 12 bp, Homo sapiens
aattcaagaaaa

SEQ ID NO: 4916514 - DNA, 15 bp, Homo sapiens
aattcaattttaaag

SEQ ID NO: 4916515 - DNA, 20 bp, Homo sapiens
aattcactcaagcactgata

SEQ ID NO: 4916516 - DNA, 16 bp, Homo sapiens
aattcagcaaaccatt

SEQ ID NO: 4916517 - DNA, 18 bp, Homo sapiens
aattccaaagtctctaat

SEQ ID NO: 4916518 - DNA, 17 bp, Homo sapiens
aattccaattatatgag

SEQ ID NO: 4916519 - DNA, 16 bp, Homo sapiens
aattccacacctttta

SEQ ID NO: 4916520 - DNA, 15 bp, Homo sapiens
aattcctacagcact

SEQ ID NO: 4916521 - DNA, 21 bp, Homo sapiens
aattcctatatcctgtgactg

SEQ ID NO: 4916522 - DNA, 15 bp, Homo sapiens
aattcgcccgagctg

SEQ ID NO: 4916523 - DNA, 15 bp, Homo sapiens
aattctacattgtca

SEQ ID NO: 4916524 - DNA, 15 bp, Homo sapiens
aattctattaaagtg

SEQ ID NO: 4916525 - DNA, 23 bp, Homo sapiens
aattctattaaagtgctaaggtt

SEQ ID NO: 4916526 - DNA, 21 bp, Homo sapiens
aattctcatttgtcacacact

SEQ ID NO: 4916527 - DNA, 22 bp, Homo sapiens
aattcttcacctaagtctctgt

SEQ ID NO: 4916528 - DNA, 20 bp, Homo sapiens
aattcttcagcgtaaaatgg

SEQ ID NO: 4916529 - DNA, 21 bp, Homo sapiens
aattcttcagcgtaaaatggt

SEQ ID NO: 4916530 - DNA, 11 bp, Homo sapiens
aattcttcagt

SEQ ID NO: 4916531 - DNA, 20 bp, Homo sapiens
aattcttcagttggttgtgt

SEQ ID NO: 4916532 - DNA, 21 bp, Homo sapiens
aattcttgaaagaattttcct

SEQ ID NO: 4916533 - DNA, 16 bp, Homo sapiens
aattctttatttctgt

SEQ ID NO: 4916534 - DNA, 17 bp, Homo sapiens
aattgaaaaactcttta

SEQ ID NO: 4916535 - DNA, 17 bp, Homo sapiens
aattgaagagagatata

SEQ ID NO: 4916536 - DNA, 18 bp, Homo sapiens
aattgaccatctgctttt

SEQ ID NO: 4916537 - DNA, 19 bp, Homo sapiens
aattgagaaaaatatatac

SEQ ID NO: 4916538 - DNA, 22 bp, Homo sapiens
aattgatcataggtatttcaaa

SEQ ID NO: 4916539 - DNA, 22 bp, Homo sapiens
aattgatcattttccccccact

SEQ ID NO: 4916540 - DNA, 13 bp, Homo sapiens
aattgatttgcat

SEQ ID NO: 4916541 - DNA, 14 bp, Homo sapiens
aattgcaaatcttg

SEQ ID NO: 4916542 - DNA, 21 bp, Homo sapiens
aattgctatgttactattttc

SEQ ID NO: 4916543 - DNA, 17 bp, Homo sapiens
aattgcttttttaaata

SEQ ID NO: 4916544 - DNA, 20 bp, Homo sapiens
aattggaacagaatgtttta

SEQ ID NO: 4916545 - DNA, 16 bp, Homo sapiens
aattggaggaaagcaa

SEQ ID NO: 4916546 - DNA, 15 bp, Homo sapiens
aattgggagtccagg

SEQ ID NO: 4916547 - DNA, 19 bp, Homo sapiens
aattgggagtccaggcaca

SEQ ID NO: 4916548 - DNA, 11 bp, Homo sapiens
aattgtcatgg

SEQ ID NO: 4916549 - DNA, 23 bp, Homo sapiens
aattgtcatggttacaaactaca

SEQ ID NO: 4916550 - DNA, 18 bp, Homo sapiens
aattgtcgaaaagagtct

SEQ ID NO: 4916551 - DNA, 23 bp, Homo sapiens
aattgtcgaaaagagtcttccaa

SEQ ID NO: 4916552 - DNA, 19 bp, Homo sapiens
aattgtctttaatttctgt

SEQ ID NO: 4916553 - DNA, 15 bp, Homo sapiens
aattgtgaactcatt

SEQ ID NO: 4916554 - DNA, 20 bp, Homo sapiens
aattgtgccgagaaaagcat

SEQ ID NO: 4916555 - DNA, 14 bp, Homo sapiens
aattgtgctgccat

SEQ ID NO: 4916556 - DNA, 15 bp, Homo sapiens
aattgtgctgccatt

SEQ ID NO: 4916557 - DNA, 18 bp, Homo sapiens
aattgttgaaattttgca

SEQ ID NO: 4916558 - DNA, 20 bp, Homo sapiens
aattgttgaaattttgcaaa

SEQ ID NO: 4916559 - DNA, 13 bp, Homo sapiens
aattgttgacagt

SEQ ID NO: 4916560 - DNA, 20 bp, Homo sapiens
aattgttgacagttctgaag

SEQ ID NO: 4916561 - DNA, 13 bp, Homo sapiens
aattgttgtttct

SEQ ID NO: 4916562 - DNA, 15 bp, Homo sapiens
aattgttgtttcttt

SEQ ID NO: 4916563 - DNA, 19 bp, Homo sapiens
aattgttgtttctttctag

SEQ ID NO: 4916564 - DNA, 19 bp, Homo sapiens
aattgtttggcttcctcct

SEQ ID NO: 4916565 - DNA, 20 bp, Homo sapiens
aattgtttggcttcctcctg

SEQ ID NO: 4916566 - DNA, 21 bp, Homo sapiens
aattgtttggcttcctcctga

SEQ ID NO: 4916567 - DNA, 14 bp, Homo sapiens
aattgttttcttta

SEQ ID NO: 4916568 - DNA, 17 bp, Homo sapiens
aattgttttgcactttt

SEQ ID NO: 4916569 - DNA, 20 bp, Homo sapiens
aattgtttttattgttttct

SEQ ID NO: 4916570 - DNA, 9 bp, Homo sapiens
aatttaaac

SEQ ID NO: 4916571 - DNA, 19 bp, Homo sapiens
aatttaaacacctcctcat

SEQ ID NO: 4916572 - DNA, 14 bp, Homo sapiens
aatttaaatataat

SEQ ID NO: 4916573 - DNA, 11 bp, Homo sapiens
aatttaaatgt

SEQ ID NO: 4916574 - DNA, 23 bp, Homo sapiens
aatttaactacccttaattactt

SEQ ID NO: 4916575 - DNA, 16 bp, Homo sapiens
aatttaagtgcgtgtg

SEQ ID NO: 4916576 - DNA, 23 bp, Homo sapiens
aatttaagtgcgtgtgtagagtt

SEQ ID NO: 4916577 - DNA, 19 bp, Homo sapiens
aatttactatatatatatg

SEQ ID NO: 4916578 - DNA, 17 bp, Homo sapiens
aatttagggtactaaat

SEQ ID NO: 4916579 - DNA, 18 bp, Homo sapiens
aatttagggtactaaatt

SEQ ID NO: 4916580 - DNA, 15 bp, Homo sapiens
aatttataaaattag

SEQ ID NO: 4916581 - DNA, 21 bp, Homo sapiens
aatttataaaattagaaagca

SEQ ID NO: 4916582 - DNA, 17 bp, Homo sapiens
aatttatacaatatcat

SEQ ID NO: 4916583 - DNA, 16 bp, Homo sapiens
aatttatatgtatatt

SEQ ID NO: 4916584 - DNA, 14 bp, Homo sapiens
aatttatcaaagca

SEQ ID NO: 4916585 - DNA, 17 bp, Homo sapiens
aatttatcacacttctg

SEQ ID NO: 4916586 - DNA, 23 bp, Homo sapiens
aatttatcctgaaatttcagatt

SEQ ID NO: 4916587 - DNA, 19 bp, Homo sapiens
aatttattacttgttgcaa

SEQ ID NO: 4916588 - DNA, 19 bp, Homo sapiens
aatttattagttaatatat

SEQ ID NO: 4916589 - DNA, 16 bp, Homo sapiens
aatttattattgaaat

SEQ ID NO: 4916590 - DNA, 17 bp, Homo sapiens
aatttcaaaaatataac

SEQ ID NO: 4916591 - DNA, 17 bp, Homo sapiens
aatttcaaaagacatgt

SEQ ID NO: 4916592 - DNA, 20 bp, Homo sapiens
aatttcaaaagacatgttgt

SEQ ID NO: 4916593 - DNA, 16 bp, Homo sapiens
aatttcaaaatgcttt

SEQ ID NO: 4916594 - DNA, 17 bp, Homo sapiens
aatttcaaggttctaac

SEQ ID NO: 4916595 - DNA, 21 bp, Homo sapiens
aatttccacaaaatctgtcca

SEQ ID NO: 4916596 - DNA, 17 bp, Homo sapiens
aatttcccttcttgcat

SEQ ID NO: 4916597 - DNA, 14 bp, Homo sapiens
aatttcgagatttg

SEQ ID NO: 4916598 - DNA, 17 bp, Homo sapiens
aatttctaaaaagatta

SEQ ID NO: 4916599 - DNA, 22 bp, Homo sapiens
aatttctaaaaagattagcaag

SEQ ID NO: 4916600 - DNA, 15 bp, Homo sapiens
aatttctaaagataa

SEQ ID NO: 4916601 - DNA, 22 bp, Homo sapiens
aatttctagcctgcactttgat

SEQ ID NO: 4916602 - DNA, 14 bp, Homo sapiens
aatttctcatcaca

SEQ ID NO: 4916603 - DNA, 16 bp, Homo sapiens
aatttcttcaaaatgt

SEQ ID NO: 4916604 - DNA, 20 bp, Homo sapiens
aatttcttcactgttgaaaa

SEQ ID NO: 4916605 - DNA, 15 bp, Homo sapiens
aatttcttgtttctc

SEQ ID NO: 4916606 - DNA, 23 bp, Homo sapiens
aatttgaaaacataatctgcaaa

SEQ ID NO: 4916607 - DNA, 13 bp, Homo sapiens
aatttgaggacaa

SEQ ID NO: 4916608 - DNA, 13 bp, Homo sapiens
aatttgatacata

SEQ ID NO: 4916609 - DNA, 12 bp, Homo sapiens
aatttgatactt

SEQ ID NO: 4916610 - DNA, 15 bp, Homo sapiens
aatttgatacttata

SEQ ID NO: 4916611 - DNA, 18 bp, Homo sapiens
aatttgatacttatattt

SEQ ID NO: 4916612 - DNA, 17 bp, Homo sapiens
aatttgattaacaaata

SEQ ID NO: 4916613 - DNA, 20 bp, Homo sapiens
aatttgattgactgcccatt

SEQ ID NO: 4916614 - DNA, 15 bp, Homo sapiens
aatttgatttctatt

SEQ ID NO: 4916615 - DNA, 22 bp, Homo sapiens
aatttgcacatcttggctatgt

SEQ ID NO: 4916616 - DNA, 15 bp, Homo sapiens
aatttgcattaaatt

SEQ ID NO: 4916617 - DNA, 19 bp, Homo sapiens
aatttgtaagtttcaggtg

SEQ ID NO: 4916618 - DNA, 14 bp, Homo sapiens
aattttaaaaatac

SEQ ID NO: 4916619 - DNA, 14 bp, Homo sapiens
aattttaaacaaag

SEQ ID NO: 4916620 - DNA, 22 bp, Homo sapiens
aattttaaggtagaacctcacc

SEQ ID NO: 4916621 - DNA, 18 bp, Homo sapiens
aattttaccctttagact

SEQ ID NO: 4916622 - DNA, 21 bp, Homo sapiens
aattttaccctttagactgta

SEQ ID NO: 4916623 - DNA, 23 bp, Homo sapiens
aattttaggcactcttaaatgat

SEQ ID NO: 4916624 - DNA, 13 bp, Homo sapiens
aattttagtattc

SEQ ID NO: 4916625 - DNA, 18 bp, Homo sapiens
aattttgcaaatataaac

SEQ ID NO: 4916626 - DNA, 18 bp, Homo sapiens
aattttgcttttaattaa

SEQ ID NO: 4916627 - DNA, 19 bp, Homo sapiens
aatttttaaaaatacactt

SEQ ID NO: 4916628 - DNA, 20 bp, Homo sapiens
aatttttaaatgtaaaacat

SEQ ID NO: 4916629 - DNA, 16 bp, Homo sapiens
aatttttaggaagttt

SEQ ID NO: 4916630 - DNA, 23 bp, Homo sapiens
aatttttcagctctctgtataaa

SEQ ID NO: 4916631 - DNA, 20 bp, Homo sapiens
aatttttctcagtttgtata

SEQ ID NO: 4916632 - DNA, 14 bp, Homo sapiens
aatttttgtaattt

SEQ ID NO: 4916633 - DNA, 17 bp, Homo sapiens
aatttttgtctcagaag

SEQ ID NO: 4916634 - DNA, 16 bp, Homo sapiens
aattttttttacattt

SEQ ID NO: 4916635 - DNA, 20 bp, Homo sapiens
aatttttttttcatagagat

SEQ ID NO: 4916636 - DNA, 19 bp, Homo sapiens
acaaaaaaaccacaaaggc

SEQ ID NO: 4916637 - DNA, 20 bp, Homo sapiens
acaaaaaaatatatttaatg

SEQ ID NO: 4916638 - DNA, 15 bp, Homo sapiens
acaaaaaactcccct

SEQ ID NO: 4916639 - DNA, 15 bp, Homo sapiens
acaaaaattgactca

SEQ ID NO: 4916640 - DNA, 16 bp, Homo sapiens
acaaaacaaaacaaaa

SEQ ID NO: 4916641 - DNA, 18 bp, Homo sapiens
acaaaacaaaacaaaact

SEQ ID NO: 4916642 - DNA, 17 bp, Homo sapiens
acaaaacccatgcattt

SEQ ID NO: 4916643 - DNA, 16 bp, Homo sapiens
acaaaacctaacttgc

SEQ ID NO: 4916644 - DNA, 17 bp, Homo sapiens
acaaaactacatgagaa

SEQ ID NO: 4916645 - DNA, 15 bp, Homo sapiens
acaaaactatacttg

SEQ ID NO: 4916646 - DNA, 16 bp, Homo sapiens
acaaaactatacttga

SEQ ID NO: 4916647 - DNA, 21 bp, Homo sapiens
acaaaactatacttgaacaaa

SEQ ID NO: 4916648 - DNA, 12 bp, Homo sapiens
acaaaacttctt

SEQ ID NO: 4916649 - DNA, 23 bp, Homo sapiens
acaaaagaggagcacttccaaaa

SEQ ID NO: 4916650 - DNA, 13 bp, Homo sapiens
acaaaagatgaaa

SEQ ID NO: 4916651 - DNA, 11 bp, Homo sapiens
acaaaagggtc

SEQ ID NO: 4916652 - DNA, 13 bp, Homo sapiens
acaaaagggtcag

SEQ ID NO: 4916653 - DNA, 14 bp, Homo sapiens
acaaaagggtcaga

SEQ ID NO: 4916654 - DNA, 12 bp, Homo sapiens
acaaaataaaca

SEQ ID NO: 4916655 - DNA, 20 bp, Homo sapiens
acaaaatccagctatgaata

SEQ ID NO: 4916656 - DNA, 10 bp, Homo sapiens
acaaaatgga

SEQ ID NO: 4916657 - DNA, 15 bp, Homo sapiens
acaaaattttatttt

SEQ ID NO: 4916658 - DNA, 16 bp, Homo sapiens
acaaaattttctcatt

SEQ ID NO: 4916659 - DNA, 14 bp, Homo sapiens
acaaacatcactct

SEQ ID NO: 4916660 - DNA, 12 bp, Homo sapiens
acaaacattgtg

SEQ ID NO: 4916661 - DNA, 17 bp, Homo sapiens
acaaacatttttcaaca

SEQ ID NO: 4916662 - DNA, 19 bp, Homo sapiens
acaaaccacaactgacaca

SEQ ID NO: 4916663 - DNA, 21 bp, Homo sapiens
acaaactttagggtaaaaatt

SEQ ID NO: 4916664 - DNA, 23 bp, Homo sapiens
acaaagagttctggaaaagaact

SEQ ID NO: 4916665 - DNA, 14 bp, Homo sapiens
acaaagcacagtgt

SEQ ID NO: 4916666 - DNA, 19 bp, Homo sapiens
acaaagcacagtttgaaca

SEQ ID NO: 4916667 - DNA, 15 bp, Homo sapiens
acaaagcactagaga

SEQ ID NO: 4916668 - DNA, 17 bp, Homo sapiens
acaaagcactagagaat

SEQ ID NO: 4916669 - DNA, 23 bp, Homo sapiens
acaaagcactagagaatgcacag

SEQ ID NO: 4916670 - DNA, 19 bp, Homo sapiens
acaaaggaagtgccccctc

SEQ ID NO: 4916671 - DNA, 21 bp, Homo sapiens
acaaaggggatcataaagtta

SEQ ID NO: 4916672 - DNA, 14 bp, Homo sapiens
acaaagtaattcct

SEQ ID NO: 4916673 - DNA, 20 bp, Homo sapiens
acaaatagtgcaactatgaa

SEQ ID NO: 4916674 - DNA, 12 bp, Homo sapiens
acaaatatattg

SEQ ID NO: 4916675 - DNA, 14 bp, Homo sapiens
acaaatattcagaa

SEQ ID NO: 4916676 - DNA, 23 bp, Homo sapiens
acaaatatttattttctttctgt

SEQ ID NO: 4916677 - DNA, 17 bp, Homo sapiens
acaaatcaacagaagca

SEQ ID NO: 4916678 - DNA, 23 bp, Homo sapiens
acaaatcaacagaagcatttgta

SEQ ID NO: 4916679 - DNA, 16 bp, Homo sapiens
aataccaagtatttat

SEQ ID NO: 4916680 - DNA, 13 bp, Homo sapiens
aataccaggattt

SEQ ID NO: 4916681 - DNA, 15 bp, Homo sapiens
aataccattaaaact

SEQ ID NO: 4916682 - DNA, 20 bp, Homo sapiens
aataccattaaaactgcttt

SEQ ID NO: 4916683 - DNA, 16 bp, Homo sapiens
aataccattgacacat

SEQ ID NO: 4916684 - DNA, 23 bp, Homo sapiens
aataccattttttaaggaaacaa

SEQ ID NO: 4916685 - DNA, 15 bp, Homo sapiens
aatacctcatgcttc

SEQ ID NO: 4916686 - DNA, 15 bp, Homo sapiens
aatacctcatgttta

SEQ ID NO: 4916687 - DNA, 19 bp, Homo sapiens
aatacctcatgtttatgaa

SEQ ID NO: 4916688 - DNA, 22 bp, Homo sapiens
aatacctcatgtttatgaaaat

SEQ ID NO: 4916689 - DNA, 13 bp, Homo sapiens
aatacctctgtgt

SEQ ID NO: 4916690 - DNA, 14 bp, Homo sapiens
aatacctctgtgtg

SEQ ID NO: 4916691 - DNA, 18 bp, Homo sapiens
aatacgcactacatgtgg

SEQ ID NO: 4916692 - DNA, 16 bp, Homo sapiens
aatactaccttgaaaa

SEQ ID NO: 4916693 - DNA, 17 bp, Homo sapiens
aatactaccttgaaaat

SEQ ID NO: 4916694 - DNA, 17 bp, Homo sapiens
aatactagtcaccccaa

SEQ ID NO: 4916695 - DNA, 17 bp, Homo sapiens
aatacttagcaaaaagt

SEQ ID NO: 4916696 - DNA, 10 bp, Homo sapiens
aatacttttt

SEQ ID NO: 4916697 - DNA, 19 bp, Homo sapiens
aatagaaaactgaaaatct

SEQ ID NO: 4916698 - DNA, 20 bp, Homo sapiens
aatagaaaactgaaaatcta

SEQ ID NO: 4916699 - DNA, 12 bp, Homo sapiens
aatagaaaagta

SEQ ID NO: 4916700 - DNA, 22 bp, Homo sapiens
aatagacactccccgaagtctt

SEQ ID NO: 4916701 - DNA, 23 bp, Homo sapiens
aatagacactccccgaagtcttt

SEQ ID NO: 4916702 - DNA, 20 bp, Homo sapiens
aatagagcaaaattgatgtg

SEQ ID NO: 4916703 - DNA, 18 bp, Homo sapiens
aatagagtatatgcactt

SEQ ID NO: 4916704 - DNA, 22 bp, Homo sapiens
aatagagtttgctattagagca

SEQ ID NO: 4916705 - DNA, 12 bp, Homo sapiens
aatagattctct

SEQ ID NO: 4916706 - DNA, 13 bp, Homo sapiens
aatagcaactttt

SEQ ID NO: 4916707 - DNA, 22 bp, Homo sapiens
aatagcgctgtttttgttgtgt

SEQ ID NO: 4916708 - DNA, 16 bp, Homo sapiens
aatagctaataatgtt

SEQ ID NO: 4916709 - DNA, 17 bp, Homo sapiens
aatagcttttattgtat

SEQ ID NO: 4916710 - DNA, 15 bp, Homo sapiens
aatagtatttgagag

SEQ ID NO: 4916711 - DNA, 20 bp, Homo sapiens
aatagtatttgagagttcta

SEQ ID NO: 4916712 - DNA, 16 bp, Homo sapiens
aatagtcattccaaat

SEQ ID NO: 4916713 - DNA, 18 bp, Homo sapiens
aatagtcattccaaatat

SEQ ID NO: 4916714 - DNA, 21 bp, Homo sapiens
aatagttaagacatgatttcc

SEQ ID NO: 4916715 - DNA, 22 bp, Homo sapiens
aatagttaagacatgatttcct

SEQ ID NO: 4916716 - DNA, 21 bp, Homo sapiens
aatagttgtccatattttcac

SEQ ID NO: 4916717 - DNA, 17 bp, Homo sapiens
aatagtttgtctatttt

SEQ ID NO: 4916718 - DNA, 22 bp, Homo sapiens
aatataaaacaaataaaaaata

SEQ ID NO: 4916719 - DNA, 14 bp, Homo sapiens
aatataaaaggcaa

SEQ ID NO: 4916720 - DNA, 13 bp, Homo sapiens
aatataaaatagt

SEQ ID NO: 4916721 - DNA, 22 bp, Homo sapiens
aatataaaatagttgtccatat

SEQ ID NO: 4916722 - DNA, 14 bp, Homo sapiens
aatataaacaaaga

SEQ ID NO: 4916723 - DNA, 21 bp, Homo sapiens
aatataacttaaaaatgtaaa

SEQ ID NO: 4916724 - DNA, 13 bp, Homo sapiens
aatataagatttt

SEQ ID NO: 4916725 - DNA, 23 bp, Homo sapiens
aatataatggaagagaaatctca

SEQ ID NO: 4916726 - DNA, 15 bp, Homo sapiens
aatataattctgtaa

SEQ ID NO: 4916727 - DNA, 19 bp, Homo sapiens
aatatataaaaatatatat

SEQ ID NO: 4916728 - DNA, 10 bp, Homo sapiens
aatatatata

SEQ ID NO: 4916729 - DNA, 16 bp, Homo sapiens
aatatatataaagaat

SEQ ID NO: 4916730 - DNA, 19 bp, Homo sapiens
aatatatatacatatgtag

SEQ ID NO: 4916731 - DNA, 19 bp, Homo sapiens
aatatatatatatatcagt

SEQ ID NO: 4916732 - DNA, 22 bp, Homo sapiens
aatatatcccagaaattagaaa

SEQ ID NO: 4916733 - DNA, 14 bp, Homo sapiens
aatatatgtattat

SEQ ID NO: 4916734 - DNA, 21 bp, Homo sapiens
aatatatgtattatttataat

SEQ ID NO: 4916735 - DNA, 15 bp, Homo sapiens
aatatattaccagca

SEQ ID NO: 4916736 - DNA, 22 bp, Homo sapiens
aatatattaccagcaagaataa

SEQ ID NO: 4916737 - DNA, 13 bp, Homo sapiens
aatatattgttaa

SEQ ID NO: 4916738 - DNA, 15 bp, Homo sapiens
aatatatttttatat

SEQ ID NO: 4916739 - DNA, 19 bp, Homo sapiens
aatatatttttatatttag

SEQ ID NO: 4916740 - DNA, 14 bp, Homo sapiens
aatatcaatcaagc

SEQ ID NO: 4916741 - DNA, 13 bp, Homo sapiens
aatatcatttatt

SEQ ID NO: 4916742 - DNA, 23 bp, Homo sapiens
aatatcatttattttttacatta

SEQ ID NO: 4916743 - DNA, 22 bp, Homo sapiens
aatatctaatatatatgaataa

SEQ ID NO: 4916744 - DNA, 16 bp, Homo sapiens
aatatctattaatata

SEQ ID NO: 4916745 - DNA, 12 bp, Homo sapiens
aatatctgaagc

SEQ ID NO: 4916746 - DNA, 18 bp, Homo sapiens
aatatcttcagctctttt

SEQ ID NO: 4916747 - DNA, 20 bp, Homo sapiens
aatatctttgtgataattta

SEQ ID NO: 4916748 - DNA, 21 bp, Homo sapiens
aatatctttgtgataatttaa

SEQ ID NO: 4916749 - DNA, 20 bp, Homo sapiens
aatatcttttatgtttgaat

SEQ ID NO: 4916750 - DNA, 21 bp, Homo sapiens
aatatcttttatgtttgaata

SEQ ID NO: 4916751 - DNA, 23 bp, Homo sapiens
aatatgattttttaaaagaaatt

SEQ ID NO: 4916752 - DNA, 10 bp, Homo sapiens
aatatgctta

SEQ ID NO: 4916753 - DNA, 14 bp, Homo sapiens
aatatggaacttct

SEQ ID NO: 4916754 - DNA, 17 bp, Homo sapiens
aatatggaacttctaat

SEQ ID NO: 4916755 - DNA, 21 bp, Homo sapiens
aatatggacacttaatactac

SEQ ID NO: 4916756 - DNA, 14 bp, Homo sapiens
aatatgtattgtaa

SEQ ID NO: 4916757 - DNA, 21 bp, Homo sapiens
aatatgtgagattttttattg

SEQ ID NO: 4916758 - DNA, 22 bp, Homo sapiens
aatatgtgagattttttattgc

SEQ ID NO: 4916759 - DNA, 14 bp, Homo sapiens
aatatgtttccttg

SEQ ID NO: 4916760 - DNA, 19 bp, Homo sapiens
aatatgtttccttgtttat

SEQ ID NO: 4916761 - DNA, 21 bp, Homo sapiens
aatattaaatctgctggagtt

SEQ ID NO: 4916762 - DNA, 22 bp, Homo sapiens
aatattactcagtttatgttgt

SEQ ID NO: 4916763 - DNA, 20 bp, Homo sapiens
aatattactgtttatttctg

SEQ ID NO: 4916764 - DNA, 14 bp, Homo sapiens
aatattagttaatg

SEQ ID NO: 4916765 - DNA, 14 bp, Homo sapiens
aatattatgtgttt

SEQ ID NO: 4916766 - DNA, 12 bp, Homo sapiens
aatattgacatt

SEQ ID NO: 4916767 - DNA, 15 bp, Homo sapiens
aatattgacatttgt

SEQ ID NO: 4916768 - DNA, 16 bp, Homo sapiens
aatattgacatttgta

SEQ ID NO: 4916769 - DNA, 17 bp, Homo sapiens
aatattgaggctttgtg

SEQ ID NO: 4916770 - DNA, 18 bp, Homo sapiens
aatattgaggctttgtgt

SEQ ID NO: 4916771 - DNA, 23 bp, Homo sapiens
aatattgttgtataatttcgaga

SEQ ID NO: 4916772 - DNA, 14 bp, Homo sapiens
aatattgtttttct

SEQ ID NO: 4916773 - DNA, 22 bp, Homo sapiens
aatatttataaagaatgtttct

SEQ ID NO: 4916774 - DNA, 19 bp, Homo sapiens
aatatttataaatgagcaa

SEQ ID NO: 4916775 - DNA, 12 bp, Homo sapiens
aatatttatgga

SEQ ID NO: 4916776 - DNA, 19 bp, Homo sapiens
aatatttatggatgcaaca

SEQ ID NO: 4916777 - DNA, 21 bp, Homo sapiens
aatatttatgtctatttaagc

SEQ ID NO: 4916778 - DNA, 17 bp, Homo sapiens
aatatttctgctttctt

SEQ ID NO: 4916779 - DNA, 21 bp, Homo sapiens
aatatttgacttgcatgaaga

SEQ ID NO: 4916780 - DNA, 22 bp, Homo sapiens
aatatttgacttgcatgaagag

SEQ ID NO: 4916781 - DNA, 23 bp, Homo sapiens
aatatttgacttgcatgaagaga

SEQ ID NO: 4916782 - DNA, 14 bp, Homo sapiens
aatattttcagtaa

SEQ ID NO: 4916783 - DNA, 16 bp, Homo sapiens
aatattttgataataa

SEQ ID NO: 4916784 - DNA, 18 bp, Homo sapiens
aatattttgataataata

SEQ ID NO: 4916785 - DNA, 15 bp, Homo sapiens
aatattttgtattat

SEQ ID NO: 4916786 - DNA, 16 bp, Homo sapiens
aatattttgtattatt

SEQ ID NO: 4916787 - DNA, 19 bp, Homo sapiens
aatattttgtattattgct

SEQ ID NO: 4916788 - DNA, 20 bp, Homo sapiens
aatattttgtattattgctg

SEQ ID NO: 4916789 - DNA, 18 bp, Homo sapiens
aatatttttatatacaga

SEQ ID NO: 4916790 - DNA, 23 bp, Homo sapiens
aatatttttatatacagaggaaa

SEQ ID NO: 4916791 - DNA, 21 bp, Homo sapiens
aatattttttatatatacagt

SEQ ID NO: 4916792 - DNA, 17 bp, Homo sapiens
aatcaaagccagggtct

SEQ ID NO: 4916793 - DNA, 16 bp, Homo sapiens
aatcaaataagtattt

SEQ ID NO: 4916794 - DNA, 18 bp, Homo sapiens
aatcaaataagtatttat

SEQ ID NO: 4916795 - DNA, 15 bp, Homo sapiens
aatcaacagaagcat

SEQ ID NO: 4916796 - DNA, 16 bp, Homo sapiens
aatcaacagaagcatt

SEQ ID NO: 4916797 - DNA, 16 bp, Homo sapiens
aatcaagagctgccct

SEQ ID NO: 4916798 - DNA, 15 bp, Homo sapiens
aatcaagttgtaact

SEQ ID NO: 4916799 - DNA, 13 bp, Homo sapiens
aatcaatgaatat

SEQ ID NO: 4916800 - DNA, 22 bp, Homo sapiens
aatcaatgaatattgaagtttc

SEQ ID NO: 4916801 - DNA, 22 bp, Homo sapiens
aatcaatgcaagagtgattgca

SEQ ID NO: 4916802 - DNA, 23 bp, Homo sapiens
aatcaatgttcacgcaacttgaa

SEQ ID NO: 4916803 - DNA, 23 bp, Homo sapiens
aatcactttgtctaactcagaat

SEQ ID NO: 4916804 - DNA, 13 bp, Homo sapiens
aatcagacaaagt

SEQ ID NO: 4916805 - DNA, 20 bp, Homo sapiens
aatcagcacagataaaaagt

SEQ ID NO: 4916806 - DNA, 12 bp, Homo sapiens
aatcagcactga

SEQ ID NO: 4916807 - DNA, 15 bp, Homo sapiens
aatcagcactgaaaa

SEQ ID NO: 4916808 - DNA, 16 bp, Homo sapiens
aatcagcactgaaaat

SEQ ID NO: 4916809 - DNA, 12 bp, Homo sapiens
aatcagcctctt

SEQ ID NO: 4916810 - DNA, 16 bp, Homo sapiens
aatcagcctcttaaag

SEQ ID NO: 4916811 - DNA, 21 bp, Homo sapiens
aatcagtaatatttatatatt

SEQ ID NO: 4916812 - DNA, 19 bp, Homo sapiens
aatcagtgggcaggataaa

SEQ ID NO: 4916813 - DNA, 14 bp, Homo sapiens
aatcagtgtgtcta

SEQ ID NO: 4916814 - DNA, 15 bp, Homo sapiens
aatcagttagttttt

SEQ ID NO: 4916815 - DNA, 23 bp, Homo sapiens
aatcatatgtgatctgtcttgta

SEQ ID NO: 4916816 - DNA, 14 bp, Homo sapiens
aatcatattgatga

SEQ ID NO: 4916817 - DNA, 18 bp, Homo sapiens
aatcatattgatgaaaag

SEQ ID NO: 4916818 - DNA, 19 bp, Homo sapiens
aatcatattgatgaaaaga

SEQ ID NO: 4916819 - DNA, 17 bp, Homo sapiens
aatcatcgaaaattcat

SEQ ID NO: 4916820 - DNA, 15 bp, Homo sapiens
aatcatctataaaga

SEQ ID NO: 4916821 - DNA, 12 bp, Homo sapiens
aatcatctattt

SEQ ID NO: 4916822 - DNA, 19 bp, Homo sapiens
aatcatctattttgatgca

SEQ ID NO: 4916823 - DNA, 20 bp, Homo sapiens
aatcatctattttgatgcag

SEQ ID NO: 4916824 - DNA, 19 bp, Homo sapiens
aatcattgctttgaagcag

SEQ ID NO: 4916825 - DNA, 14 bp, Homo sapiens
aatcattgttttga

SEQ ID NO: 4916826 - DNA, 19 bp, Homo sapiens
aatcattgttttgaatatt

SEQ ID NO: 4916827 - DNA, 20 bp, Homo sapiens
aatcatttccccataactca

SEQ ID NO: 4916828 - DNA, 16 bp, Homo sapiens
aatcatttctcactgt

SEQ ID NO: 4916829 - DNA, 19 bp, Homo sapiens
aatcattttgcctcttttc

SEQ ID NO: 4916830 - DNA, 20 bp, Homo sapiens
aatccaaatggcgtctggaa

SEQ ID NO: 4916831 - DNA, 19 bp, Homo sapiens
aatccaagctccctgcccc

SEQ ID NO: 4916832 - DNA, 17 bp, Homo sapiens
aatccaggcacagctga

SEQ ID NO: 4916833 - DNA, 11 bp, Homo sapiens
aatcccaaatt

SEQ ID NO: 4916834 - DNA, 18 bp, Homo sapiens
aatcccaaatttgattga

SEQ ID NO: 4916835 - DNA, 18 bp, Homo sapiens
aatcccacccacatgtga

SEQ ID NO: 4916836 - DNA, 15 bp, Homo sapiens
aatcccagcactttg

SEQ ID NO: 4916837 - DNA, 15 bp, Homo sapiens
aatcccccttgccac

SEQ ID NO: 4916838 - DNA, 18 bp, Homo sapiens
aatcccccttgccacccc

SEQ ID NO: 4916839 - DNA, 14 bp, Homo sapiens
aatccctgtttaat

SEQ ID NO: 4916840 - DNA, 17 bp, Homo sapiens
aatccctgtttaatatt

SEQ ID NO: 4916841 - DNA, 19 bp, Homo sapiens
aatccctttattaccccct

SEQ ID NO: 4916842 - DNA, 23 bp, Homo sapiens
aatccctttattaccccctcctt

SEQ ID NO: 4916843 - DNA, 15 bp, Homo sapiens
aatccgctctcttcc

SEQ ID NO: 4916844 - DNA, 17 bp, Homo sapiens
aatcctaagacacaaat

SEQ ID NO: 4916845 - DNA, 17 bp, Homo sapiens
aatcctatatagaatgc

SEQ ID NO: 4916846 - DNA, 22 bp, Homo sapiens
aatcctatatagaatgctgcac

SEQ ID NO: 4916847 - DNA, 16 bp, Homo sapiens
aatcctgccatttaaa

SEQ ID NO: 4916848 - DNA, 12 bp, Homo sapiens
aatcctggcagc

SEQ ID NO: 4916849 - DNA, 12 bp, Homo sapiens
aatcctgtcttt

SEQ ID NO: 4916850 - DNA, 12 bp, Homo sapiens
aatccttccaaa

SEQ ID NO: 4916851 - DNA, 21 bp, Homo sapiens
aatccttccaaaaattattat

SEQ ID NO: 4916852 - DNA, 18 bp, Homo sapiens
aatcctttattattattt

SEQ ID NO: 4916853 - DNA, 16 bp, Homo sapiens
aatctaaatctattta

SEQ ID NO: 4916854 - DNA, 19 bp, Homo sapiens
aatctaatattaaaaatat

SEQ ID NO: 4916855 - DNA, 20 bp, Homo sapiens
aatctaatattaaaaatatg

SEQ ID NO: 4916856 - DNA, 16 bp, Homo sapiens
aatctagacaatatac

SEQ ID NO: 4916857 - DNA, 23 bp, Homo sapiens
aatctaggcatgaagagcaaaaa

SEQ ID NO: 4916858 - DNA, 21 bp, Homo sapiens
aatctatccaaatctgaagat

SEQ ID NO: 4916859 - DNA, 16 bp, Homo sapiens
aatctatttattaata

SEQ ID NO: 4916860 - DNA, 20 bp, Homo sapiens
aatctatttattaatattta

SEQ ID NO: 4916861 - DNA, 23 bp, Homo sapiens
aatctatttcacttattttggct

SEQ ID NO: 4916862 - DNA, 13 bp, Homo sapiens
aatctattttcta

SEQ ID NO: 4916863 - DNA, 20 bp, Homo sapiens
aatctattttctatgtacta

SEQ ID NO: 4916864 - DNA, 19 bp, Homo sapiens
aatctcaatgaagccagct

SEQ ID NO: 4916865 - DNA, 22 bp, Homo sapiens
aatctcaccccatcccacaccc

SEQ ID NO: 4916866 - DNA, 18 bp, Homo sapiens
aatctcatacctctgacc

SEQ ID NO: 4916867 - DNA, 23 bp, Homo sapiens
aatctcataggttgccaataata

SEQ ID NO: 4916868 - DNA, 19 bp, Homo sapiens
aatctcccgctgctgctgc

SEQ ID NO: 4916869 - DNA, 16 bp, Homo sapiens
aatctctctgcagctg

SEQ ID NO: 4916870 - DNA, 18 bp, Homo sapiens
aatctctctgcagctgcc

SEQ ID NO: 4916871 - DNA, 21 bp, Homo sapiens
aatctctgttatgtactgtac

SEQ ID NO: 4916872 - DNA, 16 bp, Homo sapiens
aatctgaaattctaaa

SEQ ID NO: 4916873 - DNA, 15 bp, Homo sapiens
aatctgcaattcaaa

SEQ ID NO: 4916874 - DNA, 15 bp, Homo sapiens
aatctggaagaaaaa

SEQ ID NO: 4916875 - DNA, 15 bp, Homo sapiens
aatctggactcctct

SEQ ID NO: 4916876 - DNA, 14 bp, Homo sapiens
aatctggagaccag

SEQ ID NO: 4916877 - DNA, 15 bp, Homo sapiens
aatctggagaccagg

SEQ ID NO: 4916878 - DNA, 19 bp, Homo sapiens
aatctggtcttgttagaaa

SEQ ID NO: 4916879 - DNA, 12 bp, Homo sapiens
aatctgtacatt

SEQ ID NO: 4916880 - DNA, 13 bp, Homo sapiens
aatctgtacattt

SEQ ID NO: 4916881 - DNA, 20 bp, Homo sapiens
aatctgtcaaaacactgtgg

SEQ ID NO: 4916882 - DNA, 23 bp, Homo sapiens
aatctgtcaaaacactgtggaac

SEQ ID NO: 4916883 - DNA, 17 bp, Homo sapiens
aatctgtgtatattatt

SEQ ID NO: 4916884 - DNA, 18 bp, Homo sapiens
aatctgtgtatattattt

SEQ ID NO: 4916885 - DNA, 17 bp, Homo sapiens
aatctgtgtgtgccctg

SEQ ID NO: 4916886 - DNA, 23 bp, Homo sapiens
aatctgttatgtactagtgttct

SEQ ID NO: 4916887 - DNA, 15 bp, Homo sapiens
aatcttatagttcta

SEQ ID NO: 4916888 - DNA, 14 bp, Homo sapiens
aatcttgaaattaa

SEQ ID NO: 4916889 - DNA, 17 bp, Homo sapiens
aatcttgaaattaagaa

SEQ ID NO: 4916890 - DNA, 18 bp, Homo sapiens
aatcttgtgctagaatac

SEQ ID NO: 4916891 - DNA, 22 bp, Homo sapiens
aatctttgtttcaggttcagta

SEQ ID NO: 4916892 - DNA, 12 bp, Homo sapiens
aatcttttacaa

SEQ ID NO: 4916893 - DNA, 23 bp, Homo sapiens
aatcttttacaactgcctcgaaa

SEQ ID NO: 4916894 - DNA, 15 bp, Homo sapiens
aatgaaaaacaacca

SEQ ID NO: 4916895 - DNA, 16 bp, Homo sapiens
aatgaaaaacaaccaa

SEQ ID NO: 4916896 - DNA, 21 bp, Homo sapiens
aatgaaaataagtgaataata

SEQ ID NO: 4916897 - DNA, 19 bp, Homo sapiens
aatgaaacaaataatcaca

SEQ ID NO: 4916898 - DNA, 19 bp, Homo sapiens
aatgaaacactcagttgtt

SEQ ID NO: 4916899 - DNA, 15 bp, Homo sapiens
aatgaaagattaaac

SEQ ID NO: 4916900 - DNA, 23 bp, Homo sapiens
aatgaaaggtactatatttgcta

SEQ ID NO: 4916901 - DNA, 13 bp, Homo sapiens
actactttgcctt

SEQ ID NO: 4916902 - DNA, 13 bp, Homo sapiens
actagaattctgt

SEQ ID NO: 4916903 - DNA, 17 bp, Homo sapiens
actagacaccaaagttc

SEQ ID NO: 4916904 - DNA, 17 bp, Homo sapiens
actagactcttcactgt

SEQ ID NO: 4916905 - DNA, 16 bp, Homo sapiens
actagagaatgcacag

SEQ ID NO: 4916906 - DNA, 20 bp, Homo sapiens
actagcctttggctctggag

SEQ ID NO: 4916907 - DNA, 22 bp, Homo sapiens
actagcctttggctctggagac

SEQ ID NO: 4916908 - DNA, 13 bp, Homo sapiens
actagtacaaatt

SEQ ID NO: 4916909 - DNA, 23 bp, Homo sapiens
actagtactgtgtactgtataga

SEQ ID NO: 4916910 - DNA, 13 bp, Homo sapiens
actagtcacccca

SEQ ID NO: 4916911 - DNA, 13 bp, Homo sapiens
actagtgttctgt

SEQ ID NO: 4916912 - DNA, 20 bp, Homo sapiens
actataaagaagtaacaaaa

SEQ ID NO: 4916913 - DNA, 13 bp, Homo sapiens
actataaagagaa

SEQ ID NO: 4916914 - DNA, 17 bp, Homo sapiens
actatagcctaggtgac

SEQ ID NO: 4916915 - DNA, 17 bp, Homo sapiens
actatatacatgtgtgt

SEQ ID NO: 4916916 - DNA, 13 bp, Homo sapiens
actatatgtgaat

SEQ ID NO: 4916917 - DNA, 19 bp, Homo sapiens
actatattcatttccactc

SEQ ID NO: 4916918 - DNA, 22 bp, Homo sapiens
actatcagtttgtcctgtagag

SEQ ID NO: 4916919 - DNA, 18 bp, Homo sapiens
actatcatagttaacata

SEQ ID NO: 4916920 - DNA, 16 bp, Homo sapiens
actatcttggtgaatt

SEQ ID NO: 4916921 - DNA, 18 bp, Homo sapiens
actatgaacttctctcag

SEQ ID NO: 4916922 - DNA, 21 bp, Homo sapiens
actatgaacttctctcagact

SEQ ID NO: 4916923 - DNA, 15 bp, Homo sapiens
actatgactgctccc

SEQ ID NO: 4916924 - DNA, 13 bp, Homo sapiens
actatggaaaatc

SEQ ID NO: 4916925 - DNA, 14 bp, Homo sapiens
actatggaaaatca

SEQ ID NO: 4916926 - DNA, 20 bp, Homo sapiens
actatggaaaatcagctgct

SEQ ID NO: 4916927 - DNA, 22 bp, Homo sapiens
actatggaaaatcagctgctca

SEQ ID NO: 4916928 - DNA, 11 bp, Homo sapiens
actatgtaaac

SEQ ID NO: 4916929 - DNA, 12 bp, Homo sapiens
actatgtaaact

SEQ ID NO: 4916930 - DNA, 14 bp, Homo sapiens
actatgttgcccag

SEQ ID NO: 4916931 - DNA, 16 bp, Homo sapiens
actatgttgcccaggc

SEQ ID NO: 4916932 - DNA, 19 bp, Homo sapiens
actatgttgcccaggcagg

SEQ ID NO: 4916933 - DNA, 18 bp, Homo sapiens
actattcattaaatgttt

SEQ ID NO: 4916934 - DNA, 17 bp, Homo sapiens
actattctgtatctttc

SEQ ID NO: 4916935 - DNA, 13 bp, Homo sapiens
actatttaaactt

SEQ ID NO: 4916936 - DNA, 18 bp, Homo sapiens
actatttaaacttataaa

SEQ ID NO: 4916937 - DNA, 21 bp, Homo sapiens
actatttaaacttataaatca

SEQ ID NO: 4916938 - DNA, 16 bp, Homo sapiens
actatttgtctttcag

SEQ ID NO: 4916939 - DNA, 14 bp, Homo sapiens
actattttctacaa

SEQ ID NO: 4916940 - DNA, 15 bp, Homo sapiens
actcaaaacttaaca

SEQ ID NO: 4916941 - DNA, 15 bp, Homo sapiens
actcaaaatatttgt

SEQ ID NO: 4916942 - DNA, 17 bp, Homo sapiens
actcaaaatatttgtac

SEQ ID NO: 4916943 - DNA, 23 bp, Homo sapiens
actcaaatatgagtacaaatgcc

SEQ ID NO: 4916944 - DNA, 17 bp, Homo sapiens
actcaaatgttctaagt

SEQ ID NO: 4916945 - DNA, 18 bp, Homo sapiens
actcaaatgttctaagtt

SEQ ID NO: 4916946 - DNA, 20 bp, Homo sapiens
actcaactgggctctgtccc

SEQ ID NO: 4916947 - DNA, 23 bp, Homo sapiens
actcaatggagtatgtctgatgg

SEQ ID NO: 4916948 - DNA, 16 bp, Homo sapiens
actcaatggatttgat

SEQ ID NO: 4916949 - DNA, 13 bp, Homo sapiens
actcacaaatgat

SEQ ID NO: 4916950 - DNA, 13 bp, Homo sapiens
actcacatgacac

SEQ ID NO: 4916951 - DNA, 20 bp, Homo sapiens
actcacatttattctgctca

SEQ ID NO: 4916952 - DNA, 14 bp, Homo sapiens
actcaccagcccca

SEQ ID NO: 4916953 - DNA, 20 bp, Homo sapiens
actcaccagccccactgcca

SEQ ID NO: 4916954 - DNA, 23 bp, Homo sapiens
actcaccagccccactgccagca

SEQ ID NO: 4916955 - DNA, 23 bp, Homo sapiens
actcaccagtgtcccctccactg

SEQ ID NO: 4916956 - DNA, 18 bp, Homo sapiens
actcaccatgaagcgaaa

SEQ ID NO: 4916957 - DNA, 16 bp, Homo sapiens
actcactgaagcctgc

SEQ ID NO: 4916958 - DNA, 17 bp, Homo sapiens
actcagaagacactgat

SEQ ID NO: 4916959 - DNA, 18 bp, Homo sapiens
actcagaattatttttaa

SEQ ID NO: 4916960 - DNA, 12 bp, Homo sapiens
actcagacctga

SEQ ID NO: 4916961 - DNA, 12 bp, Homo sapiens
actcagccccta

SEQ ID NO: 4916962 - DNA, 14 bp, Homo sapiens
actcagccctgagg

SEQ ID NO: 4916963 - DNA, 16 bp, Homo sapiens
actcagcctgggacag

SEQ ID NO: 4916964 - DNA, 17 bp, Homo sapiens
actcagcttcctaccca

SEQ ID NO: 4916965 - DNA, 13 bp, Homo sapiens
actcagggacaga

SEQ ID NO: 4916966 - DNA, 17 bp, Homo sapiens
actcagggacagagcca

SEQ ID NO: 4916967 - DNA, 20 bp, Homo sapiens
actcagggacagagccatgc

SEQ ID NO: 4916968 - DNA, 21 bp, Homo sapiens
actcataaaaagcctgcaatt

SEQ ID NO: 4916969 - DNA, 13 bp, Homo sapiens
actcattcctgta

SEQ ID NO: 4916970 - DNA, 15 bp, Homo sapiens
actcattcttctgta

SEQ ID NO: 4916971 - DNA, 15 bp, Homo sapiens
actcattgaaatgtc

SEQ ID NO: 4916972 - DNA, 15 bp, Homo sapiens
actcattgctgagcc

SEQ ID NO: 4916973 - DNA, 20 bp, Homo sapiens
actcattgctgagcctctgc

SEQ ID NO: 4916974 - DNA, 22 bp, Homo sapiens
actcattgctgagcctctgctc

SEQ ID NO: 4916975 - DNA, 14 bp, Homo sapiens
actcatttctaaaa

SEQ ID NO: 4916976 - DNA, 18 bp, Homo sapiens
actcatttctaaaagaat

SEQ ID NO: 4916977 - DNA, 21 bp, Homo sapiens
actcatttttgccatacatca

SEQ ID NO: 4916978 - DNA, 18 bp, Homo sapiens
actccaaaacccatgtgg

SEQ ID NO: 4916979 - DNA, 21 bp, Homo sapiens
actccaatgtctgctgaggag

SEQ ID NO: 4916980 - DNA, 19 bp, Homo sapiens
actccaccagatagcagag

SEQ ID NO: 4916981 - DNA, 19 bp, Homo sapiens
actccacgatcctgccacc

SEQ ID NO: 4916982 - DNA, 18 bp, Homo sapiens
actccagacccctggctt

SEQ ID NO: 4916983 - DNA, 21 bp, Homo sapiens
actccagacccctggcttttc

SEQ ID NO: 4916984 - DNA, 20 bp, Homo sapiens
actccagcaacttcttctcc

SEQ ID NO: 4916985 - DNA, 19 bp, Homo sapiens
actccagtgccagcaatga

SEQ ID NO: 4916986 - DNA, 13 bp, Homo sapiens
actcccatgaagc

SEQ ID NO: 4916987 - DNA, 15 bp, Homo sapiens
actcccatgaagcct

SEQ ID NO: 4916988 - DNA, 17 bp, Homo sapiens
actcccatgaagccttt

SEQ ID NO: 4916989 - DNA, 20 bp, Homo sapiens
actcccatgaagccttttga

SEQ ID NO: 4916990 - DNA, 21 bp, Homo sapiens
actccccctaaacccctgtcc

SEQ ID NO: 4916991 - DNA, 14 bp, Homo sapiens
actccccgaagtct

SEQ ID NO: 4916992 - DNA, 17 bp, Homo sapiens
actccccgaagtctttt

SEQ ID NO: 4916993 - DNA, 13 bp, Homo sapiens
actccctcctcac

SEQ ID NO: 4916994 - DNA, 13 bp, Homo sapiens
actccctctcagg

SEQ ID NO: 4916995 - DNA, 21 bp, Homo sapiens
actccctctcaggatccaagc

SEQ ID NO: 4916996 - DNA, 14 bp, Homo sapiens
actccctgcagatg

SEQ ID NO: 4916997 - DNA, 22 bp, Homo sapiens
actcccttggtggcaagagccc

SEQ ID NO: 4916998 - DNA, 18 bp, Homo sapiens
actccgcccccagcctat

SEQ ID NO: 4916999 - DNA, 23 bp, Homo sapiens
actccggattgcgttcctccccg

SEQ ID NO: 4917000 - DNA, 19 bp, Homo sapiens
actcctaaacctttgcccc

SEQ ID NO: 4917001 - DNA, 17 bp, Homo sapiens
actcctacctgccctgg

SEQ ID NO: 4917002 - DNA, 14 bp, Homo sapiens
actcctacctggta

SEQ ID NO: 4917003 - DNA, 23 bp, Homo sapiens
actcctagagaacgcagccctag

SEQ ID NO: 4917004 - DNA, 16 bp, Homo sapiens
actcctatttttgtaa

SEQ ID NO: 4917005 - DNA, 17 bp, Homo sapiens
actcctatttttgtaaa

SEQ ID NO: 4917006 - DNA, 18 bp, Homo sapiens
actcctcagggcagcctc

SEQ ID NO: 4917007 - DNA, 22 bp, Homo sapiens
actcctcctccaaaggccccct

SEQ ID NO: 4917008 - DNA, 12 bp, Homo sapiens
actcctcctctt

SEQ ID NO: 4917009 - DNA, 13 bp, Homo sapiens
actcctcctcttt

SEQ ID NO: 4917010 - DNA, 12 bp, Homo sapiens
actcctggcctc

SEQ ID NO: 4917011 - DNA, 14 bp, Homo sapiens
actccttggcctag

SEQ ID NO: 4917012 - DNA, 18 bp, Homo sapiens
actccttggcctagccca

SEQ ID NO: 4917013 - DNA, 21 bp, Homo sapiens
actccttttggtgtgttggac

SEQ ID NO: 4917014 - DNA, 20 bp, Homo sapiens
actcgcttcccccatagcca

SEQ ID NO: 4917015 - DNA, 20 bp, Homo sapiens
actctaagatcttagattct

SEQ ID NO: 4917016 - DNA, 13 bp, Homo sapiens
actctagattcca

SEQ ID NO: 4917017 - DNA, 16 bp, Homo sapiens
actctatctgggcctg

SEQ ID NO: 4917018 - DNA, 14 bp, Homo sapiens
actctattctcaaa

SEQ ID NO: 4917019 - DNA, 13 bp, Homo sapiens
actctcctgcccc

SEQ ID NO: 4917020 - DNA, 16 bp, Homo sapiens
actctcttccctttcc

SEQ ID NO: 4917021 - DNA, 20 bp, Homo sapiens
actctgaaacacactgaaag

SEQ ID NO: 4917022 - DNA, 14 bp, Homo sapiens
actctgaagcctct

SEQ ID NO: 4917023 - DNA, 15 bp, Homo sapiens
actctgaagcctctg

SEQ ID NO: 4917024 - DNA, 17 bp, Homo sapiens
actctgaagcctctggg

SEQ ID NO: 4917025 - DNA, 19 bp, Homo sapiens
actctgacaagggctgacc

SEQ ID NO: 4917026 - DNA, 19 bp, Homo sapiens
actctgacgcaaaaccact

SEQ ID NO: 4917027 - DNA, 11 bp, Homo sapiens
actctgagccc

SEQ ID NO: 4917028 - DNA, 12 bp, Homo sapiens
actctgagccca

SEQ ID NO: 4917029 - DNA, 21 bp, Homo sapiens
actctgagcgggaggcagagt

SEQ ID NO: 4917030 - DNA, 19 bp, Homo sapiens
actctgcacatgtcttgta

SEQ ID NO: 4917031 - DNA, 21 bp, Homo sapiens
actctgcacatgtcttgtaca

SEQ ID NO: 4917032 - DNA, 17 bp, Homo sapiens
actctgcagactgctag

SEQ ID NO: 4917033 - DNA, 16 bp, Homo sapiens
actctgccagcaaaga

SEQ ID NO: 4917034 - DNA, 19 bp, Homo sapiens
actctgggctatggacaca

SEQ ID NO: 4917035 - DNA, 22 bp, Homo sapiens
actctgggctatggacacaggg

SEQ ID NO: 4917036 - DNA, 15 bp, Homo sapiens
actctggtttctcat

SEQ ID NO: 4917037 - DNA, 17 bp, Homo sapiens
actctggtttctcattc

SEQ ID NO: 4917038 - DNA, 15 bp, Homo sapiens
actctgtaaaaacac

SEQ ID NO: 4917039 - DNA, 19 bp, Homo sapiens
actctgtctcaaaaaaaca

SEQ ID NO: 4917040 - DNA, 16 bp, Homo sapiens
actctgtgtcaggtgg

SEQ ID NO: 4917041 - DNA, 13 bp, Homo sapiens
actctgttgtact

SEQ ID NO: 4917042 - DNA, 19 bp, Homo sapiens
actctgttgtactatggaa

SEQ ID NO: 4917043 - DNA, 14 bp, Homo sapiens
actcttagaaatga

SEQ ID NO: 4917044 - DNA, 12 bp, Homo sapiens
actcttcactgt

SEQ ID NO: 4917045 - DNA, 22 bp, Homo sapiens
actcttcctatttttgtagtga

SEQ ID NO: 4917046 - DNA, 16 bp, Homo sapiens
actcttgacctcaggt

SEQ ID NO: 4917047 - DNA, 21 bp, Homo sapiens
actcttgttgagttctgtaga

SEQ ID NO: 4917048 - DNA, 17 bp, Homo sapiens
actctttctaatgctga

SEQ ID NO: 4917049 - DNA, 21 bp, Homo sapiens
actctttctgtatatactttt

SEQ ID NO: 4917050 - DNA, 16 bp, Homo sapiens
actgaaaaattatact

SEQ ID NO: 4917051 - DNA, 15 bp, Homo sapiens
actgaaaatctaata

SEQ ID NO: 4917052 - DNA, 20 bp, Homo sapiens
actgaaagccttagggaagc

SEQ ID NO: 4917053 - DNA, 14 bp, Homo sapiens
actgaaagtggttt

SEQ ID NO: 4917054 - DNA, 18 bp, Homo sapiens
actgaactcactttcctc

SEQ ID NO: 4917055 - DNA, 17 bp, Homo sapiens
actgaagtgcttagtgt

SEQ ID NO: 4917056 - DNA, 13 bp, Homo sapiens
actgaattaatca

SEQ ID NO: 4917057 - DNA, 13 bp, Homo sapiens
actgacacaaagg

SEQ ID NO: 4917058 - DNA, 17 bp, Homo sapiens
actgacattgttggcca

SEQ ID NO: 4917059 - DNA, 18 bp, Homo sapiens
actgacattgttggccaa

SEQ ID NO: 4917060 - DNA, 23 bp, Homo sapiens
actgacattgttggccaaagcca

SEQ ID NO: 4917061 - DNA, 13 bp, Homo sapiens
actgaccagcctc

SEQ ID NO: 4917062 - DNA, 16 bp, Homo sapiens
actgaccatccactct

SEQ ID NO: 4917063 - DNA, 23 bp, Homo sapiens
actgaccatccactctaccctcc

SEQ ID NO: 4917064 - DNA, 17 bp, Homo sapiens
actgacccttccagaca

SEQ ID NO: 4917065 - DNA, 20 bp, Homo sapiens
actgaccttggagagacaca

SEQ ID NO: 4917066 - DNA, 21 bp, Homo sapiens
actgactggattcattctcat

SEQ ID NO: 4917067 - DNA, 13 bp, Homo sapiens
actgacttgagac

SEQ ID NO: 4917068 - DNA, 24 bp, Homo sapiens
actgacttgtttgtcttccattcc

SEQ ID NO: 4917069 - DNA, 23 bp, Homo sapiens
actgagccccgcagacctcccca

SEQ ID NO: 4917070 - DNA, 20 bp, Homo sapiens
actgagggaccaactgggcc

SEQ ID NO: 4917071 - DNA, 22 bp, Homo sapiens
actgagggaccaactgggccca

SEQ ID NO: 4917072 - DNA, 15 bp, Homo sapiens
actgatgctgagatt

SEQ ID NO: 4917073 - DNA, 16 bp, Homo sapiens
actgatgctgagattc

SEQ ID NO: 4917074 - DNA, 23 bp, Homo sapiens
actgatgggcaacccccagcctg

SEQ ID NO: 4917075 - DNA, 18 bp, Homo sapiens
actgattattttcttcat

SEQ ID NO: 4917076 - DNA, 16 bp, Homo sapiens
actgcaacctccgcct

SEQ ID NO: 4917077 - DNA, 22 bp, Homo sapiens
actgcaacctccgcctcttggg

SEQ ID NO: 4917078 - DNA, 15 bp, Homo sapiens
actgcaaccttcacc

SEQ ID NO: 4917079 - DNA, 20 bp, Homo sapiens
actgcactccagcctgggca

SEQ ID NO: 4917080 - DNA, 22 bp, Homo sapiens
actgcagcctcaacctcctggg

SEQ ID NO: 4917081 - DNA, 23 bp, Homo sapiens
actgcagcctcaacctcctgggc

SEQ ID NO: 4917082 - DNA, 17 bp, Homo sapiens
actgcagggccaggact

SEQ ID NO: 4917083 - DNA, 17 bp, Homo sapiens
actgcaggttggacccc

SEQ ID NO: 4917084 - DNA, 18 bp, Homo sapiens
actgcaggttggacccca

SEQ ID NO: 4917085 - DNA, 21 bp, Homo sapiens
actgccaaagggaaatatcat

SEQ ID NO: 4917086 - DNA, 18 bp, Homo sapiens
actgccactttgcacatt

SEQ ID NO: 4917087 - DNA, 20 bp, Homo sapiens
actgccactttgcacatttt

SEQ ID NO: 4917088 - DNA, 13 bp, Homo sapiens
actgccagcagca

SEQ ID NO: 4917089 - DNA, 18 bp, Homo sapiens
actgccagcagcagcagg

SEQ ID NO: 4917090 - DNA, 21 bp, Homo sapiens
actgccatgtactagttttag

SEQ ID NO: 4917091 - DNA, 23 bp, Homo sapiens
actgccattattttctgtcagat

SEQ ID NO: 4917092 - DNA, 19 bp, Homo sapiens
actgcccaggcctgcctgt

SEQ ID NO: 4917093 - DNA, 14 bp, Homo sapiens
actgcccgcacacc

SEQ ID NO: 4917094 - DNA, 19 bp, Homo sapiens
actgccctaactgtacatt

SEQ ID NO: 4917095 - DNA, 14 bp, Homo sapiens
actgcctctgccac

SEQ ID NO: 4917096 - DNA, 15 bp, Homo sapiens
actgcctctgccaca

SEQ ID NO: 4917097 - DNA, 13 bp, Homo sapiens
actgcctctgcct

SEQ ID NO: 4917098 - DNA, 17 bp, Homo sapiens
actgcctgtatacttta

SEQ ID NO: 4917099 - DNA, 18 bp, Homo sapiens
actgcctgtatactttag

SEQ ID NO: 4917100 - DNA, 21 bp, Homo sapiens
actgccttgaacctgtgagta

SEQ ID NO: 4917101 - DNA, 23 bp, Homo sapiens
actgccttgaacctgtgagtaaa

SEQ ID NO: 4917102 - DNA, 20 bp, Homo sapiens
actgcctttttatttatatg

SEQ ID NO: 4917103 - DNA, 13 bp, Homo sapiens
actgctagtgttc

SEQ ID NO: 4917104 - DNA, 19 bp, Homo sapiens
actgctccccagccctggc

SEQ ID NO: 4917105 - DNA, 21 bp, Homo sapiens
actgctccccagccctggctc

SEQ ID NO: 4917106 - DNA, 21 bp, Homo sapiens
actgctccctgaagccagcct

SEQ ID NO: 4917107 - DNA, 23 bp, Homo sapiens
actgctccctgaagccagccttc

SEQ ID NO: 4917108 - DNA, 18 bp, Homo sapiens
actgctcttgtttctttt

SEQ ID NO: 4917109 - DNA, 20 bp, Homo sapiens
actgctggacgtctttcttt

SEQ ID NO: 4917110 - DNA, 16 bp, Homo sapiens
actgcttgatgaagca

SEQ ID NO: 4917111 - DNA, 21 bp, Homo sapiens
actgcttttttttttccagca

SEQ ID NO: 4917112 - DNA, 17 bp, Homo sapiens
actggaagcacagcttc

SEQ ID NO: 4917113 - DNA, 19 bp, Homo sapiens
actggaagcacagcttcat

SEQ ID NO: 4917114 - DNA, 16 bp, Homo sapiens
actggaagctaatttg

SEQ ID NO: 4917115 - DNA, 12 bp, Homo sapiens
actggaagttca

SEQ ID NO: 4917116 - DNA, 21 bp, Homo sapiens
actggaagttcatacctaagt

SEQ ID NO: 4917117 - DNA, 16 bp, Homo sapiens
actggaccactgggca

SEQ ID NO: 4917118 - DNA, 20 bp, Homo sapiens
actggaccactgggcaatga

SEQ ID NO: 4917119 - DNA, 19 bp, Homo sapiens
actggactcttcaaaaact

SEQ ID NO: 4917120 - DNA, 19 bp, Homo sapiens
actggagttctatgctctc

SEQ ID NO: 4917121 - DNA, 16 bp, Homo sapiens
actggcactgaattaa

SEQ ID NO: 4917122 - DNA, 19 bp, Homo sapiens
actggccccggatcagagc

SEQ ID NO: 4917123 - DNA, 15 bp, Homo sapiens
acctatcctcactgc

SEQ ID NO: 4917124 - DNA, 16 bp, Homo sapiens
acctcaaactatctgg

SEQ ID NO: 4917125 - DNA, 21 bp, Homo sapiens
acctcaaccatcctggctgcg

SEQ ID NO: 4917126 - DNA, 17 bp, Homo sapiens
acctcacacctcactct

SEQ ID NO: 4917127 - DNA, 14 bp, Homo sapiens
acctcaccctgcta

SEQ ID NO: 4917128 - DNA, 12 bp, Homo sapiens
acctcagcctcc

SEQ ID NO: 4917129 - DNA, 12 bp, Homo sapiens
acctcagcctgc

SEQ ID NO: 4917130 - DNA, 19 bp, Homo sapiens
acctcaggcactagccttt

SEQ ID NO: 4917131 - DNA, 12 bp, Homo sapiens
acctcaggcagc

SEQ ID NO: 4917132 - DNA, 16 bp, Homo sapiens
acctcaggcagctcaa

SEQ ID NO: 4917133 - DNA, 17 bp, Homo sapiens
acctccagcccgggagc

SEQ ID NO: 4917134 - DNA, 19 bp, Homo sapiens
acctccagcccgggagcct

SEQ ID NO: 4917135 - DNA, 21 bp, Homo sapiens
acctccagcccgggagcctag

SEQ ID NO: 4917136 - DNA, 12 bp, Homo sapiens
acctcccagagg

SEQ ID NO: 4917137 - DNA, 16 bp, Homo sapiens
acctcccagaggtcca

SEQ ID NO: 4917138 - DNA, 17 bp, Homo sapiens
acctcccagaggtccag

SEQ ID NO: 4917139 - DNA, 19 bp, Homo sapiens
acctcccagaggtccagcc

SEQ ID NO: 4917140 - DNA, 19 bp, Homo sapiens
acctccccacgccctcccc

SEQ ID NO: 4917141 - DNA, 20 bp, Homo sapiens
acctccccacgccctcccct

SEQ ID NO: 4917142 - DNA, 12 bp, Homo sapiens
acctccccagcc

SEQ ID NO: 4917143 - DNA, 13 bp, Homo sapiens
acctccccagccc

SEQ ID NO: 4917144 - DNA, 18 bp, Homo sapiens
acctccctcttgttttgt

SEQ ID NO: 4917145 - DNA, 22 bp, Homo sapiens
acctccctcttgttttgtttgt

SEQ ID NO: 4917146 - DNA, 13 bp, Homo sapiens
acctcccttccga

SEQ ID NO: 4917147 - DNA, 15 bp, Homo sapiens
acctcctcttccccc

SEQ ID NO: 4917148 - DNA, 13 bp, Homo sapiens
acctcctgtggaa

SEQ ID NO: 4917149 - DNA, 18 bp, Homo sapiens
acctccttgtcactttat

SEQ ID NO: 4917150 - DNA, 19 bp, Homo sapiens
acctctacccaaaccctag

SEQ ID NO: 4917151 - DNA, 21 bp, Homo sapiens
acctctacccaaaccctaggt

SEQ ID NO: 4917152 - DNA, 16 bp, Homo sapiens
acctctcactccccat

SEQ ID NO: 4917153 - DNA, 16 bp, Homo sapiens
acctctccatcctgct

SEQ ID NO: 4917154 - DNA, 12 bp, Homo sapiens
acctctgccaga

SEQ ID NO: 4917155 - DNA, 20 bp, Homo sapiens
acctctgcggaccccagctg

SEQ ID NO: 4917156 - DNA, 14 bp, Homo sapiens
acctctggactggc

SEQ ID NO: 4917157 - DNA, 19 bp, Homo sapiens
acctctggactggctagag

SEQ ID NO: 4917158 - DNA, 13 bp, Homo sapiens
acctctgtctcat

SEQ ID NO: 4917159 - DNA, 21 bp, Homo sapiens
acctctgtctcatcctcctgg

SEQ ID NO: 4917160 - DNA, 14 bp, Homo sapiens
acctctgtgacctc

SEQ ID NO: 4917161 - DNA, 18 bp, Homo sapiens
acctctgtgacctcaggc

SEQ ID NO: 4917162 - DNA, 19 bp, Homo sapiens
acctctgtgacctcaggca

SEQ ID NO: 4917163 - DNA, 15 bp, Homo sapiens
acctctgtgtgctcc

SEQ ID NO: 4917164 - DNA, 22 bp, Homo sapiens
acctcttccccagaaaggagac

SEQ ID NO: 4917165 - DNA, 12 bp, Homo sapiens
acctcttgctgt

SEQ ID NO: 4917166 - DNA, 13 bp, Homo sapiens
acctcttgctgtc

SEQ ID NO: 4917167 - DNA, 14 bp, Homo sapiens
acctcttgctgtct

SEQ ID NO: 4917168 - DNA, 16 bp, Homo sapiens
acctcttgctgtctct

SEQ ID NO: 4917169 - DNA, 20 bp, Homo sapiens
acctcttgctgtctctgctc

SEQ ID NO: 4917170 - DNA, 15 bp, Homo sapiens
acctgaaaaaaagtt

SEQ ID NO: 4917171 - DNA, 18 bp, Homo sapiens
acctgaaaaaaagtttac

SEQ ID NO: 4917172 - DNA, 21 bp, Homo sapiens
acctgaaaaaaagtttacaag

SEQ ID NO: 4917173 - DNA, 15 bp, Homo sapiens
acctgaaattccaaa

SEQ ID NO: 4917174 - DNA, 16 bp, Homo sapiens
acctgaaattccaaag

SEQ ID NO: 4917175 - DNA, 19 bp, Homo sapiens
acctgaaattccaaagtct

SEQ ID NO: 4917176 - DNA, 15 bp, Homo sapiens
acctgacctcttgct

SEQ ID NO: 4917177 - DNA, 16 bp, Homo sapiens
acctgacctcttgctg

SEQ ID NO: 4917178 - DNA, 17 bp, Homo sapiens
acctgacctcttgctgt

SEQ ID NO: 4917179 - DNA, 21 bp, Homo sapiens
acctgacctcttgctgtctct

SEQ ID NO: 4917180 - DNA, 22 bp, Homo sapiens
acctgacctcttgctgtctctg

SEQ ID NO: 4917181 - DNA, 16 bp, Homo sapiens
acctgattgtaaactt

SEQ ID NO: 4917182 - DNA, 23 bp, Homo sapiens
acctgcaggctgagccactctct

SEQ ID NO: 4917183 - DNA, 16 bp, Homo sapiens
acctgccatgccagga

SEQ ID NO: 4917184 - DNA, 21 bp, Homo sapiens
acctgcccaacctgctctcct

SEQ ID NO: 4917185 - DNA, 15 bp, Homo sapiens
acctgccctggaaca

SEQ ID NO: 4917186 - DNA, 18 bp, Homo sapiens
acctgcctcctgcctgcc

SEQ ID NO: 4917187 - DNA, 11 bp, Homo sapiens
acctgcctctc

SEQ ID NO: 4917188 - DNA, 13 bp, Homo sapiens
acctgcctgcgtc

SEQ ID NO: 4917189 - DNA, 17 bp, Homo sapiens
acctgcctgcgtcttcc

SEQ ID NO: 4917190 - DNA, 12 bp, Homo sapiens
acctgctctcct

SEQ ID NO: 4917191 - DNA, 17 bp, Homo sapiens
acctgctctcctcttgc

SEQ ID NO: 4917192 - DNA, 16 bp, Homo sapiens
acctgctttttgaaat

SEQ ID NO: 4917193 - DNA, 21 bp, Homo sapiens
acctgctttttgaaatgaaat

SEQ ID NO: 4917194 - DNA, 22 bp, Homo sapiens
acctggccgcgtttagaccaag

SEQ ID NO: 4917195 - DNA, 15 bp, Homo sapiens
acctgggcatatcca

SEQ ID NO: 4917196 - DNA, 22 bp, Homo sapiens
acctgggttccctttccttcca

SEQ ID NO: 4917197 - DNA, 16 bp, Homo sapiens
acctggtaccctcctg

SEQ ID NO: 4917198 - DNA, 17 bp, Homo sapiens
acctggtactccctctc

SEQ ID NO: 4917199 - DNA, 16 bp, Homo sapiens
acctgtacactgactt

SEQ ID NO: 4917200 - DNA, 15 bp, Homo sapiens
acctgtcacattgca

SEQ ID NO: 4917201 - DNA, 17 bp, Homo sapiens
acctgtcacattgcatt

SEQ ID NO: 4917202 - DNA, 16 bp, Homo sapiens
acctgtctccactgtg

SEQ ID NO: 4917203 - DNA, 17 bp, Homo sapiens
acctgtctcctttctca

SEQ ID NO: 4917204 - DNA, 18 bp, Homo sapiens
acctgtctgactgtagct

SEQ ID NO: 4917205 - DNA, 17 bp, Homo sapiens
acctgtgaagctgaaaa

SEQ ID NO: 4917206 - DNA, 18 bp, Homo sapiens
acctgtgagtttaaagca

SEQ ID NO: 4917207 - DNA, 12 bp, Homo sapiens
acctgtgggtgt

SEQ ID NO: 4917208 - DNA, 22 bp, Homo sapiens
acctgtgtggtactctgaaaca

SEQ ID NO: 4917209 - DNA, 19 bp, Homo sapiens
acctgttgctgtgtttaat

SEQ ID NO: 4917210 - DNA, 22 bp, Homo sapiens
acctgttgctgtgtttaatttg

SEQ ID NO: 4917211 - DNA, 21 bp, Homo sapiens
acctgtttatgagatgctggt

SEQ ID NO: 4917212 - DNA, 18 bp, Homo sapiens
acctgttttcgcacctac

SEQ ID NO: 4917213 - DNA, 22 bp, Homo sapiens
accttaagacctactgttctaa

SEQ ID NO: 4917214 - DNA, 16 bp, Homo sapiens
accttaccaactttct

SEQ ID NO: 4917215 - DNA, 13 bp, Homo sapiens
accttagctccct

SEQ ID NO: 4917216 - DNA, 17 bp, Homo sapiens
accttaggccttcctct

SEQ ID NO: 4917217 - DNA, 23 bp, Homo sapiens
accttatcactgcattattctct

SEQ ID NO: 4917218 - DNA, 13 bp, Homo sapiens
accttccagctcc

SEQ ID NO: 4917219 - DNA, 14 bp, Homo sapiens
accttccagctcct

SEQ ID NO: 4917220 - DNA, 21 bp, Homo sapiens
accttcccaaacgcctcccct

SEQ ID NO: 4917221 - DNA, 17 bp, Homo sapiens
accttcccatgccctgg

SEQ ID NO: 4917222 - DNA, 15 bp, Homo sapiens
accttcctctggggc

SEQ ID NO: 4917223 - DNA, 16 bp, Homo sapiens
accttcctctggggct

SEQ ID NO: 4917224 - DNA, 14 bp, Homo sapiens
accttccttcctgt

SEQ ID NO: 4917225 - DNA, 17 bp, Homo sapiens
accttctagaattataa

SEQ ID NO: 4917226 - DNA, 16 bp, Homo sapiens
accttctctatatcat

SEQ ID NO: 4917227 - DNA, 19 bp, Homo sapiens
accttctgcctttgatgtt

SEQ ID NO: 4917228 - DNA, 19 bp, Homo sapiens
accttctggcttccttctc

SEQ ID NO: 4917229 - DNA, 15 bp, Homo sapiens
accttctgtggctca

SEQ ID NO: 4917230 - DNA, 19 bp, Homo sapiens
accttcttattatatatat

SEQ ID NO: 4917231 - DNA, 15 bp, Homo sapiens
accttgaatgctgcc

SEQ ID NO: 4917232 - DNA, 14 bp, Homo sapiens
accttgacagggca

SEQ ID NO: 4917233 - DNA, 20 bp, Homo sapiens
accttgctaattttctcaaa

SEQ ID NO: 4917234 - DNA, 14 bp, Homo sapiens
accttgctgtcctg

SEQ ID NO: 4917235 - DNA, 17 bp, Homo sapiens
accccaccctccctgga

SEQ ID NO: 4917236 - DNA, 13 bp, Homo sapiens
accccacccttcc

SEQ ID NO: 4917237 - DNA, 13 bp, Homo sapiens
accccacctgcag

SEQ ID NO: 4917238 - DNA, 17 bp, Homo sapiens
accccagagattcccaa

SEQ ID NO: 4917239 - DNA, 17 bp, Homo sapiens
accccagctgtgagcct

SEQ ID NO: 4917240 - DNA, 22 bp, Homo sapiens
accccagctgtgagccttggct

SEQ ID NO: 4917241 - DNA, 17 bp, Homo sapiens
accccagtggccactca

SEQ ID NO: 4917242 - DNA, 19 bp, Homo sapiens
accccagtggccactcagc

SEQ ID NO: 4917243 - DNA, 15 bp, Homo sapiens
accccatcgccaact

SEQ ID NO: 4917244 - DNA, 12 bp, Homo sapiens
acccccacccca

SEQ ID NO: 4917245 - DNA, 18 bp, Homo sapiens
acccccacccccagctca

SEQ ID NO: 4917246 - DNA, 12 bp, Homo sapiens
acccccagcctg

SEQ ID NO: 4917247 - DNA, 13 bp, Homo sapiens
acccccagcctgc

SEQ ID NO: 4917248 - DNA, 12 bp, Homo sapiens
acccccctgttc

SEQ ID NO: 4917249 - DNA, 12 bp, Homo sapiens
accccctccttc

SEQ ID NO: 4917250 - DNA, 15 bp, Homo sapiens
accccctccttcaga

SEQ ID NO: 4917251 - DNA, 16 bp, Homo sapiens
accccctccttcagac

SEQ ID NO: 4917252 - DNA, 17 bp, Homo sapiens
accccctccttcagaca

SEQ ID NO: 4917253 - DNA, 22 bp, Homo sapiens
accccctgagatcccctgagcc

SEQ ID NO: 4917254 - DNA, 16 bp, Homo sapiens
acccccttctctgctc

SEQ ID NO: 4917255 - DNA, 18 bp, Homo sapiens
acccccttctctgctcca

SEQ ID NO: 4917256 - DNA, 19 bp, Homo sapiens
acccccttctctgctccac

SEQ ID NO: 4917257 - DNA, 20 bp, Homo sapiens
acccccttctctgctccacc

SEQ ID NO: 4917258 - DNA, 19 bp, Homo sapiens
accccgcctgccctcatgg

SEQ ID NO: 4917259 - DNA, 22 bp, Homo sapiens
accccggcaggccctgcagtgt

SEQ ID NO: 4917260 - DNA, 18 bp, Homo sapiens
accccgggctctctgctg

SEQ ID NO: 4917261 - DNA, 18 bp, Homo sapiens
accccgttacagctcccc

SEQ ID NO: 4917262 - DNA, 13 bp, Homo sapiens
acccctacccctg

SEQ ID NO: 4917263 - DNA, 14 bp, Homo sapiens
acccctagttccct

SEQ ID NO: 4917264 - DNA, 15 bp, Homo sapiens
acccctagttccctc

SEQ ID NO: 4917265 - DNA, 17 bp, Homo sapiens
acccctagttccctctg

SEQ ID NO: 4917266 - DNA, 17 bp, Homo sapiens
acccctcactctggcct

SEQ ID NO: 4917267 - DNA, 12 bp, Homo sapiens
acccctccagga

SEQ ID NO: 4917268 - DNA, 14 bp, Homo sapiens
acccctcctcactg

SEQ ID NO: 4917269 - DNA, 16 bp, Homo sapiens
acccctcctcactggc

SEQ ID NO: 4917270 - DNA, 17 bp, Homo sapiens
acccctcctcactggcc

SEQ ID NO: 4917271 - DNA, 12 bp, Homo sapiens
acccctggcttt

SEQ ID NO: 4917272 - DNA, 15 bp, Homo sapiens
acccctggcttttca

SEQ ID NO: 4917273 - DNA, 11 bp, Homo sapiens
acccctgtccc

SEQ ID NO: 4917274 - DNA, 19 bp, Homo sapiens
acccctgtcctcactgctc

SEQ ID NO: 4917275 - DNA, 18 bp, Homo sapiens
acccggaggggcctggca

SEQ ID NO: 4917276 - DNA, 13 bp, Homo sapiens
acccggctaattt

SEQ ID NO: 4917277 - DNA, 18 bp, Homo sapiens
acccggtttctttttaag

SEQ ID NO: 4917278 - DNA, 16 bp, Homo sapiens
acccgtgagcgcctgt

SEQ ID NO: 4917279 - DNA, 17 bp, Homo sapiens
acccgtgagcgcctgtg

SEQ ID NO: 4917280 - DNA, 16 bp, Homo sapiens
accctacctgtgcctg

SEQ ID NO: 4917281 - DNA, 22 bp, Homo sapiens
accctaggttccctgttcttcc

SEQ ID NO: 4917282 - DNA, 15 bp, Homo sapiens
accctagttctacct

SEQ ID NO: 4917283 - DNA, 21 bp, Homo sapiens
accctagttctacctcaggca

SEQ ID NO: 4917284 - DNA, 14 bp, Homo sapiens
accctatctcctga

SEQ ID NO: 4917285 - DNA, 18 bp, Homo sapiens
accctatctcctgacaga

SEQ ID NO: 4917286 - DNA, 18 bp, Homo sapiens
accctcactctgccaggg

SEQ ID NO: 4917287 - DNA, 21 bp, Homo sapiens
accctcactctgccagggcag

SEQ ID NO: 4917288 - DNA, 13 bp, Homo sapiens
accctcccacccc

SEQ ID NO: 4917289 - DNA, 13 bp, Homo sapiens
accctccctggag

SEQ ID NO: 4917290 - DNA, 16 bp, Homo sapiens
accctctcagctccag

SEQ ID NO: 4917291 - DNA, 13 bp, Homo sapiens
accctctgggaac

SEQ ID NO: 4917292 - DNA, 21 bp, Homo sapiens
accctctgggaacctcccaga

SEQ ID NO: 4917293 - DNA, 22 bp, Homo sapiens
accctctgggaacctcccagag

SEQ ID NO: 4917294 - DNA, 16 bp, Homo sapiens
accctcttcctgtgat

SEQ ID NO: 4917295 - DNA, 23 bp, Homo sapiens
accctgaggtcagggagtgctgg

SEQ ID NO: 4917296 - DNA, 17 bp, Homo sapiens
accctgcaaggcccaca

SEQ ID NO: 4917297 - DNA, 23 bp, Homo sapiens
accctgcaaggcccacaggaggc

SEQ ID NO: 4917298 - DNA, 20 bp, Homo sapiens
accctgcccttgacatctgg

SEQ ID NO: 4917299 - DNA, 15 bp, Homo sapiens
accctggcattatgt

SEQ ID NO: 4917300 - DNA, 16 bp, Homo sapiens
accctggccgccccct

SEQ ID NO: 4917301 - DNA, 22 bp, Homo sapiens
accctggccgccccctgccccc

SEQ ID NO: 4917302 - DNA, 12 bp, Homo sapiens
accctgggaagg

SEQ ID NO: 4917303 - DNA, 17 bp, Homo sapiens
accctgggagacagacc

SEQ ID NO: 4917304 - DNA, 16 bp, Homo sapiens
accctggggagaaagt

SEQ ID NO: 4917305 - DNA, 17 bp, Homo sapiens
accctggggcctggacc

SEQ ID NO: 4917306 - DNA, 17 bp, Homo sapiens
accctgtacctcatccc

SEQ ID NO: 4917307 - DNA, 17 bp, Homo sapiens
accctgtggccctggct

SEQ ID NO: 4917308 - DNA, 20 bp, Homo sapiens
accctgtgtatacagccctg

SEQ ID NO: 4917309 - DNA, 17 bp, Homo sapiens
acccttaacccaaggag

SEQ ID NO: 4917310 - DNA, 19 bp, Homo sapiens
acccttaccccttagcctc

SEQ ID NO: 4917311 - DNA, 12 bp, Homo sapiens
acccttagaaaa

SEQ ID NO: 4917312 - DNA, 17 bp, Homo sapiens
acccttcctgagcttta

SEQ ID NO: 4917313 - DNA, 13 bp, Homo sapiens
acccttcttttct

SEQ ID NO: 4917314 - DNA, 20 bp, Homo sapiens
accctttcctcctttatcac

SEQ ID NO: 4917315 - DNA, 14 bp, Homo sapiens
accctttgtttctt

SEQ ID NO: 4917316 - DNA, 20 bp, Homo sapiens
accgaagtggactggcccct

SEQ ID NO: 4917317 - DNA, 23 bp, Homo sapiens
accgacctggtttttaaatagag

SEQ ID NO: 4917318 - DNA, 18 bp, Homo sapiens
accgacgcgtctcctgtt

SEQ ID NO: 4917319 - DNA, 20 bp, Homo sapiens
accgagtctcttctccactg

SEQ ID NO: 4917320 - DNA, 21 bp, Homo sapiens
accgagtctcttctccactgg

SEQ ID NO: 4917321 - DNA, 14 bp, Homo sapiens
accgcacagctcag

SEQ ID NO: 4917322 - DNA, 12 bp, Homo sapiens
accgccccctcc

SEQ ID NO: 4917323 - DNA, 14 bp, Homo sapiens
accgccccctcctc

SEQ ID NO: 4917324 - DNA, 15 bp, Homo sapiens
accgctcacctagag

SEQ ID NO: 4917325 - DNA, 17 bp, Homo sapiens
accgctcacctagagcc

SEQ ID NO: 4917326 - DNA, 15 bp, Homo sapiens
accgcttctgccttt

SEQ ID NO: 4917327 - DNA, 17 bp, Homo sapiens
accgcttctgccttttc

SEQ ID NO: 4917328 - DNA, 21 bp, Homo sapiens
accgcttgtggggacccaggc

SEQ ID NO: 4917329 - DNA, 22 bp, Homo sapiens
accgcttgtggggacccaggct

SEQ ID NO: 4917330 - DNA, 18 bp, Homo sapiens
accggccgatggagacac

SEQ ID NO: 4917331 - DNA, 14 bp, Homo sapiens
accggcgcgctctt

SEQ ID NO: 4917332 - DNA, 18 bp, Homo sapiens
accgggaataaccttcca

SEQ ID NO: 4917333 - DNA, 23 bp, Homo sapiens
accgggctgggagctctgcagag

SEQ ID NO: 4917334 - DNA, 23 bp, Homo sapiens
accggtccagctggcctggacag

SEQ ID NO: 4917335 - DNA, 21 bp, Homo sapiens
accgtcctcacccctgtcctc

SEQ ID NO: 4917336 - DNA, 20 bp, Homo sapiens
accgtgagcaggaaggcctg

SEQ ID NO: 4917337 - DNA, 21 bp, Homo sapiens
accgtgagcaggaaggcctgg

SEQ ID NO: 4917338 - DNA, 19 bp, Homo sapiens
acctaacgccctatttttg

SEQ ID NO: 4917339 - DNA, 22 bp, Homo sapiens
acctaattcgatgaaggctgcc

SEQ ID NO: 4917340 - DNA, 20 bp, Homo sapiens
acctacatattccatgtttg

SEQ ID NO: 4917341 - DNA, 21 bp, Homo sapiens
acctactgttctaaagctctg

SEQ ID NO: 4917342 - DNA, 22 bp, Homo sapiens
acctagaaattgacacaagtgg

SEQ ID NO: 4917343 - DNA, 17 bp, Homo sapiens
acctagagaagataatt

SEQ ID NO: 4917344 - DNA, 20 bp, Homo sapiens
acctagagacttcacccggg

SEQ ID NO: 4917345 - DNA, 13 bp, Homo sapiens
acctagcaattcc

SEQ ID NO: 4917346 - DNA, 20 bp, Homo sapiens
accacagacacacacacgca

SEQ ID NO: 4917347 - DNA, 20 bp, Homo sapiens
accacatcctccgtccagcc

SEQ ID NO: 4917348 - DNA, 16 bp, Homo sapiens
accacatcttgctctg

SEQ ID NO: 4917349 - DNA, 21 bp, Homo sapiens
accacatcttgctctgctgac

SEQ ID NO: 4917350 - DNA, 20 bp, Homo sapiens
accaccacacccagcccact

SEQ ID NO: 4917351 - DNA, 17 bp, Homo sapiens
accaccatccaccgctg

SEQ ID NO: 4917352 - DNA, 19 bp, Homo sapiens
accaccatccaccgctgct

SEQ ID NO: 4917353 - DNA, 21 bp, Homo sapiens
accaccatccaccgctgctcc

SEQ ID NO: 4917354 - DNA, 18 bp, Homo sapiens
accaccccgcctgccctc

SEQ ID NO: 4917355 - DNA, 20 bp, Homo sapiens
accaccctagtcccttcccc

SEQ ID NO: 4917356 - DNA, 18 bp, Homo sapiens
accacgctggaccttgaa

SEQ ID NO: 4917357 - DNA, 14 bp, Homo sapiens
accacgtccagctg

SEQ ID NO: 4917358 - DNA, 17 bp, Homo sapiens
accactacatgcagccc

SEQ ID NO: 4917359 - DNA, 13 bp, Homo sapiens
accactagaactc

SEQ ID NO: 4917360 - DNA, 20 bp, Homo sapiens
accactagaactctccatct

SEQ ID NO: 4917361 - DNA, 18 bp, Homo sapiens
accactgcactccagcct

SEQ ID NO: 4917362 - DNA, 20 bp, Homo sapiens
accactgtttcttgcttgta

SEQ ID NO: 4917363 - DNA, 22 bp, Homo sapiens
accactgtttcttgcttgtacc

SEQ ID NO: 4917364 - DNA, 14 bp, Homo sapiens
accacttccagggg

SEQ ID NO: 4917365 - DNA, 13 bp, Homo sapiens
accagaagggaaa

SEQ ID NO: 4917366 - DNA, 13 bp, Homo sapiens
accagactgcagg

SEQ ID NO: 4917367 - DNA, 14 bp, Homo sapiens
accagactgcaggt

SEQ ID NO: 4917368 - DNA, 12 bp, Homo sapiens
accagagcccac

SEQ ID NO: 4917369 - DNA, 19 bp, Homo sapiens
accagcatcacctgcctgt

SEQ ID NO: 4917370 - DNA, 15 bp, Homo sapiens
accagccagatcctc

SEQ ID NO: 4917371 - DNA, 20 bp, Homo sapiens
accagccccactgccagcag

SEQ ID NO: 4917372 - DNA, 23 bp, Homo sapiens
accagccccactgccagcagcag

SEQ ID NO: 4917373 - DNA, 16 bp, Homo sapiens
accagccccagtgccc

SEQ ID NO: 4917374 - DNA, 18 bp, Homo sapiens
accagccccagtgcccac

SEQ ID NO: 4917375 - DNA, 19 bp, Homo sapiens
accagccccagtgcccaca

SEQ ID NO: 4917376 - DNA, 15 bp, Homo sapiens
accagccctggggct

SEQ ID NO: 4917377 - DNA, 16 bp, Homo sapiens
accagccctggggctg

SEQ ID NO: 4917378 - DNA, 17 bp, Homo sapiens
accagccctggggctgg

SEQ ID NO: 4917379 - DNA, 18 bp, Homo sapiens
accagccctggggctggg

SEQ ID NO: 4917380 - DNA, 21 bp, Homo sapiens
accagcttgtatgcaatggat

SEQ ID NO: 4917381 - DNA, 22 bp, Homo sapiens
accagcttgtatgcaatggatt

SEQ ID NO: 4917382 - DNA, 19 bp, Homo sapiens
accaggaaaggattttata

SEQ ID NO: 4917383 - DNA, 16 bp, Homo sapiens
accaggactccctcct

SEQ ID NO: 4917384 - DNA, 17 bp, Homo sapiens
accaggactccctcctc

SEQ ID NO: 4917385 - DNA, 18 bp, Homo sapiens
accaggagaaccactaca

SEQ ID NO: 4917386 - DNA, 19 bp, Homo sapiens
accaggagaaccactacat

SEQ ID NO: 4917387 - DNA, 15 bp, Homo sapiens
accaggccattctgc

SEQ ID NO: 4917388 - DNA, 13 bp, Homo sapiens
accaggctgtgtc

SEQ ID NO: 4917389 - DNA, 16 bp, Homo sapiens
accagggccgaggagg

SEQ ID NO: 4917390 - DNA, 20 bp, Homo sapiens
accagtaggggcttataata

SEQ ID NO: 4917391 - DNA, 13 bp, Homo sapiens
accagtgccaagg

SEQ ID NO: 4917392 - DNA, 14 bp, Homo sapiens
accagtgccaagga

SEQ ID NO: 4917393 - DNA, 23 bp, Homo sapiens
accagtgcccaaagtctgtgtga

SEQ ID NO: 4917394 - DNA, 22 bp, Homo sapiens
accagtggcgttgttgcatgtt

SEQ ID NO: 4917395 - DNA, 21 bp, Homo sapiens
accagtttagatttcaagaaa

SEQ ID NO: 4917396 - DNA, 14 bp, Homo sapiens
accatacatttaaa

SEQ ID NO: 4917397 - DNA, 17 bp, Homo sapiens
accatactcatttctaa

SEQ ID NO: 4917398 - DNA, 19 bp, Homo sapiens
accatactcatttctaaaa

SEQ ID NO: 4917399 - DNA, 15 bp, Homo sapiens
accatactgagggac

SEQ ID NO: 4917400 - DNA, 15 bp, Homo sapiens
accatatttagcagt

SEQ ID NO: 4917401 - DNA, 14 bp, Homo sapiens
accatcagggacag

SEQ ID NO: 4917402 - DNA, 16 bp, Homo sapiens
accatcatgtctggct

SEQ ID NO: 4917403 - DNA, 13 bp, Homo sapiens
accatctaatagc

SEQ ID NO: 4917404 - DNA, 18 bp, Homo sapiens
accatctgcttttattaa

SEQ ID NO: 4917405 - DNA, 13 bp, Homo sapiens
accatctggcctg

SEQ ID NO: 4917406 - DNA, 15 bp, Homo sapiens
accatctggcctggc

SEQ ID NO: 4917407 - DNA, 16 bp, Homo sapiens
accatctggcctggcc

SEQ ID NO: 4917408 - DNA, 23 bp, Homo sapiens
accatctggcctggcctggccct

SEQ ID NO: 4917409 - DNA, 16 bp, Homo sapiens
accatgcaaatgctat

SEQ ID NO: 4917410 - DNA, 20 bp, Homo sapiens
accatgcccggctaattttt

SEQ ID NO: 4917411 - DNA, 14 bp, Homo sapiens
accatggactttat

SEQ ID NO: 4917412 - DNA, 16 bp, Homo sapiens
accatggactttataa

SEQ ID NO: 4917413 - DNA, 17 bp, Homo sapiens
accatggttaagagtcc

SEQ ID NO: 4917414 - DNA, 21 bp, Homo sapiens
accatggttaagagtccaaga

SEQ ID NO: 4917415 - DNA, 19 bp, Homo sapiens
accatgtgtcacttgtgct

SEQ ID NO: 4917416 - DNA, 18 bp, Homo sapiens
accattaaaactgctttt

SEQ ID NO: 4917417 - DNA, 20 bp, Homo sapiens
accattcacaataaaagctt

SEQ ID NO: 4917418 - DNA, 23 bp, Homo sapiens
accattcagatcactgaatttat

SEQ ID NO: 4917419 - DNA, 15 bp, Homo sapiens
accattccccatggg

SEQ ID NO: 4917420 - DNA, 13 bp, Homo sapiens
accattgacacat

SEQ ID NO: 4917421 - DNA, 22 bp, Homo sapiens
accattgacacatccgcctttt

SEQ ID NO: 4917422 - DNA, 22 bp, Homo sapiens
accatttgcatggctccagaaa

SEQ ID NO: 4917423 - DNA, 11 bp, Homo sapiens
accatttttca

SEQ ID NO: 4917424 - DNA, 18 bp, Homo sapiens
acccaaaaactgtcttta

SEQ ID NO: 4917425 - DNA, 19 bp, Homo sapiens
acccaaccccaagccagcc

SEQ ID NO: 4917426 - DNA, 20 bp, Homo sapiens
acccaaccctatctcctgac

SEQ ID NO: 4917427 - DNA, 13 bp, Homo sapiens
acccaagctcctc

SEQ ID NO: 4917428 - DNA, 15 bp, Homo sapiens
acccaaggagcacag

SEQ ID NO: 4917429 - DNA, 20 bp, Homo sapiens
acccaagggcagaaagtaga

SEQ ID NO: 4917430 - DNA, 15 bp, Homo sapiens
acccacatgtgacac

SEQ ID NO: 4917431 - DNA, 16 bp, Homo sapiens
acccacatgtgacaca

SEQ ID NO: 4917432 - DNA, 17 bp, Homo sapiens
acccaccccacctgcag

SEQ ID NO: 4917433 - DNA, 19 bp, Homo sapiens
acccacgattttctccagc

SEQ ID NO: 4917434 - DNA, 18 bp, Homo sapiens
acccactatccttcgtga

SEQ ID NO: 4917435 - DNA, 11 bp, Homo sapiens
acccactgctt

SEQ ID NO: 4917436 - DNA, 22 bp, Homo sapiens
acccactggttccttcttcctg

SEQ ID NO: 4917437 - DNA, 17 bp, Homo sapiens
acccagaccccaggctg

SEQ ID NO: 4917438 - DNA, 16 bp, Homo sapiens
acccagcccacttctg

SEQ ID NO: 4917439 - DNA, 17 bp, Homo sapiens
acccagcccacttctgc

SEQ ID NO: 4917440 - DNA, 18 bp, Homo sapiens
acccagcccacttctgcc

SEQ ID NO: 4917441 - DNA, 16 bp, Homo sapiens
acccagcgagccctgg

SEQ ID NO: 4917442 - DNA, 13 bp, Homo sapiens
acccaggagcccc

SEQ ID NO: 4917443 - DNA, 19 bp, Homo sapiens
acccaggagccccgaggcc

SEQ ID NO: 4917444 - DNA, 23 bp, Homo sapiens
acccaggagccccgaggccttct

SEQ ID NO: 4917445 - DNA, 11 bp, Homo sapiens
acccaggctcc

SEQ ID NO: 4917446 - DNA, 15 bp, Homo sapiens
acccaggctccgccc

SEQ ID NO: 4917447 - DNA, 20 bp, Homo sapiens
acccaggctccgcccttagt

SEQ ID NO: 4917448 - DNA, 21 bp, Homo sapiens
acccaggctccgcccttagtc

SEQ ID NO: 4917449 - DNA, 23 bp, Homo sapiens
acccaggctccgcccttagtccc

SEQ ID NO: 4917450 - DNA, 19 bp, Homo sapiens
acccagggctctgccccag

SEQ ID NO: 4917451 - DNA, 20 bp, Homo sapiens
acccatgaggcaatgtcagg

SEQ ID NO: 4917452 - DNA, 14 bp, Homo sapiens
acccatgggctctg

SEQ ID NO: 4917453 - DNA, 15 bp, Homo sapiens
accccaaagcccctt

SEQ ID NO: 4917454 - DNA, 15 bp, Homo sapiens
accccaacaaaccat

SEQ ID NO: 4917455 - DNA, 16 bp, Homo sapiens
accccaacgcacagga

SEQ ID NO: 4917456 - DNA, 17 bp, Homo sapiens
accccaacgcacaggaa

SEQ ID NO: 4917457 - DNA, 21 bp, Homo sapiens
acaggtgtggtgtaatttata

SEQ ID NO: 4917458 - DNA, 16 bp, Homo sapiens
acagtaactttatgtg

SEQ ID NO: 4917459 - DNA, 13 bp, Homo sapiens
acagtagagccag

SEQ ID NO: 4917460 - DNA, 15 bp, Homo sapiens
acagtagagccagct

SEQ ID NO: 4917461 - DNA, 22 bp, Homo sapiens
acagtatatcccaagtgcactt

SEQ ID NO: 4917462 - DNA, 19 bp, Homo sapiens
acagtattacttctgctac

SEQ ID NO: 4917463 - DNA, 16 bp, Homo sapiens
acagtatttattttgt

SEQ ID NO: 4917464 - DNA, 18 bp, Homo sapiens
acagtatttattttgtaa

SEQ ID NO: 4917465 - DNA, 19 bp, Homo sapiens
acagtcaaaataattctaa

SEQ ID NO: 4917466 - DNA, 19 bp, Homo sapiens
acagtcactgccactttgc

SEQ ID NO: 4917467 - DNA, 17 bp, Homo sapiens
acagtcatcatcagggc

SEQ ID NO: 4917468 - DNA, 18 bp, Homo sapiens
acagtcatcatcagggcc

SEQ ID NO: 4917469 - DNA, 19 bp, Homo sapiens
acagtcatcatcagggcct

SEQ ID NO: 4917470 - DNA, 19 bp, Homo sapiens
acagtcccactgtgcaggt

SEQ ID NO: 4917471 - DNA, 17 bp, Homo sapiens
acagtccctaaagaaaa

SEQ ID NO: 4917472 - DNA, 23 bp, Homo sapiens
acagtgagtcgaggacagggagg

SEQ ID NO: 4917473 - DNA, 15 bp, Homo sapiens
acagtgcatctcagc

SEQ ID NO: 4917474 - DNA, 17 bp, Homo sapiens
acagtgcatctcagccc

SEQ ID NO: 4917475 - DNA, 16 bp, Homo sapiens
acagtgggaactctga

SEQ ID NO: 4917476 - DNA, 19 bp, Homo sapiens
acagtgggaactctgacaa

SEQ ID NO: 4917477 - DNA, 24 bp, Homo sapiens
acagtgtcccccaggttccgaaga

SEQ ID NO: 4917478 - DNA, 12 bp, Homo sapiens
acagttcaagaa

SEQ ID NO: 4917479 - DNA, 16 bp, Homo sapiens
acagttcaagaaagct

SEQ ID NO: 4917480 - DNA, 20 bp, Homo sapiens
acagttcaattctcatttgt

SEQ ID NO: 4917481 - DNA, 15 bp, Homo sapiens
acagtttatcatgaa

SEQ ID NO: 4917482 - DNA, 17 bp, Homo sapiens
acagtttatcatgaagc

SEQ ID NO: 4917483 - DNA, 20 bp, Homo sapiens
acagtttatcatgaagcctg

SEQ ID NO: 4917484 - DNA, 16 bp, Homo sapiens
acagtttcttagcttt

SEQ ID NO: 4917485 - DNA, 20 bp, Homo sapiens
acagtttcttagctttttaa

SEQ ID NO: 4917486 - DNA, 16 bp, Homo sapiens
acagtttgtaaatgtt

SEQ ID NO: 4917487 - DNA, 22 bp, Homo sapiens
acagtttgtaaatgttatttct

SEQ ID NO: 4917488 - DNA, 13 bp, Homo sapiens
acagttttatgct

SEQ ID NO: 4917489 - DNA, 14 bp, Homo sapiens
acataaaaaggaca

SEQ ID NO: 4917490 - DNA, 15 bp, Homo sapiens
acataaaaaggacat

SEQ ID NO: 4917491 - DNA, 21 bp, Homo sapiens
acataaaaaggacatcagcaa

SEQ ID NO: 4917492 - DNA, 13 bp, Homo sapiens
acataaacaatga

SEQ ID NO: 4917493 - DNA, 15 bp, Homo sapiens
acataacaagaaaat

SEQ ID NO: 4917494 - DNA, 18 bp, Homo sapiens
acataacgtttttccttt

SEQ ID NO: 4917495 - DNA, 21 bp, Homo sapiens
acataacgtttttcctttaaa

SEQ ID NO: 4917496 - DNA, 22 bp, Homo sapiens
acataactaaatttgatactta

SEQ ID NO: 4917497 - DNA, 23 bp, Homo sapiens
acataactaaatttgatacttat

SEQ ID NO: 4917498 - DNA, 22 bp, Homo sapiens
acataagcggcgtaagtttaaa

SEQ ID NO: 4917499 - DNA, 20 bp, Homo sapiens
acataaggggtttgccattt

SEQ ID NO: 4917500 - DNA, 20 bp, Homo sapiens
acataagtaattcaagaaaa

SEQ ID NO: 4917501 - DNA, 21 bp, Homo sapiens
acataagtaattcaagaaaac

SEQ ID NO: 4917502 - DNA, 19 bp, Homo sapiens
acataatctagtttacaga

SEQ ID NO: 4917503 - DNA, 13 bp, Homo sapiens
acataatgaaaat

SEQ ID NO: 4917504 - DNA, 18 bp, Homo sapiens
acataatgcttaatttct

SEQ ID NO: 4917505 - DNA, 19 bp, Homo sapiens
acataattaaattttgagt

SEQ ID NO: 4917506 - DNA, 16 bp, Homo sapiens
acatacacttgtataa

SEQ ID NO: 4917507 - DNA, 20 bp, Homo sapiens
acatacacttgtataaatgt

SEQ ID NO: 4917508 - DNA, 21 bp, Homo sapiens
acatacacttgtataaatgta

SEQ ID NO: 4917509 - DNA, 20 bp, Homo sapiens
acatacagttttatgctctt

SEQ ID NO: 4917510 - DNA, 20 bp, Homo sapiens
acataccctggccgccccct

SEQ ID NO: 4917511 - DNA, 20 bp, Homo sapiens
acatacggtcaggtttaaca

SEQ ID NO: 4917512 - DNA, 23 bp, Homo sapiens
acatactttcatcctgactctgc

SEQ ID NO: 4917513 - DNA, 14 bp, Homo sapiens
acatagaggtatat

SEQ ID NO: 4917514 - DNA, 18 bp, Homo sapiens
acatagaggtatattgga

SEQ ID NO: 4917515 - DNA, 20 bp, Homo sapiens
acatagaggtatattggaag

SEQ ID NO: 4917516 - DNA, 20 bp, Homo sapiens
acatagattaatggcactga

SEQ ID NO: 4917517 - DNA, 18 bp, Homo sapiens
acatagcccatccctgcc

SEQ ID NO: 4917518 - DNA, 19 bp, Homo sapiens
acatagcccatccctgcct

SEQ ID NO: 4917519 - DNA, 22 bp, Homo sapiens
acatagctacccaaaagagaaa

SEQ ID NO: 4917520 - DNA, 22 bp, Homo sapiens
acatagtaagttcagcacttgt

SEQ ID NO: 4917521 - DNA, 21 bp, Homo sapiens
acatagttttaaactcatttt

SEQ ID NO: 4917522 - DNA, 16 bp, Homo sapiens
acatatacctataatg

SEQ ID NO: 4917523 - DNA, 16 bp, Homo sapiens
acatatattatttatt

SEQ ID NO: 4917524 - DNA, 14 bp, Homo sapiens
acatatgacttgat

SEQ ID NO: 4917525 - DNA, 15 bp, Homo sapiens
acatatgcaccttgt

SEQ ID NO: 4917526 - DNA, 17 bp, Homo sapiens
acatatgtagactatat

SEQ ID NO: 4917527 - DNA, 13 bp, Homo sapiens
acatcacaggaca

SEQ ID NO: 4917528 - DNA, 21 bp, Homo sapiens
acatcaccgacgcgtctcctg

SEQ ID NO: 4917529 - DNA, 22 bp, Homo sapiens
acatcaccgacgcgtctcctgt

SEQ ID NO: 4917530 - DNA, 12 bp, Homo sapiens
acatcagataag

SEQ ID NO: 4917531 - DNA, 14 bp, Homo sapiens
acatcaggagttca

SEQ ID NO: 4917532 - DNA, 15 bp, Homo sapiens
acatcatgaatttta

SEQ ID NO: 4917533 - DNA, 19 bp, Homo sapiens
acatccaactccagcaact

SEQ ID NO: 4917534 - DNA, 11 bp, Homo sapiens
acatccatgtc

SEQ ID NO: 4917535 - DNA, 20 bp, Homo sapiens
acatccgccttttgtataca

SEQ ID NO: 4917536 - DNA, 12 bp, Homo sapiens
acatcctgggta

SEQ ID NO: 4917537 - DNA, 13 bp, Homo sapiens
acatcctgggtaa

SEQ ID NO: 4917538 - DNA, 18 bp, Homo sapiens
acatcctttgcagggcag

SEQ ID NO: 4917539 - DNA, 21 bp, Homo sapiens
acatcctttgcagggcagccc

SEQ ID NO: 4917540 - DNA, 23 bp, Homo sapiens
acatcctttgcagggcagcccca

SEQ ID NO: 4917541 - DNA, 18 bp, Homo sapiens
acatctattttggattgt

SEQ ID NO: 4917542 - DNA, 19 bp, Homo sapiens
acatctcaggggccagagg

SEQ ID NO: 4917543 - DNA, 12 bp, Homo sapiens
acatctctcccc

SEQ ID NO: 4917544 - DNA, 21 bp, Homo sapiens
acatctctccccaaccctagg

SEQ ID NO: 4917545 - DNA, 18 bp, Homo sapiens
acatctctgaaagcacag

SEQ ID NO: 4917546 - DNA, 22 bp, Homo sapiens
acatctctgcaccctggggcct

SEQ ID NO: 4917547 - DNA, 13 bp, Homo sapiens
acatcttgctctg

SEQ ID NO: 4917548 - DNA, 15 bp, Homo sapiens
acatcttgctctgct

SEQ ID NO: 4917549 - DNA, 14 bp, Homo sapiens
acatctttcctgtc

SEQ ID NO: 4917550 - DNA, 18 bp, Homo sapiens
acatctttttaaagctta

SEQ ID NO: 4917551 - DNA, 18 bp, Homo sapiens
acatgaaaattttaaaaa

SEQ ID NO: 4917552 - DNA, 21 bp, Homo sapiens
acatgaaagtagcagtgtgaa

SEQ ID NO: 4917553 - DNA, 19 bp, Homo sapiens
acatgaacacccttagaaa

SEQ ID NO: 4917554 - DNA, 12 bp, Homo sapiens
acatgacactga

SEQ ID NO: 4917555 - DNA, 16 bp, Homo sapiens
acatgacactgacctt

SEQ ID NO: 4917556 - DNA, 18 bp, Homo sapiens
acatgagatgtgtggact

SEQ ID NO: 4917557 - DNA, 23 bp, Homo sapiens
acatgagatgtgtggactgtggc

SEQ ID NO: 4917558 - DNA, 20 bp, Homo sapiens
acatgatctgtttttcacca

SEQ ID NO: 4917559 - DNA, 14 bp, Homo sapiens
acatgatgttatgt

SEQ ID NO: 4917560 - DNA, 22 bp, Homo sapiens
acatgatgttatgtaccatatg

SEQ ID NO: 4917561 - DNA, 21 bp, Homo sapiens
acatgatttccttgaatgtgg

SEQ ID NO: 4917562 - DNA, 15 bp, Homo sapiens
acatgcaaaaagaaa

SEQ ID NO: 4917563 - DNA, 18 bp, Homo sapiens
acatgcaaaaagaaatga

SEQ ID NO: 4917564 - DNA, 21 bp, Homo sapiens
acatgcaatttattaaaatga

SEQ ID NO: 4917565 - DNA, 12 bp, Homo sapiens
acatgcacacac

SEQ ID NO: 4917566 - DNA, 13 bp, Homo sapiens
acatgcacgtgtg

SEQ ID NO: 4917567 - DNA, 19 bp, Homo sapiens
acatgcactgacccttcca

SEQ ID NO: 4917568 - DNA, 15 bp, Homo sapiens
acatgcagcccatgc

SEQ ID NO: 4917569 - DNA, 15 bp, Homo sapiens
acatgcctgccccaa

SEQ ID NO: 4917570 - DNA, 14 bp, Homo sapiens
acatggaggttcta

SEQ ID NO: 4917571 - DNA, 18 bp, Homo sapiens
acatggcctatgcacata

SEQ ID NO: 4917572 - DNA, 20 bp, Homo sapiens
acatggctctggactctaaa

SEQ ID NO: 4917573 - DNA, 18 bp, Homo sapiens
acatggtgcccctagctt

SEQ ID NO: 4917574 - DNA, 18 bp, Homo sapiens
acatgtatttatgtaatg

SEQ ID NO: 4917575 - DNA, 12 bp, Homo sapiens
acatgtgaaacc

SEQ ID NO: 4917576 - DNA, 12 bp, Homo sapiens
acatgtgacaca

SEQ ID NO: 4917577 - DNA, 16 bp, Homo sapiens
acatgtgcacatgcac

SEQ ID NO: 4917578 - DNA, 18 bp, Homo sapiens
acatgtgtgtatatatgt

SEQ ID NO: 4917579 - DNA, 12 bp, Homo sapiens
acatgtgtttta

SEQ ID NO: 4917580 - DNA, 14 bp, Homo sapiens
acatgttgtaaatt

SEQ ID NO: 4917581 - DNA, 15 bp, Homo sapiens
acattaaaaaatgaa

SEQ ID NO: 4917582 - DNA, 16 bp, Homo sapiens
acattaaaaatggaac

SEQ ID NO: 4917583 - DNA, 12 bp, Homo sapiens
acattaaatgtc

SEQ ID NO: 4917584 - DNA, 13 bp, Homo sapiens
acattaaatgtct

SEQ ID NO: 4917585 - DNA, 20 bp, Homo sapiens
acattaatggtctaaaaata

SEQ ID NO: 4917586 - DNA, 18 bp, Homo sapiens
acattagcagtttgcttt

SEQ ID NO: 4917587 - DNA, 14 bp, Homo sapiens
acattagtaaatgt

SEQ ID NO: 4917588 - DNA, 19 bp, Homo sapiens
acattagtaaatgtctttg

SEQ ID NO: 4917589 - DNA, 22 bp, Homo sapiens
acattagtaaatgtctttgtaa

SEQ ID NO: 4917590 - DNA, 24 bp, Homo sapiens
acattagtaaatgtctttgtaagt

SEQ ID NO: 4917591 - DNA, 11 bp, Homo sapiens
acattataaac

SEQ ID NO: 4917592 - DNA, 21 bp, Homo sapiens
acattatgtggttttagattt

SEQ ID NO: 4917593 - DNA, 22 bp, Homo sapiens
acattatgtggttttagatttt

SEQ ID NO: 4917594 - DNA, 14 bp, Homo sapiens
acattatgtgtgca

SEQ ID NO: 4917595 - DNA, 14 bp, Homo sapiens
acattatttatatg

SEQ ID NO: 4917596 - DNA, 18 bp, Homo sapiens
acattatttatatgggga

SEQ ID NO: 4917597 - DNA, 16 bp, Homo sapiens
acattatttctagtcc

SEQ ID NO: 4917598 - DNA, 12 bp, Homo sapiens
acattcaatgtt

SEQ ID NO: 4917599 - DNA, 15 bp, Homo sapiens
acattctgatgagca

SEQ ID NO: 4917600 - DNA, 19 bp, Homo sapiens
acattcttttaacttcttt

SEQ ID NO: 4917601 - DNA, 21 bp, Homo sapiens
acattcttttaacttctttct

SEQ ID NO: 4917602 - DNA, 22 bp, Homo sapiens
acattgacgattccttctctga

SEQ ID NO: 4917603 - DNA, 16 bp, Homo sapiens
acattgagctgatata

SEQ ID NO: 4917604 - DNA, 23 bp, Homo sapiens
acattgagctgatataaattctg

SEQ ID NO: 4917605 - DNA, 22 bp, Homo sapiens
acattgagtagacacatttaag

SEQ ID NO: 4917606 - DNA, 11 bp, Homo sapiens
acattgcattc

SEQ ID NO: 4917607 - DNA, 16 bp, Homo sapiens
acattgcattctattg

SEQ ID NO: 4917608 - DNA, 15 bp, Homo sapiens
acattgcgtttgacc

SEQ ID NO: 4917609 - DNA, 22 bp, Homo sapiens
acattggagatgccatcctctt

SEQ ID NO: 4917610 - DNA, 16 bp, Homo sapiens
acattggattatcctg

SEQ ID NO: 4917611 - DNA, 19 bp, Homo sapiens
acattgtaaatagtatttg

SEQ ID NO: 4917612 - DNA, 16 bp, Homo sapiens
acattgtgttgacatt

SEQ ID NO: 4917613 - DNA, 14 bp, Homo sapiens
acattgttgagcta

SEQ ID NO: 4917614 - DNA, 21 bp, Homo sapiens
acattgttgctccctgtgaca

SEQ ID NO: 4917615 - DNA, 10 bp, Homo sapiens
acatttaaaa

SEQ ID NO: 4917616 - DNA, 14 bp, Homo sapiens
acatttaaaactta

SEQ ID NO: 4917617 - DNA, 16 bp, Homo sapiens
acatttaatatcttca

SEQ ID NO: 4917618 - DNA, 12 bp, Homo sapiens
acatttaattta

SEQ ID NO: 4917619 - DNA, 12 bp, Homo sapiens
acatttacagtc

SEQ ID NO: 4917620 - DNA, 21 bp, Homo sapiens
acatttacagtccttcaaaat

SEQ ID NO: 4917621 - DNA, 12 bp, Homo sapiens
acatttataatt

SEQ ID NO: 4917622 - DNA, 13 bp, Homo sapiens
acatttataattg

SEQ ID NO: 4917623 - DNA, 17 bp, Homo sapiens
acatttatgatttaata

SEQ ID NO: 4917624 - DNA, 19 bp, Homo sapiens
acatttatgatttaataaa

SEQ ID NO: 4917625 - DNA, 22 bp, Homo sapiens
acatttatgatttaataaaata

SEQ ID NO: 4917626 - DNA, 13 bp, Homo sapiens
acatttctaaaat

SEQ ID NO: 4917627 - DNA, 15 bp, Homo sapiens
acatttctgtaaata

SEQ ID NO: 4917628 - DNA, 18 bp, Homo sapiens
acatttcttttcttttta

SEQ ID NO: 4917629 - DNA, 20 bp, Homo sapiens
acatttcttttctttttaca

SEQ ID NO: 4917630 - DNA, 22 bp, Homo sapiens
acatttcttttctttttacata

SEQ ID NO: 4917631 - DNA, 20 bp, Homo sapiens
acatttgccttgcagaactg

SEQ ID NO: 4917632 - DNA, 15 bp, Homo sapiens
acatttggaatactt

SEQ ID NO: 4917633 - DNA, 17 bp, Homo sapiens
acatttggaatactttt

SEQ ID NO: 4917634 - DNA, 15 bp, Homo sapiens
acatttgtacagaat

SEQ ID NO: 4917635 - DNA, 17 bp, Homo sapiens
acatttgtagttggagt

SEQ ID NO: 4917636 - DNA, 23 bp, Homo sapiens
acattttaaaaacatagaaaaat

SEQ ID NO: 4917637 - DNA, 15 bp, Homo sapiens
acattttaaataaaa

SEQ ID NO: 4917638 - DNA, 17 bp, Homo sapiens
acattttaaataaaaga

SEQ ID NO: 4917639 - DNA, 15 bp, Homo sapiens
acattttacattaaa

SEQ ID NO: 4917640 - DNA, 18 bp, Homo sapiens
acattttacattaaattt

SEQ ID NO: 4917641 - DNA, 12 bp, Homo sapiens
acattttgttct

SEQ ID NO: 4917642 - DNA, 13 bp, Homo sapiens
acattttgttgta

SEQ ID NO: 4917643 - DNA, 14 bp, Homo sapiens
acattttgttgtaa

SEQ ID NO: 4917644 - DNA, 16 bp, Homo sapiens
acattttgttgtaaaa

SEQ ID NO: 4917645 - DNA, 21 bp, Homo sapiens
acattttgttgtaaaaagaaa

SEQ ID NO: 4917646 - DNA, 14 bp, Homo sapiens
acatttttaaattg

SEQ ID NO: 4917647 - DNA, 12 bp, Homo sapiens
acatttttattt

SEQ ID NO: 4917648 - DNA, 18 bp, Homo sapiens
acatttttatttatgaag

SEQ ID NO: 4917649 - DNA, 23 bp, Homo sapiens
acatttttatttatgaagtttaa

SEQ ID NO: 4917650 - DNA, 15 bp, Homo sapiens
accaaaagaacaaga

SEQ ID NO: 4917651 - DNA, 20 bp, Homo sapiens
accaaagcaccttagctggc

SEQ ID NO: 4917652 - DNA, 12 bp, Homo sapiens
accaaagctgcc

SEQ ID NO: 4917653 - DNA, 21 bp, Homo sapiens
accaaaggacattatgtgtgc

SEQ ID NO: 4917654 - DNA, 11 bp, Homo sapiens
accaaagttct

SEQ ID NO: 4917655 - DNA, 23 bp, Homo sapiens
accaaagttctaataatttctaa

SEQ ID NO: 4917656 - DNA, 20 bp, Homo sapiens
accaaatctctcaaatctgt

SEQ ID NO: 4917657 - DNA, 22 bp, Homo sapiens
accaacacccaaagcatggact

SEQ ID NO: 4917658 - DNA, 11 bp, Homo sapiens
accaactgtgt

SEQ ID NO: 4917659 - DNA, 13 bp, Homo sapiens
accaactttctgt

SEQ ID NO: 4917660 - DNA, 14 bp, Homo sapiens
accaagacaaattc

SEQ ID NO: 4917661 - DNA, 20 bp, Homo sapiens
accaagatctataaagcgat

SEQ ID NO: 4917662 - DNA, 22 bp, Homo sapiens
accaagatgccatctgtgtcct

SEQ ID NO: 4917663 - DNA, 15 bp, Homo sapiens
accaagcaggagacg

SEQ ID NO: 4917664 - DNA, 16 bp, Homo sapiens
accaagcatcaggggg

SEQ ID NO: 4917665 - DNA, 14 bp, Homo sapiens
accaagccgtggct

SEQ ID NO: 4917666 - DNA, 21 bp, Homo sapiens
accaagctattcctttccctt

SEQ ID NO: 4917667 - DNA, 15 bp, Homo sapiens
accaataaaatttct

SEQ ID NO: 4917668 - DNA, 22 bp, Homo sapiens
accaatgccaagataattcact

SEQ ID NO: 4917669 - DNA, 17 bp, Homo sapiens
accaattattgatatat

SEQ ID NO: 4917670 - DNA, 18 bp, Homo sapiens
accaattgtgctgccatt

SEQ ID NO: 4917671 - DNA, 18 bp, Homo sapiens
accacaaaggccaaactg

SEQ ID NO: 4917672 - DNA, 20 bp, Homo sapiens
accacaaaggccaaactgct

SEQ ID NO: 4917673 - DNA, 13 bp, Homo sapiens
accacaactgaca

SEQ ID NO: 4917674 - DNA, 19 bp, Homo sapiens
accacaactgacacaggaa

SEQ ID NO: 4917675 - DNA, 12 bp, Homo sapiens
accacaagggct

SEQ ID NO: 4917676 - DNA, 13 bp, Homo sapiens
accacacccagcc

SEQ ID NO: 4917677 - DNA, 16 bp, Homo sapiens
accacacccagcccac

SEQ ID NO: 4917678 - DNA, 22 bp, Homo sapiens
accacacccagcctcagtcctc

SEQ ID NO: 4917679 - DNA, 12 bp, Homo sapiens
agggaagagcag

SEQ ID NO: 4917680 - DNA, 16 bp, Homo sapiens
agggaatccaagcctc

SEQ ID NO: 4917681 - DNA, 19 bp, Homo sapiens
agggaatccaagcctccac

SEQ ID NO: 4917682 - DNA, 23 bp, Homo sapiens
agggaatccccgaaggtgctgga

SEQ ID NO: 4917683 - DNA, 14 bp, Homo sapiens
agggacagagccat

SEQ ID NO: 4917684 - DNA, 19 bp, Homo sapiens
agggaccaactgggcccaa

SEQ ID NO: 4917685 - DNA, 13 bp, Homo sapiens
agggaccatgtgt

SEQ ID NO: 4917686 - DNA, 22 bp, Homo sapiens
agggactctgaagcctctggga

SEQ ID NO: 4917687 - DNA, 15 bp, Homo sapiens
agggactgcctctgc

SEQ ID NO: 4917688 - DNA, 18 bp, Homo sapiens
agggactgcctctgccac

SEQ ID NO: 4917689 - DNA, 15 bp, Homo sapiens
agggacttggaagct

SEQ ID NO: 4917690 - DNA, 14 bp, Homo sapiens
agggagattttgag

SEQ ID NO: 4917691 - DNA, 17 bp, Homo sapiens
agggagcagacaggagg

SEQ ID NO: 4917692 - DNA, 20 bp, Homo sapiens
agggaggacctggggcacag

SEQ ID NO: 4917693 - DNA, 19 bp, Homo sapiens
agggaggacgggagctggg

SEQ ID NO: 4917694 - DNA, 20 bp, Homo sapiens
agggaggcgggggctgccct

SEQ ID NO: 4917695 - DNA, 16 bp, Homo sapiens
agggaggtcaggccct

SEQ ID NO: 4917696 - DNA, 18 bp, Homo sapiens
agggaggtcaggccctgg

SEQ ID NO: 4917697 - DNA, 20 bp, Homo sapiens
agggagtccgaaagggactt

SEQ ID NO: 4917698 - DNA, 17 bp, Homo sapiens
agggagtgacagaggca

SEQ ID NO: 4917699 - DNA, 16 bp, Homo sapiens
agggagtgctggctca

SEQ ID NO: 4917700 - DNA, 20 bp, Homo sapiens
agggagtgctggctcacagt

SEQ ID NO: 4917701 - DNA, 23 bp, Homo sapiens
agggagtgctggctcacagtaca

SEQ ID NO: 4917702 - DNA, 15 bp, Homo sapiens
agggatgactaaaat

SEQ ID NO: 4917703 - DNA, 22 bp, Homo sapiens
agggatgggcctggcattcttg

SEQ ID NO: 4917704 - DNA, 14 bp, Homo sapiens
agggattcaggctg

SEQ ID NO: 4917705 - DNA, 16 bp, Homo sapiens
agggattcaggctgct

SEQ ID NO: 4917706 - DNA, 18 bp, Homo sapiens
agggattcaggctgcttg

SEQ ID NO: 4917707 - DNA, 13 bp, Homo sapiens
agggcaaatctgc

SEQ ID NO: 4917708 - DNA, 21 bp, Homo sapiens
agggcaaatgacatgcactga

SEQ ID NO: 4917709 - DNA, 17 bp, Homo sapiens
agggcaattggaacaaa

SEQ ID NO: 4917710 - DNA, 17 bp, Homo sapiens
agggcacaccgggcact

SEQ ID NO: 4917711 - DNA, 16 bp, Homo sapiens
agggcactggtggccc

SEQ ID NO: 4917712 - DNA, 13 bp, Homo sapiens
agggcagccccac

SEQ ID NO: 4917713 - DNA, 13 bp, Homo sapiens
agggcagctgcta

SEQ ID NO: 4917714 - DNA, 18 bp, Homo sapiens
agggcaggaaggagagcc

SEQ ID NO: 4917715 - DNA, 21 bp, Homo sapiens
agggcagtgctagtgagctgg

SEQ ID NO: 4917716 - DNA, 13 bp, Homo sapiens
agggcagttttct

SEQ ID NO: 4917717 - DNA, 23 bp, Homo sapiens
agggcatgccccggccacctctg

SEQ ID NO: 4917718 - DNA, 17 bp, Homo sapiens
agggcatggccaggtgg

SEQ ID NO: 4917719 - DNA, 16 bp, Homo sapiens
agggcattcaaatggg

SEQ ID NO: 4917720 - DNA, 19 bp, Homo sapiens
agggcattctttcccagtg

SEQ ID NO: 4917721 - DNA, 16 bp, Homo sapiens
agggccaatccccagc

SEQ ID NO: 4917722 - DNA, 21 bp, Homo sapiens
agggccaggactgagccccgc

SEQ ID NO: 4917723 - DNA, 18 bp, Homo sapiens
agggccagtcctgcctgg

SEQ ID NO: 4917724 - DNA, 21 bp, Homo sapiens
agggccagtcctgcctggcca

SEQ ID NO: 4917725 - DNA, 21 bp, Homo sapiens
agggccagtggggcctgtgga

SEQ ID NO: 4917726 - DNA, 17 bp, Homo sapiens
agggccatgcctgcccc

SEQ ID NO: 4917727 - DNA, 13 bp, Homo sapiens
agggcccagagca

SEQ ID NO: 4917728 - DNA, 14 bp, Homo sapiens
agggcccagagcag

SEQ ID NO: 4917729 - DNA, 15 bp, Homo sapiens
agggcccagaggctg

SEQ ID NO: 4917730 - DNA, 22 bp, Homo sapiens
agggccgaccagaggagccttt

SEQ ID NO: 4917731 - DNA, 15 bp, Homo sapiens
agggcctggggcctg

SEQ ID NO: 4917732 - DNA, 16 bp, Homo sapiens
agggcctggggcctga

SEQ ID NO: 4917733 - DNA, 13 bp, Homo sapiens
agggctcctccca

SEQ ID NO: 4917734 - DNA, 15 bp, Homo sapiens
agggctcctcccagc

SEQ ID NO: 4917735 - DNA, 15 bp, Homo sapiens
agggctctaaaaaaa

SEQ ID NO: 4917736 - DNA, 23 bp, Homo sapiens
agggctctaaaaaaagccccaaa

SEQ ID NO: 4917737 - DNA, 12 bp, Homo sapiens
agggctctgccc

SEQ ID NO: 4917738 - DNA, 15 bp, Homo sapiens
agggctgacctgcct

SEQ ID NO: 4917739 - DNA, 23 bp, Homo sapiens
agggcttacctgtacactgactt

SEQ ID NO: 4917740 - DNA, 15 bp, Homo sapiens
aggggaaaactgtta

SEQ ID NO: 4917741 - DNA, 14 bp, Homo sapiens
aggggaacctgcca

SEQ ID NO: 4917742 - DNA, 13 bp, Homo sapiens
aggggaagctgca

SEQ ID NO: 4917743 - DNA, 20 bp, Homo sapiens
aggggaagctgcagcttggg

SEQ ID NO: 4917744 - DNA, 14 bp, Homo sapiens
aggggaagtccctg

SEQ ID NO: 4917745 - DNA, 14 bp, Homo sapiens
aggggacaggcctc

SEQ ID NO: 4917746 - DNA, 15 bp, Homo sapiens
aggggacaggcctca

SEQ ID NO: 4917747 - DNA, 21 bp, Homo sapiens
aggggacaggcctcacctcta

SEQ ID NO: 4917748 - DNA, 16 bp, Homo sapiens
aggggatagagagaga

SEQ ID NO: 4917749 - DNA, 21 bp, Homo sapiens
aggggatagagagagaccact

SEQ ID NO: 4917750 - DNA, 20 bp, Homo sapiens
aggggcatctgcccctcccc

SEQ ID NO: 4917751 - DNA, 12 bp, Homo sapiens
aggggccgccct

SEQ ID NO: 4917752 - DNA, 14 bp, Homo sapiens
aggggcgcccacct

SEQ ID NO: 4917753 - DNA, 21 bp, Homo sapiens
aggggctctggagagaaacaa

SEQ ID NO: 4917754 - DNA, 21 bp, Homo sapiens
agggggactgctgctgcctgg

SEQ ID NO: 4917755 - DNA, 12 bp, Homo sapiens
agggggagaaaa

SEQ ID NO: 4917756 - DNA, 21 bp, Homo sapiens
agggggagaaaaggaaaagaa

SEQ ID NO: 4917757 - DNA, 13 bp, Homo sapiens
agggggctcctgg

SEQ ID NO: 4917758 - DNA, 15 bp, Homo sapiens
agggggtccgtggaa

SEQ ID NO: 4917759 - DNA, 23 bp, Homo sapiens
agggggtgattagagggaggaga

SEQ ID NO: 4917760 - DNA, 14 bp, Homo sapiens
aggggtcaaagaaa

SEQ ID NO: 4917761 - DNA, 16 bp, Homo sapiens
aggggtgacggccctc

SEQ ID NO: 4917762 - DNA, 21 bp, Homo sapiens
aggggtttgccatttgatacc

SEQ ID NO: 4917763 - DNA, 13 bp, Homo sapiens
agggtactaaatt

SEQ ID NO: 4917764 - DNA, 16 bp, Homo sapiens
agggtatcaggtgctg

SEQ ID NO: 4917765 - DNA, 20 bp, Homo sapiens
agggtcaacatcttttacat

SEQ ID NO: 4917766 - DNA, 20 bp, Homo sapiens
agggtcagaggacctgtatt

SEQ ID NO: 4917767 - DNA, 21 bp, Homo sapiens
agggtcagaggacctgtattt

SEQ ID NO: 4917768 - DNA, 16 bp, Homo sapiens
agggtcatgtttgcag

SEQ ID NO: 4917769 - DNA, 14 bp, Homo sapiens
agggtcctggctcc

SEQ ID NO: 4917770 - DNA, 15 bp, Homo sapiens
agggtcgaaagctct

SEQ ID NO: 4917771 - DNA, 22 bp, Homo sapiens
agggtcggaacccaagcttaga

SEQ ID NO: 4917772 - DNA, 21 bp, Homo sapiens
agggtctcactctgtcgccca

SEQ ID NO: 4917773 - DNA, 13 bp, Homo sapiens
agggtctgtgtga

SEQ ID NO: 4917774 - DNA, 14 bp, Homo sapiens
agggtgcccagaac

SEQ ID NO: 4917775 - DNA, 21 bp, Homo sapiens
agggtgggggccacctgcctg

SEQ ID NO: 4917776 - DNA, 23 bp, Homo sapiens
agggtgggggccacctgcctgcg

SEQ ID NO: 4917777 - DNA, 16 bp, Homo sapiens
agggtgggtgctcaga

SEQ ID NO: 4917778 - DNA, 19 bp, Homo sapiens
agggtggtgacctctgcct

SEQ ID NO: 4917779 - DNA, 21 bp, Homo sapiens
agggtggtgacctctgcctga

SEQ ID NO: 4917780 - DNA, 14 bp, Homo sapiens
agggttgtgatttt

SEQ ID NO: 4917781 - DNA, 19 bp, Homo sapiens
agggttgtgattttgtctg

SEQ ID NO: 4917782 - DNA, 22 bp, Homo sapiens
agggttgtgattttgtctgctt

SEQ ID NO: 4917783 - DNA, 23 bp, Homo sapiens
agggtttgaattgttttctttaa

SEQ ID NO: 4917784 - DNA, 13 bp, Homo sapiens
agggtttttacct

SEQ ID NO: 4917785 - DNA, 15 bp, Homo sapiens
aggtaaaatgtattt

SEQ ID NO: 4917786 - DNA, 16 bp, Homo sapiens
aggtaaaatgtatttt

SEQ ID NO: 4917787 - DNA, 14 bp, Homo sapiens
aggtaacagaacag

SEQ ID NO: 4917788 - DNA, 17 bp, Homo sapiens
aggtaacagaacagctt

SEQ ID NO: 4917789 - DNA, 23 bp, Homo sapiens
aggtaacagaacagcttcaggtt

SEQ ID NO: 4917790 - DNA, 13 bp, Homo sapiens
aggtaagtttttt

SEQ ID NO: 4917791 - DNA, 17 bp, Homo sapiens
aggtaatttttttcacc

SEQ ID NO: 4917792 - DNA, 21 bp, Homo sapiens
aggtacccctttctggctctc

SEQ ID NO: 4917793 - DNA, 14 bp, Homo sapiens
aggtactagaatgc

SEQ ID NO: 4917794 - DNA, 14 bp, Homo sapiens
aggtactattctga

SEQ ID NO: 4917795 - DNA, 18 bp, Homo sapiens
aggtagaaaaagggtcaa

SEQ ID NO: 4917796 - DNA, 15 bp, Homo sapiens
aggtagaacctcacc

SEQ ID NO: 4917797 - DNA, 13 bp, Homo sapiens
aggtagcttcagc

SEQ ID NO: 4917798 - DNA, 20 bp, Homo sapiens
aggtatggaagggtttgtgg

SEQ ID NO: 4917799 - DNA, 13 bp, Homo sapiens
aggtatggctctg

SEQ ID NO: 4917800 - DNA, 14 bp, Homo sapiens
aggtatttcaaaac

SEQ ID NO: 4917801 - DNA, 17 bp, Homo sapiens
aggtattttgaatacca

SEQ ID NO: 4917802 - DNA, 15 bp, Homo sapiens
aggtcagagcctgca

SEQ ID NO: 4917803 - DNA, 17 bp, Homo sapiens
aggtcagagcctgcagt

SEQ ID NO: 4917804 - DNA, 18 bp, Homo sapiens
aggtcagagcctgcagtt

SEQ ID NO: 4917805 - DNA, 12 bp, Homo sapiens
aggtcaggaaac

SEQ ID NO: 4917806 - DNA, 13 bp, Homo sapiens
aggtcaggccctg

SEQ ID NO: 4917807 - DNA, 14 bp, Homo sapiens
aggtcaggccctgg

SEQ ID NO: 4917808 - DNA, 15 bp, Homo sapiens
aggtcaggccctgga

SEQ ID NO: 4917809 - DNA, 14 bp, Homo sapiens
aggtcatttcttca

SEQ ID NO: 4917810 - DNA, 14 bp, Homo sapiens
aggtccacaggtct

SEQ ID NO: 4917811 - DNA, 18 bp, Homo sapiens
aggtccacaggtctagac

SEQ ID NO: 4917812 - DNA, 20 bp, Homo sapiens
aggtccacaggtctagacta

SEQ ID NO: 4917813 - DNA, 14 bp, Homo sapiens
aggtccagcccatc

SEQ ID NO: 4917814 - DNA, 23 bp, Homo sapiens
aggtccagcccatctcggagcat

SEQ ID NO: 4917815 - DNA, 18 bp, Homo sapiens
aggtccggtgttctaaga

SEQ ID NO: 4917816 - DNA, 21 bp, Homo sapiens
aggtctcggactaagcctacc

SEQ ID NO: 4917817 - DNA, 21 bp, Homo sapiens
aggtcttcatcgaatctacta

SEQ ID NO: 4917818 - DNA, 17 bp, Homo sapiens
aggtcttgaactcctgg

SEQ ID NO: 4917819 - DNA, 20 bp, Homo sapiens
aggtcttgaactcctggcct

SEQ ID NO: 4917820 - DNA, 11 bp, Homo sapiens
aggtcttgcta

SEQ ID NO: 4917821 - DNA, 13 bp, Homo sapiens
aggtgaaaatgtt

SEQ ID NO: 4917822 - DNA, 23 bp, Homo sapiens
aggtgaattaattaaacattgtg

SEQ ID NO: 4917823 - DNA, 19 bp, Homo sapiens
aggtgacactatagtttaa

SEQ ID NO: 4917824 - DNA, 13 bp, Homo sapiens
aggtgacagagtg

SEQ ID NO: 4917825 - DNA, 14 bp, Homo sapiens
aggtgacatgtgaa

SEQ ID NO: 4917826 - DNA, 15 bp, Homo sapiens
aggtgacatgtgaaa

SEQ ID NO: 4917827 - DNA, 15 bp, Homo sapiens
aggtgagaaaaaaac

SEQ ID NO: 4917828 - DNA, 15 bp, Homo sapiens
aggtgcaatttcaag

SEQ ID NO: 4917829 - DNA, 19 bp, Homo sapiens
aggtgcaatttcaaggttc

SEQ ID NO: 4917830 - DNA, 21 bp, Homo sapiens
aggtgcaatttcaaggttcta

SEQ ID NO: 4917831 - DNA, 18 bp, Homo sapiens
aggtgcctgtcccacccc

SEQ ID NO: 4917832 - DNA, 17 bp, Homo sapiens
aggtgctcccctgacag

SEQ ID NO: 4917833 - DNA, 17 bp, Homo sapiens
aggtggaaggcagacag

SEQ ID NO: 4917834 - DNA, 23 bp, Homo sapiens
aggtggaccttttaaagtgtttc

SEQ ID NO: 4917835 - DNA, 21 bp, Homo sapiens
aggtggccactttaagagaga

SEQ ID NO: 4917836 - DNA, 13 bp, Homo sapiens
aggtgggagcagg

SEQ ID NO: 4917837 - DNA, 15 bp, Homo sapiens
aggtgggagcaggag

SEQ ID NO: 4917838 - DNA, 21 bp, Homo sapiens
aggtggtgagaaatttctgtg

SEQ ID NO: 4917839 - DNA, 17 bp, Homo sapiens
aggtgtgaggaggaggc

SEQ ID NO: 4917840 - DNA, 20 bp, Homo sapiens
aggtgtgagtcaccaagccc

SEQ ID NO: 4917841 - DNA, 12 bp, Homo sapiens
aggtgtgctctg

SEQ ID NO: 4917842 - DNA, 15 bp, Homo sapiens
aggtgtgctctgatc

SEQ ID NO: 4917843 - DNA, 23 bp, Homo sapiens
aggtgttaacattccaagactct

SEQ ID NO: 4917844 - DNA, 14 bp, Homo sapiens
aggtgttagagagg

SEQ ID NO: 4917845 - DNA, 18 bp, Homo sapiens
aggtgttggttttggggg

SEQ ID NO: 4917846 - DNA, 22 bp, Homo sapiens
aggtgttttttatgaagtgcgt

SEQ ID NO: 4917847 - DNA, 15 bp, Homo sapiens
aggttaattccaatt

SEQ ID NO: 4917848 - DNA, 22 bp, Homo sapiens
aggttaattccaattatatgag

SEQ ID NO: 4917849 - DNA, 16 bp, Homo sapiens
aggttcactaaagcag

SEQ ID NO: 4917850 - DNA, 18 bp, Homo sapiens
aggttccaactgtatata

SEQ ID NO: 4917851 - DNA, 19 bp, Homo sapiens
aggttccctgttcttcctc

SEQ ID NO: 4917852 - DNA, 13 bp, Homo sapiens
aggttctaaagtt

SEQ ID NO: 4917853 - DNA, 20 bp, Homo sapiens
aggttctaaagttctaagat

SEQ ID NO: 4917854 - DNA, 15 bp, Homo sapiens
aggttctaaggccta

SEQ ID NO: 4917855 - DNA, 19 bp, Homo sapiens
aggttctaaggcctaggat

SEQ ID NO: 4917856 - DNA, 17 bp, Homo sapiens
aggttctgcctgctttg

SEQ ID NO: 4917857 - DNA, 16 bp, Homo sapiens
aggttgctgtttcaca

SEQ ID NO: 4917858 - DNA, 18 bp, Homo sapiens
aggttggaagagaatcac

SEQ ID NO: 4917859 - DNA, 13 bp, Homo sapiens
aggtttcaaagat

SEQ ID NO: 4917860 - DNA, 17 bp, Homo sapiens
aggtttgtcatcagatg

SEQ ID NO: 4917861 - DNA, 16 bp, Homo sapiens
aggttttaggttctaa

SEQ ID NO: 4917862 - DNA, 22 bp, Homo sapiens
aggttttcccctcttttgttaa

SEQ ID NO: 4917863 - DNA, 22 bp, Homo sapiens
aggttttcctcttctattttgt

SEQ ID NO: 4917864 - DNA, 24 bp, Homo sapiens
agtaaactcccctttccctcgcta

SEQ ID NO: 4917865 - DNA, 13 bp, Homo sapiens
agtaaagccatta

SEQ ID NO: 4917866 - DNA, 11 bp, Homo sapiens
agtaaatgcta

SEQ ID NO: 4917867 - DNA, 22 bp, Homo sapiens
agtaaatgctaggttaattcca

SEQ ID NO: 4917868 - DNA, 11 bp, Homo sapiens
agtaaatgtct

SEQ ID NO: 4917869 - DNA, 18 bp, Homo sapiens
agtaaatgtctttgtaag

SEQ ID NO: 4917870 - DNA, 19 bp, Homo sapiens
agtaaatgtctttgtaagt

SEQ ID NO: 4917871 - DNA, 23 bp, Homo sapiens
agtaacaggaaaccacttatcac

SEQ ID NO: 4917872 - DNA, 17 bp, Homo sapiens
agtaacttcttatggaa

SEQ ID NO: 4917873 - DNA, 19 bp, Homo sapiens
agtaacttcttatggaatt

SEQ ID NO: 4917874 - DNA, 14 bp, Homo sapiens
agtaactttatgtg

SEQ ID NO: 4917875 - DNA, 17 bp, Homo sapiens
agtaactttatgtgtaa

SEQ ID NO: 4917876 - DNA, 19 bp, Homo sapiens
agtaactttatgtgtaaat

SEQ ID NO: 4917877 - DNA, 20 bp, Homo sapiens
agtaagtaattatgcactaa

SEQ ID NO: 4917878 - DNA, 22 bp, Homo sapiens
agtaatatattctgaagcaaca

SEQ ID NO: 4917879 - DNA, 18 bp, Homo sapiens
agtaatctgtacattttg

SEQ ID NO: 4917880 - DNA, 19 bp, Homo sapiens
agtaatctgtacattttgt

SEQ ID NO: 4917881 - DNA, 21 bp, Homo sapiens
agtaatctgtacattttgttg

SEQ ID NO: 4917882 - DNA, 19 bp, Homo sapiens
agtaattcaagaaaacaac

SEQ ID NO: 4917883 - DNA, 23 bp, Homo sapiens
agtacaaatgccttaaaatggaa

SEQ ID NO: 4917884 - DNA, 17 bp, Homo sapiens
agtacaaattataaaaa

SEQ ID NO: 4917885 - DNA, 17 bp, Homo sapiens
agtacatatttattttc

SEQ ID NO: 4917886 - DNA, 15 bp, Homo sapiens
agtaccaaagtttta

SEQ ID NO: 4917887 - DNA, 19 bp, Homo sapiens
agtaccaaagttttatcaa

SEQ ID NO: 4917888 - DNA, 14 bp, Homo sapiens
agtaccagcgctct

SEQ ID NO: 4917889 - DNA, 18 bp, Homo sapiens
agtaccctctcagctcca

SEQ ID NO: 4917890 - DNA, 19 bp, Homo sapiens
agtaccctctcagctccag

SEQ ID NO: 4917891 - DNA, 16 bp, Homo sapiens
agtactacacattttt

SEQ ID NO: 4917892 - DNA, 23 bp, Homo sapiens
agtactacacatttttaaattgt

SEQ ID NO: 4917893 - DNA, 21 bp, Homo sapiens
agtactgtaataatacctcaa

SEQ ID NO: 4917894 - DNA, 17 bp, Homo sapiens
agtactgtttaccattt

SEQ ID NO: 4917895 - DNA, 17 bp, Homo sapiens
agtacttctccaccctg

SEQ ID NO: 4917896 - DNA, 21 bp, Homo sapiens
agtacttctccaccctgctct

SEQ ID NO: 4917897 - DNA, 22 bp, Homo sapiens
agtacttctccaccctgctctc

SEQ ID NO: 4917898 - DNA, 18 bp, Homo sapiens
agtacttgagtgtaatgt

SEQ ID NO: 4917899 - DNA, 19 bp, Homo sapiens
agtagaacagataatcagt

SEQ ID NO: 4917900 - DNA, 12 bp, Homo sapiens
agtagagccagc

SEQ ID NO: 4917901 - DNA, 17 bp, Homo sapiens
agctgatgttggaagag

SEQ ID NO: 4917902 - DNA, 14 bp, Homo sapiens
agctgcaccagagc

SEQ ID NO: 4917903 - DNA, 23 bp, Homo sapiens
agctgcaccagagcaacctctca

SEQ ID NO: 4917904 - DNA, 17 bp, Homo sapiens
agctgcagcttcctgtc

SEQ ID NO: 4917905 - DNA, 13 bp, Homo sapiens
agctgcagcttgg

SEQ ID NO: 4917906 - DNA, 15 bp, Homo sapiens
agctgcctagcaagc

SEQ ID NO: 4917907 - DNA, 23 bp, Homo sapiens
agctgcctgtagttaggaaataa

SEQ ID NO: 4917908 - DNA, 13 bp, Homo sapiens
agctgcctgttca

SEQ ID NO: 4917909 - DNA, 14 bp, Homo sapiens
agctgcctgttcag

SEQ ID NO: 4917910 - DNA, 18 bp, Homo sapiens
agctgcggtccacccagg

SEQ ID NO: 4917911 - DNA, 23 bp, Homo sapiens
agctgcggtccacccaggagccc

SEQ ID NO: 4917912 - DNA, 21 bp, Homo sapiens
agctgctatttattttcctaa

SEQ ID NO: 4917913 - DNA, 17 bp, Homo sapiens
agctgctggcttgcagt

SEQ ID NO: 4917914 - DNA, 12 bp, Homo sapiens
agctgctgtctt

SEQ ID NO: 4917915 - DNA, 24 bp, Homo sapiens
agctgcttttgtctatgggactca

SEQ ID NO: 4917916 - DNA, 17 bp, Homo sapiens
agctggacagaggggac

SEQ ID NO: 4917917 - DNA, 18 bp, Homo sapiens
agctggacagaggggact

SEQ ID NO: 4917918 - DNA, 22 bp, Homo sapiens
agctggacagaggggactctgg

SEQ ID NO: 4917919 - DNA, 15 bp, Homo sapiens
agctggagaagaccc

SEQ ID NO: 4917920 - DNA, 21 bp, Homo sapiens
agctggcattacagctggaga

SEQ ID NO: 4917921 - DNA, 16 bp, Homo sapiens
agctgggactacaggt

SEQ ID NO: 4917922 - DNA, 19 bp, Homo sapiens
agctgggaggcatggccct

SEQ ID NO: 4917923 - DNA, 20 bp, Homo sapiens
agctgggaggcatggccctg

SEQ ID NO: 4917924 - DNA, 22 bp, Homo sapiens
agctgggaggcatggccctggg

SEQ ID NO: 4917925 - DNA, 17 bp, Homo sapiens
agctgggtgtcaagagg

SEQ ID NO: 4917926 - DNA, 16 bp, Homo sapiens
agctggtcccactcag

SEQ ID NO: 4917927 - DNA, 18 bp, Homo sapiens
agctggtcccactcagtc

SEQ ID NO: 4917928 - DNA, 19 bp, Homo sapiens
agctggtcccactcagtcc

SEQ ID NO: 4917929 - DNA, 20 bp, Homo sapiens
agctgtcacttttgctccga

SEQ ID NO: 4917930 - DNA, 14 bp, Homo sapiens
agctgtccagagaa

SEQ ID NO: 4917931 - DNA, 15 bp, Homo sapiens
agctgtctctaactt

SEQ ID NO: 4917932 - DNA, 16 bp, Homo sapiens
agctgtctgtggcttc

SEQ ID NO: 4917933 - DNA, 15 bp, Homo sapiens
agctgtgagccttgg

SEQ ID NO: 4917934 - DNA, 17 bp, Homo sapiens
agctgtgctctggacag

SEQ ID NO: 4917935 - DNA, 18 bp, Homo sapiens
agctgtgctctggacagg

SEQ ID NO: 4917936 - DNA, 19 bp, Homo sapiens
agctgtgctctggacaggc

SEQ ID NO: 4917937 - DNA, 15 bp, Homo sapiens
agctgttaccattca

SEQ ID NO: 4917938 - DNA, 17 bp, Homo sapiens
agctgttaccattcaca

SEQ ID NO: 4917939 - DNA, 16 bp, Homo sapiens
agctgtttaagatggg

SEQ ID NO: 4917940 - DNA, 13 bp, Homo sapiens
agctgtttatgtt

SEQ ID NO: 4917941 - DNA, 22 bp, Homo sapiens
agcttaccagaagcttccatag

SEQ ID NO: 4917942 - DNA, 15 bp, Homo sapiens
agcttacctgacaca

SEQ ID NO: 4917943 - DNA, 15 bp, Homo sapiens
agcttcaccagagca

SEQ ID NO: 4917944 - DNA, 21 bp, Homo sapiens
agcttcagatggtgaagcatt

SEQ ID NO: 4917945 - DNA, 13 bp, Homo sapiens
agcttcaggttat

SEQ ID NO: 4917946 - DNA, 19 bp, Homo sapiens
agcttcatttgtgtcaatg

SEQ ID NO: 4917947 - DNA, 22 bp, Homo sapiens
agcttccatgattctatttata

SEQ ID NO: 4917948 - DNA, 16 bp, Homo sapiens
agcttccgagaatagc

SEQ ID NO: 4917949 - DNA, 22 bp, Homo sapiens
agcttccttaagtatatcatgt

SEQ ID NO: 4917950 - DNA, 19 bp, Homo sapiens
agcttccttctgtgaaagt

SEQ ID NO: 4917951 - DNA, 18 bp, Homo sapiens
agcttctaccatgaacag

SEQ ID NO: 4917952 - DNA, 18 bp, Homo sapiens
agcttcttaattaatttg

SEQ ID NO: 4917953 - DNA, 19 bp, Homo sapiens
agcttcttaattaatttga

SEQ ID NO: 4917954 - DNA, 21 bp, Homo sapiens
agcttcttaattaatttgatt

SEQ ID NO: 4917955 - DNA, 16 bp, Homo sapiens
agcttgaaagttttca

SEQ ID NO: 4917956 - DNA, 15 bp, Homo sapiens
agcttgggagagccc

SEQ ID NO: 4917957 - DNA, 20 bp, Homo sapiens
agcttggggccaccaaagct

SEQ ID NO: 4917958 - DNA, 22 bp, Homo sapiens
agcttggggccaccaaagctgc

SEQ ID NO: 4917959 - DNA, 18 bp, Homo sapiens
agcttgtaaatagctcag

SEQ ID NO: 4917960 - DNA, 17 bp, Homo sapiens
agcttgtatgcaatgga

SEQ ID NO: 4917961 - DNA, 15 bp, Homo sapiens
agctttaaacaaatt

SEQ ID NO: 4917962 - DNA, 19 bp, Homo sapiens
agctttaaactcagggaca

SEQ ID NO: 4917963 - DNA, 20 bp, Homo sapiens
agctttacacacacagatgt

SEQ ID NO: 4917964 - DNA, 21 bp, Homo sapiens
agctttacatgcaatttatta

SEQ ID NO: 4917965 - DNA, 17 bp, Homo sapiens
agctttatatatggaca

SEQ ID NO: 4917966 - DNA, 12 bp, Homo sapiens
agctttatgatt

SEQ ID NO: 4917967 - DNA, 14 bp, Homo sapiens
agctttatgatttt

SEQ ID NO: 4917968 - DNA, 15 bp, Homo sapiens
agctttatgattttc

SEQ ID NO: 4917969 - DNA, 21 bp, Homo sapiens
agctttatggtcctaaaagca

SEQ ID NO: 4917970 - DNA, 18 bp, Homo sapiens
agctttatgttcatttgt

SEQ ID NO: 4917971 - DNA, 14 bp, Homo sapiens
agctttattcttca

SEQ ID NO: 4917972 - DNA, 16 bp, Homo sapiens
agctttcaagtgcctt

SEQ ID NO: 4917973 - DNA, 22 bp, Homo sapiens
agctttctagaagtttcccttc

SEQ ID NO: 4917974 - DNA, 23 bp, Homo sapiens
agctttctagaagtttcccttcc

SEQ ID NO: 4917975 - DNA, 13 bp, Homo sapiens
agctttctccccg

SEQ ID NO: 4917976 - DNA, 17 bp, Homo sapiens
agctttcttgctccctt

SEQ ID NO: 4917977 - DNA, 21 bp, Homo sapiens
agctttgctaccaaagcacct

SEQ ID NO: 4917978 - DNA, 18 bp, Homo sapiens
agctttgctctttggtag

SEQ ID NO: 4917979 - DNA, 17 bp, Homo sapiens
agctttgtgtttggttt

SEQ ID NO: 4917980 - DNA, 15 bp, Homo sapiens
agcttttattgtata

SEQ ID NO: 4917981 - DNA, 16 bp, Homo sapiens
agcttttcaaacaaga

SEQ ID NO: 4917982 - DNA, 17 bp, Homo sapiens
agctttttaaaacatta

SEQ ID NO: 4917983 - DNA, 21 bp, Homo sapiens
agctttttaattgttgtttct

SEQ ID NO: 4917984 - DNA, 12 bp, Homo sapiens
aggaaaaagctc

SEQ ID NO: 4917985 - DNA, 16 bp, Homo sapiens
aggaaaagctgctgac

SEQ ID NO: 4917986 - DNA, 13 bp, Homo sapiens
aggaaacaagtga

SEQ ID NO: 4917987 - DNA, 21 bp, Homo sapiens
aggaaaccgcctagtttactg

SEQ ID NO: 4917988 - DNA, 17 bp, Homo sapiens
aggaaagagtcttcaac

SEQ ID NO: 4917989 - DNA, 16 bp, Homo sapiens
aggaaagcctcactga

SEQ ID NO: 4917990 - DNA, 22 bp, Homo sapiens
aggaaataaaacctttcaaatt

SEQ ID NO: 4917991 - DNA, 16 bp, Homo sapiens
aggaaatctcacccca

SEQ ID NO: 4917992 - DNA, 15 bp, Homo sapiens
aggaacaaaaaaacc

SEQ ID NO: 4917993 - DNA, 13 bp, Homo sapiens
aggaacctgtcct

SEQ ID NO: 4917994 - DNA, 14 bp, Homo sapiens
aggaaccttccttc

SEQ ID NO: 4917995 - DNA, 19 bp, Homo sapiens
aggaaccttccttcctgct

SEQ ID NO: 4917996 - DNA, 15 bp, Homo sapiens
aggaactgtccagag

SEQ ID NO: 4917997 - DNA, 15 bp, Homo sapiens
aggaagagtcttggt

SEQ ID NO: 4917998 - DNA, 16 bp, Homo sapiens
aggaagcatgagtgct

SEQ ID NO: 4917999 - DNA, 12 bp, Homo sapiens
aggaaggaaaga

SEQ ID NO: 4918000 - DNA, 18 bp, Homo sapiens
aggaaggagagcctgctg

SEQ ID NO: 4918001 - DNA, 21 bp, Homo sapiens
aggaaggaggggaagctgcag

SEQ ID NO: 4918002 - DNA, 18 bp, Homo sapiens
aggaaggattgtaaaaaa

SEQ ID NO: 4918003 - DNA, 16 bp, Homo sapiens
aggaaggtctcattct

SEQ ID NO: 4918004 - DNA, 21 bp, Homo sapiens
aggaagtgttgaagggaggtg

SEQ ID NO: 4918005 - DNA, 22 bp, Homo sapiens
aggaagttgacttatagtacat

SEQ ID NO: 4918006 - DNA, 16 bp, Homo sapiens
aggaagttttctgtag

SEQ ID NO: 4918007 - DNA, 19 bp, Homo sapiens
aggaataaattgctccttg

SEQ ID NO: 4918008 - DNA, 20 bp, Homo sapiens
aggaataaattgctccttga

SEQ ID NO: 4918009 - DNA, 12 bp, Homo sapiens
aggaataagaat

SEQ ID NO: 4918010 - DNA, 17 bp, Homo sapiens
aggaatcaaaaattgaa

SEQ ID NO: 4918011 - DNA, 19 bp, Homo sapiens
aggaatcaagagctgccct

SEQ ID NO: 4918012 - DNA, 21 bp, Homo sapiens
aggaatcatgtcaggcctgtg

SEQ ID NO: 4918013 - DNA, 22 bp, Homo sapiens
aggaatcatgtcaggcctgtgt

SEQ ID NO: 4918014 - DNA, 20 bp, Homo sapiens
aggaatccagacccggctgc

SEQ ID NO: 4918015 - DNA, 15 bp, Homo sapiens
aggaatccatgaaga

SEQ ID NO: 4918016 - DNA, 15 bp, Homo sapiens
aggaatcctggcagc

SEQ ID NO: 4918017 - DNA, 16 bp, Homo sapiens
aggaatctttaagcag

SEQ ID NO: 4918018 - DNA, 15 bp, Homo sapiens
aggaatttatacctc

SEQ ID NO: 4918019 - DNA, 14 bp, Homo sapiens
aggaattttctttg

SEQ ID NO: 4918020 - DNA, 16 bp, Homo sapiens
aggacaaaacttcttg

SEQ ID NO: 4918021 - DNA, 20 bp, Homo sapiens
aggacaaaacttcttgtcag

SEQ ID NO: 4918022 - DNA, 22 bp, Homo sapiens
aggacaaaacttcttgtcagac

SEQ ID NO: 4918023 - DNA, 14 bp, Homo sapiens
aggacaaccattcc

SEQ ID NO: 4918024 - DNA, 23 bp, Homo sapiens
aggacactaaccacgctggacct

SEQ ID NO: 4918025 - DNA, 14 bp, Homo sapiens
aggacatcagcaaa

SEQ ID NO: 4918026 - DNA, 16 bp, Homo sapiens
aggacattatgtgtgc

SEQ ID NO: 4918027 - DNA, 17 bp, Homo sapiens
aggacattatgtgtgca

SEQ ID NO: 4918028 - DNA, 15 bp, Homo sapiens
aggacattgcggaca

SEQ ID NO: 4918029 - DNA, 23 bp, Homo sapiens
aggaccaataaaatttctaagag

SEQ ID NO: 4918030 - DNA, 19 bp, Homo sapiens
aggaccaggactccctcct

SEQ ID NO: 4918031 - DNA, 21 bp, Homo sapiens
aggaccaggactccctcctca

SEQ ID NO: 4918032 - DNA, 18 bp, Homo sapiens
aggacccggaggggcctg

SEQ ID NO: 4918033 - DNA, 21 bp, Homo sapiens
aggacccggaggggcctggca

SEQ ID NO: 4918034 - DNA, 22 bp, Homo sapiens
aggacccggaggggcctggcag

SEQ ID NO: 4918035 - DNA, 19 bp, Homo sapiens
aggaccgtggccctgccct

SEQ ID NO: 4918036 - DNA, 15 bp, Homo sapiens
aggacctcccttccg

SEQ ID NO: 4918037 - DNA, 22 bp, Homo sapiens
aggacctcctcttcccccttcc

SEQ ID NO: 4918038 - DNA, 17 bp, Homo sapiens
aggacctgaaattccaa

SEQ ID NO: 4918039 - DNA, 12 bp, Homo sapiens
aggacctgcccc

SEQ ID NO: 4918040 - DNA, 17 bp, Homo sapiens
aggacctgtatttaagc

SEQ ID NO: 4918041 - DNA, 18 bp, Homo sapiens
aggacctgtatttaagca

SEQ ID NO: 4918042 - DNA, 15 bp, Homo sapiens
aggaccttgggccaa

SEQ ID NO: 4918043 - DNA, 20 bp, Homo sapiens
aggacgaacatccaaccttc

SEQ ID NO: 4918044 - DNA, 16 bp, Homo sapiens
aggacggtgcaaccca

SEQ ID NO: 4918045 - DNA, 14 bp, Homo sapiens
aggactccctcctc

SEQ ID NO: 4918046 - DNA, 16 bp, Homo sapiens
aggactccctcctcac

SEQ ID NO: 4918047 - DNA, 17 bp, Homo sapiens
aggactccctcctcacc

SEQ ID NO: 4918048 - DNA, 19 bp, Homo sapiens
aggactccctcctcacctc

SEQ ID NO: 4918049 - DNA, 14 bp, Homo sapiens
aggactcgcttgta

SEQ ID NO: 4918050 - DNA, 16 bp, Homo sapiens
aggactcgcttgtaaa

SEQ ID NO: 4918051 - DNA, 16 bp, Homo sapiens
aggactctgcctcctc

SEQ ID NO: 4918052 - DNA, 19 bp, Homo sapiens
aggactctgcctcctcttc

SEQ ID NO: 4918053 - DNA, 18 bp, Homo sapiens
aggactgagggactctga

SEQ ID NO: 4918054 - DNA, 22 bp, Homo sapiens
aggacttttctttgtggcttcc

SEQ ID NO: 4918055 - DNA, 14 bp, Homo sapiens
aggagaaccactac

SEQ ID NO: 4918056 - DNA, 15 bp, Homo sapiens
aggagaagagttgag

SEQ ID NO: 4918057 - DNA, 14 bp, Homo sapiens
aggagaagctgcat

SEQ ID NO: 4918058 - DNA, 20 bp, Homo sapiens
aggagacacgtgtggcgggc

SEQ ID NO: 4918059 - DNA, 22 bp, Homo sapiens
aggagagactcccatgaagcct

SEQ ID NO: 4918060 - DNA, 13 bp, Homo sapiens
aggagagaggcag

SEQ ID NO: 4918061 - DNA, 13 bp, Homo sapiens
aggagagcctgct

SEQ ID NO: 4918062 - DNA, 18 bp, Homo sapiens
aggagaggagagaggcag

SEQ ID NO: 4918063 - DNA, 18 bp, Homo sapiens
aggagaggatgagagccc

SEQ ID NO: 4918064 - DNA, 21 bp, Homo sapiens
aggagaggcaacatccaaaat

SEQ ID NO: 4918065 - DNA, 13 bp, Homo sapiens
aggagattgagaa

SEQ ID NO: 4918066 - DNA, 17 bp, Homo sapiens
aggagcacaggtcccac

SEQ ID NO: 4918067 - DNA, 16 bp, Homo sapiens
aggagccagacagacc

SEQ ID NO: 4918068 - DNA, 12 bp, Homo sapiens
aggagccaggca

SEQ ID NO: 4918069 - DNA, 20 bp, Homo sapiens
aggagcccatactcagcctg

SEQ ID NO: 4918070 - DNA, 11 bp, Homo sapiens
aggagcctggc

SEQ ID NO: 4918071 - DNA, 13 bp, Homo sapiens
aggagcgcaagat

SEQ ID NO: 4918072 - DNA, 17 bp, Homo sapiens
aggagcgcaagatagat

SEQ ID NO: 4918073 - DNA, 14 bp, Homo sapiens
aggagctaaggctc

SEQ ID NO: 4918074 - DNA, 16 bp, Homo sapiens
aggagctaaggctcta

SEQ ID NO: 4918075 - DNA, 21 bp, Homo sapiens
aggagctaaggctctatgagt

SEQ ID NO: 4918076 - DNA, 17 bp, Homo sapiens
aggagctcttcaggcct

SEQ ID NO: 4918077 - DNA, 23 bp, Homo sapiens
aggagctgccttggctcagacat

SEQ ID NO: 4918078 - DNA, 16 bp, Homo sapiens
aggagctgctggcttg

SEQ ID NO: 4918079 - DNA, 21 bp, Homo sapiens
aggagctgctggcttgcagtg

SEQ ID NO: 4918080 - DNA, 22 bp, Homo sapiens
aggaggaatcatgtcaggcctg

SEQ ID NO: 4918081 - DNA, 20 bp, Homo sapiens
aggaggatgtccctgggcca

SEQ ID NO: 4918082 - DNA, 23 bp, Homo sapiens
aggaggattgcttgagcccagga

SEQ ID NO: 4918083 - DNA, 12 bp, Homo sapiens
aggaggcctcca

SEQ ID NO: 4918084 - DNA, 17 bp, Homo sapiens
aggaggcctccatctca

SEQ ID NO: 4918085 - DNA, 21 bp, Homo sapiens
aggaggcgtctcgggagagga

SEQ ID NO: 4918086 - DNA, 13 bp, Homo sapiens
aggaggctggcag

SEQ ID NO: 4918087 - DNA, 15 bp, Homo sapiens
aggagggagggggct

SEQ ID NO: 4918088 - DNA, 13 bp, Homo sapiens
aggaggtgtgagg

SEQ ID NO: 4918089 - DNA, 16 bp, Homo sapiens
aggagtcccaaggaaa

SEQ ID NO: 4918090 - DNA, 17 bp, Homo sapiens
aggagtcccaaggaaag

SEQ ID NO: 4918091 - DNA, 12 bp, Homo sapiens
aggagtgagcac

SEQ ID NO: 4918092 - DNA, 20 bp, Homo sapiens
aggagtgggtgacaagagcc

SEQ ID NO: 4918093 - DNA, 14 bp, Homo sapiens
aggatagcattttt

SEQ ID NO: 4918094 - DNA, 17 bp, Homo sapiens
aggatatccttatcaga

SEQ ID NO: 4918095 - DNA, 21 bp, Homo sapiens
aggatatccttatcagagcta

SEQ ID NO: 4918096 - DNA, 22 bp, Homo sapiens
aggatatccttatcagagctaa

SEQ ID NO: 4918097 - DNA, 12 bp, Homo sapiens
aggatcagtctg

SEQ ID NO: 4918098 - DNA, 13 bp, Homo sapiens
aggatcagtctga

SEQ ID NO: 4918099 - DNA, 13 bp, Homo sapiens
aggatcagttttt

SEQ ID NO: 4918100 - DNA, 15 bp, Homo sapiens
aggatcatggtgtaa

SEQ ID NO: 4918101 - DNA, 12 bp, Homo sapiens
aggatgctggcc

SEQ ID NO: 4918102 - DNA, 21 bp, Homo sapiens
aggatgcttgattccagtggt

SEQ ID NO: 4918103 - DNA, 17 bp, Homo sapiens
aggatgtcacagggcca

SEQ ID NO: 4918104 - DNA, 18 bp, Homo sapiens
aggatgtcacagggccaa

SEQ ID NO: 4918105 - DNA, 17 bp, Homo sapiens
aggatgtctcaaacttc

SEQ ID NO: 4918106 - DNA, 16 bp, Homo sapiens
aggattacatgcatgt

SEQ ID NO: 4918107 - DNA, 18 bp, Homo sapiens
aggattattgatagtact

SEQ ID NO: 4918108 - DNA, 19 bp, Homo sapiens
aggattgaacttctttgaa

SEQ ID NO: 4918109 - DNA, 15 bp, Homo sapiens
aggattgctactgtc

SEQ ID NO: 4918110 - DNA, 18 bp, Homo sapiens
aggattgctactgtccta

SEQ ID NO: 4918111 - DNA, 21 bp, Homo sapiens
aggattgcttgagcccaggag

SEQ ID NO: 4918112 - DNA, 22 bp, Homo sapiens
aggattgcttgagcccaggagt

SEQ ID NO: 4918113 - DNA, 23 bp, Homo sapiens
aggattgtaaaaaaaaatgcctt

SEQ ID NO: 4918114 - DNA, 17 bp, Homo sapiens
aggcaaaatccttgctt

SEQ ID NO: 4918115 - DNA, 14 bp, Homo sapiens
aggcaaagctggct

SEQ ID NO: 4918116 - DNA, 13 bp, Homo sapiens
aggcaaatgtgta

SEQ ID NO: 4918117 - DNA, 18 bp, Homo sapiens
aggcaagcacctcctgcc

SEQ ID NO: 4918118 - DNA, 22 bp, Homo sapiens
aggcaatgtcaggaacagaagg

SEQ ID NO: 4918119 - DNA, 13 bp, Homo sapiens
aggcaccagaaga

SEQ ID NO: 4918120 - DNA, 20 bp, Homo sapiens
aggcacccaccatcatgtct

SEQ ID NO: 4918121 - DNA, 15 bp, Homo sapiens
aggcactagcctttg

SEQ ID NO: 4918122 - DNA, 19 bp, Homo sapiens
aggcactctgttatttaga

SEQ ID NO: 4918123 - DNA, 13 bp, Homo sapiens
agcgagccctggt

SEQ ID NO: 4918124 - DNA, 14 bp, Homo sapiens
agcgagggcagctg

SEQ ID NO: 4918125 - DNA, 15 bp, Homo sapiens
agcgagggcagctgc

SEQ ID NO: 4918126 - DNA, 15 bp, Homo sapiens
agcgatatacagatg

SEQ ID NO: 4918127 - DNA, 18 bp, Homo sapiens
agcgatggtctcagaaac

SEQ ID NO: 4918128 - DNA, 17 bp, Homo sapiens
agcgattcttctgcttc

SEQ ID NO: 4918129 - DNA, 22 bp, Homo sapiens
agcgattcttctgcttcagcct

SEQ ID NO: 4918130 - DNA, 14 bp, Homo sapiens
agcgcccagttggg

SEQ ID NO: 4918131 - DNA, 16 bp, Homo sapiens
agcgcctgtgcacaca

SEQ ID NO: 4918132 - DNA, 20 bp, Homo sapiens
agcgcgccactcgcttcccc

SEQ ID NO: 4918133 - DNA, 17 bp, Homo sapiens
agcggaacaaggagtca

SEQ ID NO: 4918134 - DNA, 17 bp, Homo sapiens
agcggccctaagggagt

SEQ ID NO: 4918135 - DNA, 12 bp, Homo sapiens
agcgggaggcag

SEQ ID NO: 4918136 - DNA, 19 bp, Homo sapiens
agcgggcaggttctgcctg

SEQ ID NO: 4918137 - DNA, 22 bp, Homo sapiens
agcggtctcaggctggtgggag

SEQ ID NO: 4918138 - DNA, 13 bp, Homo sapiens
agcgtcccagtct

SEQ ID NO: 4918139 - DNA, 16 bp, Homo sapiens
agcgtccctagcagtg

SEQ ID NO: 4918140 - DNA, 18 bp, Homo sapiens
agcgtccctagcagtgaa

SEQ ID NO: 4918141 - DNA, 13 bp, Homo sapiens
agcgtgagccact

SEQ ID NO: 4918142 - DNA, 17 bp, Homo sapiens
agcgtgagccactgcac

SEQ ID NO: 4918143 - DNA, 22 bp, Homo sapiens
agcgtgagccactgcaccgggc

SEQ ID NO: 4918144 - DNA, 16 bp, Homo sapiens
agcgttggatgtagca

SEQ ID NO: 4918145 - DNA, 11 bp, Homo sapiens
agcgtttttta

SEQ ID NO: 4918146 - DNA, 19 bp, Homo sapiens
agcgttttttaaatgtata

SEQ ID NO: 4918147 - DNA, 23 bp, Homo sapiens
agctaaccagttaccacacatct

SEQ ID NO: 4918148 - DNA, 15 bp, Homo sapiens
agctaaccttatcct

SEQ ID NO: 4918149 - DNA, 22 bp, Homo sapiens
agctaaccttatcctgcattgt

SEQ ID NO: 4918150 - DNA, 17 bp, Homo sapiens
agctaagctaggaatga

SEQ ID NO: 4918151 - DNA, 17 bp, Homo sapiens
agctaagggaagacatt

SEQ ID NO: 4918152 - DNA, 20 bp, Homo sapiens
agctaagggaagacatttct

SEQ ID NO: 4918153 - DNA, 16 bp, Homo sapiens
agctaagggtgggtgc

SEQ ID NO: 4918154 - DNA, 12 bp, Homo sapiens
agctaataatga

SEQ ID NO: 4918155 - DNA, 13 bp, Homo sapiens
agctaatgggaca

SEQ ID NO: 4918156 - DNA, 15 bp, Homo sapiens
agctaattgggagtc

SEQ ID NO: 4918157 - DNA, 22 bp, Homo sapiens
agctaatttgcattaaattcac

SEQ ID NO: 4918158 - DNA, 14 bp, Homo sapiens
agctacaggaagca

SEQ ID NO: 4918159 - DNA, 16 bp, Homo sapiens
agctacccaaaagaga

SEQ ID NO: 4918160 - DNA, 20 bp, Homo sapiens
agctacccaaaagagaaaaa

SEQ ID NO: 4918161 - DNA, 15 bp, Homo sapiens
agctactgtgtgtgt

SEQ ID NO: 4918162 - DNA, 19 bp, Homo sapiens
agctacttaagagaaatgg

SEQ ID NO: 4918163 - DNA, 14 bp, Homo sapiens
agctacttggtttg

SEQ ID NO: 4918164 - DNA, 17 bp, Homo sapiens
agctacttggtttgtgt

SEQ ID NO: 4918165 - DNA, 21 bp, Homo sapiens
agctacttggtttgtgttctt

SEQ ID NO: 4918166 - DNA, 12 bp, Homo sapiens
agctaggcctgg

SEQ ID NO: 4918167 - DNA, 21 bp, Homo sapiens
agctaggcctggccagatgca

SEQ ID NO: 4918168 - DNA, 18 bp, Homo sapiens
agctagttcgtagctttc

SEQ ID NO: 4918169 - DNA, 18 bp, Homo sapiens
agctatcagtaggctaat

SEQ ID NO: 4918170 - DNA, 16 bp, Homo sapiens
agctatctaaagtttg

SEQ ID NO: 4918171 - DNA, 23 bp, Homo sapiens
agctatgctggtaggctcctgcc

SEQ ID NO: 4918172 - DNA, 17 bp, Homo sapiens
agctatgtcaagaggct

SEQ ID NO: 4918173 - DNA, 21 bp, Homo sapiens
agctattactgtctggtttta

SEQ ID NO: 4918174 - DNA, 22 bp, Homo sapiens
agctattagccaggatcatggt

SEQ ID NO: 4918175 - DNA, 16 bp, Homo sapiens
agctattcctttccct

SEQ ID NO: 4918176 - DNA, 21 bp, Homo sapiens
agctattcctttcccttcctc

SEQ ID NO: 4918177 - DNA, 19 bp, Homo sapiens
agctcaactttctgttgga

SEQ ID NO: 4918178 - DNA, 16 bp, Homo sapiens
agctcaccagccccag

SEQ ID NO: 4918179 - DNA, 19 bp, Homo sapiens
agctcaccagccccagtgc

SEQ ID NO: 4918180 - DNA, 21 bp, Homo sapiens
agctcaccagccccagtgccc

SEQ ID NO: 4918181 - DNA, 15 bp, Homo sapiens
agctcagaacccagg

SEQ ID NO: 4918182 - DNA, 16 bp, Homo sapiens
agctcagaacccaggg

SEQ ID NO: 4918183 - DNA, 18 bp, Homo sapiens
agctcagaacccagggct

SEQ ID NO: 4918184 - DNA, 19 bp, Homo sapiens
agctcagaacccagggctc

SEQ ID NO: 4918185 - DNA, 22 bp, Homo sapiens
agctcagccccgagctgtcccc

SEQ ID NO: 4918186 - DNA, 12 bp, Homo sapiens
agctcagcgcca

SEQ ID NO: 4918187 - DNA, 15 bp, Homo sapiens
agctcaggaggcgcc

SEQ ID NO: 4918188 - DNA, 17 bp, Homo sapiens
agctcaggaggcgccct

SEQ ID NO: 4918189 - DNA, 13 bp, Homo sapiens
agctcagtcccat

SEQ ID NO: 4918190 - DNA, 15 bp, Homo sapiens
agctcatattttgta

SEQ ID NO: 4918191 - DNA, 17 bp, Homo sapiens
agctcatttcatgctct

SEQ ID NO: 4918192 - DNA, 18 bp, Homo sapiens
agctccagctcaccagcc

SEQ ID NO: 4918193 - DNA, 21 bp, Homo sapiens
agctccatctccactccagat

SEQ ID NO: 4918194 - DNA, 19 bp, Homo sapiens
agctccatgtgcctctttg

SEQ ID NO: 4918195 - DNA, 17 bp, Homo sapiens
agctccctaggagacca

SEQ ID NO: 4918196 - DNA, 11 bp, Homo sapiens
agctccctgcc

SEQ ID NO: 4918197 - DNA, 13 bp, Homo sapiens
agctccctgccaa

SEQ ID NO: 4918198 - DNA, 20 bp, Homo sapiens
agctcctcctcggaaccgct

SEQ ID NO: 4918199 - DNA, 15 bp, Homo sapiens
agctcctctcctgga

SEQ ID NO: 4918200 - DNA, 18 bp, Homo sapiens
agctcctctcctggagga

SEQ ID NO: 4918201 - DNA, 13 bp, Homo sapiens
agctcctggggcg

SEQ ID NO: 4918202 - DNA, 13 bp, Homo sapiens
agctcctgtcctc

SEQ ID NO: 4918203 - DNA, 16 bp, Homo sapiens
agctcctgtcctccca

SEQ ID NO: 4918204 - DNA, 21 bp, Homo sapiens
agctccttctgtcctactctg

SEQ ID NO: 4918205 - DNA, 17 bp, Homo sapiens
agctcgaattaagaata

SEQ ID NO: 4918206 - DNA, 20 bp, Homo sapiens
agctcgcacccccctgttct

SEQ ID NO: 4918207 - DNA, 21 bp, Homo sapiens
agctcgcacccccctgttcta

SEQ ID NO: 4918208 - DNA, 15 bp, Homo sapiens
agctcggggagcctt

SEQ ID NO: 4918209 - DNA, 13 bp, Homo sapiens
agctctagaatct

SEQ ID NO: 4918210 - DNA, 18 bp, Homo sapiens
agctctccggtctctctc

SEQ ID NO: 4918211 - DNA, 21 bp, Homo sapiens
agctctctgtataaacattaa

SEQ ID NO: 4918212 - DNA, 16 bp, Homo sapiens
agctctcttgccgagg

SEQ ID NO: 4918213 - DNA, 23 bp, Homo sapiens
agctctgaagtcacatcacagga

SEQ ID NO: 4918214 - DNA, 21 bp, Homo sapiens
agctctgcagagcaggaaaca

SEQ ID NO: 4918215 - DNA, 16 bp, Homo sapiens
agctctgcatctcctg

SEQ ID NO: 4918216 - DNA, 19 bp, Homo sapiens
agctctgcatctcctgtct

SEQ ID NO: 4918217 - DNA, 12 bp, Homo sapiens
agctctgctcct

SEQ ID NO: 4918218 - DNA, 12 bp, Homo sapiens
agctctgtcctg

SEQ ID NO: 4918219 - DNA, 16 bp, Homo sapiens
agctctgttgcaatta

SEQ ID NO: 4918220 - DNA, 18 bp, Homo sapiens
agctcttcaggcctccct

SEQ ID NO: 4918221 - DNA, 18 bp, Homo sapiens
agctcttctccaggctgt

SEQ ID NO: 4918222 - DNA, 23 bp, Homo sapiens
agctcttttttgtttgtttcttt

SEQ ID NO: 4918223 - DNA, 21 bp, Homo sapiens
agctgaacaataggctgttcc

SEQ ID NO: 4918224 - DNA, 13 bp, Homo sapiens
agctgaagttact

SEQ ID NO: 4918225 - DNA, 20 bp, Homo sapiens
agctgaatgcctcctgtggg

SEQ ID NO: 4918226 - DNA, 22 bp, Homo sapiens
agctgaatgcctcctgtgggga

SEQ ID NO: 4918227 - DNA, 17 bp, Homo sapiens
agctgagaactcctgac

SEQ ID NO: 4918228 - DNA, 21 bp, Homo sapiens
agctgatacttcatttaaaaa

SEQ ID NO: 4918229 - DNA, 15 bp, Homo sapiens
agctgatataaattc

SEQ ID NO: 4918230 - DNA, 18 bp, Homo sapiens
agctgatataaattctgt

SEQ ID NO: 4918231 - DNA, 22 bp, Homo sapiens
agctgatctgcggatctcagct

SEQ ID NO: 4918232 - DNA, 11 bp, Homo sapiens
agctgatgaaa

SEQ ID NO: 4918233 - DNA, 12 bp, Homo sapiens
agctgatgaaac

SEQ ID NO: 4918234 - DNA, 20 bp, Homo sapiens
acttctcttaaacttgtgaa

SEQ ID NO: 4918235 - DNA, 21 bp, Homo sapiens
acttctcttgttaggtaattt

SEQ ID NO: 4918236 - DNA, 20 bp, Homo sapiens
acttctgtgagacccccaca

SEQ ID NO: 4918237 - DNA, 12 bp, Homo sapiens
acttcttaaata

SEQ ID NO: 4918238 - DNA, 16 bp, Homo sapiens
acttcttaaatatctt

SEQ ID NO: 4918239 - DNA, 17 bp, Homo sapiens
acttcttaaatatcttt

SEQ ID NO: 4918240 - DNA, 20 bp, Homo sapiens
acttcttaaatatcttttat

SEQ ID NO: 4918241 - DNA, 22 bp, Homo sapiens
acttcttaaatatcttttatgt

SEQ ID NO: 4918242 - DNA, 23 bp, Homo sapiens
acttcttatggaattgatttgca

SEQ ID NO: 4918243 - DNA, 17 bp, Homo sapiens
acttcttctccatccct

SEQ ID NO: 4918244 - DNA, 15 bp, Homo sapiens
acttcttgtcagaca

SEQ ID NO: 4918245 - DNA, 19 bp, Homo sapiens
acttcttgtcagacataaa

SEQ ID NO: 4918246 - DNA, 21 bp, Homo sapiens
acttcttgtcagacataaagc

SEQ ID NO: 4918247 - DNA, 22 bp, Homo sapiens
acttcttgtcagacataaagcc

SEQ ID NO: 4918248 - DNA, 13 bp, Homo sapiens
acttctttctatt

SEQ ID NO: 4918249 - DNA, 14 bp, Homo sapiens
acttctttctattt

SEQ ID NO: 4918250 - DNA, 20 bp, Homo sapiens
acttcttttgctcttagctg

SEQ ID NO: 4918251 - DNA, 15 bp, Homo sapiens
acttgaatgtgtcag

SEQ ID NO: 4918252 - DNA, 21 bp, Homo sapiens
acttgactccatttcatcatt

SEQ ID NO: 4918253 - DNA, 17 bp, Homo sapiens
acttgagggcccagagc

SEQ ID NO: 4918254 - DNA, 18 bp, Homo sapiens
acttgagggcccagagca

SEQ ID NO: 4918255 - DNA, 19 bp, Homo sapiens
acttgagggcccagagcag

SEQ ID NO: 4918256 - DNA, 14 bp, Homo sapiens
acttgatgcatgtg

SEQ ID NO: 4918257 - DNA, 20 bp, Homo sapiens
acttgcagctgatgttggaa

SEQ ID NO: 4918258 - DNA, 19 bp, Homo sapiens
acttgcatccaactccagg

SEQ ID NO: 4918259 - DNA, 11 bp, Homo sapiens
acttgcatttc

SEQ ID NO: 4918260 - DNA, 12 bp, Homo sapiens
acttgcctgggt

SEQ ID NO: 4918261 - DNA, 14 bp, Homo sapiens
acttgctaccctga

SEQ ID NO: 4918262 - DNA, 14 bp, Homo sapiens
acttggaagctccg

SEQ ID NO: 4918263 - DNA, 15 bp, Homo sapiens
acttggcaacagaag

SEQ ID NO: 4918264 - DNA, 16 bp, Homo sapiens
acttggcaacagaagc

SEQ ID NO: 4918265 - DNA, 11 bp, Homo sapiens
acttgtagctg

SEQ ID NO: 4918266 - DNA, 16 bp, Homo sapiens
acttgtagctgtaaaa

SEQ ID NO: 4918267 - DNA, 23 bp, Homo sapiens
acttgtaggataagtgaaatgga

SEQ ID NO: 4918268 - DNA, 19 bp, Homo sapiens
acttgtataaatgtatata

SEQ ID NO: 4918269 - DNA, 21 bp, Homo sapiens
acttgtataaatgtatataca

SEQ ID NO: 4918270 - DNA, 15 bp, Homo sapiens
acttgtctcatttta

SEQ ID NO: 4918271 - DNA, 19 bp, Homo sapiens
acttgtctcattttaatgt

SEQ ID NO: 4918272 - DNA, 17 bp, Homo sapiens
acttgtgaaacacagct

SEQ ID NO: 4918273 - DNA, 20 bp, Homo sapiens
acttgtgaaacacagctgtt

SEQ ID NO: 4918274 - DNA, 11 bp, Homo sapiens
acttgtgaatg

SEQ ID NO: 4918275 - DNA, 16 bp, Homo sapiens
acttgtgattatttat

SEQ ID NO: 4918276 - DNA, 15 bp, Homo sapiens
acttgtggacacagc

SEQ ID NO: 4918277 - DNA, 22 bp, Homo sapiens
acttgtggacacagctcttctc

SEQ ID NO: 4918278 - DNA, 17 bp, Homo sapiens
acttgtggttttcaaat

SEQ ID NO: 4918279 - DNA, 14 bp, Homo sapiens
acttgtgtctctgt

SEQ ID NO: 4918280 - DNA, 21 bp, Homo sapiens
acttgtgtctctgtgctttta

SEQ ID NO: 4918281 - DNA, 16 bp, Homo sapiens
acttgttattgtgaat

SEQ ID NO: 4918282 - DNA, 17 bp, Homo sapiens
acttgttattgtgaatg

SEQ ID NO: 4918283 - DNA, 15 bp, Homo sapiens
acttgttccagctct

SEQ ID NO: 4918284 - DNA, 23 bp, Homo sapiens
actttaagagagaaatctgaaaa

SEQ ID NO: 4918285 - DNA, 20 bp, Homo sapiens
actttagaagtgcatttctg

SEQ ID NO: 4918286 - DNA, 12 bp, Homo sapiens
actttatacatt

SEQ ID NO: 4918287 - DNA, 16 bp, Homo sapiens
actttatacattagta

SEQ ID NO: 4918288 - DNA, 20 bp, Homo sapiens
actttatcactttttgaact

SEQ ID NO: 4918289 - DNA, 21 bp, Homo sapiens
actttatgtgtaaatacataa

SEQ ID NO: 4918290 - DNA, 18 bp, Homo sapiens
actttcaaaattaaatct

SEQ ID NO: 4918291 - DNA, 20 bp, Homo sapiens
actttcaaaattaaatctgt

SEQ ID NO: 4918292 - DNA, 18 bp, Homo sapiens
actttccacttcttcctt

SEQ ID NO: 4918293 - DNA, 22 bp, Homo sapiens
actttcccttgcttttccctct

SEQ ID NO: 4918294 - DNA, 15 bp, Homo sapiens
actttctaatgtttc

SEQ ID NO: 4918295 - DNA, 16 bp, Homo sapiens
actttctctgccatca

SEQ ID NO: 4918296 - DNA, 23 bp, Homo sapiens
actttctgttggattccatgcta

SEQ ID NO: 4918297 - DNA, 23 bp, Homo sapiens
actttgaaatacctcatgtttat

SEQ ID NO: 4918298 - DNA, 16 bp, Homo sapiens
actttgaggtgtctca

SEQ ID NO: 4918299 - DNA, 14 bp, Homo sapiens
actttgcacatttt

SEQ ID NO: 4918300 - DNA, 20 bp, Homo sapiens
actttgcacattttgatttt

SEQ ID NO: 4918301 - DNA, 19 bp, Homo sapiens
actttgcacgacgccctct

SEQ ID NO: 4918302 - DNA, 15 bp, Homo sapiens
actttggggaaggga

SEQ ID NO: 4918303 - DNA, 14 bp, Homo sapiens
actttgtatacttt

SEQ ID NO: 4918304 - DNA, 16 bp, Homo sapiens
actttgtatactttaa

SEQ ID NO: 4918305 - DNA, 17 bp, Homo sapiens
actttgtatactttaaa

SEQ ID NO: 4918306 - DNA, 20 bp, Homo sapiens
actttgtcgcccaggctgga

SEQ ID NO: 4918307 - DNA, 15 bp, Homo sapiens
actttgtctgaaaaa

SEQ ID NO: 4918308 - DNA, 20 bp, Homo sapiens
actttgtggaccaattattg

SEQ ID NO: 4918309 - DNA, 22 bp, Homo sapiens
actttgtggaccaattattgat

SEQ ID NO: 4918310 - DNA, 14 bp, Homo sapiens
acttttaaggcagt

SEQ ID NO: 4918311 - DNA, 18 bp, Homo sapiens
acttttattttacacaga

SEQ ID NO: 4918312 - DNA, 20 bp, Homo sapiens
acttttattttacacagaaa

SEQ ID NO: 4918313 - DNA, 12 bp, Homo sapiens
acttttcagtga

SEQ ID NO: 4918314 - DNA, 20 bp, Homo sapiens
acttttcataacctagcctt

SEQ ID NO: 4918315 - DNA, 17 bp, Homo sapiens
acttttcctccctcagt

SEQ ID NO: 4918316 - DNA, 21 bp, Homo sapiens
acttttgtaaagaaatttact

SEQ ID NO: 4918317 - DNA, 19 bp, Homo sapiens
acttttgtgtaatgaaaat

SEQ ID NO: 4918318 - DNA, 11 bp, Homo sapiens
actttttacaa

SEQ ID NO: 4918319 - DNA, 17 bp, Homo sapiens
actttttgaactaagaa

SEQ ID NO: 4918320 - DNA, 14 bp, Homo sapiens
acttttttaaataa

SEQ ID NO: 4918321 - DNA, 17 bp, Homo sapiens
acttttttaaataaact

SEQ ID NO: 4918322 - DNA, 18 bp, Homo sapiens
acttttttaaataaactt

SEQ ID NO: 4918323 - DNA, 20 bp, Homo sapiens
acttttttaaataaactttt

SEQ ID NO: 4918324 - DNA, 16 bp, Homo sapiens
actttttttcaatgtg

SEQ ID NO: 4918325 - DNA, 20 bp, Homo sapiens
agaaaaaaaaaaacttacac

SEQ ID NO: 4918326 - DNA, 13 bp, Homo sapiens
agaaaaaaaaaag

SEQ ID NO: 4918327 - DNA, 18 bp, Homo sapiens
agaaaaaaaccacacaaa

SEQ ID NO: 4918328 - DNA, 18 bp, Homo sapiens
agaaaaaaacgaaaacag

SEQ ID NO: 4918329 - DNA, 18 bp, Homo sapiens
agaaaaaataacacacat

SEQ ID NO: 4918330 - DNA, 14 bp, Homo sapiens
agaaaaagggtcaa

SEQ ID NO: 4918331 - DNA, 21 bp, Homo sapiens
agaaaaatcttgtgctagaat

SEQ ID NO: 4918332 - DNA, 16 bp, Homo sapiens
agaaaacaagcaagtt

SEQ ID NO: 4918333 - DNA, 13 bp, Homo sapiens
agaaaacattttt

SEQ ID NO: 4918334 - DNA, 23 bp, Homo sapiens
agaaaacattttttttttaaatc

SEQ ID NO: 4918335 - DNA, 19 bp, Homo sapiens
agaaaactttaaaaaatat

SEQ ID NO: 4918336 - DNA, 20 bp, Homo sapiens
agaaaagaacgtattttaaa

SEQ ID NO: 4918337 - DNA, 15 bp, Homo sapiens
agaaaagagaagaag

SEQ ID NO: 4918338 - DNA, 17 bp, Homo sapiens
agaaaagagaagaagaa

SEQ ID NO: 4918339 - DNA, 12 bp, Homo sapiens
agaaaaggaaaa

SEQ ID NO: 4918340 - DNA, 18 bp, Homo sapiens
agaaaaggaaaagaaaaa

SEQ ID NO: 4918341 - DNA, 23 bp, Homo sapiens
agaaaagtagacaatcattgttt

SEQ ID NO: 4918342 - DNA, 13 bp, Homo sapiens
agaaaagtatttt

SEQ ID NO: 4918343 - DNA, 19 bp, Homo sapiens
agaaaagtattttgaagtt

SEQ ID NO: 4918344 - DNA, 16 bp, Homo sapiens
agaaaataaagacaac

SEQ ID NO: 4918345 - DNA, 16 bp, Homo sapiens
agcatcctaagaaata

SEQ ID NO: 4918346 - DNA, 13 bp, Homo sapiens
agcatcctgagcc

SEQ ID NO: 4918347 - DNA, 16 bp, Homo sapiens
agcatcctgagccccg

SEQ ID NO: 4918348 - DNA, 19 bp, Homo sapiens
agcatctcttgaggccagg

SEQ ID NO: 4918349 - DNA, 22 bp, Homo sapiens
agcatctcttgaggccaggagt

SEQ ID NO: 4918350 - DNA, 16 bp, Homo sapiens
agcatgacataacagt

SEQ ID NO: 4918351 - DNA, 20 bp, Homo sapiens
agcatgacataacagtgcag

SEQ ID NO: 4918352 - DNA, 17 bp, Homo sapiens
agcatgtgccctcctga

SEQ ID NO: 4918353 - DNA, 17 bp, Homo sapiens
agcatgtttcatgtttt

SEQ ID NO: 4918354 - DNA, 21 bp, Homo sapiens
agcatgtttcatgttttgtga

SEQ ID NO: 4918355 - DNA, 15 bp, Homo sapiens
agcattcagagagca

SEQ ID NO: 4918356 - DNA, 17 bp, Homo sapiens
agcattcagagagcagc

SEQ ID NO: 4918357 - DNA, 15 bp, Homo sapiens
agcattccttctttg

SEQ ID NO: 4918358 - DNA, 17 bp, Homo sapiens
agcattccttctttgat

SEQ ID NO: 4918359 - DNA, 19 bp, Homo sapiens
agcattccttctttgataa

SEQ ID NO: 4918360 - DNA, 21 bp, Homo sapiens
agcattccttctttgataatg

SEQ ID NO: 4918361 - DNA, 22 bp, Homo sapiens
agcattccttctttgataatgt

SEQ ID NO: 4918362 - DNA, 15 bp, Homo sapiens
agcattgaaattata

SEQ ID NO: 4918363 - DNA, 13 bp, Homo sapiens
agcattgcctggc

SEQ ID NO: 4918364 - DNA, 23 bp, Homo sapiens
agcattgctgttatgtctgttta

SEQ ID NO: 4918365 - DNA, 14 bp, Homo sapiens
agcatttccaacac

SEQ ID NO: 4918366 - DNA, 22 bp, Homo sapiens
agcatttccaacaccacagaca

SEQ ID NO: 4918367 - DNA, 19 bp, Homo sapiens
agcatttgataatgataaa

SEQ ID NO: 4918368 - DNA, 13 bp, Homo sapiens
agcatttgtattt

SEQ ID NO: 4918369 - DNA, 16 bp, Homo sapiens
agcatttttatttcag

SEQ ID NO: 4918370 - DNA, 16 bp, Homo sapiens
agcatttttgatttat

SEQ ID NO: 4918371 - DNA, 15 bp, Homo sapiens
agccaaaccctgtct

SEQ ID NO: 4918372 - DNA, 16 bp, Homo sapiens
agccaaaccctgtctg

SEQ ID NO: 4918373 - DNA, 14 bp, Homo sapiens
agccaaagaaatga

SEQ ID NO: 4918374 - DNA, 18 bp, Homo sapiens
agccaaagctaggcctgg

SEQ ID NO: 4918375 - DNA, 21 bp, Homo sapiens
agccaagcttgttatcagctt

SEQ ID NO: 4918376 - DNA, 18 bp, Homo sapiens
agccacaagtcttccaga

SEQ ID NO: 4918377 - DNA, 22 bp, Homo sapiens
agccacatttggaatacttttt

SEQ ID NO: 4918378 - DNA, 20 bp, Homo sapiens
agccaccccgggctctctgc

SEQ ID NO: 4918379 - DNA, 16 bp, Homo sapiens
agccacctctgtcatt

SEQ ID NO: 4918380 - DNA, 13 bp, Homo sapiens
agccactgcaccg

SEQ ID NO: 4918381 - DNA, 17 bp, Homo sapiens
agccacttcggccaggt

SEQ ID NO: 4918382 - DNA, 19 bp, Homo sapiens
agccagaatcagcacagat

SEQ ID NO: 4918383 - DNA, 21 bp, Homo sapiens
agccagaatcagcacagataa

SEQ ID NO: 4918384 - DNA, 14 bp, Homo sapiens
agccagctccctct

SEQ ID NO: 4918385 - DNA, 22 bp, Homo sapiens
agccagctccctctatttatgt

SEQ ID NO: 4918386 - DNA, 12 bp, Homo sapiens
agccagcttggg

SEQ ID NO: 4918387 - DNA, 20 bp, Homo sapiens
agccaggaagtacttccacc

SEQ ID NO: 4918388 - DNA, 15 bp, Homo sapiens
agccaggatcatggt

SEQ ID NO: 4918389 - DNA, 20 bp, Homo sapiens
agccaggatcatggtgtaat

SEQ ID NO: 4918390 - DNA, 22 bp, Homo sapiens
agccaggatcatggtgtaataa

SEQ ID NO: 4918391 - DNA, 23 bp, Homo sapiens
agccaggatcatggtgtaataag

SEQ ID NO: 4918392 - DNA, 22 bp, Homo sapiens
agccaggcaacttcagtcctgg

SEQ ID NO: 4918393 - DNA, 21 bp, Homo sapiens
agccaggcaggtagccagggg

SEQ ID NO: 4918394 - DNA, 22 bp, Homo sapiens
agccagggggactagcccctgt

SEQ ID NO: 4918395 - DNA, 23 bp, Homo sapiens
agccagggggactagcccctgtg

SEQ ID NO: 4918396 - DNA, 16 bp, Homo sapiens
agccagggtctctccc

SEQ ID NO: 4918397 - DNA, 13 bp, Homo sapiens
agccagtgagatg

SEQ ID NO: 4918398 - DNA, 16 bp, Homo sapiens
agccagtgttgcctaa

SEQ ID NO: 4918399 - DNA, 22 bp, Homo sapiens
agccatacttatctctctgtgc

SEQ ID NO: 4918400 - DNA, 13 bp, Homo sapiens
agccatcaaaatg

SEQ ID NO: 4918401 - DNA, 18 bp, Homo sapiens
agccatcaaaatgctttt

SEQ ID NO: 4918402 - DNA, 15 bp, Homo sapiens
agccatgctgggaag

SEQ ID NO: 4918403 - DNA, 16 bp, Homo sapiens
agccatgtataaatgt

SEQ ID NO: 4918404 - DNA, 18 bp, Homo sapiens
agccatgtataaatgtga

SEQ ID NO: 4918405 - DNA, 22 bp, Homo sapiens
agccattaaatgaatattttga

SEQ ID NO: 4918406 - DNA, 20 bp, Homo sapiens
agcccaaaggggacaggcct

SEQ ID NO: 4918407 - DNA, 23 bp, Homo sapiens
agcccacagcacagctccctgcc

SEQ ID NO: 4918408 - DNA, 23 bp, Homo sapiens
agcccacattggattcatcagca

SEQ ID NO: 4918409 - DNA, 14 bp, Homo sapiens
agcccaccttggct

SEQ ID NO: 4918410 - DNA, 16 bp, Homo sapiens
agcccaccttggctca

SEQ ID NO: 4918411 - DNA, 15 bp, Homo sapiens
agcccacttctgcca

SEQ ID NO: 4918412 - DNA, 15 bp, Homo sapiens
agcccagaggtaaca

SEQ ID NO: 4918413 - DNA, 16 bp, Homo sapiens
agcccagaggtaacag

SEQ ID NO: 4918414 - DNA, 17 bp, Homo sapiens
agcccagaggtaacaga

SEQ ID NO: 4918415 - DNA, 18 bp, Homo sapiens
agcccagaggtaacagaa

SEQ ID NO: 4918416 - DNA, 13 bp, Homo sapiens
agcccagccctcc

SEQ ID NO: 4918417 - DNA, 16 bp, Homo sapiens
agcccagccctgttct

SEQ ID NO: 4918418 - DNA, 22 bp, Homo sapiens
agcccaggccggggtggagcat

SEQ ID NO: 4918419 - DNA, 22 bp, Homo sapiens
agcccaggtgccagcctgaggc

SEQ ID NO: 4918420 - DNA, 15 bp, Homo sapiens
agcccatactcagcc

SEQ ID NO: 4918421 - DNA, 20 bp, Homo sapiens
agcccatactcagcctgctg

SEQ ID NO: 4918422 - DNA, 15 bp, Homo sapiens
agcccatccctgcct

SEQ ID NO: 4918423 - DNA, 18 bp, Homo sapiens
agcccatccctgcctggt

SEQ ID NO: 4918424 - DNA, 17 bp, Homo sapiens
agcccatgagtccttga

SEQ ID NO: 4918425 - DNA, 22 bp, Homo sapiens
agcccatgcccacctgcccatc

SEQ ID NO: 4918426 - DNA, 16 bp, Homo sapiens
agcccatgttctgccc

SEQ ID NO: 4918427 - DNA, 20 bp, Homo sapiens
agcccatgttctgcccccag

SEQ ID NO: 4918428 - DNA, 21 bp, Homo sapiens
agcccatgttctgcccccagc

SEQ ID NO: 4918429 - DNA, 14 bp, Homo sapiens
agccccacacagct

SEQ ID NO: 4918430 - DNA, 12 bp, Homo sapiens
agccccacccag

SEQ ID NO: 4918431 - DNA, 15 bp, Homo sapiens
agccccacccaggag

SEQ ID NO: 4918432 - DNA, 16 bp, Homo sapiens
agccccacccaggagg

SEQ ID NO: 4918433 - DNA, 15 bp, Homo sapiens
agccccactgccagc

SEQ ID NO: 4918434 - DNA, 20 bp, Homo sapiens
agccccactgccagcagcag

SEQ ID NO: 4918435 - DNA, 12 bp, Homo sapiens
agccccaggcct

SEQ ID NO: 4918436 - DNA, 15 bp, Homo sapiens
agccccaggcctctg

SEQ ID NO: 4918437 - DNA, 14 bp, Homo sapiens
agccccagtgccca

SEQ ID NO: 4918438 - DNA, 22 bp, Homo sapiens
agccccattctgcctgcccagg

SEQ ID NO: 4918439 - DNA, 17 bp, Homo sapiens
agcccccagcccctccc

SEQ ID NO: 4918440 - DNA, 16 bp, Homo sapiens
agccccgagctgtccc

SEQ ID NO: 4918441 - DNA, 16 bp, Homo sapiens
agccccgaggccttct

SEQ ID NO: 4918442 - DNA, 19 bp, Homo sapiens
agccccgcagacctcccca

SEQ ID NO: 4918443 - DNA, 23 bp, Homo sapiens
agccccgcagacctccccagccc

SEQ ID NO: 4918444 - DNA, 15 bp, Homo sapiens
agccccgccctcttc

SEQ ID NO: 4918445 - DNA, 17 bp, Homo sapiens
agccccgccctcttcct

SEQ ID NO: 4918446 - DNA, 16 bp, Homo sapiens
agccccggccctgggc

SEQ ID NO: 4918447 - DNA, 18 bp, Homo sapiens
agccccggccctgggctc

SEQ ID NO: 4918448 - DNA, 16 bp, Homo sapiens
agcccctagaaaccca

SEQ ID NO: 4918449 - DNA, 18 bp, Homo sapiens
agcccctagaaacccaag

SEQ ID NO: 4918450 - DNA, 15 bp, Homo sapiens
agcccctagcccagg

SEQ ID NO: 4918451 - DNA, 18 bp, Homo sapiens
agcccctagcccaggaga

SEQ ID NO: 4918452 - DNA, 11 bp, Homo sapiens
agcccctagga

SEQ ID NO: 4918453 - DNA, 10 bp, Homo sapiens
agcccctccc

SEQ ID NO: 4918454 - DNA, 13 bp, Homo sapiens
agcccctccccca

SEQ ID NO: 4918455 - DNA, 14 bp, Homo sapiens
agcccctgtggaga

SEQ ID NO: 4918456 - DNA, 18 bp, Homo sapiens
agcccgcctgacagaaac

SEQ ID NO: 4918457 - DNA, 18 bp, Homo sapiens
agcccggcgcccctgcca

SEQ ID NO: 4918458 - DNA, 17 bp, Homo sapiens
agcccgggagcctagga

SEQ ID NO: 4918459 - DNA, 18 bp, Homo sapiens
agccctaaccccttccag

SEQ ID NO: 4918460 - DNA, 17 bp, Homo sapiens
agccctacagagctgtg

SEQ ID NO: 4918461 - DNA, 17 bp, Homo sapiens
agccctactccctgcag

SEQ ID NO: 4918462 - DNA, 24 bp, Homo sapiens
agccctactccctgcagatgccac

SEQ ID NO: 4918463 - DNA, 20 bp, Homo sapiens
agccctagagcctgcctgga

SEQ ID NO: 4918464 - DNA, 12 bp, Homo sapiens
agccctccccat

SEQ ID NO: 4918465 - DNA, 19 bp, Homo sapiens
agccctccccatggagcca

SEQ ID NO: 4918466 - DNA, 13 bp, Homo sapiens
agccctccctgcc

SEQ ID NO: 4918467 - DNA, 15 bp, Homo sapiens
agccctccctgcccc

SEQ ID NO: 4918468 - DNA, 17 bp, Homo sapiens
agccctccctgcccctc

SEQ ID NO: 4918469 - DNA, 19 bp, Homo sapiens
agccctccctgcccctccc

SEQ ID NO: 4918470 - DNA, 23 bp, Homo sapiens
agccctccctgcccctcccttca

SEQ ID NO: 4918471 - DNA, 19 bp, Homo sapiens
agccctgacgcaatgaaaa

SEQ ID NO: 4918472 - DNA, 20 bp, Homo sapiens
agccctgctttgggctgccc

SEQ ID NO: 4918473 - DNA, 14 bp, Homo sapiens
agccctggctctgc

SEQ ID NO: 4918474 - DNA, 15 bp, Homo sapiens
agccctggctctgca

SEQ ID NO: 4918475 - DNA, 12 bp, Homo sapiens
agccctggggct

SEQ ID NO: 4918476 - DNA, 15 bp, Homo sapiens
agccctggggctggg

SEQ ID NO: 4918477 - DNA, 18 bp, Homo sapiens
agccctggggctgggccc

SEQ ID NO: 4918478 - DNA, 14 bp, Homo sapiens
agccctggtggcag

SEQ ID NO: 4918479 - DNA, 15 bp, Homo sapiens
agccctggtggcagt

SEQ ID NO: 4918480 - DNA, 22 bp, Homo sapiens
agccctggtggcagtgggagct

SEQ ID NO: 4918481 - DNA, 23 bp, Homo sapiens
agccctggtggcagtgggagctg

SEQ ID NO: 4918482 - DNA, 13 bp, Homo sapiens
agcccttcatttg

SEQ ID NO: 4918483 - DNA, 17 bp, Homo sapiens
agccctttctgtgtgca

SEQ ID NO: 4918484 - DNA, 19 bp, Homo sapiens
agccgagatcacgccactg

SEQ ID NO: 4918485 - DNA, 17 bp, Homo sapiens
agccgccattgccacca

SEQ ID NO: 4918486 - DNA, 19 bp, Homo sapiens
agccgccattgccaccagg

SEQ ID NO: 4918487 - DNA, 20 bp, Homo sapiens
agccgccattgccaccagga

SEQ ID NO: 4918488 - DNA, 21 bp, Homo sapiens
agccggcgtggcaaatataaa

SEQ ID NO: 4918489 - DNA, 21 bp, Homo sapiens
agcctaggaccactcagcccc

SEQ ID NO: 4918490 - DNA, 15 bp, Homo sapiens
agcctaggtgacaga

SEQ ID NO: 4918491 - DNA, 17 bp, Homo sapiens
agcctaggtgacagagt

SEQ ID NO: 4918492 - DNA, 19 bp, Homo sapiens
agcctagtttttaatagct

SEQ ID NO: 4918493 - DNA, 18 bp, Homo sapiens
agcctatgagcatcctga

SEQ ID NO: 4918494 - DNA, 19 bp, Homo sapiens
agcctatgagcatcctgag

SEQ ID NO: 4918495 - DNA, 14 bp, Homo sapiens
agcctatggcagaa

SEQ ID NO: 4918496 - DNA, 15 bp, Homo sapiens
agcctatttacctgc

SEQ ID NO: 4918497 - DNA, 22 bp, Homo sapiens
agcctcaaggttttaggttcta

SEQ ID NO: 4918498 - DNA, 14 bp, Homo sapiens
agcctcacccttgc

SEQ ID NO: 4918499 - DNA, 17 bp, Homo sapiens
agcctcactgatatatt

SEQ ID NO: 4918500 - DNA, 13 bp, Homo sapiens
agcctcagcatcc

SEQ ID NO: 4918501 - DNA, 14 bp, Homo sapiens
agcctcagcatcct

SEQ ID NO: 4918502 - DNA, 16 bp, Homo sapiens
agcctcatatttaaag

SEQ ID NO: 4918503 - DNA, 12 bp, Homo sapiens
agcctccacagc

SEQ ID NO: 4918504 - DNA, 13 bp, Homo sapiens
agcctccacagcg

SEQ ID NO: 4918505 - DNA, 14 bp, Homo sapiens
agcctccacagcga

SEQ ID NO: 4918506 - DNA, 21 bp, Homo sapiens
agcctccacagcgagggcagc

SEQ ID NO: 4918507 - DNA, 22 bp, Homo sapiens
agcctccacagcgagggcagct

SEQ ID NO: 4918508 - DNA, 20 bp, Homo sapiens
agcctccactgcctctggaa

SEQ ID NO: 4918509 - DNA, 18 bp, Homo sapiens
agcctccatgctgcctcc

SEQ ID NO: 4918510 - DNA, 13 bp, Homo sapiens
agcctcccaaagt

SEQ ID NO: 4918511 - DNA, 14 bp, Homo sapiens
agcctcccaaagtg

SEQ ID NO: 4918512 - DNA, 16 bp, Homo sapiens
agcctcccaaagtgct

SEQ ID NO: 4918513 - DNA, 16 bp, Homo sapiens
agcctcccaaggagaa

SEQ ID NO: 4918514 - DNA, 19 bp, Homo sapiens
agcctcccgagtagctggg

SEQ ID NO: 4918515 - DNA, 15 bp, Homo sapiens
agcctccggaagctg

SEQ ID NO: 4918516 - DNA, 23 bp, Homo sapiens
agcctccggagtagctgggacca

SEQ ID NO: 4918517 - DNA, 16 bp, Homo sapiens
agcctcctctgtctgc

SEQ ID NO: 4918518 - DNA, 19 bp, Homo sapiens
agcctcctctgtctgccct

SEQ ID NO: 4918519 - DNA, 20 bp, Homo sapiens
agcctcctctgtctgccctt

SEQ ID NO: 4918520 - DNA, 21 bp, Homo sapiens
agcctcctctgtctgcccttc

SEQ ID NO: 4918521 - DNA, 21 bp, Homo sapiens
agcctcgttggaagaggaaca

SEQ ID NO: 4918522 - DNA, 15 bp, Homo sapiens
agcctctgacccctc

SEQ ID NO: 4918523 - DNA, 19 bp, Homo sapiens
agcctctgacccctcctca

SEQ ID NO: 4918524 - DNA, 15 bp, Homo sapiens
agcctctgctcccca

SEQ ID NO: 4918525 - DNA, 14 bp, Homo sapiens
agcctctggctaga

SEQ ID NO: 4918526 - DNA, 23 bp, Homo sapiens
agcctcttaaagctgcctgtagt

SEQ ID NO: 4918527 - DNA, 21 bp, Homo sapiens
agcctgaattttgttgctgtt

SEQ ID NO: 4918528 - DNA, 16 bp, Homo sapiens
agcctgagcaactctt

SEQ ID NO: 4918529 - DNA, 21 bp, Homo sapiens
agcctgagcaactcttgatta

SEQ ID NO: 4918530 - DNA, 21 bp, Homo sapiens
agcctgaggcagccacttcgg

SEQ ID NO: 4918531 - DNA, 17 bp, Homo sapiens
agcctgagtcagggccc

SEQ ID NO: 4918532 - DNA, 20 bp, Homo sapiens
agcctgagtcagggcccaga

SEQ ID NO: 4918533 - DNA, 16 bp, Homo sapiens
agcctgcactttgatg

SEQ ID NO: 4918534 - DNA, 17 bp, Homo sapiens
agcctgcactttgatgt

SEQ ID NO: 4918535 - DNA, 23 bp, Homo sapiens
agcctgcactttgatgtcatgtg

SEQ ID NO: 4918536 - DNA, 22 bp, Homo sapiens
agcctgcccaagcccaggccac

SEQ ID NO: 4918537 - DNA, 17 bp, Homo sapiens
agcctgctgcccaggct

SEQ ID NO: 4918538 - DNA, 21 bp, Homo sapiens
agcctgctggtcacagcctcc

SEQ ID NO: 4918539 - DNA, 15 bp, Homo sapiens
agcctgcttcccacc

SEQ ID NO: 4918540 - DNA, 17 bp, Homo sapiens
agcctggcacagggcag

SEQ ID NO: 4918541 - DNA, 11 bp, Homo sapiens
agcctggctct

SEQ ID NO: 4918542 - DNA, 17 bp, Homo sapiens
agcctgggcaacagagc

SEQ ID NO: 4918543 - DNA, 17 bp, Homo sapiens
agcctgggcagcatagc

SEQ ID NO: 4918544 - DNA, 15 bp, Homo sapiens
agcctgggcagccag

SEQ ID NO: 4918545 - DNA, 19 bp, Homo sapiens
agcctgggcagccaggctg

SEQ ID NO: 4918546 - DNA, 21 bp, Homo sapiens
agcctgggcagccaggctgcc

SEQ ID NO: 4918547 - DNA, 12 bp, Homo sapiens
agcctgggcccc

SEQ ID NO: 4918548 - DNA, 14 bp, Homo sapiens
agcctggggcctgg

SEQ ID NO: 4918549 - DNA, 16 bp, Homo sapiens
agcctggggcctggca

SEQ ID NO: 4918550 - DNA, 17 bp, Homo sapiens
agcctggggcctggcag

SEQ ID NO: 4918551 - DNA, 19 bp, Homo sapiens
agcctggggcctggcaggg

SEQ ID NO: 4918552 - DNA, 19 bp, Homo sapiens
agcctgtcccatggacact

SEQ ID NO: 4918553 - DNA, 16 bp, Homo sapiens
agcctgtggatgatca

SEQ ID NO: 4918554 - DNA, 18 bp, Homo sapiens
agccttaatcaggtcctc

SEQ ID NO: 4918555 - DNA, 14 bp, Homo sapiens
agccttcagctcca

SEQ ID NO: 4918556 - DNA, 23 bp, Homo sapiens
agccttcagtcttgaatttctaa

SEQ ID NO: 4918557 - DNA, 22 bp, Homo sapiens
agccttgcctaaatttaatgct

SEQ ID NO: 4918558 - DNA, 10 bp, Homo sapiens
agccttgtgt

SEQ ID NO: 4918559 - DNA, 19 bp, Homo sapiens
agccttgtgtatatttgta

SEQ ID NO: 4918560 - DNA, 17 bp, Homo sapiens
agcctttggccttggct

SEQ ID NO: 4918561 - DNA, 18 bp, Homo sapiens
agcctttggctctggaga

SEQ ID NO: 4918562 - DNA, 23 bp, Homo sapiens
agcctttggctctggagacagcc

SEQ ID NO: 4918563 - DNA, 19 bp, Homo sapiens
agcctttggttctggccag

SEQ ID NO: 4918564 - DNA, 19 bp, Homo sapiens
agcgacatagcccatccct

SEQ ID NO: 4918565 - DNA, 17 bp, Homo sapiens
agcgacccattcagaga

SEQ ID NO: 4918566 - DNA, 19 bp, Homo sapiens
agcgagcatcccccaaagt

SEQ ID NO: 4918567 - DNA, 18 bp, Homo sapiens
agacatacgaaacacaaa

SEQ ID NO: 4918568 - DNA, 18 bp, Homo sapiens
agacataggccatgaaaa

SEQ ID NO: 4918569 - DNA, 13 bp, Homo sapiens
agacatatctcta

SEQ ID NO: 4918570 - DNA, 18 bp, Homo sapiens
agacatccatgtttgtaa

SEQ ID NO: 4918571 - DNA, 14 bp, Homo sapiens
agacatctctgcac

SEQ ID NO: 4918572 - DNA, 17 bp, Homo sapiens
agacatgttgtaaatta

SEQ ID NO: 4918573 - DNA, 19 bp, Homo sapiens
agacattcttccaaaaaga

SEQ ID NO: 4918574 - DNA, 14 bp, Homo sapiens
agacatttcttttc

SEQ ID NO: 4918575 - DNA, 16 bp, Homo sapiens
agacatttcttttctt

SEQ ID NO: 4918576 - DNA, 20 bp, Homo sapiens
agacatttcttttcttttta

SEQ ID NO: 4918577 - DNA, 21 bp, Homo sapiens
agacatttcttttctttttac

SEQ ID NO: 4918578 - DNA, 18 bp, Homo sapiens
agaccaacgttactcagg

SEQ ID NO: 4918579 - DNA, 17 bp, Homo sapiens
agaccacagagctgtca

SEQ ID NO: 4918580 - DNA, 23 bp, Homo sapiens
agaccacatctttatctgttctt

SEQ ID NO: 4918581 - DNA, 16 bp, Homo sapiens
agaccaccacttcgaa

SEQ ID NO: 4918582 - DNA, 17 bp, Homo sapiens
agaccaccatccaccgc

SEQ ID NO: 4918583 - DNA, 15 bp, Homo sapiens
agaccaggctgtgtc

SEQ ID NO: 4918584 - DNA, 22 bp, Homo sapiens
agaccagttgaataaaagtgca

SEQ ID NO: 4918585 - DNA, 13 bp, Homo sapiens
agacccaccccac

SEQ ID NO: 4918586 - DNA, 19 bp, Homo sapiens
agacccaccccacctgcag

SEQ ID NO: 4918587 - DNA, 20 bp, Homo sapiens
agacccaccccacctgcagg

SEQ ID NO: 4918588 - DNA, 13 bp, Homo sapiens
agacccccacacc

SEQ ID NO: 4918589 - DNA, 19 bp, Homo sapiens
agaccctcgcccaactcca

SEQ ID NO: 4918590 - DNA, 17 bp, Homo sapiens
agaccctctgccaccag

SEQ ID NO: 4918591 - DNA, 22 bp, Homo sapiens
agaccctgcaaacagaacaggg

SEQ ID NO: 4918592 - DNA, 14 bp, Homo sapiens
agaccgtcctcacc

SEQ ID NO: 4918593 - DNA, 16 bp, Homo sapiens
agaccgtcctcacccc

SEQ ID NO: 4918594 - DNA, 18 bp, Homo sapiens
agaccgtcctcacccctg

SEQ ID NO: 4918595 - DNA, 20 bp, Homo sapiens
agaccgtcctcacccctgtc

SEQ ID NO: 4918596 - DNA, 17 bp, Homo sapiens
agacctactgttctaaa

SEQ ID NO: 4918597 - DNA, 20 bp, Homo sapiens
agacctactgttctaaagct

SEQ ID NO: 4918598 - DNA, 20 bp, Homo sapiens
agacctgctttttgaaatga

SEQ ID NO: 4918599 - DNA, 23 bp, Homo sapiens
agacctgctttttgaaatgaaat

SEQ ID NO: 4918600 - DNA, 13 bp, Homo sapiens
agaccttccataa

SEQ ID NO: 4918601 - DNA, 22 bp, Homo sapiens
agaccttccataatgctactgt

SEQ ID NO: 4918602 - DNA, 19 bp, Homo sapiens
agactaagaaatattccaa

SEQ ID NO: 4918603 - DNA, 15 bp, Homo sapiens
agactaatttaaaaa

SEQ ID NO: 4918604 - DNA, 16 bp, Homo sapiens
agactacacaggatga

SEQ ID NO: 4918605 - DNA, 18 bp, Homo sapiens
agactactattttctttt

SEQ ID NO: 4918606 - DNA, 16 bp, Homo sapiens
agactagattgccttt

SEQ ID NO: 4918607 - DNA, 22 bp, Homo sapiens
agactagtttttattccttgtg

SEQ ID NO: 4918608 - DNA, 17 bp, Homo sapiens
agactatatacatgtgt

SEQ ID NO: 4918609 - DNA, 19 bp, Homo sapiens
agactatatacatgtgtgt

SEQ ID NO: 4918610 - DNA, 20 bp, Homo sapiens
agactatggagcctggcaca

SEQ ID NO: 4918611 - DNA, 17 bp, Homo sapiens
agactatttaaacttat

SEQ ID NO: 4918612 - DNA, 15 bp, Homo sapiens
agactcaaatgttct

SEQ ID NO: 4918613 - DNA, 23 bp, Homo sapiens
agactcaaatgttctaagtttct

SEQ ID NO: 4918614 - DNA, 15 bp, Homo sapiens
agactcacaggaagg

SEQ ID NO: 4918615 - DNA, 17 bp, Homo sapiens
agactctacagaggcca

SEQ ID NO: 4918616 - DNA, 17 bp, Homo sapiens
agactctagagtccaag

SEQ ID NO: 4918617 - DNA, 21 bp, Homo sapiens
agactctagagtccaaggttt

SEQ ID NO: 4918618 - DNA, 16 bp, Homo sapiens
agactctcagcccaga

SEQ ID NO: 4918619 - DNA, 18 bp, Homo sapiens
agactctcagcccagaag

SEQ ID NO: 4918620 - DNA, 20 bp, Homo sapiens
agactctcagcccagaagaa

SEQ ID NO: 4918621 - DNA, 19 bp, Homo sapiens
agactgcaagaggctcctg

SEQ ID NO: 4918622 - DNA, 16 bp, Homo sapiens
agactggaaaaaatga

SEQ ID NO: 4918623 - DNA, 14 bp, Homo sapiens
agactggaagctaa

SEQ ID NO: 4918624 - DNA, 21 bp, Homo sapiens
agactggaagttcatacctaa

SEQ ID NO: 4918625 - DNA, 17 bp, Homo sapiens
agactggtcctgtgtgc

SEQ ID NO: 4918626 - DNA, 18 bp, Homo sapiens
agacttactctaagatct

SEQ ID NO: 4918627 - DNA, 19 bp, Homo sapiens
agacttactttactcattt

SEQ ID NO: 4918628 - DNA, 20 bp, Homo sapiens
agacttactttactcatttt

SEQ ID NO: 4918629 - DNA, 21 bp, Homo sapiens
agacttactttactcattttt

SEQ ID NO: 4918630 - DNA, 16 bp, Homo sapiens
agacttccttgagaca

SEQ ID NO: 4918631 - DNA, 18 bp, Homo sapiens
agacttttaatcagacaa

SEQ ID NO: 4918632 - DNA, 16 bp, Homo sapiens
agagaaaaaaaaaata

SEQ ID NO: 4918633 - DNA, 13 bp, Homo sapiens
agagaaacaaact

SEQ ID NO: 4918634 - DNA, 13 bp, Homo sapiens
agagaaatggcaa

SEQ ID NO: 4918635 - DNA, 13 bp, Homo sapiens
agagaaattctgt

SEQ ID NO: 4918636 - DNA, 17 bp, Homo sapiens
agagaaccgagcaaaga

SEQ ID NO: 4918637 - DNA, 20 bp, Homo sapiens
agagaaccgagcaaagatca

SEQ ID NO: 4918638 - DNA, 15 bp, Homo sapiens
agagaacgcagccct

SEQ ID NO: 4918639 - DNA, 14 bp, Homo sapiens
agagaactgtggcc

SEQ ID NO: 4918640 - DNA, 20 bp, Homo sapiens
agagaagataattgttgaaa

SEQ ID NO: 4918641 - DNA, 17 bp, Homo sapiens
agagaagcggatttcca

SEQ ID NO: 4918642 - DNA, 13 bp, Homo sapiens
agagaagctgctg

SEQ ID NO: 4918643 - DNA, 18 bp, Homo sapiens
agagaatgaaagggccca

SEQ ID NO: 4918644 - DNA, 15 bp, Homo sapiens
agagacatggctttc

SEQ ID NO: 4918645 - DNA, 19 bp, Homo sapiens
agagaccctctgccaccag

SEQ ID NO: 4918646 - DNA, 15 bp, Homo sapiens
agagacctgaagtgt

SEQ ID NO: 4918647 - DNA, 16 bp, Homo sapiens
agagacctgaagtgtg

SEQ ID NO: 4918648 - DNA, 22 bp, Homo sapiens
agagactcccatgaagcctttt

SEQ ID NO: 4918649 - DNA, 15 bp, Homo sapiens
agagactgcgttctg

SEQ ID NO: 4918650 - DNA, 17 bp, Homo sapiens
agagacttttttctagt

SEQ ID NO: 4918651 - DNA, 15 bp, Homo sapiens
agagagaaagccagg

SEQ ID NO: 4918652 - DNA, 22 bp, Homo sapiens
agagagatatatctgaaaactg

SEQ ID NO: 4918653 - DNA, 13 bp, Homo sapiens
agagagccatttt

SEQ ID NO: 4918654 - DNA, 15 bp, Homo sapiens
agagagccattttgt

SEQ ID NO: 4918655 - DNA, 17 bp, Homo sapiens
agagagccattttgtga

SEQ ID NO: 4918656 - DNA, 15 bp, Homo sapiens
agagaggagaggaga

SEQ ID NO: 4918657 - DNA, 20 bp, Homo sapiens
agagaggccttttggaatgt

SEQ ID NO: 4918658 - DNA, 17 bp, Homo sapiens
agagagggaggtatgga

SEQ ID NO: 4918659 - DNA, 22 bp, Homo sapiens
agagatcaaccccttcgctcct

SEQ ID NO: 4918660 - DNA, 15 bp, Homo sapiens
agagatgggagctcc

SEQ ID NO: 4918661 - DNA, 19 bp, Homo sapiens
agagatgggagctcctctc

SEQ ID NO: 4918662 - DNA, 21 bp, Homo sapiens
agagatgggagctcctctcct

SEQ ID NO: 4918663 - DNA, 20 bp, Homo sapiens
agagattctgtgatctttta

SEQ ID NO: 4918664 - DNA, 14 bp, Homo sapiens
agagcaaaattgat

SEQ ID NO: 4918665 - DNA, 20 bp, Homo sapiens
agagcaaaattgatgtgttt

SEQ ID NO: 4918666 - DNA, 17 bp, Homo sapiens
agagcaacctctcactc

SEQ ID NO: 4918667 - DNA, 15 bp, Homo sapiens
agagcacaaacattt

SEQ ID NO: 4918668 - DNA, 17 bp, Homo sapiens
agagcacaaacattttt

SEQ ID NO: 4918669 - DNA, 20 bp, Homo sapiens
agagcacctttgcacaggat

SEQ ID NO: 4918670 - DNA, 21 bp, Homo sapiens
agagcactaggttcaattccc

SEQ ID NO: 4918671 - DNA, 20 bp, Homo sapiens
agagcagaacggagccccag

SEQ ID NO: 4918672 - DNA, 12 bp, Homo sapiens
agagcagatgca

SEQ ID NO: 4918673 - DNA, 14 bp, Homo sapiens
agagcagatgcaga

SEQ ID NO: 4918674 - DNA, 18 bp, Homo sapiens
agagcagctttaaactca

SEQ ID NO: 4918675 - DNA, 20 bp, Homo sapiens
agagcagctttaaactcagg

SEQ ID NO: 4918676 - DNA, 21 bp, Homo sapiens
agagcagctttaaactcaggg

SEQ ID NO: 4918677 - DNA, 18 bp, Homo sapiens
agagcaggaagcattcag

SEQ ID NO: 4918678 - DNA, 12 bp, Homo sapiens
agagcatgaaat

SEQ ID NO: 4918679 - DNA, 14 bp, Homo sapiens
agagcatgaaattt

SEQ ID NO: 4918680 - DNA, 13 bp, Homo sapiens
agagccagcttgg

SEQ ID NO: 4918681 - DNA, 13 bp, Homo sapiens
agagcccaccttg

SEQ ID NO: 4918682 - DNA, 16 bp, Homo sapiens
agagcccagaggtaac

SEQ ID NO: 4918683 - DNA, 13 bp, Homo sapiens
agagcccccagga

SEQ ID NO: 4918684 - DNA, 15 bp, Homo sapiens
agagcccctggggcc

SEQ ID NO: 4918685 - DNA, 19 bp, Homo sapiens
agagcccctggggcctaga

SEQ ID NO: 4918686 - DNA, 15 bp, Homo sapiens
agagcccttcatttg

SEQ ID NO: 4918687 - DNA, 22 bp, Homo sapiens
agagccgggcacattgagctgt

SEQ ID NO: 4918688 - DNA, 21 bp, Homo sapiens
agagcctcccaaggagaacaa

SEQ ID NO: 4918689 - DNA, 13 bp, Homo sapiens
agagcctgatctc

SEQ ID NO: 4918690 - DNA, 15 bp, Homo sapiens
agagcctgcctggag

SEQ ID NO: 4918691 - DNA, 22 bp, Homo sapiens
agagccttctgatgtctctaaa

SEQ ID NO: 4918692 - DNA, 14 bp, Homo sapiens
agagcggtctcagg

SEQ ID NO: 4918693 - DNA, 18 bp, Homo sapiens
agagctaagggtgggtgc

SEQ ID NO: 4918694 - DNA, 15 bp, Homo sapiens
agagctggtgcccgg

SEQ ID NO: 4918695 - DNA, 14 bp, Homo sapiens
agagctgtggagga

SEQ ID NO: 4918696 - DNA, 20 bp, Homo sapiens
agagctgtggaggattgcta

SEQ ID NO: 4918697 - DNA, 21 bp, Homo sapiens
agagctgtttatggcctcagc

SEQ ID NO: 4918698 - DNA, 15 bp, Homo sapiens
agagcttctggcact

SEQ ID NO: 4918699 - DNA, 15 bp, Homo sapiens
agagcttttaaaaat

SEQ ID NO: 4918700 - DNA, 21 bp, Homo sapiens
agaggaacagcactggggagt

SEQ ID NO: 4918701 - DNA, 17 bp, Homo sapiens
agaggaactccttggcc

SEQ ID NO: 4918702 - DNA, 19 bp, Homo sapiens
agaggaactccttggccta

SEQ ID NO: 4918703 - DNA, 21 bp, Homo sapiens
agaggaactccttggcctagc

SEQ ID NO: 4918704 - DNA, 12 bp, Homo sapiens
agaggaactgtc

SEQ ID NO: 4918705 - DNA, 19 bp, Homo sapiens
agaggacagtggattgttt

SEQ ID NO: 4918706 - DNA, 22 bp, Homo sapiens
agaggacctgtatttaagcaaa

SEQ ID NO: 4918707 - DNA, 19 bp, Homo sapiens
agaggactcgcttgtaaat

SEQ ID NO: 4918708 - DNA, 21 bp, Homo sapiens
agaggacttttctttgtggct

SEQ ID NO: 4918709 - DNA, 22 bp, Homo sapiens
agaggacttttctttgtggctt

SEQ ID NO: 4918710 - DNA, 10 bp, Homo sapiens
agaggagaga

SEQ ID NO: 4918711 - DNA, 16 bp, Homo sapiens
agaggagaggagagag

SEQ ID NO: 4918712 - DNA, 17 bp, Homo sapiens
agaggagaggagagagg

SEQ ID NO: 4918713 - DNA, 12 bp, Homo sapiens
agaggagccaga

SEQ ID NO: 4918714 - DNA, 23 bp, Homo sapiens
agaggagcctttttaaaacacat

SEQ ID NO: 4918715 - DNA, 17 bp, Homo sapiens
agaggatgagagcccag

SEQ ID NO: 4918716 - DNA, 18 bp, Homo sapiens
agaggatgagagcccaga

SEQ ID NO: 4918717 - DNA, 15 bp, Homo sapiens
agaggcagagagcgg

SEQ ID NO: 4918718 - DNA, 13 bp, Homo sapiens
agaggcagagcct

SEQ ID NO: 4918719 - DNA, 23 bp, Homo sapiens
agaggcagccccattctgcctgc

SEQ ID NO: 4918720 - DNA, 10 bp, Homo sapiens
agaggcaggg

SEQ ID NO: 4918721 - DNA, 17 bp, Homo sapiens
agaggccagccccaccc

SEQ ID NO: 4918722 - DNA, 23 bp, Homo sapiens
agaggccatggcagaataatctt

SEQ ID NO: 4918723 - DNA, 19 bp, Homo sapiens
agaggccatgggcctcctg

SEQ ID NO: 4918724 - DNA, 19 bp, Homo sapiens
agaggctattattttcact

SEQ ID NO: 4918725 - DNA, 12 bp, Homo sapiens
agaggctgcccc

SEQ ID NO: 4918726 - DNA, 14 bp, Homo sapiens
agagggcttgtgaa

SEQ ID NO: 4918727 - DNA, 22 bp, Homo sapiens
agaggggaacagactggaagca

SEQ ID NO: 4918728 - DNA, 15 bp, Homo sapiens
agaggggactctggg

SEQ ID NO: 4918729 - DNA, 23 bp, Homo sapiens
agagggttttaggtagaaaaaca

SEQ ID NO: 4918730 - DNA, 16 bp, Homo sapiens
agaggtaacagaacag

SEQ ID NO: 4918731 - DNA, 21 bp, Homo sapiens
agaggtacagggtttttacct

SEQ ID NO: 4918732 - DNA, 17 bp, Homo sapiens
agaggtatttatcttta

SEQ ID NO: 4918733 - DNA, 13 bp, Homo sapiens
agaggtccagccc

SEQ ID NO: 4918734 - DNA, 18 bp, Homo sapiens
agaggtccagcccatctc

SEQ ID NO: 4918735 - DNA, 17 bp, Homo sapiens
agaggtcctctggagcc

SEQ ID NO: 4918736 - DNA, 17 bp, Homo sapiens
agaggtgggagggccct

SEQ ID NO: 4918737 - DNA, 19 bp, Homo sapiens
agaggttttgttgttttat

SEQ ID NO: 4918738 - DNA, 14 bp, Homo sapiens
agagtatgaacacc

SEQ ID NO: 4918739 - DNA, 19 bp, Homo sapiens
agagtccaaggtttaaaga

SEQ ID NO: 4918740 - DNA, 12 bp, Homo sapiens
agagtctaaaga

SEQ ID NO: 4918741 - DNA, 14 bp, Homo sapiens
agagtctaaagatg

SEQ ID NO: 4918742 - DNA, 23 bp, Homo sapiens
agagtctaaagatggagtttcta

SEQ ID NO: 4918743 - DNA, 11 bp, Homo sapiens
agagtctagat

SEQ ID NO: 4918744 - DNA, 15 bp, Homo sapiens
agagtctagattcaa

SEQ ID NO: 4918745 - DNA, 21 bp, Homo sapiens
agagtctagattcaaaggttc

SEQ ID NO: 4918746 - DNA, 23 bp, Homo sapiens
agagtctagattcaaaggttcta

SEQ ID NO: 4918747 - DNA, 20 bp, Homo sapiens
agagtctcactgttgcccag

SEQ ID NO: 4918748 - DNA, 21 bp, Homo sapiens
agagtcttccacttcaatgca

SEQ ID NO: 4918749 - DNA, 16 bp, Homo sapiens
agagtgactccaagaa

SEQ ID NO: 4918750 - DNA, 19 bp, Homo sapiens
agagtgagactctgtctca

SEQ ID NO: 4918751 - DNA, 17 bp, Homo sapiens
agagtgataatacaagt

SEQ ID NO: 4918752 - DNA, 18 bp, Homo sapiens
agagtgattgcagcttta

SEQ ID NO: 4918753 - DNA, 16 bp, Homo sapiens
agagtgcacagctgtc

SEQ ID NO: 4918754 - DNA, 18 bp, Homo sapiens
agagtgcattgtgagggt

SEQ ID NO: 4918755 - DNA, 13 bp, Homo sapiens
agagtggcctggc

SEQ ID NO: 4918756 - DNA, 14 bp, Homo sapiens
agagtggcctggcc

SEQ ID NO: 4918757 - DNA, 13 bp, Homo sapiens
agagtggctcctc

SEQ ID NO: 4918758 - DNA, 15 bp, Homo sapiens
agagtggctcctccc

SEQ ID NO: 4918759 - DNA, 23 bp, Homo sapiens
agagtggctcctcccggtgccca

SEQ ID NO: 4918760 - DNA, 18 bp, Homo sapiens
agagtgtagaagcattcc

SEQ ID NO: 4918761 - DNA, 14 bp, Homo sapiens
agagtgtctctgat

SEQ ID NO: 4918762 - DNA, 23 bp, Homo sapiens
agagttaaatagagtatatgcac

SEQ ID NO: 4918763 - DNA, 14 bp, Homo sapiens
agagttaagaagct

SEQ ID NO: 4918764 - DNA, 19 bp, Homo sapiens
agagttgaggaactgtaca

SEQ ID NO: 4918765 - DNA, 18 bp, Homo sapiens
agagtttgtgtgttgtct

SEQ ID NO: 4918766 - DNA, 19 bp, Homo sapiens
agagtttgtgtgttgtctt

SEQ ID NO: 4918767 - DNA, 17 bp, Homo sapiens
agataaaaagtggaatt

SEQ ID NO: 4918768 - DNA, 20 bp, Homo sapiens
agataaatatttgacttgca

SEQ ID NO: 4918769 - DNA, 22 bp, Homo sapiens
agataacacactttttattaga

SEQ ID NO: 4918770 - DNA, 14 bp, Homo sapiens
agataattgctatt

SEQ ID NO: 4918771 - DNA, 17 bp, Homo sapiens
agataattgttgaaatt

SEQ ID NO: 4918772 - DNA, 20 bp, Homo sapiens
agatacatcactgcttgatg

SEQ ID NO: 4918773 - DNA, 13 bp, Homo sapiens
agatacctcaccc

SEQ ID NO: 4918774 - DNA, 13 bp, Homo sapiens
agatactggtgga

SEQ ID NO: 4918775 - DNA, 17 bp, Homo sapiens
agatactttttcttttg

SEQ ID NO: 4918776 - DNA, 16 bp, Homo sapiens
agatagatttggaata

SEQ ID NO: 4918777 - DNA, 13 bp, Homo sapiens
agatagctgcatg

SEQ ID NO: 4918778 - DNA, 14 bp, Homo sapiens
agatagctgcatgt

SEQ ID NO: 4918779 - DNA, 18 bp, Homo sapiens
agatagggctgggcaagg

SEQ ID NO: 4918780 - DNA, 23 bp, Homo sapiens
agatagggctgggcaaggaaaaa

SEQ ID NO: 4918781 - DNA, 11 bp, Homo sapiens
agatagtttat

SEQ ID NO: 4918782 - DNA, 17 bp, Homo sapiens
agatatactttgtggac

SEQ ID NO: 4918783 - DNA, 13 bp, Homo sapiens
agatattgttcaa

SEQ ID NO: 4918784 - DNA, 11 bp, Homo sapiens
agatatttggc

SEQ ID NO: 4918785 - DNA, 21 bp, Homo sapiens
agatattttcacaatgtcagt

SEQ ID NO: 4918786 - DNA, 14 bp, Homo sapiens
agatcaaaataaaa

SEQ ID NO: 4918787 - DNA, 18 bp, Homo sapiens
agatcacgccactgcact

SEQ ID NO: 4918788 - DNA, 15 bp, Homo sapiens
agatcagtgtaccat

SEQ ID NO: 4918789 - DNA, 21 bp, Homo sapiens
agatcagtgtaccatttgcct

SEQ ID NO: 4918790 - DNA, 16 bp, Homo sapiens
agatcataaggcttca

SEQ ID NO: 4918791 - DNA, 23 bp, Homo sapiens
agatcccatgggttgtgtgttta

SEQ ID NO: 4918792 - DNA, 11 bp, Homo sapiens
agatcccctca

SEQ ID NO: 4918793 - DNA, 15 bp, Homo sapiens
agatcccctcaggac

SEQ ID NO: 4918794 - DNA, 21 bp, Homo sapiens
agatcctaagggtcgaaagct

SEQ ID NO: 4918795 - DNA, 21 bp, Homo sapiens
agatcctgtctttaaggaaaa

SEQ ID NO: 4918796 - DNA, 12 bp, Homo sapiens
agatctgtgccc

SEQ ID NO: 4918797 - DNA, 14 bp, Homo sapiens
agatcttagattct

SEQ ID NO: 4918798 - DNA, 16 bp, Homo sapiens
agatctttctccttga

SEQ ID NO: 4918799 - DNA, 22 bp, Homo sapiens
agatgaaagcagggaatttcta

SEQ ID NO: 4918800 - DNA, 21 bp, Homo sapiens
agatgaaataaagacccaggg

SEQ ID NO: 4918801 - DNA, 11 bp, Homo sapiens
agatgaataaa

SEQ ID NO: 4918802 - DNA, 21 bp, Homo sapiens
agatgagcccagccctgttct

SEQ ID NO: 4918803 - DNA, 19 bp, Homo sapiens
agatgagggatgggcctgg

SEQ ID NO: 4918804 - DNA, 22 bp, Homo sapiens
agatgagggatgggcctggcat

SEQ ID NO: 4918805 - DNA, 13 bp, Homo sapiens
agatgatccatga

SEQ ID NO: 4918806 - DNA, 20 bp, Homo sapiens
agatgatgagaatttctaaa

SEQ ID NO: 4918807 - DNA, 16 bp, Homo sapiens
agatgatggatgccaa

SEQ ID NO: 4918808 - DNA, 18 bp, Homo sapiens
agatgattaaataagatt

SEQ ID NO: 4918809 - DNA, 20 bp, Homo sapiens
agatgattaaataagattct

SEQ ID NO: 4918810 - DNA, 21 bp, Homo sapiens
agatgattaaataagattcta

SEQ ID NO: 4918811 - DNA, 13 bp, Homo sapiens
agatgcagagagc

SEQ ID NO: 4918812 - DNA, 17 bp, Homo sapiens
agatgcagagagccatt

SEQ ID NO: 4918813 - DNA, 18 bp, Homo sapiens
agatgcagagagccattt

SEQ ID NO: 4918814 - DNA, 18 bp, Homo sapiens
agatgccattcatagaga

SEQ ID NO: 4918815 - DNA, 12 bp, Homo sapiens
agatgccccaga

SEQ ID NO: 4918816 - DNA, 22 bp, Homo sapiens
agatgcgagcgctatcttcaca

SEQ ID NO: 4918817 - DNA, 23 bp, Homo sapiens
agatgcgtcccaagatgttgatt

SEQ ID NO: 4918818 - DNA, 18 bp, Homo sapiens
agatgctccaagattcta

SEQ ID NO: 4918819 - DNA, 20 bp, Homo sapiens
agatgctccaagattctaga

SEQ ID NO: 4918820 - DNA, 22 bp, Homo sapiens
agatgctccaagattctagatg

SEQ ID NO: 4918821 - DNA, 23 bp, Homo sapiens
agatgctccaagattctagatga

SEQ ID NO: 4918822 - DNA, 23 bp, Homo sapiens
agatgctgactgtactcctccca

SEQ ID NO: 4918823 - DNA, 11 bp, Homo sapiens
agatgctggag

SEQ ID NO: 4918824 - DNA, 20 bp, Homo sapiens
agatgctggagaagagagga

SEQ ID NO: 4918825 - DNA, 20 bp, Homo sapiens
agatgctgtaacttaaaata

SEQ ID NO: 4918826 - DNA, 20 bp, Homo sapiens
agatgctgtgagtctttggt

SEQ ID NO: 4918827 - DNA, 13 bp, Homo sapiens
agatggaatgctg

SEQ ID NO: 4918828 - DNA, 23 bp, Homo sapiens
agatggacagttcacaccctgca

SEQ ID NO: 4918829 - DNA, 13 bp, Homo sapiens
agatggagtttct

SEQ ID NO: 4918830 - DNA, 15 bp, Homo sapiens
agatggagtttctaa

SEQ ID NO: 4918831 - DNA, 17 bp, Homo sapiens
agatggagtttctaagg

SEQ ID NO: 4918832 - DNA, 19 bp, Homo sapiens
agatggctgtgcctctgcc

SEQ ID NO: 4918833 - DNA, 13 bp, Homo sapiens
agatgggagctcc

SEQ ID NO: 4918834 - DNA, 17 bp, Homo sapiens
agatggggataaaatga

SEQ ID NO: 4918835 - DNA, 22 bp, Homo sapiens
agatggtgaagcattctcccca

SEQ ID NO: 4918836 - DNA, 17 bp, Homo sapiens
agatgtaaaaggtatta

SEQ ID NO: 4918837 - DNA, 15 bp, Homo sapiens
agatgtatgaaggct

SEQ ID NO: 4918838 - DNA, 17 bp, Homo sapiens
agatgtatgaaggcttt

SEQ ID NO: 4918839 - DNA, 16 bp, Homo sapiens
agatgtcccttgatgc

SEQ ID NO: 4918840 - DNA, 21 bp, Homo sapiens
agatgtcccttgatgcacaga

SEQ ID NO: 4918841 - DNA, 24 bp, Homo sapiens
agatgtcccttgatgcacagagaa

SEQ ID NO: 4918842 - DNA, 15 bp, Homo sapiens
agatgtgatattcta

SEQ ID NO: 4918843 - DNA, 17 bp, Homo sapiens
agatgtgatattctaag

SEQ ID NO: 4918844 - DNA, 20 bp, Homo sapiens
agatgtgatattctaagact

SEQ ID NO: 4918845 - DNA, 16 bp, Homo sapiens
agatgttgatttttac

SEQ ID NO: 4918846 - DNA, 22 bp, Homo sapiens
agatgttgatttttactgtgtt

SEQ ID NO: 4918847 - DNA, 14 bp, Homo sapiens
agatgttgccatgt

SEQ ID NO: 4918848 - DNA, 17 bp, Homo sapiens
agatgttgccatgtgtt

SEQ ID NO: 4918849 - DNA, 18 bp, Homo sapiens
agatgttgccatgtgttt

SEQ ID NO: 4918850 - DNA, 18 bp, Homo sapiens
agatgtttattcttctag

SEQ ID NO: 4918851 - DNA, 19 bp, Homo sapiens
agatgtttattcttctaga

SEQ ID NO: 4918852 - DNA, 22 bp, Homo sapiens
agatgtttattcttctagagtt

SEQ ID NO: 4918853 - DNA, 14 bp, Homo sapiens
agatgtttccagac

SEQ ID NO: 4918854 - DNA, 23 bp, Homo sapiens
agatgtttccagacttccttgag

SEQ ID NO: 4918855 - DNA, 22 bp, Homo sapiens
agatgttttggtagattaaata

SEQ ID NO: 4918856 - DNA, 13 bp, Homo sapiens
agattaaatatag

SEQ ID NO: 4918857 - DNA, 16 bp, Homo sapiens
agattaaatatagatt

SEQ ID NO: 4918858 - DNA, 16 bp, Homo sapiens
agattaagagccatat

SEQ ID NO: 4918859 - DNA, 18 bp, Homo sapiens
agattaaggtgatgtgat

SEQ ID NO: 4918860 - DNA, 21 bp, Homo sapiens
agattagcaaggtcatttctt

SEQ ID NO: 4918861 - DNA, 14 bp, Homo sapiens
agattatagattct

SEQ ID NO: 4918862 - DNA, 15 bp, Homo sapiens
agattatagattcta

SEQ ID NO: 4918863 - DNA, 18 bp, Homo sapiens
agattatagattctaaag

SEQ ID NO: 4918864 - DNA, 16 bp, Homo sapiens
agattcaaaggttcta

SEQ ID NO: 4918865 - DNA, 17 bp, Homo sapiens
agattcagtcttgcctt

SEQ ID NO: 4918866 - DNA, 19 bp, Homo sapiens
agattccagagagtggctc

SEQ ID NO: 4918867 - DNA, 22 bp, Homo sapiens
agattccagagagtggctcctc

SEQ ID NO: 4918868 - DNA, 23 bp, Homo sapiens
agattccattggtccaagattcc

SEQ ID NO: 4918869 - DNA, 23 bp, Homo sapiens
agattccggatcctaagcatcta

SEQ ID NO: 4918870 - DNA, 14 bp, Homo sapiens
agattctaaagatt

SEQ ID NO: 4918871 - DNA, 10 bp, Homo sapiens
agattctaac

SEQ ID NO: 4918872 - DNA, 14 bp, Homo sapiens
agattctagatgat

SEQ ID NO: 4918873 - DNA, 16 bp, Homo sapiens
agattctatagttcta

SEQ ID NO: 4918874 - DNA, 21 bp, Homo sapiens
agattctctggctgtaaggct

SEQ ID NO: 4918875 - DNA, 16 bp, Homo sapiens
agattctctgtgtcta

SEQ ID NO: 4918876 - DNA, 19 bp, Homo sapiens
agattctctgtgtctaaga

SEQ ID NO: 4918877 - DNA, 14 bp, Homo sapiens
agattctgatttta

SEQ ID NO: 4918878 - DNA, 16 bp, Homo sapiens
agattcttctgtgttt

SEQ ID NO: 4918879 - DNA, 13 bp, Homo sapiens
agattctttttct

SEQ ID NO: 4918880 - DNA, 18 bp, Homo sapiens
agattgaaaatcttgtgt

SEQ ID NO: 4918881 - DNA, 20 bp, Homo sapiens
agattgcaacaggctgggct

SEQ ID NO: 4918882 - DNA, 16 bp, Homo sapiens
agattgccccaggtct

SEQ ID NO: 4918883 - DNA, 12 bp, Homo sapiens
agattgcttctc

SEQ ID NO: 4918884 - DNA, 15 bp, Homo sapiens
agattggcatggctt

SEQ ID NO: 4918885 - DNA, 23 bp, Homo sapiens
agattggcatggctttatttgtt

SEQ ID NO: 4918886 - DNA, 21 bp, Homo sapiens
agattgtccagtgcaaccaca

SEQ ID NO: 4918887 - DNA, 18 bp, Homo sapiens
agattgtgggggaaaaat

SEQ ID NO: 4918888 - DNA, 15 bp, Homo sapiens
agattgttgtttgcc

SEQ ID NO: 4918889 - DNA, 22 bp, Homo sapiens
agattgttgtttgccatacttt

SEQ ID NO: 4918890 - DNA, 17 bp, Homo sapiens
agatttatataaatgta

SEQ ID NO: 4918891 - DNA, 17 bp, Homo sapiens
agatttcaagaaaaaat

SEQ ID NO: 4918892 - DNA, 18 bp, Homo sapiens
agatttcaagaaaaaata

SEQ ID NO: 4918893 - DNA, 12 bp, Homo sapiens
agatttggaata

SEQ ID NO: 4918894 - DNA, 22 bp, Homo sapiens
agatttggaataggaataagct

SEQ ID NO: 4918895 - DNA, 23 bp, Homo sapiens
agatttgtaggaaggtctcattc

SEQ ID NO: 4918896 - DNA, 14 bp, Homo sapiens
agattttattttac

SEQ ID NO: 4918897 - DNA, 12 bp, Homo sapiens
agattttcagaa

SEQ ID NO: 4918898 - DNA, 14 bp, Homo sapiens
agattttcagtcta

SEQ ID NO: 4918899 - DNA, 22 bp, Homo sapiens
agattttctgggcctaaaggat

SEQ ID NO: 4918900 - DNA, 14 bp, Homo sapiens
agattttgataact

SEQ ID NO: 4918901 - DNA, 18 bp, Homo sapiens
agattttgataactgttt

SEQ ID NO: 4918902 - DNA, 14 bp, Homo sapiens
agatttttgcaata

SEQ ID NO: 4918903 - DNA, 16 bp, Homo sapiens
agcaaaaatataaaat

SEQ ID NO: 4918904 - DNA, 14 bp, Homo sapiens
agcaaaagaaaaag

SEQ ID NO: 4918905 - DNA, 13 bp, Homo sapiens
agcaaaattgatg

SEQ ID NO: 4918906 - DNA, 19 bp, Homo sapiens
agcaaaattgatgtgttta

SEQ ID NO: 4918907 - DNA, 22 bp, Homo sapiens
agcaaagaggactcgcttgtaa

SEQ ID NO: 4918908 - DNA, 15 bp, Homo sapiens
agcaaagatcaaaat

SEQ ID NO: 4918909 - DNA, 17 bp, Homo sapiens
agcaaagatcaaaataa

SEQ ID NO: 4918910 - DNA, 21 bp, Homo sapiens
agcaaagctgatgacaacttc

SEQ ID NO: 4918911 - DNA, 16 bp, Homo sapiens
agcaaatgtggctcct

SEQ ID NO: 4918912 - DNA, 14 bp, Homo sapiens
agcaaatttcaaaa

SEQ ID NO: 4918913 - DNA, 19 bp, Homo sapiens
agcaaatttcaaaagacat

SEQ ID NO: 4918914 - DNA, 11 bp, Homo sapiens
agcaacacaga

SEQ ID NO: 4918915 - DNA, 15 bp, Homo sapiens
agcaacacagaggaa

SEQ ID NO: 4918916 - DNA, 13 bp, Homo sapiens
agcaacacagcct

SEQ ID NO: 4918917 - DNA, 18 bp, Homo sapiens
agcaacacagcctgggcc

SEQ ID NO: 4918918 - DNA, 21 bp, Homo sapiens
agcaacacagcctgggcccca

SEQ ID NO: 4918919 - DNA, 19 bp, Homo sapiens
agcaaccgcctcaaaatgt

SEQ ID NO: 4918920 - DNA, 23 bp, Homo sapiens
agcaacctttcacctttgtgtat

SEQ ID NO: 4918921 - DNA, 14 bp, Homo sapiens
agcaactcttgatt

SEQ ID NO: 4918922 - DNA, 17 bp, Homo sapiens
agcaactgttatgaaat

SEQ ID NO: 4918923 - DNA, 16 bp, Homo sapiens
agcaacttcttctcca

SEQ ID NO: 4918924 - DNA, 20 bp, Homo sapiens
agcaagccctacagagctgt

SEQ ID NO: 4918925 - DNA, 15 bp, Homo sapiens
agcaagctggcctct

SEQ ID NO: 4918926 - DNA, 21 bp, Homo sapiens
agcaaggaagatatacatgaa

SEQ ID NO: 4918927 - DNA, 18 bp, Homo sapiens
agcaaggccctgctgccc

SEQ ID NO: 4918928 - DNA, 16 bp, Homo sapiens
agcaaggtcatttctt

SEQ ID NO: 4918929 - DNA, 20 bp, Homo sapiens
agcaaggtcatttcttcagt

SEQ ID NO: 4918930 - DNA, 20 bp, Homo sapiens
agcaagtagataaatatttg

SEQ ID NO: 4918931 - DNA, 17 bp, Homo sapiens
agcaagtgagagagatg

SEQ ID NO: 4918932 - DNA, 20 bp, Homo sapiens
agcaagttctgagagccagg

SEQ ID NO: 4918933 - DNA, 16 bp, Homo sapiens
agcaatatattaccag

SEQ ID NO: 4918934 - DNA, 22 bp, Homo sapiens
agcaatatttatggatgcaaca

SEQ ID NO: 4918935 - DNA, 19 bp, Homo sapiens
agcaatttaactagacaca

SEQ ID NO: 4918936 - DNA, 15 bp, Homo sapiens
agcacaaactttagg

SEQ ID NO: 4918937 - DNA, 19 bp, Homo sapiens
agcacagataaaaagtgga

SEQ ID NO: 4918938 - DNA, 16 bp, Homo sapiens
agcacagattttaatt

SEQ ID NO: 4918939 - DNA, 23 bp, Homo sapiens
agcacagattttaattgtcatgg

SEQ ID NO: 4918940 - DNA, 17 bp, Homo sapiens
agcacagctccctgcca

SEQ ID NO: 4918941 - DNA, 18 bp, Homo sapiens
agcacagctccctgccaa

SEQ ID NO: 4918942 - DNA, 21 bp, Homo sapiens
agcacagcttcatttcctgtg

SEQ ID NO: 4918943 - DNA, 13 bp, Homo sapiens
agcacaggagaca

SEQ ID NO: 4918944 - DNA, 23 bp, Homo sapiens
agcacaggtcccacctccagccc

SEQ ID NO: 4918945 - DNA, 19 bp, Homo sapiens
agcacagtgttaaatgaaa

SEQ ID NO: 4918946 - DNA, 14 bp, Homo sapiens
agcacagtttgaac

SEQ ID NO: 4918947 - DNA, 17 bp, Homo sapiens
agcacatattttctgtt

SEQ ID NO: 4918948 - DNA, 21 bp, Homo sapiens
agcaccgcttttgttctcgca

SEQ ID NO: 4918949 - DNA, 14 bp, Homo sapiens
agcacctcagcctg

SEQ ID NO: 4918950 - DNA, 19 bp, Homo sapiens
agcacctttgcacaggatg

SEQ ID NO: 4918951 - DNA, 15 bp, Homo sapiens
agcacggacaataaa

SEQ ID NO: 4918952 - DNA, 21 bp, Homo sapiens
agcacggacaataaacctccg

SEQ ID NO: 4918953 - DNA, 17 bp, Homo sapiens
agcactactgggtgtca

SEQ ID NO: 4918954 - DNA, 20 bp, Homo sapiens
agcactactgggtgtcattt

SEQ ID NO: 4918955 - DNA, 22 bp, Homo sapiens
agcactactgggtgtcatttca

SEQ ID NO: 4918956 - DNA, 23 bp, Homo sapiens
agcactactgggtgtcatttcat

SEQ ID NO: 4918957 - DNA, 14 bp, Homo sapiens
agcactcgtgtgca

SEQ ID NO: 4918958 - DNA, 16 bp, Homo sapiens
agcactcttaaagcaa

SEQ ID NO: 4918959 - DNA, 20 bp, Homo sapiens
agcactgttgatgtatctga

SEQ ID NO: 4918960 - DNA, 16 bp, Homo sapiens
agcacttccaaaattc

SEQ ID NO: 4918961 - DNA, 12 bp, Homo sapiens
agcacttgtata

SEQ ID NO: 4918962 - DNA, 20 bp, Homo sapiens
agcactttgaaatacctcat

SEQ ID NO: 4918963 - DNA, 21 bp, Homo sapiens
agcactttgaaatacctcatg

SEQ ID NO: 4918964 - DNA, 21 bp, Homo sapiens
agcagaacggagccccaggcc

SEQ ID NO: 4918965 - DNA, 14 bp, Homo sapiens
agcagaaggaaaca

SEQ ID NO: 4918966 - DNA, 16 bp, Homo sapiens
agcagaaggatttttt

SEQ ID NO: 4918967 - DNA, 18 bp, Homo sapiens
agcagaaggattttttaa

SEQ ID NO: 4918968 - DNA, 13 bp, Homo sapiens
agcagagaagggc

SEQ ID NO: 4918969 - DNA, 21 bp, Homo sapiens
agcagagaatgaaagggccca

SEQ ID NO: 4918970 - DNA, 23 bp, Homo sapiens
agcagaggtggccagagctggga

SEQ ID NO: 4918971 - DNA, 17 bp, Homo sapiens
agcagagtgcacagctg

SEQ ID NO: 4918972 - DNA, 17 bp, Homo sapiens
agcagatgcagagagcc

SEQ ID NO: 4918973 - DNA, 21 bp, Homo sapiens
agcagatgcagagagccattt

SEQ ID NO: 4918974 - DNA, 22 bp, Homo sapiens
agcagattgtttcctcttccaa

SEQ ID NO: 4918975 - DNA, 13 bp, Homo sapiens
agcagcagcaggt

SEQ ID NO: 4918976 - DNA, 12 bp, Homo sapiens
agcagcaggtga

SEQ ID NO: 4918977 - DNA, 13 bp, Homo sapiens
agcagcccaaatt

SEQ ID NO: 4918978 - DNA, 13 bp, Homo sapiens
agcagcctgagca

SEQ ID NO: 4918979 - DNA, 13 bp, Homo sapiens
agcagcctgtggc

SEQ ID NO: 4918980 - DNA, 14 bp, Homo sapiens
agcagcctgtggca

SEQ ID NO: 4918981 - DNA, 18 bp, Homo sapiens
agcagcgaccgccccctc

SEQ ID NO: 4918982 - DNA, 20 bp, Homo sapiens
agcagctagaaaacattttt

SEQ ID NO: 4918983 - DNA, 14 bp, Homo sapiens
agcaggacctccct

SEQ ID NO: 4918984 - DNA, 12 bp, Homo sapiens
agcaggagacga

SEQ ID NO: 4918985 - DNA, 15 bp, Homo sapiens
agcaggagagaaatt

SEQ ID NO: 4918986 - DNA, 15 bp, Homo sapiens
agcaggagattgaga

SEQ ID NO: 4918987 - DNA, 13 bp, Homo sapiens
agcaggagtggtg

SEQ ID NO: 4918988 - DNA, 18 bp, Homo sapiens
agcaggccaaggtctgag

SEQ ID NO: 4918989 - DNA, 15 bp, Homo sapiens
agcagggaaacagct

SEQ ID NO: 4918990 - DNA, 12 bp, Homo sapiens
agcagggaaggc

SEQ ID NO: 4918991 - DNA, 17 bp, Homo sapiens
agcagggaaggcctgac

SEQ ID NO: 4918992 - DNA, 13 bp, Homo sapiens
agcagggctcagc

SEQ ID NO: 4918993 - DNA, 22 bp, Homo sapiens
agcagggctcagcggggacagc

SEQ ID NO: 4918994 - DNA, 21 bp, Homo sapiens
agcaggggctacaagagggaa

SEQ ID NO: 4918995 - DNA, 18 bp, Homo sapiens
agcagggtcgggaaaggc

SEQ ID NO: 4918996 - DNA, 19 bp, Homo sapiens
agcaggtgattggaccagg

SEQ ID NO: 4918997 - DNA, 17 bp, Homo sapiens
agcaggtttttctcctc

SEQ ID NO: 4918998 - DNA, 15 bp, Homo sapiens
agcagtccatgcatg

SEQ ID NO: 4918999 - DNA, 15 bp, Homo sapiens
agcagtccctgagac

SEQ ID NO: 4919000 - DNA, 19 bp, Homo sapiens
agcagtcctgcctcagcct

SEQ ID NO: 4919001 - DNA, 16 bp, Homo sapiens
agcagtgagaaaaagc

SEQ ID NO: 4919002 - DNA, 21 bp, Homo sapiens
agcagtgagaaaaagctcctg

SEQ ID NO: 4919003 - DNA, 13 bp, Homo sapiens
agcagtgagcaga

SEQ ID NO: 4919004 - DNA, 19 bp, Homo sapiens
agcagtgtgaagtacaata

SEQ ID NO: 4919005 - DNA, 12 bp, Homo sapiens
agcagttctgtt

SEQ ID NO: 4919006 - DNA, 14 bp, Homo sapiens
agcatagatgtttt

SEQ ID NO: 4919007 - DNA, 18 bp, Homo sapiens
agcatagcttattattga

SEQ ID NO: 4919008 - DNA, 14 bp, Homo sapiens
agcatatagagatg

SEQ ID NO: 4919009 - DNA, 20 bp, Homo sapiens
agcatatgggttagatgttg

SEQ ID NO: 4919010 - DNA, 15 bp, Homo sapiens
agcatcacctgcctg

SEQ ID NO: 4919011 - DNA, 22 bp, Homo sapiens
agcatcactccccaaggaagag

SEQ ID NO: 4919012 - DNA, 23 bp, Homo sapiens
agaaaatattatgtgtttccata

SEQ ID NO: 4919013 - DNA, 14 bp, Homo sapiens
agaaacaataaaga

SEQ ID NO: 4919014 - DNA, 11 bp, Homo sapiens
agaaacactgc

SEQ ID NO: 4919015 - DNA, 13 bp, Homo sapiens
agaaacactgcct

SEQ ID NO: 4919016 - DNA, 15 bp, Homo sapiens
agaaacactttctct

SEQ ID NO: 4919017 - DNA, 13 bp, Homo sapiens
agaaacatgacac

SEQ ID NO: 4919018 - DNA, 17 bp, Homo sapiens
agaaacatgacactgac

SEQ ID NO: 4919019 - DNA, 18 bp, Homo sapiens
agaaacccaagctcctcc

SEQ ID NO: 4919020 - DNA, 15 bp, Homo sapiens
agaaacgcatccagc

SEQ ID NO: 4919021 - DNA, 18 bp, Homo sapiens
agaaacgtcttctaaact

SEQ ID NO: 4919022 - DNA, 15 bp, Homo sapiens
agaaactttatacat

SEQ ID NO: 4919023 - DNA, 22 bp, Homo sapiens
agaaactttatacattagtaaa

SEQ ID NO: 4919024 - DNA, 13 bp, Homo sapiens
agaaacttttgta

SEQ ID NO: 4919025 - DNA, 17 bp, Homo sapiens
agaaacttttgtaaaga

SEQ ID NO: 4919026 - DNA, 23 bp, Homo sapiens
agaaacttttgtaaagaaattta

SEQ ID NO: 4919027 - DNA, 16 bp, Homo sapiens
agaaagaaaatgaaga

SEQ ID NO: 4919028 - DNA, 12 bp, Homo sapiens
agaaagaaggaa

SEQ ID NO: 4919029 - DNA, 12 bp, Homo sapiens
agaaagcagggg

SEQ ID NO: 4919030 - DNA, 14 bp, Homo sapiens
agaaagcaggggct

SEQ ID NO: 4919031 - DNA, 15 bp, Homo sapiens
agaaagccaggcagg

SEQ ID NO: 4919032 - DNA, 20 bp, Homo sapiens
agaaagctggtaaactattt

SEQ ID NO: 4919033 - DNA, 20 bp, Homo sapiens
agaaaggaaaacctgaagac

SEQ ID NO: 4919034 - DNA, 20 bp, Homo sapiens
agaaaggaggggatagagag

SEQ ID NO: 4919035 - DNA, 15 bp, Homo sapiens
agaaaggcctgcaca

SEQ ID NO: 4919036 - DNA, 16 bp, Homo sapiens
agaaaggcctgcacac

SEQ ID NO: 4919037 - DNA, 16 bp, Homo sapiens
agaaaggttctgcccg

SEQ ID NO: 4919038 - DNA, 13 bp, Homo sapiens
agaaagtttagaa

SEQ ID NO: 4919039 - DNA, 13 bp, Homo sapiens
agaaataaaagtg

SEQ ID NO: 4919040 - DNA, 17 bp, Homo sapiens
agaaataagtggttatt

SEQ ID NO: 4919041 - DNA, 22 bp, Homo sapiens
agaaataagtggttatttctca

SEQ ID NO: 4919042 - DNA, 21 bp, Homo sapiens
agaaatactataacatatgta

SEQ ID NO: 4919043 - DNA, 23 bp, Homo sapiens
agaaatagtttgagaaatgcata

SEQ ID NO: 4919044 - DNA, 18 bp, Homo sapiens
agaaatatatatacatat

SEQ ID NO: 4919045 - DNA, 19 bp, Homo sapiens
agaaatatatatacatatg

SEQ ID NO: 4919046 - DNA, 15 bp, Homo sapiens
agaaatatgtgagat

SEQ ID NO: 4919047 - DNA, 18 bp, Homo sapiens
agaaatcagtaatattta

SEQ ID NO: 4919048 - DNA, 21 bp, Homo sapiens
agaaatccatatcttaaagaa

SEQ ID NO: 4919049 - DNA, 18 bp, Homo sapiens
agaaatcctgcaatgaaa

SEQ ID NO: 4919050 - DNA, 22 bp, Homo sapiens
agaaatctggtcttgttagaaa

SEQ ID NO: 4919051 - DNA, 16 bp, Homo sapiens
agaaatgaacattcca

SEQ ID NO: 4919052 - DNA, 17 bp, Homo sapiens
agaaatgactaattagg

SEQ ID NO: 4919053 - DNA, 23 bp, Homo sapiens
agaaatgcatatgtcactagaat

SEQ ID NO: 4919054 - DNA, 12 bp, Homo sapiens
agaaatgctttg

SEQ ID NO: 4919055 - DNA, 17 bp, Homo sapiens
agaaatgtaaactgcca

SEQ ID NO: 4919056 - DNA, 15 bp, Homo sapiens
agaaatgtagttgat

SEQ ID NO: 4919057 - DNA, 17 bp, Homo sapiens
agaaattagaaacctta

SEQ ID NO: 4919058 - DNA, 13 bp, Homo sapiens
agaaattctgtta

SEQ ID NO: 4919059 - DNA, 19 bp, Homo sapiens
agaaattctgttaaaatct

SEQ ID NO: 4919060 - DNA, 15 bp, Homo sapiens
agaaattggctggat

SEQ ID NO: 4919061 - DNA, 19 bp, Homo sapiens
agaaatttactatatatat

SEQ ID NO: 4919062 - DNA, 14 bp, Homo sapiens
agaaatttttatca

SEQ ID NO: 4919063 - DNA, 16 bp, Homo sapiens
agaacaaagctgttaa

SEQ ID NO: 4919064 - DNA, 12 bp, Homo sapiens
agaacaaatatt

SEQ ID NO: 4919065 - DNA, 24 bp, Homo sapiens
agaacaaatattcagaatattcat

SEQ ID NO: 4919066 - DNA, 13 bp, Homo sapiens
agaacaattgtcc

SEQ ID NO: 4919067 - DNA, 18 bp, Homo sapiens
agaacacggctcacgctt

SEQ ID NO: 4919068 - DNA, 20 bp, Homo sapiens
agaacactaactcaccagcc

SEQ ID NO: 4919069 - DNA, 19 bp, Homo sapiens
agaacagataatcagtgtg

SEQ ID NO: 4919070 - DNA, 22 bp, Homo sapiens
agaacagcttcaggttatcgaa

SEQ ID NO: 4919071 - DNA, 17 bp, Homo sapiens
agaacagtatctttgca

SEQ ID NO: 4919072 - DNA, 22 bp, Homo sapiens
agaacagtatctttgcactcca

SEQ ID NO: 4919073 - DNA, 14 bp, Homo sapiens
agaacatcattaga

SEQ ID NO: 4919074 - DNA, 20 bp, Homo sapiens
agaacatcattagaacaaag

SEQ ID NO: 4919075 - DNA, 23 bp, Homo sapiens
agaacatctttgacactctgcag

SEQ ID NO: 4919076 - DNA, 17 bp, Homo sapiens
agaaccaaagctcaaat

SEQ ID NO: 4919077 - DNA, 20 bp, Homo sapiens
agaacccagggctctgcccc

SEQ ID NO: 4919078 - DNA, 21 bp, Homo sapiens
agaacccagggctctgcccca

SEQ ID NO: 4919079 - DNA, 15 bp, Homo sapiens
agaaccgagcaaaga

SEQ ID NO: 4919080 - DNA, 20 bp, Homo sapiens
agaaccgagcaaagatcaaa

SEQ ID NO: 4919081 - DNA, 18 bp, Homo sapiens
agaacgaggattttaatt

SEQ ID NO: 4919082 - DNA, 21 bp, Homo sapiens
agaacggagccccaggcctct

SEQ ID NO: 4919083 - DNA, 20 bp, Homo sapiens
agaacgtattttaaaagcca

SEQ ID NO: 4919084 - DNA, 23 bp, Homo sapiens
agaacgtattttaaaagccacat

SEQ ID NO: 4919085 - DNA, 15 bp, Homo sapiens
agaactaaatgttct

SEQ ID NO: 4919086 - DNA, 19 bp, Homo sapiens
agaactatatgtgaatcct

SEQ ID NO: 4919087 - DNA, 21 bp, Homo sapiens
agaactatatgtgaatcctct

SEQ ID NO: 4919088 - DNA, 19 bp, Homo sapiens
agaactcactggggcctac

SEQ ID NO: 4919089 - DNA, 11 bp, Homo sapiens
agaactcctga

SEQ ID NO: 4919090 - DNA, 20 bp, Homo sapiens
agaactctgggctgctaccc

SEQ ID NO: 4919091 - DNA, 18 bp, Homo sapiens
agaacttgaatgtgtcag

SEQ ID NO: 4919092 - DNA, 22 bp, Homo sapiens
agaacttttttaaataaacttt

SEQ ID NO: 4919093 - DNA, 21 bp, Homo sapiens
agaagaaaaaaacgaaaacag

SEQ ID NO: 4919094 - DNA, 13 bp, Homo sapiens
agaagaaaagaga

SEQ ID NO: 4919095 - DNA, 12 bp, Homo sapiens
agaagaaaattc

SEQ ID NO: 4919096 - DNA, 14 bp, Homo sapiens
agaagaaagactct

SEQ ID NO: 4919097 - DNA, 15 bp, Homo sapiens
agaagaaagactcta

SEQ ID NO: 4919098 - DNA, 15 bp, Homo sapiens
agaagaagaaaaaaa

SEQ ID NO: 4919099 - DNA, 18 bp, Homo sapiens
agaagacaccagagcaga

SEQ ID NO: 4919100 - DNA, 19 bp, Homo sapiens
agaagacaccagagcagat

SEQ ID NO: 4919101 - DNA, 22 bp, Homo sapiens
agaagacaccagagcagatgca

SEQ ID NO: 4919102 - DNA, 17 bp, Homo sapiens
agaagagaagctgctga

SEQ ID NO: 4919103 - DNA, 18 bp, Homo sapiens
agaagagactctttgcat

SEQ ID NO: 4919104 - DNA, 15 bp, Homo sapiens
agaagagaggggaag

SEQ ID NO: 4919105 - DNA, 16 bp, Homo sapiens
agaagagttgaggaac

SEQ ID NO: 4919106 - DNA, 22 bp, Homo sapiens
agaagagttgaggaactgtaca

SEQ ID NO: 4919107 - DNA, 23 bp, Homo sapiens
agaagagttgaggaactgtacag

SEQ ID NO: 4919108 - DNA, 17 bp, Homo sapiens
agaagatgatcagacct

SEQ ID NO: 4919109 - DNA, 22 bp, Homo sapiens
agaagatgttgaagaatacagt

SEQ ID NO: 4919110 - DNA, 13 bp, Homo sapiens
agaagcagagaga

SEQ ID NO: 4919111 - DNA, 13 bp, Homo sapiens
agaagcattcctt

SEQ ID NO: 4919112 - DNA, 17 bp, Homo sapiens
agaagcattccttcttt

SEQ ID NO: 4919113 - DNA, 20 bp, Homo sapiens
agaagcattccttctttgat

SEQ ID NO: 4919114 - DNA, 23 bp, Homo sapiens
agaagcattccttctttgataat

SEQ ID NO: 4919115 - DNA, 19 bp, Homo sapiens
agaagcatttgtattttgt

SEQ ID NO: 4919116 - DNA, 23 bp, Homo sapiens
agaagcatttgtattttgtgtga

SEQ ID NO: 4919117 - DNA, 13 bp, Homo sapiens
agaagccctgatg

SEQ ID NO: 4919118 - DNA, 20 bp, Homo sapiens
agaagcctcgttttgatgcc

SEQ ID NO: 4919119 - DNA, 13 bp, Homo sapiens
agaagcctctggc

SEQ ID NO: 4919120 - DNA, 16 bp, Homo sapiens
agaagcctctggctag

SEQ ID NO: 4919121 - DNA, 12 bp, Homo sapiens
agaagccttcag

SEQ ID NO: 4919122 - DNA, 19 bp, Homo sapiens
agaagccttcagctccagg

SEQ ID NO: 4919123 - DNA, 16 bp, Homo sapiens
agaagcggatttccag

SEQ ID NO: 4919124 - DNA, 20 bp, Homo sapiens
agaagctgctccaggcctgc

SEQ ID NO: 4919125 - DNA, 14 bp, Homo sapiens
agaagctgctgacc

SEQ ID NO: 4919126 - DNA, 19 bp, Homo sapiens
agaagctgttgtacattta

SEQ ID NO: 4919127 - DNA, 17 bp, Homo sapiens
agaagcttcagaagttt

SEQ ID NO: 4919128 - DNA, 17 bp, Homo sapiens
agaaggaagtgaagagg

SEQ ID NO: 4919129 - DNA, 14 bp, Homo sapiens
agaaggagagaaag

SEQ ID NO: 4919130 - DNA, 13 bp, Homo sapiens
agaaggcagccac

SEQ ID NO: 4919131 - DNA, 15 bp, Homo sapiens
agaaggtggaccttt

SEQ ID NO: 4919132 - DNA, 24 bp, Homo sapiens
agaaggtggaccttttaaagtgtt

SEQ ID NO: 4919133 - DNA, 19 bp, Homo sapiens
agaagtagattaagagcca

SEQ ID NO: 4919134 - DNA, 15 bp, Homo sapiens
agaagtgcatttctg

SEQ ID NO: 4919135 - DNA, 16 bp, Homo sapiens
agaagtttcccttcct

SEQ ID NO: 4919136 - DNA, 22 bp, Homo sapiens
agaagtttgtccatttgtaaaa

SEQ ID NO: 4919137 - DNA, 15 bp, Homo sapiens
agaataaaaggtagt

SEQ ID NO: 4919138 - DNA, 15 bp, Homo sapiens
agaataagaaaacaa

SEQ ID NO: 4919139 - DNA, 16 bp, Homo sapiens
agaataagagaaagaa

SEQ ID NO: 4919140 - DNA, 21 bp, Homo sapiens
agaataagagaaagaaaatga

SEQ ID NO: 4919141 - DNA, 15 bp, Homo sapiens
agaataaggcaggca

SEQ ID NO: 4919142 - DNA, 16 bp, Homo sapiens
agaataatctttgggt

SEQ ID NO: 4919143 - DNA, 14 bp, Homo sapiens
agaataatgttcta

SEQ ID NO: 4919144 - DNA, 19 bp, Homo sapiens
agaataatgttctattgtg

SEQ ID NO: 4919145 - DNA, 17 bp, Homo sapiens
agaatagccacatttgg

SEQ ID NO: 4919146 - DNA, 19 bp, Homo sapiens
agaatagccacatttggaa

SEQ ID NO: 4919147 - DNA, 20 bp, Homo sapiens
agaatagccacatttggaat

SEQ ID NO: 4919148 - DNA, 18 bp, Homo sapiens
agaataggcattaacaca

SEQ ID NO: 4919149 - DNA, 19 bp, Homo sapiens
agaataggcattaacacaa

SEQ ID NO: 4919150 - DNA, 11 bp, Homo sapiens
agaatatatat

SEQ ID NO: 4919151 - DNA, 12 bp, Homo sapiens
agaatatattta

SEQ ID NO: 4919152 - DNA, 13 bp, Homo sapiens
agaatatgtttcc

SEQ ID NO: 4919153 - DNA, 18 bp, Homo sapiens
agaatattcagagaatat

SEQ ID NO: 4919154 - DNA, 13 bp, Homo sapiens
agaatcattacct

SEQ ID NO: 4919155 - DNA, 18 bp, Homo sapiens
agaatccacatttctaaa

SEQ ID NO: 4919156 - DNA, 20 bp, Homo sapiens
agaatccacatttctaaaat

SEQ ID NO: 4919157 - DNA, 22 bp, Homo sapiens
agaatccacatttctaaaatct

SEQ ID NO: 4919158 - DNA, 18 bp, Homo sapiens
agaatcccaaatttgatt

SEQ ID NO: 4919159 - DNA, 15 bp, Homo sapiens
agaatctattttcta

SEQ ID NO: 4919160 - DNA, 16 bp, Homo sapiens
agaatgaaagggccca

SEQ ID NO: 4919161 - DNA, 16 bp, Homo sapiens
agaatgagcacccatt

SEQ ID NO: 4919162 - DNA, 14 bp, Homo sapiens
agaatgatttcatg

SEQ ID NO: 4919163 - DNA, 16 bp, Homo sapiens
agaatgcacagatata

SEQ ID NO: 4919164 - DNA, 17 bp, Homo sapiens
agaatgcacagatatac

SEQ ID NO: 4919165 - DNA, 17 bp, Homo sapiens
agaatgtaaaagaactt

SEQ ID NO: 4919166 - DNA, 16 bp, Homo sapiens
agaatgtatctgtgaa

SEQ ID NO: 4919167 - DNA, 14 bp, Homo sapiens
agaattagattata

SEQ ID NO: 4919168 - DNA, 17 bp, Homo sapiens
agaattagtgccagaat

SEQ ID NO: 4919169 - DNA, 22 bp, Homo sapiens
agaattagtgccagaattttag

SEQ ID NO: 4919170 - DNA, 19 bp, Homo sapiens
agaattatttttaaaaaga

SEQ ID NO: 4919171 - DNA, 23 bp, Homo sapiens
agaattatttttaaaaagaaatc

SEQ ID NO: 4919172 - DNA, 18 bp, Homo sapiens
agaattctgtattggata

SEQ ID NO: 4919173 - DNA, 23 bp, Homo sapiens
agaattgctgaagggcattcttt

SEQ ID NO: 4919174 - DNA, 16 bp, Homo sapiens
agaattggctcaataa

SEQ ID NO: 4919175 - DNA, 21 bp, Homo sapiens
agaatttatcacacttctgtg

SEQ ID NO: 4919176 - DNA, 16 bp, Homo sapiens
agaatttctaccattt

SEQ ID NO: 4919177 - DNA, 21 bp, Homo sapiens
agaatttctaccatttcagag

SEQ ID NO: 4919178 - DNA, 22 bp, Homo sapiens
agaatttcttggtaagaagccg

SEQ ID NO: 4919179 - DNA, 15 bp, Homo sapiens
agaatttggaaatcc

SEQ ID NO: 4919180 - DNA, 16 bp, Homo sapiens
agaatttggaaatcct

SEQ ID NO: 4919181 - DNA, 13 bp, Homo sapiens
agaattttaggaa

SEQ ID NO: 4919182 - DNA, 22 bp, Homo sapiens
agaattttaggaacttcagaga

SEQ ID NO: 4919183 - DNA, 22 bp, Homo sapiens
agaattttcctgagacaaattt

SEQ ID NO: 4919184 - DNA, 23 bp, Homo sapiens
agaattttcctgagacaaatttt

SEQ ID NO: 4919185 - DNA, 18 bp, Homo sapiens
agacaaaaagacaaacat

SEQ ID NO: 4919186 - DNA, 19 bp, Homo sapiens
agacaaacacctcccagga

SEQ ID NO: 4919187 - DNA, 18 bp, Homo sapiens
agacaaaggttttcctct

SEQ ID NO: 4919188 - DNA, 18 bp, Homo sapiens
agacaaatcaacagaagc

SEQ ID NO: 4919189 - DNA, 15 bp, Homo sapiens
agacaacagaagtca

SEQ ID NO: 4919190 - DNA, 13 bp, Homo sapiens
agacaagaaatcc

SEQ ID NO: 4919191 - DNA, 18 bp, Homo sapiens
agacaagaaatccctgtt

SEQ ID NO: 4919192 - DNA, 17 bp, Homo sapiens
agacaagatattgtaca

SEQ ID NO: 4919193 - DNA, 21 bp, Homo sapiens
agacaagatattgtacataaa

SEQ ID NO: 4919194 - DNA, 20 bp, Homo sapiens
agacaagtgactgtatctgt

SEQ ID NO: 4919195 - DNA, 22 bp, Homo sapiens
agacaagttccatgggatacaa

SEQ ID NO: 4919196 - DNA, 15 bp, Homo sapiens
agacaatatacaagc

SEQ ID NO: 4919197 - DNA, 22 bp, Homo sapiens
agacaatcattgttttgaatat

SEQ ID NO: 4919198 - DNA, 23 bp, Homo sapiens
agacaatcattgttttgaatatt

SEQ ID NO: 4919199 - DNA, 16 bp, Homo sapiens
agacaatttgatacat

SEQ ID NO: 4919200 - DNA, 13 bp, Homo sapiens
agacaatttgcac

SEQ ID NO: 4919201 - DNA, 18 bp, Homo sapiens
agacaatttgcacatctt

SEQ ID NO: 4919202 - DNA, 19 bp, Homo sapiens
agacacaactatttttcca

SEQ ID NO: 4919203 - DNA, 10 bp, Homo sapiens
agacacacac

SEQ ID NO: 4919204 - DNA, 11 bp, Homo sapiens
agacacacaca

SEQ ID NO: 4919205 - DNA, 12 bp, Homo sapiens
agacacacacac

SEQ ID NO: 4919206 - DNA, 18 bp, Homo sapiens
agacacacacacgcacgc

SEQ ID NO: 4919207 - DNA, 15 bp, Homo sapiens
agacacagataataa

SEQ ID NO: 4919208 - DNA, 21 bp, Homo sapiens
agacacaggcccggctccagg

SEQ ID NO: 4919209 - DNA, 14 bp, Homo sapiens
agacacatttaagg

SEQ ID NO: 4919210 - DNA, 18 bp, Homo sapiens
agacaccaaagttctaat

SEQ ID NO: 4919211 - DNA, 15 bp, Homo sapiens
agacaccagagcaga

SEQ ID NO: 4919212 - DNA, 21 bp, Homo sapiens
agacaccctcaacctcttctg

SEQ ID NO: 4919213 - DNA, 17 bp, Homo sapiens
agacaccttgacagggc

SEQ ID NO: 4919214 - DNA, 22 bp, Homo sapiens
agacaccttgacagggcacacc

SEQ ID NO: 4919215 - DNA, 13 bp, Homo sapiens
agacactgcctgg

SEQ ID NO: 4919216 - DNA, 15 bp, Homo sapiens
agacactgcctgggc

SEQ ID NO: 4919217 - DNA, 17 bp, Homo sapiens
agacagaacccctacat

SEQ ID NO: 4919218 - DNA, 17 bp, Homo sapiens
agacagaacttgaatgt

SEQ ID NO: 4919219 - DNA, 16 bp, Homo sapiens
agacagaagtctcctc

SEQ ID NO: 4919220 - DNA, 17 bp, Homo sapiens
agacagaatgtatctgt

SEQ ID NO: 4919221 - DNA, 18 bp, Homo sapiens
agacagaatgtatctgtg

SEQ ID NO: 4919222 - DNA, 14 bp, Homo sapiens
agacagatgcccca

SEQ ID NO: 4919223 - DNA, 17 bp, Homo sapiens
agacagccccagagcag

SEQ ID NO: 4919224 - DNA, 20 bp, Homo sapiens
agacagccccagagcagggt

SEQ ID NO: 4919225 - DNA, 19 bp, Homo sapiens
agacagctgatacttcatt

SEQ ID NO: 4919226 - DNA, 20 bp, Homo sapiens
agacaggcaagcacctcctg

SEQ ID NO: 4919227 - DNA, 23 bp, Homo sapiens
agacaggcaagcacctcctgcct

SEQ ID NO: 4919228 - DNA, 14 bp, Homo sapiens
agacagttcaagaa

SEQ ID NO: 4919229 - DNA, 20 bp, Homo sapiens
agacagtttcttagcttttt

SEQ ID NO: 4919230 - DNA, 22 bp, Homo sapiens
agacagtttcttagctttttaa

SEQ ID NO: 4919231 - DNA, 18 bp, Homo sapiens
agacagtttgtaaatgtt

SEQ ID NO: 4919232 - DNA, 11 bp, Homo sapiens
agacataaagc

SEQ ID NO: 4919233 - DNA, 20 bp, Homo sapiens
agacataacgtttttccttt

SEQ ID NO: 4919234 - DNA, 20 bp, Homo sapiens
actggccccggatcagagca

SEQ ID NO: 4919235 - DNA, 21 bp, Homo sapiens
actggccccggatcagagcag

SEQ ID NO: 4919236 - DNA, 15 bp, Homo sapiens
actggcccctgggtc

SEQ ID NO: 4919237 - DNA, 17 bp, Homo sapiens
actggcccctgggtcag

SEQ ID NO: 4919238 - DNA, 16 bp, Homo sapiens
actgggatgagccgct

SEQ ID NO: 4919239 - DNA, 21 bp, Homo sapiens
actgggcctgttgccctttct

SEQ ID NO: 4919240 - DNA, 17 bp, Homo sapiens
actggggatgtgggagg

SEQ ID NO: 4919241 - DNA, 13 bp, Homo sapiens
actggggcctcca

SEQ ID NO: 4919242 - DNA, 16 bp, Homo sapiens
actggggcctccagaa

SEQ ID NO: 4919243 - DNA, 21 bp, Homo sapiens
actggggtgggaggtcttgct

SEQ ID NO: 4919244 - DNA, 21 bp, Homo sapiens
actgggtaaatgcaaagttct

SEQ ID NO: 4919245 - DNA, 17 bp, Homo sapiens
actgggtacttgtggac

SEQ ID NO: 4919246 - DNA, 18 bp, Homo sapiens
actgggtacttgtggaca

SEQ ID NO: 4919247 - DNA, 20 bp, Homo sapiens
actgggtacttgtggacaca

SEQ ID NO: 4919248 - DNA, 14 bp, Homo sapiens
actgggtgtcattt

SEQ ID NO: 4919249 - DNA, 20 bp, Homo sapiens
actgggtgtcatttcattcc

SEQ ID NO: 4919250 - DNA, 14 bp, Homo sapiens
actggtttgagatt

SEQ ID NO: 4919251 - DNA, 17 bp, Homo sapiens
actgtaacatattctgt

SEQ ID NO: 4919252 - DNA, 18 bp, Homo sapiens
actgtaataatacctcaa

SEQ ID NO: 4919253 - DNA, 12 bp, Homo sapiens
actgtaatttag

SEQ ID NO: 4919254 - DNA, 14 bp, Homo sapiens
actgtactcctccc

SEQ ID NO: 4919255 - DNA, 15 bp, Homo sapiens
actgtactcctccca

SEQ ID NO: 4919256 - DNA, 20 bp, Homo sapiens
actgtagaatgatttcatgc

SEQ ID NO: 4919257 - DNA, 15 bp, Homo sapiens
actgtatagacagtt

SEQ ID NO: 4919258 - DNA, 18 bp, Homo sapiens
actgtatagacagtttgt

SEQ ID NO: 4919259 - DNA, 22 bp, Homo sapiens
actgtatagacagtttgtaaat

SEQ ID NO: 4919260 - DNA, 14 bp, Homo sapiens
actgtatctgtgta

SEQ ID NO: 4919261 - DNA, 17 bp, Homo sapiens
actgtcaccctccacct

SEQ ID NO: 4919262 - DNA, 24 bp, Homo sapiens
actgtcactcattgctgagcctct

SEQ ID NO: 4919263 - DNA, 18 bp, Homo sapiens
actgtcctacccaccctc

SEQ ID NO: 4919264 - DNA, 17 bp, Homo sapiens
actgtcctctcccctcc

SEQ ID NO: 4919265 - DNA, 12 bp, Homo sapiens
actgtctcactg

SEQ ID NO: 4919266 - DNA, 17 bp, Homo sapiens
actgtctttaaaagaga

SEQ ID NO: 4919267 - DNA, 18 bp, Homo sapiens
actgtctttaaaagagag

SEQ ID NO: 4919268 - DNA, 21 bp, Homo sapiens
actgtgcaggtgctattgtta

SEQ ID NO: 4919269 - DNA, 16 bp, Homo sapiens
actgtgcatagtgctg

SEQ ID NO: 4919270 - DNA, 19 bp, Homo sapiens
actgtggcacttgcctggg

SEQ ID NO: 4919271 - DNA, 20 bp, Homo sapiens
actgtggcacttgcctgggt

SEQ ID NO: 4919272 - DNA, 22 bp, Homo sapiens
actgtgtactgtatagacagtt

SEQ ID NO: 4919273 - DNA, 18 bp, Homo sapiens
actgtgtcataaacagat

SEQ ID NO: 4919274 - DNA, 14 bp, Homo sapiens
actgtgttcattag

SEQ ID NO: 4919275 - DNA, 17 bp, Homo sapiens
actgtgttttataaaat

SEQ ID NO: 4919276 - DNA, 20 bp, Homo sapiens
actgttacctaaagtatttt

SEQ ID NO: 4919277 - DNA, 20 bp, Homo sapiens
actgttagaaaatggacact

SEQ ID NO: 4919278 - DNA, 13 bp, Homo sapiens
actgttagcactg

SEQ ID NO: 4919279 - DNA, 15 bp, Homo sapiens
actgttagcactgtt

SEQ ID NO: 4919280 - DNA, 17 bp, Homo sapiens
actgttagcactgttga

SEQ ID NO: 4919281 - DNA, 13 bp, Homo sapiens
actgttagctttt

SEQ ID NO: 4919282 - DNA, 19 bp, Homo sapiens
actgttatgaaataaagaa

SEQ ID NO: 4919283 - DNA, 20 bp, Homo sapiens
actgttcaatggttctgaaa

SEQ ID NO: 4919284 - DNA, 18 bp, Homo sapiens
actgttctaaagctctga

SEQ ID NO: 4919285 - DNA, 13 bp, Homo sapiens
actgttctgtgtc

SEQ ID NO: 4919286 - DNA, 16 bp, Homo sapiens
actgttcttgctgcta

SEQ ID NO: 4919287 - DNA, 17 bp, Homo sapiens
actgttcttgctgctag

SEQ ID NO: 4919288 - DNA, 19 bp, Homo sapiens
actgttcttgctgctagaa

SEQ ID NO: 4919289 - DNA, 14 bp, Homo sapiens
actgttgaaaatta

SEQ ID NO: 4919290 - DNA, 13 bp, Homo sapiens
actgttgatgtat

SEQ ID NO: 4919291 - DNA, 16 bp, Homo sapiens
actgttgatgtatctg

SEQ ID NO: 4919292 - DNA, 13 bp, Homo sapiens
actgttgcccagg

SEQ ID NO: 4919293 - DNA, 14 bp, Homo sapiens
actgttgcccaggc

SEQ ID NO: 4919294 - DNA, 17 bp, Homo sapiens
actgttgcccaggctgg

SEQ ID NO: 4919295 - DNA, 17 bp, Homo sapiens
actgtttatatgtgttg

SEQ ID NO: 4919296 - DNA, 21 bp, Homo sapiens
actgtttctcttgagctggcc

SEQ ID NO: 4919297 - DNA, 19 bp, Homo sapiens
acttaaaaaaaaaaaaaag

SEQ ID NO: 4919298 - DNA, 20 bp, Homo sapiens
acttaaaaaaaaaaaaaagc

SEQ ID NO: 4919299 - DNA, 21 bp, Homo sapiens
acttaaaaaaaaaaaaaagct

SEQ ID NO: 4919300 - DNA, 22 bp, Homo sapiens
acttaaaaaaaaaaaaaagctt

SEQ ID NO: 4919301 - DNA, 16 bp, Homo sapiens
acttaaaaatgtaaat

SEQ ID NO: 4919302 - DNA, 19 bp, Homo sapiens
acttaaaaatgtaaatatt

SEQ ID NO: 4919303 - DNA, 20 bp, Homo sapiens
acttaaaatattcctgcatt

SEQ ID NO: 4919304 - DNA, 13 bp, Homo sapiens
acttaagagaaat

SEQ ID NO: 4919305 - DNA, 15 bp, Homo sapiens
acttaagagaaatgg

SEQ ID NO: 4919306 - DNA, 15 bp, Homo sapiens
acttaagcaaaagaa

SEQ ID NO: 4919307 - DNA, 18 bp, Homo sapiens
acttaatactaccttgaa

SEQ ID NO: 4919308 - DNA, 19 bp, Homo sapiens
acttaatactaccttgaaa

SEQ ID NO: 4919309 - DNA, 22 bp, Homo sapiens
acttactaaaatatatatagaa

SEQ ID NO: 4919310 - DNA, 15 bp, Homo sapiens
acttacttttgtaaa

SEQ ID NO: 4919311 - DNA, 15 bp, Homo sapiens
acttagaaagcaggg

SEQ ID NO: 4919312 - DNA, 16 bp, Homo sapiens
acttagaaagcagggg

SEQ ID NO: 4919313 - DNA, 16 bp, Homo sapiens
acttagaaattgcatt

SEQ ID NO: 4919314 - DNA, 15 bp, Homo sapiens
acttagagtttctgt

SEQ ID NO: 4919315 - DNA, 21 bp, Homo sapiens
acttagagtttctgtttgatt

SEQ ID NO: 4919316 - DNA, 14 bp, Homo sapiens
acttagcatcctaa

SEQ ID NO: 4919317 - DNA, 16 bp, Homo sapiens
acttagctatcagaag

SEQ ID NO: 4919318 - DNA, 23 bp, Homo sapiens
acttataagtgaagtgatactat

SEQ ID NO: 4919319 - DNA, 17 bp, Homo sapiens
acttatagtacatgata

SEQ ID NO: 4919320 - DNA, 16 bp, Homo sapiens
acttatattgaagaca

SEQ ID NO: 4919321 - DNA, 15 bp, Homo sapiens
acttatattttcgta

SEQ ID NO: 4919322 - DNA, 23 bp, Homo sapiens
acttatattttcgtatgaaaatg

SEQ ID NO: 4919323 - DNA, 15 bp, Homo sapiens
acttatgtttttaaa

SEQ ID NO: 4919324 - DNA, 16 bp, Homo sapiens
acttattacaatttgt

SEQ ID NO: 4919325 - DNA, 19 bp, Homo sapiens
acttattgctgattttaat

SEQ ID NO: 4919326 - DNA, 13 bp, Homo sapiens
acttattgtaaat

SEQ ID NO: 4919327 - DNA, 16 bp, Homo sapiens
acttatttcttcaaat

SEQ ID NO: 4919328 - DNA, 16 bp, Homo sapiens
acttattttatttcca

SEQ ID NO: 4919329 - DNA, 22 bp, Homo sapiens
acttatttttgacagtgttgaa

SEQ ID NO: 4919330 - DNA, 22 bp, Homo sapiens
acttcaatgggctcttccaaca

SEQ ID NO: 4919331 - DNA, 18 bp, Homo sapiens
acttcagatgggaggaaa

SEQ ID NO: 4919332 - DNA, 16 bp, Homo sapiens
acttcagtcctgggag

SEQ ID NO: 4919333 - DNA, 18 bp, Homo sapiens
acttcatatatgaggact

SEQ ID NO: 4919334 - DNA, 15 bp, Homo sapiens
acttcatggaatgga

SEQ ID NO: 4919335 - DNA, 17 bp, Homo sapiens
acttcattctgcagggt

SEQ ID NO: 4919336 - DNA, 17 bp, Homo sapiens
acttccataatctggac

SEQ ID NO: 4919337 - DNA, 22 bp, Homo sapiens
acttcccagttcaggagtccca

SEQ ID NO: 4919338 - DNA, 24 bp, Homo sapiens
acttcccagttcaggagtcccaag

SEQ ID NO: 4919339 - DNA, 22 bp, Homo sapiens
acttccctttctgcttgtgtta

SEQ ID NO: 4919340 - DNA, 15 bp, Homo sapiens
acttcctgtgacttc

SEQ ID NO: 4919341 - DNA, 15 bp, Homo sapiens
acttcgtcttctaat

SEQ ID NO: 4919342 - DNA, 16 bp, Homo sapiens
acttctaatatcattc

SEQ ID NO: 4919343 - DNA, 21 bp, Homo sapiens
acttctctgcctttgacattt

SEQ ID NO: 4919344 - DNA, 23 bp, Homo sapiens
acttctctgcctttgacatttaa

SEQ ID NO: 4919345 - DNA, 17 bp, Homo sapiens
accttgctgtcctgatc

SEQ ID NO: 4919346 - DNA, 23 bp, Homo sapiens
accttgctgtcctgatctgtgat

SEQ ID NO: 4919347 - DNA, 12 bp, Homo sapiens
accttggctgca

SEQ ID NO: 4919348 - DNA, 17 bp, Homo sapiens
accttggctgcagggag

SEQ ID NO: 4919349 - DNA, 18 bp, Homo sapiens
accttggctgcagggagt

SEQ ID NO: 4919350 - DNA, 12 bp, Homo sapiens
accttgggccaa

SEQ ID NO: 4919351 - DNA, 13 bp, Homo sapiens
accttgtgtctgt

SEQ ID NO: 4919352 - DNA, 18 bp, Homo sapiens
accttgtgtctgtacacg

SEQ ID NO: 4919353 - DNA, 21 bp, Homo sapiens
accttgtgtctgtacacgtgt

SEQ ID NO: 4919354 - DNA, 18 bp, Homo sapiens
acctttcacctttgtgta

SEQ ID NO: 4919355 - DNA, 16 bp, Homo sapiens
acctttgtgtattttt

SEQ ID NO: 4919356 - DNA, 22 bp, Homo sapiens
accttttaaagtgtttcagcta

SEQ ID NO: 4919357 - DNA, 16 bp, Homo sapiens
accttttattgacaca

SEQ ID NO: 4919358 - DNA, 20 bp, Homo sapiens
accttttattgacacagaaa

SEQ ID NO: 4919359 - DNA, 17 bp, Homo sapiens
accttttgaggagcccc

SEQ ID NO: 4919360 - DNA, 19 bp, Homo sapiens
acgaaacacaaaccacaac

SEQ ID NO: 4919361 - DNA, 18 bp, Homo sapiens
acgaaacttgttattgtg

SEQ ID NO: 4919362 - DNA, 16 bp, Homo sapiens
acgaccggggccagca

SEQ ID NO: 4919363 - DNA, 13 bp, Homo sapiens
acgacgccctctc

SEQ ID NO: 4919364 - DNA, 16 bp, Homo sapiens
acgacgccctctcccc

SEQ ID NO: 4919365 - DNA, 14 bp, Homo sapiens
acgacgctgcagag

SEQ ID NO: 4919366 - DNA, 23 bp, Homo sapiens
acgcaatgaaaagtcgttttcca

SEQ ID NO: 4919367 - DNA, 11 bp, Homo sapiens
acgcacgcaca

SEQ ID NO: 4919368 - DNA, 15 bp, Homo sapiens
acgcagatgatccat

SEQ ID NO: 4919369 - DNA, 23 bp, Homo sapiens
acgcagccctagagcctgcctgg

SEQ ID NO: 4919370 - DNA, 14 bp, Homo sapiens
acgcatccagcaag

SEQ ID NO: 4919371 - DNA, 19 bp, Homo sapiens
acgcatggtcaaccctcag

SEQ ID NO: 4919372 - DNA, 18 bp, Homo sapiens
acgccactgcactatagc

SEQ ID NO: 4919373 - DNA, 12 bp, Homo sapiens
acgccctcccct

SEQ ID NO: 4919374 - DNA, 14 bp, Homo sapiens
acgccctcccctcc

SEQ ID NO: 4919375 - DNA, 18 bp, Homo sapiens
acgccctctccccacccc

SEQ ID NO: 4919376 - DNA, 23 bp, Homo sapiens
acgccggggacagaggcctgccc

SEQ ID NO: 4919377 - DNA, 14 bp, Homo sapiens
acgccttcccctca

SEQ ID NO: 4919378 - DNA, 16 bp, Homo sapiens
acgcgcgcgcacacac

SEQ ID NO: 4919379 - DNA, 18 bp, Homo sapiens
acgcgcttcgacttttct

SEQ ID NO: 4919380 - DNA, 15 bp, Homo sapiens
acgcgtctcctgttt

SEQ ID NO: 4919381 - DNA, 23 bp, Homo sapiens
acgcgtgcacacaccagagccca

SEQ ID NO: 4919382 - DNA, 14 bp, Homo sapiens
acgctgcagagcac

SEQ ID NO: 4919383 - DNA, 23 bp, Homo sapiens
acgctggaccttgaactgggtac

SEQ ID NO: 4919384 - DNA, 19 bp, Homo sapiens
acgctggagtgcagtgagc

SEQ ID NO: 4919385 - DNA, 12 bp, Homo sapiens
acgcttgtgaat

SEQ ID NO: 4919386 - DNA, 12 bp, Homo sapiens
acgctttgattc

SEQ ID NO: 4919387 - DNA, 16 bp, Homo sapiens
acgctttgattcatag

SEQ ID NO: 4919388 - DNA, 11 bp, Homo sapiens
acgctttgtca

SEQ ID NO: 4919389 - DNA, 21 bp, Homo sapiens
acggaagtggtggctgtggaa

SEQ ID NO: 4919390 - DNA, 14 bp, Homo sapiens
acggacaataaacc

SEQ ID NO: 4919391 - DNA, 20 bp, Homo sapiens
acggagcccagccctcccca

SEQ ID NO: 4919392 - DNA, 21 bp, Homo sapiens
acggagccccaggcctctgtg

SEQ ID NO: 4919393 - DNA, 23 bp, Homo sapiens
acggaggcaaagctggctcacct

SEQ ID NO: 4919394 - DNA, 19 bp, Homo sapiens
acggagtcccaccttggct

SEQ ID NO: 4919395 - DNA, 15 bp, Homo sapiens
acggccatctctttg

SEQ ID NO: 4919396 - DNA, 20 bp, Homo sapiens
acggccatctctttgtacag

SEQ ID NO: 4919397 - DNA, 18 bp, Homo sapiens
acggcctgatgctccctc

SEQ ID NO: 4919398 - DNA, 19 bp, Homo sapiens
acggcctgatgctccctcc

SEQ ID NO: 4919399 - DNA, 16 bp, Homo sapiens
acggctaagaggctgc

SEQ ID NO: 4919400 - DNA, 14 bp, Homo sapiens
acggctcactgcag

SEQ ID NO: 4919401 - DNA, 16 bp, Homo sapiens
acggctcactgcagcc

SEQ ID NO: 4919402 - DNA, 19 bp, Homo sapiens
acgggaagcaacctcccaa

SEQ ID NO: 4919403 - DNA, 14 bp, Homo sapiens
acggggactgggga

SEQ ID NO: 4919404 - DNA, 18 bp, Homo sapiens
acggggagcggcggaaag

SEQ ID NO: 4919405 - DNA, 23 bp, Homo sapiens
acggtcaggtttaacatttgcct

SEQ ID NO: 4919406 - DNA, 16 bp, Homo sapiens
acggtgaaggtgacag

SEQ ID NO: 4919407 - DNA, 19 bp, Homo sapiens
acggtgaaggtgacagcag

SEQ ID NO: 4919408 - DNA, 17 bp, Homo sapiens
acggtgacaaagatggc

SEQ ID NO: 4919409 - DNA, 18 bp, Homo sapiens
acgtaaccacggaaaaga

SEQ ID NO: 4919410 - DNA, 14 bp, Homo sapiens
acgtattttaaaag

SEQ ID NO: 4919411 - DNA, 17 bp, Homo sapiens
acgtcagacttggctca

SEQ ID NO: 4919412 - DNA, 20 bp, Homo sapiens
acgtctgaagcttgactccc

SEQ ID NO: 4919413 - DNA, 13 bp, Homo sapiens
acgtctgacaggc

SEQ ID NO: 4919414 - DNA, 14 bp, Homo sapiens
acgtctgacaggca

SEQ ID NO: 4919415 - DNA, 15 bp, Homo sapiens
acgtctgacaggcaa

SEQ ID NO: 4919416 - DNA, 13 bp, Homo sapiens
acgtctgtcttca

SEQ ID NO: 4919417 - DNA, 14 bp, Homo sapiens
acgtggaacctctg

SEQ ID NO: 4919418 - DNA, 17 bp, Homo sapiens
acgtggaacctctgtct

SEQ ID NO: 4919419 - DNA, 11 bp, Homo sapiens
acgtgtttaaa

SEQ ID NO: 4919420 - DNA, 19 bp, Homo sapiens
acgttactcagggctcctc

SEQ ID NO: 4919421 - DNA, 10 bp, Homo sapiens
acgtttctca

SEQ ID NO: 4919422 - DNA, 14 bp, Homo sapiens
acgtttttccttta

SEQ ID NO: 4919423 - DNA, 20 bp, Homo sapiens
actaaaagttcttctccaat

SEQ ID NO: 4919424 - DNA, 18 bp, Homo sapiens
actaaacatatgatttca

SEQ ID NO: 4919425 - DNA, 17 bp, Homo sapiens
actaaagcagtagaaat

SEQ ID NO: 4919426 - DNA, 15 bp, Homo sapiens
actaaatcagagaca

SEQ ID NO: 4919427 - DNA, 18 bp, Homo sapiens
actaaatcagagacaaaa

SEQ ID NO: 4919428 - DNA, 16 bp, Homo sapiens
actaaatctctaatat

SEQ ID NO: 4919429 - DNA, 17 bp, Homo sapiens
actaaatctctaatatg

SEQ ID NO: 4919430 - DNA, 19 bp, Homo sapiens
actaaatgcctagttttta

SEQ ID NO: 4919431 - DNA, 15 bp, Homo sapiens
actaaatttgatact

SEQ ID NO: 4919432 - DNA, 18 bp, Homo sapiens
actaaatttgatacttat

SEQ ID NO: 4919433 - DNA, 14 bp, Homo sapiens
actaacacaaggac

SEQ ID NO: 4919434 - DNA, 17 bp, Homo sapiens
actaaccccaacgcaca

SEQ ID NO: 4919435 - DNA, 22 bp, Homo sapiens
actaactagacaccaaagttct

SEQ ID NO: 4919436 - DNA, 22 bp, Homo sapiens
actaactcaccagccccactgc

SEQ ID NO: 4919437 - DNA, 23 bp, Homo sapiens
actaacttatttatgttaaaaga

SEQ ID NO: 4919438 - DNA, 15 bp, Homo sapiens
actaagaaacttttg

SEQ ID NO: 4919439 - DNA, 15 bp, Homo sapiens
actaagccacaagaa

SEQ ID NO: 4919440 - DNA, 13 bp, Homo sapiens
actaagttcacat

SEQ ID NO: 4919441 - DNA, 14 bp, Homo sapiens
actaataaatacat

SEQ ID NO: 4919442 - DNA, 15 bp, Homo sapiens
actaataaatacata

SEQ ID NO: 4919443 - DNA, 15 bp, Homo sapiens
actaattccacacct

SEQ ID NO: 4919444 - DNA, 19 bp, Homo sapiens
actaatttcaaaatgcttt

SEQ ID NO: 4919445 - DNA, 23 bp, Homo sapiens
actaattttacacattagatttt

SEQ ID NO: 4919446 - DNA, 13 bp, Homo sapiens
actacacattttt

SEQ ID NO: 4919447 - DNA, 14 bp, Homo sapiens
actacactgaggag

SEQ ID NO: 4919448 - DNA, 18 bp, Homo sapiens
actacagacctgcttttt

SEQ ID NO: 4919449 - DNA, 13 bp, Homo sapiens
actacattcattt

SEQ ID NO: 4919450 - DNA, 15 bp, Homo sapiens
actacccttaattac

SEQ ID NO: 4919451 - DNA, 15 bp, Homo sapiens
actaccttatcactg

SEQ ID NO: 4919452 - DNA, 17 bp, Homo sapiens
actactgaaacagattt

SEQ ID NO: 4919453 - DNA, 12 bp, Homo sapiens
actactgggtgt

SEQ ID NO: 4919454 - DNA, 13 bp, Homo sapiens
actactgggtgtc

SEQ ID NO: 4919455 - DNA, 14 bp, Homo sapiens
actactgggtgtca

SEQ ID NO: 4919456 - DNA, 23 bp, Homo sapiens
actactgggtgtcatttcattcc

SEQ ID NO: 4919457 - DNA, 14 bp, Homo sapiens
tttttatttatgaa

SEQ ID NO: 4919458 - DNA, 18 bp, Homo sapiens
tttttcaacaaatatctt

SEQ ID NO: 4919459 - DNA, 12 bp, Homo sapiens
tttttcaatgtg

SEQ ID NO: 4919460 - DNA, 13 bp, Homo sapiens
tttttcatattgt

SEQ ID NO: 4919461 - DNA, 23 bp, Homo sapiens
tttttcattcatcccattaatca

SEQ ID NO: 4919462 - DNA, 19 bp, Homo sapiens
tttttcctagcctgtttct

SEQ ID NO: 4919463 - DNA, 18 bp, Homo sapiens
tttttctcaaagttttga

SEQ ID NO: 4919464 - DNA, 12 bp, Homo sapiens
tttttgaaatga

SEQ ID NO: 4919465 - DNA, 21 bp, Homo sapiens
tttttgtcccccaacttgaga

SEQ ID NO: 4919466 - DNA, 15 bp, Homo sapiens
tttttgtttgtttct

SEQ ID NO: 4919467 - DNA, 17 bp, Homo sapiens
tttttgttttacaatgt

SEQ ID NO: 4919468 - DNA, 12 bp, Homo sapiens
ttttttaatcta

SEQ ID NO: 4919469 - DNA, 12 bp, Homo sapiens
ttttttaattta

SEQ ID NO: 4919470 - DNA, 22 bp, Homo sapiens
ttttttactcattgaaatgtca

SEQ ID NO: 4919471 - DNA, 19 bp, Homo sapiens
ttttttattgctagtattt

SEQ ID NO: 4919472 - DNA, 12 bp, Homo sapiens
ttttttcaatgt

SEQ ID NO: 4919473 - DNA, 22 bp, Homo sapiens
ttttttccatctttacaaaact

SEQ ID NO: 4919474 - DNA, 16 bp, Homo sapiens
ttttttgtttgtttct

SEQ ID NO: 4919475 - DNA, 21 bp, Homo sapiens
tttttttaatagtcattccaa

SEQ ID NO: 4919476 - DNA, 12 bp, Homo sapiens
tttttttacatt

SEQ ID NO: 4919477 - DNA, 12 bp, Homo sapiens
tttttttcttta

SEQ ID NO: 4919478 - DNA, 11 bp, Homo sapiens
tttttttgcca

SEQ ID NO: 4919479 - DNA, 14 bp, Homo sapiens
ttttttttaaacaa

SEQ ID NO: 4919480 - DNA, 16 bp, Homo sapiens
ttttattgacacagaa

SEQ ID NO: 4919481 - DNA, 18 bp, Homo sapiens
ttttattgacacagaaaa

SEQ ID NO: 4919482 - DNA, 15 bp, Homo sapiens
ttttattgttttcta

SEQ ID NO: 4919483 - DNA, 14 bp, Homo sapiens
ttttattttatgtt

SEQ ID NO: 4919484 - DNA, 20 bp, Homo sapiens
ttttattttgaaaagcttct

SEQ ID NO: 4919485 - DNA, 14 bp, Homo sapiens
ttttattttttagt

SEQ ID NO: 4919486 - DNA, 20 bp, Homo sapiens
ttttcaacaaatatcttgtg

SEQ ID NO: 4919487 - DNA, 23 bp, Homo sapiens
ttttcaaccagataacatacctt

SEQ ID NO: 4919488 - DNA, 22 bp, Homo sapiens
ttttcaacgcagccctgctttg

SEQ ID NO: 4919489 - DNA, 11 bp, Homo sapiens
ttttcaatgtg

SEQ ID NO: 4919490 - DNA, 23 bp, Homo sapiens
ttttcacaggtgtggtgtaattt

SEQ ID NO: 4919491 - DNA, 19 bp, Homo sapiens
ttttcaccagatttgctaa

SEQ ID NO: 4919492 - DNA, 16 bp, Homo sapiens
ttttcactgtagaatg

SEQ ID NO: 4919493 - DNA, 17 bp, Homo sapiens
ttttcagctctctgtat

SEQ ID NO: 4919494 - DNA, 23 bp, Homo sapiens
ttttcagtattttggagaaatta

SEQ ID NO: 4919495 - DNA, 13 bp, Homo sapiens
ttttcatattgtg

SEQ ID NO: 4919496 - DNA, 14 bp, Homo sapiens
ttttcatattgtgc

SEQ ID NO: 4919497 - DNA, 19 bp, Homo sapiens
ttttcatattgtgccaata

SEQ ID NO: 4919498 - DNA, 18 bp, Homo sapiens
ttttcatggtgaaaatgt

SEQ ID NO: 4919499 - DNA, 19 bp, Homo sapiens
ttttcattacaatggaaac

SEQ ID NO: 4919500 - DNA, 17 bp, Homo sapiens
ttttcattttccaatac

SEQ ID NO: 4919501 - DNA, 15 bp, Homo sapiens
ttttccaaaataatt

SEQ ID NO: 4919502 - DNA, 13 bp, Homo sapiens
ttttccaaactga

SEQ ID NO: 4919503 - DNA, 12 bp, Homo sapiens
ttttccagcaag

SEQ ID NO: 4919504 - DNA, 19 bp, Homo sapiens
ttttccccccactctcccc

SEQ ID NO: 4919505 - DNA, 15 bp, Homo sapiens
ttttccctcttttct

SEQ ID NO: 4919506 - DNA, 17 bp, Homo sapiens
ttttcctaaagagagta

SEQ ID NO: 4919507 - DNA, 13 bp, Homo sapiens
ttttcctatttgt

SEQ ID NO: 4919508 - DNA, 23 bp, Homo sapiens
ttttcgaacattctttgcctggt

SEQ ID NO: 4919509 - DNA, 22 bp, Homo sapiens
ttttctagcctatttacctgca

SEQ ID NO: 4919510 - DNA, 14 bp, Homo sapiens
ttttctagtacact

SEQ ID NO: 4919511 - DNA, 15 bp, Homo sapiens
ttttctcaaagtttt

SEQ ID NO: 4919512 - DNA, 19 bp, Homo sapiens
ttttctcaaagttttgaaa

SEQ ID NO: 4919513 - DNA, 23 bp, Homo sapiens
ttttctcaaagttttgaaaagct

SEQ ID NO: 4919514 - DNA, 13 bp, Homo sapiens
ttttctgactaat

SEQ ID NO: 4919515 - DNA, 17 bp, Homo sapiens
ttttctgattagctttg

SEQ ID NO: 4919516 - DNA, 17 bp, Homo sapiens
ttttctggaatacatga

SEQ ID NO: 4919517 - DNA, 23 bp, Homo sapiens
ttttctggggaaagacactgcct

SEQ ID NO: 4919518 - DNA, 14 bp, Homo sapiens
ttttctggttctaa

SEQ ID NO: 4919519 - DNA, 13 bp, Homo sapiens
ttttcttacataa

SEQ ID NO: 4919520 - DNA, 16 bp, Homo sapiens
ttttcttactcctcct

SEQ ID NO: 4919521 - DNA, 12 bp, Homo sapiens
ttttctttgtgt

SEQ ID NO: 4919522 - DNA, 16 bp, Homo sapiens
ttttctttgtgtagct

SEQ ID NO: 4919523 - DNA, 19 bp, Homo sapiens
ttttctttgtgtagctttg

SEQ ID NO: 4919524 - DNA, 21 bp, Homo sapiens
ttttcttttgtaagtgctaca

SEQ ID NO: 4919525 - DNA, 19 bp, Homo sapiens
ttttcttttgttactgttc

SEQ ID NO: 4919526 - DNA, 15 bp, Homo sapiens
ttttgaaaagctatt

SEQ ID NO: 4919527 - DNA, 17 bp, Homo sapiens
ttttgaaaagcttctta

SEQ ID NO: 4919528 - DNA, 21 bp, Homo sapiens
ttttgaaaagcttcttaatta

SEQ ID NO: 4919529 - DNA, 17 bp, Homo sapiens
ttttgaaatgaaattta

SEQ ID NO: 4919530 - DNA, 15 bp, Homo sapiens
ttttgaagtcttgta

SEQ ID NO: 4919531 - DNA, 16 bp, Homo sapiens
ttttgaagtttacatt

SEQ ID NO: 4919532 - DNA, 17 bp, Homo sapiens
ttttgaagtttacattt

SEQ ID NO: 4919533 - DNA, 14 bp, Homo sapiens
ttttgaatgttatt

SEQ ID NO: 4919534 - DNA, 21 bp, Homo sapiens
ttttgagtacggctatagcct

SEQ ID NO: 4919535 - DNA, 23 bp, Homo sapiens
ttttgagtagatattactttatc

SEQ ID NO: 4919536 - DNA, 13 bp, Homo sapiens
ttttgataactgt

SEQ ID NO: 4919537 - DNA, 16 bp, Homo sapiens
ttttgatatgagtata

SEQ ID NO: 4919538 - DNA, 17 bp, Homo sapiens
ttttgatccaagctggt

SEQ ID NO: 4919539 - DNA, 22 bp, Homo sapiens
ttttgatgtttgtggcctcaga

SEQ ID NO: 4919540 - DNA, 21 bp, Homo sapiens
ttttgatttgtactgaaaaat

SEQ ID NO: 4919541 - DNA, 18 bp, Homo sapiens
ttttgcaaatataaacat

SEQ ID NO: 4919542 - DNA, 22 bp, Homo sapiens
ttttgccactaattttagtatt

SEQ ID NO: 4919543 - DNA, 17 bp, Homo sapiens
ttttggcgctattacaa

SEQ ID NO: 4919544 - DNA, 23 bp, Homo sapiens
ttttggtattacactgtatttgt

SEQ ID NO: 4919545 - DNA, 13 bp, Homo sapiens
ttttggtgtgttg

SEQ ID NO: 4919546 - DNA, 14 bp, Homo sapiens
ttttgtaagacaaa

SEQ ID NO: 4919547 - DNA, 21 bp, Homo sapiens
ttttgtacatctggcttattt

SEQ ID NO: 4919548 - DNA, 19 bp, Homo sapiens
ttttgtagagccagggtct

SEQ ID NO: 4919549 - DNA, 22 bp, Homo sapiens
ttttgtaggggtcaaagaaatg

SEQ ID NO: 4919550 - DNA, 13 bp, Homo sapiens
ttttgtatacatc

SEQ ID NO: 4919551 - DNA, 19 bp, Homo sapiens
ttttgtatacatcctgggt

SEQ ID NO: 4919552 - DNA, 13 bp, Homo sapiens
ttttgtatcttaa

SEQ ID NO: 4919553 - DNA, 12 bp, Homo sapiens
ttttgtcttgaa

SEQ ID NO: 4919554 - DNA, 13 bp, Homo sapiens
ttttgtcttgaat

SEQ ID NO: 4919555 - DNA, 23 bp, Homo sapiens
ttttgtgactatatagagatgtt

SEQ ID NO: 4919556 - DNA, 12 bp, Homo sapiens
ttttgtgcattt

SEQ ID NO: 4919557 - DNA, 21 bp, Homo sapiens
ttttgttactgttcttgctgc

SEQ ID NO: 4919558 - DNA, 22 bp, Homo sapiens
ttttgttactgttcttgctgct

SEQ ID NO: 4919559 - DNA, 15 bp, Homo sapiens
ttttgttgattaaaa

SEQ ID NO: 4919560 - DNA, 19 bp, Homo sapiens
ttttgttgattaaaacatt

SEQ ID NO: 4919561 - DNA, 19 bp, Homo sapiens
ttttgttgtaaaaagaaaa

SEQ ID NO: 4919562 - DNA, 14 bp, Homo sapiens
ttttgtttgtctct

SEQ ID NO: 4919563 - DNA, 17 bp, Homo sapiens
ttttgtttgtctctcct

SEQ ID NO: 4919564 - DNA, 13 bp, Homo sapiens
ttttgttttacaa

SEQ ID NO: 4919565 - DNA, 22 bp, Homo sapiens
tttttaaaagtttcaatgtgat

SEQ ID NO: 4919566 - DNA, 16 bp, Homo sapiens
tttttaaaatatttat

SEQ ID NO: 4919567 - DNA, 17 bp, Homo sapiens
tttttaaaatggtgctt

SEQ ID NO: 4919568 - DNA, 19 bp, Homo sapiens
tttttaaacaaacattgtg

SEQ ID NO: 4919569 - DNA, 12 bp, Homo sapiens
tttttaaagctt

SEQ ID NO: 4919570 - DNA, 20 bp, Homo sapiens
tttttaaagtgtttctgtta

SEQ ID NO: 4919571 - DNA, 14 bp, Homo sapiens
tttttaaataaact

SEQ ID NO: 4919572 - DNA, 15 bp, Homo sapiens
tttttaaatgtatac

SEQ ID NO: 4919573 - DNA, 16 bp, Homo sapiens
tttttaagatttttct

SEQ ID NO: 4919574 - DNA, 23 bp, Homo sapiens
tttttaagggttatcttagatgt

SEQ ID NO: 4919575 - DNA, 22 bp, Homo sapiens
tttttaatctagacaatataca

SEQ ID NO: 4919576 - DNA, 19 bp, Homo sapiens
tttttaatggcagcagaaa

SEQ ID NO: 4919577 - DNA, 22 bp, Homo sapiens
tttttaatggcagcagaaaact

SEQ ID NO: 4919578 - DNA, 18 bp, Homo sapiens
tttttaattgttgtttct

SEQ ID NO: 4919579 - DNA, 16 bp, Homo sapiens
tttcttgcttgtacct

SEQ ID NO: 4919580 - DNA, 12 bp, Homo sapiens
tttcttgtttat

SEQ ID NO: 4919581 - DNA, 13 bp, Homo sapiens
tttctttaaagat

SEQ ID NO: 4919582 - DNA, 19 bp, Homo sapiens
tttctttcaacttgcatcc

SEQ ID NO: 4919583 - DNA, 22 bp, Homo sapiens
tttctttgaatgctttttgaat

SEQ ID NO: 4919584 - DNA, 15 bp, Homo sapiens
tttcttttcttttta

SEQ ID NO: 4919585 - DNA, 16 bp, Homo sapiens
tttcttttgttactgt

SEQ ID NO: 4919586 - DNA, 20 bp, Homo sapiens
tttcttttgttactgttctt

SEQ ID NO: 4919587 - DNA, 15 bp, Homo sapiens
tttgaaaaaagctca

SEQ ID NO: 4919588 - DNA, 18 bp, Homo sapiens
tttgaaaagctattagcc

SEQ ID NO: 4919589 - DNA, 16 bp, Homo sapiens
tttgaaaagcttctta

SEQ ID NO: 4919590 - DNA, 21 bp, Homo sapiens
tttgaaagtgaataaacttca

SEQ ID NO: 4919591 - DNA, 16 bp, Homo sapiens
tttgaaatgaaattta

SEQ ID NO: 4919592 - DNA, 22 bp, Homo sapiens
tttgaaatgaaatttaaacatt

SEQ ID NO: 4919593 - DNA, 21 bp, Homo sapiens
tttgaacacgaaagaaatgta

SEQ ID NO: 4919594 - DNA, 23 bp, Homo sapiens
tttgaacactggctaaagataat

SEQ ID NO: 4919595 - DNA, 15 bp, Homo sapiens
tttgaactaagaaac

SEQ ID NO: 4919596 - DNA, 17 bp, Homo sapiens
tttgaactggcaattgt

SEQ ID NO: 4919597 - DNA, 19 bp, Homo sapiens
tttgaactggcaattgtct

SEQ ID NO: 4919598 - DNA, 18 bp, Homo sapiens
tttgaagctactgtgtgt

SEQ ID NO: 4919599 - DNA, 11 bp, Homo sapiens
tttgaagctga

SEQ ID NO: 4919600 - DNA, 18 bp, Homo sapiens
tttgaagctgaaaatata

SEQ ID NO: 4919601 - DNA, 13 bp, Homo sapiens
tttgaaggcaaaa

SEQ ID NO: 4919602 - DNA, 17 bp, Homo sapiens
tttgaaggttttaagtg

SEQ ID NO: 4919603 - DNA, 16 bp, Homo sapiens
tttgaagtttacattt

SEQ ID NO: 4919604 - DNA, 19 bp, Homo sapiens
tttgaagtttacattttta

SEQ ID NO: 4919605 - DNA, 23 bp, Homo sapiens
tttgaatgttaagaattgaccat

SEQ ID NO: 4919606 - DNA, 13 bp, Homo sapiens
tttgaattaaaac

SEQ ID NO: 4919607 - DNA, 15 bp, Homo sapiens
tttgaattaaaactt

SEQ ID NO: 4919608 - DNA, 14 bp, Homo sapiens
tttgaatttactgg

SEQ ID NO: 4919609 - DNA, 19 bp, Homo sapiens
tttgacagtgttgaaaatg

SEQ ID NO: 4919610 - DNA, 18 bp, Homo sapiens
tttgacagttattttgat

SEQ ID NO: 4919611 - DNA, 20 bp, Homo sapiens
tttgacattgcgtttgacct

SEQ ID NO: 4919612 - DNA, 17 bp, Homo sapiens
tttgacattgtatgtat

SEQ ID NO: 4919613 - DNA, 22 bp, Homo sapiens
tttgacattgtatgtatctatt

SEQ ID NO: 4919614 - DNA, 16 bp, Homo sapiens
tttgacatttaattta

SEQ ID NO: 4919615 - DNA, 18 bp, Homo sapiens
tttgacctcacagtgacc

SEQ ID NO: 4919616 - DNA, 16 bp, Homo sapiens
tttgactattctgtat

SEQ ID NO: 4919617 - DNA, 14 bp, Homo sapiens
tttgacttaatgtg

SEQ ID NO: 4919618 - DNA, 16 bp, Homo sapiens
tttgacttaatgtgat

SEQ ID NO: 4919619 - DNA, 23 bp, Homo sapiens
tttgacttaatgtgattactgct

SEQ ID NO: 4919620 - DNA, 16 bp, Homo sapiens
tttgagacagtttctt

SEQ ID NO: 4919621 - DNA, 17 bp, Homo sapiens
tttgagacagtttctta

SEQ ID NO: 4919622 - DNA, 18 bp, Homo sapiens
tttgagacagtttcttag

SEQ ID NO: 4919623 - DNA, 16 bp, Homo sapiens
tttgagaccagcctgg

SEQ ID NO: 4919624 - DNA, 20 bp, Homo sapiens
tttgagattgccccaggtct

SEQ ID NO: 4919625 - DNA, 15 bp, Homo sapiens
tttgagcaattttcg

SEQ ID NO: 4919626 - DNA, 16 bp, Homo sapiens
tttgaggggaaaacac

SEQ ID NO: 4919627 - DNA, 19 bp, Homo sapiens
tttgagtagatattacttt

SEQ ID NO: 4919628 - DNA, 12 bp, Homo sapiens
tttgagttctac

SEQ ID NO: 4919629 - DNA, 14 bp, Homo sapiens
tttgataactgttt

SEQ ID NO: 4919630 - DNA, 12 bp, Homo sapiens
tttgataatgtt

SEQ ID NO: 4919631 - DNA, 15 bp, Homo sapiens
tttgatacccctggg

SEQ ID NO: 4919632 - DNA, 16 bp, Homo sapiens
tttgatacccctgggg

SEQ ID NO: 4919633 - DNA, 12 bp, Homo sapiens
tttgatacttat

SEQ ID NO: 4919634 - DNA, 18 bp, Homo sapiens
tttgatgtcatgtgttcc

SEQ ID NO: 4919635 - DNA, 14 bp, Homo sapiens
tttgatgtgacaat

SEQ ID NO: 4919636 - DNA, 19 bp, Homo sapiens
tttgatgtgacaataatat

SEQ ID NO: 4919637 - DNA, 17 bp, Homo sapiens
tttgatgtttgtggcct

SEQ ID NO: 4919638 - DNA, 19 bp, Homo sapiens
tttgatgtttgtggcctca

SEQ ID NO: 4919639 - DNA, 14 bp, Homo sapiens
tttgattaacaaat

SEQ ID NO: 4919640 - DNA, 15 bp, Homo sapiens
tttgattaacaaata

SEQ ID NO: 4919641 - DNA, 15 bp, Homo sapiens
tttgatttacagcaa

SEQ ID NO: 4919642 - DNA, 18 bp, Homo sapiens
tttgatttacagcaagta

SEQ ID NO: 4919643 - DNA, 13 bp, Homo sapiens
tttgatttacata

SEQ ID NO: 4919644 - DNA, 19 bp, Homo sapiens
tttgcaaacccgaaaataa

SEQ ID NO: 4919645 - DNA, 17 bp, Homo sapiens
tttgcaaatataaacat

SEQ ID NO: 4919646 - DNA, 19 bp, Homo sapiens
tttgcaatggctatatggc

SEQ ID NO: 4919647 - DNA, 16 bp, Homo sapiens
tttgcacagctctccg

SEQ ID NO: 4919648 - DNA, 13 bp, Homo sapiens
tttgcacattttg

SEQ ID NO: 4919649 - DNA, 21 bp, Homo sapiens
tttgcactaaatcagagacaa

SEQ ID NO: 4919650 - DNA, 14 bp, Homo sapiens
tttgcagggcagcc

SEQ ID NO: 4919651 - DNA, 17 bp, Homo sapiens
tttgcattaaattcaca

SEQ ID NO: 4919652 - DNA, 19 bp, Homo sapiens
tttgcattgaacacaaact

SEQ ID NO: 4919653 - DNA, 22 bp, Homo sapiens
tttgccatgttggccaggctgg

SEQ ID NO: 4919654 - DNA, 11 bp, Homo sapiens
tttgccatttg

SEQ ID NO: 4919655 - DNA, 16 bp, Homo sapiens
tttgccatttgatacc

SEQ ID NO: 4919656 - DNA, 17 bp, Homo sapiens
tttgccttcctttctcc

SEQ ID NO: 4919657 - DNA, 17 bp, Homo sapiens
tttgccttgcagaactg

SEQ ID NO: 4919658 - DNA, 19 bp, Homo sapiens
tttgccttgcagaactgcc

SEQ ID NO: 4919659 - DNA, 22 bp, Homo sapiens
tttgccttgcagaactgccatt

SEQ ID NO: 4919660 - DNA, 22 bp, Homo sapiens
tttgcggccagtattagactgg

SEQ ID NO: 4919661 - DNA, 14 bp, Homo sapiens
tttgctaattaaaa

SEQ ID NO: 4919662 - DNA, 14 bp, Homo sapiens
tttgctactaagtt

SEQ ID NO: 4919663 - DNA, 21 bp, Homo sapiens
tttgctagactctagacaaga

SEQ ID NO: 4919664 - DNA, 15 bp, Homo sapiens
tttgctgtgaacaat

SEQ ID NO: 4919665 - DNA, 20 bp, Homo sapiens
tttgcttcataaatgaagca

SEQ ID NO: 4919666 - DNA, 19 bp, Homo sapiens
tttgcttgctcatatgcat

SEQ ID NO: 4919667 - DNA, 21 bp, Homo sapiens
tttgcttgctcatatgcatgt

SEQ ID NO: 4919668 - DNA, 11 bp, Homo sapiens
tttggaaatcc

SEQ ID NO: 4919669 - DNA, 13 bp, Homo sapiens
tttggaagcaggg

SEQ ID NO: 4919670 - DNA, 15 bp, Homo sapiens
tttggaatacttttt

SEQ ID NO: 4919671 - DNA, 17 bp, Homo sapiens
tttggagtcccctcacc

SEQ ID NO: 4919672 - DNA, 20 bp, Homo sapiens
tttggagtcccctcacctcc

SEQ ID NO: 4919673 - DNA, 15 bp, Homo sapiens
tttggatcttgaatg

SEQ ID NO: 4919674 - DNA, 22 bp, Homo sapiens
tttggcaggggcagaaaactct

SEQ ID NO: 4919675 - DNA, 20 bp, Homo sapiens
ttgtacatctggcttatttt

SEQ ID NO: 4919676 - DNA, 23 bp, Homo sapiens
ttgtacatctggcttattttaat

SEQ ID NO: 4919677 - DNA, 21 bp, Homo sapiens
ttgtacatgtgtagcctgtgc

SEQ ID NO: 4919678 - DNA, 17 bp, Homo sapiens
ttgtacatttatgattt

SEQ ID NO: 4919679 - DNA, 20 bp, Homo sapiens
ttgtacatttatgatttaat

SEQ ID NO: 4919680 - DNA, 14 bp, Homo sapiens
ttgtacctctggct

SEQ ID NO: 4919681 - DNA, 14 bp, Homo sapiens
ttgtagaattgtta

SEQ ID NO: 4919682 - DNA, 14 bp, Homo sapiens
ttgtagagccaggg

SEQ ID NO: 4919683 - DNA, 13 bp, Homo sapiens
ttgtagctgtaaa

SEQ ID NO: 4919684 - DNA, 15 bp, Homo sapiens
ttgtaggagacttgc

SEQ ID NO: 4919685 - DNA, 20 bp, Homo sapiens
ttgtaggagctgaggtttca

SEQ ID NO: 4919686 - DNA, 17 bp, Homo sapiens
ttgtaggggtcaaagaa

SEQ ID NO: 4919687 - DNA, 20 bp, Homo sapiens
ttgtaggggtcaaagaaatg

SEQ ID NO: 4919688 - DNA, 23 bp, Homo sapiens
ttgtagtagcgttttttaaatgt

SEQ ID NO: 4919689 - DNA, 14 bp, Homo sapiens
ttgtagttgtttta

SEQ ID NO: 4919690 - DNA, 22 bp, Homo sapiens
ttgtataatttcgagatttgta

SEQ ID NO: 4919691 - DNA, 18 bp, Homo sapiens
ttgtatacatcctgggta

SEQ ID NO: 4919692 - DNA, 21 bp, Homo sapiens
ttgtatactttaaataattta

SEQ ID NO: 4919693 - DNA, 11 bp, Homo sapiens
ttgtatatatc

SEQ ID NO: 4919694 - DNA, 14 bp, Homo sapiens
ttgtatcttaaatt

SEQ ID NO: 4919695 - DNA, 21 bp, Homo sapiens
ttgtatgatgtgttgtgatag

SEQ ID NO: 4919696 - DNA, 14 bp, Homo sapiens
ttgtattattgctg

SEQ ID NO: 4919697 - DNA, 14 bp, Homo sapiens
ttgtattgtggtat

SEQ ID NO: 4919698 - DNA, 23 bp, Homo sapiens
ttgtattttgtgtgaccaactgt

SEQ ID NO: 4919699 - DNA, 18 bp, Homo sapiens
ttgtcacacactttggct

SEQ ID NO: 4919700 - DNA, 16 bp, Homo sapiens
ttgtcacatcagataa

SEQ ID NO: 4919701 - DNA, 19 bp, Homo sapiens
ttgtcactgacacaaagga

SEQ ID NO: 4919702 - DNA, 19 bp, Homo sapiens
ttgtcagacataaagccat

SEQ ID NO: 4919703 - DNA, 14 bp, Homo sapiens
ttgtccacccacct

SEQ ID NO: 4919704 - DNA, 16 bp, Homo sapiens
ttgtccgctgggtggt

SEQ ID NO: 4919705 - DNA, 23 bp, Homo sapiens
ttgtcgaaaagagtcttccaatt

SEQ ID NO: 4919706 - DNA, 20 bp, Homo sapiens
ttgtctatagttgtcagtat

SEQ ID NO: 4919707 - DNA, 12 bp, Homo sapiens
ttgtctatttat

SEQ ID NO: 4919708 - DNA, 12 bp, Homo sapiens
ttgtctatttta

SEQ ID NO: 4919709 - DNA, 13 bp, Homo sapiens
ttgtctattttaa

SEQ ID NO: 4919710 - DNA, 12 bp, Homo sapiens
ttgtctcagaag

SEQ ID NO: 4919711 - DNA, 17 bp, Homo sapiens
ttgtctcctactcctga

SEQ ID NO: 4919712 - DNA, 12 bp, Homo sapiens
ttgtctctcctt

SEQ ID NO: 4919713 - DNA, 19 bp, Homo sapiens
ttgtctctcttcagactct

SEQ ID NO: 4919714 - DNA, 17 bp, Homo sapiens
ttgtctgaagtcactgc

SEQ ID NO: 4919715 - DNA, 15 bp, Homo sapiens
ttgtcttatctggcc

SEQ ID NO: 4919716 - DNA, 17 bp, Homo sapiens
ttgtcttcaaactgtga

SEQ ID NO: 4919717 - DNA, 14 bp, Homo sapiens
ttgtcttgaaagat

SEQ ID NO: 4919718 - DNA, 22 bp, Homo sapiens
ttgtcttgaatgtcttttgaat

SEQ ID NO: 4919719 - DNA, 20 bp, Homo sapiens
ttgtgaaagttttgagtaga

SEQ ID NO: 4919720 - DNA, 14 bp, Homo sapiens
ttgtgaaatgatgg

SEQ ID NO: 4919721 - DNA, 11 bp, Homo sapiens
ttgtgaacaga

SEQ ID NO: 4919722 - DNA, 21 bp, Homo sapiens
ttgtgaatgtatttttctgtt

SEQ ID NO: 4919723 - DNA, 19 bp, Homo sapiens
ttgtgactatatagagatg

SEQ ID NO: 4919724 - DNA, 21 bp, Homo sapiens
ttgtgcaaaagcttcaaatta

SEQ ID NO: 4919725 - DNA, 22 bp, Homo sapiens
ttgtgcaaaagcttcaaattaa

SEQ ID NO: 4919726 - DNA, 19 bp, Homo sapiens
ttgtgcatttgtaaatgct

SEQ ID NO: 4919727 - DNA, 16 bp, Homo sapiens
ttgtgccaatatgtat

SEQ ID NO: 4919728 - DNA, 22 bp, Homo sapiens
ttgtgccatagtcacatggcct

SEQ ID NO: 4919729 - DNA, 21 bp, Homo sapiens
ttgtgcttcacagtagagcca

SEQ ID NO: 4919730 - DNA, 11 bp, Homo sapiens
ttgtgcttctc

SEQ ID NO: 4919731 - DNA, 15 bp, Homo sapiens
ttgtgctttgctctt

SEQ ID NO: 4919732 - DNA, 15 bp, Homo sapiens
ttgtgcttttcctga

SEQ ID NO: 4919733 - DNA, 17 bp, Homo sapiens
ttgtggacacagctctt

SEQ ID NO: 4919734 - DNA, 15 bp, Homo sapiens
ttgtggggacccagg

SEQ ID NO: 4919735 - DNA, 17 bp, Homo sapiens
ttgtggttttcaaattg

SEQ ID NO: 4919736 - DNA, 20 bp, Homo sapiens
ttgtgtatttacgctttgat

SEQ ID NO: 4919737 - DNA, 22 bp, Homo sapiens
ttgtgtatttacgctttgattc

SEQ ID NO: 4919738 - DNA, 15 bp, Homo sapiens
ttgtgtgtcatgcca

SEQ ID NO: 4919739 - DNA, 19 bp, Homo sapiens
ttgtgtgtcttaattatta

SEQ ID NO: 4919740 - DNA, 13 bp, Homo sapiens
ttgtgttgtcctt

SEQ ID NO: 4919741 - DNA, 18 bp, Homo sapiens
ttgttaactcttgtctat

SEQ ID NO: 4919742 - DNA, 22 bp, Homo sapiens
ttgttaactcttgtctattttt

SEQ ID NO: 4919743 - DNA, 20 bp, Homo sapiens
ttgttaatctctgttatgta

SEQ ID NO: 4919744 - DNA, 15 bp, Homo sapiens
ttgttacaggaagtc

SEQ ID NO: 4919745 - DNA, 9 bp, Homo sapiens
ttgttactg

SEQ ID NO: 4919746 - DNA, 10 bp, Homo sapiens
ttgttactgt

SEQ ID NO: 4919747 - DNA, 14 bp, Homo sapiens
ttgttactgttctt

SEQ ID NO: 4919748 - DNA, 17 bp, Homo sapiens
ttgttactgttcttgct

SEQ ID NO: 4919749 - DNA, 16 bp, Homo sapiens
ttgttagatagctgca

SEQ ID NO: 4919750 - DNA, 20 bp, Homo sapiens
ttgttagcttccttaagtat

SEQ ID NO: 4919751 - DNA, 22 bp, Homo sapiens
ttgttatcagtcaatattttta

SEQ ID NO: 4919752 - DNA, 13 bp, Homo sapiens
ttgttattgtgaa

SEQ ID NO: 4919753 - DNA, 19 bp, Homo sapiens
ttgttcaataataaatatt

SEQ ID NO: 4919754 - DNA, 15 bp, Homo sapiens
ttgttcactgaaggt

SEQ ID NO: 4919755 - DNA, 21 bp, Homo sapiens
ttgttcactgaaggtgattca

SEQ ID NO: 4919756 - DNA, 14 bp, Homo sapiens
ttgttcatgtttgg

SEQ ID NO: 4919757 - DNA, 12 bp, Homo sapiens
ttgttgaaattt

SEQ ID NO: 4919758 - DNA, 21 bp, Homo sapiens
ttgttgatgggcacttgagaa

SEQ ID NO: 4919759 - DNA, 22 bp, Homo sapiens
ttgttgctccctgtgacaaaat

SEQ ID NO: 4919760 - DNA, 13 bp, Homo sapiens
ttgttggaatgaa

SEQ ID NO: 4919761 - DNA, 17 bp, Homo sapiens
ttgttgtaaaaagaaaa

SEQ ID NO: 4919762 - DNA, 17 bp, Homo sapiens
ttgttgtataatttcga

SEQ ID NO: 4919763 - DNA, 15 bp, Homo sapiens
ttgttgtgtgtgcag

SEQ ID NO: 4919764 - DNA, 21 bp, Homo sapiens
ttgttgtttgccatactttgt

SEQ ID NO: 4919765 - DNA, 16 bp, Homo sapiens
ttgtttaatgtgaact

SEQ ID NO: 4919766 - DNA, 17 bp, Homo sapiens
ttgtttaatgtgaactt

SEQ ID NO: 4919767 - DNA, 14 bp, Homo sapiens
ttgtttcaagaacc

SEQ ID NO: 4919768 - DNA, 19 bp, Homo sapiens
ttgtttcctcttccaaagt

SEQ ID NO: 4919769 - DNA, 21 bp, Homo sapiens
ttgtttcctcttccaaagtaa

SEQ ID NO: 4919770 - DNA, 18 bp, Homo sapiens
ttgtttctgagaaaagaa

SEQ ID NO: 4919771 - DNA, 13 bp, Homo sapiens
ttgtttcttgttt

SEQ ID NO: 4919772 - DNA, 13 bp, Homo sapiens
ttgtttcttttaa

SEQ ID NO: 4919773 - DNA, 16 bp, Homo sapiens
ttgtttgccatacttt

SEQ ID NO: 4919774 - DNA, 16 bp, Homo sapiens
ttgtttggatgtaatt

SEQ ID NO: 4919775 - DNA, 16 bp, Homo sapiens
ttgtttgtctctcctt

SEQ ID NO: 4919776 - DNA, 12 bp, Homo sapiens
ttgtttgtctgt

SEQ ID NO: 4919777 - DNA, 14 bp, Homo sapiens
ttgtttgtttcttt

SEQ ID NO: 4919778 - DNA, 12 bp, Homo sapiens
ttgttttacaat

SEQ ID NO: 4919779 - DNA, 15 bp, Homo sapiens
ttgttttgcactttt

SEQ ID NO: 4919780 - DNA, 16 bp, Homo sapiens
ttgttttgcacttttt

SEQ ID NO: 4919781 - DNA, 18 bp, Homo sapiens
ttgttttgggggtcaggc

SEQ ID NO: 4919782 - DNA, 14 bp, Homo sapiens
ttgttttgtttgtc

SEQ ID NO: 4919783 - DNA, 13 bp, Homo sapiens
ttgtttttcattc

SEQ ID NO: 4919784 - DNA, 13 bp, Homo sapiens
ttgtttttctcac

SEQ ID NO: 4919785 - DNA, 22 bp, Homo sapiens
tttaaaaaaaaaagttacagaa

SEQ ID NO: 4919786 - DNA, 14 bp, Homo sapiens
tttaggttctaaag

SEQ ID NO: 4919787 - DNA, 15 bp, Homo sapiens
tttaggttctaaagt

SEQ ID NO: 4919788 - DNA, 23 bp, Homo sapiens
tttaggttctaaagttctaagat

SEQ ID NO: 4919789 - DNA, 14 bp, Homo sapiens
tttagtaatctgta

SEQ ID NO: 4919790 - DNA, 21 bp, Homo sapiens
tttagtatgacgctgatacat

SEQ ID NO: 4919791 - DNA, 13 bp, Homo sapiens
tttagttatagtt

SEQ ID NO: 4919792 - DNA, 19 bp, Homo sapiens
tttataaaaataaatagaa

SEQ ID NO: 4919793 - DNA, 23 bp, Homo sapiens
tttataaaaataaatagaaaagt

SEQ ID NO: 4919794 - DNA, 12 bp, Homo sapiens
tttataaatgag

SEQ ID NO: 4919795 - DNA, 23 bp, Homo sapiens
tttataagcaaatttcaaaagac

SEQ ID NO: 4919796 - DNA, 17 bp, Homo sapiens
tttataagtcattgtat

SEQ ID NO: 4919797 - DNA, 16 bp, Homo sapiens
tttataagttcacaaa

SEQ ID NO: 4919798 - DNA, 13 bp, Homo sapiens
tttatacaaaata

SEQ ID NO: 4919799 - DNA, 13 bp, Homo sapiens
tttatacattagt

SEQ ID NO: 4919800 - DNA, 16 bp, Homo sapiens
tttataccattcagat

SEQ ID NO: 4919801 - DNA, 21 bp, Homo sapiens
tttatacctcaaactatctgg

SEQ ID NO: 4919802 - DNA, 16 bp, Homo sapiens
tttatactctttctgt

SEQ ID NO: 4919803 - DNA, 20 bp, Homo sapiens
tttatagctattactgtctg

SEQ ID NO: 4919804 - DNA, 18 bp, Homo sapiens
tttataggtgagaaaaaa

SEQ ID NO: 4919805 - DNA, 14 bp, Homo sapiens
tttatataaatgta

SEQ ID NO: 4919806 - DNA, 13 bp, Homo sapiens
tttatatatacag

SEQ ID NO: 4919807 - DNA, 14 bp, Homo sapiens
tttatatgtacatg

SEQ ID NO: 4919808 - DNA, 12 bp, Homo sapiens
tttatatgtact

SEQ ID NO: 4919809 - DNA, 21 bp, Homo sapiens
tttatatgtgttgaaaaccaa

SEQ ID NO: 4919810 - DNA, 17 bp, Homo sapiens
tttatatttaattatta

SEQ ID NO: 4919811 - DNA, 14 bp, Homo sapiens
tttatatttagtga

SEQ ID NO: 4919812 - DNA, 14 bp, Homo sapiens
tttatatttagtta

SEQ ID NO: 4919813 - DNA, 15 bp, Homo sapiens
tttatcacacttctg

SEQ ID NO: 4919814 - DNA, 22 bp, Homo sapiens
tttatcactttttgaactaaga

SEQ ID NO: 4919815 - DNA, 13 bp, Homo sapiens
tttatcagataca

SEQ ID NO: 4919816 - DNA, 14 bp, Homo sapiens
tttatcagatacat

SEQ ID NO: 4919817 - DNA, 16 bp, Homo sapiens
tttatcagatacatca

SEQ ID NO: 4919818 - DNA, 22 bp, Homo sapiens
tttatcagatacatcactgctt

SEQ ID NO: 4919819 - DNA, 15 bp, Homo sapiens
tttatcatgacatgt

SEQ ID NO: 4919820 - DNA, 14 bp, Homo sapiens
tttatccacaggaa

SEQ ID NO: 4919821 - DNA, 15 bp, Homo sapiens
tttatctaaattaaa

SEQ ID NO: 4919822 - DNA, 20 bp, Homo sapiens
tttatctaatacctctgtgt

SEQ ID NO: 4919823 - DNA, 20 bp, Homo sapiens
tttatctattctgagaaaac

SEQ ID NO: 4919824 - DNA, 17 bp, Homo sapiens
tttatctctatttaata

SEQ ID NO: 4919825 - DNA, 13 bp, Homo sapiens
tttatctgtttaa

SEQ ID NO: 4919826 - DNA, 16 bp, Homo sapiens
tttatgaaaataaata

SEQ ID NO: 4919827 - DNA, 18 bp, Homo sapiens
tttatgaaaggtttacat

SEQ ID NO: 4919828 - DNA, 12 bp, Homo sapiens
tttatgaaatga

SEQ ID NO: 4919829 - DNA, 12 bp, Homo sapiens
tttatgaagttt

SEQ ID NO: 4919830 - DNA, 15 bp, Homo sapiens
tttatgaagtttaaa

SEQ ID NO: 4919831 - DNA, 17 bp, Homo sapiens
tttatgataatagattc

SEQ ID NO: 4919832 - DNA, 19 bp, Homo sapiens
tttatgataatagattctc

SEQ ID NO: 4919833 - DNA, 14 bp, Homo sapiens
tttatgatttaata

SEQ ID NO: 4919834 - DNA, 17 bp, Homo sapiens
tttatgcaaggaaggaa

SEQ ID NO: 4919835 - DNA, 20 bp, Homo sapiens
tttatgcatttgcatttgct

SEQ ID NO: 4919836 - DNA, 19 bp, Homo sapiens
tttatgccttcttattgct

SEQ ID NO: 4919837 - DNA, 20 bp, Homo sapiens
tttatgctcttttttactca

SEQ ID NO: 4919838 - DNA, 18 bp, Homo sapiens
tttatgggcattgacaaa

SEQ ID NO: 4919839 - DNA, 23 bp, Homo sapiens
tttatggtcctaaaagcaaaata

SEQ ID NO: 4919840 - DNA, 20 bp, Homo sapiens
tttatgtaatgaagtaaagc

SEQ ID NO: 4919841 - DNA, 18 bp, Homo sapiens
tttatgtctatttaagcc

SEQ ID NO: 4919842 - DNA, 16 bp, Homo sapiens
tttatgtgatcaattt

SEQ ID NO: 4919843 - DNA, 18 bp, Homo sapiens
tttatgtgtgaggagctg

SEQ ID NO: 4919844 - DNA, 21 bp, Homo sapiens
tttattaaaatgattgtaaaa

SEQ ID NO: 4919845 - DNA, 13 bp, Homo sapiens
tttattaaatttg

SEQ ID NO: 4919846 - DNA, 16 bp, Homo sapiens
tttattaatttatatg

SEQ ID NO: 4919847 - DNA, 12 bp, Homo sapiens
tttattaccccc

SEQ ID NO: 4919848 - DNA, 19 bp, Homo sapiens
tttattataaactgtatgc

SEQ ID NO: 4919849 - DNA, 19 bp, Homo sapiens
tttattccagaatgctgta

SEQ ID NO: 4919850 - DNA, 14 bp, Homo sapiens
tttattccttgtga

SEQ ID NO: 4919851 - DNA, 14 bp, Homo sapiens
tttattctcatttg

SEQ ID NO: 4919852 - DNA, 15 bp, Homo sapiens
tttattcttctagag

SEQ ID NO: 4919853 - DNA, 16 bp, Homo sapiens
tttattcttctagagt

SEQ ID NO: 4919854 - DNA, 13 bp, Homo sapiens
tttattgacacag

SEQ ID NO: 4919855 - DNA, 15 bp, Homo sapiens
tttattgacacagaa

SEQ ID NO: 4919856 - DNA, 13 bp, Homo sapiens
tttattgtataaa

SEQ ID NO: 4919857 - DNA, 22 bp, Homo sapiens
tttattgttttctatttatgcc

SEQ ID NO: 4919858 - DNA, 15 bp, Homo sapiens
tttatttaaagcatt

SEQ ID NO: 4919859 - DNA, 20 bp, Homo sapiens
tttatttacagatgaatgta

SEQ ID NO: 4919860 - DNA, 14 bp, Homo sapiens
tttatttgtttttc

SEQ ID NO: 4919861 - DNA, 17 bp, Homo sapiens
tttattttactattgga

SEQ ID NO: 4919862 - DNA, 12 bp, Homo sapiens
tttattttccta

SEQ ID NO: 4919863 - DNA, 15 bp, Homo sapiens
tttatttttcatatt

SEQ ID NO: 4919864 - DNA, 20 bp, Homo sapiens
tttatttttcatattgtgcc

SEQ ID NO: 4919865 - DNA, 14 bp, Homo sapiens
tttattttttagtg

SEQ ID NO: 4919866 - DNA, 16 bp, Homo sapiens
tttcaaaaatataact

SEQ ID NO: 4919867 - DNA, 18 bp, Homo sapiens
tttcaaaaatataactta

SEQ ID NO: 4919868 - DNA, 12 bp, Homo sapiens
tttcaaaagaca

SEQ ID NO: 4919869 - DNA, 18 bp, Homo sapiens
tttcaaaagacatgttgt

SEQ ID NO: 4919870 - DNA, 17 bp, Homo sapiens
tttcaaaatccaaaaag

SEQ ID NO: 4919871 - DNA, 18 bp, Homo sapiens
tttcaaaatccaaaaaga

SEQ ID NO: 4919872 - DNA, 12 bp, Homo sapiens
tttcaaaatgct

SEQ ID NO: 4919873 - DNA, 13 bp, Homo sapiens
tttcaaaatgctt

SEQ ID NO: 4919874 - DNA, 15 bp, Homo sapiens
tttcaaaatgctttt

SEQ ID NO: 4919875 - DNA, 13 bp, Homo sapiens
tttcaaagatgct

SEQ ID NO: 4919876 - DNA, 19 bp, Homo sapiens
tttcaaattggactttcaa

SEQ ID NO: 4919877 - DNA, 14 bp, Homo sapiens
tttcaaatttcaca

SEQ ID NO: 4919878 - DNA, 14 bp, Homo sapiens
ttcatgctctgcaa

SEQ ID NO: 4919879 - DNA, 21 bp, Homo sapiens
ttcatgtagagaaaagcacac

SEQ ID NO: 4919880 - DNA, 14 bp, Homo sapiens
ttcatgtttgcttc

SEQ ID NO: 4919881 - DNA, 17 bp, Homo sapiens
ttcattcaatattgaca

SEQ ID NO: 4919882 - DNA, 18 bp, Homo sapiens
ttcattcaatattgacat

SEQ ID NO: 4919883 - DNA, 12 bp, Homo sapiens
ttcattcatccc

SEQ ID NO: 4919884 - DNA, 18 bp, Homo sapiens
ttcattcatggaccactg

SEQ ID NO: 4919885 - DNA, 21 bp, Homo sapiens
ttcattctcattgcagaataa

SEQ ID NO: 4919886 - DNA, 13 bp, Homo sapiens
ttcattctcctgc

SEQ ID NO: 4919887 - DNA, 15 bp, Homo sapiens
ttcattctcctgcct

SEQ ID NO: 4919888 - DNA, 17 bp, Homo sapiens
ttcattgagagttttgt

SEQ ID NO: 4919889 - DNA, 12 bp, Homo sapiens
ttcattgtctct

SEQ ID NO: 4919890 - DNA, 13 bp, Homo sapiens
ttcatttccactc

SEQ ID NO: 4919891 - DNA, 16 bp, Homo sapiens
ttcatttcctgtgtct

SEQ ID NO: 4919892 - DNA, 20 bp, Homo sapiens
ttccaaaattcttatttttc

SEQ ID NO: 4919893 - DNA, 21 bp, Homo sapiens
ttccaaacaacagaaagtcat

SEQ ID NO: 4919894 - DNA, 16 bp, Homo sapiens
ttccaaagaattctta

SEQ ID NO: 4919895 - DNA, 21 bp, Homo sapiens
ttccaaagagtagaattgcat

SEQ ID NO: 4919896 - DNA, 14 bp, Homo sapiens
ttccaaagtctcta

SEQ ID NO: 4919897 - DNA, 12 bp, Homo sapiens
ttccaacaccac

SEQ ID NO: 4919898 - DNA, 21 bp, Homo sapiens
ttccaacaccacagacacaca

SEQ ID NO: 4919899 - DNA, 16 bp, Homo sapiens
ttccaagactctagag

SEQ ID NO: 4919900 - DNA, 17 bp, Homo sapiens
ttccaagactctagagt

SEQ ID NO: 4919901 - DNA, 12 bp, Homo sapiens
ttccaagagtct

SEQ ID NO: 4919902 - DNA, 15 bp, Homo sapiens
ttccaagagtctaaa

SEQ ID NO: 4919903 - DNA, 15 bp, Homo sapiens
ttccaatcctggctc

SEQ ID NO: 4919904 - DNA, 23 bp, Homo sapiens
ttccaatcctggctctgtggctt

SEQ ID NO: 4919905 - DNA, 15 bp, Homo sapiens
ttccacatgctctga

SEQ ID NO: 4919906 - DNA, 15 bp, Homo sapiens
ttccaccttcccatg

SEQ ID NO: 4919907 - DNA, 19 bp, Homo sapiens
ttccacgtgttttattcct

SEQ ID NO: 4919908 - DNA, 14 bp, Homo sapiens
ttccactgcctctg

SEQ ID NO: 4919909 - DNA, 21 bp, Homo sapiens
ttccacttagaaattgcattt

SEQ ID NO: 4919910 - DNA, 20 bp, Homo sapiens
ttccagaagaagagaagctg

SEQ ID NO: 4919911 - DNA, 19 bp, Homo sapiens
ttccagaatgctgtacatc

SEQ ID NO: 4919912 - DNA, 19 bp, Homo sapiens
ttccagaggctattatttt

SEQ ID NO: 4919913 - DNA, 18 bp, Homo sapiens
ttccagatcactgccaca

SEQ ID NO: 4919914 - DNA, 11 bp, Homo sapiens
ttccagctgct

SEQ ID NO: 4919915 - DNA, 12 bp, Homo sapiens
ttccagctgctg

SEQ ID NO: 4919916 - DNA, 13 bp, Homo sapiens
ttccagctgctgt

SEQ ID NO: 4919917 - DNA, 20 bp, Homo sapiens
ttccagctgctgtcttctgg

SEQ ID NO: 4919918 - DNA, 22 bp, Homo sapiens
ttccagctgctgtcttctggac

SEQ ID NO: 4919919 - DNA, 19 bp, Homo sapiens
ttccagtctcaaaaataca

SEQ ID NO: 4919920 - DNA, 13 bp, Homo sapiens
ttccagtgttcta

SEQ ID NO: 4919921 - DNA, 23 bp, Homo sapiens
ttccataatctggactcctctgt

SEQ ID NO: 4919922 - DNA, 17 bp, Homo sapiens
ttccatagcaacaggaa

SEQ ID NO: 4919923 - DNA, 17 bp, Homo sapiens
ttccatccataaatcca

SEQ ID NO: 4919924 - DNA, 23 bp, Homo sapiens
ttccatccataaatccagttcta

SEQ ID NO: 4919925 - DNA, 12 bp, Homo sapiens
ttccatctgaaa

SEQ ID NO: 4919926 - DNA, 19 bp, Homo sapiens
ttccatgtcgcctctgcat

SEQ ID NO: 4919927 - DNA, 16 bp, Homo sapiens
ttccattccattgttt

SEQ ID NO: 4919928 - DNA, 12 bp, Homo sapiens
ttccatttccaa

SEQ ID NO: 4919929 - DNA, 23 bp, Homo sapiens
ttccattttggcgctattacaaa

SEQ ID NO: 4919930 - DNA, 16 bp, Homo sapiens
ttcccaaacgcctccc

SEQ ID NO: 4919931 - DNA, 14 bp, Homo sapiens
ttcccaagctctgc

SEQ ID NO: 4919932 - DNA, 18 bp, Homo sapiens
ttcccaagctctgctcct

SEQ ID NO: 4919933 - DNA, 15 bp, Homo sapiens
ttcccaatcagcact

SEQ ID NO: 4919934 - DNA, 21 bp, Homo sapiens
ttcccacctccctgcccaggc

SEQ ID NO: 4919935 - DNA, 20 bp, Homo sapiens
ttcccactttcccaccccac

SEQ ID NO: 4919936 - DNA, 18 bp, Homo sapiens
ttcccagagcaaaataat

SEQ ID NO: 4919937 - DNA, 19 bp, Homo sapiens
ttcccagagtcatctgatt

SEQ ID NO: 4919938 - DNA, 14 bp, Homo sapiens
ttcccatcgctgtc

SEQ ID NO: 4919939 - DNA, 14 bp, Homo sapiens
ttcccattcttgca

SEQ ID NO: 4919940 - DNA, 17 bp, Homo sapiens
ttcccatttgtgccaga

SEQ ID NO: 4919941 - DNA, 12 bp, Homo sapiens
ttccccagcatc

SEQ ID NO: 4919942 - DNA, 18 bp, Homo sapiens
ttccccatcttctaaacc

SEQ ID NO: 4919943 - DNA, 22 bp, Homo sapiens
ttcccccaccggtccagctggc

SEQ ID NO: 4919944 - DNA, 18 bp, Homo sapiens
ttcccccatagccacccc

SEQ ID NO: 4919945 - DNA, 21 bp, Homo sapiens
ttccccccatgttgtaatgct

SEQ ID NO: 4919946 - DNA, 17 bp, Homo sapiens
ttcccccttccaaataa

SEQ ID NO: 4919947 - DNA, 15 bp, Homo sapiens
ttcccctctgctgct

SEQ ID NO: 4919948 - DNA, 18 bp, Homo sapiens
ttcccctctgctgctgtc

SEQ ID NO: 4919949 - DNA, 19 bp, Homo sapiens
ttcccctcttcccttcaac

SEQ ID NO: 4919950 - DNA, 14 bp, Homo sapiens
ttcccctgttcact

SEQ ID NO: 4919951 - DNA, 21 bp, Homo sapiens
ttcccgccagagggcttgtga

SEQ ID NO: 4919952 - DNA, 18 bp, Homo sapiens
ttcccgctcagccctccc

SEQ ID NO: 4919953 - DNA, 19 bp, Homo sapiens
ttcccggtcccgagtacag

SEQ ID NO: 4919954 - DNA, 15 bp, Homo sapiens
ttcccgtttctccac

SEQ ID NO: 4919955 - DNA, 15 bp, Homo sapiens
ttccctaaagtgatg

SEQ ID NO: 4919956 - DNA, 13 bp, Homo sapiens
ttccctacctcag

SEQ ID NO: 4919957 - DNA, 14 bp, Homo sapiens
ttccctacctcagg

SEQ ID NO: 4919958 - DNA, 15 bp, Homo sapiens
ttccctacctcaggc

SEQ ID NO: 4919959 - DNA, 13 bp, Homo sapiens
ttccctacttcct

SEQ ID NO: 4919960 - DNA, 17 bp, Homo sapiens
ttccctctgctcagcca

SEQ ID NO: 4919961 - DNA, 14 bp, Homo sapiens
ttccctctttggct

SEQ ID NO: 4919962 - DNA, 20 bp, Homo sapiens
ttccctctttggctcccctg

SEQ ID NO: 4919963 - DNA, 17 bp, Homo sapiens
ttccctcttttcttact

SEQ ID NO: 4919964 - DNA, 21 bp, Homo sapiens
ttccctgaaacacgaaacttg

SEQ ID NO: 4919965 - DNA, 23 bp, Homo sapiens
ttccctgaaacacgaaacttgtt

SEQ ID NO: 4919966 - DNA, 12 bp, Homo sapiens
ttccctgttctt

SEQ ID NO: 4919967 - DNA, 18 bp, Homo sapiens
ttccctgttcttcctcca

SEQ ID NO: 4919968 - DNA, 23 bp, Homo sapiens
ttcccttcagtaccctctcagct

SEQ ID NO: 4919969 - DNA, 13 bp, Homo sapiens
ttcccttccactg

SEQ ID NO: 4919970 - DNA, 17 bp, Homo sapiens
ttcccttcctccatcct

SEQ ID NO: 4919971 - DNA, 12 bp, Homo sapiens
ttcccttcctct

SEQ ID NO: 4919972 - DNA, 13 bp, Homo sapiens
ttcccttctctca

SEQ ID NO: 4919973 - DNA, 23 bp, Homo sapiens
ttcccttgaaattttaaactata

SEQ ID NO: 4919974 - DNA, 12 bp, Homo sapiens
ttcccttggcct

SEQ ID NO: 4919975 - DNA, 14 bp, Homo sapiens
ttcccttggcctca

SEQ ID NO: 4919976 - DNA, 16 bp, Homo sapiens
ttcccttggcctcaga

SEQ ID NO: 4919977 - DNA, 22 bp, Homo sapiens
ttccgcactttccacttcttcc

SEQ ID NO: 4919978 - DNA, 17 bp, Homo sapiens
ttccgcaggcagactac

SEQ ID NO: 4919979 - DNA, 18 bp, Homo sapiens
ttccgcccctgcctgcca

SEQ ID NO: 4919980 - DNA, 15 bp, Homo sapiens
ttccgccccttccct

SEQ ID NO: 4919981 - DNA, 20 bp, Homo sapiens
ttccgtaggtagatgtgtaa

SEQ ID NO: 4919982 - DNA, 17 bp, Homo sapiens
ttccgtgaaaacggagc

SEQ ID NO: 4919983 - DNA, 20 bp, Homo sapiens
ttcctaatcagaaattttta

SEQ ID NO: 4919984 - DNA, 18 bp, Homo sapiens
ttcctaatttcccttctt

SEQ ID NO: 4919985 - DNA, 14 bp, Homo sapiens
ttcctacagcacta

SEQ ID NO: 4919986 - DNA, 17 bp, Homo sapiens
ttcctacaggcagtctc

SEQ ID NO: 4919987 - DNA, 18 bp, Homo sapiens
ttcctacaggcagtctct

SEQ ID NO: 4919988 - DNA, 23 bp, Homo sapiens
ttcctacgtaggatgaaaagatt

SEQ ID NO: 4919989 - DNA, 16 bp, Homo sapiens
tgttttgagagtaatg

SEQ ID NO: 4919990 - DNA, 12 bp, Homo sapiens
tgttttgcactt

SEQ ID NO: 4919991 - DNA, 16 bp, Homo sapiens
tgttttggtagattaa

SEQ ID NO: 4919992 - DNA, 12 bp, Homo sapiens
tgttttgttaat

SEQ ID NO: 4919993 - DNA, 13 bp, Homo sapiens
tgttttgtttgtc

SEQ ID NO: 4919994 - DNA, 14 bp, Homo sapiens
tgttttgtttgtct

SEQ ID NO: 4919995 - DNA, 16 bp, Homo sapiens
tgttttgtttgtctct

SEQ ID NO: 4919996 - DNA, 19 bp, Homo sapiens
tgtttttaaaagtttcaat

SEQ ID NO: 4919997 - DNA, 18 bp, Homo sapiens
tgtttttattaatttata

SEQ ID NO: 4919998 - DNA, 14 bp, Homo sapiens
tgtttttcattcat

SEQ ID NO: 4919999 - DNA, 14 bp, Homo sapiens
tgtttttctccagt

SEQ ID NO: 4920000 - DNA, 15 bp, Homo sapiens
tgttttttatgaagt

SEQ ID NO: 4920001 - DNA, 13 bp, Homo sapiens
tgttttttccttt

SEQ ID NO: 4920002 - DNA, 18 bp, Homo sapiens
tgttttttttttccactt

SEQ ID NO: 4920003 - DNA, 18 bp, Homo sapiens
ttaaaaaaaaagatctgt

SEQ ID NO: 4920004 - DNA, 12 bp, Homo sapiens
ttaaaaaaagaa

SEQ ID NO: 4920005 - DNA, 17 bp, Homo sapiens
ttaaaaaaatcacaaaa

SEQ ID NO: 4920006 - DNA, 16 bp, Homo sapiens
ttaaaaaatgaaatcc

SEQ ID NO: 4920007 - DNA, 18 bp, Homo sapiens
ttaaaaagattctttttc

SEQ ID NO: 4920008 - DNA, 14 bp, Homo sapiens
ttaaaaatacatat

SEQ ID NO: 4920009 - DNA, 23 bp, Homo sapiens
ttaaaaatatggaacttctaata

SEQ ID NO: 4920010 - DNA, 12 bp, Homo sapiens
ttaaaaatggaa

SEQ ID NO: 4920011 - DNA, 14 bp, Homo sapiens
ttaaaaatgtaaat

SEQ ID NO: 4920012 - DNA, 16 bp, Homo sapiens
ttaaaaatgtaaatat

SEQ ID NO: 4920013 - DNA, 19 bp, Homo sapiens
ttaaaaatgtaaatattct

SEQ ID NO: 4920014 - DNA, 12 bp, Homo sapiens
ttaaaacaaaac

SEQ ID NO: 4920015 - DNA, 14 bp, Homo sapiens
ttaaaactcagcct

SEQ ID NO: 4920016 - DNA, 13 bp, Homo sapiens
ttaaaactgcttt

SEQ ID NO: 4920017 - DNA, 12 bp, Homo sapiens
ttaaaagaaatt

SEQ ID NO: 4920018 - DNA, 16 bp, Homo sapiens
ttaaaagaaatttatt

SEQ ID NO: 4920019 - DNA, 22 bp, Homo sapiens
ttaaaagtttcaatgtgattct

SEQ ID NO: 4920020 - DNA, 23 bp, Homo sapiens
ttaaaataggggatatttaaggt

SEQ ID NO: 4920021 - DNA, 16 bp, Homo sapiens
ttaaaatgattgtaaa

SEQ ID NO: 4920022 - DNA, 18 bp, Homo sapiens
ttaaaatgattgtaaaat

SEQ ID NO: 4920023 - DNA, 20 bp, Homo sapiens
ttaaaattatgaatctgatt

SEQ ID NO: 4920024 - DNA, 22 bp, Homo sapiens
ttaaaattatgaatctgatttt

SEQ ID NO: 4920025 - DNA, 20 bp, Homo sapiens
ttaaacaaacattgtgttga

SEQ ID NO: 4920026 - DNA, 16 bp, Homo sapiens
ttaaacacctcctcat

SEQ ID NO: 4920027 - DNA, 12 bp, Homo sapiens
ttaaacagatga

SEQ ID NO: 4920028 - DNA, 12 bp, Homo sapiens
ttaaacagcagt

SEQ ID NO: 4920029 - DNA, 21 bp, Homo sapiens
ttaaaccagtttagatttcaa

SEQ ID NO: 4920030 - DNA, 14 bp, Homo sapiens
ttaaactcaagaca

SEQ ID NO: 4920031 - DNA, 21 bp, Homo sapiens
ttaaagaaacagctttcaagt

SEQ ID NO: 4920032 - DNA, 17 bp, Homo sapiens
ttaaagagtctagattc

SEQ ID NO: 4920033 - DNA, 17 bp, Homo sapiens
ttaaagatattgttcaa

SEQ ID NO: 4920034 - DNA, 18 bp, Homo sapiens
ttaaagatcatgacatat

SEQ ID NO: 4920035 - DNA, 17 bp, Homo sapiens
ttaaagatgaactctga

SEQ ID NO: 4920036 - DNA, 18 bp, Homo sapiens
ttaaagatgaactctgaa

SEQ ID NO: 4920037 - DNA, 17 bp, Homo sapiens
ttaaagcaaaaaatgaa

SEQ ID NO: 4920038 - DNA, 19 bp, Homo sapiens
ttaaagcatatagagatga

SEQ ID NO: 4920039 - DNA, 21 bp, Homo sapiens
ttaaagcattgctgttatgtc

SEQ ID NO: 4920040 - DNA, 22 bp, Homo sapiens
ttaaagcattgctgttatgtct

SEQ ID NO: 4920041 - DNA, 13 bp, Homo sapiens
ttaaagcctcctc

SEQ ID NO: 4920042 - DNA, 14 bp, Homo sapiens
ttaaagcctcctca

SEQ ID NO: 4920043 - DNA, 18 bp, Homo sapiens
ttaaaggcccagccccta

SEQ ID NO: 4920044 - DNA, 22 bp, Homo sapiens
ttaaagtgctaaggttctaagg

SEQ ID NO: 4920045 - DNA, 14 bp, Homo sapiens
ttaaagttggaatt

SEQ ID NO: 4920046 - DNA, 13 bp, Homo sapiens
ttaaataaaagaa

SEQ ID NO: 4920047 - DNA, 14 bp, Homo sapiens
ttaaataaactttt

SEQ ID NO: 4920048 - DNA, 21 bp, Homo sapiens
ttaaataaactttttttcaat

SEQ ID NO: 4920049 - DNA, 13 bp, Homo sapiens
ttaaataatttaa

SEQ ID NO: 4920050 - DNA, 19 bp, Homo sapiens
ttaaatagagtatatgcac

SEQ ID NO: 4920051 - DNA, 18 bp, Homo sapiens
ttaaataggatattaaca

SEQ ID NO: 4920052 - DNA, 12 bp, Homo sapiens
ttaaatataatt

SEQ ID NO: 4920053 - DNA, 23 bp, Homo sapiens
ttaaatatagttcctaagaagct

SEQ ID NO: 4920054 - DNA, 16 bp, Homo sapiens
ttaaatatcttttatg

SEQ ID NO: 4920055 - DNA, 21 bp, Homo sapiens
ttaaatatcttttatgtttga

SEQ ID NO: 4920056 - DNA, 20 bp, Homo sapiens
ttaaatctaaatctatttat

SEQ ID NO: 4920057 - DNA, 14 bp, Homo sapiens
ttaaatgaaattgt

SEQ ID NO: 4920058 - DNA, 23 bp, Homo sapiens
ttaaatgaaattgtaaaacctgt

SEQ ID NO: 4920059 - DNA, 21 bp, Homo sapiens
ttaaatgaatattttgataat

SEQ ID NO: 4920060 - DNA, 16 bp, Homo sapiens
ttaaatgaggattatt

SEQ ID NO: 4920061 - DNA, 12 bp, Homo sapiens
ttaaatgtatac

SEQ ID NO: 4920062 - DNA, 19 bp, Homo sapiens
ttaaatgtatactatagta

SEQ ID NO: 4920063 - DNA, 16 bp, Homo sapiens
ttaaatgttatgacta

SEQ ID NO: 4920064 - DNA, 18 bp, Homo sapiens
ttaaattctgagacatgt

SEQ ID NO: 4920065 - DNA, 14 bp, Homo sapiens
ttaaatttgtaagt

SEQ ID NO: 4920066 - DNA, 21 bp, Homo sapiens
ttaaatttgtaagtttcaggt

SEQ ID NO: 4920067 - DNA, 17 bp, Homo sapiens
ttaaattttaaggtaga

SEQ ID NO: 4920068 - DNA, 16 bp, Homo sapiens
ttaaattttacccttt

SEQ ID NO: 4920069 - DNA, 23 bp, Homo sapiens
ttaaattttaccctttagactgt

SEQ ID NO: 4920070 - DNA, 20 bp, Homo sapiens
ttaaattttgagttctacat

SEQ ID NO: 4920071 - DNA, 18 bp, Homo sapiens
ttaaattttttttacatt

SEQ ID NO: 4920072 - DNA, 20 bp, Homo sapiens
ttaaattttttttacatttt

SEQ ID NO: 4920073 - DNA, 18 bp, Homo sapiens
ttaacaaatatgctaatt

SEQ ID NO: 4920074 - DNA, 22 bp, Homo sapiens
ttaacatagtaagttcagcact

SEQ ID NO: 4920075 - DNA, 17 bp, Homo sapiens
ttaacatatttactaag

SEQ ID NO: 4920076 - DNA, 13 bp, Homo sapiens
ttaacattccaag

SEQ ID NO: 4920077 - DNA, 16 bp, Homo sapiens
ttaacattttgttctt

SEQ ID NO: 4920078 - DNA, 17 bp, Homo sapiens
ttaacattttgttctta

SEQ ID NO: 4920079 - DNA, 13 bp, Homo sapiens
ttaactacattta

SEQ ID NO: 4920080 - DNA, 16 bp, Homo sapiens
ttaactacatttatga

SEQ ID NO: 4920081 - DNA, 15 bp, Homo sapiens
ttaactataaatatg

SEQ ID NO: 4920082 - DNA, 16 bp, Homo sapiens
ttaagaaaagtatttt

SEQ ID NO: 4920083 - DNA, 18 bp, Homo sapiens
ttaagaaaagtattttga

SEQ ID NO: 4920084 - DNA, 23 bp, Homo sapiens
ttaagaaaagtattttgaagttt

SEQ ID NO: 4920085 - DNA, 14 bp, Homo sapiens
ttaagaagctgttg

SEQ ID NO: 4920086 - DNA, 18 bp, Homo sapiens
ttaagaagctgttgtaca

SEQ ID NO: 4920087 - DNA, 20 bp, Homo sapiens
ttaagaatatgtttccttgt

SEQ ID NO: 4920088 - DNA, 14 bp, Homo sapiens
ttaagaattgacca

SEQ ID NO: 4920089 - DNA, 12 bp, Homo sapiens
ttaagagaaact

SEQ ID NO: 4920090 - DNA, 13 bp, Homo sapiens
ttaagagaaactt

SEQ ID NO: 4920091 - DNA, 15 bp, Homo sapiens
ttaagagagaaatct

SEQ ID NO: 4920092 - DNA, 14 bp, Homo sapiens
ttaagagtccaaga

SEQ ID NO: 4920093 - DNA, 16 bp, Homo sapiens
ttaagattttacaaaa

SEQ ID NO: 4920094 - DNA, 17 bp, Homo sapiens
ttaagatttttctcaaa

SEQ ID NO: 4920095 - DNA, 19 bp, Homo sapiens
ttaagcaaaagaaaaagat

SEQ ID NO: 4920096 - DNA, 21 bp, Homo sapiens
ttaagcagatggaatgctgtg

SEQ ID NO: 4920097 - DNA, 19 bp, Homo sapiens
ttaagcctcatatttaaag

SEQ ID NO: 4920098 - DNA, 21 bp, Homo sapiens
ttaagcctcatatttaaagac

SEQ ID NO: 4920099 - DNA, 14 bp, Homo sapiens
ttaaggaaactctt

SEQ ID NO: 4920100 - DNA, 17 bp, Homo sapiens
ttacagaaatactataa

SEQ ID NO: 4920101 - DNA, 22 bp, Homo sapiens
ttacagccaagtgccaaatgct

SEQ ID NO: 4920102 - DNA, 23 bp, Homo sapiens
ttacagccaagtgccaaatgctc

SEQ ID NO: 4920103 - DNA, 13 bp, Homo sapiens
ttacagctgcctg

SEQ ID NO: 4920104 - DNA, 14 bp, Homo sapiens
ttacagctgcctgc

SEQ ID NO: 4920105 - DNA, 11 bp, Homo sapiens
ttacaggccct

SEQ ID NO: 4920106 - DNA, 17 bp, Homo sapiens
ttacaggccctgctcct

SEQ ID NO: 4920107 - DNA, 18 bp, Homo sapiens
ttacaggtggacacacaa

SEQ ID NO: 4920108 - DNA, 15 bp, Homo sapiens
ttacataactgcctt

SEQ ID NO: 4920109 - DNA, 13 bp, Homo sapiens
ttacatccttaaa

SEQ ID NO: 4920110 - DNA, 23 bp, Homo sapiens
ttacatgcaatttattaaaatga

SEQ ID NO: 4920111 - DNA, 13 bp, Homo sapiens
ttacattgtaaat

SEQ ID NO: 4920112 - DNA, 21 bp, Homo sapiens
ttacatttaaagcattgctgt

SEQ ID NO: 4920113 - DNA, 13 bp, Homo sapiens
ttacatttttatt

SEQ ID NO: 4920114 - DNA, 22 bp, Homo sapiens
ttacatttttatttatgaagtt

SEQ ID NO: 4920115 - DNA, 13 bp, Homo sapiens
ttaccaactttct

SEQ ID NO: 4920116 - DNA, 15 bp, Homo sapiens
ttaccaactttctgt

SEQ ID NO: 4920117 - DNA, 16 bp, Homo sapiens
ttaccaactttctgta

SEQ ID NO: 4920118 - DNA, 18 bp, Homo sapiens
ttaccaactttctgtaaa

SEQ ID NO: 4920119 - DNA, 15 bp, Homo sapiens
ttaccacacatctat

SEQ ID NO: 4920120 - DNA, 20 bp, Homo sapiens
ttaccacacatctatgatat

SEQ ID NO: 4920121 - DNA, 17 bp, Homo sapiens
ttaccagggatgtagat

SEQ ID NO: 4920122 - DNA, 21 bp, Homo sapiens
ttaccagtctttaaaggccca

SEQ ID NO: 4920123 - DNA, 13 bp, Homo sapiens
ttaccattcacaa

SEQ ID NO: 4920124 - DNA, 15 bp, Homo sapiens
ttaccattcacaata

SEQ ID NO: 4920125 - DNA, 17 bp, Homo sapiens
ttaccattcacaataaa

SEQ ID NO: 4920126 - DNA, 15 bp, Homo sapiens
ttacccacctagaac

SEQ ID NO: 4920127 - DNA, 12 bp, Homo sapiens
ttaccctgggaa

SEQ ID NO: 4920128 - DNA, 16 bp, Homo sapiens
ttaccctttagactgt

SEQ ID NO: 4920129 - DNA, 15 bp, Homo sapiens
ttacctccaacagaa

SEQ ID NO: 4920130 - DNA, 16 bp, Homo sapiens
ttacctgacctcttgc

SEQ ID NO: 4920131 - DNA, 18 bp, Homo sapiens
ttacctgacctcttgctg

SEQ ID NO: 4920132 - DNA, 20 bp, Homo sapiens
ttacctgacctcttgctgtc

SEQ ID NO: 4920133 - DNA, 14 bp, Homo sapiens
ttacctgcaggctg

SEQ ID NO: 4920134 - DNA, 23 bp, Homo sapiens
ttacctgttttcgcacctaccat

SEQ ID NO: 4920135 - DNA, 13 bp, Homo sapiens
ttacgctttgatt

SEQ ID NO: 4920136 - DNA, 17 bp, Homo sapiens
ttactaaaatatatata

SEQ ID NO: 4920137 - DNA, 18 bp, Homo sapiens
ttactaagccacaagaaa

SEQ ID NO: 4920138 - DNA, 21 bp, Homo sapiens
ttactaagccacaagaaattt

SEQ ID NO: 4920139 - DNA, 21 bp, Homo sapiens
ttactattttgacagttattt

SEQ ID NO: 4920140 - DNA, 19 bp, Homo sapiens
ttactcagggctcctccca

SEQ ID NO: 4920141 - DNA, 18 bp, Homo sapiens
ttactcattgaaatgtca

SEQ ID NO: 4920142 - DNA, 19 bp, Homo sapiens
ttactcattgaaatgtcac

SEQ ID NO: 4920143 - DNA, 16 bp, Homo sapiens
ttactccataaacaga

SEQ ID NO: 4920144 - DNA, 12 bp, Homo sapiens
ttactcctcctc

SEQ ID NO: 4920145 - DNA, 19 bp, Homo sapiens
ttactctaagatcttagat

SEQ ID NO: 4920146 - DNA, 14 bp, Homo sapiens
ttatcagatacatc

SEQ ID NO: 4920147 - DNA, 22 bp, Homo sapiens
ttatcagctacttaagagaaat

SEQ ID NO: 4920148 - DNA, 15 bp, Homo sapiens
ttatcagtcaatatt

SEQ ID NO: 4920149 - DNA, 23 bp, Homo sapiens
ttatcagtcaatatttttagata

SEQ ID NO: 4920150 - DNA, 14 bp, Homo sapiens
ttatcatgaagcct

SEQ ID NO: 4920151 - DNA, 16 bp, Homo sapiens
ttatcatgaagcctgt

SEQ ID NO: 4920152 - DNA, 22 bp, Homo sapiens
ttatcatgaagcctgtggatga

SEQ ID NO: 4920153 - DNA, 15 bp, Homo sapiens
ttatccatttgtaat

SEQ ID NO: 4920154 - DNA, 19 bp, Homo sapiens
ttatcctaaaacaaatagt

SEQ ID NO: 4920155 - DNA, 22 bp, Homo sapiens
ttatcctgaactcttctgcaaa

SEQ ID NO: 4920156 - DNA, 16 bp, Homo sapiens
ttatcctgcattgtta

SEQ ID NO: 4920157 - DNA, 21 bp, Homo sapiens
ttatcgaaataacaatgttaa

SEQ ID NO: 4920158 - DNA, 22 bp, Homo sapiens
ttatcgaaataacaatgttaag

SEQ ID NO: 4920159 - DNA, 15 bp, Homo sapiens
ttatctaaattaaag

SEQ ID NO: 4920160 - DNA, 19 bp, Homo sapiens
ttatctgtttaaagcatat

SEQ ID NO: 4920161 - DNA, 19 bp, Homo sapiens
ttatcttctcaagttctaa

SEQ ID NO: 4920162 - DNA, 16 bp, Homo sapiens
ttatctttacttttaa

SEQ ID NO: 4920163 - DNA, 15 bp, Homo sapiens
ttatgaaaataaata

SEQ ID NO: 4920164 - DNA, 20 bp, Homo sapiens
ttatgaaataaagaaattgc

SEQ ID NO: 4920165 - DNA, 20 bp, Homo sapiens
ttatgaagtttaaaacagta

SEQ ID NO: 4920166 - DNA, 13 bp, Homo sapiens
ttatgaatcagtg

SEQ ID NO: 4920167 - DNA, 21 bp, Homo sapiens
ttatgacatcacttgtacaaa

SEQ ID NO: 4920168 - DNA, 16 bp, Homo sapiens
ttatgagcagaaggaa

SEQ ID NO: 4920169 - DNA, 19 bp, Homo sapiens
ttatgagttattcatattc

SEQ ID NO: 4920170 - DNA, 15 bp, Homo sapiens
ttatgagtttgctta

SEQ ID NO: 4920171 - DNA, 13 bp, Homo sapiens
ttatgatgatgaa

SEQ ID NO: 4920172 - DNA, 14 bp, Homo sapiens
ttatgatgatgaaa

SEQ ID NO: 4920173 - DNA, 23 bp, Homo sapiens
ttatgatgatgaaaattttacca

SEQ ID NO: 4920174 - DNA, 13 bp, Homo sapiens
ttatgatttaata

SEQ ID NO: 4920175 - DNA, 17 bp, Homo sapiens
ttatgatttaataaaat

SEQ ID NO: 4920176 - DNA, 18 bp, Homo sapiens
ttatgattttcataactt

SEQ ID NO: 4920177 - DNA, 23 bp, Homo sapiens
ttatgcaattaggtttttcctta

SEQ ID NO: 4920178 - DNA, 22 bp, Homo sapiens
ttatgcactaaatatgaaccct

SEQ ID NO: 4920179 - DNA, 14 bp, Homo sapiens
ttatggaattgatt

SEQ ID NO: 4920180 - DNA, 20 bp, Homo sapiens
ttatggaattgatttgcatt

SEQ ID NO: 4920181 - DNA, 11 bp, Homo sapiens
ttatggcctca

SEQ ID NO: 4920182 - DNA, 18 bp, Homo sapiens
ttatggcctcagctgcct

SEQ ID NO: 4920183 - DNA, 17 bp, Homo sapiens
ttatgggcattgacaaa

SEQ ID NO: 4920184 - DNA, 22 bp, Homo sapiens
ttatggtcaatcccaaaagtca

SEQ ID NO: 4920185 - DNA, 21 bp, Homo sapiens
ttatggtcctaaaagcaaaat

SEQ ID NO: 4920186 - DNA, 13 bp, Homo sapiens
ttatgtactgtac

SEQ ID NO: 4920187 - DNA, 15 bp, Homo sapiens
ttatgtactgtacta

SEQ ID NO: 4920188 - DNA, 15 bp, Homo sapiens
ttatgtagatatttg

SEQ ID NO: 4920189 - DNA, 22 bp, Homo sapiens
ttatgtagatatttggcttaaa

SEQ ID NO: 4920190 - DNA, 19 bp, Homo sapiens
ttatgtagtaattgacatg

SEQ ID NO: 4920191 - DNA, 17 bp, Homo sapiens
ttatgtctatttaagcc

SEQ ID NO: 4920192 - DNA, 17 bp, Homo sapiens
ttatgtctgtttaagaa

SEQ ID NO: 4920193 - DNA, 20 bp, Homo sapiens
ttatgtgacattttacatta

SEQ ID NO: 4920194 - DNA, 18 bp, Homo sapiens
ttatgtgtatgtgccatt

SEQ ID NO: 4920195 - DNA, 19 bp, Homo sapiens
ttatgtgtgaggagctgct

SEQ ID NO: 4920196 - DNA, 12 bp, Homo sapiens
ttatgttaaaat

SEQ ID NO: 4920197 - DNA, 15 bp, Homo sapiens
ttattaaataaaatc

SEQ ID NO: 4920198 - DNA, 16 bp, Homo sapiens
ttattaaataaaatca

SEQ ID NO: 4920199 - DNA, 21 bp, Homo sapiens
ttattaaataaaatcaatttt

SEQ ID NO: 4920200 - DNA, 16 bp, Homo sapiens
ttattaactacattta

SEQ ID NO: 4920201 - DNA, 22 bp, Homo sapiens
ttattaagttctcaatgtgaaa

SEQ ID NO: 4920202 - DNA, 19 bp, Homo sapiens
ttattaccccctccttcag

SEQ ID NO: 4920203 - DNA, 22 bp, Homo sapiens
ttattaccccctccttcagaca

SEQ ID NO: 4920204 - DNA, 15 bp, Homo sapiens
ttattagttaatata

SEQ ID NO: 4920205 - DNA, 14 bp, Homo sapiens
ttattataaactgt

SEQ ID NO: 4920206 - DNA, 16 bp, Homo sapiens
ttattattatttttta

SEQ ID NO: 4920207 - DNA, 15 bp, Homo sapiens
ttattattgaaattg

SEQ ID NO: 4920208 - DNA, 14 bp, Homo sapiens
ttattattgtggta

SEQ ID NO: 4920209 - DNA, 21 bp, Homo sapiens
ttattcactgaagttctcctg

SEQ ID NO: 4920210 - DNA, 15 bp, Homo sapiens
ttattcagcttcatt

SEQ ID NO: 4920211 - DNA, 23 bp, Homo sapiens
ttattcattctgtgatcatttat

SEQ ID NO: 4920212 - DNA, 15 bp, Homo sapiens
ttattcctgtatgtt

SEQ ID NO: 4920213 - DNA, 16 bp, Homo sapiens
ttattccttgatcatt

SEQ ID NO: 4920214 - DNA, 14 bp, Homo sapiens
ttattctactatac

SEQ ID NO: 4920215 - DNA, 19 bp, Homo sapiens
ttattctcttttatctgtt

SEQ ID NO: 4920216 - DNA, 11 bp, Homo sapiens
ttattctgctc

SEQ ID NO: 4920217 - DNA, 19 bp, Homo sapiens
ttattgacacagaaaatgt

SEQ ID NO: 4920218 - DNA, 23 bp, Homo sapiens
ttattgacacagaaaatgttgag

SEQ ID NO: 4920219 - DNA, 14 bp, Homo sapiens
ttattgatatatat

SEQ ID NO: 4920220 - DNA, 15 bp, Homo sapiens
ttattgcccacgctg

SEQ ID NO: 4920221 - DNA, 17 bp, Homo sapiens
ttattgctagtatttga

SEQ ID NO: 4920222 - DNA, 18 bp, Homo sapiens
ttattgctagtatttgaa

SEQ ID NO: 4920223 - DNA, 20 bp, Homo sapiens
ttattgctagtatttgaatt

SEQ ID NO: 4920224 - DNA, 18 bp, Homo sapiens
ttattgctgattttaatg

SEQ ID NO: 4920225 - DNA, 15 bp, Homo sapiens
ttattgcttagtaaa

SEQ ID NO: 4920226 - DNA, 17 bp, Homo sapiens
ttattgcttattgctta

SEQ ID NO: 4920227 - DNA, 13 bp, Homo sapiens
ttattgcttttat

SEQ ID NO: 4920228 - DNA, 14 bp, Homo sapiens
ttattgtataaact

SEQ ID NO: 4920229 - DNA, 22 bp, Homo sapiens
ttattgtataaactatcagttt

SEQ ID NO: 4920230 - DNA, 22 bp, Homo sapiens
ttattgtgaatgattcatgtta

SEQ ID NO: 4920231 - DNA, 14 bp, Homo sapiens
ttatttaataacat

SEQ ID NO: 4920232 - DNA, 15 bp, Homo sapiens
ttatttaataacatt

SEQ ID NO: 4920233 - DNA, 15 bp, Homo sapiens
ttatttaatgtgagt

SEQ ID NO: 4920234 - DNA, 18 bp, Homo sapiens
ttatttagactcatctta

SEQ ID NO: 4920235 - DNA, 23 bp, Homo sapiens
ttatttagactcatcttactgta

SEQ ID NO: 4920236 - DNA, 12 bp, Homo sapiens
ttatttagagat

SEQ ID NO: 4920237 - DNA, 14 bp, Homo sapiens
ttatttatagtcat

SEQ ID NO: 4920238 - DNA, 21 bp, Homo sapiens
ttatttatatggggaatatat

SEQ ID NO: 4920239 - DNA, 17 bp, Homo sapiens
ttatttatatgtactgt

SEQ ID NO: 4920240 - DNA, 23 bp, Homo sapiens
ttatttcagattttgataactgt

SEQ ID NO: 4920241 - DNA, 18 bp, Homo sapiens
ttatttccagtgttctat

SEQ ID NO: 4920242 - DNA, 22 bp, Homo sapiens
ttatttctagtccaaaattaca

SEQ ID NO: 4920243 - DNA, 12 bp, Homo sapiens
ttatttctgcat

SEQ ID NO: 4920244 - DNA, 15 bp, Homo sapiens
ttatttctgcatatg

SEQ ID NO: 4920245 - DNA, 20 bp, Homo sapiens
ttatttctgcatatgttgaa

SEQ ID NO: 4920246 - DNA, 16 bp, Homo sapiens
ttatttctgtcattca

SEQ ID NO: 4920247 - DNA, 16 bp, Homo sapiens
ttatttgtgtaataga

SEQ ID NO: 4920248 - DNA, 18 bp, Homo sapiens
ttatttgttattttcagt

SEQ ID NO: 4920249 - DNA, 23 bp, Homo sapiens
ttattttaatgtgatgatgtaat

SEQ ID NO: 4920250 - DNA, 18 bp, Homo sapiens
ttattttatgtttagata

SEQ ID NO: 4920251 - DNA, 15 bp, Homo sapiens
ttattttctgtcaga

SEQ ID NO: 4920252 - DNA, 20 bp, Homo sapiens
ttattttcttttgaattgtt

SEQ ID NO: 4920253 - DNA, 19 bp, Homo sapiens
ttattttggaaagaagaaa

SEQ ID NO: 4920254 - DNA, 13 bp, Homo sapiens
ttattttgtaatt

SEQ ID NO: 4920255 - DNA, 14 bp, Homo sapiens
ttattttgtaatta

SEQ ID NO: 4920256 - DNA, 17 bp, Homo sapiens
ttattttgtaattatga

SEQ ID NO: 4920257 - DNA, 14 bp, Homo sapiens
ttatttttaaagat

SEQ ID NO: 4920258 - DNA, 17 bp, Homo sapiens
ttatttttagacagagt

SEQ ID NO: 4920259 - DNA, 19 bp, Homo sapiens
ttatttttcatattgtgcc

SEQ ID NO: 4920260 - DNA, 14 bp, Homo sapiens
ttcaaaaactgttt

SEQ ID NO: 4920261 - DNA, 14 bp, Homo sapiens
ttcaaaagacatgt

SEQ ID NO: 4920262 - DNA, 15 bp, Homo sapiens
ttcaaaagttccaag

SEQ ID NO: 4920263 - DNA, 15 bp, Homo sapiens
ttcaaaatccaaaaa

SEQ ID NO: 4920264 - DNA, 20 bp, Homo sapiens
ttcaaaatgctttttattat

SEQ ID NO: 4920265 - DNA, 16 bp, Homo sapiens
ttcaaaattaaatctg

SEQ ID NO: 4920266 - DNA, 14 bp, Homo sapiens
ttcaaacaagaatg

SEQ ID NO: 4920267 - DNA, 15 bp, Homo sapiens
ttcaaacaagaatgt

SEQ ID NO: 4920268 - DNA, 22 bp, Homo sapiens
ttcaaagctttttccagaggct

SEQ ID NO: 4920269 - DNA, 19 bp, Homo sapiens
ttcaaatcgtttatttcac

SEQ ID NO: 4920270 - DNA, 21 bp, Homo sapiens
ttcaaatgggttttccacgct

SEQ ID NO: 4920271 - DNA, 14 bp, Homo sapiens
ttcaaatgtgctgt

SEQ ID NO: 4920272 - DNA, 14 bp, Homo sapiens
ttcaacatcctgcc

SEQ ID NO: 4920273 - DNA, 17 bp, Homo sapiens
ttcaacatcctgccagc

SEQ ID NO: 4920274 - DNA, 14 bp, Homo sapiens
ttcaaccagataac

SEQ ID NO: 4920275 - DNA, 21 bp, Homo sapiens
ttcaaccatggactttataag

SEQ ID NO: 4920276 - DNA, 15 bp, Homo sapiens
ttcaacgcagccctg

SEQ ID NO: 4920277 - DNA, 20 bp, Homo sapiens
ttcaacgcagccctgctttg

SEQ ID NO: 4920278 - DNA, 17 bp, Homo sapiens
ttcaactgaccagcctc

SEQ ID NO: 4920279 - DNA, 12 bp, Homo sapiens
ttcaagaaactg

SEQ ID NO: 4920280 - DNA, 23 bp, Homo sapiens
ttcaagaaactgaggaattttct

SEQ ID NO: 4920281 - DNA, 22 bp, Homo sapiens
ttcaagaaagcttcaaactgca

SEQ ID NO: 4920282 - DNA, 16 bp, Homo sapiens
ttcaagaacctggaaa

SEQ ID NO: 4920283 - DNA, 20 bp, Homo sapiens
ttcaagcctgtgcaatgcat

SEQ ID NO: 4920284 - DNA, 21 bp, Homo sapiens
ttcaagcgattcttctgcttc

SEQ ID NO: 4920285 - DNA, 16 bp, Homo sapiens
ttcaaggcactctaga

SEQ ID NO: 4920286 - DNA, 19 bp, Homo sapiens
ttcaaggcactctagattc

SEQ ID NO: 4920287 - DNA, 15 bp, Homo sapiens
ttcaaggcttccact

SEQ ID NO: 4920288 - DNA, 14 bp, Homo sapiens
ttcaaggttctaac

SEQ ID NO: 4920289 - DNA, 14 bp, Homo sapiens
ttcaatattgacat

SEQ ID NO: 4920290 - DNA, 15 bp, Homo sapiens
ttcaatattgacatt

SEQ ID NO: 4920291 - DNA, 16 bp, Homo sapiens
ttcaatattgacattt

SEQ ID NO: 4920292 - DNA, 19 bp, Homo sapiens
ttcaatattgacatttgta

SEQ ID NO: 4920293 - DNA, 21 bp, Homo sapiens
ttcaattaatattaattttct

SEQ ID NO: 4920294 - DNA, 14 bp, Homo sapiens
ttcaattttaaaga

SEQ ID NO: 4920295 - DNA, 15 bp, Homo sapiens
ttcacaaacttttat

SEQ ID NO: 4920296 - DNA, 16 bp, Homo sapiens
ttcacaaacttttata

SEQ ID NO: 4920297 - DNA, 13 bp, Homo sapiens
ttcacaataaaag

SEQ ID NO: 4920298 - DNA, 15 bp, Homo sapiens
ttcacaataaaagct

SEQ ID NO: 4920299 - DNA, 13 bp, Homo sapiens
ttcacaatgtggc

SEQ ID NO: 4920300 - DNA, 15 bp, Homo sapiens
ttcacaccctgcaag

SEQ ID NO: 4920301 - DNA, 12 bp, Homo sapiens
ttcacagctcct

SEQ ID NO: 4920302 - DNA, 15 bp, Homo sapiens
ttcacagctctgtgt

SEQ ID NO: 4920303 - DNA, 20 bp, Homo sapiens
ttcacaggtgtggtgtaatt

SEQ ID NO: 4920304 - DNA, 17 bp, Homo sapiens
ttcacagtagagccagc

SEQ ID NO: 4920305 - DNA, 20 bp, Homo sapiens
ttcacattaatggtctaaaa

SEQ ID NO: 4920306 - DNA, 22 bp, Homo sapiens
ttcaccacatgtgcacatgcac

SEQ ID NO: 4920307 - DNA, 16 bp, Homo sapiens
ttcaccacttcactga

SEQ ID NO: 4920308 - DNA, 18 bp, Homo sapiens
ttcacctaccgagttcaa

SEQ ID NO: 4920309 - DNA, 13 bp, Homo sapiens
ttcactaaagcag

SEQ ID NO: 4920310 - DNA, 14 bp, Homo sapiens
ttcactaaagcagt

SEQ ID NO: 4920311 - DNA, 17 bp, Homo sapiens
ttcactccccctaaacc

SEQ ID NO: 4920312 - DNA, 20 bp, Homo sapiens
ttcactgcatggctcccaca

SEQ ID NO: 4920313 - DNA, 13 bp, Homo sapiens
ttcactgctggct

SEQ ID NO: 4920314 - DNA, 13 bp, Homo sapiens
ttcactgggccaa

SEQ ID NO: 4920315 - DNA, 23 bp, Homo sapiens
ttcactgtataaataggagagga

SEQ ID NO: 4920316 - DNA, 22 bp, Homo sapiens
ttcactgttagctttttaaaac

SEQ ID NO: 4920317 - DNA, 12 bp, Homo sapiens
ttcacttcaaaa

SEQ ID NO: 4920318 - DNA, 20 bp, Homo sapiens
ttcagaagtttggcaatagt

SEQ ID NO: 4920319 - DNA, 13 bp, Homo sapiens
ttcagagaatatc

SEQ ID NO: 4920320 - DNA, 15 bp, Homo sapiens
ttcagagaggccttt

SEQ ID NO: 4920321 - DNA, 18 bp, Homo sapiens
ttcagatcactgaattta

SEQ ID NO: 4920322 - DNA, 22 bp, Homo sapiens
ttcagattcccagagcaaaata

SEQ ID NO: 4920323 - DNA, 23 bp, Homo sapiens
ttcagattttgataactgtttat

SEQ ID NO: 4920324 - DNA, 14 bp, Homo sapiens
tgaaatcctgcttc

SEQ ID NO: 4920325 - DNA, 13 bp, Homo sapiens
tgaaatgaaattt

SEQ ID NO: 4920326 - DNA, 14 bp, Homo sapiens
tgaaatgaaattta

SEQ ID NO: 4920327 - DNA, 17 bp, Homo sapiens
tgaaatgacctctgtcc

SEQ ID NO: 4920328 - DNA, 23 bp, Homo sapiens
tgaaatgaggtcagagcctgcag

SEQ ID NO: 4920329 - DNA, 18 bp, Homo sapiens
tgaaatgaggtctgttta

SEQ ID NO: 4920330 - DNA, 17 bp, Homo sapiens
tgaaatggatactacat

SEQ ID NO: 4920331 - DNA, 21 bp, Homo sapiens
tgaaattaagaaggcaaaaat

SEQ ID NO: 4920332 - DNA, 23 bp, Homo sapiens
tgaaattaagaaggcaaaaatgt

SEQ ID NO: 4920333 - DNA, 13 bp, Homo sapiens
tgaaattatagtt

SEQ ID NO: 4920334 - DNA, 21 bp, Homo sapiens
tgaaattatagtttcaagcca

SEQ ID NO: 4920335 - DNA, 14 bp, Homo sapiens
tgaaattatatctg

SEQ ID NO: 4920336 - DNA, 15 bp, Homo sapiens
tgaaattatatctgt

SEQ ID NO: 4920337 - DNA, 15 bp, Homo sapiens
tgaaattccaaagtc

SEQ ID NO: 4920338 - DNA, 17 bp, Homo sapiens
tgaaattccaaagtctc

SEQ ID NO: 4920339 - DNA, 13 bp, Homo sapiens
tgaaattctaaag

SEQ ID NO: 4920340 - DNA, 14 bp, Homo sapiens
tgaaattgtacata

SEQ ID NO: 4920341 - DNA, 18 bp, Homo sapiens
tgaaattgtgaactcatt

SEQ ID NO: 4920342 - DNA, 22 bp, Homo sapiens
tgaaattgtgaactcattgctc

SEQ ID NO: 4920343 - DNA, 21 bp, Homo sapiens
tgaaatttattagttaatata

SEQ ID NO: 4920344 - DNA, 15 bp, Homo sapiens
tgaaatttctagcct

SEQ ID NO: 4920345 - DNA, 16 bp, Homo sapiens
tgaaatttctagcctg

SEQ ID NO: 4920346 - DNA, 17 bp, Homo sapiens
tgaaattttaaactata

SEQ ID NO: 4920347 - DNA, 19 bp, Homo sapiens
tgaaattttctagactttc

SEQ ID NO: 4920348 - DNA, 21 bp, Homo sapiens
tgaaattttctagactttctg

SEQ ID NO: 4920349 - DNA, 18 bp, Homo sapiens
tgaaattttgcaaatata

SEQ ID NO: 4920350 - DNA, 13 bp, Homo sapiens
tgaacaaaagggt

SEQ ID NO: 4920351 - DNA, 14 bp, Homo sapiens
tgaacaaaatctgt

SEQ ID NO: 4920352 - DNA, 14 bp, Homo sapiens
tgaacaagaattgg

SEQ ID NO: 4920353 - DNA, 18 bp, Homo sapiens
tgaacaagaattggaagc

SEQ ID NO: 4920354 - DNA, 18 bp, Homo sapiens
tgaacaagttttaatgta

SEQ ID NO: 4920355 - DNA, 21 bp, Homo sapiens
tgaacaattgtcgaaaagagt

SEQ ID NO: 4920356 - DNA, 15 bp, Homo sapiens
tgaacacaggcagct

SEQ ID NO: 4920357 - DNA, 16 bp, Homo sapiens
tgaacacaggcagctt

SEQ ID NO: 4920358 - DNA, 20 bp, Homo sapiens
tgaacacaggcagctttcta

SEQ ID NO: 4920359 - DNA, 23 bp, Homo sapiens
tgaacacaggcagctttctagaa

SEQ ID NO: 4920360 - DNA, 17 bp, Homo sapiens
tgaacatcccctcccat

SEQ ID NO: 4920361 - DNA, 19 bp, Homo sapiens
tgaaccacatcttgctctg

SEQ ID NO: 4920362 - DNA, 22 bp, Homo sapiens
tgaaccatccacttacatatat

SEQ ID NO: 4920363 - DNA, 13 bp, Homo sapiens
tgaaccctttgtt

SEQ ID NO: 4920364 - DNA, 20 bp, Homo sapiens
tgaacctgtgagtaaatatt

SEQ ID NO: 4920365 - DNA, 17 bp, Homo sapiens
tgaactatttctacaca

SEQ ID NO: 4920366 - DNA, 18 bp, Homo sapiens
tgaactcactttcctcct

SEQ ID NO: 4920367 - DNA, 22 bp, Homo sapiens
tgaactcagatctgtctgatag

SEQ ID NO: 4920368 - DNA, 16 bp, Homo sapiens
tgaactcctggcctca

SEQ ID NO: 4920369 - DNA, 17 bp, Homo sapiens
tgaactcctggcctcaa

SEQ ID NO: 4920370 - DNA, 16 bp, Homo sapiens
tgaactctgaactttg

SEQ ID NO: 4920371 - DNA, 19 bp, Homo sapiens
tgaactcttagaaatgaag

SEQ ID NO: 4920372 - DNA, 19 bp, Homo sapiens
tgaactcttctgcaaaaat

SEQ ID NO: 4920373 - DNA, 15 bp, Homo sapiens
tgaacttctctcaga

SEQ ID NO: 4920374 - DNA, 15 bp, Homo sapiens
tgaacttgtagctgt

SEQ ID NO: 4920375 - DNA, 16 bp, Homo sapiens
tgaacttgtagctgta

SEQ ID NO: 4920376 - DNA, 17 bp, Homo sapiens
tgaacttgtagctgtaa

SEQ ID NO: 4920377 - DNA, 18 bp, Homo sapiens
tgaacttgtagctgtaaa

SEQ ID NO: 4920378 - DNA, 19 bp, Homo sapiens
tgaacttgtagctgtaaaa

SEQ ID NO: 4920379 - DNA, 21 bp, Homo sapiens
tgaactttctcttcatacttt

SEQ ID NO: 4920380 - DNA, 17 bp, Homo sapiens
tgaagaactagcatata

SEQ ID NO: 4920381 - DNA, 11 bp, Homo sapiens
tgaagaaggtg

SEQ ID NO: 4920382 - DNA, 21 bp, Homo sapiens
tgaagacaatttgatacataa

SEQ ID NO: 4920383 - DNA, 19 bp, Homo sapiens
tgaagactcattcttctgt

SEQ ID NO: 4920384 - DNA, 17 bp, Homo sapiens
tgaagactggaagctaa

SEQ ID NO: 4920385 - DNA, 23 bp, Homo sapiens
tgaagagaaccgagcaaagatca

SEQ ID NO: 4920386 - DNA, 23 bp, Homo sapiens
tgaagagacagttatttatagtc

SEQ ID NO: 4920387 - DNA, 13 bp, Homo sapiens
tgaagaggaaggg

SEQ ID NO: 4920388 - DNA, 13 bp, Homo sapiens
tgaagagtagttt

SEQ ID NO: 4920389 - DNA, 17 bp, Homo sapiens
tgaagcagctttaaaca

SEQ ID NO: 4920390 - DNA, 20 bp, Homo sapiens
tgaagcatgtttcatgtttt

SEQ ID NO: 4920391 - DNA, 21 bp, Homo sapiens
tgaagccagccttcttccatc

SEQ ID NO: 4920392 - DNA, 17 bp, Homo sapiens
tgaagcccatttctccg

SEQ ID NO: 4920393 - DNA, 15 bp, Homo sapiens
tgaagccctcccagg

SEQ ID NO: 4920394 - DNA, 13 bp, Homo sapiens
tgaagcctctggg

SEQ ID NO: 4920395 - DNA, 23 bp, Homo sapiens
tgaagcctgcgttggtccagagc

SEQ ID NO: 4920396 - DNA, 15 bp, Homo sapiens
tgaagccttttgaaa

SEQ ID NO: 4920397 - DNA, 21 bp, Homo sapiens
tgaagcgaaacacagagaagc

SEQ ID NO: 4920398 - DNA, 18 bp, Homo sapiens
tgaagcttgactcccaag

SEQ ID NO: 4920399 - DNA, 14 bp, Homo sapiens
tgaaggaaacagtt

SEQ ID NO: 4920400 - DNA, 16 bp, Homo sapiens
tgaaggaaacagttaa

SEQ ID NO: 4920401 - DNA, 19 bp, Homo sapiens
tgaaggacattgcggacag

SEQ ID NO: 4920402 - DNA, 22 bp, Homo sapiens
tgaaggacattgcggacagcca

SEQ ID NO: 4920403 - DNA, 16 bp, Homo sapiens
tgaaggagagcccttc

SEQ ID NO: 4920404 - DNA, 13 bp, Homo sapiens
tgaagggcccagg

SEQ ID NO: 4920405 - DNA, 14 bp, Homo sapiens
tgaagtagtttgta

SEQ ID NO: 4920406 - DNA, 21 bp, Homo sapiens
tgaagtcactgcacagtgcat

SEQ ID NO: 4920407 - DNA, 10 bp, Homo sapiens
tgaagtcttg

SEQ ID NO: 4920408 - DNA, 14 bp, Homo sapiens
tgaagtcttgtata

SEQ ID NO: 4920409 - DNA, 17 bp, Homo sapiens
tgaagtgagcacagcct

SEQ ID NO: 4920410 - DNA, 15 bp, Homo sapiens
tgaagttttacattg

SEQ ID NO: 4920411 - DNA, 17 bp, Homo sapiens
tgaagttttacattgtt

SEQ ID NO: 4920412 - DNA, 15 bp, Homo sapiens
tgaataaaagtgcac

SEQ ID NO: 4920413 - DNA, 16 bp, Homo sapiens
tgaataaaagtgcaca

SEQ ID NO: 4920414 - DNA, 18 bp, Homo sapiens
tgaataaacttcagcacc

SEQ ID NO: 4920415 - DNA, 16 bp, Homo sapiens
tgaataaagacaccta

SEQ ID NO: 4920416 - DNA, 15 bp, Homo sapiens
tgaatagaaatggga

SEQ ID NO: 4920417 - DNA, 17 bp, Homo sapiens
tgaatatctattaatat

SEQ ID NO: 4920418 - DNA, 18 bp, Homo sapiens
tgaatatctattaatata

SEQ ID NO: 4920419 - DNA, 12 bp, Homo sapiens
tgaatatggaca

SEQ ID NO: 4920420 - DNA, 16 bp, Homo sapiens
tgaatgaaagattaaa

SEQ ID NO: 4920421 - DNA, 22 bp, Homo sapiens
tgaatgaaagattaaacagatg

SEQ ID NO: 4920422 - DNA, 18 bp, Homo sapiens
tgaatgagtctgttgtgt

SEQ ID NO: 4920423 - DNA, 23 bp, Homo sapiens
tgaatgagtctgttgtgtgtcat

SEQ ID NO: 4920424 - DNA, 11 bp, Homo sapiens
tgaatgctgcc

SEQ ID NO: 4920425 - DNA, 18 bp, Homo sapiens
tgaatgctgccagtgtgg

SEQ ID NO: 4920426 - DNA, 22 bp, Homo sapiens
tgaatgctgccagtgtggagtg

SEQ ID NO: 4920427 - DNA, 18 bp, Homo sapiens
tgaatgctttttgaatgt

SEQ ID NO: 4920428 - DNA, 19 bp, Homo sapiens
tgactccaagaacaattgt

SEQ ID NO: 4920429 - DNA, 21 bp, Homo sapiens
tgactccacgatcctgccacc

SEQ ID NO: 4920430 - DNA, 19 bp, Homo sapiens
tgactcctacctgccctgg

SEQ ID NO: 4920431 - DNA, 20 bp, Homo sapiens
tgactcctacctgccctgga

SEQ ID NO: 4920432 - DNA, 22 bp, Homo sapiens
tgactcctacctgccctggaac

SEQ ID NO: 4920433 - DNA, 21 bp, Homo sapiens
tgactcgtatatgtctcaggt

SEQ ID NO: 4920434 - DNA, 15 bp, Homo sapiens
tgactcgtgctgcat

SEQ ID NO: 4920435 - DNA, 19 bp, Homo sapiens
tgactctgccccctgctgg

SEQ ID NO: 4920436 - DNA, 19 bp, Homo sapiens
tcctcttctattttgtaaa

SEQ ID NO: 4920437 - DNA, 19 bp, Homo sapiens
tcctcttgccactgcctct

SEQ ID NO: 4920438 - DNA, 17 bp, Homo sapiens
tcctgaaccgcacagct

SEQ ID NO: 4920439 - DNA, 18 bp, Homo sapiens
tcctgaaccgcacagctc

SEQ ID NO: 4920440 - DNA, 21 bp, Homo sapiens
tcctgaaccgcacagctcagg

SEQ ID NO: 4920441 - DNA, 22 bp, Homo sapiens
tcctgaaccgcacagctcagga

SEQ ID NO: 4920442 - DNA, 14 bp, Homo sapiens
tcctgaagaattaa

SEQ ID NO: 4920443 - DNA, 19 bp, Homo sapiens
tcctgacatcacagcagcc

SEQ ID NO: 4920444 - DNA, 20 bp, Homo sapiens
tcctgacatcacagcagcct

SEQ ID NO: 4920445 - DNA, 18 bp, Homo sapiens
tcctgacgtctgaagctt

SEQ ID NO: 4920446 - DNA, 14 bp, Homo sapiens
tcctgactctgccc

SEQ ID NO: 4920447 - DNA, 15 bp, Homo sapiens
tcctgactctgcccc

SEQ ID NO: 4920448 - DNA, 23 bp, Homo sapiens
tcctgactctgccccctgctggc

SEQ ID NO: 4920449 - DNA, 13 bp, Homo sapiens
tcctgactgtaac

SEQ ID NO: 4920450 - DNA, 23 bp, Homo sapiens
tcctgagaataagaaagtttcac

SEQ ID NO: 4920451 - DNA, 16 bp, Homo sapiens
tcctgagaccacagag

SEQ ID NO: 4920452 - DNA, 23 bp, Homo sapiens
tcctgagccccgccctcttcctg

SEQ ID NO: 4920453 - DNA, 13 bp, Homo sapiens
tcctgagctttat

SEQ ID NO: 4920454 - DNA, 21 bp, Homo sapiens
tcctgataaaacaacagctcg

SEQ ID NO: 4920455 - DNA, 13 bp, Homo sapiens
tcctgcaatgaaa

SEQ ID NO: 4920456 - DNA, 14 bp, Homo sapiens
tcctgcaatgaaag

SEQ ID NO: 4920457 - DNA, 16 bp, Homo sapiens
tcctgcatttgtgaaa

SEQ ID NO: 4920458 - DNA, 16 bp, Homo sapiens
tcctgccaccctgtag

SEQ ID NO: 4920459 - DNA, 21 bp, Homo sapiens
tcctgccagccccacacagct

SEQ ID NO: 4920460 - DNA, 15 bp, Homo sapiens
tcctgcccctctttc

SEQ ID NO: 4920461 - DNA, 16 bp, Homo sapiens
tcctgcccctctttct

SEQ ID NO: 4920462 - DNA, 14 bp, Homo sapiens
tcctgcctcagcct

SEQ ID NO: 4920463 - DNA, 17 bp, Homo sapiens
tcctgcctcagcctccg

SEQ ID NO: 4920464 - DNA, 20 bp, Homo sapiens
tcctgcctcgaactggctgc

SEQ ID NO: 4920465 - DNA, 20 bp, Homo sapiens
tcctgcctgcccctctcccg

SEQ ID NO: 4920466 - DNA, 19 bp, Homo sapiens
tcctgccttggcctcccaa

SEQ ID NO: 4920467 - DNA, 13 bp, Homo sapiens
tcctgctccagaa

SEQ ID NO: 4920468 - DNA, 17 bp, Homo sapiens
tcctggaaccttgctgt

SEQ ID NO: 4920469 - DNA, 22 bp, Homo sapiens
tcctggaaccttgctgtcctga

SEQ ID NO: 4920470 - DNA, 19 bp, Homo sapiens
tcctggacactcagacctg

SEQ ID NO: 4920471 - DNA, 18 bp, Homo sapiens
tcctggagcagaccaccc

SEQ ID NO: 4920472 - DNA, 19 bp, Homo sapiens
tcctggagcagaccacccc

SEQ ID NO: 4920473 - DNA, 22 bp, Homo sapiens
tcctggcacccggcccctgctg

SEQ ID NO: 4920474 - DNA, 14 bp, Homo sapiens
tcctggcagaaggg

SEQ ID NO: 4920475 - DNA, 15 bp, Homo sapiens
tcctggcagcccaga

SEQ ID NO: 4920476 - DNA, 17 bp, Homo sapiens
tcctggcagcccagaga

SEQ ID NO: 4920477 - DNA, 12 bp, Homo sapiens
tcctggcctcaa

SEQ ID NO: 4920478 - DNA, 12 bp, Homo sapiens
tcctgggagtga

SEQ ID NO: 4920479 - DNA, 14 bp, Homo sapiens
tcctggtctgaaaa

SEQ ID NO: 4920480 - DNA, 23 bp, Homo sapiens
tcctggttcccgtttctccacct

SEQ ID NO: 4920481 - DNA, 17 bp, Homo sapiens
tcctgtaagccaaagaa

SEQ ID NO: 4920482 - DNA, 23 bp, Homo sapiens
tcctgtaagccaaagaaatgaac

SEQ ID NO: 4920483 - DNA, 15 bp, Homo sapiens
tcctgtagttttatt

SEQ ID NO: 4920484 - DNA, 14 bp, Homo sapiens
tcctgtataagcac

SEQ ID NO: 4920485 - DNA, 22 bp, Homo sapiens
tcctgtataagcactgaaaaac

SEQ ID NO: 4920486 - DNA, 19 bp, Homo sapiens
tcctgtctttaaggaaaaa

SEQ ID NO: 4920487 - DNA, 15 bp, Homo sapiens
tcctgtctttctgag

SEQ ID NO: 4920488 - DNA, 22 bp, Homo sapiens
tcctgtctttctgagcacactt

SEQ ID NO: 4920489 - DNA, 13 bp, Homo sapiens
tcctgtgtactgt

SEQ ID NO: 4920490 - DNA, 16 bp, Homo sapiens
tcctgtgtactgtgtc

SEQ ID NO: 4920491 - DNA, 18 bp, Homo sapiens
tcctgtgtgtgcgcctac

SEQ ID NO: 4920492 - DNA, 21 bp, Homo sapiens
tcctgtttcccttcccttcca

SEQ ID NO: 4920493 - DNA, 22 bp, Homo sapiens
tcctgtttcccttcccttccac

SEQ ID NO: 4920494 - DNA, 17 bp, Homo sapiens
tcctgtttttctgggtg

SEQ ID NO: 4920495 - DNA, 22 bp, Homo sapiens
tccttaaaggcaccatctaata

SEQ ID NO: 4920496 - DNA, 20 bp, Homo sapiens
tccttacgctttgtcacaca

SEQ ID NO: 4920497 - DNA, 20 bp, Homo sapiens
tccttagaggtcctctggag

SEQ ID NO: 4920498 - DNA, 14 bp, Homo sapiens
tccttatcagagct

SEQ ID NO: 4920499 - DNA, 19 bp, Homo sapiens
tccttcaaaatccttccaa

SEQ ID NO: 4920500 - DNA, 19 bp, Homo sapiens
tccttcaagaactctgggc

SEQ ID NO: 4920501 - DNA, 15 bp, Homo sapiens
tccttcaagccagca

SEQ ID NO: 4920502 - DNA, 12 bp, Homo sapiens
tccttcagacac

SEQ ID NO: 4920503 - DNA, 19 bp, Homo sapiens
tccttccaaaaattattat

SEQ ID NO: 4920504 - DNA, 21 bp, Homo sapiens
tccttctctgaacacaggcag

SEQ ID NO: 4920505 - DNA, 23 bp, Homo sapiens
tccttctctgaacacaggcagct

SEQ ID NO: 4920506 - DNA, 21 bp, Homo sapiens
tccttctggcagattcaaatc

SEQ ID NO: 4920507 - DNA, 19 bp, Homo sapiens
tccttctgtcctactctgt

SEQ ID NO: 4920508 - DNA, 20 bp, Homo sapiens
tccttctttgataatgttaa

SEQ ID NO: 4920509 - DNA, 15 bp, Homo sapiens
tccttctttttaaaa

SEQ ID NO: 4920510 - DNA, 14 bp, Homo sapiens
tccttgaccttcct

SEQ ID NO: 4920511 - DNA, 16 bp, Homo sapiens
tccttggaagtttcat

SEQ ID NO: 4920512 - DNA, 14 bp, Homo sapiens
tccttggcaccaaa

SEQ ID NO: 4920513 - DNA, 15 bp, Homo sapiens
tccttggcaccaaag

SEQ ID NO: 4920514 - DNA, 13 bp, Homo sapiens
tccttggcctagc

SEQ ID NO: 4920515 - DNA, 17 bp, Homo sapiens
tccttggtctttgtatc

SEQ ID NO: 4920516 - DNA, 23 bp, Homo sapiens
tccttgtgcaaaatatttgacta

SEQ ID NO: 4920517 - DNA, 15 bp, Homo sapiens
tccttgtggcagagg

SEQ ID NO: 4920518 - DNA, 13 bp, Homo sapiens
tccttgtttatca

SEQ ID NO: 4920519 - DNA, 12 bp, Homo sapiens
tcctttacaaaa

SEQ ID NO: 4920520 - DNA, 22 bp, Homo sapiens
tcctttacaaaagaaatacctt

SEQ ID NO: 4920521 - DNA, 17 bp, Homo sapiens
tcctttactttcccttg

SEQ ID NO: 4920522 - DNA, 20 bp, Homo sapiens
tcctttactttcccttgctt

SEQ ID NO: 4920523 - DNA, 12 bp, Homo sapiens
tcctttatagag

SEQ ID NO: 4920524 - DNA, 15 bp, Homo sapiens
tcctttcaccacatg

SEQ ID NO: 4920525 - DNA, 13 bp, Homo sapiens
tcctttccccagc

SEQ ID NO: 4920526 - DNA, 16 bp, Homo sapiens
tcctttccccagccca

SEQ ID NO: 4920527 - DNA, 16 bp, Homo sapiens
tcctttcccttcctct

SEQ ID NO: 4920528 - DNA, 14 bp, Homo sapiens
tcctttctcagccg

SEQ ID NO: 4920529 - DNA, 23 bp, Homo sapiens
tcctttctcagccgcttctgact

SEQ ID NO: 4920530 - DNA, 17 bp, Homo sapiens
tcctttctccaggacca

SEQ ID NO: 4920531 - DNA, 13 bp, Homo sapiens
tcctttctctttc

SEQ ID NO: 4920532 - DNA, 15 bp, Homo sapiens
tcctttctctttctc

SEQ ID NO: 4920533 - DNA, 13 bp, Homo sapiens
tcctttctgtgcc

SEQ ID NO: 4920534 - DNA, 16 bp, Homo sapiens
tcctttgcagggcagc

SEQ ID NO: 4920535 - DNA, 18 bp, Homo sapiens
tcctttgcagggcagccc

SEQ ID NO: 4920536 - DNA, 17 bp, Homo sapiens
tcctttgcgcctgtgac

SEQ ID NO: 4920537 - DNA, 18 bp, Homo sapiens
tcctttggtcctgtcccc

SEQ ID NO: 4920538 - DNA, 12 bp, Homo sapiens
tcctttgtcttc

SEQ ID NO: 4920539 - DNA, 20 bp, Homo sapiens
tcctttgtgtttctattgac

SEQ ID NO: 4920540 - DNA, 20 bp, Homo sapiens
tcctttgttttctgactaat

SEQ ID NO: 4920541 - DNA, 23 bp, Homo sapiens
tccttttcttttgttactgttct

SEQ ID NO: 4920542 - DNA, 20 bp, Homo sapiens
tcctttttctgattagcttt

SEQ ID NO: 4920543 - DNA, 15 bp, Homo sapiens
tcgaaaattcatttc

SEQ ID NO: 4920544 - DNA, 21 bp, Homo sapiens
tcgaaaattcatttcacatta

SEQ ID NO: 4920545 - DNA, 23 bp, Homo sapiens
tcgaagcgcgccactcgcttccc

SEQ ID NO: 4920546 - DNA, 12 bp, Homo sapiens
tctccaccctgc

SEQ ID NO: 4920547 - DNA, 13 bp, Homo sapiens
tctccaccctgct

SEQ ID NO: 4920548 - DNA, 12 bp, Homo sapiens
tctccactgtgc

SEQ ID NO: 4920549 - DNA, 16 bp, Homo sapiens
tctccagatttttaat

SEQ ID NO: 4920550 - DNA, 21 bp, Homo sapiens
tctccagatttttcggaggcc

SEQ ID NO: 4920551 - DNA, 16 bp, Homo sapiens
tctccagctcagaacc

SEQ ID NO: 4920552 - DNA, 11 bp, Homo sapiens
tctccagctgg

SEQ ID NO: 4920553 - DNA, 16 bp, Homo sapiens
tctccaggctgtatcc

SEQ ID NO: 4920554 - DNA, 19 bp, Homo sapiens
tctccagtatccactttgc

SEQ ID NO: 4920555 - DNA, 14 bp, Homo sapiens
tctcccacgtggga

SEQ ID NO: 4920556 - DNA, 10 bp, Homo sapiens
tctccccaca

SEQ ID NO: 4920557 - DNA, 17 bp, Homo sapiens
tctccccacccctaccc

SEQ ID NO: 4920558 - DNA, 12 bp, Homo sapiens
tctccccagaat

SEQ ID NO: 4920559 - DNA, 12 bp, Homo sapiens
tctccccagtgt

SEQ ID NO: 4920560 - DNA, 19 bp, Homo sapiens
tctccccgctaaggaagat

SEQ ID NO: 4920561 - DNA, 12 bp, Homo sapiens
tctcccctccag

SEQ ID NO: 4920562 - DNA, 14 bp, Homo sapiens
tctcccctccagcc

SEQ ID NO: 4920563 - DNA, 16 bp, Homo sapiens
tctcccctccagcctt

SEQ ID NO: 4920564 - DNA, 17 bp, Homo sapiens
tctcccctgccctgctg

SEQ ID NO: 4920565 - DNA, 13 bp, Homo sapiens
tctcccgctgctg

SEQ ID NO: 4920566 - DNA, 15 bp, Homo sapiens
tctcccgctgctgct

SEQ ID NO: 4920567 - DNA, 12 bp, Homo sapiens
tctcccttaccc

SEQ ID NO: 4920568 - DNA, 17 bp, Homo sapiens
tctccgaccagacacct

SEQ ID NO: 4920569 - DNA, 20 bp, Homo sapiens
tctccgtttattataaactg

SEQ ID NO: 4920570 - DNA, 17 bp, Homo sapiens
tctcctataatctgtca

SEQ ID NO: 4920571 - DNA, 19 bp, Homo sapiens
tctcctataatctgtcaaa

SEQ ID NO: 4920572 - DNA, 12 bp, Homo sapiens
tctcctcccagg

SEQ ID NO: 4920573 - DNA, 15 bp, Homo sapiens
tctcctccccacccg

SEQ ID NO: 4920574 - DNA, 14 bp, Homo sapiens
tctcctccccttcc

SEQ ID NO: 4920575 - DNA, 13 bp, Homo sapiens
tctcctctttaaa

SEQ ID NO: 4920576 - DNA, 15 bp, Homo sapiens
tctcctgacagaagg

SEQ ID NO: 4920577 - DNA, 15 bp, Homo sapiens
tctcctgcctcagcc

SEQ ID NO: 4920578 - DNA, 20 bp, Homo sapiens
tctcctgcctgtagcagtga

SEQ ID NO: 4920579 - DNA, 22 bp, Homo sapiens
tctcctgcctgtagcagtgaga

SEQ ID NO: 4920580 - DNA, 17 bp, Homo sapiens
tctcctgtttcccttcc

SEQ ID NO: 4920581 - DNA, 18 bp, Homo sapiens
tctcctgtttcccttccc

SEQ ID NO: 4920582 - DNA, 19 bp, Homo sapiens
tctcctgtttttctgggtg

SEQ ID NO: 4920583 - DNA, 18 bp, Homo sapiens
tctccttccttacccaaa

SEQ ID NO: 4920584 - DNA, 18 bp, Homo sapiens
tctccttcgtatcccgag

SEQ ID NO: 4920585 - DNA, 23 bp, Homo sapiens
tctccttcgtatcccgagtctgg

SEQ ID NO: 4920586 - DNA, 14 bp, Homo sapiens
tctccttcttagct

SEQ ID NO: 4920587 - DNA, 13 bp, Homo sapiens
tctccttgcccta

SEQ ID NO: 4920588 - DNA, 14 bp, Homo sapiens
tctcctttcagggc

SEQ ID NO: 4920589 - DNA, 22 bp, Homo sapiens
tctcctttgctgaggcctccag

SEQ ID NO: 4920590 - DNA, 19 bp, Homo sapiens
tctccttttcttttgttac

SEQ ID NO: 4920591 - DNA, 21 bp, Homo sapiens
tctccttttcttttgttactg

SEQ ID NO: 4920592 - DNA, 20 bp, Homo sapiens
tctcggagcatcccggagga

SEQ ID NO: 4920593 - DNA, 21 bp, Homo sapiens
tctcggcaactaagcagtccc

SEQ ID NO: 4920594 - DNA, 21 bp, Homo sapiens
tctcggctccccatgtgtcct

SEQ ID NO: 4920595 - DNA, 15 bp, Homo sapiens
tctcgtgagtcattt

SEQ ID NO: 4920596 - DNA, 22 bp, Homo sapiens
tctctaacttcaaggcccatat

SEQ ID NO: 4920597 - DNA, 15 bp, Homo sapiens
tctctaattctatta

SEQ ID NO: 4920598 - DNA, 14 bp, Homo sapiens
tctctacagtgcca

SEQ ID NO: 4920599 - DNA, 13 bp, Homo sapiens
tctctagcacaat

SEQ ID NO: 4920600 - DNA, 22 bp, Homo sapiens
tctctaggaccatggttaagag

SEQ ID NO: 4920601 - DNA, 14 bp, Homo sapiens
tctctcaaattgtc

SEQ ID NO: 4920602 - DNA, 20 bp, Homo sapiens
tctctcaatatgcttacaaa

SEQ ID NO: 4920603 - DNA, 17 bp, Homo sapiens
tctctcagccttacatt

SEQ ID NO: 4920604 - DNA, 13 bp, Homo sapiens
tctctccagatgt

SEQ ID NO: 4920605 - DNA, 11 bp, Homo sapiens
tctctcctttt

SEQ ID NO: 4920606 - DNA, 12 bp, Homo sapiens
tctctccttttc

SEQ ID NO: 4920607 - DNA, 13 bp, Homo sapiens
tctctccttttct

SEQ ID NO: 4920608 - DNA, 17 bp, Homo sapiens
tctctccttttcttttg

SEQ ID NO: 4920609 - DNA, 14 bp, Homo sapiens
tctctcttctgcct

SEQ ID NO: 4920610 - DNA, 18 bp, Homo sapiens
tctctgaacacaggcagc

SEQ ID NO: 4920611 - DNA, 20 bp, Homo sapiens
tctctgaacacaggcagctt

SEQ ID NO: 4920612 - DNA, 21 bp, Homo sapiens
tctctgaacacaggcagcttt

SEQ ID NO: 4920613 - DNA, 12 bp, Homo sapiens
tctctgaagcat

SEQ ID NO: 4920614 - DNA, 12 bp, Homo sapiens
tctctgcagctg

SEQ ID NO: 4920615 - DNA, 13 bp, Homo sapiens
tctctgcagctgc

SEQ ID NO: 4920616 - DNA, 17 bp, Homo sapiens
tctctgctcgccctcct

SEQ ID NO: 4920617 - DNA, 19 bp, Homo sapiens
tctctgctggcccagccaa

SEQ ID NO: 4920618 - DNA, 19 bp, Homo sapiens
tctctggctgtaaggctct

SEQ ID NO: 4920619 - DNA, 22 bp, Homo sapiens
tctctgtataaacattaaatgt

SEQ ID NO: 4920620 - DNA, 15 bp, Homo sapiens
tctctgtgctgtgga

SEQ ID NO: 4920621 - DNA, 22 bp, Homo sapiens
tctctgtgtctaagattctaga

SEQ ID NO: 4920622 - DNA, 19 bp, Homo sapiens
tctcttccctttccccagc

SEQ ID NO: 4920623 - DNA, 13 bp, Homo sapiens
tctcttcctgccc

SEQ ID NO: 4920624 - DNA, 15 bp, Homo sapiens
tctcttcctgcccct

SEQ ID NO: 4920625 - DNA, 16 bp, Homo sapiens
tctcttcctgcccctc

SEQ ID NO: 4920626 - DNA, 13 bp, Homo sapiens
tctcttctcccag

SEQ ID NO: 4920627 - DNA, 12 bp, Homo sapiens
tctcttcttgtt

SEQ ID NO: 4920628 - DNA, 16 bp, Homo sapiens
tctcttgggaactgaa

SEQ ID NO: 4920629 - DNA, 23 bp, Homo sapiens
tctcttgggaactgaactcactt

SEQ ID NO: 4920630 - DNA, 20 bp, Homo sapiens
tctctttaatgtcacaggca

SEQ ID NO: 4920631 - DNA, 22 bp, Homo sapiens
tctctttaatgtcacaggcagg

SEQ ID NO: 4920632 - DNA, 13 bp, Homo sapiens
tctctttctctct

SEQ ID NO: 4920633 - DNA, 14 bp, Homo sapiens
tctctttctctctt

SEQ ID NO: 4920634 - DNA, 17 bp, Homo sapiens
tctctttcttcctttac

SEQ ID NO: 4920635 - DNA, 20 bp, Homo sapiens
tctctttcttcctttacttt

SEQ ID NO: 4920636 - DNA, 15 bp, Homo sapiens
tctcttttcaaaaca

SEQ ID NO: 4920637 - DNA, 11 bp, Homo sapiens
tctcttttcta

SEQ ID NO: 4920638 - DNA, 13 bp, Homo sapiens
tctcttttctctt

SEQ ID NO: 4920639 - DNA, 22 bp, Homo sapiens
tctgaaaaccccatttgctttc

SEQ ID NO: 4920640 - DNA, 12 bp, Homo sapiens
tctgaaagcaca

SEQ ID NO: 4920641 - DNA, 13 bp, Homo sapiens
tctgaaagcacag

SEQ ID NO: 4920642 - DNA, 19 bp, Homo sapiens
tctgaaagttacccactga

SEQ ID NO: 4920643 - DNA, 20 bp, Homo sapiens
tctgaaataggaaacaagtg

SEQ ID NO: 4920644 - DNA, 14 bp, Homo sapiens
tctgaaatgaaaca

SEQ ID NO: 4920645 - DNA, 14 bp, Homo sapiens
tctgaaattctaaa

SEQ ID NO: 4920646 - DNA, 17 bp, Homo sapiens
tctgaacacaggcagct

SEQ ID NO: 4920647 - DNA, 12 bp, Homo sapiens
tctgaactttgg

SEQ ID NO: 4920648 - DNA, 17 bp, Homo sapiens
tctgaagccctcccagg

SEQ ID NO: 4920649 - DNA, 22 bp, Homo sapiens
tctgaagcttgactcccaagtt

SEQ ID NO: 4920650 - DNA, 15 bp, Homo sapiens
tctgacacacagctc

SEQ ID NO: 4920651 - DNA, 19 bp, Homo sapiens
tctgacacacagctctgtc

SEQ ID NO: 4920652 - DNA, 16 bp, Homo sapiens
tctgacagaaagcaga

SEQ ID NO: 4920653 - DNA, 12 bp, Homo sapiens
tctgacaggcaa

SEQ ID NO: 4920654 - DNA, 22 bp, Homo sapiens
tctgacaggcaatgctggctgt

SEQ ID NO: 4920655 - DNA, 13 bp, Homo sapiens
tctgacccactgc

SEQ ID NO: 4920656 - DNA, 15 bp, Homo sapiens
tctgacccagtgaga

SEQ ID NO: 4920657 - DNA, 19 bp, Homo sapiens
tctgacttaagcaaaagaa

SEQ ID NO: 4920658 - DNA, 18 bp, Homo sapiens
tcccaggacaccacaccc

SEQ ID NO: 4920659 - DNA, 22 bp, Homo sapiens
tcccaggacaccacacccagcc

SEQ ID NO: 4920660 - DNA, 23 bp, Homo sapiens
tcccaggacaccacacccagcct

SEQ ID NO: 4920661 - DNA, 22 bp, Homo sapiens
tcccaggagacagttcaagaaa

SEQ ID NO: 4920662 - DNA, 18 bp, Homo sapiens
tcccaggcgccccttccc

SEQ ID NO: 4920663 - DNA, 21 bp, Homo sapiens
tcccaggcgccccttccccct

SEQ ID NO: 4920664 - DNA, 21 bp, Homo sapiens
tcccaggggcccaaggcggcc

SEQ ID NO: 4920665 - DNA, 20 bp, Homo sapiens
tcccagtccaaatgtcctcc

SEQ ID NO: 4920666 - DNA, 15 bp, Homo sapiens
tcccagtgaattctt

SEQ ID NO: 4920667 - DNA, 23 bp, Homo sapiens
tcccagttcaggagtcccaagga

SEQ ID NO: 4920668 - DNA, 14 bp, Homo sapiens
tcccatcaaaactc

SEQ ID NO: 4920669 - DNA, 15 bp, Homo sapiens
tcccatcccctggac

SEQ ID NO: 4920670 - DNA, 20 bp, Homo sapiens
tcccatctaagctgcagctt

SEQ ID NO: 4920671 - DNA, 11 bp, Homo sapiens
tcccatgaagc

SEQ ID NO: 4920672 - DNA, 12 bp, Homo sapiens
tcccatgaagcc

SEQ ID NO: 4920673 - DNA, 18 bp, Homo sapiens
tcccttaaaatagaaata

SEQ ID NO: 4920674 - DNA, 12 bp, Homo sapiens
tcccttcagccc

SEQ ID NO: 4920675 - DNA, 17 bp, Homo sapiens
tcccttcagcccccagc

SEQ ID NO: 4920676 - DNA, 13 bp, Homo sapiens
tcccttcctcttc

SEQ ID NO: 4920677 - DNA, 17 bp, Homo sapiens
tcccttctttttcttct

SEQ ID NO: 4920678 - DNA, 17 bp, Homo sapiens
tcccttgaaattttaaa

SEQ ID NO: 4920679 - DNA, 18 bp, Homo sapiens
tcccttgatgcacagaga

SEQ ID NO: 4920680 - DNA, 21 bp, Homo sapiens
tcccttgccatcctaaaagcc

SEQ ID NO: 4920681 - DNA, 19 bp, Homo sapiens
tcccttgcttttccctctt

SEQ ID NO: 4920682 - DNA, 14 bp, Homo sapiens
tcccttggcctcag

SEQ ID NO: 4920683 - DNA, 14 bp, Homo sapiens
tccctttgtctttc

SEQ ID NO: 4920684 - DNA, 17 bp, Homo sapiens
tccctttgtctttcaaa

SEQ ID NO: 4920685 - DNA, 15 bp, Homo sapiens
tccgaccctctggga

SEQ ID NO: 4920686 - DNA, 21 bp, Homo sapiens
tccgaccctctgggaacctcc

SEQ ID NO: 4920687 - DNA, 18 bp, Homo sapiens
tccgccaatgcacggcct

SEQ ID NO: 4920688 - DNA, 21 bp, Homo sapiens
tccgcccacaggaagcctgca

SEQ ID NO: 4920689 - DNA, 11 bp, Homo sapiens
tccgcccccag

SEQ ID NO: 4920690 - DNA, 15 bp, Homo sapiens
tccgcccctgcctgc

SEQ ID NO: 4920691 - DNA, 18 bp, Homo sapiens
tccgccttttgtatacat

SEQ ID NO: 4920692 - DNA, 15 bp, Homo sapiens
tccgctctcttcctg

SEQ ID NO: 4920693 - DNA, 18 bp, Homo sapiens
tccgctctcttcctgccc

SEQ ID NO: 4920694 - DNA, 16 bp, Homo sapiens
tccgctgctccttggc

SEQ ID NO: 4920695 - DNA, 15 bp, Homo sapiens
tccggacactcctag

SEQ ID NO: 4920696 - DNA, 18 bp, Homo sapiens
tccggacactcctagaga

SEQ ID NO: 4920697 - DNA, 20 bp, Homo sapiens
tccgtaataacacccttcct

SEQ ID NO: 4920698 - DNA, 22 bp, Homo sapiens
tccgtaggtagatgtgtaacct

SEQ ID NO: 4920699 - DNA, 18 bp, Homo sapiens
tccgtgaaaacggagctg

SEQ ID NO: 4920700 - DNA, 17 bp, Homo sapiens
tcctaactgaagagaca

SEQ ID NO: 4920701 - DNA, 13 bp, Homo sapiens
tcctaagaaatat

SEQ ID NO: 4920702 - DNA, 23 bp, Homo sapiens
tcctaagaaatatgtgagatttt

SEQ ID NO: 4920703 - DNA, 15 bp, Homo sapiens
tcctaagcatctaag

SEQ ID NO: 4920704 - DNA, 18 bp, Homo sapiens
tcctaagggtcgaaagct

SEQ ID NO: 4920705 - DNA, 18 bp, Homo sapiens
tcctaattaccagtcttt

SEQ ID NO: 4920706 - DNA, 14 bp, Homo sapiens
tcctaatttccctt

SEQ ID NO: 4920707 - DNA, 19 bp, Homo sapiens
tcctaatttcccttcttgc

SEQ ID NO: 4920708 - DNA, 20 bp, Homo sapiens
tcctacaagagcagcctgtg

SEQ ID NO: 4920709 - DNA, 18 bp, Homo sapiens
tcctacaagatttagaaa

SEQ ID NO: 4920710 - DNA, 20 bp, Homo sapiens
tcctacaagatttagaaaaa

SEQ ID NO: 4920711 - DNA, 13 bp, Homo sapiens
tcctacagcacta

SEQ ID NO: 4920712 - DNA, 17 bp, Homo sapiens
tcctacaggcagtctct

SEQ ID NO: 4920713 - DNA, 20 bp, Homo sapiens
tcctacccacacctctgcca

SEQ ID NO: 4920714 - DNA, 21 bp, Homo sapiens
tcctacccacacctctgccag

SEQ ID NO: 4920715 - DNA, 22 bp, Homo sapiens
tcctacccacacctctgccaga

SEQ ID NO: 4920716 - DNA, 16 bp, Homo sapiens
tcctacctgccctgga

SEQ ID NO: 4920717 - DNA, 14 bp, Homo sapiens
tcctactctgtgtc

SEQ ID NO: 4920718 - DNA, 15 bp, Homo sapiens
tcctactctgtgtca

SEQ ID NO: 4920719 - DNA, 19 bp, Homo sapiens
tcctagagaacgcagccct

SEQ ID NO: 4920720 - DNA, 13 bp, Homo sapiens
tcctagatcctaa

SEQ ID NO: 4920721 - DNA, 17 bp, Homo sapiens
tcctagccactcaggag

SEQ ID NO: 4920722 - DNA, 18 bp, Homo sapiens
tcctagtttgacctcaca

SEQ ID NO: 4920723 - DNA, 18 bp, Homo sapiens
tcctataacttgatgcat

SEQ ID NO: 4920724 - DNA, 22 bp, Homo sapiens
tcctataatctgtcaaaacact

SEQ ID NO: 4920725 - DNA, 23 bp, Homo sapiens
tcctataatctgtcaaaacactg

SEQ ID NO: 4920726 - DNA, 17 bp, Homo sapiens
tcctatcagaagtttct

SEQ ID NO: 4920727 - DNA, 15 bp, Homo sapiens
tcctatccactgggc

SEQ ID NO: 4920728 - DNA, 17 bp, Homo sapiens
tcctatccactgggcac

SEQ ID NO: 4920729 - DNA, 17 bp, Homo sapiens
tcctatctatcttccaa

SEQ ID NO: 4920730 - DNA, 14 bp, Homo sapiens
tcctattgcaaagg

SEQ ID NO: 4920731 - DNA, 17 bp, Homo sapiens
tcctatttgttttcatg

SEQ ID NO: 4920732 - DNA, 14 bp, Homo sapiens
tcctatttttgtaa

SEQ ID NO: 4920733 - DNA, 14 bp, Homo sapiens
tcctcaaacaacac

SEQ ID NO: 4920734 - DNA, 14 bp, Homo sapiens
tcctcacagtccca

SEQ ID NO: 4920735 - DNA, 20 bp, Homo sapiens
tcctcacccccagctttgct

SEQ ID NO: 4920736 - DNA, 21 bp, Homo sapiens
tcctcacccctgtcctcactg

SEQ ID NO: 4920737 - DNA, 16 bp, Homo sapiens
tcctcacctctggact

SEQ ID NO: 4920738 - DNA, 13 bp, Homo sapiens
tcctcactcccag

SEQ ID NO: 4920739 - DNA, 19 bp, Homo sapiens
tcctcactgccctccccag

SEQ ID NO: 4920740 - DNA, 13 bp, Homo sapiens
tcctcactgctcc

SEQ ID NO: 4920741 - DNA, 17 bp, Homo sapiens
tcctcactggccatccc

SEQ ID NO: 4920742 - DNA, 18 bp, Homo sapiens
tcctcactggccatccct

SEQ ID NO: 4920743 - DNA, 17 bp, Homo sapiens
tcctcagagaatttcta

SEQ ID NO: 4920744 - DNA, 19 bp, Homo sapiens
tcctcagatcatccagaag

SEQ ID NO: 4920745 - DNA, 19 bp, Homo sapiens
tcctcagcatttcttttct

SEQ ID NO: 4920746 - DNA, 19 bp, Homo sapiens
tcctcagtccatttatata

SEQ ID NO: 4920747 - DNA, 23 bp, Homo sapiens
tcctcagtccatttatatatgaa

SEQ ID NO: 4920748 - DNA, 14 bp, Homo sapiens
tcctcatccacccc

SEQ ID NO: 4920749 - DNA, 18 bp, Homo sapiens
tcctcatccaccccatcc

SEQ ID NO: 4920750 - DNA, 17 bp, Homo sapiens
tcctccaaaggccccct

SEQ ID NO: 4920751 - DNA, 18 bp, Homo sapiens
tcctccagaagcctctgg

SEQ ID NO: 4920752 - DNA, 19 bp, Homo sapiens
tcctccagaagcctctggc

SEQ ID NO: 4920753 - DNA, 20 bp, Homo sapiens
tcctccagaagcctctggct

SEQ ID NO: 4920754 - DNA, 21 bp, Homo sapiens
tcctccagaagcctctggcta

SEQ ID NO: 4920755 - DNA, 22 bp, Homo sapiens
tcctccagaagcctctggctag

SEQ ID NO: 4920756 - DNA, 20 bp, Homo sapiens
tcctccatcccaacagccat

SEQ ID NO: 4920757 - DNA, 15 bp, Homo sapiens
tcctcccacctcagc

SEQ ID NO: 4920758 - DNA, 16 bp, Homo sapiens
tcctcccacctcagcc

SEQ ID NO: 4920759 - DNA, 21 bp, Homo sapiens
tcctcccacctcagcctcccg

SEQ ID NO: 4920760 - DNA, 13 bp, Homo sapiens
tcctcccatcccc

SEQ ID NO: 4920761 - DNA, 23 bp, Homo sapiens
tcctcccctcacagcctctgacc

SEQ ID NO: 4920762 - DNA, 15 bp, Homo sapiens
tcctccctcagtgcc

SEQ ID NO: 4920763 - DNA, 16 bp, Homo sapiens
tcctccgtccagccgc

SEQ ID NO: 4920764 - DNA, 22 bp, Homo sapiens
tcctcctcggaaccgctcacct

SEQ ID NO: 4920765 - DNA, 14 bp, Homo sapiens
tcctcctctttctc

SEQ ID NO: 4920766 - DNA, 19 bp, Homo sapiens
tcctcctggaaccttgctg

SEQ ID NO: 4920767 - DNA, 16 bp, Homo sapiens
tcctccttggtgcctg

SEQ ID NO: 4920768 - DNA, 17 bp, Homo sapiens
tcctcgttcctttctcc

SEQ ID NO: 4920769 - DNA, 16 bp, Homo sapiens
tcctctatacatctct

SEQ ID NO: 4920770 - DNA, 17 bp, Homo sapiens
tcacatagctacccaaa

SEQ ID NO: 4920771 - DNA, 12 bp, Homo sapiens
tcacatatctgt

SEQ ID NO: 4920772 - DNA, 13 bp, Homo sapiens
tcacatcacagga

SEQ ID NO: 4920773 - DNA, 18 bp, Homo sapiens
tcacatcagataagacat

SEQ ID NO: 4920774 - DNA, 19 bp, Homo sapiens
tcacattaatggtctaaaa

SEQ ID NO: 4920775 - DNA, 20 bp, Homo sapiens
tcacattgagctgatataaa

SEQ ID NO: 4920776 - DNA, 18 bp, Homo sapiens
tcacattgtttgctgcta

SEQ ID NO: 4920777 - DNA, 16 bp, Homo sapiens
tcaccactccattccc

SEQ ID NO: 4920778 - DNA, 19 bp, Homo sapiens
tcaccagcaccaacaccac

SEQ ID NO: 4920779 - DNA, 16 bp, Homo sapiens
tcaccagccccagtgc

SEQ ID NO: 4920780 - DNA, 22 bp, Homo sapiens
tcaccagccccagtgcccacag

SEQ ID NO: 4920781 - DNA, 17 bp, Homo sapiens
tcaccagtgtcccctcc

SEQ ID NO: 4920782 - DNA, 20 bp, Homo sapiens
tcaccagtgtcccctccact

SEQ ID NO: 4920783 - DNA, 21 bp, Homo sapiens
tcaccagtgtcccctccactg

SEQ ID NO: 4920784 - DNA, 16 bp, Homo sapiens
tcaccatgcttccagc

SEQ ID NO: 4920785 - DNA, 22 bp, Homo sapiens
tcaccccaagtagtctgctcac

SEQ ID NO: 4920786 - DNA, 13 bp, Homo sapiens
tcaccccaccctt

SEQ ID NO: 4920787 - DNA, 21 bp, Homo sapiens
tcaccccagtggccactcagc

SEQ ID NO: 4920788 - DNA, 13 bp, Homo sapiens
tcacccccagctt

SEQ ID NO: 4920789 - DNA, 18 bp, Homo sapiens
tcacccccagctttgcta

SEQ ID NO: 4920790 - DNA, 13 bp, Homo sapiens
tcaccccccactc

SEQ ID NO: 4920791 - DNA, 18 bp, Homo sapiens
tcaccccccactcaccag

SEQ ID NO: 4920792 - DNA, 23 bp, Homo sapiens
tcaccccgctgtaagctcctttg

SEQ ID NO: 4920793 - DNA, 18 bp, Homo sapiens
tcaccccggcaggccctg

SEQ ID NO: 4920794 - DNA, 19 bp, Homo sapiens
tcaccccggcaggccctgc

SEQ ID NO: 4920795 - DNA, 23 bp, Homo sapiens
tcaccccggcaggccctgcagtg

SEQ ID NO: 4920796 - DNA, 13 bp, Homo sapiens
tcacccctccagg

SEQ ID NO: 4920797 - DNA, 20 bp, Homo sapiens
tcaccctccacctcttcacc

SEQ ID NO: 4920798 - DNA, 22 bp, Homo sapiens
tcacccttaacccaaggagcac

SEQ ID NO: 4920799 - DNA, 17 bp, Homo sapiens
tcaccgacgcgtctcct

SEQ ID NO: 4920800 - DNA, 19 bp, Homo sapiens
tatagttaggatagcattt

SEQ ID NO: 4920801 - DNA, 12 bp, Homo sapiens
tatagttctaga

SEQ ID NO: 4920802 - DNA, 15 bp, Homo sapiens
tatagttctagacat

SEQ ID NO: 4920803 - DNA, 18 bp, Homo sapiens
tatagtttaaaacacatt

SEQ ID NO: 4920804 - DNA, 22 bp, Homo sapiens
tatagtttcagatatatatcat

SEQ ID NO: 4920805 - DNA, 14 bp, Homo sapiens
tatagtttctgagg

SEQ ID NO: 4920806 - DNA, 15 bp, Homo sapiens
tatagtttgtacatg

SEQ ID NO: 4920807 - DNA, 18 bp, Homo sapiens
tatagtttgtacatgcat

SEQ ID NO: 4920808 - DNA, 22 bp, Homo sapiens
tatagttttgaatcctttgcct

SEQ ID NO: 4920809 - DNA, 15 bp, Homo sapiens
tatataaaaatatat

SEQ ID NO: 4920810 - DNA, 21 bp, Homo sapiens
tatataaaaatatatatagtg

SEQ ID NO: 4920811 - DNA, 18 bp, Homo sapiens
tatataaagaatatatat

SEQ ID NO: 4920812 - DNA, 19 bp, Homo sapiens
tatataaagaatatatata

SEQ ID NO: 4920813 - DNA, 23 bp, Homo sapiens
tatataagagcatgaaattttta

SEQ ID NO: 4920814 - DNA, 13 bp, Homo sapiens
tatataattcact

SEQ ID NO: 4920815 - DNA, 21 bp, Homo sapiens
tatataattcactcaagcact

SEQ ID NO: 4920816 - DNA, 18 bp, Homo sapiens
tatatacacatataccta

SEQ ID NO: 4920817 - DNA, 22 bp, Homo sapiens
tatatacagtaactttatgtgt

SEQ ID NO: 4920818 - DNA, 17 bp, Homo sapiens
tatatacatatgtagac

SEQ ID NO: 4920819 - DNA, 14 bp, Homo sapiens
tatatacatgtgtg

SEQ ID NO: 4920820 - DNA, 17 bp, Homo sapiens
tatatacgaacaaaaca

SEQ ID NO: 4920821 - DNA, 21 bp, Homo sapiens
tatatagcagcaaaaatataa

SEQ ID NO: 4920822 - DNA, 22 bp, Homo sapiens
tatatagcagcaaaaatataaa

SEQ ID NO: 4920823 - DNA, 15 bp, Homo sapiens
tatatagtgctatat

SEQ ID NO: 4920824 - DNA, 10 bp, Homo sapiens
tatatataaa

SEQ ID NO: 4920825 - DNA, 15 bp, Homo sapiens
tatatataaagtata

SEQ ID NO: 4920826 - DNA, 15 bp, Homo sapiens
tatatatacatatgt

SEQ ID NO: 4920827 - DNA, 18 bp, Homo sapiens
tatatatacatatgtaga

SEQ ID NO: 4920828 - DNA, 14 bp, Homo sapiens
tatatatataaagt

SEQ ID NO: 4920829 - DNA, 11 bp, Homo sapiens
tatatatatat

SEQ ID NO: 4920830 - DNA, 15 bp, Homo sapiens
tatatatatatataa

SEQ ID NO: 4920831 - DNA, 13 bp, Homo sapiens
tatatatcagttt

SEQ ID NO: 4920832 - DNA, 14 bp, Homo sapiens
tatatatcagtttg

SEQ ID NO: 4920833 - DNA, 17 bp, Homo sapiens
tatatatcagtttgatc

SEQ ID NO: 4920834 - DNA, 22 bp, Homo sapiens
tatatatcatattggtattcac

SEQ ID NO: 4920835 - DNA, 13 bp, Homo sapiens
tatatatgaaaac

SEQ ID NO: 4920836 - DNA, 15 bp, Homo sapiens
tatatatgaaaacta

SEQ ID NO: 4920837 - DNA, 16 bp, Homo sapiens
tatatatgaaaactat

SEQ ID NO: 4920838 - DNA, 16 bp, Homo sapiens
tatatatgtgtatata

SEQ ID NO: 4920839 - DNA, 22 bp, Homo sapiens
tatatatgtgtatatatacata

SEQ ID NO: 4920840 - DNA, 23 bp, Homo sapiens
tatatatgtgtatatatacatac

SEQ ID NO: 4920841 - DNA, 16 bp, Homo sapiens
tatatatgtgtatgta

SEQ ID NO: 4920842 - DNA, 17 bp, Homo sapiens
tatatattcttataaaa

SEQ ID NO: 4920843 - DNA, 13 bp, Homo sapiens
tatatcagtttga

SEQ ID NO: 4920844 - DNA, 18 bp, Homo sapiens
tatatcctgtgactgtct

SEQ ID NO: 4920845 - DNA, 16 bp, Homo sapiens
tatatcctttctaaca

SEQ ID NO: 4920846 - DNA, 16 bp, Homo sapiens
tatatctgcttcagtg

SEQ ID NO: 4920847 - DNA, 17 bp, Homo sapiens
tatatctgcttcagtgg

SEQ ID NO: 4920848 - DNA, 14 bp, Homo sapiens
tatatctgtggtct

SEQ ID NO: 4920849 - DNA, 16 bp, Homo sapiens
tatatgaataaagtgt

SEQ ID NO: 4920850 - DNA, 19 bp, Homo sapiens
tatatgaggacttgtgtct

SEQ ID NO: 4920851 - DNA, 21 bp, Homo sapiens
tatatgatttatagtttgtac

SEQ ID NO: 4920852 - DNA, 18 bp, Homo sapiens
tatatgcctttttcctag

SEQ ID NO: 4920853 - DNA, 18 bp, Homo sapiens
tatatggatgattcagaa

SEQ ID NO: 4920854 - DNA, 14 bp, Homo sapiens
tatatgtactgttt

SEQ ID NO: 4920855 - DNA, 16 bp, Homo sapiens
tatatgtattatttat

SEQ ID NO: 4920856 - DNA, 19 bp, Homo sapiens
tatatgtattatttataat

SEQ ID NO: 4920857 - DNA, 22 bp, Homo sapiens
tatatgtgaatcctcttcttta

SEQ ID NO: 4920858 - DNA, 20 bp, Homo sapiens
tatatgtgtatatatacata

SEQ ID NO: 4920859 - DNA, 16 bp, Homo sapiens
tatatgtgttgaaaac

SEQ ID NO: 4920860 - DNA, 19 bp, Homo sapiens
tatatgttttaagaggcag

SEQ ID NO: 4920861 - DNA, 13 bp, Homo sapiens
tatattaagcaga

SEQ ID NO: 4920862 - DNA, 14 bp, Homo sapiens
tatattaagcagaa

SEQ ID NO: 4920863 - DNA, 15 bp, Homo sapiens
tatattaagcagaaa

SEQ ID NO: 4920864 - DNA, 20 bp, Homo sapiens
tatattataaatatatataa

SEQ ID NO: 4920865 - DNA, 13 bp, Homo sapiens
tatattatttggc

SEQ ID NO: 4920866 - DNA, 22 bp, Homo sapiens
tatattatttggcagtttggta

SEQ ID NO: 4920867 - DNA, 14 bp, Homo sapiens
tattgagtcaaatg

SEQ ID NO: 4920868 - DNA, 19 bp, Homo sapiens
tattgagtttgtaggtaaa

SEQ ID NO: 4920869 - DNA, 22 bp, Homo sapiens
tattgagtttgtaggtaaaatg

SEQ ID NO: 4920870 - DNA, 13 bp, Homo sapiens
tattgatatatat

SEQ ID NO: 4920871 - DNA, 15 bp, Homo sapiens
tattgccttctttga

SEQ ID NO: 4920872 - DNA, 17 bp, Homo sapiens
tattgccttctttgaag

SEQ ID NO: 4920873 - DNA, 18 bp, Homo sapiens
tattgccttctttgaaga

SEQ ID NO: 4920874 - DNA, 19 bp, Homo sapiens
tattgccttctttgaagaa

SEQ ID NO: 4920875 - DNA, 17 bp, Homo sapiens
tattgctagtatttgaa

SEQ ID NO: 4920876 - DNA, 20 bp, Homo sapiens
tattgctagtatttgaatta

SEQ ID NO: 4920877 - DNA, 15 bp, Homo sapiens
tattgctgttgcttg

SEQ ID NO: 4920878 - DNA, 17 bp, Homo sapiens
tattgcttagtaaaatt

SEQ ID NO: 4920879 - DNA, 15 bp, Homo sapiens
tattggaaaaatcac

SEQ ID NO: 4920880 - DNA, 17 bp, Homo sapiens
tattggggtctgacccc

SEQ ID NO: 4920881 - DNA, 16 bp, Homo sapiens
tattgtaaacatgtgt

SEQ ID NO: 4920882 - DNA, 17 bp, Homo sapiens
tattgtaaacatgtgtt

SEQ ID NO: 4920883 - DNA, 18 bp, Homo sapiens
tattgtaaacatgtgttt

SEQ ID NO: 4920884 - DNA, 14 bp, Homo sapiens
tattgtacataaaa

SEQ ID NO: 4920885 - DNA, 15 bp, Homo sapiens
tattgtacataaaag

SEQ ID NO: 4920886 - DNA, 13 bp, Homo sapiens
tattgtgaatgat

SEQ ID NO: 4920887 - DNA, 20 bp, Homo sapiens
tattgtgggacttattacaa

SEQ ID NO: 4920888 - DNA, 22 bp, Homo sapiens
tattgtgggacttattacaatt

SEQ ID NO: 4920889 - DNA, 17 bp, Homo sapiens
tattgttaactcttgtc

SEQ ID NO: 4920890 - DNA, 21 bp, Homo sapiens
tattgttaactcttgtctatt

SEQ ID NO: 4920891 - DNA, 20 bp, Homo sapiens
tattgttcaaacaatatcat

SEQ ID NO: 4920892 - DNA, 23 bp, Homo sapiens
tattgttgacaactgtgactgta

SEQ ID NO: 4920893 - DNA, 12 bp, Homo sapiens
tatttaagcaaa

SEQ ID NO: 4920894 - DNA, 18 bp, Homo sapiens
tatttaagcctcatattt

SEQ ID NO: 4920895 - DNA, 14 bp, Homo sapiens
tatttaattattaa

SEQ ID NO: 4920896 - DNA, 19 bp, Homo sapiens
tatttacgctttgattcat

SEQ ID NO: 4920897 - DNA, 14 bp, Homo sapiens
tatttactacctta

SEQ ID NO: 4920898 - DNA, 20 bp, Homo sapiens
tatttagtgctgcatcttat

SEQ ID NO: 4920899 - DNA, 16 bp, Homo sapiens
tatttatatgtactgt

SEQ ID NO: 4920900 - DNA, 14 bp, Homo sapiens
tatttatgaagttt

SEQ ID NO: 4920901 - DNA, 19 bp, Homo sapiens
tatttatgaagtttaaaac

SEQ ID NO: 4920902 - DNA, 13 bp, Homo sapiens
tatttattaaata

SEQ ID NO: 4920903 - DNA, 13 bp, Homo sapiens
tatttattaacag

SEQ ID NO: 4920904 - DNA, 17 bp, Homo sapiens
taagattctaaaggtcc

SEQ ID NO: 4920905 - DNA, 17 bp, Homo sapiens
taagattctaacggtct

SEQ ID NO: 4920906 - DNA, 11 bp, Homo sapiens
taagattctag

SEQ ID NO: 4920907 - DNA, 12 bp, Homo sapiens
taagattctaga

SEQ ID NO: 4920908 - DNA, 14 bp, Homo sapiens
taagattctgattt

SEQ ID NO: 4920909 - DNA, 17 bp, Homo sapiens
taagattctgattttag

SEQ ID NO: 4920910 - DNA, 12 bp, Homo sapiens
taagattttaca

SEQ ID NO: 4920911 - DNA, 16 bp, Homo sapiens
taagattttacaaaag

SEQ ID NO: 4920912 - DNA, 16 bp, Homo sapiens
taagatttttctcaaa

SEQ ID NO: 4920913 - DNA, 14 bp, Homo sapiens
taagcaaatactta

SEQ ID NO: 4920914 - DNA, 16 bp, Homo sapiens
taagcaaatttcaaaa

SEQ ID NO: 4920915 - DNA, 18 bp, Homo sapiens
taagcaaatttcaaaaga

SEQ ID NO: 4920916 - DNA, 23 bp, Homo sapiens
taagcaaatttcaaaagacatgt

SEQ ID NO: 4920917 - DNA, 17 bp, Homo sapiens
taagcactcttaaagca

SEQ ID NO: 4920918 - DNA, 14 bp, Homo sapiens
taagcactgaaaaa

SEQ ID NO: 4920919 - DNA, 15 bp, Homo sapiens
taagcagaaatcctg

SEQ ID NO: 4920920 - DNA, 21 bp, Homo sapiens
taagcaggagagaaatttctc

SEQ ID NO: 4920921 - DNA, 21 bp, Homo sapiens
taagcattaccactcaggcat

SEQ ID NO: 4920922 - DNA, 11 bp, Homo sapiens
taagccaaaga

SEQ ID NO: 4920923 - DNA, 20 bp, Homo sapiens
taagccaaagaaatgaacat

SEQ ID NO: 4920924 - DNA, 16 bp, Homo sapiens
taagccacaagaaatt

SEQ ID NO: 4920925 - DNA, 13 bp, Homo sapiens
taagccagcctgg

SEQ ID NO: 4920926 - DNA, 14 bp, Homo sapiens
taagccagcctggt

SEQ ID NO: 4920927 - DNA, 24 bp, Homo sapiens
taagccagcctggtccatgcaggg

SEQ ID NO: 4920928 - DNA, 17 bp, Homo sapiens
taagcctcatatttaaa

SEQ ID NO: 4920929 - DNA, 20 bp, Homo sapiens
taagcctcatatttaaagac

SEQ ID NO: 4920930 - DNA, 11 bp, Homo sapiens
taaggaaacaa

SEQ ID NO: 4920931 - DNA, 15 bp, Homo sapiens
taaggaaccttcctt

SEQ ID NO: 4920932 - DNA, 15 bp, Homo sapiens
taaggacctgaaatt

SEQ ID NO: 4920933 - DNA, 20 bp, Homo sapiens
taaggatgtcacagggccaa

SEQ ID NO: 4920934 - DNA, 16 bp, Homo sapiens
taaggcctaggattct

SEQ ID NO: 4920935 - DNA, 19 bp, Homo sapiens
taaggcctaggattctaaa

SEQ ID NO: 4920936 - DNA, 19 bp, Homo sapiens
taaggctctgagagtctag

SEQ ID NO: 4920937 - DNA, 17 bp, Homo sapiens
taagggaagacatttct

SEQ ID NO: 4920938 - DNA, 20 bp, Homo sapiens
taagggttagtttacaatca

SEQ ID NO: 4920939 - DNA, 17 bp, Homo sapiens
taaggtccggtgttcta

SEQ ID NO: 4920940 - DNA, 18 bp, Homo sapiens
taaggtccggtgttctaa

SEQ ID NO: 4920941 - DNA, 19 bp, Homo sapiens
taaggtttcgtttctgtat

SEQ ID NO: 4920942 - DNA, 22 bp, Homo sapiens
taaggtttcgtttctgtataca

SEQ ID NO: 4920943 - DNA, 18 bp, Homo sapiens
taagtaatcaataaagaa

SEQ ID NO: 4920944 - DNA, 12 bp, Homo sapiens
taagtaattatg

SEQ ID NO: 4920945 - DNA, 19 bp, Homo sapiens
taagtactacacattttta

SEQ ID NO: 4920946 - DNA, 12 bp, Homo sapiens
taagtactgtaa

SEQ ID NO: 4920947 - DNA, 17 bp, Homo sapiens
taagtactgtaataata

SEQ ID NO: 4920948 - DNA, 14 bp, Homo sapiens
taagtatacagttc

SEQ ID NO: 4920949 - DNA, 20 bp, Homo sapiens
taagtatacagttcaataaa

SEQ ID NO: 4920950 - DNA, 15 bp, Homo sapiens
taagtattaaaacat

SEQ ID NO: 4920951 - DNA, 16 bp, Homo sapiens
taagtattaaaacatt

SEQ ID NO: 4920952 - DNA, 19 bp, Homo sapiens
taagtattaaaacattgga

SEQ ID NO: 4920953 - DNA, 17 bp, Homo sapiens
gtttgtttgtttgtctg

SEQ ID NO: 4920954 - DNA, 22 bp, Homo sapiens
gttttaaatacgcactacatgt

SEQ ID NO: 4920955 - DNA, 13 bp, Homo sapiens
gttttaaattctg

SEQ ID NO: 4920956 - DNA, 14 bp, Homo sapiens
gttttaagaggcag

SEQ ID NO: 4920957 - DNA, 14 bp, Homo sapiens
gttttaatctgaaa

SEQ ID NO: 4920958 - DNA, 16 bp, Homo sapiens
gttttaatctgaaatt

SEQ ID NO: 4920959 - DNA, 18 bp, Homo sapiens
gttttaatctgaaattct

SEQ ID NO: 4920960 - DNA, 12 bp, Homo sapiens
gttttaatgtat

SEQ ID NO: 4920961 - DNA, 21 bp, Homo sapiens
gttttacattgttgagctatt

SEQ ID NO: 4920962 - DNA, 21 bp, Homo sapiens
gttttagattttctggttcta

SEQ ID NO: 4920963 - DNA, 14 bp, Homo sapiens
gttttatcatgaca

SEQ ID NO: 4920964 - DNA, 20 bp, Homo sapiens
gttttattcctgtatgttgt

SEQ ID NO: 4920965 - DNA, 14 bp, Homo sapiens
gttttattttatgt

SEQ ID NO: 4920966 - DNA, 17 bp, Homo sapiens
gttttattttatgttta

SEQ ID NO: 4920967 - DNA, 17 bp, Homo sapiens
gttttcaaattggactt

SEQ ID NO: 4920968 - DNA, 23 bp, Homo sapiens
gttttcaaattggactttcaaaa

SEQ ID NO: 4920969 - DNA, 10 bp, Homo sapiens
gttttcatgg

SEQ ID NO: 4920970 - DNA, 21 bp, Homo sapiens
gttttcatggtgaaaatgtac

SEQ ID NO: 4920971 - DNA, 17 bp, Homo sapiens
gttttcatttggttcat

SEQ ID NO: 4920972 - DNA, 11 bp, Homo sapiens
gttttccaaac

SEQ ID NO: 4920973 - DNA, 20 bp, Homo sapiens
gttttcctctatacatctct

SEQ ID NO: 4920974 - DNA, 16 bp, Homo sapiens
gttttctgagggaaag

SEQ ID NO: 4920975 - DNA, 17 bp, Homo sapiens
gttttctgtagtcattt

SEQ ID NO: 4920976 - DNA, 15 bp, Homo sapiens
gttttctttctttaa

SEQ ID NO: 4920977 - DNA, 20 bp, Homo sapiens
gttttctttctttaaatgtt

SEQ ID NO: 4920978 - DNA, 14 bp, Homo sapiens
gttttctttgaatg

SEQ ID NO: 4920979 - DNA, 19 bp, Homo sapiens
gttttgaagctactgtgtg

SEQ ID NO: 4920980 - DNA, 18 bp, Homo sapiens
gttttgaatattactcct

SEQ ID NO: 4920981 - DNA, 14 bp, Homo sapiens
gttttgatatgagt

SEQ ID NO: 4920982 - DNA, 15 bp, Homo sapiens
gttttgatatgagta

SEQ ID NO: 4920983 - DNA, 22 bp, Homo sapiens
gttttgatgtttgtggcctcag

SEQ ID NO: 4920984 - DNA, 23 bp, Homo sapiens
gttttgatgtttgtggcctcaga

SEQ ID NO: 4920985 - DNA, 20 bp, Homo sapiens
gttttgccatgttggccagg

SEQ ID NO: 4920986 - DNA, 15 bp, Homo sapiens
gttttgggggtcagg

SEQ ID NO: 4920987 - DNA, 12 bp, Homo sapiens
gttttgtataca

SEQ ID NO: 4920988 - DNA, 19 bp, Homo sapiens
gttttgtatcttaaatttg

SEQ ID NO: 4920989 - DNA, 24 bp, Homo sapiens
gttttgtgactatatagagatgtt

SEQ ID NO: 4920990 - DNA, 16 bp, Homo sapiens
gtttttaaaagtttca

SEQ ID NO: 4920991 - DNA, 18 bp, Homo sapiens
gtttttaaatagagtttg

SEQ ID NO: 4920992 - DNA, 21 bp, Homo sapiens
gtttttaagggtttgtggaaa

SEQ ID NO: 4920993 - DNA, 21 bp, Homo sapiens
gtttttagtaatctgtacatt

SEQ ID NO: 4920994 - DNA, 19 bp, Homo sapiens
gtttttatgatatccctga

SEQ ID NO: 4920995 - DNA, 20 bp, Homo sapiens
gtttttatgatatccctgat

SEQ ID NO: 4920996 - DNA, 17 bp, Homo sapiens
gtttttattaatttata

SEQ ID NO: 4920997 - DNA, 20 bp, Homo sapiens
gtttttcaccacttcactga

SEQ ID NO: 4920998 - DNA, 17 bp, Homo sapiens
gtttttctgccagggag

SEQ ID NO: 4920999 - DNA, 21 bp, Homo sapiens
gttttttaaaatatttatctg

SEQ ID NO: 4921000 - DNA, 10 bp, Homo sapiens
gtttttttgc

SEQ ID NO: 4921001 - DNA, 23 bp, Homo sapiens
gttttttttttttttatgtgatc

SEQ ID NO: 4921002 - DNA, 19 bp, Homo sapiens
gttttttttttttttttgg

SEQ ID NO: 4921003 - DNA, 21 bp, Homo sapiens
gttttttttttttttttggct

SEQ ID NO: 4921004 - DNA, 19 bp, Homo sapiens
taaaaaaaaaaaaaagctt

SEQ ID NO: 4921005 - DNA, 20 bp, Homo sapiens
taaaaaaaaaaaaaagcttt

SEQ ID NO: 4921006 - DNA, 17 bp, Homo sapiens
taaaaaaaaaagttaca

SEQ ID NO: 4921007 - DNA, 21 bp, Homo sapiens
taaaaaaaaatagatgtcttt

SEQ ID NO: 4921008 - DNA, 12 bp, Homo sapiens
taaaaaaagaaa

SEQ ID NO: 4921009 - DNA, 11 bp, Homo sapiens
taaaaaaataa

SEQ ID NO: 4921010 - DNA, 15 bp, Homo sapiens
taaaaaaatttaagt

SEQ ID NO: 4921011 - DNA, 16 bp, Homo sapiens
taaaaaaatttaagtg

SEQ ID NO: 4921012 - DNA, 17 bp, Homo sapiens
taaaaaaatttaagtgc

SEQ ID NO: 4921013 - DNA, 11 bp, Homo sapiens
taaaaaacaac

SEQ ID NO: 4921014 - DNA, 16 bp, Homo sapiens
taaaaacccacaaaaa

SEQ ID NO: 4921015 - DNA, 21 bp, Homo sapiens
taaaaagacattcttccaaaa

SEQ ID NO: 4921016 - DNA, 16 bp, Homo sapiens
taaaaagattagcaag

SEQ ID NO: 4921017 - DNA, 13 bp, Homo sapiens
taaaaagattctt

SEQ ID NO: 4921018 - DNA, 20 bp, Homo sapiens
taaaaagccactagactctt

SEQ ID NO: 4921019 - DNA, 23 bp, Homo sapiens
taaaaagccactagactcttcac

SEQ ID NO: 4921020 - DNA, 20 bp, Homo sapiens
taaaaagcttccatgattct

SEQ ID NO: 4921021 - DNA, 15 bp, Homo sapiens
taaaaagtgacacag

SEQ ID NO: 4921022 - DNA, 17 bp, Homo sapiens
taaaaagtggaatttct

SEQ ID NO: 4921023 - DNA, 14 bp, Homo sapiens
tacaagtgtatatc

SEQ ID NO: 4921024 - DNA, 21 bp, Homo sapiens
tacaataaaactttgctgcca

SEQ ID NO: 4921025 - DNA, 13 bp, Homo sapiens
tacaatatataaa

SEQ ID NO: 4921026 - DNA, 14 bp, Homo sapiens
tacaatatataaaa

SEQ ID NO: 4921027 - DNA, 17 bp, Homo sapiens
tacaatatataaaaata

SEQ ID NO: 4921028 - DNA, 20 bp, Homo sapiens
tacaatatataaaaatatat

SEQ ID NO: 4921029 - DNA, 15 bp, Homo sapiens
tacaatgaacactta

SEQ ID NO: 4921030 - DNA, 13 bp, Homo sapiens
tacaatgtagatg

SEQ ID NO: 4921031 - DNA, 13 bp, Homo sapiens
tacaatgtgtttt

SEQ ID NO: 4921032 - DNA, 19 bp, Homo sapiens
tacaatgtgtttttctcca

SEQ ID NO: 4921033 - DNA, 20 bp, Homo sapiens
tacaatgtgtttttctccag

SEQ ID NO: 4921034 - DNA, 21 bp, Homo sapiens
tacaattaatagtttgtctat

SEQ ID NO: 4921035 - DNA, 13 bp, Homo sapiens
tacacaaagggga

SEQ ID NO: 4921036 - DNA, 11 bp, Homo sapiens
tacacacacac

SEQ ID NO: 4921037 - DNA, 13 bp, Homo sapiens
tacacatatacct

SEQ ID NO: 4921038 - DNA, 14 bp, Homo sapiens
tacacatataccta

SEQ ID NO: 4921039 - DNA, 13 bp, Homo sapiens
tacacatttgtac

SEQ ID NO: 4921040 - DNA, 16 bp, Homo sapiens
tacacatttttaaatt

SEQ ID NO: 4921041 - DNA, 19 bp, Homo sapiens
tacacatttttaaattgtt

SEQ ID NO: 4921042 - DNA, 15 bp, Homo sapiens
tacacccagacccca

SEQ ID NO: 4921043 - DNA, 16 bp, Homo sapiens
tacaccgactagccag

SEQ ID NO: 4921044 - DNA, 17 bp, Homo sapiens
tacaccgggcctggaga

SEQ ID NO: 4921045 - DNA, 15 bp, Homo sapiens
tacacctaaaggtgt

SEQ ID NO: 4921046 - DNA, 14 bp, Homo sapiens
tacacgaaagagag

SEQ ID NO: 4921047 - DNA, 15 bp, Homo sapiens
tacacgaaagagaga

SEQ ID NO: 4921048 - DNA, 17 bp, Homo sapiens
tacacgtgtcctgtagt

SEQ ID NO: 4921049 - DNA, 16 bp, Homo sapiens
tacactgaggagagat

SEQ ID NO: 4921050 - DNA, 21 bp, Homo sapiens
tacactgcaatcatatgtgat

SEQ ID NO: 4921051 - DNA, 15 bp, Homo sapiens
tacactgcctgtata

SEQ ID NO: 4921052 - DNA, 18 bp, Homo sapiens
tacactgcctgtatactt

SEQ ID NO: 4921053 - DNA, 19 bp, Homo sapiens
tacactgcctgtatacttt

SEQ ID NO: 4921054 - DNA, 21 bp, Homo sapiens
tacactgcctgtatactttag

SEQ ID NO: 4921055 - DNA, 20 bp, Homo sapiens
tacacttgtataaatgtata

SEQ ID NO: 4921056 - DNA, 21 bp, Homo sapiens
tacacttgtataaatgtatat

SEQ ID NO: 4921057 - DNA, 18 bp, Homo sapiens
tacacttttatgagcttc

SEQ ID NO: 4921058 - DNA, 19 bp, Homo sapiens
tacagaaatactataacat

SEQ ID NO: 4921059 - DNA, 22 bp, Homo sapiens
tacagaaatactataacatatg

SEQ ID NO: 4921060 - DNA, 23 bp, Homo sapiens
tacagaaatataataaaatgtgt

SEQ ID NO: 4921061 - DNA, 21 bp, Homo sapiens
tacagacctgctttttgaaat

SEQ ID NO: 4921062 - DNA, 22 bp, Homo sapiens
tacagacctgctttttgaaatg

SEQ ID NO: 4921063 - DNA, 15 bp, Homo sapiens
tacagataacattag

SEQ ID NO: 4921064 - DNA, 14 bp, Homo sapiens
tacagatgaaaatt

SEQ ID NO: 4921065 - DNA, 18 bp, Homo sapiens
tacagatgaatgtattta

SEQ ID NO: 4921066 - DNA, 13 bp, Homo sapiens
tacagatttaata

SEQ ID NO: 4921067 - DNA, 23 bp, Homo sapiens
tacagcactactgggtgtcattt

SEQ ID NO: 4921068 - DNA, 10 bp, Homo sapiens
tacagctggg

SEQ ID NO: 4921069 - DNA, 12 bp, Homo sapiens
tacagctgtgtt

SEQ ID NO: 4921070 - DNA, 17 bp, Homo sapiens
tacagctgtgttattct

SEQ ID NO: 4921071 - DNA, 18 bp, Homo sapiens
tacaggaaaagctgctga

SEQ ID NO: 4921072 - DNA, 14 bp, Homo sapiens
tacaggcagtctct

SEQ ID NO: 4921073 - DNA, 16 bp, Homo sapiens
tacaggccctgctcct

SEQ ID NO: 4921074 - DNA, 24 bp, Homo sapiens
tacagggtaactgtgctgaatgct

SEQ ID NO: 4921075 - DNA, 23 bp, Homo sapiens
tacagggtttttacctgtcacat

SEQ ID NO: 4921076 - DNA, 13 bp, Homo sapiens
tacagtaacttta

SEQ ID NO: 4921077 - DNA, 13 bp, Homo sapiens
tacagttttatgc

SEQ ID NO: 4921078 - DNA, 17 bp, Homo sapiens
tacagttttatgctctt

SEQ ID NO: 4921079 - DNA, 16 bp, Homo sapiens
tacataaattggcctg

SEQ ID NO: 4921080 - DNA, 19 bp, Homo sapiens
tacataacaagaaaatcaa

SEQ ID NO: 4921081 - DNA, 19 bp, Homo sapiens
tacataactaaatttgata

SEQ ID NO: 4921082 - DNA, 20 bp, Homo sapiens
tacataactctgtaaaaaca

SEQ ID NO: 4921083 - DNA, 23 bp, Homo sapiens
tacataactctgtaaaaacactg

SEQ ID NO: 4921084 - DNA, 13 bp, Homo sapiens
tacataactgcct

SEQ ID NO: 4921085 - DNA, 17 bp, Homo sapiens
tacataagtaattcaag

SEQ ID NO: 4921086 - DNA, 13 bp, Homo sapiens
tacataatgctta

SEQ ID NO: 4921087 - DNA, 22 bp, Homo sapiens
tacataatgcttaatttctaaa

SEQ ID NO: 4921088 - DNA, 22 bp, Homo sapiens
tacataattttttattcaagtt

SEQ ID NO: 4921089 - DNA, 21 bp, Homo sapiens
tacatacacttgtataaatgt

SEQ ID NO: 4921090 - DNA, 23 bp, Homo sapiens
tacatacggtcaggtttaacatt

SEQ ID NO: 4921091 - DNA, 23 bp, Homo sapiens
tacatactttcatcctgactctg

SEQ ID NO: 4921092 - DNA, 21 bp, Homo sapiens
tacatagttttaaactcattt

SEQ ID NO: 4921093 - DNA, 14 bp, Homo sapiens
tacatatattttta

SEQ ID NO: 4921094 - DNA, 15 bp, Homo sapiens
tacatatgtagacta

SEQ ID NO: 4921095 - DNA, 17 bp, Homo sapiens
tacatatgtagactata

SEQ ID NO: 4921096 - DNA, 21 bp, Homo sapiens
tacatatgtagactatataca

SEQ ID NO: 4921097 - DNA, 13 bp, Homo sapiens
tacatcactgctt

SEQ ID NO: 4921098 - DNA, 15 bp, Homo sapiens
tacatcactgcttga

SEQ ID NO: 4921099 - DNA, 18 bp, Homo sapiens
tacatcagttattcattc

SEQ ID NO: 4921100 - DNA, 22 bp, Homo sapiens
tacatctattttggattgtata

SEQ ID NO: 4921101 - DNA, 13 bp, Homo sapiens
tacatctgtcatg

SEQ ID NO: 4921102 - DNA, 16 bp, Homo sapiens
tacatctttaaacagt

SEQ ID NO: 4921103 - DNA, 21 bp, Homo sapiens
tacatgaaaattttaaaaata

SEQ ID NO: 4921104 - DNA, 14 bp, Homo sapiens
tacatgaaacagaa

SEQ ID NO: 4921105 - DNA, 14 bp, Homo sapiens
tacatgaatacaaa

SEQ ID NO: 4921106 - DNA, 17 bp, Homo sapiens
tacatgagaacaaacag

SEQ ID NO: 4921107 - DNA, 16 bp, Homo sapiens
tacatgagaaggaact

SEQ ID NO: 4921108 - DNA, 19 bp, Homo sapiens
tacatgaggaactgtagat

SEQ ID NO: 4921109 - DNA, 20 bp, Homo sapiens
tacatgaggaactgtagatg

SEQ ID NO: 4921110 - DNA, 22 bp, Homo sapiens
tacatgcaatttattaaaatga

SEQ ID NO: 4921111 - DNA, 17 bp, Homo sapiens
tacatgcagcccatgcc

SEQ ID NO: 4921112 - DNA, 22 bp, Homo sapiens
tacatgcagcccatgcccacct

SEQ ID NO: 4921113 - DNA, 22 bp, Homo sapiens
tacatggcagagtttgtgtgtt

SEQ ID NO: 4921114 - DNA, 16 bp, Homo sapiens
tacatgtgtagcctgt

SEQ ID NO: 4921115 - DNA, 12 bp, Homo sapiens
tacatgtgtgta

SEQ ID NO: 4921116 - DNA, 13 bp, Homo sapiens
tacatgtgtgtat

SEQ ID NO: 4921117 - DNA, 13 bp, Homo sapiens
tacattagtaaat

SEQ ID NO: 4921118 - DNA, 18 bp, Homo sapiens
tacattagtaaatgtctt

SEQ ID NO: 4921119 - DNA, 20 bp, Homo sapiens
tacattagtaaatgtctttg

SEQ ID NO: 4921120 - DNA, 21 bp, Homo sapiens
tacattagtaaatgtctttgt

SEQ ID NO: 4921121 - DNA, 23 bp, Homo sapiens
tacattagtaaatgtctttgtaa

SEQ ID NO: 4921122 - DNA, 13 bp, Homo sapiens
tacattcatttag

SEQ ID NO: 4921123 - DNA, 18 bp, Homo sapiens
tacatttaaaattgctat

SEQ ID NO: 4921124 - DNA, 14 bp, Homo sapiens
tacatttaaagcat

SEQ ID NO: 4921125 - DNA, 17 bp, Homo sapiens
tacatttaaagcattgc

SEQ ID NO: 4921126 - DNA, 18 bp, Homo sapiens
tacatttaaagcattgct

SEQ ID NO: 4921127 - DNA, 19 bp, Homo sapiens
tacatttaaagcattgctg

SEQ ID NO: 4921128 - DNA, 20 bp, Homo sapiens
tacatttaaagcattgctgt

SEQ ID NO: 4921129 - DNA, 22 bp, Homo sapiens
tacatttaaagcattgctgtta

SEQ ID NO: 4921130 - DNA, 14 bp, Homo sapiens
tacatttataattg

SEQ ID NO: 4921131 - DNA, 14 bp, Homo sapiens
tacatttatgattt

SEQ ID NO: 4921132 - DNA, 19 bp, Homo sapiens
tacatttatgatttaataa

SEQ ID NO: 4921133 - DNA, 14 bp, Homo sapiens
tagaatgagatctg

SEQ ID NO: 4921134 - DNA, 21 bp, Homo sapiens
tagaatgatttcatgctatct

SEQ ID NO: 4921135 - DNA, 21 bp, Homo sapiens
tagaatggataaaataatgct

SEQ ID NO: 4921136 - DNA, 12 bp, Homo sapiens
tagaattattta

SEQ ID NO: 4921137 - DNA, 15 bp, Homo sapiens
tagaattatttaaac

SEQ ID NO: 4921138 - DNA, 13 bp, Homo sapiens
tagaattgttata

SEQ ID NO: 4921139 - DNA, 20 bp, Homo sapiens
tagacaagatattgtacata

SEQ ID NO: 4921140 - DNA, 17 bp, Homo sapiens
tagacaatcattgtttt

SEQ ID NO: 4921141 - DNA, 17 bp, Homo sapiens
tagacacccattttcac

SEQ ID NO: 4921142 - DNA, 21 bp, Homo sapiens
tagacactccccgaagtcttt

SEQ ID NO: 4921143 - DNA, 20 bp, Homo sapiens
tagacagtttgtaaatgtta

SEQ ID NO: 4921144 - DNA, 21 bp, Homo sapiens
tagacagtttgtaaatgttat

SEQ ID NO: 4921145 - DNA, 22 bp, Homo sapiens
tagacagtttgtaaatgttatt

SEQ ID NO: 4921146 - DNA, 14 bp, Homo sapiens
tagaccaaaataaa

SEQ ID NO: 4921147 - DNA, 15 bp, Homo sapiens
tagaccaaggaacaa

SEQ ID NO: 4921148 - DNA, 16 bp, Homo sapiens
tagaccaggatttcta

SEQ ID NO: 4921149 - DNA, 23 bp, Homo sapiens
tagaccgctctcttttctgtact

SEQ ID NO: 4921150 - DNA, 20 bp, Homo sapiens
tagactatatacatgtgtgt

SEQ ID NO: 4921151 - DNA, 23 bp, Homo sapiens
tagactatatacatgtgtgtata

SEQ ID NO: 4921152 - DNA, 12 bp, Homo sapiens
tagactcttcac

SEQ ID NO: 4921153 - DNA, 11 bp, Homo sapiens
tagactttctg

SEQ ID NO: 4921154 - DNA, 12 bp, Homo sapiens
tagactttctgt

SEQ ID NO: 4921155 - DNA, 16 bp, Homo sapiens
tagagaactgtggccg

SEQ ID NO: 4921156 - DNA, 13 bp, Homo sapiens
tagagaatgcaca

SEQ ID NO: 4921157 - DNA, 14 bp, Homo sapiens
tagagaatgcacag

SEQ ID NO: 4921158 - DNA, 22 bp, Homo sapiens
tagagaatgcacagatatactt

SEQ ID NO: 4921159 - DNA, 16 bp, Homo sapiens
tagagagagaccactt

SEQ ID NO: 4921160 - DNA, 23 bp, Homo sapiens
tagagatgaagtttgtagttgtt

SEQ ID NO: 4921161 - DNA, 15 bp, Homo sapiens
tagagatttgtctaa

SEQ ID NO: 4921162 - DNA, 20 bp, Homo sapiens
tagagcacctagtccagtga

SEQ ID NO: 4921163 - DNA, 12 bp, Homo sapiens
tagagcagccca

SEQ ID NO: 4921164 - DNA, 13 bp, Homo sapiens
tagagccagcttg

SEQ ID NO: 4921165 - DNA, 12 bp, Homo sapiens
tagagcctgcct

SEQ ID NO: 4921166 - DNA, 18 bp, Homo sapiens
tagaggccagccccaccc

SEQ ID NO: 4921167 - DNA, 23 bp, Homo sapiens
tagaggtaccagcaatatgtaaa

SEQ ID NO: 4921168 - DNA, 15 bp, Homo sapiens
tagaggtactagaat

SEQ ID NO: 4921169 - DNA, 17 bp, Homo sapiens
tagaggtcctctggagc

SEQ ID NO: 4921170 - DNA, 16 bp, Homo sapiens
tagaggttttgttgtt

SEQ ID NO: 4921171 - DNA, 19 bp, Homo sapiens
tagaggttttgttgtttta

SEQ ID NO: 4921172 - DNA, 14 bp, Homo sapiens
tagagtatatgcac

SEQ ID NO: 4921173 - DNA, 20 bp, Homo sapiens
tagagtcctcactcccagtc

SEQ ID NO: 4921174 - DNA, 13 bp, Homo sapiens
tagagttaagaag

SEQ ID NO: 4921175 - DNA, 13 bp, Homo sapiens
tagagtttaacac

SEQ ID NO: 4921176 - DNA, 16 bp, Homo sapiens
tagataaatatttgac

SEQ ID NO: 4921177 - DNA, 22 bp, Homo sapiens
tagatagctgcatgtggctttt

SEQ ID NO: 4921178 - DNA, 13 bp, Homo sapiens
tagatagggctgg

SEQ ID NO: 4921179 - DNA, 16 bp, Homo sapiens
tagataggtaaatacc

SEQ ID NO: 4921180 - DNA, 17 bp, Homo sapiens
tagatagttagaacctg

SEQ ID NO: 4921181 - DNA, 14 bp, Homo sapiens
tagatatttggctt

SEQ ID NO: 4921182 - DNA, 17 bp, Homo sapiens
tagatatttggcttaaa

SEQ ID NO: 4921183 - DNA, 18 bp, Homo sapiens
tagatatttggcttaaat

SEQ ID NO: 4921184 - DNA, 15 bp, Homo sapiens
tagatattttcacaa

SEQ ID NO: 4921185 - DNA, 24 bp, Homo sapiens
tagatattttcacaatgtcagtat

SEQ ID NO: 4921186 - DNA, 14 bp, Homo sapiens
tagatgatgtattt

SEQ ID NO: 4921187 - DNA, 16 bp, Homo sapiens
tagatgcacttatgca

SEQ ID NO: 4921188 - DNA, 14 bp, Homo sapiens
tagatgctgactgt

SEQ ID NO: 4921189 - DNA, 23 bp, Homo sapiens
tagatgctgactgtactcctccc

SEQ ID NO: 4921190 - DNA, 18 bp, Homo sapiens
tagatggcctcttactaa

SEQ ID NO: 4921191 - DNA, 15 bp, Homo sapiens
tagatggtgaaattt

SEQ ID NO: 4921192 - DNA, 12 bp, Homo sapiens
tagatgtctttt

SEQ ID NO: 4921193 - DNA, 14 bp, Homo sapiens
tagatgtcttttat

SEQ ID NO: 4921194 - DNA, 18 bp, Homo sapiens
tagatgttccagtaatct

SEQ ID NO: 4921195 - DNA, 20 bp, Homo sapiens
tagatgtttattcttctaga

SEQ ID NO: 4921196 - DNA, 18 bp, Homo sapiens
tagattaaatatagatta

SEQ ID NO: 4921197 - DNA, 20 bp, Homo sapiens
tagattaaatatagattaga

SEQ ID NO: 4921198 - DNA, 17 bp, Homo sapiens
tagattaatggcactga

SEQ ID NO: 4921199 - DNA, 13 bp, Homo sapiens
tagattctaaaga

SEQ ID NO: 4921200 - DNA, 19 bp, Homo sapiens
tagattctctgtgtctaag

SEQ ID NO: 4921201 - DNA, 20 bp, Homo sapiens
tagattctctgtgtctaaga

SEQ ID NO: 4921202 - DNA, 14 bp, Homo sapiens
tagattttcatgtt

SEQ ID NO: 4921203 - DNA, 17 bp, Homo sapiens
tagattttcatgttctt

SEQ ID NO: 4921204 - DNA, 17 bp, Homo sapiens
tagattttctggttcta

SEQ ID NO: 4921205 - DNA, 19 bp, Homo sapiens
tagattttctggttctaac

SEQ ID NO: 4921206 - DNA, 18 bp, Homo sapiens
tagcaaaaagtggggcag

SEQ ID NO: 4921207 - DNA, 18 bp, Homo sapiens
tagcaagacacatcccta

SEQ ID NO: 4921208 - DNA, 14 bp, Homo sapiens
tagcaagctggcct

SEQ ID NO: 4921209 - DNA, 19 bp, Homo sapiens
tagcaaggtcatttcttca

SEQ ID NO: 4921210 - DNA, 16 bp, Homo sapiens
tagcaattccatcacc

SEQ ID NO: 4921211 - DNA, 15 bp, Homo sapiens
tagcacagattttaa

SEQ ID NO: 4921212 - DNA, 18 bp, Homo sapiens
tagcacagattttaattg

SEQ ID NO: 4921213 - DNA, 23 bp, Homo sapiens
tagcacagattttaattgtcatg

SEQ ID NO: 4921214 - DNA, 16 bp, Homo sapiens
tagcactgttgatgta

SEQ ID NO: 4921215 - DNA, 19 bp, Homo sapiens
tagcactgttgatgtatct

SEQ ID NO: 4921216 - DNA, 14 bp, Homo sapiens
tagcactttgaaat

SEQ ID NO: 4921217 - DNA, 17 bp, Homo sapiens
tagcactttgaaatacc

SEQ ID NO: 4921218 - DNA, 20 bp, Homo sapiens
tagcactttgaaatacctca

SEQ ID NO: 4921219 - DNA, 20 bp, Homo sapiens
tagcagtaaaagatgaagtt

SEQ ID NO: 4921220 - DNA, 20 bp, Homo sapiens
tagcagtgtctgtaaaagag

SEQ ID NO: 4921221 - DNA, 21 bp, Homo sapiens
tagcagtgtgaagtacaataa

SEQ ID NO: 4921222 - DNA, 19 bp, Homo sapiens
tagcatagcttattattga

SEQ ID NO: 4921223 - DNA, 17 bp, Homo sapiens
tagcatcctaagaaata

SEQ ID NO: 4921224 - DNA, 20 bp, Homo sapiens
tagcatcctaagaaatatgt

SEQ ID NO: 4921225 - DNA, 15 bp, Homo sapiens
tagcattatgcaatt

SEQ ID NO: 4921226 - DNA, 16 bp, Homo sapiens
tagcattatgcaatta

SEQ ID NO: 4921227 - DNA, 21 bp, Homo sapiens
tagccaatgtctcctcccctt

SEQ ID NO: 4921228 - DNA, 16 bp, Homo sapiens
tagccacatttggaat

SEQ ID NO: 4921229 - DNA, 19 bp, Homo sapiens
tagccagcacttgtatata

SEQ ID NO: 4921230 - DNA, 16 bp, Homo sapiens
tagccagtgctccagg

SEQ ID NO: 4921231 - DNA, 23 bp, Homo sapiens
tagccagtgctccaggcacccag

SEQ ID NO: 4921232 - DNA, 14 bp, Homo sapiens
tagcccaccctgct

SEQ ID NO: 4921233 - DNA, 16 bp, Homo sapiens
tagcccaggagagaga

SEQ ID NO: 4921234 - DNA, 12 bp, Homo sapiens
tagcccatccct

SEQ ID NO: 4921235 - DNA, 15 bp, Homo sapiens
tagcccatccctgcc

SEQ ID NO: 4921236 - DNA, 20 bp, Homo sapiens
tagcccatccctgcctggtc

SEQ ID NO: 4921237 - DNA, 13 bp, Homo sapiens
tagccccataatt

SEQ ID NO: 4921238 - DNA, 15 bp, Homo sapiens
tagccccctggcctc

SEQ ID NO: 4921239 - DNA, 15 bp, Homo sapiens
tagccctttctgtgt

SEQ ID NO: 4921240 - DNA, 20 bp, Homo sapiens
tagcctaatacaacatgtag

SEQ ID NO: 4921241 - DNA, 19 bp, Homo sapiens
tagcctccttcgcaggcat

SEQ ID NO: 4921242 - DNA, 15 bp, Homo sapiens
tagcctgtttcttcc

SEQ ID NO: 4921243 - DNA, 15 bp, Homo sapiens
tagttctaagactca

SEQ ID NO: 4921244 - DNA, 11 bp, Homo sapiens
tagttctagac

SEQ ID NO: 4921245 - DNA, 23 bp, Homo sapiens
tagttctagacatggaggttcta

SEQ ID NO: 4921246 - DNA, 15 bp, Homo sapiens
tagttctaggcactg

SEQ ID NO: 4921247 - DNA, 22 bp, Homo sapiens
tagttctgtttggtgtgtccca

SEQ ID NO: 4921248 - DNA, 17 bp, Homo sapiens
tagttgcgttacaccct

SEQ ID NO: 4921249 - DNA, 19 bp, Homo sapiens
tagtttacagaaaaatctt

SEQ ID NO: 4921250 - DNA, 18 bp, Homo sapiens
tagtttcagatatatatc

SEQ ID NO: 4921251 - DNA, 14 bp, Homo sapiens
tagtttctttggga

SEQ ID NO: 4921252 - DNA, 17 bp, Homo sapiens
tagtttgtacatgcatt

SEQ ID NO: 4921253 - DNA, 14 bp, Homo sapiens
tagtttgtataact

SEQ ID NO: 4921254 - DNA, 12 bp, Homo sapiens
tagtttgtctat

SEQ ID NO: 4921255 - DNA, 14 bp, Homo sapiens
tagttttagttttc

SEQ ID NO: 4921256 - DNA, 21 bp, Homo sapiens
tataaaatgtgcagatgcaat

SEQ ID NO: 4921257 - DNA, 15 bp, Homo sapiens
tataaaattagaaag

SEQ ID NO: 4921258 - DNA, 18 bp, Homo sapiens
tataaacatcacacacac

SEQ ID NO: 4921259 - DNA, 19 bp, Homo sapiens
tataaacattaaatgtctt

SEQ ID NO: 4921260 - DNA, 18 bp, Homo sapiens
tataaagaagaacttgca

SEQ ID NO: 4921261 - DNA, 21 bp, Homo sapiens
tataaagcgatatacagatga

SEQ ID NO: 4921262 - DNA, 19 bp, Homo sapiens
tataaagggggagggaaat

SEQ ID NO: 4921263 - DNA, 17 bp, Homo sapiens
tataaataggagaggat

SEQ ID NO: 4921264 - DNA, 19 bp, Homo sapiens
tataaatatatataaagaa

SEQ ID NO: 4921265 - DNA, 14 bp, Homo sapiens
tataaatcatattg

SEQ ID NO: 4921266 - DNA, 22 bp, Homo sapiens
tataaatcatattgatgaaaag

SEQ ID NO: 4921267 - DNA, 20 bp, Homo sapiens
tataaatgtatatacacata

SEQ ID NO: 4921268 - DNA, 12 bp, Homo sapiens
tataaattctgt

SEQ ID NO: 4921269 - DNA, 13 bp, Homo sapiens
tataaattctgtg

SEQ ID NO: 4921270 - DNA, 17 bp, Homo sapiens
tataacatatgtacata

SEQ ID NO: 4921271 - DNA, 15 bp, Homo sapiens
tataaccatatgata

SEQ ID NO: 4921272 - DNA, 15 bp, Homo sapiens
tataacttcttaaaa

SEQ ID NO: 4921273 - DNA, 16 bp, Homo sapiens
tataacttcttaaaag

SEQ ID NO: 4921274 - DNA, 12 bp, Homo sapiens
tataacttgatg

SEQ ID NO: 4921275 - DNA, 17 bp, Homo sapiens
tataacttgatgcatgt

SEQ ID NO: 4921276 - DNA, 17 bp, Homo sapiens
tataagaaatgcatatg

SEQ ID NO: 4921277 - DNA, 21 bp, Homo sapiens
tataagatcctagatcctaag

SEQ ID NO: 4921278 - DNA, 15 bp, Homo sapiens
tataagcactgaaaa

SEQ ID NO: 4921279 - DNA, 18 bp, Homo sapiens
tataagcactgaaaaaca

SEQ ID NO: 4921280 - DNA, 19 bp, Homo sapiens
tataagcattgaaattata

SEQ ID NO: 4921281 - DNA, 20 bp, Homo sapiens
tataagccagtgttgcctaa

SEQ ID NO: 4921282 - DNA, 16 bp, Homo sapiens
tataagtagcaggcca

SEQ ID NO: 4921283 - DNA, 14 bp, Homo sapiens
tataagtcacaaag

SEQ ID NO: 4921284 - DNA, 18 bp, Homo sapiens
tataagtcattgtatgtt

SEQ ID NO: 4921285 - DNA, 18 bp, Homo sapiens
tataagtgaagtgatact

SEQ ID NO: 4921286 - DNA, 23 bp, Homo sapiens
tataagtgcacacagaaatatat

SEQ ID NO: 4921287 - DNA, 13 bp, Homo sapiens
tataagtttgaag

SEQ ID NO: 4921288 - DNA, 14 bp, Homo sapiens
tataataaacataa

SEQ ID NO: 4921289 - DNA, 22 bp, Homo sapiens
tataataaaggactgtaatctt

SEQ ID NO: 4921290 - DNA, 20 bp, Homo sapiens
tataatatatatatatatca

SEQ ID NO: 4921291 - DNA, 15 bp, Homo sapiens
tataatatcctttgt

SEQ ID NO: 4921292 - DNA, 18 bp, Homo sapiens
tataatcccagcactttg

SEQ ID NO: 4921293 - DNA, 12 bp, Homo sapiens
tataatgtgtgt

SEQ ID NO: 4921294 - DNA, 14 bp, Homo sapiens
tataatgtgtgtat

SEQ ID NO: 4921295 - DNA, 15 bp, Homo sapiens
tataatgtgtgtatg

SEQ ID NO: 4921296 - DNA, 17 bp, Homo sapiens
tataatgtgtgtatgtg

SEQ ID NO: 4921297 - DNA, 22 bp, Homo sapiens
tataattcctatatcctgtgac

SEQ ID NO: 4921298 - DNA, 12 bp, Homo sapiens
tataattctgta

SEQ ID NO: 4921299 - DNA, 14 bp, Homo sapiens
tataattctgtaaa

SEQ ID NO: 4921300 - DNA, 15 bp, Homo sapiens
tataattctgtaaat

SEQ ID NO: 4921301 - DNA, 16 bp, Homo sapiens
tataattttctgaaag

SEQ ID NO: 4921302 - DNA, 19 bp, Homo sapiens
tataattttctgaaagtta

SEQ ID NO: 4921303 - DNA, 22 bp, Homo sapiens
tatacaaacctaccaaaatgga

SEQ ID NO: 4921304 - DNA, 16 bp, Homo sapiens
tatacaaatatattgt

SEQ ID NO: 4921305 - DNA, 16 bp, Homo sapiens
tatacaaattaaaaag

SEQ ID NO: 4921306 - DNA, 17 bp, Homo sapiens
tatacaaattaaaaaga

SEQ ID NO: 4921307 - DNA, 17 bp, Homo sapiens
taaaatcctaagacaca

SEQ ID NO: 4921308 - DNA, 16 bp, Homo sapiens
taaaatcttgaaaatg

SEQ ID NO: 4921309 - DNA, 20 bp, Homo sapiens
taaaatgactacttagcatc

SEQ ID NO: 4921310 - DNA, 17 bp, Homo sapiens
taaaatgaggacatgtt

SEQ ID NO: 4921311 - DNA, 14 bp, Homo sapiens
taaaatgattgtaa

SEQ ID NO: 4921312 - DNA, 21 bp, Homo sapiens
taaaatggtgaagaactagca

SEQ ID NO: 4921313 - DNA, 19 bp, Homo sapiens
taaaatgtgatgttctaag

SEQ ID NO: 4921314 - DNA, 21 bp, Homo sapiens
taaaatgtgatgttctaaggc

SEQ ID NO: 4921315 - DNA, 15 bp, Homo sapiens
taaaatgtgttgaaa

SEQ ID NO: 4921316 - DNA, 18 bp, Homo sapiens
taaaatgtgttgaaactg

SEQ ID NO: 4921317 - DNA, 18 bp, Homo sapiens
taaaattgctatgttact

SEQ ID NO: 4921318 - DNA, 17 bp, Homo sapiens
taaaatttaagtatctt

SEQ ID NO: 4921319 - DNA, 9 bp, Homo sapiens
taaaatttg

SEQ ID NO: 4921320 - DNA, 22 bp, Homo sapiens
taaaattttaggcactcttaaa

SEQ ID NO: 4921321 - DNA, 21 bp, Homo sapiens
taaaattttgcttttaattaa

SEQ ID NO: 4921322 - DNA, 15 bp, Homo sapiens
taaacaaacattgtg

SEQ ID NO: 4921323 - DNA, 22 bp, Homo sapiens
taaacaaacattgtgttgacat

SEQ ID NO: 4921324 - DNA, 16 bp, Homo sapiens
taaacaaagattcatg

SEQ ID NO: 4921325 - DNA, 18 bp, Homo sapiens
taaacaaagattcatgat

SEQ ID NO: 4921326 - DNA, 22 bp, Homo sapiens
taaacaatgatgccctgctcca

SEQ ID NO: 4921327 - DNA, 12 bp, Homo sapiens
taaacacacaga

SEQ ID NO: 4921328 - DNA, 22 bp, Homo sapiens
taaacacacagatacacacaca

SEQ ID NO: 4921329 - DNA, 16 bp, Homo sapiens
taaacacagtcaaaat

SEQ ID NO: 4921330 - DNA, 18 bp, Homo sapiens
taaacagatgatgagaat

SEQ ID NO: 4921331 - DNA, 17 bp, Homo sapiens
taaacaggtggtgagaa

SEQ ID NO: 4921332 - DNA, 23 bp, Homo sapiens
taaacaggtggtgagaaatttct

SEQ ID NO: 4921333 - DNA, 15 bp, Homo sapiens
taaacagtatttcat

SEQ ID NO: 4921334 - DNA, 15 bp, Homo sapiens
taaacatgtgtttta

SEQ ID NO: 4921335 - DNA, 21 bp, Homo sapiens
taaacattaaatgtcttatat

SEQ ID NO: 4921336 - DNA, 14 bp, Homo sapiens
taaaccaaaggaca

SEQ ID NO: 4921337 - DNA, 15 bp, Homo sapiens
taaaccaaaggacat

SEQ ID NO: 4921338 - DNA, 23 bp, Homo sapiens
taaaccaaaggacattatgtgtg

SEQ ID NO: 4921339 - DNA, 15 bp, Homo sapiens
taaacccctgtccca

SEQ ID NO: 4921340 - DNA, 15 bp, Homo sapiens
taaacctccgccaat

SEQ ID NO: 4921341 - DNA, 15 bp, Homo sapiens
taaacggattccaaa

SEQ ID NO: 4921342 - DNA, 18 bp, Homo sapiens
taaactactctttgattt

SEQ ID NO: 4921343 - DNA, 22 bp, Homo sapiens
taaactatcttggtgaattttt

SEQ ID NO: 4921344 - DNA, 19 bp, Homo sapiens
taaactcaaaatatttgta

SEQ ID NO: 4921345 - DNA, 23 bp, Homo sapiens
taaactcaaaatatttgtacata

SEQ ID NO: 4921346 - DNA, 15 bp, Homo sapiens
taaactcaagacaat

SEQ ID NO: 4921347 - DNA, 14 bp, Homo sapiens
taaactctaaacat

SEQ ID NO: 4921348 - DNA, 22 bp, Homo sapiens
taaactgaaaactcccatttac

SEQ ID NO: 4921349 - DNA, 15 bp, Homo sapiens
taaactgactatcat

SEQ ID NO: 4921350 - DNA, 18 bp, Homo sapiens
taaactgactatcataaa

SEQ ID NO: 4921351 - DNA, 22 bp, Homo sapiens
taaactggaattaaaaggatag

SEQ ID NO: 4921352 - DNA, 13 bp, Homo sapiens
taaactgtgttta

SEQ ID NO: 4921353 - DNA, 18 bp, Homo sapiens
taaactgttagcactgtt

SEQ ID NO: 4921354 - DNA, 22 bp, Homo sapiens
taaactgttagcactgttgatg

SEQ ID NO: 4921355 - DNA, 14 bp, Homo sapiens
taaacttaacttta

SEQ ID NO: 4921356 - DNA, 18 bp, Homo sapiens
taaacttataaatcatat

SEQ ID NO: 4921357 - DNA, 22 bp, Homo sapiens
taaacttgtttgctgtgaacaa

SEQ ID NO: 4921358 - DNA, 20 bp, Homo sapiens
taaactttacccaaaaacta

SEQ ID NO: 4921359 - DNA, 20 bp, Homo sapiens
taaagaaacagctttcaagt

SEQ ID NO: 4921360 - DNA, 17 bp, Homo sapiens
taaagaaatgtcttaat

SEQ ID NO: 4921361 - DNA, 16 bp, Homo sapiens
taaagaaattgcaata

SEQ ID NO: 4921362 - DNA, 20 bp, Homo sapiens
taaagaaatttactatatat

SEQ ID NO: 4921363 - DNA, 17 bp, Homo sapiens
taaagaagttgaagttt

SEQ ID NO: 4921364 - DNA, 14 bp, Homo sapiens
taaagaatatatat

SEQ ID NO: 4921365 - DNA, 20 bp, Homo sapiens
taaagacaaccatatttagc

SEQ ID NO: 4921366 - DNA, 21 bp, Homo sapiens
taaagacaaccatatttagca

SEQ ID NO: 4921367 - DNA, 15 bp, Homo sapiens
taaagacacctactg

SEQ ID NO: 4921368 - DNA, 14 bp, Homo sapiens
taaagaccaaactt

SEQ ID NO: 4921369 - DNA, 12 bp, Homo sapiens
taaagagaagac

SEQ ID NO: 4921370 - DNA, 18 bp, Homo sapiens
taaagagattcacacaca

SEQ ID NO: 4921371 - DNA, 18 bp, Homo sapiens
taaagagtctagattcaa

SEQ ID NO: 4921372 - DNA, 19 bp, Homo sapiens
taaagagtctagattcaaa

SEQ ID NO: 4921373 - DNA, 21 bp, Homo sapiens
taacaaaagttccctgaaaca

SEQ ID NO: 4921374 - DNA, 15 bp, Homo sapiens
taacaaaatggacat

SEQ ID NO: 4921375 - DNA, 22 bp, Homo sapiens
taacaaacatcactctgctgct

SEQ ID NO: 4921376 - DNA, 18 bp, Homo sapiens
taacaaatatgctaattt

SEQ ID NO: 4921377 - DNA, 16 bp, Homo sapiens
taacaagtaccaaagt

SEQ ID NO: 4921378 - DNA, 13 bp, Homo sapiens
taacaatgttaag

SEQ ID NO: 4921379 - DNA, 14 bp, Homo sapiens
taacaatgttaagg

SEQ ID NO: 4921380 - DNA, 21 bp, Homo sapiens
taacaatgttaaggaaactct

SEQ ID NO: 4921381 - DNA, 13 bp, Homo sapiens
taacaatttcctt

SEQ ID NO: 4921382 - DNA, 21 bp, Homo sapiens
taacaatttcctttatattta

SEQ ID NO: 4921383 - DNA, 17 bp, Homo sapiens
taacacaagtcctgtga

SEQ ID NO: 4921384 - DNA, 18 bp, Homo sapiens
taacacaagtcctgtgaa

SEQ ID NO: 4921385 - DNA, 20 bp, Homo sapiens
taacacacacagaaaagcat

SEQ ID NO: 4921386 - DNA, 21 bp, Homo sapiens
taacacacacagaaaagcata

SEQ ID NO: 4921387 - DNA, 15 bp, Homo sapiens
taacacccttccttc

SEQ ID NO: 4921388 - DNA, 14 bp, Homo sapiens
taacagaacagctt

SEQ ID NO: 4921389 - DNA, 23 bp, Homo sapiens
taacagcatccccaaaacaaagt

SEQ ID NO: 4921390 - DNA, 19 bp, Homo sapiens
taacaggcagatacaggaa

SEQ ID NO: 4921391 - DNA, 15 bp, Homo sapiens
taacaggcatttgtt

SEQ ID NO: 4921392 - DNA, 22 bp, Homo sapiens
taacaggtctagaaaaccagct

SEQ ID NO: 4921393 - DNA, 18 bp, Homo sapiens
taacagttcatgtttgct

SEQ ID NO: 4921394 - DNA, 14 bp, Homo sapiens
taacatatttacta

SEQ ID NO: 4921395 - DNA, 20 bp, Homo sapiens
taacatcactatccatgcac

SEQ ID NO: 4921396 - DNA, 21 bp, Homo sapiens
taacatgaacacccttagaaa

SEQ ID NO: 4921397 - DNA, 19 bp, Homo sapiens
taacattaccttactgtgg

SEQ ID NO: 4921398 - DNA, 16 bp, Homo sapiens
taacattatttatatg

SEQ ID NO: 4921399 - DNA, 13 bp, Homo sapiens
taacattccaaga

SEQ ID NO: 4921400 - DNA, 13 bp, Homo sapiens
taacattttaaat

SEQ ID NO: 4921401 - DNA, 10 bp, Homo sapiens
taacattttg

SEQ ID NO: 4921402 - DNA, 16 bp, Homo sapiens
taacattttgttctta

SEQ ID NO: 4921403 - DNA, 19 bp, Homo sapiens
taaccacaaagcacagttt

SEQ ID NO: 4921404 - DNA, 15 bp, Homo sapiens
taaccacggaaaaga

SEQ ID NO: 4921405 - DNA, 24 bp, Homo sapiens
taacccacttgtcactgacacaaa

SEQ ID NO: 4921406 - DNA, 13 bp, Homo sapiens
taaccccagctcc

SEQ ID NO: 4921407 - DNA, 21 bp, Homo sapiens
taaccttatcctgcattgtta

SEQ ID NO: 4921408 - DNA, 16 bp, Homo sapiens
taacgttgagcccctg

SEQ ID NO: 4921409 - DNA, 15 bp, Homo sapiens
taacgtttttccttt

SEQ ID NO: 4921410 - DNA, 18 bp, Homo sapiens
taactaaatttgatactt

SEQ ID NO: 4921411 - DNA, 21 bp, Homo sapiens
taactaaatttgatacttata

SEQ ID NO: 4921412 - DNA, 22 bp, Homo sapiens
taactaaatttgatacttatat

SEQ ID NO: 4921413 - DNA, 14 bp, Homo sapiens
taactacatttatg

SEQ ID NO: 4921414 - DNA, 18 bp, Homo sapiens
taactacccttaattact

SEQ ID NO: 4921415 - DNA, 22 bp, Homo sapiens
taactacccttaattacttaaa

SEQ ID NO: 4921416 - DNA, 17 bp, Homo sapiens
taactagacaccaaagt

SEQ ID NO: 4921417 - DNA, 15 bp, Homo sapiens
taactaggctcagag

SEQ ID NO: 4921418 - DNA, 17 bp, Homo sapiens
taactatatttgctttt

SEQ ID NO: 4921419 - DNA, 21 bp, Homo sapiens
gtgatttagaactgtatgtca

SEQ ID NO: 4921420 - DNA, 23 bp, Homo sapiens
gtgatttagaactgtatgtcaga

SEQ ID NO: 4921421 - DNA, 19 bp, Homo sapiens
gtgcaaaagcttcaaatta

SEQ ID NO: 4921422 - DNA, 22 bp, Homo sapiens
gtgcaaagttccctacttcctg

SEQ ID NO: 4921423 - DNA, 13 bp, Homo sapiens
gtgcacaaggatt

SEQ ID NO: 4921424 - DNA, 13 bp, Homo sapiens
gtgcacacacaca

SEQ ID NO: 4921425 - DNA, 11 bp, Homo sapiens
gtgcacacaga

SEQ ID NO: 4921426 - DNA, 16 bp, Homo sapiens
gtgcacgtggagagct

SEQ ID NO: 4921427 - DNA, 18 bp, Homo sapiens
gtgcacgtggagagctgg

SEQ ID NO: 4921428 - DNA, 12 bp, Homo sapiens
gtgcacgttgct

SEQ ID NO: 4921429 - DNA, 19 bp, Homo sapiens
gtgcactttctaatgtttc

SEQ ID NO: 4921430 - DNA, 22 bp, Homo sapiens
gtgcagaggtcagactaagaaa

SEQ ID NO: 4921431 - DNA, 19 bp, Homo sapiens
gtgcagatgcaattgtttg

SEQ ID NO: 4921432 - DNA, 20 bp, Homo sapiens
gtgcagggagggcagttttc

SEQ ID NO: 4921433 - DNA, 19 bp, Homo sapiens
gtgcatagaactgggtaaa

SEQ ID NO: 4921434 - DNA, 14 bp, Homo sapiens
gtgcatagtgctgg

SEQ ID NO: 4921435 - DNA, 16 bp, Homo sapiens
gtgcatagtgctggga

SEQ ID NO: 4921436 - DNA, 14 bp, Homo sapiens
gtgcatctcagccc

SEQ ID NO: 4921437 - DNA, 16 bp, Homo sapiens
gtgcatggaggccctc

SEQ ID NO: 4921438 - DNA, 21 bp, Homo sapiens
gtgcatggaggccctcctgtg

SEQ ID NO: 4921439 - DNA, 23 bp, Homo sapiens
gtgcattagcacagattttaatt

SEQ ID NO: 4921440 - DNA, 11 bp, Homo sapiens
gtgccaaggac

SEQ ID NO: 4921441 - DNA, 19 bp, Homo sapiens
gtgccaatatgtattgtaa

SEQ ID NO: 4921442 - DNA, 23 bp, Homo sapiens
gtgccatagagtttaacacaagt

SEQ ID NO: 4921443 - DNA, 23 bp, Homo sapiens
gtgcccaagaatagatgctgact

SEQ ID NO: 4921444 - DNA, 20 bp, Homo sapiens
gtgcccacaggatcagtctg

SEQ ID NO: 4921445 - DNA, 18 bp, Homo sapiens
gtgcccagcccggacctt

SEQ ID NO: 4921446 - DNA, 21 bp, Homo sapiens
gtgccctcctgagggaggacc

SEQ ID NO: 4921447 - DNA, 23 bp, Homo sapiens
gtgccgtgtgagtgtgacagggc

SEQ ID NO: 4921448 - DNA, 13 bp, Homo sapiens
gtgcctctgcctg

SEQ ID NO: 4921449 - DNA, 20 bp, Homo sapiens
gtcatcagagctcctctgtc

SEQ ID NO: 4921450 - DNA, 14 bp, Homo sapiens
gtcatcatcagggc

SEQ ID NO: 4921451 - DNA, 15 bp, Homo sapiens
gtcatcatcagggcc

SEQ ID NO: 4921452 - DNA, 19 bp, Homo sapiens
gtcatctgattggacaggc

SEQ ID NO: 4921453 - DNA, 20 bp, Homo sapiens
gtcatgaattcttatgctta

SEQ ID NO: 4921454 - DNA, 13 bp, Homo sapiens
gtcatgcataaat

SEQ ID NO: 4921455 - DNA, 15 bp, Homo sapiens
gtcatgtgacaggta

SEQ ID NO: 4921456 - DNA, 18 bp, Homo sapiens
gtcatgtgggtcttccag

SEQ ID NO: 4921457 - DNA, 23 bp, Homo sapiens
gtcatgtgttccctttgtctttc

SEQ ID NO: 4921458 - DNA, 23 bp, Homo sapiens
gtcatgttggtcaaaagctggat

SEQ ID NO: 4921459 - DNA, 13 bp, Homo sapiens
gtcattaatgtgt

SEQ ID NO: 4921460 - DNA, 17 bp, Homo sapiens
gtcattccttcttttta

SEQ ID NO: 4921461 - DNA, 20 bp, Homo sapiens
gtcattgtaaacaaactctt

SEQ ID NO: 4921462 - DNA, 14 bp, Homo sapiens
gtcatttaaatgtg

SEQ ID NO: 4921463 - DNA, 12 bp, Homo sapiens
gtcatttcattc

SEQ ID NO: 4921464 - DNA, 14 bp, Homo sapiens
gtcatttcattcca

SEQ ID NO: 4921465 - DNA, 15 bp, Homo sapiens
gtcatttcattccat

SEQ ID NO: 4921466 - DNA, 19 bp, Homo sapiens
gtccaaagaggctgcccct

SEQ ID NO: 4921467 - DNA, 20 bp, Homo sapiens
gtccaaataacaagtaccaa

SEQ ID NO: 4921468 - DNA, 22 bp, Homo sapiens
gtccaaatgtcctccagaagcc

SEQ ID NO: 4921469 - DNA, 22 bp, Homo sapiens
gtccaagaatccacatttctaa

SEQ ID NO: 4921470 - DNA, 16 bp, Homo sapiens
gtccaagattccggat

SEQ ID NO: 4921471 - DNA, 22 bp, Homo sapiens
gtccaagattccggatcctaag

SEQ ID NO: 4921472 - DNA, 20 bp, Homo sapiens
gtccacccacctatgtgcca

SEQ ID NO: 4921473 - DNA, 14 bp, Homo sapiens
gtccacccaggagc

SEQ ID NO: 4921474 - DNA, 15 bp, Homo sapiens
gtccacccaggagcc

SEQ ID NO: 4921475 - DNA, 23 bp, Homo sapiens
gtccacccaggagccccgaggcc

SEQ ID NO: 4921476 - DNA, 14 bp, Homo sapiens
gtccacctgtgggt

SEQ ID NO: 4921477 - DNA, 23 bp, Homo sapiens
gtccacctgtgggtgtagccagg

SEQ ID NO: 4921478 - DNA, 12 bp, Homo sapiens
gtccagaaatgg

SEQ ID NO: 4921479 - DNA, 21 bp, Homo sapiens
gtccagagcggaggctgtgtg

SEQ ID NO: 4921480 - DNA, 22 bp, Homo sapiens
gtccagccgccattgccaccag

SEQ ID NO: 4921481 - DNA, 13 bp, Homo sapiens
gtccagcctgggc

SEQ ID NO: 4921482 - DNA, 19 bp, Homo sapiens
gtccagctggcctggacag

SEQ ID NO: 4921483 - DNA, 19 bp, Homo sapiens
gtccatttatatatgaaaa

SEQ ID NO: 4921484 - DNA, 21 bp, Homo sapiens
gtccatttatccacaggaaag

SEQ ID NO: 4921485 - DNA, 22 bp, Homo sapiens
gtcccacccccacccccagctc

SEQ ID NO: 4921486 - DNA, 16 bp, Homo sapiens
gtcccacccctccctc

SEQ ID NO: 4921487 - DNA, 15 bp, Homo sapiens
gtcccacctccagcc

SEQ ID NO: 4921488 - DNA, 17 bp, Homo sapiens
gtcccacctccagcccg

SEQ ID NO: 4921489 - DNA, 19 bp, Homo sapiens
gtcccaccttggctgcagg

SEQ ID NO: 4921490 - DNA, 18 bp, Homo sapiens
gtcccacgtgtcttccac

SEQ ID NO: 4921491 - DNA, 15 bp, Homo sapiens
gtcccagccaccccg

SEQ ID NO: 4921492 - DNA, 18 bp, Homo sapiens
gtcccagccaccccgggc

SEQ ID NO: 4921493 - DNA, 21 bp, Homo sapiens
gtcccatggacactccagtgc

SEQ ID NO: 4921494 - DNA, 18 bp, Homo sapiens
gtccccagagaccaggct

SEQ ID NO: 4921495 - DNA, 20 bp, Homo sapiens
gtcccccaactctgagccca

SEQ ID NO: 4921496 - DNA, 17 bp, Homo sapiens
gtccccctatccttggc

SEQ ID NO: 4921497 - DNA, 15 bp, Homo sapiens
gtcccggggctccac

SEQ ID NO: 4921498 - DNA, 15 bp, Homo sapiens
gtccctaaagaaaaa

SEQ ID NO: 4921499 - DNA, 22 bp, Homo sapiens
gtccctaccgagtctcttctcc

SEQ ID NO: 4921500 - DNA, 22 bp, Homo sapiens
gtccctatgtatttgcagttca

SEQ ID NO: 4921501 - DNA, 15 bp, Homo sapiens
gtccctcccacctct

SEQ ID NO: 4921502 - DNA, 16 bp, Homo sapiens
gtccctgcacttgcag

SEQ ID NO: 4921503 - DNA, 19 bp, Homo sapiens
gtccctgcacttgcagact

SEQ ID NO: 4921504 - DNA, 18 bp, Homo sapiens
gtcccttcacctcctcgc

SEQ ID NO: 4921505 - DNA, 22 bp, Homo sapiens
gtcccttcccctccctggctcc

SEQ ID NO: 4921506 - DNA, 22 bp, Homo sapiens
gtcccttgatgcacagagaagc

SEQ ID NO: 4921507 - DNA, 23 bp, Homo sapiens
gtcccttgatgcacagagaagct

SEQ ID NO: 4921508 - DNA, 14 bp, Homo sapiens
gtccggtgttctaa

SEQ ID NO: 4921509 - DNA, 16 bp, Homo sapiens
gtccggtgttctaaga

SEQ ID NO: 4921510 - DNA, 20 bp, Homo sapiens
gtcctactatcactgaacaa

SEQ ID NO: 4921511 - DNA, 18 bp, Homo sapiens
gtcctagccactcaggag

SEQ ID NO: 4921512 - DNA, 14 bp, Homo sapiens
gtcctcacccctgt

SEQ ID NO: 4921513 - DNA, 15 bp, Homo sapiens
gtcctcacccctgtc

SEQ ID NO: 4921514 - DNA, 23 bp, Homo sapiens
gtcctcacccctgtcctcactgc

SEQ ID NO: 4921515 - DNA, 19 bp, Homo sapiens
gtcctcactgctccctgaa

SEQ ID NO: 4921516 - DNA, 21 bp, Homo sapiens
gtcctcactgctccctgaagc

SEQ ID NO: 4921517 - DNA, 16 bp, Homo sapiens
gtcctcagtccattta

SEQ ID NO: 4921518 - DNA, 18 bp, Homo sapiens
gtcctcagtccatttata

SEQ ID NO: 4921519 - DNA, 13 bp, Homo sapiens
gtcctccagaagc

SEQ ID NO: 4921520 - DNA, 18 bp, Homo sapiens
gtcctccagaagcctctg

SEQ ID NO: 4921521 - DNA, 19 bp, Homo sapiens
gtcctccagaagcctctgg

SEQ ID NO: 4921522 - DNA, 16 bp, Homo sapiens
gtcctcccatcccctg

SEQ ID NO: 4921523 - DNA, 18 bp, Homo sapiens
gtcctcccatcccctgga

SEQ ID NO: 4921524 - DNA, 19 bp, Homo sapiens
gtcctcccatcccctggac

SEQ ID NO: 4921525 - DNA, 11 bp, Homo sapiens
gtcctcccctc

SEQ ID NO: 4921526 - DNA, 15 bp, Homo sapiens
gtcctcccctcacag

SEQ ID NO: 4921527 - DNA, 20 bp, Homo sapiens
gtcctcccctcacagcctct

SEQ ID NO: 4921528 - DNA, 18 bp, Homo sapiens
gtcctctcccctccagcc

SEQ ID NO: 4921529 - DNA, 19 bp, Homo sapiens
gtcctctcccctccagcct

SEQ ID NO: 4921530 - DNA, 13 bp, Homo sapiens
gtcctctggagcc

SEQ ID NO: 4921531 - DNA, 18 bp, Homo sapiens
gtcctgagggtccccacc

SEQ ID NO: 4921532 - DNA, 15 bp, Homo sapiens
gtcctgcctcagcct

SEQ ID NO: 4921533 - DNA, 13 bp, Homo sapiens
gtcctgcctggcc

SEQ ID NO: 4921534 - DNA, 14 bp, Homo sapiens
gtcctgcctggcca

SEQ ID NO: 4921535 - DNA, 22 bp, Homo sapiens
gttatgtactagtgttctgttt

SEQ ID NO: 4921536 - DNA, 16 bp, Homo sapiens
gttatgtctgtttaag

SEQ ID NO: 4921537 - DNA, 17 bp, Homo sapiens
gttattccttgatcatt

SEQ ID NO: 4921538 - DNA, 12 bp, Homo sapiens
gttattgtgaat

SEQ ID NO: 4921539 - DNA, 14 bp, Homo sapiens
gttattgttttgtt

SEQ ID NO: 4921540 - DNA, 15 bp, Homo sapiens
gttatttctgcaaac

SEQ ID NO: 4921541 - DNA, 18 bp, Homo sapiens
gttcaagcgattcttctg

SEQ ID NO: 4921542 - DNA, 12 bp, Homo sapiens
gttcaagttttg

SEQ ID NO: 4921543 - DNA, 17 bp, Homo sapiens
gttcaatggttctgaaa

SEQ ID NO: 4921544 - DNA, 17 bp, Homo sapiens
gttcaattccctgaagg

SEQ ID NO: 4921545 - DNA, 23 bp, Homo sapiens
gttcaattctcatttgtcacaca

SEQ ID NO: 4921546 - DNA, 19 bp, Homo sapiens
gttcacaccctgcaaggcc

SEQ ID NO: 4921547 - DNA, 24 bp, Homo sapiens
gttcactctacttagcatgtccct

SEQ ID NO: 4921548 - DNA, 16 bp, Homo sapiens
gttcagcaccacccta

SEQ ID NO: 4921549 - DNA, 13 bp, Homo sapiens
gttcagcacttgt

SEQ ID NO: 4921550 - DNA, 22 bp, Homo sapiens
gttcagctaagctaggaatgaa

SEQ ID NO: 4921551 - DNA, 18 bp, Homo sapiens
gttcagctccagctcacc

SEQ ID NO: 4921552 - DNA, 15 bp, Homo sapiens
gttcagctgtcctcc

SEQ ID NO: 4921553 - DNA, 21 bp, Homo sapiens
gttcagctgtcctccctccac

SEQ ID NO: 4921554 - DNA, 15 bp, Homo sapiens
gttcaggagtcccaa

SEQ ID NO: 4921555 - DNA, 20 bp, Homo sapiens
gttcaggagtcccaaggaaa

SEQ ID NO: 4921556 - DNA, 20 bp, Homo sapiens
gttcaggggactcagccctg

SEQ ID NO: 4921557 - DNA, 18 bp, Homo sapiens
gttcagggttggcccctg

SEQ ID NO: 4921558 - DNA, 18 bp, Homo sapiens
gttcagtattatgtagtt

SEQ ID NO: 4921559 - DNA, 12 bp, Homo sapiens
gttcatgtagag

SEQ ID NO: 4921560 - DNA, 16 bp, Homo sapiens
gttcatgtagagaaaa

SEQ ID NO: 4921561 - DNA, 14 bp, Homo sapiens
gttcatgtttgctt

SEQ ID NO: 4921562 - DNA, 16 bp, Homo sapiens
gttcatgtttggtgca

SEQ ID NO: 4921563 - DNA, 17 bp, Homo sapiens
gttcatttgtgtgctca

SEQ ID NO: 4921564 - DNA, 19 bp, Homo sapiens
gttccaagtccaataagac

SEQ ID NO: 4921565 - DNA, 15 bp, Homo sapiens
gttccaatcctggct

SEQ ID NO: 4921566 - DNA, 23 bp, Homo sapiens
gttccaatcctggctctgtggct

SEQ ID NO: 4921567 - DNA, 16 bp, Homo sapiens
gttccacagttgccac

SEQ ID NO: 4921568 - DNA, 16 bp, Homo sapiens
gttccagctctttgaa

SEQ ID NO: 4921569 - DNA, 21 bp, Homo sapiens
gttcccagatggctggaaggg

SEQ ID NO: 4921570 - DNA, 19 bp, Homo sapiens
gttccccatctgggtcctt

SEQ ID NO: 4921571 - DNA, 23 bp, Homo sapiens
gttccccatctgggtccttgcac

SEQ ID NO: 4921572 - DNA, 18 bp, Homo sapiens
gttcccctgttcactcta

SEQ ID NO: 4921573 - DNA, 14 bp, Homo sapiens
gttccctctgctca

SEQ ID NO: 4921574 - DNA, 14 bp, Homo sapiens
gttcccttggcctc

SEQ ID NO: 4921575 - DNA, 18 bp, Homo sapiens
gttcccttggcctcagaa

SEQ ID NO: 4921576 - DNA, 18 bp, Homo sapiens
gttccgcactttccactt

SEQ ID NO: 4921577 - DNA, 20 bp, Homo sapiens
gttcgcatggtcacacactg

SEQ ID NO: 4921578 - DNA, 16 bp, Homo sapiens
gttctaaagctctgac

SEQ ID NO: 4921579 - DNA, 13 bp, Homo sapiens
gttctaaagttct

SEQ ID NO: 4921580 - DNA, 15 bp, Homo sapiens
gttctaagactcaaa

SEQ ID NO: 4921581 - DNA, 21 bp, Homo sapiens
gttctaagactcaaatgttct

SEQ ID NO: 4921582 - DNA, 13 bp, Homo sapiens
gttctaagatgtg

SEQ ID NO: 4921583 - DNA, 14 bp, Homo sapiens
gttctaagattctg

SEQ ID NO: 4921584 - DNA, 11 bp, Homo sapiens
gttctaaggcc

SEQ ID NO: 4921585 - DNA, 13 bp, Homo sapiens
gttctaaggccta

SEQ ID NO: 4921586 - DNA, 16 bp, Homo sapiens
gttctaaggctctgag

SEQ ID NO: 4921587 - DNA, 14 bp, Homo sapiens
gttctaagggggag

SEQ ID NO: 4921588 - DNA, 16 bp, Homo sapiens
gttctaagtttctaag

SEQ ID NO: 4921589 - DNA, 17 bp, Homo sapiens
gttctaagtttctaaga

SEQ ID NO: 4921590 - DNA, 19 bp, Homo sapiens
gttctaagtttctaagatt

SEQ ID NO: 4921591 - DNA, 20 bp, Homo sapiens
gttctacctcaggcagctca

SEQ ID NO: 4921592 - DNA, 21 bp, Homo sapiens
gttctacctcaggcagctcaa

SEQ ID NO: 4921593 - DNA, 21 bp, Homo sapiens
gttctagacatggaggttcta

SEQ ID NO: 4921594 - DNA, 23 bp, Homo sapiens
gttctagacatggaggttctaag

SEQ ID NO: 4921595 - DNA, 14 bp, Homo sapiens
gttctatgaacaac

SEQ ID NO: 4921596 - DNA, 20 bp, Homo sapiens
gttctatggttatgaaagaa

SEQ ID NO: 4921597 - DNA, 12 bp, Homo sapiens
gttctctgagga

SEQ ID NO: 4921598 - DNA, 16 bp, Homo sapiens
gttctctgaggacact

SEQ ID NO: 4921599 - DNA, 14 bp, Homo sapiens
gttctgcactgaaa

SEQ ID NO: 4921600 - DNA, 15 bp, Homo sapiens
gttctgcactgaaaa

SEQ ID NO: 4921601 - DNA, 15 bp, Homo sapiens
gttctgcccccagcc

SEQ ID NO: 4921602 - DNA, 17 bp, Homo sapiens
gttctgcccccagccca

SEQ ID NO: 4921603 - DNA, 20 bp, Homo sapiens
gttctgcccccagcccaaag

SEQ ID NO: 4921604 - DNA, 11 bp, Homo sapiens
gttctgggaca

SEQ ID NO: 4921605 - DNA, 14 bp, Homo sapiens
gttctgggacacag

SEQ ID NO: 4921606 - DNA, 16 bp, Homo sapiens
gttctgggacacagtt

SEQ ID NO: 4921607 - DNA, 13 bp, Homo sapiens
gttctgtgtcttt

SEQ ID NO: 4921608 - DNA, 23 bp, Homo sapiens
gttctgtgtctttcacagctcct

SEQ ID NO: 4921609 - DNA, 15 bp, Homo sapiens
gttctgtgtttaatt

SEQ ID NO: 4921610 - DNA, 23 bp, Homo sapiens
gttctgttatatcccctgctacc

SEQ ID NO: 4921611 - DNA, 13 bp, Homo sapiens
gttctgtttcaag

SEQ ID NO: 4921612 - DNA, 14 bp, Homo sapiens
gttctgtttgttat

SEQ ID NO: 4921613 - DNA, 16 bp, Homo sapiens
gttcttacacatacag

SEQ ID NO: 4921614 - DNA, 22 bp, Homo sapiens
gttcttacctgtatgtctccag

SEQ ID NO: 4921615 - DNA, 17 bp, Homo sapiens
gttcttatgcaaaatgg

SEQ ID NO: 4921616 - DNA, 18 bp, Homo sapiens
gttcttatgcaaaatgga

SEQ ID NO: 4921617 - DNA, 17 bp, Homo sapiens
gttcttgctgctagaac

SEQ ID NO: 4921618 - DNA, 21 bp, Homo sapiens
gttcttgctgctagaactttt

SEQ ID NO: 4921619 - DNA, 16 bp, Homo sapiens
gttctttcttcctctg

SEQ ID NO: 4921620 - DNA, 23 bp, Homo sapiens
gttctttgagggactgcctctgc

SEQ ID NO: 4921621 - DNA, 18 bp, Homo sapiens
gttgaaaattcaaaaagt

SEQ ID NO: 4921622 - DNA, 15 bp, Homo sapiens
gttgaagaggaaggg

SEQ ID NO: 4921623 - DNA, 13 bp, Homo sapiens
gttgaataaaagt

SEQ ID NO: 4921624 - DNA, 15 bp, Homo sapiens
gttgacaaaattttc

SEQ ID NO: 4921625 - DNA, 14 bp, Homo sapiens
gttgacaactgtga

SEQ ID NO: 4921626 - DNA, 23 bp, Homo sapiens
gttgatgatctttgcagacaggc

SEQ ID NO: 4921627 - DNA, 13 bp, Homo sapiens
gttgatgtatctg

SEQ ID NO: 4921628 - DNA, 19 bp, Homo sapiens
gttgcatactgagccaagt

SEQ ID NO: 4921629 - DNA, 13 bp, Homo sapiens
gttgccaagacaa

SEQ ID NO: 4921630 - DNA, 15 bp, Homo sapiens
gttgccaagacaaat

SEQ ID NO: 4921631 - DNA, 17 bp, Homo sapiens
gttgccaccacctctgt

SEQ ID NO: 4921632 - DNA, 12 bp, Homo sapiens
gttgcccaggca

SEQ ID NO: 4921633 - DNA, 19 bp, Homo sapiens
gttgcccaggcaggtcttg

SEQ ID NO: 4921634 - DNA, 16 bp, Homo sapiens
gttgcccaggctggcg

SEQ ID NO: 4921635 - DNA, 21 bp, Homo sapiens
gttgcccaggctggcgtgcag

SEQ ID NO: 4921636 - DNA, 24 bp, Homo sapiens
gttgcctttttcattttccaatac

SEQ ID NO: 4921637 - DNA, 23 bp, Homo sapiens
gttgcgtggactctgcacatgtc

SEQ ID NO: 4921638 - DNA, 14 bp, Homo sapiens
gttggaagagaatc

SEQ ID NO: 4921639 - DNA, 16 bp, Homo sapiens
gttggaagagaatcac

SEQ ID NO: 4921640 - DNA, 15 bp, Homo sapiens
gttggaagaggaaca

SEQ ID NO: 4921641 - DNA, 22 bp, Homo sapiens
gttggaatgaattaaataaacc

SEQ ID NO: 4921642 - DNA, 21 bp, Homo sapiens
gttggacacctttaggttctt

SEQ ID NO: 4921643 - DNA, 17 bp, Homo sapiens
gttggaccccagagatt

SEQ ID NO: 4921644 - DNA, 14 bp, Homo sapiens
gttggactaaatgc

SEQ ID NO: 4921645 - DNA, 17 bp, Homo sapiens
gttggattccatgctaa

SEQ ID NO: 4921646 - DNA, 19 bp, Homo sapiens
gttggccaggctggtctca

SEQ ID NO: 4921647 - DNA, 20 bp, Homo sapiens
gttggcccctgcccggctgc

SEQ ID NO: 4921648 - DNA, 14 bp, Homo sapiens
gttggctggatgaa

SEQ ID NO: 4921649 - DNA, 12 bp, Homo sapiens
gttggctggggg

SEQ ID NO: 4921650 - DNA, 21 bp, Homo sapiens
gttgggatactgcagggccag

SEQ ID NO: 4921651 - DNA, 13 bp, Homo sapiens
gttgggcccagat

SEQ ID NO: 4921652 - DNA, 15 bp, Homo sapiens
gttgggcccagatct

SEQ ID NO: 4921653 - DNA, 17 bp, Homo sapiens
gttgggcccagatctgg

SEQ ID NO: 4921654 - DNA, 14 bp, Homo sapiens
gttggtccagagcg

SEQ ID NO: 4921655 - DNA, 18 bp, Homo sapiens
gttggtgttccacgtgtt

SEQ ID NO: 4921656 - DNA, 12 bp, Homo sapiens
gttgtaaaaaga

SEQ ID NO: 4921657 - DNA, 18 bp, Homo sapiens
gttgtaactaggctcaga

SEQ ID NO: 4921658 - DNA, 19 bp, Homo sapiens
gttgtaactaggctcagag

SEQ ID NO: 4921659 - DNA, 22 bp, Homo sapiens
gttgtaacttatattgaagaca

SEQ ID NO: 4921660 - DNA, 18 bp, Homo sapiens
gttgtaacttatgtagat

SEQ ID NO: 4921661 - DNA, 16 bp, Homo sapiens
gttgtacatttatgat

SEQ ID NO: 4921662 - DNA, 20 bp, Homo sapiens
gttgtacatttatgatttaa

SEQ ID NO: 4921663 - DNA, 17 bp, Homo sapiens
gttgtcaagtctctgct

SEQ ID NO: 4921664 - DNA, 22 bp, Homo sapiens
gttgtcagtattattctactat

SEQ ID NO: 4921665 - DNA, 21 bp, Homo sapiens
gttgtgatagctaacatttta

SEQ ID NO: 4921666 - DNA, 12 bp, Homo sapiens
gttgtgtctttt

SEQ ID NO: 4921667 - DNA, 14 bp, Homo sapiens
gttgtgttgtcacc

SEQ ID NO: 4921668 - DNA, 11 bp, Homo sapiens
gttgtttcttt

SEQ ID NO: 4921669 - DNA, 18 bp, Homo sapiens
gtttaaagagtctagatt

SEQ ID NO: 4921670 - DNA, 19 bp, Homo sapiens
gtttaaagagtctagattc

SEQ ID NO: 4921671 - DNA, 18 bp, Homo sapiens
gtttaagaaaagtatttt

SEQ ID NO: 4921672 - DNA, 22 bp, Homo sapiens
gtttaagaaaagtattttgaag

SEQ ID NO: 4921673 - DNA, 23 bp, Homo sapiens
gtttaagaaaagtattttgaagt

SEQ ID NO: 4921674 - DNA, 18 bp, Homo sapiens
gtttaatgtgaacttgta

SEQ ID NO: 4921675 - DNA, 21 bp, Homo sapiens
gtttaatgtgaacttgtagct

SEQ ID NO: 4921676 - DNA, 14 bp, Homo sapiens
gtttacaggccctg

SEQ ID NO: 4921677 - DNA, 21 bp, Homo sapiens
gtttacatgtgtagcctatgt

SEQ ID NO: 4921678 - DNA, 11 bp, Homo sapiens
gtttacattta

SEQ ID NO: 4921679 - DNA, 12 bp, Homo sapiens
gtttacatttaa

SEQ ID NO: 4921680 - DNA, 14 bp, Homo sapiens
gtttacatttaaag

SEQ ID NO: 4921681 - DNA, 17 bp, Homo sapiens
gtttacatttaaagcat

SEQ ID NO: 4921682 - DNA, 11 bp, Homo sapiens
gtttacatttt

SEQ ID NO: 4921683 - DNA, 20 bp, Homo sapiens
gtttacatttttatttatga

SEQ ID NO: 4921684 - DNA, 22 bp, Homo sapiens
gtttacatttttatttatgaag

SEQ ID NO: 4921685 - DNA, 13 bp, Homo sapiens
gtttacctagaag

SEQ ID NO: 4921686 - DNA, 15 bp, Homo sapiens
gtttactttcaaatc

SEQ ID NO: 4921687 - DNA, 20 bp, Homo sapiens
gtttagaccaaggaacaaaa

SEQ ID NO: 4921688 - DNA, 22 bp, Homo sapiens
gtttagaccaaggaacaaaaaa

SEQ ID NO: 4921689 - DNA, 18 bp, Homo sapiens
gtttagatagggctgggc

SEQ ID NO: 4921690 - DNA, 19 bp, Homo sapiens
gtttagatagggctgggca

SEQ ID NO: 4921691 - DNA, 20 bp, Homo sapiens
gtttatactccagtgtacat

SEQ ID NO: 4921692 - DNA, 18 bp, Homo sapiens
gtttatatgtgttgaaaa

SEQ ID NO: 4921693 - DNA, 15 bp, Homo sapiens
gtttatcagatacat

SEQ ID NO: 4921694 - DNA, 16 bp, Homo sapiens
gtttatcagatacatc

SEQ ID NO: 4921695 - DNA, 17 bp, Homo sapiens
gtttatcatgaagcctg

SEQ ID NO: 4921696 - DNA, 17 bp, Homo sapiens
gtttatgcaaggaagga

SEQ ID NO: 4921697 - DNA, 18 bp, Homo sapiens
gtttatggccacatttaa

SEQ ID NO: 4921698 - DNA, 23 bp, Homo sapiens
gtttatggccacatttaatatct

SEQ ID NO: 4921699 - DNA, 22 bp, Homo sapiens
gtttatggcctcagctgcctca

SEQ ID NO: 4921700 - DNA, 12 bp, Homo sapiens
gtttatttccaa

SEQ ID NO: 4921701 - DNA, 19 bp, Homo sapiens
gtttatttctgtttctcat

SEQ ID NO: 4921702 - DNA, 16 bp, Homo sapiens
gtttatttttcatatt

SEQ ID NO: 4921703 - DNA, 23 bp, Homo sapiens
gtttcaaggcactctagattcca

SEQ ID NO: 4921704 - DNA, 21 bp, Homo sapiens
gtttcacccttaacccaagga

SEQ ID NO: 4921705 - DNA, 17 bp, Homo sapiens
gtttcagatatatatca

SEQ ID NO: 4921706 - DNA, 21 bp, Homo sapiens
gtttcagatatatatcatatt

SEQ ID NO: 4921707 - DNA, 22 bp, Homo sapiens
gtttcagctaagggaagacatt

SEQ ID NO: 4921708 - DNA, 19 bp, Homo sapiens
gtttccagacttccttgag

SEQ ID NO: 4921709 - DNA, 20 bp, Homo sapiens
gtttccagacttccttgaga

SEQ ID NO: 4921710 - DNA, 14 bp, Homo sapiens
gtttcctcttccaa

SEQ ID NO: 4921711 - DNA, 14 bp, Homo sapiens
gtttctaagattct

SEQ ID NO: 4921712 - DNA, 15 bp, Homo sapiens
gtttctaagattcta

SEQ ID NO: 4921713 - DNA, 16 bp, Homo sapiens
gtttctaagattctaa

SEQ ID NO: 4921714 - DNA, 19 bp, Homo sapiens
gtttctaagattctaaagg

SEQ ID NO: 4921715 - DNA, 21 bp, Homo sapiens
gtttctaagattctaaaggtc

SEQ ID NO: 4921716 - DNA, 14 bp, Homo sapiens
gtttctcattcttg

SEQ ID NO: 4921717 - DNA, 16 bp, Homo sapiens
gtttctctctacagtg

SEQ ID NO: 4921718 - DNA, 17 bp, Homo sapiens
gtttctcttgagctggc

SEQ ID NO: 4921719 - DNA, 22 bp, Homo sapiens
gtttctgcatgaatatcataca

SEQ ID NO: 4921720 - DNA, 22 bp, Homo sapiens
gtctaactttagaagtgcattt

SEQ ID NO: 4921721 - DNA, 15 bp, Homo sapiens
gtctaagattctaga

SEQ ID NO: 4921722 - DNA, 15 bp, Homo sapiens
gtctacaaatataag

SEQ ID NO: 4921723 - DNA, 20 bp, Homo sapiens
gtctacaaatataagatttt

SEQ ID NO: 4921724 - DNA, 16 bp, Homo sapiens
gtctacactgcaatca

SEQ ID NO: 4921725 - DNA, 21 bp, Homo sapiens
gtctagattcaaaggttctag

SEQ ID NO: 4921726 - DNA, 22 bp, Homo sapiens
gtctagattcaaaggttctagg

SEQ ID NO: 4921727 - DNA, 12 bp, Homo sapiens
gtctagattctc

SEQ ID NO: 4921728 - DNA, 22 bp, Homo sapiens
gtctatgggactcaatgcactg

SEQ ID NO: 4921729 - DNA, 11 bp, Homo sapiens
gtctattttaa

SEQ ID NO: 4921730 - DNA, 16 bp, Homo sapiens
gtctattttaaaataa

SEQ ID NO: 4921731 - DNA, 14 bp, Homo sapiens
gtctcaaaaaaaca

SEQ ID NO: 4921732 - DNA, 16 bp, Homo sapiens
gtctcaaaaatacaaa

SEQ ID NO: 4921733 - DNA, 15 bp, Homo sapiens
gtctcaagagggcac

SEQ ID NO: 4921734 - DNA, 20 bp, Homo sapiens
gtctcaagagggcactggtg

SEQ ID NO: 4921735 - DNA, 23 bp, Homo sapiens
gtctcacgggcatgggcactccc

SEQ ID NO: 4921736 - DNA, 21 bp, Homo sapiens
gtctcactatgttgcccaggc

SEQ ID NO: 4921737 - DNA, 11 bp, Homo sapiens
gtctcactctg

SEQ ID NO: 4921738 - DNA, 15 bp, Homo sapiens
gtctcactctgtcgc

SEQ ID NO: 4921739 - DNA, 20 bp, Homo sapiens
gtctcactgttgcccaggct

SEQ ID NO: 4921740 - DNA, 22 bp, Homo sapiens
gtctcactgttgcccaggctgg

SEQ ID NO: 4921741 - DNA, 23 bp, Homo sapiens
gtctcactgttgcccaggctggc

SEQ ID NO: 4921742 - DNA, 19 bp, Homo sapiens
gtctcagacttttgtacat

SEQ ID NO: 4921743 - DNA, 13 bp, Homo sapiens
gtctcagcctccc

SEQ ID NO: 4921744 - DNA, 13 bp, Homo sapiens
gtctcaggctggt

SEQ ID NO: 4921745 - DNA, 22 bp, Homo sapiens
gtctcaggctggtgggaggggc

SEQ ID NO: 4921746 - DNA, 17 bp, Homo sapiens
gtctcagggtgcagagg

SEQ ID NO: 4921747 - DNA, 15 bp, Homo sapiens
gtctcaggtccctgc

SEQ ID NO: 4921748 - DNA, 16 bp, Homo sapiens
gtctcaggtccctgca

SEQ ID NO: 4921749 - DNA, 18 bp, Homo sapiens
gtctcagtggcttcatct

SEQ ID NO: 4921750 - DNA, 15 bp, Homo sapiens
gtctcagttggaaat

SEQ ID NO: 4921751 - DNA, 19 bp, Homo sapiens
gtctcagtttgtgtgtctt

SEQ ID NO: 4921752 - DNA, 14 bp, Homo sapiens
gtctcatccccagg

SEQ ID NO: 4921753 - DNA, 16 bp, Homo sapiens
gtctcatccccagggg

SEQ ID NO: 4921754 - DNA, 22 bp, Homo sapiens
gtctcattttaatgtaaagatt

SEQ ID NO: 4921755 - DNA, 13 bp, Homo sapiens
gtctccctgggag

SEQ ID NO: 4921756 - DNA, 17 bp, Homo sapiens
gtctcgctttgttgccc

SEQ ID NO: 4921757 - DNA, 16 bp, Homo sapiens
gtctcggactaagcct

SEQ ID NO: 4921758 - DNA, 15 bp, Homo sapiens
gtctctccttttctt

SEQ ID NO: 4921759 - DNA, 19 bp, Homo sapiens
gtctctctctctctacaaa

SEQ ID NO: 4921760 - DNA, 20 bp, Homo sapiens
gtctctcttcagactctcag

SEQ ID NO: 4921761 - DNA, 22 bp, Homo sapiens
gtctctcttcagactctcagcc

SEQ ID NO: 4921762 - DNA, 17 bp, Homo sapiens
gtctctgaagtactaac

SEQ ID NO: 4921763 - DNA, 19 bp, Homo sapiens
gtctctgaagtactaacac

SEQ ID NO: 4921764 - DNA, 14 bp, Homo sapiens
gtctctgctgcatt

SEQ ID NO: 4921765 - DNA, 22 bp, Homo sapiens
gtctctgctgcatttgtgtcat

SEQ ID NO: 4921766 - DNA, 13 bp, Homo sapiens
gtctctgctggcc

SEQ ID NO: 4921767 - DNA, 20 bp, Homo sapiens
gtctctgctggcccagccaa

SEQ ID NO: 4921768 - DNA, 17 bp, Homo sapiens
gtctcttctccactgga

SEQ ID NO: 4921769 - DNA, 18 bp, Homo sapiens
gtctcttctccactggat

SEQ ID NO: 4921770 - DNA, 16 bp, Homo sapiens
gtctcttctcccagaa

SEQ ID NO: 4921771 - DNA, 22 bp, Homo sapiens
gtctcttctcccagaatcccag

SEQ ID NO: 4921772 - DNA, 23 bp, Homo sapiens
gtctcttctcccagaatcccagc

SEQ ID NO: 4921773 - DNA, 17 bp, Homo sapiens
gtctctttaagggcatg

SEQ ID NO: 4921774 - DNA, 23 bp, Homo sapiens
gtctctttaagggcatgccttgt

SEQ ID NO: 4921775 - DNA, 20 bp, Homo sapiens
gtctctttaatgtcacaggc

SEQ ID NO: 4921776 - DNA, 22 bp, Homo sapiens
gtctctttaatgtcacaggcag

SEQ ID NO: 4921777 - DNA, 17 bp, Homo sapiens
gtctcttttgtaaatta

SEQ ID NO: 4921778 - DNA, 16 bp, Homo sapiens
gtctgaagtggttgtt

SEQ ID NO: 4921779 - DNA, 21 bp, Homo sapiens
gtctgacaggcaatgctggct

SEQ ID NO: 4921780 - DNA, 22 bp, Homo sapiens
gtctgacaggcaatgctggctg

SEQ ID NO: 4921781 - DNA, 13 bp, Homo sapiens
gtctgacccactg

SEQ ID NO: 4921782 - DNA, 15 bp, Homo sapiens
gtctgagccacagca

SEQ ID NO: 4921783 - DNA, 19 bp, Homo sapiens
gtctgaggaatccagaccc

SEQ ID NO: 4921784 - DNA, 19 bp, Homo sapiens
gtctgattcccaagctctg

SEQ ID NO: 4921785 - DNA, 21 bp, Homo sapiens
gtctgattcccaagctctgct

SEQ ID NO: 4921786 - DNA, 14 bp, Homo sapiens
gtctgattggcttg

SEQ ID NO: 4921787 - DNA, 19 bp, Homo sapiens
gtctgattggcttgtagaa

SEQ ID NO: 4921788 - DNA, 22 bp, Homo sapiens
gtctgattggcttgtagaattg

SEQ ID NO: 4921789 - DNA, 17 bp, Homo sapiens
gtctgcccttcacccca

SEQ ID NO: 4921790 - DNA, 16 bp, Homo sapiens
gtctgcgtgggtcaga

SEQ ID NO: 4921791 - DNA, 14 bp, Homo sapiens
gtctggaagtccaa

SEQ ID NO: 4921792 - DNA, 15 bp, Homo sapiens
gtctggactgacagc

SEQ ID NO: 4921793 - DNA, 14 bp, Homo sapiens
gtctggagtgggca

SEQ ID NO: 4921794 - DNA, 18 bp, Homo sapiens
gtctggttttaacaattt

SEQ ID NO: 4921795 - DNA, 12 bp, Homo sapiens
gtctgtatttca

SEQ ID NO: 4921796 - DNA, 17 bp, Homo sapiens
gtctgtatttcatgtgg

SEQ ID NO: 4921797 - DNA, 18 bp, Homo sapiens
gtctgtatttcatgtggc

SEQ ID NO: 4921798 - DNA, 20 bp, Homo sapiens
gtctgtatttcatgtggctg

SEQ ID NO: 4921799 - DNA, 21 bp, Homo sapiens
gtctgtatttcatgtggctgt

SEQ ID NO: 4921800 - DNA, 16 bp, Homo sapiens
gtctgtcttcacagct

SEQ ID NO: 4921801 - DNA, 14 bp, Homo sapiens
gtctgtgtgaatgt

SEQ ID NO: 4921802 - DNA, 15 bp, Homo sapiens
gtctgtgtgaatgtg

SEQ ID NO: 4921803 - DNA, 20 bp, Homo sapiens
gtctgttgtgtgtcatgcca

SEQ ID NO: 4921804 - DNA, 15 bp, Homo sapiens
gtctgtttaagaaaa

SEQ ID NO: 4921805 - DNA, 18 bp, Homo sapiens
gtctgtttaagaaaagta

SEQ ID NO: 4921806 - DNA, 17 bp, Homo sapiens
gtctgtttgtttcaaga

SEQ ID NO: 4921807 - DNA, 19 bp, Homo sapiens
gtcttaattattatttgtg

SEQ ID NO: 4921808 - DNA, 22 bp, Homo sapiens
gtcttaatttttgaaaaaagta

SEQ ID NO: 4921809 - DNA, 17 bp, Homo sapiens
gtcttcaaactgtgaag

SEQ ID NO: 4921810 - DNA, 22 bp, Homo sapiens
gtcttcaacataacccacttgt

SEQ ID NO: 4921811 - DNA, 17 bp, Homo sapiens
gtcttcacagctctgtg

SEQ ID NO: 4921812 - DNA, 15 bp, Homo sapiens
gtcttccctacctca

SEQ ID NO: 4921813 - DNA, 21 bp, Homo sapiens
gtcttccgcccctgcctgcca

SEQ ID NO: 4921814 - DNA, 15 bp, Homo sapiens
gtcttctaatttcaa

SEQ ID NO: 4921815 - DNA, 18 bp, Homo sapiens
gtcttgaactcctggcct

SEQ ID NO: 4921816 - DNA, 20 bp, Homo sapiens
gtcttgaactcctggcctca

SEQ ID NO: 4921817 - DNA, 21 bp, Homo sapiens
gtcttgaactcctggcctcaa

SEQ ID NO: 4921818 - DNA, 17 bp, Homo sapiens
gtcttgaatgtcttttg

SEQ ID NO: 4921819 - DNA, 20 bp, Homo sapiens
gtcttgcaatggcagccttg

SEQ ID NO: 4921820 - DNA, 16 bp, Homo sapiens
gtcttgttagaaaaca

SEQ ID NO: 4921821 - DNA, 17 bp, Homo sapiens
gtcttgttagaaaacaa

SEQ ID NO: 4921822 - DNA, 16 bp, Homo sapiens
gtctttaaaggcccag

SEQ ID NO: 4921823 - DNA, 18 bp, Homo sapiens
gtctttaaaggcccagcc

SEQ ID NO: 4921824 - DNA, 19 bp, Homo sapiens
gtctttaaaggcccagccc

SEQ ID NO: 4921825 - DNA, 20 bp, Homo sapiens
gtctttaaaggcccagcccc

SEQ ID NO: 4921826 - DNA, 16 bp, Homo sapiens
gtctttcacagctcct

SEQ ID NO: 4921827 - DNA, 20 bp, Homo sapiens
gtctttggaaaaatgtttgt

SEQ ID NO: 4921828 - DNA, 15 bp, Homo sapiens
gtctttggttcagct

SEQ ID NO: 4921829 - DNA, 20 bp, Homo sapiens
gtctttgtaagagtgtagaa

SEQ ID NO: 4921830 - DNA, 18 bp, Homo sapiens
gcttattttaatgtgatg

SEQ ID NO: 4921831 - DNA, 20 bp, Homo sapiens
ggtctcttttgtaaattaaa

SEQ ID NO: 4921832 - DNA, 16 bp, Homo sapiens
ggtctgtgcatttctg

SEQ ID NO: 4921833 - DNA, 15 bp, Homo sapiens
ggtctgtgtgaatgt

SEQ ID NO: 4921834 - DNA, 16 bp, Homo sapiens
ggtctgtgtgaatgtg

SEQ ID NO: 4921835 - DNA, 20 bp, Homo sapiens
ggtcttccctacctcaggca

SEQ ID NO: 4921836 - DNA, 22 bp, Homo sapiens
ggtcttgaactcctggcctcaa

SEQ ID NO: 4921837 - DNA, 14 bp, Homo sapiens
ggtctttgtaagag

SEQ ID NO: 4921838 - DNA, 23 bp, Homo sapiens
ggtgaaatttattagttaatata

SEQ ID NO: 4921839 - DNA, 17 bp, Homo sapiens
ggtgaaccacttcattc

SEQ ID NO: 4921840 - DNA, 19 bp, Homo sapiens
ggtgaagatgggaacgcag

SEQ ID NO: 4921841 - DNA, 17 bp, Homo sapiens
ggtgacagcagtcggtt

SEQ ID NO: 4921842 - DNA, 18 bp, Homo sapiens
ggtgacagtcatcatcag

SEQ ID NO: 4921843 - DNA, 22 bp, Homo sapiens
ggtgacagtcatcatcagggcc

SEQ ID NO: 4921844 - DNA, 23 bp, Homo sapiens
ggtgacagtcatcatcagggcct

SEQ ID NO: 4921845 - DNA, 17 bp, Homo sapiens
ggtgagatgctggagaa

SEQ ID NO: 4921846 - DNA, 19 bp, Homo sapiens
ggtgagcagaagtggagct

SEQ ID NO: 4921847 - DNA, 13 bp, Homo sapiens
ggtgaggagcaca

SEQ ID NO: 4921848 - DNA, 14 bp, Homo sapiens
ggtgattcaccaaa

SEQ ID NO: 4921849 - DNA, 18 bp, Homo sapiens
ggtgattggaccaggcca

SEQ ID NO: 4921850 - DNA, 23 bp, Homo sapiens
ggtgcaacccaaggactgaggga

SEQ ID NO: 4921851 - DNA, 15 bp, Homo sapiens
ggtgcagcagtgagg

SEQ ID NO: 4921852 - DNA, 15 bp, Homo sapiens
ggtgcatagaactgg

SEQ ID NO: 4921853 - DNA, 15 bp, Homo sapiens
ggtgccaactggtgt

SEQ ID NO: 4921854 - DNA, 13 bp, Homo sapiens
ggtgccagcctga

SEQ ID NO: 4921855 - DNA, 17 bp, Homo sapiens
ggtgcctgtcccacccc

SEQ ID NO: 4921856 - DNA, 22 bp, Homo sapiens
ggtgctaaatggtcgcccagga

SEQ ID NO: 4921857 - DNA, 23 bp, Homo sapiens
ggtgctcagaataaggcaggcat

SEQ ID NO: 4921858 - DNA, 16 bp, Homo sapiens
ggtgctgcctgaatcc

SEQ ID NO: 4921859 - DNA, 16 bp, Homo sapiens
ggtgctggaggtggga

SEQ ID NO: 4921860 - DNA, 21 bp, Homo sapiens
ggtgcttgttccctctccctg

SEQ ID NO: 4921861 - DNA, 13 bp, Homo sapiens
ggtggacacacaa

SEQ ID NO: 4921862 - DNA, 23 bp, Homo sapiens
ggtggacttagaaagcaggggct

SEQ ID NO: 4921863 - DNA, 18 bp, Homo sapiens
ggtggcacaggccccctt

SEQ ID NO: 4921864 - DNA, 23 bp, Homo sapiens
ggtggcagctgcggtccacccag

SEQ ID NO: 4921865 - DNA, 16 bp, Homo sapiens
ggtggcagtgggagct

SEQ ID NO: 4921866 - DNA, 22 bp, Homo sapiens
ggtggcagtgggagctgcctgt

SEQ ID NO: 4921867 - DNA, 21 bp, Homo sapiens
ggtggccactccagacccctg

SEQ ID NO: 4921868 - DNA, 23 bp, Homo sapiens
ggtggccactccagacccctggc

SEQ ID NO: 4921869 - DNA, 13 bp, Homo sapiens
ggtggccctgtcc

SEQ ID NO: 4921870 - DNA, 23 bp, Homo sapiens
ggtggccctgtccctcccacctc

SEQ ID NO: 4921871 - DNA, 16 bp, Homo sapiens
ggtggcggccccagca

SEQ ID NO: 4921872 - DNA, 12 bp, Homo sapiens
ggtggctgggtt

SEQ ID NO: 4921873 - DNA, 18 bp, Homo sapiens
ggtggctgggttggaggg

SEQ ID NO: 4921874 - DNA, 17 bp, Homo sapiens
ggtggggcagcttgagg

SEQ ID NO: 4921875 - DNA, 15 bp, Homo sapiens
ggtggggcgaggcag

SEQ ID NO: 4921876 - DNA, 14 bp, Homo sapiens
ggtggggtcctgga

SEQ ID NO: 4921877 - DNA, 14 bp, Homo sapiens
ggtgggtgctcaga

SEQ ID NO: 4921878 - DNA, 16 bp, Homo sapiens
ggtggtgacctctgcc

SEQ ID NO: 4921879 - DNA, 18 bp, Homo sapiens
ggtgtaataagacataac

SEQ ID NO: 4921880 - DNA, 18 bp, Homo sapiens
ggtgtgagtcaccaagcc

SEQ ID NO: 4921881 - DNA, 12 bp, Homo sapiens
ggtgtgtctgct

SEQ ID NO: 4921882 - DNA, 11 bp, Homo sapiens
ggtgttctaag

SEQ ID NO: 4921883 - DNA, 22 bp, Homo sapiens
ggtgttttttatgaagtgcgtg

SEQ ID NO: 4921884 - DNA, 22 bp, Homo sapiens
ggttaaaactgtacatttaaaa

SEQ ID NO: 4921885 - DNA, 21 bp, Homo sapiens
ggttaagcattaccactcagg

SEQ ID NO: 4921886 - DNA, 18 bp, Homo sapiens
ggttagattcaaggcccc

SEQ ID NO: 4921887 - DNA, 23 bp, Homo sapiens
ggttcaagcgattcttctgcttc

SEQ ID NO: 4921888 - DNA, 18 bp, Homo sapiens
ggttcagggttggcccct

SEQ ID NO: 4921889 - DNA, 14 bp, Homo sapiens
ggttcagtttcttc

SEQ ID NO: 4921890 - DNA, 16 bp, Homo sapiens
ggttccctgttcttcc

SEQ ID NO: 4921891 - DNA, 18 bp, Homo sapiens
ggttccctgttcttcctc

SEQ ID NO: 4921892 - DNA, 22 bp, Homo sapiens
ggttccctttccttccatccct

SEQ ID NO: 4921893 - DNA, 13 bp, Homo sapiens
ggttctgcctgct

SEQ ID NO: 4921894 - DNA, 12 bp, Homo sapiens
ggttctggctgc

SEQ ID NO: 4921895 - DNA, 14 bp, Homo sapiens
ggttctttcttcct

SEQ ID NO: 4921896 - DNA, 18 bp, Homo sapiens
ggttctttcttcctctgc

SEQ ID NO: 4921897 - DNA, 13 bp, Homo sapiens
ggttgctggagcc

SEQ ID NO: 4921898 - DNA, 21 bp, Homo sapiens
ggttggcccctgcccggctgc

SEQ ID NO: 4921899 - DNA, 17 bp, Homo sapiens
ggttgggcccagatctg

SEQ ID NO: 4921900 - DNA, 14 bp, Homo sapiens
ggttgggctggtgt

SEQ ID NO: 4921901 - DNA, 14 bp, Homo sapiens
ggttggggtgacag

SEQ ID NO: 4921902 - DNA, 20 bp, Homo sapiens
ggtttaaagagtctagattc

SEQ ID NO: 4921903 - DNA, 14 bp, Homo sapiens
ggtttacaggccct

SEQ ID NO: 4921904 - DNA, 19 bp, Homo sapiens
ggtttcaccatgttgccca

SEQ ID NO: 4921905 - DNA, 22 bp, Homo sapiens
ggtttcacccttaacccaagga

SEQ ID NO: 4921906 - DNA, 17 bp, Homo sapiens
ggtttcgtttctgtata

SEQ ID NO: 4921907 - DNA, 15 bp, Homo sapiens
ggtttctctctacag

SEQ ID NO: 4921908 - DNA, 15 bp, Homo sapiens
ggtttctttttaagt

SEQ ID NO: 4921909 - DNA, 15 bp, Homo sapiens
ggtttgatcatttct

SEQ ID NO: 4921910 - DNA, 15 bp, Homo sapiens
ggtttggtttgcttt

SEQ ID NO: 4921911 - DNA, 14 bp, Homo sapiens
ggtttgtgttcttc

SEQ ID NO: 4921912 - DNA, 18 bp, Homo sapiens
ggttttaggtagaaaaac

SEQ ID NO: 4921913 - DNA, 16 bp, Homo sapiens
ggttttaggttctaaa

SEQ ID NO: 4921914 - DNA, 13 bp, Homo sapiens
ggttttccacgct

SEQ ID NO: 4921915 - DNA, 23 bp, Homo sapiens
ggttttgccatgttggccaggct

SEQ ID NO: 4921916 - DNA, 20 bp, Homo sapiens
ggtttttacctgtcacattg

SEQ ID NO: 4921917 - DNA, 13 bp, Homo sapiens
gtaaaaaaaaatg

SEQ ID NO: 4921918 - DNA, 23 bp, Homo sapiens
gtaaaaaaaaatgcctttgagac

SEQ ID NO: 4921919 - DNA, 11 bp, Homo sapiens
gtaaaaagaaa

SEQ ID NO: 4921920 - DNA, 19 bp, Homo sapiens
gtaaaacgctgtcaaaagt

SEQ ID NO: 4921921 - DNA, 21 bp, Homo sapiens
gtaaaacgctgtcaaaagttg

SEQ ID NO: 4921922 - DNA, 19 bp, Homo sapiens
gtaaaattgctgtgcttta

SEQ ID NO: 4921923 - DNA, 14 bp, Homo sapiens
gtaaacaaactctt

SEQ ID NO: 4921924 - DNA, 14 bp, Homo sapiens
gtaaacgacactct

SEQ ID NO: 4921925 - DNA, 22 bp, Homo sapiens
gtaaactatcttggtgaatttt

SEQ ID NO: 4921926 - DNA, 15 bp, Homo sapiens
gtaaactcaaaactt

SEQ ID NO: 4921927 - DNA, 21 bp, Homo sapiens
gtaaactcaaaacttaacata

SEQ ID NO: 4921928 - DNA, 11 bp, Homo sapiens
gtaaactgcca

SEQ ID NO: 4921929 - DNA, 13 bp, Homo sapiens
gtaaagaaatgtc

SEQ ID NO: 4921930 - DNA, 19 bp, Homo sapiens
gtaaagaaatttactatat

SEQ ID NO: 4921931 - DNA, 15 bp, Homo sapiens
gtaaagccattaaat

SEQ ID NO: 4921932 - DNA, 13 bp, Homo sapiens
gtaaataaaaaga

SEQ ID NO: 4921933 - DNA, 16 bp, Homo sapiens
gtaaatagtatttgag

SEQ ID NO: 4921934 - DNA, 17 bp, Homo sapiens
gtaaatagtatttgaga

SEQ ID NO: 4921935 - DNA, 19 bp, Homo sapiens
gtaaatattgaggctttgt

SEQ ID NO: 4921936 - DNA, 15 bp, Homo sapiens
gtaaatgtctttgta

SEQ ID NO: 4921937 - DNA, 16 bp, Homo sapiens
gtaaatgttatttctg

SEQ ID NO: 4921938 - DNA, 20 bp, Homo sapiens
gtaaatgttatttctgcaaa

SEQ ID NO: 4921939 - DNA, 14 bp, Homo sapiens
gtagcttgctccct

SEQ ID NO: 4921940 - DNA, 19 bp, Homo sapiens
gtagcttgctccctgtgtc

SEQ ID NO: 4921941 - DNA, 23 bp, Homo sapiens
gtaggctcctgccagtgtggaac

SEQ ID NO: 4921942 - DNA, 13 bp, Homo sapiens
gtagggaataaaa

SEQ ID NO: 4921943 - DNA, 21 bp, Homo sapiens
gtagggctgccaccaaggtga

SEQ ID NO: 4921944 - DNA, 18 bp, Homo sapiens
gtaggtaaaatgtatttt

SEQ ID NO: 4921945 - DNA, 21 bp, Homo sapiens
gtagtagccctttctgtgtgc

SEQ ID NO: 4921946 - DNA, 16 bp, Homo sapiens
gtagtcttgatgacca

SEQ ID NO: 4921947 - DNA, 22 bp, Homo sapiens
gtagtgaaataatagaatgagc

SEQ ID NO: 4921948 - DNA, 13 bp, Homo sapiens
gtagtgagcagtg

SEQ ID NO: 4921949 - DNA, 12 bp, Homo sapiens
gtagttgtcttt

SEQ ID NO: 4921950 - DNA, 13 bp, Homo sapiens
gtataaactatca

SEQ ID NO: 4921951 - DNA, 14 bp, Homo sapiens
gtataaagaaaagt

SEQ ID NO: 4921952 - DNA, 12 bp, Homo sapiens
gtataaatgtat

SEQ ID NO: 4921953 - DNA, 17 bp, Homo sapiens
gtataaatgtatataca

SEQ ID NO: 4921954 - DNA, 22 bp, Homo sapiens
gtataaatgtatatacacatat

SEQ ID NO: 4921955 - DNA, 17 bp, Homo sapiens
gtataagcactgaaaaa

SEQ ID NO: 4921956 - DNA, 14 bp, Homo sapiens
gtataatttcgaga

SEQ ID NO: 4921957 - DNA, 21 bp, Homo sapiens
gtataatttcgagatttgtag

SEQ ID NO: 4921958 - DNA, 15 bp, Homo sapiens
gtatacaatatataa

SEQ ID NO: 4921959 - DNA, 19 bp, Homo sapiens
gtatacaatatataaaaat

SEQ ID NO: 4921960 - DNA, 19 bp, Homo sapiens
gtatacagttcaataaact

SEQ ID NO: 4921961 - DNA, 22 bp, Homo sapiens
gtatactttaaataatttaact

SEQ ID NO: 4921962 - DNA, 14 bp, Homo sapiens
gtatactttagtat

SEQ ID NO: 4921963 - DNA, 13 bp, Homo sapiens
gtatagtgtaaaa

SEQ ID NO: 4921964 - DNA, 14 bp, Homo sapiens
gtatagtgtaaaat

SEQ ID NO: 4921965 - DNA, 13 bp, Homo sapiens
gtatatacacata

SEQ ID NO: 4921966 - DNA, 14 bp, Homo sapiens
gtatatacacatat

SEQ ID NO: 4921967 - DNA, 11 bp, Homo sapiens
gtatatataca

SEQ ID NO: 4921968 - DNA, 17 bp, Homo sapiens
gtatatatacatacact

SEQ ID NO: 4921969 - DNA, 16 bp, Homo sapiens
gtatatatgtgtatat

SEQ ID NO: 4921970 - DNA, 20 bp, Homo sapiens
gtatatatgtgtatatatac

SEQ ID NO: 4921971 - DNA, 13 bp, Homo sapiens
gtatatattccca

SEQ ID NO: 4921972 - DNA, 14 bp, Homo sapiens
gtatatattcccaa

SEQ ID NO: 4921973 - DNA, 19 bp, Homo sapiens
gtatatcagaaaagggaag

SEQ ID NO: 4921974 - DNA, 24 bp, Homo sapiens
gtatatcatgtaaagaaatgtctt

SEQ ID NO: 4921975 - DNA, 15 bp, Homo sapiens
gtatatgtctcaggt

SEQ ID NO: 4921976 - DNA, 18 bp, Homo sapiens
gtatattacacatttgta

SEQ ID NO: 4921977 - DNA, 14 bp, Homo sapiens
gtatattatttggc

SEQ ID NO: 4921978 - DNA, 19 bp, Homo sapiens
gtatattgtgtttgtgtat

SEQ ID NO: 4921979 - DNA, 22 bp, Homo sapiens
gtatatttaaactcaagacaat

SEQ ID NO: 4921980 - DNA, 14 bp, Homo sapiens
gtatatttgtatat

SEQ ID NO: 4921981 - DNA, 18 bp, Homo sapiens
gtatcagaagagagggga

SEQ ID NO: 4921982 - DNA, 22 bp, Homo sapiens
gtatcaggtgctgccatccagg

SEQ ID NO: 4921983 - DNA, 15 bp, Homo sapiens
gtatcagtgttttaa

SEQ ID NO: 4921984 - DNA, 17 bp, Homo sapiens
gtatcagtgttttaaat

SEQ ID NO: 4921985 - DNA, 19 bp, Homo sapiens
gtatccaaccaacttggtt

SEQ ID NO: 4921986 - DNA, 18 bp, Homo sapiens
gtatcccgagtctgggac

SEQ ID NO: 4921987 - DNA, 20 bp, Homo sapiens
gtatcccgagtctgggacac

SEQ ID NO: 4921988 - DNA, 14 bp, Homo sapiens
gtatcgatgtttta

SEQ ID NO: 4921989 - DNA, 20 bp, Homo sapiens
gtatctatatatgtgtatgt

SEQ ID NO: 4921990 - DNA, 17 bp, Homo sapiens
gtatctctgaagcatgt

SEQ ID NO: 4921991 - DNA, 19 bp, Homo sapiens
gtatctctgaagcatgttt

SEQ ID NO: 4921992 - DNA, 18 bp, Homo sapiens
gtatctgagttgccaaga

SEQ ID NO: 4921993 - DNA, 19 bp, Homo sapiens
gtatgaactttatctaaag

SEQ ID NO: 4921994 - DNA, 13 bp, Homo sapiens
gtatgaaggcttt

SEQ ID NO: 4921995 - DNA, 20 bp, Homo sapiens
gtatgatcacggctcactgc

SEQ ID NO: 4921996 - DNA, 14 bp, Homo sapiens
gtatggctctgcac

SEQ ID NO: 4921997 - DNA, 20 bp, Homo sapiens
gtatggctctgcacccctct

SEQ ID NO: 4921998 - DNA, 15 bp, Homo sapiens
gtatggtggctgggt

SEQ ID NO: 4921999 - DNA, 12 bp, Homo sapiens
gtatgtggaagg

SEQ ID NO: 4922000 - DNA, 11 bp, Homo sapiens
gtatgttgtcc

SEQ ID NO: 4922001 - DNA, 21 bp, Homo sapiens
gtatgttgtccaattgttgac

SEQ ID NO: 4922002 - DNA, 17 bp, Homo sapiens
gtattaaaacattggat

SEQ ID NO: 4922003 - DNA, 16 bp, Homo sapiens
gtattaatactaaaat

SEQ ID NO: 4922004 - DNA, 22 bp, Homo sapiens
gtattaatactaaaatatgtct

SEQ ID NO: 4922005 - DNA, 12 bp, Homo sapiens
gtattattgctg

SEQ ID NO: 4922006 - DNA, 20 bp, Homo sapiens
gtattattgctgttgcttga

SEQ ID NO: 4922007 - DNA, 15 bp, Homo sapiens
gtattcttcaacctc

SEQ ID NO: 4922008 - DNA, 18 bp, Homo sapiens
gtatttaaactatcttgt

SEQ ID NO: 4922009 - DNA, 13 bp, Homo sapiens
gtatttatcttta

SEQ ID NO: 4922010 - DNA, 22 bp, Homo sapiens
gtatttatgtaatgaagtaaag

SEQ ID NO: 4922011 - DNA, 16 bp, Homo sapiens
gtatttattttgtaat

SEQ ID NO: 4922012 - DNA, 17 bp, Homo sapiens
gtatttcatgtggctgt

SEQ ID NO: 4922013 - DNA, 18 bp, Homo sapiens
gtatttcatgtggctgta

SEQ ID NO: 4922014 - DNA, 21 bp, Homo sapiens
gtatttgaattaaaacttctt

SEQ ID NO: 4922015 - DNA, 13 bp, Homo sapiens
gtatttgcagttc

SEQ ID NO: 4922016 - DNA, 17 bp, Homo sapiens
gtatttgttcatgtttg

SEQ ID NO: 4922017 - DNA, 15 bp, Homo sapiens
gtattttaaaagcca

SEQ ID NO: 4922018 - DNA, 13 bp, Homo sapiens
gtattttgaagtt

SEQ ID NO: 4922019 - DNA, 19 bp, Homo sapiens
gtattttgaagtttacatt

SEQ ID NO: 4922020 - DNA, 16 bp, Homo sapiens
gtattttgaataccat

SEQ ID NO: 4922021 - DNA, 12 bp, Homo sapiens
gtattttgtgtg

SEQ ID NO: 4922022 - DNA, 18 bp, Homo sapiens
gtatttttatacaaacct

SEQ ID NO: 4922023 - DNA, 17 bp, Homo sapiens
gtatttttttgtaattg

SEQ ID NO: 4922024 - DNA, 13 bp, Homo sapiens
gtcaaaacactgt

SEQ ID NO: 4922025 - DNA, 14 bp, Homo sapiens
gtcaaaacactgtg

SEQ ID NO: 4922026 - DNA, 15 bp, Homo sapiens
gtcaaaacactgtgg

SEQ ID NO: 4922027 - DNA, 15 bp, Homo sapiens
gtcaaaagttggact

SEQ ID NO: 4922028 - DNA, 16 bp, Homo sapiens
gtcaaaagttggacta

SEQ ID NO: 4922029 - DNA, 19 bp, Homo sapiens
gtcaaaagttggactaaat

SEQ ID NO: 4922030 - DNA, 22 bp, Homo sapiens
gtcaaatggtaggcatttccta

SEQ ID NO: 4922031 - DNA, 18 bp, Homo sapiens
gtcaagagggtctgagga

SEQ ID NO: 4922032 - DNA, 21 bp, Homo sapiens
gtcaagtctctgctggcccag

SEQ ID NO: 4922033 - DNA, 22 bp, Homo sapiens
gtcaatgctatttttgttttta

SEQ ID NO: 4922034 - DNA, 16 bp, Homo sapiens
gtcacagcctcctctg

SEQ ID NO: 4922035 - DNA, 21 bp, Homo sapiens
gtcacagcctcctctgtctgc

SEQ ID NO: 4922036 - DNA, 17 bp, Homo sapiens
gtcacaggactctgcct

SEQ ID NO: 4922037 - DNA, 19 bp, Homo sapiens
gtcacaggactctgcctcc

SEQ ID NO: 4922038 - DNA, 20 bp, Homo sapiens
gtcacagggcatgccccggc

SEQ ID NO: 4922039 - DNA, 12 bp, Homo sapiens
gtcacagggcca

SEQ ID NO: 4922040 - DNA, 13 bp, Homo sapiens
gtcacagggccaa

SEQ ID NO: 4922041 - DNA, 13 bp, Homo sapiens
gtcacattgcatt

SEQ ID NO: 4922042 - DNA, 15 bp, Homo sapiens
gtcaccaagcccagt

SEQ ID NO: 4922043 - DNA, 18 bp, Homo sapiens
gtcaccactccattccca

SEQ ID NO: 4922044 - DNA, 16 bp, Homo sapiens
gtcaccctccacctct

SEQ ID NO: 4922045 - DNA, 15 bp, Homo sapiens
gtcacctagcaagct

SEQ ID NO: 4922046 - DNA, 16 bp, Homo sapiens
gtcacctagcaagctg

SEQ ID NO: 4922047 - DNA, 24 bp, Homo sapiens
gtcactcattgctgagcctctgct

SEQ ID NO: 4922048 - DNA, 17 bp, Homo sapiens
gtcactgccactttgca

SEQ ID NO: 4922049 - DNA, 14 bp, Homo sapiens
gtcagacataaagc

SEQ ID NO: 4922050 - DNA, 21 bp, Homo sapiens
gcctcctctgtctgcccttca

SEQ ID NO: 4922051 - DNA, 16 bp, Homo sapiens
gcctcctgtgtactgt

SEQ ID NO: 4922052 - DNA, 13 bp, Homo sapiens
gcctcctgtgtgt

SEQ ID NO: 4922053 - DNA, 23 bp, Homo sapiens
gcctcctgtgtgtgcgcctacag

SEQ ID NO: 4922054 - DNA, 21 bp, Homo sapiens
gcctcgggacacctgccctgc

SEQ ID NO: 4922055 - DNA, 20 bp, Homo sapiens
gcctcgttggaagaggaaca

SEQ ID NO: 4922056 - DNA, 21 bp, Homo sapiens
gcctctatcctacaaggccta

SEQ ID NO: 4922057 - DNA, 23 bp, Homo sapiens
gcctctccaggcaccatctccct

SEQ ID NO: 4922058 - DNA, 20 bp, Homo sapiens
gcctctgacacacagctctg

SEQ ID NO: 4922059 - DNA, 15 bp, Homo sapiens
gcctctgacccctcc

SEQ ID NO: 4922060 - DNA, 21 bp, Homo sapiens
gcctctgacccctcctcactg

SEQ ID NO: 4922061 - DNA, 15 bp, Homo sapiens
gcctctgatatggga

SEQ ID NO: 4922062 - DNA, 19 bp, Homo sapiens
gcctctgatatgggactga

SEQ ID NO: 4922063 - DNA, 19 bp, Homo sapiens
gcctctgccacactctgac

SEQ ID NO: 4922064 - DNA, 12 bp, Homo sapiens
gcctctgcctct

SEQ ID NO: 4922065 - DNA, 17 bp, Homo sapiens
gctaatcagcattctca

SEQ ID NO: 4922066 - DNA, 20 bp, Homo sapiens
gctaattgggagtccaggca

SEQ ID NO: 4922067 - DNA, 13 bp, Homo sapiens
gctaatttgcatt

SEQ ID NO: 4922068 - DNA, 13 bp, Homo sapiens
gctaattttctca

SEQ ID NO: 4922069 - DNA, 14 bp, Homo sapiens
gctaattttctcaa

SEQ ID NO: 4922070 - DNA, 16 bp, Homo sapiens
gctaatttttcatttt

SEQ ID NO: 4922071 - DNA, 19 bp, Homo sapiens
gctacaggaagcaccccat

SEQ ID NO: 4922072 - DNA, 21 bp, Homo sapiens
gctacaggaagcaccccatgc

SEQ ID NO: 4922073 - DNA, 19 bp, Homo sapiens
gctacccaaaagagaaaaa

SEQ ID NO: 4922074 - DNA, 19 bp, Homo sapiens
gctacccttttcctttgtg

SEQ ID NO: 4922075 - DNA, 20 bp, Homo sapiens
gctacccttttcctttgtgg

SEQ ID NO: 4922076 - DNA, 18 bp, Homo sapiens
gctaccctttttctccag

SEQ ID NO: 4922077 - DNA, 21 bp, Homo sapiens
gctaccctttttctccagctg

SEQ ID NO: 4922078 - DNA, 15 bp, Homo sapiens
gctactataaagaga

SEQ ID NO: 4922079 - DNA, 16 bp, Homo sapiens
gctactgatttttgtg

SEQ ID NO: 4922080 - DNA, 19 bp, Homo sapiens
gctactgcagctttacatg

SEQ ID NO: 4922081 - DNA, 16 bp, Homo sapiens
gctactgtctttggaa

SEQ ID NO: 4922082 - DNA, 21 bp, Homo sapiens
gctacttaagagaaatggcaa

SEQ ID NO: 4922083 - DNA, 11 bp, Homo sapiens
gctagaacttt

SEQ ID NO: 4922084 - DNA, 20 bp, Homo sapiens
gctagaacttttttaaataa

SEQ ID NO: 4922085 - DNA, 19 bp, Homo sapiens
gctagaggccagccccacc

SEQ ID NO: 4922086 - DNA, 13 bp, Homo sapiens
gctagagtcctca

SEQ ID NO: 4922087 - DNA, 16 bp, Homo sapiens
gctagagtcctcactc

SEQ ID NO: 4922088 - DNA, 19 bp, Homo sapiens
gctagcaaatggcagaacc

SEQ ID NO: 4922089 - DNA, 14 bp, Homo sapiens
gctagcatccctga

SEQ ID NO: 4922090 - DNA, 13 bp, Homo sapiens
gctaggaatgaaa

SEQ ID NO: 4922091 - DNA, 22 bp, Homo sapiens
gctaggacccctccatgtgggc

SEQ ID NO: 4922092 - DNA, 14 bp, Homo sapiens
gctaggcctggcca

SEQ ID NO: 4922093 - DNA, 16 bp, Homo sapiens
gctaggcctggccaga

SEQ ID NO: 4922094 - DNA, 17 bp, Homo sapiens
gctaggggacatcagag

SEQ ID NO: 4922095 - DNA, 15 bp, Homo sapiens
gctagtatttgaatt

SEQ ID NO: 4922096 - DNA, 22 bp, Homo sapiens
gctagtatttgaattaaaactt

SEQ ID NO: 4922097 - DNA, 13 bp, Homo sapiens
gctagtgagctgg

SEQ ID NO: 4922098 - DNA, 13 bp, Homo sapiens
gctatatatataa

SEQ ID NO: 4922099 - DNA, 14 bp, Homo sapiens
gctatatatataaa

SEQ ID NO: 4922100 - DNA, 19 bp, Homo sapiens
gctatatatataaatattt

SEQ ID NO: 4922101 - DNA, 13 bp, Homo sapiens
gctatctctgtgt

SEQ ID NO: 4922102 - DNA, 16 bp, Homo sapiens
gctatctctgtgtgca

SEQ ID NO: 4922103 - DNA, 18 bp, Homo sapiens
gctatgggagccccaggg

SEQ ID NO: 4922104 - DNA, 13 bp, Homo sapiens
gctattacaaata

SEQ ID NO: 4922105 - DNA, 13 bp, Homo sapiens
gctattagccagg

SEQ ID NO: 4922106 - DNA, 18 bp, Homo sapiens
gctattagccaggatcat

SEQ ID NO: 4922107 - DNA, 15 bp, Homo sapiens
gctcaagcagcgacc

SEQ ID NO: 4922108 - DNA, 21 bp, Homo sapiens
gctcaagcagcgaccgccccc

SEQ ID NO: 4922109 - DNA, 22 bp, Homo sapiens
gctcaagcagcgaccgccccct

SEQ ID NO: 4922110 - DNA, 12 bp, Homo sapiens
gctcaagttcat

SEQ ID NO: 4922111 - DNA, 20 bp, Homo sapiens
gctcacagtacagcatgtgc

SEQ ID NO: 4922112 - DNA, 16 bp, Homo sapiens
gctcacatatctgtca

SEQ ID NO: 4922113 - DNA, 23 bp, Homo sapiens
gctcaccagccccagtgcccaca

SEQ ID NO: 4922114 - DNA, 11 bp, Homo sapiens
gctcactgcag

SEQ ID NO: 4922115 - DNA, 12 bp, Homo sapiens
gctcactgcagc

SEQ ID NO: 4922116 - DNA, 13 bp, Homo sapiens
gctcactgcagcc

SEQ ID NO: 4922117 - DNA, 18 bp, Homo sapiens
gctcagaacccagggctc

SEQ ID NO: 4922118 - DNA, 20 bp, Homo sapiens
gctcagaataaggcaggcat

SEQ ID NO: 4922119 - DNA, 20 bp, Homo sapiens
gctcagagggggactgctgc

SEQ ID NO: 4922120 - DNA, 17 bp, Homo sapiens
gctcagcggggacagct

SEQ ID NO: 4922121 - DNA, 22 bp, Homo sapiens
gctcagcggggacagctccttc

SEQ ID NO: 4922122 - DNA, 20 bp, Homo sapiens
gctcaggcctataaccccag

SEQ ID NO: 4922123 - DNA, 19 bp, Homo sapiens
gctcaggggcagctcatag

SEQ ID NO: 4922124 - DNA, 21 bp, Homo sapiens
gctcaggtcacataaaacttt

SEQ ID NO: 4922125 - DNA, 15 bp, Homo sapiens
gctcattttttctta

SEQ ID NO: 4922126 - DNA, 16 bp, Homo sapiens
gctccaagattctaga

SEQ ID NO: 4922127 - DNA, 12 bp, Homo sapiens
gctccaccacat

SEQ ID NO: 4922128 - DNA, 11 bp, Homo sapiens
gctccaccctt

SEQ ID NO: 4922129 - DNA, 13 bp, Homo sapiens
gctccagctcacc

SEQ ID NO: 4922130 - DNA, 15 bp, Homo sapiens
gctccaggcctgcag

SEQ ID NO: 4922131 - DNA, 16 bp, Homo sapiens
gctccaggcctgcagc

SEQ ID NO: 4922132 - DNA, 13 bp, Homo sapiens
gctccaggctcct

SEQ ID NO: 4922133 - DNA, 23 bp, Homo sapiens
gctccaggctcctttagcgccca

SEQ ID NO: 4922134 - DNA, 18 bp, Homo sapiens
gctccagggagattttga

SEQ ID NO: 4922135 - DNA, 15 bp, Homo sapiens
gctccaggtggctct

SEQ ID NO: 4922136 - DNA, 21 bp, Homo sapiens
gctccaggtggctctgaggtg

SEQ ID NO: 4922137 - DNA, 14 bp, Homo sapiens
gctccatctccact

SEQ ID NO: 4922138 - DNA, 23 bp, Homo sapiens
gctccatgctcctcactgcccgc

SEQ ID NO: 4922139 - DNA, 17 bp, Homo sapiens
gctccatgtgcctcttt

SEQ ID NO: 4922140 - DNA, 22 bp, Homo sapiens
gctccattttcttattgcgctg

SEQ ID NO: 4922141 - DNA, 16 bp, Homo sapiens
gctcccacaggccctt

SEQ ID NO: 4922142 - DNA, 20 bp, Homo sapiens
gctcccacaggcccttcctc

SEQ ID NO: 4922143 - DNA, 18 bp, Homo sapiens
gctccctaagccagcctg

SEQ ID NO: 4922144 - DNA, 19 bp, Homo sapiens
gctccctaagccagcctgg

SEQ ID NO: 4922145 - DNA, 17 bp, Homo sapiens
gctccctcccctgccct

SEQ ID NO: 4922146 - DNA, 12 bp, Homo sapiens
gctccctgaagc

SEQ ID NO: 4922147 - DNA, 15 bp, Homo sapiens
gctccctgaagccag

SEQ ID NO: 4922148 - DNA, 17 bp, Homo sapiens
gctccctgaagccagcc

SEQ ID NO: 4922149 - DNA, 18 bp, Homo sapiens
gctccctgaagccagcct

SEQ ID NO: 4922150 - DNA, 24 bp, Homo sapiens
gctccctgaagccagccttcttcc

SEQ ID NO: 4922151 - DNA, 13 bp, Homo sapiens
gctccctgcccca

SEQ ID NO: 4922152 - DNA, 14 bp, Homo sapiens
gctccctgccccaa

SEQ ID NO: 4922153 - DNA, 21 bp, Homo sapiens
gctccctgtgtccacctgtgg

SEQ ID NO: 4922154 - DNA, 20 bp, Homo sapiens
gctcccttcagcccccagcc

SEQ ID NO: 4922155 - DNA, 14 bp, Homo sapiens
gctccgctgctcct

SEQ ID NO: 4922156 - DNA, 19 bp, Homo sapiens
gctccgctgctccttggct

SEQ ID NO: 4922157 - DNA, 21 bp, Homo sapiens
gctccgctttctacccagcga

SEQ ID NO: 4922158 - DNA, 22 bp, Homo sapiens
gctccgctttctacccagcgag

SEQ ID NO: 4922159 - DNA, 15 bp, Homo sapiens
gctcctaagcttcaa

SEQ ID NO: 4922160 - DNA, 14 bp, Homo sapiens
gctcctcacatagc

SEQ ID NO: 4922161 - DNA, 12 bp, Homo sapiens
gctcctcccagc

SEQ ID NO: 4922162 - DNA, 13 bp, Homo sapiens
gctcctcccagct

SEQ ID NO: 4922163 - DNA, 14 bp, Homo sapiens
gctcctcccggtgc

SEQ ID NO: 4922164 - DNA, 16 bp, Homo sapiens
gctcctctcctggagg

SEQ ID NO: 4922165 - DNA, 17 bp, Homo sapiens
gctcctctcctggagga

SEQ ID NO: 4922166 - DNA, 14 bp, Homo sapiens
gctcctgcagcatg

SEQ ID NO: 4922167 - DNA, 15 bp, Homo sapiens
gctcctgcagcatgg

SEQ ID NO: 4922168 - DNA, 21 bp, Homo sapiens
gctcctgcagcatggtccctg

SEQ ID NO: 4922169 - DNA, 18 bp, Homo sapiens
gccacggccaggccagag

SEQ ID NO: 4922170 - DNA, 23 bp, Homo sapiens
gccactaattttagtattcattc

SEQ ID NO: 4922171 - DNA, 16 bp, Homo sapiens
gccactagtaagtaat

SEQ ID NO: 4922172 - DNA, 20 bp, Homo sapiens
gccactccagacccctggct

SEQ ID NO: 4922173 - DNA, 15 bp, Homo sapiens
gccactcctgaaccc

SEQ ID NO: 4922174 - DNA, 18 bp, Homo sapiens
gccactcgcttcccccat

SEQ ID NO: 4922175 - DNA, 19 bp, Homo sapiens
gccactgcaccgggccaca

SEQ ID NO: 4922176 - DNA, 22 bp, Homo sapiens
gccactgcaccgggccacagag

SEQ ID NO: 4922177 - DNA, 23 bp, Homo sapiens
gccactgcaccgggccacagaga

SEQ ID NO: 4922178 - DNA, 21 bp, Homo sapiens
gccactgcactatagcctagg

SEQ ID NO: 4922179 - DNA, 15 bp, Homo sapiens
gccacttgaaatgtt

SEQ ID NO: 4922180 - DNA, 22 bp, Homo sapiens
gccacttgaacaaaatctgttg

SEQ ID NO: 4922181 - DNA, 21 bp, Homo sapiens
gccacttgatgacccccaacc

SEQ ID NO: 4922182 - DNA, 22 bp, Homo sapiens
gccactttaagagagaaatctg

SEQ ID NO: 4922183 - DNA, 21 bp, Homo sapiens
gccactttgcacgacgccctc

SEQ ID NO: 4922184 - DNA, 23 bp, Homo sapiens
gccactttgcacgacgccctctc

SEQ ID NO: 4922185 - DNA, 20 bp, Homo sapiens
gccagaatcagcacagataa

SEQ ID NO: 4922186 - DNA, 23 bp, Homo sapiens
gccagaccaacgttactcagggc

SEQ ID NO: 4922187 - DNA, 15 bp, Homo sapiens
gccagagctgggagg

SEQ ID NO: 4922188 - DNA, 18 bp, Homo sapiens
gccagaggaactgtccag

SEQ ID NO: 4922189 - DNA, 22 bp, Homo sapiens
gccagaggaactgtccagagag

SEQ ID NO: 4922190 - DNA, 20 bp, Homo sapiens
gcccaggccggccagcctca

SEQ ID NO: 4922191 - DNA, 16 bp, Homo sapiens
gcccaggctggcgtgc

SEQ ID NO: 4922192 - DNA, 19 bp, Homo sapiens
gcccaggctggcgtgcagt

SEQ ID NO: 4922193 - DNA, 16 bp, Homo sapiens
gcccaggctggtttcg

SEQ ID NO: 4922194 - DNA, 18 bp, Homo sapiens
gcccagtcctctcccaag

SEQ ID NO: 4922195 - DNA, 13 bp, Homo sapiens
gcccatctcggag

SEQ ID NO: 4922196 - DNA, 14 bp, Homo sapiens
gcccatctcggagc

SEQ ID NO: 4922197 - DNA, 23 bp, Homo sapiens
gcccatctcggagcatcccggag

SEQ ID NO: 4922198 - DNA, 17 bp, Homo sapiens
gcccatgcactggggac

SEQ ID NO: 4922199 - DNA, 20 bp, Homo sapiens
gcccatgggagctggttaga

SEQ ID NO: 4922200 - DNA, 19 bp, Homo sapiens
gcccatgttctgcccccag

SEQ ID NO: 4922201 - DNA, 22 bp, Homo sapiens
gccccaaataacttcagtcctg

SEQ ID NO: 4922202 - DNA, 19 bp, Homo sapiens
gccccaatccctttattac

SEQ ID NO: 4922203 - DNA, 14 bp, Homo sapiens
gccccactgccagc

SEQ ID NO: 4922204 - DNA, 16 bp, Homo sapiens
gccccactgccagcag

SEQ ID NO: 4922205 - DNA, 17 bp, Homo sapiens
gccccactgccagcagc

SEQ ID NO: 4922206 - DNA, 20 bp, Homo sapiens
gccccactgccagcagcagc

SEQ ID NO: 4922207 - DNA, 23 bp, Homo sapiens
gccccactgccagcagcagcagg

SEQ ID NO: 4922208 - DNA, 14 bp, Homo sapiens
gccccagagctgtt

SEQ ID NO: 4922209 - DNA, 22 bp, Homo sapiens
gccccagagctgtttatggcct

SEQ ID NO: 4922210 - DNA, 23 bp, Homo sapiens
gccccagagctgtttatggcctc

SEQ ID NO: 4922211 - DNA, 13 bp, Homo sapiens
gccccagggcacc

SEQ ID NO: 4922212 - DNA, 21 bp, Homo sapiens
gccccagggtcttccctacct

SEQ ID NO: 4922213 - DNA, 16 bp, Homo sapiens
gccccagggtgcccag

SEQ ID NO: 4922214 - DNA, 12 bp, Homo sapiens
gccccagtgccc

SEQ ID NO: 4922215 - DNA, 21 bp, Homo sapiens
gccccataattttttttttcc

SEQ ID NO: 4922216 - DNA, 14 bp, Homo sapiens
gccccatgcctgtc

SEQ ID NO: 4922217 - DNA, 16 bp, Homo sapiens
gccccatgcctgtcca

SEQ ID NO: 4922218 - DNA, 15 bp, Homo sapiens
gccccattctgcctg

SEQ ID NO: 4922219 - DNA, 18 bp, Homo sapiens
gccccattctgcctgccc

SEQ ID NO: 4922220 - DNA, 22 bp, Homo sapiens
gccccattctgcctgcccaggc

SEQ ID NO: 4922221 - DNA, 12 bp, Homo sapiens
gcccccagccta

SEQ ID NO: 4922222 - DNA, 15 bp, Homo sapiens
gccccccagctcagg

SEQ ID NO: 4922223 - DNA, 14 bp, Homo sapiens
gcccccggccccct

SEQ ID NO: 4922224 - DNA, 16 bp, Homo sapiens
gccccctcctctagct

SEQ ID NO: 4922225 - DNA, 22 bp, Homo sapiens
gccccctcctgaaccgcacagc

SEQ ID NO: 4922226 - DNA, 15 bp, Homo sapiens
gccccctgctggctc

SEQ ID NO: 4922227 - DNA, 14 bp, Homo sapiens
gccccctggtctct

SEQ ID NO: 4922228 - DNA, 19 bp, Homo sapiens
gccccgcagacctccccag

SEQ ID NO: 4922229 - DNA, 15 bp, Homo sapiens
gccccgccctcttcc

SEQ ID NO: 4922230 - DNA, 21 bp, Homo sapiens
gccccggatcagagcaggacc

SEQ ID NO: 4922231 - DNA, 13 bp, Homo sapiens
gccccggccacct

SEQ ID NO: 4922232 - DNA, 18 bp, Homo sapiens
gccccggccacctctgcg

SEQ ID NO: 4922233 - DNA, 18 bp, Homo sapiens
gcccctagaaacccaagc

SEQ ID NO: 4922234 - DNA, 14 bp, Homo sapiens
gcccctagcccagg

SEQ ID NO: 4922235 - DNA, 19 bp, Homo sapiens
gcccctagcccaggagaga

SEQ ID NO: 4922236 - DNA, 20 bp, Homo sapiens
gcccctagcccaggagagag

SEQ ID NO: 4922237 - DNA, 15 bp, Homo sapiens
gcccctcccccaacc

SEQ ID NO: 4922238 - DNA, 16 bp, Homo sapiens
gcccctcccccatctc

SEQ ID NO: 4922239 - DNA, 13 bp, Homo sapiens
gcccctcccgccc

SEQ ID NO: 4922240 - DNA, 14 bp, Homo sapiens
gcccctcccttcaa

SEQ ID NO: 4922241 - DNA, 15 bp, Homo sapiens
gcccctcccttcaac

SEQ ID NO: 4922242 - DNA, 15 bp, Homo sapiens
gcccctcgcctgtgg

SEQ ID NO: 4922243 - DNA, 14 bp, Homo sapiens
gcccctctttctct

SEQ ID NO: 4922244 - DNA, 17 bp, Homo sapiens
gcccctctttctctttc

SEQ ID NO: 4922245 - DNA, 16 bp, Homo sapiens
gcccctgaacaagaat

SEQ ID NO: 4922246 - DNA, 14 bp, Homo sapiens
gcccctgcatcccc

SEQ ID NO: 4922247 - DNA, 23 bp, Homo sapiens
gcccctgcatccccttggctgtg

SEQ ID NO: 4922248 - DNA, 16 bp, Homo sapiens
gcccctgccaccctgg

SEQ ID NO: 4922249 - DNA, 17 bp, Homo sapiens
gcccctgccaccctggg

SEQ ID NO: 4922250 - DNA, 18 bp, Homo sapiens
gcccctgccacctccctg

SEQ ID NO: 4922251 - DNA, 21 bp, Homo sapiens
gcccctgctggttcagggttg

SEQ ID NO: 4922252 - DNA, 16 bp, Homo sapiens
gcccctggtcctgagg

SEQ ID NO: 4922253 - DNA, 18 bp, Homo sapiens
gcccctgtggagactggg

SEQ ID NO: 4922254 - DNA, 16 bp, Homo sapiens
gccccttctctccctg

SEQ ID NO: 4922255 - DNA, 20 bp, Homo sapiens
gccccttgctctcccctgcc

SEQ ID NO: 4922256 - DNA, 17 bp, Homo sapiens
gcccgacagcctggcac

SEQ ID NO: 4922257 - DNA, 18 bp, Homo sapiens
gcccgagctgtttatgtt

SEQ ID NO: 4922258 - DNA, 13 bp, Homo sapiens
gcccgcacagcag

SEQ ID NO: 4922259 - DNA, 14 bp, Homo sapiens
gcccgcacagcagc

SEQ ID NO: 4922260 - DNA, 18 bp, Homo sapiens
gcccgcacagcagcctgc

SEQ ID NO: 4922261 - DNA, 15 bp, Homo sapiens
gcccggatgctgctt

SEQ ID NO: 4922262 - DNA, 17 bp, Homo sapiens
gcccggcgcccctgcca

SEQ ID NO: 4922263 - DNA, 12 bp, Homo sapiens
gcccggctccag

SEQ ID NO: 4922264 - DNA, 16 bp, Homo sapiens
gcccggctccaggctc

SEQ ID NO: 4922265 - DNA, 17 bp, Homo sapiens
gcccggctccaggctcc

SEQ ID NO: 4922266 - DNA, 18 bp, Homo sapiens
gcccgggaaggtcaccag

SEQ ID NO: 4922267 - DNA, 13 bp, Homo sapiens
gcccgggagccta

SEQ ID NO: 4922268 - DNA, 18 bp, Homo sapiens
gcccgggcgcggccagcc

SEQ ID NO: 4922269 - DNA, 16 bp, Homo sapiens
gcccggtcccacccct

SEQ ID NO: 4922270 - DNA, 13 bp, Homo sapiens
gcccgtctcagtg

SEQ ID NO: 4922271 - DNA, 20 bp, Homo sapiens
gccctacagagctgtggagg

SEQ ID NO: 4922272 - DNA, 14 bp, Homo sapiens
gccctactattcag

SEQ ID NO: 4922273 - DNA, 14 bp, Homo sapiens
gccctagagcctgc

SEQ ID NO: 4922274 - DNA, 19 bp, Homo sapiens
gccctagagcctgcctgga

SEQ ID NO: 4922275 - DNA, 15 bp, Homo sapiens
gccctatttttgcaa

SEQ ID NO: 4922276 - DNA, 21 bp, Homo sapiens
gccctcatctatgaggaaagg

SEQ ID NO: 4922277 - DNA, 16 bp, Homo sapiens
gccctcatggcccctc

SEQ ID NO: 4922278 - DNA, 22 bp, Homo sapiens
gccctcatggcccctctgacct

SEQ ID NO: 4922279 - DNA, 18 bp, Homo sapiens
gccctcattactgggcct

SEQ ID NO: 4922280 - DNA, 19 bp, Homo sapiens
gccctcattactgggcctt

SEQ ID NO: 4922281 - DNA, 21 bp, Homo sapiens
gccctcattactgggccttag

SEQ ID NO: 4922282 - DNA, 17 bp, Homo sapiens
gccctccccatcccatg

SEQ ID NO: 4922283 - DNA, 12 bp, Homo sapiens
gccctcccctcc

SEQ ID NO: 4922284 - DNA, 13 bp, Homo sapiens
gccctcccctccc

SEQ ID NO: 4922285 - DNA, 16 bp, Homo sapiens
gccctcccctcccctg

SEQ ID NO: 4922286 - DNA, 19 bp, Homo sapiens
gccctcccctcccctgctg

SEQ ID NO: 4922287 - DNA, 20 bp, Homo sapiens
gccctcccctcccctgctgc

SEQ ID NO: 4922288 - DNA, 18 bp, Homo sapiens
gccctccgcgaaaatagt

SEQ ID NO: 4922289 - DNA, 15 bp, Homo sapiens
gccctccttgtccac

SEQ ID NO: 4922290 - DNA, 19 bp, Homo sapiens
gccctccttgtccacccac

SEQ ID NO: 4922291 - DNA, 20 bp, Homo sapiens
gccctcctttctgtgcccta

SEQ ID NO: 4922292 - DNA, 23 bp, Homo sapiens
gccctcgacactcaccatgaagc

SEQ ID NO: 4922293 - DNA, 15 bp, Homo sapiens
gccctcgctgcttct

SEQ ID NO: 4922294 - DNA, 11 bp, Homo sapiens
gccctctcccc

SEQ ID NO: 4922295 - DNA, 12 bp, Homo sapiens
gccctcttcctg

SEQ ID NO: 4922296 - DNA, 20 bp, Homo sapiens
gccctgagaagctgctccag

SEQ ID NO: 4922297 - DNA, 23 bp, Homo sapiens
gccctgcaatgtatcccttctca

SEQ ID NO: 4922298 - DNA, 15 bp, Homo sapiens
gccctgcagccagct

SEQ ID NO: 4922299 - DNA, 13 bp, Homo sapiens
gccctgcagtgtt

SEQ ID NO: 4922300 - DNA, 16 bp, Homo sapiens
gacagtatcccacatc

SEQ ID NO: 4922301 - DNA, 21 bp, Homo sapiens
gacagtatcccacatccaact

SEQ ID NO: 4922302 - DNA, 18 bp, Homo sapiens
gacagtcatcatcagggc

SEQ ID NO: 4922303 - DNA, 19 bp, Homo sapiens
gacagtcatcatcagggcc

SEQ ID NO: 4922304 - DNA, 21 bp, Homo sapiens
gacagtcatcatcagggcctg

SEQ ID NO: 4922305 - DNA, 13 bp, Homo sapiens
gacagtctcactt

SEQ ID NO: 4922306 - DNA, 13 bp, Homo sapiens
gacagtcttgtgc

SEQ ID NO: 4922307 - DNA, 14 bp, Homo sapiens
gacagttcaagaaa

SEQ ID NO: 4922308 - DNA, 15 bp, Homo sapiens
gacagttctgaagaa

SEQ ID NO: 4922309 - DNA, 18 bp, Homo sapiens
gacagtttatcatgaagc

SEQ ID NO: 4922310 - DNA, 20 bp, Homo sapiens
gacagtttatcatgaagcct

SEQ ID NO: 4922311 - DNA, 12 bp, Homo sapiens
gacagtttctta

SEQ ID NO: 4922312 - DNA, 20 bp, Homo sapiens
gacagtttcttagcttttta

SEQ ID NO: 4922313 - DNA, 16 bp, Homo sapiens
gacagtttgtaaatgt

SEQ ID NO: 4922314 - DNA, 18 bp, Homo sapiens
gacataaagccatgtttc

SEQ ID NO: 4922315 - DNA, 23 bp, Homo sapiens
gacataacgtttttcctttaaaa

SEQ ID NO: 4922316 - DNA, 23 bp, Homo sapiens
gacataatatattctatttttat

SEQ ID NO: 4922317 - DNA, 12 bp, Homo sapiens
gacatacgaaac

SEQ ID NO: 4922318 - DNA, 15 bp, Homo sapiens
gacatagaggtatat

SEQ ID NO: 4922319 - DNA, 18 bp, Homo sapiens
gacatagcccatccctgc

SEQ ID NO: 4922320 - DNA, 14 bp, Homo sapiens
gacatcagcaaaca

SEQ ID NO: 4922321 - DNA, 21 bp, Homo sapiens
gacatcctgtataagcactga

SEQ ID NO: 4922322 - DNA, 20 bp, Homo sapiens
gacatctcaggggccagagg

SEQ ID NO: 4922323 - DNA, 22 bp, Homo sapiens
gacatctcaggggccagaggaa

SEQ ID NO: 4922324 - DNA, 15 bp, Homo sapiens
gacatctctgcaccc

SEQ ID NO: 4922325 - DNA, 21 bp, Homo sapiens
gacatctgtttctaaatgttt

SEQ ID NO: 4922326 - DNA, 17 bp, Homo sapiens
gacatgatttccttgaa

SEQ ID NO: 4922327 - DNA, 22 bp, Homo sapiens
gacatgatttccttgaatgtgg

SEQ ID NO: 4922328 - DNA, 13 bp, Homo sapiens
gacatgcactgac

SEQ ID NO: 4922329 - DNA, 15 bp, Homo sapiens
gacatggaggttcta

SEQ ID NO: 4922330 - DNA, 20 bp, Homo sapiens
gacatggaggttctaaggcc

SEQ ID NO: 4922331 - DNA, 20 bp, Homo sapiens
gacatggctttcagaaaacg

SEQ ID NO: 4922332 - DNA, 12 bp, Homo sapiens
gacatgtgaaac

SEQ ID NO: 4922333 - DNA, 15 bp, Homo sapiens
gacatgtgaaacctt

SEQ ID NO: 4922334 - DNA, 23 bp, Homo sapiens
gacatgtgaaaccttttttaaga

SEQ ID NO: 4922335 - DNA, 18 bp, Homo sapiens
gacatgttatatattttt

SEQ ID NO: 4922336 - DNA, 17 bp, Homo sapiens
gacatgttttccgtgaa

SEQ ID NO: 4922337 - DNA, 21 bp, Homo sapiens
gacattatgtgtgcatgtgtg

SEQ ID NO: 4922338 - DNA, 23 bp, Homo sapiens
gacattatgtgtgcatgtgtgta

SEQ ID NO: 4922339 - DNA, 15 bp, Homo sapiens
gacattgcggacagc

SEQ ID NO: 4922340 - DNA, 23 bp, Homo sapiens
gacattgcggacagccacggcca

SEQ ID NO: 4922341 - DNA, 21 bp, Homo sapiens
gacattgcgtttgacctttta

SEQ ID NO: 4922342 - DNA, 19 bp, Homo sapiens
gacatttcttttcttttta

SEQ ID NO: 4922343 - DNA, 15 bp, Homo sapiens
gacattttacattaa

SEQ ID NO: 4922344 - DNA, 16 bp, Homo sapiens
gaggatgagagcccag

SEQ ID NO: 4922345 - DNA, 19 bp, Homo sapiens
gaggatgtccctgggccag

SEQ ID NO: 4922346 - DNA, 12 bp, Homo sapiens
gaggatgttctg

SEQ ID NO: 4922347 - DNA, 22 bp, Homo sapiens
gaggattgcttgagcccaggag

SEQ ID NO: 4922348 - DNA, 15 bp, Homo sapiens
gaggcaagcaagctc

SEQ ID NO: 4922349 - DNA, 21 bp, Homo sapiens
gaggcaatgtcaggaacagaa

SEQ ID NO: 4922350 - DNA, 13 bp, Homo sapiens
gaggcagagagcg

SEQ ID NO: 4922351 - DNA, 13 bp, Homo sapiens
gaggcagccccat

SEQ ID NO: 4922352 - DNA, 21 bp, Homo sapiens
gaggcagccccattctgcctg

SEQ ID NO: 4922353 - DNA, 19 bp, Homo sapiens
gaggcagggcaaatgacat

SEQ ID NO: 4922354 - DNA, 19 bp, Homo sapiens
gaggcatcctacccttttc

SEQ ID NO: 4922355 - DNA, 18 bp, Homo sapiens
gaggcatggccctggggt

SEQ ID NO: 4922356 - DNA, 17 bp, Homo sapiens
gaggccaaaggctggtg

SEQ ID NO: 4922357 - DNA, 18 bp, Homo sapiens
gaggccaaaggctggtgg

SEQ ID NO: 4922358 - DNA, 19 bp, Homo sapiens
gaggccaaaggctggtggc

SEQ ID NO: 4922359 - DNA, 20 bp, Homo sapiens
gaggccagccccacccagga

SEQ ID NO: 4922360 - DNA, 21 bp, Homo sapiens
gaggccagccccacccaggag

SEQ ID NO: 4922361 - DNA, 17 bp, Homo sapiens
gaggccatgggcctcct

SEQ ID NO: 4922362 - DNA, 20 bp, Homo sapiens
gaggccatgggcctcctgtg

SEQ ID NO: 4922363 - DNA, 23 bp, Homo sapiens
gaggccatgggcctcctgtgtgt

SEQ ID NO: 4922364 - DNA, 18 bp, Homo sapiens
gaggccctgcccaatgag

SEQ ID NO: 4922365 - DNA, 16 bp, Homo sapiens
gaggcctgcccgggcg

SEQ ID NO: 4922366 - DNA, 15 bp, Homo sapiens
gaggccttccagctg

SEQ ID NO: 4922367 - DNA, 20 bp, Homo sapiens
gaggccttccagctgctgtc

SEQ ID NO: 4922368 - DNA, 16 bp, Homo sapiens
gaggccttctctgaag

SEQ ID NO: 4922369 - DNA, 15 bp, Homo sapiens
gaggccttgagaggc

SEQ ID NO: 4922370 - DNA, 19 bp, Homo sapiens
gaggctgacgtgtgaggga

SEQ ID NO: 4922371 - DNA, 13 bp, Homo sapiens
gaggctgaggcag

SEQ ID NO: 4922372 - DNA, 16 bp, Homo sapiens
gaggctgaggcaggag

SEQ ID NO: 4922373 - DNA, 17 bp, Homo sapiens
gaggctgaggcaggagg

SEQ ID NO: 4922374 - DNA, 17 bp, Homo sapiens
gaggctgcccccggccc

SEQ ID NO: 4922375 - DNA, 19 bp, Homo sapiens
gaggctgcccccggccccc

SEQ ID NO: 4922376 - DNA, 21 bp, Homo sapiens
gaggctgcccccggccccctg

SEQ ID NO: 4922377 - DNA, 16 bp, Homo sapiens
gaggctttggatttga

SEQ ID NO: 4922378 - DNA, 20 bp, Homo sapiens
gaggctttggatttgacatt

SEQ ID NO: 4922379 - DNA, 15 bp, Homo sapiens
gagggaaagtgcata

SEQ ID NO: 4922380 - DNA, 16 bp, Homo sapiens
gagggaccatgtgtca

SEQ ID NO: 4922381 - DNA, 21 bp, Homo sapiens
gagggaccatgtgtcacttgt

SEQ ID NO: 4922382 - DNA, 12 bp, Homo sapiens
gagggagcagac

SEQ ID NO: 4922383 - DNA, 20 bp, Homo sapiens
gagggagcagacaggaggaa

SEQ ID NO: 4922384 - DNA, 14 bp, Homo sapiens
gagggagtgacaga

SEQ ID NO: 4922385 - DNA, 16 bp, Homo sapiens
gagggagtgacagagg

SEQ ID NO: 4922386 - DNA, 18 bp, Homo sapiens
gagggagtgacagaggca

SEQ ID NO: 4922387 - DNA, 21 bp, Homo sapiens
gagggagtgacagaggcagcc

SEQ ID NO: 4922388 - DNA, 13 bp, Homo sapiens
gagggatgggcct

SEQ ID NO: 4922389 - DNA, 12 bp, Homo sapiens
gagggcactggt

SEQ ID NO: 4922390 - DNA, 16 bp, Homo sapiens
gagggcactggtggcc

SEQ ID NO: 4922391 - DNA, 22 bp, Homo sapiens
gagggcagaaaggttctgcccg

SEQ ID NO: 4922392 - DNA, 18 bp, Homo sapiens
gagggcatccataccagc

SEQ ID NO: 4922393 - DNA, 18 bp, Homo sapiens
gagggcccagagcaggaa

SEQ ID NO: 4922394 - DNA, 15 bp, Homo sapiens
gagggcttgtgaaca

SEQ ID NO: 4922395 - DNA, 15 bp, Homo sapiens
gaggggactctgggc

SEQ ID NO: 4922396 - DNA, 13 bp, Homo sapiens
gaggggcctggca

SEQ ID NO: 4922397 - DNA, 16 bp, Homo sapiens
gaggggcgcccacctc

SEQ ID NO: 4922398 - DNA, 12 bp, Homo sapiens
gaggggctctca

SEQ ID NO: 4922399 - DNA, 14 bp, Homo sapiens
gagggggactgctg

SEQ ID NO: 4922400 - DNA, 19 bp, Homo sapiens
gagggtccccacctgggac

SEQ ID NO: 4922401 - DNA, 15 bp, Homo sapiens
gagggtcctggctcc

SEQ ID NO: 4922402 - DNA, 17 bp, Homo sapiens
gagggtcctggctcctg

SEQ ID NO: 4922403 - DNA, 13 bp, Homo sapiens
gagggttgtgcta

SEQ ID NO: 4922404 - DNA, 17 bp, Homo sapiens
gaggtaacagaacagct

SEQ ID NO: 4922405 - DNA, 21 bp, Homo sapiens
gaggtagaccaggatttctaa

SEQ ID NO: 4922406 - DNA, 19 bp, Homo sapiens
gaggtatttatctttactt

SEQ ID NO: 4922407 - DNA, 19 bp, Homo sapiens
gaggtcaaggctgcagtga

SEQ ID NO: 4922408 - DNA, 14 bp, Homo sapiens
gaggtcaggccctg

SEQ ID NO: 4922409 - DNA, 11 bp, Homo sapiens
gaggtcaggga

SEQ ID NO: 4922410 - DNA, 14 bp, Homo sapiens
gaggtcagggagtg

SEQ ID NO: 4922411 - DNA, 23 bp, Homo sapiens
gaggtcagggagtgctggctcac

SEQ ID NO: 4922412 - DNA, 12 bp, Homo sapiens
gaggtcttgcta

SEQ ID NO: 4922413 - DNA, 16 bp, Homo sapiens
gaggtgaggagcagag

SEQ ID NO: 4922414 - DNA, 12 bp, Homo sapiens
gaggtgcctgga

SEQ ID NO: 4922415 - DNA, 15 bp, Homo sapiens
gaggtgcctgtccca

SEQ ID NO: 4922416 - DNA, 23 bp, Homo sapiens
gaggtggccagagctgggaggca

SEQ ID NO: 4922417 - DNA, 20 bp, Homo sapiens
gaggtggcttttgcggccag

SEQ ID NO: 4922418 - DNA, 23 bp, Homo sapiens
gaggtgggagcaggagattgaga

SEQ ID NO: 4922419 - DNA, 13 bp, Homo sapiens
gaggtgggagggc

SEQ ID NO: 4922420 - DNA, 14 bp, Homo sapiens
gaggtgggagggcc

SEQ ID NO: 4922421 - DNA, 19 bp, Homo sapiens
gaggtggggcgaggcaggc

SEQ ID NO: 4922422 - DNA, 14 bp, Homo sapiens
gaggttctaaggcc

SEQ ID NO: 4922423 - DNA, 17 bp, Homo sapiens
gagtagaaataaaagtg

SEQ ID NO: 4922424 - DNA, 15 bp, Homo sapiens
gagtagacacattta

SEQ ID NO: 4922425 - DNA, 18 bp, Homo sapiens
gagtagatggtgaaattt

SEQ ID NO: 4922426 - DNA, 19 bp, Homo sapiens
gagtcaaaactacaaatca

SEQ ID NO: 4922427 - DNA, 13 bp, Homo sapiens
gagtcaccaagcc

SEQ ID NO: 4922428 - DNA, 17 bp, Homo sapiens
gagtcaccaagcccagt

SEQ ID NO: 4922429 - DNA, 15 bp, Homo sapiens
gagtcaccttccctt

SEQ ID NO: 4922430 - DNA, 22 bp, Homo sapiens
gagtcaccttcccttgccactt

SEQ ID NO: 4922431 - DNA, 14 bp, Homo sapiens
gagtcatttaaatg

SEQ ID NO: 4922432 - DNA, 19 bp, Homo sapiens
gagtccaaggtttaaagag

SEQ ID NO: 4922433 - DNA, 14 bp, Homo sapiens
gagtccaggcacag

SEQ ID NO: 4922434 - DNA, 14 bp, Homo sapiens
gagtcccaaggaaa

SEQ ID NO: 4922435 - DNA, 16 bp, Homo sapiens
gagtcccaaggaaagc

SEQ ID NO: 4922436 - DNA, 18 bp, Homo sapiens
gagtcccaaggaaagccc

SEQ ID NO: 4922437 - DNA, 16 bp, Homo sapiens
gagtcccaccttggct

SEQ ID NO: 4922438 - DNA, 19 bp, Homo sapiens
gagtcccctcacctcctct

SEQ ID NO: 4922439 - DNA, 14 bp, Homo sapiens
gagtcgaggacagg

SEQ ID NO: 4922440 - DNA, 15 bp, Homo sapiens
gagtcgaggacaggg

SEQ ID NO: 4922441 - DNA, 16 bp, Homo sapiens
gagtcgaggacaggga

SEQ ID NO: 4922442 - DNA, 23 bp, Homo sapiens
gagtcgtcatcacttttcagtga

SEQ ID NO: 4922443 - DNA, 12 bp, Homo sapiens
gagtctaaagat

SEQ ID NO: 4922444 - DNA, 21 bp, Homo sapiens
gagtctaaagatggagtttct

SEQ ID NO: 4922445 - DNA, 17 bp, Homo sapiens
gagtctagattcaaagg

SEQ ID NO: 4922446 - DNA, 14 bp, Homo sapiens
gagtctagattctc

SEQ ID NO: 4922447 - DNA, 21 bp, Homo sapiens
gagtctcactgttgcccaggc

SEQ ID NO: 4922448 - DNA, 22 bp, Homo sapiens
gagtctcactgttgcccaggct

SEQ ID NO: 4922449 - DNA, 14 bp, Homo sapiens
gagtctcttctcca

SEQ ID NO: 4922450 - DNA, 14 bp, Homo sapiens
gagtctggagtggg

SEQ ID NO: 4922451 - DNA, 11 bp, Homo sapiens
gagtctgggac

SEQ ID NO: 4922452 - DNA, 20 bp, Homo sapiens
gagtctgttgtgtgtcatgc

SEQ ID NO: 4922453 - DNA, 18 bp, Homo sapiens
gagtctttggttctaagg

SEQ ID NO: 4922454 - DNA, 19 bp, Homo sapiens
gagtgacagtggattgcat

SEQ ID NO: 4922455 - DNA, 15 bp, Homo sapiens
gatcttctgaaatga

SEQ ID NO: 4922456 - DNA, 18 bp, Homo sapiens
gatcttctgaaatgaaac

SEQ ID NO: 4922457 - DNA, 20 bp, Homo sapiens
gatcttctgggagcaggaac

SEQ ID NO: 4922458 - DNA, 18 bp, Homo sapiens
gatctttgcagacaggca

SEQ ID NO: 4922459 - DNA, 14 bp, Homo sapiens
gatgaaaacatagc

SEQ ID NO: 4922460 - DNA, 20 bp, Homo sapiens
gatgaagcaaggaagatata

SEQ ID NO: 4922461 - DNA, 23 bp, Homo sapiens
gatgaagttttacattgttgagc

SEQ ID NO: 4922462 - DNA, 14 bp, Homo sapiens
gatgaatacatttt

SEQ ID NO: 4922463 - DNA, 19 bp, Homo sapiens
gatgaatgaggtcccaggc

SEQ ID NO: 4922464 - DNA, 15 bp, Homo sapiens
gatgactaaaatatt

SEQ ID NO: 4922465 - DNA, 18 bp, Homo sapiens
gatgactcccttaaaata

SEQ ID NO: 4922466 - DNA, 21 bp, Homo sapiens
gatgactcccttaaaatagaa

SEQ ID NO: 4922467 - DNA, 11 bp, Homo sapiens
gatgagaaagg

SEQ ID NO: 4922468 - DNA, 15 bp, Homo sapiens
gatgagaacaaagct

SEQ ID NO: 4922469 - DNA, 22 bp, Homo sapiens
gatgagaatttctaaaaagatt

SEQ ID NO: 4922470 - DNA, 14 bp, Homo sapiens
gatgagagcccaga

SEQ ID NO: 4922471 - DNA, 18 bp, Homo sapiens
gatgagagcccagaggta

SEQ ID NO: 4922472 - DNA, 13 bp, Homo sapiens
gatgagccgctgt

SEQ ID NO: 4922473 - DNA, 23 bp, Homo sapiens
gatgagccgctgtgagcccctgg

SEQ ID NO: 4922474 - DNA, 20 bp, Homo sapiens
gatgataagttcctttcctt

SEQ ID NO: 4922475 - DNA, 23 bp, Homo sapiens
gatgatccatgagtttgccctgg

SEQ ID NO: 4922476 - DNA, 14 bp, Homo sapiens
gatgatctttgcag

SEQ ID NO: 4922477 - DNA, 21 bp, Homo sapiens
gatgatctttgcagacaggca

SEQ ID NO: 4922478 - DNA, 14 bp, Homo sapiens
gatgcaaagaaaat

SEQ ID NO: 4922479 - DNA, 21 bp, Homo sapiens
gatgcaaagtacaatgtgttt

SEQ ID NO: 4922480 - DNA, 17 bp, Homo sapiens
gatgcaaggaccaggac

SEQ ID NO: 4922481 - DNA, 18 bp, Homo sapiens
gatgcaaggaccaggact

SEQ ID NO: 4922482 - DNA, 13 bp, Homo sapiens
gatgcacagagaa

SEQ ID NO: 4922483 - DNA, 21 bp, Homo sapiens
gatgcacagagaagctgggga

SEQ ID NO: 4922484 - DNA, 15 bp, Homo sapiens
gatgcaccagccctt

SEQ ID NO: 4922485 - DNA, 13 bp, Homo sapiens
gatgcagcatttg

SEQ ID NO: 4922486 - DNA, 21 bp, Homo sapiens
gatgcaggcacttattgtaaa

SEQ ID NO: 4922487 - DNA, 19 bp, Homo sapiens
gatgcagtctcctctttaa

SEQ ID NO: 4922488 - DNA, 21 bp, Homo sapiens
gatgcagtctcctctttaaaa

SEQ ID NO: 4922489 - DNA, 23 bp, Homo sapiens
gatgcatgtggtttggttcctct

SEQ ID NO: 4922490 - DNA, 22 bp, Homo sapiens
gatgccaatactagtcacccca

SEQ ID NO: 4922491 - DNA, 17 bp, Homo sapiens
gatgccagggccgacca

SEQ ID NO: 4922492 - DNA, 14 bp, Homo sapiens
gatgcctggtggca

SEQ ID NO: 4922493 - DNA, 16 bp, Homo sapiens
gatgcctggtggcagc

SEQ ID NO: 4922494 - DNA, 20 bp, Homo sapiens
gatgcctggtggcagctgcg

SEQ ID NO: 4922495 - DNA, 18 bp, Homo sapiens
gatgccttttttgtagtt

SEQ ID NO: 4922496 - DNA, 22 bp, Homo sapiens
gatgcgagcgctatcttcacat

SEQ ID NO: 4922497 - DNA, 16 bp, Homo sapiens
gatgctccaagattct

SEQ ID NO: 4922498 - DNA, 13 bp, Homo sapiens
gatgctccctccc

SEQ ID NO: 4922499 - DNA, 15 bp, Homo sapiens
gatgctccctcccct

SEQ ID NO: 4922500 - DNA, 23 bp, Homo sapiens
gatgctccctcccctgccctggt

SEQ ID NO: 4922501 - DNA, 15 bp, Homo sapiens
gatgctcttctgtgg

SEQ ID NO: 4922502 - DNA, 22 bp, Homo sapiens
gatgctgcttccggtagggagg

SEQ ID NO: 4922503 - DNA, 16 bp, Homo sapiens
gatgctggagaagaga

SEQ ID NO: 4922504 - DNA, 21 bp, Homo sapiens
gatgctggagaagagaggaga

SEQ ID NO: 4922505 - DNA, 23 bp, Homo sapiens
gatgctgggcacttcatctgatc

SEQ ID NO: 4922506 - DNA, 15 bp, Homo sapiens
gatggaattcttcct

SEQ ID NO: 4922507 - DNA, 22 bp, Homo sapiens
gatggagactggtcctgtgtgc

SEQ ID NO: 4922508 - DNA, 19 bp, Homo sapiens
gatggagcccaggcgggag

SEQ ID NO: 4922509 - DNA, 19 bp, Homo sapiens
gatggagttcttgtgccat

SEQ ID NO: 4922510 - DNA, 18 bp, Homo sapiens
gatggataacctatatga

SEQ ID NO: 4922511 - DNA, 24 bp, Homo sapiens
gatggctcagagggggactgctgc

SEQ ID NO: 4922512 - DNA, 13 bp, Homo sapiens
gatggctgtgcct

SEQ ID NO: 4922513 - DNA, 17 bp, Homo sapiens
gatggctgtgcctctgc

SEQ ID NO: 4922514 - DNA, 18 bp, Homo sapiens
gatggctgtgcctctgcc

SEQ ID NO: 4922515 - DNA, 20 bp, Homo sapiens
gatggctgtgcctctgcctg

SEQ ID NO: 4922516 - DNA, 20 bp, Homo sapiens
gatgggagctcctctcctgg

SEQ ID NO: 4922517 - DNA, 22 bp, Homo sapiens
gatgggagctcctctcctggag

SEQ ID NO: 4922518 - DNA, 15 bp, Homo sapiens
gatgggcacttgaga

SEQ ID NO: 4922519 - DNA, 14 bp, Homo sapiens
gatgggctttctct

SEQ ID NO: 4922520 - DNA, 23 bp, Homo sapiens
gatggggtctcacagtgttgccc

SEQ ID NO: 4922521 - DNA, 22 bp, Homo sapiens
gatgggtgggtggggtattttt

SEQ ID NO: 4922522 - DNA, 13 bp, Homo sapiens
gatggttcccctg

SEQ ID NO: 4922523 - DNA, 14 bp, Homo sapiens
gatggtttcttgca

SEQ ID NO: 4922524 - DNA, 21 bp, Homo sapiens
gatgtaatctctctgcagctg

SEQ ID NO: 4922525 - DNA, 11 bp, Homo sapiens
gatgtaattga

SEQ ID NO: 4922526 - DNA, 23 bp, Homo sapiens
gatgtaatttagggtactaaatt

SEQ ID NO: 4922527 - DNA, 22 bp, Homo sapiens
gatgtatgaaggcttttggtct

SEQ ID NO: 4922528 - DNA, 16 bp, Homo sapiens
gatgtcatgtgttccc

SEQ ID NO: 4922529 - DNA, 18 bp, Homo sapiens
gatgtcccaacttgtaaa

SEQ ID NO: 4922530 - DNA, 22 bp, Homo sapiens
gatgtccctgggccagggtctg

SEQ ID NO: 4922531 - DNA, 22 bp, Homo sapiens
gatgtcccttgatgcacagaga

SEQ ID NO: 4922532 - DNA, 16 bp, Homo sapiens
gatgtctctaaagcac

SEQ ID NO: 4922533 - DNA, 15 bp, Homo sapiens
gatgtgatattctaa

SEQ ID NO: 4922534 - DNA, 20 bp, Homo sapiens
gatgtgattcaaaagatgcc

SEQ ID NO: 4922535 - DNA, 12 bp, Homo sapiens
gatgtgcaagcg

SEQ ID NO: 4922536 - DNA, 19 bp, Homo sapiens
gatgtgcaagcgacgacag

SEQ ID NO: 4922537 - DNA, 14 bp, Homo sapiens
gatgtgcacccatg

SEQ ID NO: 4922538 - DNA, 18 bp, Homo sapiens
gatgtgtcctcagggagc

SEQ ID NO: 4922539 - DNA, 14 bp, Homo sapiens
gatgttagtgtttt

SEQ ID NO: 4922540 - DNA, 16 bp, Homo sapiens
gatgttctaaggctct

SEQ ID NO: 4922541 - DNA, 18 bp, Homo sapiens
gatgttctaaggctctga

SEQ ID NO: 4922542 - DNA, 14 bp, Homo sapiens
gatgttctgggaca

SEQ ID NO: 4922543 - DNA, 15 bp, Homo sapiens
gatgttgccatgtgt

SEQ ID NO: 4922544 - DNA, 18 bp, Homo sapiens
gatgtttattcttctaga

SEQ ID NO: 4922545 - DNA, 17 bp, Homo sapiens
gatgtttgtggcctcag

SEQ ID NO: 4922546 - DNA, 13 bp, Homo sapiens
gattaagagccat

SEQ ID NO: 4922547 - DNA, 17 bp, Homo sapiens
gattaaggtgatgtgat

SEQ ID NO: 4922548 - DNA, 14 bp, Homo sapiens
gattaatggcactg

SEQ ID NO: 4922549 - DNA, 20 bp, Homo sapiens
gattaatttgcatctgaaat

SEQ ID NO: 4922550 - DNA, 21 bp, Homo sapiens
gattacaagcgtgagccactg

SEQ ID NO: 4922551 - DNA, 13 bp, Homo sapiens
gattacagaggaa

SEQ ID NO: 4922552 - DNA, 14 bp, Homo sapiens
gattacatgcatgt

SEQ ID NO: 4922553 - DNA, 19 bp, Homo sapiens
gattagcaaggtcatttct

SEQ ID NO: 4922554 - DNA, 20 bp, Homo sapiens
gattagcaaggtcatttctt

SEQ ID NO: 4922555 - DNA, 23 bp, Homo sapiens
gattagcaggccaaggtctgagc

SEQ ID NO: 4922556 - DNA, 14 bp, Homo sapiens
gattagctttgtgt

SEQ ID NO: 4922557 - DNA, 20 bp, Homo sapiens
gattataaaattaatcacaa

SEQ ID NO: 4922558 - DNA, 17 bp, Homo sapiens
gattatagattctaaag

SEQ ID NO: 4922559 - DNA, 22 bp, Homo sapiens
gattatagattctaaagattct

SEQ ID NO: 4922560 - DNA, 16 bp, Homo sapiens
gattatttaataacat

SEQ ID NO: 4922561 - DNA, 17 bp, Homo sapiens
gattatttaataacatt

SEQ ID NO: 4922562 - DNA, 23 bp, Homo sapiens
gattatttaataacattacctta

SEQ ID NO: 4922563 - DNA, 18 bp, Homo sapiens
gattatttgggagggaaa

SEQ ID NO: 4922564 - DNA, 13 bp, Homo sapiens
gcactctagattc

SEQ ID NO: 4922565 - DNA, 15 bp, Homo sapiens
gcactctagattcca

SEQ ID NO: 4922566 - DNA, 14 bp, Homo sapiens
gcactgaaaaggtt

SEQ ID NO: 4922567 - DNA, 20 bp, Homo sapiens
gcactgaaaataccatcagg

SEQ ID NO: 4922568 - DNA, 17 bp, Homo sapiens
gcactgaagtgcttagt

SEQ ID NO: 4922569 - DNA, 12 bp, Homo sapiens
gcactgacattg

SEQ ID NO: 4922570 - DNA, 13 bp, Homo sapiens
gcactgccactgg

SEQ ID NO: 4922571 - DNA, 14 bp, Homo sapiens
gcactgccactggg

SEQ ID NO: 4922572 - DNA, 12 bp, Homo sapiens
gcactggcccag

SEQ ID NO: 4922573 - DNA, 15 bp, Homo sapiens
gcactggggagcccg

SEQ ID NO: 4922574 - DNA, 18 bp, Homo sapiens
gcactggggagcccgtct

SEQ ID NO: 4922575 - DNA, 14 bp, Homo sapiens
gcactggtggcccg

SEQ ID NO: 4922576 - DNA, 22 bp, Homo sapiens
gcactggtggcccgacagcctg

SEQ ID NO: 4922577 - DNA, 17 bp, Homo sapiens
gcactgtagttctaaga

SEQ ID NO: 4922578 - DNA, 20 bp, Homo sapiens
gcactgttgcaaactcagtg

SEQ ID NO: 4922579 - DNA, 19 bp, Homo sapiens
gcacttaaggcactctgtt

SEQ ID NO: 4922580 - DNA, 14 bp, Homo sapiens
gcacttattgtaaa

SEQ ID NO: 4922581 - DNA, 16 bp, Homo sapiens
gcacttattgtaaatt

SEQ ID NO: 4922582 - DNA, 17 bp, Homo sapiens
gcacttcagaattccat

SEQ ID NO: 4922583 - DNA, 11 bp, Homo sapiens
gcacttccaaa

SEQ ID NO: 4922584 - DNA, 14 bp, Homo sapiens
gcacttgcagactc

SEQ ID NO: 4922585 - DNA, 15 bp, Homo sapiens
gcacttgcctgggtc

SEQ ID NO: 4922586 - DNA, 12 bp, Homo sapiens
gcacttgtatat

SEQ ID NO: 4922587 - DNA, 21 bp, Homo sapiens
gcacttgtctcattttaatgt

SEQ ID NO: 4922588 - DNA, 17 bp, Homo sapiens
gcacttgtgattattta

SEQ ID NO: 4922589 - DNA, 21 bp, Homo sapiens
gcacttgtgattatttattat

SEQ ID NO: 4922590 - DNA, 23 bp, Homo sapiens
gcactttccacttcttcctttct

SEQ ID NO: 4922591 - DNA, 17 bp, Homo sapiens
gcactttctaatgtttc

SEQ ID NO: 4922592 - DNA, 19 bp, Homo sapiens
gcactttgaaatacctcat

SEQ ID NO: 4922593 - DNA, 18 bp, Homo sapiens
gcagaaaaatgtcattga

SEQ ID NO: 4922594 - DNA, 18 bp, Homo sapiens
gcagaaaggttctgcccg

SEQ ID NO: 4922595 - DNA, 19 bp, Homo sapiens
gcagaaatcctgcaatgaa

SEQ ID NO: 4922596 - DNA, 23 bp, Homo sapiens
gcagaactgccattattttctgt

SEQ ID NO: 4922597 - DNA, 15 bp, Homo sapiens
gcagaagacaccaga

SEQ ID NO: 4922598 - DNA, 20 bp, Homo sapiens
gcagaagacaccagagcaga

SEQ ID NO: 4922599 - DNA, 15 bp, Homo sapiens
gcagaagccctgatg

SEQ ID NO: 4922600 - DNA, 12 bp, Homo sapiens
gcagaaggaaac

SEQ ID NO: 4922601 - DNA, 19 bp, Homo sapiens
gcagaaggattttttaaag

SEQ ID NO: 4922602 - DNA, 18 bp, Homo sapiens
gcagaataatctttgggt

SEQ ID NO: 4922603 - DNA, 17 bp, Homo sapiens
gcagacagaagtctcct

SEQ ID NO: 4922604 - DNA, 19 bp, Homo sapiens
gcagacagcaggcagcgcc

SEQ ID NO: 4922605 - DNA, 17 bp, Homo sapiens
gcagacaggaggaatca

SEQ ID NO: 4922606 - DNA, 12 bp, Homo sapiens
gcagacaggcaa

SEQ ID NO: 4922607 - DNA, 13 bp, Homo sapiens
gcagacaggcaag

SEQ ID NO: 4922608 - DNA, 14 bp, Homo sapiens
gcagacaggcaagc

SEQ ID NO: 4922609 - DNA, 17 bp, Homo sapiens
gcagaccaccccgcctg

SEQ ID NO: 4922610 - DNA, 13 bp, Homo sapiens
gcagacctcccca

SEQ ID NO: 4922611 - DNA, 16 bp, Homo sapiens
gcagacctccccagcc

SEQ ID NO: 4922612 - DNA, 15 bp, Homo sapiens
gcagactacacagga

SEQ ID NO: 4922613 - DNA, 18 bp, Homo sapiens
gcagactctacagaggcc

SEQ ID NO: 4922614 - DNA, 19 bp, Homo sapiens
gcagactctacagaggcca

SEQ ID NO: 4922615 - DNA, 20 bp, Homo sapiens
gcagagaatcatacttagca

SEQ ID NO: 4922616 - DNA, 19 bp, Homo sapiens
gcagagaatgaaagggccc

SEQ ID NO: 4922617 - DNA, 23 bp, Homo sapiens
gcagagaatgaaagggcccagag

SEQ ID NO: 4922618 - DNA, 15 bp, Homo sapiens
gcagagagccatttt

SEQ ID NO: 4922619 - DNA, 21 bp, Homo sapiens
gcagagcacctttgcacagga

SEQ ID NO: 4922620 - DNA, 22 bp, Homo sapiens
gcagagcacctttgcacaggat

SEQ ID NO: 4922621 - DNA, 17 bp, Homo sapiens
gcagagcccccaggaag

SEQ ID NO: 4922622 - DNA, 24 bp, Homo sapiens
gcagagtttgtgtgttgtcttgaa

SEQ ID NO: 4922623 - DNA, 18 bp, Homo sapiens
gcagatgcagagagccat

SEQ ID NO: 4922624 - DNA, 14 bp, Homo sapiens
gcagatgccaccct

SEQ ID NO: 4922625 - DNA, 16 bp, Homo sapiens
gcagattagcaggcca

SEQ ID NO: 4922626 - DNA, 16 bp, Homo sapiens
gcagcaaggccctgct

SEQ ID NO: 4922627 - DNA, 19 bp, Homo sapiens
gcagcaaggccctgctgcc

SEQ ID NO: 4922628 - DNA, 23 bp, Homo sapiens
gcagcaatatattaccagcaaga

SEQ ID NO: 4922629 - DNA, 15 bp, Homo sapiens
gcagcaatttaaatg

SEQ ID NO: 4922630 - DNA, 16 bp, Homo sapiens
gcagcaatttaaatgt

SEQ ID NO: 4922631 - DNA, 12 bp, Homo sapiens
gcagcatcttct

SEQ ID NO: 4922632 - DNA, 11 bp, Homo sapiens
gcagcatttga

SEQ ID NO: 4922633 - DNA, 18 bp, Homo sapiens
gcagcatttgataatgat

SEQ ID NO: 4922634 - DNA, 13 bp, Homo sapiens
gcagccaggctgc

SEQ ID NO: 4922635 - DNA, 14 bp, Homo sapiens
gcagccaggctgcc

SEQ ID NO: 4922636 - DNA, 17 bp, Homo sapiens
gcagccaggctgccaag

SEQ ID NO: 4922637 - DNA, 14 bp, Homo sapiens
gcagcccagagact

SEQ ID NO: 4922638 - DNA, 13 bp, Homo sapiens
gcagcccatgccc

SEQ ID NO: 4922639 - DNA, 17 bp, Homo sapiens
gcagcccatgcccacct

SEQ ID NO: 4922640 - DNA, 13 bp, Homo sapiens
gcagccctagagc

SEQ ID NO: 4922641 - DNA, 17 bp, Homo sapiens
gcagccctagagcctgc

SEQ ID NO: 4922642 - DNA, 19 bp, Homo sapiens
gcagccctagagcctgcct

SEQ ID NO: 4922643 - DNA, 13 bp, Homo sapiens
gcagccctgcttt

SEQ ID NO: 4922644 - DNA, 16 bp, Homo sapiens
gcagccgccttccttg

SEQ ID NO: 4922645 - DNA, 18 bp, Homo sapiens
gcagccgccttccttgac

SEQ ID NO: 4922646 - DNA, 14 bp, Homo sapiens
gcagccgtgccttc

SEQ ID NO: 4922647 - DNA, 15 bp, Homo sapiens
gcagccgtgccttca

SEQ ID NO: 4922648 - DNA, 21 bp, Homo sapiens
gcagcctcaacctcctgggct

SEQ ID NO: 4922649 - DNA, 16 bp, Homo sapiens
gcagcctgtggcatct

SEQ ID NO: 4922650 - DNA, 15 bp, Homo sapiens
gcagccttggcaaac

SEQ ID NO: 4922651 - DNA, 18 bp, Homo sapiens
gcagcctttgcctccccg

SEQ ID NO: 4922652 - DNA, 14 bp, Homo sapiens
gcagcgaccgcccc

SEQ ID NO: 4922653 - DNA, 21 bp, Homo sapiens
gcagcgagggcggagccggcc

SEQ ID NO: 4922654 - DNA, 23 bp, Homo sapiens
gcagctcatagagtcccccctcc

SEQ ID NO: 4922655 - DNA, 15 bp, Homo sapiens
gcagctgcgcgggct

SEQ ID NO: 4922656 - DNA, 17 bp, Homo sapiens
gcagctgcggtccaccc

SEQ ID NO: 4922657 - DNA, 22 bp, Homo sapiens
gcagctgcggtccacccaggag

SEQ ID NO: 4922658 - DNA, 13 bp, Homo sapiens
gcagctgcttttg

SEQ ID NO: 4922659 - DNA, 14 bp, Homo sapiens
gcagctggacagag

SEQ ID NO: 4922660 - DNA, 15 bp, Homo sapiens
gcagctggacagagg

SEQ ID NO: 4922661 - DNA, 23 bp, Homo sapiens
gcagctggacagaggggactctg

SEQ ID NO: 4922662 - DNA, 22 bp, Homo sapiens
gcagctggactctgcatcccag

SEQ ID NO: 4922663 - DNA, 14 bp, Homo sapiens
gcagcttcaccaga

SEQ ID NO: 4922664 - DNA, 13 bp, Homo sapiens
gcagcttcctgtc

SEQ ID NO: 4922665 - DNA, 14 bp, Homo sapiens
gcagcttcctgtca

SEQ ID NO: 4922666 - DNA, 22 bp, Homo sapiens
gcagcttgggagagcccctggg

SEQ ID NO: 4922667 - DNA, 22 bp, Homo sapiens
gcagctttaaactcagggacag

SEQ ID NO: 4922668 - DNA, 15 bp, Homo sapiens
gcagctttctagaag

SEQ ID NO: 4922669 - DNA, 17 bp, Homo sapiens
gcaggaacaatgactac

SEQ ID NO: 4922670 - DNA, 17 bp, Homo sapiens
gcaggaaggagagcctg

SEQ ID NO: 4922671 - DNA, 15 bp, Homo sapiens
gcaggaaggcctggg

SEQ ID NO: 4922672 - DNA, 17 bp, Homo sapiens
gcaggaaggcctgggtg

SEQ ID NO: 4922673 - DNA, 16 bp, Homo sapiens
gcaggacctcccttcc

SEQ ID NO: 4922674 - DNA, 18 bp, Homo sapiens
gcaggacctcccttccga

SEQ ID NO: 4922675 - DNA, 21 bp, Homo sapiens
gaaggacattgcggacagcca

SEQ ID NO: 4922676 - DNA, 12 bp, Homo sapiens
gaaggagagaaa

SEQ ID NO: 4922677 - DNA, 20 bp, Homo sapiens
gaaggagagaaagtgggtga

SEQ ID NO: 4922678 - DNA, 16 bp, Homo sapiens
gaaggagagcctgctg

SEQ ID NO: 4922679 - DNA, 13 bp, Homo sapiens
gaaggcagacagc

SEQ ID NO: 4922680 - DNA, 15 bp, Homo sapiens
gaaggcagacagcag

SEQ ID NO: 4922681 - DNA, 16 bp, Homo sapiens
gaaggcagacagcagg

SEQ ID NO: 4922682 - DNA, 19 bp, Homo sapiens
gaaggcagacagcaggcag

SEQ ID NO: 4922683 - DNA, 21 bp, Homo sapiens
gaaggcagacagcaggcagcg

SEQ ID NO: 4922684 - DNA, 20 bp, Homo sapiens
gaaggcctgacttctgctgg

SEQ ID NO: 4922685 - DNA, 13 bp, Homo sapiens
gaaggctgccaac

SEQ ID NO: 4922686 - DNA, 22 bp, Homo sapiens
gaagggcaggaaggagagcctg

SEQ ID NO: 4922687 - DNA, 14 bp, Homo sapiens
gaagggccagtcct

SEQ ID NO: 4922688 - DNA, 16 bp, Homo sapiens
gaagggccagtcctgc

SEQ ID NO: 4922689 - DNA, 20 bp, Homo sapiens
gaagggccagtcctgcctgg

SEQ ID NO: 4922690 - DNA, 20 bp, Homo sapiens
gaagggggggctacattata

SEQ ID NO: 4922691 - DNA, 15 bp, Homo sapiens
gaagggtttgtggct

SEQ ID NO: 4922692 - DNA, 15 bp, Homo sapiens
gaaggtctcattctt

SEQ ID NO: 4922693 - DNA, 15 bp, Homo sapiens
gaaggtgacagcagt

SEQ ID NO: 4922694 - DNA, 21 bp, Homo sapiens
gaaggtgctggaggtgggagc

SEQ ID NO: 4922695 - DNA, 19 bp, Homo sapiens
gaaggttcatgtagagaaa

SEQ ID NO: 4922696 - DNA, 19 bp, Homo sapiens
gaagtaaagccattaaatg

SEQ ID NO: 4922697 - DNA, 15 bp, Homo sapiens
gaagtagttctgttt

SEQ ID NO: 4922698 - DNA, 18 bp, Homo sapiens
gaagtcccttgccatcct

SEQ ID NO: 4922699 - DNA, 12 bp, Homo sapiens
gaagtcttgtat

SEQ ID NO: 4922700 - DNA, 14 bp, Homo sapiens
gaagtgaacatttc

SEQ ID NO: 4922701 - DNA, 16 bp, Homo sapiens
gaagtgagcacagcct

SEQ ID NO: 4922702 - DNA, 16 bp, Homo sapiens
gaagtgcatttctgaa

SEQ ID NO: 4922703 - DNA, 16 bp, Homo sapiens
gaagtgcgtgaatgta

SEQ ID NO: 4922704 - DNA, 22 bp, Homo sapiens
gaagttcatacctaagtactgt

SEQ ID NO: 4922705 - DNA, 23 bp, Homo sapiens
gaagttgacttatagtacatgat

SEQ ID NO: 4922706 - DNA, 20 bp, Homo sapiens
gaagttgcattcctttgtct

SEQ ID NO: 4922707 - DNA, 20 bp, Homo sapiens
gaagttgtgccttttatagc

SEQ ID NO: 4922708 - DNA, 13 bp, Homo sapiens
gaagtttaaaaca

SEQ ID NO: 4922709 - DNA, 21 bp, Homo sapiens
gaagtttaaaacagtatttat

SEQ ID NO: 4922710 - DNA, 14 bp, Homo sapiens
gaagtttacatttt

SEQ ID NO: 4922711 - DNA, 16 bp, Homo sapiens
gaagtttgtccatttg

SEQ ID NO: 4922712 - DNA, 13 bp, Homo sapiens
gaagttttacatt

SEQ ID NO: 4922713 - DNA, 13 bp, Homo sapiens
gaagttttctgta

SEQ ID NO: 4922714 - DNA, 12 bp, Homo sapiens
gaataaaagtgc

SEQ ID NO: 4922715 - DNA, 14 bp, Homo sapiens
gaataaaatcctaa

SEQ ID NO: 4922716 - DNA, 23 bp, Homo sapiens
gaataaaatcctaagacacaaat

SEQ ID NO: 4922717 - DNA, 11 bp, Homo sapiens
gaataaacttc

SEQ ID NO: 4922718 - DNA, 15 bp, Homo sapiens
gaataaacttcagca

SEQ ID NO: 4922719 - DNA, 23 bp, Homo sapiens
gaataagaaaacaatcacactca

SEQ ID NO: 4922720 - DNA, 23 bp, Homo sapiens
gaatagaaataaaggatgtgatt

SEQ ID NO: 4922721 - DNA, 23 bp, Homo sapiens
gaatataggtctcttctcccaga

SEQ ID NO: 4922722 - DNA, 15 bp, Homo sapiens
gaatatatatatata

SEQ ID NO: 4922723 - DNA, 17 bp, Homo sapiens
gaatatatttatttaaa

SEQ ID NO: 4922724 - DNA, 17 bp, Homo sapiens
cctagcccaccctgctg

SEQ ID NO: 4922725 - DNA, 23 bp, Homo sapiens
cctagcccagcgctctgcctcac

SEQ ID NO: 4922726 - DNA, 15 bp, Homo sapiens
cctagcccaggagag

SEQ ID NO: 4922727 - DNA, 17 bp, Homo sapiens
cctagcccaggagagag

SEQ ID NO: 4922728 - DNA, 18 bp, Homo sapiens
cctagcccaggagagaga

SEQ ID NO: 4922729 - DNA, 20 bp, Homo sapiens
cctagcccaggagagagaaa

SEQ ID NO: 4922730 - DNA, 22 bp, Homo sapiens
cctagccttagaagtcacacag

SEQ ID NO: 4922731 - DNA, 21 bp, Homo sapiens
cctaggagtatatttccgcac

SEQ ID NO: 4922732 - DNA, 11 bp, Homo sapiens
cctaggattct

SEQ ID NO: 4922733 - DNA, 14 bp, Homo sapiens
cctaggctcatgga

SEQ ID NO: 4922734 - DNA, 18 bp, Homo sapiens
cctaggctccaccccatc

SEQ ID NO: 4922735 - DNA, 19 bp, Homo sapiens
cctaggttcccggtcccga

SEQ ID NO: 4922736 - DNA, 21 bp, Homo sapiens
cctaggttccctgttcttcct

SEQ ID NO: 4922737 - DNA, 20 bp, Homo sapiens
cctagttccctctgctcagc

SEQ ID NO: 4922738 - DNA, 21 bp, Homo sapiens
cctagttccctctgctcagcc

SEQ ID NO: 4922739 - DNA, 14 bp, Homo sapiens
cctagtttcctctc

SEQ ID NO: 4922740 - DNA, 17 bp, Homo sapiens
cctataacttgatgcat

SEQ ID NO: 4922741 - DNA, 15 bp, Homo sapiens
cctataatgtgtgta

SEQ ID NO: 4922742 - DNA, 19 bp, Homo sapiens
cctataatgtgtgtatgtg

SEQ ID NO: 4922743 - DNA, 13 bp, Homo sapiens
cctatcccacctc

SEQ ID NO: 4922744 - DNA, 15 bp, Homo sapiens
cctatcctcactgcc

SEQ ID NO: 4922745 - DNA, 13 bp, Homo sapiens
cctatccttggca

SEQ ID NO: 4922746 - DNA, 19 bp, Homo sapiens
cctatccttggcaccaaag

SEQ ID NO: 4922747 - DNA, 20 bp, Homo sapiens
cctatgagcatcctgagccc

SEQ ID NO: 4922748 - DNA, 22 bp, Homo sapiens
cctatgagcatcctgagccccg

SEQ ID NO: 4922749 - DNA, 20 bp, Homo sapiens
cctatgcacatatggactct

SEQ ID NO: 4922750 - DNA, 21 bp, Homo sapiens
cctatgcacatatggactctg

SEQ ID NO: 4922751 - DNA, 23 bp, Homo sapiens
cctatggcagaaaaaatgtctgt

SEQ ID NO: 4922752 - DNA, 18 bp, Homo sapiens
cctatttccattcaacaa

SEQ ID NO: 4922753 - DNA, 15 bp, Homo sapiens
cctcaaatcgtccag

SEQ ID NO: 4922754 - DNA, 12 bp, Homo sapiens
cctcaacctcct

SEQ ID NO: 4922755 - DNA, 16 bp, Homo sapiens
cctcaacctcctgtgg

SEQ ID NO: 4922756 - DNA, 12 bp, Homo sapiens
cctcaacctctt

SEQ ID NO: 4922757 - DNA, 20 bp, Homo sapiens
cctcaacctcttctggctca

SEQ ID NO: 4922758 - DNA, 20 bp, Homo sapiens
cctcaaggttttaggttcta

SEQ ID NO: 4922759 - DNA, 16 bp, Homo sapiens
cctcaagtaaactccc

SEQ ID NO: 4922760 - DNA, 15 bp, Homo sapiens
cctcacagcctctga

SEQ ID NO: 4922761 - DNA, 16 bp, Homo sapiens
cctcacagcctctgac

SEQ ID NO: 4922762 - DNA, 20 bp, Homo sapiens
cctcacagcctctgacccct

SEQ ID NO: 4922763 - DNA, 19 bp, Homo sapiens
cctcacagtgacccttccc

SEQ ID NO: 4922764 - DNA, 24 bp, Homo sapiens
cctcacagtgacccttcccaatca

SEQ ID NO: 4922765 - DNA, 17 bp, Homo sapiens
cctcacccccagctttg

SEQ ID NO: 4922766 - DNA, 19 bp, Homo sapiens
cctcaccccgttacagctc

SEQ ID NO: 4922767 - DNA, 19 bp, Homo sapiens
cctcacccctgtcctcact

SEQ ID NO: 4922768 - DNA, 20 bp, Homo sapiens
cctcacccctgtcctcactg

SEQ ID NO: 4922769 - DNA, 15 bp, Homo sapiens
cctcaccgcttccct

SEQ ID NO: 4922770 - DNA, 13 bp, Homo sapiens
cctcacctcctct

SEQ ID NO: 4922771 - DNA, 14 bp, Homo sapiens
cctcacctcctcta

SEQ ID NO: 4922772 - DNA, 14 bp, Homo sapiens
cctcacctctaccc

SEQ ID NO: 4922773 - DNA, 16 bp, Homo sapiens
cctcacctctacccaa

SEQ ID NO: 4922774 - DNA, 12 bp, Homo sapiens
cctcacctctgg

SEQ ID NO: 4922775 - DNA, 13 bp, Homo sapiens
cctcacgctgggt

SEQ ID NO: 4922776 - DNA, 12 bp, Homo sapiens
cctcactctgcc

SEQ ID NO: 4922777 - DNA, 13 bp, Homo sapiens
cctcactctgcca

SEQ ID NO: 4922778 - DNA, 14 bp, Homo sapiens
cctcactctgccag

SEQ ID NO: 4922779 - DNA, 23 bp, Homo sapiens
cctcactctttatagtgcacaaa

SEQ ID NO: 4922780 - DNA, 14 bp, Homo sapiens
cctcactgcccgca

SEQ ID NO: 4922781 - DNA, 15 bp, Homo sapiens
cctcactgcccgcac

SEQ ID NO: 4922782 - DNA, 16 bp, Homo sapiens
cctcactgctccctga

SEQ ID NO: 4922783 - DNA, 19 bp, Homo sapiens
cctcactgctccctgaagc

SEQ ID NO: 4922784 - DNA, 15 bp, Homo sapiens
cctcactggccatcc

SEQ ID NO: 4922785 - DNA, 23 bp, Homo sapiens
cctcagacgagacccaagggcag

SEQ ID NO: 4922786 - DNA, 17 bp, Homo sapiens
cctcagatgtcccttga

SEQ ID NO: 4922787 - DNA, 14 bp, Homo sapiens
cctcagcaagccct

SEQ ID NO: 4922788 - DNA, 11 bp, Homo sapiens
cctcagcctcc

SEQ ID NO: 4922789 - DNA, 23 bp, Homo sapiens
cctcagcctcccaaagtgctggg

SEQ ID NO: 4922790 - DNA, 13 bp, Homo sapiens
cctcagctaccca

SEQ ID NO: 4922791 - DNA, 15 bp, Homo sapiens
cctcagctgcctcac

SEQ ID NO: 4922792 - DNA, 18 bp, Homo sapiens
cctcagctgcctcacttc

SEQ ID NO: 4922793 - DNA, 13 bp, Homo sapiens
cctcaggactgca

SEQ ID NO: 4922794 - DNA, 18 bp, Homo sapiens
cctcaggactgcaacagg

SEQ ID NO: 4922795 - DNA, 16 bp, Homo sapiens
cctcaggcactagcct

SEQ ID NO: 4922796 - DNA, 17 bp, Homo sapiens
cctcaggcactagcctt

SEQ ID NO: 4922797 - DNA, 18 bp, Homo sapiens
cctcaggcactagccttt

SEQ ID NO: 4922798 - DNA, 13 bp, Homo sapiens
cctcaggcagctc

SEQ ID NO: 4922799 - DNA, 19 bp, Homo sapiens
cctcaggcaggaagggcag

SEQ ID NO: 4922800 - DNA, 22 bp, Homo sapiens
cctcaggtgatccacccacctc

SEQ ID NO: 4922801 - DNA, 15 bp, Homo sapiens
cctcagtatatttaa

SEQ ID NO: 4922802 - DNA, 19 bp, Homo sapiens
cctcagtatatttaaactc

SEQ ID NO: 4922803 - DNA, 12 bp, Homo sapiens
cctcagtcctcc

SEQ ID NO: 4922804 - DNA, 19 bp, Homo sapiens
cctcagtcctcccctcaca

SEQ ID NO: 4922805 - DNA, 16 bp, Homo sapiens
cctcagttcccttggc

SEQ ID NO: 4922806 - DNA, 21 bp, Homo sapiens
cctcagttcccttggcctcag

SEQ ID NO: 4922807 - DNA, 20 bp, Homo sapiens
cctcatagtatggtggctgg

SEQ ID NO: 4922808 - DNA, 13 bp, Homo sapiens
cctcatatttaaa

SEQ ID NO: 4922809 - DNA, 21 bp, Homo sapiens
cctcatcttgaagggcccagg

SEQ ID NO: 4922810 - DNA, 17 bp, Homo sapiens
cctcatgtttatgaaaa

SEQ ID NO: 4922811 - DNA, 16 bp, Homo sapiens
cctccaaaggccccct

SEQ ID NO: 4922812 - DNA, 23 bp, Homo sapiens
cctccaacacaaggctccaagac

SEQ ID NO: 4922813 - DNA, 22 bp, Homo sapiens
cctccaagctccatctccactc

SEQ ID NO: 4922814 - DNA, 22 bp, Homo sapiens
cctccaatcccaccaaccctca

SEQ ID NO: 4922815 - DNA, 23 bp, Homo sapiens
cctccaatcccaccaaccctcag

SEQ ID NO: 4922816 - DNA, 21 bp, Homo sapiens
cctccacagcgagggcagctg

SEQ ID NO: 4922817 - DNA, 19 bp, Homo sapiens
cctccacctaccactcaca

SEQ ID NO: 4922818 - DNA, 23 bp, Homo sapiens
cctccacctcttcaccccccact

SEQ ID NO: 4922819 - DNA, 13 bp, Homo sapiens
cctccactgtcac

SEQ ID NO: 4922820 - DNA, 21 bp, Homo sapiens
cctccagaactcactggggcc

SEQ ID NO: 4922821 - DNA, 19 bp, Homo sapiens
cctccagaagcctctggct

SEQ ID NO: 4922822 - DNA, 14 bp, Homo sapiens
cctccagcccggga

SEQ ID NO: 4922823 - DNA, 19 bp, Homo sapiens
cctccagcccgggagccta

SEQ ID NO: 4922824 - DNA, 22 bp, Homo sapiens
cctccagcccgggagcctagga

SEQ ID NO: 4922825 - DNA, 19 bp, Homo sapiens
cctccagctgcaccagagc

SEQ ID NO: 4922826 - DNA, 15 bp, Homo sapiens
gaaaagattcttctg

SEQ ID NO: 4922827 - DNA, 23 bp, Homo sapiens
gaaaagattcttctgtgtttata

SEQ ID NO: 4922828 - DNA, 14 bp, Homo sapiens
gaaaagatttaagc

SEQ ID NO: 4922829 - DNA, 19 bp, Homo sapiens
gaaaagcatacatgcaaaa

SEQ ID NO: 4922830 - DNA, 20 bp, Homo sapiens
gaaaagctattagccaggat

SEQ ID NO: 4922831 - DNA, 16 bp, Homo sapiens
gaaaagcttcttaatt

SEQ ID NO: 4922832 - DNA, 23 bp, Homo sapiens
gaaaagcttcttaattaatttga

SEQ ID NO: 4922833 - DNA, 18 bp, Homo sapiens
gaaaaggaaaagaaaaaa

SEQ ID NO: 4922834 - DNA, 23 bp, Homo sapiens
gaaaagtagacaatcattgtttt

SEQ ID NO: 4922835 - DNA, 18 bp, Homo sapiens
gaaaagtcacttactatt

SEQ ID NO: 4922836 - DNA, 20 bp, Homo sapiens
gaaaatctaatattaaaaat

SEQ ID NO: 4922837 - DNA, 21 bp, Homo sapiens
gaaaatctaatattaaaaata

SEQ ID NO: 4922838 - DNA, 23 bp, Homo sapiens
gaaaatctaatattaaaaatatg

SEQ ID NO: 4922839 - DNA, 22 bp, Homo sapiens
gaaaatgaatatctattaatat

SEQ ID NO: 4922840 - DNA, 12 bp, Homo sapiens
gaaaatgtactg

SEQ ID NO: 4922841 - DNA, 15 bp, Homo sapiens
gaaaatgttgagaat

SEQ ID NO: 4922842 - DNA, 17 bp, Homo sapiens
gaaaattcaaaaagtgt

SEQ ID NO: 4922843 - DNA, 21 bp, Homo sapiens
gaaaattcaaaaagtgtttat

SEQ ID NO: 4922844 - DNA, 22 bp, Homo sapiens
gaaaattcatttcacattaatg

SEQ ID NO: 4922845 - DNA, 16 bp, Homo sapiens
gaaaatttttgtagta

SEQ ID NO: 4922846 - DNA, 19 bp, Homo sapiens
gaaacaaaaacactaaaaa

SEQ ID NO: 4922847 - DNA, 12 bp, Homo sapiens
gaaacaaacttt

SEQ ID NO: 4922848 - DNA, 15 bp, Homo sapiens
gaaacaataaagaga

SEQ ID NO: 4922849 - DNA, 15 bp, Homo sapiens
gaaacacagagaagc

SEQ ID NO: 4922850 - DNA, 13 bp, Homo sapiens
gaaacacagctgt

SEQ ID NO: 4922851 - DNA, 15 bp, Homo sapiens
gaaacacagctgttc

SEQ ID NO: 4922852 - DNA, 18 bp, Homo sapiens
gaaacactttgcctcctg

SEQ ID NO: 4922853 - DNA, 19 bp, Homo sapiens
gaaacactttgcctcctgt

SEQ ID NO: 4922854 - DNA, 20 bp, Homo sapiens
gaaacactttgcctcctgtg

SEQ ID NO: 4922855 - DNA, 14 bp, Homo sapiens
gaaacagaaacaaa

SEQ ID NO: 4922856 - DNA, 21 bp, Homo sapiens
gaaacagataccatactcatt

SEQ ID NO: 4922857 - DNA, 15 bp, Homo sapiens
gaaacagctttcaag

SEQ ID NO: 4922858 - DNA, 20 bp, Homo sapiens
gaaacagctttcaagtgcct

SEQ ID NO: 4922859 - DNA, 13 bp, Homo sapiens
gaaacatgacact

SEQ ID NO: 4922860 - DNA, 14 bp, Homo sapiens
gaaacccaagctcc

SEQ ID NO: 4922861 - DNA, 14 bp, Homo sapiens
gaaaccctctgtca

SEQ ID NO: 4922862 - DNA, 18 bp, Homo sapiens
gaaaccttttttaagatt

SEQ ID NO: 4922863 - DNA, 19 bp, Homo sapiens
gaaaccttttttaagattt

SEQ ID NO: 4922864 - DNA, 21 bp, Homo sapiens
gaaaccttttttaagattttt

SEQ ID NO: 4922865 - DNA, 23 bp, Homo sapiens
gaaaccttttttaagatttttct

SEQ ID NO: 4922866 - DNA, 16 bp, Homo sapiens
gaaacgtcttctaaac

SEQ ID NO: 4922867 - DNA, 15 bp, Homo sapiens
gaaactcttatctca

SEQ ID NO: 4922868 - DNA, 20 bp, Homo sapiens
gaaactcttatctcagtcat

SEQ ID NO: 4922869 - DNA, 22 bp, Homo sapiens
gaaactgaggaattttctttgt

SEQ ID NO: 4922870 - DNA, 17 bp, Homo sapiens
gaaactggcactgaatt

SEQ ID NO: 4922871 - DNA, 12 bp, Homo sapiens
gaaactggcccc

SEQ ID NO: 4922872 - DNA, 13 bp, Homo sapiens
gaaacttgttatt

SEQ ID NO: 4922873 - DNA, 12 bp, Homo sapiens
gaaactttatac

SEQ ID NO: 4922874 - DNA, 18 bp, Homo sapiens
gaaactttatacattagt

SEQ ID NO: 4922875 - DNA, 19 bp, Homo sapiens
gaaactttatacattagta

SEQ ID NO: 4922876 - DNA, 14 bp, Homo sapiens
gaaacttttaactg

SEQ ID NO: 4922877 - DNA, 16 bp, Homo sapiens
gaaacttttgtaaaga

SEQ ID NO: 4922878 - DNA, 23 bp, Homo sapiens
gaaacttttgtaaagaaatttac

SEQ ID NO: 4922879 - DNA, 15 bp, Homo sapiens
gaaagaaagaaggaa

SEQ ID NO: 4922880 - DNA, 15 bp, Homo sapiens
gaaagaatatattta

SEQ ID NO: 4922881 - DNA, 13 bp, Homo sapiens
gaaagacactgcc

SEQ ID NO: 4922882 - DNA, 21 bp, Homo sapiens
gaaagagagagaaacaaactt

SEQ ID NO: 4922883 - DNA, 23 bp, Homo sapiens
gaaagagataccaagatgccatc

SEQ ID NO: 4922884 - DNA, 17 bp, Homo sapiens
gaaagagtcttcaacat

SEQ ID NO: 4922885 - DNA, 22 bp, Homo sapiens
gaaagatggctgtgcctctgcc

SEQ ID NO: 4922886 - DNA, 12 bp, Homo sapiens
gaaagcaggggc

SEQ ID NO: 4922887 - DNA, 14 bp, Homo sapiens
gaaagcaggggcta

SEQ ID NO: 4922888 - DNA, 23 bp, Homo sapiens
gaaagcatatgggttagatgttg

SEQ ID NO: 4922889 - DNA, 11 bp, Homo sapiens
gaaagccaggc

SEQ ID NO: 4922890 - DNA, 23 bp, Homo sapiens
gaaagccaggcaggtagccaggg

SEQ ID NO: 4922891 - DNA, 17 bp, Homo sapiens
gaaagctgagaactcct

SEQ ID NO: 4922892 - DNA, 19 bp, Homo sapiens
gaaagctgagaactcctga

SEQ ID NO: 4922893 - DNA, 21 bp, Homo sapiens
gaaagctggtaaactatttgt

SEQ ID NO: 4922894 - DNA, 19 bp, Homo sapiens
gaaaggaggcatgcctctg

SEQ ID NO: 4922895 - DNA, 20 bp, Homo sapiens
gaaaggaggcatgcctctga

SEQ ID NO: 4922896 - DNA, 13 bp, Homo sapiens
gaaaggcctgcac

SEQ ID NO: 4922897 - DNA, 16 bp, Homo sapiens
gaaagggaacagaaag

SEQ ID NO: 4922898 - DNA, 22 bp, Homo sapiens
gaaagggacttggaagctccgc

SEQ ID NO: 4922899 - DNA, 21 bp, Homo sapiens
gaaaggtactatatttgctag

SEQ ID NO: 4922900 - DNA, 16 bp, Homo sapiens
gaaaggtttacattgt

SEQ ID NO: 4922901 - DNA, 21 bp, Homo sapiens
gaaagtacttctccaccctgc

SEQ ID NO: 4922902 - DNA, 16 bp, Homo sapiens
gaaagtagaacttact

SEQ ID NO: 4922903 - DNA, 15 bp, Homo sapiens
gaaagtgaataaact

SEQ ID NO: 4922904 - DNA, 23 bp, Homo sapiens
gaaagtgttatttttcaaggaag

SEQ ID NO: 4922905 - DNA, 20 bp, Homo sapiens
gaaagtttacccatgaagat

SEQ ID NO: 4922906 - DNA, 15 bp, Homo sapiens
gaaataaaacctttc

SEQ ID NO: 4922907 - DNA, 18 bp, Homo sapiens
gaaataaaacctttcaaa

SEQ ID NO: 4922908 - DNA, 17 bp, Homo sapiens
gaaataaagtttgctta

SEQ ID NO: 4922909 - DNA, 18 bp, Homo sapiens
gaaataacaaaatggaca

SEQ ID NO: 4922910 - DNA, 17 bp, Homo sapiens
gaaataacaatgttaag

SEQ ID NO: 4922911 - DNA, 18 bp, Homo sapiens
gaaataatagaatgagca

SEQ ID NO: 4922912 - DNA, 15 bp, Homo sapiens
gaaataatatgcatt

SEQ ID NO: 4922913 - DNA, 19 bp, Homo sapiens
gaaataatgtacatctggc

SEQ ID NO: 4922914 - DNA, 21 bp, Homo sapiens
gaaatacccttcttttatgag

SEQ ID NO: 4922915 - DNA, 17 bp, Homo sapiens
gaaatacctcatgttta

SEQ ID NO: 4922916 - DNA, 15 bp, Homo sapiens
gaaatagtctgtgtg

SEQ ID NO: 4922917 - DNA, 17 bp, Homo sapiens
gaaatagtctgtgtgaa

SEQ ID NO: 4922918 - DNA, 15 bp, Homo sapiens
gaaatataataaaat

SEQ ID NO: 4922919 - DNA, 16 bp, Homo sapiens
gaaatatatacgaaca

SEQ ID NO: 4922920 - DNA, 18 bp, Homo sapiens
gaaatatatacgaacaaa

SEQ ID NO: 4922921 - DNA, 22 bp, Homo sapiens
gaaatatatacgaacaaaacac

SEQ ID NO: 4922922 - DNA, 14 bp, Homo sapiens
gaaatatatataca

SEQ ID NO: 4922923 - DNA, 16 bp, Homo sapiens
gaaatatatatacata

SEQ ID NO: 4922924 - DNA, 18 bp, Homo sapiens
gaaatatatatacatatg

SEQ ID NO: 4922925 - DNA, 14 bp, Homo sapiens
gaaatatcatttat

SEQ ID NO: 4922926 - DNA, 13 bp, Homo sapiens
gaaatatgcatct

SEQ ID NO: 4922927 - DNA, 15 bp, Homo sapiens
gaaatatgtgagatt

SEQ ID NO: 4922928 - DNA, 21 bp, Homo sapiens
gaaatattttgataataaatt

SEQ ID NO: 4922929 - DNA, 23 bp, Homo sapiens
gaaatattttgataataaattga

SEQ ID NO: 4922930 - DNA, 18 bp, Homo sapiens
gaaatcagtaatatttat

SEQ ID NO: 4922931 - DNA, 22 bp, Homo sapiens
gaaatccctgtttaatatttaa

SEQ ID NO: 4922932 - DNA, 19 bp, Homo sapiens
gaaatccttgactggacct

SEQ ID NO: 4922933 - DNA, 15 bp, Homo sapiens
gaaatctagtatttc

SEQ ID NO: 4922934 - DNA, 17 bp, Homo sapiens
gaaatgaaatttaaaca

SEQ ID NO: 4922935 - DNA, 16 bp, Homo sapiens
ctgaccttccttcctg

SEQ ID NO: 4922936 - DNA, 14 bp, Homo sapiens
ctgaccttggagag

SEQ ID NO: 4922937 - DNA, 19 bp, Homo sapiens
ctgaccttggagagacaca

SEQ ID NO: 4922938 - DNA, 21 bp, Homo sapiens
ctgaccttggagagacacagc

SEQ ID NO: 4922939 - DNA, 21 bp, Homo sapiens
ctgacgaaactggccccggat

SEQ ID NO: 4922940 - DNA, 18 bp, Homo sapiens
ctgacgcaatgaaaagtc

SEQ ID NO: 4922941 - DNA, 15 bp, Homo sapiens
ctgacggccctgcaa

SEQ ID NO: 4922942 - DNA, 21 bp, Homo sapiens
ctgacgtctgaagcttgactc

SEQ ID NO: 4922943 - DNA, 23 bp, Homo sapiens
ctgacgtctgaagcttgactccc

SEQ ID NO: 4922944 - DNA, 22 bp, Homo sapiens
ctgactagaagggccagtcctg

SEQ ID NO: 4922945 - DNA, 21 bp, Homo sapiens
ctgactcctacctgccctgga

SEQ ID NO: 4922946 - DNA, 22 bp, Homo sapiens
ctgactcctacctgccctggaa

SEQ ID NO: 4922947 - DNA, 15 bp, Homo sapiens
ctgactctgccccct

SEQ ID NO: 4922948 - DNA, 17 bp, Homo sapiens
ctgactgtactcctccc

SEQ ID NO: 4922949 - DNA, 13 bp, Homo sapiens
ctgactgtcctct

SEQ ID NO: 4922950 - DNA, 21 bp, Homo sapiens
ctgactgtcctctcccctcca

SEQ ID NO: 4922951 - DNA, 19 bp, Homo sapiens
ctgacttaagcaaaagaaa

SEQ ID NO: 4922952 - DNA, 24 bp, Homo sapiens
ctgacttaagcaaaagaaaaagat

SEQ ID NO: 4922953 - DNA, 22 bp, Homo sapiens
ctgacttcatggaatggacatc

SEQ ID NO: 4922954 - DNA, 22 bp, Homo sapiens
ctgacttggggagatggagttc

SEQ ID NO: 4922955 - DNA, 13 bp, Homo sapiens
ctgagaactcctg

SEQ ID NO: 4922956 - DNA, 15 bp, Homo sapiens
ctgagaactcctgac

SEQ ID NO: 4922957 - DNA, 22 bp, Homo sapiens
ctgagaagaggagccctcatct

SEQ ID NO: 4922958 - DNA, 15 bp, Homo sapiens
ctgagaagctgctcc

SEQ ID NO: 4922959 - DNA, 17 bp, Homo sapiens
ctgagaagctgctccag

SEQ ID NO: 4922960 - DNA, 18 bp, Homo sapiens
ctgagaagctgctccagg

SEQ ID NO: 4922961 - DNA, 23 bp, Homo sapiens
ctgagaagctgctccaggcctgc

SEQ ID NO: 4922962 - DNA, 22 bp, Homo sapiens
ctgagaccatttaacatgcaac

SEQ ID NO: 4922963 - DNA, 16 bp, Homo sapiens
ctgagagacttttaat

SEQ ID NO: 4922964 - DNA, 21 bp, Homo sapiens
ctgagaggacttttctttgtg

SEQ ID NO: 4922965 - DNA, 22 bp, Homo sapiens
ctgagaggacttttctttgtgg

SEQ ID NO: 4922966 - DNA, 15 bp, Homo sapiens
ctgagagtctagatt

SEQ ID NO: 4922967 - DNA, 14 bp, Homo sapiens
ctgagatcccctga

SEQ ID NO: 4922968 - DNA, 15 bp, Homo sapiens
ctgagcaaatgtggc

SEQ ID NO: 4922969 - DNA, 17 bp, Homo sapiens
ctgagcaaatgtggctc

SEQ ID NO: 4922970 - DNA, 21 bp, Homo sapiens
ctgagcaaatgtggctcctgg

SEQ ID NO: 4922971 - DNA, 20 bp, Homo sapiens
ctgagcaactcttgattatc

SEQ ID NO: 4922972 - DNA, 17 bp, Homo sapiens
ctgagcacactttagtg

SEQ ID NO: 4922973 - DNA, 22 bp, Homo sapiens
ctgagccccagggtgcccagaa

SEQ ID NO: 4922974 - DNA, 21 bp, Homo sapiens
ctgagccccgcagacctcccc

SEQ ID NO: 4922975 - DNA, 19 bp, Homo sapiens
ctgagccccgccctcttcc

SEQ ID NO: 4922976 - DNA, 20 bp, Homo sapiens
ctgagccccgccctcttcct

SEQ ID NO: 4922977 - DNA, 15 bp, Homo sapiens
ctgagcctctgctcc

SEQ ID NO: 4922978 - DNA, 15 bp, Homo sapiens
ctgagcgggaggcag

SEQ ID NO: 4922979 - DNA, 22 bp, Homo sapiens
ctgagcggtgggggaggagggt

SEQ ID NO: 4922980 - DNA, 21 bp, Homo sapiens
ctgaggaaggaggggaagctg

SEQ ID NO: 4922981 - DNA, 23 bp, Homo sapiens
ctgaggacaaagtggaggagggc

SEQ ID NO: 4922982 - DNA, 23 bp, Homo sapiens
ctgaggacactaaccacgctgga

SEQ ID NO: 4922983 - DNA, 14 bp, Homo sapiens
ctgaggaggcctcc

SEQ ID NO: 4922984 - DNA, 16 bp, Homo sapiens
ctgaggaggcctccat

SEQ ID NO: 4922985 - DNA, 18 bp, Homo sapiens
ctgaggctttggatttga

SEQ ID NO: 4922986 - DNA, 21 bp, Homo sapiens
ctgaggctttggatttgacat

SEQ ID NO: 4922987 - DNA, 20 bp, Homo sapiens
ctgagggactctgaagcctc

SEQ ID NO: 4922988 - DNA, 22 bp, Homo sapiens
ctgagggactctgaagcctctg

SEQ ID NO: 4922989 - DNA, 19 bp, Homo sapiens
ctgagggaggacctggggc

SEQ ID NO: 4922990 - DNA, 12 bp, Homo sapiens
ctgagggcaaat

SEQ ID NO: 4922991 - DNA, 13 bp, Homo sapiens
ctgagggcaaatc

SEQ ID NO: 4922992 - DNA, 19 bp, Homo sapiens
ctgagggcaaatccagtcc

SEQ ID NO: 4922993 - DNA, 20 bp, Homo sapiens
ctgagggcagaaaggttctg

SEQ ID NO: 4922994 - DNA, 17 bp, Homo sapiens
ctgaggggcatctgccc

SEQ ID NO: 4922995 - DNA, 19 bp, Homo sapiens
ctgagggtccccacctggg

SEQ ID NO: 4922996 - DNA, 14 bp, Homo sapiens
ctgaggtcagggag

SEQ ID NO: 4922997 - DNA, 15 bp, Homo sapiens
ctgaggtcagggagt

SEQ ID NO: 4922998 - DNA, 19 bp, Homo sapiens
ctgaggtcagggagtgctg

SEQ ID NO: 4922999 - DNA, 13 bp, Homo sapiens
ctgagttatgatg

SEQ ID NO: 4923000 - DNA, 16 bp, Homo sapiens
ctgagttgccaagaca

SEQ ID NO: 4923001 - DNA, 20 bp, Homo sapiens
ctgagttgccaagacaaatc

SEQ ID NO: 4923002 - DNA, 17 bp, Homo sapiens
ctgagtttcattctcct

SEQ ID NO: 4923003 - DNA, 19 bp, Homo sapiens
ctgatacataactaaattt

SEQ ID NO: 4923004 - DNA, 16 bp, Homo sapiens
ctgatatgggactgag

SEQ ID NO: 4923005 - DNA, 22 bp, Homo sapiens
ctgatcactagcctgtcatcct

SEQ ID NO: 4923006 - DNA, 13 bp, Homo sapiens
ctgatctcttcct

SEQ ID NO: 4923007 - DNA, 14 bp, Homo sapiens
ctgatctcttcctg

SEQ ID NO: 4923008 - DNA, 21 bp, Homo sapiens
ctgatctcttcctgttttgta

SEQ ID NO: 4923009 - DNA, 20 bp, Homo sapiens
ctgatctgcggatctcagct

SEQ ID NO: 4923010 - DNA, 21 bp, Homo sapiens
ctgatgagcaaccgcttccct

SEQ ID NO: 4923011 - DNA, 12 bp, Homo sapiens
ctgatgctccct

SEQ ID NO: 4923012 - DNA, 18 bp, Homo sapiens
ctgatgctccctcccctg

SEQ ID NO: 4923013 - DNA, 22 bp, Homo sapiens
ctgatgctccctcccctgccct

SEQ ID NO: 4923014 - DNA, 19 bp, Homo sapiens
ctgatgtccctagaaaaca

SEQ ID NO: 4923015 - DNA, 12 bp, Homo sapiens
ctgatgtctcta

SEQ ID NO: 4923016 - DNA, 18 bp, Homo sapiens
ctgatgtctctaaagcac

SEQ ID NO: 4923017 - DNA, 21 bp, Homo sapiens
ctgattaagttgtctaaacaa

SEQ ID NO: 4923018 - DNA, 12 bp, Homo sapiens
ctgattagcttt

SEQ ID NO: 4923019 - DNA, 18 bp, Homo sapiens
ctgattagctttgtgttt

SEQ ID NO: 4923020 - DNA, 18 bp, Homo sapiens
ctgattcccaagctctgc

SEQ ID NO: 4923021 - DNA, 20 bp, Homo sapiens
ctgattcccaagctctgctc

SEQ ID NO: 4923022 - DNA, 22 bp, Homo sapiens
ctgattcccaagctctgctcct

SEQ ID NO: 4923023 - DNA, 12 bp, Homo sapiens
ctgattgtaaac

SEQ ID NO: 4923024 - DNA, 14 bp, Homo sapiens
ctgatttcttgctt

SEQ ID NO: 4923025 - DNA, 17 bp, Homo sapiens
ctgatttgcatattcat

SEQ ID NO: 4923026 - DNA, 23 bp, Homo sapiens
ctgattttaggagctaaggctct

SEQ ID NO: 4923027 - DNA, 13 bp, Homo sapiens
ctgcaaaaatgga

SEQ ID NO: 4923028 - DNA, 18 bp, Homo sapiens
ctgcaaaaggagagactc

SEQ ID NO: 4923029 - DNA, 16 bp, Homo sapiens
ctgcaaacagaacagg

SEQ ID NO: 4923030 - DNA, 19 bp, Homo sapiens
ctgcaaacagaacagggtc

SEQ ID NO: 4923031 - DNA, 15 bp, Homo sapiens
ctgcaagaggctcct

SEQ ID NO: 4923032 - DNA, 16 bp, Homo sapiens
ctgcaagaggctcctg

SEQ ID NO: 4923033 - DNA, 18 bp, Homo sapiens
ctgcaagaggctcctgtc

SEQ ID NO: 4923034 - DNA, 18 bp, Homo sapiens
ctgcaaggcccacaggag

SEQ ID NO: 4923035 - DNA, 14 bp, Homo sapiens
ctgcaataacttct

SEQ ID NO: 4923036 - DNA, 16 bp, Homo sapiens
ctgcaataacttctga

SEQ ID NO: 4923037 - DNA, 17 bp, Homo sapiens
ctgcaataacttctgac

SEQ ID NO: 4923038 - DNA, 18 bp, Homo sapiens
ctgcaatcatatgtgatc

SEQ ID NO: 4923039 - DNA, 19 bp, Homo sapiens
ctgcaatcatatgtgatct

SEQ ID NO: 4923040 - DNA, 23 bp, Homo sapiens
ctgcaatcctgtctttctgagca

SEQ ID NO: 4923041 - DNA, 13 bp, Homo sapiens
ctgcaatgaaagg

SEQ ID NO: 4923042 - DNA, 17 bp, Homo sapiens
ctgcaatgggcactggg

SEQ ID NO: 4923043 - DNA, 20 bp, Homo sapiens
ctgcaatgtatcccttctca

SEQ ID NO: 4923044 - DNA, 21 bp, Homo sapiens
cttactttcctttccccagcc

SEQ ID NO: 4923045 - DNA, 22 bp, Homo sapiens
cttactttcctttccccagccc

SEQ ID NO: 4923046 - DNA, 16 bp, Homo sapiens
cttagaaagcaggggc

SEQ ID NO: 4923047 - DNA, 20 bp, Homo sapiens
cttagaaatgtaaactgcca

SEQ ID NO: 4923048 - DNA, 21 bp, Homo sapiens
cttagaaatgtaaactgccat

SEQ ID NO: 4923049 - DNA, 16 bp, Homo sapiens
cttagaaattgcattt

SEQ ID NO: 4923050 - DNA, 17 bp, Homo sapiens
cttagaaattgcatttc

SEQ ID NO: 4923051 - DNA, 15 bp, Homo sapiens
cttagaacctttctt

SEQ ID NO: 4923052 - DNA, 17 bp, Homo sapiens
cttagaagtcacacagt

SEQ ID NO: 4923053 - DNA, 20 bp, Homo sapiens
cttagaagtcacacagtatt

SEQ ID NO: 4923054 - DNA, 17 bp, Homo sapiens
cttagagtttctgtttg

SEQ ID NO: 4923055 - DNA, 18 bp, Homo sapiens
cttagagtttctgtttga

SEQ ID NO: 4923056 - DNA, 15 bp, Homo sapiens
cttagcaaaaagtgg

SEQ ID NO: 4923057 - DNA, 22 bp, Homo sapiens
cttagcatagcttattattgaa

SEQ ID NO: 4923058 - DNA, 18 bp, Homo sapiens
cttagcatcctaagaaat

SEQ ID NO: 4923059 - DNA, 20 bp, Homo sapiens
cttagcatcctaagaaatat

SEQ ID NO: 4923060 - DNA, 22 bp, Homo sapiens
cttagcatcctaagaaatatgt

SEQ ID NO: 4923061 - DNA, 11 bp, Homo sapiens
cttagctccct

SEQ ID NO: 4923062 - DNA, 21 bp, Homo sapiens
cttagctccctcccgcacccc

SEQ ID NO: 4923063 - DNA, 14 bp, Homo sapiens
cttagctgtctgct

SEQ ID NO: 4923064 - DNA, 14 bp, Homo sapiens
cttagctttttaat

SEQ ID NO: 4923065 - DNA, 22 bp, Homo sapiens
cttaggcatgtaggaccctgca

SEQ ID NO: 4923066 - DNA, 13 bp, Homo sapiens
cttagggaagctg

SEQ ID NO: 4923067 - DNA, 17 bp, Homo sapiens
cttagggaagctggcct

SEQ ID NO: 4923068 - DNA, 20 bp, Homo sapiens
cttagggaagctggcctgag

SEQ ID NO: 4923069 - DNA, 13 bp, Homo sapiens
cttagtatctcat

SEQ ID NO: 4923070 - DNA, 17 bp, Homo sapiens
cttagtcccccaactct

SEQ ID NO: 4923071 - DNA, 23 bp, Homo sapiens
cttagtcccccaactctgagccc

SEQ ID NO: 4923072 - DNA, 12 bp, Homo sapiens
cttagtctcagt

SEQ ID NO: 4923073 - DNA, 20 bp, Homo sapiens
cttagtctcagtttgtgtgt

SEQ ID NO: 4923074 - DNA, 22 bp, Homo sapiens
cttagtttggattcttatgtag

SEQ ID NO: 4923075 - DNA, 22 bp, Homo sapiens
cttataaatcatattgatgaaa

SEQ ID NO: 4923076 - DNA, 14 bp, Homo sapiens
cttataataaagga

SEQ ID NO: 4923077 - DNA, 13 bp, Homo sapiens
cttataatactct

SEQ ID NO: 4923078 - DNA, 16 bp, Homo sapiens
cttataatactctgtt

SEQ ID NO: 4923079 - DNA, 19 bp, Homo sapiens
cttataatactctgttgta

SEQ ID NO: 4923080 - DNA, 17 bp, Homo sapiens
cttatagtacatgataa

SEQ ID NO: 4923081 - DNA, 15 bp, Homo sapiens
cttatagttctaggc

SEQ ID NO: 4923082 - DNA, 14 bp, Homo sapiens
cttatatttcccta

SEQ ID NO: 4923083 - DNA, 19 bp, Homo sapiens
cttatatttccctaaaata

SEQ ID NO: 4923084 - DNA, 23 bp, Homo sapiens
cttatatttccctaaaatacatt

SEQ ID NO: 4923085 - DNA, 20 bp, Homo sapiens
cttatattttcgtatgaaaa

SEQ ID NO: 4923086 - DNA, 22 bp, Homo sapiens
cttatattttcgtatgaaaatg

SEQ ID NO: 4923087 - DNA, 21 bp, Homo sapiens
cttatccataaaaaaaaatag

SEQ ID NO: 4923088 - DNA, 21 bp, Homo sapiens
cttatcctaaaacaaatagtt

SEQ ID NO: 4923089 - DNA, 14 bp, Homo sapiens
cttatcctgcattg

SEQ ID NO: 4923090 - DNA, 19 bp, Homo sapiens
cttatctcagtcatgcata

SEQ ID NO: 4923091 - DNA, 20 bp, Homo sapiens
cttatctcagtcatgcataa

SEQ ID NO: 4923092 - DNA, 21 bp, Homo sapiens
cttatctcagtcatgcataaa

SEQ ID NO: 4923093 - DNA, 13 bp, Homo sapiens
cttatctctctgt

SEQ ID NO: 4923094 - DNA, 15 bp, Homo sapiens
cttatctctctgtgc

SEQ ID NO: 4923095 - DNA, 21 bp, Homo sapiens
cttatctctctgtgctgtgga

SEQ ID NO: 4923096 - DNA, 23 bp, Homo sapiens
cttatgattcagattgttatcta

SEQ ID NO: 4923097 - DNA, 15 bp, Homo sapiens
cttatgcaaaatgga

SEQ ID NO: 4923098 - DNA, 14 bp, Homo sapiens
cttatggaattgat

SEQ ID NO: 4923099 - DNA, 19 bp, Homo sapiens
cttatggaattgatttgca

SEQ ID NO: 4923100 - DNA, 20 bp, Homo sapiens
cttatggaattgatttgcat

SEQ ID NO: 4923101 - DNA, 21 bp, Homo sapiens
cttatggaattgatttgcatt

SEQ ID NO: 4923102 - DNA, 23 bp, Homo sapiens
cttatggaattgatttgcattga

SEQ ID NO: 4923103 - DNA, 16 bp, Homo sapiens
cttatgtagatatttg

SEQ ID NO: 4923104 - DNA, 18 bp, Homo sapiens
cttatgtagatatttggc

SEQ ID NO: 4923105 - DNA, 19 bp, Homo sapiens
cttatgtagatatttggct

SEQ ID NO: 4923106 - DNA, 14 bp, Homo sapiens
cttattctgtagat

SEQ ID NO: 4923107 - DNA, 13 bp, Homo sapiens
cttattgcccacg

SEQ ID NO: 4923108 - DNA, 18 bp, Homo sapiens
cttattgcccacgctgga

SEQ ID NO: 4923109 - DNA, 13 bp, Homo sapiens
cttatttagagat

SEQ ID NO: 4923110 - DNA, 15 bp, Homo sapiens
cttatttgcttcatt

SEQ ID NO: 4923111 - DNA, 12 bp, Homo sapiens
cttattttaatg

SEQ ID NO: 4923112 - DNA, 19 bp, Homo sapiens
cttattttcaagaaactga

SEQ ID NO: 4923113 - DNA, 16 bp, Homo sapiens
cttattttcatgtata

SEQ ID NO: 4923114 - DNA, 20 bp, Homo sapiens
cttcaaaatgtatatattta

SEQ ID NO: 4923115 - DNA, 22 bp, Homo sapiens
cttcaaaatgttatcttctcaa

SEQ ID NO: 4923116 - DNA, 18 bp, Homo sapiens
cttcaaattaaaacagct

SEQ ID NO: 4923117 - DNA, 18 bp, Homo sapiens
cttcaacatcctgccagc

SEQ ID NO: 4923118 - DNA, 20 bp, Homo sapiens
cttcaacatcctgccagccc

SEQ ID NO: 4923119 - DNA, 21 bp, Homo sapiens
cttcaacatcctgccagcccc

SEQ ID NO: 4923120 - DNA, 20 bp, Homo sapiens
cttcaaccattccccatggg

SEQ ID NO: 4923121 - DNA, 17 bp, Homo sapiens
cttcaactgaccagcct

SEQ ID NO: 4923122 - DNA, 18 bp, Homo sapiens
cttcaagaactctgggct

SEQ ID NO: 4923123 - DNA, 15 bp, Homo sapiens
cttcacagtagagcc

SEQ ID NO: 4923124 - DNA, 18 bp, Homo sapiens
cttcacagtagagccagc

SEQ ID NO: 4923125 - DNA, 22 bp, Homo sapiens
cttcacagtagagccagcttgg

SEQ ID NO: 4923126 - DNA, 18 bp, Homo sapiens
cttcaccccggcaggccc

SEQ ID NO: 4923127 - DNA, 12 bp, Homo sapiens
cttcactacttt

SEQ ID NO: 4923128 - DNA, 18 bp, Homo sapiens
cttcactgttgaaaatta

SEQ ID NO: 4923129 - DNA, 19 bp, Homo sapiens
cttcagatattattgcttt

SEQ ID NO: 4923130 - DNA, 21 bp, Homo sapiens
cttcagatgggaggaaagaga

SEQ ID NO: 4923131 - DNA, 18 bp, Homo sapiens
cttcagcattccctccca

SEQ ID NO: 4923132 - DNA, 15 bp, Homo sapiens
cttcagcccccagcc

SEQ ID NO: 4923133 - DNA, 17 bp, Homo sapiens
cttcagcccccagcccc

SEQ ID NO: 4923134 - DNA, 15 bp, Homo sapiens
cttcaggcctccctc

SEQ ID NO: 4923135 - DNA, 15 bp, Homo sapiens
cttcaggctcttctc

SEQ ID NO: 4923136 - DNA, 20 bp, Homo sapiens
cttcaggttatcgaaataac

SEQ ID NO: 4923137 - DNA, 21 bp, Homo sapiens
cttcaggttatcgaaataaca

SEQ ID NO: 4923138 - DNA, 19 bp, Homo sapiens
cttcagtaccctctcagct

SEQ ID NO: 4923139 - DNA, 23 bp, Homo sapiens
cttcagtaccctctcagctccag

SEQ ID NO: 4923140 - DNA, 17 bp, Homo sapiens
cttcagtcctgctccag

SEQ ID NO: 4923141 - DNA, 13 bp, Homo sapiens
cttcagtcctggg

SEQ ID NO: 4923142 - DNA, 16 bp, Homo sapiens
cttcagtggcagctgc

SEQ ID NO: 4923143 - DNA, 17 bp, Homo sapiens
cttcagtgtatggaaat

SEQ ID NO: 4923144 - DNA, 20 bp, Homo sapiens
cttcagtgtatggaaataaa

SEQ ID NO: 4923145 - DNA, 21 bp, Homo sapiens
cttcatactttttttcacagt

SEQ ID NO: 4923146 - DNA, 20 bp, Homo sapiens
cttcatattctaaaaccatt

SEQ ID NO: 4923147 - DNA, 14 bp, Homo sapiens
cttcatccctttcc

SEQ ID NO: 4923148 - DNA, 16 bp, Homo sapiens
cttcatccctttccag

SEQ ID NO: 4923149 - DNA, 18 bp, Homo sapiens
cttcatggaatggacatc

SEQ ID NO: 4923150 - DNA, 20 bp, Homo sapiens
cttcatggaatggacatcct

SEQ ID NO: 4923151 - DNA, 20 bp, Homo sapiens
cttcattcaatattgacatt

SEQ ID NO: 4923152 - DNA, 22 bp, Homo sapiens
cttcattcaatattgacatttg

SEQ ID NO: 4923153 - DNA, 12 bp, Homo sapiens
cttgctctgctg

SEQ ID NO: 4923154 - DNA, 13 bp, Homo sapiens
cttgctgctagaa

SEQ ID NO: 4923155 - DNA, 16 bp, Homo sapiens
cttgctgctagaactt

SEQ ID NO: 4923156 - DNA, 17 bp, Homo sapiens
cttgctgctagaacttt

SEQ ID NO: 4923157 - DNA, 16 bp, Homo sapiens
cttgctgtcctgatct

SEQ ID NO: 4923158 - DNA, 13 bp, Homo sapiens
cttgctgtctctg

SEQ ID NO: 4923159 - DNA, 15 bp, Homo sapiens
cttgctgtctctgct

SEQ ID NO: 4923160 - DNA, 18 bp, Homo sapiens
cttgcttgtacctctggc

SEQ ID NO: 4923161 - DNA, 17 bp, Homo sapiens
cttgcttttccctcttt

SEQ ID NO: 4923162 - DNA, 22 bp, Homo sapiens
cttggaagtacatgaatacaaa

SEQ ID NO: 4923163 - DNA, 13 bp, Homo sapiens
cttggacactgta

SEQ ID NO: 4923164 - DNA, 16 bp, Homo sapiens
cttggagaccttaccc

SEQ ID NO: 4923165 - DNA, 21 bp, Homo sapiens
cttggagcttacatagtttta

SEQ ID NO: 4923166 - DNA, 15 bp, Homo sapiens
cttggagggataagc

SEQ ID NO: 4923167 - DNA, 19 bp, Homo sapiens
cttggagggcccacttgta

SEQ ID NO: 4923168 - DNA, 22 bp, Homo sapiens
cttggagtattggggtctgacc

SEQ ID NO: 4923169 - DNA, 21 bp, Homo sapiens
cttggattattttaaatcatt

SEQ ID NO: 4923170 - DNA, 18 bp, Homo sapiens
cttggcaatattccttag

SEQ ID NO: 4923171 - DNA, 12 bp, Homo sapiens
cttggcaccaaa

SEQ ID NO: 4923172 - DNA, 16 bp, Homo sapiens
cttggcaccaaagatg

SEQ ID NO: 4923173 - DNA, 22 bp, Homo sapiens
cttggcaccaaagatgcagccg

SEQ ID NO: 4923174 - DNA, 15 bp, Homo sapiens
cttggcatagacatg

SEQ ID NO: 4923175 - DNA, 11 bp, Homo sapiens
cttggcctcag

SEQ ID NO: 4923176 - DNA, 12 bp, Homo sapiens
cttggcctcaga

SEQ ID NO: 4923177 - DNA, 23 bp, Homo sapiens
cttggcctcagaattcacaaaat

SEQ ID NO: 4923178 - DNA, 14 bp, Homo sapiens
cttggcctcccaag

SEQ ID NO: 4923179 - DNA, 18 bp, Homo sapiens
cttggcgtggagcaggcg

SEQ ID NO: 4923180 - DNA, 23 bp, Homo sapiens
cttggctcaagtcctcttttctg

SEQ ID NO: 4923181 - DNA, 21 bp, Homo sapiens
cttggctcaatcctctaagct

SEQ ID NO: 4923182 - DNA, 16 bp, Homo sapiens
cttggctcagacatgt

SEQ ID NO: 4923183 - DNA, 12 bp, Homo sapiens
cttggctgcagg

SEQ ID NO: 4923184 - DNA, 14 bp, Homo sapiens
cttggctgcaggga

SEQ ID NO: 4923185 - DNA, 16 bp, Homo sapiens
cttggcttacctgacc

SEQ ID NO: 4923186 - DNA, 24 bp, Homo sapiens
cttggcttacctgacctcttgctg

SEQ ID NO: 4923187 - DNA, 19 bp, Homo sapiens
cttgggccaaatccgctct

SEQ ID NO: 4923188 - DNA, 23 bp, Homo sapiens
cttggtatttttcagagatttat

SEQ ID NO: 4923189 - DNA, 20 bp, Homo sapiens
cttgtacatgtgtagcctgt

SEQ ID NO: 4923190 - DNA, 23 bp, Homo sapiens
cttgtacatgtgtagcctgtgca

SEQ ID NO: 4923191 - DNA, 18 bp, Homo sapiens
cttgtacctctggctgac

SEQ ID NO: 4923192 - DNA, 13 bp, Homo sapiens
cttgtagctgtaa

SEQ ID NO: 4923193 - DNA, 14 bp, Homo sapiens
cttgtataaatgta

SEQ ID NO: 4923194 - DNA, 18 bp, Homo sapiens
cttgtataaatgtatata

SEQ ID NO: 4923195 - DNA, 17 bp, Homo sapiens
cttgtatagtgtaaaat

SEQ ID NO: 4923196 - DNA, 23 bp, Homo sapiens
cttgtcactgacacaaaggaagt

SEQ ID NO: 4923197 - DNA, 23 bp, Homo sapiens
cttgtcactggtagaccaaaata

SEQ ID NO: 4923198 - DNA, 16 bp, Homo sapiens
cttgtcagacataaag

SEQ ID NO: 4923199 - DNA, 17 bp, Homo sapiens
cttgtcagacataaagc

SEQ ID NO: 4923200 - DNA, 18 bp, Homo sapiens
cttgtcagacataaagcc

SEQ ID NO: 4923201 - DNA, 19 bp, Homo sapiens
cttgtcagacataaagcca

SEQ ID NO: 4923202 - DNA, 22 bp, Homo sapiens
cttgtcccacgtgtcttccact

SEQ ID NO: 4923203 - DNA, 16 bp, Homo sapiens
ctcatcttgtgaaatg

SEQ ID NO: 4923204 - DNA, 16 bp, Homo sapiens
ctcatggggtccaagt

SEQ ID NO: 4923205 - DNA, 16 bp, Homo sapiens
ctcatgtatcatctgg

SEQ ID NO: 4923206 - DNA, 17 bp, Homo sapiens
ctcatgtttatgaaaat

SEQ ID NO: 4923207 - DNA, 18 bp, Homo sapiens
ctcattccaccttcccat

SEQ ID NO: 4923208 - DNA, 12 bp, Homo sapiens
ctcattcctgta

SEQ ID NO: 4923209 - DNA, 11 bp, Homo sapiens
ctcattgaaat

SEQ ID NO: 4923210 - DNA, 12 bp, Homo sapiens
ctcattgaaatg

SEQ ID NO: 4923211 - DNA, 16 bp, Homo sapiens
ctcatttctaaaagaa

SEQ ID NO: 4923212 - DNA, 17 bp, Homo sapiens
ctcatttgttaaaatta

SEQ ID NO: 4923213 - DNA, 20 bp, Homo sapiens
ctcattttctataacagata

SEQ ID NO: 4923214 - DNA, 23 bp, Homo sapiens
ctcatttttgccatacatcagtt

SEQ ID NO: 4923215 - DNA, 23 bp, Homo sapiens
ctcatttttttttttgtttctga

SEQ ID NO: 4923216 - DNA, 17 bp, Homo sapiens
ctccaaaacccatgtgg

SEQ ID NO: 4923217 - DNA, 20 bp, Homo sapiens
ctccaaaacccatgtgggaa

SEQ ID NO: 4923218 - DNA, 15 bp, Homo sapiens
ctccaaaggccccct

SEQ ID NO: 4923219 - DNA, 16 bp, Homo sapiens
ctccaaagttatccag

SEQ ID NO: 4923220 - DNA, 21 bp, Homo sapiens
ctccaacacaaggctccaaga

SEQ ID NO: 4923221 - DNA, 14 bp, Homo sapiens
ctccaagattctag

SEQ ID NO: 4923222 - DNA, 16 bp, Homo sapiens
ctccacagcgagggca

SEQ ID NO: 4923223 - DNA, 19 bp, Homo sapiens
ctccacagcgagggcagct

SEQ ID NO: 4923224 - DNA, 22 bp, Homo sapiens
ctccacagcgagggcagctgct

SEQ ID NO: 4923225 - DNA, 15 bp, Homo sapiens
ctccacccttggcct

SEQ ID NO: 4923226 - DNA, 21 bp, Homo sapiens
ctccacccttggcctgtctca

SEQ ID NO: 4923227 - DNA, 22 bp, Homo sapiens
ctccacctcttcaccccccact

SEQ ID NO: 4923228 - DNA, 18 bp, Homo sapiens
ctccacgatcctgccacc

SEQ ID NO: 4923229 - DNA, 23 bp, Homo sapiens
ctccacgatcctgccaccctgta

SEQ ID NO: 4923230 - DNA, 15 bp, Homo sapiens
ctccactgccttcga

SEQ ID NO: 4923231 - DNA, 12 bp, Homo sapiens
ctccactgtcac

SEQ ID NO: 4923232 - DNA, 16 bp, Homo sapiens
ctccactgtcacattg

SEQ ID NO: 4923233 - DNA, 13 bp, Homo sapiens
ctccactgtcacc

SEQ ID NO: 4923234 - DNA, 21 bp, Homo sapiens
ctccacttcttgttccccact

SEQ ID NO: 4923235 - DNA, 18 bp, Homo sapiens
ctccagaagcctctggct

SEQ ID NO: 4923236 - DNA, 20 bp, Homo sapiens
ctccagaagcctctggctag

SEQ ID NO: 4923237 - DNA, 15 bp, Homo sapiens
ctccagacccctggc

SEQ ID NO: 4923238 - DNA, 21 bp, Homo sapiens
ctccagacccctggcttttca

SEQ ID NO: 4923239 - DNA, 21 bp, Homo sapiens
ctccagatagctcatttcatt

SEQ ID NO: 4923240 - DNA, 14 bp, Homo sapiens
ctccagatttttaa

SEQ ID NO: 4923241 - DNA, 15 bp, Homo sapiens
ctccagcaacttctt

SEQ ID NO: 4923242 - DNA, 19 bp, Homo sapiens
ctccagcccgggagcctag

SEQ ID NO: 4923243 - DNA, 23 bp, Homo sapiens
ctccagcccgggagcctaggacc

SEQ ID NO: 4923244 - DNA, 13 bp, Homo sapiens
ctccagcgctgag

SEQ ID NO: 4923245 - DNA, 20 bp, Homo sapiens
ctccagcgtcatcggactct

SEQ ID NO: 4923246 - DNA, 18 bp, Homo sapiens
ctccagctcaccagcccc

SEQ ID NO: 4923247 - DNA, 17 bp, Homo sapiens
ctccagctcagaaccca

SEQ ID NO: 4923248 - DNA, 19 bp, Homo sapiens
ctccagctcagaacccagg

SEQ ID NO: 4923249 - DNA, 20 bp, Homo sapiens
ctccagctcagaacccaggg

SEQ ID NO: 4923250 - DNA, 17 bp, Homo sapiens
ctccagctgcaccagag

SEQ ID NO: 4923251 - DNA, 20 bp, Homo sapiens
ctccagctgggctctgcaat

SEQ ID NO: 4923252 - DNA, 15 bp, Homo sapiens
ctccaggctccttta

SEQ ID NO: 4923253 - DNA, 20 bp, Homo sapiens
ctccaggctgtatcccatga

SEQ ID NO: 4923254 - DNA, 16 bp, Homo sapiens
ctccagggaatccaag

SEQ ID NO: 4923255 - DNA, 21 bp, Homo sapiens
ctccagggaatccaagcctcc

SEQ ID NO: 4923256 - DNA, 18 bp, Homo sapiens
ctccagggagattttgag

SEQ ID NO: 4923257 - DNA, 14 bp, Homo sapiens
ctccaggtggctct

SEQ ID NO: 4923258 - DNA, 14 bp, Homo sapiens
ctccagtattcttg

SEQ ID NO: 4923259 - DNA, 20 bp, Homo sapiens
ctccagtattcttgtcaaaa

SEQ ID NO: 4923260 - DNA, 21 bp, Homo sapiens
ctccagtccccctatccttgg

SEQ ID NO: 4923261 - DNA, 18 bp, Homo sapiens
ctccagtgccagcaatga

SEQ ID NO: 4923262 - DNA, 13 bp, Homo sapiens
ctccatccctcta

SEQ ID NO: 4923263 - DNA, 15 bp, Homo sapiens
ctccatccctctaat

SEQ ID NO: 4923264 - DNA, 22 bp, Homo sapiens
ctccatccctctaatgagactg

SEQ ID NO: 4923265 - DNA, 14 bp, Homo sapiens
ctccatctcatgta

SEQ ID NO: 4923266 - DNA, 12 bp, Homo sapiens
ctccatcttatt

SEQ ID NO: 4923267 - DNA, 14 bp, Homo sapiens
ctccatgctgcctc

SEQ ID NO: 4923268 - DNA, 17 bp, Homo sapiens
ctccatgctgcctccag

SEQ ID NO: 4923269 - DNA, 16 bp, Homo sapiens
ctccattaaagtctga

SEQ ID NO: 4923270 - DNA, 13 bp, Homo sapiens
ctccattctattt

SEQ ID NO: 4923271 - DNA, 14 bp, Homo sapiens
ctccattctatttt

SEQ ID NO: 4923272 - DNA, 20 bp, Homo sapiens
ctcccaaagtgctgagatta

SEQ ID NO: 4923273 - DNA, 22 bp, Homo sapiens
ctcccaaagtgctgagattaca

SEQ ID NO: 4923274 - DNA, 16 bp, Homo sapiens
ctcccaaagtgctggg

SEQ ID NO: 4923275 - DNA, 17 bp, Homo sapiens
ctcccaaagtgctggga

SEQ ID NO: 4923276 - DNA, 16 bp, Homo sapiens
ctcccaaggagaacaa

SEQ ID NO: 4923277 - DNA, 19 bp, Homo sapiens
ctcccaagtttccatagca

SEQ ID NO: 4923278 - DNA, 20 bp, Homo sapiens
ctcccacaggcccttcctct

SEQ ID NO: 4923279 - DNA, 21 bp, Homo sapiens
ctcccacaggcccttcctctc

SEQ ID NO: 4923280 - DNA, 18 bp, Homo sapiens
ctcccaccccatgcatta

SEQ ID NO: 4923281 - DNA, 15 bp, Homo sapiens
ctcccacccccatct

SEQ ID NO: 4923282 - DNA, 20 bp, Homo sapiens
ctcccacccccatctctccc

SEQ ID NO: 4923283 - DNA, 18 bp, Homo sapiens
ctcccacccccttctctg

SEQ ID NO: 4923284 - DNA, 22 bp, Homo sapiens
ctcccacccccttctctgctcc

SEQ ID NO: 4923285 - DNA, 14 bp, Homo sapiens
ctcccacctcagcc

SEQ ID NO: 4923286 - DNA, 13 bp, Homo sapiens
ctcccacctccag

SEQ ID NO: 4923287 - DNA, 14 bp, Homo sapiens
ctcccacctctgtg

SEQ ID NO: 4923288 - DNA, 15 bp, Homo sapiens
ctcccacctctgtga

SEQ ID NO: 4923289 - DNA, 21 bp, Homo sapiens
ctcccacgtgggagacaagaa

SEQ ID NO: 4923290 - DNA, 14 bp, Homo sapiens
ctcccactgagttt

SEQ ID NO: 4923291 - DNA, 15 bp, Homo sapiens
ctcccagaatcccag

SEQ ID NO: 4923292 - DNA, 21 bp, Homo sapiens
ctcccagaatcccagccggcc

SEQ ID NO: 4923293 - DNA, 21 bp, Homo sapiens
ctcccagaggtccagcccatc

SEQ ID NO: 4923294 - DNA, 21 bp, Homo sapiens
ctctgagatctaaggatgtca

SEQ ID NO: 4923295 - DNA, 15 bp, Homo sapiens
ctctgagcgggaggc

SEQ ID NO: 4923296 - DNA, 17 bp, Homo sapiens
ctctgagcgggaggcag

SEQ ID NO: 4923297 - DNA, 14 bp, Homo sapiens
ctctgaggacacta

SEQ ID NO: 4923298 - DNA, 15 bp, Homo sapiens
ctctgaggtgcctgt

SEQ ID NO: 4923299 - DNA, 22 bp, Homo sapiens
ctctgaggtgcctgtcccaccc

SEQ ID NO: 4923300 - DNA, 15 bp, Homo sapiens
ctctgatatgggact

SEQ ID NO: 4923301 - DNA, 18 bp, Homo sapiens
ctctgcaatgggcactgg

SEQ ID NO: 4923302 - DNA, 23 bp, Homo sapiens
ctctgcaatgggcactgggatga

SEQ ID NO: 4923303 - DNA, 18 bp, Homo sapiens
ctctgcaattcccctctg

SEQ ID NO: 4923304 - DNA, 22 bp, Homo sapiens
ctctgcaattcccctctgctgc

SEQ ID NO: 4923305 - DNA, 18 bp, Homo sapiens
ctctgcacatgtcttgta

SEQ ID NO: 4923306 - DNA, 13 bp, Homo sapiens
ctctgcatcccag

SEQ ID NO: 4923307 - DNA, 15 bp, Homo sapiens
ctctgcatcccagca

SEQ ID NO: 4923308 - DNA, 17 bp, Homo sapiens
ctctgcatcccagcacc

SEQ ID NO: 4923309 - DNA, 22 bp, Homo sapiens
ctctgcatcccagcacctgcct

SEQ ID NO: 4923310 - DNA, 11 bp, Homo sapiens
ctctgccacca

SEQ ID NO: 4923311 - DNA, 12 bp, Homo sapiens
ctctgccccagt

SEQ ID NO: 4923312 - DNA, 22 bp, Homo sapiens
ctctgccctcattactgggcct

SEQ ID NO: 4923313 - DNA, 23 bp, Homo sapiens
ctctgccctcattactgggcctt

SEQ ID NO: 4923314 - DNA, 19 bp, Homo sapiens
ctctgcctctgacacacag

SEQ ID NO: 4923315 - DNA, 10 bp, Homo sapiens
ctctgcctga

SEQ ID NO: 4923316 - DNA, 18 bp, Homo sapiens
ccctagaaacccaagctc

SEQ ID NO: 4923317 - DNA, 19 bp, Homo sapiens
ccctagaaacccaagctcc

SEQ ID NO: 4923318 - DNA, 22 bp, Homo sapiens
ccctagatctttctattccaaa

SEQ ID NO: 4923319 - DNA, 20 bp, Homo sapiens
ccctagcccagcgctctgcc

SEQ ID NO: 4923320 - DNA, 16 bp, Homo sapiens
ccctagcccaggagag

SEQ ID NO: 4923321 - DNA, 18 bp, Homo sapiens
ccctagcccaggagagag

SEQ ID NO: 4923322 - DNA, 14 bp, Homo sapiens
ccctaggagaccaa

SEQ ID NO: 4923323 - DNA, 21 bp, Homo sapiens
ccctaggagtatatttccgca

SEQ ID NO: 4923324 - DNA, 17 bp, Homo sapiens
ccctaggttcccggtcc

SEQ ID NO: 4923325 - DNA, 17 bp, Homo sapiens
ccctagtcccttcccct

SEQ ID NO: 4923326 - DNA, 16 bp, Homo sapiens
ccctagttccctctgc

SEQ ID NO: 4923327 - DNA, 18 bp, Homo sapiens
ccctagttccctctgctc

SEQ ID NO: 4923328 - DNA, 23 bp, Homo sapiens
ccctagttccctctgctcagcca

SEQ ID NO: 4923329 - DNA, 19 bp, Homo sapiens
ccctatactgtagtattct

SEQ ID NO: 4923330 - DNA, 14 bp, Homo sapiens
ccctatccttggca

SEQ ID NO: 4923331 - DNA, 16 bp, Homo sapiens
ccctatccttggcacc

SEQ ID NO: 4923332 - DNA, 16 bp, Homo sapiens
ccctcaacctcttctg

SEQ ID NO: 4923333 - DNA, 15 bp, Homo sapiens
ccctcacagcctctg

SEQ ID NO: 4923334 - DNA, 12 bp, Homo sapiens
ccctcaccaaca

SEQ ID NO: 4923335 - DNA, 13 bp, Homo sapiens
ccctcactctgcc

SEQ ID NO: 4923336 - DNA, 15 bp, Homo sapiens
ccctcactctgccag

SEQ ID NO: 4923337 - DNA, 18 bp, Homo sapiens
ccctcactctgccagggc

SEQ ID NO: 4923338 - DNA, 20 bp, Homo sapiens
ccctcactctgccagggcag

SEQ ID NO: 4923339 - DNA, 14 bp, Homo sapiens
ccctcactctggcc

SEQ ID NO: 4923340 - DNA, 14 bp, Homo sapiens
ccctcagatgtccc

SEQ ID NO: 4923341 - DNA, 16 bp, Homo sapiens
ccctcagatgtccctt

SEQ ID NO: 4923342 - DNA, 17 bp, Homo sapiens
ccctcaggactgcaaca

SEQ ID NO: 4923343 - DNA, 17 bp, Homo sapiens
ccctcattactgggcct

SEQ ID NO: 4923344 - DNA, 18 bp, Homo sapiens
ccctcattactgggcctt

SEQ ID NO: 4923345 - DNA, 19 bp, Homo sapiens
ccctccagaacacggctca

SEQ ID NO: 4923346 - DNA, 13 bp, Homo sapiens
ccctcccaccccc

SEQ ID NO: 4923347 - DNA, 15 bp, Homo sapiens
ccctcccccttgtcc

SEQ ID NO: 4923348 - DNA, 17 bp, Homo sapiens
ccctccccgcacccccc

SEQ ID NO: 4923349 - DNA, 14 bp, Homo sapiens
ccctccctggagtg

SEQ ID NO: 4923350 - DNA, 14 bp, Homo sapiens
ccctccctggctcc

SEQ ID NO: 4923351 - DNA, 19 bp, Homo sapiens
ccctccctggctcccatga

SEQ ID NO: 4923352 - DNA, 14 bp, Homo sapiens
ccctcccttcaacc

SEQ ID NO: 4923353 - DNA, 17 bp, Homo sapiens
ccctcctcacctctgga

SEQ ID NO: 4923354 - DNA, 21 bp, Homo sapiens
ccctcctcactggccatccct

SEQ ID NO: 4923355 - DNA, 19 bp, Homo sapiens
ccctcctctagctgtgggg

SEQ ID NO: 4923356 - DNA, 23 bp, Homo sapiens
ccctcctgaaccgcacagctcag

SEQ ID NO: 4923357 - DNA, 20 bp, Homo sapiens
ccctcctgagggaggacctg

SEQ ID NO: 4923358 - DNA, 18 bp, Homo sapiens
ccctccttgtccacccac

SEQ ID NO: 4923359 - DNA, 22 bp, Homo sapiens
ccctcgaagcgcgccactcgct

SEQ ID NO: 4923360 - DNA, 12 bp, Homo sapiens
ccctcgcctgtg

SEQ ID NO: 4923361 - DNA, 14 bp, Homo sapiens
ccctcgctgcttct

SEQ ID NO: 4923362 - DNA, 17 bp, Homo sapiens
ccctcgctgcttctgtg

SEQ ID NO: 4923363 - DNA, 20 bp, Homo sapiens
ccctctccccacccctaccc

SEQ ID NO: 4923364 - DNA, 11 bp, Homo sapiens
ccctctccctg

SEQ ID NO: 4923365 - DNA, 14 bp, Homo sapiens
ccctctctcttctg

SEQ ID NO: 4923366 - DNA, 18 bp, Homo sapiens
ccctctctcttctgctcc

SEQ ID NO: 4923367 - DNA, 22 bp, Homo sapiens
ccctctctcttctgctccaccc

SEQ ID NO: 4923368 - DNA, 23 bp, Homo sapiens
ccctctctcttctgctccaccct

SEQ ID NO: 4923369 - DNA, 16 bp, Homo sapiens
ccctctgacctgcact

SEQ ID NO: 4923370 - DNA, 14 bp, Homo sapiens
ccctctgctgctgt

SEQ ID NO: 4923371 - DNA, 15 bp, Homo sapiens
ccctctgctgctgtc

SEQ ID NO: 4923372 - DNA, 12 bp, Homo sapiens
ccctctggaggg

SEQ ID NO: 4923373 - DNA, 15 bp, Homo sapiens
ccctctgggaacctc

SEQ ID NO: 4923374 - DNA, 20 bp, Homo sapiens
ccctctgggaacctcccaga

SEQ ID NO: 4923375 - DNA, 17 bp, Homo sapiens
ccctctgtccaccagcc

SEQ ID NO: 4923376 - DNA, 11 bp, Homo sapiens
ccctcttcctg

SEQ ID NO: 4923377 - DNA, 15 bp, Homo sapiens
ccctcttcctgacga

SEQ ID NO: 4923378 - DNA, 20 bp, Homo sapiens
ccctcttcctgacgaaactg

SEQ ID NO: 4923379 - DNA, 14 bp, Homo sapiens
ccctcttcctgtga

SEQ ID NO: 4923380 - DNA, 15 bp, Homo sapiens
ccctcttgttttgtt

SEQ ID NO: 4923381 - DNA, 13 bp, Homo sapiens
ccctctttctctt

SEQ ID NO: 4923382 - DNA, 22 bp, Homo sapiens
ccctctttctctttcttccttt

SEQ ID NO: 4923383 - DNA, 13 bp, Homo sapiens
ccctcttttctta

SEQ ID NO: 4923384 - DNA, 16 bp, Homo sapiens
ccctcttttcttactc

SEQ ID NO: 4923385 - DNA, 21 bp, Homo sapiens
ccctcttttcttactcctcct

SEQ ID NO: 4923386 - DNA, 12 bp, Homo sapiens
ccctgaaacacg

SEQ ID NO: 4923387 - DNA, 11 bp, Homo sapiens
ccctgaagcca

SEQ ID NO: 4923388 - DNA, 15 bp, Homo sapiens
ccctgaagccagcct

SEQ ID NO: 4923389 - DNA, 23 bp, Homo sapiens
ccctgaaggaacattccttagtc

SEQ ID NO: 4923390 - DNA, 20 bp, Homo sapiens
ccctgaatcccccttgccac

SEQ ID NO: 4923391 - DNA, 20 bp, Homo sapiens
ccctgacagtccctcctctc

SEQ ID NO: 4923392 - DNA, 16 bp, Homo sapiens
ccctgagaagctgctc

SEQ ID NO: 4923393 - DNA, 18 bp, Homo sapiens
ccctgagccccagggtgc

SEQ ID NO: 4923394 - DNA, 22 bp, Homo sapiens
ccctgagcgcctggatttctgg

SEQ ID NO: 4923395 - DNA, 19 bp, Homo sapiens
ccctgaggagccaggccgg

SEQ ID NO: 4923396 - DNA, 18 bp, Homo sapiens
ccctgaggtcagggagtg

SEQ ID NO: 4923397 - DNA, 18 bp, Homo sapiens
ccctgaggtgaaagggag

SEQ ID NO: 4923398 - DNA, 20 bp, Homo sapiens
ccctgaggtgaaagggagct

SEQ ID NO: 4923399 - DNA, 16 bp, Homo sapiens
ccctgattgacctgct

SEQ ID NO: 4923400 - DNA, 17 bp, Homo sapiens
ccctgattgacctgctc

SEQ ID NO: 4923401 - DNA, 18 bp, Homo sapiens
ccctgattgacctgctcc

SEQ ID NO: 4923402 - DNA, 22 bp, Homo sapiens
ccctgattgacctgctccgctg

SEQ ID NO: 4923403 - DNA, 24 bp, Homo sapiens
ccctgcaaacagaacagggtcatg

SEQ ID NO: 4923404 - DNA, 14 bp, Homo sapiens
ccctgcaaggccca

SEQ ID NO: 4923405 - DNA, 15 bp, Homo sapiens
ccctgcaaggcccac

SEQ ID NO: 4923406 - DNA, 19 bp, Homo sapiens
ccctgcactaaagccagcc

SEQ ID NO: 4923407 - DNA, 21 bp, Homo sapiens
ccctgcactaaagccagcctg

SEQ ID NO: 4923408 - DNA, 12 bp, Homo sapiens
ccctgcacttgc

SEQ ID NO: 4923409 - DNA, 14 bp, Homo sapiens
ccctgcagcacgga

SEQ ID NO: 4923410 - DNA, 19 bp, Homo sapiens
ccctgcagcacggacaata

SEQ ID NO: 4923411 - DNA, 21 bp, Homo sapiens
ccctgcagcacggacaataaa

SEQ ID NO: 4923412 - DNA, 21 bp, Homo sapiens
ccagcgagccctggtggcagt

SEQ ID NO: 4923413 - DNA, 14 bp, Homo sapiens
ccagcgctgagtgg

SEQ ID NO: 4923414 - DNA, 21 bp, Homo sapiens
ccagcgtcccagtctctggca

SEQ ID NO: 4923415 - DNA, 22 bp, Homo sapiens
ccagcgtcccagtctctggcag

SEQ ID NO: 4923416 - DNA, 13 bp, Homo sapiens
ccagctcacagtg

SEQ ID NO: 4923417 - DNA, 16 bp, Homo sapiens
ccagctcaccagcccc

SEQ ID NO: 4923418 - DNA, 19 bp, Homo sapiens
ccagctcagaacccagggc

SEQ ID NO: 4923419 - DNA, 20 bp, Homo sapiens
ccagctcagaacccagggct

SEQ ID NO: 4923420 - DNA, 15 bp, Homo sapiens
ccagctcaggggcag

SEQ ID NO: 4923421 - DNA, 19 bp, Homo sapiens
ccagctcaggggcagctca

SEQ ID NO: 4923422 - DNA, 15 bp, Homo sapiens
ccagctcagtcccat

SEQ ID NO: 4923423 - DNA, 14 bp, Homo sapiens
ccagctccctagga

SEQ ID NO: 4923424 - DNA, 17 bp, Homo sapiens
ccagctcgcacccccct

SEQ ID NO: 4923425 - DNA, 17 bp, Homo sapiens
ccagctgcaccagagca

SEQ ID NO: 4923426 - DNA, 19 bp, Homo sapiens
ccagctgctgtcttctgga

SEQ ID NO: 4923427 - DNA, 18 bp, Homo sapiens
ccagctgggctctgcaat

SEQ ID NO: 4923428 - DNA, 18 bp, Homo sapiens
ccagctgtgagccttggc

SEQ ID NO: 4923429 - DNA, 19 bp, Homo sapiens
ccagctgtgagccttggct

SEQ ID NO: 4923430 - DNA, 20 bp, Homo sapiens
ccagctgtgctctggacagg

SEQ ID NO: 4923431 - DNA, 20 bp, Homo sapiens
ccagctttgctaccaaagca

SEQ ID NO: 4923432 - DNA, 16 bp, Homo sapiens
ccagcttttaaccatc

SEQ ID NO: 4923433 - DNA, 18 bp, Homo sapiens
ccagcttttaaccatctg

SEQ ID NO: 4923434 - DNA, 14 bp, Homo sapiens
ccaggaactgggcc

SEQ ID NO: 4923435 - DNA, 19 bp, Homo sapiens
ccaggacaccacacccagc

SEQ ID NO: 4923436 - DNA, 22 bp, Homo sapiens
ccaggacaccacacccagcctc

SEQ ID NO: 4923437 - DNA, 17 bp, Homo sapiens
ccaggactccctcctca

SEQ ID NO: 4923438 - DNA, 22 bp, Homo sapiens
ccaggactccctcctcacctct

SEQ ID NO: 4923439 - DNA, 23 bp, Homo sapiens
ccaggactccctcctcacctctg

SEQ ID NO: 4923440 - DNA, 13 bp, Homo sapiens
ccaggactgagcc

SEQ ID NO: 4923441 - DNA, 21 bp, Homo sapiens
ccaggagaaccactacatgca

SEQ ID NO: 4923442 - DNA, 17 bp, Homo sapiens
ccaggagagagaaagcc

SEQ ID NO: 4923443 - DNA, 19 bp, Homo sapiens
ccaggagccccgaggcctt

SEQ ID NO: 4923444 - DNA, 18 bp, Homo sapiens
ccaggagtttgagaccag

SEQ ID NO: 4923445 - DNA, 23 bp, Homo sapiens
ccaggatcatggtgtaataagac

SEQ ID NO: 4923446 - DNA, 18 bp, Homo sapiens
ccaggatgctgggtggcc

SEQ ID NO: 4923447 - DNA, 14 bp, Homo sapiens
ccaggcacagctga

SEQ ID NO: 4923448 - DNA, 19 bp, Homo sapiens
ccaggcacccagctttgtc

SEQ ID NO: 4923449 - DNA, 16 bp, Homo sapiens
ccaggcacggtttgga

SEQ ID NO: 4923450 - DNA, 16 bp, Homo sapiens
ccaggcactgctgccc

SEQ ID NO: 4923451 - DNA, 14 bp, Homo sapiens
ccaggcaggtagcc

SEQ ID NO: 4923452 - DNA, 12 bp, Homo sapiens
ccaggcaggtct

SEQ ID NO: 4923453 - DNA, 17 bp, Homo sapiens
ccaggcaggtgcctgga

SEQ ID NO: 4923454 - DNA, 12 bp, Homo sapiens
ccaggccagagg

SEQ ID NO: 4923455 - DNA, 15 bp, Homo sapiens
ccaggccattctgcc

SEQ ID NO: 4923456 - DNA, 17 bp, Homo sapiens
ccaggccattctgccgc

SEQ ID NO: 4923457 - DNA, 14 bp, Homo sapiens
ccaggcccctgcca

SEQ ID NO: 4923458 - DNA, 15 bp, Homo sapiens
ccaggcccctgccac

SEQ ID NO: 4923459 - DNA, 17 bp, Homo sapiens
ccaggccggccagcctc

SEQ ID NO: 4923460 - DNA, 13 bp, Homo sapiens
ccaggcctctgtg

SEQ ID NO: 4923461 - DNA, 16 bp, Homo sapiens
ccaggcctctgtgtcc

SEQ ID NO: 4923462 - DNA, 18 bp, Homo sapiens
ccaggcgccccttccccc

SEQ ID NO: 4923463 - DNA, 21 bp, Homo sapiens
ccaggcgggagcggtggccct

SEQ ID NO: 4923464 - DNA, 22 bp, Homo sapiens
ccaggcgggagcggtggccctg

SEQ ID NO: 4923465 - DNA, 17 bp, Homo sapiens
ccaggctccgcccttag

SEQ ID NO: 4923466 - DNA, 18 bp, Homo sapiens
ccaggctccgcccttagt

SEQ ID NO: 4923467 - DNA, 13 bp, Homo sapiens
ccaggctgccaag

SEQ ID NO: 4923468 - DNA, 19 bp, Homo sapiens
ccaggctgccaaggccaga

SEQ ID NO: 4923469 - DNA, 12 bp, Homo sapiens
ccaggctggcgt

SEQ ID NO: 4923470 - DNA, 20 bp, Homo sapiens
ccaggctggtctaaaactcc

SEQ ID NO: 4923471 - DNA, 17 bp, Homo sapiens
ccagggaatccaagcct

SEQ ID NO: 4923472 - DNA, 23 bp, Homo sapiens
ccagggcaccctgtggccctggc

SEQ ID NO: 4923473 - DNA, 14 bp, Homo sapiens
ccagggctctgccc

SEQ ID NO: 4923474 - DNA, 16 bp, Homo sapiens
ccagggctctgcccca

SEQ ID NO: 4923475 - DNA, 16 bp, Homo sapiens
ccagggctgccctgag

SEQ ID NO: 4923476 - DNA, 21 bp, Homo sapiens
ccagggcttacctgtacactg

SEQ ID NO: 4923477 - DNA, 13 bp, Homo sapiens
ccaggggaacctg

SEQ ID NO: 4923478 - DNA, 22 bp, Homo sapiens
ccaggggcccaaggcggcccct

SEQ ID NO: 4923479 - DNA, 18 bp, Homo sapiens
ccagggggaaggccaagg

SEQ ID NO: 4923480 - DNA, 20 bp, Homo sapiens
ccagggggactagcccctgt

SEQ ID NO: 4923481 - DNA, 20 bp, Homo sapiens
ccagggtctgtgtgaatgtg

SEQ ID NO: 4923482 - DNA, 22 bp, Homo sapiens
ccagggtctgtgtgaatgtggg

SEQ ID NO: 4923483 - DNA, 22 bp, Homo sapiens
ccagggtggacttagaaagcag

SEQ ID NO: 4923484 - DNA, 14 bp, Homo sapiens
ccaggtatggctct

SEQ ID NO: 4923485 - DNA, 15 bp, Homo sapiens
ccaggtatggctctg

SEQ ID NO: 4923486 - DNA, 14 bp, Homo sapiens
ccaggtcacacgac

SEQ ID NO: 4923487 - DNA, 16 bp, Homo sapiens
ccaggtggccactcca

SEQ ID NO: 4923488 - DNA, 21 bp, Homo sapiens
ccaggtggccactccagaccc

SEQ ID NO: 4923489 - DNA, 22 bp, Homo sapiens
ccaggtgtgtccacctgggcat

SEQ ID NO: 4923490 - DNA, 20 bp, Homo sapiens
ccaggtgttaacattccaag

SEQ ID NO: 4923491 - DNA, 23 bp, Homo sapiens
ccaggtgttaacattccaagact

SEQ ID NO: 4923492 - DNA, 14 bp, Homo sapiens
ccagtatctatata

SEQ ID NO: 4923493 - DNA, 14 bp, Homo sapiens
ccagtattagactg

SEQ ID NO: 4923494 - DNA, 14 bp, Homo sapiens
ccagtcacatgacc

SEQ ID NO: 4923495 - DNA, 15 bp, Homo sapiens
ccagtccccctatcc

SEQ ID NO: 4923496 - DNA, 18 bp, Homo sapiens
ccagtccccctatccttg

SEQ ID NO: 4923497 - DNA, 18 bp, Homo sapiens
cctggtggcagctgcggt

SEQ ID NO: 4923498 - DNA, 13 bp, Homo sapiens
cctggtggcagtg

SEQ ID NO: 4923499 - DNA, 19 bp, Homo sapiens
cctggtggcagtgggagct

SEQ ID NO: 4923500 - DNA, 20 bp, Homo sapiens
cctggtggcagtgggagctg

SEQ ID NO: 4923501 - DNA, 15 bp, Homo sapiens
cctgtaagccaaaga

SEQ ID NO: 4923502 - DNA, 18 bp, Homo sapiens
cctgtaagccaaagaaat

SEQ ID NO: 4923503 - DNA, 14 bp, Homo sapiens
cctgtaccccagca

SEQ ID NO: 4923504 - DNA, 16 bp, Homo sapiens
cctgtacctcatccca

SEQ ID NO: 4923505 - DNA, 18 bp, Homo sapiens
cctgtactgttctgtgtc

SEQ ID NO: 4923506 - DNA, 23 bp, Homo sapiens
cctgtagttaggaaataaaacct

SEQ ID NO: 4923507 - DNA, 19 bp, Homo sapiens
cctgtagttgcgtggactc

SEQ ID NO: 4923508 - DNA, 17 bp, Homo sapiens
cctgtataagcactgaa

SEQ ID NO: 4923509 - DNA, 13 bp, Homo sapiens
cctgtatgttgtc

SEQ ID NO: 4923510 - DNA, 19 bp, Homo sapiens
cctgtatttaagcaaatac

SEQ ID NO: 4923511 - DNA, 20 bp, Homo sapiens
cctgtcacattgcattctat

SEQ ID NO: 4923512 - DNA, 21 bp, Homo sapiens
cctgtcacattgcattctatt

SEQ ID NO: 4923513 - DNA, 16 bp, Homo sapiens
cctgtccagcctgggc

SEQ ID NO: 4923514 - DNA, 13 bp, Homo sapiens
cctgtcccacccc

SEQ ID NO: 4923515 - DNA, 15 bp, Homo sapiens
cctgtcccaccccca

SEQ ID NO: 4923516 - DNA, 19 bp, Homo sapiens
cctgtcccatgcaggccct

SEQ ID NO: 4923517 - DNA, 23 bp, Homo sapiens
cctgtcccatggacactccagtg

SEQ ID NO: 4923518 - DNA, 14 bp, Homo sapiens
cctgtccctcccac

SEQ ID NO: 4923519 - DNA, 14 bp, Homo sapiens
cctgtcctcactgc

SEQ ID NO: 4923520 - DNA, 17 bp, Homo sapiens
cctgtcctcccatcccc

SEQ ID NO: 4923521 - DNA, 21 bp, Homo sapiens
cctgtcctcccatcccctgga

SEQ ID NO: 4923522 - DNA, 23 bp, Homo sapiens
cctgtcctcccatcccctggact

SEQ ID NO: 4923523 - DNA, 21 bp, Homo sapiens
cctgtcgagttcggctctggg

SEQ ID NO: 4923524 - DNA, 16 bp, Homo sapiens
cctgtctagtctctcc

SEQ ID NO: 4923525 - DNA, 18 bp, Homo sapiens
cctgtctagtctctcctg

SEQ ID NO: 4923526 - DNA, 22 bp, Homo sapiens
cctgtctagtctctcctgtaag

SEQ ID NO: 4923527 - DNA, 23 bp, Homo sapiens
cctgtctagtctctcctgtaagc

SEQ ID NO: 4923528 - DNA, 16 bp, Homo sapiens
cctgtctcagcctccc

SEQ ID NO: 4923529 - DNA, 17 bp, Homo sapiens
cctgtctcatccccagg

SEQ ID NO: 4923530 - DNA, 20 bp, Homo sapiens
cctgtctgagactcacagga

SEQ ID NO: 4923531 - DNA, 14 bp, Homo sapiens
cctgtctttaagga

SEQ ID NO: 4923532 - DNA, 15 bp, Homo sapiens
cctgtgagtaaatat

SEQ ID NO: 4923533 - DNA, 16 bp, Homo sapiens
cctgtgagtaaatatt

SEQ ID NO: 4923534 - DNA, 20 bp, Homo sapiens
cctgtgatccacccaaccct

SEQ ID NO: 4923535 - DNA, 16 bp, Homo sapiens
cctgtgatgctgggca

SEQ ID NO: 4923536 - DNA, 22 bp, Homo sapiens
cctgtgcacacacacacacatg

SEQ ID NO: 4923537 - DNA, 20 bp, Homo sapiens
cctgtgcatgtatgtcttgg

SEQ ID NO: 4923538 - DNA, 24 bp, Homo sapiens
cctgtggaacataaaaaggacatc

SEQ ID NO: 4923539 - DNA, 15 bp, Homo sapiens
cctgtggaacccagc

SEQ ID NO: 4923540 - DNA, 21 bp, Homo sapiens
cctgtggaatgagtgtgcatg

SEQ ID NO: 4923541 - DNA, 14 bp, Homo sapiens
cctgtggagactgg

SEQ ID NO: 4923542 - DNA, 16 bp, Homo sapiens
cctgtggagctcagcc

SEQ ID NO: 4923543 - DNA, 14 bp, Homo sapiens
cctgtggccctggc

SEQ ID NO: 4923544 - DNA, 18 bp, Homo sapiens
cctgtgggtgtagccagg

SEQ ID NO: 4923545 - DNA, 14 bp, Homo sapiens
cctgtgtactgtgt

SEQ ID NO: 4923546 - DNA, 17 bp, Homo sapiens
cctgtgtatacagccct

SEQ ID NO: 4923547 - DNA, 14 bp, Homo sapiens
cctgtgtatggaaa

SEQ ID NO: 4923548 - DNA, 17 bp, Homo sapiens
cctgtgtggtactctga

SEQ ID NO: 4923549 - DNA, 21 bp, Homo sapiens
cctgtgtgtgcgcctacagga

SEQ ID NO: 4923550 - DNA, 19 bp, Homo sapiens
cctgttaggagaagctgca

SEQ ID NO: 4923551 - DNA, 14 bp, Homo sapiens
cctgttcagctcca

SEQ ID NO: 4923552 - DNA, 16 bp, Homo sapiens
cctgttcagctccagc

SEQ ID NO: 4923553 - DNA, 21 bp, Homo sapiens
cctgttcagctccagctcacc

SEQ ID NO: 4923554 - DNA, 12 bp, Homo sapiens
cctgttcccatt

SEQ ID NO: 4923555 - DNA, 19 bp, Homo sapiens
cctgttctgggtgcagctg

SEQ ID NO: 4923556 - DNA, 14 bp, Homo sapiens
cctgttcttcctcc

SEQ ID NO: 4923557 - DNA, 20 bp, Homo sapiens
cctgttcttcctccagctgc

SEQ ID NO: 4923558 - DNA, 17 bp, Homo sapiens
cctgttgctgtgtttaa

SEQ ID NO: 4923559 - DNA, 15 bp, Homo sapiens
cctgtttaatattta

SEQ ID NO: 4923560 - DNA, 19 bp, Homo sapiens
cctgtttattcccatcttt

SEQ ID NO: 4923561 - DNA, 12 bp, Homo sapiens
cctgtttcttcc

SEQ ID NO: 4923562 - DNA, 13 bp, Homo sapiens
cctgtttcttcct

SEQ ID NO: 4923563 - DNA, 16 bp, Homo sapiens
cctgttttgtacatag

SEQ ID NO: 4923564 - DNA, 16 bp, Homo sapiens
cctgtttttctgggtg

SEQ ID NO: 4923565 - DNA, 17 bp, Homo sapiens
cctgtttttctgggtgg

SEQ ID NO: 4923566 - DNA, 12 bp, Homo sapiens
ccttaaaatgga

SEQ ID NO: 4923567 - DNA, 22 bp, Homo sapiens
ccttaaaggcaccatctaatag

SEQ ID NO: 4923568 - DNA, 15 bp, Homo sapiens
ccttaacccaaggag

SEQ ID NO: 4923569 - DNA, 15 bp, Homo sapiens
ccttaattacttaaa

SEQ ID NO: 4923570 - DNA, 19 bp, Homo sapiens
ccttacatttgtgagattc

SEQ ID NO: 4923571 - DNA, 20 bp, Homo sapiens
ccttacccctggctgtttgg

SEQ ID NO: 4923572 - DNA, 15 bp, Homo sapiens
ccttaccccttagcc

SEQ ID NO: 4923573 - DNA, 13 bp, Homo sapiens
ccttaccctggga

SEQ ID NO: 4923574 - DNA, 21 bp, Homo sapiens
ccttagaaatgtaaactgcca

SEQ ID NO: 4923575 - DNA, 22 bp, Homo sapiens
ccttagaaatgtaaactgccat

SEQ ID NO: 4923576 - DNA, 16 bp, Homo sapiens
ccttagaacctttctt

SEQ ID NO: 4923577 - DNA, 18 bp, Homo sapiens
ccttagaggtcctctgga

SEQ ID NO: 4923578 - DNA, 19 bp, Homo sapiens
ccttagaggtcctctggag

SEQ ID NO: 4923579 - DNA, 19 bp, Homo sapiens
ccttagcagggaaacagct

SEQ ID NO: 4923580 - DNA, 13 bp, Homo sapiens
ccttaggccttcc

SEQ ID NO: 4923581 - DNA, 23 bp, Homo sapiens
ccttaggccttcctctctccaga

SEQ ID NO: 4923582 - DNA, 21 bp, Homo sapiens
ccttagggaagctggcctgag

SEQ ID NO: 4923583 - DNA, 19 bp, Homo sapiens
ccttagtgggccagggctg

SEQ ID NO: 4923584 - DNA, 14 bp, Homo sapiens
ccttatcagagcta

SEQ ID NO: 4923585 - DNA, 17 bp, Homo sapiens
ccttcaccccagtggcc

SEQ ID NO: 4923586 - DNA, 18 bp, Homo sapiens
ccttcagaaccatccata

SEQ ID NO: 4923587 - DNA, 10 bp, Homo sapiens
ccttcagaca

SEQ ID NO: 4923588 - DNA, 17 bp, Homo sapiens
ccttcagacaccctcaa

SEQ ID NO: 4923589 - DNA, 17 bp, Homo sapiens
ccttcagcccccagccc

SEQ ID NO: 4923590 - DNA, 19 bp, Homo sapiens
ccttcagcccccagcccct

SEQ ID NO: 4923591 - DNA, 24 bp, Homo sapiens
ccttcagtaccctctcagctccag

SEQ ID NO: 4923592 - DNA, 20 bp, Homo sapiens
ccttcagtcttgaatttcta

SEQ ID NO: 4923593 - DNA, 17 bp, Homo sapiens
ccttccaaaaattatta

SEQ ID NO: 4923594 - DNA, 17 bp, Homo sapiens
ccttccaaataataaag

SEQ ID NO: 4923595 - DNA, 15 bp, Homo sapiens
ccttccactgcctct

SEQ ID NO: 4923596 - DNA, 18 bp, Homo sapiens
ccttccactgcctctgcc

SEQ ID NO: 4923597 - DNA, 13 bp, Homo sapiens
ccttccagacata

SEQ ID NO: 4923598 - DNA, 18 bp, Homo sapiens
ccttcccaatcagcactg

SEQ ID NO: 4923599 - DNA, 21 bp, Homo sapiens
ccttcccaatcagcactgaaa

SEQ ID NO: 4923600 - DNA, 14 bp, Homo sapiens
ccttcccatcgctg

SEQ ID NO: 4923601 - DNA, 22 bp, Homo sapiens
ccttcccctccctggctcccat

SEQ ID NO: 4923602 - DNA, 23 bp, Homo sapiens
ccttcccttccactgcctctgcc

SEQ ID NO: 4923603 - DNA, 13 bp, Homo sapiens
ccttcccttgcca

SEQ ID NO: 4923604 - DNA, 14 bp, Homo sapiens
ccttcccttgccac

SEQ ID NO: 4923605 - DNA, 14 bp, Homo sapiens
ccttccgaccctct

SEQ ID NO: 4923606 - DNA, 11 bp, Homo sapiens
ccttcctataa

SEQ ID NO: 4923607 - DNA, 21 bp, Homo sapiens
cgaacaccctcgaagcgcgcc

SEQ ID NO: 4923608 - DNA, 12 bp, Homo sapiens
cgaactggctgc

SEQ ID NO: 4923609 - DNA, 14 bp, Homo sapiens
cgaacttcacaact

SEQ ID NO: 4923610 - DNA, 21 bp, Homo sapiens
cgaagtagcttgctccctgtg

SEQ ID NO: 4923611 - DNA, 19 bp, Homo sapiens
cgaagtggactggcccctg

SEQ ID NO: 4923612 - DNA, 13 bp, Homo sapiens
cgaatagctggga

SEQ ID NO: 4923613 - DNA, 14 bp, Homo sapiens
cgaatagctgggac

SEQ ID NO: 4923614 - DNA, 16 bp, Homo sapiens
cgaatagctgggacta

SEQ ID NO: 4923615 - DNA, 19 bp, Homo sapiens
cgaatcccctccctgtcaa

SEQ ID NO: 4923616 - DNA, 18 bp, Homo sapiens
cgacactcaccatgaagc

SEQ ID NO: 4923617 - DNA, 17 bp, Homo sapiens
cgacactctctggaagc

SEQ ID NO: 4923618 - DNA, 12 bp, Homo sapiens
cgacagcctggc

SEQ ID NO: 4923619 - DNA, 14 bp, Homo sapiens
cgacagcctggcac

SEQ ID NO: 4923620 - DNA, 17 bp, Homo sapiens
cgacaggcgagagagga

SEQ ID NO: 4923621 - DNA, 12 bp, Homo sapiens
cgaccacctgcc

SEQ ID NO: 4923622 - DNA, 16 bp, Homo sapiens
cgaccagggccgagga

SEQ ID NO: 4923623 - DNA, 18 bp, Homo sapiens
cgaccccccgtgggctcc

SEQ ID NO: 4923624 - DNA, 16 bp, Homo sapiens
cgaccctctgggaacc

SEQ ID NO: 4923625 - DNA, 18 bp, Homo sapiens
cgaccctctgggaacctc

SEQ ID NO: 4923626 - DNA, 23 bp, Homo sapiens
cgaccctctgggaacctcccaga

SEQ ID NO: 4923627 - DNA, 18 bp, Homo sapiens
cgacctggtttttaaata

SEQ ID NO: 4923628 - DNA, 14 bp, Homo sapiens
cgacgcccacccaa

SEQ ID NO: 4923629 - DNA, 13 bp, Homo sapiens
cgactagccagga

SEQ ID NO: 4923630 - DNA, 20 bp, Homo sapiens
cgagaaataaagtttgctta

SEQ ID NO: 4923631 - DNA, 17 bp, Homo sapiens
cgagacccaagggcaga

SEQ ID NO: 4923632 - DNA, 20 bp, Homo sapiens
cgagaccccggcttcctttc

SEQ ID NO: 4923633 - DNA, 15 bp, Homo sapiens
cgagagaggagccag

SEQ ID NO: 4923634 - DNA, 16 bp, Homo sapiens
cgagagaggagccaga

SEQ ID NO: 4923635 - DNA, 20 bp, Homo sapiens
cgagcaatatttatggatgc

SEQ ID NO: 4923636 - DNA, 15 bp, Homo sapiens
cgagcagtcctgcct

SEQ ID NO: 4923637 - DNA, 20 bp, Homo sapiens
cgaggactttgattgcacat

SEQ ID NO: 4923638 - DNA, 16 bp, Homo sapiens
cgaggaggtgcctgga

SEQ ID NO: 4923639 - DNA, 23 bp, Homo sapiens
cgaggaggtgcctggagtgccca

SEQ ID NO: 4923640 - DNA, 19 bp, Homo sapiens
cgaggccttctctgaagga

SEQ ID NO: 4923641 - DNA, 16 bp, Homo sapiens
cgagggcagctgctat

SEQ ID NO: 4923642 - DNA, 15 bp, Homo sapiens
cgagggtcctggctc

SEQ ID NO: 4923643 - DNA, 16 bp, Homo sapiens
cgagggtcctggctcc

SEQ ID NO: 4923644 - DNA, 23 bp, Homo sapiens
cgagggtcctggctcctgagggg

SEQ ID NO: 4923645 - DNA, 16 bp, Homo sapiens
cgagtagctgggacta

SEQ ID NO: 4923646 - DNA, 15 bp, Homo sapiens
cgagtcaccttccag

SEQ ID NO: 4923647 - DNA, 20 bp, Homo sapiens
cgagtctcttctccactgga

SEQ ID NO: 4923648 - DNA, 21 bp, Homo sapiens
cgagtctcttctccactggat

SEQ ID NO: 4923649 - DNA, 20 bp, Homo sapiens
cgagtggattgtaggtgcaa

SEQ ID NO: 4923650 - DNA, 13 bp, Homo sapiens
cgatatacagatg

SEQ ID NO: 4923651 - DNA, 15 bp, Homo sapiens
cgatccacctgtctc

SEQ ID NO: 4923652 - DNA, 20 bp, Homo sapiens
cgatccacctgtctcagcct

SEQ ID NO: 4923653 - DNA, 13 bp, Homo sapiens
cgattttgcctgt

SEQ ID NO: 4923654 - DNA, 10 bp, Homo sapiens
cgcacagcag

SEQ ID NO: 4923655 - DNA, 16 bp, Homo sapiens
cgcacctaccatcagg

SEQ ID NO: 4923656 - DNA, 14 bp, Homo sapiens
cgcacgcacacaca

SEQ ID NO: 4923657 - DNA, 22 bp, Homo sapiens
cgcacttcagaattccatatct

SEQ ID NO: 4923658 - DNA, 15 bp, Homo sapiens
cgcactttccacttc

SEQ ID NO: 4923659 - DNA, 20 bp, Homo sapiens
cgcactttccacttcttcct

SEQ ID NO: 4923660 - DNA, 12 bp, Homo sapiens
cgcagacctccc

SEQ ID NO: 4923661 - DNA, 15 bp, Homo sapiens
cgcagacctccccag

SEQ ID NO: 4923662 - DNA, 15 bp, Homo sapiens
cgcagccctgctttg

SEQ ID NO: 4923663 - DNA, 13 bp, Homo sapiens
cgcagctggactc

SEQ ID NO: 4923664 - DNA, 17 bp, Homo sapiens
cgcagctggactctgca

SEQ ID NO: 4923665 - DNA, 17 bp, Homo sapiens
cgcaggattcagccgga

SEQ ID NO: 4923666 - DNA, 19 bp, Homo sapiens
cgcatggtcacacactgat

SEQ ID NO: 4923667 - DNA, 14 bp, Homo sapiens
cgccagagggcttg

SEQ ID NO: 4923668 - DNA, 21 bp, Homo sapiens
cgccagtgtaatcccccagga

SEQ ID NO: 4923669 - DNA, 22 bp, Homo sapiens
cgccagtgtaatcccccaggag

SEQ ID NO: 4923670 - DNA, 14 bp, Homo sapiens
cgccatcagcccaa

SEQ ID NO: 4923671 - DNA, 17 bp, Homo sapiens
cgccattgccaccagga

SEQ ID NO: 4923672 - DNA, 18 bp, Homo sapiens
cgccattgccaccaggag

SEQ ID NO: 4923673 - DNA, 18 bp, Homo sapiens
cgcccacaggaagcctgc

SEQ ID NO: 4923674 - DNA, 20 bp, Homo sapiens
cgcccacaggaagcctgcag

SEQ ID NO: 4923675 - DNA, 21 bp, Homo sapiens
cgcccacaggaagcctgcagt

SEQ ID NO: 4923676 - DNA, 12 bp, Homo sapiens
cgcccacctccc

SEQ ID NO: 4923677 - DNA, 14 bp, Homo sapiens
cgcccacctcccca

SEQ ID NO: 4923678 - DNA, 11 bp, Homo sapiens
cgcccaggaga

SEQ ID NO: 4923679 - DNA, 23 bp, Homo sapiens
cgcccagttgggtggatgcctgg

SEQ ID NO: 4923680 - DNA, 13 bp, Homo sapiens
cgcccccagccta

SEQ ID NO: 4923681 - DNA, 14 bp, Homo sapiens
cgccccctcctcta

SEQ ID NO: 4923682 - DNA, 13 bp, Homo sapiens
cgcccctgcctgc

SEQ ID NO: 4923683 - DNA, 15 bp, Homo sapiens
cgcccctgcctgcca

SEQ ID NO: 4923684 - DNA, 15 bp, Homo sapiens
cgcccgcccctgcag

SEQ ID NO: 4923685 - DNA, 17 bp, Homo sapiens
cgcccgcccctgcagca

SEQ ID NO: 4923686 - DNA, 14 bp, Homo sapiens
cgccctcttcctga

SEQ ID NO: 4923687 - DNA, 15 bp, Homo sapiens
cgcccttaccttccc

SEQ ID NO: 4923688 - DNA, 19 bp, Homo sapiens
cgcccttagtcccccaact

SEQ ID NO: 4923689 - DNA, 20 bp, Homo sapiens
cgcccttggcttctgtgatg

SEQ ID NO: 4923690 - DNA, 14 bp, Homo sapiens
cgcctacaggagtg

SEQ ID NO: 4923691 - DNA, 11 bp, Homo sapiens
cgcctcccagc

SEQ ID NO: 4923692 - DNA, 16 bp, Homo sapiens
cgcctcccctgcccca

SEQ ID NO: 4923693 - DNA, 13 bp, Homo sapiens
cgcctctgcattc

SEQ ID NO: 4923694 - DNA, 20 bp, Homo sapiens
cgcctgccctcatggcccct

SEQ ID NO: 4923695 - DNA, 22 bp, Homo sapiens
cgcctgccctcatggcccctct

SEQ ID NO: 4923696 - DNA, 16 bp, Homo sapiens
cgcctggatttctggt

SEQ ID NO: 4923697 - DNA, 17 bp, Homo sapiens
cgcctgtagtcctagcc

SEQ ID NO: 4923698 - DNA, 15 bp, Homo sapiens
cgcctgtgatgctgg

SEQ ID NO: 4923699 - DNA, 16 bp, Homo sapiens
cgcctgtgatgctggg

SEQ ID NO: 4923700 - DNA, 13 bp, Homo sapiens
cgcctgtgcacac

SEQ ID NO: 4923701 - DNA, 14 bp, Homo sapiens
cgcctgtgcacaca

SEQ ID NO: 4923702 - DNA, 14 bp, Homo sapiens
cgccttaagctgat

SEQ ID NO: 4923703 - DNA, 13 bp, Homo sapiens
cgccttttgtata

SEQ ID NO: 4923704 - DNA, 14 bp, Homo sapiens
cgccttttgtatac

SEQ ID NO: 4923705 - DNA, 15 bp, Homo sapiens
cgccttttgtataca

SEQ ID NO: 4923706 - DNA, 18 bp, Homo sapiens
cgcgcacacacacacata

SEQ ID NO: 4923707 - DNA, 15 bp, Homo sapiens
cgcgccactcgcttc

SEQ ID NO: 4923708 - DNA, 20 bp, Homo sapiens
cgcgccactcgcttccccca

SEQ ID NO: 4923709 - DNA, 13 bp, Homo sapiens
cgcgcgcacacac

SEQ ID NO: 4923710 - DNA, 14 bp, Homo sapiens
cgcgcgcacacaca

SEQ ID NO: 4923711 - DNA, 12 bp, Homo sapiens
cgcggccagccc

SEQ ID NO: 4923712 - DNA, 14 bp, Homo sapiens
cgcggccagccccg

SEQ ID NO: 4923713 - DNA, 16 bp, Homo sapiens
cgcgtgcacacaccag

SEQ ID NO: 4923714 - DNA, 19 bp, Homo sapiens
cgcgtgcacgtggagagct

SEQ ID NO: 4923715 - DNA, 19 bp, Homo sapiens
cgcgtgccctcgctgcttc

SEQ ID NO: 4923716 - DNA, 15 bp, Homo sapiens
cgcgtttagaccaag

SEQ ID NO: 4923717 - DNA, 16 bp, Homo sapiens
cgctactataaagaga

SEQ ID NO: 4923718 - DNA, 22 bp, Homo sapiens
cgtgccgtgtgagtgtgacagg

SEQ ID NO: 4923719 - DNA, 13 bp, Homo sapiens
cgtggactctgca

SEQ ID NO: 4923720 - DNA, 14 bp, Homo sapiens
cgtggcaaatataa

SEQ ID NO: 4923721 - DNA, 15 bp, Homo sapiens
cgtggcaaatataaa

SEQ ID NO: 4923722 - DNA, 21 bp, Homo sapiens
cgtggcagataatcagcctct

SEQ ID NO: 4923723 - DNA, 22 bp, Homo sapiens
cgtggcagataatcagcctctt

SEQ ID NO: 4923724 - DNA, 21 bp, Homo sapiens
cgtggcttcccgctcagccct

SEQ ID NO: 4923725 - DNA, 14 bp, Homo sapiens
cgtgggtcagaaga

SEQ ID NO: 4923726 - DNA, 22 bp, Homo sapiens
cgtgtagctatggaagttgcat

SEQ ID NO: 4923727 - DNA, 14 bp, Homo sapiens
cgtgtctgtattta

SEQ ID NO: 4923728 - DNA, 22 bp, Homo sapiens
cgtgtctgtatttatgtgtgag

SEQ ID NO: 4923729 - DNA, 15 bp, Homo sapiens
cgtgtgagtgtgaca

SEQ ID NO: 4923730 - DNA, 20 bp, Homo sapiens
cgtgtgagtgtgacagggcc

SEQ ID NO: 4923731 - DNA, 12 bp, Homo sapiens
cgtgtgtagagt

SEQ ID NO: 4923732 - DNA, 18 bp, Homo sapiens
cgtgtgtagagttaagaa

SEQ ID NO: 4923733 - DNA, 15 bp, Homo sapiens
cgtgtgttctatcca

SEQ ID NO: 4923734 - DNA, 22 bp, Homo sapiens
cgttactcagggctcctcccag

SEQ ID NO: 4923735 - DNA, 16 bp, Homo sapiens
cgttagaccgctctct

SEQ ID NO: 4923736 - DNA, 13 bp, Homo sapiens
cgttagctttttc

SEQ ID NO: 4923737 - DNA, 21 bp, Homo sapiens
cgttcctgacatcacagcagc

SEQ ID NO: 4923738 - DNA, 20 bp, Homo sapiens
cgttgttgcatgtttgaaat

SEQ ID NO: 4923739 - DNA, 15 bp, Homo sapiens
cgtttagaccaagga

SEQ ID NO: 4923740 - DNA, 13 bp, Homo sapiens
cgttttgaagcta

SEQ ID NO: 4923741 - DNA, 15 bp, Homo sapiens
cgttttggaagctct

SEQ ID NO: 4923742 - DNA, 11 bp, Homo sapiens
ctaaaaataaa

SEQ ID NO: 4923743 - DNA, 17 bp, Homo sapiens
ctaaaagacatttgtta

SEQ ID NO: 4923744 - DNA, 22 bp, Homo sapiens
ctaaaagcaaaataaaaactat

SEQ ID NO: 4923745 - DNA, 14 bp, Homo sapiens
ctaaaatacattta

SEQ ID NO: 4923746 - DNA, 18 bp, Homo sapiens
ctaaaatatataatttat

SEQ ID NO: 4923747 - DNA, 16 bp, Homo sapiens
ctaaaatcttggaagt

SEQ ID NO: 4923748 - DNA, 18 bp, Homo sapiens
ctaaaatgtgatgttcta

SEQ ID NO: 4923749 - DNA, 21 bp, Homo sapiens
ctaaaatgtgatgttctaagg

SEQ ID NO: 4923750 - DNA, 16 bp, Homo sapiens
ctaaacccaatccaaa

SEQ ID NO: 4923751 - DNA, 16 bp, Homo sapiens
ctaaacccctgtccca

SEQ ID NO: 4923752 - DNA, 16 bp, Homo sapiens
ctaaacggattccaaa

SEQ ID NO: 4923753 - DNA, 12 bp, Homo sapiens
ctaaagaccaaa

SEQ ID NO: 4923754 - DNA, 16 bp, Homo sapiens
ctaaagaccaaacttc

SEQ ID NO: 4923755 - DNA, 23 bp, Homo sapiens
ctaaagaccaaacttcactctgg

SEQ ID NO: 4923756 - DNA, 19 bp, Homo sapiens
ctaaagagcacttactgta

SEQ ID NO: 4923757 - DNA, 17 bp, Homo sapiens
ctaaagatggagtttct

SEQ ID NO: 4923758 - DNA, 12 bp, Homo sapiens
ctaaagattcta

SEQ ID NO: 4923759 - DNA, 23 bp, Homo sapiens
ctaaagattctatagttctagac

SEQ ID NO: 4923760 - DNA, 12 bp, Homo sapiens
ctaaagctctga

SEQ ID NO: 4923761 - DNA, 19 bp, Homo sapiens
ctaaaggtccacaggtcta

SEQ ID NO: 4923762 - DNA, 17 bp, Homo sapiens
ctaaagttctaagattc

SEQ ID NO: 4923763 - DNA, 18 bp, Homo sapiens
ctaaagttctaagattct

SEQ ID NO: 4923764 - DNA, 20 bp, Homo sapiens
ctaaagttctaagattctga

SEQ ID NO: 4923765 - DNA, 23 bp, Homo sapiens
ctaaatatgaaccctttgtttct

SEQ ID NO: 4923766 - DNA, 21 bp, Homo sapiens
ctaaatctatttattaatatt

SEQ ID NO: 4923767 - DNA, 17 bp, Homo sapiens
ctaaatgcctaataaac

SEQ ID NO: 4923768 - DNA, 18 bp, Homo sapiens
ctaaatgcctaataaaca

SEQ ID NO: 4923769 - DNA, 19 bp, Homo sapiens
ctaaatgcctaataaacaa

SEQ ID NO: 4923770 - DNA, 15 bp, Homo sapiens
ctaaatgctgaaaaa

SEQ ID NO: 4923771 - DNA, 18 bp, Homo sapiens
ctaaatggtcgcccagga

SEQ ID NO: 4923772 - DNA, 21 bp, Homo sapiens
ctaaatggtcgcccaggagac

SEQ ID NO: 4923773 - DNA, 22 bp, Homo sapiens
ctaaatgttctatggttatgaa

SEQ ID NO: 4923774 - DNA, 14 bp, Homo sapiens
ctaaattccacact

SEQ ID NO: 4923775 - DNA, 15 bp, Homo sapiens
ctaaatttgatactt

SEQ ID NO: 4923776 - DNA, 16 bp, Homo sapiens
ctaaatttgatactta

SEQ ID NO: 4923777 - DNA, 21 bp, Homo sapiens
ctaaatttgatacttatattt

SEQ ID NO: 4923778 - DNA, 20 bp, Homo sapiens
ctaaatttggggacagattc

SEQ ID NO: 4923779 - DNA, 17 bp, Homo sapiens
ctaacaaaagatgaaag

SEQ ID NO: 4923780 - DNA, 24 bp, Homo sapiens
ctaacagcatccccaaaacaaagt

SEQ ID NO: 4923781 - DNA, 21 bp, Homo sapiens
ctaacattttaaataaaagaa

SEQ ID NO: 4923782 - DNA, 14 bp, Homo sapiens
ctaaccacgctgga

SEQ ID NO: 4923783 - DNA, 18 bp, Homo sapiens
ctaaccccaacgcacagg

SEQ ID NO: 4923784 - DNA, 13 bp, Homo sapiens
ctaaccccttcca

SEQ ID NO: 4923785 - DNA, 14 bp, Homo sapiens
ctaaccttgaatgc

SEQ ID NO: 4923786 - DNA, 17 bp, Homo sapiens
ctaaccttgaatgctgc

SEQ ID NO: 4923787 - DNA, 22 bp, Homo sapiens
ctaacgttgagcccctggaggc

SEQ ID NO: 4923788 - DNA, 21 bp, Homo sapiens
ctaactagacaccaaagttct

SEQ ID NO: 4923789 - DNA, 23 bp, Homo sapiens
ctaactagacaccaaagttctaa

SEQ ID NO: 4923790 - DNA, 21 bp, Homo sapiens
ctaactcaccagccccactgc

SEQ ID NO: 4923791 - DNA, 14 bp, Homo sapiens
ctaactcctgagaa

SEQ ID NO: 4923792 - DNA, 22 bp, Homo sapiens
ctaacttattttatttccatca

SEQ ID NO: 4923793 - DNA, 17 bp, Homo sapiens
ctaagaaatatgtgaga

SEQ ID NO: 4923794 - DNA, 20 bp, Homo sapiens
ctaagactcaaatgttctaa

SEQ ID NO: 4923795 - DNA, 21 bp, Homo sapiens
ctaagactcaaatgttctaag

SEQ ID NO: 4923796 - DNA, 20 bp, Homo sapiens
ctaagagccatttaggggcc

SEQ ID NO: 4923797 - DNA, 18 bp, Homo sapiens
ctaagatgtgatattcta

SEQ ID NO: 4923798 - DNA, 11 bp, Homo sapiens
ctaagattcta

SEQ ID NO: 4923799 - DNA, 15 bp, Homo sapiens
ctaagattctaaagg

SEQ ID NO: 4923800 - DNA, 21 bp, Homo sapiens
ctaagattctaatgatgatca

SEQ ID NO: 4923801 - DNA, 13 bp, Homo sapiens
ctaagattctaga

SEQ ID NO: 4923802 - DNA, 15 bp, Homo sapiens
ctaagattctagatc

SEQ ID NO: 4923803 - DNA, 22 bp, Homo sapiens
ctaagattctagatcagatgct

SEQ ID NO: 4923804 - DNA, 18 bp, Homo sapiens
ctaagattctgattttag

SEQ ID NO: 4923805 - DNA, 19 bp, Homo sapiens
ctaagattctgattttagg

SEQ ID NO: 4923806 - DNA, 15 bp, Homo sapiens
ctaagcaagctaacc

SEQ ID NO: 4923807 - DNA, 21 bp, Homo sapiens
ctaagcatagcaaacagagga

SEQ ID NO: 4923808 - DNA, 14 bp, Homo sapiens
ctaagccagcctgg

SEQ ID NO: 4923809 - DNA, 22 bp, Homo sapiens
ctaagcgcacattcatgtgggc

SEQ ID NO: 4923810 - DNA, 22 bp, Homo sapiens
ctaagctaggaatgaaatcctg

SEQ ID NO: 4923811 - DNA, 19 bp, Homo sapiens
ctaagctgcagcttcctgt

SEQ ID NO: 4923812 - DNA, 19 bp, Homo sapiens
ctaaggacctgaaattcca

SEQ ID NO: 4923813 - DNA, 13 bp, Homo sapiens
ctaaggcctactt

SEQ ID NO: 4923814 - DNA, 21 bp, Homo sapiens
ctaaggcctaggattctaaaa

SEQ ID NO: 4923815 - DNA, 22 bp, Homo sapiens
ctaaggctctatgagtctagat

SEQ ID NO: 4923816 - DNA, 11 bp, Homo sapiens
ctaaggctctg

SEQ ID NO: 4923817 - DNA, 19 bp, Homo sapiens
ctaaggctctgagagtcta

SEQ ID NO: 4923818 - DNA, 15 bp, Homo sapiens
ctaagggaagacatt

SEQ ID NO: 4923819 - DNA, 11 bp, Homo sapiens
ctaagggggag

SEQ ID NO: 4923820 - DNA, 19 bp, Homo sapiens
ctaagggggaggggaagtc

SEQ ID NO: 4923821 - DNA, 21 bp, Homo sapiens
ctaagggtcgaaagctctaga

SEQ ID NO: 4923822 - DNA, 22 bp, Homo sapiens
ctaagggtcgaaagctctagaa

SEQ ID NO: 4923823 - DNA, 18 bp, Homo sapiens
ctaagggtgggtgctcag

SEQ ID NO: 4923824 - DNA, 20 bp, Homo sapiens
ctaaggtccggtgttctaag

SEQ ID NO: 4923825 - DNA, 15 bp, Homo sapiens
ctaaggtgtgctctg

SEQ ID NO: 4923826 - DNA, 12 bp, Homo sapiens
ctaaggttctaa

SEQ ID NO: 4923827 - DNA, 21 bp, Homo sapiens
ctatcaagtcaatcatttctc

SEQ ID NO: 4923828 - DNA, 13 bp, Homo sapiens
ctatcagaagacc

SEQ ID NO: 4923829 - DNA, 18 bp, Homo sapiens
ctatcattgcttcctcct

SEQ ID NO: 4923830 - DNA, 19 bp, Homo sapiens
ctatcattgcttcctcctc

SEQ ID NO: 4923831 - DNA, 20 bp, Homo sapiens
ctatcattgcttcctcctcc

SEQ ID NO: 4923832 - DNA, 18 bp, Homo sapiens
ctatccaaacatgtattt

SEQ ID NO: 4923833 - DNA, 20 bp, Homo sapiens
ctatccaaacatgtatttat

SEQ ID NO: 4923834 - DNA, 16 bp, Homo sapiens
ctatccatgcaccaaa

SEQ ID NO: 4923835 - DNA, 12 bp, Homo sapiens
ctatctcctgac

SEQ ID NO: 4923836 - DNA, 14 bp, Homo sapiens
ctatctcctgacag

SEQ ID NO: 4923837 - DNA, 15 bp, Homo sapiens
ctatctcctgacaga

SEQ ID NO: 4923838 - DNA, 17 bp, Homo sapiens
ctatctctcaaaacttg

SEQ ID NO: 4923839 - DNA, 17 bp, Homo sapiens
ctatctctgtgtgcaca

SEQ ID NO: 4923840 - DNA, 20 bp, Homo sapiens
ctatctggaggccttccagc

SEQ ID NO: 4923841 - DNA, 23 bp, Homo sapiens
ctatctggaggccttccagctgc

SEQ ID NO: 4923842 - DNA, 24 bp, Homo sapiens
ctatctggccatatttactacctt

SEQ ID NO: 4923843 - DNA, 15 bp, Homo sapiens
ctatctgggcctggg

SEQ ID NO: 4923844 - DNA, 16 bp, Homo sapiens
ctatctgggcctgggc

SEQ ID NO: 4923845 - DNA, 21 bp, Homo sapiens
ctatctgggcctgggctaggg

SEQ ID NO: 4923846 - DNA, 21 bp, Homo sapiens
ctatcttagtggttccccacc

SEQ ID NO: 4923847 - DNA, 12 bp, Homo sapiens
ctatgaacaact

SEQ ID NO: 4923848 - DNA, 17 bp, Homo sapiens
ctatgacagaaaagtaa

SEQ ID NO: 4923849 - DNA, 16 bp, Homo sapiens
ctatgactgctcccca

SEQ ID NO: 4923850 - DNA, 14 bp, Homo sapiens
ctatgagcatcctg

SEQ ID NO: 4923851 - DNA, 21 bp, Homo sapiens
ctatgagcatcctgagccccg

SEQ ID NO: 4923852 - DNA, 12 bp, Homo sapiens
ctatgaggaaag

SEQ ID NO: 4923853 - DNA, 13 bp, Homo sapiens
ctatgagtctaga

SEQ ID NO: 4923854 - DNA, 14 bp, Homo sapiens
ctatgagtctagat

SEQ ID NO: 4923855 - DNA, 15 bp, Homo sapiens
ctatgagtctagatg

SEQ ID NO: 4923856 - DNA, 18 bp, Homo sapiens
ctatgcacatatggactc

SEQ ID NO: 4923857 - DNA, 21 bp, Homo sapiens
ctatgcacatatggactctgc

SEQ ID NO: 4923858 - DNA, 19 bp, Homo sapiens
ctatgccagctcagtccca

SEQ ID NO: 4923859 - DNA, 20 bp, Homo sapiens
ctatgccagctcagtcccat

SEQ ID NO: 4923860 - DNA, 21 bp, Homo sapiens
ctatgctggtaggctcctgcc

SEQ ID NO: 4923861 - DNA, 18 bp, Homo sapiens
ctatgctgtttgtagtga

SEQ ID NO: 4923862 - DNA, 12 bp, Homo sapiens
ctatggacacag

SEQ ID NO: 4923863 - DNA, 22 bp, Homo sapiens
ctatggcagaaaaaatgtctgt

SEQ ID NO: 4923864 - DNA, 23 bp, Homo sapiens
ctatggcagaaaaaatgtctgta

SEQ ID NO: 4923865 - DNA, 23 bp, Homo sapiens
ctatgggactcaatgcactgaca

SEQ ID NO: 4923866 - DNA, 13 bp, Homo sapiens
ctatgggagcccc

SEQ ID NO: 4923867 - DNA, 16 bp, Homo sapiens
ctatgggagccccagg

SEQ ID NO: 4923868 - DNA, 20 bp, Homo sapiens
ctatgtactagtactgtgta

SEQ ID NO: 4923869 - DNA, 22 bp, Homo sapiens
ctatgtgtagggcgggaggatg

SEQ ID NO: 4923870 - DNA, 16 bp, Homo sapiens
ctatgttactattttc

SEQ ID NO: 4923871 - DNA, 14 bp, Homo sapiens
ctatgtttgcactt

SEQ ID NO: 4923872 - DNA, 12 bp, Homo sapiens
ctattaatatat

SEQ ID NO: 4923873 - DNA, 14 bp, Homo sapiens
ctattaatatatgt

SEQ ID NO: 4923874 - DNA, 15 bp, Homo sapiens
ctattaatatatgta

SEQ ID NO: 4923875 - DNA, 18 bp, Homo sapiens
ctattcattaaatgtttg

SEQ ID NO: 4923876 - DNA, 23 bp, Homo sapiens
ctattccttctggcctttcctct

SEQ ID NO: 4923877 - DNA, 19 bp, Homo sapiens
ctattcctttcccttcctc

SEQ ID NO: 4923878 - DNA, 20 bp, Homo sapiens
ctattcctttcccttcctct

SEQ ID NO: 4923879 - DNA, 22 bp, Homo sapiens
ctattcctttcccttcctcttc

SEQ ID NO: 4923880 - DNA, 15 bp, Homo sapiens
ctattctgagaaaac

SEQ ID NO: 4923881 - DNA, 24 bp, Homo sapiens
ctattctgtgttgcattattcatt

SEQ ID NO: 4923882 - DNA, 18 bp, Homo sapiens
ctattgatttttacttca

SEQ ID NO: 4923883 - DNA, 20 bp, Homo sapiens
ctatttaaacttataaatca

SEQ ID NO: 4923884 - DNA, 23 bp, Homo sapiens
ctatttacctgcaggctgagcca

SEQ ID NO: 4923885 - DNA, 17 bp, Homo sapiens
ctatttatatgtacatg

SEQ ID NO: 4923886 - DNA, 14 bp, Homo sapiens
ctatttattaatat

SEQ ID NO: 4923887 - DNA, 15 bp, Homo sapiens
ctatttattaatatt

SEQ ID NO: 4923888 - DNA, 17 bp, Homo sapiens
ctatttattaatattta

SEQ ID NO: 4923889 - DNA, 17 bp, Homo sapiens
ctatttattttcctaaa

SEQ ID NO: 4923890 - DNA, 14 bp, Homo sapiens
ctatttatttttac

SEQ ID NO: 4923891 - DNA, 17 bp, Homo sapiens
ctatttgtctttcagga

SEQ ID NO: 4923892 - DNA, 22 bp, Homo sapiens
ctatttgttcttcaagaacttt

SEQ ID NO: 4923893 - DNA, 14 bp, Homo sapiens
ctattttaaaataa

SEQ ID NO: 4923894 - DNA, 22 bp, Homo sapiens
ctattttaaaataaattagttg

SEQ ID NO: 4923895 - DNA, 21 bp, Homo sapiens
ctattttgatgcagcatttga

SEQ ID NO: 4923896 - DNA, 17 bp, Homo sapiens
ctattttggattgtata

SEQ ID NO: 4923897 - DNA, 12 bp, Homo sapiens
ctattttgtaaa

SEQ ID NO: 4923898 - DNA, 19 bp, Homo sapiens
ctattttgtaaactcaaaa

SEQ ID NO: 4923899 - DNA, 21 bp, Homo sapiens
ctatttttgtaaactggaatt

SEQ ID NO: 4923900 - DNA, 22 bp, Homo sapiens
ctatttttgtcttatatatatt

SEQ ID NO: 4923901 - DNA, 15 bp, Homo sapiens
ctatttttgttttta

SEQ ID NO: 4923902 - DNA, 20 bp, Homo sapiens
ctcaaaaatacaaaataaaa

SEQ ID NO: 4923903 - DNA, 12 bp, Homo sapiens
ctcaaaagcatt

SEQ ID NO: 4923904 - DNA, 21 bp, Homo sapiens
ctcaaaagcatttatcattct

SEQ ID NO: 4923905 - DNA, 12 bp, Homo sapiens
ctcaaaatgtgt

SEQ ID NO: 4923906 - DNA, 22 bp, Homo sapiens
ctcaaactaaaagacatttgtt

SEQ ID NO: 4923907 - DNA, 17 bp, Homo sapiens
ctcaaatgttctaagtt

SEQ ID NO: 4923908 - DNA, 23 bp, Homo sapiens
ctcaaatgttctaagtttctaag

SEQ ID NO: 4923909 - DNA, 15 bp, Homo sapiens
ctcaacaaagcacag

SEQ ID NO: 4923910 - DNA, 17 bp, Homo sapiens
ctcaactttctgttgga

SEQ ID NO: 4923911 - DNA, 19 bp, Homo sapiens
ctcaagagggcactggtgg

SEQ ID NO: 4923912 - DNA, 23 bp, Homo sapiens
ctcaagcagcgaccgccccctcc

SEQ ID NO: 4923913 - DNA, 13 bp, Homo sapiens
ctcaaggaatctt

SEQ ID NO: 4923914 - DNA, 14 bp, Homo sapiens
ctcaaggaatcttt

SEQ ID NO: 4923915 - DNA, 20 bp, Homo sapiens
ctcaaggttttaggttctaa

SEQ ID NO: 4923916 - DNA, 14 bp, Homo sapiens
ctcaagtcctcttt

SEQ ID NO: 4923917 - DNA, 19 bp, Homo sapiens
ctcaagtgattctcctgcc

SEQ ID NO: 4923918 - DNA, 21 bp, Homo sapiens
ctcaagtgattctcctgcctc

SEQ ID NO: 4923919 - DNA, 13 bp, Homo sapiens
ctcaagttctaag

SEQ ID NO: 4923920 - DNA, 14 bp, Homo sapiens
ctcaagttctaaga

SEQ ID NO: 4923921 - DNA, 16 bp, Homo sapiens
ctcaataaatgattct

SEQ ID NO: 4923922 - DNA, 14 bp, Homo sapiens
ctcaatcctctaag

SEQ ID NO: 4923923 - DNA, 13 bp, Homo sapiens
ctcaatgcactga

SEQ ID NO: 4923924 - DNA, 17 bp, Homo sapiens
ctcaatggactggaagg

SEQ ID NO: 4923925 - DNA, 22 bp, Homo sapiens
ctcaatggcctaaaactggcct

SEQ ID NO: 4923926 - DNA, 23 bp, Homo sapiens
ctcaatggcctaaaactggcctg

SEQ ID NO: 4923927 - DNA, 18 bp, Homo sapiens
ctcaatgtttgtaataat

SEQ ID NO: 4923928 - DNA, 17 bp, Homo sapiens
ctcaatttttgtctcag

SEQ ID NO: 4923929 - DNA, 22 bp, Homo sapiens
ctcacaaaccatgcaaatgcta

SEQ ID NO: 4923930 - DNA, 17 bp, Homo sapiens
ctcacagaacccttgga

SEQ ID NO: 4923931 - DNA, 11 bp, Homo sapiens
ctcacagcctc

SEQ ID NO: 4923932 - DNA, 15 bp, Homo sapiens
ctcacagcctctgac

SEQ ID NO: 4923933 - DNA, 22 bp, Homo sapiens
ctcacagcctctgacccctcct

SEQ ID NO: 4923934 - DNA, 23 bp, Homo sapiens
ctcacaggttggaagagaatcac

SEQ ID NO: 4923935 - DNA, 22 bp, Homo sapiens
ctcacagtacagcatgtgcctt

SEQ ID NO: 4923936 - DNA, 16 bp, Homo sapiens
ccagaaatcattttac

SEQ ID NO: 4923937 - DNA, 22 bp, Homo sapiens
ccagaaatgtctaaatgctgaa

SEQ ID NO: 4923938 - DNA, 13 bp, Homo sapiens
ccagaaattagaa

SEQ ID NO: 4923939 - DNA, 15 bp, Homo sapiens
ccagaacttccctga

SEQ ID NO: 4923940 - DNA, 18 bp, Homo sapiens
ccagaagaagagaagctg

SEQ ID NO: 4923941 - DNA, 24 bp, Homo sapiens
ccagaagatcccctcaggactgca

SEQ ID NO: 4923942 - DNA, 20 bp, Homo sapiens
ccagaagcctctggctagag

SEQ ID NO: 4923943 - DNA, 16 bp, Homo sapiens
ccagaagcttccatag

SEQ ID NO: 4923944 - DNA, 13 bp, Homo sapiens
ccagaatcccagc

SEQ ID NO: 4923945 - DNA, 14 bp, Homo sapiens
ccagaatcccagcc

SEQ ID NO: 4923946 - DNA, 17 bp, Homo sapiens
ccagaatgctgtacatc

SEQ ID NO: 4923947 - DNA, 21 bp, Homo sapiens
ccagaatgctgtacatctatt

SEQ ID NO: 4923948 - DNA, 23 bp, Homo sapiens
ccagaatggtctttctaatgtgt

SEQ ID NO: 4923949 - DNA, 20 bp, Homo sapiens
ccagaattgtgcaaatggaa

SEQ ID NO: 4923950 - DNA, 15 bp, Homo sapiens
ccagaatttggaaat

SEQ ID NO: 4923951 - DNA, 18 bp, Homo sapiens
ccagaatttggaaatcct

SEQ ID NO: 4923952 - DNA, 18 bp, Homo sapiens
ccagacagacatctctgc

SEQ ID NO: 4923953 - DNA, 16 bp, Homo sapiens
ccagacagtgtgctgt

SEQ ID NO: 4923954 - DNA, 20 bp, Homo sapiens
ccagacatacgaaacacaaa

SEQ ID NO: 4923955 - DNA, 15 bp, Homo sapiens
ccagacccctggctt

SEQ ID NO: 4923956 - DNA, 24 bp, Homo sapiens
ccagacccctggcttttcactgct

SEQ ID NO: 4923957 - DNA, 16 bp, Homo sapiens
ccagagaattcttaga

SEQ ID NO: 4923958 - DNA, 21 bp, Homo sapiens
ccagagaccgtcctcacccct

SEQ ID NO: 4923959 - DNA, 16 bp, Homo sapiens
ccagagactttgtaga

SEQ ID NO: 4923960 - DNA, 13 bp, Homo sapiens
ccagagagggtgg

SEQ ID NO: 4923961 - DNA, 14 bp, Homo sapiens
ccagagagggtggt

SEQ ID NO: 4923962 - DNA, 14 bp, Homo sapiens
ccagagagtcctgt

SEQ ID NO: 4923963 - DNA, 16 bp, Homo sapiens
ccagagagtggctcct

SEQ ID NO: 4923964 - DNA, 22 bp, Homo sapiens
ccagagagtggctcctcccggt

SEQ ID NO: 4923965 - DNA, 15 bp, Homo sapiens
ccagagcaacctctc

SEQ ID NO: 4923966 - DNA, 14 bp, Homo sapiens
ccagagcagatgca

SEQ ID NO: 4923967 - DNA, 18 bp, Homo sapiens
ccagagcagatgcagaga

SEQ ID NO: 4923968 - DNA, 22 bp, Homo sapiens
ccagagcagatgcagagagcca

SEQ ID NO: 4923969 - DNA, 18 bp, Homo sapiens
ccagagcatttccaacac

SEQ ID NO: 4923970 - DNA, 14 bp, Homo sapiens
ccagagcccacctt

SEQ ID NO: 4923971 - DNA, 14 bp, Homo sapiens
ccagagctgggagg

SEQ ID NO: 4923972 - DNA, 19 bp, Homo sapiens
ccagagctgtttatggcct

SEQ ID NO: 4923973 - DNA, 20 bp, Homo sapiens
ccagagctgtttatggcctc

SEQ ID NO: 4923974 - DNA, 21 bp, Homo sapiens
ccagagctgtttatggcctca

SEQ ID NO: 4923975 - DNA, 19 bp, Homo sapiens
ccagaggaactgtccagag

SEQ ID NO: 4923976 - DNA, 20 bp, Homo sapiens
ccagaggaactgtccagaga

SEQ ID NO: 4923977 - DNA, 22 bp, Homo sapiens
ccagaggaactgtccagagagc

SEQ ID NO: 4923978 - DNA, 23 bp, Homo sapiens
ccagaggaactgtccagagagca

SEQ ID NO: 4923979 - DNA, 18 bp, Homo sapiens
ccagaggaatcctggcag

SEQ ID NO: 4923980 - DNA, 19 bp, Homo sapiens
ccagaggaatcctggcagc

SEQ ID NO: 4923981 - DNA, 21 bp, Homo sapiens
ccagaggaatcctggcagccc

SEQ ID NO: 4923982 - DNA, 19 bp, Homo sapiens
ccagaggctattattttca

SEQ ID NO: 4923983 - DNA, 13 bp, Homo sapiens
ccagaggctgagt

SEQ ID NO: 4923984 - DNA, 19 bp, Homo sapiens
ccagagggagtgacagagg

SEQ ID NO: 4923985 - DNA, 17 bp, Homo sapiens
ccagaggtaacagaaca

SEQ ID NO: 4923986 - DNA, 19 bp, Homo sapiens
ccagaggtaacagaacagc

SEQ ID NO: 4923987 - DNA, 17 bp, Homo sapiens
ccagaggtccagcccat

SEQ ID NO: 4923988 - DNA, 16 bp, Homo sapiens
ccagagtcctttccaa

SEQ ID NO: 4923989 - DNA, 18 bp, Homo sapiens
ccagatcactgccacact

SEQ ID NO: 4923990 - DNA, 12 bp, Homo sapiens
ccagatcctggg

SEQ ID NO: 4923991 - DNA, 18 bp, Homo sapiens
ccagatgcaccagccctt

SEQ ID NO: 4923992 - DNA, 23 bp, Homo sapiens
ccagatgcaccagcccttagcag

SEQ ID NO: 4923993 - DNA, 17 bp, Homo sapiens
ccagatgcgtcccaaga

SEQ ID NO: 4923994 - DNA, 16 bp, Homo sapiens
ccagattgcaacaggc

SEQ ID NO: 4923995 - DNA, 22 bp, Homo sapiens
ccagattgcaacaggctgggct

SEQ ID NO: 4923996 - DNA, 13 bp, Homo sapiens
ccagatttttaat

SEQ ID NO: 4923997 - DNA, 24 bp, Homo sapiens
ccagattttttacagctgcctgca

SEQ ID NO: 4923998 - DNA, 15 bp, Homo sapiens
ccagcaacacagcct

SEQ ID NO: 4923999 - DNA, 17 bp, Homo sapiens
ccagcaacacagcctgg

SEQ ID NO: 4924000 - DNA, 22 bp, Homo sapiens
ccagcaacacagcctgggcccc

SEQ ID NO: 4924001 - DNA, 14 bp, Homo sapiens
ccagcaacttcttc

SEQ ID NO: 4924002 - DNA, 23 bp, Homo sapiens
ccagcaacttcttctccatccct

SEQ ID NO: 4924003 - DNA, 21 bp, Homo sapiens
ccagcaagaataaaaaagaaa

SEQ ID NO: 4924004 - DNA, 12 bp, Homo sapiens
ccagcaatgaca

SEQ ID NO: 4924005 - DNA, 18 bp, Homo sapiens
ccagcacctcagcctgca

SEQ ID NO: 4924006 - DNA, 15 bp, Homo sapiens
ccagcacctgcctcc

SEQ ID NO: 4924007 - DNA, 16 bp, Homo sapiens
ccagcacctgcctcct

SEQ ID NO: 4924008 - DNA, 12 bp, Homo sapiens
ccagcactaacg

SEQ ID NO: 4924009 - DNA, 15 bp, Homo sapiens
ccagcacttgtatat

SEQ ID NO: 4924010 - DNA, 15 bp, Homo sapiens
ccagcagaagacaaa

SEQ ID NO: 4924011 - DNA, 15 bp, Homo sapiens
ccagcagcagcaggt

SEQ ID NO: 4924012 - DNA, 16 bp, Homo sapiens
ccagcatcacctgcct

SEQ ID NO: 4924013 - DNA, 16 bp, Homo sapiens
ccagcatcactcccca

SEQ ID NO: 4924014 - DNA, 18 bp, Homo sapiens
ccagcatgacataacagt

SEQ ID NO: 4924015 - DNA, 20 bp, Homo sapiens
ccagcatgacataacagtgc

SEQ ID NO: 4924016 - DNA, 22 bp, Homo sapiens
ccagccaacttttgcatgtttt

SEQ ID NO: 4924017 - DNA, 13 bp, Homo sapiens
ccagccaccccgg

SEQ ID NO: 4924018 - DNA, 12 bp, Homo sapiens
aagtgctgggat

SEQ ID NO: 4924019 - DNA, 22 bp, Homo sapiens
aagtgctgggattacaggtgtg

SEQ ID NO: 4924020 - DNA, 18 bp, Homo sapiens
aagtggactggcccctgg

SEQ ID NO: 4924021 - DNA, 22 bp, Homo sapiens
aagtggcaatctcagatgcagt

SEQ ID NO: 4924022 - DNA, 16 bp, Homo sapiens
aagtggctatttcttt

SEQ ID NO: 4924023 - DNA, 20 bp, Homo sapiens
aagtgggaggtcaggaaact

SEQ ID NO: 4924024 - DNA, 16 bp, Homo sapiens
aagtgggcttgattct

SEQ ID NO: 4924025 - DNA, 17 bp, Homo sapiens
aagtggggcagagcctc

SEQ ID NO: 4924026 - DNA, 19 bp, Homo sapiens
aagtgggtgagatgctgga

SEQ ID NO: 4924027 - DNA, 15 bp, Homo sapiens
aagtgtaataatatg

SEQ ID NO: 4924028 - DNA, 23 bp, Homo sapiens
aagtgtatatcagaaaagggaag

SEQ ID NO: 4924029 - DNA, 17 bp, Homo sapiens
aagtgtgaacaaaagat

SEQ ID NO: 4924030 - DNA, 11 bp, Homo sapiens
aagtgttactt

SEQ ID NO: 4924031 - DNA, 15 bp, Homo sapiens
aagtgttagatagaa

SEQ ID NO: 4924032 - DNA, 18 bp, Homo sapiens
aagtgttgaagggaggtg

SEQ ID NO: 4924033 - DNA, 16 bp, Homo sapiens
aagtgtttatttttca

SEQ ID NO: 4924034 - DNA, 14 bp, Homo sapiens
aagtgtttctgtta

SEQ ID NO: 4924035 - DNA, 20 bp, Homo sapiens
aagttaagagaaactttata

SEQ ID NO: 4924036 - DNA, 21 bp, Homo sapiens
aagttaagagaaactttatac

SEQ ID NO: 4924037 - DNA, 22 bp, Homo sapiens
aagttaagagaaactttataca

SEQ ID NO: 4924038 - DNA, 19 bp, Homo sapiens
aagttacagaaatactata

SEQ ID NO: 4924039 - DNA, 23 bp, Homo sapiens
aagttagtgcttgttctaagatt

SEQ ID NO: 4924040 - DNA, 14 bp, Homo sapiens
aagttataagactc

SEQ ID NO: 4924041 - DNA, 12 bp, Homo sapiens
aagttattgtac

SEQ ID NO: 4924042 - DNA, 23 bp, Homo sapiens
aagttcatacctaagtactgtaa

SEQ ID NO: 4924043 - DNA, 17 bp, Homo sapiens
aagttccaagagtctaa

SEQ ID NO: 4924044 - DNA, 11 bp, Homo sapiens
aagttccttcc

SEQ ID NO: 4924045 - DNA, 15 bp, Homo sapiens
aagttctaagattct

SEQ ID NO: 4924046 - DNA, 18 bp, Homo sapiens
aagttctaagattctaat

SEQ ID NO: 4924047 - DNA, 19 bp, Homo sapiens
aagttctaataatttctaa

SEQ ID NO: 4924048 - DNA, 22 bp, Homo sapiens
aagttctgtgtttaatttcttc

SEQ ID NO: 4924049 - DNA, 15 bp, Homo sapiens
aagttcttctccaat

SEQ ID NO: 4924050 - DNA, 20 bp, Homo sapiens
aagttgacttatagtacatg

SEQ ID NO: 4924051 - DNA, 18 bp, Homo sapiens
aagttgaggattgttgaa

SEQ ID NO: 4924052 - DNA, 18 bp, Homo sapiens
aagttgcactgatatttt

SEQ ID NO: 4924053 - DNA, 22 bp, Homo sapiens
aagttggactaaatgcctagtt

SEQ ID NO: 4924054 - DNA, 18 bp, Homo sapiens
aagtttaaaacagtattt

SEQ ID NO: 4924055 - DNA, 18 bp, Homo sapiens
aagtttacaagtgtatat

SEQ ID NO: 4924056 - DNA, 16 bp, Homo sapiens
aagtttacatttttat

SEQ ID NO: 4924057 - DNA, 20 bp, Homo sapiens
aagtttcaaacttactattt

SEQ ID NO: 4924058 - DNA, 22 bp, Homo sapiens
aagtttcaatgtgattctaatg

SEQ ID NO: 4924059 - DNA, 19 bp, Homo sapiens
aagtttcaggtgacatgtg

SEQ ID NO: 4924060 - DNA, 21 bp, Homo sapiens
aagtttcaggtgacatgtgaa

SEQ ID NO: 4924061 - DNA, 20 bp, Homo sapiens
aagtttccatagcaacagga

SEQ ID NO: 4924062 - DNA, 12 bp, Homo sapiens
aagtttccatat

SEQ ID NO: 4924063 - DNA, 12 bp, Homo sapiens
aagtttcccttc

SEQ ID NO: 4924064 - DNA, 14 bp, Homo sapiens
aagtttcccttcct

SEQ ID NO: 4924065 - DNA, 21 bp, Homo sapiens
aagtttcctaatcagaaattt

SEQ ID NO: 4924066 - DNA, 13 bp, Homo sapiens
aagtttctaagat

SEQ ID NO: 4924067 - DNA, 17 bp, Homo sapiens
aagtttctaagattcta

SEQ ID NO: 4924068 - DNA, 17 bp, Homo sapiens
aagtttgaaggaaacag

SEQ ID NO: 4924069 - DNA, 19 bp, Homo sapiens
aagtttgtagttgttttaa

SEQ ID NO: 4924070 - DNA, 13 bp, Homo sapiens
aagttttaatgta

SEQ ID NO: 4924071 - DNA, 23 bp, Homo sapiens
aagttttcagaacctcttcccca

SEQ ID NO: 4924072 - DNA, 16 bp, Homo sapiens
aagttttgaaaagcta

SEQ ID NO: 4924073 - DNA, 13 bp, Homo sapiens
aataaaaaatgga

SEQ ID NO: 4924074 - DNA, 18 bp, Homo sapiens
aataaaaacccacaaaaa

SEQ ID NO: 4924075 - DNA, 19 bp, Homo sapiens
aataaaaactattcgaatg

SEQ ID NO: 4924076 - DNA, 13 bp, Homo sapiens
aataaaaagtgac

SEQ ID NO: 4924077 - DNA, 14 bp, Homo sapiens
aataaaacctttca

SEQ ID NO: 4924078 - DNA, 16 bp, Homo sapiens
aataaaacctttcaaa

SEQ ID NO: 4924079 - DNA, 21 bp, Homo sapiens
aataaaacctttcaaatttca

SEQ ID NO: 4924080 - DNA, 17 bp, Homo sapiens
aataaaataattctaaa

SEQ ID NO: 4924081 - DNA, 16 bp, Homo sapiens
aataaaatcaattttt

SEQ ID NO: 4924082 - DNA, 15 bp, Homo sapiens
aataaaatttctaag

SEQ ID NO: 4924083 - DNA, 16 bp, Homo sapiens
aataaaccaaaggaca

SEQ ID NO: 4924084 - DNA, 17 bp, Homo sapiens
aataaaccaaaggacat

SEQ ID NO: 4924085 - DNA, 21 bp, Homo sapiens
aataaaccaaaggacattatg

SEQ ID NO: 4924086 - DNA, 17 bp, Homo sapiens
aataaacctcaaaatgt

SEQ ID NO: 4924087 - DNA, 20 bp, Homo sapiens
aataaactactctttgattt

SEQ ID NO: 4924088 - DNA, 16 bp, Homo sapiens
aataaacttaacttta

SEQ ID NO: 4924089 - DNA, 14 bp, Homo sapiens
aataaacttcagca

SEQ ID NO: 4924090 - DNA, 13 bp, Homo sapiens
aataaactttttt

SEQ ID NO: 4924091 - DNA, 20 bp, Homo sapiens
aataaagacaaccatattta

SEQ ID NO: 4924092 - DNA, 11 bp, Homo sapiens
aataaaggact

SEQ ID NO: 4924093 - DNA, 16 bp, Homo sapiens
aataaaggatgtgatt

SEQ ID NO: 4924094 - DNA, 20 bp, Homo sapiens
aataaattgctccttgacat

SEQ ID NO: 4924095 - DNA, 13 bp, Homo sapiens
aataacaatgtgc

SEQ ID NO: 4924096 - DNA, 20 bp, Homo sapiens
aataacaatgttaaggaaac

SEQ ID NO: 4924097 - DNA, 19 bp, Homo sapiens
aataactctgtggcattat

SEQ ID NO: 4924098 - DNA, 13 bp, Homo sapiens
aataactgtgaag

SEQ ID NO: 4924099 - DNA, 20 bp, Homo sapiens
aataactgtgaagtttacat

SEQ ID NO: 4924100 - DNA, 15 bp, Homo sapiens
aataacttcagtcct

SEQ ID NO: 4924101 - DNA, 24 bp, Homo sapiens
aataacttcagtcctgctccagaa

SEQ ID NO: 4924102 - DNA, 15 bp, Homo sapiens
aataacttctgacct

SEQ ID NO: 4924103 - DNA, 12 bp, Homo sapiens
aataagaaggta

SEQ ID NO: 4924104 - DNA, 13 bp, Homo sapiens
aataagaatagaa

SEQ ID NO: 4924105 - DNA, 14 bp, Homo sapiens
aataagaatgattt

SEQ ID NO: 4924106 - DNA, 17 bp, Homo sapiens
aataagacataacgttt

SEQ ID NO: 4924107 - DNA, 16 bp, Homo sapiens
aataagtatttataat

SEQ ID NO: 4924108 - DNA, 17 bp, Homo sapiens
aataagtggttatttct

SEQ ID NO: 4924109 - DNA, 21 bp, Homo sapiens
aataataattaggttaacatt

SEQ ID NO: 4924110 - DNA, 20 bp, Homo sapiens
aataataatttttatattta

SEQ ID NO: 4924111 - DNA, 13 bp, Homo sapiens
aataatacctcaa

SEQ ID NO: 4924112 - DNA, 11 bp, Homo sapiens
aataatatgca

SEQ ID NO: 4924113 - DNA, 12 bp, Homo sapiens
aataatattgtt

SEQ ID NO: 4924114 - DNA, 16 bp, Homo sapiens
aataatattgtttttc

SEQ ID NO: 4924115 - DNA, 22 bp, Homo sapiens
aataatattgtttttctttcta

SEQ ID NO: 4924116 - DNA, 21 bp, Homo sapiens
aataatgagctattaaaactc

SEQ ID NO: 4924117 - DNA, 11 bp, Homo sapiens
aataatgctgc

SEQ ID NO: 4924118 - DNA, 14 bp, Homo sapiens
aataatgcttcaga

SEQ ID NO: 4924119 - DNA, 20 bp, Homo sapiens
aataattaggttaacattgt

SEQ ID NO: 4924120 - DNA, 18 bp, Homo sapiens
aataattatttatttaat

SEQ ID NO: 4924121 - DNA, 23 bp, Homo sapiens
aataatttaactacccttaatta

SEQ ID NO: 4924122 - DNA, 13 bp, Homo sapiens
aataatttctaat

SEQ ID NO: 4924123 - DNA, 16 bp, Homo sapiens
aataatttctaatgtt

SEQ ID NO: 4924124 - DNA, 16 bp, Homo sapiens
aataattttaaacaaa

SEQ ID NO: 4924125 - DNA, 17 bp, Homo sapiens
aataatttttatattta

SEQ ID NO: 4924126 - DNA, 22 bp, Homo sapiens
aataatttttatatttaattat

SEQ ID NO: 4924127 - DNA, 22 bp, Homo sapiens
aatacaacatgtagctgagttt

SEQ ID NO: 4924128 - DNA, 14 bp, Homo sapiens
aatacatacggtca

SEQ ID NO: 4924129 - DNA, 23 bp, Homo sapiens
aatacatacggtcaggtttaaca

SEQ ID NO: 4924130 - DNA, 20 bp, Homo sapiens
aggcactctgttatttagac

SEQ ID NO: 4924131 - DNA, 16 bp, Homo sapiens
aggcactgctgcccag

SEQ ID NO: 4924132 - DNA, 22 bp, Homo sapiens
aggcactgctgcccagcctcca

SEQ ID NO: 4924133 - DNA, 17 bp, Homo sapiens
aggcactgtagttctaa

SEQ ID NO: 4924134 - DNA, 21 bp, Homo sapiens
aggcacttattgtaaatttta

SEQ ID NO: 4924135 - DNA, 18 bp, Homo sapiens
aggcagaataagaaaaca

SEQ ID NO: 4924136 - DNA, 22 bp, Homo sapiens
aggcagacagcaggcagcgcca

SEQ ID NO: 4924137 - DNA, 9 bp, Homo sapiens
aggcagaga

SEQ ID NO: 4924138 - DNA, 21 bp, Homo sapiens
aggcagatctgtgccccatgc

SEQ ID NO: 4924139 - DNA, 14 bp, Homo sapiens
aggcagccagggct

SEQ ID NO: 4924140 - DNA, 13 bp, Homo sapiens
aggcagcctccag

SEQ ID NO: 4924141 - DNA, 21 bp, Homo sapiens
aggcagcctccagcctgccca

SEQ ID NO: 4924142 - DNA, 19 bp, Homo sapiens
aggcagcgccaagtgcgtg

SEQ ID NO: 4924143 - DNA, 21 bp, Homo sapiens
aggcagcgccaagtgcgtgcc

SEQ ID NO: 4924144 - DNA, 20 bp, Homo sapiens
aggcaggaagggcaggaagg

SEQ ID NO: 4924145 - DNA, 18 bp, Homo sapiens
aggcagggcaaatgacat

SEQ ID NO: 4924146 - DNA, 24 bp, Homo sapiens
aggcagggcaaatgacatgcactg

SEQ ID NO: 4924147 - DNA, 23 bp, Homo sapiens
aggcagggggaaggtggggtcct

SEQ ID NO: 4924148 - DNA, 14 bp, Homo sapiens
aggcaggtagccag

SEQ ID NO: 4924149 - DNA, 16 bp, Homo sapiens
aggcagtctctctctt

SEQ ID NO: 4924150 - DNA, 17 bp, Homo sapiens
aggcatgcctctgatat

SEQ ID NO: 4924151 - DNA, 13 bp, Homo sapiens
aggcatggccctg

SEQ ID NO: 4924152 - DNA, 15 bp, Homo sapiens
aggcatggccctggg

SEQ ID NO: 4924153 - DNA, 21 bp, Homo sapiens
aggcatggggggtggggggag

SEQ ID NO: 4924154 - DNA, 20 bp, Homo sapiens
aggcatgggtgcaaggaaaa

SEQ ID NO: 4924155 - DNA, 12 bp, Homo sapiens
aggcatgtcctg

SEQ ID NO: 4924156 - DNA, 18 bp, Homo sapiens
aggcatgttctctgagga

SEQ ID NO: 4924157 - DNA, 13 bp, Homo sapiens
aggcattaacaca

SEQ ID NO: 4924158 - DNA, 21 bp, Homo sapiens
aggcattaatgtttctatctg

SEQ ID NO: 4924159 - DNA, 19 bp, Homo sapiens
aggcattgaggaagagtct

SEQ ID NO: 4924160 - DNA, 12 bp, Homo sapiens
aggcatttccta

SEQ ID NO: 4924161 - DNA, 17 bp, Homo sapiens
aggccaaaggctggtgg

SEQ ID NO: 4924162 - DNA, 14 bp, Homo sapiens
aggccaagaaacgt

SEQ ID NO: 4924163 - DNA, 17 bp, Homo sapiens
aggccaagaaacgtctt

SEQ ID NO: 4924164 - DNA, 21 bp, Homo sapiens
aggccaagaaacgtcttctaa

SEQ ID NO: 4924165 - DNA, 13 bp, Homo sapiens
aggccaaggggag

SEQ ID NO: 4924166 - DNA, 18 bp, Homo sapiens
aggccaaggtctgagcca

SEQ ID NO: 4924167 - DNA, 14 bp, Homo sapiens
aggccacatgggag

SEQ ID NO: 4924168 - DNA, 21 bp, Homo sapiens
aggccagagtggcctggccag

SEQ ID NO: 4924169 - DNA, 22 bp, Homo sapiens
aggccagagtggcctggccagg

SEQ ID NO: 4924170 - DNA, 15 bp, Homo sapiens
aggccagccccaccc

SEQ ID NO: 4924171 - DNA, 21 bp, Homo sapiens
aggccagccccacccaggagg

SEQ ID NO: 4924172 - DNA, 21 bp, Homo sapiens
aggccaggagtttgagaccag

SEQ ID NO: 4924173 - DNA, 17 bp, Homo sapiens
aggccatgggcctcctg

SEQ ID NO: 4924174 - DNA, 12 bp, Homo sapiens
aggcccacagga

SEQ ID NO: 4924175 - DNA, 13 bp, Homo sapiens
aggcccacaggag

SEQ ID NO: 4924176 - DNA, 14 bp, Homo sapiens
aggcccagccccta

SEQ ID NO: 4924177 - DNA, 15 bp, Homo sapiens
aggcccagcccctag

SEQ ID NO: 4924178 - DNA, 14 bp, Homo sapiens
aggccccactgatg

SEQ ID NO: 4924179 - DNA, 21 bp, Homo sapiens
aggccccactgatgctgttct

SEQ ID NO: 4924180 - DNA, 19 bp, Homo sapiens
aggccccttctctccctgc

SEQ ID NO: 4924181 - DNA, 20 bp, Homo sapiens
aggcccgctctacatcttct

SEQ ID NO: 4924182 - DNA, 13 bp, Homo sapiens
aggcccggctcca

SEQ ID NO: 4924183 - DNA, 17 bp, Homo sapiens
aggcccggctccaggct

SEQ ID NO: 4924184 - DNA, 12 bp, Homo sapiens
aggccctgccca

SEQ ID NO: 4924185 - DNA, 18 bp, Homo sapiens
aggccctgctcctgcagc

SEQ ID NO: 4924186 - DNA, 15 bp, Homo sapiens
aggccctgctgccca

SEQ ID NO: 4924187 - DNA, 13 bp, Homo sapiens
aggcccttcctct

SEQ ID NO: 4924188 - DNA, 20 bp, Homo sapiens
aggccgcagctccattttct

SEQ ID NO: 4924189 - DNA, 19 bp, Homo sapiens
aggcctaatctcatacctc

SEQ ID NO: 4924190 - DNA, 17 bp, Homo sapiens
aggcctccatctcatgt

SEQ ID NO: 4924191 - DNA, 15 bp, Homo sapiens
aggcctccctagcca

SEQ ID NO: 4924192 - DNA, 12 bp, Homo sapiens
aggcctctctca

SEQ ID NO: 4924193 - DNA, 22 bp, Homo sapiens
aggcctctgtgtccttccctgc

SEQ ID NO: 4924194 - DNA, 17 bp, Homo sapiens
aggcctcttggagacct

SEQ ID NO: 4924195 - DNA, 12 bp, Homo sapiens
aggcctgcacac

SEQ ID NO: 4924196 - DNA, 12 bp, Homo sapiens
aggcctggccag

SEQ ID NO: 4924197 - DNA, 22 bp, Homo sapiens
aggcctggccagatgcaccagc

SEQ ID NO: 4924198 - DNA, 23 bp, Homo sapiens
aggcctgggtggatcggcctcct

SEQ ID NO: 4924199 - DNA, 20 bp, Homo sapiens
aggccttccagctgctgtct

SEQ ID NO: 4924200 - DNA, 15 bp, Homo sapiens
aggccttcctctctc

SEQ ID NO: 4924201 - DNA, 18 bp, Homo sapiens
aggccttcctctctccag

SEQ ID NO: 4924202 - DNA, 22 bp, Homo sapiens
aggccttctcctccccacccgc

SEQ ID NO: 4924203 - DNA, 18 bp, Homo sapiens
aggccttttaacattttg

SEQ ID NO: 4924204 - DNA, 19 bp, Homo sapiens
aggcgagagaggagccaga

SEQ ID NO: 4924205 - DNA, 14 bp, Homo sapiens
aggcgccccttccc

SEQ ID NO: 4924206 - DNA, 17 bp, Homo sapiens
aggcgggggctgccctt

SEQ ID NO: 4924207 - DNA, 16 bp, Homo sapiens
aggctattattttcac

SEQ ID NO: 4924208 - DNA, 19 bp, Homo sapiens
aggctcaacaataaaacat

SEQ ID NO: 4924209 - DNA, 13 bp, Homo sapiens
aggctccgccctt

SEQ ID NO: 4924210 - DNA, 21 bp, Homo sapiens
aggctcctgccagtgtggaac

SEQ ID NO: 4924211 - DNA, 12 bp, Homo sapiens
aggctcctgtcc

SEQ ID NO: 4924212 - DNA, 19 bp, Homo sapiens
aggctctgagagtctagat

SEQ ID NO: 4924213 - DNA, 16 bp, Homo sapiens
aggctctgcttctcca

SEQ ID NO: 4924214 - DNA, 15 bp, Homo sapiens
aggctgaggcaggag

SEQ ID NO: 4924215 - DNA, 14 bp, Homo sapiens
aggctgcagctgga

SEQ ID NO: 4924216 - DNA, 21 bp, Homo sapiens
aggctgcagtcagtcatgatg

SEQ ID NO: 4924217 - DNA, 15 bp, Homo sapiens
aggctgcccccggcc

SEQ ID NO: 4924218 - DNA, 20 bp, Homo sapiens
aggctgcccccggccccctg

SEQ ID NO: 4924219 - DNA, 12 bp, Homo sapiens
aggctgcccctc

SEQ ID NO: 4924220 - DNA, 20 bp, Homo sapiens
aggctggagtgcagtggcgt

SEQ ID NO: 4924221 - DNA, 17 bp, Homo sapiens
aggctggcgtgcagtgg

SEQ ID NO: 4924222 - DNA, 20 bp, Homo sapiens
aggctggcgtgcagtggtgc

SEQ ID NO: 4924223 - DNA, 10 bp, Homo sapiens
aggctgggcc

SEQ ID NO: 4924224 - DNA, 12 bp, Homo sapiens
aggctgggccat

SEQ ID NO: 4924225 - DNA, 18 bp, Homo sapiens
aggctgggcttcagtggc

SEQ ID NO: 4924226 - DNA, 19 bp, Homo sapiens
aggctgggcttcagtggca

SEQ ID NO: 4924227 - DNA, 20 bp, Homo sapiens
aggctgggcttcagtggcag

SEQ ID NO: 4924228 - DNA, 23 bp, Homo sapiens
aggctgggcttcagtggcagctg

SEQ ID NO: 4924229 - DNA, 14 bp, Homo sapiens
aggctggtgggagg

SEQ ID NO: 4924230 - DNA, 17 bp, Homo sapiens
aggctggtgggaggggc

SEQ ID NO: 4924231 - DNA, 18 bp, Homo sapiens
aggctgtatcccatgagc

SEQ ID NO: 4924232 - DNA, 20 bp, Homo sapiens
aggctgtatcccatgagcct

SEQ ID NO: 4924233 - DNA, 18 bp, Homo sapiens
aggctgttctgcactgaa

SEQ ID NO: 4924234 - DNA, 15 bp, Homo sapiens
aggcttatattcaac

SEQ ID NO: 4924235 - DNA, 16 bp, Homo sapiens
aggcttatattcaacc

SEQ ID NO: 4924236 - DNA, 17 bp, Homo sapiens
aggcttatattcaacca

SEQ ID NO: 4924237 - DNA, 18 bp, Homo sapiens
aggcttatattcaaccat

SEQ ID NO: 4924238 - DNA, 18 bp, Homo sapiens
aggctttagtgtatttat

SEQ ID NO: 4924239 - DNA, 13 bp, Homo sapiens
aggctttgtgttg

SEQ ID NO: 4924240 - DNA, 14 bp, Homo sapiens
agggaaaagggaag

SEQ ID NO: 4924241 - DNA, 15 bp, Homo sapiens
agggaaatatcattt

SEQ ID NO: 4924242 - DNA, 14 bp, Homo sapiens
agtagatattactt

SEQ ID NO: 4924243 - DNA, 18 bp, Homo sapiens
agtagatattactttatc

SEQ ID NO: 4924244 - DNA, 17 bp, Homo sapiens
agtagatggtgaaattt

SEQ ID NO: 4924245 - DNA, 21 bp, Homo sapiens
agtagcgttttttaaatgtat

SEQ ID NO: 4924246 - DNA, 22 bp, Homo sapiens
agtagcgttttttaaatgtata

SEQ ID NO: 4924247 - DNA, 13 bp, Homo sapiens
agtagctgggact

SEQ ID NO: 4924248 - DNA, 13 bp, Homo sapiens
agtagcttgctcc

SEQ ID NO: 4924249 - DNA, 14 bp, Homo sapiens
agtagcttgctccc

SEQ ID NO: 4924250 - DNA, 16 bp, Homo sapiens
agtagtaatagagcaa

SEQ ID NO: 4924251 - DNA, 16 bp, Homo sapiens
agtagtccttggcata

SEQ ID NO: 4924252 - DNA, 21 bp, Homo sapiens
agtagtttttacagctgtgtt

SEQ ID NO: 4924253 - DNA, 15 bp, Homo sapiens
agtataaaaacttga

SEQ ID NO: 4924254 - DNA, 19 bp, Homo sapiens
agtataaccatatgatact

SEQ ID NO: 4924255 - DNA, 16 bp, Homo sapiens
agtataagaaatgcat

SEQ ID NO: 4924256 - DNA, 15 bp, Homo sapiens
agtatacaatatata

SEQ ID NO: 4924257 - DNA, 21 bp, Homo sapiens
agtatacaatatataaaaata

SEQ ID NO: 4924258 - DNA, 20 bp, Homo sapiens
agtatatcccaagtgcactt

SEQ ID NO: 4924259 - DNA, 15 bp, Homo sapiens
agtatatgttccctc

SEQ ID NO: 4924260 - DNA, 17 bp, Homo sapiens
agtatcagtgttttaaa

SEQ ID NO: 4924261 - DNA, 21 bp, Homo sapiens
agtatcagtgttttaaattct

SEQ ID NO: 4924262 - DNA, 14 bp, Homo sapiens
agtatccactttgc

SEQ ID NO: 4924263 - DNA, 11 bp, Homo sapiens
agtatccaggc

SEQ ID NO: 4924264 - DNA, 23 bp, Homo sapiens
agtatctatatatgtgtatgtac

SEQ ID NO: 4924265 - DNA, 17 bp, Homo sapiens
agtatctttgcactcca

SEQ ID NO: 4924266 - DNA, 13 bp, Homo sapiens
catgtgaaacctt

SEQ ID NO: 4924267 - DNA, 22 bp, Homo sapiens
catgtgaaaccttttttaagat

SEQ ID NO: 4924268 - DNA, 12 bp, Homo sapiens
catgtgacacat

SEQ ID NO: 4924269 - DNA, 13 bp, Homo sapiens
catgtgacacata

SEQ ID NO: 4924270 - DNA, 14 bp, Homo sapiens
catgtgacacatat

SEQ ID NO: 4924271 - DNA, 16 bp, Homo sapiens
catgtgatcacgcctg

SEQ ID NO: 4924272 - DNA, 22 bp, Homo sapiens
catgtgccaggtttttggtctg

SEQ ID NO: 4924273 - DNA, 12 bp, Homo sapiens
catgtgccctcc

SEQ ID NO: 4924274 - DNA, 23 bp, Homo sapiens
catgtggtggcacaggccccctt

SEQ ID NO: 4924275 - DNA, 15 bp, Homo sapiens
catgtggtttataga

SEQ ID NO: 4924276 - DNA, 21 bp, Homo sapiens
catgtggtttggttcctctct

SEQ ID NO: 4924277 - DNA, 11 bp, Homo sapiens
catgtgtgtat

SEQ ID NO: 4924278 - DNA, 15 bp, Homo sapiens
catgtgtgtatatat

SEQ ID NO: 4924279 - DNA, 17 bp, Homo sapiens
catgtgtgtatatatgt

SEQ ID NO: 4924280 - DNA, 14 bp, Homo sapiens
catgtgttcccttt

SEQ ID NO: 4924281 - DNA, 22 bp, Homo sapiens
catgttcaaagccacattattt

SEQ ID NO: 4924282 - DNA, 15 bp, Homo sapiens
catgttctgccccca

SEQ ID NO: 4924283 - DNA, 18 bp, Homo sapiens
catgttctgcccccagcc

SEQ ID NO: 4924284 - DNA, 16 bp, Homo sapiens
catgttcttgcagtca

SEQ ID NO: 4924285 - DNA, 13 bp, Homo sapiens
catgttggccagg

SEQ ID NO: 4924286 - DNA, 20 bp, Homo sapiens
catgttggccaggctggtct

SEQ ID NO: 4924287 - DNA, 17 bp, Homo sapiens
catgttgtaatgctgca

SEQ ID NO: 4924288 - DNA, 14 bp, Homo sapiens
catgttgttaaaat

SEQ ID NO: 4924289 - DNA, 13 bp, Homo sapiens
catgtttatgaaa

SEQ ID NO: 4924290 - DNA, 14 bp, Homo sapiens
catgtttatgaaaa

SEQ ID NO: 4924291 - DNA, 23 bp, Homo sapiens
catgtttatgaaaataaatagct

SEQ ID NO: 4924292 - DNA, 14 bp, Homo sapiens
catgtttccagcag

SEQ ID NO: 4924293 - DNA, 14 bp, Homo sapiens
catgttttgtatac

SEQ ID NO: 4924294 - DNA, 20 bp, Homo sapiens
catgttttgtatacaaatat

SEQ ID NO: 4924295 - DNA, 15 bp, Homo sapiens
catgttttgtgacta

SEQ ID NO: 4924296 - DNA, 23 bp, Homo sapiens
catgttttgtgactatatagaga

SEQ ID NO: 4924297 - DNA, 21 bp, Homo sapiens
catgttttgtgcatttgtaaa

SEQ ID NO: 4924298 - DNA, 17 bp, Homo sapiens
catgtttttgttttctt

SEQ ID NO: 4924299 - DNA, 14 bp, Homo sapiens
cattaaacctgtct

SEQ ID NO: 4924300 - DNA, 14 bp, Homo sapiens
cattaaattcacaa

SEQ ID NO: 4924301 - DNA, 21 bp, Homo sapiens
cattaaattcacaaactttta

SEQ ID NO: 4924302 - DNA, 21 bp, Homo sapiens
cattaagaatgttggtttact

SEQ ID NO: 4924303 - DNA, 14 bp, Homo sapiens
cattaagtaatcaa

SEQ ID NO: 4924304 - DNA, 17 bp, Homo sapiens
cattaatcatttcccca

SEQ ID NO: 4924305 - DNA, 15 bp, Homo sapiens
cattaatgtttctat

SEQ ID NO: 4924306 - DNA, 16 bp, Homo sapiens
cattaattttttttca

SEQ ID NO: 4924307 - DNA, 13 bp, Homo sapiens
cattacaatggaa

SEQ ID NO: 4924308 - DNA, 15 bp, Homo sapiens
cattaccactcaggc

SEQ ID NO: 4924309 - DNA, 19 bp, Homo sapiens
cattacccttccctgcact

SEQ ID NO: 4924310 - DNA, 23 bp, Homo sapiens
cattacttgattaagattttaca

SEQ ID NO: 4924311 - DNA, 14 bp, Homo sapiens
cattagaattattt

SEQ ID NO: 4924312 - DNA, 19 bp, Homo sapiens
cattagaattatttaaaca

SEQ ID NO: 4924313 - DNA, 15 bp, Homo sapiens
cattagactcctcct

SEQ ID NO: 4924314 - DNA, 19 bp, Homo sapiens
cattagagcccatttcaat

SEQ ID NO: 4924315 - DNA, 19 bp, Homo sapiens
cattagattttattttact

SEQ ID NO: 4924316 - DNA, 21 bp, Homo sapiens
cattagcacagattttaattg

SEQ ID NO: 4924317 - DNA, 22 bp, Homo sapiens
cattagcacagattttaattgt

SEQ ID NO: 4924318 - DNA, 21 bp, Homo sapiens
cattatgtggttttagatttt

SEQ ID NO: 4924319 - DNA, 17 bp, Homo sapiens
cattatgtgtgcatgtg

SEQ ID NO: 4924320 - DNA, 18 bp, Homo sapiens
cattatgtgtgcatgtgt

SEQ ID NO: 4924321 - DNA, 23 bp, Homo sapiens
cattatgtgtgcatgtgtgtata

SEQ ID NO: 4924322 - DNA, 16 bp, Homo sapiens
cattattcatttagtg

SEQ ID NO: 4924323 - DNA, 20 bp, Homo sapiens
cattatttctagtccaaaat

SEQ ID NO: 4924324 - DNA, 16 bp, Homo sapiens
cattattttctgtcag

SEQ ID NO: 4924325 - DNA, 17 bp, Homo sapiens
cattattttctgtcaga

SEQ ID NO: 4924326 - DNA, 18 bp, Homo sapiens
cattattttctgtcagat

SEQ ID NO: 4924327 - DNA, 23 bp, Homo sapiens
cattcaaatgggtgatatcctga

SEQ ID NO: 4924328 - DNA, 13 bp, Homo sapiens
cattcaatgttta

SEQ ID NO: 4924329 - DNA, 17 bp, Homo sapiens
cattcagatcactgaat

SEQ ID NO: 4924330 - DNA, 23 bp, Homo sapiens
cattcagatcactgaatttataa

SEQ ID NO: 4924331 - DNA, 22 bp, Homo sapiens
cattcatggaccactgtttctt

SEQ ID NO: 4924332 - DNA, 16 bp, Homo sapiens
cattccaaagctttat

SEQ ID NO: 4924333 - DNA, 22 bp, Homo sapiens
cattccaaggagttggaagtga

SEQ ID NO: 4924334 - DNA, 17 bp, Homo sapiens
cattccaccttcccatg

SEQ ID NO: 4924335 - DNA, 13 bp, Homo sapiens
cattccattgcct

SEQ ID NO: 4924336 - DNA, 16 bp, Homo sapiens
cattccattgcctagc

SEQ ID NO: 4924337 - DNA, 15 bp, Homo sapiens
cattccttctttgat

SEQ ID NO: 4924338 - DNA, 18 bp, Homo sapiens
cattccttctttgataat

SEQ ID NO: 4924339 - DNA, 19 bp, Homo sapiens
cattccttctttgataatg

SEQ ID NO: 4924340 - DNA, 13 bp, Homo sapiens
cattccttctttt

SEQ ID NO: 4924341 - DNA, 21 bp, Homo sapiens
cattctattgccttctttgaa

SEQ ID NO: 4924342 - DNA, 23 bp, Homo sapiens
cattctattgccttctttgaaga

SEQ ID NO: 4924343 - DNA, 14 bp, Homo sapiens
cattctcactccta

SEQ ID NO: 4924344 - DNA, 17 bp, Homo sapiens
cattctcactcctacct

SEQ ID NO: 4924345 - DNA, 17 bp, Homo sapiens
cattctcataattccta

SEQ ID NO: 4924346 - DNA, 18 bp, Homo sapiens
cattctcataattcctac

SEQ ID NO: 4924347 - DNA, 13 bp, Homo sapiens
cattctcatctgc

SEQ ID NO: 4924348 - DNA, 17 bp, Homo sapiens
cattctcatctgcaccc

SEQ ID NO: 4924349 - DNA, 12 bp, Homo sapiens
cattctccccag

SEQ ID NO: 4924350 - DNA, 15 bp, Homo sapiens
cattctccccagtgt

SEQ ID NO: 4924351 - DNA, 11 bp, Homo sapiens
cattctcctgc

SEQ ID NO: 4924352 - DNA, 13 bp, Homo sapiens
cattctcctgcct

SEQ ID NO: 4924353 - DNA, 23 bp, Homo sapiens
cattctcctgcctgtagcagtga

SEQ ID NO: 4924354 - DNA, 15 bp, Homo sapiens
cattctccttgttgt

SEQ ID NO: 4924355 - DNA, 23 bp, Homo sapiens
cattctcgtgagtcatttaaatg

SEQ ID NO: 4924356 - DNA, 15 bp, Homo sapiens
cattctgatgagcaa

SEQ ID NO: 4924357 - DNA, 18 bp, Homo sapiens
cattctgccgccccctcc

SEQ ID NO: 4924358 - DNA, 22 bp, Homo sapiens
cattctgccgccccctcctgaa

SEQ ID NO: 4924359 - DNA, 18 bp, Homo sapiens
cattctgcctctctagga

SEQ ID NO: 4924360 - DNA, 15 bp, Homo sapiens
cattctgcctgccca

SEQ ID NO: 4924361 - DNA, 16 bp, Homo sapiens
cattctgcctgcccag

SEQ ID NO: 4924362 - DNA, 20 bp, Homo sapiens
cattctgcctgcccaggccc

SEQ ID NO: 4924363 - DNA, 21 bp, Homo sapiens
cattcttcctagttttctcct

SEQ ID NO: 4924364 - DNA, 17 bp, Homo sapiens
cattcttttaacttctt

SEQ ID NO: 4924365 - DNA, 18 bp, Homo sapiens
cattcttttaacttcttt

SEQ ID NO: 4924366 - DNA, 16 bp, Homo sapiens
cattgaaatgagcacc

SEQ ID NO: 4924367 - DNA, 21 bp, Homo sapiens
cattgaaatgagcacctccat

SEQ ID NO: 4924368 - DNA, 18 bp, Homo sapiens
cattgacaaatctgtgta

SEQ ID NO: 4924369 - DNA, 15 bp, Homo sapiens
cattgagtaatatag

SEQ ID NO: 4924370 - DNA, 12 bp, Homo sapiens
cattgcattcta

SEQ ID NO: 4924371 - DNA, 15 bp, Homo sapiens
cattgccaccaggag

SEQ ID NO: 4924372 - DNA, 17 bp, Homo sapiens
cattgccaccaggagaa

SEQ ID NO: 4924373 - DNA, 14 bp, Homo sapiens
cattgcggacagcc

SEQ ID NO: 4924374 - DNA, 17 bp, Homo sapiens
cattgctagataaaagc

SEQ ID NO: 4924375 - DNA, 17 bp, Homo sapiens
cattgctgagcctctgc

SEQ ID NO: 4924376 - DNA, 20 bp, Homo sapiens
ccaaatttgattgatttgaa

SEQ ID NO: 4924377 - DNA, 13 bp, Homo sapiens
ccaacaaaccatc

SEQ ID NO: 4924378 - DNA, 18 bp, Homo sapiens
ccaacaagccagaatcag

SEQ ID NO: 4924379 - DNA, 15 bp, Homo sapiens
ccaacaccacagaaa

SEQ ID NO: 4924380 - DNA, 14 bp, Homo sapiens
ccaacaccacagac

SEQ ID NO: 4924381 - DNA, 22 bp, Homo sapiens
ccaacacccaaagcatggacta

SEQ ID NO: 4924382 - DNA, 22 bp, Homo sapiens
ccaacagcgacatagcccatcc

SEQ ID NO: 4924383 - DNA, 22 bp, Homo sapiens
ccaacaggctgttctgcactga

SEQ ID NO: 4924384 - DNA, 13 bp, Homo sapiens
ccaacccccaccc

SEQ ID NO: 4924385 - DNA, 17 bp, Homo sapiens
ccaacccccaccccaca

SEQ ID NO: 4924386 - DNA, 22 bp, Homo sapiens
ccaaccctaggttccctgttct

SEQ ID NO: 4924387 - DNA, 23 bp, Homo sapiens
ccaaccctatctcctgacagaag

SEQ ID NO: 4924388 - DNA, 18 bp, Homo sapiens
ccaaccgacaggccctgg

SEQ ID NO: 4924389 - DNA, 12 bp, Homo sapiens
ccaacctgctga

SEQ ID NO: 4924390 - DNA, 12 bp, Homo sapiens
ccaaccttccca

SEQ ID NO: 4924391 - DNA, 21 bp, Homo sapiens
ccaactccagcaacttcttct

SEQ ID NO: 4924392 - DNA, 15 bp, Homo sapiens
ccaactctgagccca

SEQ ID NO: 4924393 - DNA, 17 bp, Homo sapiens
ccaactgggcccaagac

SEQ ID NO: 4924394 - DNA, 13 bp, Homo sapiens
ccaacttcccagt

SEQ ID NO: 4924395 - DNA, 19 bp, Homo sapiens
ccaacttctcttgctttct

SEQ ID NO: 4924396 - DNA, 21 bp, Homo sapiens
ccaacttgagggcccagagca

SEQ ID NO: 4924397 - DNA, 13 bp, Homo sapiens
ccaactttctgta

SEQ ID NO: 4924398 - DNA, 14 bp, Homo sapiens
ccaactttctgtaa

SEQ ID NO: 4924399 - DNA, 14 bp, Homo sapiens
ccaagaaacgtctt

SEQ ID NO: 4924400 - DNA, 13 bp, Homo sapiens
ccaagaaagcagg

SEQ ID NO: 4924401 - DNA, 21 bp, Homo sapiens
ccaagaatccacatttctaaa

SEQ ID NO: 4924402 - DNA, 18 bp, Homo sapiens
ccaagacaaatcaacaga

SEQ ID NO: 4924403 - DNA, 22 bp, Homo sapiens
ccaagacaaatcaacagaagca

SEQ ID NO: 4924404 - DNA, 18 bp, Homo sapiens
ccaagacagatgccccag

SEQ ID NO: 4924405 - DNA, 21 bp, Homo sapiens
ccaagacagatgccccagagc

SEQ ID NO: 4924406 - DNA, 15 bp, Homo sapiens
ccaagactctagagt

SEQ ID NO: 4924407 - DNA, 22 bp, Homo sapiens
ccaagactctagagtccaaggt

SEQ ID NO: 4924408 - DNA, 19 bp, Homo sapiens
ccaagacttcattgtccct

SEQ ID NO: 4924409 - DNA, 20 bp, Homo sapiens
ccaagagaaggggaagcact

SEQ ID NO: 4924410 - DNA, 16 bp, Homo sapiens
ccaagagtctaaagat

SEQ ID NO: 4924411 - DNA, 13 bp, Homo sapiens
ccaagattccgga

SEQ ID NO: 4924412 - DNA, 20 bp, Homo sapiens
ccaagattccggatcctaag

SEQ ID NO: 4924413 - DNA, 15 bp, Homo sapiens
ccaagattctagatg

SEQ ID NO: 4924414 - DNA, 16 bp, Homo sapiens
ccaagattctagatga

SEQ ID NO: 4924415 - DNA, 19 bp, Homo sapiens
ccaagcactttcagtccaa

SEQ ID NO: 4924416 - DNA, 17 bp, Homo sapiens
ccaagcaggagacgaca

SEQ ID NO: 4924417 - DNA, 16 bp, Homo sapiens
ccaagcatcaggggga

SEQ ID NO: 4924418 - DNA, 15 bp, Homo sapiens
ccaagccaaaaacct

SEQ ID NO: 4924419 - DNA, 15 bp, Homo sapiens
ccaagccgtggcttc

SEQ ID NO: 4924420 - DNA, 21 bp, Homo sapiens
ccaagccgtggcttcccgctc

SEQ ID NO: 4924421 - DNA, 23 bp, Homo sapiens
ccaagccgtggcttcccgctcag

SEQ ID NO: 4924422 - DNA, 14 bp, Homo sapiens
ccaagcctccacag

SEQ ID NO: 4924423 - DNA, 15 bp, Homo sapiens
ccaagcctccacagc

SEQ ID NO: 4924424 - DNA, 19 bp, Homo sapiens
ccaagcctccacagcgagg

SEQ ID NO: 4924425 - DNA, 18 bp, Homo sapiens
ccaagctatctaaagttt

SEQ ID NO: 4924426 - DNA, 18 bp, Homo sapiens
ccaagctattcctttccc

SEQ ID NO: 4924427 - DNA, 19 bp, Homo sapiens
ccaagctattcctttccct

SEQ ID NO: 4924428 - DNA, 23 bp, Homo sapiens
ccaagctattcctttcccttcct

SEQ ID NO: 4924429 - DNA, 15 bp, Homo sapiens
ccaagctccctgccc

SEQ ID NO: 4924430 - DNA, 12 bp, Homo sapiens
ccaagctctgct

SEQ ID NO: 4924431 - DNA, 14 bp, Homo sapiens
ccaagctctgctcc

SEQ ID NO: 4924432 - DNA, 20 bp, Homo sapiens
ccaagctggtcccactcagt

SEQ ID NO: 4924433 - DNA, 14 bp, Homo sapiens
ccaagctgttttct

SEQ ID NO: 4924434 - DNA, 15 bp, Homo sapiens
ccaagcttgttatca

SEQ ID NO: 4924435 - DNA, 15 bp, Homo sapiens
ccaaggagaacaaat

SEQ ID NO: 4924436 - DNA, 14 bp, Homo sapiens
ccaaggagcacagg

SEQ ID NO: 4924437 - DNA, 16 bp, Homo sapiens
ccaaggagcacaggtc

SEQ ID NO: 4924438 - DNA, 18 bp, Homo sapiens
ccaaggagcacaggtccc

SEQ ID NO: 4924439 - DNA, 18 bp, Homo sapiens
ccaaggccagagtggcct

SEQ ID NO: 4924440 - DNA, 15 bp, Homo sapiens
ccaaggcggcccctc

SEQ ID NO: 4924441 - DNA, 16 bp, Homo sapiens
ccaaggcggcccctcc

SEQ ID NO: 4924442 - DNA, 16 bp, Homo sapiens
ccaaggctctgagcaa

SEQ ID NO: 4924443 - DNA, 22 bp, Homo sapiens
ccaaggcttctccaattctgcc

SEQ ID NO: 4924444 - DNA, 22 bp, Homo sapiens
ccaaggtttaaagagtctagat

SEQ ID NO: 4924445 - DNA, 21 bp, Homo sapiens
ccaagtatagcctatggcaga

SEQ ID NO: 4924446 - DNA, 14 bp, Homo sapiens
ccaagtatttatta

SEQ ID NO: 4924447 - DNA, 19 bp, Homo sapiens
ccaagtcggaacagcagat

SEQ ID NO: 4924448 - DNA, 16 bp, Homo sapiens
ccaagtggctcccaca

SEQ ID NO: 4924449 - DNA, 14 bp, Homo sapiens
ccaagtgtgaacaa

SEQ ID NO: 4924450 - DNA, 16 bp, Homo sapiens
ccaagtttccatagca

SEQ ID NO: 4924451 - DNA, 17 bp, Homo sapiens
ccaagtttccatagcaa

SEQ ID NO: 4924452 - DNA, 20 bp, Homo sapiens
ccaagtttccatagcaacag

SEQ ID NO: 4924453 - DNA, 15 bp, Homo sapiens
ccaatatgtattgta

SEQ ID NO: 4924454 - DNA, 12 bp, Homo sapiens
ccaatatttctg

SEQ ID NO: 4924455 - DNA, 22 bp, Homo sapiens
cagtatttattttgtaattatg

SEQ ID NO: 4924456 - DNA, 14 bp, Homo sapiens
cagtattttggaga

SEQ ID NO: 4924457 - DNA, 13 bp, Homo sapiens
cagtcaagaagaa

SEQ ID NO: 4924458 - DNA, 14 bp, Homo sapiens
cagtcaagaagaaa

SEQ ID NO: 4924459 - DNA, 20 bp, Homo sapiens
cagtcaagaagaaaaaggtt

SEQ ID NO: 4924460 - DNA, 15 bp, Homo sapiens
cagtcaatattttta

SEQ ID NO: 4924461 - DNA, 16 bp, Homo sapiens
cagtcagaaaacttta

SEQ ID NO: 4924462 - DNA, 13 bp, Homo sapiens
cagtcatcatcag

SEQ ID NO: 4924463 - DNA, 17 bp, Homo sapiens
cagtcatgcataaatat

SEQ ID NO: 4924464 - DNA, 22 bp, Homo sapiens
cagtcattagactcctcctcca

SEQ ID NO: 4924465 - DNA, 18 bp, Homo sapiens
cagtccaaatgtcctcca

SEQ ID NO: 4924466 - DNA, 21 bp, Homo sapiens
cagtccaaatgtcctccagaa

SEQ ID NO: 4924467 - DNA, 22 bp, Homo sapiens
cagtccaaatgtcctccagaag

SEQ ID NO: 4924468 - DNA, 23 bp, Homo sapiens
cagtccatgcatgacagcctcta

SEQ ID NO: 4924469 - DNA, 14 bp, Homo sapiens
cagtcccactgtgc

SEQ ID NO: 4924470 - DNA, 19 bp, Homo sapiens
cagtccccctatccttggc

SEQ ID NO: 4924471 - DNA, 21 bp, Homo sapiens
cagtccccctatccttggcac

SEQ ID NO: 4924472 - DNA, 23 bp, Homo sapiens
cagtccccgtgaaggagagccct

SEQ ID NO: 4924473 - DNA, 15 bp, Homo sapiens
cagtccctatgtatt

SEQ ID NO: 4924474 - DNA, 15 bp, Homo sapiens
cagtcctcccctcac

SEQ ID NO: 4924475 - DNA, 19 bp, Homo sapiens
cagtcctgcctcagcctcc

SEQ ID NO: 4924476 - DNA, 15 bp, Homo sapiens
cagtcctgcctggcc

SEQ ID NO: 4924477 - DNA, 16 bp, Homo sapiens
cagtcctgcctggcca

SEQ ID NO: 4924478 - DNA, 13 bp, Homo sapiens
cagtcctgctcca

SEQ ID NO: 4924479 - DNA, 14 bp, Homo sapiens
cagtcctgctccag

SEQ ID NO: 4924480 - DNA, 12 bp, Homo sapiens
cagtcctgggag

SEQ ID NO: 4924481 - DNA, 15 bp, Homo sapiens
cagtcgttagaatat

SEQ ID NO: 4924482 - DNA, 13 bp, Homo sapiens
cagtctcctcttt

SEQ ID NO: 4924483 - DNA, 18 bp, Homo sapiens
cagtctgaatgctgccac

SEQ ID NO: 4924484 - DNA, 19 bp, Homo sapiens
cagtctgattcccaagctc

SEQ ID NO: 4924485 - DNA, 20 bp, Homo sapiens
cagtctgattcccaagctct

SEQ ID NO: 4924486 - DNA, 22 bp, Homo sapiens
cagtctgattcccaagctctgc

SEQ ID NO: 4924487 - DNA, 15 bp, Homo sapiens
cagtctggaatgcag

SEQ ID NO: 4924488 - DNA, 19 bp, Homo sapiens
cagtcttgccttacacaaa

SEQ ID NO: 4924489 - DNA, 21 bp, Homo sapiens
cagtctttaaaggcccagccc

SEQ ID NO: 4924490 - DNA, 22 bp, Homo sapiens
cagtctttaaaggcccagcccc

SEQ ID NO: 4924491 - DNA, 23 bp, Homo sapiens
cagtctttaaaggcccagcccct

SEQ ID NO: 4924492 - DNA, 12 bp, Homo sapiens
cagtctttttct

SEQ ID NO: 4924493 - DNA, 16 bp, Homo sapiens
cagtctttttctgttg

SEQ ID NO: 4924494 - DNA, 20 bp, Homo sapiens
cagtctttttctgttgtaac

SEQ ID NO: 4924495 - DNA, 21 bp, Homo sapiens
cagtctttttctgttgtaact

SEQ ID NO: 4924496 - DNA, 14 bp, Homo sapiens
cagtgacaaaccat

SEQ ID NO: 4924497 - DNA, 14 bp, Homo sapiens
cagtgagaaaaagc

SEQ ID NO: 4924498 - DNA, 19 bp, Homo sapiens
cagtgagaaaaagctcctg

SEQ ID NO: 4924499 - DNA, 22 bp, Homo sapiens
cagtgagaaaaagctcctgtcc

SEQ ID NO: 4924500 - DNA, 14 bp, Homo sapiens
cagtgagatgaggg

SEQ ID NO: 4924501 - DNA, 20 bp, Homo sapiens
cagtgagatgagggatgggc

SEQ ID NO: 4924502 - DNA, 20 bp, Homo sapiens
cagtgagattacagaggaag

SEQ ID NO: 4924503 - DNA, 17 bp, Homo sapiens
cagtgagtcgaggacag

SEQ ID NO: 4924504 - DNA, 18 bp, Homo sapiens
cagtgagtctctggggca

SEQ ID NO: 4924505 - DNA, 15 bp, Homo sapiens
cagtgagtgagcctg

SEQ ID NO: 4924506 - DNA, 18 bp, Homo sapiens
cagtgagtgagcctggct

SEQ ID NO: 4924507 - DNA, 21 bp, Homo sapiens
cagtgagtgagcctggctctt

SEQ ID NO: 4924508 - DNA, 20 bp, Homo sapiens
cagtgatatggcagaagaca

SEQ ID NO: 4924509 - DNA, 21 bp, Homo sapiens
cagtgatatggcagaagacac

SEQ ID NO: 4924510 - DNA, 17 bp, Homo sapiens
cagtgcagggcaaaata

SEQ ID NO: 4924511 - DNA, 10 bp, Homo sapiens
cagtgccaac

SEQ ID NO: 4924512 - DNA, 12 bp, Homo sapiens
cagtgcccacag

SEQ ID NO: 4924513 - DNA, 15 bp, Homo sapiens
cagtgcccacaggat

SEQ ID NO: 4924514 - DNA, 18 bp, Homo sapiens
cagtgcccacaggatcag

SEQ ID NO: 4924515 - DNA, 21 bp, Homo sapiens
cagtgcctggatcccctctgt

SEQ ID NO: 4924516 - DNA, 22 bp, Homo sapiens
cagtgctgtccatgcttctcat

SEQ ID NO: 4924517 - DNA, 13 bp, Homo sapiens
cagtggagaatta

SEQ ID NO: 4924518 - DNA, 15 bp, Homo sapiens
cagtggaggtttgtc

SEQ ID NO: 4924519 - DNA, 14 bp, Homo sapiens
cagtggcagctgct

SEQ ID NO: 4924520 - DNA, 19 bp, Homo sapiens
cagtggcgttgttgcatgt

SEQ ID NO: 4924521 - DNA, 19 bp, Homo sapiens
cagtgggacagggcatggc

SEQ ID NO: 4924522 - DNA, 15 bp, Homo sapiens
cagtgggagctgcct

SEQ ID NO: 4924523 - DNA, 19 bp, Homo sapiens
cagtggtgcgatctgggtt

SEQ ID NO: 4924524 - DNA, 15 bp, Homo sapiens
cagtgtaatccccca

SEQ ID NO: 4924525 - DNA, 16 bp, Homo sapiens
cagtgtcccctccact

SEQ ID NO: 4924526 - DNA, 20 bp, Homo sapiens
cagtgtcccctccactgtca

SEQ ID NO: 4924527 - DNA, 21 bp, Homo sapiens
cagtgtgaagtacaataattc

SEQ ID NO: 4924528 - DNA, 14 bp, Homo sapiens
cagtgtgacaagga

SEQ ID NO: 4924529 - DNA, 18 bp, Homo sapiens
cagtgttaaatgaaattg

SEQ ID NO: 4924530 - DNA, 14 bp, Homo sapiens
cagtgttccccatc

SEQ ID NO: 4924531 - DNA, 19 bp, Homo sapiens
cagtgttccccatctgggt

SEQ ID NO: 4924532 - DNA, 14 bp, Homo sapiens
cagtgttcgcttgg

SEQ ID NO: 4924533 - DNA, 17 bp, Homo sapiens
cagtgttcgcttggctc

SEQ ID NO: 4924534 - DNA, 12 bp, Homo sapiens
cagtgttgagat

SEQ ID NO: 4924535 - DNA, 13 bp, Homo sapiens
cagtgttgcctaa

SEQ ID NO: 4924536 - DNA, 14 bp, Homo sapiens
cagttaaaatgtga

SEQ ID NO: 4924537 - DNA, 22 bp, Homo sapiens
cagttaattactcagcagaatg

SEQ ID NO: 4924538 - DNA, 13 bp, Homo sapiens
cagttatgaatca

SEQ ID NO: 4924539 - DNA, 14 bp, Homo sapiens
cagttatttatagt

SEQ ID NO: 4924540 - DNA, 14 bp, Homo sapiens
cagttcaagaaagc

SEQ ID NO: 4924541 - DNA, 22 bp, Homo sapiens
cagttcaatctcccgctgctgc

SEQ ID NO: 4924542 - DNA, 13 bp, Homo sapiens
cagttcacaccct

SEQ ID NO: 4924543 - DNA, 14 bp, Homo sapiens
cagttcacaccctg

SEQ ID NO: 4924544 - DNA, 20 bp, Homo sapiens
cagttcacaccctgcaaggc

SEQ ID NO: 4924545 - DNA, 13 bp, Homo sapiens
cagttcagcacca

SEQ ID NO: 4924546 - DNA, 23 bp, Homo sapiens
cagttcaggagtcccaaggaaag

SEQ ID NO: 4924547 - DNA, 16 bp, Homo sapiens
cagttcatgtttgctt

SEQ ID NO: 4924548 - DNA, 18 bp, Homo sapiens
cagttcccttggcctcag

SEQ ID NO: 4924549 - DNA, 14 bp, Homo sapiens
cagttctgaagaat

SEQ ID NO: 4924550 - DNA, 21 bp, Homo sapiens
cagttggaaataataaaagat

SEQ ID NO: 4924551 - DNA, 18 bp, Homo sapiens
cagttgggtggatgcctg

SEQ ID NO: 4924552 - DNA, 14 bp, Homo sapiens
cagttggttgtgtc

SEQ ID NO: 4924553 - DNA, 21 bp, Homo sapiens
cagtttatttttaaagataga

SEQ ID NO: 4924554 - DNA, 13 bp, Homo sapiens
cagtttgaacaaa

SEQ ID NO: 4924555 - DNA, 20 bp, Homo sapiens
cagtttgatcacactatttt

SEQ ID NO: 4924556 - DNA, 12 bp, Homo sapiens
cagtttgctttg

SEQ ID NO: 4924557 - DNA, 15 bp, Homo sapiens
cagtttgtgtgtctt

SEQ ID NO: 4924558 - DNA, 16 bp, Homo sapiens
cagttttatgctcttt

SEQ ID NO: 4924559 - DNA, 20 bp, Homo sapiens
cataaaaaggacatcagcaa

SEQ ID NO: 4924560 - DNA, 14 bp, Homo sapiens
cataaaagaatttt

SEQ ID NO: 4924561 - DNA, 13 bp, Homo sapiens
cataaatatgcag

SEQ ID NO: 4924562 - DNA, 16 bp, Homo sapiens
cataaatccagttcta

SEQ ID NO: 4924563 - DNA, 16 bp, Homo sapiens
cataacctagccttag

SEQ ID NO: 4924564 - DNA, 15 bp, Homo sapiens
cataacgtttttcct

SEQ ID NO: 4924565 - DNA, 16 bp, Homo sapiens
cataacgtttttcctt

SEQ ID NO: 4924566 - DNA, 18 bp, Homo sapiens
cataacgtttttccttta

SEQ ID NO: 4924567 - DNA, 20 bp, Homo sapiens
cataacgtttttcctttaaa

SEQ ID NO: 4924568 - DNA, 16 bp, Homo sapiens
cataactaaatttgat

SEQ ID NO: 4924569 - DNA, 20 bp, Homo sapiens
cataactaaatttgatactt

SEQ ID NO: 4924570 - DNA, 21 bp, Homo sapiens
cataacttattgctgatttta

SEQ ID NO: 4924571 - DNA, 23 bp, Homo sapiens
cataacttattgctgattttaat

SEQ ID NO: 4924572 - DNA, 21 bp, Homo sapiens
cataaggggtttgccatttga

SEQ ID NO: 4924573 - DNA, 23 bp, Homo sapiens
cataaggggtttgccatttgata

SEQ ID NO: 4924574 - DNA, 17 bp, Homo sapiens
cataagtaattcaagaa

SEQ ID NO: 4924575 - DNA, 18 bp, Homo sapiens
cataagtaattcaagaaa

SEQ ID NO: 4924576 - DNA, 21 bp, Homo sapiens
cataatctagtttacagaaaa

SEQ ID NO: 4924577 - DNA, 22 bp, Homo sapiens
cataatctagtttacagaaaaa

SEQ ID NO: 4924578 - DNA, 22 bp, Homo sapiens
cataatctggactcctctgtcc

SEQ ID NO: 4924579 - DNA, 14 bp, Homo sapiens
cataatgctactgt

SEQ ID NO: 4924580 - DNA, 18 bp, Homo sapiens
cataatgcttaatttcta

SEQ ID NO: 4924581 - DNA, 18 bp, Homo sapiens
cataattcctacagcact

SEQ ID NO: 4924582 - DNA, 13 bp, Homo sapiens
catacacgaaaga

SEQ ID NO: 4924583 - DNA, 17 bp, Homo sapiens
catacatgcaaaaagaa

SEQ ID NO: 4924584 - DNA, 13 bp, Homo sapiens
catacctctgacc

SEQ ID NO: 4924585 - DNA, 20 bp, Homo sapiens
catactactgaaacagattt

SEQ ID NO: 4924586 - DNA, 14 bp, Homo sapiens
catactcagcctgc

SEQ ID NO: 4924587 - DNA, 18 bp, Homo sapiens
catactcatttctaaaag

SEQ ID NO: 4924588 - DNA, 19 bp, Homo sapiens
catactgagccaagtataa

SEQ ID NO: 4924589 - DNA, 16 bp, Homo sapiens
catacttatctctctg

SEQ ID NO: 4924590 - DNA, 22 bp, Homo sapiens
catacttatctctctgtgctgt

SEQ ID NO: 4924591 - DNA, 17 bp, Homo sapiens
catactttcatcctgac

SEQ ID NO: 4924592 - DNA, 14 bp, Homo sapiens
catagaaacatgac

SEQ ID NO: 4924593 - DNA, 18 bp, Homo sapiens
catagaaacatgacactg

SEQ ID NO: 4924594 - DNA, 20 bp, Homo sapiens
catagaaacatgacactgac

SEQ ID NO: 4924595 - DNA, 14 bp, Homo sapiens
catagaactgggta

SEQ ID NO: 4924596 - DNA, 17 bp, Homo sapiens
catagagatttgtctaa

SEQ ID NO: 4924597 - DNA, 17 bp, Homo sapiens
catagagtcccccctcc

SEQ ID NO: 4924598 - DNA, 15 bp, Homo sapiens
catagagtttaacac

SEQ ID NO: 4924599 - DNA, 19 bp, Homo sapiens
catagattaatggcactga

SEQ ID NO: 4924600 - DNA, 22 bp, Homo sapiens
catagatttatttttcagttcc

SEQ ID NO: 4924601 - DNA, 23 bp, Homo sapiens
catagatttatttttcagttcca

SEQ ID NO: 4924602 - DNA, 15 bp, Homo sapiens
catagcaacaggaaa

SEQ ID NO: 4924603 - DNA, 18 bp, Homo sapiens
catagcccatccctgcct

SEQ ID NO: 4924604 - DNA, 15 bp, Homo sapiens
cagctacagctttct

SEQ ID NO: 4924605 - DNA, 15 bp, Homo sapiens
cagctacttcctcct

SEQ ID NO: 4924606 - DNA, 24 bp, Homo sapiens
cagctatcgaacttcacaactagg

SEQ ID NO: 4924607 - DNA, 13 bp, Homo sapiens
cagctatgctggt

SEQ ID NO: 4924608 - DNA, 20 bp, Homo sapiens
cagctcaatggactggaagg

SEQ ID NO: 4924609 - DNA, 16 bp, Homo sapiens
cagctcaccagcccca

SEQ ID NO: 4924610 - DNA, 19 bp, Homo sapiens
cagctcaccagccccagtg

SEQ ID NO: 4924611 - DNA, 17 bp, Homo sapiens
cagctcagaacccaggg

SEQ ID NO: 4924612 - DNA, 18 bp, Homo sapiens
cagctcagaacccagggc

SEQ ID NO: 4924613 - DNA, 21 bp, Homo sapiens
cagctcagaacccagggctct

SEQ ID NO: 4924614 - DNA, 11 bp, Homo sapiens
cagctcagcgc

SEQ ID NO: 4924615 - DNA, 18 bp, Homo sapiens
cagctcaggggcagctca

SEQ ID NO: 4924616 - DNA, 17 bp, Homo sapiens
cagctccagctcaccag

SEQ ID NO: 4924617 - DNA, 17 bp, Homo sapiens
cagctccaggtggctct

SEQ ID NO: 4924618 - DNA, 15 bp, Homo sapiens
cagctccctaggaga

SEQ ID NO: 4924619 - DNA, 19 bp, Homo sapiens
cagctccctaggagaccaa

SEQ ID NO: 4924620 - DNA, 19 bp, Homo sapiens
cagctccctgccaaactga

SEQ ID NO: 4924621 - DNA, 16 bp, Homo sapiens
cagctccttctgtcct

SEQ ID NO: 4924622 - DNA, 20 bp, Homo sapiens
cagctcgatccaaattgtgc

SEQ ID NO: 4924623 - DNA, 22 bp, Homo sapiens
cagctcgcacccccctgttcta

SEQ ID NO: 4924624 - DNA, 15 bp, Homo sapiens
cagctctaataaaac

SEQ ID NO: 4924625 - DNA, 16 bp, Homo sapiens
cagctctaataaaaca

SEQ ID NO: 4924626 - DNA, 15 bp, Homo sapiens
cagctctactggtct

SEQ ID NO: 4924627 - DNA, 20 bp, Homo sapiens
cagctctagacactgccaca

SEQ ID NO: 4924628 - DNA, 16 bp, Homo sapiens
cagctctctgtataaa

SEQ ID NO: 4924629 - DNA, 18 bp, Homo sapiens
cagctctctgtataaaca

SEQ ID NO: 4924630 - DNA, 18 bp, Homo sapiens
cagctctgtcctgggagt

SEQ ID NO: 4924631 - DNA, 23 bp, Homo sapiens
cagctctgtcctgggagtgagct

SEQ ID NO: 4924632 - DNA, 17 bp, Homo sapiens
cagctctgtgttgccat

SEQ ID NO: 4924633 - DNA, 17 bp, Homo sapiens
cagctgaatgcctcctg

SEQ ID NO: 4924634 - DNA, 20 bp, Homo sapiens
cagctgaatgcctcctgtgg

SEQ ID NO: 4924635 - DNA, 23 bp, Homo sapiens
cagctgaatgcctcctgtgggga

SEQ ID NO: 4924636 - DNA, 21 bp, Homo sapiens
cagctgagagacttttaatca

SEQ ID NO: 4924637 - DNA, 20 bp, Homo sapiens
cagctgatgttggaagagaa

SEQ ID NO: 4924638 - DNA, 17 bp, Homo sapiens
cagctgcagctgggctg

SEQ ID NO: 4924639 - DNA, 22 bp, Homo sapiens
cagctgccgggcctgatttggt

SEQ ID NO: 4924640 - DNA, 15 bp, Homo sapiens
cagctgcgcgggctt

SEQ ID NO: 4924641 - DNA, 18 bp, Homo sapiens
cagctgcggtccacccag

SEQ ID NO: 4924642 - DNA, 22 bp, Homo sapiens
cagctgctatttattttcctaa

SEQ ID NO: 4924643 - DNA, 12 bp, Homo sapiens
cagctgctgtct

SEQ ID NO: 4924644 - DNA, 14 bp, Homo sapiens
cagctggacagagg

SEQ ID NO: 4924645 - DNA, 18 bp, Homo sapiens
cagctggactctgcatcc

SEQ ID NO: 4924646 - DNA, 16 bp, Homo sapiens
cagctggcctggacag

SEQ ID NO: 4924647 - DNA, 17 bp, Homo sapiens
cagctggcctggacagt

SEQ ID NO: 4924648 - DNA, 15 bp, Homo sapiens
cagctgggctctgca

SEQ ID NO: 4924649 - DNA, 16 bp, Homo sapiens
cagctgggctctgcaa

SEQ ID NO: 4924650 - DNA, 17 bp, Homo sapiens
cagctgtacttcgtctt

SEQ ID NO: 4924651 - DNA, 17 bp, Homo sapiens
cagctgtcctccctcca

SEQ ID NO: 4924652 - DNA, 14 bp, Homo sapiens
cagctgtctgtggc

SEQ ID NO: 4924653 - DNA, 15 bp, Homo sapiens
cagctgtgagccttg

SEQ ID NO: 4924654 - DNA, 17 bp, Homo sapiens
cagctgtgagccttggc

SEQ ID NO: 4924655 - DNA, 15 bp, Homo sapiens
cagcttcatttcctg

SEQ ID NO: 4924656 - DNA, 20 bp, Homo sapiens
cagcttcctacccacacctc

SEQ ID NO: 4924657 - DNA, 13 bp, Homo sapiens
cagcttcctgtca

SEQ ID NO: 4924658 - DNA, 14 bp, Homo sapiens
cagcttgagggttg

SEQ ID NO: 4924659 - DNA, 16 bp, Homo sapiens
cagcttgcgaataaca

SEQ ID NO: 4924660 - DNA, 17 bp, Homo sapiens
cagcttggccctttcct

SEQ ID NO: 4924661 - DNA, 23 bp, Homo sapiens
cagcttgggagagcccctggggc

SEQ ID NO: 4924662 - DNA, 15 bp, Homo sapiens
cagcttgtaggagct

SEQ ID NO: 4924663 - DNA, 16 bp, Homo sapiens
cagcttgtaggagctg

SEQ ID NO: 4924664 - DNA, 20 bp, Homo sapiens
cagcttgtgtgcaaaagcag

SEQ ID NO: 4924665 - DNA, 18 bp, Homo sapiens
cagctttaaactcaggga

SEQ ID NO: 4924666 - DNA, 22 bp, Homo sapiens
cagctttaaactcagggacaga

SEQ ID NO: 4924667 - DNA, 19 bp, Homo sapiens
cagctttacatgcaattta

SEQ ID NO: 4924668 - DNA, 21 bp, Homo sapiens
cagctttacatgcaatttatt

SEQ ID NO: 4924669 - DNA, 14 bp, Homo sapiens
cagctttcaagtgc

SEQ ID NO: 4924670 - DNA, 16 bp, Homo sapiens
cagctttcagggccat

SEQ ID NO: 4924671 - DNA, 16 bp, Homo sapiens
cagctttgagaagcct

SEQ ID NO: 4924672 - DNA, 18 bp, Homo sapiens
cagctttgagaagccttc

SEQ ID NO: 4924673 - DNA, 16 bp, Homo sapiens
cagcttttaaccatct

SEQ ID NO: 4924674 - DNA, 19 bp, Homo sapiens
caggaaaagctgctgacag

SEQ ID NO: 4924675 - DNA, 18 bp, Homo sapiens
caggaaaccaacacccaa

SEQ ID NO: 4924676 - DNA, 19 bp, Homo sapiens
caggaaagctcagctactg

SEQ ID NO: 4924677 - DNA, 21 bp, Homo sapiens
caggaacctgtcctaaggaac

SEQ ID NO: 4924678 - DNA, 19 bp, Homo sapiens
caggaactagactgcctgg

SEQ ID NO: 4924679 - DNA, 16 bp, Homo sapiens
caggaagcaccccatg

SEQ ID NO: 4924680 - DNA, 18 bp, Homo sapiens
caggaagcattcagagag

SEQ ID NO: 4924681 - DNA, 21 bp, Homo sapiens
caggaagcctgcagtcctgga

SEQ ID NO: 4924682 - DNA, 16 bp, Homo sapiens
caggaaggagagcctg

SEQ ID NO: 4924683 - DNA, 16 bp, Homo sapiens
cagggaaacagctaat

SEQ ID NO: 4924684 - DNA, 15 bp, Homo sapiens
cagggaaggcctgac

SEQ ID NO: 4924685 - DNA, 14 bp, Homo sapiens
cagggaatccaagc

SEQ ID NO: 4924686 - DNA, 14 bp, Homo sapiens
cagggacagagcca

SEQ ID NO: 4924687 - DNA, 15 bp, Homo sapiens
cagggacagagccat

SEQ ID NO: 4924688 - DNA, 17 bp, Homo sapiens
cagggacagagccatgc

SEQ ID NO: 4924689 - DNA, 12 bp, Homo sapiens
cagggacaggat

SEQ ID NO: 4924690 - DNA, 14 bp, Homo sapiens
cagggagcagggaa

SEQ ID NO: 4924691 - DNA, 19 bp, Homo sapiens
cagggaggtcaggccctgg

SEQ ID NO: 4924692 - DNA, 23 bp, Homo sapiens
cagggaggtcaggccctggaact

SEQ ID NO: 4924693 - DNA, 18 bp, Homo sapiens
cagggaggtgaccccagg

SEQ ID NO: 4924694 - DNA, 21 bp, Homo sapiens
cagggatgtagattaaggtga

SEQ ID NO: 4924695 - DNA, 21 bp, Homo sapiens
cagggcaaaatattcactggg

SEQ ID NO: 4924696 - DNA, 14 bp, Homo sapiens
cagggcaaatgaca

SEQ ID NO: 4924697 - DNA, 14 bp, Homo sapiens
cagggcacaccggg

SEQ ID NO: 4924698 - DNA, 23 bp, Homo sapiens
cagggcacaccgggcactcagaa

SEQ ID NO: 4924699 - DNA, 22 bp, Homo sapiens
cagggcaccctgtggccctggc

SEQ ID NO: 4924700 - DNA, 21 bp, Homo sapiens
cagggcagcctcccccggctc

SEQ ID NO: 4924701 - DNA, 22 bp, Homo sapiens
cagggcagtgctagtgagctgg

SEQ ID NO: 4924702 - DNA, 23 bp, Homo sapiens
cagggcatgccccggccacctct

SEQ ID NO: 4924703 - DNA, 17 bp, Homo sapiens
cagggccaacttgaggg

SEQ ID NO: 4924704 - DNA, 19 bp, Homo sapiens
cagggccaacttgagggcc

SEQ ID NO: 4924705 - DNA, 16 bp, Homo sapiens
cagggccaatccccag

SEQ ID NO: 4924706 - DNA, 13 bp, Homo sapiens
cagggccaggact

SEQ ID NO: 4924707 - DNA, 17 bp, Homo sapiens
cagggccagtggggcct

SEQ ID NO: 4924708 - DNA, 20 bp, Homo sapiens
cagggccagtggggcctgtg

SEQ ID NO: 4924709 - DNA, 21 bp, Homo sapiens
cagggccagtggggcctgtgg

SEQ ID NO: 4924710 - DNA, 22 bp, Homo sapiens
cagggccgaggaggtgcctgga

SEQ ID NO: 4924711 - DNA, 23 bp, Homo sapiens
cagggcctcccgcatcaaggtca

SEQ ID NO: 4924712 - DNA, 12 bp, Homo sapiens
cagggcctgggg

SEQ ID NO: 4924713 - DNA, 15 bp, Homo sapiens
cagggctaccctccc

SEQ ID NO: 4924714 - DNA, 23 bp, Homo sapiens
cagggctcagcggggacagctcc

SEQ ID NO: 4924715 - DNA, 16 bp, Homo sapiens
cagggctgccctgaga

SEQ ID NO: 4924716 - DNA, 11 bp, Homo sapiens
aaaaaaagaaa

SEQ ID NO: 4924717 - DNA, 13 bp, Homo sapiens
aaaaaaagaagaa

SEQ ID NO: 4924718 - DNA, 14 bp, Homo sapiens
aaaaaaagatctgt

SEQ ID NO: 4924719 - DNA, 12 bp, Homo sapiens
aaaaaaagcata

SEQ ID NO: 4924720 - DNA, 11 bp, Homo sapiens
aaaaaaatagt

SEQ ID NO: 4924721 - DNA, 12 bp, Homo sapiens
aaaaaaatcttc

SEQ ID NO: 4924722 - DNA, 13 bp, Homo sapiens
aaaaaaatgaatg

SEQ ID NO: 4924723 - DNA, 11 bp, Homo sapiens
aaaaaaatgcc

SEQ ID NO: 4924724 - DNA, 15 bp, Homo sapiens
aaaaaagagaattag

SEQ ID NO: 4924725 - DNA, 12 bp, Homo sapiens
aaaaaagctcat

SEQ ID NO: 4924726 - DNA, 12 bp, Homo sapiens
aaaaaatcatct

SEQ ID NO: 4924727 - DNA, 17 bp, Homo sapiens
aaaaaatcatctatttt

SEQ ID NO: 4924728 - DNA, 13 bp, Homo sapiens
aaaaaatctatcc

SEQ ID NO: 4924729 - DNA, 12 bp, Homo sapiens
aaaaacaaccaa

SEQ ID NO: 4924730 - DNA, 14 bp, Homo sapiens
aaaaacacaaaagt

SEQ ID NO: 4924731 - DNA, 14 bp, Homo sapiens
aaaaacatattctt

SEQ ID NO: 4924732 - DNA, 15 bp, Homo sapiens
aaaaacgaaaacagt

SEQ ID NO: 4924733 - DNA, 15 bp, Homo sapiens
aaaaactgtctttaa

SEQ ID NO: 4924734 - DNA, 21 bp, Homo sapiens
aaaaacttagtgacaaaatag

SEQ ID NO: 4924735 - DNA, 15 bp, Homo sapiens
aaaaagaaaggaggg

SEQ ID NO: 4924736 - DNA, 12 bp, Homo sapiens
aaaaagaagaag

SEQ ID NO: 4924737 - DNA, 15 bp, Homo sapiens
aaaaagattcttttt

SEQ ID NO: 4924738 - DNA, 17 bp, Homo sapiens
aaaaagctcatttcatg

SEQ ID NO: 4924739 - DNA, 23 bp, Homo sapiens
aaaaagctttatgattttcataa

SEQ ID NO: 4924740 - DNA, 16 bp, Homo sapiens
aaaaaggacatcagca

SEQ ID NO: 4924741 - DNA, 21 bp, Homo sapiens
aaaaagggtcaatgctatttt

SEQ ID NO: 4924742 - DNA, 23 bp, Homo sapiens
aaaaagggtcaatgctatttttg

SEQ ID NO: 4924743 - DNA, 13 bp, Homo sapiens
aaaaagtgacaca

SEQ ID NO: 4924744 - DNA, 14 bp, Homo sapiens
aaaaagtgacacag

SEQ ID NO: 4924745 - DNA, 23 bp, Homo sapiens
aaaaagtgacacagcagcttcac

SEQ ID NO: 4924746 - DNA, 17 bp, Homo sapiens
aaaaagtggaatttctt

SEQ ID NO: 4924747 - DNA, 19 bp, Homo sapiens
aaaaagtggaatttcttgt

SEQ ID NO: 4924748 - DNA, 12 bp, Homo sapiens
aaaaataaatgg

SEQ ID NO: 4924749 - DNA, 14 bp, Homo sapiens
aaaaatataactta

SEQ ID NO: 4924750 - DNA, 13 bp, Homo sapiens
aaaaatatattta

SEQ ID NO: 4924751 - DNA, 24 bp, Homo sapiens
aaaaatgcctttgagacagtttct

SEQ ID NO: 4924752 - DNA, 12 bp, Homo sapiens
aaaaatggatat

SEQ ID NO: 4924753 - DNA, 15 bp, Homo sapiens
aaaaatggatattat

SEQ ID NO: 4924754 - DNA, 12 bp, Homo sapiens
aaaaatgtaaat

SEQ ID NO: 4924755 - DNA, 22 bp, Homo sapiens
aaaaattcagcaaaccattttt

SEQ ID NO: 4924756 - DNA, 18 bp, Homo sapiens
aaaaattcctaagaatca

SEQ ID NO: 4924757 - DNA, 19 bp, Homo sapiens
aaaaattcctttgtgtttc

SEQ ID NO: 4924758 - DNA, 22 bp, Homo sapiens
aaaacaactatggatcagaata

SEQ ID NO: 4924759 - DNA, 19 bp, Homo sapiens
aaaacaatcatttgctttt

SEQ ID NO: 4924760 - DNA, 19 bp, Homo sapiens
aaaacaatctggaagaaaa

SEQ ID NO: 4924761 - DNA, 12 bp, Homo sapiens
aaaacacattgc

SEQ ID NO: 4924762 - DNA, 15 bp, Homo sapiens
aaaacacctagcttt

SEQ ID NO: 4924763 - DNA, 14 bp, Homo sapiens
aaaacactgtggaa

SEQ ID NO: 4924764 - DNA, 23 bp, Homo sapiens
aaaacagctgtctctaacttatt

SEQ ID NO: 4924765 - DNA, 21 bp, Homo sapiens
aaaacaggtcttcatcgaatc

SEQ ID NO: 4924766 - DNA, 18 bp, Homo sapiens
aaaacagtatttattttg

SEQ ID NO: 4924767 - DNA, 19 bp, Homo sapiens
aaaacagtatttattttgt

SEQ ID NO: 4924768 - DNA, 21 bp, Homo sapiens
aaaacagtatttattttgtaa

SEQ ID NO: 4924769 - DNA, 19 bp, Homo sapiens
aaaacatattcttgtgctt

SEQ ID NO: 4924770 - DNA, 21 bp, Homo sapiens
aaaacattttttaatagaata

SEQ ID NO: 4924771 - DNA, 13 bp, Homo sapiens
aaaaccaaaatga

SEQ ID NO: 4924772 - DNA, 14 bp, Homo sapiens
aaaaccaaaatgac

SEQ ID NO: 4924773 - DNA, 21 bp, Homo sapiens
aaaaccacaaaggccaaactg

SEQ ID NO: 4924774 - DNA, 12 bp, Homo sapiens
aaaaccacacaa

SEQ ID NO: 4924775 - DNA, 14 bp, Homo sapiens
aaaacgaaaacagt

SEQ ID NO: 4924776 - DNA, 18 bp, Homo sapiens
aaaactaaatctctaata

SEQ ID NO: 4924777 - DNA, 21 bp, Homo sapiens
aaaactacaaatcaagtattt

SEQ ID NO: 4924778 - DNA, 20 bp, Homo sapiens
aaactttacccaaaaactaa

SEQ ID NO: 4924779 - DNA, 19 bp, Homo sapiens
aaactttagggtaaaaatt

SEQ ID NO: 4924780 - DNA, 23 bp, Homo sapiens
aaactttatacattagtaaatgt

SEQ ID NO: 4924781 - DNA, 13 bp, Homo sapiens
aaacttttaactg

SEQ ID NO: 4924782 - DNA, 18 bp, Homo sapiens
aaacttttcaaggcttat

SEQ ID NO: 4924783 - DNA, 13 bp, Homo sapiens
aaactttttttca

SEQ ID NO: 4924784 - DNA, 15 bp, Homo sapiens
aaactttttttcaat

SEQ ID NO: 4924785 - DNA, 11 bp, Homo sapiens
aaagaaaaaaa

SEQ ID NO: 4924786 - DNA, 19 bp, Homo sapiens
aaagaaaaaaaaaagaaga

SEQ ID NO: 4924787 - DNA, 16 bp, Homo sapiens
aaagaaaagaaaattt

SEQ ID NO: 4924788 - DNA, 16 bp, Homo sapiens
aaagaaaataaagaca

SEQ ID NO: 4924789 - DNA, 19 bp, Homo sapiens
aaagaaaatttttgtagta

SEQ ID NO: 4924790 - DNA, 14 bp, Homo sapiens
aaagaaataccttg

SEQ ID NO: 4924791 - DNA, 23 bp, Homo sapiens
aaagaaatccatatcttaaagaa

SEQ ID NO: 4924792 - DNA, 15 bp, Homo sapiens
aaagaaatgaacatt

SEQ ID NO: 4924793 - DNA, 17 bp, Homo sapiens
aaagaaatttactatat

SEQ ID NO: 4924794 - DNA, 18 bp, Homo sapiens
aaagaatatatttattta

SEQ ID NO: 4924795 - DNA, 13 bp, Homo sapiens
aaagaatattcag

SEQ ID NO: 4924796 - DNA, 22 bp, Homo sapiens
aaagaatattcagagaatatca

SEQ ID NO: 4924797 - DNA, 22 bp, Homo sapiens
aaagaatgagaaggagtcagaa

SEQ ID NO: 4924798 - DNA, 19 bp, Homo sapiens
aaagacacctactgagtgg

SEQ ID NO: 4924799 - DNA, 22 bp, Homo sapiens
aaagaccaaacttcactctggg

SEQ ID NO: 4924800 - DNA, 15 bp, Homo sapiens
aaagacccaggggga

SEQ ID NO: 4924801 - DNA, 19 bp, Homo sapiens
aaagacgatttgtcagtta

SEQ ID NO: 4924802 - DNA, 17 bp, Homo sapiens
aaagactctattctcaa

SEQ ID NO: 4924803 - DNA, 18 bp, Homo sapiens
aaagactttaaaagtgat

SEQ ID NO: 4924804 - DNA, 19 bp, Homo sapiens
aaagagaattagattatat

SEQ ID NO: 4924805 - DNA, 21 bp, Homo sapiens
aaagagaattgggggcttagg

SEQ ID NO: 4924806 - DNA, 24 bp, Homo sapiens
aaagagatccaggaagcatgagtg

SEQ ID NO: 4924807 - DNA, 21 bp, Homo sapiens
aaagaggactcgcttgtaaat

SEQ ID NO: 4924808 - DNA, 14 bp, Homo sapiens
aaagaggctgcccc

SEQ ID NO: 4924809 - DNA, 13 bp, Homo sapiens
aaagagtagaatt

SEQ ID NO: 4924810 - DNA, 18 bp, Homo sapiens
aaagagtagaattgcatt

SEQ ID NO: 4924811 - DNA, 13 bp, Homo sapiens
aaagagtctagat

SEQ ID NO: 4924812 - DNA, 21 bp, Homo sapiens
aaagagtctagattcaaaggt

SEQ ID NO: 4924813 - DNA, 23 bp, Homo sapiens
aaagagttctggaaaagaactgt

SEQ ID NO: 4924814 - DNA, 20 bp, Homo sapiens
aaagataattgctatttatt

SEQ ID NO: 4924815 - DNA, 16 bp, Homo sapiens
aaagatcaaaataaaa

SEQ ID NO: 4924816 - DNA, 20 bp, Homo sapiens
aaagatgcaaggaccaggac

SEQ ID NO: 4924817 - DNA, 21 bp, Homo sapiens
aaagatgccaattattgttac

SEQ ID NO: 4924818 - DNA, 11 bp, Homo sapiens
aaagattaaac

SEQ ID NO: 4924819 - DNA, 22 bp, Homo sapiens
aaagattagcaaggtcatttct

SEQ ID NO: 4924820 - DNA, 14 bp, Homo sapiens
aaagattcacctga

SEQ ID NO: 4924821 - DNA, 12 bp, Homo sapiens
aaagattctata

SEQ ID NO: 4924822 - DNA, 17 bp, Homo sapiens
aaagattctttttctga

SEQ ID NO: 4924823 - DNA, 17 bp, Homo sapiens
aaagatttaagcacaaa

SEQ ID NO: 4924824 - DNA, 21 bp, Homo sapiens
aaagatttaagcacaaacttt

SEQ ID NO: 4924825 - DNA, 18 bp, Homo sapiens
aaagcaaaataaaaacta

SEQ ID NO: 4924826 - DNA, 21 bp, Homo sapiens
aaagcacagtgttaaatgaaa

SEQ ID NO: 4924827 - DNA, 15 bp, Homo sapiens
aaagcacagtttgaa

SEQ ID NO: 4924828 - DNA, 18 bp, Homo sapiens
aaagcactagagaatgca

SEQ ID NO: 4924829 - DNA, 21 bp, Homo sapiens
aaagcaggggctacaagaggg

SEQ ID NO: 4924830 - DNA, 16 bp, Homo sapiens
aaagcataaaaacatt

SEQ ID NO: 4924831 - DNA, 17 bp, Homo sapiens
aaagcatacatgcaaaa

SEQ ID NO: 4924832 - DNA, 17 bp, Homo sapiens
aaagcatagatgttttg

SEQ ID NO: 4924833 - DNA, 18 bp, Homo sapiens
aaagcattgctgttatgt

SEQ ID NO: 4924834 - DNA, 14 bp, Homo sapiens
aaagcatttatcat

SEQ ID NO: 4924835 - DNA, 15 bp, Homo sapiens
aaagccaaagctagg

SEQ ID NO: 4924836 - DNA, 12 bp, Homo sapiens
aaagccacccca

SEQ ID NO: 4924837 - DNA, 18 bp, Homo sapiens
aaagccacctctgtcatt

SEQ ID NO: 4924838 - DNA, 16 bp, Homo sapiens
aaagccactagactct

SEQ ID NO: 4924839 - DNA, 23 bp, Homo sapiens
aaagcccttccatgtcgcctctg

SEQ ID NO: 4924840 - DNA, 13 bp, Homo sapiens
aaagcctcaacca

SEQ ID NO: 4924841 - DNA, 20 bp, Homo sapiens
aaagcctcaaggttttaggt

SEQ ID NO: 4924842 - DNA, 17 bp, Homo sapiens
aaagcctgtaagcctgc

SEQ ID NO: 4924843 - DNA, 22 bp, Homo sapiens
aaagcctgtaagcctgcaagcc

SEQ ID NO: 4924844 - DNA, 11 bp, Homo sapiens
aaagccttgtg

SEQ ID NO: 4924845 - DNA, 22 bp, Homo sapiens
aaagccttgtgtatatttgtat

SEQ ID NO: 4924846 - DNA, 14 bp, Homo sapiens
aaagctaggcctgg

SEQ ID NO: 4924847 - DNA, 16 bp, Homo sapiens
aaagctaggcctggcc

SEQ ID NO: 4924848 - DNA, 17 bp, Homo sapiens
aaagctattagccagga

SEQ ID NO: 4924849 - DNA, 22 bp, Homo sapiens
aaagctattagccaggatcatg

SEQ ID NO: 4924850 - DNA, 23 bp, Homo sapiens
aaagctattagccaggatcatgg

SEQ ID NO: 4924851 - DNA, 20 bp, Homo sapiens
aaagctcctggggcgtccag

SEQ ID NO: 4924852 - DNA, 14 bp, Homo sapiens
aaagctctagaatc

SEQ ID NO: 4924853 - DNA, 22 bp, Homo sapiens
aaagctctgttgcaattaggat

SEQ ID NO: 4924854 - DNA, 17 bp, Homo sapiens
aaagctgcctgtagtta

SEQ ID NO: 4924855 - DNA, 23 bp, Homo sapiens
aaagcttatccataaaaaaaaat

SEQ ID NO: 4924856 - DNA, 17 bp, Homo sapiens
aaagcttccatgattct

SEQ ID NO: 4924857 - DNA, 18 bp, Homo sapiens
aaagcttccatgattcta

SEQ ID NO: 4924858 - DNA, 20 bp, Homo sapiens
aaagcttcttaattaatttg

SEQ ID NO: 4924859 - DNA, 23 bp, Homo sapiens
aaagcttcttaattaatttgatt

SEQ ID NO: 4924860 - DNA, 16 bp, Homo sapiens
aaagctttttcctcct

SEQ ID NO: 4924861 - DNA, 14 bp, Homo sapiens
aaaggaaaaagctc

SEQ ID NO: 4924862 - DNA, 15 bp, Homo sapiens
aaaggaaaacctgaa

SEQ ID NO: 4924863 - DNA, 23 bp, Homo sapiens
aaaggaaatctcaccccatccca

SEQ ID NO: 4924864 - DNA, 18 bp, Homo sapiens
aaaggaagtgccccctcc

SEQ ID NO: 4924865 - DNA, 14 bp, Homo sapiens
aaaggacatcagca

SEQ ID NO: 4924866 - DNA, 14 bp, Homo sapiens
aaaggacattatgt

SEQ ID NO: 4924867 - DNA, 18 bp, Homo sapiens
aaaggacattatgtgtgc

SEQ ID NO: 4924868 - DNA, 13 bp, Homo sapiens
aaaggactgtaat

SEQ ID NO: 4924869 - DNA, 20 bp, Homo sapiens
aaaggagacaagttccatgg

SEQ ID NO: 4924870 - DNA, 16 bp, Homo sapiens
aaaggaggcatgcctc

SEQ ID NO: 4924871 - DNA, 18 bp, Homo sapiens
aaaggaggcatgcctctg

SEQ ID NO: 4924872 - DNA, 13 bp, Homo sapiens
aaaggaggctggc

SEQ ID NO: 4924873 - DNA, 16 bp, Homo sapiens
aaaggagtcaaaacta

SEQ ID NO: 4924874 - DNA, 21 bp, Homo sapiens
aaaggatagatcaaagtcaaa

SEQ ID NO: 4924875 - DNA, 18 bp, Homo sapiens
aaaggatagtatttttat

SEQ ID NO: 4924876 - DNA, 13 bp, Homo sapiens
aaaggatgtgatt

SEQ ID NO: 4924877 - DNA, 17 bp, Homo sapiens
aaaggcaaatgtgtaca

SEQ ID NO: 4924878 - DNA, 17 bp, Homo sapiens
aaaggcaccatctaata

SEQ ID NO: 4924879 - DNA, 13 bp, Homo sapiens
aaaggcccagccc

SEQ ID NO: 4924880 - DNA, 16 bp, Homo sapiens
aaaggcccagccccta

SEQ ID NO: 4924881 - DNA, 17 bp, Homo sapiens
aaaggcttgaagctgtg

SEQ ID NO: 4924882 - DNA, 18 bp, Homo sapiens
aaagggagctatcaggaa

SEQ ID NO: 4924883 - DNA, 17 bp, Homo sapiens
aaagggggtccgtggaa

SEQ ID NO: 4924884 - DNA, 20 bp, Homo sapiens
aaaggggttggggtgacagt

SEQ ID NO: 4924885 - DNA, 21 bp, Homo sapiens
aaaggtagcttacctgacaca

SEQ ID NO: 4924886 - DNA, 18 bp, Homo sapiens
aaaggtattttgaatacc

SEQ ID NO: 4924887 - DNA, 16 bp, Homo sapiens
aacagtatttattttg

SEQ ID NO: 4924888 - DNA, 19 bp, Homo sapiens
aacataaaaaggacatcag

SEQ ID NO: 4924889 - DNA, 17 bp, Homo sapiens
aacataacccacttgtc

SEQ ID NO: 4924890 - DNA, 14 bp, Homo sapiens
aacataatctagtt

SEQ ID NO: 4924891 - DNA, 12 bp, Homo sapiens
aacataatgaaa

SEQ ID NO: 4924892 - DNA, 12 bp, Homo sapiens
aacataattaaa

SEQ ID NO: 4924893 - DNA, 21 bp, Homo sapiens
aacatagtaagttcagcactt

SEQ ID NO: 4924894 - DNA, 14 bp, Homo sapiens
aacatatgatttca

SEQ ID NO: 4924895 - DNA, 16 bp, Homo sapiens
aacatatgtacataaa

SEQ ID NO: 4924896 - DNA, 21 bp, Homo sapiens
aacatatgtacataaattgca

SEQ ID NO: 4924897 - DNA, 18 bp, Homo sapiens
aacatcactatccatgca

SEQ ID NO: 4924898 - DNA, 17 bp, Homo sapiens
aacatccatgtcctatg

SEQ ID NO: 4924899 - DNA, 13 bp, Homo sapiens
aacatgacactga

SEQ ID NO: 4924900 - DNA, 14 bp, Homo sapiens
aacatgacactgac

SEQ ID NO: 4924901 - DNA, 23 bp, Homo sapiens
aacatgcttatgacaatgactgt

SEQ ID NO: 4924902 - DNA, 19 bp, Homo sapiens
aacattaaaaatggaactg

SEQ ID NO: 4924903 - DNA, 14 bp, Homo sapiens
aacattaaatgtct

SEQ ID NO: 4924904 - DNA, 17 bp, Homo sapiens
aacattaccttactgtg

SEQ ID NO: 4924905 - DNA, 19 bp, Homo sapiens
aacattaccttactgtgga

SEQ ID NO: 4924906 - DNA, 12 bp, Homo sapiens
aacattatttat

SEQ ID NO: 4924907 - DNA, 16 bp, Homo sapiens
aacattatttattcag

SEQ ID NO: 4924908 - DNA, 11 bp, Homo sapiens
aacattccaag

SEQ ID NO: 4924909 - DNA, 12 bp, Homo sapiens
aacattccaaga

SEQ ID NO: 4924910 - DNA, 20 bp, Homo sapiens
aacattgagattatgatgaa

SEQ ID NO: 4924911 - DNA, 12 bp, Homo sapiens
aacattggatta

SEQ ID NO: 4924912 - DNA, 12 bp, Homo sapiens
aacattgtatta

SEQ ID NO: 4924913 - DNA, 20 bp, Homo sapiens
aacattgttgctccctgtga

SEQ ID NO: 4924914 - DNA, 15 bp, Homo sapiens
aacatttctgtaaat

SEQ ID NO: 4924915 - DNA, 19 bp, Homo sapiens
aacatttctgtaaatacca

SEQ ID NO: 4924916 - DNA, 20 bp, Homo sapiens
aacatttctgtaaataccat

SEQ ID NO: 4924917 - DNA, 12 bp, Homo sapiens
aacatttgcctt

SEQ ID NO: 4924918 - DNA, 19 bp, Homo sapiens
aacattttaaataaaagaa

SEQ ID NO: 4924919 - DNA, 20 bp, Homo sapiens
aacattttaaataaaagaaa

SEQ ID NO: 4924920 - DNA, 21 bp, Homo sapiens
aacattttgttcttacacata

SEQ ID NO: 4924921 - DNA, 22 bp, Homo sapiens
aacatttttcaacaaatatctt

SEQ ID NO: 4924922 - DNA, 21 bp, Homo sapiens
aaccaaaagaacaagaatttc

SEQ ID NO: 4924923 - DNA, 16 bp, Homo sapiens
aaccaaaatgacatct

SEQ ID NO: 4924924 - DNA, 22 bp, Homo sapiens
aaccaaaatgacatctttttaa

SEQ ID NO: 4924925 - DNA, 21 bp, Homo sapiens
aaccaacttggttctgcttca

SEQ ID NO: 4924926 - DNA, 18 bp, Homo sapiens
aaccaagccgtggcttcc

SEQ ID NO: 4924927 - DNA, 18 bp, Homo sapiens
aaccaattttcaaagttc

SEQ ID NO: 4924928 - DNA, 18 bp, Homo sapiens
aaccacatcttgctctgc

SEQ ID NO: 4924929 - DNA, 18 bp, Homo sapiens
aaccacgtctgtcttcac

SEQ ID NO: 4924930 - DNA, 21 bp, Homo sapiens
aaccacgtctgtcttcacagc

SEQ ID NO: 4924931 - DNA, 14 bp, Homo sapiens
aaccacttcattct

SEQ ID NO: 4924932 - DNA, 13 bp, Homo sapiens
aaccagtgccaag

SEQ ID NO: 4924933 - DNA, 14 bp, Homo sapiens
aaccagtgccaagg

SEQ ID NO: 4924934 - DNA, 15 bp, Homo sapiens
aaccagtgccaagga

SEQ ID NO: 4924935 - DNA, 13 bp, Homo sapiens
aaccatatgatac

SEQ ID NO: 4924936 - DNA, 22 bp, Homo sapiens
aaccatccagtgacaaaccatc

SEQ ID NO: 4924937 - DNA, 15 bp, Homo sapiens
aaccatctggcctgg

SEQ ID NO: 4924938 - DNA, 16 bp, Homo sapiens
aaccatgaagacagga

SEQ ID NO: 4924939 - DNA, 19 bp, Homo sapiens
aaccatgcaaatgctatga

SEQ ID NO: 4924940 - DNA, 13 bp, Homo sapiens
aacccaagctcct

SEQ ID NO: 4924941 - DNA, 15 bp, Homo sapiens
aaccccaacgcacag

SEQ ID NO: 4924942 - DNA, 12 bp, Homo sapiens
aaccccagctcc

SEQ ID NO: 4924943 - DNA, 11 bp, Homo sapiens
aacccccaccc

SEQ ID NO: 4924944 - DNA, 13 bp, Homo sapiens
aacccccacccca

SEQ ID NO: 4924945 - DNA, 13 bp, Homo sapiens
aacccccagcctg

SEQ ID NO: 4924946 - DNA, 15 bp, Homo sapiens
aacccccagcctgct

SEQ ID NO: 4924947 - DNA, 16 bp, Homo sapiens
aacccccattctcatc

SEQ ID NO: 4924948 - DNA, 17 bp, Homo sapiens
aaccctaggttccctgt

SEQ ID NO: 4924949 - DNA, 21 bp, Homo sapiens
aaccctatactgtagtattct

SEQ ID NO: 4924950 - DNA, 15 bp, Homo sapiens
aaccctatctcctga

SEQ ID NO: 4924951 - DNA, 16 bp, Homo sapiens
aaccctatctcctgac

SEQ ID NO: 4924952 - DNA, 23 bp, Homo sapiens
aacccttaccccttagcctccct

SEQ ID NO: 4924953 - DNA, 13 bp, Homo sapiens
aaccgcacagctc

SEQ ID NO: 4924954 - DNA, 14 bp, Homo sapiens
aaccgcacagctca

SEQ ID NO: 4924955 - DNA, 19 bp, Homo sapiens
aaccgctcacctagagcca

SEQ ID NO: 4924956 - DNA, 18 bp, Homo sapiens
aacctaacttgcgcagaa

SEQ ID NO: 4924957 - DNA, 16 bp, Homo sapiens
aacctcattgacaaga

SEQ ID NO: 4924958 - DNA, 13 bp, Homo sapiens
aacctcccagagg

SEQ ID NO: 4924959 - DNA, 20 bp, Homo sapiens
aacctcccagaggtccagcc

SEQ ID NO: 4924960 - DNA, 23 bp, Homo sapiens
aacctcccagaggtccagcccat

SEQ ID NO: 4924961 - DNA, 16 bp, Homo sapiens
aacctccctcttgttt

SEQ ID NO: 4924962 - DNA, 22 bp, Homo sapiens
aacctcctgtggaacccagcag

SEQ ID NO: 4924963 - DNA, 13 bp, Homo sapiens
aacctctcactcc

SEQ ID NO: 4924964 - DNA, 16 bp, Homo sapiens
aacctctgtctcatcc

SEQ ID NO: 4924965 - DNA, 11 bp, Homo sapiens
aacctgaaaaa

SEQ ID NO: 4924966 - DNA, 19 bp, Homo sapiens
aacctgacaaaaaaaaagt

SEQ ID NO: 4924967 - DNA, 12 bp, Homo sapiens
aacctgattgta

SEQ ID NO: 4924968 - DNA, 23 bp, Homo sapiens
aacctggccgcgtttagaccaag

SEQ ID NO: 4924969 - DNA, 20 bp, Homo sapiens
aacctgggattcaggaatgt

SEQ ID NO: 4924970 - DNA, 15 bp, Homo sapiens
aacctgtcctaagga

SEQ ID NO: 4924971 - DNA, 15 bp, Homo sapiens
aacctgtctccactg

SEQ ID NO: 4924972 - DNA, 22 bp, Homo sapiens
aacctgtctccactgtgccttt

SEQ ID NO: 4924973 - DNA, 16 bp, Homo sapiens
aacctgtgagtaaata

SEQ ID NO: 4924974 - DNA, 18 bp, Homo sapiens
aacctgtgagtaaatatt

SEQ ID NO: 4924975 - DNA, 21 bp, Homo sapiens
aacctgttgctgtgtttaatt

SEQ ID NO: 4924976 - DNA, 13 bp, Homo sapiens
aaccttaagacct

SEQ ID NO: 4924977 - DNA, 22 bp, Homo sapiens
aaccttatcctgcattgttagc

SEQ ID NO: 4924978 - DNA, 15 bp, Homo sapiens
aaccttgaatgctgc

SEQ ID NO: 4924979 - DNA, 18 bp, Homo sapiens
aaccttgaatgctgccag

SEQ ID NO: 4924980 - DNA, 11 bp, Homo sapiens
aaccttgctgt

SEQ ID NO: 4924981 - DNA, 16 bp, Homo sapiens
aaccttgctgtcctga

SEQ ID NO: 4924982 - DNA, 14 bp, Homo sapiens
aacctttcaaattt

SEQ ID NO: 4924983 - DNA, 21 bp, Homo sapiens
aaccttttttaagatttttct

SEQ ID NO: 4924984 - DNA, 21 bp, Homo sapiens
aacgcagccctagagcctgcc

SEQ ID NO: 4924985 - DNA, 23 bp, Homo sapiens
aacgcagccctagagcctgcctg

SEQ ID NO: 4924986 - DNA, 15 bp, Homo sapiens
aacggattccaaaga

SEQ ID NO: 4924987 - DNA, 13 bp, Homo sapiens
aacgtattttaaa

SEQ ID NO: 4924988 - DNA, 14 bp, Homo sapiens
aacgtgatacattt

SEQ ID NO: 4924989 - DNA, 20 bp, Homo sapiens
aacgttactcagggctcctc

SEQ ID NO: 4924990 - DNA, 23 bp, Homo sapiens
aacgtttttcctttaaaaaaatt

SEQ ID NO: 4924991 - DNA, 14 bp, Homo sapiens
aactaaatttgata

SEQ ID NO: 4924992 - DNA, 16 bp, Homo sapiens
aactaaatttgatact

SEQ ID NO: 4924993 - DNA, 17 bp, Homo sapiens
aactaaatttgatactt

SEQ ID NO: 4924994 - DNA, 18 bp, Homo sapiens
aactaagaaacttttgta

SEQ ID NO: 4924995 - DNA, 18 bp, Homo sapiens
aactaagcagtccctgag

SEQ ID NO: 4924996 - DNA, 14 bp, Homo sapiens
aactactctttgat

SEQ ID NO: 4924997 - DNA, 15 bp, Homo sapiens
aactactctttgatt

SEQ ID NO: 4924998 - DNA, 13 bp, Homo sapiens
aagattctagatg

SEQ ID NO: 4924999 - DNA, 15 bp, Homo sapiens
aagattctagatgat

SEQ ID NO: 4925000 - DNA, 19 bp, Homo sapiens
aagattctatagttctaga

SEQ ID NO: 4925001 - DNA, 16 bp, Homo sapiens
aagattctttttctga

SEQ ID NO: 4925002 - DNA, 21 bp, Homo sapiens
aagattggtgggattttttgt

SEQ ID NO: 4925003 - DNA, 20 bp, Homo sapiens
aagattgtgggggaaaaata

SEQ ID NO: 4925004 - DNA, 13 bp, Homo sapiens
aagatttagaaaa

SEQ ID NO: 4925005 - DNA, 17 bp, Homo sapiens
aagatttccttgtgcaa

SEQ ID NO: 4925006 - DNA, 17 bp, Homo sapiens
aagatttggaataaagt

SEQ ID NO: 4925007 - DNA, 13 bp, Homo sapiens
aagatttttctca

SEQ ID NO: 4925008 - DNA, 19 bp, Homo sapiens
aagatttttctcaaagttt

SEQ ID NO: 4925009 - DNA, 21 bp, Homo sapiens
aagatttttctcaaagttttg

SEQ ID NO: 4925010 - DNA, 20 bp, Homo sapiens
aagcaaaaaatgaatgtcta

SEQ ID NO: 4925011 - DNA, 23 bp, Homo sapiens
aagcaaatacttagcaaaaagtg

SEQ ID NO: 4925012 - DNA, 20 bp, Homo sapiens
aagcaaatttcaaaagacat

SEQ ID NO: 4925013 - DNA, 16 bp, Homo sapiens
aagcaagcaacacaga

SEQ ID NO: 4925014 - DNA, 15 bp, Homo sapiens
aagcaagctaacctt

SEQ ID NO: 4925015 - DNA, 14 bp, Homo sapiens
aagcacaggagaca

SEQ ID NO: 4925016 - DNA, 14 bp, Homo sapiens
aagcacagtttgaa

SEQ ID NO: 4925017 - DNA, 17 bp, Homo sapiens
aagcacagtttgaacaa

SEQ ID NO: 4925018 - DNA, 14 bp, Homo sapiens
aagcacctcctgcc

SEQ ID NO: 4925019 - DNA, 11 bp, Homo sapiens
aagcactgata

SEQ ID NO: 4925020 - DNA, 18 bp, Homo sapiens
aagcagagtgcacagctg

SEQ ID NO: 4925021 - DNA, 16 bp, Homo sapiens
aagcagcatcttctgg

SEQ ID NO: 4925022 - DNA, 17 bp, Homo sapiens
aagcagctttaaacaaa

SEQ ID NO: 4925023 - DNA, 21 bp, Homo sapiens
aagcaggggctacaagaggga

SEQ ID NO: 4925024 - DNA, 17 bp, Homo sapiens
aagcataaaaacatttt

SEQ ID NO: 4925025 - DNA, 23 bp, Homo sapiens
aagcatacatgcaaaaagaaatg

SEQ ID NO: 4925026 - DNA, 15 bp, Homo sapiens
aagcatagatgtttt

SEQ ID NO: 4925027 - DNA, 17 bp, Homo sapiens
aagcatagatgttttgg

SEQ ID NO: 4925028 - DNA, 16 bp, Homo sapiens
aagcatatagagatga

SEQ ID NO: 4925029 - DNA, 21 bp, Homo sapiens
aagcatatgggttagatgttg

SEQ ID NO: 4925030 - DNA, 13 bp, Homo sapiens
aagcatctaagtt

SEQ ID NO: 4925031 - DNA, 14 bp, Homo sapiens
aagcatgtttcatg

SEQ ID NO: 4925032 - DNA, 19 bp, Homo sapiens
aagcattaccactcaggca

SEQ ID NO: 4925033 - DNA, 15 bp, Homo sapiens
aagcattcagagagc

SEQ ID NO: 4925034 - DNA, 17 bp, Homo sapiens
aagcattcagagagcag

SEQ ID NO: 4925035 - DNA, 18 bp, Homo sapiens
aagcattccttctttgat

SEQ ID NO: 4925036 - DNA, 21 bp, Homo sapiens
aagcattccttctttgataat

SEQ ID NO: 4925037 - DNA, 14 bp, Homo sapiens
aagcattgaaatta

SEQ ID NO: 4925038 - DNA, 21 bp, Homo sapiens
aagcattgcctggccttcctg

SEQ ID NO: 4925039 - DNA, 21 bp, Homo sapiens
aagcattgctgttatgtctgt

SEQ ID NO: 4925040 - DNA, 15 bp, Homo sapiens
aagcatttatcattc

SEQ ID NO: 4925041 - DNA, 17 bp, Homo sapiens
aagccaaaaaccttagc

SEQ ID NO: 4925042 - DNA, 22 bp, Homo sapiens
aagccaaaaaccttagctccct

SEQ ID NO: 4925043 - DNA, 22 bp, Homo sapiens
aagccaaagaaatgaacattcc

SEQ ID NO: 4925044 - DNA, 22 bp, Homo sapiens
aagccaaagtggcatgttttgt

SEQ ID NO: 4925045 - DNA, 19 bp, Homo sapiens
aagccactctgtcccttcc

SEQ ID NO: 4925046 - DNA, 12 bp, Homo sapiens
aagccagggtct

SEQ ID NO: 4925047 - DNA, 23 bp, Homo sapiens
aagccagtgttgcctaagtatta

SEQ ID NO: 4925048 - DNA, 20 bp, Homo sapiens
aagccatgtataaatgtgat

SEQ ID NO: 4925049 - DNA, 22 bp, Homo sapiens
aagccattaaatgaatattttg

SEQ ID NO: 4925050 - DNA, 20 bp, Homo sapiens
aagcccatgagtccttgaaa

SEQ ID NO: 4925051 - DNA, 13 bp, Homo sapiens
aagccgtggcttc

SEQ ID NO: 4925052 - DNA, 15 bp, Homo sapiens
aagccgtggcttccc

SEQ ID NO: 4925053 - DNA, 23 bp, Homo sapiens
aagcctcaaggttttaggttcta

SEQ ID NO: 4925054 - DNA, 13 bp, Homo sapiens
aagcctccacagc

SEQ ID NO: 4925055 - DNA, 23 bp, Homo sapiens
aagcctccacagcgagggcagct

SEQ ID NO: 4925056 - DNA, 17 bp, Homo sapiens
aagcctgcaatttcata

SEQ ID NO: 4925057 - DNA, 22 bp, Homo sapiens
aagcctgcaatttcatatgctg

SEQ ID NO: 4925058 - DNA, 14 bp, Homo sapiens
aagcctgtggatga

SEQ ID NO: 4925059 - DNA, 17 bp, Homo sapiens
aagcctgtggatgatca

SEQ ID NO: 4925060 - DNA, 14 bp, Homo sapiens
aagccttagggaag

SEQ ID NO: 4925061 - DNA, 21 bp, Homo sapiens
aagccttgtgtatatttgtat

SEQ ID NO: 4925062 - DNA, 14 bp, Homo sapiens
aagcgattctcctg

SEQ ID NO: 4925063 - DNA, 16 bp, Homo sapiens
aagcgattcttctgct

SEQ ID NO: 4925064 - DNA, 21 bp, Homo sapiens
aagcgattcttctgcttcagc

SEQ ID NO: 4925065 - DNA, 20 bp, Homo sapiens
aagcgtgagccactgcaccg

SEQ ID NO: 4925066 - DNA, 21 bp, Homo sapiens
aagcgtgagccactgcaccgg

SEQ ID NO: 4925067 - DNA, 23 bp, Homo sapiens
aagcgtgcacaaggattgaaaat

SEQ ID NO: 4925068 - DNA, 18 bp, Homo sapiens
aagctaataattcttcac

SEQ ID NO: 4925069 - DNA, 15 bp, Homo sapiens
aagctaatttgcatt

SEQ ID NO: 4925070 - DNA, 16 bp, Homo sapiens
aagctaggcctggcca

SEQ ID NO: 4925071 - DNA, 18 bp, Homo sapiens
aagctaggcctggccaga

SEQ ID NO: 4925072 - DNA, 19 bp, Homo sapiens
aagctattcctttcccttc

SEQ ID NO: 4925073 - DNA, 22 bp, Homo sapiens
aagctattcctttcccttcctc

SEQ ID NO: 4925074 - DNA, 15 bp, Homo sapiens
aagctcagattattt

SEQ ID NO: 4925075 - DNA, 21 bp, Homo sapiens
aagctcatattttgtatatat

SEQ ID NO: 4925076 - DNA, 18 bp, Homo sapiens
aagctcatttcatgctct

SEQ ID NO: 4925077 - DNA, 19 bp, Homo sapiens
aagctcatttcatgctctg

SEQ ID NO: 4925078 - DNA, 20 bp, Homo sapiens
aagctccatctccactccag

SEQ ID NO: 4925079 - DNA, 16 bp, Homo sapiens
aagctccatgtgcctc

SEQ ID NO: 4925080 - DNA, 18 bp, Homo sapiens
aagctccatgtgcctctt

SEQ ID NO: 4925081 - DNA, 14 bp, Homo sapiens
aagctcctgtcctc

SEQ ID NO: 4925082 - DNA, 22 bp, Homo sapiens
aagctcctgtcctcccatcccc

SEQ ID NO: 4925083 - DNA, 17 bp, Homo sapiens
aagctctgctcctctcc

SEQ ID NO: 4925084 - DNA, 12 bp, Homo sapiens
aagctgaaaata

SEQ ID NO: 4925085 - DNA, 17 bp, Homo sapiens
aagctgagaactcctga

SEQ ID NO: 4925086 - DNA, 18 bp, Homo sapiens
aagctgagaactcctgac

SEQ ID NO: 4925087 - DNA, 13 bp, Homo sapiens
aagctgatcctgc

SEQ ID NO: 4925088 - DNA, 16 bp, Homo sapiens
aagctgcagcttcctg

SEQ ID NO: 4925089 - DNA, 20 bp, Homo sapiens
aagctgcccactgtttctct

SEQ ID NO: 4925090 - DNA, 15 bp, Homo sapiens
aagctgccctgccca

SEQ ID NO: 4925091 - DNA, 14 bp, Homo sapiens
aagctgcctgtagt

SEQ ID NO: 4925092 - DNA, 21 bp, Homo sapiens
aagctgcctgtagttaggaaa

SEQ ID NO: 4925093 - DNA, 21 bp, Homo sapiens
aagctgctgaccaattgtgct

SEQ ID NO: 4925094 - DNA, 21 bp, Homo sapiens
aagctggccgagggtcctggc

SEQ ID NO: 4925095 - DNA, 12 bp, Homo sapiens
aagctggcctct

SEQ ID NO: 4925096 - DNA, 22 bp, Homo sapiens
aagctggcctctaccacaaggg

SEQ ID NO: 4925097 - DNA, 13 bp, Homo sapiens
aagctggcctgag

SEQ ID NO: 4925098 - DNA, 23 bp, Homo sapiens
aagctgtagtagccctttctgtg

SEQ ID NO: 4925099 - DNA, 16 bp, Homo sapiens
aagctgtgaacaggct

SEQ ID NO: 4925100 - DNA, 17 bp, Homo sapiens
aagctgttaaactgtta

SEQ ID NO: 4925101 - DNA, 20 bp, Homo sapiens
aagctgttaaactgttagca

SEQ ID NO: 4925102 - DNA, 14 bp, Homo sapiens
aagctgttgtacat

SEQ ID NO: 4925103 - DNA, 21 bp, Homo sapiens
aagctgttgtacatttatgat

SEQ ID NO: 4925104 - DNA, 22 bp, Homo sapiens
aagcttatccataaaaaaaaat

SEQ ID NO: 4925105 - DNA, 14 bp, Homo sapiens
aagcttcaaattaa

SEQ ID NO: 4925106 - DNA, 11 bp, Homo sapiens
aagcttctaat

SEQ ID NO: 4925107 - DNA, 13 bp, Homo sapiens
aatgagcacctcc

SEQ ID NO: 4925108 - DNA, 14 bp, Homo sapiens
aatgagcacctcca

SEQ ID NO: 4925109 - DNA, 14 bp, Homo sapiens
aatgaggacatgtt

SEQ ID NO: 4925110 - DNA, 16 bp, Homo sapiens
aatgaggacatgtttt

SEQ ID NO: 4925111 - DNA, 16 bp, Homo sapiens
aatgaggtcagagcct

SEQ ID NO: 4925112 - DNA, 15 bp, Homo sapiens
aatgaggtctgttta

SEQ ID NO: 4925113 - DNA, 13 bp, Homo sapiens
aatgagtgtgcat

SEQ ID NO: 4925114 - DNA, 12 bp, Homo sapiens
aatgataaaaca

SEQ ID NO: 4925115 - DNA, 13 bp, Homo sapiens
aatgataaaacac

SEQ ID NO: 4925116 - DNA, 14 bp, Homo sapiens
aatgataaaacacc

SEQ ID NO: 4925117 - DNA, 18 bp, Homo sapiens
aatgataagtaaatgcta

SEQ ID NO: 4925118 - DNA, 18 bp, Homo sapiens
aatgataccctgaatttg

SEQ ID NO: 4925119 - DNA, 21 bp, Homo sapiens
aatgatagacaattgaggtaa

SEQ ID NO: 4925120 - DNA, 18 bp, Homo sapiens
aatgatagtaagaaaagt

SEQ ID NO: 4925121 - DNA, 18 bp, Homo sapiens
aatgatagttgattttca

SEQ ID NO: 4925122 - DNA, 16 bp, Homo sapiens
aatgatcagcatctgt

SEQ ID NO: 4925123 - DNA, 21 bp, Homo sapiens
aatgatgatcaattatagttt

SEQ ID NO: 4925124 - DNA, 23 bp, Homo sapiens
aatgatgatcaattatagtttct

SEQ ID NO: 4925125 - DNA, 14 bp, Homo sapiens
aatgatggcaattt

SEQ ID NO: 4925126 - DNA, 18 bp, Homo sapiens
aatgattattttcattac

SEQ ID NO: 4925127 - DNA, 19 bp, Homo sapiens
aatgattattttcattaca

SEQ ID NO: 4925128 - DNA, 14 bp, Homo sapiens
aatgattcatgtta

SEQ ID NO: 4925129 - DNA, 15 bp, Homo sapiens
aatgattcatgttat

SEQ ID NO: 4925130 - DNA, 20 bp, Homo sapiens
aatgattgtaaaatagcttg

SEQ ID NO: 4925131 - DNA, 20 bp, Homo sapiens
aatgcaaagttctgtgttta

SEQ ID NO: 4925132 - DNA, 19 bp, Homo sapiens
aatgcaagagtgattgcag

SEQ ID NO: 4925133 - DNA, 24 bp, Homo sapiens
aatgcaatctccccttgatttaaa

SEQ ID NO: 4925134 - DNA, 15 bp, Homo sapiens
aatgcatcaggtcct

SEQ ID NO: 4925135 - DNA, 13 bp, Homo sapiens
aatgcattaaacc

SEQ ID NO: 4925136 - DNA, 22 bp, Homo sapiens
aatgcattataggatcatttgt

SEQ ID NO: 4925137 - DNA, 23 bp, Homo sapiens
aatgcattataggatcatttgtt

SEQ ID NO: 4925138 - DNA, 13 bp, Homo sapiens
aatgccaagataa

SEQ ID NO: 4925139 - DNA, 17 bp, Homo sapiens
aatgccaagataattca

SEQ ID NO: 4925140 - DNA, 19 bp, Homo sapiens
aatgcccgtaatgcttaga

SEQ ID NO: 4925141 - DNA, 15 bp, Homo sapiens
aatgcctaataaaca

SEQ ID NO: 4925142 - DNA, 24 bp, Homo sapiens
aatgcctagtttttagtaatctgt

SEQ ID NO: 4925143 - DNA, 17 bp, Homo sapiens
aatgcctcctgtgggga

SEQ ID NO: 4925144 - DNA, 20 bp, Homo sapiens
aatgccttaaaatggaattg

SEQ ID NO: 4925145 - DNA, 20 bp, Homo sapiens
aatgcctttgagacagtttc

SEQ ID NO: 4925146 - DNA, 22 bp, Homo sapiens
aatgcctttgagacagtttctt

SEQ ID NO: 4925147 - DNA, 23 bp, Homo sapiens
aatgcctttgagacagtttctta

SEQ ID NO: 4925148 - DNA, 19 bp, Homo sapiens
aatgctaatttaaagagac

SEQ ID NO: 4925149 - DNA, 17 bp, Homo sapiens
aatgctaggtctcggac

SEQ ID NO: 4925150 - DNA, 18 bp, Homo sapiens
aatgctaggttaattcca

SEQ ID NO: 4925151 - DNA, 19 bp, Homo sapiens
aatgctaggttaattccaa

SEQ ID NO: 4925152 - DNA, 21 bp, Homo sapiens
aatgctaggttaattccaatt

SEQ ID NO: 4925153 - DNA, 23 bp, Homo sapiens
aatgctatttttgtttttagaat

SEQ ID NO: 4925154 - DNA, 17 bp, Homo sapiens
aatgctgccagtgtgga

SEQ ID NO: 4925155 - DNA, 21 bp, Homo sapiens
aatgctggctgttggctgggg

SEQ ID NO: 4925156 - DNA, 22 bp, Homo sapiens
aatgctggctgttggctggggg

SEQ ID NO: 4925157 - DNA, 13 bp, Homo sapiens
aatgctgtacatc

SEQ ID NO: 4925158 - DNA, 16 bp, Homo sapiens
aatgcttaatttctaa

SEQ ID NO: 4925159 - DNA, 20 bp, Homo sapiens
aatgcttcattcaatattga

SEQ ID NO: 4925160 - DNA, 11 bp, Homo sapiens
aatgctttttg

SEQ ID NO: 4925161 - DNA, 19 bp, Homo sapiens
aatggaaagtaactcattt

SEQ ID NO: 4925162 - DNA, 16 bp, Homo sapiens
aatggaagagaaatct

SEQ ID NO: 4925163 - DNA, 18 bp, Homo sapiens
aatggaataaaaggcttg

SEQ ID NO: 4925164 - DNA, 22 bp, Homo sapiens
aatggacatcctgtataagcac

SEQ ID NO: 4925165 - DNA, 17 bp, Homo sapiens
aatggactggaagggga

SEQ ID NO: 4925166 - DNA, 19 bp, Homo sapiens
aatggagtcagtttgcagt

SEQ ID NO: 4925167 - DNA, 17 bp, Homo sapiens
aatggatattattagaa

SEQ ID NO: 4925168 - DNA, 19 bp, Homo sapiens
aatggatattattagaaat

SEQ ID NO: 4925169 - DNA, 14 bp, Homo sapiens
aatggattctattt

SEQ ID NO: 4925170 - DNA, 16 bp, Homo sapiens
aatggattggattatt

SEQ ID NO: 4925171 - DNA, 18 bp, Homo sapiens
aatggattggattattta

SEQ ID NO: 4925172 - DNA, 19 bp, Homo sapiens
aatggattgttaatttcag

SEQ ID NO: 4925173 - DNA, 16 bp, Homo sapiens
aatggcaagttttgat

SEQ ID NO: 4925174 - DNA, 12 bp, Homo sapiens
aatggcagcaga

SEQ ID NO: 4925175 - DNA, 16 bp, Homo sapiens
aatgggaatattttat

SEQ ID NO: 4925176 - DNA, 22 bp, Homo sapiens
aatggtgaaaataaaataaagc

SEQ ID NO: 4925177 - DNA, 16 bp, Homo sapiens
aatggtgatcactcca

SEQ ID NO: 4925178 - DNA, 19 bp, Homo sapiens
aatgtaaaaaagaaaaaca

SEQ ID NO: 4925179 - DNA, 12 bp, Homo sapiens
aatgtaaaatga

SEQ ID NO: 4925180 - DNA, 14 bp, Homo sapiens
aatgtaaactgcca

SEQ ID NO: 4925181 - DNA, 23 bp, Homo sapiens
aatgtaaaggagtcaaaactaca

SEQ ID NO: 4925182 - DNA, 12 bp, Homo sapiens
aatgtaaatatt

SEQ ID NO: 4925183 - DNA, 15 bp, Homo sapiens
aatgtaacttttgta

SEQ ID NO: 4925184 - DNA, 16 bp, Homo sapiens
aatgtaacttttgtaa

SEQ ID NO: 4925185 - DNA, 22 bp, Homo sapiens
aatgtaacttttgtaagacaaa

SEQ ID NO: 4925186 - DNA, 16 bp, Homo sapiens
aatgtaagattataga

SEQ ID NO: 4925187 - DNA, 21 bp, Homo sapiens
aatgtaagattatagattcta

SEQ ID NO: 4925188 - DNA, 22 bp, Homo sapiens
aatgtacacactggtacttaga

SEQ ID NO: 4925189 - DNA, 17 bp, Homo sapiens
aatgtacatctggcctt

SEQ ID NO: 4925190 - DNA, 21 bp, Homo sapiens
aatgtaccttctttcactctg

SEQ ID NO: 4925191 - DNA, 18 bp, Homo sapiens
aatgtagttgatgtatcc

SEQ ID NO: 4925192 - DNA, 13 bp, Homo sapiens
aatgtatatacac

SEQ ID NO: 4925193 - DNA, 15 bp, Homo sapiens
aatgtatatacacat

SEQ ID NO: 4925194 - DNA, 18 bp, Homo sapiens
aatgtatatacacatata

SEQ ID NO: 4925195 - DNA, 12 bp, Homo sapiens
aatgtatatatt

SEQ ID NO: 4925196 - DNA, 13 bp, Homo sapiens
aatgtatatattt

SEQ ID NO: 4925197 - DNA, 22 bp, Homo sapiens
aatgtatcccttctcacagcac

SEQ ID NO: 4925198 - DNA, 13 bp, Homo sapiens
aatgtatttgttc

SEQ ID NO: 4925199 - DNA, 15 bp, Homo sapiens
aatgtcacaggcagg

SEQ ID NO: 4925200 - DNA, 16 bp, Homo sapiens
aatgtcacaggcaggt

SEQ ID NO: 4925201 - DNA, 20 bp, Homo sapiens
aatgtcacgtactgtctgat

SEQ ID NO: 4925202 - DNA, 22 bp, Homo sapiens
aatgtcacgtactgtctgattg

SEQ ID NO: 4925203 - DNA, 15 bp, Homo sapiens
aatgtcatatactgc

SEQ ID NO: 4925204 - DNA, 19 bp, Homo sapiens
aatgtcatatactgccatg

SEQ ID NO: 4925205 - DNA, 13 bp, Homo sapiens
aatgtctttgtaa

SEQ ID NO: 4925206 - DNA, 19 bp, Homo sapiens
aatgtctttgtaagtcagt

SEQ ID NO: 4925207 - DNA, 22 bp, Homo sapiens
aatgtctttgtaagtcagtgtt

SEQ ID NO: 4925208 - DNA, 17 bp, Homo sapiens
aatgtcttttgaatatt

SEQ ID NO: 4925209 - DNA, 21 bp, Homo sapiens
aatgtgagtttggtctggact

SEQ ID NO: 4925210 - DNA, 18 bp, Homo sapiens
aatgtgatgatgtaattg

SEQ ID NO: 4925211 - DNA, 20 bp, Homo sapiens
aatgtgatgatgtaattgac

SEQ ID NO: 4925212 - DNA, 13 bp, Homo sapiens
aatgtgatgttct

SEQ ID NO: 4925213 - DNA, 16 bp, Homo sapiens
aatgtgatgttctaag

SEQ ID NO: 4925214 - DNA, 19 bp, Homo sapiens
aatgtgatgttctaaggct

SEQ ID NO: 4925215 - DNA, 17 bp, Homo sapiens
aatgtgattactgctct

SEQ ID NO: 4925216 - DNA, 15 bp, Homo sapiens
aatgtggaagaaaat

SEQ ID NO: 4925217 - DNA, 23 bp, Homo sapiens
acacagtcaaaataattctaaat

SEQ ID NO: 4925218 - DNA, 13 bp, Homo sapiens
acacagtgagtcg

SEQ ID NO: 4925219 - DNA, 22 bp, Homo sapiens
acacagtgggaactctgacaag

SEQ ID NO: 4925220 - DNA, 13 bp, Homo sapiens
acacatacagttt

SEQ ID NO: 4925221 - DNA, 17 bp, Homo sapiens
acacatacagttttatg

SEQ ID NO: 4925222 - DNA, 23 bp, Homo sapiens
acacatatacctataatgtgtgt

SEQ ID NO: 4925223 - DNA, 17 bp, Homo sapiens
acacatccagacatcat

SEQ ID NO: 4925224 - DNA, 18 bp, Homo sapiens
acacatccgccttttgta

SEQ ID NO: 4925225 - DNA, 19 bp, Homo sapiens
acacatccgccttttgtat

SEQ ID NO: 4925226 - DNA, 16 bp, Homo sapiens
acacatgctaggatgc

SEQ ID NO: 4925227 - DNA, 23 bp, Homo sapiens
acacattagattttattttacta

SEQ ID NO: 4925228 - DNA, 13 bp, Homo sapiens
acacatttgtaca

SEQ ID NO: 4925229 - DNA, 15 bp, Homo sapiens
acacatttgtacaga

SEQ ID NO: 4925230 - DNA, 19 bp, Homo sapiens
acacatttttaaattgtta

SEQ ID NO: 4925231 - DNA, 14 bp, Homo sapiens
acaccaaataaata

SEQ ID NO: 4925232 - DNA, 13 bp, Homo sapiens
acaccacacccag

SEQ ID NO: 4925233 - DNA, 15 bp, Homo sapiens
acaccacacccagcc

SEQ ID NO: 4925234 - DNA, 17 bp, Homo sapiens
acaccacacccagcctc

SEQ ID NO: 4925235 - DNA, 16 bp, Homo sapiens
acaccacagacacaca

SEQ ID NO: 4925236 - DNA, 21 bp, Homo sapiens
acaccacagacacacacacgc

SEQ ID NO: 4925237 - DNA, 13 bp, Homo sapiens
acaccagagccca

SEQ ID NO: 4925238 - DNA, 19 bp, Homo sapiens
acacccaaagaggtattta

SEQ ID NO: 4925239 - DNA, 20 bp, Homo sapiens
acacccagcccacttctgcc

SEQ ID NO: 4925240 - DNA, 14 bp, Homo sapiens
acacccagcctcag

SEQ ID NO: 4925241 - DNA, 20 bp, Homo sapiens
acacccagcctcagtcctcc

SEQ ID NO: 4925242 - DNA, 21 bp, Homo sapiens
acacccgtgagcgcctgtgca

SEQ ID NO: 4925243 - DNA, 19 bp, Homo sapiens
acaccctcactctgccagg

SEQ ID NO: 4925244 - DNA, 16 bp, Homo sapiens
acaccctcccccgcca

SEQ ID NO: 4925245 - DNA, 23 bp, Homo sapiens
acaccctgcaaggcccacaggag

SEQ ID NO: 4925246 - DNA, 13 bp, Homo sapiens
acaccgactagcc

SEQ ID NO: 4925247 - DNA, 13 bp, Homo sapiens
acacctctgccag

SEQ ID NO: 4925248 - DNA, 14 bp, Homo sapiens
acaccttgacaggg

SEQ ID NO: 4925249 - DNA, 15 bp, Homo sapiens
acaccttgacagggc

SEQ ID NO: 4925250 - DNA, 16 bp, Homo sapiens
acaccttgacagggca

SEQ ID NO: 4925251 - DNA, 21 bp, Homo sapiens
acaccttgtgaccttctctat

SEQ ID NO: 4925252 - DNA, 22 bp, Homo sapiens
acaccttgtgaccttctctata

SEQ ID NO: 4925253 - DNA, 21 bp, Homo sapiens
acaccttttattgacacagaa

SEQ ID NO: 4925254 - DNA, 23 bp, Homo sapiens
acaccttttattgacacagaaaa

SEQ ID NO: 4925255 - DNA, 14 bp, Homo sapiens
acacgaaacttgtt

SEQ ID NO: 4925256 - DNA, 17 bp, Homo sapiens
acacgaaacttgttatt

SEQ ID NO: 4925257 - DNA, 15 bp, Homo sapiens
acacgaaagaaatgt

SEQ ID NO: 4925258 - DNA, 14 bp, Homo sapiens
acacgcacgcacac

SEQ ID NO: 4925259 - DNA, 15 bp, Homo sapiens
acacgcacgcacaca

SEQ ID NO: 4925260 - DNA, 17 bp, Homo sapiens
acacgcacgcacacaca

SEQ ID NO: 4925261 - DNA, 18 bp, Homo sapiens
acacgcacgcacacacac

SEQ ID NO: 4925262 - DNA, 17 bp, Homo sapiens
acacgcgcgcacacaca

SEQ ID NO: 4925263 - DNA, 21 bp, Homo sapiens
acacgcgggcgcgatcccaca

SEQ ID NO: 4925264 - DNA, 18 bp, Homo sapiens
acacggagcccagccctc

SEQ ID NO: 4925265 - DNA, 12 bp, Homo sapiens
acacgtgtcctg

SEQ ID NO: 4925266 - DNA, 14 bp, Homo sapiens
acactaaaaataaa

SEQ ID NO: 4925267 - DNA, 17 bp, Homo sapiens
acactaaccacgctgga

SEQ ID NO: 4925268 - DNA, 17 bp, Homo sapiens
acactaactcaccagcc

SEQ ID NO: 4925269 - DNA, 12 bp, Homo sapiens
acactaattcct

SEQ ID NO: 4925270 - DNA, 14 bp, Homo sapiens
acactacattagaa

SEQ ID NO: 4925271 - DNA, 18 bp, Homo sapiens
acactatcatagttaaca

SEQ ID NO: 4925272 - DNA, 19 bp, Homo sapiens
acactatcatagttaacat

SEQ ID NO: 4925273 - DNA, 14 bp, Homo sapiens
acactcagacctga

SEQ ID NO: 4925274 - DNA, 19 bp, Homo sapiens
acactcagacctgaattct

SEQ ID NO: 4925275 - DNA, 14 bp, Homo sapiens
acactccagtgcca

SEQ ID NO: 4925276 - DNA, 23 bp, Homo sapiens
acactcctagagaacgcagccct

SEQ ID NO: 4925277 - DNA, 17 bp, Homo sapiens
acactgaccatccactc

SEQ ID NO: 4925278 - DNA, 22 bp, Homo sapiens
acactgaccttggagagacaca

SEQ ID NO: 4925279 - DNA, 16 bp, Homo sapiens
acactgcaatcatatg

SEQ ID NO: 4925280 - DNA, 16 bp, Homo sapiens
acactggtgtgacctg

SEQ ID NO: 4925281 - DNA, 23 bp, Homo sapiens
acactgtgcccagcccggacctt

SEQ ID NO: 4925282 - DNA, 16 bp, Homo sapiens
acactgttgtttagtt

SEQ ID NO: 4925283 - DNA, 14 bp, Homo sapiens
acacttaatactac

SEQ ID NO: 4925284 - DNA, 14 bp, Homo sapiens
acacttataagtga

SEQ ID NO: 4925285 - DNA, 19 bp, Homo sapiens
acacttcaggctcttctcc

SEQ ID NO: 4925286 - DNA, 14 bp, Homo sapiens
acacttccataatc

SEQ ID NO: 4925287 - DNA, 19 bp, Homo sapiens
acacttgtgattataaaat

SEQ ID NO: 4925288 - DNA, 22 bp, Homo sapiens
acacttgtgattataaaattaa

SEQ ID NO: 4925289 - DNA, 20 bp, Homo sapiens
acactttgcctcctgtgtac

SEQ ID NO: 4925290 - DNA, 22 bp, Homo sapiens
acagaaaaatcttgtgctagaa

SEQ ID NO: 4925291 - DNA, 17 bp, Homo sapiens
acagaaacaaaaacact

SEQ ID NO: 4925292 - DNA, 18 bp, Homo sapiens
acagaaacactgcctttt

SEQ ID NO: 4925293 - DNA, 19 bp, Homo sapiens
acagaaacactgccttttt

SEQ ID NO: 4925294 - DNA, 22 bp, Homo sapiens
acagaaacctatcctcactgcc

SEQ ID NO: 4925295 - DNA, 15 bp, Homo sapiens
acagaaaccttttta

SEQ ID NO: 4925296 - DNA, 19 bp, Homo sapiens
acagaaagtcattccttct

SEQ ID NO: 4925297 - DNA, 22 bp, Homo sapiens
acagaaagtcattccttctttt

SEQ ID NO: 4925298 - DNA, 19 bp, Homo sapiens
acagaaatataataaaatg

SEQ ID NO: 4925299 - DNA, 19 bp, Homo sapiens
acagaaatatatatacata

SEQ ID NO: 4925300 - DNA, 19 bp, Homo sapiens
acagaaatggggaattctc

SEQ ID NO: 4925301 - DNA, 22 bp, Homo sapiens
acagaaatggggaattctctaa

SEQ ID NO: 4925302 - DNA, 14 bp, Homo sapiens
acagaacagggtca

SEQ ID NO: 4925303 - DNA, 15 bp, Homo sapiens
acagaacagggtcat

SEQ ID NO: 4925304 - DNA, 13 bp, Homo sapiens
acagaactaaatg

SEQ ID NO: 4925305 - DNA, 18 bp, Homo sapiens
acagaactaaatgttcta

SEQ ID NO: 4925306 - DNA, 22 bp, Homo sapiens
acagaagcagttgagtcgtcat

SEQ ID NO: 4925307 - DNA, 13 bp, Homo sapiens
acagaagcttcag

SEQ ID NO: 4925308 - DNA, 16 bp, Homo sapiens
acagaagtcatgaagc

SEQ ID NO: 4925309 - DNA, 17 bp, Homo sapiens
acagaagtcatgaagcc

SEQ ID NO: 4925310 - DNA, 14 bp, Homo sapiens
acagaatgtatctg

SEQ ID NO: 4925311 - DNA, 14 bp, Homo sapiens
acagaattttggaa

SEQ ID NO: 4925312 - DNA, 13 bp, Homo sapiens
acagacacacaca

SEQ ID NO: 4925313 - DNA, 14 bp, Homo sapiens
acagacacacacac

SEQ ID NO: 4925314 - DNA, 15 bp, Homo sapiens
acagacacacacacg

SEQ ID NO: 4925315 - DNA, 17 bp, Homo sapiens
acagacacaggcccggc

SEQ ID NO: 4925316 - DNA, 16 bp, Homo sapiens
acagacagacacacac

SEQ ID NO: 4925317 - DNA, 21 bp, Homo sapiens
acagaccacatctttatctgt

SEQ ID NO: 4925318 - DNA, 15 bp, Homo sapiens
acagacctgcttttt

SEQ ID NO: 4925319 - DNA, 16 bp, Homo sapiens
acagacctgctttttg

SEQ ID NO: 4925320 - DNA, 23 bp, Homo sapiens
acagactgcaagaggctcctgtc

SEQ ID NO: 4925321 - DNA, 15 bp, Homo sapiens
acagactgttaatta

SEQ ID NO: 4925322 - DNA, 22 bp, Homo sapiens
acagagctgtcacttttgctcc

SEQ ID NO: 4925323 - DNA, 19 bp, Homo sapiens
acagaggaaacaatattta

SEQ ID NO: 4925324 - DNA, 23 bp, Homo sapiens
acagaggaaacaatatttataaa

SEQ ID NO: 4925325 - DNA, 19 bp, Homo sapiens
acagaggaagaatttgtta

SEQ ID NO: 4925326 - DNA, 20 bp, Homo sapiens
acagaggaagaatttgttat

SEQ ID NO: 4925327 - DNA, 17 bp, Homo sapiens
accagccccactgccag

SEQ ID NO: 4925328 - DNA, 18 bp, Homo sapiens
accagccccactgccagc

SEQ ID NO: 4925329 - DNA, 22 bp, Homo sapiens
accagccccactgccagcagca

SEQ ID NO: 4925330 - DNA, 20 bp, Homo sapiens
accagccccagtgcccacag

SEQ ID NO: 4925331 - DNA, 11 bp, Homo sapiens
accagccctgg

SEQ ID NO: 4925332 - DNA, 12 bp, Homo sapiens
accagccctggg

SEQ ID NO: 4925333 - DNA, 19 bp, Homo sapiens
accagcctccatgctgcct

SEQ ID NO: 4925334 - DNA, 13 bp, Homo sapiens
accagcctgggca

SEQ ID NO: 4925335 - DNA, 17 bp, Homo sapiens
accagctgctgctctga

SEQ ID NO: 4925336 - DNA, 16 bp, Homo sapiens
accagcttagatttta

SEQ ID NO: 4925337 - DNA, 19 bp, Homo sapiens
accagcttttaaccatctg

SEQ ID NO: 4925338 - DNA, 18 bp, Homo sapiens
accaggactccctcctca

SEQ ID NO: 4925339 - DNA, 14 bp, Homo sapiens
accaggagaaccac

SEQ ID NO: 4925340 - DNA, 15 bp, Homo sapiens
accaggatttctaat

SEQ ID NO: 4925341 - DNA, 14 bp, Homo sapiens
accagtcacatgac

SEQ ID NO: 4925342 - DNA, 19 bp, Homo sapiens
accagtctttaaaggccca

SEQ ID NO: 4925343 - DNA, 22 bp, Homo sapiens
accagtgcccaaagtctgtgtg

SEQ ID NO: 4925344 - DNA, 23 bp, Homo sapiens
accagtggcgttgttgcatgttt

SEQ ID NO: 4925345 - DNA, 18 bp, Homo sapiens
accagtgtcccctccact

SEQ ID NO: 4925346 - DNA, 14 bp, Homo sapiens
accagttaattact

SEQ ID NO: 4925347 - DNA, 19 bp, Homo sapiens
accatatgatctgttttgt

SEQ ID NO: 4925348 - DNA, 13 bp, Homo sapiens
accatatttagca

SEQ ID NO: 4925349 - DNA, 22 bp, Homo sapiens
accatccactctaccctcccac

SEQ ID NO: 4925350 - DNA, 13 bp, Homo sapiens
accatcctggctg

SEQ ID NO: 4925351 - DNA, 15 bp, Homo sapiens
accatgaaacaaagc

SEQ ID NO: 4925352 - DNA, 18 bp, Homo sapiens
accatgaacagaaaacat

SEQ ID NO: 4925353 - DNA, 23 bp, Homo sapiens
accatgagaataagagaaagaaa

SEQ ID NO: 4925354 - DNA, 17 bp, Homo sapiens
accattaaaactgcttt

SEQ ID NO: 4925355 - DNA, 19 bp, Homo sapiens
accattaaaactgcttttt

SEQ ID NO: 4925356 - DNA, 19 bp, Homo sapiens
accattcacaataaaagct

SEQ ID NO: 4925357 - DNA, 12 bp, Homo sapiens
accattccccat

SEQ ID NO: 4925358 - DNA, 20 bp, Homo sapiens
accatttcagagaggccttt

SEQ ID NO: 4925359 - DNA, 19 bp, Homo sapiens
accatttgctactgtacat

SEQ ID NO: 4925360 - DNA, 23 bp, Homo sapiens
accattttggggtacccactgct

SEQ ID NO: 4925361 - DNA, 17 bp, Homo sapiens
accatttttcattcact

SEQ ID NO: 4925362 - DNA, 15 bp, Homo sapiens
acccaaaagagaaaa

SEQ ID NO: 4925363 - DNA, 16 bp, Homo sapiens
acccaaaagagaaaaa

SEQ ID NO: 4925364 - DNA, 14 bp, Homo sapiens
acccaaagcatgga

SEQ ID NO: 4925365 - DNA, 17 bp, Homo sapiens
acccaaccctatctcct

SEQ ID NO: 4925366 - DNA, 18 bp, Homo sapiens
acccaaccctatctcctg

SEQ ID NO: 4925367 - DNA, 15 bp, Homo sapiens
acccaagcttagaac

SEQ ID NO: 4925368 - DNA, 16 bp, Homo sapiens
acccaaggagcacagg

SEQ ID NO: 4925369 - DNA, 21 bp, Homo sapiens
acccaaggagcacaggtccca

SEQ ID NO: 4925370 - DNA, 22 bp, Homo sapiens
acccaaggagcacaggtcccac

SEQ ID NO: 4925371 - DNA, 13 bp, Homo sapiens
acccaatccaaat

SEQ ID NO: 4925372 - DNA, 12 bp, Homo sapiens
acccaatttccc

SEQ ID NO: 4925373 - DNA, 15 bp, Homo sapiens
acccacacctctgcc

SEQ ID NO: 4925374 - DNA, 16 bp, Homo sapiens
acccacacctctgcca

SEQ ID NO: 4925375 - DNA, 18 bp, Homo sapiens
acccacatgtaaatgata

SEQ ID NO: 4925376 - DNA, 23 bp, Homo sapiens
acccaccccacctgcagggctgc

SEQ ID NO: 4925377 - DNA, 14 bp, Homo sapiens
acccacctcacccc

SEQ ID NO: 4925378 - DNA, 13 bp, Homo sapiens
acccacctcagcc

SEQ ID NO: 4925379 - DNA, 16 bp, Homo sapiens
acccacctcagcctcc

SEQ ID NO: 4925380 - DNA, 15 bp, Homo sapiens
acccactgctctggt

SEQ ID NO: 4925381 - DNA, 22 bp, Homo sapiens
acccacttgtcactgacacaaa

SEQ ID NO: 4925382 - DNA, 23 bp, Homo sapiens
acccagaggaggcagaataagaa

SEQ ID NO: 4925383 - DNA, 15 bp, Homo sapiens
acccagcccacttct

SEQ ID NO: 4925384 - DNA, 12 bp, Homo sapiens
acccagcctcag

SEQ ID NO: 4925385 - DNA, 13 bp, Homo sapiens
acccagcctcagt

SEQ ID NO: 4925386 - DNA, 17 bp, Homo sapiens
acccagcctcagtcctc

SEQ ID NO: 4925387 - DNA, 22 bp, Homo sapiens
acccagcctcagtcctcccctc

SEQ ID NO: 4925388 - DNA, 23 bp, Homo sapiens
acccagcgagccctggtggcagt

SEQ ID NO: 4925389 - DNA, 24 bp, Homo sapiens
acccagcgagccctggtggcagtg

SEQ ID NO: 4925390 - DNA, 23 bp, Homo sapiens
acccagcgggcaggttctgcctg

SEQ ID NO: 4925391 - DNA, 14 bp, Homo sapiens
acccaggaccaagc

SEQ ID NO: 4925392 - DNA, 15 bp, Homo sapiens
acccaggagccccga

SEQ ID NO: 4925393 - DNA, 20 bp, Homo sapiens
acccaggctggagtgcagtg

SEQ ID NO: 4925394 - DNA, 16 bp, Homo sapiens
acccagggctctgccc

SEQ ID NO: 4925395 - DNA, 21 bp, Homo sapiens
acccaggtgatgttagtgttt

SEQ ID NO: 4925396 - DNA, 16 bp, Homo sapiens
acccataatcctttct

SEQ ID NO: 4925397 - DNA, 17 bp, Homo sapiens
acccataatcctttctg

SEQ ID NO: 4925398 - DNA, 17 bp, Homo sapiens
acccatagatcttctga

SEQ ID NO: 4925399 - DNA, 21 bp, Homo sapiens
acccatagatcttctgaaatg

SEQ ID NO: 4925400 - DNA, 19 bp, Homo sapiens
acccatctagtacttgaaa

SEQ ID NO: 4925401 - DNA, 17 bp, Homo sapiens
acccatgggctctgaca

SEQ ID NO: 4925402 - DNA, 24 bp, Homo sapiens
acccatgtaaataccagactgcag

SEQ ID NO: 4925403 - DNA, 13 bp, Homo sapiens
acccattcagaga

SEQ ID NO: 4925404 - DNA, 21 bp, Homo sapiens
acccattcagagactgtccct

SEQ ID NO: 4925405 - DNA, 16 bp, Homo sapiens
accccaaacaccttcc

SEQ ID NO: 4925406 - DNA, 16 bp, Homo sapiens
accccaaagccccttg

SEQ ID NO: 4925407 - DNA, 18 bp, Homo sapiens
accccaaagccccttgct

SEQ ID NO: 4925408 - DNA, 11 bp, Homo sapiens
accccacactt

SEQ ID NO: 4925409 - DNA, 15 bp, Homo sapiens
accccaccctccctg

SEQ ID NO: 4925410 - DNA, 18 bp, Homo sapiens
accccaccctccctggag

SEQ ID NO: 4925411 - DNA, 14 bp, Homo sapiens
accccacctgcagg

SEQ ID NO: 4925412 - DNA, 14 bp, Homo sapiens
accccagctcccta

SEQ ID NO: 4925413 - DNA, 17 bp, Homo sapiens
accccagctccctagga

SEQ ID NO: 4925414 - DNA, 18 bp, Homo sapiens
accccagctgtgagcctt

SEQ ID NO: 4925415 - DNA, 19 bp, Homo sapiens
accccagctgtgagccttg

SEQ ID NO: 4925416 - DNA, 20 bp, Homo sapiens
accccagctgtgagccttgg

SEQ ID NO: 4925417 - DNA, 16 bp, Homo sapiens
accccagtggccactc

SEQ ID NO: 4925418 - DNA, 15 bp, Homo sapiens
accccatcccacacc

SEQ ID NO: 4925419 - DNA, 14 bp, Homo sapiens
acccccaccccaca

SEQ ID NO: 4925420 - DNA, 16 bp, Homo sapiens
acccccaccccacact

SEQ ID NO: 4925421 - DNA, 17 bp, Homo sapiens
acccccaccccacactt

SEQ ID NO: 4925422 - DNA, 14 bp, Homo sapiens
acccccagcctgct

SEQ ID NO: 4925423 - DNA, 12 bp, Homo sapiens
acccccagctca

SEQ ID NO: 4925424 - DNA, 13 bp, Homo sapiens
acccccagctcaa

SEQ ID NO: 4925425 - DNA, 20 bp, Homo sapiens
acccccagctcaatggactg

SEQ ID NO: 4925426 - DNA, 17 bp, Homo sapiens
acccccatctctccctc

SEQ ID NO: 4925427 - DNA, 16 bp, Homo sapiens
acccccattctcatct

SEQ ID NO: 4925428 - DNA, 14 bp, Homo sapiens
acccccctgttcta

SEQ ID NO: 4925429 - DNA, 17 bp, Homo sapiens
acccccctgttctaagg

SEQ ID NO: 4925430 - DNA, 18 bp, Homo sapiens
acccccttctactgagcc

SEQ ID NO: 4925431 - DNA, 14 bp, Homo sapiens
accccggcaggccc

SEQ ID NO: 4925432 - DNA, 15 bp, Homo sapiens
accccggcaggccct

SEQ ID NO: 4925433 - DNA, 17 bp, Homo sapiens
accccggcaggccctgc

SEQ ID NO: 4925434 - DNA, 18 bp, Homo sapiens
accccggcaggccctgca

SEQ ID NO: 4925435 - DNA, 21 bp, Homo sapiens
accccggcaggccctgcagtg

SEQ ID NO: 4925436 - DNA, 16 bp, Homo sapiens
accccgggctctctgc

SEQ ID NO: 4925437 - DNA, 15 bp, Homo sapiens
acctcaggcagctca

SEQ ID NO: 4925438 - DNA, 17 bp, Homo sapiens
acctcaggcagctcaag

SEQ ID NO: 4925439 - DNA, 21 bp, Homo sapiens
acctcaggtgatccacccacc

SEQ ID NO: 4925440 - DNA, 19 bp, Homo sapiens
acctcagttcccttggcct

SEQ ID NO: 4925441 - DNA, 20 bp, Homo sapiens
acctcagttcccttggcctc

SEQ ID NO: 4925442 - DNA, 23 bp, Homo sapiens
acctcagttcccttggcctcaga

SEQ ID NO: 4925443 - DNA, 11 bp, Homo sapiens
acctcatgttt

SEQ ID NO: 4925444 - DNA, 15 bp, Homo sapiens
acctcatgtttatga

SEQ ID NO: 4925445 - DNA, 19 bp, Homo sapiens
acctcatgtttatgaaaat

SEQ ID NO: 4925446 - DNA, 20 bp, Homo sapiens
acctcatgtttatgaaaata

SEQ ID NO: 4925447 - DNA, 23 bp, Homo sapiens
acctccaacagaactaaatgttc

SEQ ID NO: 4925448 - DNA, 16 bp, Homo sapiens
acctccagcccgggag

SEQ ID NO: 4925449 - DNA, 19 bp, Homo sapiens
acctccattaaagtctgaa

SEQ ID NO: 4925450 - DNA, 13 bp, Homo sapiens
acctcccagaggt

SEQ ID NO: 4925451 - DNA, 14 bp, Homo sapiens
acctcccagaggtc

SEQ ID NO: 4925452 - DNA, 21 bp, Homo sapiens
acctcccagaggtccagccca

SEQ ID NO: 4925453 - DNA, 23 bp, Homo sapiens
acctcccagaggtccagcccatc

SEQ ID NO: 4925454 - DNA, 14 bp, Homo sapiens
acctccccacgccc

SEQ ID NO: 4925455 - DNA, 22 bp, Homo sapiens
acctccccacgccctcccctcc

SEQ ID NO: 4925456 - DNA, 19 bp, Homo sapiens
acctccccagcccctagcc

SEQ ID NO: 4925457 - DNA, 23 bp, Homo sapiens
acctccccagcccctagcccagg

SEQ ID NO: 4925458 - DNA, 14 bp, Homo sapiens
acctcccctgcctt

SEQ ID NO: 4925459 - DNA, 20 bp, Homo sapiens
acctcccctgccttgctgtt

SEQ ID NO: 4925460 - DNA, 23 bp, Homo sapiens
acctccctcttgttttgtttgtc

SEQ ID NO: 4925461 - DNA, 13 bp, Homo sapiens
acctccctgccca

SEQ ID NO: 4925462 - DNA, 18 bp, Homo sapiens
acctccctgcccaggccg

SEQ ID NO: 4925463 - DNA, 21 bp, Homo sapiens
acctccctgcccaggccggcc

SEQ ID NO: 4925464 - DNA, 22 bp, Homo sapiens
acctcccttccgaccctctggg

SEQ ID NO: 4925465 - DNA, 12 bp, Homo sapiens
acctcctgcctc

SEQ ID NO: 4925466 - DNA, 14 bp, Homo sapiens
acctcctgtggaac

SEQ ID NO: 4925467 - DNA, 20 bp, Homo sapiens
acctcctgtggaacccagca

SEQ ID NO: 4925468 - DNA, 14 bp, Homo sapiens
acctctactttcca

SEQ ID NO: 4925469 - DNA, 15 bp, Homo sapiens
acctctactttccag

SEQ ID NO: 4925470 - DNA, 12 bp, Homo sapiens
acctctcactcc

SEQ ID NO: 4925471 - DNA, 13 bp, Homo sapiens
acctctcactccc

SEQ ID NO: 4925472 - DNA, 23 bp, Homo sapiens
acctctctcctttgctgaggcct

SEQ ID NO: 4925473 - DNA, 18 bp, Homo sapiens
acctctgcggaccccagc

SEQ ID NO: 4925474 - DNA, 19 bp, Homo sapiens
acctctgcggaccccagct

SEQ ID NO: 4925475 - DNA, 23 bp, Homo sapiens
acctctggactggctagagtcct

SEQ ID NO: 4925476 - DNA, 13 bp, Homo sapiens
acctctggctgac

SEQ ID NO: 4925477 - DNA, 15 bp, Homo sapiens
acctctgtcatttgt

SEQ ID NO: 4925478 - DNA, 12 bp, Homo sapiens
acctctgtctca

SEQ ID NO: 4925479 - DNA, 20 bp, Homo sapiens
acctctgtctcatcctcctg

SEQ ID NO: 4925480 - DNA, 23 bp, Homo sapiens
acctctgtctcatcctcctggaa

SEQ ID NO: 4925481 - DNA, 16 bp, Homo sapiens
acctctgtgacctcag

SEQ ID NO: 4925482 - DNA, 21 bp, Homo sapiens
acctctgtgaggaaagcacac

SEQ ID NO: 4925483 - DNA, 11 bp, Homo sapiens
acctctgtgtg

SEQ ID NO: 4925484 - DNA, 14 bp, Homo sapiens
acctcttccccaga

SEQ ID NO: 4925485 - DNA, 23 bp, Homo sapiens
acctcttccccagaaaggagact

SEQ ID NO: 4925486 - DNA, 16 bp, Homo sapiens
acctcttctggctcaa

SEQ ID NO: 4925487 - DNA, 19 bp, Homo sapiens
acctgaaaaaaagtttaca

SEQ ID NO: 4925488 - DNA, 12 bp, Homo sapiens
acctgaaaagta

SEQ ID NO: 4925489 - DNA, 14 bp, Homo sapiens
acctgaaattccaa

SEQ ID NO: 4925490 - DNA, 22 bp, Homo sapiens
acctgaaattccaaagtctcta

SEQ ID NO: 4925491 - DNA, 13 bp, Homo sapiens
acctgaagactga

SEQ ID NO: 4925492 - DNA, 19 bp, Homo sapiens
acctgaagactgaggacaa

SEQ ID NO: 4925493 - DNA, 18 bp, Homo sapiens
acctgatcactagcctgt

SEQ ID NO: 4925494 - DNA, 21 bp, Homo sapiens
acctgcatttgtatgtgtccc

SEQ ID NO: 4925495 - DNA, 14 bp, Homo sapiens
acctgccctggaac

SEQ ID NO: 4925496 - DNA, 14 bp, Homo sapiens
acctgcctcctgcc

SEQ ID NO: 4925497 - DNA, 23 bp, Homo sapiens
acctgcctcggcctcccaaagtg

SEQ ID NO: 4925498 - DNA, 23 bp, Homo sapiens
acctgcctctcacacacatagat

SEQ ID NO: 4925499 - DNA, 11 bp, Homo sapiens
acctgcctgcg

SEQ ID NO: 4925500 - DNA, 18 bp, Homo sapiens
acctgcctgcgtcttccg

SEQ ID NO: 4925501 - DNA, 17 bp, Homo sapiens
acctgctccgctgctcc

SEQ ID NO: 4925502 - DNA, 18 bp, Homo sapiens
acctgctccgctgctcct

SEQ ID NO: 4925503 - DNA, 19 bp, Homo sapiens
acctgctctcctcttgcca

SEQ ID NO: 4925504 - DNA, 13 bp, Homo sapiens
acctgctttttga

SEQ ID NO: 4925505 - DNA, 15 bp, Homo sapiens
acctgctttttgaaa

SEQ ID NO: 4925506 - DNA, 18 bp, Homo sapiens
acctgctttttgaaatga

SEQ ID NO: 4925507 - DNA, 23 bp, Homo sapiens
acctgctttttgaaatgaaattt

SEQ ID NO: 4925508 - DNA, 19 bp, Homo sapiens
acctggaaaaattccagaa

SEQ ID NO: 4925509 - DNA, 21 bp, Homo sapiens
acctggggcacagtccaggaa

SEQ ID NO: 4925510 - DNA, 21 bp, Homo sapiens
acctggtactccctctcagga

SEQ ID NO: 4925511 - DNA, 12 bp, Homo sapiens
acctgtatttaa

SEQ ID NO: 4925512 - DNA, 16 bp, Homo sapiens
acctgtcacattgcat

SEQ ID NO: 4925513 - DNA, 17 bp, Homo sapiens
acctgtctccactgtgc

SEQ ID NO: 4925514 - DNA, 19 bp, Homo sapiens
acctgtgagtttaaagcaa

SEQ ID NO: 4925515 - DNA, 13 bp, Homo sapiens
acctgtgggtgta

SEQ ID NO: 4925516 - DNA, 13 bp, Homo sapiens
acctgtgtacata

SEQ ID NO: 4925517 - DNA, 15 bp, Homo sapiens
accttaccaactttc

SEQ ID NO: 4925518 - DNA, 19 bp, Homo sapiens
accttagctccctcccgca

SEQ ID NO: 4925519 - DNA, 20 bp, Homo sapiens
accttagctccctcccgcac

SEQ ID NO: 4925520 - DNA, 21 bp, Homo sapiens
accttagctggcattacagct

SEQ ID NO: 4925521 - DNA, 16 bp, Homo sapiens
accttaggccttcctc

SEQ ID NO: 4925522 - DNA, 15 bp, Homo sapiens
accttatcctgcatt

SEQ ID NO: 4925523 - DNA, 18 bp, Homo sapiens
accttatcctgcattgtt

SEQ ID NO: 4925524 - DNA, 17 bp, Homo sapiens
accttccagctcctgta

SEQ ID NO: 4925525 - DNA, 14 bp, Homo sapiens
accttcccaaacgc

SEQ ID NO: 4925526 - DNA, 14 bp, Homo sapiens
accttcccttgcca

SEQ ID NO: 4925527 - DNA, 15 bp, Homo sapiens
accttccttcctgtt

SEQ ID NO: 4925528 - DNA, 16 bp, Homo sapiens
accttctagaattata

SEQ ID NO: 4925529 - DNA, 12 bp, Homo sapiens
accttctgcctt

SEQ ID NO: 4925530 - DNA, 13 bp, Homo sapiens
accttctgtggct

SEQ ID NO: 4925531 - DNA, 15 bp, Homo sapiens
accttcttattatat

SEQ ID NO: 4925532 - DNA, 18 bp, Homo sapiens
accttgaatgctgccagt

SEQ ID NO: 4925533 - DNA, 16 bp, Homo sapiens
accttgacagggcaca

SEQ ID NO: 4925534 - DNA, 17 bp, Homo sapiens
accttggagagacacag

SEQ ID NO: 4925535 - DNA, 14 bp, Homo sapiens
accttggctcaagt

SEQ ID NO: 4925536 - DNA, 23 bp, Homo sapiens
acctttgcacaggatgctggcct

SEQ ID NO: 4925537 - DNA, 19 bp, Homo sapiens
accttttaaagtgtttcag

SEQ ID NO: 4925538 - DNA, 19 bp, Homo sapiens
accttttaccagcttttaa

SEQ ID NO: 4925539 - DNA, 20 bp, Homo sapiens
accttttaccagcttttaac

SEQ ID NO: 4925540 - DNA, 19 bp, Homo sapiens
accttttgaagtagtttgt

SEQ ID NO: 4925541 - DNA, 20 bp, Homo sapiens
accttttttaagatttttct

SEQ ID NO: 4925542 - DNA, 21 bp, Homo sapiens
acgaaacttgttattgtgaat

SEQ ID NO: 4925543 - DNA, 12 bp, Homo sapiens
acgaaagagaga

SEQ ID NO: 4925544 - DNA, 14 bp, Homo sapiens
acgaaagagagaga

SEQ ID NO: 4925545 - DNA, 23 bp, Homo sapiens
acgaaagagagagaaacaaactt

SEQ ID NO: 4925546 - DNA, 14 bp, Homo sapiens
acgaatattttcag

SEQ ID NO: 4925547 - DNA, 18 bp, Homo sapiens
actagcctttggctctgg

SEQ ID NO: 4925548 - DNA, 19 bp, Homo sapiens
actagcctttggctctgga

SEQ ID NO: 4925549 - DNA, 14 bp, Homo sapiens
actaggctcagaga

SEQ ID NO: 4925550 - DNA, 16 bp, Homo sapiens
actagggattcaggct

SEQ ID NO: 4925551 - DNA, 17 bp, Homo sapiens
actagggattcaggctg

SEQ ID NO: 4925552 - DNA, 16 bp, Homo sapiens
actaggttcaattccc

SEQ ID NO: 4925553 - DNA, 19 bp, Homo sapiens
actagtaagtaattatgca

SEQ ID NO: 4925554 - DNA, 20 bp, Homo sapiens
actagtacaaattataaaaa

SEQ ID NO: 4925555 - DNA, 22 bp, Homo sapiens
actagtcaccccaagtagtctg

SEQ ID NO: 4925556 - DNA, 14 bp, Homo sapiens
actagtgacagctt

SEQ ID NO: 4925557 - DNA, 17 bp, Homo sapiens
actataacatatgtaca

SEQ ID NO: 4925558 - DNA, 18 bp, Homo sapiens
actatacttgaacaaaag

SEQ ID NO: 4925559 - DNA, 22 bp, Homo sapiens
actatagcctaggtgacagagt

SEQ ID NO: 4925560 - DNA, 20 bp, Homo sapiens
actatagtttaaaacacatt

SEQ ID NO: 4925561 - DNA, 16 bp, Homo sapiens
actatatacatgtgtg

SEQ ID NO: 4925562 - DNA, 18 bp, Homo sapiens
actatatacatgtgtgta

SEQ ID NO: 4925563 - DNA, 17 bp, Homo sapiens
actatatagagatgttt

SEQ ID NO: 4925564 - DNA, 14 bp, Homo sapiens
actatatatatatg

SEQ ID NO: 4925565 - DNA, 19 bp, Homo sapiens
actatatatatatgccttt

SEQ ID NO: 4925566 - DNA, 13 bp, Homo sapiens
actatcataaaat

SEQ ID NO: 4925567 - DNA, 11 bp, Homo sapiens
actatcttgtg

SEQ ID NO: 4925568 - DNA, 19 bp, Homo sapiens
actatgaacttctctcaga

SEQ ID NO: 4925569 - DNA, 19 bp, Homo sapiens
actatggagcctggcacag

SEQ ID NO: 4925570 - DNA, 16 bp, Homo sapiens
actatgtaaactactt

SEQ ID NO: 4925571 - DNA, 15 bp, Homo sapiens
actatgttgcccagg

SEQ ID NO: 4925572 - DNA, 17 bp, Homo sapiens
actatgttgcccaggca

SEQ ID NO: 4925573 - DNA, 22 bp, Homo sapiens
actattaggtgcaatttcaagg

SEQ ID NO: 4925574 - DNA, 20 bp, Homo sapiens
actattcattaaatgtttga

SEQ ID NO: 4925575 - DNA, 19 bp, Homo sapiens
actattcgaatgaaaagac

SEQ ID NO: 4925576 - DNA, 21 bp, Homo sapiens
actattggaatctgatatact

SEQ ID NO: 4925577 - DNA, 16 bp, Homo sapiens
actatttaaacttata

SEQ ID NO: 4925578 - DNA, 19 bp, Homo sapiens
actatttgcttatttaata

SEQ ID NO: 4925579 - DNA, 16 bp, Homo sapiens
actcaaatgttctaag

SEQ ID NO: 4925580 - DNA, 22 bp, Homo sapiens
actcaacaaaacccatgcattt

SEQ ID NO: 4925581 - DNA, 23 bp, Homo sapiens
actcaaccttaagacctactgtt

SEQ ID NO: 4925582 - DNA, 12 bp, Homo sapiens
actcaagcactg

SEQ ID NO: 4925583 - DNA, 15 bp, Homo sapiens
actcaagcactgata

SEQ ID NO: 4925584 - DNA, 24 bp, Homo sapiens
actcaatggagtatgtctgatgga

SEQ ID NO: 4925585 - DNA, 22 bp, Homo sapiens
actcaccagccccactgccagc

SEQ ID NO: 4925586 - DNA, 17 bp, Homo sapiens
actcaccagtgtcccct

SEQ ID NO: 4925587 - DNA, 22 bp, Homo sapiens
actcactggggcctacagcttt

SEQ ID NO: 4925588 - DNA, 14 bp, Homo sapiens
actcactgtcaatg

SEQ ID NO: 4925589 - DNA, 15 bp, Homo sapiens
actcagaagacactg

SEQ ID NO: 4925590 - DNA, 17 bp, Homo sapiens
actcagaattattttta

SEQ ID NO: 4925591 - DNA, 16 bp, Homo sapiens
actcagatctgtctga

SEQ ID NO: 4925592 - DNA, 17 bp, Homo sapiens
actcagcccctaggagt

SEQ ID NO: 4925593 - DNA, 23 bp, Homo sapiens
actcagccggcgtggcaaatata

SEQ ID NO: 4925594 - DNA, 12 bp, Homo sapiens
actcagcctgct

SEQ ID NO: 4925595 - DNA, 14 bp, Homo sapiens
actcaggaggctga

SEQ ID NO: 4925596 - DNA, 18 bp, Homo sapiens
actcaggaggctgaggca

SEQ ID NO: 4925597 - DNA, 22 bp, Homo sapiens
actcaggatttaaaaactggaa

SEQ ID NO: 4925598 - DNA, 18 bp, Homo sapiens
actcagggacagagccat

SEQ ID NO: 4925599 - DNA, 19 bp, Homo sapiens
actcagggctcctcccagc

SEQ ID NO: 4925600 - DNA, 20 bp, Homo sapiens
actcagggctcctcccagct

SEQ ID NO: 4925601 - DNA, 22 bp, Homo sapiens
actcagggctcctcccagcttg

SEQ ID NO: 4925602 - DNA, 13 bp, Homo sapiens
actcattgaaatg

SEQ ID NO: 4925603 - DNA, 14 bp, Homo sapiens
actcattgaaatgt

SEQ ID NO: 4925604 - DNA, 16 bp, Homo sapiens
actcattgaaatgtca

SEQ ID NO: 4925605 - DNA, 19 bp, Homo sapiens
actcatttctaaaagaata

SEQ ID NO: 4925606 - DNA, 20 bp, Homo sapiens
actccaatgtctgctgagga

SEQ ID NO: 4925607 - DNA, 18 bp, Homo sapiens
actccacgatcctgccac

SEQ ID NO: 4925608 - DNA, 15 bp, Homo sapiens
actccagcaacttct

SEQ ID NO: 4925609 - DNA, 15 bp, Homo sapiens
actccagtgccagca

SEQ ID NO: 4925610 - DNA, 22 bp, Homo sapiens
actccattcccaactagacatt

SEQ ID NO: 4925611 - DNA, 15 bp, Homo sapiens
actcccagtccccag

SEQ ID NO: 4925612 - DNA, 14 bp, Homo sapiens
actcccatgaagcc

SEQ ID NO: 4925613 - DNA, 16 bp, Homo sapiens
actccccgaagtcttt

SEQ ID NO: 4925614 - DNA, 15 bp, Homo sapiens
actccctcctcacct

SEQ ID NO: 4925615 - DNA, 16 bp, Homo sapiens
actccctcctcacctc

SEQ ID NO: 4925616 - DNA, 19 bp, Homo sapiens
actccctcctcacctctgg

SEQ ID NO: 4925617 - DNA, 17 bp, Homo sapiens
actccctgcagatgcca

SEQ ID NO: 4925618 - DNA, 12 bp, Homo sapiens
actccgccccca

SEQ ID NO: 4925619 - DNA, 16 bp, Homo sapiens
actcctacctgccctg

SEQ ID NO: 4925620 - DNA, 18 bp, Homo sapiens
actcctacctgccctgga

SEQ ID NO: 4925621 - DNA, 22 bp, Homo sapiens
actcctagagaacgcagcccta

SEQ ID NO: 4925622 - DNA, 20 bp, Homo sapiens
actcctatttttgtaaactg

SEQ ID NO: 4925623 - DNA, 21 bp, Homo sapiens
actcctccctttccttcctaa

SEQ ID NO: 4925624 - DNA, 11 bp, Homo sapiens
actcctcctct

SEQ ID NO: 4925625 - DNA, 19 bp, Homo sapiens
actcctgacgtctgaagct

SEQ ID NO: 4925626 - DNA, 21 bp, Homo sapiens
actcctgacgtctgaagcttg

SEQ ID NO: 4925627 - DNA, 23 bp, Homo sapiens
actcctgacgtctgaagcttgac

SEQ ID NO: 4925628 - DNA, 11 bp, Homo sapiens
actcctgactc

SEQ ID NO: 4925629 - DNA, 12 bp, Homo sapiens
actcctgactcc

SEQ ID NO: 4925630 - DNA, 18 bp, Homo sapiens
actcctgactcctacctg

SEQ ID NO: 4925631 - DNA, 14 bp, Homo sapiens
actcctggcctcaa

SEQ ID NO: 4925632 - DNA, 12 bp, Homo sapiens
actccttggcct

SEQ ID NO: 4925633 - DNA, 16 bp, Homo sapiens
actccttggcctagcc

SEQ ID NO: 4925634 - DNA, 15 bp, Homo sapiens
actcgcttcccccat

SEQ ID NO: 4925635 - DNA, 14 bp, Homo sapiens
actcgcttgtaaat

SEQ ID NO: 4925636 - DNA, 15 bp, Homo sapiens
actcgcttgtaaata

SEQ ID NO: 4925637 - DNA, 17 bp, Homo sapiens
actcgcttgtaaatacc

SEQ ID NO: 4925638 - DNA, 16 bp, Homo sapiens
actcggcaccctgcaa

SEQ ID NO: 4925639 - DNA, 14 bp, Homo sapiens
actcgtatatgtct

SEQ ID NO: 4925640 - DNA, 15 bp, Homo sapiens
actctaaagaccaaa

SEQ ID NO: 4925641 - DNA, 22 bp, Homo sapiens
actctaaattctttatttctgt

SEQ ID NO: 4925642 - DNA, 13 bp, Homo sapiens
actctaagatctt

SEQ ID NO: 4925643 - DNA, 17 bp, Homo sapiens
actctaagatcttagat

SEQ ID NO: 4925644 - DNA, 21 bp, Homo sapiens
actctaagatcttagattctc

SEQ ID NO: 4925645 - DNA, 15 bp, Homo sapiens
actctacagaggcca

SEQ ID NO: 4925646 - DNA, 16 bp, Homo sapiens
actctaccctcccacc

SEQ ID NO: 4925647 - DNA, 19 bp, Homo sapiens
actctaccctcccaccccc

SEQ ID NO: 4925648 - DNA, 19 bp, Homo sapiens
actctagagtccaaggttt

SEQ ID NO: 4925649 - DNA, 21 bp, Homo sapiens
actctagatgaagttttacat

SEQ ID NO: 4925650 - DNA, 20 bp, Homo sapiens
actctatgccccaaatatag

SEQ ID NO: 4925651 - DNA, 13 bp, Homo sapiens
actctccatctta

SEQ ID NO: 4925652 - DNA, 11 bp, Homo sapiens
actctccccac

SEQ ID NO: 4925653 - DNA, 12 bp, Homo sapiens
actctccccaca

SEQ ID NO: 4925654 - DNA, 13 bp, Homo sapiens
actctctccaccc

SEQ ID NO: 4925655 - DNA, 21 bp, Homo sapiens
actctctccaccctatatgta

SEQ ID NO: 4925656 - DNA, 13 bp, Homo sapiens
actctcttccctt

SEQ ID NO: 4925657 - DNA, 18 bp, Homo sapiens
acttcacattaaaaaatg

SEQ ID NO: 4925658 - DNA, 11 bp, Homo sapiens
acttcagcacc

SEQ ID NO: 4925659 - DNA, 14 bp, Homo sapiens
acttcagctctgtt

SEQ ID NO: 4925660 - DNA, 14 bp, Homo sapiens
acttcaggctcttc

SEQ ID NO: 4925661 - DNA, 20 bp, Homo sapiens
acttcaggctcttctccttt

SEQ ID NO: 4925662 - DNA, 20 bp, Homo sapiens
acttcatggaatggacatcc

SEQ ID NO: 4925663 - DNA, 15 bp, Homo sapiens
acttcattgtccctc

SEQ ID NO: 4925664 - DNA, 14 bp, Homo sapiens
acttccaaaattct

SEQ ID NO: 4925665 - DNA, 15 bp, Homo sapiens
acttccaaaattctt

SEQ ID NO: 4925666 - DNA, 18 bp, Homo sapiens
acttccaggggaacctgc

SEQ ID NO: 4925667 - DNA, 18 bp, Homo sapiens
acttcctcctccccactt

SEQ ID NO: 4925668 - DNA, 14 bp, Homo sapiens
acttccttgagaca

SEQ ID NO: 4925669 - DNA, 18 bp, Homo sapiens
acttcgtcttctaatttc

SEQ ID NO: 4925670 - DNA, 20 bp, Homo sapiens
acttcgtcttctaatttcaa

SEQ ID NO: 4925671 - DNA, 15 bp, Homo sapiens
acttctaatatcatt

SEQ ID NO: 4925672 - DNA, 16 bp, Homo sapiens
acttctccaccctgct

SEQ ID NO: 4925673 - DNA, 16 bp, Homo sapiens
acttctctctaaggag

SEQ ID NO: 4925674 - DNA, 22 bp, Homo sapiens
acttctctctaaggagaatggc

SEQ ID NO: 4925675 - DNA, 19 bp, Homo sapiens
acttctcttaaacttgtga

SEQ ID NO: 4925676 - DNA, 16 bp, Homo sapiens
acttctcttgctttct

SEQ ID NO: 4925677 - DNA, 19 bp, Homo sapiens
acttctgtgagacccccac

SEQ ID NO: 4925678 - DNA, 23 bp, Homo sapiens
acttctgtgagacccccacacct

SEQ ID NO: 4925679 - DNA, 14 bp, Homo sapiens
acttcttaaatatc

SEQ ID NO: 4925680 - DNA, 16 bp, Homo sapiens
acttcttatggaattg

SEQ ID NO: 4925681 - DNA, 13 bp, Homo sapiens
acttcttgtcaga

SEQ ID NO: 4925682 - DNA, 20 bp, Homo sapiens
acttcttgtcagacataaag

SEQ ID NO: 4925683 - DNA, 23 bp, Homo sapiens
acttcttgtcagacataaagcca

SEQ ID NO: 4925684 - DNA, 24 bp, Homo sapiens
acttcttgtcagacataaagccat

SEQ ID NO: 4925685 - DNA, 17 bp, Homo sapiens
acttgaaattatatctg

SEQ ID NO: 4925686 - DNA, 17 bp, Homo sapiens
acttgaacaaaagggtc

SEQ ID NO: 4925687 - DNA, 18 bp, Homo sapiens
acttgaacaaaagggtca

SEQ ID NO: 4925688 - DNA, 20 bp, Homo sapiens
acttgaacaaaagggtcaga

SEQ ID NO: 4925689 - DNA, 21 bp, Homo sapiens
acttgaacaaaagggtcagag

SEQ ID NO: 4925690 - DNA, 19 bp, Homo sapiens
acttgaacaaaatctgttg

SEQ ID NO: 4925691 - DNA, 21 bp, Homo sapiens
acttgagatgtatgaaggctt

SEQ ID NO: 4925692 - DNA, 22 bp, Homo sapiens
acttgagatgtatgaaggcttt

SEQ ID NO: 4925693 - DNA, 16 bp, Homo sapiens
acttgagggcccagag

SEQ ID NO: 4925694 - DNA, 21 bp, Homo sapiens
acttgagggcccagagcagga

SEQ ID NO: 4925695 - DNA, 19 bp, Homo sapiens
acttgcagactctacagag

SEQ ID NO: 4925696 - DNA, 23 bp, Homo sapiens
acttgcagactctacagaggcca

SEQ ID NO: 4925697 - DNA, 12 bp, Homo sapiens
acttgcatgaag

SEQ ID NO: 4925698 - DNA, 14 bp, Homo sapiens
acttgcgcagaaaa

SEQ ID NO: 4925699 - DNA, 20 bp, Homo sapiens
acttggggagatggagttct

SEQ ID NO: 4925700 - DNA, 22 bp, Homo sapiens
acttgggggaacgatgtgtctg

SEQ ID NO: 4925701 - DNA, 16 bp, Homo sapiens
acttgggtgacggcag

SEQ ID NO: 4925702 - DNA, 16 bp, Homo sapiens
acttggttctgcttca

SEQ ID NO: 4925703 - DNA, 22 bp, Homo sapiens
acttgtaatatttttatataca

SEQ ID NO: 4925704 - DNA, 14 bp, Homo sapiens
acttgtacaaaata

SEQ ID NO: 4925705 - DNA, 18 bp, Homo sapiens
acttgtacaaaataaaca

SEQ ID NO: 4925706 - DNA, 20 bp, Homo sapiens
acttgtacaaaataaacaaa

SEQ ID NO: 4925707 - DNA, 14 bp, Homo sapiens
acttgtagctgtaa

SEQ ID NO: 4925708 - DNA, 21 bp, Homo sapiens
acttgtagctgtaaaacgctg

SEQ ID NO: 4925709 - DNA, 21 bp, Homo sapiens
acttgtcactgacacaaagga

SEQ ID NO: 4925710 - DNA, 13 bp, Homo sapiens
acttgtcatgtga

SEQ ID NO: 4925711 - DNA, 18 bp, Homo sapiens
acttgtgaaacacagctg

SEQ ID NO: 4925712 - DNA, 19 bp, Homo sapiens
acttgtgaaacacagctgt

SEQ ID NO: 4925713 - DNA, 10 bp, Homo sapiens
acttgtgaat

SEQ ID NO: 4925714 - DNA, 17 bp, Homo sapiens
acttgtgaatgcttctc

SEQ ID NO: 4925715 - DNA, 21 bp, Homo sapiens
acttgtgctttcagttagcct

SEQ ID NO: 4925716 - DNA, 16 bp, Homo sapiens
acttgtggacacagct

SEQ ID NO: 4925717 - DNA, 19 bp, Homo sapiens
acttgtggacacagctctt

SEQ ID NO: 4925718 - DNA, 16 bp, Homo sapiens
acttgtggttgaatta

SEQ ID NO: 4925719 - DNA, 19 bp, Homo sapiens
acttgttattgtgaatgat

SEQ ID NO: 4925720 - DNA, 16 bp, Homo sapiens
acttgttccagctctt

SEQ ID NO: 4925721 - DNA, 16 bp, Homo sapiens
acttgtttgtcttcca

SEQ ID NO: 4925722 - DNA, 16 bp, Homo sapiens
actttaaaaggagcca

SEQ ID NO: 4925723 - DNA, 17 bp, Homo sapiens
actttaagagagaaatc

SEQ ID NO: 4925724 - DNA, 13 bp, Homo sapiens
actttacccacct

SEQ ID NO: 4925725 - DNA, 21 bp, Homo sapiens
actttagaagtgcatttctga

SEQ ID NO: 4925726 - DNA, 13 bp, Homo sapiens
actttagtatgac

SEQ ID NO: 4925727 - DNA, 17 bp, Homo sapiens
actttatcactttttga

SEQ ID NO: 4925728 - DNA, 13 bp, Homo sapiens
actttatctaaag

SEQ ID NO: 4925729 - DNA, 13 bp, Homo sapiens
actttatgtgtaa

SEQ ID NO: 4925730 - DNA, 13 bp, Homo sapiens
actttcaaaatta

SEQ ID NO: 4925731 - DNA, 19 bp, Homo sapiens
actttcatcctgactctgc

SEQ ID NO: 4925732 - DNA, 21 bp, Homo sapiens
actttcatcctgactctgccc

SEQ ID NO: 4925733 - DNA, 17 bp, Homo sapiens
actttccacttcttcct

SEQ ID NO: 4925734 - DNA, 16 bp, Homo sapiens
actttcccaggttctg

SEQ ID NO: 4925735 - DNA, 11 bp, Homo sapiens
actttcccttg

SEQ ID NO: 4925736 - DNA, 21 bp, Homo sapiens
actttccttttctattccttc

SEQ ID NO: 4925737 - DNA, 16 bp, Homo sapiens
actttcgtacattggc

SEQ ID NO: 4925738 - DNA, 17 bp, Homo sapiens
actttctaatgtttctg

SEQ ID NO: 4925739 - DNA, 14 bp, Homo sapiens
actttctgtaaact

SEQ ID NO: 4925740 - DNA, 18 bp, Homo sapiens
actttctgtaaactcaaa

SEQ ID NO: 4925741 - DNA, 22 bp, Homo sapiens
actttctgttggattccatgct

SEQ ID NO: 4925742 - DNA, 15 bp, Homo sapiens
actttgaaatacctc

SEQ ID NO: 4925743 - DNA, 16 bp, Homo sapiens
actttgaaatacctca

SEQ ID NO: 4925744 - DNA, 23 bp, Homo sapiens
actttgacgagtcaccttccagg

SEQ ID NO: 4925745 - DNA, 15 bp, Homo sapiens
actttgatgtcatgt

SEQ ID NO: 4925746 - DNA, 22 bp, Homo sapiens
actttgatgtcatgtgttccct

SEQ ID NO: 4925747 - DNA, 15 bp, Homo sapiens
actttgcctcctgtg

SEQ ID NO: 4925748 - DNA, 15 bp, Homo sapiens
actttgctgatttcc

SEQ ID NO: 4925749 - DNA, 23 bp, Homo sapiens
actttggagagtgagctacagag

SEQ ID NO: 4925750 - DNA, 23 bp, Homo sapiens
actttggagtcccctcacctcct

SEQ ID NO: 4925751 - DNA, 18 bp, Homo sapiens
actttggtttctgtctgt

SEQ ID NO: 4925752 - DNA, 18 bp, Homo sapiens
actttgtatactttaaat

SEQ ID NO: 4925753 - DNA, 21 bp, Homo sapiens
actttgtatactttaaataat

SEQ ID NO: 4925754 - DNA, 14 bp, Homo sapiens
actttgtctgaaaa

SEQ ID NO: 4925755 - DNA, 18 bp, Homo sapiens
actttgtggaccaattat

SEQ ID NO: 4925756 - DNA, 23 bp, Homo sapiens
acttttatactctttctgtatat

SEQ ID NO: 4925757 - DNA, 21 bp, Homo sapiens
acttttatctattctgagaaa

SEQ ID NO: 4925758 - DNA, 15 bp, Homo sapiens
acttttatttgcaac

SEQ ID NO: 4925759 - DNA, 18 bp, Homo sapiens
acttttatttgcaacatt

SEQ ID NO: 4925760 - DNA, 22 bp, Homo sapiens
acttttattttacacagaaaca

SEQ ID NO: 4925761 - DNA, 23 bp, Homo sapiens
acttttcaaggcttatattcaac

SEQ ID NO: 4925762 - DNA, 20 bp, Homo sapiens
acttttgagtgtgtgtgtgc

SEQ ID NO: 4925763 - DNA, 12 bp, Homo sapiens
acttttgtaaga

SEQ ID NO: 4925764 - DNA, 17 bp, Homo sapiens
acttttgtaagacaaag

SEQ ID NO: 4925765 - DNA, 17 bp, Homo sapiens
actttttcttttgtaag

SEQ ID NO: 4925766 - DNA, 18 bp, Homo sapiens
agagagcgagcgctaccc

SEQ ID NO: 4925767 - DNA, 16 bp, Homo sapiens
agagagcggtctcagg

SEQ ID NO: 4925768 - DNA, 15 bp, Homo sapiens
agagaggcagagagc

SEQ ID NO: 4925769 - DNA, 20 bp, Homo sapiens
agagagggtggtgacctctg

SEQ ID NO: 4925770 - DNA, 14 bp, Homo sapiens
agagagtggctcct

SEQ ID NO: 4925771 - DNA, 20 bp, Homo sapiens
agagataccaagatgccatc

SEQ ID NO: 4925772 - DNA, 19 bp, Homo sapiens
agagatatatctgaaaact

SEQ ID NO: 4925773 - DNA, 23 bp, Homo sapiens
agagatatatctgaaaactggaa

SEQ ID NO: 4925774 - DNA, 16 bp, Homo sapiens
agagatccaggaagca

SEQ ID NO: 4925775 - DNA, 23 bp, Homo sapiens
agagatgctgtaacttaaaatag

SEQ ID NO: 4925776 - DNA, 22 bp, Homo sapiens
agagatggacagttcacaccct

SEQ ID NO: 4925777 - DNA, 20 bp, Homo sapiens
agagatgggagctcctctcc

SEQ ID NO: 4925778 - DNA, 24 bp, Homo sapiens
agagatgggagctcctctcctgga

SEQ ID NO: 4925779 - DNA, 15 bp, Homo sapiens
agagatgtgcaccca

SEQ ID NO: 4925780 - DNA, 18 bp, Homo sapiens
agagatttatataaatgt

SEQ ID NO: 4925781 - DNA, 14 bp, Homo sapiens
agagcaactctgag

SEQ ID NO: 4925782 - DNA, 13 bp, Homo sapiens
agagcacaaacat

SEQ ID NO: 4925783 - DNA, 15 bp, Homo sapiens
agagcagatgcagag

SEQ ID NO: 4925784 - DNA, 19 bp, Homo sapiens
agagcagatgcagagagcc

SEQ ID NO: 4925785 - DNA, 17 bp, Homo sapiens
agagcagcctgtggcat

SEQ ID NO: 4925786 - DNA, 20 bp, Homo sapiens
agagcaggaagcattcagag

SEQ ID NO: 4925787 - DNA, 13 bp, Homo sapiens
agagcaggacctc

SEQ ID NO: 4925788 - DNA, 19 bp, Homo sapiens
agagcagtaccagcgctct

SEQ ID NO: 4925789 - DNA, 13 bp, Homo sapiens
agagccagaccaa

SEQ ID NO: 4925790 - DNA, 11 bp, Homo sapiens
agagccagctt

SEQ ID NO: 4925791 - DNA, 20 bp, Homo sapiens
agagccatataagtttgaag

SEQ ID NO: 4925792 - DNA, 22 bp, Homo sapiens
agagccatataagtttgaagga

SEQ ID NO: 4925793 - DNA, 22 bp, Homo sapiens
agagcccagaggtaacagaaca

SEQ ID NO: 4925794 - DNA, 14 bp, Homo sapiens
agagcctgatctct

SEQ ID NO: 4925795 - DNA, 19 bp, Homo sapiens
agagcctgatctcttcctg

SEQ ID NO: 4925796 - DNA, 17 bp, Homo sapiens
agagcctgcctggagcg

SEQ ID NO: 4925797 - DNA, 12 bp, Homo sapiens
agagcctgctgc

SEQ ID NO: 4925798 - DNA, 15 bp, Homo sapiens
agagcctgctgcatg

SEQ ID NO: 4925799 - DNA, 23 bp, Homo sapiens
agagctcctctgtcctgcttctg

SEQ ID NO: 4925800 - DNA, 13 bp, Homo sapiens
agagctgccctcc

SEQ ID NO: 4925801 - DNA, 17 bp, Homo sapiens
agagctggaccagtggt

SEQ ID NO: 4925802 - DNA, 16 bp, Homo sapiens
agagctggtgcccgga

SEQ ID NO: 4925803 - DNA, 18 bp, Homo sapiens
agagcttagcctggagca

SEQ ID NO: 4925804 - DNA, 21 bp, Homo sapiens
agaggaaatctgtaacaggta

SEQ ID NO: 4925805 - DNA, 15 bp, Homo sapiens
agaggaactgtccag

SEQ ID NO: 4925806 - DNA, 20 bp, Homo sapiens
agaggaactgtccagagagc

SEQ ID NO: 4925807 - DNA, 19 bp, Homo sapiens
agaggaatccatgaagaat

SEQ ID NO: 4925808 - DNA, 17 bp, Homo sapiens
agaggaatcctggcagc

SEQ ID NO: 4925809 - DNA, 13 bp, Homo sapiens
agaggaatttata

SEQ ID NO: 4925810 - DNA, 19 bp, Homo sapiens
agaggacctgtatttaagc

SEQ ID NO: 4925811 - DNA, 23 bp, Homo sapiens
agaggacctgtatttaagcaaat

SEQ ID NO: 4925812 - DNA, 12 bp, Homo sapiens
agaggagagagg

SEQ ID NO: 4925813 - DNA, 15 bp, Homo sapiens
agaggagaggagaga

SEQ ID NO: 4925814 - DNA, 17 bp, Homo sapiens
agaggagccagacagac

SEQ ID NO: 4925815 - DNA, 13 bp, Homo sapiens
agaggatgagagc

SEQ ID NO: 4925816 - DNA, 14 bp, Homo sapiens
agaggatgagagcc

SEQ ID NO: 4925817 - DNA, 13 bp, Homo sapiens
agaggatgtgcaa

SEQ ID NO: 4925818 - DNA, 13 bp, Homo sapiens
agaggcagagagc

SEQ ID NO: 4925819 - DNA, 14 bp, Homo sapiens
agaggcagagagcg

SEQ ID NO: 4925820 - DNA, 23 bp, Homo sapiens
agaggcagagagcggtctcaggc

SEQ ID NO: 4925821 - DNA, 21 bp, Homo sapiens
agaggcagggtctcactctgt

SEQ ID NO: 4925822 - DNA, 18 bp, Homo sapiens
agaggccaaaggctggtg

SEQ ID NO: 4925823 - DNA, 16 bp, Homo sapiens
agaggccagccccacc

SEQ ID NO: 4925824 - DNA, 21 bp, Homo sapiens
agaggccagccccacccagga

SEQ ID NO: 4925825 - DNA, 23 bp, Homo sapiens
agaggccagccccacccaggagg

SEQ ID NO: 4925826 - DNA, 14 bp, Homo sapiens
agaggccatggcag

SEQ ID NO: 4925827 - DNA, 15 bp, Homo sapiens
agaggccatggcaga

SEQ ID NO: 4925828 - DNA, 16 bp, Homo sapiens
agaggccatggcagaa

SEQ ID NO: 4925829 - DNA, 13 bp, Homo sapiens
agaggcctgcccg

SEQ ID NO: 4925830 - DNA, 13 bp, Homo sapiens
agaggctgaggac

SEQ ID NO: 4925831 - DNA, 18 bp, Homo sapiens
agaggctgcccctctcac

SEQ ID NO: 4925832 - DNA, 20 bp, Homo sapiens
agaggctgcccctctcacca

SEQ ID NO: 4925833 - DNA, 19 bp, Homo sapiens
agagggagaagggatggag

SEQ ID NO: 4925834 - DNA, 24 bp, Homo sapiens
agagggaggagaatgagcctcggc

SEQ ID NO: 4925835 - DNA, 14 bp, Homo sapiens
agaggggactctgg

SEQ ID NO: 4925836 - DNA, 18 bp, Homo sapiens
agaggggactctgggcta

SEQ ID NO: 4925837 - DNA, 16 bp, Homo sapiens
agagggggactgctgc

SEQ ID NO: 4925838 - DNA, 22 bp, Homo sapiens
agagggggactgctgctgcctg

SEQ ID NO: 4925839 - DNA, 22 bp, Homo sapiens
agagggtggtgacctctgcctg

SEQ ID NO: 4925840 - DNA, 18 bp, Homo sapiens
agaggtaacagaacagct

SEQ ID NO: 4925841 - DNA, 17 bp, Homo sapiens
agaggtacagggttttt

SEQ ID NO: 4925842 - DNA, 13 bp, Homo sapiens
agaggtggccaga

SEQ ID NO: 4925843 - DNA, 18 bp, Homo sapiens
agaggtggccagagctgg

SEQ ID NO: 4925844 - DNA, 14 bp, Homo sapiens
agaggtgggagggc

SEQ ID NO: 4925845 - DNA, 15 bp, Homo sapiens
agagtagaattgcat

SEQ ID NO: 4925846 - DNA, 21 bp, Homo sapiens
agagtagatggtgaaatttat

SEQ ID NO: 4925847 - DNA, 16 bp, Homo sapiens
agagtattgagatact

SEQ ID NO: 4925848 - DNA, 14 bp, Homo sapiens
agagtcctcactcc

SEQ ID NO: 4925849 - DNA, 17 bp, Homo sapiens
agagtctaaagatggag

SEQ ID NO: 4925850 - DNA, 13 bp, Homo sapiens
agagtctagattc

SEQ ID NO: 4925851 - DNA, 17 bp, Homo sapiens
agagtctagattcaaag

SEQ ID NO: 4925852 - DNA, 22 bp, Homo sapiens
agagtctagattcaaaggttct

SEQ ID NO: 4925853 - DNA, 15 bp, Homo sapiens
agagtctagattctc

SEQ ID NO: 4925854 - DNA, 17 bp, Homo sapiens
agagtctagcactcatt

SEQ ID NO: 4925855 - DNA, 15 bp, Homo sapiens
agagtgattgcagct

SEQ ID NO: 4925856 - DNA, 14 bp, Homo sapiens
agagtgcacagctg

SEQ ID NO: 4925857 - DNA, 22 bp, Homo sapiens
agagtggcctggccaggagctc

SEQ ID NO: 4925858 - DNA, 12 bp, Homo sapiens
agagtgtagaag

SEQ ID NO: 4925859 - DNA, 15 bp, Homo sapiens
agagtgtagaagcat

SEQ ID NO: 4925860 - DNA, 21 bp, Homo sapiens
agagtgtctcagggtgcagag

SEQ ID NO: 4925861 - DNA, 11 bp, Homo sapiens
agagtgtgtgt

SEQ ID NO: 4925862 - DNA, 16 bp, Homo sapiens
agagttaagaagctgt

SEQ ID NO: 4925863 - DNA, 16 bp, Homo sapiens
agagttgtgcacgcag

SEQ ID NO: 4925864 - DNA, 14 bp, Homo sapiens
agagtttaacacaa

SEQ ID NO: 4925865 - DNA, 21 bp, Homo sapiens
agagtttgccttcctttctcc

SEQ ID NO: 4925866 - DNA, 13 bp, Homo sapiens
agagttttgtctt

SEQ ID NO: 4925867 - DNA, 14 bp, Homo sapiens
agagttttgtcttg

SEQ ID NO: 4925868 - DNA, 21 bp, Homo sapiens
agataaccagctgtaacacag

SEQ ID NO: 4925869 - DNA, 15 bp, Homo sapiens
agataatcagcctct

SEQ ID NO: 4925870 - DNA, 16 bp, Homo sapiens
agataatcagcctctt

SEQ ID NO: 4925871 - DNA, 19 bp, Homo sapiens
agataatcagtgtgtctaa

SEQ ID NO: 4925872 - DNA, 16 bp, Homo sapiens
agataatctagaacac

SEQ ID NO: 4925873 - DNA, 23 bp, Homo sapiens
agataatctagaacacaggcaaa

SEQ ID NO: 4925874 - DNA, 18 bp, Homo sapiens
agataattgctatttatt

SEQ ID NO: 4925875 - DNA, 13 bp, Homo sapiens
agatacatcactg

SEQ ID NO: 4925876 - DNA, 20 bp, Homo sapiens
agatttaagcacaaacttta

SEQ ID NO: 4925877 - DNA, 20 bp, Homo sapiens
agatttaccagggatgtaga

SEQ ID NO: 4925878 - DNA, 12 bp, Homo sapiens
agatttagtgta

SEQ ID NO: 4925879 - DNA, 19 bp, Homo sapiens
agatttagtgtaataagac

SEQ ID NO: 4925880 - DNA, 18 bp, Homo sapiens
agatttatttttcagttc

SEQ ID NO: 4925881 - DNA, 21 bp, Homo sapiens
agatttatttttcagttccaa

SEQ ID NO: 4925882 - DNA, 19 bp, Homo sapiens
agatttcaagaaaaaataa

SEQ ID NO: 4925883 - DNA, 13 bp, Homo sapiens
agatttcctcctg

SEQ ID NO: 4925884 - DNA, 22 bp, Homo sapiens
agatttcttaaataatgcttca

SEQ ID NO: 4925885 - DNA, 16 bp, Homo sapiens
agattttaattgtcat

SEQ ID NO: 4925886 - DNA, 15 bp, Homo sapiens
agattttattttact

SEQ ID NO: 4925887 - DNA, 12 bp, Homo sapiens
agattttctggt

SEQ ID NO: 4925888 - DNA, 16 bp, Homo sapiens
agattttctggttcta

SEQ ID NO: 4925889 - DNA, 16 bp, Homo sapiens
agattttgataactgt

SEQ ID NO: 4925890 - DNA, 21 bp, Homo sapiens
agatttttcggaggccccact

SEQ ID NO: 4925891 - DNA, 13 bp, Homo sapiens
agatttttctcaa

SEQ ID NO: 4925892 - DNA, 13 bp, Homo sapiens
agattttttattg

SEQ ID NO: 4925893 - DNA, 18 bp, Homo sapiens
agattttttattgctagt

SEQ ID NO: 4925894 - DNA, 23 bp, Homo sapiens
agattttttattgctagtatttg

SEQ ID NO: 4925895 - DNA, 13 bp, Homo sapiens
agattttttttaa

SEQ ID NO: 4925896 - DNA, 12 bp, Homo sapiens
agcaaaagaaaa

SEQ ID NO: 4925897 - DNA, 15 bp, Homo sapiens
agcaaaataaaaact

SEQ ID NO: 4925898 - DNA, 16 bp, Homo sapiens
agcaaaataaaaacta

SEQ ID NO: 4925899 - DNA, 13 bp, Homo sapiens
agcaaacagagga

SEQ ID NO: 4925900 - DNA, 23 bp, Homo sapiens
agcaaaccatttttaaagtagaa

SEQ ID NO: 4925901 - DNA, 23 bp, Homo sapiens
agcaaagaggactcgcttgtaaa

SEQ ID NO: 4925902 - DNA, 23 bp, Homo sapiens
agcaaagctgatgacaacttccc

SEQ ID NO: 4925903 - DNA, 22 bp, Homo sapiens
agcaaatacttagcaaaaagtg

SEQ ID NO: 4925904 - DNA, 21 bp, Homo sapiens
agcaaatatcatactgttcaa

SEQ ID NO: 4925905 - DNA, 15 bp, Homo sapiens
agcaacacagcctgg

SEQ ID NO: 4925906 - DNA, 17 bp, Homo sapiens
agcaacacagcctgggc

SEQ ID NO: 4925907 - DNA, 22 bp, Homo sapiens
agcaacaggaatcaagagctgc

SEQ ID NO: 4925908 - DNA, 23 bp, Homo sapiens
agcaacaggaatcaagagctgcc

SEQ ID NO: 4925909 - DNA, 18 bp, Homo sapiens
agcaaccggtggatcctc

SEQ ID NO: 4925910 - DNA, 22 bp, Homo sapiens
agcaacctttcacctttgtgta

SEQ ID NO: 4925911 - DNA, 18 bp, Homo sapiens
agcaacttcttctccatc

SEQ ID NO: 4925912 - DNA, 21 bp, Homo sapiens
agcaacttcttctccatccct

SEQ ID NO: 4925913 - DNA, 16 bp, Homo sapiens
agcaagcaacacagag

SEQ ID NO: 4925914 - DNA, 14 bp, Homo sapiens
agcaagctggcctc

SEQ ID NO: 4925915 - DNA, 17 bp, Homo sapiens
agcaaggccctgctgcc

SEQ ID NO: 4925916 - DNA, 19 bp, Homo sapiens
agcaaggccctgctgccca

SEQ ID NO: 4925917 - DNA, 15 bp, Homo sapiens
agcaagtagataaat

SEQ ID NO: 4925918 - DNA, 24 bp, Homo sapiens
agcaagtgagagagatgggagctc

SEQ ID NO: 4925919 - DNA, 14 bp, Homo sapiens
agcaagtgagagct

SEQ ID NO: 4925920 - DNA, 22 bp, Homo sapiens
agcaatatattaccagcaagaa

SEQ ID NO: 4925921 - DNA, 21 bp, Homo sapiens
agcaatgacatctcaggggcc

SEQ ID NO: 4925922 - DNA, 17 bp, Homo sapiens
agcaatttaaatgttat

SEQ ID NO: 4925923 - DNA, 19 bp, Homo sapiens
agcaatttaaatgttatga

SEQ ID NO: 4925924 - DNA, 21 bp, Homo sapiens
agcaatttcttgctctatctc

SEQ ID NO: 4925925 - DNA, 14 bp, Homo sapiens
agcaattttcgaac

SEQ ID NO: 4925926 - DNA, 21 bp, Homo sapiens
agcacagataaaaagtggaat

SEQ ID NO: 4925927 - DNA, 17 bp, Homo sapiens
agcacagattttaattg

SEQ ID NO: 4925928 - DNA, 21 bp, Homo sapiens
agcacagattttaattgtcat

SEQ ID NO: 4925929 - DNA, 12 bp, Homo sapiens
agcacagcctag

SEQ ID NO: 4925930 - DNA, 16 bp, Homo sapiens
agcacagtgttaaatg

SEQ ID NO: 4925931 - DNA, 18 bp, Homo sapiens
agcacagtgttaaatgaa

SEQ ID NO: 4925932 - DNA, 17 bp, Homo sapiens
agcacagtttgaacaaa

SEQ ID NO: 4925933 - DNA, 20 bp, Homo sapiens
agcacatgctggccagcctg

SEQ ID NO: 4925934 - DNA, 21 bp, Homo sapiens
agcacatgctggccagcctgg

SEQ ID NO: 4925935 - DNA, 22 bp, Homo sapiens
agcaccaaaagcttaccaaggg

SEQ ID NO: 4925936 - DNA, 21 bp, Homo sapiens
agcacctccattaaagtctga

SEQ ID NO: 4925937 - DNA, 14 bp, Homo sapiens
agcacctcctgcct

SEQ ID NO: 4925938 - DNA, 16 bp, Homo sapiens
agcacctcctgcctcg

SEQ ID NO: 4925939 - DNA, 19 bp, Homo sapiens
agcacctccttgtcacttt

SEQ ID NO: 4925940 - DNA, 14 bp, Homo sapiens
agcacctgcctcct

SEQ ID NO: 4925941 - DNA, 14 bp, Homo sapiens
agcacctgtaagaa

SEQ ID NO: 4925942 - DNA, 14 bp, Homo sapiens
agcacggacaataa

SEQ ID NO: 4925943 - DNA, 16 bp, Homo sapiens
agcactaacgtaaata

SEQ ID NO: 4925944 - DNA, 19 bp, Homo sapiens
agcactactgggtgtcatt

SEQ ID NO: 4925945 - DNA, 15 bp, Homo sapiens
agcactaggcaccca

SEQ ID NO: 4925946 - DNA, 10 bp, Homo sapiens
agcactgaaa

SEQ ID NO: 4925947 - DNA, 11 bp, Homo sapiens
agcactgaaaa

SEQ ID NO: 4925948 - DNA, 17 bp, Homo sapiens
agcactgttgatgtatc

SEQ ID NO: 4925949 - DNA, 12 bp, Homo sapiens
agcacttccaaa

SEQ ID NO: 4925950 - DNA, 19 bp, Homo sapiens
agcacttccaaaattctta

SEQ ID NO: 4925951 - DNA, 19 bp, Homo sapiens
agcacttgtctcattttaa

SEQ ID NO: 4925952 - DNA, 19 bp, Homo sapiens
agcactttgaaatacctca

SEQ ID NO: 4925953 - DNA, 22 bp, Homo sapiens
agcagaaaactggccctgccct

SEQ ID NO: 4925954 - DNA, 22 bp, Homo sapiens
agcagaccaccccgcctgccct

SEQ ID NO: 4925955 - DNA, 16 bp, Homo sapiens
agcagagtgcacagct

SEQ ID NO: 4925956 - DNA, 19 bp, Homo sapiens
agcagatacctcaccctgc

SEQ ID NO: 4925957 - DNA, 12 bp, Homo sapiens
agcagatgcaga

SEQ ID NO: 4925958 - DNA, 16 bp, Homo sapiens
agcagatgcagagagc

SEQ ID NO: 4925959 - DNA, 21 bp, Homo sapiens
agcagatggaatgctgtgtta

SEQ ID NO: 4925960 - DNA, 15 bp, Homo sapiens
agcagcaaaaatata

SEQ ID NO: 4925961 - DNA, 16 bp, Homo sapiens
agcagcaaaaatataa

SEQ ID NO: 4925962 - DNA, 20 bp, Homo sapiens
agcagcaaaaatataaaata

SEQ ID NO: 4925963 - DNA, 12 bp, Homo sapiens
agcagcagcagg

SEQ ID NO: 4925964 - DNA, 14 bp, Homo sapiens
agcagcatcttctg

SEQ ID NO: 4925965 - DNA, 20 bp, Homo sapiens
agcagcatttttatttcaga

SEQ ID NO: 4925966 - DNA, 12 bp, Homo sapiens
agcagcccaaat

SEQ ID NO: 4925967 - DNA, 20 bp, Homo sapiens
agcagccgccttaagctgat

SEQ ID NO: 4925968 - DNA, 23 bp, Homo sapiens
agcagcctgagcaactcttgatt

SEQ ID NO: 4925969 - DNA, 23 bp, Homo sapiens
agcagcgaccgccccctcctcta

SEQ ID NO: 4925970 - DNA, 18 bp, Homo sapiens
agcagcttcaccagagca

SEQ ID NO: 4925971 - DNA, 22 bp, Homo sapiens
agcagctttaaactcagggaca

SEQ ID NO: 4925972 - DNA, 22 bp, Homo sapiens
agcaggaagcattcagagagca

SEQ ID NO: 4925973 - DNA, 14 bp, Homo sapiens
agcaggaaggcctg

SEQ ID NO: 4925974 - DNA, 16 bp, Homo sapiens
agcaggaaggcctggg

SEQ ID NO: 4925975 - DNA, 17 bp, Homo sapiens
agcaggacctcccttcc

SEQ ID NO: 4925976 - DNA, 22 bp, Homo sapiens
agcaggacctcccttccgaccc

SEQ ID NO: 4925977 - DNA, 18 bp, Homo sapiens
agcaggagattgagaagg

SEQ ID NO: 4925978 - DNA, 19 bp, Homo sapiens
agcaggagattgagaagga

SEQ ID NO: 4925979 - DNA, 21 bp, Homo sapiens
agcaggagattgagaaggaga

SEQ ID NO: 4925980 - DNA, 20 bp, Homo sapiens
agcaggcacttgattccttg

SEQ ID NO: 4925981 - DNA, 16 bp, Homo sapiens
agcagggaatttctat

SEQ ID NO: 4925982 - DNA, 15 bp, Homo sapiens
agcagggctcagcgg

SEQ ID NO: 4925983 - DNA, 20 bp, Homo sapiens
agcaggtgattggaccaggc

SEQ ID NO: 4925984 - DNA, 15 bp, Homo sapiens
agcagtacatgggaa

SEQ ID NO: 4925985 - DNA, 14 bp, Homo sapiens
agcctgcactttga

SEQ ID NO: 4925986 - DNA, 12 bp, Homo sapiens
agcctgctgcat

SEQ ID NO: 4925987 - DNA, 13 bp, Homo sapiens
agcctgctgccca

SEQ ID NO: 4925988 - DNA, 14 bp, Homo sapiens
agcctgcttcccac

SEQ ID NO: 4925989 - DNA, 22 bp, Homo sapiens
agcctgcttcccacctccctgc

SEQ ID NO: 4925990 - DNA, 20 bp, Homo sapiens
agcctggcacagggcagtgg

SEQ ID NO: 4925991 - DNA, 12 bp, Homo sapiens
agcctggctctt

SEQ ID NO: 4925992 - DNA, 18 bp, Homo sapiens
agcctgggcaacagagca

SEQ ID NO: 4925993 - DNA, 20 bp, Homo sapiens
agcctgggcaacagagcaag

SEQ ID NO: 4925994 - DNA, 20 bp, Homo sapiens
agcctgggcagcatagcaag

SEQ ID NO: 4925995 - DNA, 11 bp, Homo sapiens
agcctgggccc

SEQ ID NO: 4925996 - DNA, 16 bp, Homo sapiens
agcctgggccccagct

SEQ ID NO: 4925997 - DNA, 18 bp, Homo sapiens
agcctggggcctggcagg

SEQ ID NO: 4925998 - DNA, 21 bp, Homo sapiens
agcctgtcatccttggtcttt

SEQ ID NO: 4925999 - DNA, 21 bp, Homo sapiens
agcctgtggcatctttgcctt

SEQ ID NO: 4926000 - DNA, 14 bp, Homo sapiens
agccttacatttgt

SEQ ID NO: 4926001 - DNA, 15 bp, Homo sapiens
agccttagggaagct

SEQ ID NO: 4926002 - DNA, 22 bp, Homo sapiens
agccttagggaagctggcctga

SEQ ID NO: 4926003 - DNA, 22 bp, Homo sapiens
agccttcttccatcccaggaca

SEQ ID NO: 4926004 - DNA, 14 bp, Homo sapiens
agccttgtgtatat

SEQ ID NO: 4926005 - DNA, 20 bp, Homo sapiens
agccttgtgtatatttgtat

SEQ ID NO: 4926006 - DNA, 22 bp, Homo sapiens
agccttgtgtatatttgtatat

SEQ ID NO: 4926007 - DNA, 24 bp, Homo sapiens
agccttgtgtatatttgtatatta

SEQ ID NO: 4926008 - DNA, 18 bp, Homo sapiens
agccttttccctctttgg

SEQ ID NO: 4926009 - DNA, 23 bp, Homo sapiens
agccttttccctctttggctccc

SEQ ID NO: 4926010 - DNA, 16 bp, Homo sapiens
agcctttttaaaacac

SEQ ID NO: 4926011 - DNA, 18 bp, Homo sapiens
agcctttttaaaacacat

SEQ ID NO: 4926012 - DNA, 14 bp, Homo sapiens
agcgaaacacagag

SEQ ID NO: 4926013 - DNA, 20 bp, Homo sapiens
agcgaatgctaggtctcgga

SEQ ID NO: 4926014 - DNA, 21 bp, Homo sapiens
agcgacatagcccatccctgc

SEQ ID NO: 4926015 - DNA, 14 bp, Homo sapiens
agcgaccgccccct

SEQ ID NO: 4926016 - DNA, 15 bp, Homo sapiens
agcgaccgccccctc

SEQ ID NO: 4926017 - DNA, 16 bp, Homo sapiens
agcgaccgccccctcc

SEQ ID NO: 4926018 - DNA, 22 bp, Homo sapiens
agcgaccttcctcatccacccc

SEQ ID NO: 4926019 - DNA, 15 bp, Homo sapiens
agcgagcatccccca

SEQ ID NO: 4926020 - DNA, 16 bp, Homo sapiens
agcgagggcagctgct

SEQ ID NO: 4926021 - DNA, 20 bp, Homo sapiens
agcgatatacagatgaaaat

SEQ ID NO: 4926022 - DNA, 19 bp, Homo sapiens
agcgattcttctgcttcag

SEQ ID NO: 4926023 - DNA, 19 bp, Homo sapiens
agcgcaggtttagtttact

SEQ ID NO: 4926024 - DNA, 15 bp, Homo sapiens
agcgccaagtgcgtg

SEQ ID NO: 4926025 - DNA, 20 bp, Homo sapiens
agcgccaagtgcgtgccgtg

SEQ ID NO: 4926026 - DNA, 18 bp, Homo sapiens
agcgccagcctgtcccat

SEQ ID NO: 4926027 - DNA, 22 bp, Homo sapiens
agcgcccagttgggtggatgcc

SEQ ID NO: 4926028 - DNA, 17 bp, Homo sapiens
agcgcctgtgcacacac

SEQ ID NO: 4926029 - DNA, 19 bp, Homo sapiens
agcgcgccactcgcttccc

SEQ ID NO: 4926030 - DNA, 22 bp, Homo sapiens
agcgctcagaacagtatctttg

SEQ ID NO: 4926031 - DNA, 12 bp, Homo sapiens
agcgctctgcct

SEQ ID NO: 4926032 - DNA, 22 bp, Homo sapiens
agcggaacaaggagtcagacat

SEQ ID NO: 4926033 - DNA, 15 bp, Homo sapiens
agcggaggctgtgtg

SEQ ID NO: 4926034 - DNA, 16 bp, Homo sapiens
agcggaggctgtgtgc

SEQ ID NO: 4926035 - DNA, 13 bp, Homo sapiens
agcggatttccag

SEQ ID NO: 4926036 - DNA, 20 bp, Homo sapiens
agcggggacagctccttctg

SEQ ID NO: 4926037 - DNA, 23 bp, Homo sapiens
agcggtctcaggctggtgggagg

SEQ ID NO: 4926038 - DNA, 21 bp, Homo sapiens
agcggtggccctgtccctccc

SEQ ID NO: 4926039 - DNA, 20 bp, Homo sapiens
agcggtgggggaggagggtt

SEQ ID NO: 4926040 - DNA, 16 bp, Homo sapiens
agcgtcccagtctctg

SEQ ID NO: 4926041 - DNA, 19 bp, Homo sapiens
agcgtgagccactgcaccg

SEQ ID NO: 4926042 - DNA, 23 bp, Homo sapiens
agcgtgtctgtatttatgtgtga

SEQ ID NO: 4926043 - DNA, 17 bp, Homo sapiens
agcgttttttaaatgta

SEQ ID NO: 4926044 - DNA, 20 bp, Homo sapiens
agcgttttttaaatgtatac

SEQ ID NO: 4926045 - DNA, 18 bp, Homo sapiens
agctaaacggattccaaa

SEQ ID NO: 4926046 - DNA, 17 bp, Homo sapiens
agctaacattttaaata

SEQ ID NO: 4926047 - DNA, 18 bp, Homo sapiens
agctaagggaagacattt

SEQ ID NO: 4926048 - DNA, 19 bp, Homo sapiens
agctaagggaagacatttc

SEQ ID NO: 4926049 - DNA, 22 bp, Homo sapiens
agctaagggtgggtgctcagaa

SEQ ID NO: 4926050 - DNA, 21 bp, Homo sapiens
agctaataatgttaaccaagg

SEQ ID NO: 4926051 - DNA, 16 bp, Homo sapiens
agctaataattcttca

SEQ ID NO: 4926052 - DNA, 23 bp, Homo sapiens
agctacagagccgagcaatattt

SEQ ID NO: 4926053 - DNA, 17 bp, Homo sapiens
agctacccactatcctt

SEQ ID NO: 4926054 - DNA, 15 bp, Homo sapiens
agctacccttttcct

SEQ ID NO: 4926055 - DNA, 18 bp, Homo sapiens
agctactgcggaaaagga

SEQ ID NO: 4926056 - DNA, 23 bp, Homo sapiens
agctactgtgtgtgtgaatgaac

SEQ ID NO: 4926057 - DNA, 17 bp, Homo sapiens
agctacttaagagaaat

SEQ ID NO: 4926058 - DNA, 18 bp, Homo sapiens
agctacttaagagaaatg

SEQ ID NO: 4926059 - DNA, 16 bp, Homo sapiens
agctacttcctcctcc

SEQ ID NO: 4926060 - DNA, 21 bp, Homo sapiens
agctacttcctcctccccact

SEQ ID NO: 4926061 - DNA, 16 bp, Homo sapiens
agctacttggtttgtg

SEQ ID NO: 4926062 - DNA, 12 bp, Homo sapiens
agctaggaatga

SEQ ID NO: 4926063 - DNA, 19 bp, Homo sapiens
agctagtaatatattctga

SEQ ID NO: 4926064 - DNA, 17 bp, Homo sapiens
agctagttcgtagcttt

SEQ ID NO: 4926065 - DNA, 12 bp, Homo sapiens
agctagttttct

SEQ ID NO: 4926066 - DNA, 17 bp, Homo sapiens
agctatcgaacttcaca

SEQ ID NO: 4926067 - DNA, 15 bp, Homo sapiens
agctatctaaagttt

SEQ ID NO: 4926068 - DNA, 19 bp, Homo sapiens
agctatgggagccccaggg

SEQ ID NO: 4926069 - DNA, 14 bp, Homo sapiens
agctattaaaactc

SEQ ID NO: 4926070 - DNA, 18 bp, Homo sapiens
agctattagccaggatca

SEQ ID NO: 4926071 - DNA, 18 bp, Homo sapiens
agctattcctttcccttc

SEQ ID NO: 4926072 - DNA, 17 bp, Homo sapiens
agctcaaataaaaataa

SEQ ID NO: 4926073 - DNA, 18 bp, Homo sapiens
agctcacagtgctgtgtg

SEQ ID NO: 4926074 - DNA, 23 bp, Homo sapiens
agctcaccagccccagtgcccac

SEQ ID NO: 4926075 - DNA, 17 bp, Homo sapiens
agctcagaacccagggc

SEQ ID NO: 4926076 - DNA, 21 bp, Homo sapiens
agctcagctactgatttttgt

SEQ ID NO: 4926077 - DNA, 16 bp, Homo sapiens
agctcaggggcagctc

SEQ ID NO: 4926078 - DNA, 17 bp, Homo sapiens
agctcaggggcagctca

SEQ ID NO: 4926079 - DNA, 17 bp, Homo sapiens
agctcaggtgtccctgc

SEQ ID NO: 4926080 - DNA, 18 bp, Homo sapiens
agctcaggtgtccctgca

SEQ ID NO: 4926081 - DNA, 20 bp, Homo sapiens
agctcaggtgtccctgcact

SEQ ID NO: 4926082 - DNA, 21 bp, Homo sapiens
agctccactgtcaccctccac

SEQ ID NO: 4926083 - DNA, 23 bp, Homo sapiens
agctccactgtcaccctccacct

SEQ ID NO: 4926084 - DNA, 19 bp, Homo sapiens
agctccagctcaccagccc

SEQ ID NO: 4926085 - DNA, 21 bp, Homo sapiens
agctccagggaatccaagcct

SEQ ID NO: 4926086 - DNA, 13 bp, Homo sapiens
agctccctgcccc

SEQ ID NO: 4926087 - DNA, 16 bp, Homo sapiens
agctccgcctctgtcc

SEQ ID NO: 4926088 - DNA, 12 bp, Homo sapiens
agctcctcccac

SEQ ID NO: 4926089 - DNA, 16 bp, Homo sapiens
agctcctctcctggag

SEQ ID NO: 4926090 - DNA, 17 bp, Homo sapiens
agctcctctcctggagg

SEQ ID NO: 4926091 - DNA, 21 bp, Homo sapiens
agctcctctgtcctgcttctg

SEQ ID NO: 4926092 - DNA, 22 bp, Homo sapiens
agctcctggggcgtccaggccg

SEQ ID NO: 4926093 - DNA, 11 bp, Homo sapiens
agctcctgtaa

SEQ ID NO: 4926094 - DNA, 22 bp, Homo sapiens
aggagattgagaaggagagaaa

SEQ ID NO: 4926095 - DNA, 17 bp, Homo sapiens
aggagccccgaggcctt

SEQ ID NO: 4926096 - DNA, 13 bp, Homo sapiens
aggagccctcatc

SEQ ID NO: 4926097 - DNA, 22 bp, Homo sapiens
aggagcctgctggtcacagcct

SEQ ID NO: 4926098 - DNA, 16 bp, Homo sapiens
aggagcctttttaaaa

SEQ ID NO: 4926099 - DNA, 22 bp, Homo sapiens
aggagctacccttttcctttgt

SEQ ID NO: 4926100 - DNA, 13 bp, Homo sapiens
aggagctgctggc

SEQ ID NO: 4926101 - DNA, 14 bp, Homo sapiens
aggagctgctggct

SEQ ID NO: 4926102 - DNA, 17 bp, Homo sapiens
aggagctgctggcttgc

SEQ ID NO: 4926103 - DNA, 15 bp, Homo sapiens
aggaggatgtccctg

SEQ ID NO: 4926104 - DNA, 15 bp, Homo sapiens
aggaggcctccatct

SEQ ID NO: 4926105 - DNA, 20 bp, Homo sapiens
aggaggcgcccttggcttct

SEQ ID NO: 4926106 - DNA, 17 bp, Homo sapiens
aggaggctgaggcagga

SEQ ID NO: 4926107 - DNA, 14 bp, Homo sapiens
aggagggcatccat

SEQ ID NO: 4926108 - DNA, 22 bp, Homo sapiens
aggagggcatccataccagctc

SEQ ID NO: 4926109 - DNA, 14 bp, Homo sapiens
aggaggggaagctg

SEQ ID NO: 4926110 - DNA, 15 bp, Homo sapiens
aggagggtacagctg

SEQ ID NO: 4926111 - DNA, 17 bp, Homo sapiens
aggagggtacagctggg

SEQ ID NO: 4926112 - DNA, 19 bp, Homo sapiens
aggagggtacagctgggct

SEQ ID NO: 4926113 - DNA, 23 bp, Homo sapiens
aggagtgggtgacaagagcctga

SEQ ID NO: 4926114 - DNA, 16 bp, Homo sapiens
aggagtttgagaccag

SEQ ID NO: 4926115 - DNA, 23 bp, Homo sapiens
aggatatccttatcagagctaag

SEQ ID NO: 4926116 - DNA, 15 bp, Homo sapiens
aggatcagttaacta

SEQ ID NO: 4926117 - DNA, 19 bp, Homo sapiens
aggatgaatgaggtcccag

SEQ ID NO: 4926118 - DNA, 15 bp, Homo sapiens
aggatgagagcccag

SEQ ID NO: 4926119 - DNA, 23 bp, Homo sapiens
aggatgagagcccagaggtaaca

SEQ ID NO: 4926120 - DNA, 14 bp, Homo sapiens
aggatgctgggtgg

SEQ ID NO: 4926121 - DNA, 15 bp, Homo sapiens
aggatgctgggtggc

SEQ ID NO: 4926122 - DNA, 19 bp, Homo sapiens
aggatgggggctggcctct

SEQ ID NO: 4926123 - DNA, 21 bp, Homo sapiens
aggatgtccctgggccagggt

SEQ ID NO: 4926124 - DNA, 23 bp, Homo sapiens
aggatgtccctgggccagggtct

SEQ ID NO: 4926125 - DNA, 20 bp, Homo sapiens
aggatgtgattgtggaatgg

SEQ ID NO: 4926126 - DNA, 16 bp, Homo sapiens
aggatgttctgggaca

SEQ ID NO: 4926127 - DNA, 20 bp, Homo sapiens
aggatgttctgggacacagt

SEQ ID NO: 4926128 - DNA, 13 bp, Homo sapiens
aggattattgata

SEQ ID NO: 4926129 - DNA, 12 bp, Homo sapiens
aggattctaaaa

SEQ ID NO: 4926130 - DNA, 17 bp, Homo sapiens
aggattgctactgtcct

SEQ ID NO: 4926131 - DNA, 22 bp, Homo sapiens
aggattgctactgtcctaccca

SEQ ID NO: 4926132 - DNA, 14 bp, Homo sapiens
aggattgctatctg

SEQ ID NO: 4926133 - DNA, 20 bp, Homo sapiens
aggattgttgaatctatttc

SEQ ID NO: 4926134 - DNA, 19 bp, Homo sapiens
aggatttaaaaactggaac

SEQ ID NO: 4926135 - DNA, 19 bp, Homo sapiens
aggattttgatccaagctg

SEQ ID NO: 4926136 - DNA, 19 bp, Homo sapiens
aggcaaaatccttgcttat

SEQ ID NO: 4926137 - DNA, 19 bp, Homo sapiens
aggcaaaattgcaaatctt

SEQ ID NO: 4926138 - DNA, 17 bp, Homo sapiens
aggcaaatgtgtacatg

SEQ ID NO: 4926139 - DNA, 19 bp, Homo sapiens
aggcaacctgattgtaaac

SEQ ID NO: 4926140 - DNA, 17 bp, Homo sapiens
aggcaacttcagtcctg

SEQ ID NO: 4926141 - DNA, 19 bp, Homo sapiens
aggcaacttcagtcctggg

SEQ ID NO: 4926142 - DNA, 22 bp, Homo sapiens
aggcaacttcagtcctgggaga

SEQ ID NO: 4926143 - DNA, 18 bp, Homo sapiens
aggcaagcaagctctctt

SEQ ID NO: 4926144 - DNA, 19 bp, Homo sapiens
aggcaagttaagagaaact

SEQ ID NO: 4926145 - DNA, 14 bp, Homo sapiens
aggcaatgctggct

SEQ ID NO: 4926146 - DNA, 16 bp, Homo sapiens
aggcaatgctggctgt

SEQ ID NO: 4926147 - DNA, 23 bp, Homo sapiens
aggcaatgtcaggaacagaagga

SEQ ID NO: 4926148 - DNA, 14 bp, Homo sapiens
aggcacagctgagt

SEQ ID NO: 4926149 - DNA, 13 bp, Homo sapiens
aggcactagcctt

SEQ ID NO: 4926150 - DNA, 23 bp, Homo sapiens
aggcactagcctttggctctgga

SEQ ID NO: 4926151 - DNA, 14 bp, Homo sapiens
aggcactctagatt

SEQ ID NO: 4926152 - DNA, 15 bp, Homo sapiens
aggcactctagattc

SEQ ID NO: 4926153 - DNA, 17 bp, Homo sapiens
aggcactctagattcca

SEQ ID NO: 4926154 - DNA, 14 bp, Homo sapiens
aggcactcttaaat

SEQ ID NO: 4926155 - DNA, 19 bp, Homo sapiens
aggcactgtagttctaaga

SEQ ID NO: 4926156 - DNA, 21 bp, Homo sapiens
aggcactgtagttctaagact

SEQ ID NO: 4926157 - DNA, 16 bp, Homo sapiens
aggcacttattgtaaa

SEQ ID NO: 4926158 - DNA, 23 bp, Homo sapiens
aggcagacagcaggcagcgccaa

SEQ ID NO: 4926159 - DNA, 18 bp, Homo sapiens
aggcagactacacaggat

SEQ ID NO: 4926160 - DNA, 22 bp, Homo sapiens
aggcagagaatcatacttagca

SEQ ID NO: 4926161 - DNA, 15 bp, Homo sapiens
aggcagatctgtgcc

SEQ ID NO: 4926162 - DNA, 15 bp, Homo sapiens
aggcagccagtgaga

SEQ ID NO: 4926163 - DNA, 16 bp, Homo sapiens
aggcagccccattctg

SEQ ID NO: 4926164 - DNA, 17 bp, Homo sapiens
aggcagccccattctgc

SEQ ID NO: 4926165 - DNA, 15 bp, Homo sapiens
aggcagccctgccat

SEQ ID NO: 4926166 - DNA, 17 bp, Homo sapiens
aggcaggaagggcagga

SEQ ID NO: 4926167 - DNA, 22 bp, Homo sapiens
aggcaggccaaggccttctcct

SEQ ID NO: 4926168 - DNA, 16 bp, Homo sapiens
aggcagggcaaatgac

SEQ ID NO: 4926169 - DNA, 19 bp, Homo sapiens
aggcagggtctcactctgt

SEQ ID NO: 4926170 - DNA, 20 bp, Homo sapiens
aggcagggtctcactctgtc

SEQ ID NO: 4926171 - DNA, 21 bp, Homo sapiens
aggcagggtctcactctgtcg

SEQ ID NO: 4926172 - DNA, 16 bp, Homo sapiens
aggcaggtagccaggg

SEQ ID NO: 4926173 - DNA, 22 bp, Homo sapiens
aggcatctctgtactttgcttg

SEQ ID NO: 4926174 - DNA, 21 bp, Homo sapiens
aggcatgaagagcaaaaatat

SEQ ID NO: 4926175 - DNA, 18 bp, Homo sapiens
aggcatgcctctgatatg

SEQ ID NO: 4926176 - DNA, 21 bp, Homo sapiens
aggcatgcctctgatatggga

SEQ ID NO: 4926177 - DNA, 21 bp, Homo sapiens
aggcatggccctggggtccca

SEQ ID NO: 4926178 - DNA, 21 bp, Homo sapiens
aggcatgggtgcaaggaaaat

SEQ ID NO: 4926179 - DNA, 17 bp, Homo sapiens
aggcatgtaggaccctg

SEQ ID NO: 4926180 - DNA, 14 bp, Homo sapiens
aggcatgtcctgga

SEQ ID NO: 4926181 - DNA, 17 bp, Homo sapiens
aggcatgttctctgagg

SEQ ID NO: 4926182 - DNA, 16 bp, Homo sapiens
aggcattaatgtttct

SEQ ID NO: 4926183 - DNA, 20 bp, Homo sapiens
aggcattaatgtttctatct

SEQ ID NO: 4926184 - DNA, 14 bp, Homo sapiens
aggcattgaggaag

SEQ ID NO: 4926185 - DNA, 13 bp, Homo sapiens
aggccaaactgct

SEQ ID NO: 4926186 - DNA, 18 bp, Homo sapiens
aggccaagtcaggccctt

SEQ ID NO: 4926187 - DNA, 16 bp, Homo sapiens
aggccagagtggcctg

SEQ ID NO: 4926188 - DNA, 13 bp, Homo sapiens
aggccagccccac

SEQ ID NO: 4926189 - DNA, 16 bp, Homo sapiens
aggccagccccaccca

SEQ ID NO: 4926190 - DNA, 11 bp, Homo sapiens
aggccaggagt

SEQ ID NO: 4926191 - DNA, 19 bp, Homo sapiens
aggccatgaaaaaaatgat

SEQ ID NO: 4926192 - DNA, 18 bp, Homo sapiens
aggccatgggcctcctgt

SEQ ID NO: 4926193 - DNA, 16 bp, Homo sapiens
aggccattctgccgcc

SEQ ID NO: 4926194 - DNA, 13 bp, Homo sapiens
aggcccagcccct

SEQ ID NO: 4926195 - DNA, 19 bp, Homo sapiens
aggccccactgatgctgtt

SEQ ID NO: 4926196 - DNA, 15 bp, Homo sapiens
aggcccctgccaccc

SEQ ID NO: 4926197 - DNA, 17 bp, Homo sapiens
aggcccctggacaagca

SEQ ID NO: 4926198 - DNA, 18 bp, Homo sapiens
aggccccttctctccctg

SEQ ID NO: 4926199 - DNA, 15 bp, Homo sapiens
aggcccggctccagg

SEQ ID NO: 4926200 - DNA, 15 bp, Homo sapiens
aggccctcctgtgct

SEQ ID NO: 4926201 - DNA, 17 bp, Homo sapiens
aggccctcctgtgctgg

SEQ ID NO: 4926202 - DNA, 11 bp, Homo sapiens
aggccctgcag

SEQ ID NO: 4926203 - DNA, 12 bp, Homo sapiens
aggccctgcagt

SEQ ID NO: 4926204 - DNA, 22 bp, Homo sapiens
agggcagtgctagtgagctggg

SEQ ID NO: 4926205 - DNA, 19 bp, Homo sapiens
agggcataaaacagctttg

SEQ ID NO: 4926206 - DNA, 23 bp, Homo sapiens
agggccaacttgagggcccagag

SEQ ID NO: 4926207 - DNA, 12 bp, Homo sapiens
agggccaggact

SEQ ID NO: 4926208 - DNA, 19 bp, Homo sapiens
agggccaggactgagcccc

SEQ ID NO: 4926209 - DNA, 10 bp, Homo sapiens
agggccaggc

SEQ ID NO: 4926210 - DNA, 16 bp, Homo sapiens
agggccagtcctgcct

SEQ ID NO: 4926211 - DNA, 19 bp, Homo sapiens
agggccagtcctgcctggc

SEQ ID NO: 4926212 - DNA, 22 bp, Homo sapiens
agggccagtcctgcctggccag

SEQ ID NO: 4926213 - DNA, 15 bp, Homo sapiens
agggccagtggggcc

SEQ ID NO: 4926214 - DNA, 23 bp, Homo sapiens
agggccagtggggcctgtggaat

SEQ ID NO: 4926215 - DNA, 15 bp, Homo sapiens
agggcccacttgtat

SEQ ID NO: 4926216 - DNA, 11 bp, Homo sapiens
agggcccagag

SEQ ID NO: 4926217 - DNA, 14 bp, Homo sapiens
agggcccagagagg

SEQ ID NO: 4926218 - DNA, 12 bp, Homo sapiens
agggcccagagc

SEQ ID NO: 4926219 - DNA, 20 bp, Homo sapiens
agggccgaggaggtgcctgg

SEQ ID NO: 4926220 - DNA, 21 bp, Homo sapiens
agggccgaggaggtgcctgga

SEQ ID NO: 4926221 - DNA, 20 bp, Homo sapiens
agggcctcaaaggcccgctc

SEQ ID NO: 4926222 - DNA, 20 bp, Homo sapiens
agggcctggggcctgagaga

SEQ ID NO: 4926223 - DNA, 22 bp, Homo sapiens
agggcctggggcctgagagaat

SEQ ID NO: 4926224 - DNA, 21 bp, Homo sapiens
agggctactgcagctttacat

SEQ ID NO: 4926225 - DNA, 16 bp, Homo sapiens
agggctagcatccctg

SEQ ID NO: 4926226 - DNA, 19 bp, Homo sapiens
agggctcagcggggacagc

SEQ ID NO: 4926227 - DNA, 23 bp, Homo sapiens
agggctcagcggggacagctcct

SEQ ID NO: 4926228 - DNA, 16 bp, Homo sapiens
agggctctcttaggca

SEQ ID NO: 4926229 - DNA, 16 bp, Homo sapiens
agggctctgccccagt

SEQ ID NO: 4926230 - DNA, 16 bp, Homo sapiens
agggctgacctgcctc

SEQ ID NO: 4926231 - DNA, 19 bp, Homo sapiens
agggctgacctgcctctca

SEQ ID NO: 4926232 - DNA, 13 bp, Homo sapiens
agggctgccctga

SEQ ID NO: 4926233 - DNA, 23 bp, Homo sapiens
agggctgccctgagaagctgctc

SEQ ID NO: 4926234 - DNA, 14 bp, Homo sapiens
agggctggccccag

SEQ ID NO: 4926235 - DNA, 20 bp, Homo sapiens
agggctgggcaaggaaaaag

SEQ ID NO: 4926236 - DNA, 15 bp, Homo sapiens
aggggaacctgccat

SEQ ID NO: 4926237 - DNA, 12 bp, Homo sapiens
aggggaagctgc

SEQ ID NO: 4926238 - DNA, 17 bp, Homo sapiens
aggggacaggcctcacc

SEQ ID NO: 4926239 - DNA, 19 bp, Homo sapiens
aggggacaggcctcacctc

SEQ ID NO: 4926240 - DNA, 17 bp, Homo sapiens
aggggactcagccctga

SEQ ID NO: 4926241 - DNA, 13 bp, Homo sapiens
aggggatatttaa

SEQ ID NO: 4926242 - DNA, 14 bp, Homo sapiens
aggggatatttaag

SEQ ID NO: 4926243 - DNA, 19 bp, Homo sapiens
aggggcacttcattgagag

SEQ ID NO: 4926244 - DNA, 16 bp, Homo sapiens
aggggcatctgcccct

SEQ ID NO: 4926245 - DNA, 22 bp, Homo sapiens
aggggccagaggaactgtccag

SEQ ID NO: 4926246 - DNA, 13 bp, Homo sapiens
aggggcctggcag

SEQ ID NO: 4926247 - DNA, 15 bp, Homo sapiens
aggggcctggcagcc

SEQ ID NO: 4926248 - DNA, 23 bp, Homo sapiens
aggggcctggcagccgtgccttc

SEQ ID NO: 4926249 - DNA, 15 bp, Homo sapiens
aggggctacaagagg

SEQ ID NO: 4926250 - DNA, 21 bp, Homo sapiens
aggggcttataataaaggact

SEQ ID NO: 4926251 - DNA, 15 bp, Homo sapiens
agggggaagaagcag

SEQ ID NO: 4926252 - DNA, 22 bp, Homo sapiens
agggggactgctgctgcctggc

SEQ ID NO: 4926253 - DNA, 20 bp, Homo sapiens
agggggagaaaaggaaaaga

SEQ ID NO: 4926254 - DNA, 16 bp, Homo sapiens
aggggtcaaagaaatg

SEQ ID NO: 4926255 - DNA, 15 bp, Homo sapiens
aggggtcccagccac

SEQ ID NO: 4926256 - DNA, 18 bp, Homo sapiens
aggggttggggtgacagt

SEQ ID NO: 4926257 - DNA, 13 bp, Homo sapiens
agggtacagctgg

SEQ ID NO: 4926258 - DNA, 19 bp, Homo sapiens
agggtatcaggtgctgcca

SEQ ID NO: 4926259 - DNA, 21 bp, Homo sapiens
agggtatcaggtgctgccatc

SEQ ID NO: 4926260 - DNA, 19 bp, Homo sapiens
agggtcctggctcctgagg

SEQ ID NO: 4926261 - DNA, 16 bp, Homo sapiens
agggtcgaaagctcta

SEQ ID NO: 4926262 - DNA, 20 bp, Homo sapiens
agggtctcactatgttgccc

SEQ ID NO: 4926263 - DNA, 12 bp, Homo sapiens
agggtctctccc

SEQ ID NO: 4926264 - DNA, 16 bp, Homo sapiens
agggtctctccctcag

SEQ ID NO: 4926265 - DNA, 17 bp, Homo sapiens
agggtcttccctacctc

SEQ ID NO: 4926266 - DNA, 16 bp, Homo sapiens
agggtggacttagaaa

SEQ ID NO: 4926267 - DNA, 22 bp, Homo sapiens
agggtggacttagaaagcaggg

SEQ ID NO: 4926268 - DNA, 11 bp, Homo sapiens
agggtggccct

SEQ ID NO: 4926269 - DNA, 18 bp, Homo sapiens
agggtggcccttgcagtt

SEQ ID NO: 4926270 - DNA, 17 bp, Homo sapiens
agggtgggggccacctg

SEQ ID NO: 4926271 - DNA, 18 bp, Homo sapiens
agggtgggggccacctgc

SEQ ID NO: 4926272 - DNA, 20 bp, Homo sapiens
agggtgggggccacctgcct

SEQ ID NO: 4926273 - DNA, 17 bp, Homo sapiens
agggtgggtgctcagaa

SEQ ID NO: 4926274 - DNA, 20 bp, Homo sapiens
agggtgggtgctcagaataa

SEQ ID NO: 4926275 - DNA, 15 bp, Homo sapiens
agggttgctggagcc

SEQ ID NO: 4926276 - DNA, 14 bp, Homo sapiens
agggttggcccctg

SEQ ID NO: 4926277 - DNA, 17 bp, Homo sapiens
agggttggcccctgccc

SEQ ID NO: 4926278 - DNA, 22 bp, Homo sapiens
agggttttgccatgttggccag

SEQ ID NO: 4926279 - DNA, 14 bp, Homo sapiens
aggtaaaatgtatt

SEQ ID NO: 4926280 - DNA, 12 bp, Homo sapiens
aggtaaagatat

SEQ ID NO: 4926281 - DNA, 15 bp, Homo sapiens
aggtaacagaacagc

SEQ ID NO: 4926282 - DNA, 18 bp, Homo sapiens
aggtaacagaacagcttc

SEQ ID NO: 4926283 - DNA, 14 bp, Homo sapiens
aggtaacaggcaga

SEQ ID NO: 4926284 - DNA, 18 bp, Homo sapiens
aggtaatcaatgaatatt

SEQ ID NO: 4926285 - DNA, 23 bp, Homo sapiens
aggtaatttttaccctaatgtct

SEQ ID NO: 4926286 - DNA, 18 bp, Homo sapiens
aggtacagggtttttacc

SEQ ID NO: 4926287 - DNA, 17 bp, Homo sapiens
aggtacccctttctggc

SEQ ID NO: 4926288 - DNA, 12 bp, Homo sapiens
aggtagaaactt

SEQ ID NO: 4926289 - DNA, 18 bp, Homo sapiens
aggtagagccacaaaaga

SEQ ID NO: 4926290 - DNA, 17 bp, Homo sapiens
aggtatattggaagagg

SEQ ID NO: 4926291 - DNA, 22 bp, Homo sapiens
aggtatggaagggtttgtggct

SEQ ID NO: 4926292 - DNA, 23 bp, Homo sapiens
aggtatggctctgcacccctctg

SEQ ID NO: 4926293 - DNA, 14 bp, Homo sapiens
aggtatgttgcctt

SEQ ID NO: 4926294 - DNA, 18 bp, Homo sapiens
aggtattattatctttaa

SEQ ID NO: 4926295 - DNA, 15 bp, Homo sapiens
aggtcacataaaact

SEQ ID NO: 4926296 - DNA, 19 bp, Homo sapiens
aggtcagactaagaaatat

SEQ ID NO: 4926297 - DNA, 13 bp, Homo sapiens
aggtcagagcctg

SEQ ID NO: 4926298 - DNA, 15 bp, Homo sapiens
aggtccacaggtcta

SEQ ID NO: 4926299 - DNA, 15 bp, Homo sapiens
aggtccagcccatct

SEQ ID NO: 4926300 - DNA, 14 bp, Homo sapiens
aggtcccacctcca

SEQ ID NO: 4926301 - DNA, 15 bp, Homo sapiens
aggtcccacctccag

SEQ ID NO: 4926302 - DNA, 16 bp, Homo sapiens
aggtcccacctccagc

SEQ ID NO: 4926303 - DNA, 18 bp, Homo sapiens
aggtcccacctccagccc

SEQ ID NO: 4926304 - DNA, 13 bp, Homo sapiens
aggtcccaggcag

SEQ ID NO: 4926305 - DNA, 19 bp, Homo sapiens
aggtccggtgttctaagat

SEQ ID NO: 4926306 - DNA, 16 bp, Homo sapiens
aggtcctacagggcca

SEQ ID NO: 4926307 - DNA, 21 bp, Homo sapiens
aggtcgaccccaaagcccctt

SEQ ID NO: 4926308 - DNA, 13 bp, Homo sapiens
aggtctcacgggc

SEQ ID NO: 4926309 - DNA, 19 bp, Homo sapiens
aggtctcttctcccagaat

SEQ ID NO: 4926310 - DNA, 18 bp, Homo sapiens
aggtctgagccacagcag

SEQ ID NO: 4926311 - DNA, 23 bp, Homo sapiens
aggtctgagccacagcagcattt

SEQ ID NO: 4926312 - DNA, 21 bp, Homo sapiens
aggtctgggctaggtagaaaa

SEQ ID NO: 4926313 - DNA, 20 bp, Homo sapiens
aggtctgtttaaagtggcaa

SEQ ID NO: 4926314 - DNA, 17 bp, Homo sapiens
agtctttaaaggcccag

SEQ ID NO: 4926315 - DNA, 20 bp, Homo sapiens
agtctttaaaggcccagccc

SEQ ID NO: 4926316 - DNA, 12 bp, Homo sapiens
agtctttggggt

SEQ ID NO: 4926317 - DNA, 15 bp, Homo sapiens
agtctttggttctaa

SEQ ID NO: 4926318 - DNA, 17 bp, Homo sapiens
agtcttttgttcgcatg

SEQ ID NO: 4926319 - DNA, 18 bp, Homo sapiens
agtctttttctgttgtaa

SEQ ID NO: 4926320 - DNA, 20 bp, Homo sapiens
agtctttttctgttgtaact

SEQ ID NO: 4926321 - DNA, 20 bp, Homo sapiens
agtgaaataacaaaatggac

SEQ ID NO: 4926322 - DNA, 20 bp, Homo sapiens
agtgaactacgcttgctcat

SEQ ID NO: 4926323 - DNA, 16 bp, Homo sapiens
agtgaagactggaagc

SEQ ID NO: 4926324 - DNA, 14 bp, Homo sapiens
agtgaataaacttc

SEQ ID NO: 4926325 - DNA, 15 bp, Homo sapiens
agtgaataaacttca

SEQ ID NO: 4926326 - DNA, 18 bp, Homo sapiens
agtgaataaacttcagca

SEQ ID NO: 4926327 - DNA, 21 bp, Homo sapiens
agtgaataaacttcagcacca

SEQ ID NO: 4926328 - DNA, 13 bp, Homo sapiens
agtgaatgaaaga

SEQ ID NO: 4926329 - DNA, 15 bp, Homo sapiens
agtgaatgaaagatt

SEQ ID NO: 4926330 - DNA, 13 bp, Homo sapiens
agtgacacagcag

SEQ ID NO: 4926331 - DNA, 21 bp, Homo sapiens
agtgacagaccacatctttat

SEQ ID NO: 4926332 - DNA, 19 bp, Homo sapiens
agtgacagtggattgcatt

SEQ ID NO: 4926333 - DNA, 20 bp, Homo sapiens
agtgagaaaaagctcctgtc

SEQ ID NO: 4926334 - DNA, 16 bp, Homo sapiens
agtgagacaaaatttt

SEQ ID NO: 4926335 - DNA, 19 bp, Homo sapiens
agtgagacaaaattttagt

SEQ ID NO: 4926336 - DNA, 14 bp, Homo sapiens
agtgagagctgggt

SEQ ID NO: 4926337 - DNA, 14 bp, Homo sapiens
agtgagatgaggga

SEQ ID NO: 4926338 - DNA, 13 bp, Homo sapiens
agtgagcctggct

SEQ ID NO: 4926339 - DNA, 15 bp, Homo sapiens
agtgagcctggctct

SEQ ID NO: 4926340 - DNA, 16 bp, Homo sapiens
agtgagctacagagcc

SEQ ID NO: 4926341 - DNA, 15 bp, Homo sapiens
agtgagtcgaggaca

SEQ ID NO: 4926342 - DNA, 14 bp, Homo sapiens
agtgagtctgtcag

SEQ ID NO: 4926343 - DNA, 14 bp, Homo sapiens
agtgatatggcaga

SEQ ID NO: 4926344 - DNA, 15 bp, Homo sapiens
agtgatcctcccacc

SEQ ID NO: 4926345 - DNA, 19 bp, Homo sapiens
agtgatcctcccacctcag

SEQ ID NO: 4926346 - DNA, 24 bp, Homo sapiens
agtgatcctcccacctcagcctcc

SEQ ID NO: 4926347 - DNA, 17 bp, Homo sapiens
agtgatgtttttatgat

SEQ ID NO: 4926348 - DNA, 17 bp, Homo sapiens
agtgattctcctgcctc

SEQ ID NO: 4926349 - DNA, 18 bp, Homo sapiens
agtgattctcctgcctca

SEQ ID NO: 4926350 - DNA, 22 bp, Homo sapiens
agtgattctcctgcctcagcct

SEQ ID NO: 4926351 - DNA, 20 bp, Homo sapiens
agtgattgcagctttatgtt

SEQ ID NO: 4926352 - DNA, 17 bp, Homo sapiens
agtgcacaaaatgaatg

SEQ ID NO: 4926353 - DNA, 19 bp, Homo sapiens
agtgcacacagaaatatat

SEQ ID NO: 4926354 - DNA, 14 bp, Homo sapiens
agtgcactttctaa

SEQ ID NO: 4926355 - DNA, 15 bp, Homo sapiens
agtgcatctcagccc

SEQ ID NO: 4926356 - DNA, 12 bp, Homo sapiens
agtgcatttctg

SEQ ID NO: 4926357 - DNA, 12 bp, Homo sapiens
agtgccaaggac

SEQ ID NO: 4926358 - DNA, 22 bp, Homo sapiens
agtgccaaggacctcctcttcc

SEQ ID NO: 4926359 - DNA, 16 bp, Homo sapiens
agtgcccaccctggga

SEQ ID NO: 4926360 - DNA, 18 bp, Homo sapiens
agtgcccaccctgggaga

SEQ ID NO: 4926361 - DNA, 13 bp, Homo sapiens
agtgcgtgtgtag

SEQ ID NO: 4926362 - DNA, 13 bp, Homo sapiens
agtgctaaggttc

SEQ ID NO: 4926363 - DNA, 17 bp, Homo sapiens
agtgctaaggttctaag

SEQ ID NO: 4926364 - DNA, 21 bp, Homo sapiens
agtgctaaggttctaaggcct

SEQ ID NO: 4926365 - DNA, 17 bp, Homo sapiens
agtgctacataaattgg

SEQ ID NO: 4926366 - DNA, 21 bp, Homo sapiens
agtgctagtgagctgggcatg

SEQ ID NO: 4926367 - DNA, 14 bp, Homo sapiens
agtgctatatatat

SEQ ID NO: 4926368 - DNA, 15 bp, Homo sapiens
agtgctgagattaca

SEQ ID NO: 4926369 - DNA, 21 bp, Homo sapiens
agtgctgagattacaggcatg

SEQ ID NO: 4926370 - DNA, 22 bp, Homo sapiens
agtgctgcatcttatagcactt

SEQ ID NO: 4926371 - DNA, 15 bp, Homo sapiens
agtgctggctcacag

SEQ ID NO: 4926372 - DNA, 21 bp, Homo sapiens
agtgctgggattacaggtgtg

SEQ ID NO: 4926373 - DNA, 19 bp, Homo sapiens
agtgctgtccatgcttctc

SEQ ID NO: 4926374 - DNA, 22 bp, Homo sapiens
agtgctgtccatgcttctcatc

SEQ ID NO: 4926375 - DNA, 16 bp, Homo sapiens
agtgcttttctgttta

SEQ ID NO: 4926376 - DNA, 14 bp, Homo sapiens
agtggaaaaacaca

SEQ ID NO: 4926377 - DNA, 16 bp, Homo sapiens
agtggaaacatttata

SEQ ID NO: 4926378 - DNA, 17 bp, Homo sapiens
agtggaatttcttgttt

SEQ ID NO: 4926379 - DNA, 16 bp, Homo sapiens
agtggactggcccctg

SEQ ID NO: 4926380 - DNA, 17 bp, Homo sapiens
agtggactggcccctgg

SEQ ID NO: 4926381 - DNA, 22 bp, Homo sapiens
agtggcatgttttgtgcatttg

SEQ ID NO: 4926382 - DNA, 14 bp, Homo sapiens
agtggccactcagc

SEQ ID NO: 4926383 - DNA, 17 bp, Homo sapiens
agtggctcctcccggtg

SEQ ID NO: 4926384 - DNA, 21 bp, Homo sapiens
agtggctcctcccggtgccca

SEQ ID NO: 4926385 - DNA, 20 bp, Homo sapiens
agtgggatctgtcacaccag

SEQ ID NO: 4926386 - DNA, 12 bp, Homo sapiens
agtgggccaggg

SEQ ID NO: 4926387 - DNA, 15 bp, Homo sapiens
agtgggccagggctg

SEQ ID NO: 4926388 - DNA, 16 bp, Homo sapiens
agtgggcttgattctg

SEQ ID NO: 4926389 - DNA, 14 bp, Homo sapiens
agtggggcctgtgg

SEQ ID NO: 4926390 - DNA, 18 bp, Homo sapiens
agtgggtgacaagagcct

SEQ ID NO: 4926391 - DNA, 16 bp, Homo sapiens
agtgggttattctgga

SEQ ID NO: 4926392 - DNA, 19 bp, Homo sapiens
agtgggttattctggagtt

SEQ ID NO: 4926393 - DNA, 20 bp, Homo sapiens
agtggtctttgtaagagtgt

SEQ ID NO: 4926394 - DNA, 14 bp, Homo sapiens
agtggtgcagacag

SEQ ID NO: 4926395 - DNA, 15 bp, Homo sapiens
agtgtaataatatga

SEQ ID NO: 4926396 - DNA, 13 bp, Homo sapiens
agtgtacctgtgt

SEQ ID NO: 4926397 - DNA, 20 bp, Homo sapiens
agtgtacctgtgtacataac

SEQ ID NO: 4926398 - DNA, 18 bp, Homo sapiens
agtgtagaagcattcctt

SEQ ID NO: 4926399 - DNA, 20 bp, Homo sapiens
agtgtagaagcattccttct

SEQ ID NO: 4926400 - DNA, 22 bp, Homo sapiens
agtgtagaagcattccttcttt

SEQ ID NO: 4926401 - DNA, 14 bp, Homo sapiens
agtgtatatcagaa

SEQ ID NO: 4926402 - DNA, 16 bp, Homo sapiens
agtgtatggaaataaa

SEQ ID NO: 4926403 - DNA, 21 bp, Homo sapiens
agtgtcccctccactgtcaca

SEQ ID NO: 4926404 - DNA, 14 bp, Homo sapiens
agtgtctaaaaaca

SEQ ID NO: 4926405 - DNA, 14 bp, Homo sapiens
agtgtgacagggcc

SEQ ID NO: 4926406 - DNA, 14 bp, Homo sapiens
agtgtggactctgg

SEQ ID NO: 4926407 - DNA, 20 bp, Homo sapiens
agtgtggctgaggaggcctc

SEQ ID NO: 4926408 - DNA, 16 bp, Homo sapiens
agtgtgtgtgtgcatg

SEQ ID NO: 4926409 - DNA, 21 bp, Homo sapiens
agtgttatttttcaaggaagg

SEQ ID NO: 4926410 - DNA, 18 bp, Homo sapiens
agtgttctgccagatctt

SEQ ID NO: 4926411 - DNA, 16 bp, Homo sapiens
agtgttgaaaatgttc

SEQ ID NO: 4926412 - DNA, 12 bp, Homo sapiens
agtgttgaaggg

SEQ ID NO: 4926413 - DNA, 17 bp, Homo sapiens
agtgttgagccttttcc

SEQ ID NO: 4926414 - DNA, 16 bp, Homo sapiens
agtgttgcctaagtat

SEQ ID NO: 4926415 - DNA, 17 bp, Homo sapiens
agtgttgcctaagtatt

SEQ ID NO: 4926416 - DNA, 17 bp, Homo sapiens
agtgtttatttttcata

SEQ ID NO: 4926417 - DNA, 18 bp, Homo sapiens
agtgtttcagctaaggga

SEQ ID NO: 4926418 - DNA, 14 bp, Homo sapiens
agtgtttctgttat

SEQ ID NO: 4926419 - DNA, 12 bp, Homo sapiens
agtgtttggggg

SEQ ID NO: 4926420 - DNA, 18 bp, Homo sapiens
agtgttttaaattctgag

SEQ ID NO: 4926421 - DNA, 23 bp, Homo sapiens
agttaaatagagtatatgcactt

SEQ ID NO: 4926422 - DNA, 21 bp, Homo sapiens
agttaagaagctgttgtacat

SEQ ID NO: 4926423 - DNA, 20 bp, Homo sapiens
agttaagacatgatttcctt

SEQ ID NO: 4926424 - DNA, 17 bp, Homo sapiens
ataatactctgttgtac

SEQ ID NO: 4926425 - DNA, 22 bp, Homo sapiens
ataatatggctatgcttaaaag

SEQ ID NO: 4926426 - DNA, 23 bp, Homo sapiens
ataatatggctatgcttaaaagg

SEQ ID NO: 4926427 - DNA, 17 bp, Homo sapiens
ataatattgttgtataa

SEQ ID NO: 4926428 - DNA, 16 bp, Homo sapiens
ataatcagcctcttaa

SEQ ID NO: 4926429 - DNA, 16 bp, Homo sapiens
ataatcccagcacttt

SEQ ID NO: 4926430 - DNA, 15 bp, Homo sapiens
ataatctagaacaca

SEQ ID NO: 4926431 - DNA, 14 bp, Homo sapiens
ataatctagtttac

SEQ ID NO: 4926432 - DNA, 20 bp, Homo sapiens
ataatctggactcctctgtc

SEQ ID NO: 4926433 - DNA, 22 bp, Homo sapiens
ataatctggactcctctgtcca

SEQ ID NO: 4926434 - DNA, 13 bp, Homo sapiens
ataatctttgggt

SEQ ID NO: 4926435 - DNA, 16 bp, Homo sapiens
ataatggaagagaaat

SEQ ID NO: 4926436 - DNA, 20 bp, Homo sapiens
ataatggaagagaaatctca

SEQ ID NO: 4926437 - DNA, 12 bp, Homo sapiens
ataatgtgtgta

SEQ ID NO: 4926438 - DNA, 14 bp, Homo sapiens
ataatgtgtgtatg

SEQ ID NO: 4926439 - DNA, 15 bp, Homo sapiens
ataatgtgtgtatgt

SEQ ID NO: 4926440 - DNA, 16 bp, Homo sapiens
ataatgtgtgtatgtg

SEQ ID NO: 4926441 - DNA, 19 bp, Homo sapiens
ataatgtgtgtatgtgtat

SEQ ID NO: 4926442 - DNA, 11 bp, Homo sapiens
ataatgttaaa

SEQ ID NO: 4926443 - DNA, 18 bp, Homo sapiens
ataatgttaaccaaggaa

SEQ ID NO: 4926444 - DNA, 20 bp, Homo sapiens
ataatgttaaccaaggaaat

SEQ ID NO: 4926445 - DNA, 20 bp, Homo sapiens
ataattaaattttgagttct

SEQ ID NO: 4926446 - DNA, 16 bp, Homo sapiens
ataattatttatttaa

SEQ ID NO: 4926447 - DNA, 17 bp, Homo sapiens
ataattatttatttaat

SEQ ID NO: 4926448 - DNA, 22 bp, Homo sapiens
ataattcactcaagcactgata

SEQ ID NO: 4926449 - DNA, 13 bp, Homo sapiens
ataattcctacag

SEQ ID NO: 4926450 - DNA, 22 bp, Homo sapiens
ataattcctatatcctgtgact

SEQ ID NO: 4926451 - DNA, 12 bp, Homo sapiens
ataattctaaag

SEQ ID NO: 4926452 - DNA, 14 bp, Homo sapiens
ataattctgtaaat

SEQ ID NO: 4926453 - DNA, 16 bp, Homo sapiens
ataattgctatttatt

SEQ ID NO: 4926454 - DNA, 22 bp, Homo sapiens
ataattgttgaaattttgcaaa

SEQ ID NO: 4926455 - DNA, 12 bp, Homo sapiens
ataatttaagag

SEQ ID NO: 4926456 - DNA, 14 bp, Homo sapiens
ataatttctaatgt

SEQ ID NO: 4926457 - DNA, 15 bp, Homo sapiens
ataattttaagaaat

SEQ ID NO: 4926458 - DNA, 16 bp, Homo sapiens
atacaaacaatctctt

SEQ ID NO: 4926459 - DNA, 18 bp, Homo sapiens
atacaaagcgtgcacaag

SEQ ID NO: 4926460 - DNA, 16 bp, Homo sapiens
atacaaatatattgtt

SEQ ID NO: 4926461 - DNA, 12 bp, Homo sapiens
atacaacaaagg

SEQ ID NO: 4926462 - DNA, 15 bp, Homo sapiens
atacaacctccctct

SEQ ID NO: 4926463 - DNA, 23 bp, Homo sapiens
atacaacctccctcttgttttgt

SEQ ID NO: 4926464 - DNA, 17 bp, Homo sapiens
atacaagattgaaaatc

SEQ ID NO: 4926465 - DNA, 23 bp, Homo sapiens
atacacatatacctataatgtgt

SEQ ID NO: 4926466 - DNA, 18 bp, Homo sapiens
atacaccgggcctggaga

SEQ ID NO: 4926467 - DNA, 19 bp, Homo sapiens
atacactaaccaaatctct

SEQ ID NO: 4926468 - DNA, 22 bp, Homo sapiens
atacacttgtataaatgtatat

SEQ ID NO: 4926469 - DNA, 15 bp, Homo sapiens
atacagatgaaaatt

SEQ ID NO: 4926470 - DNA, 22 bp, Homo sapiens
atacagatgaaaatttgagact

SEQ ID NO: 4926471 - DNA, 20 bp, Homo sapiens
atacagccctcccccagcag

SEQ ID NO: 4926472 - DNA, 14 bp, Homo sapiens
atacaggaaaagct

SEQ ID NO: 4926473 - DNA, 19 bp, Homo sapiens
atacaggaaaagctgctga

SEQ ID NO: 4926474 - DNA, 20 bp, Homo sapiens
atacaggaaaagctgctgac

SEQ ID NO: 4926475 - DNA, 21 bp, Homo sapiens
atacaggatttgaactcagat

SEQ ID NO: 4926476 - DNA, 22 bp, Homo sapiens
atacagttaggcaccagaagaa

SEQ ID NO: 4926477 - DNA, 19 bp, Homo sapiens
atacagttcaataaactta

SEQ ID NO: 4926478 - DNA, 14 bp, Homo sapiens
atacagttttatgc

SEQ ID NO: 4926479 - DNA, 19 bp, Homo sapiens
atacagttttatgctcttt

SEQ ID NO: 4926480 - DNA, 22 bp, Homo sapiens
atacatacacttgtataaatgt

SEQ ID NO: 4926481 - DNA, 21 bp, Homo sapiens
atacatatcgctgacttcatg

SEQ ID NO: 4926482 - DNA, 23 bp, Homo sapiens
atacatatgtagactatatacat

SEQ ID NO: 4926483 - DNA, 18 bp, Homo sapiens
atacatcactgcttgatg

SEQ ID NO: 4926484 - DNA, 19 bp, Homo sapiens
atacatcactgcttgatga

SEQ ID NO: 4926485 - DNA, 14 bp, Homo sapiens
atacatcagttatt

SEQ ID NO: 4926486 - DNA, 16 bp, Homo sapiens
atacatctctccccaa

SEQ ID NO: 4926487 - DNA, 17 bp, Homo sapiens
atacatgtgtgtatata

SEQ ID NO: 4926488 - DNA, 21 bp, Homo sapiens
atacattagtaaatgtctttg

SEQ ID NO: 4926489 - DNA, 15 bp, Homo sapiens
atacatttaaaactt

SEQ ID NO: 4926490 - DNA, 19 bp, Homo sapiens
atacatttgaggggaaaac

SEQ ID NO: 4926491 - DNA, 20 bp, Homo sapiens
ataccaatgcttttatcaaa

SEQ ID NO: 4926492 - DNA, 18 bp, Homo sapiens
ataccattaaaactgctt

SEQ ID NO: 4926493 - DNA, 14 bp, Homo sapiens
ataccctgcccttg

SEQ ID NO: 4926494 - DNA, 19 bp, Homo sapiens
atacccttcttttatgagc

SEQ ID NO: 4926495 - DNA, 13 bp, Homo sapiens
atacctaagtact

SEQ ID NO: 4926496 - DNA, 19 bp, Homo sapiens
atacctataatgtgtgtat

SEQ ID NO: 4926497 - DNA, 16 bp, Homo sapiens
atacctcaatgtttga

SEQ ID NO: 4926498 - DNA, 16 bp, Homo sapiens
atacctctgtgtgctc

SEQ ID NO: 4926499 - DNA, 17 bp, Homo sapiens
atacctctgtgtgctcc

SEQ ID NO: 4926500 - DNA, 11 bp, Homo sapiens
atacgaacaaa

SEQ ID NO: 4926501 - DNA, 21 bp, Homo sapiens
atacgcctgtagtcctagcca

SEQ ID NO: 4926502 - DNA, 19 bp, Homo sapiens
atacgctactataaagaga

SEQ ID NO: 4926503 - DNA, 12 bp, Homo sapiens
atactaaaatat

SEQ ID NO: 4926504 - DNA, 14 bp, Homo sapiens
atactaaaatatgt

SEQ ID NO: 4926505 - DNA, 16 bp, Homo sapiens
atactaaaatatgtct

SEQ ID NO: 4926506 - DNA, 12 bp, Homo sapiens
atactacatctt

SEQ ID NO: 4926507 - DNA, 16 bp, Homo sapiens
atactacatctttaaa

SEQ ID NO: 4926508 - DNA, 15 bp, Homo sapiens
atactaccttgaaaa

SEQ ID NO: 4926509 - DNA, 14 bp, Homo sapiens
atactactgaaaca

SEQ ID NO: 4926510 - DNA, 22 bp, Homo sapiens
atactatttaaagcctcctcat

SEQ ID NO: 4926511 - DNA, 13 bp, Homo sapiens
atactcagcctgc

SEQ ID NO: 4926512 - DNA, 16 bp, Homo sapiens
atactctgttgtacta

SEQ ID NO: 4926513 - DNA, 14 bp, Homo sapiens
atactctttctgta

SEQ ID NO: 4926514 - DNA, 17 bp, Homo sapiens
atactctttctgtatat

SEQ ID NO: 4926515 - DNA, 17 bp, Homo sapiens
atactgattatgtcttt

SEQ ID NO: 4926516 - DNA, 20 bp, Homo sapiens
atactgattatgtcttttat

SEQ ID NO: 4926517 - DNA, 16 bp, Homo sapiens
atactggactcttcaa

SEQ ID NO: 4926518 - DNA, 19 bp, Homo sapiens
atactggactcttcaaaaa

SEQ ID NO: 4926519 - DNA, 21 bp, Homo sapiens
atactggactcttcaaaaact

SEQ ID NO: 4926520 - DNA, 17 bp, Homo sapiens
atacttagcaaaaagtg

SEQ ID NO: 4926521 - DNA, 16 bp, Homo sapiens
atacttatctctctgt

SEQ ID NO: 4926522 - DNA, 17 bp, Homo sapiens
atacttatctctctgtg

SEQ ID NO: 4926523 - DNA, 13 bp, Homo sapiens
atacttgaacaaa

SEQ ID NO: 4926524 - DNA, 14 bp, Homo sapiens
atacttgaacaaaa

SEQ ID NO: 4926525 - DNA, 17 bp, Homo sapiens
atacttgaacaaaaggg

SEQ ID NO: 4926526 - DNA, 18 bp, Homo sapiens
atacttgaacaaaagggt

SEQ ID NO: 4926527 - DNA, 13 bp, Homo sapiens
atactttaaataa

SEQ ID NO: 4926528 - DNA, 19 bp, Homo sapiens
atactttaaataatttaac

SEQ ID NO: 4926529 - DNA, 16 bp, Homo sapiens
atactttgtggaccaa

SEQ ID NO: 4926530 - DNA, 15 bp, Homo sapiens
atagaaacatgacac

SEQ ID NO: 4926531 - DNA, 21 bp, Homo sapiens
atagaaacatgacactgacct

SEQ ID NO: 4926532 - DNA, 14 bp, Homo sapiens
atagaagctgtagt

SEQ ID NO: 4926533 - DNA, 16 bp, Homo sapiens
atagaatcaatcagta

SEQ ID NO: 4926534 - DNA, 15 bp, Homo sapiens
atattgaagacaatt

SEQ ID NO: 4926535 - DNA, 12 bp, Homo sapiens
atattgacattt

SEQ ID NO: 4926536 - DNA, 13 bp, Homo sapiens
atattgacatttg

SEQ ID NO: 4926537 - DNA, 22 bp, Homo sapiens
atattgaggctttgtgttgtaa

SEQ ID NO: 4926538 - DNA, 13 bp, Homo sapiens
atattgatgaaaa

SEQ ID NO: 4926539 - DNA, 15 bp, Homo sapiens
atattggaaaaatca

SEQ ID NO: 4926540 - DNA, 17 bp, Homo sapiens
atattggcatggatttc

SEQ ID NO: 4926541 - DNA, 18 bp, Homo sapiens
atattgtgttgtgaatgt

SEQ ID NO: 4926542 - DNA, 17 bp, Homo sapiens
atattgttaatctctgt

SEQ ID NO: 4926543 - DNA, 13 bp, Homo sapiens
atattgttgacaa

SEQ ID NO: 4926544 - DNA, 15 bp, Homo sapiens
atattgttgacaact

SEQ ID NO: 4926545 - DNA, 21 bp, Homo sapiens
atattgttgacaactgtgact

SEQ ID NO: 4926546 - DNA, 17 bp, Homo sapiens
atattgtttttctttct

SEQ ID NO: 4926547 - DNA, 12 bp, Homo sapiens
atatttaaactc

SEQ ID NO: 4926548 - DNA, 23 bp, Homo sapiens
atatttaatgataagtaaatgct

SEQ ID NO: 4926549 - DNA, 14 bp, Homo sapiens
atatttaatgcatt

SEQ ID NO: 4926550 - DNA, 15 bp, Homo sapiens
atatttaattattaa

SEQ ID NO: 4926551 - DNA, 22 bp, Homo sapiens
atatttagttatagtttcagat

SEQ ID NO: 4926552 - DNA, 19 bp, Homo sapiens
atatttatgtctatttaag

SEQ ID NO: 4926553 - DNA, 21 bp, Homo sapiens
atatttatgtctatttaagcc

SEQ ID NO: 4926554 - DNA, 16 bp, Homo sapiens
atatttattaaataaa

SEQ ID NO: 4926555 - DNA, 17 bp, Homo sapiens
atatttatttaaagcat

SEQ ID NO: 4926556 - DNA, 21 bp, Homo sapiens
atatttattttctttctgtaa

SEQ ID NO: 4926557 - DNA, 19 bp, Homo sapiens
atatttattttttttaagt

SEQ ID NO: 4926558 - DNA, 21 bp, Homo sapiens
atatttcccatttgtgccaga

SEQ ID NO: 4926559 - DNA, 23 bp, Homo sapiens
atatttgaaaaaaacttcattct

SEQ ID NO: 4926560 - DNA, 13 bp, Homo sapiens
atatttgaatttt

SEQ ID NO: 4926561 - DNA, 15 bp, Homo sapiens
atatttgacttgcat

SEQ ID NO: 4926562 - DNA, 16 bp, Homo sapiens
atatttgacttgcatg

SEQ ID NO: 4926563 - DNA, 13 bp, Homo sapiens
atatttgcttttt

SEQ ID NO: 4926564 - DNA, 15 bp, Homo sapiens
atatttggcttaaat

SEQ ID NO: 4926565 - DNA, 12 bp, Homo sapiens
atatttgtacat

SEQ ID NO: 4926566 - DNA, 23 bp, Homo sapiens
atattttacctcttattgcaaaa

SEQ ID NO: 4926567 - DNA, 13 bp, Homo sapiens
atatttttaaaga

SEQ ID NO: 4926568 - DNA, 18 bp, Homo sapiens
atatttttatatttagtt

SEQ ID NO: 4926569 - DNA, 17 bp, Homo sapiens
atattttttaatttaaa

SEQ ID NO: 4926570 - DNA, 16 bp, Homo sapiens
atatttttttaattta

SEQ ID NO: 4926571 - DNA, 17 bp, Homo sapiens
atatttttttaatttaa

SEQ ID NO: 4926572 - DNA, 19 bp, Homo sapiens
atcaaaactcacaagtgct

SEQ ID NO: 4926573 - DNA, 15 bp, Homo sapiens
atcaaaataaaaagt

SEQ ID NO: 4926574 - DNA, 18 bp, Homo sapiens
atcaaagagagaaaataa

SEQ ID NO: 4926575 - DNA, 13 bp, Homo sapiens
atcaaagccaggg

SEQ ID NO: 4926576 - DNA, 19 bp, Homo sapiens
atcaaataagtatttataa

SEQ ID NO: 4926577 - DNA, 22 bp, Homo sapiens
atcaacagaagcatttgtattt

SEQ ID NO: 4926578 - DNA, 17 bp, Homo sapiens
atcaactactattcaaa

SEQ ID NO: 4926579 - DNA, 14 bp, Homo sapiens
atcaactttaatca

SEQ ID NO: 4926580 - DNA, 21 bp, Homo sapiens
atcaactttaatcaagttgta

SEQ ID NO: 4926581 - DNA, 15 bp, Homo sapiens
atcaagagctgccct

SEQ ID NO: 4926582 - DNA, 17 bp, Homo sapiens
atcaagagctgccctcc

SEQ ID NO: 4926583 - DNA, 20 bp, Homo sapiens
atcaagagctgccctccttg

SEQ ID NO: 4926584 - DNA, 15 bp, Homo sapiens
atcaagtcaatcatt

SEQ ID NO: 4926585 - DNA, 19 bp, Homo sapiens
atcaagtcaatcatttctc

SEQ ID NO: 4926586 - DNA, 20 bp, Homo sapiens
atcaagttgtaacttatatt

SEQ ID NO: 4926587 - DNA, 19 bp, Homo sapiens
atcaatcaaataagtattt

SEQ ID NO: 4926588 - DNA, 19 bp, Homo sapiens
atcaatcatctgtgtgaaa

SEQ ID NO: 4926589 - DNA, 20 bp, Homo sapiens
atcaatcatctgtgtgaaaa

SEQ ID NO: 4926590 - DNA, 22 bp, Homo sapiens
atcaatcatctgtgtgaaaatg

SEQ ID NO: 4926591 - DNA, 16 bp, Homo sapiens
atcaatcctttattat

SEQ ID NO: 4926592 - DNA, 15 bp, Homo sapiens
atcaatgaatattga

SEQ ID NO: 4926593 - DNA, 22 bp, Homo sapiens
atcaatgttcacgcaacttgaa

SEQ ID NO: 4926594 - DNA, 23 bp, Homo sapiens
atcaatgttcacgcaacttgaaa

SEQ ID NO: 4926595 - DNA, 17 bp, Homo sapiens
atcaattatagtttctg

SEQ ID NO: 4926596 - DNA, 16 bp, Homo sapiens
atcacaatttttaatg

SEQ ID NO: 4926597 - DNA, 20 bp, Homo sapiens
atcacagggttgggcccaga

SEQ ID NO: 4926598 - DNA, 22 bp, Homo sapiens
atcacattgagctgatataaat

SEQ ID NO: 4926599 - DNA, 14 bp, Homo sapiens
atcacctgcctgtt

SEQ ID NO: 4926600 - DNA, 15 bp, Homo sapiens
atcacctgcctgtta

SEQ ID NO: 4926601 - DNA, 17 bp, Homo sapiens
atcacgacgctgcagag

SEQ ID NO: 4926602 - DNA, 18 bp, Homo sapiens
atcacggctcactgcagc

SEQ ID NO: 4926603 - DNA, 22 bp, Homo sapiens
atcacggctcactgcagcctca

SEQ ID NO: 4926604 - DNA, 21 bp, Homo sapiens
atcactatccatgcaccaaac

SEQ ID NO: 4926605 - DNA, 18 bp, Homo sapiens
atcactccccaaggaaga

SEQ ID NO: 4926606 - DNA, 20 bp, Homo sapiens
atcactccccaaggaagagc

SEQ ID NO: 4926607 - DNA, 14 bp, Homo sapiens
atcactctgctgct

SEQ ID NO: 4926608 - DNA, 17 bp, Homo sapiens
atcactgaacaaactaa

SEQ ID NO: 4926609 - DNA, 15 bp, Homo sapiens
atcactgaatttata

SEQ ID NO: 4926610 - DNA, 22 bp, Homo sapiens
atcactgcattattctctttta

SEQ ID NO: 4926611 - DNA, 12 bp, Homo sapiens
atcactgccaca

SEQ ID NO: 4926612 - DNA, 14 bp, Homo sapiens
atcactgcttgatg

SEQ ID NO: 4926613 - DNA, 21 bp, Homo sapiens
atcactgcttgatgaagcaag

SEQ ID NO: 4926614 - DNA, 14 bp, Homo sapiens
atcacttgtacaaa

SEQ ID NO: 4926615 - DNA, 17 bp, Homo sapiens
atcacttgtacaaaata

SEQ ID NO: 4926616 - DNA, 18 bp, Homo sapiens
atcacttgtacaaaataa

SEQ ID NO: 4926617 - DNA, 21 bp, Homo sapiens
atcacttgtacaaaataaaca

SEQ ID NO: 4926618 - DNA, 13 bp, Homo sapiens
atcacttttcagt

SEQ ID NO: 4926619 - DNA, 15 bp, Homo sapiens
atcagaaatttttat

SEQ ID NO: 4926620 - DNA, 23 bp, Homo sapiens
atcagaagaccacaaaaattgac

SEQ ID NO: 4926621 - DNA, 19 bp, Homo sapiens
atcagaatagccacatttg

SEQ ID NO: 4926622 - DNA, 16 bp, Homo sapiens
atcagagcaggacctc

SEQ ID NO: 4926623 - DNA, 20 bp, Homo sapiens
atcagatgctccaagattct

SEQ ID NO: 4926624 - DNA, 23 bp, Homo sapiens
atcagatgctccaagattctaga

SEQ ID NO: 4926625 - DNA, 21 bp, Homo sapiens
atcagatggaaatattttgat

SEQ ID NO: 4926626 - DNA, 12 bp, Homo sapiens
atcagcactgaa

SEQ ID NO: 4926627 - DNA, 13 bp, Homo sapiens
atcagcactgaaa

SEQ ID NO: 4926628 - DNA, 14 bp, Homo sapiens
atcagcactgaaaa

SEQ ID NO: 4926629 - DNA, 18 bp, Homo sapiens
atcagcatctgtgatggg

SEQ ID NO: 4926630 - DNA, 15 bp, Homo sapiens
atcagccacattcta

SEQ ID NO: 4926631 - DNA, 21 bp, Homo sapiens
atcagctacttaagagaaatg

SEQ ID NO: 4926632 - DNA, 18 bp, Homo sapiens
atcaggcctaatctcata

SEQ ID NO: 4926633 - DNA, 19 bp, Homo sapiens
atcaggcctaatctcatac

SEQ ID NO: 4926634 - DNA, 21 bp, Homo sapiens
atcagggggaagaagcagaga

SEQ ID NO: 4926635 - DNA, 23 bp, Homo sapiens
atcagggggaagaagcagagaga

SEQ ID NO: 4926636 - DNA, 14 bp, Homo sapiens
atcaggtgctgcca

SEQ ID NO: 4926637 - DNA, 15 bp, Homo sapiens
atcagtaatatttat

SEQ ID NO: 4926638 - DNA, 18 bp, Homo sapiens
atcagtaggctaatgtca

SEQ ID NO: 4926639 - DNA, 16 bp, Homo sapiens
atcagtccctatgtat

SEQ ID NO: 4926640 - DNA, 19 bp, Homo sapiens
atcagtctgattcccaagc

SEQ ID NO: 4926641 - DNA, 18 bp, Homo sapiens
atcagtgggcaggataaa

SEQ ID NO: 4926642 - DNA, 21 bp, Homo sapiens
atcagtgggcaggataaactg

SEQ ID NO: 4926643 - DNA, 22 bp, Homo sapiens
atcagtgggcaggataaactga

SEQ ID NO: 4926644 - DNA, 18 bp, Homo sapiens
atctgtcaaaacactgtg

SEQ ID NO: 4926645 - DNA, 23 bp, Homo sapiens
atctgtcaagtgggatctgtcac

SEQ ID NO: 4926646 - DNA, 18 bp, Homo sapiens
atctgtccaaaggaggct

SEQ ID NO: 4926647 - DNA, 19 bp, Homo sapiens
atctgtccaaaggaggctg

SEQ ID NO: 4926648 - DNA, 23 bp, Homo sapiens
atctgtccaaaggaggctggcag

SEQ ID NO: 4926649 - DNA, 12 bp, Homo sapiens
atctgtcttgta

SEQ ID NO: 4926650 - DNA, 21 bp, Homo sapiens
atctgtcttgtaatattttgt

SEQ ID NO: 4926651 - DNA, 21 bp, Homo sapiens
atctgtgaagtagttctgttt

SEQ ID NO: 4926652 - DNA, 12 bp, Homo sapiens
atctgtgcccca

SEQ ID NO: 4926653 - DNA, 13 bp, Homo sapiens
atctgtgtgaaaa

SEQ ID NO: 4926654 - DNA, 17 bp, Homo sapiens
atctgtgtgaaaatggg

SEQ ID NO: 4926655 - DNA, 20 bp, Homo sapiens
atctgttctgggctctttcc

SEQ ID NO: 4926656 - DNA, 15 bp, Homo sapiens
atctgttgttttgtt

SEQ ID NO: 4926657 - DNA, 15 bp, Homo sapiens
atcttagggtgaacc

SEQ ID NO: 4926658 - DNA, 12 bp, Homo sapiens
atcttagtggtt

SEQ ID NO: 4926659 - DNA, 15 bp, Homo sapiens
atcttatagcacttt

SEQ ID NO: 4926660 - DNA, 16 bp, Homo sapiens
atcttattttcatgta

SEQ ID NO: 4926661 - DNA, 17 bp, Homo sapiens
atcttccatatttggaa

SEQ ID NO: 4926662 - DNA, 18 bp, Homo sapiens
atcttccatatttggaag

SEQ ID NO: 4926663 - DNA, 19 bp, Homo sapiens
atcttccatatttggaaga

SEQ ID NO: 4926664 - DNA, 21 bp, Homo sapiens
atcttctaaacccaatccaaa

SEQ ID NO: 4926665 - DNA, 20 bp, Homo sapiens
atcttcttatgcaatttcct

SEQ ID NO: 4926666 - DNA, 21 bp, Homo sapiens
atcttgaaattaagaaggcaa

SEQ ID NO: 4926667 - DNA, 12 bp, Homo sapiens
atcttgaatgtg

SEQ ID NO: 4926668 - DNA, 19 bp, Homo sapiens
atcttgaatgtggtctcag

SEQ ID NO: 4926669 - DNA, 20 bp, Homo sapiens
atcttgaatgtggtctcagg

SEQ ID NO: 4926670 - DNA, 22 bp, Homo sapiens
atcttgagtataagaaatgcat

SEQ ID NO: 4926671 - DNA, 16 bp, Homo sapiens
atcttgcgaatccaag

SEQ ID NO: 4926672 - DNA, 16 bp, Homo sapiens
atcttgctctgctgac

SEQ ID NO: 4926673 - DNA, 13 bp, Homo sapiens
atcttggctatgt

SEQ ID NO: 4926674 - DNA, 16 bp, Homo sapiens
atcttgtatacacata

SEQ ID NO: 4926675 - DNA, 22 bp, Homo sapiens
atcttgtgtgattaacttattt

SEQ ID NO: 4926676 - DNA, 16 bp, Homo sapiens
atcttgtgttgtcctt

SEQ ID NO: 4926677 - DNA, 17 bp, Homo sapiens
atctttaagcagagaag

SEQ ID NO: 4926678 - DNA, 16 bp, Homo sapiens
atctttgcactccaat

SEQ ID NO: 4926679 - DNA, 20 bp, Homo sapiens
atcttttaaagtgttacttt

SEQ ID NO: 4926680 - DNA, 22 bp, Homo sapiens
atcttttaaagtgttacttttt

SEQ ID NO: 4926681 - DNA, 22 bp, Homo sapiens
atcttttacaactgcctcgaaa

SEQ ID NO: 4926682 - DNA, 20 bp, Homo sapiens
atcttttatgtttgaatatg

SEQ ID NO: 4926683 - DNA, 13 bp, Homo sapiens
atcttttcattct

SEQ ID NO: 4926684 - DNA, 14 bp, Homo sapiens
atcttttttcaaaa

SEQ ID NO: 4926685 - DNA, 14 bp, Homo sapiens
atgaaaactataca

SEQ ID NO: 4926686 - DNA, 13 bp, Homo sapiens
atgaaaagacaag

SEQ ID NO: 4926687 - DNA, 16 bp, Homo sapiens
atgaaaataaatagct

SEQ ID NO: 4926688 - DNA, 19 bp, Homo sapiens
atgaaaatttgagactatt

SEQ ID NO: 4926689 - DNA, 21 bp, Homo sapiens
atgaaaattttaccagcagaa

SEQ ID NO: 4926690 - DNA, 19 bp, Homo sapiens
atgaaagatggctgtgcct

SEQ ID NO: 4926691 - DNA, 20 bp, Homo sapiens
atgaaagatggctgtgcctc

SEQ ID NO: 4926692 - DNA, 23 bp, Homo sapiens
atgaaagatggctgtgcctctgc

SEQ ID NO: 4926693 - DNA, 19 bp, Homo sapiens
atgaaagattaaacagatg

SEQ ID NO: 4926694 - DNA, 18 bp, Homo sapiens
atgaaagggcccagagag

SEQ ID NO: 4926695 - DNA, 16 bp, Homo sapiens
atgaaaggtttacatt

SEQ ID NO: 4926696 - DNA, 16 bp, Homo sapiens
atgaaatttaaacatt

SEQ ID NO: 4926697 - DNA, 18 bp, Homo sapiens
atgaaatttaaacattaa

SEQ ID NO: 4926698 - DNA, 17 bp, Homo sapiens
atgaacacccttagaaa

SEQ ID NO: 4926699 - DNA, 13 bp, Homo sapiens
atgaacattccaa

SEQ ID NO: 4926700 - DNA, 20 bp, Homo sapiens
atgaaccacatcttgctctg

SEQ ID NO: 4926701 - DNA, 22 bp, Homo sapiens
atgaaccacatcttgctctgct

SEQ ID NO: 4926702 - DNA, 23 bp, Homo sapiens
atgaaccacatcttgctctgctg

SEQ ID NO: 4926703 - DNA, 13 bp, Homo sapiens
atgaacccttcct

SEQ ID NO: 4926704 - DNA, 22 bp, Homo sapiens
atgaacccttcctgagctttat

SEQ ID NO: 4926705 - DNA, 17 bp, Homo sapiens
atgaaccctttgtttct

SEQ ID NO: 4926706 - DNA, 16 bp, Homo sapiens
atgaacttattctgta

SEQ ID NO: 4926707 - DNA, 21 bp, Homo sapiens
atgaagattggtgggattttt

SEQ ID NO: 4926708 - DNA, 13 bp, Homo sapiens
atgaagcaaggaa

SEQ ID NO: 4926709 - DNA, 14 bp, Homo sapiens
atgaagcaaggaag

SEQ ID NO: 4926710 - DNA, 15 bp, Homo sapiens
atgaagcaaggaaga

SEQ ID NO: 4926711 - DNA, 22 bp, Homo sapiens
atgaagcagctttaaacaaatt

SEQ ID NO: 4926712 - DNA, 22 bp, Homo sapiens
atgaagcctgtggatgatcaat

SEQ ID NO: 4926713 - DNA, 16 bp, Homo sapiens
atgaagtgcgtgaatg

SEQ ID NO: 4926714 - DNA, 15 bp, Homo sapiens
atgaagtgttagata

SEQ ID NO: 4926715 - DNA, 22 bp, Homo sapiens
atgaagtttaaaacagtattta

SEQ ID NO: 4926716 - DNA, 20 bp, Homo sapiens
atgaatatctattaatatat

SEQ ID NO: 4926717 - DNA, 21 bp, Homo sapiens
atgaatatctattaatatatg

SEQ ID NO: 4926718 - DNA, 22 bp, Homo sapiens
atgaatatctattaatatatgt

SEQ ID NO: 4926719 - DNA, 15 bp, Homo sapiens
atgaatattttgata

SEQ ID NO: 4926720 - DNA, 19 bp, Homo sapiens
atgaatattttgataataa

SEQ ID NO: 4926721 - DNA, 22 bp, Homo sapiens
atgaatattttgataataatat

SEQ ID NO: 4926722 - DNA, 18 bp, Homo sapiens
atgaatcccacccacatg

SEQ ID NO: 4926723 - DNA, 15 bp, Homo sapiens
atgaatctgattttt

SEQ ID NO: 4926724 - DNA, 24 bp, Homo sapiens
atgaatctgtctcccagttatgaa

SEQ ID NO: 4926725 - DNA, 16 bp, Homo sapiens
atgaatgagaatctac

SEQ ID NO: 4926726 - DNA, 15 bp, Homo sapiens
atgaatgagtctgtt

SEQ ID NO: 4926727 - DNA, 17 bp, Homo sapiens
atgaatgtatttatttg

SEQ ID NO: 4926728 - DNA, 14 bp, Homo sapiens
atgaatttaaatat

SEQ ID NO: 4926729 - DNA, 19 bp, Homo sapiens
atgacaacagaagcttcag

SEQ ID NO: 4926730 - DNA, 22 bp, Homo sapiens
atgacacccgtgagcgcctgtg

SEQ ID NO: 4926731 - DNA, 12 bp, Homo sapiens
atgacactgacc

SEQ ID NO: 4926732 - DNA, 23 bp, Homo sapiens
atgacaggcctgaagatattact

SEQ ID NO: 4926733 - DNA, 24 bp, Homo sapiens
atgacaggcctgaagatattacta

SEQ ID NO: 4926734 - DNA, 16 bp, Homo sapiens
atgacaggtaaattaa

SEQ ID NO: 4926735 - DNA, 20 bp, Homo sapiens
atgacataacagtgcagggc

SEQ ID NO: 4926736 - DNA, 14 bp, Homo sapiens
atgacatcacttgt

SEQ ID NO: 4926737 - DNA, 16 bp, Homo sapiens
atgacatctcaggggc

SEQ ID NO: 4926738 - DNA, 14 bp, Homo sapiens
atgacatcttttta

SEQ ID NO: 4926739 - DNA, 15 bp, Homo sapiens
atgacatgcactgac

SEQ ID NO: 4926740 - DNA, 18 bp, Homo sapiens
atgacatgcactgaccct

SEQ ID NO: 4926741 - DNA, 19 bp, Homo sapiens
atgacatgcactgaccctt

SEQ ID NO: 4926742 - DNA, 23 bp, Homo sapiens
atgacatgttatatattttttgt

SEQ ID NO: 4926743 - DNA, 17 bp, Homo sapiens
atgaccatactgaggga

SEQ ID NO: 4926744 - DNA, 17 bp, Homo sapiens
atgacgctgatacataa

SEQ ID NO: 4926745 - DNA, 21 bp, Homo sapiens
atgactaattagggtacattt

SEQ ID NO: 4926746 - DNA, 23 bp, Homo sapiens
atgactaattagggtacatttat

SEQ ID NO: 4926747 - DNA, 15 bp, Homo sapiens
atgactatgtaaact

SEQ ID NO: 4926748 - DNA, 17 bp, Homo sapiens
atgactcacatgatgca

SEQ ID NO: 4926749 - DNA, 21 bp, Homo sapiens
atgactgctccccagccctgg

SEQ ID NO: 4926750 - DNA, 21 bp, Homo sapiens
atgagaaaggttgaagcacca

SEQ ID NO: 4926751 - DNA, 17 bp, Homo sapiens
atgagaacaaagctgtt

SEQ ID NO: 4926752 - DNA, 18 bp, Homo sapiens
atgagaacaaagctgtta

SEQ ID NO: 4926753 - DNA, 21 bp, Homo sapiens
atgggctctgacagaaagcag

SEQ ID NO: 4926754 - DNA, 19 bp, Homo sapiens
atgggcttcactgtataaa

SEQ ID NO: 4926755 - DNA, 16 bp, Homo sapiens
atggggagaggaactc

SEQ ID NO: 4926756 - DNA, 21 bp, Homo sapiens
atgggtgttgtatggggaggc

SEQ ID NO: 4926757 - DNA, 18 bp, Homo sapiens
atggtacatgtcttccat

SEQ ID NO: 4926758 - DNA, 17 bp, Homo sapiens
atggtaccaatcatgaa

SEQ ID NO: 4926759 - DNA, 20 bp, Homo sapiens
atggtaccagccctggggct

SEQ ID NO: 4926760 - DNA, 17 bp, Homo sapiens
atggtaggcatttccta

SEQ ID NO: 4926761 - DNA, 15 bp, Homo sapiens
atggtcacacactga

SEQ ID NO: 4926762 - DNA, 22 bp, Homo sapiens
atggtcatcttggagggaccaa

SEQ ID NO: 4926763 - DNA, 18 bp, Homo sapiens
atggtctcagaaaccaaa

SEQ ID NO: 4926764 - DNA, 17 bp, Homo sapiens
atggtgaaaatgtactg

SEQ ID NO: 4926765 - DNA, 17 bp, Homo sapiens
atggtgaaatttattag

SEQ ID NO: 4926766 - DNA, 16 bp, Homo sapiens
atggtggacccagcgg

SEQ ID NO: 4926767 - DNA, 15 bp, Homo sapiens
atggtggctgggttg

SEQ ID NO: 4926768 - DNA, 20 bp, Homo sapiens
atggtgtaataagacataac

SEQ ID NO: 4926769 - DNA, 20 bp, Homo sapiens
atggttatgaaagaatatat

SEQ ID NO: 4926770 - DNA, 19 bp, Homo sapiens
atggttcccctgttcactc

SEQ ID NO: 4926771 - DNA, 15 bp, Homo sapiens
atggttgccttaaag

SEQ ID NO: 4926772 - DNA, 21 bp, Homo sapiens
atggtttattttgtattgtgg

SEQ ID NO: 4926773 - DNA, 19 bp, Homo sapiens
atgtaaaaaagaaaaacac

SEQ ID NO: 4926774 - DNA, 13 bp, Homo sapiens
atgtaaactgcca

SEQ ID NO: 4926775 - DNA, 15 bp, Homo sapiens
atgtaaactgccata

SEQ ID NO: 4926776 - DNA, 14 bp, Homo sapiens
atgtaaagaaatgt

SEQ ID NO: 4926777 - DNA, 17 bp, Homo sapiens
atgtaaagaaatgtctt

SEQ ID NO: 4926778 - DNA, 17 bp, Homo sapiens
atgtaaagtatgtaaac

SEQ ID NO: 4926779 - DNA, 20 bp, Homo sapiens
atgtaagattatagattcta

SEQ ID NO: 4926780 - DNA, 14 bp, Homo sapiens
atgtaatgtccctt

SEQ ID NO: 4926781 - DNA, 23 bp, Homo sapiens
atgtaatgtgtggtggcctcagc

SEQ ID NO: 4926782 - DNA, 14 bp, Homo sapiens
atgtacaagatgaa

SEQ ID NO: 4926783 - DNA, 18 bp, Homo sapiens
atgtaccatgaaacaaag

SEQ ID NO: 4926784 - DNA, 18 bp, Homo sapiens
atgtaccatttgcatggc

SEQ ID NO: 4926785 - DNA, 22 bp, Homo sapiens
atgtaccatttgcatggctcca

SEQ ID NO: 4926786 - DNA, 18 bp, Homo sapiens
atgtactagtactgtgta

SEQ ID NO: 4926787 - DNA, 19 bp, Homo sapiens
atgtactagtactgtgtac

SEQ ID NO: 4926788 - DNA, 15 bp, Homo sapiens
atgtactagtgttct

SEQ ID NO: 4926789 - DNA, 21 bp, Homo sapiens
atgtactagttttagttttct

SEQ ID NO: 4926790 - DNA, 12 bp, Homo sapiens
atgtactgtact

SEQ ID NO: 4926791 - DNA, 18 bp, Homo sapiens
atgtactgtactaattct

SEQ ID NO: 4926792 - DNA, 17 bp, Homo sapiens
atgtagactatatacat

SEQ ID NO: 4926793 - DNA, 19 bp, Homo sapiens
atgtagactatatacatgt

SEQ ID NO: 4926794 - DNA, 20 bp, Homo sapiens
atgtagactatatacatgtg

SEQ ID NO: 4926795 - DNA, 21 bp, Homo sapiens
atgtagactatatacatgtgt

SEQ ID NO: 4926796 - DNA, 15 bp, Homo sapiens
atgtagagaaaagca

SEQ ID NO: 4926797 - DNA, 20 bp, Homo sapiens
atgtagatatttggcttaaa

SEQ ID NO: 4926798 - DNA, 19 bp, Homo sapiens
atgtagattaaggtgatgt

SEQ ID NO: 4926799 - DNA, 19 bp, Homo sapiens
atgtagcacataaactttg

SEQ ID NO: 4926800 - DNA, 18 bp, Homo sapiens
atgtagcattatgcaatt

SEQ ID NO: 4926801 - DNA, 22 bp, Homo sapiens
atgtagcgtgtttacatgtgta

SEQ ID NO: 4926802 - DNA, 19 bp, Homo sapiens
atgtatactatagtaccag

SEQ ID NO: 4926803 - DNA, 17 bp, Homo sapiens
atgtatatatttagtgc

SEQ ID NO: 4926804 - DNA, 17 bp, Homo sapiens
atgtatcatagaaatgt

SEQ ID NO: 4926805 - DNA, 19 bp, Homo sapiens
atgtattctagctaatgta

SEQ ID NO: 4926806 - DNA, 21 bp, Homo sapiens
atgtattgtaaacatgtgttt

SEQ ID NO: 4926807 - DNA, 13 bp, Homo sapiens
atgtatttatgta

SEQ ID NO: 4926808 - DNA, 13 bp, Homo sapiens
atgtatttgttca

SEQ ID NO: 4926809 - DNA, 18 bp, Homo sapiens
atgtatttgttcatgttt

SEQ ID NO: 4926810 - DNA, 16 bp, Homo sapiens
atgtatttttctacat

SEQ ID NO: 4926811 - DNA, 19 bp, Homo sapiens
atgtatttttctacattat

SEQ ID NO: 4926812 - DNA, 17 bp, Homo sapiens
atgtcaaaattgtttaa

SEQ ID NO: 4926813 - DNA, 20 bp, Homo sapiens
atgtcaaagagaaaacttat

SEQ ID NO: 4926814 - DNA, 12 bp, Homo sapiens
atgtcacagggc

SEQ ID NO: 4926815 - DNA, 14 bp, Homo sapiens
atgtcactagaatg

SEQ ID NO: 4926816 - DNA, 22 bp, Homo sapiens
atgtcatatactgccatgtact

SEQ ID NO: 4926817 - DNA, 13 bp, Homo sapiens
atgtcatgtgttc

SEQ ID NO: 4926818 - DNA, 15 bp, Homo sapiens
atgtcattaatgtgt

SEQ ID NO: 4926819 - DNA, 18 bp, Homo sapiens
atgtcattgagtaatata

SEQ ID NO: 4926820 - DNA, 20 bp, Homo sapiens
atgtccaaagaggctgcccc

SEQ ID NO: 4926821 - DNA, 14 bp, Homo sapiens
atgtccactgtgta

SEQ ID NO: 4926822 - DNA, 19 bp, Homo sapiens
atgtccctagaaaacaatg

SEQ ID NO: 4926823 - DNA, 15 bp, Homo sapiens
atgtccctgggccag

SEQ ID NO: 4926824 - DNA, 16 bp, Homo sapiens
atgtccctgggccagg

SEQ ID NO: 4926825 - DNA, 18 bp, Homo sapiens
atgtccctgggccagggt

SEQ ID NO: 4926826 - DNA, 20 bp, Homo sapiens
atgtccctgggccagggtct

SEQ ID NO: 4926827 - DNA, 21 bp, Homo sapiens
atgtccctgggccagggtctg

SEQ ID NO: 4926828 - DNA, 18 bp, Homo sapiens
atgtcccttgatgcacag

SEQ ID NO: 4926829 - DNA, 19 bp, Homo sapiens
atgtcccttgatgcacaga

SEQ ID NO: 4926830 - DNA, 20 bp, Homo sapiens
atgtcctactatcactgaac

SEQ ID NO: 4926831 - DNA, 15 bp, Homo sapiens
atgtcgcctctgcat

SEQ ID NO: 4926832 - DNA, 17 bp, Homo sapiens
atgtctaaatgctgaaa

SEQ ID NO: 4926833 - DNA, 12 bp, Homo sapiens
atgtctatttaa

SEQ ID NO: 4926834 - DNA, 16 bp, Homo sapiens
atgtctgtttaagaaa

SEQ ID NO: 4926835 - DNA, 17 bp, Homo sapiens
atgtctgtttaagaaaa

SEQ ID NO: 4926836 - DNA, 19 bp, Homo sapiens
atgtcttcataaagtactt

SEQ ID NO: 4926837 - DNA, 18 bp, Homo sapiens
atgtcttcatttcattgt

SEQ ID NO: 4926838 - DNA, 19 bp, Homo sapiens
atgtcttggacactgtaca

SEQ ID NO: 4926839 - DNA, 22 bp, Homo sapiens
atgtcttgtacatgtgtagcct

SEQ ID NO: 4926840 - DNA, 18 bp, Homo sapiens
atgtctttctccaaagtt

SEQ ID NO: 4926841 - DNA, 22 bp, Homo sapiens
atgtctttgtaagtcagtgttg

SEQ ID NO: 4926842 - DNA, 18 bp, Homo sapiens
atgtcttttatagtggaa

SEQ ID NO: 4926843 - DNA, 19 bp, Homo sapiens
atgtcttttatagtggaaa

SEQ ID NO: 4926844 - DNA, 21 bp, Homo sapiens
atgtcttttatagtggaaaaa

SEQ ID NO: 4926845 - DNA, 20 bp, Homo sapiens
atgtcttttatatttgtatc

SEQ ID NO: 4926846 - DNA, 13 bp, Homo sapiens
atgtgaaacactt

SEQ ID NO: 4926847 - DNA, 22 bp, Homo sapiens
atgtgaaacactttgcctcctg

SEQ ID NO: 4926848 - DNA, 12 bp, Homo sapiens
atgtgaaacctt

SEQ ID NO: 4926849 - DNA, 13 bp, Homo sapiens
atgtgaacttgta

SEQ ID NO: 4926850 - DNA, 23 bp, Homo sapiens
atgtgaacttgtagctgtaaaac

SEQ ID NO: 4926851 - DNA, 15 bp, Homo sapiens
atgtgacaataatat

SEQ ID NO: 4926852 - DNA, 11 bp, Homo sapiens
atgtgacacat

SEQ ID NO: 4926853 - DNA, 16 bp, Homo sapiens
atgtgacaggtaaact

SEQ ID NO: 4926854 - DNA, 14 bp, Homo sapiens
atgtgactgtataa

SEQ ID NO: 4926855 - DNA, 17 bp, Homo sapiens
atgtgagtttggtctgg

SEQ ID NO: 4926856 - DNA, 21 bp, Homo sapiens
atgtgagtttggtctggactg

SEQ ID NO: 4926857 - DNA, 23 bp, Homo sapiens
atgtgagtttggtctggactgac

SEQ ID NO: 4926858 - DNA, 14 bp, Homo sapiens
atgtgatattctaa

SEQ ID NO: 4926859 - DNA, 18 bp, Homo sapiens
atgtgatattctaagact

SEQ ID NO: 4926860 - DNA, 18 bp, Homo sapiens
atgtgatcacgcctggct

SEQ ID NO: 4926861 - DNA, 20 bp, Homo sapiens
atgtgatctgtcttgtaata

SEQ ID NO: 4926862 - DNA, 14 bp, Homo sapiens
atgtgatgatgtaa

SEQ ID NO: 4926863 - DNA, 16 bp, Homo sapiens
atgtgatgatgtaatt

SEQ ID NO: 4926864 - DNA, 14 bp, Homo sapiens
atgtgatgttctaa

SEQ ID NO: 4926865 - DNA, 17 bp, Homo sapiens
atgtgatgttctaaggc

SEQ ID NO: 4926866 - DNA, 19 bp, Homo sapiens
atgtgatgttctaaggctc

SEQ ID NO: 4926867 - DNA, 15 bp, Homo sapiens
atgtgattacaaggc

SEQ ID NO: 4926868 - DNA, 15 bp, Homo sapiens
atgtgattcaaaaga

SEQ ID NO: 4926869 - DNA, 15 bp, Homo sapiens
atgtgattgtggaat

SEQ ID NO: 4926870 - DNA, 17 bp, Homo sapiens
atgtgattgtggaatgg

SEQ ID NO: 4926871 - DNA, 23 bp, Homo sapiens
atgtgcacatgcacgtgtgtgca

SEQ ID NO: 4926872 - DNA, 20 bp, Homo sapiens
atgtgccagggcaatgatga

SEQ ID NO: 4926873 - DNA, 22 bp, Homo sapiens
atgtgccaggtttttggtctga

SEQ ID NO: 4926874 - DNA, 16 bp, Homo sapiens
atgtgccctcctgagg

SEQ ID NO: 4926875 - DNA, 18 bp, Homo sapiens
atgtgccctcctgaggga

SEQ ID NO: 4926876 - DNA, 18 bp, Homo sapiens
atgtggcaaggaaaaaca

SEQ ID NO: 4926877 - DNA, 18 bp, Homo sapiens
atgtggcccctgaacaag

SEQ ID NO: 4926878 - DNA, 14 bp, Homo sapiens
atgtgggtcttcca

SEQ ID NO: 4926879 - DNA, 16 bp, Homo sapiens
atgtgggttgcctggt

SEQ ID NO: 4926880 - DNA, 22 bp, Homo sapiens
atgtggtggcacaggccccctt

SEQ ID NO: 4926881 - DNA, 16 bp, Homo sapiens
atgtggttttagattt

SEQ ID NO: 4926882 - DNA, 18 bp, Homo sapiens
atgtgtacaatgtacaca

SEQ ID NO: 4926883 - DNA, 19 bp, Homo sapiens
atgtgtatatatacataca

SEQ ID NO: 4926884 - DNA, 23 bp, Homo sapiens
atgtgtatatatacatacacttg

SEQ ID NO: 4926885 - DNA, 17 bp, Homo sapiens
atgtgtcacttgtgctt

SEQ ID NO: 4926886 - DNA, 17 bp, Homo sapiens
atgtgtcctcagggagc

SEQ ID NO: 4926887 - DNA, 16 bp, Homo sapiens
atgtgtctgtatttca

SEQ ID NO: 4926888 - DNA, 18 bp, Homo sapiens
atgtgtctgtatttcatg

SEQ ID NO: 4926889 - DNA, 17 bp, Homo sapiens
atgtgtgcatgtgtgta

SEQ ID NO: 4926890 - DNA, 23 bp, Homo sapiens
atgtgtgtataagtgcacacaga

SEQ ID NO: 4926891 - DNA, 14 bp, Homo sapiens
atgtgtgtatatat

SEQ ID NO: 4926892 - DNA, 14 bp, Homo sapiens
atgtgtgtatgtgt

SEQ ID NO: 4926893 - DNA, 12 bp, Homo sapiens
atgtgtgtgtgt

SEQ ID NO: 4926894 - DNA, 22 bp, Homo sapiens
atgtgttccctttgtctttcaa

SEQ ID NO: 4926895 - DNA, 20 bp, Homo sapiens
atgtgttctcggagtgtgta

SEQ ID NO: 4926896 - DNA, 14 bp, Homo sapiens
atgtgttgaaaacc

SEQ ID NO: 4926897 - DNA, 16 bp, Homo sapiens
atgtgttgaaaaccaa

SEQ ID NO: 4926898 - DNA, 13 bp, Homo sapiens
atgtgttgtgata

SEQ ID NO: 4926899 - DNA, 17 bp, Homo sapiens
atgtgtttttctccagt

SEQ ID NO: 4926900 - DNA, 14 bp, Homo sapiens
atgttaaatttgta

SEQ ID NO: 4926901 - DNA, 20 bp, Homo sapiens
atgttaaatttgtaagtttc

SEQ ID NO: 4926902 - DNA, 18 bp, Homo sapiens
atgttaaccaaggaaata

SEQ ID NO: 4926903 - DNA, 13 bp, Homo sapiens
atgttaagcagat

SEQ ID NO: 4926904 - DNA, 18 bp, Homo sapiens
atgttaaggaaactctta

SEQ ID NO: 4926905 - DNA, 18 bp, Homo sapiens
atgttagtgttttaagaa

SEQ ID NO: 4926906 - DNA, 13 bp, Homo sapiens
atgttatatttaa

SEQ ID NO: 4926907 - DNA, 17 bp, Homo sapiens
atgttatcttctcaagt

SEQ ID NO: 4926908 - DNA, 20 bp, Homo sapiens
atgttatttgttattttcag

SEQ ID NO: 4926909 - DNA, 18 bp, Homo sapiens
atgttcatttgtttgttt

SEQ ID NO: 4926910 - DNA, 17 bp, Homo sapiens
atgttctaaggctctga

SEQ ID NO: 4926911 - DNA, 19 bp, Homo sapiens
atgttctaaggctctgaga

SEQ ID NO: 4926912 - DNA, 15 bp, Homo sapiens
atgttctaagtttct

SEQ ID NO: 4926913 - DNA, 16 bp, Homo sapiens
atgttctaagtttcta

SEQ ID NO: 4926914 - DNA, 20 bp, Homo sapiens
atgttctaagtttctaagat

SEQ ID NO: 4926915 - DNA, 21 bp, Homo sapiens
atgttctaagtttctaagatt

SEQ ID NO: 4926916 - DNA, 17 bp, Homo sapiens
atgttctctgaggacac

SEQ ID NO: 4926917 - DNA, 17 bp, Homo sapiens
atgttctgcccccagcc

SEQ ID NO: 4926918 - DNA, 12 bp, Homo sapiens
atgttctgggac

SEQ ID NO: 4926919 - DNA, 15 bp, Homo sapiens
atgttctgggacaca

SEQ ID NO: 4926920 - DNA, 14 bp, Homo sapiens
atgttgaatacttt

SEQ ID NO: 4926921 - DNA, 18 bp, Homo sapiens
atgttgccatgtgtttta

SEQ ID NO: 4926922 - DNA, 12 bp, Homo sapiens
atgttgcccagg

SEQ ID NO: 4926923 - DNA, 17 bp, Homo sapiens
atgttgcccaggcaggt

SEQ ID NO: 4926924 - DNA, 15 bp, Homo sapiens
atgttgctggactgt

SEQ ID NO: 4926925 - DNA, 19 bp, Homo sapiens
atgttgctggactgtcata

SEQ ID NO: 4926926 - DNA, 14 bp, Homo sapiens
atgttggtttactt

SEQ ID NO: 4926927 - DNA, 16 bp, Homo sapiens
atgttggtttactttc

SEQ ID NO: 4926928 - DNA, 18 bp, Homo sapiens
atgttggtttactttcaa

SEQ ID NO: 4926929 - DNA, 22 bp, Homo sapiens
atgttgtaaattaggaggctca

SEQ ID NO: 4926930 - DNA, 15 bp, Homo sapiens
atgttgtacaatgta

SEQ ID NO: 4926931 - DNA, 17 bp, Homo sapiens
atgttgttatgctatta

SEQ ID NO: 4926932 - DNA, 13 bp, Homo sapiens
atgtttatgaaaa

SEQ ID NO: 4926933 - DNA, 17 bp, Homo sapiens
atgtttatttactaatt

SEQ ID NO: 4926934 - DNA, 21 bp, Homo sapiens
atgtttcacaccggaaggttt

SEQ ID NO: 4926935 - DNA, 15 bp, Homo sapiens
atgtttccagacttc

SEQ ID NO: 4926936 - DNA, 19 bp, Homo sapiens
atgtttccagcagaagaca

SEQ ID NO: 4926937 - DNA, 24 bp, Homo sapiens
atgtttccagcagaagacaaaaag

SEQ ID NO: 4926938 - DNA, 12 bp, Homo sapiens
atgtttgaaatg

SEQ ID NO: 4926939 - DNA, 22 bp, Homo sapiens
atgtttgaggagcatgttttgt

SEQ ID NO: 4926940 - DNA, 15 bp, Homo sapiens
atgtttgcctctgcc

SEQ ID NO: 4926941 - DNA, 18 bp, Homo sapiens
atgtttgcctctgcctct

SEQ ID NO: 4926942 - DNA, 23 bp, Homo sapiens
atgtttgctcttgtttttattaa

SEQ ID NO: 4926943 - DNA, 19 bp, Homo sapiens
atgtttggtgcatagaact

SEQ ID NO: 4926944 - DNA, 20 bp, Homo sapiens
atgtttggtgcatagaactg

SEQ ID NO: 4926945 - DNA, 20 bp, Homo sapiens
atgtttgtctcagttggaaa

SEQ ID NO: 4926946 - DNA, 10 bp, Homo sapiens
atgtttgtgg

SEQ ID NO: 4926947 - DNA, 17 bp, Homo sapiens
atgtttgtggcctcaga

SEQ ID NO: 4926948 - DNA, 14 bp, Homo sapiens
atgttttgtgacta

SEQ ID NO: 4926949 - DNA, 17 bp, Homo sapiens
atgttttgtgactatat

SEQ ID NO: 4926950 - DNA, 22 bp, Homo sapiens
atgttttgtgcatttgtaaatg

SEQ ID NO: 4926951 - DNA, 20 bp, Homo sapiens
atgtttttaaaagtttcaat

SEQ ID NO: 4926952 - DNA, 22 bp, Homo sapiens
atgtttttaaaagtttcaatgt

SEQ ID NO: 4926953 - DNA, 18 bp, Homo sapiens
atgtttttatacaaaata

SEQ ID NO: 4926954 - DNA, 20 bp, Homo sapiens
atgtttttatgatatccctg

SEQ ID NO: 4926955 - DNA, 20 bp, Homo sapiens
attaaaaaaaaagatctgtt

SEQ ID NO: 4926956 - DNA, 17 bp, Homo sapiens
attaaaaagattctttt

SEQ ID NO: 4926957 - DNA, 19 bp, Homo sapiens
attaaaaagattctttttc

SEQ ID NO: 4926958 - DNA, 13 bp, Homo sapiens
attaaaaagttaa

SEQ ID NO: 4926959 - DNA, 21 bp, Homo sapiens
attaaaaatatggaacttcta

SEQ ID NO: 4926960 - DNA, 22 bp, Homo sapiens
attaaaacagctgcattagaaa

SEQ ID NO: 4926961 - DNA, 14 bp, Homo sapiens
attaaaacattgga

SEQ ID NO: 4926962 - DNA, 20 bp, Homo sapiens
attaaaacattggattatcc

SEQ ID NO: 4926963 - DNA, 13 bp, Homo sapiens
attaaaactcagc

SEQ ID NO: 4926964 - DNA, 15 bp, Homo sapiens
attaaaactcagcct

SEQ ID NO: 4926965 - DNA, 12 bp, Homo sapiens
attaaaactgct

SEQ ID NO: 4926966 - DNA, 13 bp, Homo sapiens
attaaaactgctt

SEQ ID NO: 4926967 - DNA, 14 bp, Homo sapiens
attaaaactgcttt

SEQ ID NO: 4926968 - DNA, 16 bp, Homo sapiens
attaaaactgcttttt

SEQ ID NO: 4926969 - DNA, 18 bp, Homo sapiens
attaaaatgattgtaaaa

SEQ ID NO: 4926970 - DNA, 20 bp, Homo sapiens
attaaaatgattgtaaaata

SEQ ID NO: 4926971 - DNA, 21 bp, Homo sapiens
attaaacagatgatgagaatt

SEQ ID NO: 4926972 - DNA, 21 bp, Homo sapiens
attcttgttttctttctttaa

SEQ ID NO: 4926973 - DNA, 23 bp, Homo sapiens
attcttgttttctttctttaaat

SEQ ID NO: 4926974 - DNA, 17 bp, Homo sapiens
attctttatttctgtca

SEQ ID NO: 4926975 - DNA, 18 bp, Homo sapiens
attctttcagctatcagt

SEQ ID NO: 4926976 - DNA, 12 bp, Homo sapiens
attctttcccag

SEQ ID NO: 4926977 - DNA, 15 bp, Homo sapiens
attctttcccagtga

SEQ ID NO: 4926978 - DNA, 20 bp, Homo sapiens
attctttcccagtgagtctc

SEQ ID NO: 4926979 - DNA, 13 bp, Homo sapiens
attctttttctga

SEQ ID NO: 4926980 - DNA, 16 bp, Homo sapiens
attgaaaaactcttta

SEQ ID NO: 4926981 - DNA, 17 bp, Homo sapiens
attgaaaaactctttat

SEQ ID NO: 4926982 - DNA, 12 bp, Homo sapiens
attgaaattata

SEQ ID NO: 4926983 - DNA, 21 bp, Homo sapiens
attgaaattgtacatatttgt

SEQ ID NO: 4926984 - DNA, 20 bp, Homo sapiens
attgaagacaatttgataca

SEQ ID NO: 4926985 - DNA, 19 bp, Homo sapiens
attgaagagagatatatct

SEQ ID NO: 4926986 - DNA, 21 bp, Homo sapiens
attgaaggaagccaaatttat

SEQ ID NO: 4926987 - DNA, 13 bp, Homo sapiens
attgacaaatctg

SEQ ID NO: 4926988 - DNA, 17 bp, Homo sapiens
attgacaaatctgtgta

SEQ ID NO: 4926989 - DNA, 21 bp, Homo sapiens
attgacaaatctgtgtatatt

SEQ ID NO: 4926990 - DNA, 15 bp, Homo sapiens
attgacaagaactga

SEQ ID NO: 4926991 - DNA, 19 bp, Homo sapiens
attgacacatccgcctttt

SEQ ID NO: 4926992 - DNA, 17 bp, Homo sapiens
attgacatttgtagttg

SEQ ID NO: 4926993 - DNA, 14 bp, Homo sapiens
attgaccatctgct

SEQ ID NO: 4926994 - DNA, 22 bp, Homo sapiens
attgacggttttttattattgt

SEQ ID NO: 4926995 - DNA, 15 bp, Homo sapiens
attgactttcagtaa

SEQ ID NO: 4926996 - DNA, 12 bp, Homo sapiens
attgagatttct

SEQ ID NO: 4926997 - DNA, 15 bp, Homo sapiens
attgagctgatataa

SEQ ID NO: 4926998 - DNA, 14 bp, Homo sapiens
attgaggctttgtg

SEQ ID NO: 4926999 - DNA, 16 bp, Homo sapiens
attgaggctttgtgtt

SEQ ID NO: 4927000 - DNA, 17 bp, Homo sapiens
attgatgaaaagattta

SEQ ID NO: 4927001 - DNA, 13 bp, Homo sapiens
attgattcctttt

SEQ ID NO: 4927002 - DNA, 22 bp, Homo sapiens
attgattccttttttcaaaatc

SEQ ID NO: 4927003 - DNA, 15 bp, Homo sapiens
attgatttgcattga

SEQ ID NO: 4927004 - DNA, 16 bp, Homo sapiens
attgatttgcattgaa

SEQ ID NO: 4927005 - DNA, 19 bp, Homo sapiens
attgcaaaatagcatttgt

SEQ ID NO: 4927006 - DNA, 23 bp, Homo sapiens
attgcaaaggttccaactgtata

SEQ ID NO: 4927007 - DNA, 16 bp, Homo sapiens
attgcaatatctgaag

SEQ ID NO: 4927008 - DNA, 17 bp, Homo sapiens
attgcaatatctgaagc

SEQ ID NO: 4927009 - DNA, 21 bp, Homo sapiens
attgcacattgttgttttttt

SEQ ID NO: 4927010 - DNA, 14 bp, Homo sapiens
attgcagctttatg

SEQ ID NO: 4927011 - DNA, 16 bp, Homo sapiens
attgcaggtggaactc

SEQ ID NO: 4927012 - DNA, 21 bp, Homo sapiens
attgcatctaggtaattttta

SEQ ID NO: 4927013 - DNA, 14 bp, Homo sapiens
attgcattctattg

SEQ ID NO: 4927014 - DNA, 23 bp, Homo sapiens
attgcattctattgccttctttg

SEQ ID NO: 4927015 - DNA, 11 bp, Homo sapiens
attgcattgac

SEQ ID NO: 4927016 - DNA, 16 bp, Homo sapiens
attgcatttcctgaca

SEQ ID NO: 4927017 - DNA, 14 bp, Homo sapiens
attgccaccaggag

SEQ ID NO: 4927018 - DNA, 15 bp, Homo sapiens
attgccaccaggaga

SEQ ID NO: 4927019 - DNA, 18 bp, Homo sapiens
attgccttctttgaagaa

SEQ ID NO: 4927020 - DNA, 21 bp, Homo sapiens
attgccttctttgaagaaggt

SEQ ID NO: 4927021 - DNA, 14 bp, Homo sapiens
attgctactgtcct

SEQ ID NO: 4927022 - DNA, 14 bp, Homo sapiens
attgctagataaaa

SEQ ID NO: 4927023 - DNA, 16 bp, Homo sapiens
attgctagataaaagc

SEQ ID NO: 4927024 - DNA, 17 bp, Homo sapiens
attgctagataaaagct

SEQ ID NO: 4927025 - DNA, 18 bp, Homo sapiens
attgctatgttactattt

SEQ ID NO: 4927026 - DNA, 18 bp, Homo sapiens
attgctccctaagactgt

SEQ ID NO: 4927027 - DNA, 23 bp, Homo sapiens
attgctgagcctctgctccccag

SEQ ID NO: 4927028 - DNA, 12 bp, Homo sapiens
attgctgatttt

SEQ ID NO: 4927029 - DNA, 18 bp, Homo sapiens
attgctgtgctttatgga

SEQ ID NO: 4927030 - DNA, 13 bp, Homo sapiens
attgcttagtaaa

SEQ ID NO: 4927031 - DNA, 19 bp, Homo sapiens
attgcttcctcctccccaa

SEQ ID NO: 4927032 - DNA, 17 bp, Homo sapiens
attgcttgagcccagga

SEQ ID NO: 4927033 - DNA, 18 bp, Homo sapiens
attgctttcgtgtaaatt

SEQ ID NO: 4927034 - DNA, 21 bp, Homo sapiens
attgctttgaagcagttgtgt

SEQ ID NO: 4927035 - DNA, 15 bp, Homo sapiens
attgcttttttgtat

SEQ ID NO: 4927036 - DNA, 12 bp, Homo sapiens
attggaaaaatc

SEQ ID NO: 4927037 - DNA, 13 bp, Homo sapiens
attggaaaaatca

SEQ ID NO: 4927038 - DNA, 14 bp, Homo sapiens
attggaaaaatcac

SEQ ID NO: 4927039 - DNA, 23 bp, Homo sapiens
attggaaatggatgcaaagtaca

SEQ ID NO: 4927040 - DNA, 18 bp, Homo sapiens
attggaatctgatatact

SEQ ID NO: 4927041 - DNA, 13 bp, Homo sapiens
attggacagttgt

SEQ ID NO: 4927042 - DNA, 15 bp, Homo sapiens
attggaccaggccat

SEQ ID NO: 4927043 - DNA, 23 bp, Homo sapiens
attggcatggctttatttgtttt

SEQ ID NO: 4927044 - DNA, 14 bp, Homo sapiens
attggcttgtagaa

SEQ ID NO: 4927045 - DNA, 15 bp, Homo sapiens
attggcttgtagaat

SEQ ID NO: 4927046 - DNA, 18 bp, Homo sapiens
attggcttgtagaattgt

SEQ ID NO: 4927047 - DNA, 20 bp, Homo sapiens
attgggagtccaggcacagg

SEQ ID NO: 4927048 - DNA, 19 bp, Homo sapiens
attgggggggccaaaagga

SEQ ID NO: 4927049 - DNA, 23 bp, Homo sapiens
attgggggggccaaaaggaaaaa

SEQ ID NO: 4927050 - DNA, 19 bp, Homo sapiens
attgggttcatgatgcagt

SEQ ID NO: 4927051 - DNA, 22 bp, Homo sapiens
attgggttcatgatgcagtctc

SEQ ID NO: 4927052 - DNA, 20 bp, Homo sapiens
attgtaaaaaaaaatgcctt

SEQ ID NO: 4927053 - DNA, 14 bp, Homo sapiens
attgtaaacaaact

SEQ ID NO: 4927054 - DNA, 14 bp, Homo sapiens
attgtacagctgtt

SEQ ID NO: 4927055 - DNA, 12 bp, Homo sapiens
attgtacataaa

SEQ ID NO: 4927056 - DNA, 15 bp, Homo sapiens
attgtaggtgcaagc

SEQ ID NO: 4927057 - DNA, 13 bp, Homo sapiens
attgtataaacta

SEQ ID NO: 4927058 - DNA, 22 bp, Homo sapiens
attgtataaactatcagtttgt

SEQ ID NO: 4927059 - DNA, 14 bp, Homo sapiens
attgtatgatgtgt

SEQ ID NO: 4927060 - DNA, 21 bp, Homo sapiens
attgtcatatcagcacatatt

SEQ ID NO: 4927061 - DNA, 13 bp, Homo sapiens
attgtctatttat

SEQ ID NO: 4927062 - DNA, 14 bp, Homo sapiens
attgtctatttatc

SEQ ID NO: 4927063 - DNA, 18 bp, Homo sapiens
attgtcttttgtcatgtg

SEQ ID NO: 4927064 - DNA, 15 bp, Homo sapiens
attgtgaactcattg

SEQ ID NO: 4927065 - DNA, 14 bp, Homo sapiens
attgtgcttctccc

SEQ ID NO: 4927066 - DNA, 18 bp, Homo sapiens
attgtgcttctccccaga

SEQ ID NO: 4927067 - DNA, 19 bp, Homo sapiens
attgtgcttctccccagaa

SEQ ID NO: 4927068 - DNA, 16 bp, Homo sapiens
attgtgggcataaact

SEQ ID NO: 4927069 - DNA, 19 bp, Homo sapiens
attgtgggcataaactgtt

SEQ ID NO: 4927070 - DNA, 23 bp, Homo sapiens
attgtggtaggccttttaacatt

SEQ ID NO: 4927071 - DNA, 15 bp, Homo sapiens
attgtgtatattcat

SEQ ID NO: 4927072 - DNA, 17 bp, Homo sapiens
attgtgttgacattaag

SEQ ID NO: 4927073 - DNA, 20 bp, Homo sapiens
attgtgttgacattaagaat

SEQ ID NO: 4927074 - DNA, 13 bp, Homo sapiens
attgtgtttgtgt

SEQ ID NO: 4927075 - DNA, 17 bp, Homo sapiens
attgttaactcttgtct

SEQ ID NO: 4927076 - DNA, 18 bp, Homo sapiens
attgttaatctctgttat

SEQ ID NO: 4927077 - DNA, 17 bp, Homo sapiens
attgttacacattaagt

SEQ ID NO: 4927078 - DNA, 15 bp, Homo sapiens
attgttcaaacaata

SEQ ID NO: 4927079 - DNA, 16 bp, Homo sapiens
attgttcaaacaatat

SEQ ID NO: 4927080 - DNA, 19 bp, Homo sapiens
attgttcaaacaatatcat

SEQ ID NO: 4927081 - DNA, 24 bp, Homo sapiens
attgttcaaacaatatcatatcat

SEQ ID NO: 4927082 - DNA, 17 bp, Homo sapiens
attgttgaatctatttc

SEQ ID NO: 4927083 - DNA, 17 bp, Homo sapiens
attgttgacagttctga

SEQ ID NO: 4927084 - DNA, 21 bp, Homo sapiens
attgttgacagttctgaagaa

SEQ ID NO: 4927085 - DNA, 14 bp, Homo sapiens
attgttgctccctg

SEQ ID NO: 4927086 - DNA, 16 bp, Homo sapiens
attgttgctccctgtg

SEQ ID NO: 4927087 - DNA, 14 bp, Homo sapiens
attgttgtttcttt

SEQ ID NO: 4927088 - DNA, 17 bp, Homo sapiens
attgttgtttttttaat

SEQ ID NO: 4927089 - DNA, 17 bp, Homo sapiens
attgtttctcaaatctt

SEQ ID NO: 4927090 - DNA, 12 bp, Homo sapiens
attgtttgctgc

SEQ ID NO: 4927091 - DNA, 18 bp, Homo sapiens
attgtttggcttcctcct

SEQ ID NO: 4927092 - DNA, 20 bp, Homo sapiens
attgttttaatctgaaattc

SEQ ID NO: 4927093 - DNA, 15 bp, Homo sapiens
attgttttagagact

SEQ ID NO: 4927094 - DNA, 13 bp, Homo sapiens
attgttttatcat

SEQ ID NO: 4927095 - DNA, 22 bp, Homo sapiens
attgttttctatttatgccttg

SEQ ID NO: 4927096 - DNA, 19 bp, Homo sapiens
attgttttctttaaagatg

SEQ ID NO: 4927097 - DNA, 15 bp, Homo sapiens
attgttttgaatatt

SEQ ID NO: 4927098 - DNA, 15 bp, Homo sapiens
attgttttgcacttt

SEQ ID NO: 4927099 - DNA, 11 bp, Homo sapiens
attgtttttct

SEQ ID NO: 4927100 - DNA, 14 bp, Homo sapiens
attgtttttctttc

SEQ ID NO: 4927101 - DNA, 21 bp, Homo sapiens
atttaaaaaaatcacaaaaat

SEQ ID NO: 4927102 - DNA, 14 bp, Homo sapiens
atttaaaaactgga

SEQ ID NO: 4927103 - DNA, 13 bp, Homo sapiens
atttaaacacaca

SEQ ID NO: 4927104 - DNA, 16 bp, Homo sapiens
atttaaactatcttgt

SEQ ID NO: 4927105 - DNA, 18 bp, Homo sapiens
atttaaactcaagacaat

SEQ ID NO: 4927106 - DNA, 21 bp, Homo sapiens
atttaaagacagggaagagca

SEQ ID NO: 4927107 - DNA, 19 bp, Homo sapiens
atttaaagatattgttcaa

SEQ ID NO: 4927108 - DNA, 20 bp, Homo sapiens
atttaaatataattctgtaa

SEQ ID NO: 4927109 - DNA, 15 bp, Homo sapiens
atttaaatgtgtaca

SEQ ID NO: 4927110 - DNA, 23 bp, Homo sapiens
atttaaatgttatgactatgtaa

SEQ ID NO: 4927111 - DNA, 15 bp, Homo sapiens
atttaaatttaaaga

SEQ ID NO: 4927112 - DNA, 18 bp, Homo sapiens
atttaaatttaaagatat

SEQ ID NO: 4927113 - DNA, 13 bp, Homo sapiens
atttaacaagatc

SEQ ID NO: 4927114 - DNA, 20 bp, Homo sapiens
atttaacattatttatatgg

SEQ ID NO: 4927115 - DNA, 15 bp, Homo sapiens
atttaagcaaatact

SEQ ID NO: 4927116 - DNA, 16 bp, Homo sapiens
atttaagcaaatactt

SEQ ID NO: 4927117 - DNA, 19 bp, Homo sapiens
atttaagtgcgtgtgtaga

SEQ ID NO: 4927118 - DNA, 11 bp, Homo sapiens
atttaataaag

SEQ ID NO: 4927119 - DNA, 13 bp, Homo sapiens
atttaataacatt

SEQ ID NO: 4927120 - DNA, 23 bp, Homo sapiens
atttaataacattaccttactgt

SEQ ID NO: 4927121 - DNA, 21 bp, Homo sapiens
atttaatatggatttgttaca

SEQ ID NO: 4927122 - DNA, 13 bp, Homo sapiens
atttaatgcatta

SEQ ID NO: 4927123 - DNA, 20 bp, Homo sapiens
atttaatgcattaaacctgt

SEQ ID NO: 4927124 - DNA, 12 bp, Homo sapiens
atttaatgctgc

SEQ ID NO: 4927125 - DNA, 14 bp, Homo sapiens
atttaatgctgcct

SEQ ID NO: 4927126 - DNA, 14 bp, Homo sapiens
atttaatgtgagtt

SEQ ID NO: 4927127 - DNA, 15 bp, Homo sapiens
atttaatttagtgat

SEQ ID NO: 4927128 - DNA, 12 bp, Homo sapiens
atttaatttcca

SEQ ID NO: 4927129 - DNA, 13 bp, Homo sapiens
atttaatttccag

SEQ ID NO: 4927130 - DNA, 19 bp, Homo sapiens
atttaatttttttgagaca

SEQ ID NO: 4927131 - DNA, 23 bp, Homo sapiens
atttaatttttttgagacagagt

SEQ ID NO: 4927132 - DNA, 14 bp, Homo sapiens
atttactaaacata

SEQ ID NO: 4927133 - DNA, 21 bp, Homo sapiens
atttactaagccacaagaaat

SEQ ID NO: 4927134 - DNA, 12 bp, Homo sapiens
atttactatata

SEQ ID NO: 4927135 - DNA, 14 bp, Homo sapiens
atttactatatata

SEQ ID NO: 4927136 - DNA, 20 bp, Homo sapiens
atttactggacataacattt

SEQ ID NO: 4927137 - DNA, 13 bp, Homo sapiens
atttagaaaaaag

SEQ ID NO: 4927138 - DNA, 20 bp, Homo sapiens
atttagagaactgtggccgt

SEQ ID NO: 4927139 - DNA, 16 bp, Homo sapiens
atttagagatgctgta

SEQ ID NO: 4927140 - DNA, 22 bp, Homo sapiens
atttagctaaacggattccaaa

SEQ ID NO: 4927141 - DNA, 23 bp, Homo sapiens
atttaggtttttgtttgtttcct

SEQ ID NO: 4927142 - DNA, 19 bp, Homo sapiens
atttagtgatcttagcata

SEQ ID NO: 4927143 - DNA, 21 bp, Homo sapiens
atttataaaattagaaagcaa

SEQ ID NO: 4927144 - DNA, 12 bp, Homo sapiens
atttatagtttg

SEQ ID NO: 4927145 - DNA, 22 bp, Homo sapiens
atttatagtttgtacatgcatt

SEQ ID NO: 4927146 - DNA, 15 bp, Homo sapiens
atttatataaatgta

SEQ ID NO: 4927147 - DNA, 17 bp, Homo sapiens
atttatatatgaaaact

SEQ ID NO: 4927148 - DNA, 20 bp, Homo sapiens
atttatcaaagcatagatgt

SEQ ID NO: 4927149 - DNA, 20 bp, Homo sapiens
atttatccacaggaaagtgt

SEQ ID NO: 4927150 - DNA, 12 bp, Homo sapiens
atttatccacta

SEQ ID NO: 4927151 - DNA, 16 bp, Homo sapiens
atttatccatttgtaa

SEQ ID NO: 4927152 - DNA, 21 bp, Homo sapiens
atttatcctgaaatttcagat

SEQ ID NO: 4927153 - DNA, 13 bp, Homo sapiens
atttatctaaatt

SEQ ID NO: 4927154 - DNA, 14 bp, Homo sapiens
atttatctctattt

SEQ ID NO: 4927155 - DNA, 22 bp, Homo sapiens
atttatctctatttaatattta

SEQ ID NO: 4927156 - DNA, 15 bp, Homo sapiens
atttatgatttaata

SEQ ID NO: 4927157 - DNA, 21 bp, Homo sapiens
atttatgccttgatgatttaa

SEQ ID NO: 4927158 - DNA, 13 bp, Homo sapiens
atttatgtgtgag

SEQ ID NO: 4927159 - DNA, 18 bp, Homo sapiens
atttatgtgtgaggagct

SEQ ID NO: 4927160 - DNA, 13 bp, Homo sapiens
atttatgtttgca

SEQ ID NO: 4927161 - DNA, 19 bp, Homo sapiens
atttattaaaatgattgta

SEQ ID NO: 4927162 - DNA, 21 bp, Homo sapiens
atttattaaaatgattgtaaa

SEQ ID NO: 4927163 - DNA, 13 bp, Homo sapiens
atttattaaataa

SEQ ID NO: 4927164 - DNA, 14 bp, Homo sapiens
atttattaaataaa

SEQ ID NO: 4927165 - DNA, 16 bp, Homo sapiens
atttattaaataaaat

SEQ ID NO: 4927166 - DNA, 18 bp, Homo sapiens
atttattaaataaaatca

SEQ ID NO: 4927167 - DNA, 14 bp, Homo sapiens
atttattaatattt

SEQ ID NO: 4927168 - DNA, 23 bp, Homo sapiens
atttattaatatttaacattatt

SEQ ID NO: 4927169 - DNA, 12 bp, Homo sapiens
atttattattga

SEQ ID NO: 4927170 - DNA, 15 bp, Homo sapiens
atttattattgaaat

SEQ ID NO: 4927171 - DNA, 17 bp, Homo sapiens
atttattattgaaattg

SEQ ID NO: 4927172 - DNA, 11 bp, Homo sapiens
atttattattt

SEQ ID NO: 4927173 - DNA, 19 bp, Homo sapiens
atttattatttatttatta

SEQ ID NO: 4927174 - DNA, 20 bp, Homo sapiens
atttattcagcttcatttgt

SEQ ID NO: 4927175 - DNA, 23 bp, Homo sapiens
atttatttacagatgaatgtatt

SEQ ID NO: 4927176 - DNA, 15 bp, Homo sapiens
atttatttatgtact

SEQ ID NO: 4927177 - DNA, 22 bp, Homo sapiens
atttattttaaaaaatgaaaat

SEQ ID NO: 4927178 - DNA, 15 bp, Homo sapiens
atttattttcctaaa

SEQ ID NO: 4927179 - DNA, 16 bp, Homo sapiens
atttattttgtaatta

SEQ ID NO: 4927180 - DNA, 19 bp, Homo sapiens
atttattttgtaattatga

SEQ ID NO: 4927181 - DNA, 14 bp, Homo sapiens
atttatttttacaa

SEQ ID NO: 4927182 - DNA, 14 bp, Homo sapiens
atttattttttaca

SEQ ID NO: 4927183 - DNA, 19 bp, Homo sapiens
atttattttttacattatt

SEQ ID NO: 4927184 - DNA, 15 bp, Homo sapiens
atttcaaaaatataa

SEQ ID NO: 4927185 - DNA, 18 bp, Homo sapiens
atttcaaaagacatgttg

SEQ ID NO: 4927186 - DNA, 14 bp, Homo sapiens
atttcaaaatgctt

SEQ ID NO: 4927187 - DNA, 13 bp, Homo sapiens
atttcaagaaaaa

SEQ ID NO: 4927188 - DNA, 20 bp, Homo sapiens
atttcaagaaaaaataaatg

SEQ ID NO: 4927189 - DNA, 14 bp, Homo sapiens
atttcacaggctaa

SEQ ID NO: 4927190 - DNA, 16 bp, Homo sapiens
atttcactagaaaagc

SEQ ID NO: 4927191 - DNA, 16 bp, Homo sapiens
atttcagagaggcctt

SEQ ID NO: 4927192 - DNA, 22 bp, Homo sapiens
atttcagattttgataactgtt

SEQ ID NO: 4927193 - DNA, 18 bp, Homo sapiens
caaaactatacttgaaca

SEQ ID NO: 4927194 - DNA, 19 bp, Homo sapiens
caaaactatacttgaacaa

SEQ ID NO: 4927195 - DNA, 15 bp, Homo sapiens
caaaagaaatacctt

SEQ ID NO: 4927196 - DNA, 15 bp, Homo sapiens
caaaagacatgttgt

SEQ ID NO: 4927197 - DNA, 12 bp, Homo sapiens
caaaagagaaaa

SEQ ID NO: 4927198 - DNA, 12 bp, Homo sapiens
caaaagatgaaa

SEQ ID NO: 4927199 - DNA, 18 bp, Homo sapiens
caaaagattgctgaaaaa

SEQ ID NO: 4927200 - DNA, 20 bp, Homo sapiens
caaaagcagtaaatttgcta

SEQ ID NO: 4927201 - DNA, 14 bp, Homo sapiens
caaaagccttgtgt

SEQ ID NO: 4927202 - DNA, 20 bp, Homo sapiens
caaaagccttgtgtatattt

SEQ ID NO: 4927203 - DNA, 19 bp, Homo sapiens
caaaagctagacagatccc

SEQ ID NO: 4927204 - DNA, 11 bp, Homo sapiens
caaaaggaaaa

SEQ ID NO: 4927205 - DNA, 17 bp, Homo sapiens
caaaaggaaaaagctcc

SEQ ID NO: 4927206 - DNA, 14 bp, Homo sapiens
caaaagggaaaaga

SEQ ID NO: 4927207 - DNA, 14 bp, Homo sapiens
caaaagggtcagag

SEQ ID NO: 4927208 - DNA, 20 bp, Homo sapiens
caaaaggttcactaaagcag

SEQ ID NO: 4927209 - DNA, 18 bp, Homo sapiens
caaaagttggactaaatg

SEQ ID NO: 4927210 - DNA, 15 bp, Homo sapiens
caaaagttttcctga

SEQ ID NO: 4927211 - DNA, 15 bp, Homo sapiens
caaaataaaaactat

SEQ ID NO: 4927212 - DNA, 18 bp, Homo sapiens
caaaataattttaagaaa

SEQ ID NO: 4927213 - DNA, 13 bp, Homo sapiens
caaaatagaagct

SEQ ID NO: 4927214 - DNA, 15 bp, Homo sapiens
caaaatagcatttgt

SEQ ID NO: 4927215 - DNA, 16 bp, Homo sapiens
caaaatatttgtacat

SEQ ID NO: 4927216 - DNA, 12 bp, Homo sapiens
caaaatattttc

SEQ ID NO: 4927217 - DNA, 18 bp, Homo sapiens
caaaatccttccaaagaa

SEQ ID NO: 4927218 - DNA, 16 bp, Homo sapiens
caaaatccttgcttat

SEQ ID NO: 4927219 - DNA, 16 bp, Homo sapiens
caaaatgacatctttt

SEQ ID NO: 4927220 - DNA, 23 bp, Homo sapiens
caaaatgctttttatttctgcat

SEQ ID NO: 4927221 - DNA, 16 bp, Homo sapiens
caaaatggacatggtg

SEQ ID NO: 4927222 - DNA, 15 bp, Homo sapiens
caaaatgtatatatt

SEQ ID NO: 4927223 - DNA, 16 bp, Homo sapiens
caaaatgtatatattt

SEQ ID NO: 4927224 - DNA, 17 bp, Homo sapiens
caaaatgtatatattta

SEQ ID NO: 4927225 - DNA, 18 bp, Homo sapiens
caaaatgtatatatttag

SEQ ID NO: 4927226 - DNA, 20 bp, Homo sapiens
caaaatgttatcttctcaag

SEQ ID NO: 4927227 - DNA, 19 bp, Homo sapiens
caaaatttgatgccaggac

SEQ ID NO: 4927228 - DNA, 23 bp, Homo sapiens
caaaattttataagcaaatttca

SEQ ID NO: 4927229 - DNA, 16 bp, Homo sapiens
caaaattttattttgt

SEQ ID NO: 4927230 - DNA, 20 bp, Homo sapiens
caaaattttctcattttctt

SEQ ID NO: 4927231 - DNA, 17 bp, Homo sapiens
caaacaaatatgcaaaa

SEQ ID NO: 4927232 - DNA, 21 bp, Homo sapiens
caaacaaggggctgttacata

SEQ ID NO: 4927233 - DNA, 14 bp, Homo sapiens
caaacacctcccag

SEQ ID NO: 4927234 - DNA, 14 bp, Homo sapiens
caaacaccttccag

SEQ ID NO: 4927235 - DNA, 16 bp, Homo sapiens
caaacagaacagggtc

SEQ ID NO: 4927236 - DNA, 18 bp, Homo sapiens
caaacatcactctgctgc

SEQ ID NO: 4927237 - DNA, 18 bp, Homo sapiens
caaacatcctatcaacaa

SEQ ID NO: 4927238 - DNA, 15 bp, Homo sapiens
caaacatgagatgtg

SEQ ID NO: 4927239 - DNA, 16 bp, Homo sapiens
caaacatgtatttatg

SEQ ID NO: 4927240 - DNA, 15 bp, Homo sapiens
caaaccaaataaaaa

SEQ ID NO: 4927241 - DNA, 23 bp, Homo sapiens
caaacccacgattttctccagct

SEQ ID NO: 4927242 - DNA, 21 bp, Homo sapiens
caaaccccgaccacctgccca

SEQ ID NO: 4927243 - DNA, 17 bp, Homo sapiens
caaacgcctcccctgcc

SEQ ID NO: 4927244 - DNA, 20 bp, Homo sapiens
caaactaaaagacatttgtt

SEQ ID NO: 4927245 - DNA, 16 bp, Homo sapiens
caaactaaaggtgcac

SEQ ID NO: 4927246 - DNA, 22 bp, Homo sapiens
caaactacagacctgctttttg

SEQ ID NO: 4927247 - DNA, 17 bp, Homo sapiens
caaactggagtctggag

SEQ ID NO: 4927248 - DNA, 15 bp, Homo sapiens
caaactggggcctcc

SEQ ID NO: 4927249 - DNA, 21 bp, Homo sapiens
caaactgtaaataaaaagaaa

SEQ ID NO: 4927250 - DNA, 16 bp, Homo sapiens
caaactgttcaagaaa

SEQ ID NO: 4927251 - DNA, 15 bp, Homo sapiens
caaacttactatttt

SEQ ID NO: 4927252 - DNA, 17 bp, Homo sapiens
caaacttcactctgggc

SEQ ID NO: 4927253 - DNA, 18 bp, Homo sapiens
caaacttttatactcttt

SEQ ID NO: 4927254 - DNA, 21 bp, Homo sapiens
caaacttttcaaggcttatat

SEQ ID NO: 4927255 - DNA, 14 bp, Homo sapiens
caaagaaatgaaca

SEQ ID NO: 4927256 - DNA, 17 bp, Homo sapiens
caaagagcacaaacatt

SEQ ID NO: 4927257 - DNA, 12 bp, Homo sapiens
caaagaggctgc

SEQ ID NO: 4927258 - DNA, 13 bp, Homo sapiens
caaagatcaaaat

SEQ ID NO: 4927259 - DNA, 20 bp, Homo sapiens
caaagatcaaaataaaaagt

SEQ ID NO: 4927260 - DNA, 23 bp, Homo sapiens
caaagatgcagccgccttccttg

SEQ ID NO: 4927261 - DNA, 11 bp, Homo sapiens
caaagatgctg

SEQ ID NO: 4927262 - DNA, 16 bp, Homo sapiens
caaagatgctgtgagt

SEQ ID NO: 4927263 - DNA, 13 bp, Homo sapiens
caaagattcatga

SEQ ID NO: 4927264 - DNA, 16 bp, Homo sapiens
caaagattcatgattt

SEQ ID NO: 4927265 - DNA, 13 bp, Homo sapiens
caaagcacagtgt

SEQ ID NO: 4927266 - DNA, 22 bp, Homo sapiens
caaagcacagtgttaaatgaaa

SEQ ID NO: 4927267 - DNA, 17 bp, Homo sapiens
caaagcacagtttgaac

SEQ ID NO: 4927268 - DNA, 23 bp, Homo sapiens
caaagccagggtctctccctcag

SEQ ID NO: 4927269 - DNA, 13 bp, Homo sapiens
caaagctaggcct

SEQ ID NO: 4927270 - DNA, 16 bp, Homo sapiens
caaagctgttaaactg

SEQ ID NO: 4927271 - DNA, 17 bp, Homo sapiens
caaagctgttaaactgt

SEQ ID NO: 4927272 - DNA, 18 bp, Homo sapiens
caaagctgttaaactgtt

SEQ ID NO: 4927273 - DNA, 17 bp, Homo sapiens
caaaggaggctggcagg

SEQ ID NO: 4927274 - DNA, 20 bp, Homo sapiens
caaaggcaagttaagagaaa

SEQ ID NO: 4927275 - DNA, 13 bp, Homo sapiens
caaaggccaaact

SEQ ID NO: 4927276 - DNA, 14 bp, Homo sapiens
caaaggccaaactg

SEQ ID NO: 4927277 - DNA, 19 bp, Homo sapiens
caaaggccaaactgctgga

SEQ ID NO: 4927278 - DNA, 17 bp, Homo sapiens
caaagggaaatatcatt

SEQ ID NO: 4927279 - DNA, 21 bp, Homo sapiens
caaaggggacaggcctcacct

SEQ ID NO: 4927280 - DNA, 23 bp, Homo sapiens
caaagggtatcaggtgctgccat

SEQ ID NO: 4927281 - DNA, 22 bp, Homo sapiens
caaaggttctaggtttcaaaga

SEQ ID NO: 4927282 - DNA, 19 bp, Homo sapiens
caaaggttttcctcttcta

SEQ ID NO: 4927283 - DNA, 13 bp, Homo sapiens
caaagtataacca

SEQ ID NO: 4927284 - DNA, 23 bp, Homo sapiens
caaagtcctttttttccatcttt

SEQ ID NO: 4927285 - DNA, 13 bp, Homo sapiens
caaagtctctaat

SEQ ID NO: 4927286 - DNA, 14 bp, Homo sapiens
caaagtctgtgtga

SEQ ID NO: 4927287 - DNA, 23 bp, Homo sapiens
caaagtgaaggacatagaggtat

SEQ ID NO: 4927288 - DNA, 16 bp, Homo sapiens
caaagtgctgagatta

SEQ ID NO: 4927289 - DNA, 19 bp, Homo sapiens
caaagtgctgggattacag

SEQ ID NO: 4927290 - DNA, 15 bp, Homo sapiens
caaagttaacagatt

SEQ ID NO: 4927291 - DNA, 19 bp, Homo sapiens
caaagttttgaaaagctat

SEQ ID NO: 4927292 - DNA, 18 bp, Homo sapiens
caaataaactctaaacat

SEQ ID NO: 4927293 - DNA, 17 bp, Homo sapiens
caaatataaaacttaca

SEQ ID NO: 4927294 - DNA, 19 bp, Homo sapiens
caaatatagcgttcccaac

SEQ ID NO: 4927295 - DNA, 13 bp, Homo sapiens
caaatatattgtt

SEQ ID NO: 4927296 - DNA, 14 bp, Homo sapiens
caaatatattgtta

SEQ ID NO: 4927297 - DNA, 15 bp, Homo sapiens
caaatatattgttaa

SEQ ID NO: 4927298 - DNA, 17 bp, Homo sapiens
caaatatgctaatttgg

SEQ ID NO: 4927299 - DNA, 13 bp, Homo sapiens
caaatattcagaa

SEQ ID NO: 4927300 - DNA, 14 bp, Homo sapiens
caaatatttatttt

SEQ ID NO: 4927301 - DNA, 15 bp, Homo sapiens
caaatatttattttc

SEQ ID NO: 4927302 - DNA, 13 bp, Homo sapiens
caaatcaacagaa

SEQ ID NO: 4927303 - DNA, 18 bp, Homo sapiens
caaatccgctctcttcct

SEQ ID NO: 4927304 - DNA, 17 bp, Homo sapiens
caagtcctgtgaatttc

SEQ ID NO: 4927305 - DNA, 18 bp, Homo sapiens
caagtcggaacagcagat

SEQ ID NO: 4927306 - DNA, 16 bp, Homo sapiens
caagtctcagtggctt

SEQ ID NO: 4927307 - DNA, 18 bp, Homo sapiens
caagtctctgctggccca

SEQ ID NO: 4927308 - DNA, 18 bp, Homo sapiens
caagtgactgtatctgtg

SEQ ID NO: 4927309 - DNA, 19 bp, Homo sapiens
caagtgactgtatctgtgt

SEQ ID NO: 4927310 - DNA, 17 bp, Homo sapiens
caagtgagagctgggtg

SEQ ID NO: 4927311 - DNA, 19 bp, Homo sapiens
caagtgatctgcccacctc

SEQ ID NO: 4927312 - DNA, 16 bp, Homo sapiens
caagtgattctcctgc

SEQ ID NO: 4927313 - DNA, 22 bp, Homo sapiens
caagtgattctcctgcctcagc

SEQ ID NO: 4927314 - DNA, 20 bp, Homo sapiens
caagtgcactttctaatgtt

SEQ ID NO: 4927315 - DNA, 23 bp, Homo sapiens
caagtggaccttaggccttcctc

SEQ ID NO: 4927316 - DNA, 14 bp, Homo sapiens
caagtgtatatcag

SEQ ID NO: 4927317 - DNA, 16 bp, Homo sapiens
caagtgtatatcagaa

SEQ ID NO: 4927318 - DNA, 18 bp, Homo sapiens
caagtgtggggggtcctt

SEQ ID NO: 4927319 - DNA, 19 bp, Homo sapiens
caagtgttgttttttaagt

SEQ ID NO: 4927320 - DNA, 14 bp, Homo sapiens
caagttctaagatt

SEQ ID NO: 4927321 - DNA, 17 bp, Homo sapiens
caagttctaagattcta

SEQ ID NO: 4927322 - DNA, 18 bp, Homo sapiens
caagttctaagattctaa

SEQ ID NO: 4927323 - DNA, 16 bp, Homo sapiens
caagtttccatagcaa

SEQ ID NO: 4927324 - DNA, 12 bp, Homo sapiens
caataaaagctt

SEQ ID NO: 4927325 - DNA, 19 bp, Homo sapiens
caataaagaaaacttccat

SEQ ID NO: 4927326 - DNA, 12 bp, Homo sapiens
caataaagagat

SEQ ID NO: 4927327 - DNA, 22 bp, Homo sapiens
caataaagagttagaatgaaaa

SEQ ID NO: 4927328 - DNA, 15 bp, Homo sapiens
caataaatgtctgtt

SEQ ID NO: 4927329 - DNA, 14 bp, Homo sapiens
caataacactaaaa

SEQ ID NO: 4927330 - DNA, 13 bp, Homo sapiens
caataacactgtc

SEQ ID NO: 4927331 - DNA, 21 bp, Homo sapiens
caataatattgttgtataatt

SEQ ID NO: 4927332 - DNA, 23 bp, Homo sapiens
caataatattgttgtataatttc

SEQ ID NO: 4927333 - DNA, 19 bp, Homo sapiens
caataattcatattcttca

SEQ ID NO: 4927334 - DNA, 18 bp, Homo sapiens
caatacagataacattag

SEQ ID NO: 4927335 - DNA, 17 bp, Homo sapiens
caatactagtcacccca

SEQ ID NO: 4927336 - DNA, 23 bp, Homo sapiens
caatataaaaggcaaatgtgtac

SEQ ID NO: 4927337 - DNA, 16 bp, Homo sapiens
caatatataaaaatat

SEQ ID NO: 4927338 - DNA, 20 bp, Homo sapiens
caatatataaaaatatatat

SEQ ID NO: 4927339 - DNA, 21 bp, Homo sapiens
caatatataaaaatatatata

SEQ ID NO: 4927340 - DNA, 17 bp, Homo sapiens
caatatctaatatatat

SEQ ID NO: 4927341 - DNA, 13 bp, Homo sapiens
caatatgtattgt

SEQ ID NO: 4927342 - DNA, 13 bp, Homo sapiens
caatattccttag

SEQ ID NO: 4927343 - DNA, 23 bp, Homo sapiens
caatatttctgctttctttgatt

SEQ ID NO: 4927344 - DNA, 19 bp, Homo sapiens
caatatttgaattttaaat

SEQ ID NO: 4927345 - DNA, 22 bp, Homo sapiens
caatcaaataagtatttataat

SEQ ID NO: 4927346 - DNA, 13 bp, Homo sapiens
caatcatatgtga

SEQ ID NO: 4927347 - DNA, 15 bp, Homo sapiens
caatcatatgtgatc

SEQ ID NO: 4927348 - DNA, 17 bp, Homo sapiens
caatcatctgtgtgaaa

SEQ ID NO: 4927349 - DNA, 12 bp, Homo sapiens
caatcatttctc

SEQ ID NO: 4927350 - DNA, 13 bp, Homo sapiens
caatcatttctca

SEQ ID NO: 4927351 - DNA, 17 bp, Homo sapiens
caatcccaccaaccctc

SEQ ID NO: 4927352 - DNA, 20 bp, Homo sapiens
caatccctcaccttctgagt

SEQ ID NO: 4927353 - DNA, 20 bp, Homo sapiens
caatccctttattaccccct

SEQ ID NO: 4927354 - DNA, 13 bp, Homo sapiens
caatcctctaagc

SEQ ID NO: 4927355 - DNA, 14 bp, Homo sapiens
caatcctttattat

SEQ ID NO: 4927356 - DNA, 13 bp, Homo sapiens
caatcgcaaatca

SEQ ID NO: 4927357 - DNA, 15 bp, Homo sapiens
caatcgcaaatcaaa

SEQ ID NO: 4927358 - DNA, 12 bp, Homo sapiens
caatctaatttt

SEQ ID NO: 4927359 - DNA, 14 bp, Homo sapiens
caatctattatttc

SEQ ID NO: 4927360 - DNA, 23 bp, Homo sapiens
caatctattatttctctaattat

SEQ ID NO: 4927361 - DNA, 16 bp, Homo sapiens
caatcttttttactct

SEQ ID NO: 4927362 - DNA, 12 bp, Homo sapiens
caatgaaaagtc

SEQ ID NO: 4927363 - DNA, 18 bp, Homo sapiens
caatgaacacttataagt

SEQ ID NO: 4927364 - DNA, 14 bp, Homo sapiens
caatgaagccagct

SEQ ID NO: 4927365 - DNA, 21 bp, Homo sapiens
caatgaagccagctcacagtg

SEQ ID NO: 4927366 - DNA, 14 bp, Homo sapiens
caatgaatattgaa

SEQ ID NO: 4927367 - DNA, 17 bp, Homo sapiens
caatgacatctcagggg

SEQ ID NO: 4927368 - DNA, 20 bp, Homo sapiens
caatgactgtgctactgtct

SEQ ID NO: 4927369 - DNA, 21 bp, Homo sapiens
caatgactgtgctactgtctt

SEQ ID NO: 4927370 - DNA, 20 bp, Homo sapiens
caatgatagtaagaaaagtg

SEQ ID NO: 4927371 - DNA, 18 bp, Homo sapiens
caatgcacatccattccc

SEQ ID NO: 4927372 - DNA, 20 bp, Homo sapiens
caatgcagcaaggccctgct

SEQ ID NO: 4927373 - DNA, 20 bp, Homo sapiens
caatgctatttttgttttta

SEQ ID NO: 4927374 - DNA, 13 bp, Homo sapiens
caatgctggctgt

SEQ ID NO: 4927375 - DNA, 14 bp, Homo sapiens
caatggcagccttg

SEQ ID NO: 4927376 - DNA, 15 bp, Homo sapiens
caatggcagccttgg

SEQ ID NO: 4927377 - DNA, 16 bp, Homo sapiens
caatggcagccttggc

SEQ ID NO: 4927378 - DNA, 22 bp, Homo sapiens
caatggctatatggcaagaaag

SEQ ID NO: 4927379 - DNA, 16 bp, Homo sapiens
caatgtcaggaacaga

SEQ ID NO: 4927380 - DNA, 19 bp, Homo sapiens
caatgtcaggaacagaagg

SEQ ID NO: 4927381 - DNA, 21 bp, Homo sapiens
caatgtcatatactgccatgt

SEQ ID NO: 4927382 - DNA, 18 bp, Homo sapiens
caatgtgaaaaatgtgtc

SEQ ID NO: 4927383 - DNA, 13 bp, Homo sapiens
caatgtgctctcg

SEQ ID NO: 4927384 - DNA, 17 bp, Homo sapiens
caatgtgtttttctcca

SEQ ID NO: 4927385 - DNA, 23 bp, Homo sapiens
caatgtttatgcaaggaaggaaa

SEQ ID NO: 4927386 - DNA, 18 bp, Homo sapiens
caattaataaaaaatgga

SEQ ID NO: 4927387 - DNA, 18 bp, Homo sapiens
caattaatagtttgtcta

SEQ ID NO: 4927388 - DNA, 19 bp, Homo sapiens
caattaatagtttgtctat

SEQ ID NO: 4927389 - DNA, 22 bp, Homo sapiens
caattaatagtttgtctatttt

SEQ ID NO: 4927390 - DNA, 15 bp, Homo sapiens
caattattgatatat

SEQ ID NO: 4927391 - DNA, 17 bp, Homo sapiens
caattattgatatatat

SEQ ID NO: 4927392 - DNA, 20 bp, Homo sapiens
caattattgatatatattat

SEQ ID NO: 4927393 - DNA, 17 bp, Homo sapiens
caattcaatacaaacaa

SEQ ID NO: 4927394 - DNA, 22 bp, Homo sapiens
caattcaatacaaacaatctct

SEQ ID NO: 4927395 - DNA, 21 bp, Homo sapiens
caattccaatatttctgcttt

SEQ ID NO: 4927396 - DNA, 14 bp, Homo sapiens
caattccatcaccc

SEQ ID NO: 4927397 - DNA, 13 bp, Homo sapiens
caattcccctctg

SEQ ID NO: 4927398 - DNA, 21 bp, Homo sapiens
caattgtgggcataaactgtt

SEQ ID NO: 4927399 - DNA, 21 bp, Homo sapiens
caattgttgacagttctgaag

SEQ ID NO: 4927400 - DNA, 16 bp, Homo sapiens
caatttcaaggttcta

SEQ ID NO: 4927401 - DNA, 19 bp, Homo sapiens
caatttcctttatatttag

SEQ ID NO: 4927402 - DNA, 20 bp, Homo sapiens
caatttcctttatatttagt

SEQ ID NO: 4927403 - DNA, 14 bp, Homo sapiens
caatttgatacata

SEQ ID NO: 4927404 - DNA, 13 bp, Homo sapiens
caattttaaagac

SEQ ID NO: 4927405 - DNA, 20 bp, Homo sapiens
caattttctggaatacatga

SEQ ID NO: 4927406 - DNA, 14 bp, Homo sapiens
caatttttaggaag

SEQ ID NO: 4927407 - DNA, 20 bp, Homo sapiens
cacaaaaatttgaacactgg

SEQ ID NO: 4927408 - DNA, 18 bp, Homo sapiens
cacaaaagtttctctttt

SEQ ID NO: 4927409 - DNA, 15 bp, Homo sapiens
cacaaaccatgcaaa

SEQ ID NO: 4927410 - DNA, 17 bp, Homo sapiens
cacaaaccttctgcctt

SEQ ID NO: 4927411 - DNA, 14 bp, Homo sapiens
cacaaactgtaaat

SEQ ID NO: 4927412 - DNA, 23 bp, Homo sapiens
cacaaactgtaaataaaaagaaa

SEQ ID NO: 4927413 - DNA, 18 bp, Homo sapiens
cacaaaggccaaactgct

SEQ ID NO: 4927414 - DNA, 22 bp, Homo sapiens
caccctgtacctcatcccatga

SEQ ID NO: 4927415 - DNA, 16 bp, Homo sapiens
caccctgtactgttct

SEQ ID NO: 4927416 - DNA, 16 bp, Homo sapiens
caccctgtggccctgg

SEQ ID NO: 4927417 - DNA, 15 bp, Homo sapiens
cacccttagaaaatg

SEQ ID NO: 4927418 - DNA, 13 bp, Homo sapiens
cacccttcttttc

SEQ ID NO: 4927419 - DNA, 21 bp, Homo sapiens
cacccttcttttctcatgtgt

SEQ ID NO: 4927420 - DNA, 22 bp, Homo sapiens
caccgaagtggactggcccctg

SEQ ID NO: 4927421 - DNA, 22 bp, Homo sapiens
caccgggcactcagaagacact

SEQ ID NO: 4927422 - DNA, 18 bp, Homo sapiens
caccgggccacagagaaa

SEQ ID NO: 4927423 - DNA, 15 bp, Homo sapiens
caccggtccagctgg

SEQ ID NO: 4927424 - DNA, 20 bp, Homo sapiens
cacctaaaggtgtatttaaa

SEQ ID NO: 4927425 - DNA, 22 bp, Homo sapiens
cacctaattcgatgaaggctgc

SEQ ID NO: 4927426 - DNA, 23 bp, Homo sapiens
cacctaattcgatgaaggctgcc

SEQ ID NO: 4927427 - DNA, 18 bp, Homo sapiens
cacctaccactcacatga

SEQ ID NO: 4927428 - DNA, 17 bp, Homo sapiens
cacctaccatcagggac

SEQ ID NO: 4927429 - DNA, 18 bp, Homo sapiens
cacctaccgagttcaagt

SEQ ID NO: 4927430 - DNA, 22 bp, Homo sapiens
cacctacttttctttcctcaga

SEQ ID NO: 4927431 - DNA, 15 bp, Homo sapiens
cacctagctgtgcaa

SEQ ID NO: 4927432 - DNA, 16 bp, Homo sapiens
cacctagctttattct

SEQ ID NO: 4927433 - DNA, 12 bp, Homo sapiens
cacctcagcctc

SEQ ID NO: 4927434 - DNA, 14 bp, Homo sapiens
cacctcagcctccc

SEQ ID NO: 4927435 - DNA, 17 bp, Homo sapiens
cacctcagttcccttgg

SEQ ID NO: 4927436 - DNA, 19 bp, Homo sapiens
cacctcagttcccttggcc

SEQ ID NO: 4927437 - DNA, 21 bp, Homo sapiens
cacctcagttcccttggcctc

SEQ ID NO: 4927438 - DNA, 20 bp, Homo sapiens
cacctccagcccgggagcct

SEQ ID NO: 4927439 - DNA, 9 bp, Homo sapiens
cacctcccc

SEQ ID NO: 4927440 - DNA, 13 bp, Homo sapiens
cacctccccacgc

SEQ ID NO: 4927441 - DNA, 14 bp, Homo sapiens
cacctccctgccca

SEQ ID NO: 4927442 - DNA, 15 bp, Homo sapiens
cacctccctgcccag

SEQ ID NO: 4927443 - DNA, 16 bp, Homo sapiens
cacctccctgcccagg

SEQ ID NO: 4927444 - DNA, 17 bp, Homo sapiens
cacctccctgcccaggc

SEQ ID NO: 4927445 - DNA, 23 bp, Homo sapiens
cacctccctgcccaggccggcca

SEQ ID NO: 4927446 - DNA, 13 bp, Homo sapiens
cacctcctgcctc

SEQ ID NO: 4927447 - DNA, 16 bp, Homo sapiens
cacctctacccaaacc

SEQ ID NO: 4927448 - DNA, 22 bp, Homo sapiens
cacctctacccaaaccctaggt

SEQ ID NO: 4927449 - DNA, 19 bp, Homo sapiens
cacctctcctactcactta

SEQ ID NO: 4927450 - DNA, 14 bp, Homo sapiens
cacctctgtaattt

SEQ ID NO: 4927451 - DNA, 18 bp, Homo sapiens
cacctctgtgacctcagg

SEQ ID NO: 4927452 - DNA, 20 bp, Homo sapiens
cacctctgtgacctcaggca

SEQ ID NO: 4927453 - DNA, 13 bp, Homo sapiens
cacctctgtggca

SEQ ID NO: 4927454 - DNA, 15 bp, Homo sapiens
cacctgaagactcat

SEQ ID NO: 4927455 - DNA, 23 bp, Homo sapiens
cacctgaagactcattcttctgt

SEQ ID NO: 4927456 - DNA, 23 bp, Homo sapiens
cacctgagtcaccctacctgtgc

SEQ ID NO: 4927457 - DNA, 18 bp, Homo sapiens
cacctgcccatcacaggg

SEQ ID NO: 4927458 - DNA, 13 bp, Homo sapiens
cacctgccctgcc

SEQ ID NO: 4927459 - DNA, 14 bp, Homo sapiens
cacctgccctgccc

SEQ ID NO: 4927460 - DNA, 21 bp, Homo sapiens
cacctgcctgcgtcttccgcc

SEQ ID NO: 4927461 - DNA, 14 bp, Homo sapiens
cacctgctcttcta

SEQ ID NO: 4927462 - DNA, 15 bp, Homo sapiens
cacctgtctcagcct

SEQ ID NO: 4927463 - DNA, 19 bp, Homo sapiens
cacctgtctcagcctccca

SEQ ID NO: 4927464 - DNA, 10 bp, Homo sapiens
cacctgtggg

SEQ ID NO: 4927465 - DNA, 19 bp, Homo sapiens
caccttaccaactttctgt

SEQ ID NO: 4927466 - DNA, 14 bp, Homo sapiens
caccttccagctcc

SEQ ID NO: 4927467 - DNA, 15 bp, Homo sapiens
caccttccagctcct

SEQ ID NO: 4927468 - DNA, 18 bp, Homo sapiens
caccttccagctcctgta

SEQ ID NO: 4927469 - DNA, 18 bp, Homo sapiens
caccttcccactttccca

SEQ ID NO: 4927470 - DNA, 13 bp, Homo sapiens
caccttcccatgc

SEQ ID NO: 4927471 - DNA, 17 bp, Homo sapiens
caccttcccttgccact

SEQ ID NO: 4927472 - DNA, 12 bp, Homo sapiens
caccttctgagt

SEQ ID NO: 4927473 - DNA, 20 bp, Homo sapiens
caccttcttattatatatat

SEQ ID NO: 4927474 - DNA, 13 bp, Homo sapiens
caccttggctgca

SEQ ID NO: 4927475 - DNA, 21 bp, Homo sapiens
cacctttgtgtatttttcaat

SEQ ID NO: 4927476 - DNA, 12 bp, Homo sapiens
cacgaaacttgt

SEQ ID NO: 4927477 - DNA, 14 bp, Homo sapiens
cacgaaacttgtta

SEQ ID NO: 4927478 - DNA, 13 bp, Homo sapiens
cacgaaagagaga

SEQ ID NO: 4927479 - DNA, 13 bp, Homo sapiens
cacgccactgcac

SEQ ID NO: 4927480 - DNA, 15 bp, Homo sapiens
cacgccctcccctcc

SEQ ID NO: 4927481 - DNA, 24 bp, Homo sapiens
cacgccctcccctcccctgctgca

SEQ ID NO: 4927482 - DNA, 13 bp, Homo sapiens
cacgcgcgcacac

SEQ ID NO: 4927483 - DNA, 15 bp, Homo sapiens
cacgcgcgcacacac

SEQ ID NO: 4927484 - DNA, 22 bp, Homo sapiens
cacgcgcgcacacacacacata

SEQ ID NO: 4927485 - DNA, 15 bp, Homo sapiens
cacgcgtgcacacac

SEQ ID NO: 4927486 - DNA, 23 bp, Homo sapiens
cacgcgtgcacacaccagagccc

SEQ ID NO: 4927487 - DNA, 15 bp, Homo sapiens
cacgctggagtgcag

SEQ ID NO: 4927488 - DNA, 20 bp, Homo sapiens
cacgctggagtgcagtgagc

SEQ ID NO: 4927489 - DNA, 21 bp, Homo sapiens
cacgctggagtgcagtgagcc

SEQ ID NO: 4927490 - DNA, 13 bp, Homo sapiens
cacgctgttctaa

SEQ ID NO: 4927491 - DNA, 23 bp, Homo sapiens
cacggaggcatcctacccttttc

SEQ ID NO: 4927492 - DNA, 16 bp, Homo sapiens
cacggccaggccagag

SEQ ID NO: 4927493 - DNA, 17 bp, Homo sapiens
cacggccaggccagagg

SEQ ID NO: 4927494 - DNA, 15 bp, Homo sapiens
cacggctcactgcag

SEQ ID NO: 4927495 - DNA, 14 bp, Homo sapiens
cacggtagtgcctg

SEQ ID NO: 4927496 - DNA, 14 bp, Homo sapiens
cacgtctgtcttca

SEQ ID NO: 4927497 - DNA, 15 bp, Homo sapiens
cacgtctgtcttcac

SEQ ID NO: 4927498 - DNA, 16 bp, Homo sapiens
cacgtgggctcatatg

SEQ ID NO: 4927499 - DNA, 15 bp, Homo sapiens
cacgtgtcctgtagt

SEQ ID NO: 4927500 - DNA, 13 bp, Homo sapiens
cacgttctttccc

SEQ ID NO: 4927501 - DNA, 15 bp, Homo sapiens
cactaaagtatgtaa

SEQ ID NO: 4927502 - DNA, 22 bp, Homo sapiens
cactaaagtatgtaaagtatgt

SEQ ID NO: 4927503 - DNA, 14 bp, Homo sapiens
cactaaccacgctg

SEQ ID NO: 4927504 - DNA, 18 bp, Homo sapiens
cactaaccacgctggacc

SEQ ID NO: 4927505 - DNA, 15 bp, Homo sapiens
cactaactcaccagc

SEQ ID NO: 4927506 - DNA, 19 bp, Homo sapiens
cactaactcaccagcccca

SEQ ID NO: 4927507 - DNA, 15 bp, Homo sapiens
cactaccgattcttt

SEQ ID NO: 4927508 - DNA, 12 bp, Homo sapiens
cactagaaaact

SEQ ID NO: 4927509 - DNA, 18 bp, Homo sapiens
cactagcctttggctctg

SEQ ID NO: 4927510 - DNA, 20 bp, Homo sapiens
cactaggcacccagctgcca

SEQ ID NO: 4927511 - DNA, 21 bp, Homo sapiens
cactagtaagtaattatgcac

SEQ ID NO: 4927512 - DNA, 17 bp, Homo sapiens
cactatgttgcccaggc

SEQ ID NO: 4927513 - DNA, 20 bp, Homo sapiens
cactatgttgcccaggcagg

SEQ ID NO: 4927514 - DNA, 20 bp, Homo sapiens
cactcacatttattctgctc

SEQ ID NO: 4927515 - DNA, 17 bp, Homo sapiens
cactcagaagacactga

SEQ ID NO: 4927516 - DNA, 19 bp, Homo sapiens
cactcagaagacactgatg

SEQ ID NO: 4927517 - DNA, 12 bp, Homo sapiens
cactcagacctg

SEQ ID NO: 4927518 - DNA, 22 bp, Homo sapiens
cactcagcccctaggagtatat

SEQ ID NO: 4927519 - DNA, 21 bp, Homo sapiens
cactcaggaggctgaggcagg

SEQ ID NO: 4927520 - DNA, 16 bp, Homo sapiens
cactcagtccatagca

SEQ ID NO: 4927521 - DNA, 19 bp, Homo sapiens
cactcattgctgagcctct

SEQ ID NO: 4927522 - DNA, 23 bp, Homo sapiens
cactcattgctgagcctctgctc

SEQ ID NO: 4927523 - DNA, 21 bp, Homo sapiens
cactccaatgtctgctgagga

SEQ ID NO: 4927524 - DNA, 21 bp, Homo sapiens
cagagactgtccctgaaacct

SEQ ID NO: 4927525 - DNA, 15 bp, Homo sapiens
cagagagagagaaag

SEQ ID NO: 4927526 - DNA, 19 bp, Homo sapiens
cagagagccattttgtgaa

SEQ ID NO: 4927527 - DNA, 20 bp, Homo sapiens
cagagaggccttttggaatg

SEQ ID NO: 4927528 - DNA, 22 bp, Homo sapiens
cagagagggtggtgacctctgc

SEQ ID NO: 4927529 - DNA, 18 bp, Homo sapiens
cagagatgtcatcagagc

SEQ ID NO: 4927530 - DNA, 16 bp, Homo sapiens
cagagattcccaagcc

SEQ ID NO: 4927531 - DNA, 22 bp, Homo sapiens
cagagcacctttgcacaggatg

SEQ ID NO: 4927532 - DNA, 21 bp, Homo sapiens
cagagcaggaagcattcagag

SEQ ID NO: 4927533 - DNA, 13 bp, Homo sapiens
cagagcaggacct

SEQ ID NO: 4927534 - DNA, 19 bp, Homo sapiens
cagagcaggacctcccttc

SEQ ID NO: 4927535 - DNA, 17 bp, Homo sapiens
cagagcccaccttggct

SEQ ID NO: 4927536 - DNA, 19 bp, Homo sapiens
cagagcccaccttggctca

SEQ ID NO: 4927537 - DNA, 14 bp, Homo sapiens
cagagcccccagga

SEQ ID NO: 4927538 - DNA, 21 bp, Homo sapiens
cagagcccctacagcattgtt

SEQ ID NO: 4927539 - DNA, 19 bp, Homo sapiens
cagagcctcccaaggagaa

SEQ ID NO: 4927540 - DNA, 19 bp, Homo sapiens
cagagcggaggctgtgtgc

SEQ ID NO: 4927541 - DNA, 21 bp, Homo sapiens
cagagcgtggctgtgctctca

SEQ ID NO: 4927542 - DNA, 16 bp, Homo sapiens
cagagctggaccagtg

SEQ ID NO: 4927543 - DNA, 15 bp, Homo sapiens
cagagctgtggagga

SEQ ID NO: 4927544 - DNA, 22 bp, Homo sapiens
cagaggaactgtccagagagca

SEQ ID NO: 4927545 - DNA, 16 bp, Homo sapiens
cagaggaatcctggca

SEQ ID NO: 4927546 - DNA, 18 bp, Homo sapiens
cagaggaatttatacctc

SEQ ID NO: 4927547 - DNA, 17 bp, Homo sapiens
cagaggacctgtattta

SEQ ID NO: 4927548 - DNA, 22 bp, Homo sapiens
cagaggagcctttttaaaacac

SEQ ID NO: 4927549 - DNA, 11 bp, Homo sapiens
cagaggcagcc

SEQ ID NO: 4927550 - DNA, 20 bp, Homo sapiens
cagaggcagccccattctgc

SEQ ID NO: 4927551 - DNA, 22 bp, Homo sapiens
cagaggcagccccattctgcct

SEQ ID NO: 4927552 - DNA, 20 bp, Homo sapiens
cagaggccatgggcctcctg

SEQ ID NO: 4927553 - DNA, 21 bp, Homo sapiens
cagaggccatgggcctcctgt

SEQ ID NO: 4927554 - DNA, 22 bp, Homo sapiens
cagaggctgagttttctctttg

SEQ ID NO: 4927555 - DNA, 16 bp, Homo sapiens
cagagggagtgacaga

SEQ ID NO: 4927556 - DNA, 18 bp, Homo sapiens
cagagggagtgacagagg

SEQ ID NO: 4927557 - DNA, 21 bp, Homo sapiens
cagagggagtgacagaggcag

SEQ ID NO: 4927558 - DNA, 12 bp, Homo sapiens
cagaggggaagg

SEQ ID NO: 4927559 - DNA, 17 bp, Homo sapiens
cagaggggactctgggc

SEQ ID NO: 4927560 - DNA, 21 bp, Homo sapiens
cagagggggactgctgctgcc

SEQ ID NO: 4927561 - DNA, 19 bp, Homo sapiens
cagaggggtaagagaggat

SEQ ID NO: 4927562 - DNA, 16 bp, Homo sapiens
cagagggttaggagtg

SEQ ID NO: 4927563 - DNA, 15 bp, Homo sapiens
cagaggtaacagaac

SEQ ID NO: 4927564 - DNA, 16 bp, Homo sapiens
cagaggtaacagaaca

SEQ ID NO: 4927565 - DNA, 15 bp, Homo sapiens
cagaggtccagccca

SEQ ID NO: 4927566 - DNA, 21 bp, Homo sapiens
cagaggttctttgagggactg

SEQ ID NO: 4927567 - DNA, 14 bp, Homo sapiens
cagagtcctttcca

SEQ ID NO: 4927568 - DNA, 17 bp, Homo sapiens
cagagtctcactgttgc

SEQ ID NO: 4927569 - DNA, 20 bp, Homo sapiens
cagagtctcactgttgccca

SEQ ID NO: 4927570 - DNA, 17 bp, Homo sapiens
cagagtgagactctgtc

SEQ ID NO: 4927571 - DNA, 20 bp, Homo sapiens
cagagtgagactctgtctca

SEQ ID NO: 4927572 - DNA, 15 bp, Homo sapiens
cagagtgcacagctg

SEQ ID NO: 4927573 - DNA, 16 bp, Homo sapiens
cagagtgcacagctgt

SEQ ID NO: 4927574 - DNA, 16 bp, Homo sapiens
cagagtttgccttcct

SEQ ID NO: 4927575 - DNA, 17 bp, Homo sapiens
cagagtttgtgtgttgt

SEQ ID NO: 4927576 - DNA, 22 bp, Homo sapiens
cagagtttgtgtgttgtcttga

SEQ ID NO: 4927577 - DNA, 16 bp, Homo sapiens
cagataacataccttt

SEQ ID NO: 4927578 - DNA, 17 bp, Homo sapiens
cagataaccagctgtaa

SEQ ID NO: 4927579 - DNA, 14 bp, Homo sapiens
cagataatcagtgt

SEQ ID NO: 4927580 - DNA, 14 bp, Homo sapiens
cagatacacacaca

SEQ ID NO: 4927581 - DNA, 12 bp, Homo sapiens
cagatacatcac

SEQ ID NO: 4927582 - DNA, 13 bp, Homo sapiens
cagatacatcact

SEQ ID NO: 4927583 - DNA, 15 bp, Homo sapiens
cagatatactttgtg

SEQ ID NO: 4927584 - DNA, 18 bp, Homo sapiens
cagatatactttgtggac

SEQ ID NO: 4927585 - DNA, 19 bp, Homo sapiens
cagatcactgaatttataa

SEQ ID NO: 4927586 - DNA, 13 bp, Homo sapiens
cagatcactgcca

SEQ ID NO: 4927587 - DNA, 16 bp, Homo sapiens
cagatcactgccacac

SEQ ID NO: 4927588 - DNA, 14 bp, Homo sapiens
cagatcctcttggt

SEQ ID NO: 4927589 - DNA, 17 bp, Homo sapiens
cagatctggtcccttgc

SEQ ID NO: 4927590 - DNA, 23 bp, Homo sapiens
cagatctgtgccccatgcctgtc

SEQ ID NO: 4927591 - DNA, 14 bp, Homo sapiens
cagatgaaaatttg

SEQ ID NO: 4927592 - DNA, 13 bp, Homo sapiens
cagatgaataaac

SEQ ID NO: 4927593 - DNA, 14 bp, Homo sapiens
cagatgaataaact

SEQ ID NO: 4927594 - DNA, 19 bp, Homo sapiens
cagatgaatgtatttattt

SEQ ID NO: 4927595 - DNA, 17 bp, Homo sapiens
cagatgagaacaaagct

SEQ ID NO: 4927596 - DNA, 14 bp, Homo sapiens
cagatgatccatga

SEQ ID NO: 4927597 - DNA, 17 bp, Homo sapiens
cagatgcaccagccctt

SEQ ID NO: 4927598 - DNA, 16 bp, Homo sapiens
cagatgcagagagcca

SEQ ID NO: 4927599 - DNA, 16 bp, Homo sapiens
cagatgccaccctagc

SEQ ID NO: 4927600 - DNA, 15 bp, Homo sapiens
cagatgccccagagc

SEQ ID NO: 4927601 - DNA, 13 bp, Homo sapiens
cagatgcgtccca

SEQ ID NO: 4927602 - DNA, 20 bp, Homo sapiens
cagatgcgtcccaagatgtt

SEQ ID NO: 4927603 - DNA, 21 bp, Homo sapiens
cagatgcgtcccaagatgttg

SEQ ID NO: 4927604 - DNA, 21 bp, Homo sapiens
cagatgctaaaatccctggat

SEQ ID NO: 4927605 - DNA, 14 bp, Homo sapiens
cagatgctccaaga

SEQ ID NO: 4927606 - DNA, 16 bp, Homo sapiens
cagatgctccaagatt

SEQ ID NO: 4927607 - DNA, 18 bp, Homo sapiens
cagatgctccaagattct

SEQ ID NO: 4927608 - DNA, 19 bp, Homo sapiens
cagatgctccaagattcta

SEQ ID NO: 4927609 - DNA, 21 bp, Homo sapiens
cagatgctccaagattctaga

SEQ ID NO: 4927610 - DNA, 16 bp, Homo sapiens
cagatggaatgctgtg

SEQ ID NO: 4927611 - DNA, 17 bp, Homo sapiens
cagatggaatgctgtgt

SEQ ID NO: 4927612 - DNA, 16 bp, Homo sapiens
cagatggtgaagcatt

SEQ ID NO: 4927613 - DNA, 15 bp, Homo sapiens
cagatgtttccagac

SEQ ID NO: 4927614 - DNA, 17 bp, Homo sapiens
cagattcagtcttgcct

SEQ ID NO: 4927615 - DNA, 18 bp, Homo sapiens
cagattcagtcttgcctt

SEQ ID NO: 4927616 - DNA, 19 bp, Homo sapiens
cagattcccagagcaaaat

SEQ ID NO: 4927617 - DNA, 15 bp, Homo sapiens
cagattttaattgtc

SEQ ID NO: 4927618 - DNA, 15 bp, Homo sapiens
cagattttgataact

SEQ ID NO: 4927619 - DNA, 14 bp, Homo sapiens
cagcaaaaatataa

SEQ ID NO: 4927620 - DNA, 14 bp, Homo sapiens
cagcaacacagagc

SEQ ID NO: 4927621 - DNA, 20 bp, Homo sapiens
cagcaacttcttctccatcc

SEQ ID NO: 4927622 - DNA, 16 bp, Homo sapiens
cagcaaggccctgctg

SEQ ID NO: 4927623 - DNA, 14 bp, Homo sapiens
cagcaagtgagagc

SEQ ID NO: 4927624 - DNA, 15 bp, Homo sapiens
cagcaagtgagagct

SEQ ID NO: 4927625 - DNA, 16 bp, Homo sapiens
cagcaagtgagagctg

SEQ ID NO: 4927626 - DNA, 20 bp, Homo sapiens
cagcaatatattaccagcaa

SEQ ID NO: 4927627 - DNA, 23 bp, Homo sapiens
cagcaatatattaccagcaagaa

SEQ ID NO: 4927628 - DNA, 21 bp, Homo sapiens
cagcaatgacatctcaggggc

SEQ ID NO: 4927629 - DNA, 16 bp, Homo sapiens
cagcacatgctggcca

SEQ ID NO: 4927630 - DNA, 15 bp, Homo sapiens
cagcacctcagcctg

SEQ ID NO: 4927631 - DNA, 16 bp, Homo sapiens
cagcacctcagcctgc

SEQ ID NO: 4927632 - DNA, 13 bp, Homo sapiens
cagcacctgcctc

SEQ ID NO: 4927633 - DNA, 20 bp, Homo sapiens
cagcacctgtaagaaacaga

SEQ ID NO: 4927634 - DNA, 23 bp, Homo sapiens
catagcggactcctcctttctcc

SEQ ID NO: 4927635 - DNA, 15 bp, Homo sapiens
catagctgtctagag

SEQ ID NO: 4927636 - DNA, 18 bp, Homo sapiens
catagcttattattgaag

SEQ ID NO: 4927637 - DNA, 23 bp, Homo sapiens
catagtaacttcttatggaattg

SEQ ID NO: 4927638 - DNA, 20 bp, Homo sapiens
catagtagtatgatgataca

SEQ ID NO: 4927639 - DNA, 17 bp, Homo sapiens
catagtagtttttacag

SEQ ID NO: 4927640 - DNA, 20 bp, Homo sapiens
catagtagtttttacagctg

SEQ ID NO: 4927641 - DNA, 19 bp, Homo sapiens
catagtatggtggctgggt

SEQ ID NO: 4927642 - DNA, 20 bp, Homo sapiens
catagtatggtggctgggtt

SEQ ID NO: 4927643 - DNA, 11 bp, Homo sapiens
catagtgctgg

SEQ ID NO: 4927644 - DNA, 13 bp, Homo sapiens
catagtgctggga

SEQ ID NO: 4927645 - DNA, 15 bp, Homo sapiens
catagtggtgcagag

SEQ ID NO: 4927646 - DNA, 18 bp, Homo sapiens
catagttttaaactcatt

SEQ ID NO: 4927647 - DNA, 22 bp, Homo sapiens
catataagtttgaaggaaacag

SEQ ID NO: 4927648 - DNA, 18 bp, Homo sapiens
catatacctataatgtgt

SEQ ID NO: 4927649 - DNA, 19 bp, Homo sapiens
catatacctataatgtgtg

SEQ ID NO: 4927650 - DNA, 22 bp, Homo sapiens
catatacctataatgtgtgtat

SEQ ID NO: 4927651 - DNA, 18 bp, Homo sapiens
catatactgttcttcatt

SEQ ID NO: 4927652 - DNA, 21 bp, Homo sapiens
catatactgttcttcatttta

SEQ ID NO: 4927653 - DNA, 18 bp, Homo sapiens
catataggtgatgtttgc

SEQ ID NO: 4927654 - DNA, 16 bp, Homo sapiens
catatccaccacctcc

SEQ ID NO: 4927655 - DNA, 18 bp, Homo sapiens
catatcggctcacaaaga

SEQ ID NO: 4927656 - DNA, 22 bp, Homo sapiens
catatcttgcgaatccaagctc

SEQ ID NO: 4927657 - DNA, 15 bp, Homo sapiens
catatgatctgtttt

SEQ ID NO: 4927658 - DNA, 19 bp, Homo sapiens
catatgcaccttgtgtctg

SEQ ID NO: 4927659 - DNA, 22 bp, Homo sapiens
catatgccttggggaggacaaa

SEQ ID NO: 4927660 - DNA, 14 bp, Homo sapiens
catatgtaaacata

SEQ ID NO: 4927661 - DNA, 15 bp, Homo sapiens
catatgtacataaat

SEQ ID NO: 4927662 - DNA, 19 bp, Homo sapiens
catatgtacataaattgca

SEQ ID NO: 4927663 - DNA, 21 bp, Homo sapiens
catatgtagactatatacatg

SEQ ID NO: 4927664 - DNA, 14 bp, Homo sapiens
catatgtgatctgt

SEQ ID NO: 4927665 - DNA, 18 bp, Homo sapiens
catatgttgaatactttt

SEQ ID NO: 4927666 - DNA, 16 bp, Homo sapiens
catattccatatttat

SEQ ID NO: 4927667 - DNA, 15 bp, Homo sapiens
catattctaaaacca

SEQ ID NO: 4927668 - DNA, 15 bp, Homo sapiens
catattcttgtgctt

SEQ ID NO: 4927669 - DNA, 20 bp, Homo sapiens
catattgatgaaaagattta

SEQ ID NO: 4927670 - DNA, 21 bp, Homo sapiens
catattgtgccaatatgtatt

SEQ ID NO: 4927671 - DNA, 23 bp, Homo sapiens
catattgtgcttcacagtagagc

SEQ ID NO: 4927672 - DNA, 16 bp, Homo sapiens
catatttactacctta

SEQ ID NO: 4927673 - DNA, 14 bp, Homo sapiens
catatttattttct

SEQ ID NO: 4927674 - DNA, 15 bp, Homo sapiens
catatttggaagaaa

SEQ ID NO: 4927675 - DNA, 16 bp, Homo sapiens
catcaacaaagaaata

SEQ ID NO: 4927676 - DNA, 15 bp, Homo sapiens
catcacaatacagat

SEQ ID NO: 4927677 - DNA, 14 bp, Homo sapiens
catcacagcagcct

SEQ ID NO: 4927678 - DNA, 13 bp, Homo sapiens
catcacctctgta

SEQ ID NO: 4927679 - DNA, 22 bp, Homo sapiens
catcactatccatgcaccaaac

SEQ ID NO: 4927680 - DNA, 17 bp, Homo sapiens
catcacttttcagtgat

SEQ ID NO: 4927681 - DNA, 14 bp, Homo sapiens
catcagaagtggta

SEQ ID NO: 4927682 - DNA, 12 bp, Homo sapiens
catcagggacag

SEQ ID NO: 4927683 - DNA, 15 bp, Homo sapiens
catcagggcctgggg

SEQ ID NO: 4927684 - DNA, 16 bp, Homo sapiens
catcagggcctggggc

SEQ ID NO: 4927685 - DNA, 12 bp, Homo sapiens
catcagggggaa

SEQ ID NO: 4927686 - DNA, 17 bp, Homo sapiens
catcagggggaagaagc

SEQ ID NO: 4927687 - DNA, 15 bp, Homo sapiens
catcagtccctatgt

SEQ ID NO: 4927688 - DNA, 12 bp, Homo sapiens
catcatgcagct

SEQ ID NO: 4927689 - DNA, 13 bp, Homo sapiens
catcatgtctggc

SEQ ID NO: 4927690 - DNA, 13 bp, Homo sapiens
catcattgtttct

SEQ ID NO: 4927691 - DNA, 17 bp, Homo sapiens
catcattgtttctgcat

SEQ ID NO: 4927692 - DNA, 23 bp, Homo sapiens
catccaaaatagttaagacatga

SEQ ID NO: 4927693 - DNA, 18 bp, Homo sapiens
catccaactccagcaact

SEQ ID NO: 4927694 - DNA, 14 bp, Homo sapiens
catccaacttatgt

SEQ ID NO: 4927695 - DNA, 20 bp, Homo sapiens
catccaatctattatttctc

SEQ ID NO: 4927696 - DNA, 15 bp, Homo sapiens
catccactctaccct

SEQ ID NO: 4927697 - DNA, 22 bp, Homo sapiens
catccactctaccctcccaccc

SEQ ID NO: 4927698 - DNA, 17 bp, Homo sapiens
catccactgtgccatgt

SEQ ID NO: 4927699 - DNA, 23 bp, Homo sapiens
catccactgtgccatgtgccagg

SEQ ID NO: 4927700 - DNA, 21 bp, Homo sapiens
catccacttacatatattttt

SEQ ID NO: 4927701 - DNA, 15 bp, Homo sapiens
catccaggttcagct

SEQ ID NO: 4927702 - DNA, 17 bp, Homo sapiens
catccaggttcagcttg

SEQ ID NO: 4927703 - DNA, 17 bp, Homo sapiens
catccagttaaccaagt

SEQ ID NO: 4927704 - DNA, 13 bp, Homo sapiens
catccagttcatg

SEQ ID NO: 4927705 - DNA, 17 bp, Homo sapiens
catccataccagctcgc

SEQ ID NO: 4927706 - DNA, 15 bp, Homo sapiens
catccatgtttgtaa

SEQ ID NO: 4927707 - DNA, 18 bp, Homo sapiens
catccatgtttgtaaaac

SEQ ID NO: 4927708 - DNA, 18 bp, Homo sapiens
catccattcccaagaaat

SEQ ID NO: 4927709 - DNA, 18 bp, Homo sapiens
catcccaaccagtgccaa

SEQ ID NO: 4927710 - DNA, 21 bp, Homo sapiens
catcccagacaggtccctccc

SEQ ID NO: 4927711 - DNA, 20 bp, Homo sapiens
catcccagcacctgcctcct

SEQ ID NO: 4927712 - DNA, 16 bp, Homo sapiens
catcccagccccaatt

SEQ ID NO: 4927713 - DNA, 20 bp, Homo sapiens
catcccagccccaattttct

SEQ ID NO: 4927714 - DNA, 13 bp, Homo sapiens
catcccaggacac

SEQ ID NO: 4927715 - DNA, 22 bp, Homo sapiens
catcccaggacaccacacccag

SEQ ID NO: 4927716 - DNA, 18 bp, Homo sapiens
catcccatgagaccctgg

SEQ ID NO: 4927717 - DNA, 22 bp, Homo sapiens
catccccaaaacaaagtctttg

SEQ ID NO: 4927718 - DNA, 12 bp, Homo sapiens
catcccccaaag

SEQ ID NO: 4927719 - DNA, 17 bp, Homo sapiens
catcccgtgttctcctt

SEQ ID NO: 4927720 - DNA, 12 bp, Homo sapiens
catccctacccc

SEQ ID NO: 4927721 - DNA, 14 bp, Homo sapiens
catccctaccccct

SEQ ID NO: 4927722 - DNA, 14 bp, Homo sapiens
catccctgcctggt

SEQ ID NO: 4927723 - DNA, 19 bp, Homo sapiens
catccgccttttgtataca

SEQ ID NO: 4927724 - DNA, 15 bp, Homo sapiens
catcctaagaaatat

SEQ ID NO: 4927725 - DNA, 22 bp, Homo sapiens
catcctaagaaatatgtgagat

SEQ ID NO: 4927726 - DNA, 17 bp, Homo sapiens
catcctatccactgggc

SEQ ID NO: 4927727 - DNA, 19 bp, Homo sapiens
catcctccgtccagccgcc

SEQ ID NO: 4927728 - DNA, 14 bp, Homo sapiens
catcctcctggaac

SEQ ID NO: 4927729 - DNA, 20 bp, Homo sapiens
catcctctttctcttttcta

SEQ ID NO: 4927730 - DNA, 21 bp, Homo sapiens
catcctctttctcttttctag

SEQ ID NO: 4927731 - DNA, 16 bp, Homo sapiens
catcctgactctgccc

SEQ ID NO: 4927732 - DNA, 19 bp, Homo sapiens
catcctgactctgccccct

SEQ ID NO: 4927733 - DNA, 12 bp, Homo sapiens
catcctgagccc

SEQ ID NO: 4927734 - DNA, 20 bp, Homo sapiens
catcctgagccccgccctct

SEQ ID NO: 4927735 - DNA, 15 bp, Homo sapiens
catcctggcacccgg

SEQ ID NO: 4927736 - DNA, 22 bp, Homo sapiens
catcctggcacccggcccctgc

SEQ ID NO: 4927737 - DNA, 13 bp, Homo sapiens
catcctggctgcg

SEQ ID NO: 4927738 - DNA, 13 bp, Homo sapiens
catcctgggtaat

SEQ ID NO: 4927739 - DNA, 12 bp, Homo sapiens
catccttcctat

SEQ ID NO: 4927740 - DNA, 13 bp, Homo sapiens
catccttcctata

SEQ ID NO: 4927741 - DNA, 23 bp, Homo sapiens
catccttgactttgaactaatga

SEQ ID NO: 4927742 - DNA, 20 bp, Homo sapiens
catccttggtctttgtatct

SEQ ID NO: 4927743 - DNA, 19 bp, Homo sapiens
catcctttacgtgtttaaa

SEQ ID NO: 4927744 - DNA, 15 bp, Homo sapiens
catctaagctgcagc

SEQ ID NO: 4927745 - DNA, 21 bp, Homo sapiens
catctaagctgcagcttcctg

SEQ ID NO: 4927746 - DNA, 20 bp, Homo sapiens
catctaagttataagactct

SEQ ID NO: 4927747 - DNA, 14 bp, Homo sapiens
catctattttgatg

SEQ ID NO: 4927748 - DNA, 19 bp, Homo sapiens
catctattttgatgcagca

SEQ ID NO: 4927749 - DNA, 21 bp, Homo sapiens
catctattttgatgcagcatt

SEQ ID NO: 4927750 - DNA, 16 bp, Homo sapiens
catctattttggattg

SEQ ID NO: 4927751 - DNA, 20 bp, Homo sapiens
catctcagcctaccatgaga

SEQ ID NO: 4927752 - DNA, 12 bp, Homo sapiens
catctcaggggc

SEQ ID NO: 4927753 - DNA, 20 bp, Homo sapiens
catctcatgtatcatctgga

SEQ ID NO: 4927754 - DNA, 14 bp, Homo sapiens
catctccactccag

SEQ ID NO: 4927755 - DNA, 14 bp, Homo sapiens
catctcccaccctg

SEQ ID NO: 4927756 - DNA, 13 bp, Homo sapiens
catctcccttcct

SEQ ID NO: 4927757 - DNA, 21 bp, Homo sapiens
catctcctataatctgtcaaa

SEQ ID NO: 4927758 - DNA, 20 bp, Homo sapiens
catctcggagcatcccggag

SEQ ID NO: 4927759 - DNA, 21 bp, Homo sapiens
catctcggagcatcccggagg

SEQ ID NO: 4927760 - DNA, 23 bp, Homo sapiens
catctctccctcccctgccattt

SEQ ID NO: 4927761 - DNA, 13 bp, Homo sapiens
catctctgcttgg

SEQ ID NO: 4927762 - DNA, 20 bp, Homo sapiens
catctcttgaggccaggagt

SEQ ID NO: 4927763 - DNA, 22 bp, Homo sapiens
catctgatatctatagtagaca

SEQ ID NO: 4927764 - DNA, 13 bp, Homo sapiens
catctgatttgca

SEQ ID NO: 4927765 - DNA, 15 bp, Homo sapiens
catctgcacccttct

SEQ ID NO: 4927766 - DNA, 16 bp, Homo sapiens
catctgcacccttctt

SEQ ID NO: 4927767 - DNA, 11 bp, Homo sapiens
catctgcccct

SEQ ID NO: 4927768 - DNA, 14 bp, Homo sapiens
catctgcccctccc

SEQ ID NO: 4927769 - DNA, 18 bp, Homo sapiens
catctgcccctcccccaa

SEQ ID NO: 4927770 - DNA, 21 bp, Homo sapiens
catctggataggagcctgctg

SEQ ID NO: 4927771 - DNA, 22 bp, Homo sapiens
catctggataggagcctgctgg

SEQ ID NO: 4927772 - DNA, 16 bp, Homo sapiens
catctggcctggcctg

SEQ ID NO: 4927773 - DNA, 23 bp, Homo sapiens
catctggcctggcctggccctgc

SEQ ID NO: 4927774 - DNA, 14 bp, Homo sapiens
catctgtgatggga

SEQ ID NO: 4927775 - DNA, 14 bp, Homo sapiens
catctgtgtcctgg

SEQ ID NO: 4927776 - DNA, 15 bp, Homo sapiens
catctgtgtgaaaat

SEQ ID NO: 4927777 - DNA, 20 bp, Homo sapiens
catctgttgttttgttttaa

SEQ ID NO: 4927778 - DNA, 15 bp, Homo sapiens
catcttatagcactt

SEQ ID NO: 4927779 - DNA, 17 bp, Homo sapiens
catcttctgccttagtc

SEQ ID NO: 4927780 - DNA, 15 bp, Homo sapiens
catcttgctctgctg

SEQ ID NO: 4927781 - DNA, 19 bp, Homo sapiens
catctttaaacagtatttc

SEQ ID NO: 4927782 - DNA, 22 bp, Homo sapiens
catctttacaaaactacatgag

SEQ ID NO: 4927783 - DNA, 16 bp, Homo sapiens
catctttatctgttct

SEQ ID NO: 4927784 - DNA, 17 bp, Homo sapiens
catctttatctgttctt

SEQ ID NO: 4927785 - DNA, 13 bp, Homo sapiens
catctttcctgtc

SEQ ID NO: 4927786 - DNA, 16 bp, Homo sapiens
catctttttaaagctt

SEQ ID NO: 4927787 - DNA, 23 bp, Homo sapiens
catctttttaaagcttatccata

SEQ ID NO: 4927788 - DNA, 14 bp, Homo sapiens
catgaaaattttaa

SEQ ID NO: 4927789 - DNA, 13 bp, Homo sapiens
catgaaacagaaa

SEQ ID NO: 4927790 - DNA, 22 bp, Homo sapiens
catgaaatatagatcagttata

SEQ ID NO: 4927791 - DNA, 18 bp, Homo sapiens
catgaacacccttagaaa

SEQ ID NO: 4927792 - DNA, 22 bp, Homo sapiens
catgaacagaaaacattctgat

SEQ ID NO: 4927793 - DNA, 12 bp, Homo sapiens
catgaagccttt

SEQ ID NO: 4927794 - DNA, 15 bp, Homo sapiens
catgaagccttttga

SEQ ID NO: 4927795 - DNA, 14 bp, Homo sapiens
catgaatctgtctc

SEQ ID NO: 4927796 - DNA, 15 bp, Homo sapiens
catgaattttacatg

SEQ ID NO: 4927797 - DNA, 13 bp, Homo sapiens
catgacactgacc

SEQ ID NO: 4927798 - DNA, 18 bp, Homo sapiens
catgacaggcctgaagat

SEQ ID NO: 4927799 - DNA, 20 bp, Homo sapiens
catgacataacagtgcaggg

SEQ ID NO: 4927800 - DNA, 16 bp, Homo sapiens
catgacatgttatata

SEQ ID NO: 4927801 - DNA, 17 bp, Homo sapiens
catgacatgttatatat

SEQ ID NO: 4927802 - DNA, 22 bp, Homo sapiens
catgagaccctggtgcctggct

SEQ ID NO: 4927803 - DNA, 23 bp, Homo sapiens
catgagaccctggtgcctggctc

SEQ ID NO: 4927804 - DNA, 12 bp, Homo sapiens
catgagatgtgt

SEQ ID NO: 4927805 - DNA, 14 bp, Homo sapiens
catgagatgtgtgg

SEQ ID NO: 4927806 - DNA, 15 bp, Homo sapiens
catgagatgtgtgga

SEQ ID NO: 4927807 - DNA, 17 bp, Homo sapiens
catgagatgtgtggact

SEQ ID NO: 4927808 - DNA, 23 bp, Homo sapiens
catgagatgtgtggactgtggca

SEQ ID NO: 4927809 - DNA, 12 bp, Homo sapiens
catgagcctcag

SEQ ID NO: 4927810 - DNA, 21 bp, Homo sapiens
catgagcctcagcatcctggc

SEQ ID NO: 4927811 - DNA, 18 bp, Homo sapiens
catgaggaactgtagatg

SEQ ID NO: 4927812 - DNA, 15 bp, Homo sapiens
catgaggaaggaaca

SEQ ID NO: 4927813 - DNA, 23 bp, Homo sapiens
catgaggcaatgtcaggaacaga

SEQ ID NO: 4927814 - DNA, 24 bp, Homo sapiens
catgaggcaatgtcaggaacagaa

SEQ ID NO: 4927815 - DNA, 21 bp, Homo sapiens
catgagtccttgaaaatattt

SEQ ID NO: 4927816 - DNA, 15 bp, Homo sapiens
catgagtttgccctg

SEQ ID NO: 4927817 - DNA, 22 bp, Homo sapiens
catgagtttgccctggtttcac

SEQ ID NO: 4927818 - DNA, 12 bp, Homo sapiens
catgatgcagtc

SEQ ID NO: 4927819 - DNA, 15 bp, Homo sapiens
catgatgcagtctcc

SEQ ID NO: 4927820 - DNA, 23 bp, Homo sapiens
catgatggttattttcttttctt

SEQ ID NO: 4927821 - DNA, 12 bp, Homo sapiens
catgatttcctt

SEQ ID NO: 4927822 - DNA, 16 bp, Homo sapiens
catgcaaaaagaaatg

SEQ ID NO: 4927823 - DNA, 17 bp, Homo sapiens
catgcaattcatcccag

SEQ ID NO: 4927824 - DNA, 10 bp, Homo sapiens
catgcacaca

SEQ ID NO: 4927825 - DNA, 16 bp, Homo sapiens
catgcacgtgtgtgca

SEQ ID NO: 4927826 - DNA, 14 bp, Homo sapiens
catgcactgaccct

SEQ ID NO: 4927827 - DNA, 17 bp, Homo sapiens
catgcactgacccttcc

SEQ ID NO: 4927828 - DNA, 18 bp, Homo sapiens
catgcactgacccttcca

SEQ ID NO: 4927829 - DNA, 20 bp, Homo sapiens
catgcactgacccttccaga

SEQ ID NO: 4927830 - DNA, 22 bp, Homo sapiens
catgcagcccatgcccacctgc

SEQ ID NO: 4927831 - DNA, 12 bp, Homo sapiens
catgcaggccct

SEQ ID NO: 4927832 - DNA, 23 bp, Homo sapiens
catgcagtctaaaatgcttcagt

SEQ ID NO: 4927833 - DNA, 16 bp, Homo sapiens
catgcataaatatgca

SEQ ID NO: 4927834 - DNA, 17 bp, Homo sapiens
catgcataaatatgcag

SEQ ID NO: 4927835 - DNA, 22 bp, Homo sapiens
catgcataaatatgcagtgata

SEQ ID NO: 4927836 - DNA, 21 bp, Homo sapiens
catgccaccatggccagccaa

SEQ ID NO: 4927837 - DNA, 17 bp, Homo sapiens
catgccacgttccacag

SEQ ID NO: 4927838 - DNA, 19 bp, Homo sapiens
catgccacgttccacagtt

SEQ ID NO: 4927839 - DNA, 13 bp, Homo sapiens
catgccaggaacc

SEQ ID NO: 4927840 - DNA, 13 bp, Homo sapiens
catgcccacctgc

SEQ ID NO: 4927841 - DNA, 17 bp, Homo sapiens
catgcccacctgcccat

SEQ ID NO: 4927842 - DNA, 16 bp, Homo sapiens
catgccccggccacct

SEQ ID NO: 4927843 - DNA, 18 bp, Homo sapiens
catgccccggccacctct

SEQ ID NO: 4927844 - DNA, 19 bp, Homo sapiens
catgccccggccacctctg

SEQ ID NO: 4927845 - DNA, 20 bp, Homo sapiens
catgccccggccacctctgc

SEQ ID NO: 4927846 - DNA, 21 bp, Homo sapiens
catgccccggccacctctgcg

SEQ ID NO: 4927847 - DNA, 12 bp, Homo sapiens
catgcctctgat

SEQ ID NO: 4927848 - DNA, 21 bp, Homo sapiens
catgcctctgatatgggactg

SEQ ID NO: 4927849 - DNA, 23 bp, Homo sapiens
catgcctctgatatgggactgag

SEQ ID NO: 4927850 - DNA, 13 bp, Homo sapiens
catgcggtcgggc

SEQ ID NO: 4927851 - DNA, 15 bp, Homo sapiens
catgctaagcaagct

SEQ ID NO: 4927852 - DNA, 23 bp, Homo sapiens
catgctatctctgtgtgcacaaa

SEQ ID NO: 4927853 - DNA, 19 bp, Homo sapiens
catgctcctcactgcccgc

SEQ ID NO: 4927854 - DNA, 20 bp, Homo sapiens
catgctcctcactgcccgca

SEQ ID NO: 4927855 - DNA, 16 bp, Homo sapiens
catgctctgcaaaagg

SEQ ID NO: 4927856 - DNA, 15 bp, Homo sapiens
catgctggccagcct

SEQ ID NO: 4927857 - DNA, 20 bp, Homo sapiens
catgctgggaagacgcctga

SEQ ID NO: 4927858 - DNA, 19 bp, Homo sapiens
catgctttaaagtgtaata

SEQ ID NO: 4927859 - DNA, 12 bp, Homo sapiens
catggacactcc

SEQ ID NO: 4927860 - DNA, 14 bp, Homo sapiens
catggacactccag

SEQ ID NO: 4927861 - DNA, 17 bp, Homo sapiens
catggactttataagcc

SEQ ID NO: 4927862 - DNA, 13 bp, Homo sapiens
catggaggttcta

SEQ ID NO: 4927863 - DNA, 15 bp, Homo sapiens
catggaggttctaag

SEQ ID NO: 4927864 - DNA, 18 bp, Homo sapiens
catggaggttctaaggcc

SEQ ID NO: 4927865 - DNA, 15 bp, Homo sapiens
catggccaggtggcc

SEQ ID NO: 4927866 - DNA, 14 bp, Homo sapiens
catggccctggggt

SEQ ID NO: 4927867 - DNA, 14 bp, Homo sapiens
catggccctgtgct

SEQ ID NO: 4927868 - DNA, 16 bp, Homo sapiens
catggcctatgcacat

SEQ ID NO: 4927869 - DNA, 19 bp, Homo sapiens
catggcctatgcacatatg

SEQ ID NO: 4927870 - DNA, 17 bp, Homo sapiens
catggctccagaaatgt

SEQ ID NO: 4927871 - DNA, 21 bp, Homo sapiens
catgggcttcactgtataaat

SEQ ID NO: 4927872 - DNA, 23 bp, Homo sapiens
catgggcttcactgtataaatag

SEQ ID NO: 4927873 - DNA, 14 bp, Homo sapiens
catggtaccagccc

SEQ ID NO: 4927874 - DNA, 17 bp, Homo sapiens
catggtcacacactgat

SEQ ID NO: 4927875 - DNA, 15 bp, Homo sapiens
catggtccctgcctt

SEQ ID NO: 4927876 - DNA, 17 bp, Homo sapiens
catggtccctgccttag

SEQ ID NO: 4927877 - DNA, 11 bp, Homo sapiens
catggtgaaaa

SEQ ID NO: 4927878 - DNA, 19 bp, Homo sapiens
catggtgaaaatgtactga

SEQ ID NO: 4927879 - DNA, 21 bp, Homo sapiens
catggtgaaaatgtactgaga

SEQ ID NO: 4927880 - DNA, 16 bp, Homo sapiens
catggtggacccagcg

SEQ ID NO: 4927881 - DNA, 19 bp, Homo sapiens
catggtgggttcaggggac

SEQ ID NO: 4927882 - DNA, 18 bp, Homo sapiens
catggtgtaataagacat

SEQ ID NO: 4927883 - DNA, 21 bp, Homo sapiens
catggtgtaataagacataac

SEQ ID NO: 4927884 - DNA, 16 bp, Homo sapiens
catgtaaaagcggaaa

SEQ ID NO: 4927885 - DNA, 16 bp, Homo sapiens
catgtaaagaaatgtc

SEQ ID NO: 4927886 - DNA, 17 bp, Homo sapiens
catgtaaagaaatgtct

SEQ ID NO: 4927887 - DNA, 13 bp, Homo sapiens
catgtacctcccc

SEQ ID NO: 4927888 - DNA, 16 bp, Homo sapiens
catgtacctcccctgc

SEQ ID NO: 4927889 - DNA, 19 bp, Homo sapiens
catgtacctcccctgcctt

SEQ ID NO: 4927890 - DNA, 20 bp, Homo sapiens
catgtacctcccctgccttg

SEQ ID NO: 4927891 - DNA, 21 bp, Homo sapiens
catgtacctcccctgccttgc

SEQ ID NO: 4927892 - DNA, 22 bp, Homo sapiens
catgtactagttttagttttct

SEQ ID NO: 4927893 - DNA, 13 bp, Homo sapiens
catgtagccccct

SEQ ID NO: 4927894 - DNA, 17 bp, Homo sapiens
catgtagccccctggcc

SEQ ID NO: 4927895 - DNA, 20 bp, Homo sapiens
catgtagccccctggcctct

SEQ ID NO: 4927896 - DNA, 14 bp, Homo sapiens
catgtagctgagtt

SEQ ID NO: 4927897 - DNA, 17 bp, Homo sapiens
catgtataaatgtgata

SEQ ID NO: 4927898 - DNA, 13 bp, Homo sapiens
catgtatgtcttg

SEQ ID NO: 4927899 - DNA, 17 bp, Homo sapiens
catgtatgtcttggaca

SEQ ID NO: 4927900 - DNA, 21 bp, Homo sapiens
catgtatgtcttggacactgt

SEQ ID NO: 4927901 - DNA, 22 bp, Homo sapiens
catgtatgtcttggacactgta

SEQ ID NO: 4927902 - DNA, 21 bp, Homo sapiens
catgtcaaacatgagatgtgt

SEQ ID NO: 4927903 - DNA, 14 bp, Homo sapiens
catgtccaaagagg

SEQ ID NO: 4927904 - DNA, 15 bp, Homo sapiens
catgtccaaagaggc

SEQ ID NO: 4927905 - DNA, 21 bp, Homo sapiens
catgtccaaagaggctgcccc

SEQ ID NO: 4927906 - DNA, 16 bp, Homo sapiens
catgtccctaccgagt

SEQ ID NO: 4927907 - DNA, 14 bp, Homo sapiens
catgtcctatgtgt

SEQ ID NO: 4927908 - DNA, 15 bp, Homo sapiens
catgtcctatgtgtg

SEQ ID NO: 4927909 - DNA, 21 bp, Homo sapiens
catgtcgctagccagtgctcc

SEQ ID NO: 4927910 - DNA, 12 bp, Homo sapiens
catgtctggcta

SEQ ID NO: 4927911 - DNA, 15 bp, Homo sapiens
catgtcttgtacatg

SEQ ID NO: 4927912 - DNA, 21 bp, Homo sapiens
catgtgaaaccttttttaaga

SEQ ID NO: 4927913 - DNA, 24 bp, Homo sapiens
catgtgaaaccttttttaagattt

SEQ ID NO: 4927914 - DNA, 14 bp, Homo sapiens
catgtgcacatgca

SEQ ID NO: 4927915 - DNA, 22 bp, Homo sapiens
catgtgccagggcaatgatgaa

SEQ ID NO: 4927916 - DNA, 14 bp, Homo sapiens
catgtgccctcctg

SEQ ID NO: 4927917 - DNA, 20 bp, Homo sapiens
catgtggcttttttaaaaaa

SEQ ID NO: 4927918 - DNA, 15 bp, Homo sapiens
catgtgggtcttcca

SEQ ID NO: 4927919 - DNA, 22 bp, Homo sapiens
catgtggtggcacaggccccct

SEQ ID NO: 4927920 - DNA, 15 bp, Homo sapiens
catgtgtagcctatg

SEQ ID NO: 4927921 - DNA, 16 bp, Homo sapiens
catgtgtagcctatgt

SEQ ID NO: 4927922 - DNA, 18 bp, Homo sapiens
catgtgtagcctgtgcat

SEQ ID NO: 4927923 - DNA, 17 bp, Homo sapiens
catgtgtcacttgtgct

SEQ ID NO: 4927924 - DNA, 22 bp, Homo sapiens
catgtgtcacttgtgctttgct

SEQ ID NO: 4927925 - DNA, 14 bp, Homo sapiens
catgtgtgctgaac

SEQ ID NO: 4927926 - DNA, 13 bp, Homo sapiens
catgtgtgtataa

SEQ ID NO: 4927927 - DNA, 20 bp, Homo sapiens
catgtgtgtatatatgtgta

SEQ ID NO: 4927928 - DNA, 13 bp, Homo sapiens
catgtgtgtgtgt

SEQ ID NO: 4927929 - DNA, 12 bp, Homo sapiens
catgttaccatc

SEQ ID NO: 4927930 - DNA, 20 bp, Homo sapiens
catgttcacaccgctgcact

SEQ ID NO: 4927931 - DNA, 19 bp, Homo sapiens
catgttctgcccccagccc

SEQ ID NO: 4927932 - DNA, 22 bp, Homo sapiens
catgttgcccccgtgagccaat

SEQ ID NO: 4927933 - DNA, 19 bp, Homo sapiens
catgttggccaggctggtc

SEQ ID NO: 4927934 - DNA, 15 bp, Homo sapiens
catgttgtaatgctg

SEQ ID NO: 4927935 - DNA, 16 bp, Homo sapiens
catgttgtaatgctgc

SEQ ID NO: 4927936 - DNA, 20 bp, Homo sapiens
catgtttatgaaaataaata

SEQ ID NO: 4927937 - DNA, 16 bp, Homo sapiens
catgtttcatgttttg

SEQ ID NO: 4927938 - DNA, 21 bp, Homo sapiens
catgtttggtgcatagaactg

SEQ ID NO: 4927939 - DNA, 15 bp, Homo sapiens
catgttttgtataca

SEQ ID NO: 4927940 - DNA, 22 bp, Homo sapiens
catgttttgtatacaaatatat

SEQ ID NO: 4927941 - DNA, 14 bp, Homo sapiens
catgttttgtgact

SEQ ID NO: 4927942 - DNA, 21 bp, Homo sapiens
cattaaaaaatgaaatatttt

SEQ ID NO: 4927943 - DNA, 13 bp, Homo sapiens
cattaaaactgct

SEQ ID NO: 4927944 - DNA, 15 bp, Homo sapiens
cattaaaactgcttt

SEQ ID NO: 4927945 - DNA, 12 bp, Homo sapiens
cattaaacctgt

SEQ ID NO: 4927946 - DNA, 22 bp, Homo sapiens
cattaaacctgtctccactgtg

SEQ ID NO: 4927947 - DNA, 13 bp, Homo sapiens
cattaaagtctga

SEQ ID NO: 4927948 - DNA, 17 bp, Homo sapiens
cattaaagtctgaatca

SEQ ID NO: 4927949 - DNA, 11 bp, Homo sapiens
cattaaatgaa

SEQ ID NO: 4927950 - DNA, 14 bp, Homo sapiens
cattaaatgaatat

SEQ ID NO: 4927951 - DNA, 12 bp, Homo sapiens
cattaaatgttt

SEQ ID NO: 4927952 - DNA, 13 bp, Homo sapiens
cattaaatgtttg

SEQ ID NO: 4927953 - DNA, 14 bp, Homo sapiens
cattaaatgtttga

SEQ ID NO: 4927954 - DNA, 17 bp, Homo sapiens
cattaaattcacaaact

SEQ ID NO: 4927955 - DNA, 20 bp, Homo sapiens
cattaagtaatcaataaaga

SEQ ID NO: 4927956 - DNA, 18 bp, Homo sapiens
cattaatcaatcatctgt

SEQ ID NO: 4927957 - DNA, 16 bp, Homo sapiens
cattaatcatttcccc

SEQ ID NO: 4927958 - DNA, 13 bp, Homo sapiens
cattaatgtgttg

SEQ ID NO: 4927959 - DNA, 14 bp, Homo sapiens
cattaatgtgttgg

SEQ ID NO: 4927960 - DNA, 12 bp, Homo sapiens
cattaattctat

SEQ ID NO: 4927961 - DNA, 13 bp, Homo sapiens
cattaccactcag

SEQ ID NO: 4927962 - DNA, 14 bp, Homo sapiens
cattaccactcagg

SEQ ID NO: 4927963 - DNA, 15 bp, Homo sapiens
cattacccttccctg

SEQ ID NO: 4927964 - DNA, 20 bp, Homo sapiens
cattaccttactgtggagga

SEQ ID NO: 4927965 - DNA, 16 bp, Homo sapiens
cattactcttaaggaa

SEQ ID NO: 4927966 - DNA, 14 bp, Homo sapiens
cattagaaaaagag

SEQ ID NO: 4927967 - DNA, 17 bp, Homo sapiens
cattagactcctcctcc

SEQ ID NO: 4927968 - DNA, 17 bp, Homo sapiens
cattagtaaatgtcttt

SEQ ID NO: 4927969 - DNA, 18 bp, Homo sapiens
cattagtaaatgtctttg

SEQ ID NO: 4927970 - DNA, 13 bp, Homo sapiens
cattataaacgct

SEQ ID NO: 4927971 - DNA, 13 bp, Homo sapiens
cattatccctgaa

SEQ ID NO: 4927972 - DNA, 20 bp, Homo sapiens
cattattcatttagtgagtt

SEQ ID NO: 4927973 - DNA, 18 bp, Homo sapiens
cattattctcttttatct

SEQ ID NO: 4927974 - DNA, 16 bp, Homo sapiens
cattattgcttattgc

SEQ ID NO: 4927975 - DNA, 23 bp, Homo sapiens
cattatttatatggggaatatat

SEQ ID NO: 4927976 - DNA, 22 bp, Homo sapiens
cattatttattcagcttcattt

SEQ ID NO: 4927977 - DNA, 14 bp, Homo sapiens
cattattttctgtc

SEQ ID NO: 4927978 - DNA, 12 bp, Homo sapiens
cattcaacaaga

SEQ ID NO: 4927979 - DNA, 15 bp, Homo sapiens
cattcactagctttg

SEQ ID NO: 4927980 - DNA, 13 bp, Homo sapiens
cattcacttctct

SEQ ID NO: 4927981 - DNA, 17 bp, Homo sapiens
cattcatggaccactgt

SEQ ID NO: 4927982 - DNA, 17 bp, Homo sapiens
cattccaagactctaga

SEQ ID NO: 4927983 - DNA, 16 bp, Homo sapiens
cattccttctttgata

SEQ ID NO: 4927984 - DNA, 23 bp, Homo sapiens
cattctaggtaggggcccacttc

SEQ ID NO: 4927985 - DNA, 15 bp, Homo sapiens
cattctatcaagccc

SEQ ID NO: 4927986 - DNA, 17 bp, Homo sapiens
cattctatcaagcccag

SEQ ID NO: 4927987 - DNA, 23 bp, Homo sapiens
cattctatcaagcccaggtgcca

SEQ ID NO: 4927988 - DNA, 14 bp, Homo sapiens
cattctattgcctt

SEQ ID NO: 4927989 - DNA, 16 bp, Homo sapiens
cattctattgccttct

SEQ ID NO: 4927990 - DNA, 19 bp, Homo sapiens
cattctattgccttctttg

SEQ ID NO: 4927991 - DNA, 22 bp, Homo sapiens
cattctattgccttctttgaag

SEQ ID NO: 4927992 - DNA, 16 bp, Homo sapiens
cattctattttagaat

SEQ ID NO: 4927993 - DNA, 16 bp, Homo sapiens
cattctcataattcct

SEQ ID NO: 4927994 - DNA, 21 bp, Homo sapiens
cattctcataattcctacagc

SEQ ID NO: 4927995 - DNA, 21 bp, Homo sapiens
cattctcatctgcacccttct

SEQ ID NO: 4927996 - DNA, 23 bp, Homo sapiens
cattctcatctgcacccttcttt

SEQ ID NO: 4927997 - DNA, 19 bp, Homo sapiens
cattctcattgcagaataa

SEQ ID NO: 4927998 - DNA, 18 bp, Homo sapiens
cattctgcattgctagat

SEQ ID NO: 4927999 - DNA, 19 bp, Homo sapiens
cattctgcattgctagata

SEQ ID NO: 4928000 - DNA, 21 bp, Homo sapiens
cattctgccgccccctcctga

SEQ ID NO: 4928001 - DNA, 23 bp, Homo sapiens
cattctgccgccccctcctgaac

SEQ ID NO: 4928002 - DNA, 17 bp, Homo sapiens
cattctgcctctctagg

SEQ ID NO: 4928003 - DNA, 12 bp, Homo sapiens
cattctgcctgc

SEQ ID NO: 4928004 - DNA, 13 bp, Homo sapiens
cattctgcctgcc

SEQ ID NO: 4928005 - DNA, 17 bp, Homo sapiens
cattctgtgatcattta

SEQ ID NO: 4928006 - DNA, 12 bp, Homo sapiens
cattcttactta

SEQ ID NO: 4928007 - DNA, 21 bp, Homo sapiens
cattcttacttactaaaatat

SEQ ID NO: 4928008 - DNA, 23 bp, Homo sapiens
cattcttgttttctttctttaaa

SEQ ID NO: 4928009 - DNA, 13 bp, Homo sapiens
cattctttcccag

SEQ ID NO: 4928010 - DNA, 19 bp, Homo sapiens
cattgaaatgagcacctcc

SEQ ID NO: 4928011 - DNA, 13 bp, Homo sapiens
cattgaaatgtca

SEQ ID NO: 4928012 - DNA, 14 bp, Homo sapiens
cattgaaatgtcac

SEQ ID NO: 4928013 - DNA, 17 bp, Homo sapiens
cattgaacacaaactgt

SEQ ID NO: 4928014 - DNA, 22 bp, Homo sapiens
cattgaacacaaactgtaaata

SEQ ID NO: 4928015 - DNA, 16 bp, Homo sapiens
cattgacaaatctgtg

SEQ ID NO: 4928016 - DNA, 22 bp, Homo sapiens
cattgaccgcgactaatttcaa

SEQ ID NO: 4928017 - DNA, 19 bp, Homo sapiens
cattgacgattccttctct

SEQ ID NO: 4928018 - DNA, 20 bp, Homo sapiens
cattgagctgatataaattc

SEQ ID NO: 4928019 - DNA, 15 bp, Homo sapiens
cattgagctgtgcaa

SEQ ID NO: 4928020 - DNA, 17 bp, Homo sapiens
cattgaggaagagtctt

SEQ ID NO: 4928021 - DNA, 13 bp, Homo sapiens
cattgagtagaca

SEQ ID NO: 4928022 - DNA, 23 bp, Homo sapiens
cattgagtagacacatttaagga

SEQ ID NO: 4928023 - DNA, 16 bp, Homo sapiens
cattgcagaataatgt

SEQ ID NO: 4928024 - DNA, 22 bp, Homo sapiens
cattgcagaataatgttctatt

SEQ ID NO: 4928025 - DNA, 22 bp, Homo sapiens
cattgcatcacctctgtaattt

SEQ ID NO: 4928026 - DNA, 14 bp, Homo sapiens
cattgccaccagga

SEQ ID NO: 4928027 - DNA, 22 bp, Homo sapiens
cattgcctaactactagttttt

SEQ ID NO: 4928028 - DNA, 23 bp, Homo sapiens
cattgcgtttgaccttttatgta

SEQ ID NO: 4928029 - DNA, 21 bp, Homo sapiens
cattgctgagcctctgctccc

SEQ ID NO: 4928030 - DNA, 14 bp, Homo sapiens
cattgctgttatgt

SEQ ID NO: 4928031 - DNA, 20 bp, Homo sapiens
cattgctgttatgtctgttt

SEQ ID NO: 4928032 - DNA, 18 bp, Homo sapiens
cattgctttcgtgtaaat

SEQ ID NO: 4928033 - DNA, 19 bp, Homo sapiens
cattgctttcgtgtaaatt

SEQ ID NO: 4928034 - DNA, 16 bp, Homo sapiens
cattgctttgaagcag

SEQ ID NO: 4928035 - DNA, 22 bp, Homo sapiens
cattgctttgaagcagttgtgt

SEQ ID NO: 4928036 - DNA, 20 bp, Homo sapiens
cattgcttttattttgaaaa

SEQ ID NO: 4928037 - DNA, 23 bp, Homo sapiens
cattgggttgtagccaaaggttc

SEQ ID NO: 4928038 - DNA, 13 bp, Homo sapiens
cattggtgttgtc

SEQ ID NO: 4928039 - DNA, 13 bp, Homo sapiens
cattgtaaacaaa

SEQ ID NO: 4928040 - DNA, 16 bp, Homo sapiens
cattgtactacctgtg

SEQ ID NO: 4928041 - DNA, 15 bp, Homo sapiens
cattgtagagcttct

SEQ ID NO: 4928042 - DNA, 20 bp, Homo sapiens
cattgtatgatgtgttgtga

SEQ ID NO: 4928043 - DNA, 22 bp, Homo sapiens
cattgtatgatgtgttgtgata

SEQ ID NO: 4928044 - DNA, 17 bp, Homo sapiens
cattgtccctcttcact

SEQ ID NO: 4928045 - DNA, 15 bp, Homo sapiens
cattgtgttgacatt

SEQ ID NO: 4928046 - DNA, 22 bp, Homo sapiens
cattgttagcactaggcaccca

SEQ ID NO: 4928047 - DNA, 17 bp, Homo sapiens
cattgttggccaaagcc

SEQ ID NO: 4928048 - DNA, 14 bp, Homo sapiens
cattgtttgctgct

SEQ ID NO: 4928049 - DNA, 14 bp, Homo sapiens
cattgttttgaaac

SEQ ID NO: 4928050 - DNA, 19 bp, Homo sapiens
cattgttttgaatattact

SEQ ID NO: 4928051 - DNA, 15 bp, Homo sapiens
catttaaaaaaatca

SEQ ID NO: 4928052 - DNA, 12 bp, Homo sapiens
catttaaagcat

SEQ ID NO: 4928053 - DNA, 15 bp, Homo sapiens
catttaaagcattgc

SEQ ID NO: 4928054 - DNA, 12 bp, Homo sapiens
catttaatttag

SEQ ID NO: 4928055 - DNA, 20 bp, Homo sapiens
catttacagtccttcaaaat

SEQ ID NO: 4928056 - DNA, 13 bp, Homo sapiens
catttactaaaca

SEQ ID NO: 4928057 - DNA, 17 bp, Homo sapiens
catttactaaacatatg

SEQ ID NO: 4928058 - DNA, 17 bp, Homo sapiens
catttactttgtgttca

SEQ ID NO: 4928059 - DNA, 22 bp, Homo sapiens
catttagaaaatagagctttta

SEQ ID NO: 4928060 - DNA, 22 bp, Homo sapiens
catttagctaaacggattccaa

SEQ ID NO: 4928061 - DNA, 12 bp, Homo sapiens
catttatatatg

SEQ ID NO: 4928062 - DNA, 15 bp, Homo sapiens
catttatatatgaaa

SEQ ID NO: 4928063 - DNA, 15 bp, Homo sapiens
catttatcattcttg

SEQ ID NO: 4928064 - DNA, 16 bp, Homo sapiens
catttcaattctcaaa

SEQ ID NO: 4928065 - DNA, 13 bp, Homo sapiens
catttcacattaa

SEQ ID NO: 4928066 - DNA, 15 bp, Homo sapiens
catttcacattaatg

SEQ ID NO: 4928067 - DNA, 17 bp, Homo sapiens
catttcatcattgtttc

SEQ ID NO: 4928068 - DNA, 19 bp, Homo sapiens
catttcatcattgtttctg

SEQ ID NO: 4928069 - DNA, 12 bp, Homo sapiens
catttcattcca

SEQ ID NO: 4928070 - DNA, 15 bp, Homo sapiens
catttcattccattg

SEQ ID NO: 4928071 - DNA, 13 bp, Homo sapiens
catttcattgtat

SEQ ID NO: 4928072 - DNA, 13 bp, Homo sapiens
catttccaacacc

SEQ ID NO: 4928073 - DNA, 19 bp, Homo sapiens
catttccaacaccacagac

SEQ ID NO: 4928074 - DNA, 20 bp, Homo sapiens
catttccaacaccacagaca

SEQ ID NO: 4928075 - DNA, 22 bp, Homo sapiens
catttccaacaccacagacaca

SEQ ID NO: 4928076 - DNA, 23 bp, Homo sapiens
catttcctatcacctatttccat

SEQ ID NO: 4928077 - DNA, 20 bp, Homo sapiens
catttcctgacagaaggact

SEQ ID NO: 4928078 - DNA, 13 bp, Homo sapiens
catttcctgtgtc

SEQ ID NO: 4928079 - DNA, 17 bp, Homo sapiens
catttctgaatagaaat

SEQ ID NO: 4928080 - DNA, 14 bp, Homo sapiens
catttctgtaaata

SEQ ID NO: 4928081 - DNA, 19 bp, Homo sapiens
catttcttttctttttaca

SEQ ID NO: 4928082 - DNA, 23 bp, Homo sapiens
catttgactgaagatgcagctca

SEQ ID NO: 4928083 - DNA, 16 bp, Homo sapiens
catttgagcagggctc

SEQ ID NO: 4928084 - DNA, 17 bp, Homo sapiens
catttgagcagggctca

SEQ ID NO: 4928085 - DNA, 18 bp, Homo sapiens
catttgagcagggctcag

SEQ ID NO: 4928086 - DNA, 16 bp, Homo sapiens
catttgataatgataa

SEQ ID NO: 4928087 - DNA, 19 bp, Homo sapiens
catttgatacccctgggga

SEQ ID NO: 4928088 - DNA, 15 bp, Homo sapiens
catttgccttgcaga

SEQ ID NO: 4928089 - DNA, 19 bp, Homo sapiens
catttgccttgcagaactg

SEQ ID NO: 4928090 - DNA, 20 bp, Homo sapiens
catttgccttgcagaactgc

SEQ ID NO: 4928091 - DNA, 21 bp, Homo sapiens
catttgccttgcagaactgcc

SEQ ID NO: 4928092 - DNA, 14 bp, Homo sapiens
catttgccttgctg

SEQ ID NO: 4928093 - DNA, 19 bp, Homo sapiens
catttgctctttcatctct

SEQ ID NO: 4928094 - DNA, 16 bp, Homo sapiens
catttgctttttcacc

SEQ ID NO: 4928095 - DNA, 18 bp, Homo sapiens
catttgtaaatgctgtgt

SEQ ID NO: 4928096 - DNA, 20 bp, Homo sapiens
catttgtacagaattttgga

SEQ ID NO: 4928097 - DNA, 11 bp, Homo sapiens
catttgtattt

SEQ ID NO: 4928098 - DNA, 18 bp, Homo sapiens
catttgtattttgtgtga

SEQ ID NO: 4928099 - DNA, 15 bp, Homo sapiens
catttgtgtcaatgg

SEQ ID NO: 4928100 - DNA, 18 bp, Homo sapiens
catttgttaaaattatca

SEQ ID NO: 4928101 - DNA, 14 bp, Homo sapiens
catttgttcactga

SEQ ID NO: 4928102 - DNA, 16 bp, Homo sapiens
catttgttggaatgaa

SEQ ID NO: 4928103 - DNA, 15 bp, Homo sapiens
cattttaaataaaag

SEQ ID NO: 4928104 - DNA, 18 bp, Homo sapiens
cattttacattaaatttt

SEQ ID NO: 4928105 - DNA, 20 bp, Homo sapiens
cattttccccccactctccc

SEQ ID NO: 4928106 - DNA, 18 bp, Homo sapiens
cattttcctacaggcagt

SEQ ID NO: 4928107 - DNA, 19 bp, Homo sapiens
cattttctataacagatat

SEQ ID NO: 4928108 - DNA, 23 bp, Homo sapiens
cattttcttattgcgctgctacc

SEQ ID NO: 4928109 - DNA, 21 bp, Homo sapiens
cattttggcgctattacaaat

SEQ ID NO: 4928110 - DNA, 22 bp, Homo sapiens
cattttgggacaattgttttaa

SEQ ID NO: 4928111 - DNA, 20 bp, Homo sapiens
cattttggggtacccactgc

SEQ ID NO: 4928112 - DNA, 23 bp, Homo sapiens
cattttggtaagagacagaatgt

SEQ ID NO: 4928113 - DNA, 14 bp, Homo sapiens
cattttgtgaatgg

SEQ ID NO: 4928114 - DNA, 19 bp, Homo sapiens
cattttgttcttacacata

SEQ ID NO: 4928115 - DNA, 23 bp, Homo sapiens
cattttgttgtaaaaagaaaaac

SEQ ID NO: 4928116 - DNA, 19 bp, Homo sapiens
catttttagtagagacagg

SEQ ID NO: 4928117 - DNA, 22 bp, Homo sapiens
catttttatttcagattttgat

SEQ ID NO: 4928118 - DNA, 23 bp, Homo sapiens
catttttatttcagattttgata

SEQ ID NO: 4928119 - DNA, 21 bp, Homo sapiens
catttttcattcacttctctt

SEQ ID NO: 4928120 - DNA, 17 bp, Homo sapiens
catttttgatttatgca

SEQ ID NO: 4928121 - DNA, 19 bp, Homo sapiens
cattttttgggcagcaatt

SEQ ID NO: 4928122 - DNA, 17 bp, Homo sapiens
catttttttaatttatt

SEQ ID NO: 4928123 - DNA, 16 bp, Homo sapiens
ccaaaaggaaaaagct

SEQ ID NO: 4928124 - DNA, 15 bp, Homo sapiens
ccaaaatgacatctt

SEQ ID NO: 4928125 - DNA, 16 bp, Homo sapiens
ccaaaatgacatcttt

SEQ ID NO: 4928126 - DNA, 19 bp, Homo sapiens
ccaaaatgacatcttttta

SEQ ID NO: 4928127 - DNA, 20 bp, Homo sapiens
ccaaacaccttccagctcct

SEQ ID NO: 4928128 - DNA, 14 bp, Homo sapiens
ccaaacatgtattt

SEQ ID NO: 4928129 - DNA, 13 bp, Homo sapiens
ccaaacgcctccc

SEQ ID NO: 4928130 - DNA, 21 bp, Homo sapiens
ccaaactgactcaacagtcat

SEQ ID NO: 4928131 - DNA, 13 bp, Homo sapiens
ccaaactgctgga

SEQ ID NO: 4928132 - DNA, 16 bp, Homo sapiens
ccaaagaaatgaacat

SEQ ID NO: 4928133 - DNA, 17 bp, Homo sapiens
ccaaagaaatgaacatt

SEQ ID NO: 4928134 - DNA, 14 bp, Homo sapiens
ccaaagaattctta

SEQ ID NO: 4928135 - DNA, 21 bp, Homo sapiens
ccaaagagcacaaacattttt

SEQ ID NO: 4928136 - DNA, 12 bp, Homo sapiens
ccaaagaggctg

SEQ ID NO: 4928137 - DNA, 14 bp, Homo sapiens
ccaaagaggctgcc

SEQ ID NO: 4928138 - DNA, 21 bp, Homo sapiens
ccaaagaggctgcccctctca

SEQ ID NO: 4928139 - DNA, 23 bp, Homo sapiens
ccaaagaggctgcccctctcacc

SEQ ID NO: 4928140 - DNA, 16 bp, Homo sapiens
ccaaagatgcagccgc

SEQ ID NO: 4928141 - DNA, 22 bp, Homo sapiens
ccaaagatgcagccgccttcct

SEQ ID NO: 4928142 - DNA, 15 bp, Homo sapiens
ccaaagctaggcctg

SEQ ID NO: 4928143 - DNA, 12 bp, Homo sapiens
ccaaaggaggct

SEQ ID NO: 4928144 - DNA, 17 bp, Homo sapiens
ccaaaggaggctggcag

SEQ ID NO: 4928145 - DNA, 13 bp, Homo sapiens
ccaaaggctggtg

SEQ ID NO: 4928146 - DNA, 20 bp, Homo sapiens
ccaaagggagagttccagag

SEQ ID NO: 4928147 - DNA, 19 bp, Homo sapiens
ccaaaggggacaggcctca

SEQ ID NO: 4928148 - DNA, 17 bp, Homo sapiens
ccaaagtgacctaccca

SEQ ID NO: 4928149 - DNA, 19 bp, Homo sapiens
ccaaagttctaataatttc

SEQ ID NO: 4928150 - DNA, 20 bp, Homo sapiens
ccaaagttctaataatttct

SEQ ID NO: 4928151 - DNA, 23 bp, Homo sapiens
ccaaagttctaataatttctaat

SEQ ID NO: 4928152 - DNA, 15 bp, Homo sapiens
ccaaataacttcagt

SEQ ID NO: 4928153 - DNA, 19 bp, Homo sapiens
ccaaatctctcaaatctgt

SEQ ID NO: 4928154 - DNA, 17 bp, Homo sapiens
ccaaattatttgtgtaa

SEQ ID NO: 4928155 - DNA, 20 bp, Homo sapiens
ccaaattgtgcttctcccca

SEQ ID NO: 4928156 - DNA, 11 bp, Homo sapiens
ccaacaaacca

SEQ ID NO: 4928157 - DNA, 16 bp, Homo sapiens
ccaacaaaccatccag

SEQ ID NO: 4928158 - DNA, 15 bp, Homo sapiens
ccaacaccacagaca

SEQ ID NO: 4928159 - DNA, 18 bp, Homo sapiens
ccaacaccacagacacac

SEQ ID NO: 4928160 - DNA, 23 bp, Homo sapiens
ccaacaccacagacacacacacg

SEQ ID NO: 4928161 - DNA, 20 bp, Homo sapiens
ccaacacccaaagcatggac

SEQ ID NO: 4928162 - DNA, 20 bp, Homo sapiens
ccaacaccctgtctaaaaaa

SEQ ID NO: 4928163 - DNA, 15 bp, Homo sapiens
ccaacagccatgccc

SEQ ID NO: 4928164 - DNA, 12 bp, Homo sapiens
ccaacagtgagt

SEQ ID NO: 4928165 - DNA, 23 bp, Homo sapiens
ccaaccaacttggttctgcttca

SEQ ID NO: 4928166 - DNA, 20 bp, Homo sapiens
ccaaccaagtggctcccaca

SEQ ID NO: 4928167 - DNA, 18 bp, Homo sapiens
ccaacccccaccccacac

SEQ ID NO: 4928168 - DNA, 20 bp, Homo sapiens
ccaacccccaccccacactt

SEQ ID NO: 4928169 - DNA, 16 bp, Homo sapiens
ccaaccgacaggccct

SEQ ID NO: 4928170 - DNA, 19 bp, Homo sapiens
ccaacgttactcagggctc

SEQ ID NO: 4928171 - DNA, 14 bp, Homo sapiens
ccaactcacctgag

SEQ ID NO: 4928172 - DNA, 13 bp, Homo sapiens
ccaactgtgagca

SEQ ID NO: 4928173 - DNA, 23 bp, Homo sapiens
ccaactgttcagctgtcctccct

SEQ ID NO: 4928174 - DNA, 10 bp, Homo sapiens
ccaacttgag

SEQ ID NO: 4928175 - DNA, 19 bp, Homo sapiens
ccaagaatagatgctgact

SEQ ID NO: 4928176 - DNA, 16 bp, Homo sapiens
ccaagacaaatcaaca

SEQ ID NO: 4928177 - DNA, 23 bp, Homo sapiens
ccaagacagatgccccagagctg

SEQ ID NO: 4928178 - DNA, 13 bp, Homo sapiens
ccaagactctaga

SEQ ID NO: 4928179 - DNA, 14 bp, Homo sapiens
ccaagactctagag

SEQ ID NO: 4928180 - DNA, 21 bp, Homo sapiens
ccaagactctagagtccaagg

SEQ ID NO: 4928181 - DNA, 20 bp, Homo sapiens
ccaagagagggccatgcaat

SEQ ID NO: 4928182 - DNA, 17 bp, Homo sapiens
ccaagattctagatgat

SEQ ID NO: 4928183 - DNA, 21 bp, Homo sapiens
ccaagcagagcaatcagttag

SEQ ID NO: 4928184 - DNA, 14 bp, Homo sapiens
ccaagcaggagacg

SEQ ID NO: 4928185 - DNA, 21 bp, Homo sapiens
ccaagccaaaaaccttagctc

SEQ ID NO: 4928186 - DNA, 14 bp, Homo sapiens
ccaagccgtggctt

SEQ ID NO: 4928187 - DNA, 17 bp, Homo sapiens
ccaagccgtggcttccc

SEQ ID NO: 4928188 - DNA, 13 bp, Homo sapiens
ccaagcctccaca

SEQ ID NO: 4928189 - DNA, 18 bp, Homo sapiens
ccaagcctccacagcgag

SEQ ID NO: 4928190 - DNA, 17 bp, Homo sapiens
ccaagctaagcactgcc

SEQ ID NO: 4928191 - DNA, 15 bp, Homo sapiens
ccaagctatctaaag

SEQ ID NO: 4928192 - DNA, 16 bp, Homo sapiens
ccaagctattcctttc

SEQ ID NO: 4928193 - DNA, 17 bp, Homo sapiens
ccaagctattcctttcc

SEQ ID NO: 4928194 - DNA, 20 bp, Homo sapiens
ccaagctattcctttccctt

SEQ ID NO: 4928195 - DNA, 11 bp, Homo sapiens
ccaagctccct

SEQ ID NO: 4928196 - DNA, 13 bp, Homo sapiens
ccaagctcctcct

SEQ ID NO: 4928197 - DNA, 16 bp, Homo sapiens
ccaagctctgctcctc

SEQ ID NO: 4928198 - DNA, 18 bp, Homo sapiens
ccaagctctgctcctctc

SEQ ID NO: 4928199 - DNA, 17 bp, Homo sapiens
ccaagcttgttatcagc

SEQ ID NO: 4928200 - DNA, 15 bp, Homo sapiens
ccaaggaaatatatt

SEQ ID NO: 4928201 - DNA, 13 bp, Homo sapiens
ccaaggaacaaaa

SEQ ID NO: 4928202 - DNA, 23 bp, Homo sapiens
ccaaggactgagggactctgaag

SEQ ID NO: 4928203 - DNA, 19 bp, Homo sapiens
ccaaggagcacaggtccca

SEQ ID NO: 4928204 - DNA, 16 bp, Homo sapiens
ccaaggccttctcctc

SEQ ID NO: 4928205 - DNA, 15 bp, Homo sapiens
ccaagggcagaaagt

SEQ ID NO: 4928206 - DNA, 22 bp, Homo sapiens
ccaaggggaatgtttgcctctg

SEQ ID NO: 4928207 - DNA, 21 bp, Homo sapiens
ccaaggggcaaatttttattt

SEQ ID NO: 4928208 - DNA, 19 bp, Homo sapiens
ccaaggtttaaagagtcta

SEQ ID NO: 4928209 - DNA, 15 bp, Homo sapiens
ccaagtagtctgctc

SEQ ID NO: 4928210 - DNA, 20 bp, Homo sapiens
ccaagtagtctgctcacagt

SEQ ID NO: 4928211 - DNA, 19 bp, Homo sapiens
ccaagtcagcccaacaggc

SEQ ID NO: 4928212 - DNA, 21 bp, Homo sapiens
ccaagtccgcagaagccctga

SEQ ID NO: 4928213 - DNA, 23 bp, Homo sapiens
ccaagtggtttccacatgctctg

SEQ ID NO: 4928214 - DNA, 16 bp, Homo sapiens
ccaatatgtattgtaa

SEQ ID NO: 4928215 - DNA, 15 bp, Homo sapiens
ccaatcagcactgaa

SEQ ID NO: 4928216 - DNA, 17 bp, Homo sapiens
ccaatcagcactgaaaa

SEQ ID NO: 4928217 - DNA, 21 bp, Homo sapiens
ccaatgagactctagggtcca

SEQ ID NO: 4928218 - DNA, 23 bp, Homo sapiens
ccaatgagactctagggtccagt

SEQ ID NO: 4928219 - DNA, 20 bp, Homo sapiens
ccaatgttagagactttttt

SEQ ID NO: 4928220 - DNA, 12 bp, Homo sapiens
ccaatgttttcc

SEQ ID NO: 4928221 - DNA, 18 bp, Homo sapiens
ccaattattgatatatat

SEQ ID NO: 4928222 - DNA, 13 bp, Homo sapiens
ccaattgtgctgc

SEQ ID NO: 4928223 - DNA, 15 bp, Homo sapiens
ccaattgtgctgcca

SEQ ID NO: 4928224 - DNA, 22 bp, Homo sapiens
ccaattgttgacagttctgaag

SEQ ID NO: 4928225 - DNA, 22 bp, Homo sapiens
ccacaaaggccaaactgctgga

SEQ ID NO: 4928226 - DNA, 19 bp, Homo sapiens
ccacaactcctacatgatg

SEQ ID NO: 4928227 - DNA, 15 bp, Homo sapiens
ccacaagtcttccag

SEQ ID NO: 4928228 - DNA, 13 bp, Homo sapiens
ccacacccagccc

SEQ ID NO: 4928229 - DNA, 20 bp, Homo sapiens
ccacacccagcccacttctg

SEQ ID NO: 4928230 - DNA, 19 bp, Homo sapiens
ccacacccagcctcagtcc

SEQ ID NO: 4928231 - DNA, 23 bp, Homo sapiens
ccacaccctgtactgttctgtgt

SEQ ID NO: 4928232 - DNA, 18 bp, Homo sapiens
ccacacctcagttccctt

SEQ ID NO: 4928233 - DNA, 23 bp, Homo sapiens
ccacactaacctgggttcccttt

SEQ ID NO: 4928234 - DNA, 16 bp, Homo sapiens
ccacactctccatcac

SEQ ID NO: 4928235 - DNA, 21 bp, Homo sapiens
ccacacttgttccagctcttt

SEQ ID NO: 4928236 - DNA, 15 bp, Homo sapiens
ccacagacacacaca

SEQ ID NO: 4928237 - DNA, 14 bp, Homo sapiens
ccacagcagcattt

SEQ ID NO: 4928238 - DNA, 18 bp, Homo sapiens
ccacagcagcatttttat

SEQ ID NO: 4928239 - DNA, 15 bp, Homo sapiens
ccacagcgagggcag

SEQ ID NO: 4928240 - DNA, 16 bp, Homo sapiens
ccacagctgagaatgt

SEQ ID NO: 4928241 - DNA, 19 bp, Homo sapiens
ccacaggaggcaagcaagc

SEQ ID NO: 4928242 - DNA, 16 bp, Homo sapiens
ccacaggatcagtctg

SEQ ID NO: 4928243 - DNA, 16 bp, Homo sapiens
ccacaggcccttcctc

SEQ ID NO: 4928244 - DNA, 15 bp, Homo sapiens
ccacagtagtcttga

SEQ ID NO: 4928245 - DNA, 20 bp, Homo sapiens
ccacagttgccaccacctct

SEQ ID NO: 4928246 - DNA, 19 bp, Homo sapiens
ccacatccaactccagcaa

SEQ ID NO: 4928247 - DNA, 19 bp, Homo sapiens
ccacatcctccgtccagcc

SEQ ID NO: 4928248 - DNA, 17 bp, Homo sapiens
ccacatcttgctctgct

SEQ ID NO: 4928249 - DNA, 19 bp, Homo sapiens
ccacatcttgctctgctga

SEQ ID NO: 4928250 - DNA, 20 bp, Homo sapiens
ccacatcttgctctgctgac

SEQ ID NO: 4928251 - DNA, 15 bp, Homo sapiens
ccacatttctaaaat

SEQ ID NO: 4928252 - DNA, 13 bp, Homo sapiens
ccacatttggaat

SEQ ID NO: 4928253 - DNA, 19 bp, Homo sapiens
ccacatttggaatactttt

SEQ ID NO: 4928254 - DNA, 23 bp, Homo sapiens
ccacatttggttctaagaaaccc

SEQ ID NO: 4928255 - DNA, 16 bp, Homo sapiens
ccaccaaagctgccca

SEQ ID NO: 4928256 - DNA, 18 bp, Homo sapiens
ccaccaaagctgcccact

SEQ ID NO: 4928257 - DNA, 19 bp, Homo sapiens
ccaccagcatcacctgcct

SEQ ID NO: 4928258 - DNA, 13 bp, Homo sapiens
ccaccaggagaac

SEQ ID NO: 4928259 - DNA, 18 bp, Homo sapiens
ccaccaggatcccagggg

SEQ ID NO: 4928260 - DNA, 18 bp, Homo sapiens
ccaccatcatgtctggct

SEQ ID NO: 4928261 - DNA, 16 bp, Homo sapiens
ccaccatggccagcca

SEQ ID NO: 4928262 - DNA, 16 bp, Homo sapiens
ccacccacctcagcct

SEQ ID NO: 4928263 - DNA, 14 bp, Homo sapiens
ccacccaggagccc

SEQ ID NO: 4928264 - DNA, 12 bp, Homo sapiens
ccacccaggagg

SEQ ID NO: 4928265 - DNA, 14 bp, Homo sapiens
ccacccaggaggga

SEQ ID NO: 4928266 - DNA, 18 bp, Homo sapiens
ccacccaggagggagggg

SEQ ID NO: 4928267 - DNA, 16 bp, Homo sapiens
ccaccccacctgcagg

SEQ ID NO: 4928268 - DNA, 16 bp, Homo sapiens
ccacccccagctcaat

SEQ ID NO: 4928269 - DNA, 13 bp, Homo sapiens
ccacccccttctc

SEQ ID NO: 4928270 - DNA, 19 bp, Homo sapiens
ccacccccttctctgctcc

SEQ ID NO: 4928271 - DNA, 20 bp, Homo sapiens
ccaccccgggctctctgctg

SEQ ID NO: 4928272 - DNA, 13 bp, Homo sapiens
ccacccctacccc

SEQ ID NO: 4928273 - DNA, 13 bp, Homo sapiens
ccacccctccaga

SEQ ID NO: 4928274 - DNA, 13 bp, Homo sapiens
ccaccctccctgg

SEQ ID NO: 4928275 - DNA, 15 bp, Homo sapiens
ccaccctccctggag

SEQ ID NO: 4928276 - DNA, 14 bp, Homo sapiens
ccaccctcctttca

SEQ ID NO: 4928277 - DNA, 19 bp, Homo sapiens
ccaccctgctgccttctga

SEQ ID NO: 4928278 - DNA, 13 bp, Homo sapiens
ccaccgctgctcc

SEQ ID NO: 4928279 - DNA, 19 bp, Homo sapiens
ccaccgggctgggagctct

SEQ ID NO: 4928280 - DNA, 22 bp, Homo sapiens
ccaccgggctgggagctctgca

SEQ ID NO: 4928281 - DNA, 23 bp, Homo sapiens
ccaccgggctgggagctctgcag

SEQ ID NO: 4928282 - DNA, 18 bp, Homo sapiens
ccaccggtccagctggcc

SEQ ID NO: 4928283 - DNA, 18 bp, Homo sapiens
ccacctagaacactaact

SEQ ID NO: 4928284 - DNA, 21 bp, Homo sapiens
ccacctagactgtaaacctct

SEQ ID NO: 4928285 - DNA, 12 bp, Homo sapiens
ccacctcagcct

SEQ ID NO: 4928286 - DNA, 13 bp, Homo sapiens
ccacctcagcctc

SEQ ID NO: 4928287 - DNA, 17 bp, Homo sapiens
ccacctccccacgccct

SEQ ID NO: 4928288 - DNA, 23 bp, Homo sapiens
ccacctccccacgccctcccctc

SEQ ID NO: 4928289 - DNA, 15 bp, Homo sapiens
ccacctccctcacca

SEQ ID NO: 4928290 - DNA, 14 bp, Homo sapiens
ccacctctctcctt

SEQ ID NO: 4928291 - DNA, 17 bp, Homo sapiens
ccacctctctcctttgc

SEQ ID NO: 4928292 - DNA, 11 bp, Homo sapiens
ccacctctgcg

SEQ ID NO: 4928293 - DNA, 18 bp, Homo sapiens
ccacctctgtcatttgtt

SEQ ID NO: 4928294 - DNA, 22 bp, Homo sapiens
ccacctctgtgacctcaggcac

SEQ ID NO: 4928295 - DNA, 14 bp, Homo sapiens
ccacctctgtggca

SEQ ID NO: 4928296 - DNA, 21 bp, Homo sapiens
ccacctctgtggcattgaaat

SEQ ID NO: 4928297 - DNA, 15 bp, Homo sapiens
ccacctgcagggctg

SEQ ID NO: 4928298 - DNA, 9 bp, Homo sapiens
ccacctgcc

SEQ ID NO: 4928299 - DNA, 14 bp, Homo sapiens
ccacctgcccaacc

SEQ ID NO: 4928300 - DNA, 20 bp, Homo sapiens
ccacctgcccatcacagggt

SEQ ID NO: 4928301 - DNA, 11 bp, Homo sapiens
ccacctgcctg

SEQ ID NO: 4928302 - DNA, 12 bp, Homo sapiens
ccacctgcctgc

SEQ ID NO: 4928303 - DNA, 16 bp, Homo sapiens
ccacctgcctgcgtct

SEQ ID NO: 4928304 - DNA, 21 bp, Homo sapiens
ccacctgcctgcgtcttccgc

SEQ ID NO: 4928305 - DNA, 18 bp, Homo sapiens
ccacctgtctcagcctcc

SEQ ID NO: 4928306 - DNA, 12 bp, Homo sapiens
ccacctgtgggt

SEQ ID NO: 4928307 - DNA, 13 bp, Homo sapiens
ccaccttggctca

SEQ ID NO: 4928308 - DNA, 14 bp, Homo sapiens
ccaccttggctcaa

SEQ ID NO: 4928309 - DNA, 23 bp, Homo sapiens
ccacgaatttgctggggaatctc

SEQ ID NO: 4928310 - DNA, 16 bp, Homo sapiens
ccacgagggtcaggac

SEQ ID NO: 4928311 - DNA, 15 bp, Homo sapiens
ccacgatcctgccac

SEQ ID NO: 4928312 - DNA, 16 bp, Homo sapiens
ccacgattttctccag

SEQ ID NO: 4928313 - DNA, 21 bp, Homo sapiens
ccacgattttctccagctcag

SEQ ID NO: 4928314 - DNA, 22 bp, Homo sapiens
ccacgctagggcggggcacaga

SEQ ID NO: 4928315 - DNA, 18 bp, Homo sapiens
ccacgctggaccttgaac

SEQ ID NO: 4928316 - DNA, 19 bp, Homo sapiens
ccacgctggagtgcagtga

SEQ ID NO: 4928317 - DNA, 12 bp, Homo sapiens
ccacggccaggc

SEQ ID NO: 4928318 - DNA, 17 bp, Homo sapiens
ccacggctaagaggctg

SEQ ID NO: 4928319 - DNA, 18 bp, Homo sapiens
ccacggctaagaggctgc

SEQ ID NO: 4928320 - DNA, 17 bp, Homo sapiens
ccacgtctgtcttcaca

SEQ ID NO: 4928321 - DNA, 15 bp, Homo sapiens
ccacgtgtcttccac

SEQ ID NO: 4928322 - DNA, 20 bp, Homo sapiens
ccacgttccacagttgccac

SEQ ID NO: 4928323 - DNA, 16 bp, Homo sapiens
ccactcaccagtgtcc

SEQ ID NO: 4928324 - DNA, 13 bp, Homo sapiens
ccactcagcccct

SEQ ID NO: 4928325 - DNA, 15 bp, Homo sapiens
ccactcagcccctag

SEQ ID NO: 4928326 - DNA, 21 bp, Homo sapiens
ccactccagacccctggcttt

SEQ ID NO: 4928327 - DNA, 13 bp, Homo sapiens
ccactccattccc

SEQ ID NO: 4928328 - DNA, 13 bp, Homo sapiens
ccactcgcttccc

SEQ ID NO: 4928329 - DNA, 21 bp, Homo sapiens
ccactcgcttcccccatagcc

SEQ ID NO: 4928330 - DNA, 18 bp, Homo sapiens
ccactctaccctcccacc

SEQ ID NO: 4928331 - DNA, 12 bp, Homo sapiens
ccactctcccca

SEQ ID NO: 4928332 - DNA, 15 bp, Homo sapiens
ccactctcttccctt

SEQ ID NO: 4928333 - DNA, 17 bp, Homo sapiens
ccactgcaccgggccac

SEQ ID NO: 4928334 - DNA, 13 bp, Homo sapiens
ccactgccagcag

SEQ ID NO: 4928335 - DNA, 14 bp, Homo sapiens
ccactgccagcagc

SEQ ID NO: 4928336 - DNA, 14 bp, Homo sapiens
ccactgcctctgcc

SEQ ID NO: 4928337 - DNA, 15 bp, Homo sapiens
ccactgcctctgcct

SEQ ID NO: 4928338 - DNA, 20 bp, Homo sapiens
ccactgcctctggaattgct

SEQ ID NO: 4928339 - DNA, 15 bp, Homo sapiens
ccactgctctggtta

SEQ ID NO: 4928340 - DNA, 18 bp, Homo sapiens
ccactgctgcagtagggg

SEQ ID NO: 4928341 - DNA, 14 bp, Homo sapiens
ccactgtcaccctc

SEQ ID NO: 4928342 - DNA, 19 bp, Homo sapiens
ccactgtgccatgtgccag

SEQ ID NO: 4928343 - DNA, 15 bp, Homo sapiens
ccactgtttcttgct

SEQ ID NO: 4928344 - DNA, 18 bp, Homo sapiens
ccactgtttcttgcttgt

SEQ ID NO: 4928345 - DNA, 22 bp, Homo sapiens
ccacttattccccattcttcct

SEQ ID NO: 4928346 - DNA, 13 bp, Homo sapiens
ccacttccagggg

SEQ ID NO: 4928347 - DNA, 19 bp, Homo sapiens
ccacttccaggggaacctg

SEQ ID NO: 4928348 - DNA, 20 bp, Homo sapiens
ccacttcggccaggtcacac

SEQ ID NO: 4928349 - DNA, 17 bp, Homo sapiens
ccacttcttcctttctc

SEQ ID NO: 4928350 - DNA, 18 bp, Homo sapiens
ccacttcttcctttctct

SEQ ID NO: 4928351 - DNA, 19 bp, Homo sapiens
ccactttacccacctagaa

SEQ ID NO: 4928352 - DNA, 21 bp, Homo sapiens
ccactttgcacgacgccctct

SEQ ID NO: 4928353 - DNA, 14 bp, Homo sapiens
ccagaaaggagact

SEQ ID NO: 4928354 - DNA, 13 bp, Homo sapiens
ccagaacttccct

SEQ ID NO: 4928355 - DNA, 14 bp, Homo sapiens
ccagaacttccctg

SEQ ID NO: 4928356 - DNA, 19 bp, Homo sapiens
ccagaagaagagaagctgc

SEQ ID NO: 4928357 - DNA, 20 bp, Homo sapiens
ccagaagaagagaagctgct

SEQ ID NO: 4928358 - DNA, 22 bp, Homo sapiens
ccagaagatcccctcaggactg

SEQ ID NO: 4928359 - DNA, 19 bp, Homo sapiens
ccagaagcctctggctaga

SEQ ID NO: 4928360 - DNA, 21 bp, Homo sapiens
ccagaatttggaaatcctagt

SEQ ID NO: 4928361 - DNA, 22 bp, Homo sapiens
ccagacaaggaaatacccttct

SEQ ID NO: 4928362 - DNA, 20 bp, Homo sapiens
ccagacaccttgacagggca

SEQ ID NO: 4928363 - DNA, 11 bp, Homo sapiens
ccagacagacc

SEQ ID NO: 4928364 - DNA, 14 bp, Homo sapiens
ccagacccctggct

SEQ ID NO: 4928365 - DNA, 16 bp, Homo sapiens
ccagacccctggcttt

SEQ ID NO: 4928366 - DNA, 22 bp, Homo sapiens
ccagactgcaggttggacccca

SEQ ID NO: 4928367 - DNA, 15 bp, Homo sapiens
ccagactgttagaaa

SEQ ID NO: 4928368 - DNA, 14 bp, Homo sapiens
ccagacttccttga

SEQ ID NO: 4928369 - DNA, 20 bp, Homo sapiens
ccagagaccaggctgtgtcc

SEQ ID NO: 4928370 - DNA, 18 bp, Homo sapiens
ccagagagcaactctgag

SEQ ID NO: 4928371 - DNA, 23 bp, Homo sapiens
ccagagagggtggtgacctctgc

SEQ ID NO: 4928372 - DNA, 14 bp, Homo sapiens
ccagagagtggctc

SEQ ID NO: 4928373 - DNA, 18 bp, Homo sapiens
ccagagagtggctcctcc

SEQ ID NO: 4928374 - DNA, 19 bp, Homo sapiens
ccagagcaacctctcactc

SEQ ID NO: 4928375 - DNA, 16 bp, Homo sapiens
ccagagcagatgcaga

SEQ ID NO: 4928376 - DNA, 17 bp, Homo sapiens
ccagagcagatgcagag

SEQ ID NO: 4928377 - DNA, 20 bp, Homo sapiens
ccagagcagatgcagagagc

SEQ ID NO: 4928378 - DNA, 14 bp, Homo sapiens
ccagagcaggaagc

SEQ ID NO: 4928379 - DNA, 14 bp, Homo sapiens
ccagagcagggtgt

SEQ ID NO: 4928380 - DNA, 20 bp, Homo sapiens
ccagagcatttccaacacca

SEQ ID NO: 4928381 - DNA, 23 bp, Homo sapiens
ccagagctgtttatggcctcagc

SEQ ID NO: 4928382 - DNA, 24 bp, Homo sapiens
ccagagctgtttatggcctcagct

SEQ ID NO: 4928383 - DNA, 20 bp, Homo sapiens
ccagaggaatcctggcagcc

SEQ ID NO: 4928384 - DNA, 22 bp, Homo sapiens
ccagaggaatcctggcagccca

SEQ ID NO: 4928385 - DNA, 13 bp, Homo sapiens
ccagaggagcctt

SEQ ID NO: 4928386 - DNA, 15 bp, Homo sapiens
ccagaggagcctttt

SEQ ID NO: 4928387 - DNA, 21 bp, Homo sapiens
ccagagggagtgacagaggca

SEQ ID NO: 4928388 - DNA, 23 bp, Homo sapiens
ccagagggagtgacagaggcagc

SEQ ID NO: 4928389 - DNA, 21 bp, Homo sapiens
ccagagtcctttccaaggctt

SEQ ID NO: 4928390 - DNA, 14 bp, Homo sapiens
ccagagtggcctgg

SEQ ID NO: 4928391 - DNA, 15 bp, Homo sapiens
ccagagtggcctggc

SEQ ID NO: 4928392 - DNA, 19 bp, Homo sapiens
ccagagtggcctggccagg

SEQ ID NO: 4928393 - DNA, 21 bp, Homo sapiens
ccagagtggcctggccaggag

SEQ ID NO: 4928394 - DNA, 23 bp, Homo sapiens
ccagagtggcctggccaggagct

SEQ ID NO: 4928395 - DNA, 13 bp, Homo sapiens
ccagatctggtcc

SEQ ID NO: 4928396 - DNA, 17 bp, Homo sapiens
ccagatgcaccagccct

SEQ ID NO: 4928397 - DNA, 21 bp, Homo sapiens
ccagatgcgtcccaagatgtt

SEQ ID NO: 4928398 - DNA, 23 bp, Homo sapiens
ccagatggcccggatgctgcttc

SEQ ID NO: 4928399 - DNA, 17 bp, Homo sapiens
ccagatgtttccagact

SEQ ID NO: 4928400 - DNA, 22 bp, Homo sapiens
ccagatttttcggaggccccac

SEQ ID NO: 4928401 - DNA, 16 bp, Homo sapiens
ccagcaacacagcctg

SEQ ID NO: 4928402 - DNA, 20 bp, Homo sapiens
ccagcaacacagcctgggcc

SEQ ID NO: 4928403 - DNA, 19 bp, Homo sapiens
ccagcaagaataaaaaaga

SEQ ID NO: 4928404 - DNA, 17 bp, Homo sapiens
ccagcaagagaaccccg

SEQ ID NO: 4928405 - DNA, 15 bp, Homo sapiens
ccagcaagtgagagc

SEQ ID NO: 4928406 - DNA, 19 bp, Homo sapiens
ccagcaagtgagagctggg

SEQ ID NO: 4928407 - DNA, 20 bp, Homo sapiens
ccagcaagtgagagctgggt

SEQ ID NO: 4928408 - DNA, 21 bp, Homo sapiens
ccagcaagtgagagctgggtg

SEQ ID NO: 4928409 - DNA, 22 bp, Homo sapiens
ccagcaagtgagagctgggtgt

SEQ ID NO: 4928410 - DNA, 11 bp, Homo sapiens
ccagcactttg

SEQ ID NO: 4928411 - DNA, 14 bp, Homo sapiens
ccagcagcagcagg

SEQ ID NO: 4928412 - DNA, 22 bp, Homo sapiens
ccagcagttgaatgacaacaga

SEQ ID NO: 4928413 - DNA, 14 bp, Homo sapiens
ccagcatcacctgc

SEQ ID NO: 4928414 - DNA, 17 bp, Homo sapiens
ccagcatcacctgcctg

SEQ ID NO: 4928415 - DNA, 14 bp, Homo sapiens
ccagcatcactccc

SEQ ID NO: 4928416 - DNA, 21 bp, Homo sapiens
ccagcatgacataacagtgca

SEQ ID NO: 4928417 - DNA, 17 bp, Homo sapiens
ccagccaaaccctgtct

SEQ ID NO: 4928418 - DNA, 18 bp, Homo sapiens
ccagccaaaccctgtctg

SEQ ID NO: 4928419 - DNA, 19 bp, Homo sapiens
ccagccacacttgaaccta

SEQ ID NO: 4928420 - DNA, 21 bp, Homo sapiens
ccagccaccccgggctctctg

SEQ ID NO: 4928421 - DNA, 13 bp, Homo sapiens
ccagccagatcct

SEQ ID NO: 4928422 - DNA, 18 bp, Homo sapiens
ccagccagatcctcttgg

SEQ ID NO: 4928423 - DNA, 16 bp, Homo sapiens
ccagccatcaaaatgc

SEQ ID NO: 4928424 - DNA, 18 bp, Homo sapiens
ccagccatcaaaatgctt

SEQ ID NO: 4928425 - DNA, 12 bp, Homo sapiens
ccagcccaaagg

SEQ ID NO: 4928426 - DNA, 12 bp, Homo sapiens
ccagcccacatt

SEQ ID NO: 4928427 - DNA, 16 bp, Homo sapiens
ccagcccacttctgcc

SEQ ID NO: 4928428 - DNA, 17 bp, Homo sapiens
ccagcccacttctgcca

SEQ ID NO: 4928429 - DNA, 15 bp, Homo sapiens
ccagccccacacagc

SEQ ID NO: 4928430 - DNA, 18 bp, Homo sapiens
ccagccccacccaggagg

SEQ ID NO: 4928431 - DNA, 18 bp, Homo sapiens
ccagccccactgccagca

SEQ ID NO: 4928432 - DNA, 19 bp, Homo sapiens
ccagccccactgccagcag

SEQ ID NO: 4928433 - DNA, 20 bp, Homo sapiens
ccagccccactgccagcagc

SEQ ID NO: 4928434 - DNA, 21 bp, Homo sapiens
ccagccccactgccagcagca

SEQ ID NO: 4928435 - DNA, 23 bp, Homo sapiens
ccagccccactgccagcagcagc

SEQ ID NO: 4928436 - DNA, 13 bp, Homo sapiens
ccagccccagtgc

SEQ ID NO: 4928437 - DNA, 17 bp, Homo sapiens
ccagccccagtgcccac

SEQ ID NO: 4928438 - DNA, 15 bp, Homo sapiens
ccagcccctagaaac

SEQ ID NO: 4928439 - DNA, 13 bp, Homo sapiens
ccagcccctagcc

SEQ ID NO: 4928440 - DNA, 17 bp, Homo sapiens
ccagcccctagcccagg

SEQ ID NO: 4928441 - DNA, 18 bp, Homo sapiens
ccagcccctagcccagga

SEQ ID NO: 4928442 - DNA, 22 bp, Homo sapiens
ccagcccctagcccaggagaga

SEQ ID NO: 4928443 - DNA, 18 bp, Homo sapiens
ccagcccctcccccatct

SEQ ID NO: 4928444 - DNA, 21 bp, Homo sapiens
ccagcccctcccccatctccc

SEQ ID NO: 4928445 - DNA, 17 bp, Homo sapiens
ccagcccgggagcctag

SEQ ID NO: 4928446 - DNA, 20 bp, Homo sapiens
ccagcccgggagcctaggac

SEQ ID NO: 4928447 - DNA, 21 bp, Homo sapiens
ccagcccgggagcctaggacc

SEQ ID NO: 4928448 - DNA, 21 bp, Homo sapiens
ccagccctccccatggagcca

SEQ ID NO: 4928449 - DNA, 17 bp, Homo sapiens
ccagccctggctctgca

SEQ ID NO: 4928450 - DNA, 21 bp, Homo sapiens
ccagcccttttgttgagccag

SEQ ID NO: 4928451 - DNA, 16 bp, Homo sapiens
ccagccggccaatgga

SEQ ID NO: 4928452 - DNA, 19 bp, Homo sapiens
ccagccggccaatggaaac

SEQ ID NO: 4928453 - DNA, 14 bp, Homo sapiens
ccagcctcaccctt

SEQ ID NO: 4928454 - DNA, 17 bp, Homo sapiens
ccagcctcacccttgcg

SEQ ID NO: 4928455 - DNA, 11 bp, Homo sapiens
ccagcctcagt

SEQ ID NO: 4928456 - DNA, 19 bp, Homo sapiens
ccagcctcagtcctcccct

SEQ ID NO: 4928457 - DNA, 15 bp, Homo sapiens
ccagcctctggcatt

SEQ ID NO: 4928458 - DNA, 13 bp, Homo sapiens
ccagcctgaggca

SEQ ID NO: 4928459 - DNA, 23 bp, Homo sapiens
ccagcctgcccaagcccaggcca

SEQ ID NO: 4928460 - DNA, 16 bp, Homo sapiens
ccagcctgggcagcca

SEQ ID NO: 4928461 - DNA, 18 bp, Homo sapiens
ccagcctgggcagccagg

SEQ ID NO: 4928462 - DNA, 23 bp, Homo sapiens
ccagcctgtcccatggacactcc

SEQ ID NO: 4928463 - DNA, 15 bp, Homo sapiens
ccagcgagccctggt

SEQ ID NO: 4928464 - DNA, 14 bp, Homo sapiens
ccagcgctctgcct

SEQ ID NO: 4928465 - DNA, 15 bp, Homo sapiens
ccagctaccctgtgt

SEQ ID NO: 4928466 - DNA, 17 bp, Homo sapiens
ccagctcaatggactgg

SEQ ID NO: 4928467 - DNA, 15 bp, Homo sapiens
ccagctcaccagccc

SEQ ID NO: 4928468 - DNA, 16 bp, Homo sapiens
ccagctcagaacccag

SEQ ID NO: 4928469 - DNA, 17 bp, Homo sapiens
ccagctcagaacccagg

SEQ ID NO: 4928470 - DNA, 18 bp, Homo sapiens
ccagctcagaacccaggg

SEQ ID NO: 4928471 - DNA, 16 bp, Homo sapiens
ccagctgcaccagagc

SEQ ID NO: 4928472 - DNA, 16 bp, Homo sapiens
ccagctgcaggaatca

SEQ ID NO: 4928473 - DNA, 20 bp, Homo sapiens
ccagctgcaggaatcaaaaa

SEQ ID NO: 4928474 - DNA, 15 bp, Homo sapiens
ccagctgctgctctg

SEQ ID NO: 4928475 - DNA, 16 bp, Homo sapiens
ccagctgctgctctga

SEQ ID NO: 4928476 - DNA, 13 bp, Homo sapiens
ccagctgctgtct

SEQ ID NO: 4928477 - DNA, 13 bp, Homo sapiens
ccagctggcctgg

SEQ ID NO: 4928478 - DNA, 16 bp, Homo sapiens
ccagctggcctggaca

SEQ ID NO: 4928479 - DNA, 19 bp, Homo sapiens
ccagctgggctctgcaatt

SEQ ID NO: 4928480 - DNA, 21 bp, Homo sapiens
ccagctgtgctctggacaggc

SEQ ID NO: 4928481 - DNA, 14 bp, Homo sapiens
ccagcttggggcca

SEQ ID NO: 4928482 - DNA, 19 bp, Homo sapiens
ccagcttggggccaccaaa

SEQ ID NO: 4928483 - DNA, 21 bp, Homo sapiens
ccagcttttaaccatctgata

SEQ ID NO: 4928484 - DNA, 13 bp, Homo sapiens
ccaggaacaagct

SEQ ID NO: 4928485 - DNA, 17 bp, Homo sapiens
ccaggacaccacaccca

SEQ ID NO: 4928486 - DNA, 20 bp, Homo sapiens
ccaggacaccacacccagcc

SEQ ID NO: 4928487 - DNA, 14 bp, Homo sapiens
ccaggactgagccc

SEQ ID NO: 4928488 - DNA, 12 bp, Homo sapiens
ccaggagagaga

SEQ ID NO: 4928489 - DNA, 14 bp, Homo sapiens
ccaggagagagaaa

SEQ ID NO: 4928490 - DNA, 16 bp, Homo sapiens
ccaggagagagaaagc

SEQ ID NO: 4928491 - DNA, 16 bp, Homo sapiens
ccaggagccccgaggc

SEQ ID NO: 4928492 - DNA, 16 bp, Homo sapiens
ccaggagcctgtgcct

SEQ ID NO: 4928493 - DNA, 21 bp, Homo sapiens
ccaggagctcttcaggcctcc

SEQ ID NO: 4928494 - DNA, 18 bp, Homo sapiens
ccaggagggcatccatac

SEQ ID NO: 4928495 - DNA, 20 bp, Homo sapiens
ccaggagggcatccatacca

SEQ ID NO: 4928496 - DNA, 22 bp, Homo sapiens
ccaggaggtgggagtgaggagc

SEQ ID NO: 4928497 - DNA, 17 bp, Homo sapiens
ccaggagtttgagacca

SEQ ID NO: 4928498 - DNA, 15 bp, Homo sapiens
ccaggatcatggtgt

SEQ ID NO: 4928499 - DNA, 17 bp, Homo sapiens
ccaggatcatggtgtaa

SEQ ID NO: 4928500 - DNA, 11 bp, Homo sapiens
ccaggcacagg

SEQ ID NO: 4928501 - DNA, 15 bp, Homo sapiens
ccaggcaccatctcc

SEQ ID NO: 4928502 - DNA, 17 bp, Homo sapiens
ccaggcagatctgtgcc

SEQ ID NO: 4928503 - DNA, 21 bp, Homo sapiens
ccaggcagatctgtgccccat

SEQ ID NO: 4928504 - DNA, 18 bp, Homo sapiens
ccaggcaggtagccaggg

SEQ ID NO: 4928505 - DNA, 19 bp, Homo sapiens
ccaggcaggtagccagggg

SEQ ID NO: 4928506 - DNA, 14 bp, Homo sapiens
ccaggcaggtcttg

SEQ ID NO: 4928507 - DNA, 23 bp, Homo sapiens
ccaggcaggtcttgaactcctgg

SEQ ID NO: 4928508 - DNA, 19 bp, Homo sapiens
ccaggcaggtgcctggaca

SEQ ID NO: 4928509 - DNA, 21 bp, Homo sapiens
ccaggccagagggagtgacag

SEQ ID NO: 4928510 - DNA, 16 bp, Homo sapiens
ccaggcccctgccacc

SEQ ID NO: 4928511 - DNA, 19 bp, Homo sapiens
ccaggccgcgccctttccc

SEQ ID NO: 4928512 - DNA, 14 bp, Homo sapiens
ccaggccggccagc

SEQ ID NO: 4928513 - DNA, 15 bp, Homo sapiens
ccaggccggccagcc

SEQ ID NO: 4928514 - DNA, 18 bp, Homo sapiens
ccaggccggccagcctca

SEQ ID NO: 4928515 - DNA, 21 bp, Homo sapiens
ccaggccggggtggagcatgg

SEQ ID NO: 4928516 - DNA, 18 bp, Homo sapiens
ccaggcctctgtgtcctt

SEQ ID NO: 4928517 - DNA, 13 bp, Homo sapiens
ccaggcctgcagc

SEQ ID NO: 4928518 - DNA, 14 bp, Homo sapiens
ccaggcctgcagca

SEQ ID NO: 4928519 - DNA, 20 bp, Homo sapiens
ccaggctagtccggacccac

SEQ ID NO: 4928520 - DNA, 13 bp, Homo sapiens
ccaggctccgccc

SEQ ID NO: 4928521 - DNA, 13 bp, Homo sapiens
ccaggctggacat

SEQ ID NO: 4928522 - DNA, 18 bp, Homo sapiens
ccaggctggacatgctga

SEQ ID NO: 4928523 - DNA, 17 bp, Homo sapiens
ccaggctggtctaaaac

SEQ ID NO: 4928524 - DNA, 19 bp, Homo sapiens
ccaggctggtctcaaactc

SEQ ID NO: 4928525 - DNA, 18 bp, Homo sapiens
ccagggaagctggccgag

SEQ ID NO: 4928526 - DNA, 15 bp, Homo sapiens
ccagggagattttga

SEQ ID NO: 4928527 - DNA, 13 bp, Homo sapiens
ccagggagccttt

SEQ ID NO: 4928528 - DNA, 18 bp, Homo sapiens
ccagggagcctttggttc

SEQ ID NO: 4928529 - DNA, 14 bp, Homo sapiens
ccagggcagtgcta

SEQ ID NO: 4928530 - DNA, 15 bp, Homo sapiens
ccagggctgccctga

SEQ ID NO: 4928531 - DNA, 19 bp, Homo sapiens
ccagggctgccctgagaag

SEQ ID NO: 4928532 - DNA, 21 bp, Homo sapiens
ccagggctgccctgagaagct

SEQ ID NO: 4928533 - DNA, 15 bp, Homo sapiens
ccaggggaacctgcc

SEQ ID NO: 4928534 - DNA, 16 bp, Homo sapiens
ccaggggaacctgcca

SEQ ID NO: 4928535 - DNA, 19 bp, Homo sapiens
ccagggggactagcccctg

SEQ ID NO: 4928536 - DNA, 16 bp, Homo sapiens
ccagggtctgtgtgaa

SEQ ID NO: 4928537 - DNA, 14 bp, Homo sapiens
ccagggtcttccct

SEQ ID NO: 4928538 - DNA, 15 bp, Homo sapiens
ccagggtgcccagaa

SEQ ID NO: 4928539 - DNA, 22 bp, Homo sapiens
ccagggtgcccagaacttccct

SEQ ID NO: 4928540 - DNA, 21 bp, Homo sapiens
ccagggtggacttagaaagca

SEQ ID NO: 4928541 - DNA, 17 bp, Homo sapiens
ccaggtatggctctgca

SEQ ID NO: 4928542 - DNA, 14 bp, Homo sapiens
ccaggttcagcttg

SEQ ID NO: 4928543 - DNA, 15 bp, Homo sapiens
ccaggttcagcttgt

SEQ ID NO: 4928544 - DNA, 18 bp, Homo sapiens
ccagtatctatatatgtg

SEQ ID NO: 4928545 - DNA, 22 bp, Homo sapiens
ccagtcccaatggtcctgactt

SEQ ID NO: 4928546 - DNA, 18 bp, Homo sapiens
ccagtccccctgccccag

SEQ ID NO: 4928547 - DNA, 22 bp, Homo sapiens
ccagtcctctcccaagtccaca

SEQ ID NO: 4928548 - DNA, 14 bp, Homo sapiens
ccagtcctgcctgg

SEQ ID NO: 4928549 - DNA, 15 bp, Homo sapiens
ccagtcctgcctggc

SEQ ID NO: 4928550 - DNA, 19 bp, Homo sapiens
ccagtcctgcctggccagg

SEQ ID NO: 4928551 - DNA, 21 bp, Homo sapiens
ccagtcctgcctggccaggca

SEQ ID NO: 4928552 - DNA, 22 bp, Homo sapiens
ccagtcctgcctggccaggcag

SEQ ID NO: 4928553 - DNA, 18 bp, Homo sapiens
ccagtcgttagaatatag

SEQ ID NO: 4928554 - DNA, 19 bp, Homo sapiens
ccagtctggaatgcagtgg

SEQ ID NO: 4928555 - DNA, 21 bp, Homo sapiens
ccagtctttaaaggcccagcc

SEQ ID NO: 4928556 - DNA, 16 bp, Homo sapiens
ccagtgaattcttgaa

SEQ ID NO: 4928557 - DNA, 20 bp, Homo sapiens
ccagtgaattcttgaaggaa

SEQ ID NO: 4928558 - DNA, 23 bp, Homo sapiens
ccagtgaattcttgaaggaaaat

SEQ ID NO: 4928559 - DNA, 17 bp, Homo sapiens
ccagtgacccctgacct

SEQ ID NO: 4928560 - DNA, 21 bp, Homo sapiens
ccagtgagatgagggatgggc

SEQ ID NO: 4928561 - DNA, 18 bp, Homo sapiens
ccagtgagggacgtcaga

SEQ ID NO: 4928562 - DNA, 22 bp, Homo sapiens
ccagtgagggacgtcagacttg

SEQ ID NO: 4928563 - DNA, 19 bp, Homo sapiens
ccagtgcccaaagtctgtg

SEQ ID NO: 4928564 - DNA, 22 bp, Homo sapiens
ccagtgcccaaagtctgtgtga

SEQ ID NO: 4928565 - DNA, 23 bp, Homo sapiens
ccagtgcccacaggatcagtctg

SEQ ID NO: 4928566 - DNA, 20 bp, Homo sapiens
ccagtgctccaggcacccag

SEQ ID NO: 4928567 - DNA, 22 bp, Homo sapiens
ccagtgctgtccatgcttctca

SEQ ID NO: 4928568 - DNA, 19 bp, Homo sapiens
ccagtggatgccacagccc

SEQ ID NO: 4928569 - DNA, 21 bp, Homo sapiens
ccagtggccactcagcttcct

SEQ ID NO: 4928570 - DNA, 14 bp, Homo sapiens
ccagtggggcctgt

SEQ ID NO: 4928571 - DNA, 16 bp, Homo sapiens
ccagtggggcctgtgg

SEQ ID NO: 4928572 - DNA, 17 bp, Homo sapiens
ccagtggggcctgtgga

SEQ ID NO: 4928573 - DNA, 19 bp, Homo sapiens
ccagtggtttccagtcatg

SEQ ID NO: 4928574 - DNA, 14 bp, Homo sapiens
ccagtgtgacaagg

SEQ ID NO: 4928575 - DNA, 12 bp, Homo sapiens
ccagtgtggaac

SEQ ID NO: 4928576 - DNA, 21 bp, Homo sapiens
ccagttagactagtccccggt

SEQ ID NO: 4928577 - DNA, 18 bp, Homo sapiens
ccagttcaggagtcccaa

SEQ ID NO: 4928578 - DNA, 20 bp, Homo sapiens
ccagttgggtggatgcctgg

SEQ ID NO: 4928579 - DNA, 23 bp, Homo sapiens
ccagtttagatttcaagaaaaaa

SEQ ID NO: 4928580 - DNA, 21 bp, Homo sapiens
ccataatctggactcctctgt

SEQ ID NO: 4928581 - DNA, 23 bp, Homo sapiens
ccataatgctaatttaaagagac

SEQ ID NO: 4928582 - DNA, 21 bp, Homo sapiens
ccataatgctactgtctcact

SEQ ID NO: 4928583 - DNA, 14 bp, Homo sapiens
ccatactcagcctg

SEQ ID NO: 4928584 - DNA, 14 bp, Homo sapiens
ccatactcatttct

SEQ ID NO: 4928585 - DNA, 15 bp, Homo sapiens
ccatactcatttcta

SEQ ID NO: 4928586 - DNA, 19 bp, Homo sapiens
ccatactttgtctgaaaaa

SEQ ID NO: 4928587 - DNA, 13 bp, Homo sapiens
ccatagaaacatg

SEQ ID NO: 4928588 - DNA, 16 bp, Homo sapiens
ccatagaaacatgaca

SEQ ID NO: 4928589 - DNA, 21 bp, Homo sapiens
ccatagaaacatgacactgac

SEQ ID NO: 4928590 - DNA, 16 bp, Homo sapiens
ccatagatcttctgaa

SEQ ID NO: 4928591 - DNA, 17 bp, Homo sapiens
ccatagatcttctgaaa

SEQ ID NO: 4928592 - DNA, 19 bp, Homo sapiens
ccatataagtttgaaggaa

SEQ ID NO: 4928593 - DNA, 22 bp, Homo sapiens
ccatatcttgcgaatccaagct

SEQ ID NO: 4928594 - DNA, 15 bp, Homo sapiens
ccatattctgttggc

SEQ ID NO: 4928595 - DNA, 19 bp, Homo sapiens
ccatattctgttggccagt

SEQ ID NO: 4928596 - DNA, 18 bp, Homo sapiens
ccatatttactaccttat

SEQ ID NO: 4928597 - DNA, 23 bp, Homo sapiens
ccatattttcacaggtgtggtgt

SEQ ID NO: 4928598 - DNA, 20 bp, Homo sapiens
ccatcacagggttgggccca

SEQ ID NO: 4928599 - DNA, 13 bp, Homo sapiens
ccatcaccctctt

SEQ ID NO: 4928600 - DNA, 20 bp, Homo sapiens
ccatcaccctcttcctgtga

SEQ ID NO: 4928601 - DNA, 16 bp, Homo sapiens
ccatcatgtctggcta

SEQ ID NO: 4928602 - DNA, 19 bp, Homo sapiens
ccatcattacccttccctg

SEQ ID NO: 4928603 - DNA, 21 bp, Homo sapiens
ccatccataaatccagttcta

SEQ ID NO: 4928604 - DNA, 18 bp, Homo sapiens
ccatcccaaccagtgcca

SEQ ID NO: 4928605 - DNA, 21 bp, Homo sapiens
ccatcccaaccagtgccaagg

SEQ ID NO: 4928606 - DNA, 23 bp, Homo sapiens
ccatcccaaccagtgccaaggac

SEQ ID NO: 4928607 - DNA, 15 bp, Homo sapiens
ccatcccctggactg

SEQ ID NO: 4928608 - DNA, 22 bp, Homo sapiens
ccatccctcgtggtccccaaca

SEQ ID NO: 4928609 - DNA, 17 bp, Homo sapiens
ccatccctgcctggtca

SEQ ID NO: 4928610 - DNA, 20 bp, Homo sapiens
ccatccggtttgccatgttg

SEQ ID NO: 4928611 - DNA, 17 bp, Homo sapiens
ccatctcccaccctgta

SEQ ID NO: 4928612 - DNA, 20 bp, Homo sapiens
ccatctcctataatctgtca

SEQ ID NO: 4928613 - DNA, 23 bp, Homo sapiens
ccatctcctataatctgtcaaaa

SEQ ID NO: 4928614 - DNA, 13 bp, Homo sapiens
ccatctcggagca

SEQ ID NO: 4928615 - DNA, 20 bp, Homo sapiens
ccatctcggagcatcccgga

SEQ ID NO: 4928616 - DNA, 23 bp, Homo sapiens
ccatctcggagcatcccggagga

SEQ ID NO: 4928617 - DNA, 17 bp, Homo sapiens
ccatctctccctcccct

SEQ ID NO: 4928618 - DNA, 18 bp, Homo sapiens
ccatctctgattttcaaa

SEQ ID NO: 4928619 - DNA, 16 bp, Homo sapiens
ccatctgatatctata

SEQ ID NO: 4928620 - DNA, 16 bp, Homo sapiens
ccatctggcctggcct

SEQ ID NO: 4928621 - DNA, 22 bp, Homo sapiens
ccatctggcctggcctggccct

SEQ ID NO: 4928622 - DNA, 15 bp, Homo sapiens
ccatctgtgtcctgg

SEQ ID NO: 4928623 - DNA, 15 bp, Homo sapiens
ccatcttacttgagc

SEQ ID NO: 4928624 - DNA, 17 bp, Homo sapiens
ccatctttactcccaag

SEQ ID NO: 4928625 - DNA, 20 bp, Homo sapiens
ccatctttactcccaagact

SEQ ID NO: 4928626 - DNA, 21 bp, Homo sapiens
ccatgaaaaaaatgatcccca

SEQ ID NO: 4928627 - DNA, 22 bp, Homo sapiens
ccatgaacagaaaacattctga

SEQ ID NO: 4928628 - DNA, 14 bp, Homo sapiens
ccatgaagaattcc

SEQ ID NO: 4928629 - DNA, 13 bp, Homo sapiens
ccatgaagacagg

SEQ ID NO: 4928630 - DNA, 14 bp, Homo sapiens
ccatgaagcctttt

SEQ ID NO: 4928631 - DNA, 23 bp, Homo sapiens
ccatgagaccctggtgcctggct

SEQ ID NO: 4928632 - DNA, 23 bp, Homo sapiens
ccatgagcctcagcatcctggca

SEQ ID NO: 4928633 - DNA, 17 bp, Homo sapiens
ccatgaggaaggaacag

SEQ ID NO: 4928634 - DNA, 17 bp, Homo sapiens
ccatgagtttgccctgg

SEQ ID NO: 4928635 - DNA, 17 bp, Homo sapiens
ccatgcaattcatccca

SEQ ID NO: 4928636 - DNA, 12 bp, Homo sapiens
ccatgcaggggg

SEQ ID NO: 4928637 - DNA, 19 bp, Homo sapiens
ccatgcagggggctcctgg

SEQ ID NO: 4928638 - DNA, 17 bp, Homo sapiens
ccatgcctgtccagcct

SEQ ID NO: 4928639 - DNA, 18 bp, Homo sapiens
ccatgcctgtccagcctg

SEQ ID NO: 4928640 - DNA, 19 bp, Homo sapiens
ccatgcctgtccagcctgg

SEQ ID NO: 4928641 - DNA, 16 bp, Homo sapiens
ccatgctgggaagacg

SEQ ID NO: 4928642 - DNA, 15 bp, Homo sapiens
ccatggacactccag

SEQ ID NO: 4928643 - DNA, 14 bp, Homo sapiens
ccatggccctgtgc

SEQ ID NO: 4928644 - DNA, 17 bp, Homo sapiens
ccatgggcctcctgtgt

SEQ ID NO: 4928645 - DNA, 13 bp, Homo sapiens
ccatgggctctga

SEQ ID NO: 4928646 - DNA, 16 bp, Homo sapiens
ccatgggcttcactgt

SEQ ID NO: 4928647 - DNA, 19 bp, Homo sapiens
ccatgtacctcccctgcct

SEQ ID NO: 4928648 - DNA, 22 bp, Homo sapiens
ccatgtagccccctggcctctg

SEQ ID NO: 4928649 - DNA, 16 bp, Homo sapiens
ccatgtatttatctct

SEQ ID NO: 4928650 - DNA, 23 bp, Homo sapiens
ccatgtatttatctctatttaat

SEQ ID NO: 4928651 - DNA, 17 bp, Homo sapiens
ccatgtccaaagaggct

SEQ ID NO: 4928652 - DNA, 23 bp, Homo sapiens
ccatgtccaaagaggctgcccct

SEQ ID NO: 4928653 - DNA, 17 bp, Homo sapiens
ccatgtcctatgtgtga

SEQ ID NO: 4928654 - DNA, 19 bp, Homo sapiens
ccatgtcctatgtgtgact

SEQ ID NO: 4928655 - DNA, 15 bp, Homo sapiens
ccatgtcctcagcat

SEQ ID NO: 4928656 - DNA, 15 bp, Homo sapiens
ccatgtcgcctctgc

SEQ ID NO: 4928657 - DNA, 16 bp, Homo sapiens
ccatgtgcctctttgt

SEQ ID NO: 4928658 - DNA, 17 bp, Homo sapiens
ccatgtggtggcacagg

SEQ ID NO: 4928659 - DNA, 18 bp, Homo sapiens
ccatgtggtggcacaggc

SEQ ID NO: 4928660 - DNA, 14 bp, Homo sapiens
ccatgtgtcctggt

SEQ ID NO: 4928661 - DNA, 18 bp, Homo sapiens
ccatgttctgcccccagc

SEQ ID NO: 4928662 - DNA, 19 bp, Homo sapiens
ccatgttctgcccccagcc

SEQ ID NO: 4928663 - DNA, 22 bp, Homo sapiens
ccatgttctgcccccagcccaa

SEQ ID NO: 4928664 - DNA, 14 bp, Homo sapiens
ccatgttggccagg

SEQ ID NO: 4928665 - DNA, 17 bp, Homo sapiens
ccatgttggccaggctg

SEQ ID NO: 4928666 - DNA, 18 bp, Homo sapiens
ccatgttgtaatgctgca

SEQ ID NO: 4928667 - DNA, 22 bp, Homo sapiens
ccatgttgtaatgctgcacttc

SEQ ID NO: 4928668 - DNA, 14 bp, Homo sapiens
ccattaaagtctga

SEQ ID NO: 4928669 - DNA, 16 bp, Homo sapiens
ccattaaatgaatatt

SEQ ID NO: 4928670 - DNA, 19 bp, Homo sapiens
ccattaaatgaatattttg

SEQ ID NO: 4928671 - DNA, 21 bp, Homo sapiens
ccattatccctgaatccccct

SEQ ID NO: 4928672 - DNA, 20 bp, Homo sapiens
ccattcacaataaaagctta

SEQ ID NO: 4928673 - DNA, 16 bp, Homo sapiens
ccattccaaagcttta

SEQ ID NO: 4928674 - DNA, 21 bp, Homo sapiens
ccattcccaagaaatgctttg

SEQ ID NO: 4928675 - DNA, 16 bp, Homo sapiens
ccattctcatctgcac

SEQ ID NO: 4928676 - DNA, 22 bp, Homo sapiens
ccattctgccgccccctcctga

SEQ ID NO: 4928677 - DNA, 15 bp, Homo sapiens
ccattctgcctgccc

SEQ ID NO: 4928678 - DNA, 19 bp, Homo sapiens
ccattctgcctgcccaggc

SEQ ID NO: 4928679 - DNA, 14 bp, Homo sapiens
ccattcttcctagt

SEQ ID NO: 4928680 - DNA, 20 bp, Homo sapiens
ccattcttcctagttttctc

SEQ ID NO: 4928681 - DNA, 21 bp, Homo sapiens
ccattgccaccaggagaacca

SEQ ID NO: 4928682 - DNA, 17 bp, Homo sapiens
ccattgcctagctcttt

SEQ ID NO: 4928683 - DNA, 16 bp, Homo sapiens
ccatttgtaattaaat

SEQ ID NO: 4928684 - DNA, 20 bp, Homo sapiens
ccatttgtaattaaattatg

SEQ ID NO: 4928685 - DNA, 14 bp, Homo sapiens
ccatttgtgccaga

SEQ ID NO: 4928686 - DNA, 15 bp, Homo sapiens
ccatttgtgccagag

SEQ ID NO: 4928687 - DNA, 22 bp, Homo sapiens
ccattttcctacaggcagtctc

SEQ ID NO: 4928688 - DNA, 23 bp, Homo sapiens
ccattttcctacaggcagtctct

SEQ ID NO: 4928689 - DNA, 12 bp, Homo sapiens
ccattttgtgaa

SEQ ID NO: 4928690 - DNA, 17 bp, Homo sapiens
ccattttttaaggaaac

SEQ ID NO: 4928691 - DNA, 19 bp, Homo sapiens
ccattttttaaggaaacaa

SEQ ID NO: 4928692 - DNA, 17 bp, Homo sapiens
cccaaaacaaagtcttt

SEQ ID NO: 4928693 - DNA, 14 bp, Homo sapiens
cccaaaagattgct

SEQ ID NO: 4928694 - DNA, 17 bp, Homo sapiens
cccaaacaaatatgcaa

SEQ ID NO: 4928695 - DNA, 16 bp, Homo sapiens
cccaaacaccttccag

SEQ ID NO: 4928696 - DNA, 21 bp, Homo sapiens
cccaaacaccttccagctcct

SEQ ID NO: 4928697 - DNA, 22 bp, Homo sapiens
cccaaacaccttccagctcctg

SEQ ID NO: 4928698 - DNA, 13 bp, Homo sapiens
cccaaaccctagg

SEQ ID NO: 4928699 - DNA, 21 bp, Homo sapiens
cccaaagagcacaaacatttt

SEQ ID NO: 4928700 - DNA, 13 bp, Homo sapiens
cccaaagtgctgg

SEQ ID NO: 4928701 - DNA, 15 bp, Homo sapiens
cccaacaacatccat

SEQ ID NO: 4928702 - DNA, 23 bp, Homo sapiens
cccaacagcgacatagcccatcc

SEQ ID NO: 4928703 - DNA, 18 bp, Homo sapiens
cccaaccccaagccagcc

SEQ ID NO: 4928704 - DNA, 14 bp, Homo sapiens
cccaacccccaccc

SEQ ID NO: 4928705 - DNA, 14 bp, Homo sapiens
cccaacctgctctc

SEQ ID NO: 4928706 - DNA, 14 bp, Homo sapiens
cccaactctgagcc

SEQ ID NO: 4928707 - DNA, 19 bp, Homo sapiens
cccaactctgagcccatgt

SEQ ID NO: 4928708 - DNA, 19 bp, Homo sapiens
cccaagacagatgccccag

SEQ ID NO: 4928709 - DNA, 21 bp, Homo sapiens
cccaagagaaggggaagcact

SEQ ID NO: 4928710 - DNA, 13 bp, Homo sapiens
cccaagctcctcc

SEQ ID NO: 4928711 - DNA, 14 bp, Homo sapiens
cccaagctcctcct

SEQ ID NO: 4928712 - DNA, 15 bp, Homo sapiens
cccaagctctgctcc

SEQ ID NO: 4928713 - DNA, 19 bp, Homo sapiens
cccaagctgttttcttcta

SEQ ID NO: 4928714 - DNA, 15 bp, Homo sapiens
cccaaggactgaggg

SEQ ID NO: 4928715 - DNA, 18 bp, Homo sapiens
cccaaggagcacaggtcc

SEQ ID NO: 4928716 - DNA, 15 bp, Homo sapiens
cccaaggcggcccct

SEQ ID NO: 4928717 - DNA, 23 bp, Homo sapiens
cccaagtagctgggattacaggt

SEQ ID NO: 4928718 - DNA, 15 bp, Homo sapiens
cccaagtgtgaacaa

SEQ ID NO: 4928719 - DNA, 17 bp, Homo sapiens
cccaatcagcactgaaa

SEQ ID NO: 4928720 - DNA, 22 bp, Homo sapiens
cccaatgagactctagggtcca

SEQ ID NO: 4928721 - DNA, 13 bp, Homo sapiens
cccacacctcagt

SEQ ID NO: 4928722 - DNA, 16 bp, Homo sapiens
cccacacctctgccag

SEQ ID NO: 4928723 - DNA, 14 bp, Homo sapiens
cccacactaacctg

SEQ ID NO: 4928724 - DNA, 22 bp, Homo sapiens
cccacagcacagctccctgcca

SEQ ID NO: 4928725 - DNA, 22 bp, Homo sapiens
cccacaggaggcaagcaagctc

SEQ ID NO: 4928726 - DNA, 16 bp, Homo sapiens
cccacaggcccttcct

SEQ ID NO: 4928727 - DNA, 18 bp, Homo sapiens
cccacaggcccttcctct

SEQ ID NO: 4928728 - DNA, 19 bp, Homo sapiens
cccacatagtgatggttcc

SEQ ID NO: 4928729 - DNA, 18 bp, Homo sapiens
cccaccatcatgtctggc

SEQ ID NO: 4928730 - DNA, 14 bp, Homo sapiens
cccacccacatgtg

SEQ ID NO: 4928731 - DNA, 12 bp, Homo sapiens
cccacccaggag

SEQ ID NO: 4928732 - DNA, 12 bp, Homo sapiens
cccaccccacac

SEQ ID NO: 4928733 - DNA, 16 bp, Homo sapiens
cccaccccacctgcag

SEQ ID NO: 4928734 - DNA, 19 bp, Homo sapiens
cccacccccttctctgctc

SEQ ID NO: 4928735 - DNA, 14 bp, Homo sapiens
cccaccctccctgg

SEQ ID NO: 4928736 - DNA, 18 bp, Homo sapiens
cccaccctccctggagtg

SEQ ID NO: 4928737 - DNA, 12 bp, Homo sapiens
cccaccctggga

SEQ ID NO: 4928738 - DNA, 17 bp, Homo sapiens
cccaccggtccagctgg

SEQ ID NO: 4928739 - DNA, 21 bp, Homo sapiens
cccaccggtccagctggcctg

SEQ ID NO: 4928740 - DNA, 21 bp, Homo sapiens
cccacctagaacactaactca

SEQ ID NO: 4928741 - DNA, 21 bp, Homo sapiens
cccacctcagcctcccaaagt

SEQ ID NO: 4928742 - DNA, 18 bp, Homo sapiens
cccacctccagcccggga

SEQ ID NO: 4928743 - DNA, 13 bp, Homo sapiens
cccacctccccac

SEQ ID NO: 4928744 - DNA, 13 bp, Homo sapiens
cccacctccctgc

SEQ ID NO: 4928745 - DNA, 16 bp, Homo sapiens
cccacctccctgccca

SEQ ID NO: 4928746 - DNA, 17 bp, Homo sapiens
cccacctccctgcccag

SEQ ID NO: 4928747 - DNA, 15 bp, Homo sapiens
cccacctctgtgacc

SEQ ID NO: 4928748 - DNA, 18 bp, Homo sapiens
cccacctctgtgacctca

SEQ ID NO: 4928749 - DNA, 21 bp, Homo sapiens
cccacctctgtgacctcaggc

SEQ ID NO: 4928750 - DNA, 23 bp, Homo sapiens
cccacctgcccatcacagggttg

SEQ ID NO: 4928751 - DNA, 13 bp, Homo sapiens
cccacctgggacc

SEQ ID NO: 4928752 - DNA, 15 bp, Homo sapiens
cccaccttggctcaa

SEQ ID NO: 4928753 - DNA, 14 bp, Homo sapiens
cccaccttggctgc

SEQ ID NO: 4928754 - DNA, 15 bp, Homo sapiens
cccaccttggctgca

SEQ ID NO: 4928755 - DNA, 16 bp, Homo sapiens
cccaccttggctgcag

SEQ ID NO: 4928756 - DNA, 17 bp, Homo sapiens
cccaccttggctgcagg

SEQ ID NO: 4928757 - DNA, 19 bp, Homo sapiens
cccaccttggctgcaggga

SEQ ID NO: 4928758 - DNA, 17 bp, Homo sapiens
cccacgagaccccggct

SEQ ID NO: 4928759 - DNA, 20 bp, Homo sapiens
cccacgattttctccagctc

SEQ ID NO: 4928760 - DNA, 19 bp, Homo sapiens
cccacggggcctcgggacc

SEQ ID NO: 4928761 - DNA, 17 bp, Homo sapiens
cccactctccccacact

SEQ ID NO: 4928762 - DNA, 22 bp, Homo sapiens
cccactgcttttggtctgtgtg

SEQ ID NO: 4928763 - DNA, 23 bp, Homo sapiens
cccactgcttttggtctgtgtga

SEQ ID NO: 4928764 - DNA, 21 bp, Homo sapiens
cccactgtttctcttgagctg

SEQ ID NO: 4928765 - DNA, 18 bp, Homo sapiens
cccacttctctctaagga

SEQ ID NO: 4928766 - DNA, 22 bp, Homo sapiens
cccacttgtcactgacacaaag

SEQ ID NO: 4928767 - DNA, 23 bp, Homo sapiens
cccacttgtcactgacacaaagg

SEQ ID NO: 4928768 - DNA, 20 bp, Homo sapiens
cccagaaaaaaaaaaactta

SEQ ID NO: 4928769 - DNA, 14 bp, Homo sapiens
cccagaaaggagac

SEQ ID NO: 4928770 - DNA, 15 bp, Homo sapiens
cccagaaaggagact

SEQ ID NO: 4928771 - DNA, 17 bp, Homo sapiens
cccagaaaggagactag

SEQ ID NO: 4928772 - DNA, 15 bp, Homo sapiens
cccagaatcccagcc

SEQ ID NO: 4928773 - DNA, 16 bp, Homo sapiens
cccagaatcccagccg

SEQ ID NO: 4928774 - DNA, 20 bp, Homo sapiens
cccagaatcccagccggcca

SEQ ID NO: 4928775 - DNA, 23 bp, Homo sapiens
cccagacagacatctctgcaccc

SEQ ID NO: 4928776 - DNA, 22 bp, Homo sapiens
cccagactactattttcttttt

SEQ ID NO: 4928777 - DNA, 17 bp, Homo sapiens
cccagagaacagcgaag

SEQ ID NO: 4928778 - DNA, 20 bp, Homo sapiens
cccagagaccaggctgtgtc

SEQ ID NO: 4928779 - DNA, 21 bp, Homo sapiens
cccagagactttgtagatcct

SEQ ID NO: 4928780 - DNA, 13 bp, Homo sapiens
cccagagatgtca

SEQ ID NO: 4928781 - DNA, 14 bp, Homo sapiens
cccagagcaggaag

SEQ ID NO: 4928782 - DNA, 16 bp, Homo sapiens
cccagagcaggaagca

SEQ ID NO: 4928783 - DNA, 13 bp, Homo sapiens
cccagaggaggca

SEQ ID NO: 4928784 - DNA, 12 bp, Homo sapiens
cccagaggctga

SEQ ID NO: 4928785 - DNA, 22 bp, Homo sapiens
cccagaggtaacagaacagctt

SEQ ID NO: 4928786 - DNA, 16 bp, Homo sapiens
cccagaggtccagccc

SEQ ID NO: 4928787 - DNA, 18 bp, Homo sapiens
cccagaggtccagcccat

SEQ ID NO: 4928788 - DNA, 19 bp, Homo sapiens
cccagatcagtcagagccc

SEQ ID NO: 4928789 - DNA, 20 bp, Homo sapiens
cccagatctggtcccttgca

SEQ ID NO: 4928790 - DNA, 23 bp, Homo sapiens
cccagatggctggaaggggtcca

SEQ ID NO: 4928791 - DNA, 19 bp, Homo sapiens
cccagcaagtgagagctgg

SEQ ID NO: 4928792 - DNA, 17 bp, Homo sapiens
cccagcacctcagcctg

SEQ ID NO: 4928793 - DNA, 17 bp, Homo sapiens
cccagcacctgcctcct

SEQ ID NO: 4928794 - DNA, 19 bp, Homo sapiens
cccagcatcactccccaag

SEQ ID NO: 4928795 - DNA, 23 bp, Homo sapiens
cccagcatgacataacagtgcag

SEQ ID NO: 4928796 - DNA, 17 bp, Homo sapiens
cccagccaaaccctgtc

SEQ ID NO: 4928797 - DNA, 13 bp, Homo sapiens
cccagcccaaagg

SEQ ID NO: 4928798 - DNA, 19 bp, Homo sapiens
cccagcccaaaggggacag

SEQ ID NO: 4928799 - DNA, 19 bp, Homo sapiens
cccagcccctagaaaccca

SEQ ID NO: 4928800 - DNA, 22 bp, Homo sapiens
cccagcccctagaaacccaagc

SEQ ID NO: 4928801 - DNA, 22 bp, Homo sapiens
cccagcccctagcccaggagag

SEQ ID NO: 4928802 - DNA, 16 bp, Homo sapiens
cccagcccctccccca

SEQ ID NO: 4928803 - DNA, 18 bp, Homo sapiens
cccagccctggctctgca

SEQ ID NO: 4928804 - DNA, 18 bp, Homo sapiens
cccagccggccaatggaa

SEQ ID NO: 4928805 - DNA, 15 bp, Homo sapiens
cccagcctatgagca

SEQ ID NO: 4928806 - DNA, 23 bp, Homo sapiens
cccagcctatgagcatcctgagc

SEQ ID NO: 4928807 - DNA, 18 bp, Homo sapiens
cccagcgagccctggtgg

SEQ ID NO: 4928808 - DNA, 16 bp, Homo sapiens
cccagcgctctgcctc

SEQ ID NO: 4928809 - DNA, 17 bp, Homo sapiens
cccagctcaggggcagc

SEQ ID NO: 4928810 - DNA, 18 bp, Homo sapiens
cccagctcaggggcagct

SEQ ID NO: 4928811 - DNA, 23 bp, Homo sapiens
cccagctgtgctctggacaggca

SEQ ID NO: 4928812 - DNA, 21 bp, Homo sapiens
cccaggacaccacacccagcc

SEQ ID NO: 4928813 - DNA, 15 bp, Homo sapiens
cccaggaccaagcca

SEQ ID NO: 4928814 - DNA, 13 bp, Homo sapiens
cccaggagagaga

SEQ ID NO: 4928815 - DNA, 15 bp, Homo sapiens
cccaggagagagaaa

SEQ ID NO: 4928816 - DNA, 16 bp, Homo sapiens
cccaggagagagaaag

SEQ ID NO: 4928817 - DNA, 14 bp, Homo sapiens
cccaggagggaggg

SEQ ID NO: 4928818 - DNA, 18 bp, Homo sapiens
cccaggagggagggggct

SEQ ID NO: 4928819 - DNA, 24 bp, Homo sapiens
cccaggagttcgaggctgcagtca

SEQ ID NO: 4928820 - DNA, 22 bp, Homo sapiens
cccaggcccctgccaccctggg

SEQ ID NO: 4928821 - DNA, 12 bp, Homo sapiens
cccaggccggcc

SEQ ID NO: 4928822 - DNA, 21 bp, Homo sapiens
cccaggccggccagcctcacc

SEQ ID NO: 4928823 - DNA, 18 bp, Homo sapiens
cccaggcgccccttcccc

SEQ ID NO: 4928824 - DNA, 22 bp, Homo sapiens
cccaggcgggagcggtggccct

SEQ ID NO: 4928825 - DNA, 23 bp, Homo sapiens
cccaggcgggagcggtggccctg

SEQ ID NO: 4928826 - DNA, 18 bp, Homo sapiens
cccaggctccgcccttag

SEQ ID NO: 4928827 - DNA, 23 bp, Homo sapiens
cccaggctccgcccttagtcccc

SEQ ID NO: 4928828 - DNA, 22 bp, Homo sapiens
cccaggctggacatgctgactg

SEQ ID NO: 4928829 - DNA, 19 bp, Homo sapiens
cccaggctggagtgcagtg

SEQ ID NO: 4928830 - DNA, 17 bp, Homo sapiens
cccaggctggcgtgcag

SEQ ID NO: 4928831 - DNA, 15 bp, Homo sapiens
cccagggctaccctc

SEQ ID NO: 4928832 - DNA, 21 bp, Homo sapiens
cccagggctaccctcccccag

SEQ ID NO: 4928833 - DNA, 16 bp, Homo sapiens
cccagggctctgcccc

SEQ ID NO: 4928834 - DNA, 19 bp, Homo sapiens
cccagggggcatgaccaga

SEQ ID NO: 4928835 - DNA, 18 bp, Homo sapiens
cccaggggtcccagccac

SEQ ID NO: 4928836 - DNA, 19 bp, Homo sapiens
cccaggggtcccagccacc

SEQ ID NO: 4928837 - DNA, 20 bp, Homo sapiens
cccaggggtcccagccaccc

SEQ ID NO: 4928838 - DNA, 15 bp, Homo sapiens
cccagtcctctccca

SEQ ID NO: 4928839 - DNA, 10 bp, Homo sapiens
cccagtctgg

SEQ ID NO: 4928840 - DNA, 20 bp, Homo sapiens
cccagtgcccacaggatcag

SEQ ID NO: 4928841 - DNA, 17 bp, Homo sapiens
cccagtggccactcagc

SEQ ID NO: 4928842 - DNA, 13 bp, Homo sapiens
cccatactcagcc

SEQ ID NO: 4928843 - DNA, 15 bp, Homo sapiens
cccatactcagcctg

SEQ ID NO: 4928844 - DNA, 21 bp, Homo sapiens
cccatcacagggttgggccca

SEQ ID NO: 4928845 - DNA, 21 bp, Homo sapiens
cccatcccctggactgggagg

SEQ ID NO: 4928846 - DNA, 18 bp, Homo sapiens
cccatccctgcctggtca

SEQ ID NO: 4928847 - DNA, 16 bp, Homo sapiens
cccatctaagctgcag

SEQ ID NO: 4928848 - DNA, 22 bp, Homo sapiens
cccatctgggtccttgcacccc

SEQ ID NO: 4928849 - DNA, 17 bp, Homo sapiens
cccatgaagccttttga

SEQ ID NO: 4928850 - DNA, 22 bp, Homo sapiens
cccatgactttatatggatgat

SEQ ID NO: 4928851 - DNA, 17 bp, Homo sapiens
cccatgccacgttccac

SEQ ID NO: 4928852 - DNA, 13 bp, Homo sapiens
cccatgcctgtcc

SEQ ID NO: 4928853 - DNA, 13 bp, Homo sapiens
cccatggagccag

SEQ ID NO: 4928854 - DNA, 19 bp, Homo sapiens
cccatggagccagctccct

SEQ ID NO: 4928855 - DNA, 21 bp, Homo sapiens
cccatggccctgtgctaatcc

SEQ ID NO: 4928856 - DNA, 15 bp, Homo sapiens
cccatgtaaatacca

SEQ ID NO: 4928857 - DNA, 14 bp, Homo sapiens
cccatgtagccccc

SEQ ID NO: 4928858 - DNA, 22 bp, Homo sapiens
cccatgtctttctccaaagtta

SEQ ID NO: 4928859 - DNA, 21 bp, Homo sapiens
cccatgttctgcccccagccc

SEQ ID NO: 4928860 - DNA, 20 bp, Homo sapiens
cccatgttgtaatgctgcac

SEQ ID NO: 4928861 - DNA, 18 bp, Homo sapiens
cccattcagagactgtcc

SEQ ID NO: 4928862 - DNA, 15 bp, Homo sapiens
cccattctcatctgc

SEQ ID NO: 4928863 - DNA, 16 bp, Homo sapiens
cccattctcatctgca

SEQ ID NO: 4928864 - DNA, 21 bp, Homo sapiens
cccattctgcctgcccaggcc

SEQ ID NO: 4928865 - DNA, 20 bp, Homo sapiens
cccattcttcctagttttct

SEQ ID NO: 4928866 - DNA, 18 bp, Homo sapiens
cccatttgtgccagagga

SEQ ID NO: 4928867 - DNA, 12 bp, Homo sapiens
ccccaaatatag

SEQ ID NO: 4928868 - DNA, 20 bp, Homo sapiens
ccccaacagcgacatagccc

SEQ ID NO: 4928869 - DNA, 19 bp, Homo sapiens
ccccaactctgagcccatg

SEQ ID NO: 4928870 - DNA, 14 bp, Homo sapiens
ccccaagctgtttt

SEQ ID NO: 4928871 - DNA, 16 bp, Homo sapiens
ccccaagctgttttct

SEQ ID NO: 4928872 - DNA, 17 bp, Homo sapiens
ccccaagctgttttctt

SEQ ID NO: 4928873 - DNA, 20 bp, Homo sapiens
ccccaagtagtctgctcaca

SEQ ID NO: 4928874 - DNA, 23 bp, Homo sapiens
ccccacacttgttccagctcttt

SEQ ID NO: 4928875 - DNA, 13 bp, Homo sapiens
ccccacccaggag

SEQ ID NO: 4928876 - DNA, 13 bp, Homo sapiens
ccccacccccagc

SEQ ID NO: 4928877 - DNA, 19 bp, Homo sapiens
ccccaccggtccagctggc

SEQ ID NO: 4928878 - DNA, 22 bp, Homo sapiens
ccccaccggtccagctggcctg

SEQ ID NO: 4928879 - DNA, 12 bp, Homo sapiens
ccccactctccc

SEQ ID NO: 4928880 - DNA, 21 bp, Homo sapiens
ccccactgacagcctcccacc

SEQ ID NO: 4928881 - DNA, 16 bp, Homo sapiens
ccccactgccagcagc

SEQ ID NO: 4928882 - DNA, 22 bp, Homo sapiens
ccccagagctgtttatggcctc

SEQ ID NO: 4928883 - DNA, 23 bp, Homo sapiens
ccccagagctgtttatggcctca

SEQ ID NO: 4928884 - DNA, 15 bp, Homo sapiens
ccccagattgcaaca

SEQ ID NO: 4928885 - DNA, 20 bp, Homo sapiens
ccccagattgcaacaggctg

SEQ ID NO: 4928886 - DNA, 21 bp, Homo sapiens
ccccagattgcaacaggctgg

SEQ ID NO: 4928887 - DNA, 12 bp, Homo sapiens
ccccagcatcac

SEQ ID NO: 4928888 - DNA, 20 bp, Homo sapiens
ccccagcccctagcccagga

SEQ ID NO: 4928889 - DNA, 22 bp, Homo sapiens
ccccagcccctcccccatctcc

SEQ ID NO: 4928890 - DNA, 16 bp, Homo sapiens
ccccagcctctggcat

SEQ ID NO: 4928891 - DNA, 18 bp, Homo sapiens
ccccagcgtcccagtctc

SEQ ID NO: 4928892 - DNA, 23 bp, Homo sapiens
ccccagcgtcccagtctctggca

SEQ ID NO: 4928893 - DNA, 14 bp, Homo sapiens
ccccagctcaatgg

SEQ ID NO: 4928894 - DNA, 16 bp, Homo sapiens
ccccagctcaggggca

SEQ ID NO: 4928895 - DNA, 17 bp, Homo sapiens
ccccagctcaggggcag

SEQ ID NO: 4928896 - DNA, 21 bp, Homo sapiens
ccccagctcaggggcagctca

SEQ ID NO: 4928897 - DNA, 14 bp, Homo sapiens
ccccagctgtgagc

SEQ ID NO: 4928898 - DNA, 19 bp, Homo sapiens
ccccagctgtgagccttgg

SEQ ID NO: 4928899 - DNA, 15 bp, Homo sapiens
ccccaggcctctgtg

SEQ ID NO: 4928900 - DNA, 17 bp, Homo sapiens
ccccaggggtcccagcc

SEQ ID NO: 4928901 - DNA, 19 bp, Homo sapiens
ccccagggtcttccctacc

SEQ ID NO: 4928902 - DNA, 15 bp, Homo sapiens
ccccagtgcccacag

SEQ ID NO: 4928903 - DNA, 16 bp, Homo sapiens
ccccagtgcccacagg

SEQ ID NO: 4928904 - DNA, 21 bp, Homo sapiens
ccccatgcctgtccagcctgg

SEQ ID NO: 4928905 - DNA, 23 bp, Homo sapiens
ccccatgcctgtccagcctgggc

SEQ ID NO: 4928906 - DNA, 24 bp, Homo sapiens
ccccatgcctgtccagcctgggca

SEQ ID NO: 4928907 - DNA, 23 bp, Homo sapiens
ccccatgtgtcctggttcccgtt

SEQ ID NO: 4928908 - DNA, 15 bp, Homo sapiens
ccccattctgcctgc

SEQ ID NO: 4928909 - DNA, 16 bp, Homo sapiens
ccccattcttcctagt

SEQ ID NO: 4928910 - DNA, 21 bp, Homo sapiens
ccccattcttcctagttttct

SEQ ID NO: 4928911 - DNA, 23 bp, Homo sapiens
ccccattcttcctagttttctcc

SEQ ID NO: 4928912 - DNA, 20 bp, Homo sapiens
ccccatttgctttcttttct

SEQ ID NO: 4928913 - DNA, 21 bp, Homo sapiens
cccccaccggtccagctggcc

SEQ ID NO: 4928914 - DNA, 15 bp, Homo sapiens
cccccagcctctggc

SEQ ID NO: 4928915 - DNA, 21 bp, Homo sapiens
cccccagctcaggggcagctc

SEQ ID NO: 4928916 - DNA, 22 bp, Homo sapiens
cccccatgttgtaatgctgcac

SEQ ID NO: 4928917 - DNA, 17 bp, Homo sapiens
cccccattctcatctgc

SEQ ID NO: 4928918 - DNA, 11 bp, Homo sapiens
ccccccactct

SEQ ID NO: 4928919 - DNA, 12 bp, Homo sapiens
ccccccagctca

SEQ ID NO: 4928920 - DNA, 12 bp, Homo sapiens
cccccctctgtc

SEQ ID NO: 4928921 - DNA, 16 bp, Homo sapiens
ccccctatccttggca

SEQ ID NO: 4928922 - DNA, 21 bp, Homo sapiens
ccccctcatctcattcaaacc

SEQ ID NO: 4928923 - DNA, 15 bp, Homo sapiens
ccccctggcctctgt

SEQ ID NO: 4928924 - DNA, 16 bp, Homo sapiens
cccccttcaagcctgt

SEQ ID NO: 4928925 - DNA, 16 bp, Homo sapiens
cccccttctctgctcc

SEQ ID NO: 4928926 - DNA, 22 bp, Homo sapiens
cccccttctctgctccaccaca

SEQ ID NO: 4928927 - DNA, 14 bp, Homo sapiens
ccccgcagacctcc

SEQ ID NO: 4928928 - DNA, 20 bp, Homo sapiens
ccccgcagacctccccagcc

SEQ ID NO: 4928929 - DNA, 20 bp, Homo sapiens
ccccgctgtaagctcctttg

SEQ ID NO: 4928930 - DNA, 22 bp, Homo sapiens
ccccgctgtaagctcctttgtg

SEQ ID NO: 4928931 - DNA, 15 bp, Homo sapiens
ccccggatcagagca

SEQ ID NO: 4928932 - DNA, 18 bp, Homo sapiens
ccccggcaggccctgcag

SEQ ID NO: 4928933 - DNA, 21 bp, Homo sapiens
ccccggcaggccctgcagtgt

SEQ ID NO: 4928934 - DNA, 15 bp, Homo sapiens
ccccggccacctctg

SEQ ID NO: 4928935 - DNA, 16 bp, Homo sapiens
ccccggccacctctgc

SEQ ID NO: 4928936 - DNA, 21 bp, Homo sapiens
ccccggccctgggctcggagg

SEQ ID NO: 4928937 - DNA, 18 bp, Homo sapiens
ccccgggctctctgctgt

SEQ ID NO: 4928938 - DNA, 20 bp, Homo sapiens
ccccggtggcggccccagca

SEQ ID NO: 4928939 - DNA, 22 bp, Homo sapiens
ccccgtggccatccctgtgagg

SEQ ID NO: 4928940 - DNA, 17 bp, Homo sapiens
cccctagaaacccaagc

SEQ ID NO: 4928941 - DNA, 13 bp, Homo sapiens
cccctagcccagg

SEQ ID NO: 4928942 - DNA, 20 bp, Homo sapiens
cccctagcccaggagagaga

SEQ ID NO: 4928943 - DNA, 23 bp, Homo sapiens
cccctagctttatatatggacat

SEQ ID NO: 4928944 - DNA, 15 bp, Homo sapiens
cccctagttccctct

SEQ ID NO: 4928945 - DNA, 21 bp, Homo sapiens
cccctcaacctcctgtggaac

SEQ ID NO: 4928946 - DNA, 17 bp, Homo sapiens
cccctcacagcctctga

SEQ ID NO: 4928947 - DNA, 20 bp, Homo sapiens
cccctcacagcctctgaccc

SEQ ID NO: 4928948 - DNA, 14 bp, Homo sapiens
cccctcactctggc

SEQ ID NO: 4928949 - DNA, 15 bp, Homo sapiens
cccctcaggactgca

SEQ ID NO: 4928950 - DNA, 12 bp, Homo sapiens
cccctccactgt

SEQ ID NO: 4928951 - DNA, 18 bp, Homo sapiens
cccctcccccaaccccca

SEQ ID NO: 4928952 - DNA, 15 bp, Homo sapiens
cccctcccctgctgc

SEQ ID NO: 4928953 - DNA, 13 bp, Homo sapiens
cccctccctctgt

SEQ ID NO: 4928954 - DNA, 20 bp, Homo sapiens
cccctcctgaaccgcacagc

SEQ ID NO: 4928955 - DNA, 12 bp, Homo sapiens
cccctctcacca

SEQ ID NO: 4928956 - DNA, 15 bp, Homo sapiens
cccctctccttctta

SEQ ID NO: 4928957 - DNA, 14 bp, Homo sapiens
cccctctttctctt

SEQ ID NO: 4928958 - DNA, 16 bp, Homo sapiens
cccctgcagcacggac

SEQ ID NO: 4928959 - DNA, 20 bp, Homo sapiens
cccctgcagcacggacaata

SEQ ID NO: 4928960 - DNA, 22 bp, Homo sapiens
cccctgcagcacggacaataaa

SEQ ID NO: 4928961 - DNA, 13 bp, Homo sapiens
cccctgccctgct

SEQ ID NO: 4928962 - DNA, 15 bp, Homo sapiens
cccctgccctgctgc

SEQ ID NO: 4928963 - DNA, 13 bp, Homo sapiens
cccctgcctgcca

SEQ ID NO: 4928964 - DNA, 12 bp, Homo sapiens
cccctgccttgc

SEQ ID NO: 4928965 - DNA, 19 bp, Homo sapiens
cccctgctgcaggggctct

SEQ ID NO: 4928966 - DNA, 15 bp, Homo sapiens
cccctggactgggag

SEQ ID NO: 4928967 - DNA, 17 bp, Homo sapiens
cccctggctgtttggac

SEQ ID NO: 4928968 - DNA, 20 bp, Homo sapiens
cccctggcttttcactgctg

SEQ ID NO: 4928969 - DNA, 23 bp, Homo sapiens
cccctggcttttcactgctggct

SEQ ID NO: 4928970 - DNA, 21 bp, Homo sapiens
cccctgggtcagtctggtggg

SEQ ID NO: 4928971 - DNA, 13 bp, Homo sapiens
cccctgtcctcac

SEQ ID NO: 4928972 - DNA, 16 bp, Homo sapiens
cccctgtcctcactgc

SEQ ID NO: 4928973 - DNA, 13 bp, Homo sapiens
cccctgttctaag

SEQ ID NO: 4928974 - DNA, 12 bp, Homo sapiens
ccccttccccct

SEQ ID NO: 4928975 - DNA, 21 bp, Homo sapiens
ccccttctacatttcttagac

SEQ ID NO: 4928976 - DNA, 13 bp, Homo sapiens
ccccttctctgct

SEQ ID NO: 4928977 - DNA, 14 bp, Homo sapiens
ccccttctctgctc

SEQ ID NO: 4928978 - DNA, 14 bp, Homo sapiens
ccccttgccacccc

SEQ ID NO: 4928979 - DNA, 15 bp, Homo sapiens
ccccttgtcctttcc

SEQ ID NO: 4928980 - DNA, 10 bp, Homo sapiens
cccctttcct

SEQ ID NO: 4928981 - DNA, 22 bp, Homo sapiens
cccgaaggttatggtcaatccc

SEQ ID NO: 4928982 - DNA, 15 bp, Homo sapiens
cccgaggccttctct

SEQ ID NO: 4928983 - DNA, 14 bp, Homo sapiens
cccgagtagctggg

SEQ ID NO: 4928984 - DNA, 15 bp, Homo sapiens
cccgagtagctggga

SEQ ID NO: 4928985 - DNA, 22 bp, Homo sapiens
cccgagtagctgggactacagg

SEQ ID NO: 4928986 - DNA, 22 bp, Homo sapiens
cccgcacaccctcactctgcca

SEQ ID NO: 4928987 - DNA, 16 bp, Homo sapiens
cccgcacagcagcctg

SEQ ID NO: 4928988 - DNA, 20 bp, Homo sapiens
cccgcagacctccccagccc

SEQ ID NO: 4928989 - DNA, 17 bp, Homo sapiens
cccgcccctgcagcacg

SEQ ID NO: 4928990 - DNA, 15 bp, Homo sapiens
cccgctaaggaagat

SEQ ID NO: 4928991 - DNA, 12 bp, Homo sapiens
cccgctcagccc

SEQ ID NO: 4928992 - DNA, 15 bp, Homo sapiens
cccgctgctgctgct

SEQ ID NO: 4928993 - DNA, 16 bp, Homo sapiens
cccgctgctgctgctg

SEQ ID NO: 4928994 - DNA, 19 bp, Homo sapiens
cccggagattggacggcct

SEQ ID NO: 4928995 - DNA, 14 bp, Homo sapiens
cccggaggaaatct

SEQ ID NO: 4928996 - DNA, 20 bp, Homo sapiens
cccggaggaaatctgcagag

SEQ ID NO: 4928997 - DNA, 17 bp, Homo sapiens
cccggaggggcctggca

SEQ ID NO: 4928998 - DNA, 15 bp, Homo sapiens
cccggatgctgcttc

SEQ ID NO: 4928999 - DNA, 19 bp, Homo sapiens
cccggcaggccctgcagtg

SEQ ID NO: 4929000 - DNA, 13 bp, Homo sapiens
cccggccacctct

SEQ ID NO: 4929001 - DNA, 21 bp, Homo sapiens
cccggccacctctgcggaccc

SEQ ID NO: 4929002 - DNA, 12 bp, Homo sapiens
cccggccccctg

SEQ ID NO: 4929003 - DNA, 13 bp, Homo sapiens
cccggccccctgg

SEQ ID NO: 4929004 - DNA, 15 bp, Homo sapiens
cccggcccctgctgg

SEQ ID NO: 4929005 - DNA, 15 bp, Homo sapiens
cccggctccaggctc

SEQ ID NO: 4929006 - DNA, 22 bp, Homo sapiens
cccggctcgagcagtcctgcct

SEQ ID NO: 4929007 - DNA, 20 bp, Homo sapiens
cccggcttcctttcccaagc

SEQ ID NO: 4929008 - DNA, 13 bp, Homo sapiens
cccgggagcctag

SEQ ID NO: 4929009 - DNA, 19 bp, Homo sapiens
cccgggagcctaggaccac

SEQ ID NO: 4929010 - DNA, 17 bp, Homo sapiens
cccggtcccgagtacag

SEQ ID NO: 4929011 - DNA, 18 bp, Homo sapiens
cccggtggcggccccagc

SEQ ID NO: 4929012 - DNA, 12 bp, Homo sapiens
cccgtggtctct

SEQ ID NO: 4929013 - DNA, 16 bp, Homo sapiens
cccgttacagctcccc

SEQ ID NO: 4929014 - DNA, 12 bp, Homo sapiens
cccgtttctcca

SEQ ID NO: 4929015 - DNA, 12 bp, Homo sapiens
ccctaaactgta

SEQ ID NO: 4929016 - DNA, 12 bp, Homo sapiens
ccctaagagact

SEQ ID NO: 4929017 - DNA, 14 bp, Homo sapiens
ccctaagccagcct

SEQ ID NO: 4929018 - DNA, 23 bp, Homo sapiens
ccctaagccagcctggtccatgc

SEQ ID NO: 4929019 - DNA, 16 bp, Homo sapiens
ccctgggccagggtct

SEQ ID NO: 4929020 - DNA, 17 bp, Homo sapiens
ccctgggccagggtctg

SEQ ID NO: 4929021 - DNA, 14 bp, Homo sapiens
ccctggggcctgga

SEQ ID NO: 4929022 - DNA, 17 bp, Homo sapiens
ccctggggcctggacct

SEQ ID NO: 4929023 - DNA, 21 bp, Homo sapiens
ccctggggcctggacctgcct

SEQ ID NO: 4929024 - DNA, 14 bp, Homo sapiens
ccctggggctgggc

SEQ ID NO: 4929025 - DNA, 15 bp, Homo sapiens
ccctggtcctgaggg

SEQ ID NO: 4929026 - DNA, 14 bp, Homo sapiens
ccctggtctctggt

SEQ ID NO: 4929027 - DNA, 15 bp, Homo sapiens
ccctggtgcctggct

SEQ ID NO: 4929028 - DNA, 13 bp, Homo sapiens
ccctggtggcagt

SEQ ID NO: 4929029 - DNA, 16 bp, Homo sapiens
ccctggtggcagtggg

SEQ ID NO: 4929030 - DNA, 19 bp, Homo sapiens
ccctggtggcagtgggagc

SEQ ID NO: 4929031 - DNA, 22 bp, Homo sapiens
ccctggtggcagtgggagctgc

SEQ ID NO: 4929032 - DNA, 20 bp, Homo sapiens
ccctggttgggtggcaattc

SEQ ID NO: 4929033 - DNA, 16 bp, Homo sapiens
ccctgtacctcatccc

SEQ ID NO: 4929034 - DNA, 22 bp, Homo sapiens
ccctgtacctcatcccatgaga

SEQ ID NO: 4929035 - DNA, 18 bp, Homo sapiens
ccctgtactgttctgtgt

SEQ ID NO: 4929036 - DNA, 20 bp, Homo sapiens
ccctgtcccatgcaggccct

SEQ ID NO: 4929037 - DNA, 21 bp, Homo sapiens
ccctgtcccatgcaggccctt

SEQ ID NO: 4929038 - DNA, 23 bp, Homo sapiens
ccctgtcccatgcaggccctttg

SEQ ID NO: 4929039 - DNA, 10 bp, Homo sapiens
ccctgtccct

SEQ ID NO: 4929040 - DNA, 12 bp, Homo sapiens
ccctgtccctcc

SEQ ID NO: 4929041 - DNA, 16 bp, Homo sapiens
ccctgtccctcccacc

SEQ ID NO: 4929042 - DNA, 17 bp, Homo sapiens
ccctgtccctcccacct

SEQ ID NO: 4929043 - DNA, 18 bp, Homo sapiens
ccctgtccctcccacctc

SEQ ID NO: 4929044 - DNA, 21 bp, Homo sapiens
ccctgtccctcccacctctgt

SEQ ID NO: 4929045 - DNA, 23 bp, Homo sapiens
ccctgtccctcccacctctgtga

SEQ ID NO: 4929046 - DNA, 13 bp, Homo sapiens
ccctgtcctcact

SEQ ID NO: 4929047 - DNA, 17 bp, Homo sapiens
ccctgtcctcactgctc

SEQ ID NO: 4929048 - DNA, 19 bp, Homo sapiens
ccctgtgtccacctgtggg

SEQ ID NO: 4929049 - DNA, 14 bp, Homo sapiens
ccctgttcactcta

SEQ ID NO: 4929050 - DNA, 12 bp, Homo sapiens
ccctgttctaag

SEQ ID NO: 4929051 - DNA, 14 bp, Homo sapiens
ccctgttcttcctc

SEQ ID NO: 4929052 - DNA, 14 bp, Homo sapiens
ccctgtttaatatt

SEQ ID NO: 4929053 - DNA, 19 bp, Homo sapiens
ccctgtttaatatttaaac

SEQ ID NO: 4929054 - DNA, 21 bp, Homo sapiens
ccctgtttaatatttaaacag

SEQ ID NO: 4929055 - DNA, 20 bp, Homo sapiens
cccttaacccaaggagcaca

SEQ ID NO: 4929056 - DNA, 19 bp, Homo sapiens
cccttaattacttaaaaaa

SEQ ID NO: 4929057 - DNA, 22 bp, Homo sapiens
cccttaccccttagcctccctg

SEQ ID NO: 4929058 - DNA, 21 bp, Homo sapiens
cccttaccctttcctccttta

SEQ ID NO: 4929059 - DNA, 16 bp, Homo sapiens
cccttagaaaatgtgt

SEQ ID NO: 4929060 - DNA, 18 bp, Homo sapiens
cccttagtcccccaactc

SEQ ID NO: 4929061 - DNA, 15 bp, Homo sapiens
cccttccaaataata

SEQ ID NO: 4929062 - DNA, 18 bp, Homo sapiens
cccttccaaataataaag

SEQ ID NO: 4929063 - DNA, 12 bp, Homo sapiens
cccttccactgc

SEQ ID NO: 4929064 - DNA, 14 bp, Homo sapiens
cccttccactgcct

SEQ ID NO: 4929065 - DNA, 20 bp, Homo sapiens
cccttccagatcactgccac

SEQ ID NO: 4929066 - DNA, 12 bp, Homo sapiens
cccttccctgca

SEQ ID NO: 4929067 - DNA, 16 bp, Homo sapiens
cccttccctgtccttg

SEQ ID NO: 4929068 - DNA, 15 bp, Homo sapiens
cccttccgaccctct

SEQ ID NO: 4929069 - DNA, 20 bp, Homo sapiens
cccttccgaccctctgggaa

SEQ ID NO: 4929070 - DNA, 16 bp, Homo sapiens
cccttcctctccactg

SEQ ID NO: 4929071 - DNA, 20 bp, Homo sapiens
cccttcctctccactgcctt

SEQ ID NO: 4929072 - DNA, 16 bp, Homo sapiens
cccttcctcttcggcc

SEQ ID NO: 4929073 - DNA, 22 bp, Homo sapiens
cccttcctcttcggccctcaga

SEQ ID NO: 4929074 - DNA, 11 bp, Homo sapiens
cccttccttta

SEQ ID NO: 4929075 - DNA, 13 bp, Homo sapiens
cccttctctgctc

SEQ ID NO: 4929076 - DNA, 15 bp, Homo sapiens
cccttctctgctcca

SEQ ID NO: 4929077 - DNA, 20 bp, Homo sapiens
cccttctctgctccaccaca

SEQ ID NO: 4929078 - DNA, 22 bp, Homo sapiens
cccttcttttatgagcagaagg

SEQ ID NO: 4929079 - DNA, 11 bp, Homo sapiens
cccttcttttt

SEQ ID NO: 4929080 - DNA, 15 bp, Homo sapiens
cccttgacaccgggg

SEQ ID NO: 4929081 - DNA, 19 bp, Homo sapiens
cccttgatgcacagagaag

SEQ ID NO: 4929082 - DNA, 19 bp, Homo sapiens
cccttgatttaaacacaca

SEQ ID NO: 4929083 - DNA, 22 bp, Homo sapiens
cccttgcactaaagtatgtaaa

SEQ ID NO: 4929084 - DNA, 16 bp, Homo sapiens
cccttgcagctagttt

SEQ ID NO: 4929085 - DNA, 19 bp, Homo sapiens
cccttgcagttcagcacca

SEQ ID NO: 4929086 - DNA, 23 bp, Homo sapiens
cccttgcagttcagcaccaccct

SEQ ID NO: 4929087 - DNA, 16 bp, Homo sapiens
cccttgccactttgca

SEQ ID NO: 4929088 - DNA, 11 bp, Homo sapiens
cccttgctttt

SEQ ID NO: 4929089 - DNA, 21 bp, Homo sapiens
cccttgcttttccctcttttc

SEQ ID NO: 4929090 - DNA, 22 bp, Homo sapiens
cccttggacaagacaaaccaag

SEQ ID NO: 4929091 - DNA, 12 bp, Homo sapiens
cccttggcctca

SEQ ID NO: 4929092 - DNA, 13 bp, Homo sapiens
cccttggcctcag

SEQ ID NO: 4929093 - DNA, 16 bp, Homo sapiens
cccttggcctgtctca

SEQ ID NO: 4929094 - DNA, 19 bp, Homo sapiens
cccttggcctgtctcatcc

SEQ ID NO: 4929095 - DNA, 23 bp, Homo sapiens
cccttggctgtgaggcccctgga

SEQ ID NO: 4929096 - DNA, 16 bp, Homo sapiens
cccttggcttctgtga

SEQ ID NO: 4929097 - DNA, 12 bp, Homo sapiens
cccttgggccac

SEQ ID NO: 4929098 - DNA, 23 bp, Homo sapiens
ccctttccccgacgcccacccaa

SEQ ID NO: 4929099 - DNA, 14 bp, Homo sapiens
ccctttctggctct

SEQ ID NO: 4929100 - DNA, 12 bp, Homo sapiens
ccctttctgtgt

SEQ ID NO: 4929101 - DNA, 17 bp, Homo sapiens
ccctttgtctttcaaac

SEQ ID NO: 4929102 - DNA, 19 bp, Homo sapiens
cccttttttgtcccccaac

SEQ ID NO: 4929103 - DNA, 21 bp, Homo sapiens
cccttttttgtcccccaactt

SEQ ID NO: 4929104 - DNA, 23 bp, Homo sapiens
ccgaacatcaccgacgcgtctcc

SEQ ID NO: 4929105 - DNA, 18 bp, Homo sapiens
ccgaatcccctccctgtc

SEQ ID NO: 4929106 - DNA, 12 bp, Homo sapiens
ccgacagcctgg

SEQ ID NO: 4929107 - DNA, 14 bp, Homo sapiens
ccgacaggccctgg

SEQ ID NO: 4929108 - DNA, 17 bp, Homo sapiens
ccgaccagacaccttga

SEQ ID NO: 4929109 - DNA, 18 bp, Homo sapiens
ccgaccagacaccttgac

SEQ ID NO: 4929110 - DNA, 17 bp, Homo sapiens
ccgaccagaggagcctt

SEQ ID NO: 4929111 - DNA, 18 bp, Homo sapiens
ccgaccagaggagccttt

SEQ ID NO: 4929112 - DNA, 16 bp, Homo sapiens
ccgaccctctgggaac

SEQ ID NO: 4929113 - DNA, 13 bp, Homo sapiens
ccgacgcccaccc

SEQ ID NO: 4929114 - DNA, 17 bp, Homo sapiens
ccgacgcgtctcctgtt

SEQ ID NO: 4929115 - DNA, 23 bp, Homo sapiens
ccgactgcacagcggcccctgca

SEQ ID NO: 4929116 - DNA, 18 bp, Homo sapiens
ccgagatcacgccactgc

SEQ ID NO: 4929117 - DNA, 23 bp, Homo sapiens
ccgagcaaagatcaaaataaaaa

SEQ ID NO: 4929118 - DNA, 17 bp, Homo sapiens
ccgagggtcctggctcc

SEQ ID NO: 4929119 - DNA, 21 bp, Homo sapiens
ccgagggtcctggctcctgag

SEQ ID NO: 4929120 - DNA, 23 bp, Homo sapiens
ccgagggtcctggctcctgaggg

SEQ ID NO: 4929121 - DNA, 14 bp, Homo sapiens
ccgagtacagtctg

SEQ ID NO: 4929122 - DNA, 14 bp, Homo sapiens
ccgagtagctggga

SEQ ID NO: 4929123 - DNA, 16 bp, Homo sapiens
ccgagtagctgggact

SEQ ID NO: 4929124 - DNA, 20 bp, Homo sapiens
ccgagtagctgggactacag

SEQ ID NO: 4929125 - DNA, 20 bp, Homo sapiens
ccgagtctcttctccactgg

SEQ ID NO: 4929126 - DNA, 20 bp, Homo sapiens
ccgcacaccctcactctgcc

SEQ ID NO: 4929127 - DNA, 22 bp, Homo sapiens
ccgcacaccctcactctgccag

SEQ ID NO: 4929128 - DNA, 18 bp, Homo sapiens
ccgcacagctcaggaggc

SEQ ID NO: 4929129 - DNA, 19 bp, Homo sapiens
cctactgttctaaagctct

SEQ ID NO: 4929130 - DNA, 13 bp, Homo sapiens
cctacttcctgtg

SEQ ID NO: 4929131 - DNA, 15 bp, Homo sapiens
cctacttcctgtgac

SEQ ID NO: 4929132 - DNA, 12 bp, Homo sapiens
cctagaagaagc

SEQ ID NO: 4929133 - DNA, 21 bp, Homo sapiens
cctagactctgtaacatcact

SEQ ID NO: 4929134 - DNA, 17 bp, Homo sapiens
cctagagaacgcagccc

SEQ ID NO: 4929135 - DNA, 19 bp, Homo sapiens
cctagagaacgcagcccta

SEQ ID NO: 4929136 - DNA, 12 bp, Homo sapiens
cctagagccaga

SEQ ID NO: 4929137 - DNA, 14 bp, Homo sapiens
cctagagccagacc

SEQ ID NO: 4929138 - DNA, 16 bp, Homo sapiens
cctagagccagaccaa

SEQ ID NO: 4929139 - DNA, 17 bp, Homo sapiens
cctagagcctgcctgga

SEQ ID NO: 4929140 - DNA, 14 bp, Homo sapiens
cctagcaagctggc

SEQ ID NO: 4929141 - DNA, 15 bp, Homo sapiens
cctagcccaccctgc

SEQ ID NO: 4929142 - DNA, 17 bp, Homo sapiens
cctagcccagcgctctg

SEQ ID NO: 4929143 - DNA, 19 bp, Homo sapiens
cctagccttagaagtcaca

SEQ ID NO: 4929144 - DNA, 21 bp, Homo sapiens
cctagctttatatatggacat

SEQ ID NO: 4929145 - DNA, 23 bp, Homo sapiens
cctagctttatatatggacatgg

SEQ ID NO: 4929146 - DNA, 16 bp, Homo sapiens
cctaggaccactcagc

SEQ ID NO: 4929147 - DNA, 12 bp, Homo sapiens
cctaggagacca

SEQ ID NO: 4929148 - DNA, 16 bp, Homo sapiens
cctaggagtatatttc

SEQ ID NO: 4929149 - DNA, 15 bp, Homo sapiens
cctaggctccacccc

SEQ ID NO: 4929150 - DNA, 16 bp, Homo sapiens
cctaggttcccggtcc

SEQ ID NO: 4929151 - DNA, 18 bp, Homo sapiens
cctaggttcccggtcccg

SEQ ID NO: 4929152 - DNA, 20 bp, Homo sapiens
cctaggttcccggtcccgag

SEQ ID NO: 4929153 - DNA, 21 bp, Homo sapiens
cctaggttcccggtcccgagt

SEQ ID NO: 4929154 - DNA, 18 bp, Homo sapiens
cctaggttccctgttctt

SEQ ID NO: 4929155 - DNA, 22 bp, Homo sapiens
cctaggttccctgttcttcctc

SEQ ID NO: 4929156 - DNA, 15 bp, Homo sapiens
cctagtcccttcccc

SEQ ID NO: 4929157 - DNA, 17 bp, Homo sapiens
cctagttccctctgctc

SEQ ID NO: 4929158 - DNA, 18 bp, Homo sapiens
cctagttccctctgctca

SEQ ID NO: 4929159 - DNA, 15 bp, Homo sapiens
cctagtttcctctcc

SEQ ID NO: 4929160 - DNA, 17 bp, Homo sapiens
cctagtttgacctcaca

SEQ ID NO: 4929161 - DNA, 18 bp, Homo sapiens
cctagttttctcctccca

SEQ ID NO: 4929162 - DNA, 18 bp, Homo sapiens
cctataacttgatgcatg

SEQ ID NO: 4929163 - DNA, 16 bp, Homo sapiens
cctataatgtgtgtat

SEQ ID NO: 4929164 - DNA, 19 bp, Homo sapiens
cctatactgtagtattctt

SEQ ID NO: 4929165 - DNA, 16 bp, Homo sapiens
cctatatcctgtgact

SEQ ID NO: 4929166 - DNA, 18 bp, Homo sapiens
cctatatgatttatagtt

SEQ ID NO: 4929167 - DNA, 14 bp, Homo sapiens
cctatccttggcac

SEQ ID NO: 4929168 - DNA, 16 bp, Homo sapiens
cctatccttggcacca

SEQ ID NO: 4929169 - DNA, 22 bp, Homo sapiens
cctatcgccccctacgcgcctt

SEQ ID NO: 4929170 - DNA, 16 bp, Homo sapiens
cctatctatcttccaa

SEQ ID NO: 4929171 - DNA, 21 bp, Homo sapiens
cctatctatcttccaaatgca

SEQ ID NO: 4929172 - DNA, 14 bp, Homo sapiens
cctatctcctgaca

SEQ ID NO: 4929173 - DNA, 15 bp, Homo sapiens
cctatgagcatcctg

SEQ ID NO: 4929174 - DNA, 16 bp, Homo sapiens
cctcaacctcctgggc

SEQ ID NO: 4929175 - DNA, 22 bp, Homo sapiens
cctcaaggttttaggttctaaa

SEQ ID NO: 4929176 - DNA, 20 bp, Homo sapiens
cctcaagtgattctcctgcc

SEQ ID NO: 4929177 - DNA, 13 bp, Homo sapiens
cctcaatgtttga

SEQ ID NO: 4929178 - DNA, 23 bp, Homo sapiens
cctcacacaccctgaggtcaggg

SEQ ID NO: 4929179 - DNA, 14 bp, Homo sapiens
cctcacagcctctg

SEQ ID NO: 4929180 - DNA, 19 bp, Homo sapiens
cctcacagcctctgacccc

SEQ ID NO: 4929181 - DNA, 23 bp, Homo sapiens
cctcacagtcccactgtgcaggt

SEQ ID NO: 4929182 - DNA, 15 bp, Homo sapiens
cctcacccctgtcct

SEQ ID NO: 4929183 - DNA, 21 bp, Homo sapiens
cctcacccctgtcctcactgc

SEQ ID NO: 4929184 - DNA, 14 bp, Homo sapiens
cctcaccgcttccc

SEQ ID NO: 4929185 - DNA, 18 bp, Homo sapiens
cctcacctctggactggc

SEQ ID NO: 4929186 - DNA, 22 bp, Homo sapiens
cctcacctctggactggctaga

SEQ ID NO: 4929187 - DNA, 16 bp, Homo sapiens
cctcactctgccaggg

SEQ ID NO: 4929188 - DNA, 17 bp, Homo sapiens
cctcactctggcctcag

SEQ ID NO: 4929189 - DNA, 16 bp, Homo sapiens
cctcactgcccgcaca

SEQ ID NO: 4929190 - DNA, 18 bp, Homo sapiens
cctcactgcccgcacacc

SEQ ID NO: 4929191 - DNA, 21 bp, Homo sapiens
cctcactgctccctgaagcca

SEQ ID NO: 4929192 - DNA, 17 bp, Homo sapiens
cctcactggccatccct

SEQ ID NO: 4929193 - DNA, 18 bp, Homo sapiens
cctcactggccatccctc

SEQ ID NO: 4929194 - DNA, 22 bp, Homo sapiens
cctcactggccatccctcgtgg

SEQ ID NO: 4929195 - DNA, 16 bp, Homo sapiens
cctcagcatcctggca

SEQ ID NO: 4929196 - DNA, 17 bp, Homo sapiens
cctcagcatcctggcac

SEQ ID NO: 4929197 - DNA, 23 bp, Homo sapiens
cctcagccgactgcacagcggcc

SEQ ID NO: 4929198 - DNA, 22 bp, Homo sapiens
cctcagcctcccaaagtgctgg

SEQ ID NO: 4929199 - DNA, 12 bp, Homo sapiens
cctcagcctccg

SEQ ID NO: 4929200 - DNA, 14 bp, Homo sapiens
cctcagcctgcaca

SEQ ID NO: 4929201 - DNA, 20 bp, Homo sapiens
cctcagctacccactatcct

SEQ ID NO: 4929202 - DNA, 14 bp, Homo sapiens
cctcagctgaatgc

SEQ ID NO: 4929203 - DNA, 14 bp, Homo sapiens
cctcagctgcctca

SEQ ID NO: 4929204 - DNA, 19 bp, Homo sapiens
cctcagctgcctcacttcc

SEQ ID NO: 4929205 - DNA, 22 bp, Homo sapiens
cctcagggagcagggaaggcct

SEQ ID NO: 4929206 - DNA, 23 bp, Homo sapiens
cctcagggagcagggaaggcctg

SEQ ID NO: 4929207 - DNA, 16 bp, Homo sapiens
cctcagtccatttata

SEQ ID NO: 4929208 - DNA, 23 bp, Homo sapiens
cctcagtcctcccctcacagcct

SEQ ID NO: 4929209 - DNA, 11 bp, Homo sapiens
cctcagtgcca

SEQ ID NO: 4929210 - DNA, 15 bp, Homo sapiens
cctcagttcccttgg

SEQ ID NO: 4929211 - DNA, 18 bp, Homo sapiens
cctcagttcccttggcct

SEQ ID NO: 4929212 - DNA, 13 bp, Homo sapiens
cctcatcccatga

SEQ ID NO: 4929213 - DNA, 21 bp, Homo sapiens
cctcatctatgaggaaaggtt

SEQ ID NO: 4929214 - DNA, 13 bp, Homo sapiens
cctcatctcattc

SEQ ID NO: 4929215 - DNA, 16 bp, Homo sapiens
cctcatcttgaagggc

SEQ ID NO: 4929216 - DNA, 20 bp, Homo sapiens
cctcatcttgaagggcccag

SEQ ID NO: 4929217 - DNA, 22 bp, Homo sapiens
cctcatggcccctctgacctgc

SEQ ID NO: 4929218 - DNA, 19 bp, Homo sapiens
cctcatggtgggttcaggg

SEQ ID NO: 4929219 - DNA, 18 bp, Homo sapiens
cctcatgtttatgaaaat

SEQ ID NO: 4929220 - DNA, 16 bp, Homo sapiens
cctcattactgggcct

SEQ ID NO: 4929221 - DNA, 21 bp, Homo sapiens
cctcattccaccttcccatgc

SEQ ID NO: 4929222 - DNA, 17 bp, Homo sapiens
cctccaaaggcccccta

SEQ ID NO: 4929223 - DNA, 13 bp, Homo sapiens
cctccacagcgag

SEQ ID NO: 4929224 - DNA, 22 bp, Homo sapiens
cctccacagcgagggcagctgc

SEQ ID NO: 4929225 - DNA, 14 bp, Homo sapiens
cctccacctcttca

SEQ ID NO: 4929226 - DNA, 18 bp, Homo sapiens
cctccagaagcctctggc

SEQ ID NO: 4929227 - DNA, 17 bp, Homo sapiens
cctccagcccgggagcc

SEQ ID NO: 4929228 - DNA, 20 bp, Homo sapiens
cctccagcccgggagcctag

SEQ ID NO: 4929229 - DNA, 15 bp, Homo sapiens
cctccagctgcacca

SEQ ID NO: 4929230 - DNA, 16 bp, Homo sapiens
cctccagctgcaccag

SEQ ID NO: 4929231 - DNA, 18 bp, Homo sapiens
cctccagctgcaccagag

SEQ ID NO: 4929232 - DNA, 20 bp, Homo sapiens
cctccagctgcaccagagca

SEQ ID NO: 4929233 - DNA, 21 bp, Homo sapiens
cctccatcctatccactgggc

SEQ ID NO: 4929234 - DNA, 16 bp, Homo sapiens
cctccatgacagcgct

SEQ ID NO: 4929235 - DNA, 16 bp, Homo sapiens
cctccatgctgcctcc

SEQ ID NO: 4929236 - DNA, 15 bp, Homo sapiens
cctcccaaagtgctg

SEQ ID NO: 4929237 - DNA, 13 bp, Homo sapiens
cctcccaacccag

SEQ ID NO: 4929238 - DNA, 21 bp, Homo sapiens
cctcccaaggagaacaaatat

SEQ ID NO: 4929239 - DNA, 20 bp, Homo sapiens
cctctgtgtccttccctgca

SEQ ID NO: 4929240 - DNA, 19 bp, Homo sapiens
cctctgtgtgctcctcctt

SEQ ID NO: 4929241 - DNA, 23 bp, Homo sapiens
cctcttaaagctgcctgtagtta

SEQ ID NO: 4929242 - DNA, 13 bp, Homo sapiens
cctcttcactccc

SEQ ID NO: 4929243 - DNA, 14 bp, Homo sapiens
cctcttcactcccc

SEQ ID NO: 4929244 - DNA, 19 bp, Homo sapiens
cctcttcctccctcattcc

SEQ ID NO: 4929245 - DNA, 13 bp, Homo sapiens
cctcttcggccct

SEQ ID NO: 4929246 - DNA, 16 bp, Homo sapiens
cctcttcggccctcag

SEQ ID NO: 4929247 - DNA, 13 bp, Homo sapiens
cctcttgctgtct

SEQ ID NO: 4929248 - DNA, 14 bp, Homo sapiens
cctcttgctgtctc

SEQ ID NO: 4929249 - DNA, 20 bp, Homo sapiens
cctcttgctgtctctgctcg

SEQ ID NO: 4929250 - DNA, 17 bp, Homo sapiens
cctctttaaaacaaaac

SEQ ID NO: 4929251 - DNA, 12 bp, Homo sapiens
cctctttaagag

SEQ ID NO: 4929252 - DNA, 18 bp, Homo sapiens
cctctttctctttcttcc

SEQ ID NO: 4929253 - DNA, 14 bp, Homo sapiens
cctctttggctccc

SEQ ID NO: 4929254 - DNA, 11 bp, Homo sapiens
cctcttttctt

SEQ ID NO: 4929255 - DNA, 13 bp, Homo sapiens
cctgaaattccaa

SEQ ID NO: 4929256 - DNA, 16 bp, Homo sapiens
cctgaacaagaattgg

SEQ ID NO: 4929257 - DNA, 17 bp, Homo sapiens
cctgaacaagaattgga

SEQ ID NO: 4929258 - DNA, 21 bp, Homo sapiens
cctgaaccgcacagctcagga

SEQ ID NO: 4929259 - DNA, 21 bp, Homo sapiens
cctgaagactcattcttctgt

SEQ ID NO: 4929260 - DNA, 15 bp, Homo sapiens
cctgaagactgagga

SEQ ID NO: 4929261 - DNA, 16 bp, Homo sapiens
cctgaagccagccttc

SEQ ID NO: 4929262 - DNA, 22 bp, Homo sapiens
cctgaatcccccttgccacccc

SEQ ID NO: 4929263 - DNA, 21 bp, Homo sapiens
cctgaattttgttgctgtttt

SEQ ID NO: 4929264 - DNA, 18 bp, Homo sapiens
cctgacagtcttgtgctt

SEQ ID NO: 4929265 - DNA, 18 bp, Homo sapiens
cctgacctcttgctgtct

SEQ ID NO: 4929266 - DNA, 21 bp, Homo sapiens
cctgacctcttgctgtctctg

SEQ ID NO: 4929267 - DNA, 23 bp, Homo sapiens
cctgacctcttgctgtctctgct

SEQ ID NO: 4929268 - DNA, 13 bp, Homo sapiens
cctgacgaaactg

SEQ ID NO: 4929269 - DNA, 18 bp, Homo sapiens
cctgacgaaactggcccc

SEQ ID NO: 4929270 - DNA, 22 bp, Homo sapiens
cctgactctgccccctgctggc

SEQ ID NO: 4929271 - DNA, 22 bp, Homo sapiens
cctgagaagtgtctaaaaacac

SEQ ID NO: 4929272 - DNA, 18 bp, Homo sapiens
cctgagaccatttaacat

SEQ ID NO: 4929273 - DNA, 15 bp, Homo sapiens
cctgagatcccctga

SEQ ID NO: 4929274 - DNA, 17 bp, Homo sapiens
cctgagatcccctgagc

SEQ ID NO: 4929275 - DNA, 18 bp, Homo sapiens
cctgagatcccctgagcc

SEQ ID NO: 4929276 - DNA, 13 bp, Homo sapiens
cctgagcaactct

SEQ ID NO: 4929277 - DNA, 14 bp, Homo sapiens
cctgagcaactctt

SEQ ID NO: 4929278 - DNA, 15 bp, Homo sapiens
cctgagcaactcttg

SEQ ID NO: 4929279 - DNA, 21 bp, Homo sapiens
cctgagccccagggtgcccag

SEQ ID NO: 4929280 - DNA, 18 bp, Homo sapiens
cctgagccccgccctctt

SEQ ID NO: 4929281 - DNA, 17 bp, Homo sapiens
cctgagccctactccct

SEQ ID NO: 4929282 - DNA, 21 bp, Homo sapiens
cctgagccctactccctgcag

SEQ ID NO: 4929283 - DNA, 21 bp, Homo sapiens
cctgaggaaggaggggaagct

SEQ ID NO: 4929284 - DNA, 23 bp, Homo sapiens
cctgaggaaggaggggaagctgc

SEQ ID NO: 4929285 - DNA, 16 bp, Homo sapiens
cctgagggaggacctg

SEQ ID NO: 4929286 - DNA, 21 bp, Homo sapiens
cctgagggaggacctggggca

SEQ ID NO: 4929287 - DNA, 22 bp, Homo sapiens
cctgagggcagaaaggttctgc

SEQ ID NO: 4929288 - DNA, 23 bp, Homo sapiens
cctgagggcagaaaggttctgcc

SEQ ID NO: 4929289 - DNA, 20 bp, Homo sapiens
cctgaggggcatctgcccct

SEQ ID NO: 4929290 - DNA, 14 bp, Homo sapiens
cctgaggtcaggga

SEQ ID NO: 4929291 - DNA, 22 bp, Homo sapiens
cctgaggtcagggagtgctggc

SEQ ID NO: 4929292 - DNA, 16 bp, Homo sapiens
cctgagtcagggccca

SEQ ID NO: 4929293 - DNA, 18 bp, Homo sapiens
cctgagtcagggcccaga

SEQ ID NO: 4929294 - DNA, 21 bp, Homo sapiens
cctgagtcagggcccagaggc

SEQ ID NO: 4929295 - DNA, 23 bp, Homo sapiens
cctgagtcagggcccagaggctg

SEQ ID NO: 4929296 - DNA, 21 bp, Homo sapiens
cctgagtggccagggaatcta

SEQ ID NO: 4929297 - DNA, 17 bp, Homo sapiens
cctgataaagcacagct

SEQ ID NO: 4929298 - DNA, 15 bp, Homo sapiens
cctgatctcttcctg

SEQ ID NO: 4929299 - DNA, 14 bp, Homo sapiens
cctgatgctccctc

SEQ ID NO: 4929300 - DNA, 23 bp, Homo sapiens
cctgatgctccctcccctgccct

SEQ ID NO: 4929301 - DNA, 21 bp, Homo sapiens
cctgatggcacttagctatca

SEQ ID NO: 4929302 - DNA, 18 bp, Homo sapiens
cctgatggtacaggaaag

SEQ ID NO: 4929303 - DNA, 21 bp, Homo sapiens
cctgatggtacaggaaagctc

SEQ ID NO: 4929304 - DNA, 16 bp, Homo sapiens
cctgattgacctgctc

SEQ ID NO: 4929305 - DNA, 17 bp, Homo sapiens
cctgattgacctgctcc

SEQ ID NO: 4929306 - DNA, 20 bp, Homo sapiens
cctgattgtgtatattcata

SEQ ID NO: 4929307 - DNA, 18 bp, Homo sapiens
cctgcaaacagaacaggg

SEQ ID NO: 4929308 - DNA, 21 bp, Homo sapiens
cctgcaaacagaacagggtca

SEQ ID NO: 4929309 - DNA, 21 bp, Homo sapiens
cctgcaaggcccacaggaggc

SEQ ID NO: 4929310 - DNA, 13 bp, Homo sapiens
cctgcaatatttg

SEQ ID NO: 4929311 - DNA, 14 bp, Homo sapiens
cctgcaatgaaagg

SEQ ID NO: 4929312 - DNA, 20 bp, Homo sapiens
cctgcacaaagcccttccat

SEQ ID NO: 4929313 - DNA, 23 bp, Homo sapiens
cctgcacaaagcccttccatgtc

SEQ ID NO: 4929314 - DNA, 12 bp, Homo sapiens
cctgcacacaag

SEQ ID NO: 4929315 - DNA, 23 bp, Homo sapiens
cctgcacacaagcccacagcaca

SEQ ID NO: 4929316 - DNA, 20 bp, Homo sapiens
cctgcactaaagccagcctg

SEQ ID NO: 4929317 - DNA, 21 bp, Homo sapiens
cctgcactggggagcccgtct

SEQ ID NO: 4929318 - DNA, 17 bp, Homo sapiens
cctgcacttgcagactc

SEQ ID NO: 4929319 - DNA, 18 bp, Homo sapiens
cctgcactttgatgtcat

SEQ ID NO: 4929320 - DNA, 15 bp, Homo sapiens
cctgcagatgccacc

SEQ ID NO: 4929321 - DNA, 21 bp, Homo sapiens
cctgcagatgccaccctagcc

SEQ ID NO: 4929322 - DNA, 15 bp, Homo sapiens
cctgcagcacggaca

SEQ ID NO: 4929323 - DNA, 22 bp, Homo sapiens
cctgcagcctcctccacctcac

SEQ ID NO: 4929324 - DNA, 21 bp, Homo sapiens
cctgcagtgttcgcttggctc

SEQ ID NO: 4929325 - DNA, 21 bp, Homo sapiens
cctgcatccccttggctgtga

SEQ ID NO: 4929326 - DNA, 14 bp, Homo sapiens
cctgcatctttagt

SEQ ID NO: 4929327 - DNA, 18 bp, Homo sapiens
cctgcatctttagtgctt

SEQ ID NO: 4929328 - DNA, 14 bp, Homo sapiens
cctgcatttctgag

SEQ ID NO: 4929329 - DNA, 22 bp, Homo sapiens
cctgccaccctggggagaaagt

SEQ ID NO: 4929330 - DNA, 15 bp, Homo sapiens
cctgccagccccaca

SEQ ID NO: 4929331 - DNA, 18 bp, Homo sapiens
cctgccagccccacacag

SEQ ID NO: 4929332 - DNA, 15 bp, Homo sapiens
cctgccatgccagga

SEQ ID NO: 4929333 - DNA, 19 bp, Homo sapiens
cctgccatgtacctcccct

SEQ ID NO: 4929334 - DNA, 17 bp, Homo sapiens
cctgcccaagcccaggc

SEQ ID NO: 4929335 - DNA, 14 bp, Homo sapiens
cctgcccaggcccc

SEQ ID NO: 4929336 - DNA, 13 bp, Homo sapiens
cctgcccaggccg

SEQ ID NO: 4929337 - DNA, 23 bp, Homo sapiens
cctgcccaggccggccagcctca

SEQ ID NO: 4929338 - DNA, 22 bp, Homo sapiens
cctgccccccagcctctggcat

SEQ ID NO: 4929339 - DNA, 14 bp, Homo sapiens
cctgcccctccctt

SEQ ID NO: 4929340 - DNA, 18 bp, Homo sapiens
cctgcccctcccttcaac

SEQ ID NO: 4929341 - DNA, 16 bp, Homo sapiens
cctgcccctctcccgc

SEQ ID NO: 4929342 - DNA, 14 bp, Homo sapiens
cctgcccctctttc

SEQ ID NO: 4929343 - DNA, 18 bp, Homo sapiens
cctgcccctctttctctt

SEQ ID NO: 4929344 - DNA, 19 bp, Homo sapiens
cctgcccctctttctcttt

SEQ ID NO: 4929345 - DNA, 17 bp, Homo sapiens
cctgcccgcacagcagc

SEQ ID NO: 4929346 - DNA, 20 bp, Homo sapiens
cctgcccgcacagcagcctg

SEQ ID NO: 4929347 - DNA, 14 bp, Homo sapiens
cctgcccgttcttg

SEQ ID NO: 4929348 - DNA, 15 bp, Homo sapiens
cctggtatggctgca

SEQ ID NO: 4929349 - DNA, 21 bp, Homo sapiens
cctggtcacaggactctgcct

SEQ ID NO: 4929350 - DNA, 21 bp, Homo sapiens
cctggtccagggaagctggcc

SEQ ID NO: 4929351 - DNA, 13 bp, Homo sapiens
cctggtctctggt

SEQ ID NO: 4929352 - DNA, 14 bp, Homo sapiens
cctggtctctggtc

SEQ ID NO: 4929353 - DNA, 16 bp, Homo sapiens
cctggtgaatggcctt

SEQ ID NO: 4929354 - DNA, 18 bp, Homo sapiens
cctggtgctgccacactt

SEQ ID NO: 4929355 - DNA, 14 bp, Homo sapiens
cctggtggcagctg

SEQ ID NO: 4929356 - DNA, 14 bp, Homo sapiens
cctggtggcagtgg

SEQ ID NO: 4929357 - DNA, 21 bp, Homo sapiens
cctggtggcagtgggagctgc

SEQ ID NO: 4929358 - DNA, 22 bp, Homo sapiens
cctggttcccgtttctccacct

SEQ ID NO: 4929359 - DNA, 23 bp, Homo sapiens
cctgtaacatactggcctggact

SEQ ID NO: 4929360 - DNA, 16 bp, Homo sapiens
cctgtaagccaaagaa

SEQ ID NO: 4929361 - DNA, 23 bp, Homo sapiens
cctgtaagccaaagaaatgaaca

SEQ ID NO: 4929362 - DNA, 14 bp, Homo sapiens
cctgtaagcctgca

SEQ ID NO: 4929363 - DNA, 19 bp, Homo sapiens
cctgtaagcctgcaagcct

SEQ ID NO: 4929364 - DNA, 22 bp, Homo sapiens
cctgtaccttttgaggagcccc

SEQ ID NO: 4929365 - DNA, 20 bp, Homo sapiens
cctgtactgttctgtgtctt

SEQ ID NO: 4929366 - DNA, 15 bp, Homo sapiens
cctgtagttaggaaa

SEQ ID NO: 4929367 - DNA, 17 bp, Homo sapiens
cctgtagttaggaaata

SEQ ID NO: 4929368 - DNA, 19 bp, Homo sapiens
cctgtagttaggaaataaa

SEQ ID NO: 4929369 - DNA, 21 bp, Homo sapiens
cctgtagttaggaaataaaac

SEQ ID NO: 4929370 - DNA, 22 bp, Homo sapiens
cctgtagttaggaaataaaacc

SEQ ID NO: 4929371 - DNA, 20 bp, Homo sapiens
cctgtagttgcgtggactct

SEQ ID NO: 4929372 - DNA, 17 bp, Homo sapiens
cctgtagttttatttta

SEQ ID NO: 4929373 - DNA, 12 bp, Homo sapiens
cctgtatacttt

SEQ ID NO: 4929374 - DNA, 13 bp, Homo sapiens
cctgtatacttta

SEQ ID NO: 4929375 - DNA, 14 bp, Homo sapiens
cctgtatgttgtcc

SEQ ID NO: 4929376 - DNA, 16 bp, Homo sapiens
cctgtatttaagcaaa

SEQ ID NO: 4929377 - DNA, 17 bp, Homo sapiens
cctgtatttaagcaaat

SEQ ID NO: 4929378 - DNA, 18 bp, Homo sapiens
cctgtatttaagcaaata

SEQ ID NO: 4929379 - DNA, 20 bp, Homo sapiens
cctgtatttaagcaaatact

SEQ ID NO: 4929380 - DNA, 14 bp, Homo sapiens
cctgtccagcctgg

SEQ ID NO: 4929381 - DNA, 11 bp, Homo sapiens
cctgtcccacc

SEQ ID NO: 4929382 - DNA, 16 bp, Homo sapiens
cctgtcccatgcaggc

SEQ ID NO: 4929383 - DNA, 13 bp, Homo sapiens
cctgtccctccca

SEQ ID NO: 4929384 - DNA, 18 bp, Homo sapiens
cctgtccctcccacctct

SEQ ID NO: 4929385 - DNA, 20 bp, Homo sapiens
cctgtccctcccacctctgt

SEQ ID NO: 4929386 - DNA, 21 bp, Homo sapiens
cctgtccctcccacctctgtg

SEQ ID NO: 4929387 - DNA, 12 bp, Homo sapiens
cctgtcctcact

SEQ ID NO: 4929388 - DNA, 14 bp, Homo sapiens
cctgtctcagcctc

SEQ ID NO: 4929389 - DNA, 18 bp, Homo sapiens
cctgtctcatccccaggg

SEQ ID NO: 4929390 - DNA, 17 bp, Homo sapiens
cctgtctttaaggaaaa

SEQ ID NO: 4929391 - DNA, 20 bp, Homo sapiens
cctgtgcctcctcaccccca

SEQ ID NO: 4929392 - DNA, 17 bp, Homo sapiens
cctgtggaacccagcag

SEQ ID NO: 4929393 - DNA, 15 bp, Homo sapiens
cctgtggagctcagc

SEQ ID NO: 4929394 - DNA, 19 bp, Homo sapiens
cctgtggagctcagccccg

SEQ ID NO: 4929395 - DNA, 23 bp, Homo sapiens
cctgtggcatctttgccttgggc

SEQ ID NO: 4929396 - DNA, 19 bp, Homo sapiens
cctgtgtccacctgtgggt

SEQ ID NO: 4929397 - DNA, 21 bp, Homo sapiens
cctgtgtcttgcaatggcagc

SEQ ID NO: 4929398 - DNA, 19 bp, Homo sapiens
cctgtgtggtactctgaaa

SEQ ID NO: 4929399 - DNA, 20 bp, Homo sapiens
cctgttaatgtatttgttca

SEQ ID NO: 4929400 - DNA, 19 bp, Homo sapiens
cctgttcagctccagctca

SEQ ID NO: 4929401 - DNA, 12 bp, Homo sapiens
cctgttctaagg

SEQ ID NO: 4929402 - DNA, 21 bp, Homo sapiens
cctgttctaagggggagggga

SEQ ID NO: 4929403 - DNA, 12 bp, Homo sapiens
cctgttcttcct

SEQ ID NO: 4929404 - DNA, 22 bp, Homo sapiens
cctgttgccctttctgtaccat

SEQ ID NO: 4929405 - DNA, 22 bp, Homo sapiens
cctgttgctgtgtttaatttga

SEQ ID NO: 4929406 - DNA, 21 bp, Homo sapiens
cctgtttaatatttaaacagc

SEQ ID NO: 4929407 - DNA, 22 bp, Homo sapiens
ccttaagacctactgttctaaa

SEQ ID NO: 4929408 - DNA, 22 bp, Homo sapiens
ccttaatgcttcatatgaggag

SEQ ID NO: 4929409 - DNA, 16 bp, Homo sapiens
ccttaattacttaaaa

SEQ ID NO: 4929410 - DNA, 19 bp, Homo sapiens
ccttaatttttttttcata

SEQ ID NO: 4929411 - DNA, 19 bp, Homo sapiens
ccttaccaactttctgtaa

SEQ ID NO: 4929412 - DNA, 18 bp, Homo sapiens
ccttagaagtcacacagt

SEQ ID NO: 4929413 - DNA, 20 bp, Homo sapiens
ccttagcagggaaacagcta

SEQ ID NO: 4929414 - DNA, 15 bp, Homo sapiens
ccttagcctccctga

SEQ ID NO: 4929415 - DNA, 19 bp, Homo sapiens
ccttagctggcattacagc

SEQ ID NO: 4929416 - DNA, 22 bp, Homo sapiens
ccttagctggcattacagctgg

SEQ ID NO: 4929417 - DNA, 22 bp, Homo sapiens
ccttaggccacatgggagcagt

SEQ ID NO: 4929418 - DNA, 18 bp, Homo sapiens
ccttagggaagctggcct

SEQ ID NO: 4929419 - DNA, 20 bp, Homo sapiens
ccttagtctcagtttgtgtg

SEQ ID NO: 4929420 - DNA, 19 bp, Homo sapiens
ccttatgacttgctacttt

SEQ ID NO: 4929421 - DNA, 14 bp, Homo sapiens
ccttattttcaaga

SEQ ID NO: 4929422 - DNA, 16 bp, Homo sapiens
ccttcacattttttat

SEQ ID NO: 4929423 - DNA, 11 bp, Homo sapiens
ccttcagacac

SEQ ID NO: 4929424 - DNA, 13 bp, Homo sapiens
ccttcagccccca

SEQ ID NO: 4929425 - DNA, 18 bp, Homo sapiens
ccttcagcccccagcccc

SEQ ID NO: 4929426 - DNA, 12 bp, Homo sapiens
ccttcagctcca

SEQ ID NO: 4929427 - DNA, 20 bp, Homo sapiens
ccttcagtaccctctcagct

SEQ ID NO: 4929428 - DNA, 23 bp, Homo sapiens
ccttcagtaccctctcagctcca

SEQ ID NO: 4929429 - DNA, 16 bp, Homo sapiens
ccttcatggccccagc

SEQ ID NO: 4929430 - DNA, 20 bp, Homo sapiens
ccttccaaataataaagtct

SEQ ID NO: 4929431 - DNA, 12 bp, Homo sapiens
ccttccagctcc

SEQ ID NO: 4929432 - DNA, 15 bp, Homo sapiens
ccttccagctcctgt

SEQ ID NO: 4929433 - DNA, 16 bp, Homo sapiens
ccttccagctcctgta

SEQ ID NO: 4929434 - DNA, 12 bp, Homo sapiens
ccttccagctgc

SEQ ID NO: 4929435 - DNA, 13 bp, Homo sapiens
ccttccagctgct

SEQ ID NO: 4929436 - DNA, 16 bp, Homo sapiens
ccttccagctgctgtc

SEQ ID NO: 4929437 - DNA, 16 bp, Homo sapiens
ccttccaggacccctg

SEQ ID NO: 4929438 - DNA, 12 bp, Homo sapiens
ccttccatccct

SEQ ID NO: 4929439 - DNA, 18 bp, Homo sapiens
ccttccatgtcgcctctg

SEQ ID NO: 4929440 - DNA, 15 bp, Homo sapiens
ccttcccatgccctg

SEQ ID NO: 4929441 - DNA, 15 bp, Homo sapiens
ccttcccctccctgg

SEQ ID NO: 4929442 - DNA, 16 bp, Homo sapiens
ccttcccctccttctc

SEQ ID NO: 4929443 - DNA, 13 bp, Homo sapiens
ccttccctgcact

SEQ ID NO: 4929444 - DNA, 12 bp, Homo sapiens
ccttcccttgcc

SEQ ID NO: 4929445 - DNA, 16 bp, Homo sapiens
ccttcccttgccactt

SEQ ID NO: 4929446 - DNA, 20 bp, Homo sapiens
ccttcccttgccactttgca

SEQ ID NO: 4929447 - DNA, 18 bp, Homo sapiens
ccttccgaccctctggga

SEQ ID NO: 4929448 - DNA, 19 bp, Homo sapiens
ccttccgccccttcccttc

SEQ ID NO: 4929449 - DNA, 9 bp, Homo sapiens
ccttcctaa

SEQ ID NO: 4929450 - DNA, 18 bp, Homo sapiens
ccttcctaccctcctgca

SEQ ID NO: 4929451 - DNA, 16 bp, Homo sapiens
ccttcctcatccaccc

SEQ ID NO: 4929452 - DNA, 17 bp, Homo sapiens
ccttcctcatccacccc

SEQ ID NO: 4929453 - DNA, 15 bp, Homo sapiens
ccttcctctggggct

SEQ ID NO: 4929454 - DNA, 22 bp, Homo sapiens
ccttcctctggggctctagggt

SEQ ID NO: 4929455 - DNA, 16 bp, Homo sapiens
ccttccttcccgccag

SEQ ID NO: 4929456 - DNA, 14 bp, Homo sapiens
ccttcctttctcca

SEQ ID NO: 4929457 - DNA, 15 bp, Homo sapiens
ccttcgatacaccgg

SEQ ID NO: 4929458 - DNA, 17 bp, Homo sapiens
cgaaataacaatgttaa

SEQ ID NO: 4929459 - DNA, 11 bp, Homo sapiens
cgaacaaaaca

SEQ ID NO: 4929460 - DNA, 19 bp, Homo sapiens
cgaacatccaaccttccca

SEQ ID NO: 4929461 - DNA, 23 bp, Homo sapiens
cgaaccgtgagcaggaaggcctg

SEQ ID NO: 4929462 - DNA, 14 bp, Homo sapiens
cgaactggctgcaa

SEQ ID NO: 4929463 - DNA, 14 bp, Homo sapiens
cgaagaagatgctc

SEQ ID NO: 4929464 - DNA, 16 bp, Homo sapiens
cgaaggtgctggaggt

SEQ ID NO: 4929465 - DNA, 22 bp, Homo sapiens
cgaagtggactggcccctgggt

SEQ ID NO: 4929466 - DNA, 18 bp, Homo sapiens
cgaatccaagctccctgc

SEQ ID NO: 4929467 - DNA, 17 bp, Homo sapiens
cgaatctactaattcca

SEQ ID NO: 4929468 - DNA, 20 bp, Homo sapiens
cgaatggactttggaagcag

SEQ ID NO: 4929469 - DNA, 14 bp, Homo sapiens
cgaattaatagctt

SEQ ID NO: 4929470 - DNA, 16 bp, Homo sapiens
cgaattaatagctttt

SEQ ID NO: 4929471 - DNA, 23 bp, Homo sapiens
cgacaggcgagagaggagccaga

SEQ ID NO: 4929472 - DNA, 22 bp, Homo sapiens
cgacatagcccatccctgcctg

SEQ ID NO: 4929473 - DNA, 19 bp, Homo sapiens
cgaccccccgtgggctccc

SEQ ID NO: 4929474 - DNA, 21 bp, Homo sapiens
cgaccctctgggaacctccca

SEQ ID NO: 4929475 - DNA, 22 bp, Homo sapiens
cgaccctctgggaacctcccag

SEQ ID NO: 4929476 - DNA, 13 bp, Homo sapiens
cgacgctgcagag

SEQ ID NO: 4929477 - DNA, 14 bp, Homo sapiens
cgactaatttcaaa

SEQ ID NO: 4929478 - DNA, 14 bp, Homo sapiens
cgagcaaagatcaa

SEQ ID NO: 4929479 - DNA, 15 bp, Homo sapiens
cgagcaaagatcaaa

SEQ ID NO: 4929480 - DNA, 20 bp, Homo sapiens
cgagcaaagatcaaaataaa

SEQ ID NO: 4929481 - DNA, 23 bp, Homo sapiens
cgagcagtcctgcctcagcctcc

SEQ ID NO: 4929482 - DNA, 15 bp, Homo sapiens
cgagccctggtggca

SEQ ID NO: 4929483 - DNA, 16 bp, Homo sapiens
cgagccctggtggcag

SEQ ID NO: 4929484 - DNA, 15 bp, Homo sapiens
cgagctccagagcaa

SEQ ID NO: 4929485 - DNA, 13 bp, Homo sapiens
cgaggacagggag

SEQ ID NO: 4929486 - DNA, 14 bp, Homo sapiens
cgaggacagggagg

SEQ ID NO: 4929487 - DNA, 16 bp, Homo sapiens
cgaggacagggaggtg

SEQ ID NO: 4929488 - DNA, 18 bp, Homo sapiens
cgaggccttctctgaagg

SEQ ID NO: 4929489 - DNA, 21 bp, Homo sapiens
cgagggcagggaccacaccct

SEQ ID NO: 4929490 - DNA, 14 bp, Homo sapiens
cgagtcaccttcca

SEQ ID NO: 4929491 - DNA, 17 bp, Homo sapiens
cgagtctcttctccact

SEQ ID NO: 4929492 - DNA, 18 bp, Homo sapiens
cgagtctcttctccactg

SEQ ID NO: 4929493 - DNA, 16 bp, Homo sapiens
cgagtctgggacacaa

SEQ ID NO: 4929494 - DNA, 17 bp, Homo sapiens
cgagtgagacaaaattt

SEQ ID NO: 4929495 - DNA, 22 bp, Homo sapiens
cgatatttttaaagatctgtaa

SEQ ID NO: 4929496 - DNA, 22 bp, Homo sapiens
cgatccacctgtctcagcctcc

SEQ ID NO: 4929497 - DNA, 14 bp, Homo sapiens
cgatcccacacagg

SEQ ID NO: 4929498 - DNA, 17 bp, Homo sapiens
cgatcctgccaccctgt

SEQ ID NO: 4929499 - DNA, 19 bp, Homo sapiens
cgatctgggttcactgcaa

SEQ ID NO: 4929500 - DNA, 13 bp, Homo sapiens
cgattcttctgct

SEQ ID NO: 4929501 - DNA, 20 bp, Homo sapiens
cgcaagatagatttggaata

SEQ ID NO: 4929502 - DNA, 14 bp, Homo sapiens
cgcacacacacaca

SEQ ID NO: 4929503 - DNA, 18 bp, Homo sapiens
cgcacacacacacataca

SEQ ID NO: 4929504 - DNA, 17 bp, Homo sapiens
cgcaccccccaagctgt

SEQ ID NO: 4929505 - DNA, 21 bp, Homo sapiens
cgcacccccctgttctaaggg

SEQ ID NO: 4929506 - DNA, 15 bp, Homo sapiens
cgcacgcacacacac

SEQ ID NO: 4929507 - DNA, 19 bp, Homo sapiens
cgcagacctccccagcccc

SEQ ID NO: 4929508 - DNA, 10 bp, Homo sapiens
cgcagccctg

SEQ ID NO: 4929509 - DNA, 16 bp, Homo sapiens
cgcagccctggcaggg

SEQ ID NO: 4929510 - DNA, 16 bp, Homo sapiens
cgccaagtgcgtgccg

SEQ ID NO: 4929511 - DNA, 21 bp, Homo sapiens
cgccacacagaccaccatcca

SEQ ID NO: 4929512 - DNA, 18 bp, Homo sapiens
cgccaccgccacccgcag

SEQ ID NO: 4929513 - DNA, 15 bp, Homo sapiens
cgccactcgcttccc

SEQ ID NO: 4929514 - DNA, 13 bp, Homo sapiens
cgccatcagccca

SEQ ID NO: 4929515 - DNA, 14 bp, Homo sapiens
cgccattgccacca

SEQ ID NO: 4929516 - DNA, 22 bp, Homo sapiens
cgcccacaggaagcctgcagtc

SEQ ID NO: 4929517 - DNA, 22 bp, Homo sapiens
cgcccagttgggtggatgcctg

SEQ ID NO: 4929518 - DNA, 18 bp, Homo sapiens
cgcccatgcactggggac

SEQ ID NO: 4929519 - DNA, 18 bp, Homo sapiens
cgcccgcccctgcagcac

SEQ ID NO: 4929520 - DNA, 16 bp, Homo sapiens
cgccctcctttctgtg

SEQ ID NO: 4929521 - DNA, 21 bp, Homo sapiens
cgcccttagtcccccaactct

SEQ ID NO: 4929522 - DNA, 17 bp, Homo sapiens
cgcccttggcttctgtg

SEQ ID NO: 4929523 - DNA, 16 bp, Homo sapiens
cgccggggacagaggc

SEQ ID NO: 4929524 - DNA, 18 bp, Homo sapiens
cgcctaaggtcacagcta

SEQ ID NO: 4929525 - DNA, 20 bp, Homo sapiens
cgcctaaggtcacagctagt

SEQ ID NO: 4929526 - DNA, 13 bp, Homo sapiens
cgcctcaaaatgt

SEQ ID NO: 4929527 - DNA, 21 bp, Homo sapiens
cgcctcactgcaaccttcacc

SEQ ID NO: 4929528 - DNA, 14 bp, Homo sapiens
cgcctcccagcctg

SEQ ID NO: 4929529 - DNA, 16 bp, Homo sapiens
cgcctgacagaaacca

SEQ ID NO: 4929530 - DNA, 17 bp, Homo sapiens
cgcctgccctcatggcc

SEQ ID NO: 4929531 - DNA, 15 bp, Homo sapiens
cgcctggatttctgg

SEQ ID NO: 4929532 - DNA, 20 bp, Homo sapiens
cgcctggatttctggttctg

SEQ ID NO: 4929533 - DNA, 22 bp, Homo sapiens
cgccttccgccccttcccttcc

SEQ ID NO: 4929534 - DNA, 14 bp, Homo sapiens
cgcgatcccacaca

SEQ ID NO: 4929535 - DNA, 16 bp, Homo sapiens
cgcgatcccacacagg

SEQ ID NO: 4929536 - DNA, 12 bp, Homo sapiens
cgcgcacacaca

SEQ ID NO: 4929537 - DNA, 22 bp, Homo sapiens
cgcggccagccccggccctggg

SEQ ID NO: 4929538 - DNA, 20 bp, Homo sapiens
cgcgtgcacacaccagagcc

SEQ ID NO: 4929539 - DNA, 12 bp, Homo sapiens
cgctaaggaaga

SEQ ID NO: 4929540 - DNA, 13 bp, Homo sapiens
cgctattacaaat

SEQ ID NO: 4929541 - DNA, 14 bp, Homo sapiens
cgctattacaaata

SEQ ID NO: 4929542 - DNA, 15 bp, Homo sapiens
cgctcgtgtgttcta

SEQ ID NO: 4929543 - DNA, 23 bp, Homo sapiens
cgctcgtgtgttctatccaaaca

SEQ ID NO: 4929544 - DNA, 13 bp, Homo sapiens
cgctctcttttct

SEQ ID NO: 4929545 - DNA, 24 bp, Homo sapiens
cgctcttcgcgcccgcccctgcag

SEQ ID NO: 4929546 - DNA, 21 bp, Homo sapiens
cgctcttggcaggtactcagc

SEQ ID NO: 4929547 - DNA, 16 bp, Homo sapiens
cgctgacttcatggaa

SEQ ID NO: 4929548 - DNA, 20 bp, Homo sapiens
cgctgagtatggagcagcct

SEQ ID NO: 4929549 - DNA, 20 bp, Homo sapiens
cgctgagtgggagaaggcag

SEQ ID NO: 4929550 - DNA, 23 bp, Homo sapiens
cgctggaccttgaactgggtact

SEQ ID NO: 4929551 - DNA, 14 bp, Homo sapiens
cgctgggtggtacc

SEQ ID NO: 4929552 - DNA, 13 bp, Homo sapiens
cgcttcccccata

SEQ ID NO: 4929553 - DNA, 18 bp, Homo sapiens
cgcttcccccatagccac

SEQ ID NO: 4929554 - DNA, 18 bp, Homo sapiens
cgcttgtaaataccagga

SEQ ID NO: 4929555 - DNA, 16 bp, Homo sapiens
cgctttctacccagcg

SEQ ID NO: 4929556 - DNA, 17 bp, Homo sapiens
cggaacccaagcttaga

SEQ ID NO: 4929557 - DNA, 19 bp, Homo sapiens
cggaacccaagcttagaac

SEQ ID NO: 4929558 - DNA, 16 bp, Homo sapiens
cggaatagttggctag

SEQ ID NO: 4929559 - DNA, 17 bp, Homo sapiens
cggaatagttggctagg

SEQ ID NO: 4929560 - DNA, 16 bp, Homo sapiens
cggacactcctagaga

SEQ ID NO: 4929561 - DNA, 20 bp, Homo sapiens
cggacagccacggccaggcc

SEQ ID NO: 4929562 - DNA, 22 bp, Homo sapiens
cggaccgcttgtggggacccag

SEQ ID NO: 4929563 - DNA, 20 bp, Homo sapiens
cggactaagcctacctgctc

SEQ ID NO: 4929564 - DNA, 21 bp, Homo sapiens
cggactaagcctacctgctct

SEQ ID NO: 4929565 - DNA, 19 bp, Homo sapiens
cggactcctcctttctcct

SEQ ID NO: 4929566 - DNA, 15 bp, Homo sapiens
cggagacggagtccc

SEQ ID NO: 4929567 - DNA, 20 bp, Homo sapiens
cggagacggagtcccacctt

SEQ ID NO: 4929568 - DNA, 18 bp, Homo sapiens
cggagatatgaagagcaa

SEQ ID NO: 4929569 - DNA, 14 bp, Homo sapiens
cggagccccaggcc

SEQ ID NO: 4929570 - DNA, 16 bp, Homo sapiens
cggaggcaaagctggc

SEQ ID NO: 4929571 - DNA, 23 bp, Homo sapiens
cggagggtgggggccacctgcct

SEQ ID NO: 4929572 - DNA, 20 bp, Homo sapiens
cggagtcccaccttggctgc

SEQ ID NO: 4929573 - DNA, 17 bp, Homo sapiens
cggatcctaagcatcta

SEQ ID NO: 4929574 - DNA, 19 bp, Homo sapiens
cggatcctaagcatctaag

SEQ ID NO: 4929575 - DNA, 15 bp, Homo sapiens
cggattgcgttcctc

SEQ ID NO: 4929576 - DNA, 12 bp, Homo sapiens
cggcaggccctg

SEQ ID NO: 4929577 - DNA, 13 bp, Homo sapiens
cggcaggccctgc

SEQ ID NO: 4929578 - DNA, 14 bp, Homo sapiens
cggcatttcaaatg

SEQ ID NO: 4929579 - DNA, 23 bp, Homo sapiens
cggccaagataggaccttgggcc

SEQ ID NO: 4929580 - DNA, 12 bp, Homo sapiens
cggccaatggaa

SEQ ID NO: 4929581 - DNA, 11 bp, Homo sapiens
cggccaggcca

SEQ ID NO: 4929582 - DNA, 20 bp, Homo sapiens
cggccaggccagagggagtg

SEQ ID NO: 4929583 - DNA, 12 bp, Homo sapiens
cggccccctgcc

SEQ ID NO: 4929584 - DNA, 18 bp, Homo sapiens
cggccccctggtctctgg

SEQ ID NO: 4929585 - DNA, 22 bp, Homo sapiens
cggccctgcaatgtatcccttc

SEQ ID NO: 4929586 - DNA, 18 bp, Homo sapiens
cggccctgggctcggagg

SEQ ID NO: 4929587 - DNA, 15 bp, Homo sapiens
cggccgctccaccag

SEQ ID NO: 4929588 - DNA, 15 bp, Homo sapiens
cggcctcccaaagtg

SEQ ID NO: 4929589 - DNA, 23 bp, Homo sapiens
cggcctcctcttcaccccggcag

SEQ ID NO: 4929590 - DNA, 16 bp, Homo sapiens
cggcgcttcccagcac

SEQ ID NO: 4929591 - DNA, 15 bp, Homo sapiens
cggctcactgcagcc

SEQ ID NO: 4929592 - DNA, 16 bp, Homo sapiens
cggctcactgcagcct

SEQ ID NO: 4929593 - DNA, 18 bp, Homo sapiens
cggctcactgcagcctca

SEQ ID NO: 4929594 - DNA, 14 bp, Homo sapiens
cggctccaggctcc

SEQ ID NO: 4929595 - DNA, 17 bp, Homo sapiens
cggctccccatgtgtcc

SEQ ID NO: 4929596 - DNA, 15 bp, Homo sapiens
cgggaacagacaaca

SEQ ID NO: 4929597 - DNA, 14 bp, Homo sapiens
cgggagcatctctt

SEQ ID NO: 4929598 - DNA, 22 bp, Homo sapiens
cgggagcatctcttgaggccag

SEQ ID NO: 4929599 - DNA, 21 bp, Homo sapiens
cgggaggatgttctgggacac

SEQ ID NO: 4929600 - DNA, 16 bp, Homo sapiens
cgggaggcagagtttg

SEQ ID NO: 4929601 - DNA, 15 bp, Homo sapiens
cgggcaccagccagc

SEQ ID NO: 4929602 - DNA, 15 bp, Homo sapiens
cgggcatgggcactc

SEQ ID NO: 4929603 - DNA, 17 bp, Homo sapiens
cgggcatgggcactccc

SEQ ID NO: 4929604 - DNA, 20 bp, Homo sapiens
cgggcgcgatcccacacagg

SEQ ID NO: 4929605 - DNA, 16 bp, Homo sapiens
cgggcgcggccagccc

SEQ ID NO: 4929606 - DNA, 16 bp, Homo sapiens
cgggctgggagctctg

SEQ ID NO: 4929607 - DNA, 17 bp, Homo sapiens
cggggacagaggcctgc

SEQ ID NO: 4929608 - DNA, 18 bp, Homo sapiens
cggggacagaggcctgcc

SEQ ID NO: 4929609 - DNA, 15 bp, Homo sapiens
cggggacagctcctt

SEQ ID NO: 4929610 - DNA, 23 bp, Homo sapiens
cggggacagctccttctgtccta

SEQ ID NO: 4929611 - DNA, 14 bp, Homo sapiens
cggggccccagggc

SEQ ID NO: 4929612 - DNA, 18 bp, Homo sapiens
cggggcctcgggacctca

SEQ ID NO: 4929613 - DNA, 21 bp, Homo sapiens
cggggtatcctgggggaccca

SEQ ID NO: 4929614 - DNA, 15 bp, Homo sapiens
cggtagggaggcagc

SEQ ID NO: 4929615 - DNA, 19 bp, Homo sapiens
cggtagggaggcagcctcc

SEQ ID NO: 4929616 - DNA, 16 bp, Homo sapiens
cggtccacccaggagc

SEQ ID NO: 4929617 - DNA, 20 bp, Homo sapiens
cggtccacccaggagccccg

SEQ ID NO: 4929618 - DNA, 21 bp, Homo sapiens
cggtccagctggcctggacag

SEQ ID NO: 4929619 - DNA, 18 bp, Homo sapiens
cggtgaaggtgacagcag

SEQ ID NO: 4929620 - DNA, 20 bp, Homo sapiens
cggtgagaggggaacagact

SEQ ID NO: 4929621 - DNA, 17 bp, Homo sapiens
cggtggcggccccagca

SEQ ID NO: 4929622 - DNA, 20 bp, Homo sapiens
cggttatgaaattcaccccc

SEQ ID NO: 4929623 - DNA, 14 bp, Homo sapiens
cgtaaccagccaga

SEQ ID NO: 4929624 - DNA, 16 bp, Homo sapiens
cgtaagtttaaaggat

SEQ ID NO: 4929625 - DNA, 17 bp, Homo sapiens
cgtaataattattatta

SEQ ID NO: 4929626 - DNA, 21 bp, Homo sapiens
cgtaggatgaaaagattcttc

SEQ ID NO: 4929627 - DNA, 16 bp, Homo sapiens
cgtatcccgagtctgg

SEQ ID NO: 4929628 - DNA, 12 bp, Homo sapiens
cgtatgaaaatg

SEQ ID NO: 4929629 - DNA, 17 bp, Homo sapiens
cgtcagaagcacccagg

SEQ ID NO: 4929630 - DNA, 19 bp, Homo sapiens
cgtcagggttggtgtgctg

SEQ ID NO: 4929631 - DNA, 22 bp, Homo sapiens
cgtcctcacccctgtcctcact

SEQ ID NO: 4929632 - DNA, 16 bp, Homo sapiens
cgtcgaggggctctca

SEQ ID NO: 4929633 - DNA, 15 bp, Homo sapiens
cgtctgaagcttgac

SEQ ID NO: 4929634 - DNA, 13 bp, Homo sapiens
cgtctgacaggca

SEQ ID NO: 4929635 - DNA, 21 bp, Homo sapiens
cgtctgacaggcaatgctggc

SEQ ID NO: 4929636 - DNA, 18 bp, Homo sapiens
cgtctgtcttcacagctc

SEQ ID NO: 4929637 - DNA, 18 bp, Homo sapiens
cgtcttccgcccctgcct

SEQ ID NO: 4929638 - DNA, 16 bp, Homo sapiens
cgtgaaaacggagctg

SEQ ID NO: 4929639 - DNA, 15 bp, Homo sapiens
cgtgacaacacttgt

SEQ ID NO: 4929640 - DNA, 14 bp, Homo sapiens
cgtgagccaccgcg

SEQ ID NO: 4929641 - DNA, 14 bp, Homo sapiens
cgtgagccactgca

SEQ ID NO: 4929642 - DNA, 20 bp, Homo sapiens
cgtgagcgcctgtgcacaca

SEQ ID NO: 4929643 - DNA, 16 bp, Homo sapiens
cgtgaggtcccaggaa

SEQ ID NO: 4929644 - DNA, 18 bp, Homo sapiens
cgtgcacacaccagagcc

SEQ ID NO: 4929645 - DNA, 20 bp, Homo sapiens
cgtgcacacaccagagccca

SEQ ID NO: 4929646 - DNA, 22 bp, Homo sapiens
cgtgcacacaccagagcccacc

SEQ ID NO: 4929647 - DNA, 17 bp, Homo sapiens
cgtgcacgtggagagct

SEQ ID NO: 4929648 - DNA, 22 bp, Homo sapiens
cgtgcagtggtgcgatctgggt

SEQ ID NO: 4929649 - DNA, 21 bp, Homo sapiens
cgtgcattagcacagatttta

SEQ ID NO: 4929650 - DNA, 15 bp, Homo sapiens
cgtgccttcagctct

SEQ ID NO: 4929651 - DNA, 19 bp, Homo sapiens
cgtggaacctctgtctcat

SEQ ID NO: 4929652 - DNA, 22 bp, Homo sapiens
cgtggagcaggcggtggggaga

SEQ ID NO: 4929653 - DNA, 16 bp, Homo sapiens
cgtggccatccctgtg

SEQ ID NO: 4929654 - DNA, 15 bp, Homo sapiens
cgtggccctgccctc

SEQ ID NO: 4929655 - DNA, 18 bp, Homo sapiens
cgtggccctgccctctcc

SEQ ID NO: 4929656 - DNA, 18 bp, Homo sapiens
cgtggcttcccgctcagc

SEQ ID NO: 4929657 - DNA, 12 bp, Homo sapiens
cgtgggctcccg

SEQ ID NO: 4929658 - DNA, 17 bp, Homo sapiens
cgtgtattgagatttct

SEQ ID NO: 4929659 - DNA, 22 bp, Homo sapiens
cgtgtattgagatttcttaaat

SEQ ID NO: 4929660 - DNA, 12 bp, Homo sapiens
cgtgtctgaatc

SEQ ID NO: 4929661 - DNA, 20 bp, Homo sapiens
cgtgtcttccactttgcata

SEQ ID NO: 4929662 - DNA, 21 bp, Homo sapiens
cgtgtgagtgtgacagggcca

SEQ ID NO: 4929663 - DNA, 22 bp, Homo sapiens
cgtgtgtagagttaagaagctg

SEQ ID NO: 4929664 - DNA, 16 bp, Homo sapiens
cgtgtgtgttgtctga

SEQ ID NO: 4929665 - DNA, 21 bp, Homo sapiens
cgtgttttattcctgtatgtt

SEQ ID NO: 4929666 - DNA, 21 bp, Homo sapiens
cgttactcagggctcctccca

SEQ ID NO: 4929667 - DNA, 12 bp, Homo sapiens
cgttcatttgtg

SEQ ID NO: 4929668 - DNA, 12 bp, Homo sapiens
cgttccacagtt

SEQ ID NO: 4929669 - DNA, 16 bp, Homo sapiens
cgttccacagttgcca

SEQ ID NO: 4929670 - DNA, 19 bp, Homo sapiens
cgttccacagttgccacca

SEQ ID NO: 4929671 - DNA, 22 bp, Homo sapiens
cgttccacagttgccaccacct

SEQ ID NO: 4929672 - DNA, 14 bp, Homo sapiens
cgttggtccagagc

SEQ ID NO: 4929673 - DNA, 21 bp, Homo sapiens
cgtttagaccaaggaacaaaa

SEQ ID NO: 4929674 - DNA, 15 bp, Homo sapiens
cgtttgtatgtgtgt

SEQ ID NO: 4929675 - DNA, 20 bp, Homo sapiens
cgttttgaagctactgtgtg

SEQ ID NO: 4929676 - DNA, 13 bp, Homo sapiens
cgtttttccttta

SEQ ID NO: 4929677 - DNA, 17 bp, Homo sapiens
ctaaaaaacagaggcca

SEQ ID NO: 4929678 - DNA, 11 bp, Homo sapiens
ctaagtattaa

SEQ ID NO: 4929679 - DNA, 14 bp, Homo sapiens
ctaagtctctgtga

SEQ ID NO: 4929680 - DNA, 22 bp, Homo sapiens
ctaagtgatcctcccacctcag

SEQ ID NO: 4929681 - DNA, 12 bp, Homo sapiens
ctaagtttctaa

SEQ ID NO: 4929682 - DNA, 13 bp, Homo sapiens
ctaagtttctaag

SEQ ID NO: 4929683 - DNA, 18 bp, Homo sapiens
ctaagtttctaagattct

SEQ ID NO: 4929684 - DNA, 19 bp, Homo sapiens
ctaagtttctaagattcta

SEQ ID NO: 4929685 - DNA, 23 bp, Homo sapiens
ctaagtttctaagattctaaagg

SEQ ID NO: 4929686 - DNA, 11 bp, Homo sapiens
ctaataaatac

SEQ ID NO: 4929687 - DNA, 20 bp, Homo sapiens
ctaataatgagctattaaaa

SEQ ID NO: 4929688 - DNA, 15 bp, Homo sapiens
ctaataatttctaat

SEQ ID NO: 4929689 - DNA, 16 bp, Homo sapiens
ctaatacctctgtgtg

SEQ ID NO: 4929690 - DNA, 18 bp, Homo sapiens
ctaatatatatgaataaa

SEQ ID NO: 4929691 - DNA, 20 bp, Homo sapiens
ctaatatggccacagtagtc

SEQ ID NO: 4929692 - DNA, 18 bp, Homo sapiens
ctaatatgtaacaagcca

SEQ ID NO: 4929693 - DNA, 18 bp, Homo sapiens
ctaatattaaaaatatgg

SEQ ID NO: 4929694 - DNA, 13 bp, Homo sapiens
ctaatcaaagcca

SEQ ID NO: 4929695 - DNA, 17 bp, Homo sapiens
ctaatcagaaattttta

SEQ ID NO: 4929696 - DNA, 21 bp, Homo sapiens
ctaatctcatacctctgacca

SEQ ID NO: 4929697 - DNA, 13 bp, Homo sapiens
ctaatgagactga

SEQ ID NO: 4929698 - DNA, 19 bp, Homo sapiens
ctaatgggtatttaaacaa

SEQ ID NO: 4929699 - DNA, 19 bp, Homo sapiens
ctaatgtcttcatttcatt

SEQ ID NO: 4929700 - DNA, 22 bp, Homo sapiens
ctaatgtcttcatttcattgta

SEQ ID NO: 4929701 - DNA, 15 bp, Homo sapiens
ctaattaaaaagtta

SEQ ID NO: 4929702 - DNA, 16 bp, Homo sapiens
ctaattaaaaagttaa

SEQ ID NO: 4929703 - DNA, 14 bp, Homo sapiens
ctaatttaaagaga

SEQ ID NO: 4929704 - DNA, 18 bp, Homo sapiens
ctaatttcaaaatgcttt

SEQ ID NO: 4929705 - DNA, 19 bp, Homo sapiens
ctaatttcaaaatgctttt

SEQ ID NO: 4929706 - DNA, 16 bp, Homo sapiens
ctaatttcccttcttg

SEQ ID NO: 4929707 - DNA, 16 bp, Homo sapiens
ctaatttgaggctcag

SEQ ID NO: 4929708 - DNA, 15 bp, Homo sapiens
ctaatttgatgttta

SEQ ID NO: 4929709 - DNA, 21 bp, Homo sapiens
ctaatttgcattaaattcaca

SEQ ID NO: 4929710 - DNA, 15 bp, Homo sapiens
ctaattttagtattc

SEQ ID NO: 4929711 - DNA, 13 bp, Homo sapiens
ctaattttctcaa

SEQ ID NO: 4929712 - DNA, 19 bp, Homo sapiens
ctaattttctcaaaagcat

SEQ ID NO: 4929713 - DNA, 12 bp, Homo sapiens
ctaatttttaag

SEQ ID NO: 4929714 - DNA, 23 bp, Homo sapiens
ctacaaaaaattagaaattggct

SEQ ID NO: 4929715 - DNA, 16 bp, Homo sapiens
ctacaacaagagttta

SEQ ID NO: 4929716 - DNA, 15 bp, Homo sapiens
ctacaagagcagcct

SEQ ID NO: 4929717 - DNA, 20 bp, Homo sapiens
ctacaagagcagcctgtggc

SEQ ID NO: 4929718 - DNA, 12 bp, Homo sapiens
ctacaaggccta

SEQ ID NO: 4929719 - DNA, 17 bp, Homo sapiens
ctacacatttttaaatt

SEQ ID NO: 4929720 - DNA, 19 bp, Homo sapiens
ctacacatttttaaattgt

SEQ ID NO: 4929721 - DNA, 13 bp, Homo sapiens
ctacactgaggag

SEQ ID NO: 4929722 - DNA, 22 bp, Homo sapiens
ctacagacctgctttttgaaat

SEQ ID NO: 4929723 - DNA, 12 bp, Homo sapiens
ctacagagctgt

SEQ ID NO: 4929724 - DNA, 14 bp, Homo sapiens
ctacagagctgtgg

SEQ ID NO: 4929725 - DNA, 15 bp, Homo sapiens
ctacagaggccatgg

SEQ ID NO: 4929726 - DNA, 17 bp, Homo sapiens
ctacagaggccatgggc

SEQ ID NO: 4929727 - DNA, 15 bp, Homo sapiens
ctacagcactactgg

SEQ ID NO: 4929728 - DNA, 22 bp, Homo sapiens
ctacagctaatcagcattctca

SEQ ID NO: 4929729 - DNA, 11 bp, Homo sapiens
ctacagctttc

SEQ ID NO: 4929730 - DNA, 14 bp, Homo sapiens
ctacaggtgtgagt

SEQ ID NO: 4929731 - DNA, 11 bp, Homo sapiens
ctacagtgcca

SEQ ID NO: 4929732 - DNA, 12 bp, Homo sapiens
ctacagtgccaa

SEQ ID NO: 4929733 - DNA, 20 bp, Homo sapiens
ctacagtgccaactcctcac

SEQ ID NO: 4929734 - DNA, 10 bp, Homo sapiens
ctacatgaaa

SEQ ID NO: 4929735 - DNA, 15 bp, Homo sapiens
ctacatgaaacagaa

SEQ ID NO: 4929736 - DNA, 14 bp, Homo sapiens
ctacatgcagccca

SEQ ID NO: 4929737 - DNA, 21 bp, Homo sapiens
ctacatgcagcccatgcccac

SEQ ID NO: 4929738 - DNA, 12 bp, Homo sapiens
ctacattcattt

SEQ ID NO: 4929739 - DNA, 14 bp, Homo sapiens
ctaccaaagcacct

SEQ ID NO: 4929740 - DNA, 16 bp, Homo sapiens
ctaccactcacatgac

SEQ ID NO: 4929741 - DNA, 17 bp, Homo sapiens
ctacccaaaccctaggt

SEQ ID NO: 4929742 - DNA, 18 bp, Homo sapiens
ctacccacacctctgcca

SEQ ID NO: 4929743 - DNA, 20 bp, Homo sapiens
ctacccactatccttcgtga

SEQ ID NO: 4929744 - DNA, 14 bp, Homo sapiens
ctacccacttctaa

SEQ ID NO: 4929745 - DNA, 16 bp, Homo sapiens
ctacccacttctaaat

SEQ ID NO: 4929746 - DNA, 18 bp, Homo sapiens
ctacccagcgagccctgg

SEQ ID NO: 4929747 - DNA, 12 bp, Homo sapiens
ctacccctggct

SEQ ID NO: 4929748 - DNA, 19 bp, Homo sapiens
ctacccctggctgtactgc

SEQ ID NO: 4929749 - DNA, 14 bp, Homo sapiens
ctaccctcccccag

SEQ ID NO: 4929750 - DNA, 19 bp, Homo sapiens
ctacccttaattacttaaa

SEQ ID NO: 4929751 - DNA, 19 bp, Homo sapiens
ctaccgagtctcttctcca

SEQ ID NO: 4929752 - DNA, 21 bp, Homo sapiens
ctaccgagtctcttctccact

SEQ ID NO: 4929753 - DNA, 22 bp, Homo sapiens
ctaccgagtctcttctccactg

SEQ ID NO: 4929754 - DNA, 13 bp, Homo sapiens
ctacctcaggcag

SEQ ID NO: 4929755 - DNA, 14 bp, Homo sapiens
ctacctcaggcagg

SEQ ID NO: 4929756 - DNA, 20 bp, Homo sapiens
ctacctcaggcaggaagggc

SEQ ID NO: 4929757 - DNA, 20 bp, Homo sapiens
ctacctgattggtgcaaccc

SEQ ID NO: 4929758 - DNA, 15 bp, Homo sapiens
ctacctgctctccaa

SEQ ID NO: 4929759 - DNA, 12 bp, Homo sapiens
ctacctgtgcct

SEQ ID NO: 4929760 - DNA, 13 bp, Homo sapiens
ctacctgtgcctg

SEQ ID NO: 4929761 - DNA, 15 bp, Homo sapiens
ctacctgtgtggtac

SEQ ID NO: 4929762 - DNA, 12 bp, Homo sapiens
ctactaattcca

SEQ ID NO: 4929763 - DNA, 14 bp, Homo sapiens
ctactataaagaga

SEQ ID NO: 4929764 - DNA, 22 bp, Homo sapiens
ctactccctgcagatgccaccc

SEQ ID NO: 4929765 - DNA, 13 bp, Homo sapiens
ctactgaaacaga

SEQ ID NO: 4929766 - DNA, 20 bp, Homo sapiens
ctactgaaacagatttcata

SEQ ID NO: 4929767 - DNA, 17 bp, Homo sapiens
ctactgcagctttacat

SEQ ID NO: 4929768 - DNA, 14 bp, Homo sapiens
ctactgggtgtcat

SEQ ID NO: 4929769 - DNA, 20 bp, Homo sapiens
ctactgtacataaacaatga

SEQ ID NO: 4929770 - DNA, 19 bp, Homo sapiens
ctactgtcctacccaccct

SEQ ID NO: 4929771 - DNA, 20 bp, Homo sapiens
ctactgtgtgtgtgaatgaa

SEQ ID NO: 4929772 - DNA, 15 bp, Homo sapiens
ctactgttctaaagc

SEQ ID NO: 4929773 - DNA, 20 bp, Homo sapiens
ctactgttctaaagctctga

SEQ ID NO: 4929774 - DNA, 19 bp, Homo sapiens
ctacttagcatcctaagaa

SEQ ID NO: 4929775 - DNA, 13 bp, Homo sapiens
ctacttcctcctc

SEQ ID NO: 4929776 - DNA, 20 bp, Homo sapiens
ctacttcctcctccccactt

SEQ ID NO: 4929777 - DNA, 20 bp, Homo sapiens
ctacttcctgtgacttcagc

SEQ ID NO: 4929778 - DNA, 17 bp, Homo sapiens
ctacttggtttgtgttc

SEQ ID NO: 4929779 - DNA, 22 bp, Homo sapiens
ctagaaaacaatgcaaaacctt

SEQ ID NO: 4929780 - DNA, 16 bp, Homo sapiens
ctagaaaacatttttt

SEQ ID NO: 4929781 - DNA, 23 bp, Homo sapiens
ctagaaacccaagctcctcctcg

SEQ ID NO: 4929782 - DNA, 21 bp, Homo sapiens
ctagaaacgagttggtgtctt

SEQ ID NO: 4929783 - DNA, 16 bp, Homo sapiens
ctagaaattgacacaa

SEQ ID NO: 4929784 - DNA, 20 bp, Homo sapiens
ctagaaattgacacaagtgg

SEQ ID NO: 4929785 - DNA, 22 bp, Homo sapiens
ctagaacactaactcaccagcc

SEQ ID NO: 4929786 - DNA, 23 bp, Homo sapiens
ctagaacttttttaaataaactt

SEQ ID NO: 4929787 - DNA, 18 bp, Homo sapiens
ctagaagtttcccttcct

SEQ ID NO: 4929788 - DNA, 19 bp, Homo sapiens
ctagaagtttcccttcctc

SEQ ID NO: 4929789 - DNA, 23 bp, Homo sapiens
ctatatttgctagactctagaca

SEQ ID NO: 4929790 - DNA, 16 bp, Homo sapiens
ctatcacctatttcca

SEQ ID NO: 4929791 - DNA, 22 bp, Homo sapiens
ctatcatactactgaaacagat

SEQ ID NO: 4929792 - DNA, 17 bp, Homo sapiens
ctatcatagttaacata

SEQ ID NO: 4929793 - DNA, 12 bp, Homo sapiens
ctatcatttatt

SEQ ID NO: 4929794 - DNA, 19 bp, Homo sapiens
ctatccaaacatgtattta

SEQ ID NO: 4929795 - DNA, 17 bp, Homo sapiens
ctatccatgcaccaaac

SEQ ID NO: 4929796 - DNA, 14 bp, Homo sapiens
ctatccctcacaca

SEQ ID NO: 4929797 - DNA, 11 bp, Homo sapiens
ctatccttggc

SEQ ID NO: 4929798 - DNA, 12 bp, Homo sapiens
ctatccttggca

SEQ ID NO: 4929799 - DNA, 17 bp, Homo sapiens
ctatccttggcaccaaa

SEQ ID NO: 4929800 - DNA, 18 bp, Homo sapiens
ctatccttggcaccaaag

SEQ ID NO: 4929801 - DNA, 20 bp, Homo sapiens
ctatccttggcaccaaagat

SEQ ID NO: 4929802 - DNA, 14 bp, Homo sapiens
ctatctaaagtttg

SEQ ID NO: 4929803 - DNA, 19 bp, Homo sapiens
ctatctcctgacagaaggt

SEQ ID NO: 4929804 - DNA, 21 bp, Homo sapiens
ctatctctgtgtgcacaaata

SEQ ID NO: 4929805 - DNA, 12 bp, Homo sapiens
ctatctgggcct

SEQ ID NO: 4929806 - DNA, 13 bp, Homo sapiens
ctatctgggcctg

SEQ ID NO: 4929807 - DNA, 17 bp, Homo sapiens
ctatctgggcctgggct

SEQ ID NO: 4929808 - DNA, 15 bp, Homo sapiens
ctatgactgctcccc

SEQ ID NO: 4929809 - DNA, 13 bp, Homo sapiens
ctatgaggaaagg

SEQ ID NO: 4929810 - DNA, 16 bp, Homo sapiens
ctatgagtctagatgt

SEQ ID NO: 4929811 - DNA, 17 bp, Homo sapiens
ctatgagtctagatgtt

SEQ ID NO: 4929812 - DNA, 23 bp, Homo sapiens
ctatgatgtgaaacactttgcct

SEQ ID NO: 4929813 - DNA, 12 bp, Homo sapiens
ctatgcacatat

SEQ ID NO: 4929814 - DNA, 22 bp, Homo sapiens
ctatgcacatatggactctgca

SEQ ID NO: 4929815 - DNA, 16 bp, Homo sapiens
ctatggaaaatcagct

SEQ ID NO: 4929816 - DNA, 14 bp, Homo sapiens
ctatggacacaggg

SEQ ID NO: 4929817 - DNA, 23 bp, Homo sapiens
ctatggagcctggcacaggactg

SEQ ID NO: 4929818 - DNA, 17 bp, Homo sapiens
ctatggctgagttctgg

SEQ ID NO: 4929819 - DNA, 15 bp, Homo sapiens
ctatgggagccccag

SEQ ID NO: 4929820 - DNA, 17 bp, Homo sapiens
ctatgggagccccaggg

SEQ ID NO: 4929821 - DNA, 19 bp, Homo sapiens
ctatgggagccccagggtc

SEQ ID NO: 4929822 - DNA, 22 bp, Homo sapiens
ctatggggagaggaactccttg

SEQ ID NO: 4929823 - DNA, 15 bp, Homo sapiens
ctatggttatgaaag

SEQ ID NO: 4929824 - DNA, 13 bp, Homo sapiens
ctatgtaaactac

SEQ ID NO: 4929825 - DNA, 18 bp, Homo sapiens
ctatgtactagtactgtg

SEQ ID NO: 4929826 - DNA, 23 bp, Homo sapiens
ctatgtactagtactgtgtactg

SEQ ID NO: 4929827 - DNA, 15 bp, Homo sapiens
ctatgttactatttt

SEQ ID NO: 4929828 - DNA, 22 bp, Homo sapiens
ctatgttactattttctacaat

SEQ ID NO: 4929829 - DNA, 15 bp, Homo sapiens
ctatgttgcccaggc

SEQ ID NO: 4929830 - DNA, 18 bp, Homo sapiens
ctatgttgcccaggcagg

SEQ ID NO: 4929831 - DNA, 18 bp, Homo sapiens
ctatgttgtggtccatca

SEQ ID NO: 4929832 - DNA, 22 bp, Homo sapiens
ctattaaagtgctaaggttcta

SEQ ID NO: 4929833 - DNA, 23 bp, Homo sapiens
ctattaaagtgctaaggttctaa

SEQ ID NO: 4929834 - DNA, 17 bp, Homo sapiens
ctattaatatatgtatt

SEQ ID NO: 4929835 - DNA, 21 bp, Homo sapiens
ctattaatatatgtattattt

SEQ ID NO: 4929836 - DNA, 22 bp, Homo sapiens
ctattattttcactgtagaatg

SEQ ID NO: 4929837 - DNA, 21 bp, Homo sapiens
ctattcaggagagtagaacag

SEQ ID NO: 4929838 - DNA, 19 bp, Homo sapiens
ctattcagtggcgagaaat

SEQ ID NO: 4929839 - DNA, 16 bp, Homo sapiens
ctattccttctggcct

SEQ ID NO: 4929840 - DNA, 15 bp, Homo sapiens
ctattcgaatgaaaa

SEQ ID NO: 4929841 - DNA, 16 bp, Homo sapiens
ctattctgagaaaaca

SEQ ID NO: 4929842 - DNA, 18 bp, Homo sapiens
ctattctgccactcctga

SEQ ID NO: 4929843 - DNA, 13 bp, Homo sapiens
ctattgacttcaa

SEQ ID NO: 4929844 - DNA, 14 bp, Homo sapiens
ctattgatactctt

SEQ ID NO: 4929845 - DNA, 17 bp, Homo sapiens
ctattgcatttatatgt

SEQ ID NO: 4929846 - DNA, 19 bp, Homo sapiens
ctattgcatttatatgtac

SEQ ID NO: 4929847 - DNA, 18 bp, Homo sapiens
ctatttaaacttataaat

SEQ ID NO: 4929848 - DNA, 13 bp, Homo sapiens
ctatttattaata

SEQ ID NO: 4929849 - DNA, 20 bp, Homo sapiens
ctatttattaatatttaaca

SEQ ID NO: 4929850 - DNA, 13 bp, Homo sapiens
ctatttattttcc

SEQ ID NO: 4929851 - DNA, 16 bp, Homo sapiens
ctatttattttcctaa

SEQ ID NO: 4929852 - DNA, 18 bp, Homo sapiens
ctatttattttcctaaag

SEQ ID NO: 4929853 - DNA, 22 bp, Homo sapiens
ctatttctacacagtgggaact

SEQ ID NO: 4929854 - DNA, 22 bp, Homo sapiens
ctatttctgggtcttttgctac

SEQ ID NO: 4929855 - DNA, 19 bp, Homo sapiens
ctatttgcttatttaataa

SEQ ID NO: 4929856 - DNA, 16 bp, Homo sapiens
ctatttgttttcatgg

SEQ ID NO: 4929857 - DNA, 11 bp, Homo sapiens
ctattttctat

SEQ ID NO: 4929858 - DNA, 19 bp, Homo sapiens
ctattttgacagttatttt

SEQ ID NO: 4929859 - DNA, 13 bp, Homo sapiens
ctattttgatgca

SEQ ID NO: 4929860 - DNA, 14 bp, Homo sapiens
ctattttgatgcag

SEQ ID NO: 4929861 - DNA, 15 bp, Homo sapiens
ctattttgatgcagc

SEQ ID NO: 4929862 - DNA, 23 bp, Homo sapiens
ctcaaaaaaaaaatttttttcct

SEQ ID NO: 4929863 - DNA, 12 bp, Homo sapiens
ctcaaagttttg

SEQ ID NO: 4929864 - DNA, 19 bp, Homo sapiens
ctcaaatcgtccagcgacc

SEQ ID NO: 4929865 - DNA, 13 bp, Homo sapiens
ctcaaatgttcta

SEQ ID NO: 4929866 - DNA, 21 bp, Homo sapiens
ctcaaatgttctaagtttcta

SEQ ID NO: 4929867 - DNA, 22 bp, Homo sapiens
ctcaaatgttctaagtttctaa

SEQ ID NO: 4929868 - DNA, 17 bp, Homo sapiens
ctcaacctcctgggcta

SEQ ID NO: 4929869 - DNA, 16 bp, Homo sapiens
ctcaaccttaagacct

SEQ ID NO: 4929870 - DNA, 16 bp, Homo sapiens
ctcaacgtattgtttc

SEQ ID NO: 4929871 - DNA, 13 bp, Homo sapiens
ctcaactttctgt

SEQ ID NO: 4929872 - DNA, 11 bp, Homo sapiens
ctcaagacaat

SEQ ID NO: 4929873 - DNA, 22 bp, Homo sapiens
ctcaagcagcgaccgccccctc

SEQ ID NO: 4929874 - DNA, 16 bp, Homo sapiens
ctcaagcgattctcct

SEQ ID NO: 4929875 - DNA, 17 bp, Homo sapiens
ctcaagcgattctcctg

SEQ ID NO: 4929876 - DNA, 14 bp, Homo sapiens
ctcaaggttttagg

SEQ ID NO: 4929877 - DNA, 22 bp, Homo sapiens
ctcaaggttttaggttctaaag

SEQ ID NO: 4929878 - DNA, 23 bp, Homo sapiens
ctcaaggttttaggttctaaagt

SEQ ID NO: 4929879 - DNA, 20 bp, Homo sapiens
ctcaagttctaagattctaa

SEQ ID NO: 4929880 - DNA, 13 bp, Homo sapiens
ctcaataaagatt

SEQ ID NO: 4929881 - DNA, 15 bp, Homo sapiens
ctcaatgcactgaca

SEQ ID NO: 4929882 - DNA, 13 bp, Homo sapiens
ctcaatggactgg

SEQ ID NO: 4929883 - DNA, 14 bp, Homo sapiens
ctcaatggactgga

SEQ ID NO: 4929884 - DNA, 20 bp, Homo sapiens
ctcaatggactggaagggga

SEQ ID NO: 4929885 - DNA, 11 bp, Homo sapiens
ctcaatgtgaa

SEQ ID NO: 4929886 - DNA, 12 bp, Homo sapiens
ctcaatgtttga

SEQ ID NO: 4929887 - DNA, 18 bp, Homo sapiens
ctcaatttttgtctcaga

SEQ ID NO: 4929888 - DNA, 16 bp, Homo sapiens
ctcacacaccctgagg

SEQ ID NO: 4929889 - DNA, 19 bp, Homo sapiens
ctcacacctcactctttat

SEQ ID NO: 4929890 - DNA, 15 bp, Homo sapiens
ctcacagcacatgct

SEQ ID NO: 4929891 - DNA, 19 bp, Homo sapiens
ctcacagcacatgctggcc

SEQ ID NO: 4929892 - DNA, 19 bp, Homo sapiens
ctcacagcctctgacccct

SEQ ID NO: 4929893 - DNA, 19 bp, Homo sapiens
ctcacaggttggaagagaa

SEQ ID NO: 4929894 - DNA, 22 bp, Homo sapiens
ctcacaggttggaagagaatca

SEQ ID NO: 4929895 - DNA, 19 bp, Homo sapiens
ctcacagtaacccaaacct

SEQ ID NO: 4929896 - DNA, 17 bp, Homo sapiens
ctcacagtcccactgtg

SEQ ID NO: 4929897 - DNA, 20 bp, Homo sapiens
ctcaccagccccactgccag

SEQ ID NO: 4929898 - DNA, 15 bp, Homo sapiens
ctcaccagccccagt

SEQ ID NO: 4929899 - DNA, 21 bp, Homo sapiens
ctcatttgtcacacactttgg

SEQ ID NO: 4929900 - DNA, 13 bp, Homo sapiens
ctcattttaatgt

SEQ ID NO: 4929901 - DNA, 22 bp, Homo sapiens
ctcatttttttttttgtttctg

SEQ ID NO: 4929902 - DNA, 23 bp, Homo sapiens
ctccaacacaaggctccaagacc

SEQ ID NO: 4929903 - DNA, 20 bp, Homo sapiens
ctccaacagaactaaatgtt

SEQ ID NO: 4929904 - DNA, 16 bp, Homo sapiens
ctccaagacctaggct

SEQ ID NO: 4929905 - DNA, 13 bp, Homo sapiens
ctccaagattcta

SEQ ID NO: 4929906 - DNA, 14 bp, Homo sapiens
ctccaagctccatc

SEQ ID NO: 4929907 - DNA, 19 bp, Homo sapiens
ctccaagctccatctccac

SEQ ID NO: 4929908 - DNA, 16 bp, Homo sapiens
ctccaagtctcagtgg

SEQ ID NO: 4929909 - DNA, 21 bp, Homo sapiens
ctccaagtctcagtggcttca

SEQ ID NO: 4929910 - DNA, 17 bp, Homo sapiens
ctccaatgtctgctgag

SEQ ID NO: 4929911 - DNA, 20 bp, Homo sapiens
ctccaccagcatcacctgcc

SEQ ID NO: 4929912 - DNA, 22 bp, Homo sapiens
ctccaccagcatcacctgcctg

SEQ ID NO: 4929913 - DNA, 13 bp, Homo sapiens
ctccaccctgctc

SEQ ID NO: 4929914 - DNA, 16 bp, Homo sapiens
ctccacccttggcctg

SEQ ID NO: 4929915 - DNA, 12 bp, Homo sapiens
ctccacctacca

SEQ ID NO: 4929916 - DNA, 15 bp, Homo sapiens
ctccacgcgcttcga

SEQ ID NO: 4929917 - DNA, 16 bp, Homo sapiens
ctccactgccttcgat

SEQ ID NO: 4929918 - DNA, 9 bp, Homo sapiens
ctccactgt

SEQ ID NO: 4929919 - DNA, 11 bp, Homo sapiens
ctccactgtca

SEQ ID NO: 4929920 - DNA, 13 bp, Homo sapiens
ctccactgtcaca

SEQ ID NO: 4929921 - DNA, 17 bp, Homo sapiens
ctccactgtgcctttgc

SEQ ID NO: 4929922 - DNA, 15 bp, Homo sapiens
ctccagaagcctctg

SEQ ID NO: 4929923 - DNA, 16 bp, Homo sapiens
ctccagaagcctctgg

SEQ ID NO: 4929924 - DNA, 21 bp, Homo sapiens
ctccagaagcctctggctaga

SEQ ID NO: 4929925 - DNA, 20 bp, Homo sapiens
ctccagaggggctcaggtca

SEQ ID NO: 4929926 - DNA, 20 bp, Homo sapiens
ctccagatttttcggaggcc

SEQ ID NO: 4929927 - DNA, 23 bp, Homo sapiens
ctccagatttttcggaggcccca

SEQ ID NO: 4929928 - DNA, 16 bp, Homo sapiens
ctccagcaacacagcc

SEQ ID NO: 4929929 - DNA, 20 bp, Homo sapiens
ctccagcaacacagcctggg

SEQ ID NO: 4929930 - DNA, 21 bp, Homo sapiens
ctccagcaacacagcctgggc

SEQ ID NO: 4929931 - DNA, 14 bp, Homo sapiens
ctccagcccgggag

SEQ ID NO: 4929932 - DNA, 20 bp, Homo sapiens
ctccagcccgggagcctagg

SEQ ID NO: 4929933 - DNA, 22 bp, Homo sapiens
ctccagcccgggagcctaggac

SEQ ID NO: 4929934 - DNA, 23 bp, Homo sapiens
ctccagcctgcccaagcccaggc

SEQ ID NO: 4929935 - DNA, 14 bp, Homo sapiens
ctccagcctgggca

SEQ ID NO: 4929936 - DNA, 21 bp, Homo sapiens
ctccagctcagaacccagggc

SEQ ID NO: 4929937 - DNA, 23 bp, Homo sapiens
ctccagctcagaacccagggctc

SEQ ID NO: 4929938 - DNA, 15 bp, Homo sapiens
ctccagctgggctct

SEQ ID NO: 4929939 - DNA, 19 bp, Homo sapiens
ctccagctgggctctgcaa

SEQ ID NO: 4929940 - DNA, 22 bp, Homo sapiens
ctccaggcctgcagcaggagtg

SEQ ID NO: 4929941 - DNA, 16 bp, Homo sapiens
ctccaggtctcacggg

SEQ ID NO: 4929942 - DNA, 17 bp, Homo sapiens
ctccaggtggctctgag

SEQ ID NO: 4929943 - DNA, 22 bp, Homo sapiens
ctccagtccccctatccttggc

SEQ ID NO: 4929944 - DNA, 15 bp, Homo sapiens
ctccataaacagact

SEQ ID NO: 4929945 - DNA, 17 bp, Homo sapiens
ctccatcccaacagcca

SEQ ID NO: 4929946 - DNA, 20 bp, Homo sapiens
ctccatcctatccactgggc

SEQ ID NO: 4929947 - DNA, 13 bp, Homo sapiens
ctccatgctgcct

SEQ ID NO: 4929948 - DNA, 15 bp, Homo sapiens
ctccatgtgcctctt

SEQ ID NO: 4929949 - DNA, 13 bp, Homo sapiens
ctccatgtgggct

SEQ ID NO: 4929950 - DNA, 18 bp, Homo sapiens
ctcccaaagtgctgggat

SEQ ID NO: 4929951 - DNA, 22 bp, Homo sapiens
ctcccaaagtgctgggattaca

SEQ ID NO: 4929952 - DNA, 23 bp, Homo sapiens
ctcccaaagtgctgggattacag

SEQ ID NO: 4929953 - DNA, 21 bp, Homo sapiens
ctcccaagacttcattgtccc

SEQ ID NO: 4929954 - DNA, 15 bp, Homo sapiens
ctcccacaggccctt

SEQ ID NO: 4929955 - DNA, 19 bp, Homo sapiens
ctcccacccccatctctcc

SEQ ID NO: 4929956 - DNA, 12 bp, Homo sapiens
ctcccaccctgt

SEQ ID NO: 4929957 - DNA, 20 bp, Homo sapiens
ctcccaccctgtacctcatc

SEQ ID NO: 4929958 - DNA, 16 bp, Homo sapiens
ctcccacctcagcctc

SEQ ID NO: 4929959 - DNA, 17 bp, Homo sapiens
ctcccacctctgtgacc

SEQ ID NO: 4929960 - DNA, 19 bp, Homo sapiens
ctcccacctctgtgacctc

SEQ ID NO: 4929961 - DNA, 14 bp, Homo sapiens
ctcccagaggtcca

SEQ ID NO: 4929962 - DNA, 22 bp, Homo sapiens
ctcccagaggtccagcccatct

SEQ ID NO: 4929963 - DNA, 20 bp, Homo sapiens
ctcccagcttgtaggagctg

SEQ ID NO: 4929964 - DNA, 18 bp, Homo sapiens
ctcccaggaactgggcca

SEQ ID NO: 4929965 - DNA, 16 bp, Homo sapiens
ctcccaggagacagtt

SEQ ID NO: 4929966 - DNA, 17 bp, Homo sapiens
ctcccaggcgccccttc

SEQ ID NO: 4929967 - DNA, 15 bp, Homo sapiens
ctcccatcacctcta

SEQ ID NO: 4929968 - DNA, 19 bp, Homo sapiens
ctcccatcatgcccggtcc

SEQ ID NO: 4929969 - DNA, 16 bp, Homo sapiens
ctcccatgaccatact

SEQ ID NO: 4929970 - DNA, 21 bp, Homo sapiens
ctcccatgaccatactgaggg

SEQ ID NO: 4929971 - DNA, 19 bp, Homo sapiens
ctccccaaccctaggttcc

SEQ ID NO: 4929972 - DNA, 23 bp, Homo sapiens
ctccccaagtggtttccacatgc

SEQ ID NO: 4929973 - DNA, 12 bp, Homo sapiens
ctccccacccct

SEQ ID NO: 4929974 - DNA, 11 bp, Homo sapiens
ctccccagaat

SEQ ID NO: 4929975 - DNA, 11 bp, Homo sapiens
ctccccagtgt

SEQ ID NO: 4929976 - DNA, 15 bp, Homo sapiens
ctccccatcccatgt

SEQ ID NO: 4929977 - DNA, 17 bp, Homo sapiens
ctccccatggagccagc

SEQ ID NO: 4929978 - DNA, 18 bp, Homo sapiens
ctccccatgtgtcctggt

SEQ ID NO: 4929979 - DNA, 21 bp, Homo sapiens
ctccccatgtgtcctggttcc

SEQ ID NO: 4929980 - DNA, 21 bp, Homo sapiens
ctcccccaacccccaccccac

SEQ ID NO: 4929981 - DNA, 19 bp, Homo sapiens
ctcccccatctcccaccct

SEQ ID NO: 4929982 - DNA, 15 bp, Homo sapiens
ctccccgccttccgc

SEQ ID NO: 4929983 - DNA, 22 bp, Homo sapiens
ctccccgccttccgccccttcc

SEQ ID NO: 4929984 - DNA, 13 bp, Homo sapiens
ctcccctcacagc

SEQ ID NO: 4929985 - DNA, 15 bp, Homo sapiens
ctcccctcacagcct

SEQ ID NO: 4929986 - DNA, 19 bp, Homo sapiens
ctcccctcacagcctctga

SEQ ID NO: 4929987 - DNA, 12 bp, Homo sapiens
ctcccctccagc

SEQ ID NO: 4929988 - DNA, 14 bp, Homo sapiens
ctcccctgccattt

SEQ ID NO: 4929989 - DNA, 12 bp, Homo sapiens
ctcccctgccct

SEQ ID NO: 4929990 - DNA, 16 bp, Homo sapiens
ctcccctgccctgctg

SEQ ID NO: 4929991 - DNA, 15 bp, Homo sapiens
ctcccctgctgcagg

SEQ ID NO: 4929992 - DNA, 16 bp, Homo sapiens
ctcccctgctgcaggg

SEQ ID NO: 4929993 - DNA, 14 bp, Homo sapiens
ctcccctgtacctt

SEQ ID NO: 4929994 - DNA, 19 bp, Homo sapiens
ctccccttcctcactgccc

SEQ ID NO: 4929995 - DNA, 22 bp, Homo sapiens
ctccccttgatttaaacacaca

SEQ ID NO: 4929996 - DNA, 23 bp, Homo sapiens
ctccccttgatttaaacacacag

SEQ ID NO: 4929997 - DNA, 22 bp, Homo sapiens
ctcccctttccctcgctatgtg

SEQ ID NO: 4929998 - DNA, 19 bp, Homo sapiens
ctcccgaatagctgggact

SEQ ID NO: 4929999 - DNA, 18 bp, Homo sapiens
ctcccgagtagctgggac

SEQ ID NO: 4930000 - DNA, 16 bp, Homo sapiens
ctcccgccccttccca

SEQ ID NO: 4930001 - DNA, 13 bp, Homo sapiens
ctcccgctgctgc

SEQ ID NO: 4930002 - DNA, 17 bp, Homo sapiens
ctcccgctgctgctgct

SEQ ID NO: 4930003 - DNA, 16 bp, Homo sapiens
ctccctaagccagcct

SEQ ID NO: 4930004 - DNA, 18 bp, Homo sapiens
ctccctatccctcacaca

SEQ ID NO: 4930005 - DNA, 23 bp, Homo sapiens
ctccctcagtgccctcattttat

SEQ ID NO: 4930006 - DNA, 18 bp, Homo sapiens
ctccctcccctgccattt

SEQ ID NO: 4930007 - DNA, 16 bp, Homo sapiens
ctccctcccctgccct

SEQ ID NO: 4930008 - DNA, 23 bp, Homo sapiens
ctccctcccctgccctggtccag

SEQ ID NO: 4930009 - DNA, 16 bp, Homo sapiens
ctcctttctgtgccct

SEQ ID NO: 4930010 - DNA, 17 bp, Homo sapiens
ctcctttctgtgcccta

SEQ ID NO: 4930011 - DNA, 12 bp, Homo sapiens
ctccttttatgt

SEQ ID NO: 4930012 - DNA, 11 bp, Homo sapiens
ctccttttctt

SEQ ID NO: 4930013 - DNA, 17 bp, Homo sapiens
ctccttttcttttgtta

SEQ ID NO: 4930014 - DNA, 21 bp, Homo sapiens
ctccttttcttttgttactgt

SEQ ID NO: 4930015 - DNA, 22 bp, Homo sapiens
ctccttttcttttgttactgtt

SEQ ID NO: 4930016 - DNA, 23 bp, Homo sapiens
ctccttttcttttgttactgttc

SEQ ID NO: 4930017 - DNA, 19 bp, Homo sapiens
ctcgaaacacagaaacctt

SEQ ID NO: 4930018 - DNA, 23 bp, Homo sapiens
ctcgagggcagggaccacaccct

SEQ ID NO: 4930019 - DNA, 19 bp, Homo sapiens
ctcgatccaaattgtgctt

SEQ ID NO: 4930020 - DNA, 19 bp, Homo sapiens
ctcgcacccccctgttcta

SEQ ID NO: 4930021 - DNA, 13 bp, Homo sapiens
ctcgcctctccca

SEQ ID NO: 4930022 - DNA, 14 bp, Homo sapiens
ctcgcctctcccac

SEQ ID NO: 4930023 - DNA, 15 bp, Homo sapiens
ctcgctgcttctgtg

SEQ ID NO: 4930024 - DNA, 14 bp, Homo sapiens
ctcgcttcccccat

SEQ ID NO: 4930025 - DNA, 14 bp, Homo sapiens
ctcgcttgtaaata

SEQ ID NO: 4930026 - DNA, 20 bp, Homo sapiens
ctcggaaccgctcacctaga

SEQ ID NO: 4930027 - DNA, 15 bp, Homo sapiens
ctcggaggctgcccc

SEQ ID NO: 4930028 - DNA, 21 bp, Homo sapiens
ctcggcaactaagcagtccct

SEQ ID NO: 4930029 - DNA, 15 bp, Homo sapiens
ctcggcctcccaaag

SEQ ID NO: 4930030 - DNA, 18 bp, Homo sapiens
ctcggcctcccaaagtgc

SEQ ID NO: 4930031 - DNA, 15 bp, Homo sapiens
ctcgtgagtcattta

SEQ ID NO: 4930032 - DNA, 14 bp, Homo sapiens
ctcgttcctttctc

SEQ ID NO: 4930033 - DNA, 14 bp, Homo sapiens
ctctaaagaccaaa

SEQ ID NO: 4930034 - DNA, 17 bp, Homo sapiens
ctctaaagaccaaactt

SEQ ID NO: 4930035 - DNA, 11 bp, Homo sapiens
ctctaaagcac

SEQ ID NO: 4930036 - DNA, 17 bp, Homo sapiens
ctctacaaactcccact

SEQ ID NO: 4930037 - DNA, 12 bp, Homo sapiens
ctctacatattt

SEQ ID NO: 4930038 - DNA, 15 bp, Homo sapiens
ctctacatcttctgc

SEQ ID NO: 4930039 - DNA, 17 bp, Homo sapiens
ctctacatcttctgcct

SEQ ID NO: 4930040 - DNA, 19 bp, Homo sapiens
ctctacttagcatgtccct

SEQ ID NO: 4930041 - DNA, 13 bp, Homo sapiens
ctctactttccag

SEQ ID NO: 4930042 - DNA, 15 bp, Homo sapiens
ctctactttccaggc

SEQ ID NO: 4930043 - DNA, 17 bp, Homo sapiens
ctctactttccaggcta

SEQ ID NO: 4930044 - DNA, 15 bp, Homo sapiens
ctctagagtccaagg

SEQ ID NO: 4930045 - DNA, 14 bp, Homo sapiens
ctctagggttgctg

SEQ ID NO: 4930046 - DNA, 21 bp, Homo sapiens
ctctagggttgctggagcctg

SEQ ID NO: 4930047 - DNA, 14 bp, Homo sapiens
ctctatctctcaaa

SEQ ID NO: 4930048 - DNA, 15 bp, Homo sapiens
ctctatctgggcctg

SEQ ID NO: 4930049 - DNA, 17 bp, Homo sapiens
ctctatctgggcctggg

SEQ ID NO: 4930050 - DNA, 20 bp, Homo sapiens
ctctatctgggcctgggcta

SEQ ID NO: 4930051 - DNA, 21 bp, Homo sapiens
ctctatgccagctcagtccca

SEQ ID NO: 4930052 - DNA, 16 bp, Homo sapiens
ctctatttatgtttgc

SEQ ID NO: 4930053 - DNA, 23 bp, Homo sapiens
ctctcaaaacttggtatttttca

SEQ ID NO: 4930054 - DNA, 23 bp, Homo sapiens
ctctcaaactaaaagacatttgt

SEQ ID NO: 4930055 - DNA, 15 bp, Homo sapiens
ctctcaatatgctta

SEQ ID NO: 4930056 - DNA, 14 bp, Homo sapiens
ctctcacacacata

SEQ ID NO: 4930057 - DNA, 19 bp, Homo sapiens
ctctcactccccatgccac

SEQ ID NO: 4930058 - DNA, 13 bp, Homo sapiens
ctctcagcccaga

SEQ ID NO: 4930059 - DNA, 16 bp, Homo sapiens
ctctcagctcagcgcc

SEQ ID NO: 4930060 - DNA, 13 bp, Homo sapiens
ctctcaggatcca

SEQ ID NO: 4930061 - DNA, 18 bp, Homo sapiens
ctctcagttaaaatgtga

SEQ ID NO: 4930062 - DNA, 17 bp, Homo sapiens
ctctccaagtctcagtg

SEQ ID NO: 4930063 - DNA, 23 bp, Homo sapiens
ctctccaagtctcagtggcttca

SEQ ID NO: 4930064 - DNA, 14 bp, Homo sapiens
ctctccactgcctt

SEQ ID NO: 4930065 - DNA, 15 bp, Homo sapiens
ctctccactgccttc

SEQ ID NO: 4930066 - DNA, 18 bp, Homo sapiens
ctctccccaacccccatt

SEQ ID NO: 4930067 - DNA, 22 bp, Homo sapiens
ctctccccacccctacccctgg

SEQ ID NO: 4930068 - DNA, 14 bp, Homo sapiens
ctctccccagcaag

SEQ ID NO: 4930069 - DNA, 24 bp, Homo sapiens
ctctccccagcaagtgagagctgg

SEQ ID NO: 4930070 - DNA, 15 bp, Homo sapiens
ctctcccctgccctg

SEQ ID NO: 4930071 - DNA, 17 bp, Homo sapiens
ctctcccctgccctgct

SEQ ID NO: 4930072 - DNA, 18 bp, Homo sapiens
ctctcccctgccctgctg

SEQ ID NO: 4930073 - DNA, 13 bp, Homo sapiens
ctctccctcccct

SEQ ID NO: 4930074 - DNA, 21 bp, Homo sapiens
ctctccgaccagacaccttga

SEQ ID NO: 4930075 - DNA, 15 bp, Homo sapiens
ctctccggtctctct

SEQ ID NO: 4930076 - DNA, 15 bp, Homo sapiens
ctctcctcttgccac

SEQ ID NO: 4930077 - DNA, 16 bp, Homo sapiens
ctctcctcttgccact

SEQ ID NO: 4930078 - DNA, 20 bp, Homo sapiens
ctctcctgtaagccaaagaa

SEQ ID NO: 4930079 - DNA, 19 bp, Homo sapiens
ctctcctgtttcccttccc

SEQ ID NO: 4930080 - DNA, 12 bp, Homo sapiens
ctctccttcctt

SEQ ID NO: 4930081 - DNA, 11 bp, Homo sapiens
ctctccttttc

SEQ ID NO: 4930082 - DNA, 18 bp, Homo sapiens
ctctcgcacctttccaaa

SEQ ID NO: 4930083 - DNA, 15 bp, Homo sapiens
ctctcggctccccat

SEQ ID NO: 4930084 - DNA, 18 bp, Homo sapiens
ctctcggctccccatgtg

SEQ ID NO: 4930085 - DNA, 19 bp, Homo sapiens
ctctcgggttgtgtgtctg

SEQ ID NO: 4930086 - DNA, 13 bp, Homo sapiens
ctctctagcacaa

SEQ ID NO: 4930087 - DNA, 22 bp, Homo sapiens
ctctctagcacaatttgcacta

SEQ ID NO: 4930088 - DNA, 14 bp, Homo sapiens
ctctctccacccta

SEQ ID NO: 4930089 - DNA, 15 bp, Homo sapiens
ctctctcctttgctg

SEQ ID NO: 4930090 - DNA, 21 bp, Homo sapiens
ctctctcttctgctccaccct

SEQ ID NO: 4930091 - DNA, 12 bp, Homo sapiens
ctctctgcagct

SEQ ID NO: 4930092 - DNA, 13 bp, Homo sapiens
ctctctgctgtac

SEQ ID NO: 4930093 - DNA, 20 bp, Homo sapiens
ctctctggaagccctggaga

SEQ ID NO: 4930094 - DNA, 13 bp, Homo sapiens
ctctctgtataaa

SEQ ID NO: 4930095 - DNA, 15 bp, Homo sapiens
ctctctgtataaaca

SEQ ID NO: 4930096 - DNA, 20 bp, Homo sapiens
ctctctgtataaacattaaa

SEQ ID NO: 4930097 - DNA, 15 bp, Homo sapiens
ctctcttcagactct

SEQ ID NO: 4930098 - DNA, 22 bp, Homo sapiens
ctctcttcagactctcagccca

SEQ ID NO: 4930099 - DNA, 11 bp, Homo sapiens
ctctcttcctg

SEQ ID NO: 4930100 - DNA, 14 bp, Homo sapiens
ctctcttcctgccc

SEQ ID NO: 4930101 - DNA, 15 bp, Homo sapiens
ctctcttcctgcccc

SEQ ID NO: 4930102 - DNA, 17 bp, Homo sapiens
ctctcttctgctccacc

SEQ ID NO: 4930103 - DNA, 13 bp, Homo sapiens
ctctcttttcctg

SEQ ID NO: 4930104 - DNA, 12 bp, Homo sapiens
ctctcttttctg

SEQ ID NO: 4930105 - DNA, 18 bp, Homo sapiens
ctctcttttctgtacttc

SEQ ID NO: 4930106 - DNA, 15 bp, Homo sapiens
ctctgaacacaggca

SEQ ID NO: 4930107 - DNA, 20 bp, Homo sapiens
ctctgaacacaggcagcttt

SEQ ID NO: 4930108 - DNA, 14 bp, Homo sapiens
ctctgaactttgga

SEQ ID NO: 4930109 - DNA, 17 bp, Homo sapiens
ctctgaagcatgtttca

SEQ ID NO: 4930110 - DNA, 16 bp, Homo sapiens
ctctgaagcctctggg

SEQ ID NO: 4930111 - DNA, 18 bp, Homo sapiens
ctctgacaagggctgacc

SEQ ID NO: 4930112 - DNA, 20 bp, Homo sapiens
ctctgacaagggctgacctg

SEQ ID NO: 4930113 - DNA, 14 bp, Homo sapiens
ctctgacacacagc

SEQ ID NO: 4930114 - DNA, 17 bp, Homo sapiens
ctctgacacacagctct

SEQ ID NO: 4930115 - DNA, 18 bp, Homo sapiens
ctctgacacacagctctg

SEQ ID NO: 4930116 - DNA, 23 bp, Homo sapiens
ctctgacattatgtggttttaga

SEQ ID NO: 4930117 - DNA, 12 bp, Homo sapiens
ctctgacccctc

SEQ ID NO: 4930118 - DNA, 21 bp, Homo sapiens
ctctgacccctcctcactggc

SEQ ID NO: 4930119 - DNA, 14 bp, Homo sapiens
ctctgacctgcact

SEQ ID NO: 4930120 - DNA, 14 bp, Homo sapiens
ctgacctcttgctg

SEQ ID NO: 4930121 - DNA, 16 bp, Homo sapiens
ctgacctcttgctgtc

SEQ ID NO: 4930122 - DNA, 21 bp, Homo sapiens
ctgacctcttgctgtctctgc

SEQ ID NO: 4930123 - DNA, 23 bp, Homo sapiens
ctgacctcttgctgtctctgctc

SEQ ID NO: 4930124 - DNA, 14 bp, Homo sapiens
ctgacctgcactgg

SEQ ID NO: 4930125 - DNA, 14 bp, Homo sapiens
ctgacctgcctctc

SEQ ID NO: 4930126 - DNA, 21 bp, Homo sapiens
ctgacgcaaaaccactttcct

SEQ ID NO: 4930127 - DNA, 13 bp, Homo sapiens
ctgacggccctgc

SEQ ID NO: 4930128 - DNA, 14 bp, Homo sapiens
ctgacggccctgca

SEQ ID NO: 4930129 - DNA, 16 bp, Homo sapiens
ctgacggccctgcaat

SEQ ID NO: 4930130 - DNA, 22 bp, Homo sapiens
ctgacgtctgaagcttgactcc

SEQ ID NO: 4930131 - DNA, 13 bp, Homo sapiens
ctgactaaatttg

SEQ ID NO: 4930132 - DNA, 18 bp, Homo sapiens
ctgactaaatttggggac

SEQ ID NO: 4930133 - DNA, 18 bp, Homo sapiens
ctgactcctacctgccct

SEQ ID NO: 4930134 - DNA, 20 bp, Homo sapiens
ctgactggttaacagcagtc

SEQ ID NO: 4930135 - DNA, 16 bp, Homo sapiens
ctgactgtcctctccc

SEQ ID NO: 4930136 - DNA, 20 bp, Homo sapiens
ctgacttaagcaaaagaaaa

SEQ ID NO: 4930137 - DNA, 18 bp, Homo sapiens
ctgacttctaatatcatt

SEQ ID NO: 4930138 - DNA, 20 bp, Homo sapiens
ctgacttggggagatggagt

SEQ ID NO: 4930139 - DNA, 21 bp, Homo sapiens
ctgacttggggagatggagtt

SEQ ID NO: 4930140 - DNA, 13 bp, Homo sapiens
ctgagaaaagaac

SEQ ID NO: 4930141 - DNA, 21 bp, Homo sapiens
ctgagaagaggagccctcatc

SEQ ID NO: 4930142 - DNA, 14 bp, Homo sapiens
ctgagaagctgctc

SEQ ID NO: 4930143 - DNA, 21 bp, Homo sapiens
ctgagaagctgctccaggcct

SEQ ID NO: 4930144 - DNA, 19 bp, Homo sapiens
ctgagactcacaggaagga

SEQ ID NO: 4930145 - DNA, 18 bp, Homo sapiens
ctgagagaattggctcaa

SEQ ID NO: 4930146 - DNA, 16 bp, Homo sapiens
ctgagagacatggctt

SEQ ID NO: 4930147 - DNA, 14 bp, Homo sapiens
ctgagaggggaagc

SEQ ID NO: 4930148 - DNA, 17 bp, Homo sapiens
ctgagagtctagattct

SEQ ID NO: 4930149 - DNA, 22 bp, Homo sapiens
ctgagagtctagattctctggc

SEQ ID NO: 4930150 - DNA, 13 bp, Homo sapiens
ctgagattcttca

SEQ ID NO: 4930151 - DNA, 14 bp, Homo sapiens
ctgagccacagcag

SEQ ID NO: 4930152 - DNA, 15 bp, Homo sapiens
ctgagccactctctt

SEQ ID NO: 4930153 - DNA, 19 bp, Homo sapiens
ctgagcccatgttctgccc

SEQ ID NO: 4930154 - DNA, 21 bp, Homo sapiens
ctgagccccagggtgcccaga

SEQ ID NO: 4930155 - DNA, 17 bp, Homo sapiens
ctgagccccgcagacct

SEQ ID NO: 4930156 - DNA, 22 bp, Homo sapiens
ctgagccccgccctcttcctga

SEQ ID NO: 4930157 - DNA, 18 bp, Homo sapiens
ctgagccctactccctgc

SEQ ID NO: 4930158 - DNA, 20 bp, Homo sapiens
ctgagccctactccctgcag

SEQ ID NO: 4930159 - DNA, 18 bp, Homo sapiens
ctgagcctctgctcccca

SEQ ID NO: 4930160 - DNA, 21 bp, Homo sapiens
ctgagcgcctggatttctggt

SEQ ID NO: 4930161 - DNA, 18 bp, Homo sapiens
ctgagcgtccagaaatgg

SEQ ID NO: 4930162 - DNA, 13 bp, Homo sapiens
ctgagctcactcg

SEQ ID NO: 4930163 - DNA, 22 bp, Homo sapiens
ctgaggaaggaggggaagctgc

SEQ ID NO: 4930164 - DNA, 14 bp, Homo sapiens
ctgaggaatccaga

SEQ ID NO: 4930165 - DNA, 17 bp, Homo sapiens
ctgaggaatccagaccc

SEQ ID NO: 4930166 - DNA, 21 bp, Homo sapiens
ctgaggaatccagacccggct

SEQ ID NO: 4930167 - DNA, 16 bp, Homo sapiens
ctgaggaattttcttt

SEQ ID NO: 4930168 - DNA, 20 bp, Homo sapiens
ctgaggacactaaccacgct

SEQ ID NO: 4930169 - DNA, 14 bp, Homo sapiens
ctgaggaccagcca

SEQ ID NO: 4930170 - DNA, 15 bp, Homo sapiens
ctgaggaggcctcca

SEQ ID NO: 4930171 - DNA, 15 bp, Homo sapiens
ctgaggcaggaggat

SEQ ID NO: 4930172 - DNA, 23 bp, Homo sapiens
ctgaggctctgacccagtgagat

SEQ ID NO: 4930173 - DNA, 12 bp, Homo sapiens
ctgagggaccaa

SEQ ID NO: 4930174 - DNA, 16 bp, Homo sapiens
ctgagggaccaactgg

SEQ ID NO: 4930175 - DNA, 18 bp, Homo sapiens
ctgagggaccaactgggc

SEQ ID NO: 4930176 - DNA, 19 bp, Homo sapiens
ctgagggaccaactgggcc

SEQ ID NO: 4930177 - DNA, 21 bp, Homo sapiens
ctgagggaccaactgggccca

SEQ ID NO: 4930178 - DNA, 14 bp, Homo sapiens
ctgagggactctga

SEQ ID NO: 4930179 - DNA, 18 bp, Homo sapiens
ctgagggtccccacctgg

SEQ ID NO: 4930180 - DNA, 18 bp, Homo sapiens
ctgagggtctgggcggcg

SEQ ID NO: 4930181 - DNA, 21 bp, Homo sapiens
ctgaggtttcacccttaaccc

SEQ ID NO: 4930182 - DNA, 13 bp, Homo sapiens
ctgagtatgtgga

SEQ ID NO: 4930183 - DNA, 18 bp, Homo sapiens
ctgagtatgtggaaggca

SEQ ID NO: 4930184 - DNA, 20 bp, Homo sapiens
ctgagtcaatgcgcaaaatg

SEQ ID NO: 4930185 - DNA, 23 bp, Homo sapiens
ctgagtcaccctacctgtgcctg

SEQ ID NO: 4930186 - DNA, 16 bp, Homo sapiens
ctgagtcagggcccag

SEQ ID NO: 4930187 - DNA, 21 bp, Homo sapiens
ctgagtccaagagggtccttt

SEQ ID NO: 4930188 - DNA, 21 bp, Homo sapiens
ctgagtttcattctcctgcct

SEQ ID NO: 4930189 - DNA, 21 bp, Homo sapiens
ctgagttttctctttgtgggg

SEQ ID NO: 4930190 - DNA, 18 bp, Homo sapiens
ctgataaagcacagctgt

SEQ ID NO: 4930191 - DNA, 16 bp, Homo sapiens
ctgatataaattctgt

SEQ ID NO: 4930192 - DNA, 16 bp, Homo sapiens
ctgatatattttccag

SEQ ID NO: 4930193 - DNA, 17 bp, Homo sapiens
ctgatattttacctctt

SEQ ID NO: 4930194 - DNA, 12 bp, Homo sapiens
ctgatctgcgga

SEQ ID NO: 4930195 - DNA, 12 bp, Homo sapiens
ctgatgaaaaca

SEQ ID NO: 4930196 - DNA, 14 bp, Homo sapiens
ctgatgctccctcc

SEQ ID NO: 4930197 - DNA, 15 bp, Homo sapiens
ctgatgctccctccc

SEQ ID NO: 4930198 - DNA, 23 bp, Homo sapiens
ctgatgctccctcccctgccctg

SEQ ID NO: 4930199 - DNA, 24 bp, Homo sapiens
ctgatgctccctcccctgccctgg

SEQ ID NO: 4930200 - DNA, 22 bp, Homo sapiens
ctgatgggcaacccccagcctg

SEQ ID NO: 4930201 - DNA, 16 bp, Homo sapiens
ctgatggtacaggaaa

SEQ ID NO: 4930202 - DNA, 15 bp, Homo sapiens
ctgatgttggaagag

SEQ ID NO: 4930203 - DNA, 17 bp, Homo sapiens
ctgattattttcttcat

SEQ ID NO: 4930204 - DNA, 15 bp, Homo sapiens
ctgattcactgcatg

SEQ ID NO: 4930205 - DNA, 20 bp, Homo sapiens
ctgattcactgcatggctcc

SEQ ID NO: 4930206 - DNA, 17 bp, Homo sapiens
ctgattcccaagctctg

SEQ ID NO: 4930207 - DNA, 19 bp, Homo sapiens
ctgattctgggatgctcct

SEQ ID NO: 4930208 - DNA, 20 bp, Homo sapiens
ctgattgacctgctccgctg

SEQ ID NO: 4930209 - DNA, 23 bp, Homo sapiens
ctgattggcttgtagaattgtta

SEQ ID NO: 4930210 - DNA, 21 bp, Homo sapiens
ctgattgtggatcttttcatt

SEQ ID NO: 4930211 - DNA, 13 bp, Homo sapiens
ctgatttcccctc

SEQ ID NO: 4930212 - DNA, 22 bp, Homo sapiens
ctgatttgcaataaaaatgata

SEQ ID NO: 4930213 - DNA, 12 bp, Homo sapiens
ctgattttaatg

SEQ ID NO: 4930214 - DNA, 23 bp, Homo sapiens
ctgattttaatggattgttaatt

SEQ ID NO: 4930215 - DNA, 21 bp, Homo sapiens
ctgattttcaaagctttttcc

SEQ ID NO: 4930216 - DNA, 21 bp, Homo sapiens
ctgcaaaaatggatattatta

SEQ ID NO: 4930217 - DNA, 18 bp, Homo sapiens
ctgcaaacaaacaccttc

SEQ ID NO: 4930218 - DNA, 14 bp, Homo sapiens
ctgcaaacagaaca

SEQ ID NO: 4930219 - DNA, 20 bp, Homo sapiens
ctgcaaacagaacagggtca

SEQ ID NO: 4930220 - DNA, 12 bp, Homo sapiens
ctgcaaagaaag

SEQ ID NO: 4930221 - DNA, 22 bp, Homo sapiens
ctgcaaagggtatcaggtgctg

SEQ ID NO: 4930222 - DNA, 14 bp, Homo sapiens
ctgcaaggcccaca

SEQ ID NO: 4930223 - DNA, 16 bp, Homo sapiens
ctgcaaggcccacagg

SEQ ID NO: 4930224 - DNA, 19 bp, Homo sapiens
ctgcaaggcccacaggagg

SEQ ID NO: 4930225 - DNA, 17 bp, Homo sapiens
ctgcaaggtctttggtt

SEQ ID NO: 4930226 - DNA, 18 bp, Homo sapiens
ctgcaataacttctgacc

SEQ ID NO: 4930227 - DNA, 16 bp, Homo sapiens
ctgcaatatttgaatt

SEQ ID NO: 4930228 - DNA, 18 bp, Homo sapiens
ctgcaattcaaaagttcc

SEQ ID NO: 4930229 - DNA, 19 bp, Homo sapiens
ctgccccctgctggctctt

SEQ ID NO: 4930230 - DNA, 13 bp, Homo sapiens
ctgcccctccccc

SEQ ID NO: 4930231 - DNA, 14 bp, Homo sapiens
ctgcccctctttct

SEQ ID NO: 4930232 - DNA, 16 bp, Homo sapiens
ctgcccctctttctct

SEQ ID NO: 4930233 - DNA, 22 bp, Homo sapiens
ctgccccttcctttaaaaaact

SEQ ID NO: 4930234 - DNA, 18 bp, Homo sapiens
ctgcccgcacagcagcct

SEQ ID NO: 4930235 - DNA, 21 bp, Homo sapiens
ctgcccgggaaggtcaccagc

SEQ ID NO: 4930236 - DNA, 19 bp, Homo sapiens
ctgccctcatggcccctct

SEQ ID NO: 4930237 - DNA, 20 bp, Homo sapiens
ctgccctcattactgggcct

SEQ ID NO: 4930238 - DNA, 21 bp, Homo sapiens
ctgccctcattactgggcctt

SEQ ID NO: 4930239 - DNA, 20 bp, Homo sapiens
ctgccctccttgtccaccca

SEQ ID NO: 4930240 - DNA, 21 bp, Homo sapiens
ctgccctgctgccgcctccca

SEQ ID NO: 4930241 - DNA, 17 bp, Homo sapiens
ctgccctggaacatcct

SEQ ID NO: 4930242 - DNA, 17 bp, Homo sapiens
ctgccctggcagggtca

SEQ ID NO: 4930243 - DNA, 14 bp, Homo sapiens
ctgccctggtccag

SEQ ID NO: 4930244 - DNA, 20 bp, Homo sapiens
ctgccctggtccagggaagc

SEQ ID NO: 4930245 - DNA, 21 bp, Homo sapiens
ctgccctggtccagggaagct

SEQ ID NO: 4930246 - DNA, 13 bp, Homo sapiens
ctgccctggtgct

SEQ ID NO: 4930247 - DNA, 18 bp, Homo sapiens
ctgccctggtgctgccac

SEQ ID NO: 4930248 - DNA, 20 bp, Homo sapiens
ctgccctggtgctgccacac

SEQ ID NO: 4930249 - DNA, 21 bp, Homo sapiens
ctgcccttcaccccagtggcc

SEQ ID NO: 4930250 - DNA, 18 bp, Homo sapiens
ctgccgccccctcctgaa

SEQ ID NO: 4930251 - DNA, 18 bp, Homo sapiens
ctgccgcctcccagcctg

SEQ ID NO: 4930252 - DNA, 19 bp, Homo sapiens
ctgccgcctcccagcctgg

SEQ ID NO: 4930253 - DNA, 15 bp, Homo sapiens
ctgccgtgccgcctg

SEQ ID NO: 4930254 - DNA, 17 bp, Homo sapiens
ctgccgtgccgcctgca

SEQ ID NO: 4930255 - DNA, 22 bp, Homo sapiens
ctgccgtgccgcctgcactcct

SEQ ID NO: 4930256 - DNA, 19 bp, Homo sapiens
ctgcctagcaagctggcct

SEQ ID NO: 4930257 - DNA, 17 bp, Homo sapiens
ctgcctagctgcctagc

SEQ ID NO: 4930258 - DNA, 18 bp, Homo sapiens
ctgcctagctgcctagca

SEQ ID NO: 4930259 - DNA, 23 bp, Homo sapiens
ctgcctcacttcctacaagagca

SEQ ID NO: 4930260 - DNA, 13 bp, Homo sapiens
ctgcctcagcctc

SEQ ID NO: 4930261 - DNA, 24 bp, Homo sapiens
ctgcctcctcttcaactgaccagc

SEQ ID NO: 4930262 - DNA, 12 bp, Homo sapiens
ctgcctcctgcc

SEQ ID NO: 4930263 - DNA, 19 bp, Homo sapiens
ctgcctcctgcctgcccct

SEQ ID NO: 4930264 - DNA, 15 bp, Homo sapiens
ctgcctcgaaacaca

SEQ ID NO: 4930265 - DNA, 18 bp, Homo sapiens
ctgcctcgaaacacagaa

SEQ ID NO: 4930266 - DNA, 14 bp, Homo sapiens
ctgcctcgaactgg

SEQ ID NO: 4930267 - DNA, 13 bp, Homo sapiens
ctgcctctcacac

SEQ ID NO: 4930268 - DNA, 18 bp, Homo sapiens
ctgcctctgacacacagc

SEQ ID NO: 4930269 - DNA, 16 bp, Homo sapiens
ctgcctctgccacact

SEQ ID NO: 4930270 - DNA, 15 bp, Homo sapiens
ctgcctctgccttag

SEQ ID NO: 4930271 - DNA, 17 bp, Homo sapiens
ctgcctctgccttagag

SEQ ID NO: 4930272 - DNA, 21 bp, Homo sapiens
ctgcctgcagtactttacctc

SEQ ID NO: 4930273 - DNA, 20 bp, Homo sapiens
ctgcctgcccaggcccctgc

SEQ ID NO: 4930274 - DNA, 21 bp, Homo sapiens
ctgcctgcccaggcccctgcc

SEQ ID NO: 4930275 - DNA, 17 bp, Homo sapiens
ctgcctgcccgcacagc

SEQ ID NO: 4930276 - DNA, 20 bp, Homo sapiens
ctgcctgcccgcacagcagc

SEQ ID NO: 4930277 - DNA, 17 bp, Homo sapiens
ctgcctgcgtcttccgc

SEQ ID NO: 4930278 - DNA, 12 bp, Homo sapiens
ctgcctggccag

SEQ ID NO: 4930279 - DNA, 13 bp, Homo sapiens
ctgcctggccagg

SEQ ID NO: 4930280 - DNA, 17 bp, Homo sapiens
ctgcctggccaggcaga

SEQ ID NO: 4930281 - DNA, 12 bp, Homo sapiens
ctgcctgggctg

SEQ ID NO: 4930282 - DNA, 17 bp, Homo sapiens
ctgcctgtagttaggaa

SEQ ID NO: 4930283 - DNA, 19 bp, Homo sapiens
ctgcctgtagttaggaaat

SEQ ID NO: 4930284 - DNA, 21 bp, Homo sapiens
ctgcctgtagttaggaaataa

SEQ ID NO: 4930285 - DNA, 13 bp, Homo sapiens
ctgcctgtatact

SEQ ID NO: 4930286 - DNA, 17 bp, Homo sapiens
ctgcctgtatactttag

SEQ ID NO: 4930287 - DNA, 12 bp, Homo sapiens
ctgcctgtgctg

SEQ ID NO: 4930288 - DNA, 22 bp, Homo sapiens
ctgcctgttaggagaagctgca

SEQ ID NO: 4930289 - DNA, 23 bp, Homo sapiens
ctgcctgttcagctccagctcac

SEQ ID NO: 4930290 - DNA, 15 bp, Homo sapiens
ctgcctgttcccatt

SEQ ID NO: 4930291 - DNA, 23 bp, Homo sapiens
ctgccttagaggagcccacggct

SEQ ID NO: 4930292 - DNA, 19 bp, Homo sapiens
ctgccttaggcctacctga

SEQ ID NO: 4930293 - DNA, 16 bp, Homo sapiens
ctgccttagtctcagt

SEQ ID NO: 4930294 - DNA, 18 bp, Homo sapiens
ctgccttcccatgaatct

SEQ ID NO: 4930295 - DNA, 19 bp, Homo sapiens
ctgccttctgacggccctg

SEQ ID NO: 4930296 - DNA, 20 bp, Homo sapiens
ctgccttctgacggccctgc

SEQ ID NO: 4930297 - DNA, 22 bp, Homo sapiens
ctgccttctgacggccctgcaa

SEQ ID NO: 4930298 - DNA, 17 bp, Homo sapiens
ctgccttggctcagaca

SEQ ID NO: 4930299 - DNA, 17 bp, Homo sapiens
ctgcgcccttaccttcc

SEQ ID NO: 4930300 - DNA, 14 bp, Homo sapiens
ctgcggaccccagc

SEQ ID NO: 4930301 - DNA, 15 bp, Homo sapiens
ctgcggaccccagct

SEQ ID NO: 4930302 - DNA, 20 bp, Homo sapiens
ctgcggtccacccaggagcc

SEQ ID NO: 4930303 - DNA, 17 bp, Homo sapiens
ctgcgtcttccgcccct

SEQ ID NO: 4930304 - DNA, 20 bp, Homo sapiens
ctgcgtgccagtcaagaaga

SEQ ID NO: 4930305 - DNA, 14 bp, Homo sapiens
ctgcgtgggtcaga

SEQ ID NO: 4930306 - DNA, 18 bp, Homo sapiens
ctgcgttggtccagagcg

SEQ ID NO: 4930307 - DNA, 19 bp, Homo sapiens
ctgcgttggtccagagcgg

SEQ ID NO: 4930308 - DNA, 20 bp, Homo sapiens
ctgcgttttggaagctctga

SEQ ID NO: 4930309 - DNA, 16 bp, Homo sapiens
ctgctaattccccaga

SEQ ID NO: 4930310 - DNA, 15 bp, Homo sapiens
ctgctagaacttttt

SEQ ID NO: 4930311 - DNA, 20 bp, Homo sapiens
ctgctagaacttttttaaat

SEQ ID NO: 4930312 - DNA, 21 bp, Homo sapiens
ctgctagaacttttttaaata

SEQ ID NO: 4930313 - DNA, 19 bp, Homo sapiens
ctgctatttattttcctaa

SEQ ID NO: 4930314 - DNA, 16 bp, Homo sapiens
ctgctcacatatctgt

SEQ ID NO: 4930315 - DNA, 18 bp, Homo sapiens
ctgctcagcaacctttca

SEQ ID NO: 4930316 - DNA, 11 bp, Homo sapiens
ctgctcagcca

SEQ ID NO: 4930317 - DNA, 11 bp, Homo sapiens
ctgctccacca

SEQ ID NO: 4930318 - DNA, 13 bp, Homo sapiens
ctgctccaccaca

SEQ ID NO: 4930319 - DNA, 12 bp, Homo sapiens
ctgctccaccct

SEQ ID NO: 4930320 - DNA, 17 bp, Homo sapiens
ctgctccacccttggcc

SEQ ID NO: 4930321 - DNA, 19 bp, Homo sapiens
ctgctccacccttggcctg

SEQ ID NO: 4930322 - DNA, 12 bp, Homo sapiens
ctgctccaggcc

SEQ ID NO: 4930323 - DNA, 16 bp, Homo sapiens
ctgctccccagccctg

SEQ ID NO: 4930324 - DNA, 16 bp, Homo sapiens
ctgctccctgaagcca

SEQ ID NO: 4930325 - DNA, 17 bp, Homo sapiens
ctgctccctgaagccag

SEQ ID NO: 4930326 - DNA, 20 bp, Homo sapiens
ctgctccctgaagccagcct

SEQ ID NO: 4930327 - DNA, 22 bp, Homo sapiens
ctgctccctgaagccagccttc

SEQ ID NO: 4930328 - DNA, 15 bp, Homo sapiens
ctgctccgctgctcc

SEQ ID NO: 4930329 - DNA, 17 bp, Homo sapiens
ctgctccgctgctcctt

SEQ ID NO: 4930330 - DNA, 23 bp, Homo sapiens
ctgctcctctccccagcaagtga

SEQ ID NO: 4930331 - DNA, 13 bp, Homo sapiens
ctgctcctgcagc

SEQ ID NO: 4930332 - DNA, 14 bp, Homo sapiens
ctgctcctgcagca

SEQ ID NO: 4930333 - DNA, 20 bp, Homo sapiens
ctgctccttggcttacctga

SEQ ID NO: 4930334 - DNA, 17 bp, Homo sapiens
ctgctcgccctcctttc

SEQ ID NO: 4930335 - DNA, 21 bp, Homo sapiens
ctgctctattccaaaaaggtt

SEQ ID NO: 4930336 - DNA, 15 bp, Homo sapiens
ctgctctccgaccag

SEQ ID NO: 4930337 - DNA, 20 bp, Homo sapiens
ctgctctcctcttgccactg

SEQ ID NO: 4930338 - DNA, 23 bp, Homo sapiens
ctgctctgagttatgttaaaatc

SEQ ID NO: 4930339 - DNA, 22 bp, Homo sapiens
ctggccgccccctgccccccag

SEQ ID NO: 4930340 - DNA, 20 bp, Homo sapiens
ctggcctaaaatcttggaag

SEQ ID NO: 4930341 - DNA, 14 bp, Homo sapiens
ctggcctctctagc

SEQ ID NO: 4930342 - DNA, 13 bp, Homo sapiens
ctggcctctgtgc

SEQ ID NO: 4930343 - DNA, 14 bp, Homo sapiens
ctggcctctgtgcc

SEQ ID NO: 4930344 - DNA, 16 bp, Homo sapiens
ctggcctctgtgcctt

SEQ ID NO: 4930345 - DNA, 20 bp, Homo sapiens
ctggcctctgtgccttcttt

SEQ ID NO: 4930346 - DNA, 13 bp, Homo sapiens
ctggcctggcaca

SEQ ID NO: 4930347 - DNA, 14 bp, Homo sapiens
ctggcctggcacac

SEQ ID NO: 4930348 - DNA, 18 bp, Homo sapiens
ctggcctggcacacatca

SEQ ID NO: 4930349 - DNA, 15 bp, Homo sapiens
ctggcctggccctgc

SEQ ID NO: 4930350 - DNA, 14 bp, Homo sapiens
ctggcctggcctgg

SEQ ID NO: 4930351 - DNA, 15 bp, Homo sapiens
ctggcctggcctggc

SEQ ID NO: 4930352 - DNA, 18 bp, Homo sapiens
ctggcctggcctggccct

SEQ ID NO: 4930353 - DNA, 23 bp, Homo sapiens
ctggctagaggccagccccaccc

SEQ ID NO: 4930354 - DNA, 20 bp, Homo sapiens
ctggctagagtcctcactcc

SEQ ID NO: 4930355 - DNA, 16 bp, Homo sapiens
ctggctcacagtacag

SEQ ID NO: 4930356 - DNA, 24 bp, Homo sapiens
ctggctcacagtacagcatgtgcc

SEQ ID NO: 4930357 - DNA, 19 bp, Homo sapiens
ctggctcccacaggccctt

SEQ ID NO: 4930358 - DNA, 17 bp, Homo sapiens
ctggctcctgaggggca

SEQ ID NO: 4930359 - DNA, 18 bp, Homo sapiens
ctggctctgcaatgggca

SEQ ID NO: 4930360 - DNA, 24 bp, Homo sapiens
ctggctctgcaatgggcactggga

SEQ ID NO: 4930361 - DNA, 15 bp, Homo sapiens
ctggctcttctgccc

SEQ ID NO: 4930362 - DNA, 21 bp, Homo sapiens
ctggctcttgatacccccctc

SEQ ID NO: 4930363 - DNA, 22 bp, Homo sapiens
ctggctcttgatacccccctct

SEQ ID NO: 4930364 - DNA, 17 bp, Homo sapiens
ctggctcttgtgctgga

SEQ ID NO: 4930365 - DNA, 16 bp, Homo sapiens
ctggctgccccaacct

SEQ ID NO: 4930366 - DNA, 19 bp, Homo sapiens
ctggctgccccaacctgct

SEQ ID NO: 4930367 - DNA, 20 bp, Homo sapiens
ctggctgccccaacctgctg

SEQ ID NO: 4930368 - DNA, 18 bp, Homo sapiens
ctggctgttggctggggg

SEQ ID NO: 4930369 - DNA, 20 bp, Homo sapiens
ctggctgttggctgggggcc

SEQ ID NO: 4930370 - DNA, 21 bp, Homo sapiens
ctggctgtttggactttgtat

SEQ ID NO: 4930371 - DNA, 22 bp, Homo sapiens
ctggcttattttaatgtgatga

SEQ ID NO: 4930372 - DNA, 15 bp, Homo sapiens
ctggcttttcactgc

SEQ ID NO: 4930373 - DNA, 13 bp, Homo sapiens
ctgggaacctccc

SEQ ID NO: 4930374 - DNA, 15 bp, Homo sapiens
ctgggaacctcccag

SEQ ID NO: 4930375 - DNA, 22 bp, Homo sapiens
ctgggaacctcccagaggtcca

SEQ ID NO: 4930376 - DNA, 20 bp, Homo sapiens
ctgggaagctgagggcaaat

SEQ ID NO: 4930377 - DNA, 22 bp, Homo sapiens
ctgggaccacaggttcatgcca

SEQ ID NO: 4930378 - DNA, 17 bp, Homo sapiens
ctgggactacaggtgtg

SEQ ID NO: 4930379 - DNA, 14 bp, Homo sapiens
ctgggagacagacc

SEQ ID NO: 4930380 - DNA, 13 bp, Homo sapiens
ctgggaggcatgg

SEQ ID NO: 4930381 - DNA, 12 bp, Homo sapiens
ctgggagtgagc

SEQ ID NO: 4930382 - DNA, 16 bp, Homo sapiens
ctgggagtgagctggt

SEQ ID NO: 4930383 - DNA, 17 bp, Homo sapiens
ctgggatgagccgctgt

SEQ ID NO: 4930384 - DNA, 21 bp, Homo sapiens
ctgggattacaggcgtgagcc

SEQ ID NO: 4930385 - DNA, 20 bp, Homo sapiens
ctgggattacaggtgtgaac

SEQ ID NO: 4930386 - DNA, 15 bp, Homo sapiens
ctgggcaaggaaaaa

SEQ ID NO: 4930387 - DNA, 19 bp, Homo sapiens
ctgggcaatgatggcaatt

SEQ ID NO: 4930388 - DNA, 17 bp, Homo sapiens
ctgggcacactctgcca

SEQ ID NO: 4930389 - DNA, 18 bp, Homo sapiens
ctgggcacactctgccag

SEQ ID NO: 4930390 - DNA, 17 bp, Homo sapiens
ctgggcagccaggctgc

SEQ ID NO: 4930391 - DNA, 19 bp, Homo sapiens
ctgggccaactcacctgag

SEQ ID NO: 4930392 - DNA, 22 bp, Homo sapiens
ctgggccaattcaatacaaaca

SEQ ID NO: 4930393 - DNA, 23 bp, Homo sapiens
ctgggccaattcaatacaaacaa

SEQ ID NO: 4930394 - DNA, 15 bp, Homo sapiens
ctgggccagggtctg

SEQ ID NO: 4930395 - DNA, 17 bp, Homo sapiens
ctgggccatgtccaaag

SEQ ID NO: 4930396 - DNA, 17 bp, Homo sapiens
ctgggccccccagctca

SEQ ID NO: 4930397 - DNA, 17 bp, Homo sapiens
ctgggcctgttgccctt

SEQ ID NO: 4930398 - DNA, 15 bp, Homo sapiens
ctgggctaggggaca

SEQ ID NO: 4930399 - DNA, 17 bp, Homo sapiens
ctgggctatggacacag

SEQ ID NO: 4930400 - DNA, 19 bp, Homo sapiens
ctgggctatggacacaggg

SEQ ID NO: 4930401 - DNA, 16 bp, Homo sapiens
ctgggctcggaggctg

SEQ ID NO: 4930402 - DNA, 21 bp, Homo sapiens
ctgggctcggaggctgccccc

SEQ ID NO: 4930403 - DNA, 23 bp, Homo sapiens
ctgggctctgcaattcccctctg

SEQ ID NO: 4930404 - DNA, 19 bp, Homo sapiens
ctgggctgctacccagaaa

SEQ ID NO: 4930405 - DNA, 15 bp, Homo sapiens
ctgggctggccagtt

SEQ ID NO: 4930406 - DNA, 12 bp, Homo sapiens
ctgggctgtgtg

SEQ ID NO: 4930407 - DNA, 17 bp, Homo sapiens
ctgggcttcagtggcag

SEQ ID NO: 4930408 - DNA, 22 bp, Homo sapiens
ctggggacctggtaccctcctg

SEQ ID NO: 4930409 - DNA, 16 bp, Homo sapiens
ctggggatgtgggagg

SEQ ID NO: 4930410 - DNA, 22 bp, Homo sapiens
ctggggatgtgggagggagcag

SEQ ID NO: 4930411 - DNA, 19 bp, Homo sapiens
ctggggcacagtccaggaa

SEQ ID NO: 4930412 - DNA, 15 bp, Homo sapiens
ctggggcaggctggg

SEQ ID NO: 4930413 - DNA, 18 bp, Homo sapiens
ctggggcaggctgggcca

SEQ ID NO: 4930414 - DNA, 19 bp, Homo sapiens
ctggggcaggctgggccat

SEQ ID NO: 4930415 - DNA, 19 bp, Homo sapiens
ctggggcctagactctgta

SEQ ID NO: 4930416 - DNA, 15 bp, Homo sapiens
ctggggcctcagacg

SEQ ID NO: 4930417 - DNA, 17 bp, Homo sapiens
ctggggcctccagaact

SEQ ID NO: 4930418 - DNA, 16 bp, Homo sapiens
ctggggcctgagagaa

SEQ ID NO: 4930419 - DNA, 18 bp, Homo sapiens
ctggggcctggacctgcc

SEQ ID NO: 4930420 - DNA, 12 bp, Homo sapiens
ctggggcctggc

SEQ ID NO: 4930421 - DNA, 20 bp, Homo sapiens
ctgggggaatgagcccagag

SEQ ID NO: 4930422 - DNA, 19 bp, Homo sapiens
ctgggggtggggaggtgtc

SEQ ID NO: 4930423 - DNA, 14 bp, Homo sapiens
ctgggtacttgtgg

SEQ ID NO: 4930424 - DNA, 20 bp, Homo sapiens
ctgggtacttgtggacacag

SEQ ID NO: 4930425 - DNA, 21 bp, Homo sapiens
ctgggtacttgtggacacagc

SEQ ID NO: 4930426 - DNA, 23 bp, Homo sapiens
ctgggtacttgtggacacagctc

SEQ ID NO: 4930427 - DNA, 14 bp, Homo sapiens
ctgggtcacacacg

SEQ ID NO: 4930428 - DNA, 17 bp, Homo sapiens
ctgggtcagtctggtgg

SEQ ID NO: 4930429 - DNA, 21 bp, Homo sapiens
ctgggtcctaattaccagtct

SEQ ID NO: 4930430 - DNA, 21 bp, Homo sapiens
ctgggtcttcagcattccctc

SEQ ID NO: 4930431 - DNA, 14 bp, Homo sapiens
ctgggtgcagctga

SEQ ID NO: 4930432 - DNA, 13 bp, Homo sapiens
ctgggtggcctcg

SEQ ID NO: 4930433 - DNA, 21 bp, Homo sapiens
ctgggtgtcatttcattccat

SEQ ID NO: 4930434 - DNA, 20 bp, Homo sapiens
ctgggttcactgcaacctcc

SEQ ID NO: 4930435 - DNA, 14 bp, Homo sapiens
ctgggttccctttc

SEQ ID NO: 4930436 - DNA, 15 bp, Homo sapiens
ctgggttggagggtg

SEQ ID NO: 4930437 - DNA, 18 bp, Homo sapiens
ctggtaacagttcatgtt

SEQ ID NO: 4930438 - DNA, 14 bp, Homo sapiens
ctggtaccctcctg

SEQ ID NO: 4930439 - DNA, 16 bp, Homo sapiens
ctggtaccctcctggc

SEQ ID NO: 4930440 - DNA, 18 bp, Homo sapiens
ctggtactccctctcagg

SEQ ID NO: 4930441 - DNA, 20 bp, Homo sapiens
ctggtactccctctcaggat

SEQ ID NO: 4930442 - DNA, 19 bp, Homo sapiens
ctggtacttagagtttctg

SEQ ID NO: 4930443 - DNA, 13 bp, Homo sapiens
ctggtatggctgc

SEQ ID NO: 4930444 - DNA, 17 bp, Homo sapiens
ctggtatggctgcagtc

SEQ ID NO: 4930445 - DNA, 19 bp, Homo sapiens
ctggtcacaggactctgcc

SEQ ID NO: 4930446 - DNA, 21 bp, Homo sapiens
ctggtcacaggactctgcctc

SEQ ID NO: 4930447 - DNA, 21 bp, Homo sapiens
ctggtccagggaagctggccg

SEQ ID NO: 4930448 - DNA, 19 bp, Homo sapiens
ctgtctcatccccaggggt

SEQ ID NO: 4930449 - DNA, 15 bp, Homo sapiens
ctgtctccactgtgc

SEQ ID NO: 4930450 - DNA, 15 bp, Homo sapiens
ctgtctcttgaaaaa

SEQ ID NO: 4930451 - DNA, 19 bp, Homo sapiens
ctgtctctttaagggcatg

SEQ ID NO: 4930452 - DNA, 21 bp, Homo sapiens
ctgtctgaaccacgcgggggc

SEQ ID NO: 4930453 - DNA, 18 bp, Homo sapiens
ctgtcttgtaatattttg

SEQ ID NO: 4930454 - DNA, 22 bp, Homo sapiens
ctgtcttgtaatattttgtatt

SEQ ID NO: 4930455 - DNA, 17 bp, Homo sapiens
ctgtctttaaaagagag

SEQ ID NO: 4930456 - DNA, 20 bp, Homo sapiens
ctgtctttggaaaaatgttt

SEQ ID NO: 4930457 - DNA, 21 bp, Homo sapiens
ctgtcttttcaggtttgtcat

SEQ ID NO: 4930458 - DNA, 15 bp, Homo sapiens
ctgtgaaactggcac

SEQ ID NO: 4930459 - DNA, 18 bp, Homo sapiens
ctgtgaaagtacatttgg

SEQ ID NO: 4930460 - DNA, 16 bp, Homo sapiens
ctgtgaaatgctggca

SEQ ID NO: 4930461 - DNA, 21 bp, Homo sapiens
ctgtgaacaggctgggctgct

SEQ ID NO: 4930462 - DNA, 14 bp, Homo sapiens
ctgtgactcttttt

SEQ ID NO: 4930463 - DNA, 22 bp, Homo sapiens
ctgtgacttcagctctgtttta

SEQ ID NO: 4930464 - DNA, 16 bp, Homo sapiens
ctgtgacttctccagg

SEQ ID NO: 4930465 - DNA, 15 bp, Homo sapiens
ctgtgagacccccac

SEQ ID NO: 4930466 - DNA, 17 bp, Homo sapiens
ctgtgagacccccacac

SEQ ID NO: 4930467 - DNA, 19 bp, Homo sapiens
ctgtgagacccccacacct

SEQ ID NO: 4930468 - DNA, 23 bp, Homo sapiens
ctgtgagacccccacacctcagt

SEQ ID NO: 4930469 - DNA, 14 bp, Homo sapiens
ctgtgagcccctgg

SEQ ID NO: 4930470 - DNA, 15 bp, Homo sapiens
ctgtgagccttggct

SEQ ID NO: 4930471 - DNA, 18 bp, Homo sapiens
ctgtgagtaaatattgag

SEQ ID NO: 4930472 - DNA, 20 bp, Homo sapiens
ctgtgagtctttggttctaa

SEQ ID NO: 4930473 - DNA, 21 bp, Homo sapiens
ctgtgagtctttggttctaag

SEQ ID NO: 4930474 - DNA, 23 bp, Homo sapiens
ctgtgagtctttggttctaagga

SEQ ID NO: 4930475 - DNA, 19 bp, Homo sapiens
ctgtgatccacccaaccct

SEQ ID NO: 4930476 - DNA, 13 bp, Homo sapiens
ctgtgatgagctg

SEQ ID NO: 4930477 - DNA, 15 bp, Homo sapiens
ctgtgatgagctgat

SEQ ID NO: 4930478 - DNA, 17 bp, Homo sapiens
ctgtgcaacgccgtggg

SEQ ID NO: 4930479 - DNA, 11 bp, Homo sapiens
ctgtgcacaca

SEQ ID NO: 4930480 - DNA, 15 bp, Homo sapiens
ctgtgcagcgcagct

SEQ ID NO: 4930481 - DNA, 16 bp, Homo sapiens
ctgtgcatagtgctgg

SEQ ID NO: 4930482 - DNA, 17 bp, Homo sapiens
ctgtgcatgtatgtctt

SEQ ID NO: 4930483 - DNA, 17 bp, Homo sapiens
ctgtgccccatgcctgt

SEQ ID NO: 4930484 - DNA, 21 bp, Homo sapiens
ctgtgccccatgcctgtccag

SEQ ID NO: 4930485 - DNA, 13 bp, Homo sapiens
ctgtgcctcctca

SEQ ID NO: 4930486 - DNA, 16 bp, Homo sapiens
ctgtgcctctgcctgt

SEQ ID NO: 4930487 - DNA, 17 bp, Homo sapiens
ctgtgcctctgcctgtc

SEQ ID NO: 4930488 - DNA, 18 bp, Homo sapiens
ctgtgctctggacaggca

SEQ ID NO: 4930489 - DNA, 17 bp, Homo sapiens
ctgtgcttcaattaata

SEQ ID NO: 4930490 - DNA, 18 bp, Homo sapiens
ctgtgcttcaattaataa

SEQ ID NO: 4930491 - DNA, 17 bp, Homo sapiens
ctgtgcttttaaatgca

SEQ ID NO: 4930492 - DNA, 18 bp, Homo sapiens
ctgtggaacataaaaagg

SEQ ID NO: 4930493 - DNA, 21 bp, Homo sapiens
ctgtggaacataaaaaggaca

SEQ ID NO: 4930494 - DNA, 18 bp, Homo sapiens
ctgtggaactaataaata

SEQ ID NO: 4930495 - DNA, 19 bp, Homo sapiens
ctgtggaatgagtgtgcat

SEQ ID NO: 4930496 - DNA, 17 bp, Homo sapiens
ctgtggaggaaggattg

SEQ ID NO: 4930497 - DNA, 20 bp, Homo sapiens
ctgtggaggaaggattgtaa

SEQ ID NO: 4930498 - DNA, 16 bp, Homo sapiens
ctgtggatgccagggc

SEQ ID NO: 4930499 - DNA, 16 bp, Homo sapiens
ctgtggccctggctct

SEQ ID NO: 4930500 - DNA, 20 bp, Homo sapiens
ctgtggccgttatctggaag

SEQ ID NO: 4930501 - DNA, 24 bp, Homo sapiens
ctgtgggggtgagggtcccatgtg

SEQ ID NO: 4930502 - DNA, 19 bp, Homo sapiens
ctgtgggggtgtgccccct

SEQ ID NO: 4930503 - DNA, 22 bp, Homo sapiens
ctgtggtcttcaaattgtcttt

SEQ ID NO: 4930504 - DNA, 14 bp, Homo sapiens
ctgtgtactgtgtc

SEQ ID NO: 4930505 - DNA, 19 bp, Homo sapiens
ctgtgtatggaaaaaccat

SEQ ID NO: 4930506 - DNA, 19 bp, Homo sapiens
ctgtgtcaggtggggcagc

SEQ ID NO: 4930507 - DNA, 17 bp, Homo sapiens
ctgtgtccacctgtggg

SEQ ID NO: 4930508 - DNA, 12 bp, Homo sapiens
ctgtgtctaaga

SEQ ID NO: 4930509 - DNA, 20 bp, Homo sapiens
ctgtgtctaagattctagat

SEQ ID NO: 4930510 - DNA, 16 bp, Homo sapiens
ctgtgtcttgcaatgg

SEQ ID NO: 4930511 - DNA, 19 bp, Homo sapiens
ctgtgtcttgcaatggcag

SEQ ID NO: 4930512 - DNA, 20 bp, Homo sapiens
ctgtgtcttgcaatggcagc

SEQ ID NO: 4930513 - DNA, 17 bp, Homo sapiens
ctgtgtgaatgtgggca

SEQ ID NO: 4930514 - DNA, 15 bp, Homo sapiens
ctgtgtgatgaactt

SEQ ID NO: 4930515 - DNA, 21 bp, Homo sapiens
ctgtgtgcaccttaccaactt

SEQ ID NO: 4930516 - DNA, 18 bp, Homo sapiens
ctgtgtgcctgggggagt

SEQ ID NO: 4930517 - DNA, 15 bp, Homo sapiens
ctgtgtgcgctctgt

SEQ ID NO: 4930518 - DNA, 18 bp, Homo sapiens
ctgtgtgtgtgaatgaac

SEQ ID NO: 4930519 - DNA, 14 bp, Homo sapiens
ctgtgttgccatgt

SEQ ID NO: 4930520 - DNA, 15 bp, Homo sapiens
ctgtgttgtattaac

SEQ ID NO: 4930521 - DNA, 18 bp, Homo sapiens
ctgtgttttataaaatag

SEQ ID NO: 4930522 - DNA, 13 bp, Homo sapiens
ctgttaatgtatt

SEQ ID NO: 4930523 - DNA, 14 bp, Homo sapiens
ctgttaatgtattt

SEQ ID NO: 4930524 - DNA, 21 bp, Homo sapiens
ctgttacataacaagaaaatc

SEQ ID NO: 4930525 - DNA, 15 bp, Homo sapiens
ctgttaccattcaca

SEQ ID NO: 4930526 - DNA, 16 bp, Homo sapiens
ctgttaccgcctgtct

SEQ ID NO: 4930527 - DNA, 16 bp, Homo sapiens
ctgttagcactgttga

SEQ ID NO: 4930528 - DNA, 20 bp, Homo sapiens
ctgttagcactgttgatgta

SEQ ID NO: 4930529 - DNA, 13 bp, Homo sapiens
ctgttatgtactg

SEQ ID NO: 4930530 - DNA, 13 bp, Homo sapiens
ctgttcagctcca

SEQ ID NO: 4930531 - DNA, 16 bp, Homo sapiens
ctgttcagctccagct

SEQ ID NO: 4930532 - DNA, 19 bp, Homo sapiens
ctgttcagctccagctcac

SEQ ID NO: 4930533 - DNA, 15 bp, Homo sapiens
ctgttccttagacct

SEQ ID NO: 4930534 - DNA, 16 bp, Homo sapiens
ctgttccttagacctt

SEQ ID NO: 4930535 - DNA, 16 bp, Homo sapiens
ctgttctcttcttcat

SEQ ID NO: 4930536 - DNA, 14 bp, Homo sapiens
ctgttctgtgtctt

SEQ ID NO: 4930537 - DNA, 15 bp, Homo sapiens
ctgttctgtttcaag

SEQ ID NO: 4930538 - DNA, 21 bp, Homo sapiens
ctgttctgtttcaaggcactc

SEQ ID NO: 4930539 - DNA, 13 bp, Homo sapiens
ctgttcttcctcc

SEQ ID NO: 4930540 - DNA, 15 bp, Homo sapiens
ctgttcttcctccag

SEQ ID NO: 4930541 - DNA, 20 bp, Homo sapiens
ctgttcttcctccagctgca

SEQ ID NO: 4930542 - DNA, 11 bp, Homo sapiens
ctgttcttgct

SEQ ID NO: 4930543 - DNA, 16 bp, Homo sapiens
ctgttcttgctgctag

SEQ ID NO: 4930544 - DNA, 19 bp, Homo sapiens
ctgttcttgctgctagaac

SEQ ID NO: 4930545 - DNA, 20 bp, Homo sapiens
ctgttcttgctgctagaact

SEQ ID NO: 4930546 - DNA, 12 bp, Homo sapiens
ctgttgaaaatt

SEQ ID NO: 4930547 - DNA, 22 bp, Homo sapiens
ctgttgaaaattattttaaaca

SEQ ID NO: 4930548 - DNA, 15 bp, Homo sapiens
ctgttgatgtatctg

SEQ ID NO: 4930549 - DNA, 22 bp, Homo sapiens
ctgttgcaattaggattttgat

SEQ ID NO: 4930550 - DNA, 15 bp, Homo sapiens
ctgttgcccaggctg

SEQ ID NO: 4930551 - DNA, 17 bp, Homo sapiens
ctgttgcccaggctggc

SEQ ID NO: 4930552 - DNA, 18 bp, Homo sapiens
ctgttgcccaggctggcg

SEQ ID NO: 4930553 - DNA, 20 bp, Homo sapiens
ctgttgccctttctgtacca

SEQ ID NO: 4930554 - DNA, 22 bp, Homo sapiens
ctgttgcctttttcattttcca

SEQ ID NO: 4930555 - DNA, 21 bp, Homo sapiens
ctgttgctgtgtttaatttga

SEQ ID NO: 4930556 - DNA, 11 bp, Homo sapiens
ctgttgcttga

SEQ ID NO: 4930557 - DNA, 16 bp, Homo sapiens
ctgttggattccatgc

SEQ ID NO: 4930558 - DNA, 17 bp, Homo sapiens
ctgttggattccatgct

SEQ ID NO: 4930559 - DNA, 14 bp, Homo sapiens
ctgttggcagtgag

SEQ ID NO: 4930560 - DNA, 22 bp, Homo sapiens
ctgttggcagtgagtgagcctg

SEQ ID NO: 4930561 - DNA, 15 bp, Homo sapiens
ctgttggccagtgtg

SEQ ID NO: 4930562 - DNA, 14 bp, Homo sapiens
ctgttggctggggg

SEQ ID NO: 4930563 - DNA, 22 bp, Homo sapiens
ctgttggctgggggcctcagtg

SEQ ID NO: 4930564 - DNA, 16 bp, Homo sapiens
ctgttgtaactaggct

SEQ ID NO: 4930565 - DNA, 12 bp, Homo sapiens
ctgttgtaactt

SEQ ID NO: 4930566 - DNA, 21 bp, Homo sapiens
ctgttgtaacttatgtagata

SEQ ID NO: 4930567 - DNA, 20 bp, Homo sapiens
ctgtttaagaaaagtatttt

SEQ ID NO: 4930568 - DNA, 16 bp, Homo sapiens
ctgtttaatatttaaa

SEQ ID NO: 4930569 - DNA, 17 bp, Homo sapiens
ctgtttatggcctcagc

SEQ ID NO: 4930570 - DNA, 19 bp, Homo sapiens
ctgtttatggcctcagctg

SEQ ID NO: 4930571 - DNA, 21 bp, Homo sapiens
ctgtttatggcctcagctgcc

SEQ ID NO: 4930572 - DNA, 22 bp, Homo sapiens
ctgtttatggcctcagctgcct

SEQ ID NO: 4930573 - DNA, 16 bp, Homo sapiens
ctgtttatttctgttt

SEQ ID NO: 4930574 - DNA, 22 bp, Homo sapiens
ctgtttcaaggcactctagatt

SEQ ID NO: 4930575 - DNA, 11 bp, Homo sapiens
ctgtttcacaa

SEQ ID NO: 4930576 - DNA, 19 bp, Homo sapiens
ctgtttcccttcccttcca

SEQ ID NO: 4930577 - DNA, 11 bp, Homo sapiens
ctgtttctcat

SEQ ID NO: 4930578 - DNA, 17 bp, Homo sapiens
ctgtttctcttgagctg

SEQ ID NO: 4930579 - DNA, 14 bp, Homo sapiens
ctgtttcttgcttg

SEQ ID NO: 4930580 - DNA, 13 bp, Homo sapiens
ctgtttgattctt

SEQ ID NO: 4930581 - DNA, 17 bp, Homo sapiens
ctgtttgtagtgaaata

SEQ ID NO: 4930582 - DNA, 14 bp, Homo sapiens
ctgtttgtttcata

SEQ ID NO: 4930583 - DNA, 22 bp, Homo sapiens
ctgttttacaaaaaagaaaaga

SEQ ID NO: 4930584 - DNA, 20 bp, Homo sapiens
cttaaaataaacagttgtga

SEQ ID NO: 4930585 - DNA, 20 bp, Homo sapiens
cttaaaatattcctgcattt

SEQ ID NO: 4930586 - DNA, 11 bp, Homo sapiens
cttaaaatgga

SEQ ID NO: 4930587 - DNA, 18 bp, Homo sapiens
cttaaaatggaattgaaa

SEQ ID NO: 4930588 - DNA, 14 bp, Homo sapiens
cttaaacttgtgaa

SEQ ID NO: 4930589 - DNA, 15 bp, Homo sapiens
cttaaatatctttta

SEQ ID NO: 4930590 - DNA, 23 bp, Homo sapiens
cttaaattgggttcatgatgcag

SEQ ID NO: 4930591 - DNA, 13 bp, Homo sapiens
cttaacccaagga

SEQ ID NO: 4930592 - DNA, 16 bp, Homo sapiens
cttaacccaaggagca

SEQ ID NO: 4930593 - DNA, 11 bp, Homo sapiens
cttaactattc

SEQ ID NO: 4930594 - DNA, 22 bp, Homo sapiens
cttaagacctactgttctaaag

SEQ ID NO: 4930595 - DNA, 23 bp, Homo sapiens
cttaagacctactgttctaaagc

SEQ ID NO: 4930596 - DNA, 16 bp, Homo sapiens
cttaagagaaatggca

SEQ ID NO: 4930597 - DNA, 11 bp, Homo sapiens
cttaagcacaa

SEQ ID NO: 4930598 - DNA, 16 bp, Homo sapiens
cttaatactaccttga

SEQ ID NO: 4930599 - DNA, 22 bp, Homo sapiens
cttaatgtgattactgctctat

SEQ ID NO: 4930600 - DNA, 13 bp, Homo sapiens
cttaatgttctta

SEQ ID NO: 4930601 - DNA, 18 bp, Homo sapiens
cttaattaatttgattaa

SEQ ID NO: 4930602 - DNA, 17 bp, Homo sapiens
cttaattacttaaaaaa

SEQ ID NO: 4930603 - DNA, 20 bp, Homo sapiens
cttaatttttttttcataga

SEQ ID NO: 4930604 - DNA, 13 bp, Homo sapiens
cttacacaaaggg

SEQ ID NO: 4930605 - DNA, 16 bp, Homo sapiens
cttacacatacagttt

SEQ ID NO: 4930606 - DNA, 17 bp, Homo sapiens
cttacacatacagtttt

SEQ ID NO: 4930607 - DNA, 20 bp, Homo sapiens
cttacattagcagtttgctt

SEQ ID NO: 4930608 - DNA, 22 bp, Homo sapiens
cttacattagcagtttgctttg

SEQ ID NO: 4930609 - DNA, 22 bp, Homo sapiens
cttacccaaactgttcaagaaa

SEQ ID NO: 4930610 - DNA, 16 bp, Homo sapiens
cttacccaatttccca

SEQ ID NO: 4930611 - DNA, 22 bp, Homo sapiens
cttacccctggctgtttggact

SEQ ID NO: 4930612 - DNA, 20 bp, Homo sapiens
cttaccccttagcctccctg

SEQ ID NO: 4930613 - DNA, 11 bp, Homo sapiens
cttacctgaca

SEQ ID NO: 4930614 - DNA, 17 bp, Homo sapiens
cttacctgtacactgac

SEQ ID NO: 4930615 - DNA, 17 bp, Homo sapiens
cttacgaatattttcag

SEQ ID NO: 4930616 - DNA, 18 bp, Homo sapiens
cttacggccatctctttg

SEQ ID NO: 4930617 - DNA, 15 bp, Homo sapiens
cttactaaaatatat

SEQ ID NO: 4930618 - DNA, 15 bp, Homo sapiens
cttactaatgtaaaa

SEQ ID NO: 4930619 - DNA, 16 bp, Homo sapiens
cttactacactgagga

SEQ ID NO: 4930620 - DNA, 15 bp, Homo sapiens
cttactcctcctctt

SEQ ID NO: 4930621 - DNA, 23 bp, Homo sapiens
cttactcctcctctttctctccc

SEQ ID NO: 4930622 - DNA, 20 bp, Homo sapiens
cttactctaagatcttagat

SEQ ID NO: 4930623 - DNA, 16 bp, Homo sapiens
cttactctgtccattt

SEQ ID NO: 4930624 - DNA, 17 bp, Homo sapiens
cttactgattattttct

SEQ ID NO: 4930625 - DNA, 23 bp, Homo sapiens
cttactgtacctgttccttagac

SEQ ID NO: 4930626 - DNA, 16 bp, Homo sapiens
cttactgtggaggaag

SEQ ID NO: 4930627 - DNA, 20 bp, Homo sapiens
cttactttcctttccccagc

SEQ ID NO: 4930628 - DNA, 23 bp, Homo sapiens
cttactttcctttccccagccca

SEQ ID NO: 4930629 - DNA, 14 bp, Homo sapiens
cttagaaagcaggg

SEQ ID NO: 4930630 - DNA, 17 bp, Homo sapiens
cttagaaagcaggggct

SEQ ID NO: 4930631 - DNA, 18 bp, Homo sapiens
cttagaaagcaggggcta

SEQ ID NO: 4930632 - DNA, 18 bp, Homo sapiens
cttagaaatgtaaactgc

SEQ ID NO: 4930633 - DNA, 15 bp, Homo sapiens
cttagaagtcacaca

SEQ ID NO: 4930634 - DNA, 16 bp, Homo sapiens
cttagacataacaaaa

SEQ ID NO: 4930635 - DNA, 18 bp, Homo sapiens
cttagaccttccataatg

SEQ ID NO: 4930636 - DNA, 16 bp, Homo sapiens
cttagatgtttcacac

SEQ ID NO: 4930637 - DNA, 20 bp, Homo sapiens
cttagattctctgtgtctaa

SEQ ID NO: 4930638 - DNA, 19 bp, Homo sapiens
cttagcatagcttattatt

SEQ ID NO: 4930639 - DNA, 14 bp, Homo sapiens
cttagcctggagca

SEQ ID NO: 4930640 - DNA, 15 bp, Homo sapiens
cttagcctggagcac

SEQ ID NO: 4930641 - DNA, 14 bp, Homo sapiens
cttagctatcagaa

SEQ ID NO: 4930642 - DNA, 13 bp, Homo sapiens
cttagctccctcc

SEQ ID NO: 4930643 - DNA, 17 bp, Homo sapiens
cttagctccctcccgca

SEQ ID NO: 4930644 - DNA, 16 bp, Homo sapiens
cttagctttttaattg

SEQ ID NO: 4930645 - DNA, 21 bp, Homo sapiens
cttaggtggcaagctgtgact

SEQ ID NO: 4930646 - DNA, 19 bp, Homo sapiens
cttagtaaaatttatttca

SEQ ID NO: 4930647 - DNA, 22 bp, Homo sapiens
cttagtcccccaactctgagcc

SEQ ID NO: 4930648 - DNA, 18 bp, Homo sapiens
cttagtctcagtttgtgt

SEQ ID NO: 4930649 - DNA, 23 bp, Homo sapiens
cttagtctcagtttgtgtgtctt

SEQ ID NO: 4930650 - DNA, 14 bp, Homo sapiens
cttagtgggccagg

SEQ ID NO: 4930651 - DNA, 17 bp, Homo sapiens
cttagtgggccagggct

SEQ ID NO: 4930652 - DNA, 16 bp, Homo sapiens
cttagttatcagcttt

SEQ ID NO: 4930653 - DNA, 21 bp, Homo sapiens
cttataaatcatattgatgaa

SEQ ID NO: 4930654 - DNA, 20 bp, Homo sapiens
cttataagtgaagtgatact

SEQ ID NO: 4930655 - DNA, 22 bp, Homo sapiens
cttatagcactttgaaatacct

SEQ ID NO: 4930656 - DNA, 14 bp, Homo sapiens
cttataggtgttgg

SEQ ID NO: 4930657 - DNA, 19 bp, Homo sapiens
cttatagtacatgataaat

SEQ ID NO: 4930658 - DNA, 19 bp, Homo sapiens
cttatatagcagcaaaaat

SEQ ID NO: 4930659 - DNA, 19 bp, Homo sapiens
cttatattcaaccatggac

SEQ ID NO: 4930660 - DNA, 21 bp, Homo sapiens
cttatattcaaccatggactt

SEQ ID NO: 4930661 - DNA, 18 bp, Homo sapiens
cttatattgaagacaatt

SEQ ID NO: 4930662 - DNA, 15 bp, Homo sapiens
cttatattttcgtat

SEQ ID NO: 4930663 - DNA, 19 bp, Homo sapiens
cttatattttcgtatgaaa

SEQ ID NO: 4930664 - DNA, 21 bp, Homo sapiens
cttatattttcgtatgaaaat

SEQ ID NO: 4930665 - DNA, 13 bp, Homo sapiens
cttatcagagcta

SEQ ID NO: 4930666 - DNA, 23 bp, Homo sapiens
cttatcagctacttaagagaaat

SEQ ID NO: 4930667 - DNA, 21 bp, Homo sapiens
cttatgacatcacttgtacaa

SEQ ID NO: 4930668 - DNA, 18 bp, Homo sapiens
cttgatgaccaaagtcct

SEQ ID NO: 4930669 - DNA, 15 bp, Homo sapiens
cttgatgcacagaga

SEQ ID NO: 4930670 - DNA, 21 bp, Homo sapiens
cttgatggctccgaacaccct

SEQ ID NO: 4930671 - DNA, 22 bp, Homo sapiens
cttgattaagattttacaaaag

SEQ ID NO: 4930672 - DNA, 18 bp, Homo sapiens
cttgcaagcatgcttgtg

SEQ ID NO: 4930673 - DNA, 16 bp, Homo sapiens
cttgcaatggcagcct

SEQ ID NO: 4930674 - DNA, 14 bp, Homo sapiens
cttgcacccctcac

SEQ ID NO: 4930675 - DNA, 16 bp, Homo sapiens
cttgcagaactgccat

SEQ ID NO: 4930676 - DNA, 17 bp, Homo sapiens
cttgcagaactgccatt

SEQ ID NO: 4930677 - DNA, 16 bp, Homo sapiens
cttgcagtcatcagaa

SEQ ID NO: 4930678 - DNA, 15 bp, Homo sapiens
cttgcatccaactcc

SEQ ID NO: 4930679 - DNA, 19 bp, Homo sapiens
cttgcatccaactccagga

SEQ ID NO: 4930680 - DNA, 16 bp, Homo sapiens
cttgcatccttcctat

SEQ ID NO: 4930681 - DNA, 14 bp, Homo sapiens
cttgcatgaagaga

SEQ ID NO: 4930682 - DNA, 14 bp, Homo sapiens
cttgccactgcctc

SEQ ID NO: 4930683 - DNA, 20 bp, Homo sapiens
cttgccagagccgggcacat

SEQ ID NO: 4930684 - DNA, 15 bp, Homo sapiens
cttgccctagatgag

SEQ ID NO: 4930685 - DNA, 22 bp, Homo sapiens
cttgccctttccccccatgttg

SEQ ID NO: 4930686 - DNA, 23 bp, Homo sapiens
cttgcctaaatttaatgctgcct

SEQ ID NO: 4930687 - DNA, 10 bp, Homo sapiens
cttgcctggg

SEQ ID NO: 4930688 - DNA, 15 bp, Homo sapiens
cttgccttacacaaa

SEQ ID NO: 4930689 - DNA, 14 bp, Homo sapiens
cttgcgaatccaag

SEQ ID NO: 4930690 - DNA, 19 bp, Homo sapiens
cttgcgaatccaagctccc

SEQ ID NO: 4930691 - DNA, 20 bp, Homo sapiens
cttgcgaatccaagctccct

SEQ ID NO: 4930692 - DNA, 23 bp, Homo sapiens
cttgctagctatgtgaccttgag

SEQ ID NO: 4930693 - DNA, 18 bp, Homo sapiens
cttgctcccttcagcccc

SEQ ID NO: 4930694 - DNA, 23 bp, Homo sapiens
cttgctcccttcagcccccagcc

SEQ ID NO: 4930695 - DNA, 17 bp, Homo sapiens
cttgctctgctgacaga

SEQ ID NO: 4930696 - DNA, 12 bp, Homo sapiens
cttgctgctaga

SEQ ID NO: 4930697 - DNA, 15 bp, Homo sapiens
cttgctgctagaact

SEQ ID NO: 4930698 - DNA, 17 bp, Homo sapiens
cttgctggacggggact

SEQ ID NO: 4930699 - DNA, 17 bp, Homo sapiens
cttgctgtcctgatctg

SEQ ID NO: 4930700 - DNA, 18 bp, Homo sapiens
cttgctgtcctgatctgt

SEQ ID NO: 4930701 - DNA, 12 bp, Homo sapiens
cttgctgtctct

SEQ ID NO: 4930702 - DNA, 21 bp, Homo sapiens
cttgctgtctctgctcgccct

SEQ ID NO: 4930703 - DNA, 16 bp, Homo sapiens
cttgctgttggtcatg

SEQ ID NO: 4930704 - DNA, 12 bp, Homo sapiens
cttgcttgtacc

SEQ ID NO: 4930705 - DNA, 21 bp, Homo sapiens
cttgctttctatgctgtttgt

SEQ ID NO: 4930706 - DNA, 18 bp, Homo sapiens
cttgctttcttttttaaa

SEQ ID NO: 4930707 - DNA, 22 bp, Homo sapiens
cttgctttcttttttaaaatca

SEQ ID NO: 4930708 - DNA, 13 bp, Homo sapiens
cttgctttgattt

SEQ ID NO: 4930709 - DNA, 14 bp, Homo sapiens
cttgctttgattta

SEQ ID NO: 4930710 - DNA, 20 bp, Homo sapiens
cttgctttgatttacagcaa

SEQ ID NO: 4930711 - DNA, 16 bp, Homo sapiens
cttgcttttccctctt

SEQ ID NO: 4930712 - DNA, 18 bp, Homo sapiens
cttgcttttccctctttt

SEQ ID NO: 4930713 - DNA, 21 bp, Homo sapiens
cttgcttttccctcttttctt

SEQ ID NO: 4930714 - DNA, 22 bp, Homo sapiens
cttgcttttccctcttttctta

SEQ ID NO: 4930715 - DNA, 14 bp, Homo sapiens
cttggagaccttac

SEQ ID NO: 4930716 - DNA, 15 bp, Homo sapiens
cttggagagacacag

SEQ ID NO: 4930717 - DNA, 16 bp, Homo sapiens
cttggagagacacagc

SEQ ID NO: 4930718 - DNA, 15 bp, Homo sapiens
cttggcaaaagcctt

SEQ ID NO: 4930719 - DNA, 17 bp, Homo sapiens
cttggcaaaagccttgt

SEQ ID NO: 4930720 - DNA, 23 bp, Homo sapiens
cttggcaaaagccttgtgtatat

SEQ ID NO: 4930721 - DNA, 21 bp, Homo sapiens
cttggccggctgtgctcagag

SEQ ID NO: 4930722 - DNA, 20 bp, Homo sapiens
cttggcctagcccaccctgc

SEQ ID NO: 4930723 - DNA, 21 bp, Homo sapiens
cttggcctagcccaccctgct

SEQ ID NO: 4930724 - DNA, 23 bp, Homo sapiens
cttggcctgtctcatccccaggg

SEQ ID NO: 4930725 - DNA, 14 bp, Homo sapiens
cttggctcagacat

SEQ ID NO: 4930726 - DNA, 14 bp, Homo sapiens
cttggctccatgct

SEQ ID NO: 4930727 - DNA, 22 bp, Homo sapiens
cttggctttcattattagtact

SEQ ID NO: 4930728 - DNA, 16 bp, Homo sapiens
cttggcttttctagcc

SEQ ID NO: 4930729 - DNA, 17 bp, Homo sapiens
cttgggagagcccctgg

SEQ ID NO: 4930730 - DNA, 22 bp, Homo sapiens
cttgggagagcccctggggcct

SEQ ID NO: 4930731 - DNA, 14 bp, Homo sapiens
cttgggctgctcct

SEQ ID NO: 4930732 - DNA, 19 bp, Homo sapiens
cttggggaggacaaaactt

SEQ ID NO: 4930733 - DNA, 21 bp, Homo sapiens
cttggggccaccaaagctgcc

SEQ ID NO: 4930734 - DNA, 16 bp, Homo sapiens
cttggtctttgtatct

SEQ ID NO: 4930735 - DNA, 21 bp, Homo sapiens
cttggttatttgtttaccact

SEQ ID NO: 4930736 - DNA, 19 bp, Homo sapiens
cttggtttctctctacagt

SEQ ID NO: 4930737 - DNA, 23 bp, Homo sapiens
cttggtttctctctacagtgcca

SEQ ID NO: 4930738 - DNA, 12 bp, Homo sapiens
cttgtaaatacc

SEQ ID NO: 4930739 - DNA, 16 bp, Homo sapiens
cttgtaaatagctcag

SEQ ID NO: 4930740 - DNA, 17 bp, Homo sapiens
cttgtaaatagctcagg

SEQ ID NO: 4930741 - DNA, 16 bp, Homo sapiens
cttgtaatattttgta

SEQ ID NO: 4930742 - DNA, 17 bp, Homo sapiens
cttgtaatattttgtat

SEQ ID NO: 4930743 - DNA, 18 bp, Homo sapiens
cttgtaatattttgtatt

SEQ ID NO: 4930744 - DNA, 12 bp, Homo sapiens
cttgtacaaaat

SEQ ID NO: 4930745 - DNA, 14 bp, Homo sapiens
cttgtacatgtgta

SEQ ID NO: 4930746 - DNA, 20 bp, Homo sapiens
cttgtacctctggctgacta

SEQ ID NO: 4930747 - DNA, 23 bp, Homo sapiens
cttgtacctctggctgactaaat

SEQ ID NO: 4930748 - DNA, 17 bp, Homo sapiens
cttgtagaattgttata

SEQ ID NO: 4930749 - DNA, 15 bp, Homo sapiens
cttgtagctgtaaaa

SEQ ID NO: 4930750 - DNA, 17 bp, Homo sapiens
cttgtataaatgtatat

SEQ ID NO: 4930751 - DNA, 19 bp, Homo sapiens
cttgtataaatgtatatac

SEQ ID NO: 4930752 - DNA, 21 bp, Homo sapiens
cttgtataaatgtatatacac

SEQ ID NO: 4930753 - DNA, 23 bp, Homo sapiens
cttgtataaatgtatatacacat

SEQ ID NO: 4930754 - DNA, 19 bp, Homo sapiens
cttgtataagatcctagat

SEQ ID NO: 4930755 - DNA, 16 bp, Homo sapiens
cttgtatagtgtaaaa

SEQ ID NO: 4930756 - DNA, 20 bp, Homo sapiens
cttgtatatacgcatctata

SEQ ID NO: 4930757 - DNA, 19 bp, Homo sapiens
cttgtatcaacactgttac

SEQ ID NO: 4930758 - DNA, 20 bp, Homo sapiens
cttgtatcaacactgttact

SEQ ID NO: 4930759 - DNA, 17 bp, Homo sapiens
cttgtcactgacacaaa

SEQ ID NO: 4930760 - DNA, 18 bp, Homo sapiens
cttgtcactgacacaaag

SEQ ID NO: 4930761 - DNA, 21 bp, Homo sapiens
cttgtcactgacacaaaggaa

SEQ ID NO: 4930762 - DNA, 15 bp, Homo sapiens
cttgtcactggtaga

SEQ ID NO: 4930763 - DNA, 15 bp, Homo sapiens
cttgtcagacataaa

SEQ ID NO: 4930764 - DNA, 15 bp, Homo sapiens
cttgtccacccacct

SEQ ID NO: 4930765 - DNA, 16 bp, Homo sapiens
cttgtcctcagtccat

SEQ ID NO: 4930766 - DNA, 22 bp, Homo sapiens
cttgtcctcagtccatttatat

SEQ ID NO: 4930767 - DNA, 14 bp, Homo sapiens
cttgtcctttccct

SEQ ID NO: 4930768 - DNA, 19 bp, Homo sapiens
cttgtctcattttaatgta

SEQ ID NO: 4930769 - DNA, 18 bp, Homo sapiens
cttgtctcctactcctga

SEQ ID NO: 4930770 - DNA, 19 bp, Homo sapiens
cttgtctcctactcctgac

SEQ ID NO: 4930771 - DNA, 17 bp, Homo sapiens
cttgtcttttcaaaata

SEQ ID NO: 4930772 - DNA, 17 bp, Homo sapiens
cttgtgaaacacagctg

SEQ ID NO: 4930773 - DNA, 20 bp, Homo sapiens
cttgtgaaacacagctgttc

SEQ ID NO: 4930774 - DNA, 15 bp, Homo sapiens
cttgtgattatttat

SEQ ID NO: 4930775 - DNA, 21 bp, Homo sapiens
cttgtgcaaaatatttgacta

SEQ ID NO: 4930776 - DNA, 17 bp, Homo sapiens
cttgtgccacaccctcc

SEQ ID NO: 4930777 - DNA, 17 bp, Homo sapiens
ctttgcacgacgccctc

SEQ ID NO: 4930778 - DNA, 14 bp, Homo sapiens
ctttgcagacaggc

SEQ ID NO: 4930779 - DNA, 15 bp, Homo sapiens
ctttgcagacaggca

SEQ ID NO: 4930780 - DNA, 16 bp, Homo sapiens
ctttgcagacaggcaa

SEQ ID NO: 4930781 - DNA, 13 bp, Homo sapiens
ctttgcagggcag

SEQ ID NO: 4930782 - DNA, 15 bp, Homo sapiens
ctttgcagggcagcc

SEQ ID NO: 4930783 - DNA, 18 bp, Homo sapiens
ctttgcatatgagccgtg

SEQ ID NO: 4930784 - DNA, 14 bp, Homo sapiens
ctttgcctcctgtg

SEQ ID NO: 4930785 - DNA, 22 bp, Homo sapiens
ctttgcctcctgtgtactgtgt

SEQ ID NO: 4930786 - DNA, 11 bp, Homo sapiens
ctttgcctggt

SEQ ID NO: 4930787 - DNA, 15 bp, Homo sapiens
ctttgccttcttttg

SEQ ID NO: 4930788 - DNA, 15 bp, Homo sapiens
ctttgcgcctgtgac

SEQ ID NO: 4930789 - DNA, 16 bp, Homo sapiens
ctttgctcttgtccca

SEQ ID NO: 4930790 - DNA, 16 bp, Homo sapiens
ctttggagtcccctca

SEQ ID NO: 4930791 - DNA, 18 bp, Homo sapiens
ctttggagtcccctcacc

SEQ ID NO: 4930792 - DNA, 22 bp, Homo sapiens
ctttggagtcccctcacctcct

SEQ ID NO: 4930793 - DNA, 15 bp, Homo sapiens
ctttggatttgacat

SEQ ID NO: 4930794 - DNA, 14 bp, Homo sapiens
ctttggctctggag

SEQ ID NO: 4930795 - DNA, 20 bp, Homo sapiens
ctttgggctgccctggtgct

SEQ ID NO: 4930796 - DNA, 21 bp, Homo sapiens
ctttgggctgccctggtgctg

SEQ ID NO: 4930797 - DNA, 14 bp, Homo sapiens
ctttggttcagcta

SEQ ID NO: 4930798 - DNA, 19 bp, Homo sapiens
ctttggttctggccagaat

SEQ ID NO: 4930799 - DNA, 21 bp, Homo sapiens
ctttggttctggccagaatgc

SEQ ID NO: 4930800 - DNA, 23 bp, Homo sapiens
ctttgtaagagtgtagaagcatt

SEQ ID NO: 4930801 - DNA, 22 bp, Homo sapiens
ctttgtaagtcagtgttgagat

SEQ ID NO: 4930802 - DNA, 19 bp, Homo sapiens
ctttgtacagagtgctttt

SEQ ID NO: 4930803 - DNA, 21 bp, Homo sapiens
ctttgtagatccttagaggtc

SEQ ID NO: 4930804 - DNA, 23 bp, Homo sapiens
ctttgtatcttccatatttggaa

SEQ ID NO: 4930805 - DNA, 12 bp, Homo sapiens
ctttgtatgcac

SEQ ID NO: 4930806 - DNA, 13 bp, Homo sapiens
ctttgtattcaaa

SEQ ID NO: 4930807 - DNA, 15 bp, Homo sapiens
ctttgtcccggggct

SEQ ID NO: 4930808 - DNA, 13 bp, Homo sapiens
ctttgtctttcaa

SEQ ID NO: 4930809 - DNA, 16 bp, Homo sapiens
ctttgtctttcaaact

SEQ ID NO: 4930810 - DNA, 13 bp, Homo sapiens
ctttgtgataatt

SEQ ID NO: 4930811 - DNA, 20 bp, Homo sapiens
ctttgtggattctgaggccc

SEQ ID NO: 4930812 - DNA, 13 bp, Homo sapiens
ctttgtggcttcc

SEQ ID NO: 4930813 - DNA, 21 bp, Homo sapiens
ctttgtggggcttggcgtgga

SEQ ID NO: 4930814 - DNA, 16 bp, Homo sapiens
ctttgtggttttatgg

SEQ ID NO: 4930815 - DNA, 16 bp, Homo sapiens
ctttgtgtagctttgc

SEQ ID NO: 4930816 - DNA, 18 bp, Homo sapiens
ctttgtgtagctttgctc

SEQ ID NO: 4930817 - DNA, 20 bp, Homo sapiens
ctttgtgttgggagggatta

SEQ ID NO: 4930818 - DNA, 13 bp, Homo sapiens
ctttgtgttgtaa

SEQ ID NO: 4930819 - DNA, 14 bp, Homo sapiens
ctttgtgtttctat

SEQ ID NO: 4930820 - DNA, 18 bp, Homo sapiens
cttttaaaacacttccat

SEQ ID NO: 4930821 - DNA, 13 bp, Homo sapiens
cttttaaagtgtt

SEQ ID NO: 4930822 - DNA, 20 bp, Homo sapiens
cttttaattaaataaaagct

SEQ ID NO: 4930823 - DNA, 21 bp, Homo sapiens
cttttaggaaaatcactttgt

SEQ ID NO: 4930824 - DNA, 12 bp, Homo sapiens
cttttatactct

SEQ ID NO: 4930825 - DNA, 12 bp, Homo sapiens
cttttatagcta

SEQ ID NO: 4930826 - DNA, 14 bp, Homo sapiens
cttttatagctatt

SEQ ID NO: 4930827 - DNA, 20 bp, Homo sapiens
cttttataggtgagaaaaaa

SEQ ID NO: 4930828 - DNA, 21 bp, Homo sapiens
cttttataggtgagaaaaaaa

SEQ ID NO: 4930829 - DNA, 15 bp, Homo sapiens
cttttatatttgtat

SEQ ID NO: 4930830 - DNA, 16 bp, Homo sapiens
cttttatatttgtatc

SEQ ID NO: 4930831 - DNA, 13 bp, Homo sapiens
cttttatcaaaca

SEQ ID NO: 4930832 - DNA, 15 bp, Homo sapiens
cttttatgtagtaat

SEQ ID NO: 4930833 - DNA, 18 bp, Homo sapiens
cttttatgtagtaattga

SEQ ID NO: 4930834 - DNA, 22 bp, Homo sapiens
cttttatgtagtaattgacatg

SEQ ID NO: 4930835 - DNA, 15 bp, Homo sapiens
cttttatgtttgaat

SEQ ID NO: 4930836 - DNA, 17 bp, Homo sapiens
cttttatgtttgaatat

SEQ ID NO: 4930837 - DNA, 18 bp, Homo sapiens
cttttatgtttgaatatg

SEQ ID NO: 4930838 - DNA, 18 bp, Homo sapiens
cttttattgacacagaaa

SEQ ID NO: 4930839 - DNA, 16 bp, Homo sapiens
cttttattgtataaac

SEQ ID NO: 4930840 - DNA, 19 bp, Homo sapiens
cttttatttgcaacattta

SEQ ID NO: 4930841 - DNA, 19 bp, Homo sapiens
cttttattttgaaaagctt

SEQ ID NO: 4930842 - DNA, 12 bp, Homo sapiens
cttttcactgct

SEQ ID NO: 4930843 - DNA, 16 bp, Homo sapiens
cttttcactgctggct

SEQ ID NO: 4930844 - DNA, 15 bp, Homo sapiens
cttttcattctcatt

SEQ ID NO: 4930845 - DNA, 12 bp, Homo sapiens
cttttccctctt

SEQ ID NO: 4930846 - DNA, 15 bp, Homo sapiens
cttttccctcttttc

SEQ ID NO: 4930847 - DNA, 22 bp, Homo sapiens
cttttcctgataaagcacagct

SEQ ID NO: 4930848 - DNA, 12 bp, Homo sapiens
cttttctagttt

SEQ ID NO: 4930849 - DNA, 18 bp, Homo sapiens
cttttctcatgtgtttgc

SEQ ID NO: 4930850 - DNA, 11 bp, Homo sapiens
cttttctgctg

SEQ ID NO: 4930851 - DNA, 21 bp, Homo sapiens
cttttctggggaaagacactg

SEQ ID NO: 4930852 - DNA, 17 bp, Homo sapiens
cttttcttactcctcct

SEQ ID NO: 4930853 - DNA, 18 bp, Homo sapiens
cttttcttactcctcctc

SEQ ID NO: 4930854 - DNA, 14 bp, Homo sapiens
cttttctttaaaga

SEQ ID NO: 4930855 - DNA, 17 bp, Homo sapiens
cttttcttttgttactg

SEQ ID NO: 4930856 - DNA, 19 bp, Homo sapiens
cttttcttttgttactgtt

SEQ ID NO: 4930857 - DNA, 21 bp, Homo sapiens
cttttcttttgttactgttct

SEQ ID NO: 4930858 - DNA, 14 bp, Homo sapiens
cttttctttttaca

SEQ ID NO: 4930859 - DNA, 23 bp, Homo sapiens
cttttctttttacataactgcct

SEQ ID NO: 4930860 - DNA, 15 bp, Homo sapiens
cttttggcttccatg

SEQ ID NO: 4930861 - DNA, 15 bp, Homo sapiens
cttttggtgtgttgg

SEQ ID NO: 4930862 - DNA, 17 bp, Homo sapiens
cttttggtgtgttggac

SEQ ID NO: 4930863 - DNA, 12 bp, Homo sapiens
cttttgtaaaga

SEQ ID NO: 4930864 - DNA, 23 bp, Homo sapiens
cttttgtaaagaaatttactata

SEQ ID NO: 4930865 - DNA, 13 bp, Homo sapiens
cttttgtacatct

SEQ ID NO: 4930866 - DNA, 10 bp, Homo sapiens
cttttgttac

SEQ ID NO: 4930867 - DNA, 16 bp, Homo sapiens
cttttgttactgttct

SEQ ID NO: 4930868 - DNA, 18 bp, Homo sapiens
cttttgttactgttcttg

SEQ ID NO: 4930869 - DNA, 22 bp, Homo sapiens
cttttgttactgttcttgctgc

SEQ ID NO: 4930870 - DNA, 16 bp, Homo sapiens
ctttttaaagtgtttc

SEQ ID NO: 4930871 - DNA, 18 bp, Homo sapiens
ctttttaagtaatgtgga

SEQ ID NO: 4930872 - DNA, 12 bp, Homo sapiens
ctttttatttat

SEQ ID NO: 4930873 - DNA, 19 bp, Homo sapiens
ctttttatttatatgtact

SEQ ID NO: 4930874 - DNA, 13 bp, Homo sapiens
ctttttccagagg

SEQ ID NO: 4930875 - DNA, 12 bp, Homo sapiens
ctttttcctcct

SEQ ID NO: 4930876 - DNA, 15 bp, Homo sapiens
ctttttctgttgtaa

SEQ ID NO: 4930877 - DNA, 16 bp, Homo sapiens
ctttttctgttgtaac

SEQ ID NO: 4930878 - DNA, 18 bp, Homo sapiens
ctttttctgttgtaactt

SEQ ID NO: 4930879 - DNA, 17 bp, Homo sapiens
cttttttaaaaaagcaa

SEQ ID NO: 4930880 - DNA, 14 bp, Homo sapiens
cttttttaaataaa

SEQ ID NO: 4930881 - DNA, 11 bp, Homo sapiens
cttttttactc

SEQ ID NO: 4930882 - DNA, 20 bp, Homo sapiens
cttttttactcattgaaatg

SEQ ID NO: 4930883 - DNA, 21 bp, Homo sapiens
cttttttactcattgaaatgt

SEQ ID NO: 4930884 - DNA, 23 bp, Homo sapiens
cttttttactcattgaaatgtca

SEQ ID NO: 4930885 - DNA, 11 bp, Homo sapiens
cttttttgtcc

SEQ ID NO: 4930886 - DNA, 22 bp, Homo sapiens
cttttttgtcccccaacttgag

SEQ ID NO: 4930887 - DNA, 15 bp, Homo sapiens
cttttttgtttgttt

SEQ ID NO: 4930888 - DNA, 23 bp, Homo sapiens
gaaagttttgagtagatattact

SEQ ID NO: 4930889 - DNA, 16 bp, Homo sapiens
gaaataaaacctttca

SEQ ID NO: 4930890 - DNA, 17 bp, Homo sapiens
gaaataaacttcactga

SEQ ID NO: 4930891 - DNA, 15 bp, Homo sapiens
gaaataacaaaatgg

SEQ ID NO: 4930892 - DNA, 17 bp, Homo sapiens
gaaataacaaaatggac

SEQ ID NO: 4930893 - DNA, 15 bp, Homo sapiens
gaaataacaatgtta

SEQ ID NO: 4930894 - DNA, 18 bp, Homo sapiens
gaaataacaatgttaagg

SEQ ID NO: 4930895 - DNA, 13 bp, Homo sapiens
gaaataatatgca

SEQ ID NO: 4930896 - DNA, 22 bp, Homo sapiens
gaaatacccttcttttatgagc

SEQ ID NO: 4930897 - DNA, 16 bp, Homo sapiens
gaaatacctcatgttt

SEQ ID NO: 4930898 - DNA, 15 bp, Homo sapiens
gaaataggaaacaag

SEQ ID NO: 4930899 - DNA, 19 bp, Homo sapiens
gaaatatatatacatatgt

SEQ ID NO: 4930900 - DNA, 13 bp, Homo sapiens
gaaatatgtgaga

SEQ ID NO: 4930901 - DNA, 16 bp, Homo sapiens
gaaatcaatgcaagag

SEQ ID NO: 4930902 - DNA, 18 bp, Homo sapiens
gaaatcatcgaaaattca

SEQ ID NO: 4930903 - DNA, 23 bp, Homo sapiens
gaaatccctgtttaatatttaaa

SEQ ID NO: 4930904 - DNA, 21 bp, Homo sapiens
gaaatcctagtttcctctcct

SEQ ID NO: 4930905 - DNA, 22 bp, Homo sapiens
gaaatcctagtttcctctcctt

SEQ ID NO: 4930906 - DNA, 14 bp, Homo sapiens
gaaatcttttaaaa

SEQ ID NO: 4930907 - DNA, 13 bp, Homo sapiens
gaaatgaacattc

SEQ ID NO: 4930908 - DNA, 18 bp, Homo sapiens
gaaatgagaaggcagcca

SEQ ID NO: 4930909 - DNA, 18 bp, Homo sapiens
gaaatgaggtcagagcct

SEQ ID NO: 4930910 - DNA, 21 bp, Homo sapiens
gaaatgaggtctgtttaaagt

SEQ ID NO: 4930911 - DNA, 11 bp, Homo sapiens
gaaatgatgtt

SEQ ID NO: 4930912 - DNA, 16 bp, Homo sapiens
gaaatgtaccttcttt

SEQ ID NO: 4930913 - DNA, 21 bp, Homo sapiens
gaaatgttaaaggttcacagg

SEQ ID NO: 4930914 - DNA, 19 bp, Homo sapiens
gaaattatatctgtggtct

SEQ ID NO: 4930915 - DNA, 23 bp, Homo sapiens
gaaattatgtgacattttacatt

SEQ ID NO: 4930916 - DNA, 13 bp, Homo sapiens
gaaattatttaat

SEQ ID NO: 4930917 - DNA, 12 bp, Homo sapiens
gaaattccaaag

SEQ ID NO: 4930918 - DNA, 22 bp, Homo sapiens
gaaattggaacagaatgtttta

SEQ ID NO: 4930919 - DNA, 18 bp, Homo sapiens
gaaattgtgaactcattg

SEQ ID NO: 4930920 - DNA, 15 bp, Homo sapiens
gaaatttaaacatta

SEQ ID NO: 4930921 - DNA, 13 bp, Homo sapiens
gaaatttactata

SEQ ID NO: 4930922 - DNA, 15 bp, Homo sapiens
gaaatttgatttcta

SEQ ID NO: 4930923 - DNA, 18 bp, Homo sapiens
gaaattttctagactttc

SEQ ID NO: 4930924 - DNA, 20 bp, Homo sapiens
gaaattttctagactttctg

SEQ ID NO: 4930925 - DNA, 21 bp, Homo sapiens
gaaattttctagactttctgt

SEQ ID NO: 4930926 - DNA, 15 bp, Homo sapiens
gaaattttgcaaata

SEQ ID NO: 4930927 - DNA, 16 bp, Homo sapiens
gaaattttgcaaatat

SEQ ID NO: 4930928 - DNA, 13 bp, Homo sapiens
gaacaaagctgtt

SEQ ID NO: 4930929 - DNA, 18 bp, Homo sapiens
gaacaaagctgttaaact

SEQ ID NO: 4930930 - DNA, 12 bp, Homo sapiens
gaacaagtttta

SEQ ID NO: 4930931 - DNA, 19 bp, Homo sapiens
gaacacaaactgtaaataa

SEQ ID NO: 4930932 - DNA, 11 bp, Homo sapiens
gaacacaggca

SEQ ID NO: 4930933 - DNA, 17 bp, Homo sapiens
gaacacaggcaaaatcc

SEQ ID NO: 4930934 - DNA, 12 bp, Homo sapiens
gaacacaggcag

SEQ ID NO: 4930935 - DNA, 16 bp, Homo sapiens
gaacacaggcagcttt

SEQ ID NO: 4930936 - DNA, 14 bp, Homo sapiens
gaacaccctcgaag

SEQ ID NO: 4930937 - DNA, 13 bp, Homo sapiens
gaacacccttaga

SEQ ID NO: 4930938 - DNA, 18 bp, Homo sapiens
gaacactcttttgcttta

SEQ ID NO: 4930939 - DNA, 14 bp, Homo sapiens
gaacagaaggatga

SEQ ID NO: 4930940 - DNA, 19 bp, Homo sapiens
gaacagaaggatgaatgag

SEQ ID NO: 4930941 - DNA, 14 bp, Homo sapiens
gaacagaatgtttt

SEQ ID NO: 4930942 - DNA, 19 bp, Homo sapiens
gaacagacaacagaagtca

SEQ ID NO: 4930943 - DNA, 19 bp, Homo sapiens
gaacagaccggagaggaca

SEQ ID NO: 4930944 - DNA, 19 bp, Homo sapiens
gaacagactggaagcacag

SEQ ID NO: 4930945 - DNA, 20 bp, Homo sapiens
gaacagactggaagcacagc

SEQ ID NO: 4930946 - DNA, 21 bp, Homo sapiens
gaacagcgaagtagcttgctc

SEQ ID NO: 4930947 - DNA, 22 bp, Homo sapiens
gaacagctatgggagccccagg

SEQ ID NO: 4930948 - DNA, 14 bp, Homo sapiens
gaacagcttcaggt

SEQ ID NO: 4930949 - DNA, 14 bp, Homo sapiens
gaacaggctgggct

SEQ ID NO: 4930950 - DNA, 14 bp, Homo sapiens
gaacataaaaagga

SEQ ID NO: 4930951 - DNA, 19 bp, Homo sapiens
gaacatcctttgcagggca

SEQ ID NO: 4930952 - DNA, 20 bp, Homo sapiens
gaacatctttgacactctgc

SEQ ID NO: 4930953 - DNA, 13 bp, Homo sapiens
gaaccaaagctca

SEQ ID NO: 4930954 - DNA, 18 bp, Homo sapiens
gaaccacatcttgctctg

SEQ ID NO: 4930955 - DNA, 21 bp, Homo sapiens
gaaccacatcttgctctgctg

SEQ ID NO: 4930956 - DNA, 21 bp, Homo sapiens
gaaccaccacacccagcccac

SEQ ID NO: 4930957 - DNA, 19 bp, Homo sapiens
gaaccactacatgcagccc

SEQ ID NO: 4930958 - DNA, 20 bp, Homo sapiens
gaaccatccacttacatata

SEQ ID NO: 4930959 - DNA, 16 bp, Homo sapiens
gaaccatgaagacagg

SEQ ID NO: 4930960 - DNA, 17 bp, Homo sapiens
gaaccatgaagacagga

SEQ ID NO: 4930961 - DNA, 19 bp, Homo sapiens
gaaccccgtcgaggggctc

SEQ ID NO: 4930962 - DNA, 19 bp, Homo sapiens
gaaccgagcaaagatcaaa

SEQ ID NO: 4930963 - DNA, 16 bp, Homo sapiens
gaaccgcacagctcag

SEQ ID NO: 4930964 - DNA, 17 bp, Homo sapiens
gaaccgttttgaagcta

SEQ ID NO: 4930965 - DNA, 13 bp, Homo sapiens
gaacctcccagag

SEQ ID NO: 4930966 - DNA, 22 bp, Homo sapiens
gaacctcccagaggtccagccc

SEQ ID NO: 4930967 - DNA, 12 bp, Homo sapiens
gaacctctgtct

SEQ ID NO: 4930968 - DNA, 14 bp, Homo sapiens
gaacctctgtctca

SEQ ID NO: 4930969 - DNA, 18 bp, Homo sapiens
gaacctctgtctcatcct

SEQ ID NO: 4930970 - DNA, 14 bp, Homo sapiens
gaacctcttcccca

SEQ ID NO: 4930971 - DNA, 12 bp, Homo sapiens
gaacctgtgagt

SEQ ID NO: 4930972 - DNA, 22 bp, Homo sapiens
gaacgcagccctagagcctgcc

SEQ ID NO: 4930973 - DNA, 23 bp, Homo sapiens
gaacgcagccctagagcctgcct

SEQ ID NO: 4930974 - DNA, 18 bp, Homo sapiens
gaacggtgaaggtgacag

SEQ ID NO: 4930975 - DNA, 15 bp, Homo sapiens
gaactaaatgttcta

SEQ ID NO: 4930976 - DNA, 16 bp, Homo sapiens
gaactaaatgttctat

SEQ ID NO: 4930977 - DNA, 22 bp, Homo sapiens
gaactacgcttgctcatttttt

SEQ ID NO: 4930978 - DNA, 18 bp, Homo sapiens
gaactagcatatagccat

SEQ ID NO: 4930979 - DNA, 16 bp, Homo sapiens
gaactagggaagctca

SEQ ID NO: 4930980 - DNA, 15 bp, Homo sapiens
gaactcctgacctca

SEQ ID NO: 4930981 - DNA, 13 bp, Homo sapiens
gaactcctggcct

SEQ ID NO: 4930982 - DNA, 15 bp, Homo sapiens
gaactcctggcctca

SEQ ID NO: 4930983 - DNA, 14 bp, Homo sapiens
gaactccttggcct

SEQ ID NO: 4930984 - DNA, 15 bp, Homo sapiens
gaactccttggccta

SEQ ID NO: 4930985 - DNA, 19 bp, Homo sapiens
gaactctatctgggcctgg

SEQ ID NO: 4930986 - DNA, 20 bp, Homo sapiens
gaactctatctgggcctggg

SEQ ID NO: 4930987 - DNA, 21 bp, Homo sapiens
gaactctatctgggcctgggc

SEQ ID NO: 4930988 - DNA, 17 bp, Homo sapiens
gaactctgacaagggct

SEQ ID NO: 4930989 - DNA, 18 bp, Homo sapiens
gaactcttagaaatgaag

SEQ ID NO: 4930990 - DNA, 20 bp, Homo sapiens
gaactgccattattttctgt

SEQ ID NO: 4930991 - DNA, 18 bp, Homo sapiens
gaactgtagatgatgtat

SEQ ID NO: 4930992 - DNA, 14 bp, Homo sapiens
gaactgtccagaga

SEQ ID NO: 4930993 - DNA, 15 bp, Homo sapiens
gaactgtccagagag

SEQ ID NO: 4930994 - DNA, 21 bp, Homo sapiens
gaacttactattcattaaatg

SEQ ID NO: 4930995 - DNA, 13 bp, Homo sapiens
gaacttctaatat

SEQ ID NO: 4930996 - DNA, 14 bp, Homo sapiens
gaacttgaatgtgt

SEQ ID NO: 4930997 - DNA, 12 bp, Homo sapiens
gaacttgcatgg

SEQ ID NO: 4930998 - DNA, 17 bp, Homo sapiens
gaacttttttaaataaa

SEQ ID NO: 4930999 - DNA, 10 bp, Homo sapiens
gaagaaaaaa

SEQ ID NO: 4931000 - DNA, 11 bp, Homo sapiens
gaagaaaaaaa

SEQ ID NO: 4931001 - DNA, 9 bp, Homo sapiens
gaagaagaa

SEQ ID NO: 4931002 - DNA, 14 bp, Homo sapiens
gaagaagaaaagag

SEQ ID NO: 4931003 - DNA, 15 bp, Homo sapiens
gaagaagaaaagaga

SEQ ID NO: 4931004 - DNA, 14 bp, Homo sapiens
gaagaagaagaaaa

SEQ ID NO: 4931005 - DNA, 15 bp, Homo sapiens
gaagaagaagaagaa

SEQ ID NO: 4931006 - DNA, 16 bp, Homo sapiens
gaagaagagaagctgc

SEQ ID NO: 4931007 - DNA, 13 bp, Homo sapiens
gaagaagatgctc

SEQ ID NO: 4931008 - DNA, 15 bp, Homo sapiens
gaagaagcagagaga

SEQ ID NO: 4931009 - DNA, 13 bp, Homo sapiens
gaagaatttgtta

SEQ ID NO: 4931010 - DNA, 14 bp, Homo sapiens
gaagaatttgttat

SEQ ID NO: 4931011 - DNA, 15 bp, Homo sapiens
gaagacaaaaagaca

SEQ ID NO: 4931012 - DNA, 14 bp, Homo sapiens
gaagacaccagagc

SEQ ID NO: 4931013 - DNA, 18 bp, Homo sapiens
gaagacaccagagcagat

SEQ ID NO: 4931014 - DNA, 23 bp, Homo sapiens
gaagacaccagagcagatgcaga

SEQ ID NO: 4931015 - DNA, 15 bp, Homo sapiens
gaagacatttctttt

SEQ ID NO: 4931016 - DNA, 17 bp, Homo sapiens
gaagacatttcttttct

SEQ ID NO: 4931017 - DNA, 14 bp, Homo sapiens
gaagaccctccccg

SEQ ID NO: 4931018 - DNA, 14 bp, Homo sapiens
gaagagaagctgct

SEQ ID NO: 4931019 - DNA, 16 bp, Homo sapiens
gaagagaagctgctga

SEQ ID NO: 4931020 - DNA, 20 bp, Homo sapiens
gaagagaagctgctgaccaa

SEQ ID NO: 4931021 - DNA, 23 bp, Homo sapiens
gaagagagatatatctgaaaact

SEQ ID NO: 4931022 - DNA, 13 bp, Homo sapiens
gaagagaggagag

SEQ ID NO: 4931023 - DNA, 19 bp, Homo sapiens
gaagagaggagaggagaga

SEQ ID NO: 4931024 - DNA, 14 bp, Homo sapiens
gaagagaggggaag

SEQ ID NO: 4931025 - DNA, 21 bp, Homo sapiens
gaagagcaaaaatatcccttc

SEQ ID NO: 4931026 - DNA, 17 bp, Homo sapiens
gaagagggttttaggta

SEQ ID NO: 4931027 - DNA, 17 bp, Homo sapiens
gaagattttcagtctag

SEQ ID NO: 4931028 - DNA, 14 bp, Homo sapiens
gaagcaaataaata

SEQ ID NO: 4931029 - DNA, 15 bp, Homo sapiens
gaagcaaataaatat

SEQ ID NO: 4931030 - DNA, 14 bp, Homo sapiens
gaagcaacatttta

SEQ ID NO: 4931031 - DNA, 14 bp, Homo sapiens
gaagcacagcttca

SEQ ID NO: 4931032 - DNA, 21 bp, Homo sapiens
gaagcaccccatgccaaagct

SEQ ID NO: 4931033 - DNA, 12 bp, Homo sapiens
gaagcagagaga

SEQ ID NO: 4931034 - DNA, 14 bp, Homo sapiens
gaagcagagagatg

SEQ ID NO: 4931035 - DNA, 15 bp, Homo sapiens
gaagcagagagatgc

SEQ ID NO: 4931036 - DNA, 16 bp, Homo sapiens
gaagcagttgtgtcag

SEQ ID NO: 4931037 - DNA, 17 bp, Homo sapiens
gaagcatttactttgtg

SEQ ID NO: 4931038 - DNA, 12 bp, Homo sapiens
gaagcatttgta

SEQ ID NO: 4931039 - DNA, 20 bp, Homo sapiens
gaagccagccttcttccatc

SEQ ID NO: 4931040 - DNA, 16 bp, Homo sapiens
gaagcccaagtgaaat

SEQ ID NO: 4931041 - DNA, 16 bp, Homo sapiens
gaagccgggaacagac

SEQ ID NO: 4931042 - DNA, 13 bp, Homo sapiens
gaagcctctggct

SEQ ID NO: 4931043 - DNA, 14 bp, Homo sapiens
gaagcctctggcta

SEQ ID NO: 4931044 - DNA, 23 bp, Homo sapiens
gaagcctgcgttggtccagagcg

SEQ ID NO: 4931045 - DNA, 18 bp, Homo sapiens
gaagcctgtggatgatca

SEQ ID NO: 4931046 - DNA, 14 bp, Homo sapiens
gaagcggatttcca

SEQ ID NO: 4931047 - DNA, 16 bp, Homo sapiens
gaagcggatttccagg

SEQ ID NO: 4931048 - DNA, 14 bp, Homo sapiens
gaagctaatttgca

SEQ ID NO: 4931049 - DNA, 15 bp, Homo sapiens
gaagctactgtgtgt

SEQ ID NO: 4931050 - DNA, 20 bp, Homo sapiens
gaagctactgtgtgtgtgaa

SEQ ID NO: 4931051 - DNA, 22 bp, Homo sapiens
gaagctactgtgtgtgtgaatg

SEQ ID NO: 4931052 - DNA, 15 bp, Homo sapiens
gaagctccactgtca

SEQ ID NO: 4931053 - DNA, 18 bp, Homo sapiens
gaagctccactgtcaccc

SEQ ID NO: 4931054 - DNA, 23 bp, Homo sapiens
gaagctccactgtcaccctccac

SEQ ID NO: 4931055 - DNA, 20 bp, Homo sapiens
gaagctctgaagtcacatca

SEQ ID NO: 4931056 - DNA, 15 bp, Homo sapiens
gaagctgaaaatata

SEQ ID NO: 4931057 - DNA, 17 bp, Homo sapiens
gaagctgagggcaaatc

SEQ ID NO: 4931058 - DNA, 12 bp, Homo sapiens
gaagctgcagct

SEQ ID NO: 4931059 - DNA, 15 bp, Homo sapiens
gaagctgcagcttgg

SEQ ID NO: 4931060 - DNA, 18 bp, Homo sapiens
gaagctgcatccagaggc

SEQ ID NO: 4931061 - DNA, 10 bp, Homo sapiens
gaagctgctg

SEQ ID NO: 4931062 - DNA, 11 bp, Homo sapiens
gaagctgctga

SEQ ID NO: 4931063 - DNA, 13 bp, Homo sapiens
gaagctgctgacc

SEQ ID NO: 4931064 - DNA, 14 bp, Homo sapiens
gaagctgctgacca

SEQ ID NO: 4931065 - DNA, 21 bp, Homo sapiens
gaagctgttgtacatttatga

SEQ ID NO: 4931066 - DNA, 22 bp, Homo sapiens
gaaggacccggaggggcctggc

SEQ ID NO: 4931067 - DNA, 20 bp, Homo sapiens
gaaggacgggttggggccgg

SEQ ID NO: 4931068 - DNA, 16 bp, Homo sapiens
gaaggcagccaccagc

SEQ ID NO: 4931069 - DNA, 13 bp, Homo sapiens
gaaggcctgactt

SEQ ID NO: 4931070 - DNA, 16 bp, Homo sapiens
gaagggagcagcacac

SEQ ID NO: 4931071 - DNA, 21 bp, Homo sapiens
gaagggcataaaacagctttg

SEQ ID NO: 4931072 - DNA, 22 bp, Homo sapiens
gaagggccagtcctgcctggcc

SEQ ID NO: 4931073 - DNA, 22 bp, Homo sapiens
gaaggggcctcaccgagtgggg

SEQ ID NO: 4931074 - DNA, 19 bp, Homo sapiens
gaagggggggctacattat

SEQ ID NO: 4931075 - DNA, 17 bp, Homo sapiens
gaaggtgctggaggtgg

SEQ ID NO: 4931076 - DNA, 23 bp, Homo sapiens
gaaggtgctggaggtgggagcag

SEQ ID NO: 4931077 - DNA, 23 bp, Homo sapiens
gaaggtggaccttttaaagtgtt

SEQ ID NO: 4931078 - DNA, 13 bp, Homo sapiens
gaagtcacacagt

SEQ ID NO: 4931079 - DNA, 15 bp, Homo sapiens
gaagtcactgcacag

SEQ ID NO: 4931080 - DNA, 12 bp, Homo sapiens
gaagtcatatgt

SEQ ID NO: 4931081 - DNA, 17 bp, Homo sapiens
gaagtccaatgtggcaa

SEQ ID NO: 4931082 - DNA, 9 bp, Homo sapiens
gaagtcttg

SEQ ID NO: 4931083 - DNA, 16 bp, Homo sapiens
gaagtgccccctcccc

SEQ ID NO: 4931084 - DNA, 15 bp, Homo sapiens
gaagtgcgtgaatgt

SEQ ID NO: 4931085 - DNA, 20 bp, Homo sapiens
gaagtgctggcaaccactaa

SEQ ID NO: 4931086 - DNA, 21 bp, Homo sapiens
gaagtgcttagtgtacttgga

SEQ ID NO: 4931087 - DNA, 14 bp, Homo sapiens
gaagtggtccatct

SEQ ID NO: 4931088 - DNA, 18 bp, Homo sapiens
gaagtgttgaagggaggt

SEQ ID NO: 4931089 - DNA, 16 bp, Homo sapiens
gaagttactttatgtt

SEQ ID NO: 4931090 - DNA, 17 bp, Homo sapiens
gaagttgaagtttagga

SEQ ID NO: 4931091 - DNA, 14 bp, Homo sapiens
gaagtttaaaacag

SEQ ID NO: 4931092 - DNA, 17 bp, Homo sapiens
gaagtttacattgtaaa

SEQ ID NO: 4931093 - DNA, 13 bp, Homo sapiens
gaagtttacattt

SEQ ID NO: 4931094 - DNA, 17 bp, Homo sapiens
gaagtttattctcattt

SEQ ID NO: 4931095 - DNA, 12 bp, Homo sapiens
gaataaacttca

SEQ ID NO: 4931096 - DNA, 14 bp, Homo sapiens
gaataaacttcagc

SEQ ID NO: 4931097 - DNA, 17 bp, Homo sapiens
gaataaacttcagcacc

SEQ ID NO: 4931098 - DNA, 22 bp, Homo sapiens
gaataatctttgggtaacttca

SEQ ID NO: 4931099 - DNA, 18 bp, Homo sapiens
gaataattatttatttaa

SEQ ID NO: 4931100 - DNA, 20 bp, Homo sapiens
gaataccattaaaactgctt

SEQ ID NO: 4931101 - DNA, 18 bp, Homo sapiens
gaatagccacatttggaa

SEQ ID NO: 4931102 - DNA, 14 bp, Homo sapiens
gaatagctgggact

SEQ ID NO: 4931103 - DNA, 22 bp, Homo sapiens
gaatagctgggactacaggtgt

SEQ ID NO: 4931104 - DNA, 23 bp, Homo sapiens
gaatagctgggactacaggtgtg

SEQ ID NO: 4931105 - DNA, 21 bp, Homo sapiens
gaatagttggtcatctagcaa

SEQ ID NO: 4931106 - DNA, 14 bp, Homo sapiens
gaatatctttcgat

SEQ ID NO: 4931107 - DNA, 19 bp, Homo sapiens
gaatatgtttccttgttta

SEQ ID NO: 4931108 - DNA, 18 bp, Homo sapiens
gaatattcccaagcccat

SEQ ID NO: 4931109 - DNA, 15 bp, Homo sapiens
gacaccaaagttcta

SEQ ID NO: 4931110 - DNA, 23 bp, Homo sapiens
gacaccaaccgacaggccctggc

SEQ ID NO: 4931111 - DNA, 19 bp, Homo sapiens
gacaccacacccagcctca

SEQ ID NO: 4931112 - DNA, 21 bp, Homo sapiens
gacaccacacccagcctcagt

SEQ ID NO: 4931113 - DNA, 13 bp, Homo sapiens
gacaccagagcag

SEQ ID NO: 4931114 - DNA, 14 bp, Homo sapiens
gacaccagagcaga

SEQ ID NO: 4931115 - DNA, 19 bp, Homo sapiens
gacaccgggccagtatcta

SEQ ID NO: 4931116 - DNA, 20 bp, Homo sapiens
gacaccggggtggtgggaac

SEQ ID NO: 4931117 - DNA, 14 bp, Homo sapiens
gacacctgccctgc

SEQ ID NO: 4931118 - DNA, 17 bp, Homo sapiens
gacaccttgacagggca

SEQ ID NO: 4931119 - DNA, 21 bp, Homo sapiens
gacacgtgtggcgggcagtgg

SEQ ID NO: 4931120 - DNA, 15 bp, Homo sapiens
gacactaaccacgct

SEQ ID NO: 4931121 - DNA, 21 bp, Homo sapiens
gacactaaccacgctggacct

SEQ ID NO: 4931122 - DNA, 20 bp, Homo sapiens
gacactatagtttaaaacac

SEQ ID NO: 4931123 - DNA, 13 bp, Homo sapiens
gacactcagacct

SEQ ID NO: 4931124 - DNA, 15 bp, Homo sapiens
gacactcagacctga

SEQ ID NO: 4931125 - DNA, 12 bp, Homo sapiens
gacactccagtg

SEQ ID NO: 4931126 - DNA, 16 bp, Homo sapiens
gacactccccgaagtc

SEQ ID NO: 4931127 - DNA, 21 bp, Homo sapiens
gacactccccgaagtcttttg

SEQ ID NO: 4931128 - DNA, 14 bp, Homo sapiens
gacactcctagaga

SEQ ID NO: 4931129 - DNA, 17 bp, Homo sapiens
gacactctctggaagcc

SEQ ID NO: 4931130 - DNA, 15 bp, Homo sapiens
gacactgatgggcaa

SEQ ID NO: 4931131 - DNA, 13 bp, Homo sapiens
gacactgcctggg

SEQ ID NO: 4931132 - DNA, 13 bp, Homo sapiens
gacactgtacaag

SEQ ID NO: 4931133 - DNA, 18 bp, Homo sapiens
gacagaacttgaatgtgt

SEQ ID NO: 4931134 - DNA, 20 bp, Homo sapiens
gacagacacaggcccggctc

SEQ ID NO: 4931135 - DNA, 22 bp, Homo sapiens
gacagacacaggcccggctcca

SEQ ID NO: 4931136 - DNA, 12 bp, Homo sapiens
gacagagaaggg

SEQ ID NO: 4931137 - DNA, 12 bp, Homo sapiens
gacagaggcctg

SEQ ID NO: 4931138 - DNA, 16 bp, Homo sapiens
gacagaggggactctg

SEQ ID NO: 4931139 - DNA, 19 bp, Homo sapiens
gacagaggggactctgggc

SEQ ID NO: 4931140 - DNA, 20 bp, Homo sapiens
gacagaggggactctgggct

SEQ ID NO: 4931141 - DNA, 14 bp, Homo sapiens
gacagagtctcact

SEQ ID NO: 4931142 - DNA, 21 bp, Homo sapiens
gacagagtctcactgttgccc

SEQ ID NO: 4931143 - DNA, 20 bp, Homo sapiens
gacagagtgagactctgtct

SEQ ID NO: 4931144 - DNA, 23 bp, Homo sapiens
gacagatccccgttcctgacatc

SEQ ID NO: 4931145 - DNA, 20 bp, Homo sapiens
gacagatgccccagagctgt

SEQ ID NO: 4931146 - DNA, 19 bp, Homo sapiens
gacagcatgtgccctcctg

SEQ ID NO: 4931147 - DNA, 21 bp, Homo sapiens
gacagcatgtgccctcctgag

SEQ ID NO: 4931148 - DNA, 14 bp, Homo sapiens
gacagccacggcca

SEQ ID NO: 4931149 - DNA, 20 bp, Homo sapiens
gacagccacggccaggccag

SEQ ID NO: 4931150 - DNA, 18 bp, Homo sapiens
gacagccccagagcaggg

SEQ ID NO: 4931151 - DNA, 19 bp, Homo sapiens
gacagccccagagcagggt

SEQ ID NO: 4931152 - DNA, 13 bp, Homo sapiens
gacagcctggcac

SEQ ID NO: 4931153 - DNA, 15 bp, Homo sapiens
gacagctccttctgt

SEQ ID NO: 4931154 - DNA, 17 bp, Homo sapiens
gacagctccttctgtcc

SEQ ID NO: 4931155 - DNA, 17 bp, Homo sapiens
gacagctgatacttcat

SEQ ID NO: 4931156 - DNA, 16 bp, Homo sapiens
gacaggatgggggctg

SEQ ID NO: 4931157 - DNA, 17 bp, Homo sapiens
gacaggcaagcacctcc

SEQ ID NO: 4931158 - DNA, 18 bp, Homo sapiens
gacaggcaagcacctcct

SEQ ID NO: 4931159 - DNA, 20 bp, Homo sapiens
gacaggcaagcacctcctgc

SEQ ID NO: 4931160 - DNA, 23 bp, Homo sapiens
gacaggcaatgctggctgttggc

SEQ ID NO: 4931161 - DNA, 21 bp, Homo sapiens
gacaggcatgttctctgagga

SEQ ID NO: 4931162 - DNA, 13 bp, Homo sapiens
gacaggccctggc

SEQ ID NO: 4931163 - DNA, 15 bp, Homo sapiens
gacaggcgagagagg

SEQ ID NO: 4931164 - DNA, 20 bp, Homo sapiens
gacagggaacagtatttcca

SEQ ID NO: 4931165 - DNA, 16 bp, Homo sapiens
gacagggaagagcaga

SEQ ID NO: 4931166 - DNA, 15 bp, Homo sapiens
gacagggcatggcca

SEQ ID NO: 4931167 - DNA, 10 bp, Homo sapiens
gacagggcca

SEQ ID NO: 4931168 - DNA, 12 bp, Homo sapiens
gacagggccagt

SEQ ID NO: 4931169 - DNA, 16 bp, Homo sapiens
gacagggccagtgggg

SEQ ID NO: 4931170 - DNA, 20 bp, Homo sapiens
gacagggccagtggggcctg

SEQ ID NO: 4931171 - DNA, 12 bp, Homo sapiens
gacagggtttca

SEQ ID NO: 4931172 - DNA, 20 bp, Homo sapiens
gacagggttttgccatgttg

SEQ ID NO: 4931173 - DNA, 16 bp, Homo sapiens
gacaggtccctcccct

SEQ ID NO: 4931174 - DNA, 18 bp, Homo sapiens
gacagtatcccacatcca

SEQ ID NO: 4931175 - DNA, 23 bp, Homo sapiens
gacagtcactgccactttgcaca

SEQ ID NO: 4931176 - DNA, 20 bp, Homo sapiens
gacagtcatcatcagggcct

SEQ ID NO: 4931177 - DNA, 23 bp, Homo sapiens
gacagtcatcatcagggcctggg

SEQ ID NO: 4931178 - DNA, 20 bp, Homo sapiens
gacagtggattgcatttctt

SEQ ID NO: 4931179 - DNA, 15 bp, Homo sapiens
gacagttcacaccct

SEQ ID NO: 4931180 - DNA, 17 bp, Homo sapiens
gacagttcacaccctgc

SEQ ID NO: 4931181 - DNA, 23 bp, Homo sapiens
gacagtttcttagctttttaatt

SEQ ID NO: 4931182 - DNA, 13 bp, Homo sapiens
gacagtttgtaaa

SEQ ID NO: 4931183 - DNA, 18 bp, Homo sapiens
gacagtttgtaaatgtta

SEQ ID NO: 4931184 - DNA, 11 bp, Homo sapiens
gacataaagcc

SEQ ID NO: 4931185 - DNA, 12 bp, Homo sapiens
gacataaagcca

SEQ ID NO: 4931186 - DNA, 15 bp, Homo sapiens
gacataacagtgcag

SEQ ID NO: 4931187 - DNA, 14 bp, Homo sapiens
gacataacgttttt

SEQ ID NO: 4931188 - DNA, 21 bp, Homo sapiens
gacataacgtttttcctttaa

SEQ ID NO: 4931189 - DNA, 14 bp, Homo sapiens
gacatagatatttt

SEQ ID NO: 4931190 - DNA, 22 bp, Homo sapiens
gacatagcccatccctgcctgg

SEQ ID NO: 4931191 - DNA, 23 bp, Homo sapiens
gacataggccatgaaaaaaatga

SEQ ID NO: 4931192 - DNA, 14 bp, Homo sapiens
gacatcacagcagc

SEQ ID NO: 4931193 - DNA, 15 bp, Homo sapiens
gacatcacagcagcc

SEQ ID NO: 4931194 - DNA, 15 bp, Homo sapiens
gacatcacttgtaca

SEQ ID NO: 4931195 - DNA, 22 bp, Homo sapiens
gacatcacttgtacaaaataaa

SEQ ID NO: 4931196 - DNA, 20 bp, Homo sapiens
gacatcagaggttctttgag

SEQ ID NO: 4931197 - DNA, 18 bp, Homo sapiens
gacatcatgaattttaca

SEQ ID NO: 4931198 - DNA, 13 bp, Homo sapiens
gacatctcagggg

SEQ ID NO: 4931199 - DNA, 15 bp, Homo sapiens
gacatctcaggggcc

SEQ ID NO: 4931200 - DNA, 16 bp, Homo sapiens
gacatctcaggggcca

SEQ ID NO: 4931201 - DNA, 18 bp, Homo sapiens
gacatctcaggggccaga

SEQ ID NO: 4931202 - DNA, 13 bp, Homo sapiens
gacatctctgcac

SEQ ID NO: 4931203 - DNA, 12 bp, Homo sapiens
gacatgcactga

SEQ ID NO: 4931204 - DNA, 20 bp, Homo sapiens
gacatgcactgacccttcca

SEQ ID NO: 4931205 - DNA, 21 bp, Homo sapiens
gacatgctgactgtcctctcc

SEQ ID NO: 4931206 - DNA, 19 bp, Homo sapiens
gacatggctttcagaaaac

SEQ ID NO: 4931207 - DNA, 15 bp, Homo sapiens
gacatgttatatatt

SEQ ID NO: 4931208 - DNA, 15 bp, Homo sapiens
gacatgttgtaaatt

SEQ ID NO: 4931209 - DNA, 17 bp, Homo sapiens
gacattatgtggtttta

SEQ ID NO: 4931210 - DNA, 20 bp, Homo sapiens
gacattatgtgtgcatgtgt

SEQ ID NO: 4931211 - DNA, 14 bp, Homo sapiens
gacattgcggacag

SEQ ID NO: 4931212 - DNA, 13 bp, Homo sapiens
gacatttaattta

SEQ ID NO: 4931213 - DNA, 14 bp, Homo sapiens
gacatttaatttag

SEQ ID NO: 4931214 - DNA, 15 bp, Homo sapiens
gacatttgccttgct

SEQ ID NO: 4931215 - DNA, 18 bp, Homo sapiens
gaccaaacttcactctgg

SEQ ID NO: 4931216 - DNA, 14 bp, Homo sapiens
gaccaactgtcact

SEQ ID NO: 4931217 - DNA, 13 bp, Homo sapiens
gaccaactgtgtt

SEQ ID NO: 4931218 - DNA, 21 bp, Homo sapiens
gaccaactgtgttgtattaac

SEQ ID NO: 4931219 - DNA, 18 bp, Homo sapiens
gactccacgatcctgcca

SEQ ID NO: 4931220 - DNA, 20 bp, Homo sapiens
gactccacgatcctgccacc

SEQ ID NO: 4931221 - DNA, 13 bp, Homo sapiens
gactcccatgaag

SEQ ID NO: 4931222 - DNA, 14 bp, Homo sapiens
gactcccatgaagc

SEQ ID NO: 4931223 - DNA, 18 bp, Homo sapiens
gactcccatgaagccttt

SEQ ID NO: 4931224 - DNA, 21 bp, Homo sapiens
gactcccatgaagccttttga

SEQ ID NO: 4931225 - DNA, 13 bp, Homo sapiens
gactccctcctca

SEQ ID NO: 4931226 - DNA, 14 bp, Homo sapiens
gactccctcctcac

SEQ ID NO: 4931227 - DNA, 23 bp, Homo sapiens
gactccctcctcacctctggact

SEQ ID NO: 4931228 - DNA, 16 bp, Homo sapiens
gactcctcctttctcc

SEQ ID NO: 4931229 - DNA, 22 bp, Homo sapiens
gactcctggtctgaaaatgttg

SEQ ID NO: 4931230 - DNA, 13 bp, Homo sapiens
gactcgcttgtaa

SEQ ID NO: 4931231 - DNA, 14 bp, Homo sapiens
gactcgcttgtaaa

SEQ ID NO: 4931232 - DNA, 15 bp, Homo sapiens
gactctaaagaccaa

SEQ ID NO: 4931233 - DNA, 19 bp, Homo sapiens
gactctaaagaccaaactt

SEQ ID NO: 4931234 - DNA, 15 bp, Homo sapiens
gactctgaagcctct

SEQ ID NO: 4931235 - DNA, 19 bp, Homo sapiens
gactctgaagcctctggga

SEQ ID NO: 4931236 - DNA, 20 bp, Homo sapiens
gactctgagcgggaggcaga

SEQ ID NO: 4931237 - DNA, 12 bp, Homo sapiens
gactctgcacat

SEQ ID NO: 4931238 - DNA, 15 bp, Homo sapiens
gactctgcacatgtc

SEQ ID NO: 4931239 - DNA, 13 bp, Homo sapiens
gactctgccccct

SEQ ID NO: 4931240 - DNA, 19 bp, Homo sapiens
gactctgccccctgctggc

SEQ ID NO: 4931241 - DNA, 21 bp, Homo sapiens
gactctgccccctgctggctc

SEQ ID NO: 4931242 - DNA, 12 bp, Homo sapiens
gactctgcctcc

SEQ ID NO: 4931243 - DNA, 20 bp, Homo sapiens
gactctgggctatggacaca

SEQ ID NO: 4931244 - DNA, 22 bp, Homo sapiens
gactctgggctatggacacagg

SEQ ID NO: 4931245 - DNA, 20 bp, Homo sapiens
gactgacagcatgtgccctc

SEQ ID NO: 4931246 - DNA, 12 bp, Homo sapiens
gactgaggacaa

SEQ ID NO: 4931247 - DNA, 15 bp, Homo sapiens
gactgaggacaaagt

SEQ ID NO: 4931248 - DNA, 21 bp, Homo sapiens
gactgcatgtaccatttgcat

SEQ ID NO: 4931249 - DNA, 16 bp, Homo sapiens
gactgcgttctgcaag

SEQ ID NO: 4931250 - DNA, 21 bp, Homo sapiens
gactgctccccagccctggct

SEQ ID NO: 4931251 - DNA, 21 bp, Homo sapiens
gactgctgctgcctggccact

SEQ ID NO: 4931252 - DNA, 15 bp, Homo sapiens
gactggaagcacagc

SEQ ID NO: 4931253 - DNA, 16 bp, Homo sapiens
gactggaagcacagct

SEQ ID NO: 4931254 - DNA, 18 bp, Homo sapiens
gactggaagcacagcttc

SEQ ID NO: 4931255 - DNA, 19 bp, Homo sapiens
gactggaagttcataccta

SEQ ID NO: 4931256 - DNA, 17 bp, Homo sapiens
gactggacctggtggct

SEQ ID NO: 4931257 - DNA, 14 bp, Homo sapiens
gactggcccctggg

SEQ ID NO: 4931258 - DNA, 23 bp, Homo sapiens
gactggggatgtgggagggagca

SEQ ID NO: 4931259 - DNA, 18 bp, Homo sapiens
gactggtttacaggccct

SEQ ID NO: 4931260 - DNA, 16 bp, Homo sapiens
gactgtactcctccca

SEQ ID NO: 4931261 - DNA, 17 bp, Homo sapiens
gactgtactcctcccag

SEQ ID NO: 4931262 - DNA, 14 bp, Homo sapiens
gactgtatctgtgt

SEQ ID NO: 4931263 - DNA, 19 bp, Homo sapiens
gactgtatctgtgtagact

SEQ ID NO: 4931264 - DNA, 15 bp, Homo sapiens
gactgtcatagaaat

SEQ ID NO: 4931265 - DNA, 19 bp, Homo sapiens
gactgtcctctcccctcca

SEQ ID NO: 4931266 - DNA, 20 bp, Homo sapiens
gactgtcctctcccctccag

SEQ ID NO: 4931267 - DNA, 23 bp, Homo sapiens
gactgtcctctcccctccagcct

SEQ ID NO: 4931268 - DNA, 21 bp, Homo sapiens
gactgtctcaagagggcactg

SEQ ID NO: 4931269 - DNA, 13 bp, Homo sapiens
gactgtgctactg

SEQ ID NO: 4931270 - DNA, 17 bp, Homo sapiens
gactgtggcacttgcct

SEQ ID NO: 4931271 - DNA, 15 bp, Homo sapiens
gacttactctaagat

SEQ ID NO: 4931272 - DNA, 19 bp, Homo sapiens
gacttagaaagcaggggct

SEQ ID NO: 4931273 - DNA, 22 bp, Homo sapiens
gacttagttgcgttacaccctt

SEQ ID NO: 4931274 - DNA, 17 bp, Homo sapiens
gacttatagtacatgat

SEQ ID NO: 4931275 - DNA, 14 bp, Homo sapiens
gacttcggaccgct

SEQ ID NO: 4931276 - DNA, 22 bp, Homo sapiens
gacttctccaggtctcacgggc

SEQ ID NO: 4931277 - DNA, 18 bp, Homo sapiens
gacttgcatgaagagaag

SEQ ID NO: 4931278 - DNA, 16 bp, Homo sapiens
gacttggaagctccgc

SEQ ID NO: 4931279 - DNA, 20 bp, Homo sapiens
gacttggggagatggagttc

SEQ ID NO: 4931280 - DNA, 22 bp, Homo sapiens
gacttgggggaacgatgtgtct

SEQ ID NO: 4931281 - DNA, 13 bp, Homo sapiens
gactttataagcc

SEQ ID NO: 4931282 - DNA, 21 bp, Homo sapiens
gactttatctaatacctctgt

SEQ ID NO: 4931283 - DNA, 21 bp, Homo sapiens
gactttcaaaattaaatctgt

SEQ ID NO: 4931284 - DNA, 20 bp, Homo sapiens
gactttgattgcacattgtt

SEQ ID NO: 4931285 - DNA, 15 bp, Homo sapiens
gactttggaagcagg

SEQ ID NO: 4931286 - DNA, 15 bp, Homo sapiens
gactttgtagatcct

SEQ ID NO: 4931287 - DNA, 18 bp, Homo sapiens
gactttgtatactttaaa

SEQ ID NO: 4931288 - DNA, 10 bp, Homo sapiens
gagaaaaaaa

SEQ ID NO: 4931289 - DNA, 13 bp, Homo sapiens
gagaaaaggaaaa

SEQ ID NO: 4931290 - DNA, 15 bp, Homo sapiens
gagaaactttataca

SEQ ID NO: 4931291 - DNA, 17 bp, Homo sapiens
gagaaactttatacatt

SEQ ID NO: 4931292 - DNA, 16 bp, Homo sapiens
gagaaaggttgaagca

SEQ ID NO: 4931293 - DNA, 23 bp, Homo sapiens
gagaaataaagtttgcttagaaa

SEQ ID NO: 4931294 - DNA, 20 bp, Homo sapiens
gagaaattctgttaaaatct

SEQ ID NO: 4931295 - DNA, 17 bp, Homo sapiens
gagaacaaacagatcga

SEQ ID NO: 4931296 - DNA, 22 bp, Homo sapiens
gagaaccgagcaaagatcaaaa

SEQ ID NO: 4931297 - DNA, 23 bp, Homo sapiens
gagaaccgagcaaagatcaaaat

SEQ ID NO: 4931298 - DNA, 16 bp, Homo sapiens
gagaacgcagccctag

SEQ ID NO: 4931299 - DNA, 15 bp, Homo sapiens
gagaagaagaaaaaa

SEQ ID NO: 4931300 - DNA, 15 bp, Homo sapiens
gagaagagaggagag

SEQ ID NO: 4931301 - DNA, 16 bp, Homo sapiens
gagaagcggatttcca

SEQ ID NO: 4931302 - DNA, 11 bp, Homo sapiens
gagaagctgct

SEQ ID NO: 4931303 - DNA, 12 bp, Homo sapiens
gagaagctgctc

SEQ ID NO: 4931304 - DNA, 16 bp, Homo sapiens
gagaaggcagccacca

SEQ ID NO: 4931305 - DNA, 15 bp, Homo sapiens
gagaagggatggagg

SEQ ID NO: 4931306 - DNA, 17 bp, Homo sapiens
gagaagggcataaaaca

SEQ ID NO: 4931307 - DNA, 17 bp, Homo sapiens
gagaaggggaagcactc

SEQ ID NO: 4931308 - DNA, 16 bp, Homo sapiens
gagaagttttgttttt

SEQ ID NO: 4931309 - DNA, 21 bp, Homo sapiens
gagaatcatacttagcaaagt

SEQ ID NO: 4931310 - DNA, 15 bp, Homo sapiens
gagaatgaaagggcc

SEQ ID NO: 4931311 - DNA, 23 bp, Homo sapiens
gagaatgaaagggcccagagagg

SEQ ID NO: 4931312 - DNA, 12 bp, Homo sapiens
gagaatttctaa

SEQ ID NO: 4931313 - DNA, 23 bp, Homo sapiens
gagaatttctaaaaagattagca

SEQ ID NO: 4931314 - DNA, 17 bp, Homo sapiens
gagacaagaaatccctg

SEQ ID NO: 4931315 - DNA, 16 bp, Homo sapiens
gagacacggagcccag

SEQ ID NO: 4931316 - DNA, 19 bp, Homo sapiens
gagacacgtgtggcgggca

SEQ ID NO: 4931317 - DNA, 19 bp, Homo sapiens
gagacagagttttcactct

SEQ ID NO: 4931318 - DNA, 15 bp, Homo sapiens
gagacagccccagag

SEQ ID NO: 4931319 - DNA, 12 bp, Homo sapiens
gagacaggaagg

SEQ ID NO: 4931320 - DNA, 19 bp, Homo sapiens
gagacagggtttcaccatg

SEQ ID NO: 4931321 - DNA, 19 bp, Homo sapiens
gagaccagcctgggcagca

SEQ ID NO: 4931322 - DNA, 16 bp, Homo sapiens
gagaccagggagcctt

SEQ ID NO: 4931323 - DNA, 19 bp, Homo sapiens
gagacggagtcccaccttg

SEQ ID NO: 4931324 - DNA, 18 bp, Homo sapiens
gagacgtggaacctctgt

SEQ ID NO: 4931325 - DNA, 22 bp, Homo sapiens
gagacgtggaacctctgtctca

SEQ ID NO: 4931326 - DNA, 22 bp, Homo sapiens
gagacgtttttggaagagtagt

SEQ ID NO: 4931327 - DNA, 22 bp, Homo sapiens
gagactatggagcctggcacag

SEQ ID NO: 4931328 - DNA, 17 bp, Homo sapiens
gagactcccatgaagcc

SEQ ID NO: 4931329 - DNA, 19 bp, Homo sapiens
gagcctgtgcctcctcacc

SEQ ID NO: 4931330 - DNA, 23 bp, Homo sapiens
gagcctttggttctggccagaat

SEQ ID NO: 4931331 - DNA, 23 bp, Homo sapiens
gagccttttccctctttggctcc

SEQ ID NO: 4931332 - DNA, 16 bp, Homo sapiens
gagcgagcgctaccca

SEQ ID NO: 4931333 - DNA, 13 bp, Homo sapiens
gagcgcaagatag

SEQ ID NO: 4931334 - DNA, 16 bp, Homo sapiens
gagcgggaggcagagt

SEQ ID NO: 4931335 - DNA, 14 bp, Homo sapiens
gagcggtctcaggc

SEQ ID NO: 4931336 - DNA, 16 bp, Homo sapiens
gagcgtgaatctgtat

SEQ ID NO: 4931337 - DNA, 20 bp, Homo sapiens
gagctaagggtgggtgctca

SEQ ID NO: 4931338 - DNA, 13 bp, Homo sapiens
gagctattgctgt

SEQ ID NO: 4931339 - DNA, 17 bp, Homo sapiens
gagctcctctcctggag

SEQ ID NO: 4931340 - DNA, 18 bp, Homo sapiens
gagctcctctcctggagg

SEQ ID NO: 4931341 - DNA, 17 bp, Homo sapiens
gagctcttcaggcctcc

SEQ ID NO: 4931342 - DNA, 14 bp, Homo sapiens
gagctgaggtttca

SEQ ID NO: 4931343 - DNA, 16 bp, Homo sapiens
gagctgatataaattc

SEQ ID NO: 4931344 - DNA, 15 bp, Homo sapiens
gagctgccctccttg

SEQ ID NO: 4931345 - DNA, 16 bp, Homo sapiens
gagctgcctgttcagc

SEQ ID NO: 4931346 - DNA, 20 bp, Homo sapiens
gagctgcctgttcagctcca

SEQ ID NO: 4931347 - DNA, 21 bp, Homo sapiens
gagctgcctgttcagctccag

SEQ ID NO: 4931348 - DNA, 16 bp, Homo sapiens
gagctgctggcttgca

SEQ ID NO: 4931349 - DNA, 21 bp, Homo sapiens
gagctgctggcttgcagtgcg

SEQ ID NO: 4931350 - DNA, 17 bp, Homo sapiens
gagctggtgcccggaga

SEQ ID NO: 4931351 - DNA, 19 bp, Homo sapiens
gagctgtggaggattgcta

SEQ ID NO: 4931352 - DNA, 16 bp, Homo sapiens
gagctgttaccattca

SEQ ID NO: 4931353 - DNA, 16 bp, Homo sapiens
gagctgtttatggcct

SEQ ID NO: 4931354 - DNA, 17 bp, Homo sapiens
gagctgtttatggcctc

SEQ ID NO: 4931355 - DNA, 22 bp, Homo sapiens
gagctgtttatggcctcagctg

SEQ ID NO: 4931356 - DNA, 17 bp, Homo sapiens
gagctgtttatgttttt

SEQ ID NO: 4931357 - DNA, 22 bp, Homo sapiens
gagcttccaaggggcaaatttt

SEQ ID NO: 4931358 - DNA, 21 bp, Homo sapiens
gagctttatggtcctaaaagc

SEQ ID NO: 4931359 - DNA, 23 bp, Homo sapiens
gagctttatggtcctaaaagcaa

SEQ ID NO: 4931360 - DNA, 20 bp, Homo sapiens
gaggaaaaccaagccgtggc

SEQ ID NO: 4931361 - DNA, 23 bp, Homo sapiens
gaggaaaaccaagccgtggcttc

SEQ ID NO: 4931362 - DNA, 13 bp, Homo sapiens
gaggaaagagagc

SEQ ID NO: 4931363 - DNA, 20 bp, Homo sapiens
gaggaaagagtcttcaacat

SEQ ID NO: 4931364 - DNA, 15 bp, Homo sapiens
gaggaactccttggc

SEQ ID NO: 4931365 - DNA, 14 bp, Homo sapiens
gaggaactgggcct

SEQ ID NO: 4931366 - DNA, 16 bp, Homo sapiens
gaggaactgtacagaa

SEQ ID NO: 4931367 - DNA, 16 bp, Homo sapiens
gaggaaggattgtaaa

SEQ ID NO: 4931368 - DNA, 17 bp, Homo sapiens
gaggaataattatttat

SEQ ID NO: 4931369 - DNA, 20 bp, Homo sapiens
gaggaatcatgtcaggcctg

SEQ ID NO: 4931370 - DNA, 15 bp, Homo sapiens
gaggaatccagaccc

SEQ ID NO: 4931371 - DNA, 15 bp, Homo sapiens
gaggaatcctggcag

SEQ ID NO: 4931372 - DNA, 17 bp, Homo sapiens
gaggaatcctggcagcc

SEQ ID NO: 4931373 - DNA, 19 bp, Homo sapiens
gaggaatcctggcagccca

SEQ ID NO: 4931374 - DNA, 17 bp, Homo sapiens
gaggacaaaacttcttg

SEQ ID NO: 4931375 - DNA, 20 bp, Homo sapiens
gaggacaggcgggaggaggt

SEQ ID NO: 4931376 - DNA, 21 bp, Homo sapiens
gaggacatgtttttgttttct

SEQ ID NO: 4931377 - DNA, 22 bp, Homo sapiens
gaggacctgaccctactccctt

SEQ ID NO: 4931378 - DNA, 17 bp, Homo sapiens
gaggacctggggcacag

SEQ ID NO: 4931379 - DNA, 23 bp, Homo sapiens
gaggacctgtatttaagcaaata

SEQ ID NO: 4931380 - DNA, 20 bp, Homo sapiens
gaggacggtgcaacccaagg

SEQ ID NO: 4931381 - DNA, 14 bp, Homo sapiens
gaggacttgtgtct

SEQ ID NO: 4931382 - DNA, 17 bp, Homo sapiens
gaggacttgtgtctctg

SEQ ID NO: 4931383 - DNA, 22 bp, Homo sapiens
gaggacttgtgtctctgtgctt

SEQ ID NO: 4931384 - DNA, 13 bp, Homo sapiens
gaggagagaggca

SEQ ID NO: 4931385 - DNA, 13 bp, Homo sapiens
gaggagaggagag

SEQ ID NO: 4931386 - DNA, 14 bp, Homo sapiens
gaggagaggagaga

SEQ ID NO: 4931387 - DNA, 16 bp, Homo sapiens
gaggagaggagagagg

SEQ ID NO: 4931388 - DNA, 17 bp, Homo sapiens
gaggagaggagagaggc

SEQ ID NO: 4931389 - DNA, 14 bp, Homo sapiens
gaggagcatgtttt

SEQ ID NO: 4931390 - DNA, 16 bp, Homo sapiens
gaggagccagacagac

SEQ ID NO: 4931391 - DNA, 14 bp, Homo sapiens
gaggagccccagct

SEQ ID NO: 4931392 - DNA, 11 bp, Homo sapiens
gaggagctgct

SEQ ID NO: 4931393 - DNA, 13 bp, Homo sapiens
gaggagctgctgg

SEQ ID NO: 4931394 - DNA, 21 bp, Homo sapiens
gaggaggatgtccctgggcca

SEQ ID NO: 4931395 - DNA, 21 bp, Homo sapiens
gaggaggtgtgaggaggaggc

SEQ ID NO: 4931396 - DNA, 14 bp, Homo sapiens
gaggatgagagccc

SEQ ID NO: 4931397 - DNA, 17 bp, Homo sapiens
gaggattgttgaatcta

SEQ ID NO: 4931398 - DNA, 23 bp, Homo sapiens
gaggcaacctgattgtaaacttc

SEQ ID NO: 4931399 - DNA, 11 bp, Homo sapiens
gaggcagagag

SEQ ID NO: 4931400 - DNA, 22 bp, Homo sapiens
gaggcagagagcggtctcaggc

SEQ ID NO: 4931401 - DNA, 12 bp, Homo sapiens
gaggcagagttt

SEQ ID NO: 4931402 - DNA, 12 bp, Homo sapiens
gaggcagccagg

SEQ ID NO: 4931403 - DNA, 18 bp, Homo sapiens
gaggcagccccattctgc

SEQ ID NO: 4931404 - DNA, 19 bp, Homo sapiens
gaggcagccccattctgcc

SEQ ID NO: 4931405 - DNA, 22 bp, Homo sapiens
gaggcagccccattctgcctgc

SEQ ID NO: 4931406 - DNA, 23 bp, Homo sapiens
gaggcaggaggattgcttgagcc

SEQ ID NO: 4931407 - DNA, 9 bp, Homo sapiens
gaggcaggg

SEQ ID NO: 4931408 - DNA, 18 bp, Homo sapiens
gaggcagggtctcactct

SEQ ID NO: 4931409 - DNA, 20 bp, Homo sapiens
gaggcagggtctcactctgt

SEQ ID NO: 4931410 - DNA, 20 bp, Homo sapiens
gaggcatcctacccttttct

SEQ ID NO: 4931411 - DNA, 14 bp, Homo sapiens
gaggcatggccctg

SEQ ID NO: 4931412 - DNA, 17 bp, Homo sapiens
gaggcatggccctgggg

SEQ ID NO: 4931413 - DNA, 17 bp, Homo sapiens
gaggccctcctgtgctg

SEQ ID NO: 4931414 - DNA, 19 bp, Homo sapiens
gaggccctcctgtgctggg

SEQ ID NO: 4931415 - DNA, 18 bp, Homo sapiens
gaggccttccagctgctg

SEQ ID NO: 4931416 - DNA, 9 bp, Homo sapiens
gaggctgcc

SEQ ID NO: 4931417 - DNA, 12 bp, Homo sapiens
gaggctgccccc

SEQ ID NO: 4931418 - DNA, 23 bp, Homo sapiens
gaggctgcccccggccccctggt

SEQ ID NO: 4931419 - DNA, 14 bp, Homo sapiens
gaggctgcccctct

SEQ ID NO: 4931420 - DNA, 18 bp, Homo sapiens
gaggctgcccctctcacc

SEQ ID NO: 4931421 - DNA, 19 bp, Homo sapiens
gaggctgcccctctcacca

SEQ ID NO: 4931422 - DNA, 22 bp, Homo sapiens
gaggctgtgtgcctgggggagt

SEQ ID NO: 4931423 - DNA, 14 bp, Homo sapiens
gaggctttggattt

SEQ ID NO: 4931424 - DNA, 14 bp, Homo sapiens
gaggctttgtgttg

SEQ ID NO: 4931425 - DNA, 10 bp, Homo sapiens
gagggaaaag

SEQ ID NO: 4931426 - DNA, 16 bp, Homo sapiens
gagggaaaagggaagt

SEQ ID NO: 4931427 - DNA, 14 bp, Homo sapiens
gagggaagggacgg

SEQ ID NO: 4931428 - DNA, 19 bp, Homo sapiens
gagggaccaactgggccca

SEQ ID NO: 4931429 - DNA, 22 bp, Homo sapiens
gagggacgtcagacttggctca

SEQ ID NO: 4931430 - DNA, 14 bp, Homo sapiens
gagggactctgaag

SEQ ID NO: 4931431 - DNA, 18 bp, Homo sapiens
gagggactgcctctgcca

SEQ ID NO: 4931432 - DNA, 13 bp, Homo sapiens
gagggagaaggga

SEQ ID NO: 4931433 - DNA, 21 bp, Homo sapiens
gagggagacactggcccctca

SEQ ID NO: 4931434 - DNA, 13 bp, Homo sapiens
gagggaggacctg

SEQ ID NO: 4931435 - DNA, 14 bp, Homo sapiens
gagggcagctgcta

SEQ ID NO: 4931436 - DNA, 14 bp, Homo sapiens
gagggcccagagca

SEQ ID NO: 4931437 - DNA, 16 bp, Homo sapiens
gagggcccagagcagg

SEQ ID NO: 4931438 - DNA, 15 bp, Homo sapiens
gagggccctacctga

SEQ ID NO: 4931439 - DNA, 14 bp, Homo sapiens
gatacataataaaa

SEQ ID NO: 4931440 - DNA, 14 bp, Homo sapiens
gatacatcactgct

SEQ ID NO: 4931441 - DNA, 13 bp, Homo sapiens
gatacccccctct

SEQ ID NO: 4931442 - DNA, 21 bp, Homo sapiens
gatacccccctctgtcttgtg

SEQ ID NO: 4931443 - DNA, 22 bp, Homo sapiens
gatactaaaagttcttctccaa

SEQ ID NO: 4931444 - DNA, 18 bp, Homo sapiens
gatactgcagggccagga

SEQ ID NO: 4931445 - DNA, 21 bp, Homo sapiens
gatactttttcttttgtaagt

SEQ ID NO: 4931446 - DNA, 16 bp, Homo sapiens
gatagctaacatttta

SEQ ID NO: 4931447 - DNA, 18 bp, Homo sapiens
gataggaatgtgaaagca

SEQ ID NO: 4931448 - DNA, 15 bp, Homo sapiens
gatagggctgggcaa

SEQ ID NO: 4931449 - DNA, 12 bp, Homo sapiens
gatataaattct

SEQ ID NO: 4931450 - DNA, 16 bp, Homo sapiens
gatatacagatgaaaa

SEQ ID NO: 4931451 - DNA, 17 bp, Homo sapiens
gatatactctagatgaa

SEQ ID NO: 4931452 - DNA, 15 bp, Homo sapiens
gatatactgtgtgct

SEQ ID NO: 4931453 - DNA, 14 bp, Homo sapiens
gatatactttgtgg

SEQ ID NO: 4931454 - DNA, 18 bp, Homo sapiens
gatatccttatcagagct

SEQ ID NO: 4931455 - DNA, 21 bp, Homo sapiens
gatatgaagagcaactgggac

SEQ ID NO: 4931456 - DNA, 13 bp, Homo sapiens
gatatgggactga

SEQ ID NO: 4931457 - DNA, 22 bp, Homo sapiens
gatatgggactgagcctggccc

SEQ ID NO: 4931458 - DNA, 23 bp, Homo sapiens
gatattattagaaattagaaaaa

SEQ ID NO: 4931459 - DNA, 13 bp, Homo sapiens
gatattgtacata

SEQ ID NO: 4931460 - DNA, 17 bp, Homo sapiens
gatattgtacataaaag

SEQ ID NO: 4931461 - DNA, 22 bp, Homo sapiens
gatattgttcaaacaatatcat

SEQ ID NO: 4931462 - DNA, 22 bp, Homo sapiens
gatatttaggagtgtgtgacat

SEQ ID NO: 4931463 - DNA, 21 bp, Homo sapiens
gatattttacctcttattgca

SEQ ID NO: 4931464 - DNA, 22 bp, Homo sapiens
gatcaaccccttcgctcctgtg

SEQ ID NO: 4931465 - DNA, 23 bp, Homo sapiens
gatcaaccccttcgctcctgtgt

SEQ ID NO: 4931466 - DNA, 14 bp, Homo sapiens
gatcaatcctttat

SEQ ID NO: 4931467 - DNA, 15 bp, Homo sapiens
gatcaatcctttatt

SEQ ID NO: 4931468 - DNA, 18 bp, Homo sapiens
gatcaattatagtttctg

SEQ ID NO: 4931469 - DNA, 19 bp, Homo sapiens
gatcaattatagtttctga

SEQ ID NO: 4931470 - DNA, 13 bp, Homo sapiens
gatcacgccactg

SEQ ID NO: 4931471 - DNA, 18 bp, Homo sapiens
gatcacgccactgcacta

SEQ ID NO: 4931472 - DNA, 18 bp, Homo sapiens
gatcacggctcactgcag

SEQ ID NO: 4931473 - DNA, 23 bp, Homo sapiens
gatcacggctcactgcagcctca

SEQ ID NO: 4931474 - DNA, 16 bp, Homo sapiens
gatcagagcaggacct

SEQ ID NO: 4931475 - DNA, 14 bp, Homo sapiens
gatcagcatctgtg

SEQ ID NO: 4931476 - DNA, 22 bp, Homo sapiens
gatcagtctgattcccaagctc

SEQ ID NO: 4931477 - DNA, 14 bp, Homo sapiens
gatcagttaactat

SEQ ID NO: 4931478 - DNA, 15 bp, Homo sapiens
gatcataaactgact

SEQ ID NO: 4931479 - DNA, 17 bp, Homo sapiens
gatcataggtatttcaa

SEQ ID NO: 4931480 - DNA, 18 bp, Homo sapiens
gatcataggtatttcaaa

SEQ ID NO: 4931481 - DNA, 21 bp, Homo sapiens
gatcatcaacaagatttcctt

SEQ ID NO: 4931482 - DNA, 16 bp, Homo sapiens
gatcatccactgtgcc

SEQ ID NO: 4931483 - DNA, 22 bp, Homo sapiens
gatcatcccatctaagctgcag

SEQ ID NO: 4931484 - DNA, 15 bp, Homo sapiens
gatcatggtgtaata

SEQ ID NO: 4931485 - DNA, 20 bp, Homo sapiens
gatcatggtgtaataagaca

SEQ ID NO: 4931486 - DNA, 15 bp, Homo sapiens
gatcatgttgttaaa

SEQ ID NO: 4931487 - DNA, 22 bp, Homo sapiens
gatcatttattttaagcactct

SEQ ID NO: 4931488 - DNA, 15 bp, Homo sapiens
gatcattttcccccc

SEQ ID NO: 4931489 - DNA, 19 bp, Homo sapiens
gatccaaattgtgcttctc

SEQ ID NO: 4931490 - DNA, 22 bp, Homo sapiens
gatccaagctaagcactgccac

SEQ ID NO: 4931491 - DNA, 18 bp, Homo sapiens
gatccacccacctcagcc

SEQ ID NO: 4931492 - DNA, 18 bp, Homo sapiens
gatccacctgtctcagcc

SEQ ID NO: 4931493 - DNA, 19 bp, Homo sapiens
gatccacctgtctcagcct

SEQ ID NO: 4931494 - DNA, 14 bp, Homo sapiens
gatcccctcaggac

SEQ ID NO: 4931495 - DNA, 14 bp, Homo sapiens
gatcccctgagccc

SEQ ID NO: 4931496 - DNA, 16 bp, Homo sapiens
gatcctaagcatctaa

SEQ ID NO: 4931497 - DNA, 21 bp, Homo sapiens
gatcctctcctttgaaacctg

SEQ ID NO: 4931498 - DNA, 22 bp, Homo sapiens
gatcctgggtactgaaagcctt

SEQ ID NO: 4931499 - DNA, 19 bp, Homo sapiens
gatcctgtctttaaggaaa

SEQ ID NO: 4931500 - DNA, 21 bp, Homo sapiens
gatctaaggatgtcacagggc

SEQ ID NO: 4931501 - DNA, 13 bp, Homo sapiens
gatctataaagcg

SEQ ID NO: 4931502 - DNA, 21 bp, Homo sapiens
gatctcagctttgagaagcct

SEQ ID NO: 4931503 - DNA, 20 bp, Homo sapiens
gatctgcagggggtgtgtct

SEQ ID NO: 4931504 - DNA, 17 bp, Homo sapiens
gatctgcggatctcagc

SEQ ID NO: 4931505 - DNA, 18 bp, Homo sapiens
gatctgcggatctcagct

SEQ ID NO: 4931506 - DNA, 21 bp, Homo sapiens
gatctgcggatctcagctttg

SEQ ID NO: 4931507 - DNA, 18 bp, Homo sapiens
gatctgggttcactgcaa

SEQ ID NO: 4931508 - DNA, 17 bp, Homo sapiens
gatctgtcacaccagcc

SEQ ID NO: 4931509 - DNA, 19 bp, Homo sapiens
gatctgtcacaccagccat

SEQ ID NO: 4931510 - DNA, 14 bp, Homo sapiens
gatcttagattctc

SEQ ID NO: 4931511 - DNA, 19 bp, Homo sapiens
gatcttagggtgaaccact

SEQ ID NO: 4931512 - DNA, 12 bp, Homo sapiens
gatcttctgaaa

SEQ ID NO: 4931513 - DNA, 13 bp, Homo sapiens
gatcttgaatgtg

SEQ ID NO: 4931514 - DNA, 16 bp, Homo sapiens
gatctttgcagacagg

SEQ ID NO: 4931515 - DNA, 17 bp, Homo sapiens
gatctttgcagacaggc

SEQ ID NO: 4931516 - DNA, 13 bp, Homo sapiens
gatcttttaaagt

SEQ ID NO: 4931517 - DNA, 20 bp, Homo sapiens
gatcttttaaagtgttactt

SEQ ID NO: 4931518 - DNA, 13 bp, Homo sapiens
gatgaaaagattt

SEQ ID NO: 4931519 - DNA, 15 bp, Homo sapiens
gatgaaaatttgaga

SEQ ID NO: 4931520 - DNA, 21 bp, Homo sapiens
gatgaaatgaggtcagagcct

SEQ ID NO: 4931521 - DNA, 19 bp, Homo sapiens
gatgaacttattctgtaga

SEQ ID NO: 4931522 - DNA, 21 bp, Homo sapiens
gatgaagcaaggaagatatac

SEQ ID NO: 4931523 - DNA, 22 bp, Homo sapiens
gatgaagtttgtagttgtttta

SEQ ID NO: 4931524 - DNA, 22 bp, Homo sapiens
gatgaagttttacattgttgag

SEQ ID NO: 4931525 - DNA, 14 bp, Homo sapiens
gatgaatgtattta

SEQ ID NO: 4931526 - DNA, 15 bp, Homo sapiens
gatgacctggataac

SEQ ID NO: 4931527 - DNA, 18 bp, Homo sapiens
gatgactaaaatatttat

SEQ ID NO: 4931528 - DNA, 14 bp, Homo sapiens
gatgagaacaaagc

SEQ ID NO: 4931529 - DNA, 21 bp, Homo sapiens
gatgagagcccagaggtaaca

SEQ ID NO: 4931530 - DNA, 18 bp, Homo sapiens
gatgagggatgggcctgg

SEQ ID NO: 4931531 - DNA, 21 bp, Homo sapiens
gatgatacaagattagaagct

SEQ ID NO: 4931532 - DNA, 18 bp, Homo sapiens
gatgatcaatcctttatt

SEQ ID NO: 4931533 - DNA, 20 bp, Homo sapiens
gatgatcaattatagtttct

SEQ ID NO: 4931534 - DNA, 21 bp, Homo sapiens
gatgatgaaatgaggtcagag

SEQ ID NO: 4931535 - DNA, 22 bp, Homo sapiens
gatgatggttgcaaaagactaa

SEQ ID NO: 4931536 - DNA, 19 bp, Homo sapiens
gatgcaaggaccaggactc

SEQ ID NO: 4931537 - DNA, 17 bp, Homo sapiens
gatgcacagagaagctg

SEQ ID NO: 4931538 - DNA, 19 bp, Homo sapiens
gatgcacagagaagctggg

SEQ ID NO: 4931539 - DNA, 13 bp, Homo sapiens
gatgcaccagccc

SEQ ID NO: 4931540 - DNA, 14 bp, Homo sapiens
gatgcaccagccct

SEQ ID NO: 4931541 - DNA, 12 bp, Homo sapiens
gatgcagcattt

SEQ ID NO: 4931542 - DNA, 15 bp, Homo sapiens
gatgcagcatttgat

SEQ ID NO: 4931543 - DNA, 14 bp, Homo sapiens
gatgcagccgcctt

SEQ ID NO: 4931544 - DNA, 20 bp, Homo sapiens
gatgcagccgccttccttga

SEQ ID NO: 4931545 - DNA, 22 bp, Homo sapiens
gatgcagccgccttccttgacc

SEQ ID NO: 4931546 - DNA, 13 bp, Homo sapiens
gatgcagtctcct

SEQ ID NO: 4931547 - DNA, 17 bp, Homo sapiens
gatgcctggtggcagct

SEQ ID NO: 4931548 - DNA, 16 bp, Homo sapiens
gattttctccagctca

SEQ ID NO: 4931549 - DNA, 21 bp, Homo sapiens
gattttctgggcctaaaggat

SEQ ID NO: 4931550 - DNA, 16 bp, Homo sapiens
gattttctggttctaa

SEQ ID NO: 4931551 - DNA, 21 bp, Homo sapiens
gattttggtattacactgtat

SEQ ID NO: 4931552 - DNA, 23 bp, Homo sapiens
gatttttcggaggccccactgat

SEQ ID NO: 4931553 - DNA, 22 bp, Homo sapiens
gatttttctaaccttgaatgct

SEQ ID NO: 4931554 - DNA, 12 bp, Homo sapiens
gatttttctcaa

SEQ ID NO: 4931555 - DNA, 20 bp, Homo sapiens
gatttttgcaataccaagta

SEQ ID NO: 4931556 - DNA, 20 bp, Homo sapiens
gattttttacagctgcctgc

SEQ ID NO: 4931557 - DNA, 21 bp, Homo sapiens
gatttttttcccaattgagaa

SEQ ID NO: 4931558 - DNA, 21 bp, Homo sapiens
gcaaaaacaaaaagaaaagaa

SEQ ID NO: 4931559 - DNA, 16 bp, Homo sapiens
gcaaaaatataaaata

SEQ ID NO: 4931560 - DNA, 12 bp, Homo sapiens
gcaaaagaaaaa

SEQ ID NO: 4931561 - DNA, 23 bp, Homo sapiens
gcaaaagccttgtgtatatttgt

SEQ ID NO: 4931562 - DNA, 20 bp, Homo sapiens
gcaaaataattttaaacaaa

SEQ ID NO: 4931563 - DNA, 22 bp, Homo sapiens
gcaaaatggaacgctaatgaaa

SEQ ID NO: 4931564 - DNA, 17 bp, Homo sapiens
gcaaaattgatgtgttt

SEQ ID NO: 4931565 - DNA, 20 bp, Homo sapiens
gcaaaatttgatgccaggac

SEQ ID NO: 4931566 - DNA, 21 bp, Homo sapiens
gcaaaatttgatgccaggaca

SEQ ID NO: 4931567 - DNA, 22 bp, Homo sapiens
gcaaaatttgatgccaggacac

SEQ ID NO: 4931568 - DNA, 23 bp, Homo sapiens
gcaaacagaggaagaatttgtta

SEQ ID NO: 4931569 - DNA, 20 bp, Homo sapiens
gcaaagaggactcgcttgta

SEQ ID NO: 4931570 - DNA, 23 bp, Homo sapiens
gcaaagaggactcgcttgtaaat

SEQ ID NO: 4931571 - DNA, 16 bp, Homo sapiens
gcaaagatcaaaataa

SEQ ID NO: 4931572 - DNA, 19 bp, Homo sapiens
gcaaagtacaatgtgtttt

SEQ ID NO: 4931573 - DNA, 23 bp, Homo sapiens
gcaaagttccctacttcctgtga

SEQ ID NO: 4931574 - DNA, 16 bp, Homo sapiens
gcaaagttctgtgttt

SEQ ID NO: 4931575 - DNA, 18 bp, Homo sapiens
gcaaatacttagcaaaaa

SEQ ID NO: 4931576 - DNA, 11 bp, Homo sapiens
gcaaatataaa

SEQ ID NO: 4931577 - DNA, 14 bp, Homo sapiens
gcaaatataaaact

SEQ ID NO: 4931578 - DNA, 14 bp, Homo sapiens
gcaaatataaacat

SEQ ID NO: 4931579 - DNA, 15 bp, Homo sapiens
gcaaatataaacatc

SEQ ID NO: 4931580 - DNA, 16 bp, Homo sapiens
gcaaatataaacatct

SEQ ID NO: 4931581 - DNA, 17 bp, Homo sapiens
gcaaatataaacatctc

SEQ ID NO: 4931582 - DNA, 16 bp, Homo sapiens
gcaaatttcaaaagac

SEQ ID NO: 4931583 - DNA, 21 bp, Homo sapiens
gcaaatttttattttttagtg

SEQ ID NO: 4931584 - DNA, 22 bp, Homo sapiens
gcaacaagaccaccacttcgaa

SEQ ID NO: 4931585 - DNA, 19 bp, Homo sapiens
gcaacagacaagtgactgt

SEQ ID NO: 4931586 - DNA, 18 bp, Homo sapiens
gcaacaggaatcaagagc

SEQ ID NO: 4931587 - DNA, 21 bp, Homo sapiens
gcaacaggaatcaagagctgc

SEQ ID NO: 4931588 - DNA, 19 bp, Homo sapiens
gcaacaggctgggcttcag

SEQ ID NO: 4931589 - DNA, 13 bp, Homo sapiens
gcaacatccaaaa

SEQ ID NO: 4931590 - DNA, 15 bp, Homo sapiens
gcaaccacacacctc

SEQ ID NO: 4931591 - DNA, 16 bp, Homo sapiens
gcaacccaaggactga

SEQ ID NO: 4931592 - DNA, 20 bp, Homo sapiens
gcaacccaaggactgaggga

SEQ ID NO: 4931593 - DNA, 14 bp, Homo sapiens
gcaacccccagcct

SEQ ID NO: 4931594 - DNA, 19 bp, Homo sapiens
gcaacctccgcctcttggg

SEQ ID NO: 4931595 - DNA, 17 bp, Homo sapiens
gcaacctgattgtaaac

SEQ ID NO: 4931596 - DNA, 15 bp, Homo sapiens
gcaactcttgattat

SEQ ID NO: 4931597 - DNA, 18 bp, Homo sapiens
gcaactgttatgaaataa

SEQ ID NO: 4931598 - DNA, 18 bp, Homo sapiens
gcaacttcttctccatcc

SEQ ID NO: 4931599 - DNA, 19 bp, Homo sapiens
gcaagagtgattgcagctt

SEQ ID NO: 4931600 - DNA, 22 bp, Homo sapiens
gcaagcaacttgcaggctccat

SEQ ID NO: 4931601 - DNA, 17 bp, Homo sapiens
gcaagcaagctctcttg

SEQ ID NO: 4931602 - DNA, 15 bp, Homo sapiens
gcaagcacctcctgc

SEQ ID NO: 4931603 - DNA, 20 bp, Homo sapiens
gcaagcacctcctgcctcga

SEQ ID NO: 4931604 - DNA, 11 bp, Homo sapiens
gcaagcatgct

SEQ ID NO: 4931605 - DNA, 15 bp, Homo sapiens
gcaagcatgcttgtg

SEQ ID NO: 4931606 - DNA, 20 bp, Homo sapiens
gcaagccctacagagctgtg

SEQ ID NO: 4931607 - DNA, 12 bp, Homo sapiens
gcaagctggcct

SEQ ID NO: 4931608 - DNA, 11 bp, Homo sapiens
gcaaggaaaaa

SEQ ID NO: 4931609 - DNA, 19 bp, Homo sapiens
gcaaggaaaaagaaaataa

SEQ ID NO: 4931610 - DNA, 22 bp, Homo sapiens
gcaagggcacaagtcctggatg

SEQ ID NO: 4931611 - DNA, 14 bp, Homo sapiens
gcaagtagataaat

SEQ ID NO: 4931612 - DNA, 14 bp, Homo sapiens
gcaagttaagagaa

SEQ ID NO: 4931613 - DNA, 19 bp, Homo sapiens
gcaataaacgcattatcag

SEQ ID NO: 4931614 - DNA, 15 bp, Homo sapiens
gcaataacttctgac

SEQ ID NO: 4931615 - DNA, 13 bp, Homo sapiens
gcaataccaagta

SEQ ID NO: 4931616 - DNA, 14 bp, Homo sapiens
gcaatatttgaatt

SEQ ID NO: 4931617 - DNA, 21 bp, Homo sapiens
gcaatctccccttgatttaaa

SEQ ID NO: 4931618 - DNA, 23 bp, Homo sapiens
gcaatgaaaagtcgttttccaaa

SEQ ID NO: 4931619 - DNA, 19 bp, Homo sapiens
gcaatgacatctcaggggc

SEQ ID NO: 4931620 - DNA, 17 bp, Homo sapiens
gcaatgatgaatgagaa

SEQ ID NO: 4931621 - DNA, 23 bp, Homo sapiens
gcaatgctggctgttggctgggg

SEQ ID NO: 4931622 - DNA, 12 bp, Homo sapiens
gcaatggcagcc

SEQ ID NO: 4931623 - DNA, 14 bp, Homo sapiens
gcaatgggcactgg

SEQ ID NO: 4931624 - DNA, 22 bp, Homo sapiens
gcaatgtatcccttctcacagc

SEQ ID NO: 4931625 - DNA, 19 bp, Homo sapiens
gcaattaggattttgatgt

SEQ ID NO: 4931626 - DNA, 16 bp, Homo sapiens
gcaattcaaaagttcc

SEQ ID NO: 4931627 - DNA, 22 bp, Homo sapiens
gcaattcaaaagttccaagagt

SEQ ID NO: 4931628 - DNA, 15 bp, Homo sapiens
gcaattccgcattta

SEQ ID NO: 4931629 - DNA, 18 bp, Homo sapiens
gcaatttaaatgttatga

SEQ ID NO: 4931630 - DNA, 16 bp, Homo sapiens
gcaatttatacaatat

SEQ ID NO: 4931631 - DNA, 18 bp, Homo sapiens
gcaatttcaaggttctaa

SEQ ID NO: 4931632 - DNA, 13 bp, Homo sapiens
gcacaaacatttt

SEQ ID NO: 4931633 - DNA, 17 bp, Homo sapiens
gcacaaacatttttcaa

SEQ ID NO: 4931634 - DNA, 14 bp, Homo sapiens
gcacaaatatttat

SEQ ID NO: 4931635 - DNA, 16 bp, Homo sapiens
gcacaaatatttattt

SEQ ID NO: 4931636 - DNA, 22 bp, Homo sapiens
gcacaactgcaataacttctga

SEQ ID NO: 4931637 - DNA, 12 bp, Homo sapiens
gcacaatttgca

SEQ ID NO: 4931638 - DNA, 21 bp, Homo sapiens
gcacacacacacacacacatc

SEQ ID NO: 4931639 - DNA, 22 bp, Homo sapiens
gcacacacacacacatgcacac

SEQ ID NO: 4931640 - DNA, 15 bp, Homo sapiens
gcacacacacacata

SEQ ID NO: 4931641 - DNA, 15 bp, Homo sapiens
gcacacaccagagcc

SEQ ID NO: 4931642 - DNA, 17 bp, Homo sapiens
gcacacaccagagccca

SEQ ID NO: 4931643 - DNA, 18 bp, Homo sapiens
gcacacaccagagcccac

SEQ ID NO: 4931644 - DNA, 14 bp, Homo sapiens
gcacacagaaatat

SEQ ID NO: 4931645 - DNA, 15 bp, Homo sapiens
gcacacagaaatata

SEQ ID NO: 4931646 - DNA, 18 bp, Homo sapiens
gcacacagaaatatatat

SEQ ID NO: 4931647 - DNA, 20 bp, Homo sapiens
gcacacagaaatatatatac

SEQ ID NO: 4931648 - DNA, 21 bp, Homo sapiens
gcacaccctcactctgccagg

SEQ ID NO: 4931649 - DNA, 14 bp, Homo sapiens
gcacacttccagac

SEQ ID NO: 4931650 - DNA, 12 bp, Homo sapiens
gcacagagaagc

SEQ ID NO: 4931651 - DNA, 17 bp, Homo sapiens
gcacagattttaattgt

SEQ ID NO: 4931652 - DNA, 12 bp, Homo sapiens
gcacagcagcct

SEQ ID NO: 4931653 - DNA, 13 bp, Homo sapiens
gcacagcagcctg

SEQ ID NO: 4931654 - DNA, 20 bp, Homo sapiens
gcacagctcaggaggcgccc

SEQ ID NO: 4931655 - DNA, 16 bp, Homo sapiens
gcacagctccctgcca

SEQ ID NO: 4931656 - DNA, 17 bp, Homo sapiens
gcacagctccctgccaa

SEQ ID NO: 4931657 - DNA, 23 bp, Homo sapiens
gcacagctccctgccaaactgaa

SEQ ID NO: 4931658 - DNA, 19 bp, Homo sapiens
gcacagctgaaagttcttg

SEQ ID NO: 4931659 - DNA, 21 bp, Homo sapiens
gcacagcttcatttcctgtgt

SEQ ID NO: 4931660 - DNA, 19 bp, Homo sapiens
gcacaggtcccacctccag

SEQ ID NO: 4931661 - DNA, 22 bp, Homo sapiens
gcacaggtcccacctccagccc

SEQ ID NO: 4931662 - DNA, 23 bp, Homo sapiens
gcacaggtcccacctccagcccg

SEQ ID NO: 4931663 - DNA, 13 bp, Homo sapiens
gcacagtgcatct

SEQ ID NO: 4931664 - DNA, 12 bp, Homo sapiens
gcacagtttgaa

SEQ ID NO: 4931665 - DNA, 13 bp, Homo sapiens
gcacatatggact

SEQ ID NO: 4931666 - DNA, 18 bp, Homo sapiens
gcacatatggactctgca

SEQ ID NO: 4931667 - DNA, 13 bp, Homo sapiens
gcacatctgcatt

SEQ ID NO: 4931668 - DNA, 19 bp, Homo sapiens
gcacatgctggccagcctg

SEQ ID NO: 4931669 - DNA, 13 bp, Homo sapiens
gcacatgtcttgt

SEQ ID NO: 4931670 - DNA, 20 bp, Homo sapiens
gcacatgtcttgtacatgtg

SEQ ID NO: 4931671 - DNA, 23 bp, Homo sapiens
gcaccaaagatgcagccgccttc

SEQ ID NO: 4931672 - DNA, 20 bp, Homo sapiens
gcaccaccctagtcccttcc

SEQ ID NO: 4931673 - DNA, 19 bp, Homo sapiens
gcaccagagcaacctctca

SEQ ID NO: 4931674 - DNA, 17 bp, Homo sapiens
gcacccccctgttctaa

SEQ ID NO: 4931675 - DNA, 12 bp, Homo sapiens
gcaccctctggc

SEQ ID NO: 4931676 - DNA, 19 bp, Homo sapiens
gcaccctgtggccctggct

SEQ ID NO: 4931677 - DNA, 12 bp, Homo sapiens
gcacccttcttt

SEQ ID NO: 4931678 - DNA, 18 bp, Homo sapiens
gcacccttcttttctcat

SEQ ID NO: 4931679 - DNA, 22 bp, Homo sapiens
gcaccgcggcgcttcccagcac

SEQ ID NO: 4931680 - DNA, 23 bp, Homo sapiens
gcacctaaaccaccagtgcccaa

SEQ ID NO: 4931681 - DNA, 17 bp, Homo sapiens
gcacctaccatcaggga

SEQ ID NO: 4931682 - DNA, 18 bp, Homo sapiens
gcaccttaccaactttct

SEQ ID NO: 4931683 - DNA, 19 bp, Homo sapiens
gcaccttaccaactttctg

SEQ ID NO: 4931684 - DNA, 14 bp, Homo sapiens
gcaccttgtgtctg

SEQ ID NO: 4931685 - DNA, 22 bp, Homo sapiens
gcacctttccttcaagccagca

SEQ ID NO: 4931686 - DNA, 17 bp, Homo sapiens
gcacgacgccctctccc

SEQ ID NO: 4931687 - DNA, 20 bp, Homo sapiens
gcacgacgccctctccccac

SEQ ID NO: 4931688 - DNA, 10 bp, Homo sapiens
gcacgcacac

SEQ ID NO: 4931689 - DNA, 11 bp, Homo sapiens
gcacgcacaca

SEQ ID NO: 4931690 - DNA, 14 bp, Homo sapiens
gcacgcacacacac

SEQ ID NO: 4931691 - DNA, 15 bp, Homo sapiens
gcacgcacacacaca

SEQ ID NO: 4931692 - DNA, 12 bp, Homo sapiens
gcacggacaata

SEQ ID NO: 4931693 - DNA, 16 bp, Homo sapiens
gcacggacaataaacc

SEQ ID NO: 4931694 - DNA, 17 bp, Homo sapiens
gcacggacaataaacct

SEQ ID NO: 4931695 - DNA, 14 bp, Homo sapiens
gcacgtgtgtgcac

SEQ ID NO: 4931696 - DNA, 18 bp, Homo sapiens
gcactaaagccagcctga

SEQ ID NO: 4931697 - DNA, 19 bp, Homo sapiens
gcactaaagccagcctgac

SEQ ID NO: 4931698 - DNA, 19 bp, Homo sapiens
gcactaaggtgtgctctga

SEQ ID NO: 4931699 - DNA, 14 bp, Homo sapiens
gcactactgggtgt

SEQ ID NO: 4931700 - DNA, 16 bp, Homo sapiens
gcactactgggtgtca

SEQ ID NO: 4931701 - DNA, 18 bp, Homo sapiens
gcactagagaatgcacag

SEQ ID NO: 4931702 - DNA, 20 bp, Homo sapiens
gcactagagaatgcacagat

SEQ ID NO: 4931703 - DNA, 20 bp, Homo sapiens
gcactagcctttggctctgg

SEQ ID NO: 4931704 - DNA, 22 bp, Homo sapiens
gcactatagcctaggtgacaga

SEQ ID NO: 4931705 - DNA, 16 bp, Homo sapiens
gcactcagaagacact

SEQ ID NO: 4931706 - DNA, 15 bp, Homo sapiens
gcactgacccttcca

SEQ ID NO: 4931707 - DNA, 17 bp, Homo sapiens
gcactgaggaccagcca

SEQ ID NO: 4931708 - DNA, 14 bp, Homo sapiens
gcactgctgcccag

SEQ ID NO: 4931709 - DNA, 22 bp, Homo sapiens
gcactggggagcccgtctcagt

SEQ ID NO: 4931710 - DNA, 23 bp, Homo sapiens
gcactggtggcccgacagcctgg

SEQ ID NO: 4931711 - DNA, 24 bp, Homo sapiens
gcactggtggcccgacagcctggc

SEQ ID NO: 4931712 - DNA, 19 bp, Homo sapiens
gcactgtagttctaagact

SEQ ID NO: 4931713 - DNA, 17 bp, Homo sapiens
gcactgttgatgtatct

SEQ ID NO: 4931714 - DNA, 19 bp, Homo sapiens
gcactgttgatgtatctga

SEQ ID NO: 4931715 - DNA, 22 bp, Homo sapiens
gcacttaagcacaagcagagtg

SEQ ID NO: 4931716 - DNA, 23 bp, Homo sapiens
gcacttcattgagagttttgtct

SEQ ID NO: 4931717 - DNA, 18 bp, Homo sapiens
gcacttccaaaattctta

SEQ ID NO: 4931718 - DNA, 21 bp, Homo sapiens
gcacttccttttacctgccca

SEQ ID NO: 4931719 - DNA, 18 bp, Homo sapiens
gcacttgcctgggtcaca

SEQ ID NO: 4931720 - DNA, 15 bp, Homo sapiens
gcacttgtatatacg

SEQ ID NO: 4931721 - DNA, 23 bp, Homo sapiens
gcacttgtctcattttaatgtaa

SEQ ID NO: 4931722 - DNA, 20 bp, Homo sapiens
gcactttccacttcttcctt

SEQ ID NO: 4931723 - DNA, 16 bp, Homo sapiens
gcactttctaatgttt

SEQ ID NO: 4931724 - DNA, 17 bp, Homo sapiens
gcactttgaaatacctc

SEQ ID NO: 4931725 - DNA, 21 bp, Homo sapiens
gcagaaaggaaaacctgaaga

SEQ ID NO: 4931726 - DNA, 23 bp, Homo sapiens
gcagaaaggaaaacctgaagact

SEQ ID NO: 4931727 - DNA, 21 bp, Homo sapiens
gcagaaaggttctgcccggga

SEQ ID NO: 4931728 - DNA, 19 bp, Homo sapiens
gcagaactgccattatttt

SEQ ID NO: 4931729 - DNA, 22 bp, Homo sapiens
gcagaagaatgggaatatttta

SEQ ID NO: 4931730 - DNA, 23 bp, Homo sapiens
gcagaatcctaggctccacccca

SEQ ID NO: 4931731 - DNA, 20 bp, Homo sapiens
gcagacacgccttcccctca

SEQ ID NO: 4931732 - DNA, 20 bp, Homo sapiens
gcagacagaagtctcctcaa

SEQ ID NO: 4931733 - DNA, 18 bp, Homo sapiens
gcagacagcaggcagcgc

SEQ ID NO: 4931734 - DNA, 20 bp, Homo sapiens
gcagacagcaggcagcgcca

SEQ ID NO: 4931735 - DNA, 23 bp, Homo sapiens
gcagacaggcaagcacctcctgc

SEQ ID NO: 4931736 - DNA, 13 bp, Homo sapiens
gcagaccaccccg

SEQ ID NO: 4931737 - DNA, 21 bp, Homo sapiens
gcagaccaccccgcctgccct

SEQ ID NO: 4931738 - DNA, 15 bp, Homo sapiens
gcagacctccccagc

SEQ ID NO: 4931739 - DNA, 19 bp, Homo sapiens
gcagacctccccagcccct

SEQ ID NO: 4931740 - DNA, 17 bp, Homo sapiens
gcagactctacagaggc

SEQ ID NO: 4931741 - DNA, 17 bp, Homo sapiens
gcagagagagagaaaga

SEQ ID NO: 4931742 - DNA, 20 bp, Homo sapiens
gcagagagatgcggccaaga

SEQ ID NO: 4931743 - DNA, 21 bp, Homo sapiens
gcagagagccattttgtgaat

SEQ ID NO: 4931744 - DNA, 20 bp, Homo sapiens
gcagagcctcccaaggagaa

SEQ ID NO: 4931745 - DNA, 16 bp, Homo sapiens
gcagaggatgttcata

SEQ ID NO: 4931746 - DNA, 14 bp, Homo sapiens
gcagaggtggccag

SEQ ID NO: 4931747 - DNA, 15 bp, Homo sapiens
gcagaggtggccaga

SEQ ID NO: 4931748 - DNA, 15 bp, Homo sapiens
gcagagtgcacagct

SEQ ID NO: 4931749 - DNA, 17 bp, Homo sapiens
gcagagtgcacagctgt

SEQ ID NO: 4931750 - DNA, 21 bp, Homo sapiens
gcagataacaatgcagcaagg

SEQ ID NO: 4931751 - DNA, 16 bp, Homo sapiens
gcagataatcagcctc

SEQ ID NO: 4931752 - DNA, 17 bp, Homo sapiens
gcagataatcagcctct

SEQ ID NO: 4931753 - DNA, 19 bp, Homo sapiens
gcagataatcagcctctta

SEQ ID NO: 4931754 - DNA, 13 bp, Homo sapiens
gcagatctgtgcc

SEQ ID NO: 4931755 - DNA, 20 bp, Homo sapiens
gcagatctgtgccccatgcc

SEQ ID NO: 4931756 - DNA, 22 bp, Homo sapiens
gcagatctgtgccccatgcctg

SEQ ID NO: 4931757 - DNA, 14 bp, Homo sapiens
gcagatgatccatg

SEQ ID NO: 4931758 - DNA, 17 bp, Homo sapiens
gcagatgccaccctagc

SEQ ID NO: 4931759 - DNA, 18 bp, Homo sapiens
gcagatgccaccctagcc

SEQ ID NO: 4931760 - DNA, 18 bp, Homo sapiens
gcagatggaatgctgtgt

SEQ ID NO: 4931761 - DNA, 13 bp, Homo sapiens
gcagattagcagg

SEQ ID NO: 4931762 - DNA, 17 bp, Homo sapiens
gcagcaaggccctgctg

SEQ ID NO: 4931763 - DNA, 13 bp, Homo sapiens
gcagcagaaaact

SEQ ID NO: 4931764 - DNA, 14 bp, Homo sapiens
gcagcagaaaactt

SEQ ID NO: 4931765 - DNA, 14 bp, Homo sapiens
gcagcatcttctgg

SEQ ID NO: 4931766 - DNA, 15 bp, Homo sapiens
gcagcatggtccctg

SEQ ID NO: 4931767 - DNA, 18 bp, Homo sapiens
gcatcagggggaagaagc

SEQ ID NO: 4931768 - DNA, 17 bp, Homo sapiens
gcatcatagtagttttt

SEQ ID NO: 4931769 - DNA, 13 bp, Homo sapiens
gcatcatgcatgt

SEQ ID NO: 4931770 - DNA, 12 bp, Homo sapiens
gcatccatacca

SEQ ID NO: 4931771 - DNA, 17 bp, Homo sapiens
gcatccataccagctcg

SEQ ID NO: 4931772 - DNA, 19 bp, Homo sapiens
gcatccataccagctcgca

SEQ ID NO: 4931773 - DNA, 20 bp, Homo sapiens
gcatcccaggatgctgggtg

SEQ ID NO: 4931774 - DNA, 16 bp, Homo sapiens
gcatcccccaaagttc

SEQ ID NO: 4931775 - DNA, 19 bp, Homo sapiens
gcatccccttggctgtgag

SEQ ID NO: 4931776 - DNA, 14 bp, Homo sapiens
gcatcctaagaaat

SEQ ID NO: 4931777 - DNA, 21 bp, Homo sapiens
gcatcctaagaaatatgtgag

SEQ ID NO: 4931778 - DNA, 22 bp, Homo sapiens
gcatcctgagccccgccctctt

SEQ ID NO: 4931779 - DNA, 17 bp, Homo sapiens
gcatcctggcacccggc

SEQ ID NO: 4931780 - DNA, 16 bp, Homo sapiens
gcatccttcctataac

SEQ ID NO: 4931781 - DNA, 23 bp, Homo sapiens
gcatccttcctataacttgatgc

SEQ ID NO: 4931782 - DNA, 13 bp, Homo sapiens
gcatctcagccca

SEQ ID NO: 4931783 - DNA, 14 bp, Homo sapiens
gcatctcagcccac

SEQ ID NO: 4931784 - DNA, 17 bp, Homo sapiens
gcatctctgtactttgc

SEQ ID NO: 4931785 - DNA, 16 bp, Homo sapiens
gcatctcttgaggcca

SEQ ID NO: 4931786 - DNA, 17 bp, Homo sapiens
gcatctcttgaggccag

SEQ ID NO: 4931787 - DNA, 20 bp, Homo sapiens
gcatctgaaataggaaacaa

SEQ ID NO: 4931788 - DNA, 12 bp, Homo sapiens
gcatctgcccct

SEQ ID NO: 4931789 - DNA, 14 bp, Homo sapiens
gcatctgtgatggg

SEQ ID NO: 4931790 - DNA, 15 bp, Homo sapiens
gcatctttgccttgg

SEQ ID NO: 4931791 - DNA, 12 bp, Homo sapiens
gcatgaaatttt

SEQ ID NO: 4931792 - DNA, 22 bp, Homo sapiens
gcatgaagagaagcaattttgg

SEQ ID NO: 4931793 - DNA, 15 bp, Homo sapiens
gcatgacagcctcta

SEQ ID NO: 4931794 - DNA, 15 bp, Homo sapiens
gcatgaccagatgcg

SEQ ID NO: 4931795 - DNA, 21 bp, Homo sapiens
gcatgacttgtagcatattct

SEQ ID NO: 4931796 - DNA, 14 bp, Homo sapiens
gcatgccccggcca

SEQ ID NO: 4931797 - DNA, 19 bp, Homo sapiens
gcatgcctctgatatggga

SEQ ID NO: 4931798 - DNA, 21 bp, Homo sapiens
gcatgcctctgatatgggact

SEQ ID NO: 4931799 - DNA, 22 bp, Homo sapiens
gcatgcctgagagacatggctt

SEQ ID NO: 4931800 - DNA, 13 bp, Homo sapiens
gcatgccttgtgc

SEQ ID NO: 4931801 - DNA, 16 bp, Homo sapiens
gcatggaggccctcct

SEQ ID NO: 4931802 - DNA, 15 bp, Homo sapiens
gcatggatttctgtc

SEQ ID NO: 4931803 - DNA, 12 bp, Homo sapiens
gcatggccctgg

SEQ ID NO: 4931804 - DNA, 16 bp, Homo sapiens
gcatggccctggggtc

SEQ ID NO: 4931805 - DNA, 17 bp, Homo sapiens
gcatggctccagaaatg

SEQ ID NO: 4931806 - DNA, 19 bp, Homo sapiens
gcatggctccagaaatgtc

SEQ ID NO: 4931807 - DNA, 15 bp, Homo sapiens
gcatgggcactccct

SEQ ID NO: 4931808 - DNA, 17 bp, Homo sapiens
gcatggtaccagccctg

SEQ ID NO: 4931809 - DNA, 23 bp, Homo sapiens
gcatggtaccagccctggggctg

SEQ ID NO: 4931810 - DNA, 22 bp, Homo sapiens
gcatggtcaaccctcaggggaa

SEQ ID NO: 4931811 - DNA, 15 bp, Homo sapiens
gcatggtcacacact

SEQ ID NO: 4931812 - DNA, 18 bp, Homo sapiens
gcatggtcacacactgat

SEQ ID NO: 4931813 - DNA, 17 bp, Homo sapiens
gcatgtaaaagcggaaa

SEQ ID NO: 4931814 - DNA, 18 bp, Homo sapiens
gcatgtaccatttgcatg

SEQ ID NO: 4931815 - DNA, 20 bp, Homo sapiens
gcatgtcaaacatgagatgt

SEQ ID NO: 4931816 - DNA, 20 bp, Homo sapiens
gcatgtggtttggttcctct

SEQ ID NO: 4931817 - DNA, 11 bp, Homo sapiens
gcatgtgtgta

SEQ ID NO: 4931818 - DNA, 21 bp, Homo sapiens
gcatgttctctgaggacacta

SEQ ID NO: 4931819 - DNA, 18 bp, Homo sapiens
gcatgtttgaaatgaggt

SEQ ID NO: 4931820 - DNA, 14 bp, Homo sapiens
gcatgttttgtata

SEQ ID NO: 4931821 - DNA, 14 bp, Homo sapiens
gcattaaacctgtc

SEQ ID NO: 4931822 - DNA, 15 bp, Homo sapiens
gcattaaacctgtct

SEQ ID NO: 4931823 - DNA, 19 bp, Homo sapiens
gcattaaattttaaggtag

SEQ ID NO: 4931824 - DNA, 13 bp, Homo sapiens
gcattaacacaaa

SEQ ID NO: 4931825 - DNA, 13 bp, Homo sapiens
gcattaatgtttc

SEQ ID NO: 4931826 - DNA, 20 bp, Homo sapiens
gcattagcacagattttaat

SEQ ID NO: 4931827 - DNA, 21 bp, Homo sapiens
gcattagcacagattttaatt

SEQ ID NO: 4931828 - DNA, 22 bp, Homo sapiens
gcattagcacagattttaattg

SEQ ID NO: 4931829 - DNA, 22 bp, Homo sapiens
gcattatgtccactgtgtatag

SEQ ID NO: 4931830 - DNA, 12 bp, Homo sapiens
gcattattcatt

SEQ ID NO: 4931831 - DNA, 16 bp, Homo sapiens
gcattattcatttagt

SEQ ID NO: 4931832 - DNA, 16 bp, Homo sapiens
gcattattctctttta

SEQ ID NO: 4931833 - DNA, 13 bp, Homo sapiens
gcattcagagagc

SEQ ID NO: 4931834 - DNA, 16 bp, Homo sapiens
gcattcagagagcagc

SEQ ID NO: 4931835 - DNA, 14 bp, Homo sapiens
gcattccttctttg

SEQ ID NO: 4931836 - DNA, 15 bp, Homo sapiens
gcattccttctttga

SEQ ID NO: 4931837 - DNA, 16 bp, Homo sapiens
gcattctattgccttc

SEQ ID NO: 4931838 - DNA, 18 bp, Homo sapiens
gcattctttcccagtgag

SEQ ID NO: 4931839 - DNA, 12 bp, Homo sapiens
gcattgaacaca

SEQ ID NO: 4931840 - DNA, 18 bp, Homo sapiens
gcattgaacacaaactgt

SEQ ID NO: 4931841 - DNA, 21 bp, Homo sapiens
gcattgaacacaaactgtaaa

SEQ ID NO: 4931842 - DNA, 16 bp, Homo sapiens
gcattgacaaatctgt

SEQ ID NO: 4931843 - DNA, 23 bp, Homo sapiens
gcattgactggtttacaggccct

SEQ ID NO: 4931844 - DNA, 21 bp, Homo sapiens
gcattgactttcagtaaacat

SEQ ID NO: 4931845 - DNA, 22 bp, Homo sapiens
gcattgactttcagtaaacata

SEQ ID NO: 4931846 - DNA, 18 bp, Homo sapiens
gcattgaggaagagtctt

SEQ ID NO: 4931847 - DNA, 13 bp, Homo sapiens
gcattgctttcgt

SEQ ID NO: 4931848 - DNA, 20 bp, Homo sapiens
gcattgcttttattttgaaa

SEQ ID NO: 4931849 - DNA, 15 bp, Homo sapiens
gcatttactttgtgt

SEQ ID NO: 4931850 - DNA, 18 bp, Homo sapiens
gcatttactttgtgttca

SEQ ID NO: 4931851 - DNA, 18 bp, Homo sapiens
gcatttctgaatagaaat

SEQ ID NO: 4931852 - DNA, 12 bp, Homo sapiens
gcatttgttcac

SEQ ID NO: 4931853 - DNA, 20 bp, Homo sapiens
gcatttttgatttatgcatg

SEQ ID NO: 4931854 - DNA, 16 bp, Homo sapiens
gccaaaagctagacag

SEQ ID NO: 4931855 - DNA, 21 bp, Homo sapiens
gccaaaagctagacagatccc

SEQ ID NO: 4931856 - DNA, 22 bp, Homo sapiens
gccaaagaaatgaacattccaa

SEQ ID NO: 4931857 - DNA, 13 bp, Homo sapiens
gccaaagccaaag

SEQ ID NO: 4931858 - DNA, 22 bp, Homo sapiens
gccaaagctaggcctggccaga

SEQ ID NO: 4931859 - DNA, 19 bp, Homo sapiens
gccaaagggaaatatcatt

SEQ ID NO: 4931860 - DNA, 20 bp, Homo sapiens
gccaaatccgctctcttcct

SEQ ID NO: 4931861 - DNA, 18 bp, Homo sapiens
gccaaattatttgtgtaa

SEQ ID NO: 4931862 - DNA, 20 bp, Homo sapiens
gccaacaccacagaaatggg

SEQ ID NO: 4931863 - DNA, 22 bp, Homo sapiens
gccaacttgagggcccagagca

SEQ ID NO: 4931864 - DNA, 20 bp, Homo sapiens
gccaagaaaagggctgacat

SEQ ID NO: 4931865 - DNA, 15 bp, Homo sapiens
gccaagaaacgtctt

SEQ ID NO: 4931866 - DNA, 23 bp, Homo sapiens
gccaagacaaatcaacagaagca

SEQ ID NO: 4931867 - DNA, 20 bp, Homo sapiens
gccaaggccagagtggcctg

SEQ ID NO: 4931868 - DNA, 21 bp, Homo sapiens
gccaaggccagagtggcctgg

SEQ ID NO: 4931869 - DNA, 14 bp, Homo sapiens
gccaaggccttctc

SEQ ID NO: 4931870 - DNA, 22 bp, Homo sapiens
gccaaggggagtcaccttccct

SEQ ID NO: 4931871 - DNA, 19 bp, Homo sapiens
gccaagtgcgtgccgtgtg

SEQ ID NO: 4931872 - DNA, 22 bp, Homo sapiens
gccaatccctcaccttctgagt

SEQ ID NO: 4931873 - DNA, 16 bp, Homo sapiens
gccaatggagactgtc

SEQ ID NO: 4931874 - DNA, 21 bp, Homo sapiens
gccaatggagactgtctcaag

SEQ ID NO: 4931875 - DNA, 19 bp, Homo sapiens
gccaattattgttacacat

SEQ ID NO: 4931876 - DNA, 15 bp, Homo sapiens
gccacaagtcttcca

SEQ ID NO: 4931877 - DNA, 19 bp, Homo sapiens
gccatgtataaatgtgata

SEQ ID NO: 4931878 - DNA, 15 bp, Homo sapiens
gccatgtccaaagag

SEQ ID NO: 4931879 - DNA, 18 bp, Homo sapiens
gccatgtccaaagaggct

SEQ ID NO: 4931880 - DNA, 19 bp, Homo sapiens
gccatgtccaaagaggctg

SEQ ID NO: 4931881 - DNA, 16 bp, Homo sapiens
gccattattttctgtc

SEQ ID NO: 4931882 - DNA, 17 bp, Homo sapiens
gccattattttctgtca

SEQ ID NO: 4931883 - DNA, 20 bp, Homo sapiens
gccattattttctgtcagat

SEQ ID NO: 4931884 - DNA, 19 bp, Homo sapiens
gccattgccaccaggagaa

SEQ ID NO: 4931885 - DNA, 11 bp, Homo sapiens
gccatttaaaa

SEQ ID NO: 4931886 - DNA, 13 bp, Homo sapiens
gccatttatttat

SEQ ID NO: 4931887 - DNA, 17 bp, Homo sapiens
gccatttgatttttcta

SEQ ID NO: 4931888 - DNA, 15 bp, Homo sapiens
gccatttgctttttc

SEQ ID NO: 4931889 - DNA, 14 bp, Homo sapiens
gccattttgtgaat

SEQ ID NO: 4931890 - DNA, 18 bp, Homo sapiens
gcccaaaaatatggttga

SEQ ID NO: 4931891 - DNA, 21 bp, Homo sapiens
gcccaaaggggacaggcctca

SEQ ID NO: 4931892 - DNA, 14 bp, Homo sapiens
gcccaaatttttct

SEQ ID NO: 4931893 - DNA, 24 bp, Homo sapiens
gcccaacctgctctcctcttgcca

SEQ ID NO: 4931894 - DNA, 21 bp, Homo sapiens
gcccaagaatagatgctgact

SEQ ID NO: 4931895 - DNA, 19 bp, Homo sapiens
gcccaagacagatgcccca

SEQ ID NO: 4931896 - DNA, 20 bp, Homo sapiens
gcccaagacagatgccccag

SEQ ID NO: 4931897 - DNA, 23 bp, Homo sapiens
gcccaagacagatgccccagagc

SEQ ID NO: 4931898 - DNA, 15 bp, Homo sapiens
gcccaaggcggcccc

SEQ ID NO: 4931899 - DNA, 15 bp, Homo sapiens
gcccaattggaggaa

SEQ ID NO: 4931900 - DNA, 16 bp, Homo sapiens
gcccacaggaggcaag

SEQ ID NO: 4931901 - DNA, 17 bp, Homo sapiens
gcccacaggaggcaagc

SEQ ID NO: 4931902 - DNA, 19 bp, Homo sapiens
gcccacaggatcagtctga

SEQ ID NO: 4931903 - DNA, 18 bp, Homo sapiens
gcccaccctgctgccttc

SEQ ID NO: 4931904 - DNA, 14 bp, Homo sapiens
gcccacctgcccat

SEQ ID NO: 4931905 - DNA, 20 bp, Homo sapiens
gcccacctgcccatcacagg

SEQ ID NO: 4931906 - DNA, 17 bp, Homo sapiens
gcccacgctggagtgca

SEQ ID NO: 4931907 - DNA, 20 bp, Homo sapiens
gcccacggctaagaggctgc

SEQ ID NO: 4931908 - DNA, 13 bp, Homo sapiens
gcccacttctgcc

SEQ ID NO: 4931909 - DNA, 14 bp, Homo sapiens
gcccagagcaggaa

SEQ ID NO: 4931910 - DNA, 22 bp, Homo sapiens
gcccagaggtaacagaacagct

SEQ ID NO: 4931911 - DNA, 16 bp, Homo sapiens
gcccagccctccccat

SEQ ID NO: 4931912 - DNA, 16 bp, Homo sapiens
gcccagccctgttctg

SEQ ID NO: 4931913 - DNA, 15 bp, Homo sapiens
gcccagcgctctgcc

SEQ ID NO: 4931914 - DNA, 20 bp, Homo sapiens
gcccaggagagagaaagcca

SEQ ID NO: 4931915 - DNA, 22 bp, Homo sapiens
gcccaggagggcatccatacca

SEQ ID NO: 4931916 - DNA, 13 bp, Homo sapiens
gcccaggcaggtc

SEQ ID NO: 4931917 - DNA, 11 bp, Homo sapiens
gcccaggcccc

SEQ ID NO: 4931918 - DNA, 22 bp, Homo sapiens
gcccaggcccctgccaccctgg

SEQ ID NO: 4931919 - DNA, 23 bp, Homo sapiens
gcccaggcccctgccaccctggg

SEQ ID NO: 4931920 - DNA, 14 bp, Homo sapiens
gcccaggccggcca

SEQ ID NO: 4931921 - DNA, 11 bp, Homo sapiens
gcccaggctgg

SEQ ID NO: 4931922 - DNA, 20 bp, Homo sapiens
gcccaggctggagtgcagtg

SEQ ID NO: 4931923 - DNA, 12 bp, Homo sapiens
gcccaggctggc

SEQ ID NO: 4931924 - DNA, 15 bp, Homo sapiens
gcccaggctggcgtg

SEQ ID NO: 4931925 - DNA, 22 bp, Homo sapiens
gcccaggctgtgcagcgcagct

SEQ ID NO: 4931926 - DNA, 14 bp, Homo sapiens
gcccagggtggact

SEQ ID NO: 4931927 - DNA, 23 bp, Homo sapiens
gcccagggtggacttagaaagca

SEQ ID NO: 4931928 - DNA, 22 bp, Homo sapiens
gcccagtctggaatgcagtggt

SEQ ID NO: 4931929 - DNA, 15 bp, Homo sapiens
gcccagttgggtgga

SEQ ID NO: 4931930 - DNA, 17 bp, Homo sapiens
gcccatactcagcctgc

SEQ ID NO: 4931931 - DNA, 19 bp, Homo sapiens
gcccatactcagcctgctg

SEQ ID NO: 4931932 - DNA, 22 bp, Homo sapiens
gcccatagaaacatgacactga

SEQ ID NO: 4931933 - DNA, 23 bp, Homo sapiens
gcccatagaaacatgacactgac

SEQ ID NO: 4931934 - DNA, 13 bp, Homo sapiens
gcccatcacaggg

SEQ ID NO: 4931935 - DNA, 17 bp, Homo sapiens
gcccatcacagggttgg

SEQ ID NO: 4931936 - DNA, 14 bp, Homo sapiens
gcccatccctgcct

SEQ ID NO: 4931937 - DNA, 16 bp, Homo sapiens
gcccatccctgcctgg

SEQ ID NO: 4931938 - DNA, 19 bp, Homo sapiens
gcccatccctgcctggtca

SEQ ID NO: 4931939 - DNA, 22 bp, Homo sapiens
gcccatgttctgcccccagccc

SEQ ID NO: 4931940 - DNA, 23 bp, Homo sapiens
gcccatgttctgcccccagccca

SEQ ID NO: 4931941 - DNA, 18 bp, Homo sapiens
gccccaaacaaatatgca

SEQ ID NO: 4931942 - DNA, 19 bp, Homo sapiens
gccccaaacaaatatgcaa

SEQ ID NO: 4931943 - DNA, 21 bp, Homo sapiens
gccccaaatatagcgttccca

SEQ ID NO: 4931944 - DNA, 13 bp, Homo sapiens
gccccaacctgct

SEQ ID NO: 4931945 - DNA, 12 bp, Homo sapiens
gccccacccagg

SEQ ID NO: 4931946 - DNA, 13 bp, Homo sapiens
gccccactgatgc

SEQ ID NO: 4931947 - DNA, 22 bp, Homo sapiens
gccccagagcagggtgttggga

SEQ ID NO: 4931948 - DNA, 13 bp, Homo sapiens
gccccagagctgt

SEQ ID NO: 4931949 - DNA, 16 bp, Homo sapiens
gccccagggctaccct

SEQ ID NO: 4931950 - DNA, 23 bp, Homo sapiens
gccccagggtcttccctacctca

SEQ ID NO: 4931951 - DNA, 15 bp, Homo sapiens
gccccagtgcccaca

SEQ ID NO: 4931952 - DNA, 21 bp, Homo sapiens
gccccagtgcccacaggatca

SEQ ID NO: 4931953 - DNA, 23 bp, Homo sapiens
gccccatgcctgtccagcctggg

SEQ ID NO: 4931954 - DNA, 15 bp, Homo sapiens
gcccccagcccctcc

SEQ ID NO: 4931955 - DNA, 19 bp, Homo sapiens
gcccccagcccctccccca

SEQ ID NO: 4931956 - DNA, 20 bp, Homo sapiens
gcccccagcccctcccccat

SEQ ID NO: 4931957 - DNA, 16 bp, Homo sapiens
gccccccagcctctgg

SEQ ID NO: 4931958 - DNA, 16 bp, Homo sapiens
gccccccagctcaggg

SEQ ID NO: 4931959 - DNA, 22 bp, Homo sapiens
gccccctccccggcaccctctg

SEQ ID NO: 4931960 - DNA, 23 bp, Homo sapiens
gccccctccccggcaccctctgg

SEQ ID NO: 4931961 - DNA, 20 bp, Homo sapiens
gccccctcctctagctgtgg

SEQ ID NO: 4931962 - DNA, 21 bp, Homo sapiens
gccccctcctgaaccgcacag

SEQ ID NO: 4931963 - DNA, 13 bp, Homo sapiens
gccccctgccccc

SEQ ID NO: 4931964 - DNA, 14 bp, Homo sapiens
gccccctgcccccc

SEQ ID NO: 4931965 - DNA, 20 bp, Homo sapiens
gccccctgctggctcttctg

SEQ ID NO: 4931966 - DNA, 15 bp, Homo sapiens
gccccctggcctctg

SEQ ID NO: 4931967 - DNA, 17 bp, Homo sapiens
gccccctggcctctgtg

SEQ ID NO: 4931968 - DNA, 19 bp, Homo sapiens
gccccctggcctctgtgcc

SEQ ID NO: 4931969 - DNA, 13 bp, Homo sapiens
gccccctggtctc

SEQ ID NO: 4931970 - DNA, 16 bp, Homo sapiens
gccccctggtctctgg

SEQ ID NO: 4931971 - DNA, 15 bp, Homo sapiens
gccccgaggccttct

SEQ ID NO: 4931972 - DNA, 20 bp, Homo sapiens
gccccgcagacctccccagc

SEQ ID NO: 4931973 - DNA, 22 bp, Homo sapiens
gccccggatcagagcaggacct

SEQ ID NO: 4931974 - DNA, 17 bp, Homo sapiens
gccccggccacctctgc

SEQ ID NO: 4931975 - DNA, 21 bp, Homo sapiens
gcccctagaaacccaagctcc

SEQ ID NO: 4931976 - DNA, 13 bp, Homo sapiens
gcccctagcccag

SEQ ID NO: 4931977 - DNA, 12 bp, Homo sapiens
gcccctcccttc

SEQ ID NO: 4931978 - DNA, 21 bp, Homo sapiens
gcccctctcccgccagactgt

SEQ ID NO: 4931979 - DNA, 12 bp, Homo sapiens
gcccctctttct

SEQ ID NO: 4931980 - DNA, 13 bp, Homo sapiens
gcccctgcacaaa

SEQ ID NO: 4931981 - DNA, 13 bp, Homo sapiens
gcccctgccaccc

SEQ ID NO: 4931982 - DNA, 13 bp, Homo sapiens
gcccctgcccggc

SEQ ID NO: 4931983 - DNA, 14 bp, Homo sapiens
gcccctgcccggct

SEQ ID NO: 4931984 - DNA, 21 bp, Homo sapiens
gcccctgcctgccatgtacct

SEQ ID NO: 4931985 - DNA, 22 bp, Homo sapiens
gcccctgcctgccatgtacctc

SEQ ID NO: 4931986 - DNA, 16 bp, Homo sapiens
gcccctgctggttcag

SEQ ID NO: 4931987 - DNA, 15 bp, Homo sapiens
gcccgggagcctagg

SEQ ID NO: 4931988 - DNA, 20 bp, Homo sapiens
gcccgggagcctaggaccac

SEQ ID NO: 4931989 - DNA, 14 bp, Homo sapiens
gcccgtctcagtgt

SEQ ID NO: 4931990 - DNA, 16 bp, Homo sapiens
gccctacagagctgtg

SEQ ID NO: 4931991 - DNA, 15 bp, Homo sapiens
gccctactcattggg

SEQ ID NO: 4931992 - DNA, 16 bp, Homo sapiens
gccctactccctgcag

SEQ ID NO: 4931993 - DNA, 21 bp, Homo sapiens
gccctagagcctgcctggagc

SEQ ID NO: 4931994 - DNA, 23 bp, Homo sapiens
gccctagagcctgcctggagcgt

SEQ ID NO: 4931995 - DNA, 18 bp, Homo sapiens
gccctcagatgtcccttg

SEQ ID NO: 4931996 - DNA, 23 bp, Homo sapiens
gccctcatcttgaagggcccagg

SEQ ID NO: 4931997 - DNA, 18 bp, Homo sapiens
gccctccccatggagcca

SEQ ID NO: 4931998 - DNA, 19 bp, Homo sapiens
gccctccccatggagccag

SEQ ID NO: 4931999 - DNA, 22 bp, Homo sapiens
gccctccgaccacttccagggg

SEQ ID NO: 4932000 - DNA, 12 bp, Homo sapiens
gccctcctgtgc

SEQ ID NO: 4932001 - DNA, 13 bp, Homo sapiens
gccctcctttctg

SEQ ID NO: 4932002 - DNA, 17 bp, Homo sapiens
gccctcctttctgtgcc

SEQ ID NO: 4932003 - DNA, 15 bp, Homo sapiens
gccctctccccaccc

SEQ ID NO: 4932004 - DNA, 23 bp, Homo sapiens
gccctctccccacccctacccct

SEQ ID NO: 4932005 - DNA, 17 bp, Homo sapiens
gccctctcccttaccct

SEQ ID NO: 4932006 - DNA, 22 bp, Homo sapiens
gccctctcccttaccctgggaa

SEQ ID NO: 4932007 - DNA, 13 bp, Homo sapiens
gccctcttcctga

SEQ ID NO: 4932008 - DNA, 16 bp, Homo sapiens
gccctcttcctgacga

SEQ ID NO: 4932009 - DNA, 16 bp, Homo sapiens
gccctgaggaaggagg

SEQ ID NO: 4932010 - DNA, 21 bp, Homo sapiens
gccctgaggtgaaagggagct

SEQ ID NO: 4932011 - DNA, 14 bp, Homo sapiens
gccctgcagccagc

SEQ ID NO: 4932012 - DNA, 22 bp, Homo sapiens
gccctgcagtgttcgcttggct

SEQ ID NO: 4932013 - DNA, 13 bp, Homo sapiens
gccctgccctgag

SEQ ID NO: 4932014 - DNA, 16 bp, Homo sapiens
gccctgctcctgcagc

SEQ ID NO: 4932015 - DNA, 21 bp, Homo sapiens
gccctgctgccgcctcccagc

SEQ ID NO: 4932016 - DNA, 16 bp, Homo sapiens
gccctgctttgggctg

SEQ ID NO: 4932017 - DNA, 21 bp, Homo sapiens
gccctgctttgggctgccctg

SEQ ID NO: 4932018 - DNA, 21 bp, Homo sapiens
gccctggaactctatctgggc

SEQ ID NO: 4932019 - DNA, 15 bp, Homo sapiens
gccctggcagggggc

SEQ ID NO: 4932020 - DNA, 16 bp, Homo sapiens
gccctggcagggggca

SEQ ID NO: 4932021 - DNA, 19 bp, Homo sapiens
gccctggctcccacaggcc

SEQ ID NO: 4932022 - DNA, 14 bp, Homo sapiens
gccctggctctgca

SEQ ID NO: 4932023 - DNA, 16 bp, Homo sapiens
gccctgggctcggagg

SEQ ID NO: 4932024 - DNA, 17 bp, Homo sapiens
gccctgggctcggaggc

SEQ ID NO: 4932025 - DNA, 19 bp, Homo sapiens
gccctgggctcggaggctg

SEQ ID NO: 4932026 - DNA, 23 bp, Homo sapiens
gccctgggctcggaggctgcccc

SEQ ID NO: 4932027 - DNA, 23 bp, Homo sapiens
gccctggtccagggaagctggcc

SEQ ID NO: 4932028 - DNA, 18 bp, Homo sapiens
gccctggtggcagtggga

SEQ ID NO: 4932029 - DNA, 19 bp, Homo sapiens
gccctggtggcagtgggag

SEQ ID NO: 4932030 - DNA, 16 bp, Homo sapiens
gccctggtttcactgg

SEQ ID NO: 4932031 - DNA, 18 bp, Homo sapiens
gccctggtttcactggcc

SEQ ID NO: 4932032 - DNA, 15 bp, Homo sapiens
gccctgtccctccca

SEQ ID NO: 4932033 - DNA, 16 bp, Homo sapiens
gccctgtccctcccac

SEQ ID NO: 4932034 - DNA, 17 bp, Homo sapiens
gccctgtccctcccacc

SEQ ID NO: 4932035 - DNA, 18 bp, Homo sapiens
gccctgtccctcccacct

SEQ ID NO: 4932036 - DNA, 19 bp, Homo sapiens
gccctgtccctcccacctc

SEQ ID NO: 4932037 - DNA, 21 bp, Homo sapiens
gccctgtccctcccacctctg

SEQ ID NO: 4932038 - DNA, 22 bp, Homo sapiens
gccctgtccctcccacctctgt

SEQ ID NO: 4932039 - DNA, 23 bp, Homo sapiens
gccctgtccctcccacctctgtg

SEQ ID NO: 4932040 - DNA, 22 bp, Homo sapiens
gcccttagcagggaaacagcta

SEQ ID NO: 4932041 - DNA, 20 bp, Homo sapiens
gcccttagtcccccaactct

SEQ ID NO: 4932042 - DNA, 22 bp, Homo sapiens
gcccttcacattttttatgggc

SEQ ID NO: 4932043 - DNA, 12 bp, Homo sapiens
gcccttccatgt

SEQ ID NO: 4932044 - DNA, 14 bp, Homo sapiens
gcccttcctctcca

SEQ ID NO: 4932045 - DNA, 15 bp, Homo sapiens
gcccttcctctccac

SEQ ID NO: 4932046 - DNA, 20 bp, Homo sapiens
gcccttcctctccactgcct

SEQ ID NO: 4932047 - DNA, 21 bp, Homo sapiens
gcccttcctctccactgcctt

SEQ ID NO: 4932048 - DNA, 22 bp, Homo sapiens
gcccttcctctccactgccttc

SEQ ID NO: 4932049 - DNA, 22 bp, Homo sapiens
gcccttgcagttcagcaccacc

SEQ ID NO: 4932050 - DNA, 16 bp, Homo sapiens
gccctttgaagcctca

SEQ ID NO: 4932051 - DNA, 20 bp, Homo sapiens
gccgaatcccctccctgtca

SEQ ID NO: 4932052 - DNA, 19 bp, Homo sapiens
gccgaccagaggagccttt

SEQ ID NO: 4932053 - DNA, 19 bp, Homo sapiens
gccgagatcacgccactgc

SEQ ID NO: 4932054 - DNA, 22 bp, Homo sapiens
gccgagatcacgccactgcact

SEQ ID NO: 4932055 - DNA, 16 bp, Homo sapiens
gccgagggtcctggct

SEQ ID NO: 4932056 - DNA, 18 bp, Homo sapiens
gccgagggtcctggctcc

SEQ ID NO: 4932057 - DNA, 17 bp, Homo sapiens
gccgatatactctagat

SEQ ID NO: 4932058 - DNA, 13 bp, Homo sapiens
gccgatggagaca

SEQ ID NO: 4932059 - DNA, 17 bp, Homo sapiens
gccgccattgccaccag

SEQ ID NO: 4932060 - DNA, 15 bp, Homo sapiens
gccgccccctcctga

SEQ ID NO: 4932061 - DNA, 16 bp, Homo sapiens
gccgccccctcctgaa

SEQ ID NO: 4932062 - DNA, 12 bp, Homo sapiens
gccgcctcccag

SEQ ID NO: 4932063 - DNA, 14 bp, Homo sapiens
gccgcctcccagcc

SEQ ID NO: 4932064 - DNA, 16 bp, Homo sapiens
gccgcctcccagcctg

SEQ ID NO: 4932065 - DNA, 19 bp, Homo sapiens
gccgcctcccagcctgggg

SEQ ID NO: 4932066 - DNA, 13 bp, Homo sapiens
gccgcctgcactc

SEQ ID NO: 4932067 - DNA, 18 bp, Homo sapiens
gccgcctgcactcctcag

SEQ ID NO: 4932068 - DNA, 21 bp, Homo sapiens
gccgcgtggtgccatccccag

SEQ ID NO: 4932069 - DNA, 19 bp, Homo sapiens
gccgcgtttagaccaagga

SEQ ID NO: 4932070 - DNA, 20 bp, Homo sapiens
gccgcgtttagaccaaggaa

SEQ ID NO: 4932071 - DNA, 12 bp, Homo sapiens
gccgctgtgagc

SEQ ID NO: 4932072 - DNA, 18 bp, Homo sapiens
gccggctgtgctcagaga

SEQ ID NO: 4932073 - DNA, 22 bp, Homo sapiens
gccgggaacagacaacagaagt

SEQ ID NO: 4932074 - DNA, 19 bp, Homo sapiens
gccgggccgaatcccctcc

SEQ ID NO: 4932075 - DNA, 18 bp, Homo sapiens
gcgggcaggttctgcctg

SEQ ID NO: 4932076 - DNA, 19 bp, Homo sapiens
gcgggcttatttattaaca

SEQ ID NO: 4932077 - DNA, 14 bp, Homo sapiens
gcggggacagctcc

SEQ ID NO: 4932078 - DNA, 18 bp, Homo sapiens
gcggggacagctccttct

SEQ ID NO: 4932079 - DNA, 19 bp, Homo sapiens
gcggggacagctccttctg

SEQ ID NO: 4932080 - DNA, 23 bp, Homo sapiens
gcggggacagctccttctgtcct

SEQ ID NO: 4932081 - DNA, 18 bp, Homo sapiens
gcggtccacccaggagcc

SEQ ID NO: 4932082 - DNA, 20 bp, Homo sapiens
gcggtccacccaggagcccc

SEQ ID NO: 4932083 - DNA, 23 bp, Homo sapiens
gcggtccacccaggagccccgag

SEQ ID NO: 4932084 - DNA, 16 bp, Homo sapiens
gcggtggggagagatg

SEQ ID NO: 4932085 - DNA, 20 bp, Homo sapiens
gcgtagcgtgcccgtgtgca

SEQ ID NO: 4932086 - DNA, 19 bp, Homo sapiens
gcgtcccagtctctggcag

SEQ ID NO: 4932087 - DNA, 19 bp, Homo sapiens
gcgtccctagcagtgaact

SEQ ID NO: 4932088 - DNA, 21 bp, Homo sapiens
gcgtctcctgtttttctgggt

SEQ ID NO: 4932089 - DNA, 16 bp, Homo sapiens
gcgtgagccactgcac

SEQ ID NO: 4932090 - DNA, 23 bp, Homo sapiens
gcgtgagccactgcaccgggcca

SEQ ID NO: 4932091 - DNA, 16 bp, Homo sapiens
gcgtgaggtcccagga

SEQ ID NO: 4932092 - DNA, 18 bp, Homo sapiens
gcgtgcacacaccagagc

SEQ ID NO: 4932093 - DNA, 20 bp, Homo sapiens
gcgtgccgtgtgagtgtgac

SEQ ID NO: 4932094 - DNA, 18 bp, Homo sapiens
gcgtggactctgcacatg

SEQ ID NO: 4932095 - DNA, 17 bp, Homo sapiens
gcgtggcaaatataaaa

SEQ ID NO: 4932096 - DNA, 12 bp, Homo sapiens
gcgtgggtcaga

SEQ ID NO: 4932097 - DNA, 12 bp, Homo sapiens
gcgtgtgtagag

SEQ ID NO: 4932098 - DNA, 15 bp, Homo sapiens
gcgtgtgtagagtta

SEQ ID NO: 4932099 - DNA, 22 bp, Homo sapiens
gcgtgtgtagagttaagaagct

SEQ ID NO: 4932100 - DNA, 22 bp, Homo sapiens
gcgttgggagggggagaaaagg

SEQ ID NO: 4932101 - DNA, 19 bp, Homo sapiens
gcgttttttaaatgtatac

SEQ ID NO: 4932102 - DNA, 17 bp, Homo sapiens
gctaaacgttggtgacg

SEQ ID NO: 4932103 - DNA, 23 bp, Homo sapiens
gctaacattttaaataaaagaaa

SEQ ID NO: 4932104 - DNA, 19 bp, Homo sapiens
gctaaccttatcctgcatt

SEQ ID NO: 4932105 - DNA, 21 bp, Homo sapiens
gctaaccttatcctgcattgt

SEQ ID NO: 4932106 - DNA, 11 bp, Homo sapiens
gctaaggctct

SEQ ID NO: 4932107 - DNA, 16 bp, Homo sapiens
gctaagggaagacatt

SEQ ID NO: 4932108 - DNA, 23 bp, Homo sapiens
gctaagggaagacatttcttttc

SEQ ID NO: 4932109 - DNA, 20 bp, Homo sapiens
gctaagggtgggtgctcaga

SEQ ID NO: 4932110 - DNA, 16 bp, Homo sapiens
gctaaggttctaaggc

SEQ ID NO: 4932111 - DNA, 20 bp, Homo sapiens
gctaagtacacaataagcaa

SEQ ID NO: 4932112 - DNA, 21 bp, Homo sapiens
gctaagtacacaataagcaaa

SEQ ID NO: 4932113 - DNA, 22 bp, Homo sapiens
gctaagtacacaataagcaaaa

SEQ ID NO: 4932114 - DNA, 18 bp, Homo sapiens
gctaagtgatcctcccac

SEQ ID NO: 4932115 - DNA, 18 bp, Homo sapiens
gctaatcaaagccagggt

SEQ ID NO: 4932116 - DNA, 13 bp, Homo sapiens
gctaatgggacac

SEQ ID NO: 4932117 - DNA, 15 bp, Homo sapiens
gctaatgggacacta

SEQ ID NO: 4932118 - DNA, 14 bp, Homo sapiens
gctaattaaaaagt

SEQ ID NO: 4932119 - DNA, 12 bp, Homo sapiens
gctaatttgcat

SEQ ID NO: 4932120 - DNA, 15 bp, Homo sapiens
gctaatttgcattaa

SEQ ID NO: 4932121 - DNA, 17 bp, Homo sapiens
gctaattttctcaaaag

SEQ ID NO: 4932122 - DNA, 19 bp, Homo sapiens
gctaattttctcaaaagca

SEQ ID NO: 4932123 - DNA, 17 bp, Homo sapiens
gctaatttttgtaattt

SEQ ID NO: 4932124 - DNA, 21 bp, Homo sapiens
gctacagctttcttgctccct

SEQ ID NO: 4932125 - DNA, 11 bp, Homo sapiens
gctacattata

SEQ ID NO: 4932126 - DNA, 13 bp, Homo sapiens
gctacattataaa

SEQ ID NO: 4932127 - DNA, 15 bp, Homo sapiens
gctacattataaacg

SEQ ID NO: 4932128 - DNA, 16 bp, Homo sapiens
gctaccctttttctcc

SEQ ID NO: 4932129 - DNA, 20 bp, Homo sapiens
gctaccctttttctccagct

SEQ ID NO: 4932130 - DNA, 14 bp, Homo sapiens
gctaccgttgactt

SEQ ID NO: 4932131 - DNA, 14 bp, Homo sapiens
gctacgaatcttcc

SEQ ID NO: 4932132 - DNA, 15 bp, Homo sapiens
gctacgaatcttccg

SEQ ID NO: 4932133 - DNA, 18 bp, Homo sapiens
gctactagaattctgtat

SEQ ID NO: 4932134 - DNA, 18 bp, Homo sapiens
gctactgcagctttacat

SEQ ID NO: 4932135 - DNA, 20 bp, Homo sapiens
gctactgtcctacccaccct

SEQ ID NO: 4932136 - DNA, 12 bp, Homo sapiens
gctactgtctca

SEQ ID NO: 4932137 - DNA, 10 bp, Homo sapiens
gctagaactt

SEQ ID NO: 4932138 - DNA, 12 bp, Homo sapiens
gctagaactttt

SEQ ID NO: 4932139 - DNA, 14 bp, Homo sapiens
gctagaactttttt

SEQ ID NO: 4932140 - DNA, 17 bp, Homo sapiens
gctagaacttttttaaa

SEQ ID NO: 4932141 - DNA, 19 bp, Homo sapiens
gctagaacttttttaaata

SEQ ID NO: 4932142 - DNA, 21 bp, Homo sapiens
gctagaacttttttaaataaa

SEQ ID NO: 4932143 - DNA, 21 bp, Homo sapiens
gctagaggccagccccaccca

SEQ ID NO: 4932144 - DNA, 20 bp, Homo sapiens
gctagagtcctcactcccag

SEQ ID NO: 4932145 - DNA, 21 bp, Homo sapiens
gctagcttttaggaaaatcac

SEQ ID NO: 4932146 - DNA, 20 bp, Homo sapiens
gctaggacccctccatgtgg

SEQ ID NO: 4932147 - DNA, 15 bp, Homo sapiens
gctaggcctggccag

SEQ ID NO: 4932148 - DNA, 15 bp, Homo sapiens
gctagggtggccctt

SEQ ID NO: 4932149 - DNA, 16 bp, Homo sapiens
gctagtatttgaatta

SEQ ID NO: 4932150 - DNA, 14 bp, Homo sapiens
gctagtgttctgtc

SEQ ID NO: 4932151 - DNA, 16 bp, Homo sapiens
gctagttgggcttcct

SEQ ID NO: 4932152 - DNA, 18 bp, Homo sapiens
gctatagctacaggaagc

SEQ ID NO: 4932153 - DNA, 11 bp, Homo sapiens
gctatatatat

SEQ ID NO: 4932154 - DNA, 20 bp, Homo sapiens
gctatctctgtgtgcacaaa

SEQ ID NO: 4932155 - DNA, 11 bp, Homo sapiens
gctatggacac

SEQ ID NO: 4932156 - DNA, 14 bp, Homo sapiens
gctatggacacagg

SEQ ID NO: 4932157 - DNA, 13 bp, Homo sapiens
gctatgggagccc

SEQ ID NO: 4932158 - DNA, 17 bp, Homo sapiens
gctatgggagccccagg

SEQ ID NO: 4932159 - DNA, 20 bp, Homo sapiens
gctattaaaactcagcctgg

SEQ ID NO: 4932160 - DNA, 12 bp, Homo sapiens
gctattacaaat

SEQ ID NO: 4932161 - DNA, 15 bp, Homo sapiens
gctattactgtctgg

SEQ ID NO: 4932162 - DNA, 17 bp, Homo sapiens
gctattagccaggatca

SEQ ID NO: 4932163 - DNA, 21 bp, Homo sapiens
gctattagccaggatcatggt

SEQ ID NO: 4932164 - DNA, 21 bp, Homo sapiens
gctattattttcactgtagaa

SEQ ID NO: 4932165 - DNA, 16 bp, Homo sapiens
gctattcctttccctt

SEQ ID NO: 4932166 - DNA, 21 bp, Homo sapiens
gctattcctttcccttcctct

SEQ ID NO: 4932167 - DNA, 16 bp, Homo sapiens
gctcaacaataaaaca

SEQ ID NO: 4932168 - DNA, 23 bp, Homo sapiens
gctcaagcagcgaccgccccctc

SEQ ID NO: 4932169 - DNA, 18 bp, Homo sapiens
gctcaagcgattctcctg

SEQ ID NO: 4932170 - DNA, 19 bp, Homo sapiens
gctcaagtcctcttttctg

SEQ ID NO: 4932171 - DNA, 22 bp, Homo sapiens
gctcaagtcctcttttctgaga

SEQ ID NO: 4932172 - DNA, 14 bp, Homo sapiens
gctcaatcctctaa

SEQ ID NO: 4932173 - DNA, 16 bp, Homo sapiens
gctcaatcctctaagc

SEQ ID NO: 4932174 - DNA, 15 bp, Homo sapiens
gctcacaccaaattt

SEQ ID NO: 4932175 - DNA, 14 bp, Homo sapiens
gctcaccagcccca

SEQ ID NO: 4932176 - DNA, 18 bp, Homo sapiens
gctcaccagccccagtgc

SEQ ID NO: 4932177 - DNA, 20 bp, Homo sapiens
gctcaccagccccagtgccc

SEQ ID NO: 4932178 - DNA, 16 bp, Homo sapiens
gctcactcggcaccct

SEQ ID NO: 4932179 - DNA, 14 bp, Homo sapiens
gctcactgcagcct

SEQ ID NO: 4932180 - DNA, 16 bp, Homo sapiens
gctcactgcagcctca

SEQ ID NO: 4932181 - DNA, 14 bp, Homo sapiens
gctcagaacccagg

SEQ ID NO: 4932182 - DNA, 18 bp, Homo sapiens
gctcagagatgtgcaccc

SEQ ID NO: 4932183 - DNA, 19 bp, Homo sapiens
gctcagagggggactgctg

SEQ ID NO: 4932184 - DNA, 20 bp, Homo sapiens
gctcagccccgagctgtccc

SEQ ID NO: 4932185 - DNA, 16 bp, Homo sapiens
gctgacagacacaggc

SEQ ID NO: 4932186 - DNA, 20 bp, Homo sapiens
gctgacagacacaggcccgg

SEQ ID NO: 4932187 - DNA, 20 bp, Homo sapiens
gctgaccaattgtgctgcca

SEQ ID NO: 4932188 - DNA, 18 bp, Homo sapiens
gctgacctcccagtgacc

SEQ ID NO: 4932189 - DNA, 15 bp, Homo sapiens
gctgacgtgtgaggg

SEQ ID NO: 4932190 - DNA, 23 bp, Homo sapiens
gctgactagaagggccagtcctg

SEQ ID NO: 4932191 - DNA, 16 bp, Homo sapiens
gctgactgtcctctcc

SEQ ID NO: 4932192 - DNA, 23 bp, Homo sapiens
gctgactgtcctctcccctccag

SEQ ID NO: 4932193 - DNA, 15 bp, Homo sapiens
gctgagaactcctga

SEQ ID NO: 4932194 - DNA, 17 bp, Homo sapiens
gctgagaactcctgact

SEQ ID NO: 4932195 - DNA, 14 bp, Homo sapiens
gctgagagactttt

SEQ ID NO: 4932196 - DNA, 19 bp, Homo sapiens
gctgagcctctgctcccca

SEQ ID NO: 4932197 - DNA, 14 bp, Homo sapiens
gctgaggaggcctc

SEQ ID NO: 4932198 - DNA, 15 bp, Homo sapiens
gctgaggcaggagga

SEQ ID NO: 4932199 - DNA, 23 bp, Homo sapiens
gctgaggctctgacccagtgaga

SEQ ID NO: 4932200 - DNA, 20 bp, Homo sapiens
gctgagtatggagcagcctg

SEQ ID NO: 4932201 - DNA, 19 bp, Homo sapiens
gctgatacataactaaatt

SEQ ID NO: 4932202 - DNA, 21 bp, Homo sapiens
gctgatgaacttattctgtag

SEQ ID NO: 4932203 - DNA, 17 bp, Homo sapiens
gctgatttggtgaccaa

SEQ ID NO: 4932204 - DNA, 14 bp, Homo sapiens
gctgattttaatgg

SEQ ID NO: 4932205 - DNA, 17 bp, Homo sapiens
gctgcaccagagcaacc

SEQ ID NO: 4932206 - DNA, 15 bp, Homo sapiens
gctgcagctgggctg

SEQ ID NO: 4932207 - DNA, 14 bp, Homo sapiens
gctgcagcttggga

SEQ ID NO: 4932208 - DNA, 15 bp, Homo sapiens
gctgcaggaatcaaa

SEQ ID NO: 4932209 - DNA, 17 bp, Homo sapiens
gctgcaggacttgagaa

SEQ ID NO: 4932210 - DNA, 13 bp, Homo sapiens
gctgcaggggctc

SEQ ID NO: 4932211 - DNA, 17 bp, Homo sapiens
gctgcaggggctctgga

SEQ ID NO: 4932212 - DNA, 22 bp, Homo sapiens
gctgcaggggctctggagagaa

SEQ ID NO: 4932213 - DNA, 13 bp, Homo sapiens
gctgcatcttata

SEQ ID NO: 4932214 - DNA, 17 bp, Homo sapiens
gctgcatcttatagcac

SEQ ID NO: 4932215 - DNA, 22 bp, Homo sapiens
gctgcatcttatagcactttga

SEQ ID NO: 4932216 - DNA, 20 bp, Homo sapiens
gctgcatgcctggtctttcc

SEQ ID NO: 4932217 - DNA, 22 bp, Homo sapiens
gctgcatggggtggggtagggc

SEQ ID NO: 4932218 - DNA, 16 bp, Homo sapiens
gctgccaaggccagag

SEQ ID NO: 4932219 - DNA, 23 bp, Homo sapiens
gctgccacaccagtcacatgacc

SEQ ID NO: 4932220 - DNA, 15 bp, Homo sapiens
gctgccacacttcag

SEQ ID NO: 4932221 - DNA, 18 bp, Homo sapiens
gctgccacacttcaggct

SEQ ID NO: 4932222 - DNA, 13 bp, Homo sapiens
gctgccatccagg

SEQ ID NO: 4932223 - DNA, 17 bp, Homo sapiens
gctgcccaatctccatc

SEQ ID NO: 4932224 - DNA, 14 bp, Homo sapiens
gctgccccaacctg

SEQ ID NO: 4932225 - DNA, 19 bp, Homo sapiens
gctgcccccggccccctgg

SEQ ID NO: 4932226 - DNA, 14 bp, Homo sapiens
gctgcccctctcac

SEQ ID NO: 4932227 - DNA, 16 bp, Homo sapiens
gctgccctccttgtcc

SEQ ID NO: 4932228 - DNA, 20 bp, Homo sapiens
gctgccctccttgtccaccc

SEQ ID NO: 4932229 - DNA, 16 bp, Homo sapiens
gctgccctgagaagct

SEQ ID NO: 4932230 - DNA, 15 bp, Homo sapiens
gctgccctggtgctg

SEQ ID NO: 4932231 - DNA, 17 bp, Homo sapiens
gctgccctggtgctgcc

SEQ ID NO: 4932232 - DNA, 23 bp, Homo sapiens
gctgccctggtgctgccacactt

SEQ ID NO: 4932233 - DNA, 13 bp, Homo sapiens
gctgcccttgggc

SEQ ID NO: 4932234 - DNA, 15 bp, Homo sapiens
gctgccgcctcccag

SEQ ID NO: 4932235 - DNA, 19 bp, Homo sapiens
gctgccgcctcccagcctg

SEQ ID NO: 4932236 - DNA, 18 bp, Homo sapiens
gctgccgtgccgcctgca

SEQ ID NO: 4932237 - DNA, 17 bp, Homo sapiens
gctgcctagcaagctgg

SEQ ID NO: 4932238 - DNA, 12 bp, Homo sapiens
gctgcctcactt

SEQ ID NO: 4932239 - DNA, 13 bp, Homo sapiens
gctgcctgaatcc

SEQ ID NO: 4932240 - DNA, 22 bp, Homo sapiens
gctgcctgcccgcacagcagcc

SEQ ID NO: 4932241 - DNA, 15 bp, Homo sapiens
gctgcctgtagttag

SEQ ID NO: 4932242 - DNA, 20 bp, Homo sapiens
gctgcctgtagttaggaaat

SEQ ID NO: 4932243 - DNA, 12 bp, Homo sapiens
gctgcctgttca

SEQ ID NO: 4932244 - DNA, 19 bp, Homo sapiens
gctgcctgttcagctccag

SEQ ID NO: 4932245 - DNA, 21 bp, Homo sapiens
gctgccttcccatgaatctgt

SEQ ID NO: 4932246 - DNA, 19 bp, Homo sapiens
gctgccttctgacggccct

SEQ ID NO: 4932247 - DNA, 20 bp, Homo sapiens
gctgccttctgacggccctg

SEQ ID NO: 4932248 - DNA, 14 bp, Homo sapiens
gctgccttggctca

SEQ ID NO: 4932249 - DNA, 15 bp, Homo sapiens
gctgcggtccaccca

SEQ ID NO: 4932250 - DNA, 17 bp, Homo sapiens
gctgcggtccacccagg

SEQ ID NO: 4932251 - DNA, 22 bp, Homo sapiens
gctgcggtccacccaggagccc

SEQ ID NO: 4932252 - DNA, 12 bp, Homo sapiens
gctgctacccag

SEQ ID NO: 4932253 - DNA, 13 bp, Homo sapiens
gctgctagaactt

SEQ ID NO: 4932254 - DNA, 19 bp, Homo sapiens
gctgctagaacttttttaa

SEQ ID NO: 4932255 - DNA, 15 bp, Homo sapiens
gctgctccaggcctg

SEQ ID NO: 4932256 - DNA, 14 bp, Homo sapiens
gctgctccttggct

SEQ ID NO: 4932257 - DNA, 12 bp, Homo sapiens
gctgctgacagt

SEQ ID NO: 4932258 - DNA, 22 bp, Homo sapiens
gctgctgaccaattgtgctgcc

SEQ ID NO: 4932259 - DNA, 18 bp, Homo sapiens
gctgctgcctggccactg

SEQ ID NO: 4932260 - DNA, 12 bp, Homo sapiens
gctgctgctgct

SEQ ID NO: 4932261 - DNA, 15 bp, Homo sapiens
gctgctggcttgcag

SEQ ID NO: 4932262 - DNA, 18 bp, Homo sapiens
gctgctggggcctcagac

SEQ ID NO: 4932263 - DNA, 16 bp, Homo sapiens
gctgctgtccctcccc

SEQ ID NO: 4932264 - DNA, 23 bp, Homo sapiens
gctgctgtccctcccccttgtcc

SEQ ID NO: 4932265 - DNA, 18 bp, Homo sapiens
gctgcttagacataacaa

SEQ ID NO: 4932266 - DNA, 23 bp, Homo sapiens
gctgcttccggtagggaggcagc

SEQ ID NO: 4932267 - DNA, 13 bp, Homo sapiens
gctggaagggtca

SEQ ID NO: 4932268 - DNA, 13 bp, Homo sapiens
gctggacagaggg

SEQ ID NO: 4932269 - DNA, 21 bp, Homo sapiens
gctggacagaggggactctgg

SEQ ID NO: 4932270 - DNA, 19 bp, Homo sapiens
gctggacggggactgggga

SEQ ID NO: 4932271 - DNA, 18 bp, Homo sapiens
gctggacgtctttctttt

SEQ ID NO: 4932272 - DNA, 13 bp, Homo sapiens
gctggactctgca

SEQ ID NO: 4932273 - DNA, 18 bp, Homo sapiens
gctggagaagagaggaga

SEQ ID NO: 4932274 - DNA, 23 bp, Homo sapiens
gctggagcctgagtcagggccca

SEQ ID NO: 4932275 - DNA, 15 bp, Homo sapiens
gctggaggtgggagc

SEQ ID NO: 4932276 - DNA, 16 bp, Homo sapiens
gctggaggtgggagca

SEQ ID NO: 4932277 - DNA, 22 bp, Homo sapiens
gctggaggtgggagcaggagat

SEQ ID NO: 4932278 - DNA, 22 bp, Homo sapiens
gctggaggtggggcgaggcagg

SEQ ID NO: 4932279 - DNA, 12 bp, Homo sapiens
gctggagtgcag

SEQ ID NO: 4932280 - DNA, 14 bp, Homo sapiens
gctggagtgcagtg

SEQ ID NO: 4932281 - DNA, 17 bp, Homo sapiens
gctggagtgcagtgagc

SEQ ID NO: 4932282 - DNA, 22 bp, Homo sapiens
gctggagtgcagtgagccgaga

SEQ ID NO: 4932283 - DNA, 14 bp, Homo sapiens
gctggatggagccc

SEQ ID NO: 4932284 - DNA, 12 bp, Homo sapiens
gctggccagcct

SEQ ID NO: 4932285 - DNA, 14 bp, Homo sapiens
gctggccagcctgg

SEQ ID NO: 4932286 - DNA, 15 bp, Homo sapiens
gctggccagcctggg

SEQ ID NO: 4932287 - DNA, 20 bp, Homo sapiens
gctggccgagggtcctggct

SEQ ID NO: 4932288 - DNA, 24 bp, Homo sapiens
gctggccgagggtcctggctcctg

SEQ ID NO: 4932289 - DNA, 19 bp, Homo sapiens
gctggcctctctagcacaa

SEQ ID NO: 4932290 - DNA, 18 bp, Homo sapiens
gctggcctctggctctca

SEQ ID NO: 4932291 - DNA, 15 bp, Homo sapiens
gctggcgtgcagtgg

SEQ ID NO: 4932292 - DNA, 18 bp, Homo sapiens
gctggcgtgcagtggtgc

SEQ ID NO: 4932293 - DNA, 16 bp, Homo sapiens
gctggctcacagtaca

SEQ ID NO: 4932294 - DNA, 23 bp, Homo sapiens
gctggctcacagtacagcatgtg

SEQ ID NO: 4932295 - DNA, 18 bp, Homo sapiens
gctggctcttctgcccaa

SEQ ID NO: 4932296 - DNA, 11 bp, Homo sapiens
gctggctgcct

SEQ ID NO: 4932297 - DNA, 15 bp, Homo sapiens
gctggctgttggctg

SEQ ID NO: 4932298 - DNA, 16 bp, Homo sapiens
gctggctgttggctgg

SEQ ID NO: 4932299 - DNA, 18 bp, Homo sapiens
gctgggactacaggcacc

SEQ ID NO: 4932300 - DNA, 19 bp, Homo sapiens
gctgggactacaggcaccc

SEQ ID NO: 4932301 - DNA, 19 bp, Homo sapiens
gctgggactacaggtgtga

SEQ ID NO: 4932302 - DNA, 15 bp, Homo sapiens
gctgggagctctgca

SEQ ID NO: 4932303 - DNA, 14 bp, Homo sapiens
gctgggaggcatgg

SEQ ID NO: 4932304 - DNA, 15 bp, Homo sapiens
gctgggaggcatggc

SEQ ID NO: 4932305 - DNA, 13 bp, Homo sapiens
gctgggctctgca

SEQ ID NO: 4932306 - DNA, 18 bp, Homo sapiens
gctgggcttcagtggcag

SEQ ID NO: 4932307 - DNA, 19 bp, Homo sapiens
gctgggcttcagtggcagc

SEQ ID NO: 4932308 - DNA, 21 bp, Homo sapiens
gctgggcttcagtggcagctg

SEQ ID NO: 4932309 - DNA, 23 bp, Homo sapiens
gctggggacctggtaccctcctg

SEQ ID NO: 4932310 - DNA, 13 bp, Homo sapiens
gctggggaggagc

SEQ ID NO: 4932311 - DNA, 17 bp, Homo sapiens
gctggggcctcagacga

SEQ ID NO: 4932312 - DNA, 20 bp, Homo sapiens
gctgggggaatgagcccaga

SEQ ID NO: 4932313 - DNA, 13 bp, Homo sapiens
gctgggggcagga

SEQ ID NO: 4932314 - DNA, 20 bp, Homo sapiens
gctgggggcaggagggccct

SEQ ID NO: 4932315 - DNA, 13 bp, Homo sapiens
gctgggggcctca

SEQ ID NO: 4932316 - DNA, 14 bp, Homo sapiens
gctgggggcctcag

SEQ ID NO: 4932317 - DNA, 20 bp, Homo sapiens
gctgggggcctcagtgccac

SEQ ID NO: 4932318 - DNA, 23 bp, Homo sapiens
gctgggtattggaaatggatgca

SEQ ID NO: 4932319 - DNA, 21 bp, Homo sapiens
gctgggttggagggtgtccca

SEQ ID NO: 4932320 - DNA, 18 bp, Homo sapiens
gctggtcacagcctcctc

SEQ ID NO: 4932321 - DNA, 20 bp, Homo sapiens
gctggtcccactcagtccat

SEQ ID NO: 4932322 - DNA, 14 bp, Homo sapiens
gctggtgggagggg

SEQ ID NO: 4932323 - DNA, 16 bp, Homo sapiens
gctggtgtcacctgaa

SEQ ID NO: 4932324 - DNA, 14 bp, Homo sapiens
gctggttagaaatg

SEQ ID NO: 4932325 - DNA, 16 bp, Homo sapiens
gctgtaacttaaaata

SEQ ID NO: 4932326 - DNA, 16 bp, Homo sapiens
gctgtaaggctctaga

SEQ ID NO: 4932327 - DNA, 23 bp, Homo sapiens
gctgtaaggctctagatcataag

SEQ ID NO: 4932328 - DNA, 20 bp, Homo sapiens
gctgtacatctattttggat

SEQ ID NO: 4932329 - DNA, 20 bp, Homo sapiens
gctgtacttcgtcttctaat

SEQ ID NO: 4932330 - DNA, 13 bp, Homo sapiens
gctgtcacaggcg

SEQ ID NO: 4932331 - DNA, 12 bp, Homo sapiens
gctgtctctgct

SEQ ID NO: 4932332 - DNA, 13 bp, Homo sapiens
gctgtctctgctc

SEQ ID NO: 4932333 - DNA, 15 bp, Homo sapiens
gctgtctgtggcttc

SEQ ID NO: 4932334 - DNA, 24 bp, Homo sapiens
gctgtcttctggacaggctctgct

SEQ ID NO: 4932335 - DNA, 14 bp, Homo sapiens
gctgtgagccttgg

SEQ ID NO: 4932336 - DNA, 22 bp, Homo sapiens
gctgtgatttttgttgattaaa

SEQ ID NO: 4932337 - DNA, 18 bp, Homo sapiens
gctgtgcagcgcagctgg

SEQ ID NO: 4932338 - DNA, 12 bp, Homo sapiens
gctgtgcctctg

SEQ ID NO: 4932339 - DNA, 16 bp, Homo sapiens
gctgtgctctggacag

SEQ ID NO: 4932340 - DNA, 15 bp, Homo sapiens
gctgtggaagcaaca

SEQ ID NO: 4932341 - DNA, 23 bp, Homo sapiens
gctgtggtttccatctgaaagta

SEQ ID NO: 4932342 - DNA, 13 bp, Homo sapiens
gctgttaaactgt

SEQ ID NO: 4932343 - DNA, 15 bp, Homo sapiens
gctgttaaactgtta

SEQ ID NO: 4932344 - DNA, 15 bp, Homo sapiens
gctgttaccattcac

SEQ ID NO: 4932345 - DNA, 17 bp, Homo sapiens
gctgttaccgcctgtct

SEQ ID NO: 4932346 - DNA, 19 bp, Homo sapiens
gctgttatgtctgtttaag

SEQ ID NO: 4932347 - DNA, 20 bp, Homo sapiens
gctgttatgtctgtttaaga

SEQ ID NO: 4932348 - DNA, 13 bp, Homo sapiens
gctgttctgcact

SEQ ID NO: 4932349 - DNA, 14 bp, Homo sapiens
gctgttctgcactg

SEQ ID NO: 4932350 - DNA, 15 bp, Homo sapiens
gctgttctgcactga

SEQ ID NO: 4932351 - DNA, 13 bp, Homo sapiens
gctgttggctggg

SEQ ID NO: 4932352 - DNA, 15 bp, Homo sapiens
gctgtttatggcctc

SEQ ID NO: 4932353 - DNA, 23 bp, Homo sapiens
gctgtttatggcctcagctgcct

SEQ ID NO: 4932354 - DNA, 18 bp, Homo sapiens
gctgtttgtagtgaaata

SEQ ID NO: 4932355 - DNA, 19 bp, Homo sapiens
gcttaaaataaacagttgt

SEQ ID NO: 4932356 - DNA, 11 bp, Homo sapiens
gcttaagttcc

SEQ ID NO: 4932357 - DNA, 12 bp, Homo sapiens
gcttacctgaca

SEQ ID NO: 4932358 - DNA, 14 bp, Homo sapiens
gcttagtatctcat

SEQ ID NO: 4932359 - DNA, 17 bp, Homo sapiens
gcttataataaaggact

SEQ ID NO: 4932360 - DNA, 18 bp, Homo sapiens
gcttattgcttagtaaaa

SEQ ID NO: 4932361 - DNA, 16 bp, Homo sapiens
gcttatttaataaaga

SEQ ID NO: 4932362 - DNA, 16 bp, Homo sapiens
gcttatttattaacag

SEQ ID NO: 4932363 - DNA, 19 bp, Homo sapiens
gcttatttattaacaggat

SEQ ID NO: 4932364 - DNA, 13 bp, Homo sapiens
gcttattttaatg

SEQ ID NO: 4932365 - DNA, 21 bp, Homo sapiens
gcttattttaatgtgatgatg

SEQ ID NO: 4932366 - DNA, 16 bp, Homo sapiens
gcttcaataaatcttt

SEQ ID NO: 4932367 - DNA, 15 bp, Homo sapiens
gcttcaattaataaa

SEQ ID NO: 4932368 - DNA, 17 bp, Homo sapiens
gcttcacagtagagcca

SEQ ID NO: 4932369 - DNA, 16 bp, Homo sapiens
gcttcactgtataaat

SEQ ID NO: 4932370 - DNA, 14 bp, Homo sapiens
gcttcataaatgaa

SEQ ID NO: 4932371 - DNA, 22 bp, Homo sapiens
gcttcataaatgaagcagcttt

SEQ ID NO: 4932372 - DNA, 16 bp, Homo sapiens
gcttcatttcctgtgt

SEQ ID NO: 4932373 - DNA, 15 bp, Homo sapiens
gcttccaaatattgt

SEQ ID NO: 4932374 - DNA, 18 bp, Homo sapiens
gcttccatgattctattt

SEQ ID NO: 4932375 - DNA, 23 bp, Homo sapiens
gcttcccacctccctgcccaggc

SEQ ID NO: 4932376 - DNA, 14 bp, Homo sapiens
gcttcccccatagc

SEQ ID NO: 4932377 - DNA, 15 bp, Homo sapiens
gcttcccccatagcc

SEQ ID NO: 4932378 - DNA, 15 bp, Homo sapiens
gcttcccgctcagcc

SEQ ID NO: 4932379 - DNA, 17 bp, Homo sapiens
gcttcccgctcagccct

SEQ ID NO: 4932380 - DNA, 20 bp, Homo sapiens
gcttccggtagggaggcagc

SEQ ID NO: 4932381 - DNA, 16 bp, Homo sapiens
gcttcgacttttctta

SEQ ID NO: 4932382 - DNA, 12 bp, Homo sapiens
gcttctcatccc

SEQ ID NO: 4932383 - DNA, 18 bp, Homo sapiens
gcttctcatcttgtgaaa

SEQ ID NO: 4932384 - DNA, 13 bp, Homo sapiens
gcttctccccaga

SEQ ID NO: 4932385 - DNA, 17 bp, Homo sapiens
gcttctgaatgtgctga

SEQ ID NO: 4932386 - DNA, 20 bp, Homo sapiens
gcttctggaatttgttcaag

SEQ ID NO: 4932387 - DNA, 16 bp, Homo sapiens
gcttctgtgatgagct

SEQ ID NO: 4932388 - DNA, 20 bp, Homo sapiens
gcttctgtgatgagctgatc

SEQ ID NO: 4932389 - DNA, 21 bp, Homo sapiens
gcttcttcctatttgccatgg

SEQ ID NO: 4932390 - DNA, 23 bp, Homo sapiens
gcttgactcaggatttaaaaact

SEQ ID NO: 4932391 - DNA, 14 bp, Homo sapiens
gcttgagcccagga

SEQ ID NO: 4932392 - DNA, 15 bp, Homo sapiens
gcttgagcccaggag

SEQ ID NO: 4932393 - DNA, 16 bp, Homo sapiens
gcttgagggttgggct

SEQ ID NO: 4932394 - DNA, 14 bp, Homo sapiens
gcttgatgaagcaa

SEQ ID NO: 4932395 - DNA, 20 bp, Homo sapiens
gcttgatgaagcaaggaaga

SEQ ID NO: 4932396 - DNA, 14 bp, Homo sapiens
gcttgattctgcag

SEQ ID NO: 4932397 - DNA, 15 bp, Homo sapiens
gcttggccctttcct

SEQ ID NO: 4932398 - DNA, 15 bp, Homo sapiens
gcttggctccatgct

SEQ ID NO: 4932399 - DNA, 17 bp, Homo sapiens
gcttgtaaatagctcag

SEQ ID NO: 4932400 - DNA, 13 bp, Homo sapiens
gcttgtaggagct

SEQ ID NO: 4932401 - DNA, 17 bp, Homo sapiens
gcttgtatcaacactgt

SEQ ID NO: 4932402 - DNA, 19 bp, Homo sapiens
gcttgtggggacccaggct

SEQ ID NO: 4932403 - DNA, 20 bp, Homo sapiens
gcttgttttataaaattttg

SEQ ID NO: 4932404 - DNA, 23 bp, Homo sapiens
gcttgttttataaaattttgctt

SEQ ID NO: 4932405 - DNA, 17 bp, Homo sapiens
gctttaaacaaattcat

SEQ ID NO: 4932406 - DNA, 18 bp, Homo sapiens
ggacacaaaactccgccc

SEQ ID NO: 4932407 - DNA, 21 bp, Homo sapiens
ggacacacaaggtgcaaatca

SEQ ID NO: 4932408 - DNA, 18 bp, Homo sapiens
ggacacagctcttctcca

SEQ ID NO: 4932409 - DNA, 21 bp, Homo sapiens
ggacacagctcttctccaggc

SEQ ID NO: 4932410 - DNA, 17 bp, Homo sapiens
ggacaccacacccagcc

SEQ ID NO: 4932411 - DNA, 19 bp, Homo sapiens
ggacaccacacccagcctc

SEQ ID NO: 4932412 - DNA, 14 bp, Homo sapiens
ggacactcctagag

SEQ ID NO: 4932413 - DNA, 14 bp, Homo sapiens
ggacagagccatgc

SEQ ID NO: 4932414 - DNA, 15 bp, Homo sapiens
ggacagaggcctgcc

SEQ ID NO: 4932415 - DNA, 12 bp, Homo sapiens
ggacagagggga

SEQ ID NO: 4932416 - DNA, 13 bp, Homo sapiens
ggacagaggggac

SEQ ID NO: 4932417 - DNA, 20 bp, Homo sapiens
ggacagaggggactctgggc

SEQ ID NO: 4932418 - DNA, 16 bp, Homo sapiens
ggacagagtatgaaca

SEQ ID NO: 4932419 - DNA, 20 bp, Homo sapiens
ggacaggatgacctggataa

SEQ ID NO: 4932420 - DNA, 17 bp, Homo sapiens
ggacagggaggtgaccc

SEQ ID NO: 4932421 - DNA, 15 bp, Homo sapiens
ggacagggcatggcc

SEQ ID NO: 4932422 - DNA, 21 bp, Homo sapiens
ggacagtttatcatgaagcct

SEQ ID NO: 4932423 - DNA, 19 bp, Homo sapiens
ggaccactgtttcttgctt

SEQ ID NO: 4932424 - DNA, 20 bp, Homo sapiens
ggaccagtggtttccagtca

SEQ ID NO: 4932425 - DNA, 16 bp, Homo sapiens
ggaccatgtgtcactt

SEQ ID NO: 4932426 - DNA, 22 bp, Homo sapiens
ggaccatgtgtcacttgtgctt

SEQ ID NO: 4932427 - DNA, 17 bp, Homo sapiens
ggacccagcgggcaggt

SEQ ID NO: 4932428 - DNA, 19 bp, Homo sapiens
ggacccatagatcttctga

SEQ ID NO: 4932429 - DNA, 21 bp, Homo sapiens
ggaccccagagattcccaagc

SEQ ID NO: 4932430 - DNA, 21 bp, Homo sapiens
ggaccccagctgtgagccttg

SEQ ID NO: 4932431 - DNA, 23 bp, Homo sapiens
ggacccgaccccccgtgggctcc

SEQ ID NO: 4932432 - DNA, 11 bp, Homo sapiens
ggacctccctt

SEQ ID NO: 4932433 - DNA, 18 bp, Homo sapiens
ggacctgtatttaagcaa

SEQ ID NO: 4932434 - DNA, 20 bp, Homo sapiens
ggacctgtatttaagcaaat

SEQ ID NO: 4932435 - DNA, 17 bp, Homo sapiens
ggaccttgaactgggta

SEQ ID NO: 4932436 - DNA, 21 bp, Homo sapiens
ggacgagatgggaaggcacag

SEQ ID NO: 4932437 - DNA, 17 bp, Homo sapiens
ggacggggaagccgagc

SEQ ID NO: 4932438 - DNA, 16 bp, Homo sapiens
ggactaagcctacctg

SEQ ID NO: 4932439 - DNA, 16 bp, Homo sapiens
ggactcaatgcactga

SEQ ID NO: 4932440 - DNA, 14 bp, Homo sapiens
ggactcagccctga

SEQ ID NO: 4932441 - DNA, 20 bp, Homo sapiens
ggactcagggccatgcctgc

SEQ ID NO: 4932442 - DNA, 17 bp, Homo sapiens
ggactcctcctttctcc

SEQ ID NO: 4932443 - DNA, 12 bp, Homo sapiens
ggactcctctgt

SEQ ID NO: 4932444 - DNA, 15 bp, Homo sapiens
ggactcctctgtcca

SEQ ID NO: 4932445 - DNA, 19 bp, Homo sapiens
ggactctgaagcctctggg

SEQ ID NO: 4932446 - DNA, 15 bp, Homo sapiens
ggactctgagcggga

SEQ ID NO: 4932447 - DNA, 13 bp, Homo sapiens
ggactctgcacat

SEQ ID NO: 4932448 - DNA, 21 bp, Homo sapiens
ggactctgcatcccagcacct

SEQ ID NO: 4932449 - DNA, 17 bp, Homo sapiens
ggactctggtgcctcca

SEQ ID NO: 4932450 - DNA, 14 bp, Homo sapiens
ggactgcctctgcc

SEQ ID NO: 4932451 - DNA, 22 bp, Homo sapiens
ggactgcctctgccacactctg

SEQ ID NO: 4932452 - DNA, 17 bp, Homo sapiens
ggactgctgctgcctgg

SEQ ID NO: 4932453 - DNA, 20 bp, Homo sapiens
ggactggctagagtcctcac

SEQ ID NO: 4932454 - DNA, 17 bp, Homo sapiens
ggactggggatgtggga

SEQ ID NO: 4932455 - DNA, 23 bp, Homo sapiens
ggactggggatgtgggagggagc

SEQ ID NO: 4932456 - DNA, 15 bp, Homo sapiens
ggactgggggccaga

SEQ ID NO: 4932457 - DNA, 14 bp, Homo sapiens
ggactggtttgaga

SEQ ID NO: 4932458 - DNA, 20 bp, Homo sapiens
ggacttagaaagcaggggct

SEQ ID NO: 4932459 - DNA, 14 bp, Homo sapiens
ggacttggaagctc

SEQ ID NO: 4932460 - DNA, 15 bp, Homo sapiens
ggacttggaagctcc

SEQ ID NO: 4932461 - DNA, 16 bp, Homo sapiens
ggacttgtgtctctgt

SEQ ID NO: 4932462 - DNA, 15 bp, Homo sapiens
ggagaaaaggaaaag

SEQ ID NO: 4932463 - DNA, 11 bp, Homo sapiens
ggagaacaaat

SEQ ID NO: 4932464 - DNA, 23 bp, Homo sapiens
ggagaacatctttgacactctgc

SEQ ID NO: 4932465 - DNA, 20 bp, Homo sapiens
ggagaagagttgaggaactg

SEQ ID NO: 4932466 - DNA, 21 bp, Homo sapiens
ggagaagggatggaggtcaca

SEQ ID NO: 4932467 - DNA, 20 bp, Homo sapiens
ggagacactggcccctcaaa

SEQ ID NO: 4932468 - DNA, 17 bp, Homo sapiens
ggagacagccccagagc

SEQ ID NO: 4932469 - DNA, 20 bp, Homo sapiens
ggagacagccccagagcagg

SEQ ID NO: 4932470 - DNA, 21 bp, Homo sapiens
ggagacagccccagagcaggg

SEQ ID NO: 4932471 - DNA, 17 bp, Homo sapiens
ggagaccaaggcgggag

SEQ ID NO: 4932472 - DNA, 19 bp, Homo sapiens
ggagacccaccccacctgc

SEQ ID NO: 4932473 - DNA, 21 bp, Homo sapiens
ggagaccctgcaaacagaaca

SEQ ID NO: 4932474 - DNA, 22 bp, Homo sapiens
ggagaccctgcaaacagaacag

SEQ ID NO: 4932475 - DNA, 20 bp, Homo sapiens
ggagaccggggtatcctggg

SEQ ID NO: 4932476 - DNA, 14 bp, Homo sapiens
ggagactagattgc

SEQ ID NO: 4932477 - DNA, 22 bp, Homo sapiens
ggagacttgccagagccgggca

SEQ ID NO: 4932478 - DNA, 24 bp, Homo sapiens
ggagagaaagtgggtgagatgctg

SEQ ID NO: 4932479 - DNA, 19 bp, Homo sapiens
ggagagactcccatgaagc

SEQ ID NO: 4932480 - DNA, 10 bp, Homo sapiens
ggagagagaa

SEQ ID NO: 4932481 - DNA, 14 bp, Homo sapiens
ggagagagaaagcc

SEQ ID NO: 4932482 - DNA, 20 bp, Homo sapiens
ggagagagaaagccaggcag

SEQ ID NO: 4932483 - DNA, 15 bp, Homo sapiens
ggagagctggtgccc

SEQ ID NO: 4932484 - DNA, 17 bp, Homo sapiens
ggagagctggtgcccgg

SEQ ID NO: 4932485 - DNA, 17 bp, Homo sapiens
ggagaggaactccttgg

SEQ ID NO: 4932486 - DNA, 15 bp, Homo sapiens
ggagaggagagaggc

SEQ ID NO: 4932487 - DNA, 18 bp, Homo sapiens
ggagatactggtggaagt

SEQ ID NO: 4932488 - DNA, 14 bp, Homo sapiens
ggagattgagaagg

SEQ ID NO: 4932489 - DNA, 16 bp, Homo sapiens
ggagattgagaaggag

SEQ ID NO: 4932490 - DNA, 20 bp, Homo sapiens
ggagattgagaaggagagaa

SEQ ID NO: 4932491 - DNA, 21 bp, Homo sapiens
ggagattgagaaggagagaaa

SEQ ID NO: 4932492 - DNA, 14 bp, Homo sapiens
ggagcacaggtccc

SEQ ID NO: 4932493 - DNA, 23 bp, Homo sapiens
ggagcaggcggtggggagagatg

SEQ ID NO: 4932494 - DNA, 19 bp, Homo sapiens
ggagcagggaaggcctgac

SEQ ID NO: 4932495 - DNA, 17 bp, Homo sapiens
ggagcagtccatgcatg

SEQ ID NO: 4932496 - DNA, 18 bp, Homo sapiens
ggagcagtccatgcatga

SEQ ID NO: 4932497 - DNA, 13 bp, Homo sapiens
ggagccagacaga

SEQ ID NO: 4932498 - DNA, 22 bp, Homo sapiens
ggagcccaggcgggagcggtgg

SEQ ID NO: 4932499 - DNA, 18 bp, Homo sapiens
ggagccccagctaccctt

SEQ ID NO: 4932500 - DNA, 22 bp, Homo sapiens
ggagccccaggcctctgtgtcc

SEQ ID NO: 4932501 - DNA, 13 bp, Homo sapiens
ggagccccagggt

SEQ ID NO: 4932502 - DNA, 13 bp, Homo sapiens
ggagccctcatct

SEQ ID NO: 4932503 - DNA, 21 bp, Homo sapiens
ggagcctaggaccactcagcc

SEQ ID NO: 4932504 - DNA, 22 bp, Homo sapiens
ggagcctgagtcagggcccaga

SEQ ID NO: 4932505 - DNA, 13 bp, Homo sapiens
ggagcctgctggt

SEQ ID NO: 4932506 - DNA, 22 bp, Homo sapiens
ggagcctgctggtcacagcctc

SEQ ID NO: 4932507 - DNA, 16 bp, Homo sapiens
ggagcctggcacagga

SEQ ID NO: 4932508 - DNA, 20 bp, Homo sapiens
ggagcctggcacaggactga

SEQ ID NO: 4932509 - DNA, 20 bp, Homo sapiens
ggagcctttggttctggcca

SEQ ID NO: 4932510 - DNA, 15 bp, Homo sapiens
ggagcggtggccctg

SEQ ID NO: 4932511 - DNA, 15 bp, Homo sapiens
ggagctatcaggaac

SEQ ID NO: 4932512 - DNA, 12 bp, Homo sapiens
ggagctcagccc

SEQ ID NO: 4932513 - DNA, 21 bp, Homo sapiens
ggagctcctctcctggaggat

SEQ ID NO: 4932514 - DNA, 22 bp, Homo sapiens
ggagctgcctgttcagctccag

SEQ ID NO: 4932515 - DNA, 17 bp, Homo sapiens
ggcagacagcaggcagc

SEQ ID NO: 4932516 - DNA, 11 bp, Homo sapiens
ggcagagagag

SEQ ID NO: 4932517 - DNA, 12 bp, Homo sapiens
ggcagagagaga

SEQ ID NO: 4932518 - DNA, 14 bp, Homo sapiens
ggcagagagagaga

SEQ ID NO: 4932519 - DNA, 20 bp, Homo sapiens
ggcagataatcagcctctta

SEQ ID NO: 4932520 - DNA, 15 bp, Homo sapiens
ggcagcaatttaaat

SEQ ID NO: 4932521 - DNA, 16 bp, Homo sapiens
ggcagcaatttaaatg

SEQ ID NO: 4932522 - DNA, 19 bp, Homo sapiens
ggcagcatagcaagacaca

SEQ ID NO: 4932523 - DNA, 20 bp, Homo sapiens
ggcagccaaacccatgaggc

SEQ ID NO: 4932524 - DNA, 15 bp, Homo sapiens
ggcagcccagagact

SEQ ID NO: 4932525 - DNA, 21 bp, Homo sapiens
ggcagccccattctgcctgcc

SEQ ID NO: 4932526 - DNA, 23 bp, Homo sapiens
ggcagccccattctgcctgccca

SEQ ID NO: 4932527 - DNA, 18 bp, Homo sapiens
ggcagccgtgccttcagc

SEQ ID NO: 4932528 - DNA, 22 bp, Homo sapiens
ggcagcgccaagtgcgtgccgt

SEQ ID NO: 4932529 - DNA, 21 bp, Homo sapiens
ggcagctgcggtccacccagg

SEQ ID NO: 4932530 - DNA, 16 bp, Homo sapiens
ggcaggaaggagagcc

SEQ ID NO: 4932531 - DNA, 13 bp, Homo sapiens
ggcaggccctgca

SEQ ID NO: 4932532 - DNA, 16 bp, Homo sapiens
ggcaggccctgcagtg

SEQ ID NO: 4932533 - DNA, 15 bp, Homo sapiens
ggcagggaggtcagg

SEQ ID NO: 4932534 - DNA, 19 bp, Homo sapiens
ggcagggaggtcaggccct

SEQ ID NO: 4932535 - DNA, 21 bp, Homo sapiens
ggcagggctggccccagggca

SEQ ID NO: 4932536 - DNA, 20 bp, Homo sapiens
ggcagggtctcactctgtcg

SEQ ID NO: 4932537 - DNA, 20 bp, Homo sapiens
ggcaggtagccagggggact

SEQ ID NO: 4932538 - DNA, 14 bp, Homo sapiens
ggcagtctctctct

SEQ ID NO: 4932539 - DNA, 24 bp, Homo sapiens
ggcagtgctagtgagctgggcatg

SEQ ID NO: 4932540 - DNA, 12 bp, Homo sapiens
ggcagtggaggt

SEQ ID NO: 4932541 - DNA, 14 bp, Homo sapiens
ggcagtgggagctg

SEQ ID NO: 4932542 - DNA, 16 bp, Homo sapiens
ggcagtgggagctgcc

SEQ ID NO: 4932543 - DNA, 22 bp, Homo sapiens
ggcatatccaccacctccctca

SEQ ID NO: 4932544 - DNA, 19 bp, Homo sapiens
ggcatctttgccttgggct

SEQ ID NO: 4932545 - DNA, 20 bp, Homo sapiens
ggcatgaagagcaaaaatat

SEQ ID NO: 4932546 - DNA, 18 bp, Homo sapiens
ggcatgccccggccacct

SEQ ID NO: 4932547 - DNA, 23 bp, Homo sapiens
ggcatgcctctgatatgggactg

SEQ ID NO: 4932548 - DNA, 17 bp, Homo sapiens
ggcatgcggtcgggcag

SEQ ID NO: 4932549 - DNA, 17 bp, Homo sapiens
ggcatggccaggtggcc

SEQ ID NO: 4932550 - DNA, 13 bp, Homo sapiens
ggcatggccctgg

SEQ ID NO: 4932551 - DNA, 16 bp, Homo sapiens
ggcatggccctggggt

SEQ ID NO: 4932552 - DNA, 17 bp, Homo sapiens
ggcatggccctggggtc

SEQ ID NO: 4932553 - DNA, 21 bp, Homo sapiens
ggcatggctttatttgttttt

SEQ ID NO: 4932554 - DNA, 18 bp, Homo sapiens
ggcatggtaccagccctg

SEQ ID NO: 4932555 - DNA, 19 bp, Homo sapiens
ggcatggtaccagccctgg

SEQ ID NO: 4932556 - DNA, 20 bp, Homo sapiens
ggcatggtaccagccctggg

SEQ ID NO: 4932557 - DNA, 17 bp, Homo sapiens
ggcattaatgtttctat

SEQ ID NO: 4932558 - DNA, 19 bp, Homo sapiens
ggcattagaattatttaaa

SEQ ID NO: 4932559 - DNA, 14 bp, Homo sapiens
ggcattcttgtaca

SEQ ID NO: 4932560 - DNA, 19 bp, Homo sapiens
ggcattgaggaagagtctt

SEQ ID NO: 4932561 - DNA, 15 bp, Homo sapiens
ggcatttttatttta

SEQ ID NO: 4932562 - DNA, 17 bp, Homo sapiens
ggccaaaagctagacag

SEQ ID NO: 4932563 - DNA, 14 bp, Homo sapiens
ggccaaaaggaaaa

SEQ ID NO: 4932564 - DNA, 16 bp, Homo sapiens
ggccaaaggctggtgg

SEQ ID NO: 4932565 - DNA, 22 bp, Homo sapiens
ggccaaatccgctctcttcctg

SEQ ID NO: 4932566 - DNA, 20 bp, Homo sapiens
ggccacatgggagcagtcca

SEQ ID NO: 4932567 - DNA, 13 bp, Homo sapiens
ggccactgctccc

SEQ ID NO: 4932568 - DNA, 21 bp, Homo sapiens
ggccactttaagagagaaatc

SEQ ID NO: 4932569 - DNA, 14 bp, Homo sapiens
ggccagagctggga

SEQ ID NO: 4932570 - DNA, 14 bp, Homo sapiens
ggccagagtggcct

SEQ ID NO: 4932571 - DNA, 20 bp, Homo sapiens
ggccagagtggcctggccag

SEQ ID NO: 4932572 - DNA, 15 bp, Homo sapiens
ggccagatgcaccag

SEQ ID NO: 4932573 - DNA, 20 bp, Homo sapiens
ggccagatgcaccagccctt

SEQ ID NO: 4932574 - DNA, 14 bp, Homo sapiens
ggccagccccaccc

SEQ ID NO: 4932575 - DNA, 16 bp, Homo sapiens
ggccagccccacccag

SEQ ID NO: 4932576 - DNA, 20 bp, Homo sapiens
ggccagccccggccctgggc

SEQ ID NO: 4932577 - DNA, 18 bp, Homo sapiens
ggccagcctcacccttgc

SEQ ID NO: 4932578 - DNA, 15 bp, Homo sapiens
ggccagcctggggcc

SEQ ID NO: 4932579 - DNA, 21 bp, Homo sapiens
ggccagcctggggcctggcag

SEQ ID NO: 4932580 - DNA, 22 bp, Homo sapiens
ggccagcctggggcctggcagg

SEQ ID NO: 4932581 - DNA, 13 bp, Homo sapiens
ggccaggactgag

SEQ ID NO: 4932582 - DNA, 15 bp, Homo sapiens
ggccaggactgagcc

SEQ ID NO: 4932583 - DNA, 20 bp, Homo sapiens
ggccaggactgagccccgca

SEQ ID NO: 4932584 - DNA, 22 bp, Homo sapiens
ggccaggcagatctgtgcccca

SEQ ID NO: 4932585 - DNA, 12 bp, Homo sapiens
ggccaggcaggt

SEQ ID NO: 4932586 - DNA, 14 bp, Homo sapiens
ggccaggccagagg

SEQ ID NO: 4932587 - DNA, 11 bp, Homo sapiens
ggccaggctgg

SEQ ID NO: 4932588 - DNA, 18 bp, Homo sapiens
ggccaggctggtctcaaa

SEQ ID NO: 4932589 - DNA, 14 bp, Homo sapiens
ggccagggctgccc

SEQ ID NO: 4932590 - DNA, 18 bp, Homo sapiens
ggccagggctgccctgag

SEQ ID NO: 4932591 - DNA, 19 bp, Homo sapiens
ggccagggctgccctgaga

SEQ ID NO: 4932592 - DNA, 20 bp, Homo sapiens
ggccagggctgccctgagaa

SEQ ID NO: 4932593 - DNA, 23 bp, Homo sapiens
ggccagggtctgtgtgaatgtgg

SEQ ID NO: 4932594 - DNA, 19 bp, Homo sapiens
ggccaggtggccactccag

SEQ ID NO: 4932595 - DNA, 20 bp, Homo sapiens
ggccagtgtgacaaggattg

SEQ ID NO: 4932596 - DNA, 14 bp, Homo sapiens
ggccatccctgtga

SEQ ID NO: 4932597 - DNA, 13 bp, Homo sapiens
ggccatgggcctc

SEQ ID NO: 4932598 - DNA, 13 bp, Homo sapiens
ggccatgtccaaa

SEQ ID NO: 4932599 - DNA, 20 bp, Homo sapiens
ggccattctgccgccccctc

SEQ ID NO: 4932600 - DNA, 17 bp, Homo sapiens
ggcccaaggcggcccct

SEQ ID NO: 4932601 - DNA, 18 bp, Homo sapiens
ggcccacaggaggcaagc

SEQ ID NO: 4932602 - DNA, 23 bp, Homo sapiens
ggcccacaggaggcaagcaagct

SEQ ID NO: 4932603 - DNA, 17 bp, Homo sapiens
ggcccacgtggttgggg

SEQ ID NO: 4932604 - DNA, 12 bp, Homo sapiens
ggcccagagagg

SEQ ID NO: 4932605 - DNA, 16 bp, Homo sapiens
ggcccagagcaggaag

SEQ ID NO: 4932606 - DNA, 22 bp, Homo sapiens
ggcccagatctggtcccttgca

SEQ ID NO: 4932607 - DNA, 14 bp, Homo sapiens
ggcccagcccctag

SEQ ID NO: 4932608 - DNA, 13 bp, Homo sapiens
ggccccagggcac

SEQ ID NO: 4932609 - DNA, 16 bp, Homo sapiens
ggccccagggcaccct

SEQ ID NO: 4932610 - DNA, 18 bp, Homo sapiens
ggccccagggctaccctc

SEQ ID NO: 4932611 - DNA, 15 bp, Homo sapiens
ggccccccagctcag

SEQ ID NO: 4932612 - DNA, 13 bp, Homo sapiens
ggccccctgcccg

SEQ ID NO: 4932613 - DNA, 12 bp, Homo sapiens
ggcccctgccac

SEQ ID NO: 4932614 - DNA, 16 bp, Homo sapiens
ggcccctgccaccctg

SEQ ID NO: 4932615 - DNA, 16 bp, Homo sapiens
ggcccctgcccggctg

SEQ ID NO: 4932616 - DNA, 20 bp, Homo sapiens
ggcccctgcccggctgcgga

SEQ ID NO: 4932617 - DNA, 16 bp, Homo sapiens
ggcccgacagcctggc

SEQ ID NO: 4932618 - DNA, 15 bp, Homo sapiens
ggcccggatgctgct

SEQ ID NO: 4932619 - DNA, 17 bp, Homo sapiens
ggcccggatgctgcttc

SEQ ID NO: 4932620 - DNA, 15 bp, Homo sapiens
ggcccggctccaggc

SEQ ID NO: 4932621 - DNA, 21 bp, Homo sapiens
ggccctagcccagcgctctgc

SEQ ID NO: 4932622 - DNA, 23 bp, Homo sapiens
ggccctcgacactcaccatgaag

SEQ ID NO: 4932623 - DNA, 17 bp, Homo sapiens
ggccctctcccttaccc

SEQ ID NO: 4932624 - DNA, 16 bp, Homo sapiens
ggccctgcagccagct

SEQ ID NO: 4932625 - DNA, 12 bp, Homo sapiens
ggctgcagggag

SEQ ID NO: 4932626 - DNA, 13 bp, Homo sapiens
ggctgcccctctc

SEQ ID NO: 4932627 - DNA, 24 bp, Homo sapiens
ggctgccctgagaagctgctccag

SEQ ID NO: 4932628 - DNA, 12 bp, Homo sapiens
ggctgccctggt

SEQ ID NO: 4932629 - DNA, 13 bp, Homo sapiens
ggctgccctggtg

SEQ ID NO: 4932630 - DNA, 22 bp, Homo sapiens
ggctgccctggtgctgccacac

SEQ ID NO: 4932631 - DNA, 16 bp, Homo sapiens
ggctgccttagaacct

SEQ ID NO: 4932632 - DNA, 17 bp, Homo sapiens
ggctgcggcgtctgtct

SEQ ID NO: 4932633 - DNA, 16 bp, Homo sapiens
ggctgctacccagaaa

SEQ ID NO: 4932634 - DNA, 21 bp, Homo sapiens
ggctgctggggcctcagacga

SEQ ID NO: 4932635 - DNA, 16 bp, Homo sapiens
ggctggaaggggtcca

SEQ ID NO: 4932636 - DNA, 19 bp, Homo sapiens
ggctggagtgcagtggcgt

SEQ ID NO: 4932637 - DNA, 20 bp, Homo sapiens
ggctggagtgcagtggtgca

SEQ ID NO: 4932638 - DNA, 15 bp, Homo sapiens
ggctggatgaaattt

SEQ ID NO: 4932639 - DNA, 18 bp, Homo sapiens
ggctggatgtggtggcat

SEQ ID NO: 4932640 - DNA, 19 bp, Homo sapiens
ggctggatgtggtggcata

SEQ ID NO: 4932641 - DNA, 15 bp, Homo sapiens
ggctggcagggctgg

SEQ ID NO: 4932642 - DNA, 19 bp, Homo sapiens
ggctggcctctggctctca

SEQ ID NO: 4932643 - DNA, 15 bp, Homo sapiens
ggctgggagctctgc

SEQ ID NO: 4932644 - DNA, 17 bp, Homo sapiens
ggctgggccatgtccaa

SEQ ID NO: 4932645 - DNA, 20 bp, Homo sapiens
ggctgggccatgtccaaaga

SEQ ID NO: 4932646 - DNA, 13 bp, Homo sapiens
ggctgggcccccc

SEQ ID NO: 4932647 - DNA, 13 bp, Homo sapiens
ggctgggcttcag

SEQ ID NO: 4932648 - DNA, 21 bp, Homo sapiens
ggctgggcttcagtggcagct

SEQ ID NO: 4932649 - DNA, 16 bp, Homo sapiens
ggctggggaggacctg

SEQ ID NO: 4932650 - DNA, 14 bp, Homo sapiens
ggctgggggcagga

SEQ ID NO: 4932651 - DNA, 16 bp, Homo sapiens
ggctgggggcaggagg

SEQ ID NO: 4932652 - DNA, 15 bp, Homo sapiens
ggctgggggcctcag

SEQ ID NO: 4932653 - DNA, 13 bp, Homo sapiens
ggctggtgggagg

SEQ ID NO: 4932654 - DNA, 15 bp, Homo sapiens
ggctgtaaggctcta

SEQ ID NO: 4932655 - DNA, 13 bp, Homo sapiens
ggctgtgcctctg

SEQ ID NO: 4932656 - DNA, 15 bp, Homo sapiens
ggctgttctgcactg

SEQ ID NO: 4932657 - DNA, 17 bp, Homo sapiens
ggctgttgaagtcacct

SEQ ID NO: 4932658 - DNA, 14 bp, Homo sapiens
ggctgttggctggg

SEQ ID NO: 4932659 - DNA, 16 bp, Homo sapiens
ggctgttggctggggg

SEQ ID NO: 4932660 - DNA, 20 bp, Homo sapiens
ggctgttggctgggggcctc

SEQ ID NO: 4932661 - DNA, 21 bp, Homo sapiens
ggcttatattcaaccatggac

SEQ ID NO: 4932662 - DNA, 12 bp, Homo sapiens
ggcttattttaa

SEQ ID NO: 4932663 - DNA, 21 bp, Homo sapiens
ggcttattttaatgtgatgat

SEQ ID NO: 4932664 - DNA, 21 bp, Homo sapiens
ggcttcactgtataaatagga

SEQ ID NO: 4932665 - DNA, 18 bp, Homo sapiens
ggcttcagtggcagctgc

SEQ ID NO: 4932666 - DNA, 23 bp, Homo sapiens
ggcttccatcccaaccagtgcca

SEQ ID NO: 4932667 - DNA, 16 bp, Homo sapiens
ggcttcctcatagtat

SEQ ID NO: 4932668 - DNA, 13 bp, Homo sapiens
ggcttcctcctga

SEQ ID NO: 4932669 - DNA, 15 bp, Homo sapiens
ggcttgactcaggat

SEQ ID NO: 4932670 - DNA, 20 bp, Homo sapiens
ggcttgagcccccgcgccca

SEQ ID NO: 4932671 - DNA, 19 bp, Homo sapiens
ggcttgtagaattgttata

SEQ ID NO: 4932672 - DNA, 20 bp, Homo sapiens
ggctttatgataatagattc

SEQ ID NO: 4932673 - DNA, 22 bp, Homo sapiens
ggctttatgataatagattctc

SEQ ID NO: 4932674 - DNA, 19 bp, Homo sapiens
ggctttcagaaaacgggaa

SEQ ID NO: 4932675 - DNA, 20 bp, Homo sapiens
ggctttccttgtggcagagg

SEQ ID NO: 4932676 - DNA, 15 bp, Homo sapiens
ggctttctcttttct

SEQ ID NO: 4932677 - DNA, 12 bp, Homo sapiens
ggctttggattt

SEQ ID NO: 4932678 - DNA, 14 bp, Homo sapiens
ggcttttcactgct

SEQ ID NO: 4932679 - DNA, 13 bp, Homo sapiens
gggaaagacactg

SEQ ID NO: 4932680 - DNA, 18 bp, Homo sapiens
gggaaagacactgcctgg

SEQ ID NO: 4932681 - DNA, 23 bp, Homo sapiens
gggaaaggaggcatgcctctgat

SEQ ID NO: 4932682 - DNA, 18 bp, Homo sapiens
gggaaccatgaagacagg

SEQ ID NO: 4932683 - DNA, 19 bp, Homo sapiens
gggaaccatgaagacagga

SEQ ID NO: 4932684 - DNA, 16 bp, Homo sapiens
gggaacctcccagagg

SEQ ID NO: 4932685 - DNA, 16 bp, Homo sapiens
gggaacgatgtgtctg

SEQ ID NO: 4932686 - DNA, 13 bp, Homo sapiens
gggaactctgaca

SEQ ID NO: 4932687 - DNA, 14 bp, Homo sapiens
gggaactctgacaa

SEQ ID NO: 4932688 - DNA, 18 bp, Homo sapiens
gggaagcgctcagaacag

SEQ ID NO: 4932689 - DNA, 16 bp, Homo sapiens
gggaagctgcagcttg

SEQ ID NO: 4932690 - DNA, 13 bp, Homo sapiens
gggaaggcctgac

SEQ ID NO: 4932691 - DNA, 15 bp, Homo sapiens
gggaaggcctgactt

SEQ ID NO: 4932692 - DNA, 19 bp, Homo sapiens
gggaaggtcaccagcacca

SEQ ID NO: 4932693 - DNA, 23 bp, Homo sapiens
gggaagtgaagactggaagctaa

SEQ ID NO: 4932694 - DNA, 22 bp, Homo sapiens
gggaatccccgaaggtgctgga

SEQ ID NO: 4932695 - DNA, 18 bp, Homo sapiens
gggaatgagcccagagaa

SEQ ID NO: 4932696 - DNA, 22 bp, Homo sapiens
gggaatgagcccagagaacagc

SEQ ID NO: 4932697 - DNA, 19 bp, Homo sapiens
gggaatgtttgcctctgcc

SEQ ID NO: 4932698 - DNA, 19 bp, Homo sapiens
gggacacaaaactccgccc

SEQ ID NO: 4932699 - DNA, 23 bp, Homo sapiens
gggacacaaaactccgcccccag

SEQ ID NO: 4932700 - DNA, 14 bp, Homo sapiens
gggacagattcagt

SEQ ID NO: 4932701 - DNA, 13 bp, Homo sapiens
gggacagctcctt

SEQ ID NO: 4932702 - DNA, 21 bp, Homo sapiens
gggacagctccttctgtccta

SEQ ID NO: 4932703 - DNA, 12 bp, Homo sapiens
gggacccaggct

SEQ ID NO: 4932704 - DNA, 13 bp, Homo sapiens
gggacccaggctc

SEQ ID NO: 4932705 - DNA, 17 bp, Homo sapiens
gggacccaggctccgcc

SEQ ID NO: 4932706 - DNA, 18 bp, Homo sapiens
gggacctggtaccctcct

SEQ ID NO: 4932707 - DNA, 20 bp, Homo sapiens
gggacgctccgctgccgtgc

SEQ ID NO: 4932708 - DNA, 14 bp, Homo sapiens
gggacgtttctcat

SEQ ID NO: 4932709 - DNA, 19 bp, Homo sapiens
gggactcaatgcactgaca

SEQ ID NO: 4932710 - DNA, 20 bp, Homo sapiens
gggactctgaagcctctggg

SEQ ID NO: 4932711 - DNA, 16 bp, Homo sapiens
gggactgcctctgcca

SEQ ID NO: 4932712 - DNA, 17 bp, Homo sapiens
gggactgctgctgcctg

SEQ ID NO: 4932713 - DNA, 23 bp, Homo sapiens
gggacttggaagctccgctttct

SEQ ID NO: 4932714 - DNA, 19 bp, Homo sapiens
gggagacactggcccctca

SEQ ID NO: 4932715 - DNA, 19 bp, Homo sapiens
gggagatggagttcttgtg

SEQ ID NO: 4932716 - DNA, 21 bp, Homo sapiens
gggagccccagggtcttccct

SEQ ID NO: 4932717 - DNA, 16 bp, Homo sapiens
gggagcctaggaccac

SEQ ID NO: 4932718 - DNA, 13 bp, Homo sapiens
gggagctgcctgt

SEQ ID NO: 4932719 - DNA, 16 bp, Homo sapiens
gggaggacaaaacttc

SEQ ID NO: 4932720 - DNA, 19 bp, Homo sapiens
gggaggacctggggcacag

SEQ ID NO: 4932721 - DNA, 22 bp, Homo sapiens
gggaggatgttctgggacacag

SEQ ID NO: 4932722 - DNA, 17 bp, Homo sapiens
gggaggcatggccctgg

SEQ ID NO: 4932723 - DNA, 16 bp, Homo sapiens
gggagtcaccttccct

SEQ ID NO: 4932724 - DNA, 11 bp, Homo sapiens
gggagtgagct

SEQ ID NO: 4932725 - DNA, 14 bp, Homo sapiens
gggagtgagctggt

SEQ ID NO: 4932726 - DNA, 22 bp, Homo sapiens
gggagttgtcaagtctctgctg

SEQ ID NO: 4932727 - DNA, 15 bp, Homo sapiens
gggataaaatgacta

SEQ ID NO: 4932728 - DNA, 13 bp, Homo sapiens
gggatagagagag

SEQ ID NO: 4932729 - DNA, 20 bp, Homo sapiens
gggatgagctcaagcaggaa

SEQ ID NO: 4932730 - DNA, 19 bp, Homo sapiens
gggatggacgatctcccac

SEQ ID NO: 4932731 - DNA, 14 bp, Homo sapiens
gggatgggcctggc

SEQ ID NO: 4932732 - DNA, 14 bp, Homo sapiens
gggattcaggctgc

SEQ ID NO: 4932733 - DNA, 20 bp, Homo sapiens
gggcaaggaaaaagaaaata

SEQ ID NO: 4932734 - DNA, 21 bp, Homo sapiens
gggcacaactgcaataacttc

SEQ ID NO: 4932735 - DNA, 21 bp, Homo sapiens
ggtggacttagaaagcagggg

SEQ ID NO: 4932736 - DNA, 13 bp, Homo sapiens
ggtggatgcctgg

SEQ ID NO: 4932737 - DNA, 17 bp, Homo sapiens
ggtggcacaggccccct

SEQ ID NO: 4932738 - DNA, 19 bp, Homo sapiens
ggtggcagtgggagctgcc

SEQ ID NO: 4932739 - DNA, 22 bp, Homo sapiens
ggtggccactccagacccctgg

SEQ ID NO: 4932740 - DNA, 11 bp, Homo sapiens
ggtggcctcag

SEQ ID NO: 4932741 - DNA, 12 bp, Homo sapiens
ggtggcctcggg

SEQ ID NO: 4932742 - DNA, 22 bp, Homo sapiens
ggtggctttccttgtggcagag

SEQ ID NO: 4932743 - DNA, 23 bp, Homo sapiens
ggtggctttccttgtggcagagg

SEQ ID NO: 4932744 - DNA, 13 bp, Homo sapiens
ggtggggcagctt

SEQ ID NO: 4932745 - DNA, 12 bp, Homo sapiens
ggtgggggagga

SEQ ID NO: 4932746 - DNA, 13 bp, Homo sapiens
ggtgggtgctcag

SEQ ID NO: 4932747 - DNA, 14 bp, Homo sapiens
ggtggtgacctctg

SEQ ID NO: 4932748 - DNA, 15 bp, Homo sapiens
ggtggtgacctctgc

SEQ ID NO: 4932749 - DNA, 14 bp, Homo sapiens
ggtgtaataagaca

SEQ ID NO: 4932750 - DNA, 16 bp, Homo sapiens
ggtgtaataagacata

SEQ ID NO: 4932751 - DNA, 13 bp, Homo sapiens
ggtgtatttaaac

SEQ ID NO: 4932752 - DNA, 16 bp, Homo sapiens
ggtgtatttaaactat

SEQ ID NO: 4932753 - DNA, 14 bp, Homo sapiens
ggtgtcatttcatt

SEQ ID NO: 4932754 - DNA, 15 bp, Homo sapiens
ggtgtgacctgaggg

SEQ ID NO: 4932755 - DNA, 12 bp, Homo sapiens
ggtgtggctcct

SEQ ID NO: 4932756 - DNA, 17 bp, Homo sapiens
ggtgttttaaaaaatct

SEQ ID NO: 4932757 - DNA, 14 bp, Homo sapiens
ggttaaatactgtg

SEQ ID NO: 4932758 - DNA, 17 bp, Homo sapiens
ggttaatctttcctgat

SEQ ID NO: 4932759 - DNA, 23 bp, Homo sapiens
ggttatcgaaataacaatgttaa

SEQ ID NO: 4932760 - DNA, 21 bp, Homo sapiens
ggttcaagcgattcttctgct

SEQ ID NO: 4932761 - DNA, 18 bp, Homo sapiens
ggttcaattccctgaagg

SEQ ID NO: 4932762 - DNA, 12 bp, Homo sapiens
ggttcagcttgt

SEQ ID NO: 4932763 - DNA, 22 bp, Homo sapiens
ggttcagggttggcccctgccc

SEQ ID NO: 4932764 - DNA, 15 bp, Homo sapiens
ggttcatgatgcagt

SEQ ID NO: 4932765 - DNA, 12 bp, Homo sapiens
ggttccccaccg

SEQ ID NO: 4932766 - DNA, 17 bp, Homo sapiens
ggttcccgtttctccac

SEQ ID NO: 4932767 - DNA, 13 bp, Homo sapiens
ggttctaaagttc

SEQ ID NO: 4932768 - DNA, 15 bp, Homo sapiens
ggttctaaagttcta

SEQ ID NO: 4932769 - DNA, 11 bp, Homo sapiens
ggttctaaggc

SEQ ID NO: 4932770 - DNA, 12 bp, Homo sapiens
ggttctaaggcc

SEQ ID NO: 4932771 - DNA, 23 bp, Homo sapiens
ggttctaaggcctaggattctaa

SEQ ID NO: 4932772 - DNA, 21 bp, Homo sapiens
ggttctaggcatctctgtact

SEQ ID NO: 4932773 - DNA, 23 bp, Homo sapiens
ggttctaggcatctctgtacttt

SEQ ID NO: 4932774 - DNA, 18 bp, Homo sapiens
ggttctccccctttctct

SEQ ID NO: 4932775 - DNA, 16 bp, Homo sapiens
ggttctgcctgctttg

SEQ ID NO: 4932776 - DNA, 16 bp, Homo sapiens
ggttctttcttcctct

SEQ ID NO: 4932777 - DNA, 15 bp, Homo sapiens
ggttgctggagcctg

SEQ ID NO: 4932778 - DNA, 20 bp, Homo sapiens
ggttgttttttcctttgctc

SEQ ID NO: 4932779 - DNA, 15 bp, Homo sapiens
ggtttaaagagtcta

SEQ ID NO: 4932780 - DNA, 22 bp, Homo sapiens
ggtttaaagagtctagattcaa

SEQ ID NO: 4932781 - DNA, 22 bp, Homo sapiens
ggtttacatgtgatgttttagt

SEQ ID NO: 4932782 - DNA, 22 bp, Homo sapiens
ggtttacattcatctcattcca

SEQ ID NO: 4932783 - DNA, 12 bp, Homo sapiens
ggtttacattta

SEQ ID NO: 4932784 - DNA, 15 bp, Homo sapiens
ggtttacatttaaag

SEQ ID NO: 4932785 - DNA, 17 bp, Homo sapiens
ggtttacctagagaaca

SEQ ID NO: 4932786 - DNA, 12 bp, Homo sapiens
ggtttactttca

SEQ ID NO: 4932787 - DNA, 14 bp, Homo sapiens
ggtttactttcaaa

SEQ ID NO: 4932788 - DNA, 18 bp, Homo sapiens
ggtttataattttctgaa

SEQ ID NO: 4932789 - DNA, 18 bp, Homo sapiens
ggtttcaaagatgctgtg

SEQ ID NO: 4932790 - DNA, 22 bp, Homo sapiens
ggtttctttcagattttttgaa

SEQ ID NO: 4932791 - DNA, 21 bp, Homo sapiens
ggtttgaaagtgaataaactt

SEQ ID NO: 4932792 - DNA, 22 bp, Homo sapiens
ggtttgagattgccccaggtct

SEQ ID NO: 4932793 - DNA, 17 bp, Homo sapiens
ggttttaggtagaaaaa

SEQ ID NO: 4932794 - DNA, 22 bp, Homo sapiens
ggtttttacctgtcacattgca

SEQ ID NO: 4932795 - DNA, 19 bp, Homo sapiens
gtaaaaaaaaatgcctttg

SEQ ID NO: 4932796 - DNA, 12 bp, Homo sapiens
gtaaaaagaaaa

SEQ ID NO: 4932797 - DNA, 17 bp, Homo sapiens
gtaaaaggtattaaatt

SEQ ID NO: 4932798 - DNA, 19 bp, Homo sapiens
gtaaaatgtgaagtgaatg

SEQ ID NO: 4932799 - DNA, 22 bp, Homo sapiens
gtaaaatgtgaagtgaatgaaa

SEQ ID NO: 4932800 - DNA, 19 bp, Homo sapiens
gtaaacaaactcttgaaga

SEQ ID NO: 4932801 - DNA, 19 bp, Homo sapiens
gtaaacacagtcaaaataa

SEQ ID NO: 4932802 - DNA, 20 bp, Homo sapiens
gtaaacagatggcactttga

SEQ ID NO: 4932803 - DNA, 20 bp, Homo sapiens
gtaaacatgtgttttaattc

SEQ ID NO: 4932804 - DNA, 23 bp, Homo sapiens
gtaaactcaaaatatttgtacat

SEQ ID NO: 4932805 - DNA, 17 bp, Homo sapiens
gtaaactggaattaaaa

SEQ ID NO: 4932806 - DNA, 16 bp, Homo sapiens
gtaaagaaatgtctta

SEQ ID NO: 4932807 - DNA, 21 bp, Homo sapiens
gtaaagtatgtaaacaggaga

SEQ ID NO: 4932808 - DNA, 14 bp, Homo sapiens
gtaaatacaggtag

SEQ ID NO: 4932809 - DNA, 17 bp, Homo sapiens
gtaaatcctgccattta

SEQ ID NO: 4932810 - DNA, 14 bp, Homo sapiens
gtaaatcttttaca

SEQ ID NO: 4932811 - DNA, 15 bp, Homo sapiens
gtaaatgctgtgttg

SEQ ID NO: 4932812 - DNA, 15 bp, Homo sapiens
gtaacagaacagctt

SEQ ID NO: 4932813 - DNA, 19 bp, Homo sapiens
gtaacatcactatccatgc

SEQ ID NO: 4932814 - DNA, 13 bp, Homo sapiens
gtaaccagccaga

SEQ ID NO: 4932815 - DNA, 20 bp, Homo sapiens
gtaaccagccagatcctctt

SEQ ID NO: 4932816 - DNA, 14 bp, Homo sapiens
gtaacttaaaatag

SEQ ID NO: 4932817 - DNA, 13 bp, Homo sapiens
gtaaggctctaga

SEQ ID NO: 4932818 - DNA, 14 bp, Homo sapiens
gtaaggctctagat

SEQ ID NO: 4932819 - DNA, 17 bp, Homo sapiens
gtaagtcagtgttgaga

SEQ ID NO: 4932820 - DNA, 19 bp, Homo sapiens
gtaagtcagtgttgagatg

SEQ ID NO: 4932821 - DNA, 14 bp, Homo sapiens
gtaagtttcaggtg

SEQ ID NO: 4932822 - DNA, 16 bp, Homo sapiens
gtaataaactgtgttt

SEQ ID NO: 4932823 - DNA, 19 bp, Homo sapiens
gtaataagacataacgttt

SEQ ID NO: 4932824 - DNA, 14 bp, Homo sapiens
gtaataatacctca

SEQ ID NO: 4932825 - DNA, 15 bp, Homo sapiens
gtaatagagcaaaat

SEQ ID NO: 4932826 - DNA, 19 bp, Homo sapiens
gtaatattttgtattattg

SEQ ID NO: 4932827 - DNA, 18 bp, Homo sapiens
gtaatatttttatataca

SEQ ID NO: 4932828 - DNA, 16 bp, Homo sapiens
gtaatcaataaagaaa

SEQ ID NO: 4932829 - DNA, 19 bp, Homo sapiens
gtaatcaataaagaaaact

SEQ ID NO: 4932830 - DNA, 12 bp, Homo sapiens
gtaatcaatgaa

SEQ ID NO: 4932831 - DNA, 21 bp, Homo sapiens
gtaatcaatgaatattgaagt

SEQ ID NO: 4932832 - DNA, 19 bp, Homo sapiens
gtaatccaggcacagctga

SEQ ID NO: 4932833 - DNA, 14 bp, Homo sapiens
gtaatctctctgca

SEQ ID NO: 4932834 - DNA, 18 bp, Homo sapiens
gtaatctctctgcagctg

SEQ ID NO: 4932835 - DNA, 13 bp, Homo sapiens
gtaatgaagtaaa

SEQ ID NO: 4932836 - DNA, 12 bp, Homo sapiens
gtaatgctgcac

SEQ ID NO: 4932837 - DNA, 17 bp, Homo sapiens
gtaatgctgcacttcct

SEQ ID NO: 4932838 - DNA, 18 bp, Homo sapiens
gtaatgtagcgtgtttac

SEQ ID NO: 4932839 - DNA, 17 bp, Homo sapiens
gtaatgtggaagaaaat

SEQ ID NO: 4932840 - DNA, 13 bp, Homo sapiens
gtaattatgattt

SEQ ID NO: 4932841 - DNA, 21 bp, Homo sapiens
gtaattatgcactaaatatga

SEQ ID NO: 4932842 - DNA, 15 bp, Homo sapiens
gtaattgaacttatc

SEQ ID NO: 4932843 - DNA, 12 bp, Homo sapiens
gtaattgctttt

SEQ ID NO: 4932844 - DNA, 20 bp, Homo sapiens
gtaatttagggtactaaatt

SEQ ID NO: 4932845 - DNA, 18 bp, Homo sapiens
gtaatttggtttaaaaat

SEQ ID NO: 4932846 - DNA, 17 bp, Homo sapiens
gtataagaaatgcatat

SEQ ID NO: 4932847 - DNA, 17 bp, Homo sapiens
gtataagtgcacacaga

SEQ ID NO: 4932848 - DNA, 15 bp, Homo sapiens
gtatacaaatatatt

SEQ ID NO: 4932849 - DNA, 14 bp, Homo sapiens
gtatacaatatata

SEQ ID NO: 4932850 - DNA, 18 bp, Homo sapiens
gtatacaatatataaaaa

SEQ ID NO: 4932851 - DNA, 21 bp, Homo sapiens
gtatacaatatataaaaatat

SEQ ID NO: 4932852 - DNA, 22 bp, Homo sapiens
gtatacaatatataaaaatata

SEQ ID NO: 4932853 - DNA, 23 bp, Homo sapiens
gtatacaccatatactgttcttc

SEQ ID NO: 4932854 - DNA, 18 bp, Homo sapiens
gtatacatcctgggtaat

SEQ ID NO: 4932855 - DNA, 13 bp, Homo sapiens
gtatactttaaat

SEQ ID NO: 4932856 - DNA, 23 bp, Homo sapiens
gtatactttaaataatttaacta

SEQ ID NO: 4932857 - DNA, 13 bp, Homo sapiens
gtatactttagta

SEQ ID NO: 4932858 - DNA, 17 bp, Homo sapiens
gtatagacagtttgtaa

SEQ ID NO: 4932859 - DNA, 19 bp, Homo sapiens
gtatagacagtttgtaaat

SEQ ID NO: 4932860 - DNA, 23 bp, Homo sapiens
gtatagcctatggcagaaaaaat

SEQ ID NO: 4932861 - DNA, 16 bp, Homo sapiens
gtatagtgtaaaataa

SEQ ID NO: 4932862 - DNA, 18 bp, Homo sapiens
gtatatacacatatacct

SEQ ID NO: 4932863 - DNA, 13 bp, Homo sapiens
gtatatacttttt

SEQ ID NO: 4932864 - DNA, 11 bp, Homo sapiens
gtatatattta

SEQ ID NO: 4932865 - DNA, 12 bp, Homo sapiens
gtatatcatgta

SEQ ID NO: 4932866 - DNA, 21 bp, Homo sapiens
gtatatctgggctggccagtt

SEQ ID NO: 4932867 - DNA, 17 bp, Homo sapiens
gtatattacacatttgt

SEQ ID NO: 4932868 - DNA, 15 bp, Homo sapiens
gtatattcatatatt

SEQ ID NO: 4932869 - DNA, 12 bp, Homo sapiens
gtatattggaag

SEQ ID NO: 4932870 - DNA, 13 bp, Homo sapiens
gtatattgtgttt

SEQ ID NO: 4932871 - DNA, 19 bp, Homo sapiens
gtatcacgggtcacttgaa

SEQ ID NO: 4932872 - DNA, 19 bp, Homo sapiens
gtatcagtgttttaaattc

SEQ ID NO: 4932873 - DNA, 15 bp, Homo sapiens
gtatcatagaaatgt

SEQ ID NO: 4932874 - DNA, 21 bp, Homo sapiens
gtatcccatgagcctcagcat

SEQ ID NO: 4932875 - DNA, 18 bp, Homo sapiens
gtatcccttctcacagca

SEQ ID NO: 4932876 - DNA, 19 bp, Homo sapiens
gtatcccttctcacagcac

SEQ ID NO: 4932877 - DNA, 18 bp, Homo sapiens
gtatcctgggggacccaa

SEQ ID NO: 4932878 - DNA, 15 bp, Homo sapiens
gtatcgtaaccagcc

SEQ ID NO: 4932879 - DNA, 20 bp, Homo sapiens
gtatctctgaagcatgtttc

SEQ ID NO: 4932880 - DNA, 20 bp, Homo sapiens
gtatctgagttgccaagaca

SEQ ID NO: 4932881 - DNA, 23 bp, Homo sapiens
gtatctgagttgccaagacaaat

SEQ ID NO: 4932882 - DNA, 20 bp, Homo sapiens
gtatctgtgaagtagttctg

SEQ ID NO: 4932883 - DNA, 13 bp, Homo sapiens
gtatcttaaattt

SEQ ID NO: 4932884 - DNA, 21 bp, Homo sapiens
gtatcttccatatttggaaga

SEQ ID NO: 4932885 - DNA, 22 bp, Homo sapiens
gtatcttccatatttggaagaa

SEQ ID NO: 4932886 - DNA, 22 bp, Homo sapiens
gtatgaaagatggctgtgcctc

SEQ ID NO: 4932887 - DNA, 23 bp, Homo sapiens
gtatgaaagatggctgtgcctct

SEQ ID NO: 4932888 - DNA, 14 bp, Homo sapiens
gtatgaaagattgt

SEQ ID NO: 4932889 - DNA, 19 bp, Homo sapiens
gtatgaataaagacaccta

SEQ ID NO: 4932890 - DNA, 21 bp, Homo sapiens
gtatggaaaaaccatttgaag

SEQ ID NO: 4932891 - DNA, 20 bp, Homo sapiens
gtatggattgggggggccaa

SEQ ID NO: 4932892 - DNA, 21 bp, Homo sapiens
gtatggctctgcacccctctg

SEQ ID NO: 4932893 - DNA, 13 bp, Homo sapiens
gtatggtctaaca

SEQ ID NO: 4932894 - DNA, 13 bp, Homo sapiens
gtatggtggctgg

SEQ ID NO: 4932895 - DNA, 23 bp, Homo sapiens
gtatgtaatgtgtggtggcctca

SEQ ID NO: 4932896 - DNA, 21 bp, Homo sapiens
gtatgtgacaccaaagccacc

SEQ ID NO: 4932897 - DNA, 23 bp, Homo sapiens
gtatgtgacaccaaagccacctc

SEQ ID NO: 4932898 - DNA, 12 bp, Homo sapiens
gtattaaaacat

SEQ ID NO: 4932899 - DNA, 14 bp, Homo sapiens
gtattaaaacattg

SEQ ID NO: 4932900 - DNA, 19 bp, Homo sapiens
gtattaatactaaaatatg

SEQ ID NO: 4932901 - DNA, 21 bp, Homo sapiens
gtattaatactaaaatatgtc

SEQ ID NO: 4932902 - DNA, 14 bp, Homo sapiens
gtattcttgtcaaa

SEQ ID NO: 4932903 - DNA, 14 bp, Homo sapiens
gtattgagatactt

SEQ ID NO: 4932904 - DNA, 23 bp, Homo sapiens
gtattgagatactttttcttttg

SEQ ID NO: 4932905 - DNA, 10 bp, Homo sapiens
gtattggaaa

SEQ ID NO: 4932906 - DNA, 17 bp, Homo sapiens
gtattggtggctttcct

SEQ ID NO: 4932907 - DNA, 17 bp, Homo sapiens
gtattgtaaacatgtgt

SEQ ID NO: 4932908 - DNA, 12 bp, Homo sapiens
gtattgtggtat

SEQ ID NO: 4932909 - DNA, 14 bp, Homo sapiens
gtatttaagcaaat

SEQ ID NO: 4932910 - DNA, 17 bp, Homo sapiens
gtatttaagcaaatact

SEQ ID NO: 4932911 - DNA, 16 bp, Homo sapiens
gtatttacgctttgat

SEQ ID NO: 4932912 - DNA, 19 bp, Homo sapiens
gtatttatgtaatgaagta

SEQ ID NO: 4932913 - DNA, 16 bp, Homo sapiens
gtatttatttatgtac

SEQ ID NO: 4932914 - DNA, 15 bp, Homo sapiens
gtatttattttgtaa

SEQ ID NO: 4932915 - DNA, 17 bp, Homo sapiens
gtatttattttgtaatt

SEQ ID NO: 4932916 - DNA, 21 bp, Homo sapiens
gtatttcagtgtagttaattt

SEQ ID NO: 4932917 - DNA, 22 bp, Homo sapiens
gtatttgaattaaaacttctta

SEQ ID NO: 4932918 - DNA, 21 bp, Homo sapiens
gtatttgagagttctaaattt

SEQ ID NO: 4932919 - DNA, 20 bp, Homo sapiens
gtatttgggaagtgaagact

SEQ ID NO: 4932920 - DNA, 14 bp, Homo sapiens
gtatttgttcatgt

SEQ ID NO: 4932921 - DNA, 14 bp, Homo sapiens
gtattttgaagttt

SEQ ID NO: 4932922 - DNA, 11 bp, Homo sapiens
gtattttgaat

SEQ ID NO: 4932923 - DNA, 14 bp, Homo sapiens
gtattttggagaaa

SEQ ID NO: 4932924 - DNA, 17 bp, Homo sapiens
gtattttggagaaatta

SEQ ID NO: 4932925 - DNA, 18 bp, Homo sapiens
gtattttgtgtgaccaac

SEQ ID NO: 4932926 - DNA, 23 bp, Homo sapiens
gtattttgtgtgaccaactgtgt

SEQ ID NO: 4932927 - DNA, 15 bp, Homo sapiens
gtcaaaagctggatt

SEQ ID NO: 4932928 - DNA, 12 bp, Homo sapiens
gtcaaagaaatg

SEQ ID NO: 4932929 - DNA, 16 bp, Homo sapiens
gtcaaagaaatgctga

SEQ ID NO: 4932930 - DNA, 21 bp, Homo sapiens
gtcaacaagtatgaataaaga

SEQ ID NO: 4932931 - DNA, 17 bp, Homo sapiens
gtcaaccctcaggggaa

SEQ ID NO: 4932932 - DNA, 19 bp, Homo sapiens
gtcaagagggtctgaggaa

SEQ ID NO: 4932933 - DNA, 20 bp, Homo sapiens
gtcaagggcttactatttct

SEQ ID NO: 4932934 - DNA, 17 bp, Homo sapiens
gtcaagtctctgctggc

SEQ ID NO: 4932935 - DNA, 14 bp, Homo sapiens
gtcaagtgggatct

SEQ ID NO: 4932936 - DNA, 16 bp, Homo sapiens
gtcaagtgggatctgt

SEQ ID NO: 4932937 - DNA, 14 bp, Homo sapiens
gtcaatcatttctc

SEQ ID NO: 4932938 - DNA, 16 bp, Homo sapiens
gtcaatcatttctcac

SEQ ID NO: 4932939 - DNA, 13 bp, Homo sapiens
gtcacacactgat

SEQ ID NO: 4932940 - DNA, 20 bp, Homo sapiens
gtcacacagtattacttctg

SEQ ID NO: 4932941 - DNA, 12 bp, Homo sapiens
gtcacaggcagg

SEQ ID NO: 4932942 - DNA, 16 bp, Homo sapiens
gtcacaggcaggtcca

SEQ ID NO: 4932943 - DNA, 14 bp, Homo sapiens
gtcacataaaactt

SEQ ID NO: 4932944 - DNA, 15 bp, Homo sapiens
gtcacatcacaggac

SEQ ID NO: 4932945 - DNA, 16 bp, Homo sapiens
gtcacatcagataaga

SEQ ID NO: 4932946 - DNA, 17 bp, Homo sapiens
gtcacattgcattctat

SEQ ID NO: 4932947 - DNA, 12 bp, Homo sapiens
gtcaccaagccc

SEQ ID NO: 4932948 - DNA, 20 bp, Homo sapiens
gtcacccaggctggagtgca

SEQ ID NO: 4932949 - DNA, 23 bp, Homo sapiens
gtcaccccaagtagtctgctcac

SEQ ID NO: 4932950 - DNA, 15 bp, Homo sapiens
gtcacccctccagga

SEQ ID NO: 4932951 - DNA, 19 bp, Homo sapiens
gtcaccttccaggacccct

SEQ ID NO: 4932952 - DNA, 14 bp, Homo sapiens
gtcactcattgctg

SEQ ID NO: 4932953 - DNA, 18 bp, Homo sapiens
gtcactcattgctgagcc

SEQ ID NO: 4932954 - DNA, 19 bp, Homo sapiens
gtcactcattgctgagcct

SEQ ID NO: 4932955 - DNA, 21 bp, Homo sapiens
gtcactcattgctgagcctct

SEQ ID NO: 4932956 - DNA, 12 bp, Homo sapiens
gtcctgcttctg

SEQ ID NO: 4932957 - DNA, 22 bp, Homo sapiens
gtcctggccagatggcccggat

SEQ ID NO: 4932958 - DNA, 17 bp, Homo sapiens
gtcctgggagacccatg

SEQ ID NO: 4932959 - DNA, 17 bp, Homo sapiens
gtcctgggagtgagctg

SEQ ID NO: 4932960 - DNA, 11 bp, Homo sapiens
gtccttgaaaa

SEQ ID NO: 4932961 - DNA, 19 bp, Homo sapiens
gtccttgcacccctcactc

SEQ ID NO: 4932962 - DNA, 17 bp, Homo sapiens
gtccttggaagtttcat

SEQ ID NO: 4932963 - DNA, 14 bp, Homo sapiens
gtcctttagtacct

SEQ ID NO: 4932964 - DNA, 21 bp, Homo sapiens
gtcctttatgtggaaaacaga

SEQ ID NO: 4932965 - DNA, 20 bp, Homo sapiens
gtcctttccaaggcttctcc

SEQ ID NO: 4932966 - DNA, 16 bp, Homo sapiens
gtcgaaagctctagaa

SEQ ID NO: 4932967 - DNA, 16 bp, Homo sapiens
gtcgaggacagggagg

SEQ ID NO: 4932968 - DNA, 16 bp, Homo sapiens
gtcgaggggctctcag

SEQ ID NO: 4932969 - DNA, 13 bp, Homo sapiens
gtcgcccagtctg

SEQ ID NO: 4932970 - DNA, 12 bp, Homo sapiens
gtcgcctctgca

SEQ ID NO: 4932971 - DNA, 14 bp, Homo sapiens
gtcgggcaccagcc

SEQ ID NO: 4932972 - DNA, 21 bp, Homo sapiens
gtctaaagatggagtttctaa

SEQ ID NO: 4932973 - DNA, 22 bp, Homo sapiens
gtctaaagatggagtttctaag

SEQ ID NO: 4932974 - DNA, 23 bp, Homo sapiens
gtctaaagatggagtttctaagg

SEQ ID NO: 4932975 - DNA, 23 bp, Homo sapiens
gtctaactttagaagtgcatttc

SEQ ID NO: 4932976 - DNA, 21 bp, Homo sapiens
gtctacactgcaatcatatgt

SEQ ID NO: 4932977 - DNA, 20 bp, Homo sapiens
gtctagattcaaaggttcta

SEQ ID NO: 4932978 - DNA, 14 bp, Homo sapiens
gtctagtctctcct

SEQ ID NO: 4932979 - DNA, 21 bp, Homo sapiens
gtctagttgccaaatctggct

SEQ ID NO: 4932980 - DNA, 23 bp, Homo sapiens
gtctagttgccaaatctggctcc

SEQ ID NO: 4932981 - DNA, 16 bp, Homo sapiens
gtctatttttgtctta

SEQ ID NO: 4932982 - DNA, 20 bp, Homo sapiens
gtctcaaactcctgggctca

SEQ ID NO: 4932983 - DNA, 22 bp, Homo sapiens
gtctcaaactcttgacctcagg

SEQ ID NO: 4932984 - DNA, 17 bp, Homo sapiens
gtctcaagagggcactg

SEQ ID NO: 4932985 - DNA, 23 bp, Homo sapiens
gtctcacagtgttgcccaggctg

SEQ ID NO: 4932986 - DNA, 19 bp, Homo sapiens
gtctcactatgttgcccag

SEQ ID NO: 4932987 - DNA, 20 bp, Homo sapiens
gtctcactatgttgcccagg

SEQ ID NO: 4932988 - DNA, 23 bp, Homo sapiens
gtctcactatgttgcccaggcag

SEQ ID NO: 4932989 - DNA, 16 bp, Homo sapiens
gtctcactctgtcgcc

SEQ ID NO: 4932990 - DNA, 19 bp, Homo sapiens
gtctcactctgtcgcccag

SEQ ID NO: 4932991 - DNA, 15 bp, Homo sapiens
gtctcactgaaacat

SEQ ID NO: 4932992 - DNA, 13 bp, Homo sapiens
gtctcactgttgc

SEQ ID NO: 4932993 - DNA, 18 bp, Homo sapiens
gtctcactgttgcccagg

SEQ ID NO: 4932994 - DNA, 21 bp, Homo sapiens
gtctcactgttgcccaggctg

SEQ ID NO: 4932995 - DNA, 18 bp, Homo sapiens
gtctcagggtgcagaggt

SEQ ID NO: 4932996 - DNA, 18 bp, Homo sapiens
gtctcagtttgtgtgtct

SEQ ID NO: 4932997 - DNA, 21 bp, Homo sapiens
gtctcagtttgtgtgtcttaa

SEQ ID NO: 4932998 - DNA, 15 bp, Homo sapiens
gtctcatccccaggg

SEQ ID NO: 4932999 - DNA, 12 bp, Homo sapiens
gtctccactgtg

SEQ ID NO: 4933000 - DNA, 14 bp, Homo sapiens
gtctcccttctgtt

SEQ ID NO: 4933001 - DNA, 14 bp, Homo sapiens
gtctcctactcctg

SEQ ID NO: 4933002 - DNA, 15 bp, Homo sapiens
gtctcctactcctga

SEQ ID NO: 4933003 - DNA, 14 bp, Homo sapiens
gtctcctccccttc

SEQ ID NO: 4933004 - DNA, 16 bp, Homo sapiens
gtctcctccccttccc

SEQ ID NO: 4933005 - DNA, 21 bp, Homo sapiens
gtctcctttctcagccacaaa

SEQ ID NO: 4933006 - DNA, 19 bp, Homo sapiens
gtctcgctttgttgcccag

SEQ ID NO: 4933007 - DNA, 23 bp, Homo sapiens
gtctcgctttgttgcccaggctg

SEQ ID NO: 4933008 - DNA, 14 bp, Homo sapiens
gtctctccctcagg

SEQ ID NO: 4933009 - DNA, 12 bp, Homo sapiens
gtctctcctttt

SEQ ID NO: 4933010 - DNA, 14 bp, Homo sapiens
gtctctccttttct

SEQ ID NO: 4933011 - DNA, 15 bp, Homo sapiens
gtctctctctctcta

SEQ ID NO: 4933012 - DNA, 17 bp, Homo sapiens
gtctctgctggcccagc

SEQ ID NO: 4933013 - DNA, 19 bp, Homo sapiens
gtctctggggcaggctgct

SEQ ID NO: 4933014 - DNA, 14 bp, Homo sapiens
gtctcttctccact

SEQ ID NO: 4933015 - DNA, 14 bp, Homo sapiens
gtctcttctcccag

SEQ ID NO: 4933016 - DNA, 17 bp, Homo sapiens
gtctcttctcccagaat

SEQ ID NO: 4933017 - DNA, 11 bp, Homo sapiens
gtctcttttgt

SEQ ID NO: 4933018 - DNA, 19 bp, Homo sapiens
gtctgaagtcactgcacag

SEQ ID NO: 4933019 - DNA, 14 bp, Homo sapiens
gtctgacaggcaat

SEQ ID NO: 4933020 - DNA, 20 bp, Homo sapiens
gtctgacaggcaatgctggc

SEQ ID NO: 4933021 - DNA, 16 bp, Homo sapiens
gtctgagccacagcag

SEQ ID NO: 4933022 - DNA, 21 bp, Homo sapiens
gtctgagccacagcagcattt

SEQ ID NO: 4933023 - DNA, 22 bp, Homo sapiens
gtctgagccacagcagcatttt

SEQ ID NO: 4933024 - DNA, 18 bp, Homo sapiens
gtctgatggatcccgaag

SEQ ID NO: 4933025 - DNA, 17 bp, Homo sapiens
gtctgattcccaagctc

SEQ ID NO: 4933026 - DNA, 18 bp, Homo sapiens
gtctgattcccaagctct

SEQ ID NO: 4933027 - DNA, 13 bp, Homo sapiens
gtctgctgaggag

SEQ ID NO: 4933028 - DNA, 16 bp, Homo sapiens
gtctggaatgcagtgg

SEQ ID NO: 4933029 - DNA, 12 bp, Homo sapiens
gtctggagtggg

SEQ ID NO: 4933030 - DNA, 13 bp, Homo sapiens
gtctggtgggagg

SEQ ID NO: 4933031 - DNA, 21 bp, Homo sapiens
gtctggttttaacaatttcct

SEQ ID NO: 4933032 - DNA, 14 bp, Homo sapiens
gtctgtacacgtgt

SEQ ID NO: 4933033 - DNA, 19 bp, Homo sapiens
gtctgtacacgtgtcctgt

SEQ ID NO: 4933034 - DNA, 21 bp, Homo sapiens
gtctgtacacgtgtcctgtag

SEQ ID NO: 4933035 - DNA, 23 bp, Homo sapiens
gtctgtatttatgtgtgaggagc

SEQ ID NO: 4933036 - DNA, 14 bp, Homo sapiens
gtctgtatttcatg

SEQ ID NO: 4933037 - DNA, 20 bp, Homo sapiens
gtctgtgtgcgctctgtgga

SEQ ID NO: 4933038 - DNA, 17 bp, Homo sapiens
gtctgttcacttttcct

SEQ ID NO: 4933039 - DNA, 22 bp, Homo sapiens
gtctgttgtgtgtcatgccagt

SEQ ID NO: 4933040 - DNA, 17 bp, Homo sapiens
gtctgtttaaagtggca

SEQ ID NO: 4933041 - DNA, 14 bp, Homo sapiens
gtctgtttaagaaa

SEQ ID NO: 4933042 - DNA, 23 bp, Homo sapiens
gtctgtttgtttcaagaacctgg

SEQ ID NO: 4933043 - DNA, 17 bp, Homo sapiens
gtcttcaaattgtcttt

SEQ ID NO: 4933044 - DNA, 20 bp, Homo sapiens
gtcttcaaattgtcttttgt

SEQ ID NO: 4933045 - DNA, 18 bp, Homo sapiens
gtcttcaacatcctgcca

SEQ ID NO: 4933046 - DNA, 19 bp, Homo sapiens
gtcttcaacatcctgccag

SEQ ID NO: 4933047 - DNA, 20 bp, Homo sapiens
gtcttcaacatcctgccagc

SEQ ID NO: 4933048 - DNA, 23 bp, Homo sapiens
gtcttccagggggaaggccaagg

SEQ ID NO: 4933049 - DNA, 18 bp, Homo sapiens
gtcttccctacctcaggc

SEQ ID NO: 4933050 - DNA, 19 bp, Homo sapiens
gtcttccgcccctgcctgc

SEQ ID NO: 4933051 - DNA, 18 bp, Homo sapiens
gtcttcctgaaatgcagt

SEQ ID NO: 4933052 - DNA, 14 bp, Homo sapiens
gtcttctaaacttc

SEQ ID NO: 4933053 - DNA, 13 bp, Homo sapiens
gtcttctaatttc

SEQ ID NO: 4933054 - DNA, 13 bp, Homo sapiens
gtcttctctgtct

SEQ ID NO: 4933055 - DNA, 18 bp, Homo sapiens
gtcttctggacaggctct

SEQ ID NO: 4933056 - DNA, 23 bp, Homo sapiens
gtcttctggacaggctctgcttc

SEQ ID NO: 4933057 - DNA, 16 bp, Homo sapiens
gtcttgaactcctggc

SEQ ID NO: 4933058 - DNA, 17 bp, Homo sapiens
gtcttgaactcctggcc

SEQ ID NO: 4933059 - DNA, 19 bp, Homo sapiens
gtcttgaatgtcttttgaa

SEQ ID NO: 4933060 - DNA, 16 bp, Homo sapiens
gtcttgcaatggcagc

SEQ ID NO: 4933061 - DNA, 17 bp, Homo sapiens
gtcttgcaatggcagcc

SEQ ID NO: 4933062 - DNA, 18 bp, Homo sapiens
gtcttgcaatggcagcct

SEQ ID NO: 4933063 - DNA, 14 bp, Homo sapiens
gtcttggacactgt

SEQ ID NO: 4933064 - DNA, 19 bp, Homo sapiens
gtcttgtaatattttgtat

SEQ ID NO: 4933065 - DNA, 20 bp, Homo sapiens
gtcttgtaatattttgtatt

SEQ ID NO: 4933066 - DNA, 20 bp, Homo sapiens
taattccaatatgatgactc

SEQ ID NO: 4933067 - DNA, 21 bp, Homo sapiens
taattcctatatcctgtgact

SEQ ID NO: 4933068 - DNA, 22 bp, Homo sapiens
taattcctctcactaaacttta

SEQ ID NO: 4933069 - DNA, 23 bp, Homo sapiens
taattctattaaagtgctaaggt

SEQ ID NO: 4933070 - DNA, 23 bp, Homo sapiens
taattcttcagcgtaaaatggtg

SEQ ID NO: 4933071 - DNA, 18 bp, Homo sapiens
taattgcatctcaaaatt

SEQ ID NO: 4933072 - DNA, 12 bp, Homo sapiens
taattgttgaaa

SEQ ID NO: 4933073 - DNA, 15 bp, Homo sapiens
taattgttgtttctt

SEQ ID NO: 4933074 - DNA, 19 bp, Homo sapiens
taattgttgtttctttcta

SEQ ID NO: 4933075 - DNA, 16 bp, Homo sapiens
taattgttttgcactt

SEQ ID NO: 4933076 - DNA, 19 bp, Homo sapiens
taatttaaacacctcctca

SEQ ID NO: 4933077 - DNA, 21 bp, Homo sapiens
taatttagggtactaaattta

SEQ ID NO: 4933078 - DNA, 21 bp, Homo sapiens
taatttagtgatcttagcata

SEQ ID NO: 4933079 - DNA, 16 bp, Homo sapiens
taatttcaaaatgctt

SEQ ID NO: 4933080 - DNA, 17 bp, Homo sapiens
taatttcgagatttgta

SEQ ID NO: 4933081 - DNA, 17 bp, Homo sapiens
taatttctaaagataat

SEQ ID NO: 4933082 - DNA, 18 bp, Homo sapiens
taatttctgtcagaatgc

SEQ ID NO: 4933083 - DNA, 22 bp, Homo sapiens
taatttcttcaaaatgtatata

SEQ ID NO: 4933084 - DNA, 14 bp, Homo sapiens
taatttgatgttta

SEQ ID NO: 4933085 - DNA, 17 bp, Homo sapiens
taatttgattaacaaat

SEQ ID NO: 4933086 - DNA, 14 bp, Homo sapiens
taattttacacatt

SEQ ID NO: 4933087 - DNA, 12 bp, Homo sapiens
taattttctcaa

SEQ ID NO: 4933088 - DNA, 13 bp, Homo sapiens
taattttctcaaa

SEQ ID NO: 4933089 - DNA, 19 bp, Homo sapiens
taattttctcaaaagcatt

SEQ ID NO: 4933090 - DNA, 22 bp, Homo sapiens
taattttctcaaaagcatttat

SEQ ID NO: 4933091 - DNA, 21 bp, Homo sapiens
taatttttaccctaatgtctt

SEQ ID NO: 4933092 - DNA, 17 bp, Homo sapiens
taattttttattcaagt

SEQ ID NO: 4933093 - DNA, 16 bp, Homo sapiens
taattttttttagtat

SEQ ID NO: 4933094 - DNA, 19 bp, Homo sapiens
tacaaaataaacaaataac

SEQ ID NO: 4933095 - DNA, 17 bp, Homo sapiens
tacaaatatattgttaa

SEQ ID NO: 4933096 - DNA, 21 bp, Homo sapiens
tacaaatgccttaaaatggaa

SEQ ID NO: 4933097 - DNA, 19 bp, Homo sapiens
tacaaattaaaaagattct

SEQ ID NO: 4933098 - DNA, 21 bp, Homo sapiens
tacaacataatctagtttaca

SEQ ID NO: 4933099 - DNA, 17 bp, Homo sapiens
tacaacctccctcttgt

SEQ ID NO: 4933100 - DNA, 23 bp, Homo sapiens
tacaactgcctcgaaacacagaa

SEQ ID NO: 4933101 - DNA, 22 bp, Homo sapiens
tacaagaagtttattctcattt

SEQ ID NO: 4933102 - DNA, 21 bp, Homo sapiens
tacaagattagaagctgaaaa

SEQ ID NO: 4933103 - DNA, 17 bp, Homo sapiens
tacaagatttagaaaaa

SEQ ID NO: 4933104 - DNA, 21 bp, Homo sapiens
tacaagccattctaaggaaat

SEQ ID NO: 4933105 - DNA, 21 bp, Homo sapiens
tacaagcgtgagccactgcac

SEQ ID NO: 4933106 - DNA, 20 bp, Homo sapiens
tacaagtatacttatatttc

SEQ ID NO: 4933107 - DNA, 15 bp, Homo sapiens
tacaagtgtatatca

SEQ ID NO: 4933108 - DNA, 21 bp, Homo sapiens
tacaagtgtatatcagaaaag

SEQ ID NO: 4933109 - DNA, 18 bp, Homo sapiens
tacaataattcatattct

SEQ ID NO: 4933110 - DNA, 15 bp, Homo sapiens
tacaatcgcaaatca

SEQ ID NO: 4933111 - DNA, 21 bp, Homo sapiens
tacaatgaacacttataagtg

SEQ ID NO: 4933112 - DNA, 17 bp, Homo sapiens
tacaatgtcatatactg

SEQ ID NO: 4933113 - DNA, 18 bp, Homo sapiens
tacaattctacattgtca

SEQ ID NO: 4933114 - DNA, 22 bp, Homo sapiens
tacaattgtgggcataaactgt

SEQ ID NO: 4933115 - DNA, 14 bp, Homo sapiens
tacacaataagcaa

SEQ ID NO: 4933116 - DNA, 15 bp, Homo sapiens
tacacaataagcaaa

SEQ ID NO: 4933117 - DNA, 13 bp, Homo sapiens
tacacaattctta

SEQ ID NO: 4933118 - DNA, 16 bp, Homo sapiens
tacacacacagatgtg

SEQ ID NO: 4933119 - DNA, 15 bp, Homo sapiens
tacacacacatacac

SEQ ID NO: 4933120 - DNA, 18 bp, Homo sapiens
tacacactggtacttaga

SEQ ID NO: 4933121 - DNA, 15 bp, Homo sapiens
tacacagaaacactg

SEQ ID NO: 4933122 - DNA, 18 bp, Homo sapiens
tacacagaaacactgcct

SEQ ID NO: 4933123 - DNA, 23 bp, Homo sapiens
tacacatacagttttatgctctt

SEQ ID NO: 4933124 - DNA, 14 bp, Homo sapiens
tacacattagattt

SEQ ID NO: 4933125 - DNA, 15 bp, Homo sapiens
tacacatttgtacag

SEQ ID NO: 4933126 - DNA, 16 bp, Homo sapiens
tacacatttgtacaga

SEQ ID NO: 4933127 - DNA, 15 bp, Homo sapiens
tacaccgggcctgga

SEQ ID NO: 4933128 - DNA, 23 bp, Homo sapiens
tacacctaaaggtgtatttaaac

SEQ ID NO: 4933129 - DNA, 16 bp, Homo sapiens
tacacgaaagagagag

SEQ ID NO: 4933130 - DNA, 13 bp, Homo sapiens
tacacgtgtcctg

SEQ ID NO: 4933131 - DNA, 16 bp, Homo sapiens
tacactgcctgtatac

SEQ ID NO: 4933132 - DNA, 16 bp, Homo sapiens
tacacttgtataaatg

SEQ ID NO: 4933133 - DNA, 17 bp, Homo sapiens
tacacttgtataaatgt

SEQ ID NO: 4933134 - DNA, 19 bp, Homo sapiens
tacacttgtataaatgtat

SEQ ID NO: 4933135 - DNA, 15 bp, Homo sapiens
tacacttttatgagc

SEQ ID NO: 4933136 - DNA, 14 bp, Homo sapiens
tacagacctgcttt

SEQ ID NO: 4933137 - DNA, 11 bp, Homo sapiens
tacagaggaaa

SEQ ID NO: 4933138 - DNA, 18 bp, Homo sapiens
tacagaggccatgggcct

SEQ ID NO: 4933139 - DNA, 22 bp, Homo sapiens
tacagatgaatgtatttatttg

SEQ ID NO: 4933140 - DNA, 19 bp, Homo sapiens
tacagcactactgggtgtc

SEQ ID NO: 4933141 - DNA, 21 bp, Homo sapiens
tacagccaagtgccaaatgct

SEQ ID NO: 4933142 - DNA, 11 bp, Homo sapiens
tacagctcccc

SEQ ID NO: 4933143 - DNA, 14 bp, Homo sapiens
tacagctgcctgca

SEQ ID NO: 4933144 - DNA, 16 bp, Homo sapiens
tacagctgtttaagat

SEQ ID NO: 4933145 - DNA, 21 bp, Homo sapiens
tacagctttacacacacagat

SEQ ID NO: 4933146 - DNA, 23 bp, Homo sapiens
tacagctttcttgctcccttcag

SEQ ID NO: 4933147 - DNA, 19 bp, Homo sapiens
tacaggaaaagctgctgac

SEQ ID NO: 4933148 - DNA, 15 bp, Homo sapiens
tacaggcagtctctc

SEQ ID NO: 4933149 - DNA, 19 bp, Homo sapiens
tacaggccctgctcctgca

SEQ ID NO: 4933150 - DNA, 13 bp, Homo sapiens
tacagggttttta

SEQ ID NO: 4933151 - DNA, 15 bp, Homo sapiens
tacagggtttttacc

SEQ ID NO: 4933152 - DNA, 23 bp, Homo sapiens
tacagtaactttatgtgtaaata

SEQ ID NO: 4933153 - DNA, 18 bp, Homo sapiens
tacagttttatgctcttt

SEQ ID NO: 4933154 - DNA, 15 bp, Homo sapiens
tacataaaagaattt

SEQ ID NO: 4933155 - DNA, 12 bp, Homo sapiens
tacataaattgg

SEQ ID NO: 4933156 - DNA, 18 bp, Homo sapiens
tacataacaagaaaatca

SEQ ID NO: 4933157 - DNA, 22 bp, Homo sapiens
tacataagcggcgtaagtttaa

SEQ ID NO: 4933158 - DNA, 20 bp, Homo sapiens
tacataatgcttaatttcta

SEQ ID NO: 4933159 - DNA, 21 bp, Homo sapiens
tacataatgcttaatttctaa

SEQ ID NO: 4933160 - DNA, 22 bp, Homo sapiens
tacataccctggccgccccctg

SEQ ID NO: 4933161 - DNA, 22 bp, Homo sapiens
tacatacggtcaggtttaacat

SEQ ID NO: 4933162 - DNA, 21 bp, Homo sapiens
tacatagatttatttttcagt

SEQ ID NO: 4933163 - DNA, 12 bp, Homo sapiens
tacatagtgtaa

SEQ ID NO: 4933164 - DNA, 15 bp, Homo sapiens
tacatagttttaaac

SEQ ID NO: 4933165 - DNA, 19 bp, Homo sapiens
tacatagttttaaactcat

SEQ ID NO: 4933166 - DNA, 17 bp, Homo sapiens
tacatatcgctgacttc

SEQ ID NO: 4933167 - DNA, 22 bp, Homo sapiens
tacatatcgctgacttcatgga

SEQ ID NO: 4933168 - DNA, 23 bp, Homo sapiens
tacatatgtagactatatacatg

SEQ ID NO: 4933169 - DNA, 17 bp, Homo sapiens
tacatatttgagactag

SEQ ID NO: 4933170 - DNA, 20 bp, Homo sapiens
tacatctattttggattgta

SEQ ID NO: 4933171 - DNA, 20 bp, Homo sapiens
tacatctggcttattttaat

SEQ ID NO: 4933172 - DNA, 12 bp, Homo sapiens
tacatgaaacag

SEQ ID NO: 4933173 - DNA, 15 bp, Homo sapiens
tacatgaaacagaaa

SEQ ID NO: 4933174 - DNA, 23 bp, Homo sapiens
tacatgaggaactgtagatgatg

SEQ ID NO: 4933175 - DNA, 16 bp, Homo sapiens
tactcagcctgctgcc

SEQ ID NO: 4933176 - DNA, 15 bp, Homo sapiens
tactcagggctcctc

SEQ ID NO: 4933177 - DNA, 16 bp, Homo sapiens
tactcagggctcctcc

SEQ ID NO: 4933178 - DNA, 17 bp, Homo sapiens
tactcagggctcctccc

SEQ ID NO: 4933179 - DNA, 18 bp, Homo sapiens
tactcagggctcctccca

SEQ ID NO: 4933180 - DNA, 19 bp, Homo sapiens
tactcagggctcctcccag

SEQ ID NO: 4933181 - DNA, 14 bp, Homo sapiens
tactcattgaaatg

SEQ ID NO: 4933182 - DNA, 16 bp, Homo sapiens
tactcattgaaatgtc

SEQ ID NO: 4933183 - DNA, 18 bp, Homo sapiens
tactccctgcagatgcca

SEQ ID NO: 4933184 - DNA, 20 bp, Homo sapiens
tactcctatttttgtaaact

SEQ ID NO: 4933185 - DNA, 15 bp, Homo sapiens
tactcctcctctttc

SEQ ID NO: 4933186 - DNA, 18 bp, Homo sapiens
tactcctcctctttctct

SEQ ID NO: 4933187 - DNA, 17 bp, Homo sapiens
tactcctctttacactg

SEQ ID NO: 4933188 - DNA, 18 bp, Homo sapiens
tactctaagatcttagat

SEQ ID NO: 4933189 - DNA, 21 bp, Homo sapiens
tactctggggtgctgcctgaa

SEQ ID NO: 4933190 - DNA, 23 bp, Homo sapiens
tactctggggtgctgcctgaatc

SEQ ID NO: 4933191 - DNA, 19 bp, Homo sapiens
tactctgtccatttatcca

SEQ ID NO: 4933192 - DNA, 14 bp, Homo sapiens
tactctttctgtat

SEQ ID NO: 4933193 - DNA, 16 bp, Homo sapiens
tactctttctgtatat

SEQ ID NO: 4933194 - DNA, 20 bp, Homo sapiens
tactgagtatgtggaaggca

SEQ ID NO: 4933195 - DNA, 18 bp, Homo sapiens
tactgattcactgcatgg

SEQ ID NO: 4933196 - DNA, 15 bp, Homo sapiens
tactgatttttgtga

SEQ ID NO: 4933197 - DNA, 20 bp, Homo sapiens
tactgcagcctttgcctccc

SEQ ID NO: 4933198 - DNA, 20 bp, Homo sapiens
tactgcccaggcctgcctgt

SEQ ID NO: 4933199 - DNA, 15 bp, Homo sapiens
tactgctcaggctgc

SEQ ID NO: 4933200 - DNA, 22 bp, Homo sapiens
tactgctcaggctgcagctgga

SEQ ID NO: 4933201 - DNA, 19 bp, Homo sapiens
tactggagcttcattttgg

SEQ ID NO: 4933202 - DNA, 12 bp, Homo sapiens
tactgggcctta

SEQ ID NO: 4933203 - DNA, 23 bp, Homo sapiens
tactgggccttagtgggccaggg

SEQ ID NO: 4933204 - DNA, 22 bp, Homo sapiens
tactgggtgtcatttcattcca

SEQ ID NO: 4933205 - DNA, 17 bp, Homo sapiens
tactgtaataatacctc

SEQ ID NO: 4933206 - DNA, 13 bp, Homo sapiens
tactgtaattcct

SEQ ID NO: 4933207 - DNA, 16 bp, Homo sapiens
tactgtaattcctcaa

SEQ ID NO: 4933208 - DNA, 15 bp, Homo sapiens
tactgtactaattct

SEQ ID NO: 4933209 - DNA, 14 bp, Homo sapiens
tactgtctcactga

SEQ ID NO: 4933210 - DNA, 22 bp, Homo sapiens
tactgtctcactgaaacattta

SEQ ID NO: 4933211 - DNA, 15 bp, Homo sapiens
tactgtctgattggc

SEQ ID NO: 4933212 - DNA, 16 bp, Homo sapiens
tactgtctggttttaa

SEQ ID NO: 4933213 - DNA, 19 bp, Homo sapiens
tactgtctggttttaacaa

SEQ ID NO: 4933214 - DNA, 15 bp, Homo sapiens
tactgtgaaactggc

SEQ ID NO: 4933215 - DNA, 16 bp, Homo sapiens
tactgtggaggaagga

SEQ ID NO: 4933216 - DNA, 18 bp, Homo sapiens
tactgtggaggaaggatt

SEQ ID NO: 4933217 - DNA, 12 bp, Homo sapiens
tactgtgtactg

SEQ ID NO: 4933218 - DNA, 19 bp, Homo sapiens
tactgtgtggaacttttat

SEQ ID NO: 4933219 - DNA, 14 bp, Homo sapiens
tactgtgtgtgtga

SEQ ID NO: 4933220 - DNA, 18 bp, Homo sapiens
tactgtgtgtgtgaatga

SEQ ID NO: 4933221 - DNA, 12 bp, Homo sapiens
tactgttctaaa

SEQ ID NO: 4933222 - DNA, 15 bp, Homo sapiens
tactgttctaaagct

SEQ ID NO: 4933223 - DNA, 10 bp, Homo sapiens
tactgttctt

SEQ ID NO: 4933224 - DNA, 17 bp, Homo sapiens
tactgttcttcatttta

SEQ ID NO: 4933225 - DNA, 12 bp, Homo sapiens
tactgttcttgc

SEQ ID NO: 4933226 - DNA, 15 bp, Homo sapiens
tactgttcttgctgc

SEQ ID NO: 4933227 - DNA, 18 bp, Homo sapiens
tactgttcttgctgctag

SEQ ID NO: 4933228 - DNA, 22 bp, Homo sapiens
tactgttcttgctgctagaact

SEQ ID NO: 4933229 - DNA, 15 bp, Homo sapiens
tactgtttatttctg

SEQ ID NO: 4933230 - DNA, 23 bp, Homo sapiens
tactgtttatttctgtttctcat

SEQ ID NO: 4933231 - DNA, 21 bp, Homo sapiens
tacttaaaaaaaaaaaaaagc

SEQ ID NO: 4933232 - DNA, 23 bp, Homo sapiens
tacttaaaaaaaaaaaaaagctt

SEQ ID NO: 4933233 - DNA, 14 bp, Homo sapiens
tacttaagagaaat

SEQ ID NO: 4933234 - DNA, 19 bp, Homo sapiens
tacttaagagaaatggcaa

SEQ ID NO: 4933235 - DNA, 17 bp, Homo sapiens
tacttactaaaatatat

SEQ ID NO: 4933236 - DNA, 16 bp, Homo sapiens
tacttagagtttctgt

SEQ ID NO: 4933237 - DNA, 18 bp, Homo sapiens
tacttagagtttctgttt

SEQ ID NO: 4933238 - DNA, 19 bp, Homo sapiens
tacttagagtttctgtttg

SEQ ID NO: 4933239 - DNA, 18 bp, Homo sapiens
tacttagcaaagttttac

SEQ ID NO: 4933240 - DNA, 15 bp, Homo sapiens
tacttagcatcctaa

SEQ ID NO: 4933241 - DNA, 22 bp, Homo sapiens
tacttatattttcgtatgaaaa

SEQ ID NO: 4933242 - DNA, 23 bp, Homo sapiens
tacttatattttcgtatgaaaat

SEQ ID NO: 4933243 - DNA, 19 bp, Homo sapiens
tacttcaggggcacttcat

SEQ ID NO: 4933244 - DNA, 14 bp, Homo sapiens
tacttcctcctccc

SEQ ID NO: 4933245 - DNA, 20 bp, Homo sapiens
tacttctccaccctgctctc

SEQ ID NO: 4933246 - DNA, 20 bp, Homo sapiens
tacttggtttgtgttcttct

SEQ ID NO: 4933247 - DNA, 14 bp, Homo sapiens
tacttgtggacaca

SEQ ID NO: 4933248 - DNA, 18 bp, Homo sapiens
tactttatcactttttga

SEQ ID NO: 4933249 - DNA, 15 bp, Homo sapiens
tactttcccttgctt

SEQ ID NO: 4933250 - DNA, 23 bp, Homo sapiens
tactttcccttgcttttccctct

SEQ ID NO: 4933251 - DNA, 18 bp, Homo sapiens
tactttggtttctgtctg

SEQ ID NO: 4933252 - DNA, 13 bp, Homo sapiens
tacttttgagtgt

SEQ ID NO: 4933253 - DNA, 18 bp, Homo sapiens
tactttttcttttgtaag

SEQ ID NO: 4933254 - DNA, 13 bp, Homo sapiens
tactttttgttat

SEQ ID NO: 4933255 - DNA, 15 bp, Homo sapiens
tagaaaaaaattact

SEQ ID NO: 4933256 - DNA, 18 bp, Homo sapiens
tagaaaaaagtttacaac

SEQ ID NO: 4933257 - DNA, 21 bp, Homo sapiens
tagaaaaagggtcaatgctat

SEQ ID NO: 4933258 - DNA, 15 bp, Homo sapiens
tagaaaacaatgcaa

SEQ ID NO: 4933259 - DNA, 13 bp, Homo sapiens
tagaaaactgaaa

SEQ ID NO: 4933260 - DNA, 21 bp, Homo sapiens
tagaaaactgaaaatctaata

SEQ ID NO: 4933261 - DNA, 21 bp, Homo sapiens
tagaaaatagagcttttaaaa

SEQ ID NO: 4933262 - DNA, 12 bp, Homo sapiens
tagaaaatgtgt

SEQ ID NO: 4933263 - DNA, 24 bp, Homo sapiens
tagaaaatgtgtcctatctatctt

SEQ ID NO: 4933264 - DNA, 20 bp, Homo sapiens
tagaaacccaagctcctcct

SEQ ID NO: 4933265 - DNA, 15 bp, Homo sapiens
tagaaagcaggggct

SEQ ID NO: 4933266 - DNA, 14 bp, Homo sapiens
tagaaatagtttga

SEQ ID NO: 4933267 - DNA, 16 bp, Homo sapiens
tagaaatgtaaactgc

SEQ ID NO: 4933268 - DNA, 18 bp, Homo sapiens
tagaaatgtaaactgcca

SEQ ID NO: 4933269 - DNA, 19 bp, Homo sapiens
tagaaatgtaaactgccat

SEQ ID NO: 4933270 - DNA, 20 bp, Homo sapiens
tagaacaaaggacagagtat

SEQ ID NO: 4933271 - DNA, 20 bp, Homo sapiens
tagaactgtatgtcagacat

SEQ ID NO: 4933272 - DNA, 15 bp, Homo sapiens
tagaacttactattc

SEQ ID NO: 4933273 - DNA, 17 bp, Homo sapiens
tagaacttttttaaata

SEQ ID NO: 4933274 - DNA, 23 bp, Homo sapiens
tagaacttttttaaataaacttt

SEQ ID NO: 4933275 - DNA, 15 bp, Homo sapiens
tagaataaagttgaa

SEQ ID NO: 4933276 - DNA, 19 bp, Homo sapiens
tagaatataggtctcttct

SEQ ID NO: 4933277 - DNA, 22 bp, Homo sapiens
tagaatataggtctcttctccc

SEQ ID NO: 4933278 - DNA, 15 bp, Homo sapiens
tagaatctattttct

SEQ ID NO: 4933279 - DNA, 18 bp, Homo sapiens
tagaatctattttctatg

SEQ ID NO: 4933280 - DNA, 19 bp, Homo sapiens
tagaatctattttctatgt

SEQ ID NO: 4933281 - DNA, 18 bp, Homo sapiens
tagaatctgcaattcaaa

SEQ ID NO: 4933282 - DNA, 17 bp, Homo sapiens
tagaatgaaaactcatt

SEQ ID NO: 4933283 - DNA, 16 bp, Homo sapiens
tagaatgatttcatgc

SEQ ID NO: 4933284 - DNA, 14 bp, Homo sapiens
tagaattgcattga

SEQ ID NO: 4933285 - DNA, 23 bp, Homo sapiens
tagtggaaaaacacatggggaaa

SEQ ID NO: 4933286 - DNA, 15 bp, Homo sapiens
tagtgggccagggct

SEQ ID NO: 4933287 - DNA, 13 bp, Homo sapiens
tagtggtctttgt

SEQ ID NO: 4933288 - DNA, 18 bp, Homo sapiens
tagtggtctttgtaagag

SEQ ID NO: 4933289 - DNA, 11 bp, Homo sapiens
tagtgtaaaat

SEQ ID NO: 4933290 - DNA, 13 bp, Homo sapiens
tagtgtaaaataa

SEQ ID NO: 4933291 - DNA, 14 bp, Homo sapiens
tagtgtaataagac

SEQ ID NO: 4933292 - DNA, 17 bp, Homo sapiens
tagtgtaataagactta

SEQ ID NO: 4933293 - DNA, 12 bp, Homo sapiens
tagtgttctgtt

SEQ ID NO: 4933294 - DNA, 19 bp, Homo sapiens
tagtgttttaagaaatgta

SEQ ID NO: 4933295 - DNA, 20 bp, Homo sapiens
tagttaacatagtaagttca

SEQ ID NO: 4933296 - DNA, 23 bp, Homo sapiens
tagttaagacatgatttccttga

SEQ ID NO: 4933297 - DNA, 16 bp, Homo sapiens
tagttaatttatctaa

SEQ ID NO: 4933298 - DNA, 15 bp, Homo sapiens
tagttaggatagcat

SEQ ID NO: 4933299 - DNA, 19 bp, Homo sapiens
tagttccctctgctcagcc

SEQ ID NO: 4933300 - DNA, 14 bp, Homo sapiens
tagttctaagactc

SEQ ID NO: 4933301 - DNA, 18 bp, Homo sapiens
tagttgtcagtattattc

SEQ ID NO: 4933302 - DNA, 17 bp, Homo sapiens
tagttgtctctcttcag

SEQ ID NO: 4933303 - DNA, 16 bp, Homo sapiens
tagttgttttaagtac

SEQ ID NO: 4933304 - DNA, 20 bp, Homo sapiens
tagtttacagaaaaatcttg

SEQ ID NO: 4933305 - DNA, 17 bp, Homo sapiens
tagtttacctctttaaa

SEQ ID NO: 4933306 - DNA, 13 bp, Homo sapiens
tagtttactgttt

SEQ ID NO: 4933307 - DNA, 14 bp, Homo sapiens
tagtttactgtttt

SEQ ID NO: 4933308 - DNA, 13 bp, Homo sapiens
tagtttctgaggc

SEQ ID NO: 4933309 - DNA, 12 bp, Homo sapiens
tagtttcttgtg

SEQ ID NO: 4933310 - DNA, 17 bp, Homo sapiens
tagtttgtataacttct

SEQ ID NO: 4933311 - DNA, 22 bp, Homo sapiens
tagtttgtctattttaaaataa

SEQ ID NO: 4933312 - DNA, 20 bp, Homo sapiens
tagtttttacagctgtgtta

SEQ ID NO: 4933313 - DNA, 23 bp, Homo sapiens
tagttttttttttttttatgtga

SEQ ID NO: 4933314 - DNA, 14 bp, Homo sapiens
tataaaaagccact

SEQ ID NO: 4933315 - DNA, 18 bp, Homo sapiens
tataaaaagcttccatga

SEQ ID NO: 4933316 - DNA, 13 bp, Homo sapiens
tataaaaatatat

SEQ ID NO: 4933317 - DNA, 19 bp, Homo sapiens
tataaaaggcaaatgtgta

SEQ ID NO: 4933318 - DNA, 20 bp, Homo sapiens
tataaaaggcaaatgtgtac

SEQ ID NO: 4933319 - DNA, 18 bp, Homo sapiens
tataaaatataaacaaag

SEQ ID NO: 4933320 - DNA, 19 bp, Homo sapiens
tataaaatataaacaaaga

SEQ ID NO: 4933321 - DNA, 18 bp, Homo sapiens
tataaaattagaaagcaa

SEQ ID NO: 4933322 - DNA, 17 bp, Homo sapiens
tataaacatcacacaca

SEQ ID NO: 4933323 - DNA, 18 bp, Homo sapiens
tataaacattaaatgtct

SEQ ID NO: 4933324 - DNA, 19 bp, Homo sapiens
tataaagaagaacttgcat

SEQ ID NO: 4933325 - DNA, 17 bp, Homo sapiens
tataaagagaagacgaa

SEQ ID NO: 4933326 - DNA, 23 bp, Homo sapiens
tataaagcgatatacagatgaaa

SEQ ID NO: 4933327 - DNA, 21 bp, Homo sapiens
tataaagggggagggaaatag

SEQ ID NO: 4933328 - DNA, 18 bp, Homo sapiens
tataaagtatagagagaa

SEQ ID NO: 4933329 - DNA, 19 bp, Homo sapiens
tataaagtatagagagaag

SEQ ID NO: 4933330 - DNA, 20 bp, Homo sapiens
tataaagtatagagagaagt

SEQ ID NO: 4933331 - DNA, 13 bp, Homo sapiens
tataaataggaga

SEQ ID NO: 4933332 - DNA, 17 bp, Homo sapiens
tataaatataagccttt

SEQ ID NO: 4933333 - DNA, 15 bp, Homo sapiens
tataaatgtgatatg

SEQ ID NO: 4933334 - DNA, 11 bp, Homo sapiens
tataaattctg

SEQ ID NO: 4933335 - DNA, 17 bp, Homo sapiens
tataaattctgtgggtc

SEQ ID NO: 4933336 - DNA, 20 bp, Homo sapiens
tataacagatacatttccct

SEQ ID NO: 4933337 - DNA, 15 bp, Homo sapiens
tataaccccagctcc

SEQ ID NO: 4933338 - DNA, 14 bp, Homo sapiens
tataagatcctaga

SEQ ID NO: 4933339 - DNA, 19 bp, Homo sapiens
tataagatcctagatccta

SEQ ID NO: 4933340 - DNA, 22 bp, Homo sapiens
tataagcaaatttcaaaagaca

SEQ ID NO: 4933341 - DNA, 17 bp, Homo sapiens
tataagtgcacacagaa

SEQ ID NO: 4933342 - DNA, 21 bp, Homo sapiens
tataagtgcacacagaaatat

SEQ ID NO: 4933343 - DNA, 16 bp, Homo sapiens
tataagtttgaaggaa

SEQ ID NO: 4933344 - DNA, 12 bp, Homo sapiens
tataataaacat

SEQ ID NO: 4933345 - DNA, 14 bp, Homo sapiens
tataatactctgtt

SEQ ID NO: 4933346 - DNA, 17 bp, Homo sapiens
tataatagcaacttttg

SEQ ID NO: 4933347 - DNA, 13 bp, Homo sapiens
tataatctgtcaa

SEQ ID NO: 4933348 - DNA, 19 bp, Homo sapiens
tataatctgtcaaaacact

SEQ ID NO: 4933349 - DNA, 23 bp, Homo sapiens
tataatctgtcaaaacactgtgg

SEQ ID NO: 4933350 - DNA, 11 bp, Homo sapiens
tataatgaacc

SEQ ID NO: 4933351 - DNA, 19 bp, Homo sapiens
tataatgtgtgtatgtgta

SEQ ID NO: 4933352 - DNA, 20 bp, Homo sapiens
tataatgtgtgtatgtgtat

SEQ ID NO: 4933353 - DNA, 20 bp, Homo sapiens
tataatttcgagatttgtag

SEQ ID NO: 4933354 - DNA, 21 bp, Homo sapiens
tatacaaaataagaacgagga

SEQ ID NO: 4933355 - DNA, 18 bp, Homo sapiens
tatacaaattaaaaagat

SEQ ID NO: 4933356 - DNA, 21 bp, Homo sapiens
tatacaaccctggcattatgt

SEQ ID NO: 4933357 - DNA, 19 bp, Homo sapiens
tatacaatatataaaaata

SEQ ID NO: 4933358 - DNA, 15 bp, Homo sapiens
tatacacatatacct

SEQ ID NO: 4933359 - DNA, 19 bp, Homo sapiens
tatacagatgaaaatttga

SEQ ID NO: 4933360 - DNA, 16 bp, Homo sapiens
tatacagtaactttat

SEQ ID NO: 4933361 - DNA, 18 bp, Homo sapiens
tatacagtaactttatgt

SEQ ID NO: 4933362 - DNA, 20 bp, Homo sapiens
tatacagtaactttatgtgt

SEQ ID NO: 4933363 - DNA, 22 bp, Homo sapiens
tatacagtaactttatgtgtaa

SEQ ID NO: 4933364 - DNA, 15 bp, Homo sapiens
tatacatacacttgt

SEQ ID NO: 4933365 - DNA, 15 bp, Homo sapiens
tatacatatgtagac

SEQ ID NO: 4933366 - DNA, 23 bp, Homo sapiens
tatacatatgtagactatataca

SEQ ID NO: 4933367 - DNA, 15 bp, Homo sapiens
tatacatcctgggta

SEQ ID NO: 4933368 - DNA, 15 bp, Homo sapiens
tatacatgtgtgtat

SEQ ID NO: 4933369 - DNA, 18 bp, Homo sapiens
tatacatgtgtgtatata

SEQ ID NO: 4933370 - DNA, 19 bp, Homo sapiens
tatacatgtgtgtatatat

SEQ ID NO: 4933371 - DNA, 19 bp, Homo sapiens
tatacattagtaaatgtct

SEQ ID NO: 4933372 - DNA, 15 bp, Homo sapiens
tatacctataatgtg

SEQ ID NO: 4933373 - DNA, 17 bp, Homo sapiens
tatacctataatgtgtg

SEQ ID NO: 4933374 - DNA, 19 bp, Homo sapiens
tatacctataatgtgtgta

SEQ ID NO: 4933375 - DNA, 17 bp, Homo sapiens
tatactatagtaccagt

SEQ ID NO: 4933376 - DNA, 17 bp, Homo sapiens
tatactgattatgtctt

SEQ ID NO: 4933377 - DNA, 20 bp, Homo sapiens
tatactgattatgtctttta

SEQ ID NO: 4933378 - DNA, 22 bp, Homo sapiens
tatactgtaatttagttattga

SEQ ID NO: 4933379 - DNA, 13 bp, Homo sapiens
tatacttgaacaa

SEQ ID NO: 4933380 - DNA, 23 bp, Homo sapiens
tatacttgaacaaaagggtcaga

SEQ ID NO: 4933381 - DNA, 19 bp, Homo sapiens
tatacttgtggttttcaaa

SEQ ID NO: 4933382 - DNA, 14 bp, Homo sapiens
tatactttaaataa

SEQ ID NO: 4933383 - DNA, 16 bp, Homo sapiens
tatactttaaataatt

SEQ ID NO: 4933384 - DNA, 12 bp, Homo sapiens
tatactttagta

SEQ ID NO: 4933385 - DNA, 20 bp, Homo sapiens
tatactttgtggaccaatta

SEQ ID NO: 4933386 - DNA, 19 bp, Homo sapiens
tatagaaatatatacgaac

SEQ ID NO: 4933387 - DNA, 21 bp, Homo sapiens
tatagaaatatatacgaacaa

SEQ ID NO: 4933388 - DNA, 14 bp, Homo sapiens
tatagacagtttgt

SEQ ID NO: 4933389 - DNA, 21 bp, Homo sapiens
tatagacagtttgtaaatgtt

SEQ ID NO: 4933390 - DNA, 22 bp, Homo sapiens
tatagagatgtttttaaaagtt

SEQ ID NO: 4933391 - DNA, 16 bp, Homo sapiens
tatagagttcatccca

SEQ ID NO: 4933392 - DNA, 17 bp, Homo sapiens
tatagagttcatcccag

SEQ ID NO: 4933393 - DNA, 16 bp, Homo sapiens
tatagattagaaaaat

SEQ ID NO: 4933394 - DNA, 12 bp, Homo sapiens
tatagattctaa

SEQ ID NO: 4933395 - DNA, 15 bp, Homo sapiens
tatagcactttgaaa

SEQ ID NO: 4933396 - DNA, 22 bp, Homo sapiens
tatagcagcaaaaatataaaat

SEQ ID NO: 4933397 - DNA, 20 bp, Homo sapiens
tatagcctaggtgacagagt

SEQ ID NO: 4933398 - DNA, 22 bp, Homo sapiens
tatagctacaggaagcacccca

SEQ ID NO: 4933399 - DNA, 11 bp, Homo sapiens
tatagctatta

SEQ ID NO: 4933400 - DNA, 20 bp, Homo sapiens
tataggtctcttctcccaga

SEQ ID NO: 4933401 - DNA, 16 bp, Homo sapiens
tatagtacatgataaa

SEQ ID NO: 4933402 - DNA, 16 bp, Homo sapiens
tatagtgcacaaaatg

SEQ ID NO: 4933403 - DNA, 18 bp, Homo sapiens
tatagtgcacaaaatgaa

SEQ ID NO: 4933404 - DNA, 13 bp, Homo sapiens
tatagtttcagat

SEQ ID NO: 4933405 - DNA, 22 bp, Homo sapiens
tatagtttctgaggctttatga

SEQ ID NO: 4933406 - DNA, 14 bp, Homo sapiens
tatataaaaatata

SEQ ID NO: 4933407 - DNA, 18 bp, Homo sapiens
tatataaaaatatatata

SEQ ID NO: 4933408 - DNA, 14 bp, Homo sapiens
tatatacacatata

SEQ ID NO: 4933409 - DNA, 14 bp, Homo sapiens
tatatacagtaact

SEQ ID NO: 4933410 - DNA, 13 bp, Homo sapiens
tatatacatgtgt

SEQ ID NO: 4933411 - DNA, 18 bp, Homo sapiens
tatatacatgtgtgtata

SEQ ID NO: 4933412 - DNA, 21 bp, Homo sapiens
tatatacttgtggttttcaaa

SEQ ID NO: 4933413 - DNA, 13 bp, Homo sapiens
tatatagaatgct

SEQ ID NO: 4933414 - DNA, 13 bp, Homo sapiens
tatatagagatgt

SEQ ID NO: 4933415 - DNA, 16 bp, Homo sapiens
tatatagagatgtttt

SEQ ID NO: 4933416 - DNA, 17 bp, Homo sapiens
tatatagtgctatatat

SEQ ID NO: 4933417 - DNA, 13 bp, Homo sapiens
tatatataaagta

SEQ ID NO: 4933418 - DNA, 11 bp, Homo sapiens
tatatatacat

SEQ ID NO: 4933419 - DNA, 19 bp, Homo sapiens
tatatatagtgctatatat

SEQ ID NO: 4933420 - DNA, 14 bp, Homo sapiens
tatatatataaata

SEQ ID NO: 4933421 - DNA, 15 bp, Homo sapiens
tatatatataatata

SEQ ID NO: 4933422 - DNA, 19 bp, Homo sapiens
tatatatctgcttcagtgg

SEQ ID NO: 4933423 - DNA, 22 bp, Homo sapiens
tatatatgaaaactatacaaca

SEQ ID NO: 4933424 - DNA, 15 bp, Homo sapiens
tatatatgccttttt

SEQ ID NO: 4933425 - DNA, 19 bp, Homo sapiens
tatatatgcctttttccta

SEQ ID NO: 4933426 - DNA, 12 bp, Homo sapiens
tatatatgtgta

SEQ ID NO: 4933427 - DNA, 19 bp, Homo sapiens
tatatatgtgtatatatac

SEQ ID NO: 4933428 - DNA, 20 bp, Homo sapiens
tatatatgtgtatatataca

SEQ ID NO: 4933429 - DNA, 17 bp, Homo sapiens
tatatcctttctaacaa

SEQ ID NO: 4933430 - DNA, 12 bp, Homo sapiens
tatatctgaaaa

SEQ ID NO: 4933431 - DNA, 18 bp, Homo sapiens
tatatctgaaaactggaa

SEQ ID NO: 4933432 - DNA, 18 bp, Homo sapiens
tatatctgtggtcttcaa

SEQ ID NO: 4933433 - DNA, 12 bp, Homo sapiens
tatatgaaaact

SEQ ID NO: 4933434 - DNA, 22 bp, Homo sapiens
tatatgaatttaaatataattc

SEQ ID NO: 4933435 - DNA, 15 bp, Homo sapiens
tatatgatttatagt

SEQ ID NO: 4933436 - DNA, 17 bp, Homo sapiens
tatatgcctttttccta

SEQ ID NO: 4933437 - DNA, 22 bp, Homo sapiens
tatatggatgattcagaaattg

SEQ ID NO: 4933438 - DNA, 16 bp, Homo sapiens
tatatggcaagaaagc

SEQ ID NO: 4933439 - DNA, 12 bp, Homo sapiens
tatatgtacatg

SEQ ID NO: 4933440 - DNA, 14 bp, Homo sapiens
tatatgtgtatata

SEQ ID NO: 4933441 - DNA, 14 bp, Homo sapiens
tatatgtgtatgta

SEQ ID NO: 4933442 - DNA, 15 bp, Homo sapiens
tatatgtgttgaaaa

SEQ ID NO: 4933443 - DNA, 21 bp, Homo sapiens
tatattacacatttgtacaga

SEQ ID NO: 4933444 - DNA, 21 bp, Homo sapiens
tatattaccagcaagaataaa

SEQ ID NO: 4933445 - DNA, 14 bp, Homo sapiens
tatattataaatat

SEQ ID NO: 4933446 - DNA, 21 bp, Homo sapiens
tatattcaaccatggacttta

SEQ ID NO: 4933447 - DNA, 14 bp, Homo sapiens
tatatttaaactca

SEQ ID NO: 4933448 - DNA, 15 bp, Homo sapiens
tatatttaacaagat

SEQ ID NO: 4933449 - DNA, 11 bp, Homo sapiens
tatatttaatg

SEQ ID NO: 4933450 - DNA, 15 bp, Homo sapiens
tatatttaattatta

SEQ ID NO: 4933451 - DNA, 16 bp, Homo sapiens
tatatttatttaaagc

SEQ ID NO: 4933452 - DNA, 14 bp, Homo sapiens
tatatttctttgtt

SEQ ID NO: 4933453 - DNA, 14 bp, Homo sapiens
tatatttgcttttt

SEQ ID NO: 4933454 - DNA, 13 bp, Homo sapiens
tatatttttatat

SEQ ID NO: 4933455 - DNA, 20 bp, Homo sapiens
tatatttttatatttagtta

SEQ ID NO: 4933456 - DNA, 18 bp, Homo sapiens
tatatttttttaatttaa

SEQ ID NO: 4933457 - DNA, 12 bp, Homo sapiens
tatcaaagcata

SEQ ID NO: 4933458 - DNA, 21 bp, Homo sapiens
tatcaacactgttactttcgt

SEQ ID NO: 4933459 - DNA, 15 bp, Homo sapiens
tatcaactttaatca

SEQ ID NO: 4933460 - DNA, 17 bp, Homo sapiens
tatcaatatctaatata

SEQ ID NO: 4933461 - DNA, 18 bp, Homo sapiens
tatcaatatctaatatat

SEQ ID NO: 4933462 - DNA, 17 bp, Homo sapiens
tatcacacttctgtgag

SEQ ID NO: 4933463 - DNA, 17 bp, Homo sapiens
tatcactttttgaacta

SEQ ID NO: 4933464 - DNA, 18 bp, Homo sapiens
tatcactttttgaactaa

SEQ ID NO: 4933465 - DNA, 15 bp, Homo sapiens
tatcagatacatcac

SEQ ID NO: 4933466 - DNA, 16 bp, Homo sapiens
tatcagatacatcact

SEQ ID NO: 4933467 - DNA, 18 bp, Homo sapiens
tatcagctacttaagaga

SEQ ID NO: 4933468 - DNA, 19 bp, Homo sapiens
tatcagctacttaagagaa

SEQ ID NO: 4933469 - DNA, 15 bp, Homo sapiens
tatcaggtctcccac

SEQ ID NO: 4933470 - DNA, 23 bp, Homo sapiens
tatcaggtctcccacgtgggaga

SEQ ID NO: 4933471 - DNA, 17 bp, Homo sapiens
tatcagtgttttaaatt

SEQ ID NO: 4933472 - DNA, 20 bp, Homo sapiens
tatcagtgttttaaattctg

SEQ ID NO: 4933473 - DNA, 12 bp, Homo sapiens
tatcagtttgat

SEQ ID NO: 4933474 - DNA, 15 bp, Homo sapiens
tatcatagaaatgta

SEQ ID NO: 4933475 - DNA, 15 bp, Homo sapiens
tatcatagttaacat

SEQ ID NO: 4933476 - DNA, 11 bp, Homo sapiens
tatcatgaagc

SEQ ID NO: 4933477 - DNA, 12 bp, Homo sapiens
tatcatgaagcc

SEQ ID NO: 4933478 - DNA, 16 bp, Homo sapiens
tatcatgaagcctgtg

SEQ ID NO: 4933479 - DNA, 14 bp, Homo sapiens
tatccagttactgc

SEQ ID NO: 4933480 - DNA, 13 bp, Homo sapiens
tatccccaaatta

SEQ ID NO: 4933481 - DNA, 11 bp, Homo sapiens
tatcccttccg

SEQ ID NO: 4933482 - DNA, 18 bp, Homo sapiens
tatcccttctcacagcac

SEQ ID NO: 4933483 - DNA, 19 bp, Homo sapiens
tatcctacaacaagagttt

SEQ ID NO: 4933484 - DNA, 17 bp, Homo sapiens
tatcctgtgactgtctc

SEQ ID NO: 4933485 - DNA, 22 bp, Homo sapiens
tatcctttgtggcaccttttct

SEQ ID NO: 4933486 - DNA, 19 bp, Homo sapiens
tatcgaaataacaatgtta

SEQ ID NO: 4933487 - DNA, 16 bp, Homo sapiens
tatcgatctcttattt

SEQ ID NO: 4933488 - DNA, 16 bp, Homo sapiens
tatcgatgttttatta

SEQ ID NO: 4933489 - DNA, 20 bp, Homo sapiens
tatcgctgacttcatggaat

SEQ ID NO: 4933490 - DNA, 12 bp, Homo sapiens
tatctaaatgat

SEQ ID NO: 4933491 - DNA, 16 bp, Homo sapiens
tatctaatacctctgt

SEQ ID NO: 4933492 - DNA, 21 bp, Homo sapiens
tatctaatatgtaacaagcca

SEQ ID NO: 4933493 - DNA, 21 bp, Homo sapiens
tatctacccaagggcagaaag

SEQ ID NO: 4933494 - DNA, 15 bp, Homo sapiens
tatctatatatgtgt

SEQ ID NO: 4933495 - DNA, 17 bp, Homo sapiens
tatctatatatgtgtat

SEQ ID NO: 4933496 - DNA, 22 bp, Homo sapiens
tatctatatatgtgtatgtacg

SEQ ID NO: 4933497 - DNA, 23 bp, Homo sapiens
tatctatcttccaaatgcaattt

SEQ ID NO: 4933498 - DNA, 17 bp, Homo sapiens
tatctattaatatatgt

SEQ ID NO: 4933499 - DNA, 19 bp, Homo sapiens
tatctattctgagaaaaca

SEQ ID NO: 4933500 - DNA, 23 bp, Homo sapiens
tatctattctgagaaaacaagca

SEQ ID NO: 4933501 - DNA, 22 bp, Homo sapiens
tatctcagtcatgcataaatat

SEQ ID NO: 4933502 - DNA, 23 bp, Homo sapiens
tatctcatcaacaaagaaatatt

SEQ ID NO: 4933503 - DNA, 14 bp, Homo sapiens
tatctcctgacaga

SEQ ID NO: 4933504 - DNA, 20 bp, Homo sapiens
tatctctatttaatatttat

SEQ ID NO: 4933505 - DNA, 15 bp, Homo sapiens
tatctctgaagcatg

SEQ ID NO: 4933506 - DNA, 16 bp, Homo sapiens
tatttattttgtaatt

SEQ ID NO: 4933507 - DNA, 19 bp, Homo sapiens
tatttcagattttgataac

SEQ ID NO: 4933508 - DNA, 23 bp, Homo sapiens
tatttcagattttgataactgtt

SEQ ID NO: 4933509 - DNA, 12 bp, Homo sapiens
tatttcattgcc

SEQ ID NO: 4933510 - DNA, 22 bp, Homo sapiens
tatttccagtgttctatgaaca

SEQ ID NO: 4933511 - DNA, 15 bp, Homo sapiens
tatttcgaaagctgc

SEQ ID NO: 4933512 - DNA, 14 bp, Homo sapiens
tatttctgcaaaca

SEQ ID NO: 4933513 - DNA, 15 bp, Homo sapiens
tatttctgctttctt

SEQ ID NO: 4933514 - DNA, 17 bp, Homo sapiens
tatttctgggtcttttg

SEQ ID NO: 4933515 - DNA, 18 bp, Homo sapiens
tatttctgggtcttttgc

SEQ ID NO: 4933516 - DNA, 20 bp, Homo sapiens
tatttctgtcattcaaatgg

SEQ ID NO: 4933517 - DNA, 22 bp, Homo sapiens
tatttcttcaaatccttccaaa

SEQ ID NO: 4933518 - DNA, 22 bp, Homo sapiens
tatttctttatatttatccact

SEQ ID NO: 4933519 - DNA, 16 bp, Homo sapiens
tatttgaaaaaaactt

SEQ ID NO: 4933520 - DNA, 23 bp, Homo sapiens
tatttgaaaaaaacttcattctc

SEQ ID NO: 4933521 - DNA, 15 bp, Homo sapiens
tatttgaattaaaac

SEQ ID NO: 4933522 - DNA, 18 bp, Homo sapiens
tatttgaattttaaatct

SEQ ID NO: 4933523 - DNA, 17 bp, Homo sapiens
tatttgcaacatttaca

SEQ ID NO: 4933524 - DNA, 18 bp, Homo sapiens
tatttgcagttcacctgc

SEQ ID NO: 4933525 - DNA, 14 bp, Homo sapiens
tatttggcagtttg

SEQ ID NO: 4933526 - DNA, 17 bp, Homo sapiens
tatttggcagtttggta

SEQ ID NO: 4933527 - DNA, 21 bp, Homo sapiens
tatttggcagtttggtatttg

SEQ ID NO: 4933528 - DNA, 12 bp, Homo sapiens
tatttgtatctc

SEQ ID NO: 4933529 - DNA, 23 bp, Homo sapiens
tatttgtatctctgaagcatgtt

SEQ ID NO: 4933530 - DNA, 12 bp, Homo sapiens
tatttgtggaat

SEQ ID NO: 4933531 - DNA, 14 bp, Homo sapiens
tatttgtgtaatag

SEQ ID NO: 4933532 - DNA, 12 bp, Homo sapiens
tatttgtgtttt

SEQ ID NO: 4933533 - DNA, 14 bp, Homo sapiens
tatttgttcatgtt

SEQ ID NO: 4933534 - DNA, 16 bp, Homo sapiens
tatttgttcatgtttg

SEQ ID NO: 4933535 - DNA, 12 bp, Homo sapiens
tattttaaaagc

SEQ ID NO: 4933536 - DNA, 19 bp, Homo sapiens
tattttaagcactcttaaa

SEQ ID NO: 4933537 - DNA, 17 bp, Homo sapiens
tattttacacagaaaca

SEQ ID NO: 4933538 - DNA, 24 bp, Homo sapiens
tattttacacagaaacactgcctt

SEQ ID NO: 4933539 - DNA, 11 bp, Homo sapiens
tattttcacaa

SEQ ID NO: 4933540 - DNA, 18 bp, Homo sapiens
tattttcagtaatgttat

SEQ ID NO: 4933541 - DNA, 17 bp, Homo sapiens
tattttcagtattttgg

SEQ ID NO: 4933542 - DNA, 21 bp, Homo sapiens
tattttcccctatcatttatt

SEQ ID NO: 4933543 - DNA, 15 bp, Homo sapiens
tattttctatgtact

SEQ ID NO: 4933544 - DNA, 21 bp, Homo sapiens
tattttctatgtactagtact

SEQ ID NO: 4933545 - DNA, 12 bp, Homo sapiens
tattttctgtca

SEQ ID NO: 4933546 - DNA, 13 bp, Homo sapiens
tattttctgtcag

SEQ ID NO: 4933547 - DNA, 22 bp, Homo sapiens
tattttctgtcagatgagaaca

SEQ ID NO: 4933548 - DNA, 21 bp, Homo sapiens
tattttcttacccaatttccc

SEQ ID NO: 4933549 - DNA, 12 bp, Homo sapiens
tattttcttcat

SEQ ID NO: 4933550 - DNA, 16 bp, Homo sapiens
tattttcttttgaatt

SEQ ID NO: 4933551 - DNA, 11 bp, Homo sapiens
tattttgaagt

SEQ ID NO: 4933552 - DNA, 19 bp, Homo sapiens
tattttgaagtttacattt

SEQ ID NO: 4933553 - DNA, 22 bp, Homo sapiens
tattttgaagtttacattttta

SEQ ID NO: 4933554 - DNA, 13 bp, Homo sapiens
tattttgatgcag

SEQ ID NO: 4933555 - DNA, 16 bp, Homo sapiens
tattttggagaaatta

SEQ ID NO: 4933556 - DNA, 20 bp, Homo sapiens
tattttgtaaactcaaaata

SEQ ID NO: 4933557 - DNA, 13 bp, Homo sapiens
tatttttaaagat

SEQ ID NO: 4933558 - DNA, 15 bp, Homo sapiens
tatttttaaagatag

SEQ ID NO: 4933559 - DNA, 19 bp, Homo sapiens
tatttttagactcatcaat

SEQ ID NO: 4933560 - DNA, 22 bp, Homo sapiens
tatttttataaatataagcctt

SEQ ID NO: 4933561 - DNA, 21 bp, Homo sapiens
tatttttatactcttcctatt

SEQ ID NO: 4933562 - DNA, 20 bp, Homo sapiens
tatttttctacattattgct

SEQ ID NO: 4933563 - DNA, 12 bp, Homo sapiens
tatttttgtaaa

SEQ ID NO: 4933564 - DNA, 16 bp, Homo sapiens
tattttttatatatac

SEQ ID NO: 4933565 - DNA, 20 bp, Homo sapiens
tatttttttaatttaacatg

SEQ ID NO: 4933566 - DNA, 19 bp, Homo sapiens
tatttttttgtaattgctt

SEQ ID NO: 4933567 - DNA, 21 bp, Homo sapiens
tcaaaaatacaaaataaaaac

SEQ ID NO: 4933568 - DNA, 15 bp, Homo sapiens
tcaaaaatataactt

SEQ ID NO: 4933569 - DNA, 16 bp, Homo sapiens
tcaaaaatataactta

SEQ ID NO: 4933570 - DNA, 14 bp, Homo sapiens
tcaaaacactgtgg

SEQ ID NO: 4933571 - DNA, 15 bp, Homo sapiens
tcaaaacactgtgga

SEQ ID NO: 4933572 - DNA, 20 bp, Homo sapiens
tcaaaagagaaaaacaaaac

SEQ ID NO: 4933573 - DNA, 13 bp, Homo sapiens
tcaaaagttccaa

SEQ ID NO: 4933574 - DNA, 17 bp, Homo sapiens
tcaaaagttccaagagt

SEQ ID NO: 4933575 - DNA, 21 bp, Homo sapiens
tcaaaagttccaagagtctaa

SEQ ID NO: 4933576 - DNA, 17 bp, Homo sapiens
tcaaaagttggactaaa

SEQ ID NO: 4933577 - DNA, 20 bp, Homo sapiens
tcaaaagttggactaaatgc

SEQ ID NO: 4933578 - DNA, 21 bp, Homo sapiens
tcaaaataaaaagtgacacag

SEQ ID NO: 4933579 - DNA, 23 bp, Homo sapiens
tcaaaataaaaagtgacacagca

SEQ ID NO: 4933580 - DNA, 15 bp, Homo sapiens
tcaaaatattactca

SEQ ID NO: 4933581 - DNA, 16 bp, Homo sapiens
tcaaaatccaaaaaga

SEQ ID NO: 4933582 - DNA, 12 bp, Homo sapiens
tcaaaatgcttt

SEQ ID NO: 4933583 - DNA, 17 bp, Homo sapiens
tcaaaatgctttttatt

SEQ ID NO: 4933584 - DNA, 17 bp, Homo sapiens
tcaaacaacactggtgt

SEQ ID NO: 4933585 - DNA, 22 bp, Homo sapiens
tcaaacccacgattttctccag

SEQ ID NO: 4933586 - DNA, 23 bp, Homo sapiens
tcaaaccccgaccacctgcccaa

SEQ ID NO: 4933587 - DNA, 17 bp, Homo sapiens
tcaaacttactattttg

SEQ ID NO: 4933588 - DNA, 22 bp, Homo sapiens
tcaaagaaagaaagtttagaag

SEQ ID NO: 4933589 - DNA, 12 bp, Homo sapiens
tcaaagaaatgc

SEQ ID NO: 4933590 - DNA, 16 bp, Homo sapiens
tcaaagagaaaactta

SEQ ID NO: 4933591 - DNA, 20 bp, Homo sapiens
tcaaagagagaaaataaaga

SEQ ID NO: 4933592 - DNA, 19 bp, Homo sapiens
tcaaagatgctgtgagtct

SEQ ID NO: 4933593 - DNA, 14 bp, Homo sapiens
tcaaagcatagatg

SEQ ID NO: 4933594 - DNA, 20 bp, Homo sapiens
tcaaagccacattatttcta

SEQ ID NO: 4933595 - DNA, 21 bp, Homo sapiens
tcaaagccacattatttctag

SEQ ID NO: 4933596 - DNA, 15 bp, Homo sapiens
tcaaagccagggtct

SEQ ID NO: 4933597 - DNA, 15 bp, Homo sapiens
tcaaagctttttcca

SEQ ID NO: 4933598 - DNA, 14 bp, Homo sapiens
tcaaagttttgaaa

SEQ ID NO: 4933599 - DNA, 17 bp, Homo sapiens
tcaaagttttgaaaagc

SEQ ID NO: 4933600 - DNA, 22 bp, Homo sapiens
tcaaagttttgaaaagctatta

SEQ ID NO: 4933601 - DNA, 17 bp, Homo sapiens
tcaaataagtatttata

SEQ ID NO: 4933602 - DNA, 19 bp, Homo sapiens
tcaaataagtatttataat

SEQ ID NO: 4933603 - DNA, 22 bp, Homo sapiens
tcaaatccacccatatgttaaa

SEQ ID NO: 4933604 - DNA, 16 bp, Homo sapiens
tcaaatccttccaaaa

SEQ ID NO: 4933605 - DNA, 22 bp, Homo sapiens
tcaaatccttccaaaaattatt

SEQ ID NO: 4933606 - DNA, 21 bp, Homo sapiens
tcaaatggtaggcatttccta

SEQ ID NO: 4933607 - DNA, 15 bp, Homo sapiens
tcaaatgttctaagt

SEQ ID NO: 4933608 - DNA, 20 bp, Homo sapiens
tcaaatgttctaagtttcta

SEQ ID NO: 4933609 - DNA, 21 bp, Homo sapiens
tcaaatgttctaagtttctaa

SEQ ID NO: 4933610 - DNA, 22 bp, Homo sapiens
tcaaatgttctaagtttctaag

SEQ ID NO: 4933611 - DNA, 23 bp, Homo sapiens
tcaaatgttctaagtttctaaga

SEQ ID NO: 4933612 - DNA, 12 bp, Homo sapiens
tcaaatttcaca

SEQ ID NO: 4933613 - DNA, 18 bp, Homo sapiens
tcaacaaagcacagtgtt

SEQ ID NO: 4933614 - DNA, 18 bp, Homo sapiens
tcaacagaagcatttgta

SEQ ID NO: 4933615 - DNA, 21 bp, Homo sapiens
tcaacagaagcatttgtattt

SEQ ID NO: 4933616 - DNA, 18 bp, Homo sapiens
tcaacagctatgctggta

SEQ ID NO: 4933617 - DNA, 14 bp, Homo sapiens
tcaacatcctgcca

SEQ ID NO: 4933618 - DNA, 13 bp, Homo sapiens
tcaaccagataac

SEQ ID NO: 4933619 - DNA, 13 bp, Homo sapiens
tcaaccatcctgg

SEQ ID NO: 4933620 - DNA, 18 bp, Homo sapiens
tcaaccattccccatggg

SEQ ID NO: 4933621 - DNA, 20 bp, Homo sapiens
tcaaccccttcgctcctgtg

SEQ ID NO: 4933622 - DNA, 13 bp, Homo sapiens
tcaacctcctggg

SEQ ID NO: 4933623 - DNA, 18 bp, Homo sapiens
tcaacctcttctggctca

SEQ ID NO: 4933624 - DNA, 14 bp, Homo sapiens
tcaacgcagccctg

SEQ ID NO: 4933625 - DNA, 15 bp, Homo sapiens
tcaacgcagccctgc

SEQ ID NO: 4933626 - DNA, 23 bp, Homo sapiens
tcaactttctgttggattccatg

SEQ ID NO: 4933627 - DNA, 17 bp, Homo sapiens
tcaagaaaacaacttca

SEQ ID NO: 4933628 - DNA, 13 bp, Homo sapiens
tcaagaaactgag

SEQ ID NO: 4933629 - DNA, 23 bp, Homo sapiens
tcaagaaactgaggaattttctt

SEQ ID NO: 4933630 - DNA, 13 bp, Homo sapiens
tcaagagctgccc

SEQ ID NO: 4933631 - DNA, 17 bp, Homo sapiens
tcaagagctgccctcct

SEQ ID NO: 4933632 - DNA, 21 bp, Homo sapiens
tcaagagggcactggtggccc

SEQ ID NO: 4933633 - DNA, 17 bp, Homo sapiens
tcaagagggtctgagga

SEQ ID NO: 4933634 - DNA, 18 bp, Homo sapiens
tcaagcagcgaccgcccc

SEQ ID NO: 4933635 - DNA, 23 bp, Homo sapiens
tcaagcagcgaccgccccctcct

SEQ ID NO: 4933636 - DNA, 19 bp, Homo sapiens
tcaagccagcaacacagag

SEQ ID NO: 4933637 - DNA, 16 bp, Homo sapiens
tcaagcgattcttctg

SEQ ID NO: 4933638 - DNA, 17 bp, Homo sapiens
tcaagcgattcttctgc

SEQ ID NO: 4933639 - DNA, 21 bp, Homo sapiens
tcaagcgattcttctgcttca

SEQ ID NO: 4933640 - DNA, 14 bp, Homo sapiens
tcaaggcactctag

SEQ ID NO: 4933641 - DNA, 18 bp, Homo sapiens
tcaaggcactctagattc

SEQ ID NO: 4933642 - DNA, 20 bp, Homo sapiens
tcaaggcactctagattcca

SEQ ID NO: 4933643 - DNA, 20 bp, Homo sapiens
tcaaggtggccaaattattt

SEQ ID NO: 4933644 - DNA, 14 bp, Homo sapiens
tcaaggttctaacc

SEQ ID NO: 4933645 - DNA, 21 bp, Homo sapiens
tcaaggttttaggttctaaag

SEQ ID NO: 4933646 - DNA, 22 bp, Homo sapiens
tcaaggttttaggttctaaagt

SEQ ID NO: 4933647 - DNA, 12 bp, Homo sapiens
tcaagtattttg

SEQ ID NO: 4933648 - DNA, 17 bp, Homo sapiens
tcaagtctctgctggcc

SEQ ID NO: 4933649 - DNA, 16 bp, Homo sapiens
tcaagtgattctcctg

SEQ ID NO: 4933650 - DNA, 20 bp, Homo sapiens
tcaagtgattctcctgcctc

SEQ ID NO: 4933651 - DNA, 21 bp, Homo sapiens
tcaagtgattctcctgcctca

SEQ ID NO: 4933652 - DNA, 18 bp, Homo sapiens
tcaagtgggatctgtcac

SEQ ID NO: 4933653 - DNA, 17 bp, Homo sapiens
tcaagttattgtacagc

SEQ ID NO: 4933654 - DNA, 14 bp, Homo sapiens
tcaagttcctttgg

SEQ ID NO: 4933655 - DNA, 14 bp, Homo sapiens
tcaagttctaagat

SEQ ID NO: 4933656 - DNA, 16 bp, Homo sapiens
tcaagttctaagattc

SEQ ID NO: 4933657 - DNA, 18 bp, Homo sapiens
tcaagttctaagattcta

SEQ ID NO: 4933658 - DNA, 14 bp, Homo sapiens
tcaataaagaaaac

SEQ ID NO: 4933659 - DNA, 16 bp, Homo sapiens
tcaataaagaaaactt

SEQ ID NO: 4933660 - DNA, 15 bp, Homo sapiens
tcaataaatgtctgt

SEQ ID NO: 4933661 - DNA, 13 bp, Homo sapiens
tcaataagaaggt

SEQ ID NO: 4933662 - DNA, 18 bp, Homo sapiens
tcaatatccaaaccaaat

SEQ ID NO: 4933663 - DNA, 19 bp, Homo sapiens
tcaatcatctgtgtgaaaa

SEQ ID NO: 4933664 - DNA, 12 bp, Homo sapiens
tcaatcatttct

SEQ ID NO: 4933665 - DNA, 13 bp, Homo sapiens
tcaatcatttctc

SEQ ID NO: 4933666 - DNA, 14 bp, Homo sapiens
tcaatcatttctca

SEQ ID NO: 4933667 - DNA, 13 bp, Homo sapiens
tcaatcccaaaag

SEQ ID NO: 4933668 - DNA, 19 bp, Homo sapiens
tcaatcccaaaagtcacca

SEQ ID NO: 4933669 - DNA, 13 bp, Homo sapiens
tcaatcccagcct

SEQ ID NO: 4933670 - DNA, 16 bp, Homo sapiens
tcaatgaagccagctc

SEQ ID NO: 4933671 - DNA, 21 bp, Homo sapiens
tcaatgaagccagctcacagt

SEQ ID NO: 4933672 - DNA, 15 bp, Homo sapiens
tcaatgaatattgaa

SEQ ID NO: 4933673 - DNA, 16 bp, Homo sapiens
tcaatgattattttca

SEQ ID NO: 4933674 - DNA, 20 bp, Homo sapiens
tcaatgcaagagtgattgca

SEQ ID NO: 4933675 - DNA, 17 bp, Homo sapiens
tcaatgcgcaaaatgca

SEQ ID NO: 4933676 - DNA, 22 bp, Homo sapiens
tcaatgtgattctaatgtcttc

SEQ ID NO: 4933677 - DNA, 21 bp, Homo sapiens
tcaatgttcacgcaacttgaa

SEQ ID NO: 4933678 - DNA, 22 bp, Homo sapiens
tcaatgttcacgcaacttgaaa

SEQ ID NO: 4933679 - DNA, 21 bp, Homo sapiens
tcaatgtttatgcaaggaagg

SEQ ID NO: 4933680 - DNA, 11 bp, Homo sapiens
tcaattaataa

SEQ ID NO: 4933681 - DNA, 19 bp, Homo sapiens
tcaattatagtttctgagg

SEQ ID NO: 4933682 - DNA, 17 bp, Homo sapiens
tcaatttttgtctcaga

SEQ ID NO: 4933683 - DNA, 19 bp, Homo sapiens
tcaatttttgtctcagaag

SEQ ID NO: 4933684 - DNA, 21 bp, Homo sapiens
tcacaaaaatttgaacactgg

SEQ ID NO: 4933685 - DNA, 15 bp, Homo sapiens
tcacaaacttttata

SEQ ID NO: 4933686 - DNA, 14 bp, Homo sapiens
tcacaaccttctgt

SEQ ID NO: 4933687 - DNA, 15 bp, Homo sapiens
tcacaatacagataa

SEQ ID NO: 4933688 - DNA, 17 bp, Homo sapiens
tcacaatgtcagtattt

SEQ ID NO: 4933689 - DNA, 10 bp, Homo sapiens
tcacacacac

SEQ ID NO: 4933690 - DNA, 15 bp, Homo sapiens
tcacacactttggct

SEQ ID NO: 4933691 - DNA, 21 bp, Homo sapiens
tcacacagtattacttctgct

SEQ ID NO: 4933692 - DNA, 23 bp, Homo sapiens
tcacacagtgagtcgaggacagg

SEQ ID NO: 4933693 - DNA, 21 bp, Homo sapiens
tcacaccctgcaaggcccaca

SEQ ID NO: 4933694 - DNA, 15 bp, Homo sapiens
tcacacctcactctt

SEQ ID NO: 4933695 - DNA, 19 bp, Homo sapiens
tcacagcacatgctggcca

SEQ ID NO: 4933696 - DNA, 22 bp, Homo sapiens
tcacagcctcctctgtctgccc

SEQ ID NO: 4933697 - DNA, 11 bp, Homo sapiens
tcacagcctct

SEQ ID NO: 4933698 - DNA, 13 bp, Homo sapiens
tcacagcctctga

SEQ ID NO: 4933699 - DNA, 17 bp, Homo sapiens
tcacagcctctgacccc

SEQ ID NO: 4933700 - DNA, 21 bp, Homo sapiens
tcacagcctctgacccctcct

SEQ ID NO: 4933701 - DNA, 11 bp, Homo sapiens
tcacagctcct

SEQ ID NO: 4933702 - DNA, 14 bp, Homo sapiens
tcacagctcctccc

SEQ ID NO: 4933703 - DNA, 19 bp, Homo sapiens
tcacaggactctgcctcct

SEQ ID NO: 4933704 - DNA, 23 bp, Homo sapiens
tcacaggactctgcctcctcttc

SEQ ID NO: 4933705 - DNA, 11 bp, Homo sapiens
tcacaggcagg

SEQ ID NO: 4933706 - DNA, 19 bp, Homo sapiens
tcacaggcaggtccagggt

SEQ ID NO: 4933707 - DNA, 12 bp, Homo sapiens
tcacaggctaat

SEQ ID NO: 4933708 - DNA, 14 bp, Homo sapiens
tcacagggttgggc

SEQ ID NO: 4933709 - DNA, 19 bp, Homo sapiens
tcacagggttgggcccaga

SEQ ID NO: 4933710 - DNA, 18 bp, Homo sapiens
tcacaggttggaagagaa

SEQ ID NO: 4933711 - DNA, 20 bp, Homo sapiens
tcacaggttggaagagaatc

SEQ ID NO: 4933712 - DNA, 19 bp, Homo sapiens
tcacagtacagcatgtgcc

SEQ ID NO: 4933713 - DNA, 20 bp, Homo sapiens
tcacagtacagcatgtgcct

SEQ ID NO: 4933714 - DNA, 19 bp, Homo sapiens
tcacagtagagccagcttg

SEQ ID NO: 4933715 - DNA, 16 bp, Homo sapiens
tcacagtgacccttcc

SEQ ID NO: 4933716 - DNA, 17 bp, Homo sapiens
tcacagtgacccttccc

SEQ ID NO: 4933717 - DNA, 17 bp, Homo sapiens
tcacagttggccttcag

SEQ ID NO: 4933718 - DNA, 22 bp, Homo sapiens
tcacagttggctggatgaaatt

SEQ ID NO: 4933719 - DNA, 21 bp, Homo sapiens
tcacatcgcttctgtgtatct

SEQ ID NO: 4933720 - DNA, 18 bp, Homo sapiens
tcacatggtgcccctagc

SEQ ID NO: 4933721 - DNA, 22 bp, Homo sapiens
tcacattaaaaaatgaaatatt

SEQ ID NO: 4933722 - DNA, 16 bp, Homo sapiens
tcacattaatggtcta

SEQ ID NO: 4933723 - DNA, 21 bp, Homo sapiens
tcacattgagctgatataaat

SEQ ID NO: 4933724 - DNA, 16 bp, Homo sapiens
tcacattgcattctat

SEQ ID NO: 4933725 - DNA, 20 bp, Homo sapiens
tcacattgcattctattgcc

SEQ ID NO: 4933726 - DNA, 17 bp, Homo sapiens
tcagtaccctctcagct

SEQ ID NO: 4933727 - DNA, 23 bp, Homo sapiens
tcagtatgctgcccctgtcttgc

SEQ ID NO: 4933728 - DNA, 21 bp, Homo sapiens
tcagtattaatactaaaatat

SEQ ID NO: 4933729 - DNA, 14 bp, Homo sapiens
tcagtcatgcataa

SEQ ID NO: 4933730 - DNA, 15 bp, Homo sapiens
tcagtcatgcataaa

SEQ ID NO: 4933731 - DNA, 16 bp, Homo sapiens
tcagtcatgcataaat

SEQ ID NO: 4933732 - DNA, 21 bp, Homo sapiens
tcagtcattagactcctcctc

SEQ ID NO: 4933733 - DNA, 17 bp, Homo sapiens
tcagtcccatcagagag

SEQ ID NO: 4933734 - DNA, 18 bp, Homo sapiens
tcagtccccgtgaaggag

SEQ ID NO: 4933735 - DNA, 13 bp, Homo sapiens
tcagtccctatgt

SEQ ID NO: 4933736 - DNA, 16 bp, Homo sapiens
tcagtcctgctccaga

SEQ ID NO: 4933737 - DNA, 17 bp, Homo sapiens
tcagtctgattcccaag

SEQ ID NO: 4933738 - DNA, 21 bp, Homo sapiens
tcagtctgattcccaagctct

SEQ ID NO: 4933739 - DNA, 24 bp, Homo sapiens
tcagtctgattcccaagctctgct

SEQ ID NO: 4933740 - DNA, 16 bp, Homo sapiens
tcagtctggtgggagg

SEQ ID NO: 4933741 - DNA, 17 bp, Homo sapiens
tcagtctggtgggagga

SEQ ID NO: 4933742 - DNA, 15 bp, Homo sapiens
tcagtctttttctgt

SEQ ID NO: 4933743 - DNA, 20 bp, Homo sapiens
tcagtctttttctgttgtaa

SEQ ID NO: 4933744 - DNA, 19 bp, Homo sapiens
tcagtgatgtaccatgaaa

SEQ ID NO: 4933745 - DNA, 17 bp, Homo sapiens
tcagtggcttcatctgt

SEQ ID NO: 4933746 - DNA, 17 bp, Homo sapiens
tcagtgggcaggataaa

SEQ ID NO: 4933747 - DNA, 19 bp, Homo sapiens
tcagtgggcaggataaact

SEQ ID NO: 4933748 - DNA, 18 bp, Homo sapiens
tcagtgtaccatttgcct

SEQ ID NO: 4933749 - DNA, 17 bp, Homo sapiens
tcagtgtagttaattta

SEQ ID NO: 4933750 - DNA, 15 bp, Homo sapiens
tcagtgttgagatgg

SEQ ID NO: 4933751 - DNA, 15 bp, Homo sapiens
tcagtgttttaaatt

SEQ ID NO: 4933752 - DNA, 17 bp, Homo sapiens
tcagtgttttaaattct

SEQ ID NO: 4933753 - DNA, 16 bp, Homo sapiens
tcagttaactattgca

SEQ ID NO: 4933754 - DNA, 16 bp, Homo sapiens
tcagttattcattctg

SEQ ID NO: 4933755 - DNA, 20 bp, Homo sapiens
tcagttcctttgtgtgtact

SEQ ID NO: 4933756 - DNA, 15 bp, Homo sapiens
tcagttgtgactaac

SEQ ID NO: 4933757 - DNA, 16 bp, Homo sapiens
tcagtttgatcacact

SEQ ID NO: 4933758 - DNA, 12 bp, Homo sapiens
tcagttttcatt

SEQ ID NO: 4933759 - DNA, 13 bp, Homo sapiens
tcagttttcattt

SEQ ID NO: 4933760 - DNA, 18 bp, Homo sapiens
tcagttttttgttttaca

SEQ ID NO: 4933761 - DNA, 15 bp, Homo sapiens
tcataaaaactgctt

SEQ ID NO: 4933762 - DNA, 19 bp, Homo sapiens
tcataaacagatgaataaa

SEQ ID NO: 4933763 - DNA, 11 bp, Homo sapiens
tcataacttat

SEQ ID NO: 4933764 - DNA, 15 bp, Homo sapiens
tcataacttattgct

SEQ ID NO: 4933765 - DNA, 20 bp, Homo sapiens
tcataacttattgctgattt

SEQ ID NO: 4933766 - DNA, 15 bp, Homo sapiens
tcataaggcttcaaa

SEQ ID NO: 4933767 - DNA, 18 bp, Homo sapiens
tcatacctaagtactgta

SEQ ID NO: 4933768 - DNA, 14 bp, Homo sapiens
tcatacctcagaat

SEQ ID NO: 4933769 - DNA, 21 bp, Homo sapiens
tcatactacattgagtagaca

SEQ ID NO: 4933770 - DNA, 20 bp, Homo sapiens
tcatactactgaaacagatt

SEQ ID NO: 4933771 - DNA, 13 bp, Homo sapiens
tcatagaaatgta

SEQ ID NO: 4933772 - DNA, 23 bp, Homo sapiens
tcatagaaatgtaacttttgtaa

SEQ ID NO: 4933773 - DNA, 15 bp, Homo sapiens
tcatagtaacttctt

SEQ ID NO: 4933774 - DNA, 16 bp, Homo sapiens
tcatagtaacttctta

SEQ ID NO: 4933775 - DNA, 18 bp, Homo sapiens
tcatagtaacttcttatg

SEQ ID NO: 4933776 - DNA, 18 bp, Homo sapiens
tcatagtagtttttacag

SEQ ID NO: 4933777 - DNA, 22 bp, Homo sapiens
tcatagtagtttttacagctgt

SEQ ID NO: 4933778 - DNA, 15 bp, Homo sapiens
tcatagtatggtggc

SEQ ID NO: 4933779 - DNA, 15 bp, Homo sapiens
tcatatactgccatg

SEQ ID NO: 4933780 - DNA, 22 bp, Homo sapiens
tcatatccttcttacacgacta

SEQ ID NO: 4933781 - DNA, 12 bp, Homo sapiens
tcatatgtgatc

SEQ ID NO: 4933782 - DNA, 17 bp, Homo sapiens
tcatatgtgatctgtct

SEQ ID NO: 4933783 - DNA, 22 bp, Homo sapiens
tcatatgtgatctgtcttgtaa

SEQ ID NO: 4933784 - DNA, 19 bp, Homo sapiens
tcatattgatgaaaagatt

SEQ ID NO: 4933785 - DNA, 21 bp, Homo sapiens
tcatattgatgaaaagattta

SEQ ID NO: 4933786 - DNA, 20 bp, Homo sapiens
tcatattgtgccaatatgta

SEQ ID NO: 4933787 - DNA, 22 bp, Homo sapiens
tcatattgtgccaatatgtatt

SEQ ID NO: 4933788 - DNA, 15 bp, Homo sapiens
tcatattttgtatat

SEQ ID NO: 4933789 - DNA, 17 bp, Homo sapiens
tcatcacttttcagtga

SEQ ID NO: 4933790 - DNA, 22 bp, Homo sapiens
tcatcagaagtggtaggaaagc

SEQ ID NO: 4933791 - DNA, 17 bp, Homo sapiens
tcatcagagctcctctg

SEQ ID NO: 4933792 - DNA, 18 bp, Homo sapiens
tcatcagatggaaatatt

SEQ ID NO: 4933793 - DNA, 16 bp, Homo sapiens
tcatcagccaccatcc

SEQ ID NO: 4933794 - DNA, 18 bp, Homo sapiens
tcatcagccaccatccta

SEQ ID NO: 4933795 - DNA, 21 bp, Homo sapiens
tcatcagggcctggggcctga

SEQ ID NO: 4933796 - DNA, 23 bp, Homo sapiens
tcatcagggcctggggcctgaga

SEQ ID NO: 4933797 - DNA, 19 bp, Homo sapiens
tcatcatagtaaaagaaat

SEQ ID NO: 4933798 - DNA, 13 bp, Homo sapiens
tcatcatcagggc

SEQ ID NO: 4933799 - DNA, 20 bp, Homo sapiens
tcatcatggaggtcatacat

SEQ ID NO: 4933800 - DNA, 12 bp, Homo sapiens
tcatcattgttt

SEQ ID NO: 4933801 - DNA, 17 bp, Homo sapiens
tcatccaacttatgttt

SEQ ID NO: 4933802 - DNA, 16 bp, Homo sapiens
tcatccaccccatccc

SEQ ID NO: 4933803 - DNA, 18 bp, Homo sapiens
tcatccactgtgccatgt

SEQ ID NO: 4933804 - DNA, 19 bp, Homo sapiens
tcatccactgtgccatgtg

SEQ ID NO: 4933805 - DNA, 14 bp, Homo sapiens
tcatcccagcccca

SEQ ID NO: 4933806 - DNA, 12 bp, Homo sapiens
tcatccccaggg

SEQ ID NO: 4933807 - DNA, 21 bp, Homo sapiens
tcatccccaggggtcccagcc

SEQ ID NO: 4933808 - DNA, 12 bp, Homo sapiens
tcatccctttcc

SEQ ID NO: 4933809 - DNA, 13 bp, Homo sapiens
tcatccctttcca

SEQ ID NO: 4933810 - DNA, 23 bp, Homo sapiens
tcatcctcctggaaccttgctgt

SEQ ID NO: 4933811 - DNA, 16 bp, Homo sapiens
tcatcctgactctgcc

SEQ ID NO: 4933812 - DNA, 15 bp, Homo sapiens
tcatcctgtgctcgg

SEQ ID NO: 4933813 - DNA, 19 bp, Homo sapiens
tcatcgaaaattcatttca

SEQ ID NO: 4933814 - DNA, 14 bp, Homo sapiens
tcatcgaatctact

SEQ ID NO: 4933815 - DNA, 17 bp, Homo sapiens
tcatcgctcgtgtgttc

SEQ ID NO: 4933816 - DNA, 23 bp, Homo sapiens
tcatcgctcgtgtgttctatcca

SEQ ID NO: 4933817 - DNA, 15 bp, Homo sapiens
tcatctattcaagca

SEQ ID NO: 4933818 - DNA, 17 bp, Homo sapiens
tcatctattttgatgca

SEQ ID NO: 4933819 - DNA, 22 bp, Homo sapiens
tcatctgcacccttcttttctc

SEQ ID NO: 4933820 - DNA, 13 bp, Homo sapiens
tcatcttgtgaaa

SEQ ID NO: 4933821 - DNA, 14 bp, Homo sapiens
tcatcttgtgaaat

SEQ ID NO: 4933822 - DNA, 19 bp, Homo sapiens
tcatgacatgttatatatt

SEQ ID NO: 4933823 - DNA, 21 bp, Homo sapiens
tcatgatgcagtctcctcttt

SEQ ID NO: 4933824 - DNA, 19 bp, Homo sapiens
tcatgcataaatatgcagt

SEQ ID NO: 4933825 - DNA, 17 bp, Homo sapiens
tcatgcatgtcaaacat

SEQ ID NO: 4933826 - DNA, 17 bp, Homo sapiens
tcatgcccggtcccacc

SEQ ID NO: 4933827 - DNA, 15 bp, Homo sapiens
tcatgctatctctgt

SEQ ID NO: 4933828 - DNA, 19 bp, Homo sapiens
tcatgctttaaagtgtaat

SEQ ID NO: 4933829 - DNA, 17 bp, Homo sapiens
tcatggaatggacatcc

SEQ ID NO: 4933830 - DNA, 16 bp, Homo sapiens
tcatggaccactgttt

SEQ ID NO: 4933831 - DNA, 23 bp, Homo sapiens
tcatggaccactgtttcttgctt

SEQ ID NO: 4933832 - DNA, 18 bp, Homo sapiens
tcatgggcaccaacctgc

SEQ ID NO: 4933833 - DNA, 22 bp, Homo sapiens
tcatgggttatgtgtatgtgcc

SEQ ID NO: 4933834 - DNA, 15 bp, Homo sapiens
tcatggtgtaataag

SEQ ID NO: 4933835 - DNA, 16 bp, Homo sapiens
tcatggtgtaataaga

SEQ ID NO: 4933836 - DNA, 20 bp, Homo sapiens
tcatggtgtaataagacata

SEQ ID NO: 4933837 - DNA, 22 bp, Homo sapiens
tcatggtgtaataagacataac

SEQ ID NO: 4933838 - DNA, 17 bp, Homo sapiens
tcatgtagagaaaagca

SEQ ID NO: 4933839 - DNA, 20 bp, Homo sapiens
tcatgtagagaaaagcacac

SEQ ID NO: 4933840 - DNA, 20 bp, Homo sapiens
tcatgtatcatctggatagg

SEQ ID NO: 4933841 - DNA, 16 bp, Homo sapiens
tcatgtcaggcctgtg

SEQ ID NO: 4933842 - DNA, 19 bp, Homo sapiens
tcatgtcaggcctgtgtgt

SEQ ID NO: 4933843 - DNA, 20 bp, Homo sapiens
tcatgttatatttaatgcat

SEQ ID NO: 4933844 - DNA, 16 bp, Homo sapiens
tcatgtttatgaaaat

SEQ ID NO: 4933845 - DNA, 17 bp, Homo sapiens
tcatgtttatgaaaata

SEQ ID NO: 4933846 - DNA, 22 bp, Homo sapiens
tcatgtttatgaaaataaatag

SEQ ID NO: 4933847 - DNA, 17 bp, Homo sapiens
tcatgtttgcttcataa

SEQ ID NO: 4933848 - DNA, 21 bp, Homo sapiens
tcatgtttgcttcataaatga

SEQ ID NO: 4933849 - DNA, 11 bp, Homo sapiens
tcatgtttggt

SEQ ID NO: 4933850 - DNA, 22 bp, Homo sapiens
tcatgtttggtgcatagaactg

SEQ ID NO: 4933851 - DNA, 17 bp, Homo sapiens
tcatgttttgtgactat

SEQ ID NO: 4933852 - DNA, 16 bp, Homo sapiens
tcattaaatgtttgac

SEQ ID NO: 4933853 - DNA, 15 bp, Homo sapiens
tcattacccttccct

SEQ ID NO: 4933854 - DNA, 22 bp, Homo sapiens
tcattaccttttaccagctttt

SEQ ID NO: 4933855 - DNA, 23 bp, Homo sapiens
tcattaccttttaccagctttta

SEQ ID NO: 4933856 - DNA, 21 bp, Homo sapiens
tcattacttgattaagatttt

SEQ ID NO: 4933857 - DNA, 13 bp, Homo sapiens
tcattagctgtga

SEQ ID NO: 4933858 - DNA, 21 bp, Homo sapiens
tcattcaatattgacatttgt

SEQ ID NO: 4933859 - DNA, 16 bp, Homo sapiens
tcattcacttctctta

SEQ ID NO: 4933860 - DNA, 12 bp, Homo sapiens
tcattccaaata

SEQ ID NO: 4933861 - DNA, 17 bp, Homo sapiens
tcattccaacagtgagt

SEQ ID NO: 4933862 - DNA, 21 bp, Homo sapiens
tcattccaacttcccagttca

SEQ ID NO: 4933863 - DNA, 23 bp, Homo sapiens
tcattccaccttcccatgccctg

SEQ ID NO: 4933864 - DNA, 15 bp, Homo sapiens
tcattccttccacta

SEQ ID NO: 4933865 - DNA, 15 bp, Homo sapiens
tcattctatcaagcc

SEQ ID NO: 4933866 - DNA, 18 bp, Homo sapiens
tcattctcataattccta

SEQ ID NO: 4933867 - DNA, 14 bp, Homo sapiens
tcattctcctgcct

SEQ ID NO: 4933868 - DNA, 14 bp, Homo sapiens
tcattgtaaacaaa

SEQ ID NO: 4933869 - DNA, 20 bp, Homo sapiens
tcattgtccctcttcactcc

SEQ ID NO: 4933870 - DNA, 12 bp, Homo sapiens
tcattgttttga

SEQ ID NO: 4933871 - DNA, 17 bp, Homo sapiens
tcattgttttgaatatt

SEQ ID NO: 4933872 - DNA, 12 bp, Homo sapiens
tcatttagaact

SEQ ID NO: 4933873 - DNA, 23 bp, Homo sapiens
tcatttagtgagttattccttga

SEQ ID NO: 4933874 - DNA, 16 bp, Homo sapiens
tcatttattttaagca

SEQ ID NO: 4933875 - DNA, 14 bp, Homo sapiens
tcatttcacattaa

SEQ ID NO: 4933876 - DNA, 14 bp, Homo sapiens
tcatttcattccat

SEQ ID NO: 4933877 - DNA, 20 bp, Homo sapiens
tcatttggttcattaattct

SEQ ID NO: 4933878 - DNA, 12 bp, Homo sapiens
tcatttgtgtca

SEQ ID NO: 4933879 - DNA, 15 bp, Homo sapiens
tcatttgtgtcaatg

SEQ ID NO: 4933880 - DNA, 16 bp, Homo sapiens
tcatttgttgtgatgt

SEQ ID NO: 4933881 - DNA, 13 bp, Homo sapiens
tcattttaatgta

SEQ ID NO: 4933882 - DNA, 17 bp, Homo sapiens
tcattttaatgtaaaga

SEQ ID NO: 4933883 - DNA, 19 bp, Homo sapiens
tcattttaatgtaaagatt

SEQ ID NO: 4933884 - DNA, 13 bp, Homo sapiens
tcattttccaata

SEQ ID NO: 4933885 - DNA, 23 bp, Homo sapiens
tcattttgggacaattgttttaa

SEQ ID NO: 4933886 - DNA, 19 bp, Homo sapiens
tccaaaataattttaagaa

SEQ ID NO: 4933887 - DNA, 16 bp, Homo sapiens
tccaaaccaaataaaa

SEQ ID NO: 4933888 - DNA, 14 bp, Homo sapiens
tccaaagaggctgc

SEQ ID NO: 4933889 - DNA, 23 bp, Homo sapiens
tccaaagagtagaattgcattga

SEQ ID NO: 4933890 - DNA, 20 bp, Homo sapiens
tccaaagctttattaccagt

SEQ ID NO: 4933891 - DNA, 17 bp, Homo sapiens
tccaaagtctctaattc

SEQ ID NO: 4933892 - DNA, 18 bp, Homo sapiens
tccaaagtctctaattct

SEQ ID NO: 4933893 - DNA, 14 bp, Homo sapiens
tccaaattgtgctt

SEQ ID NO: 4933894 - DNA, 23 bp, Homo sapiens
tccaacacaaggctccaagacct

SEQ ID NO: 4933895 - DNA, 17 bp, Homo sapiens
tccaacaccacagacac

SEQ ID NO: 4933896 - DNA, 14 bp, Homo sapiens
tccaaccttcccaa

SEQ ID NO: 4933897 - DNA, 20 bp, Homo sapiens
tccaactgtatatattccca

SEQ ID NO: 4933898 - DNA, 20 bp, Homo sapiens
tccaacttatgtttttaaat

SEQ ID NO: 4933899 - DNA, 19 bp, Homo sapiens
tccaagaatccacatttct

SEQ ID NO: 4933900 - DNA, 21 bp, Homo sapiens
tccaagaatccacatttctaa

SEQ ID NO: 4933901 - DNA, 13 bp, Homo sapiens
tccaagactctag

SEQ ID NO: 4933902 - DNA, 15 bp, Homo sapiens
tccaagactctagag

SEQ ID NO: 4933903 - DNA, 16 bp, Homo sapiens
tccaagactctagagt

SEQ ID NO: 4933904 - DNA, 13 bp, Homo sapiens
tccaagattctag

SEQ ID NO: 4933905 - DNA, 18 bp, Homo sapiens
tccaagattctagatgat

SEQ ID NO: 4933906 - DNA, 20 bp, Homo sapiens
tccaagattctagatgatta

SEQ ID NO: 4933907 - DNA, 20 bp, Homo sapiens
tccaagcctccacagcgagg

SEQ ID NO: 4933908 - DNA, 21 bp, Homo sapiens
tccaagcctccacagcgaggg

SEQ ID NO: 4933909 - DNA, 14 bp, Homo sapiens
tccaagctaagcac

SEQ ID NO: 4933910 - DNA, 16 bp, Homo sapiens
tccaagctggtcccac

SEQ ID NO: 4933911 - DNA, 16 bp, Homo sapiens
tccaaggttcccttgt

SEQ ID NO: 4933912 - DNA, 20 bp, Homo sapiens
tccaaggtttaaagagtcta

SEQ ID NO: 4933913 - DNA, 23 bp, Homo sapiens
tccaataagacactcaaatatga

SEQ ID NO: 4933914 - DNA, 15 bp, Homo sapiens
tccaatatttctgct

SEQ ID NO: 4933915 - DNA, 18 bp, Homo sapiens
tccaatcccaccaaccct

SEQ ID NO: 4933916 - DNA, 15 bp, Homo sapiens
tccaatctcaaggaa

SEQ ID NO: 4933917 - DNA, 17 bp, Homo sapiens
tccaatctcaaggaatc

SEQ ID NO: 4933918 - DNA, 20 bp, Homo sapiens
tccaatgttagagacttttt

SEQ ID NO: 4933919 - DNA, 22 bp, Homo sapiens
tccaattgttgacagttctgaa

SEQ ID NO: 4933920 - DNA, 22 bp, Homo sapiens
tccaattttctggaatacatga

SEQ ID NO: 4933921 - DNA, 23 bp, Homo sapiens
tccacagagagggagagcagaga

SEQ ID NO: 4933922 - DNA, 14 bp, Homo sapiens
tccacaggtctaga

SEQ ID NO: 4933923 - DNA, 12 bp, Homo sapiens
tccacagttgcc

SEQ ID NO: 4933924 - DNA, 14 bp, Homo sapiens
tccacagttgccac

SEQ ID NO: 4933925 - DNA, 16 bp, Homo sapiens
tccacagttgccacca

SEQ ID NO: 4933926 - DNA, 19 bp, Homo sapiens
tccacagttgccaccacct

SEQ ID NO: 4933927 - DNA, 12 bp, Homo sapiens
tccacatgctct

SEQ ID NO: 4933928 - DNA, 13 bp, Homo sapiens
tccacatttctaa

SEQ ID NO: 4933929 - DNA, 14 bp, Homo sapiens
tccacatttctaaa

SEQ ID NO: 4933930 - DNA, 17 bp, Homo sapiens
tccaccaagaaagcagg

SEQ ID NO: 4933931 - DNA, 17 bp, Homo sapiens
tccaccacctccctcac

SEQ ID NO: 4933932 - DNA, 18 bp, Homo sapiens
tccaccacctccctcacc

SEQ ID NO: 4933933 - DNA, 12 bp, Homo sapiens
tccaccagcatc

SEQ ID NO: 4933934 - DNA, 20 bp, Homo sapiens
tccaccagcatcacctgcct

SEQ ID NO: 4933935 - DNA, 19 bp, Homo sapiens
tccacccaaccctatctcc

SEQ ID NO: 4933936 - DNA, 12 bp, Homo sapiens
tccacccacctc

SEQ ID NO: 4933937 - DNA, 12 bp, Homo sapiens
tccacccaggag

SEQ ID NO: 4933938 - DNA, 14 bp, Homo sapiens
tccacccaggagcc

SEQ ID NO: 4933939 - DNA, 20 bp, Homo sapiens
tccacccataatcctttctg

SEQ ID NO: 4933940 - DNA, 22 bp, Homo sapiens
tccacccataatcctttctgcc

SEQ ID NO: 4933941 - DNA, 22 bp, Homo sapiens
tccaccccatccctccccagtt

SEQ ID NO: 4933942 - DNA, 12 bp, Homo sapiens
tccaccctgctc

SEQ ID NO: 4933943 - DNA, 13 bp, Homo sapiens
tccaccctgctct

SEQ ID NO: 4933944 - DNA, 16 bp, Homo sapiens
tccacccttggcctgt

SEQ ID NO: 4933945 - DNA, 19 bp, Homo sapiens
tccacccttggcctgtctc

SEQ ID NO: 4933946 - DNA, 15 bp, Homo sapiens
tccctcccacctctg

SEQ ID NO: 4933947 - DNA, 19 bp, Homo sapiens
tccctcccacctctgtgac

SEQ ID NO: 4933948 - DNA, 21 bp, Homo sapiens
tccctcccacctctgtgacct

SEQ ID NO: 4933949 - DNA, 18 bp, Homo sapiens
tccctcccatcatgcccg

SEQ ID NO: 4933950 - DNA, 15 bp, Homo sapiens
tccctccccagctcc

SEQ ID NO: 4933951 - DNA, 14 bp, Homo sapiens
tccctcccccttgt

SEQ ID NO: 4933952 - DNA, 13 bp, Homo sapiens
tccctcccctgcc

SEQ ID NO: 4933953 - DNA, 16 bp, Homo sapiens
tccctcctcacctctg

SEQ ID NO: 4933954 - DNA, 22 bp, Homo sapiens
tccctcgctgcacaaatactcc

SEQ ID NO: 4933955 - DNA, 12 bp, Homo sapiens
tccctctccctg

SEQ ID NO: 4933956 - DNA, 16 bp, Homo sapiens
tccctctctcttctgc

SEQ ID NO: 4933957 - DNA, 21 bp, Homo sapiens
tccctctgctcagccaagctt

SEQ ID NO: 4933958 - DNA, 22 bp, Homo sapiens
tccctcttgttttgtttgtctc

SEQ ID NO: 4933959 - DNA, 14 bp, Homo sapiens
tccctcttttctta

SEQ ID NO: 4933960 - DNA, 16 bp, Homo sapiens
tccctcttttcttact

SEQ ID NO: 4933961 - DNA, 13 bp, Homo sapiens
tccctgaaacacg

SEQ ID NO: 4933962 - DNA, 21 bp, Homo sapiens
tccctgaaacacgaaacttgt

SEQ ID NO: 4933963 - DNA, 14 bp, Homo sapiens
tccctgacccgtct

SEQ ID NO: 4933964 - DNA, 21 bp, Homo sapiens
tccctgcactaaagccagcct

SEQ ID NO: 4933965 - DNA, 23 bp, Homo sapiens
tccctgcactaaagccagcctga

SEQ ID NO: 4933966 - DNA, 22 bp, Homo sapiens
tccctgcagatgccaccctagc

SEQ ID NO: 4933967 - DNA, 17 bp, Homo sapiens
tccctgcatttctgagt

SEQ ID NO: 4933968 - DNA, 12 bp, Homo sapiens
tccctgccagag

SEQ ID NO: 4933969 - DNA, 14 bp, Homo sapiens
tccctgcccctccc

SEQ ID NO: 4933970 - DNA, 15 bp, Homo sapiens
tccctgcctggtcac

SEQ ID NO: 4933971 - DNA, 17 bp, Homo sapiens
tccctgcgcctgtgatg

SEQ ID NO: 4933972 - DNA, 11 bp, Homo sapiens
tccctggagtg

SEQ ID NO: 4933973 - DNA, 17 bp, Homo sapiens
tccctgttcttcctcca

SEQ ID NO: 4933974 - DNA, 21 bp, Homo sapiens
tccctgtttaatatttaaaca

SEQ ID NO: 4933975 - DNA, 11 bp, Homo sapiens
tcccttcaacc

SEQ ID NO: 4933976 - DNA, 21 bp, Homo sapiens
tcccttcaaccattccccatg

SEQ ID NO: 4933977 - DNA, 13 bp, Homo sapiens
tcccttcagcccc

SEQ ID NO: 4933978 - DNA, 18 bp, Homo sapiens
tcccttcagcccccagcc

SEQ ID NO: 4933979 - DNA, 19 bp, Homo sapiens
tcccttcagcccccagccc

SEQ ID NO: 4933980 - DNA, 19 bp, Homo sapiens
tcccttcagtaccctctca

SEQ ID NO: 4933981 - DNA, 18 bp, Homo sapiens
tcccttccactgcctctg

SEQ ID NO: 4933982 - DNA, 20 bp, Homo sapiens
tcccttcccctccctggctc

SEQ ID NO: 4933983 - DNA, 21 bp, Homo sapiens
tcccttccgaccctctgggaa

SEQ ID NO: 4933984 - DNA, 16 bp, Homo sapiens
tcccttctcacagcac

SEQ ID NO: 4933985 - DNA, 13 bp, Homo sapiens
tcccttcttgcat

SEQ ID NO: 4933986 - DNA, 15 bp, Homo sapiens
tcccttgatgcacag

SEQ ID NO: 4933987 - DNA, 15 bp, Homo sapiens
tcccttgcttttccc

SEQ ID NO: 4933988 - DNA, 18 bp, Homo sapiens
tcccttgcttttccctct

SEQ ID NO: 4933989 - DNA, 21 bp, Homo sapiens
tcccttgcttttccctctttt

SEQ ID NO: 4933990 - DNA, 16 bp, Homo sapiens
tcccttggcctcagaa

SEQ ID NO: 4933991 - DNA, 16 bp, Homo sapiens
tccctttccccagcat

SEQ ID NO: 4933992 - DNA, 19 bp, Homo sapiens
tccctttctgcttgtgtta

SEQ ID NO: 4933993 - DNA, 16 bp, Homo sapiens
tccctttgtctttcaa

SEQ ID NO: 4933994 - DNA, 18 bp, Homo sapiens
tccctttgtctttcaaac

SEQ ID NO: 4933995 - DNA, 20 bp, Homo sapiens
tccctttttatatcccattt

SEQ ID NO: 4933996 - DNA, 18 bp, Homo sapiens
tccgaagctacttctcca

SEQ ID NO: 4933997 - DNA, 20 bp, Homo sapiens
tccgaccactaattgccaag

SEQ ID NO: 4933998 - DNA, 18 bp, Homo sapiens
tccgaccacttccagggg

SEQ ID NO: 4933999 - DNA, 15 bp, Homo sapiens
tccgcactttccact

SEQ ID NO: 4934000 - DNA, 22 bp, Homo sapiens
tccgcactttccacttcttcct

SEQ ID NO: 4934001 - DNA, 15 bp, Homo sapiens
tccgcagaagccctg

SEQ ID NO: 4934002 - DNA, 17 bp, Homo sapiens
tccgccccttcccttcc

SEQ ID NO: 4934003 - DNA, 21 bp, Homo sapiens
tccgcccttagtcccccaact

SEQ ID NO: 4934004 - DNA, 14 bp, Homo sapiens
tccgcctcttgggt

SEQ ID NO: 4934005 - DNA, 14 bp, Homo sapiens
tccgccttttgtat

SEQ ID NO: 4934006 - DNA, 19 bp, Homo sapiens
tccgcgaaaatagtttgtt

SEQ ID NO: 4934007 - DNA, 12 bp, Homo sapiens
tccgctctcttc

SEQ ID NO: 4934008 - DNA, 15 bp, Homo sapiens
tccggagtagctggg

SEQ ID NO: 4934009 - DNA, 16 bp, Homo sapiens
tccggatcctaagcat

SEQ ID NO: 4934010 - DNA, 18 bp, Homo sapiens
tccggtagggaggcagcc

SEQ ID NO: 4934011 - DNA, 14 bp, Homo sapiens
tccggtgttctaag

SEQ ID NO: 4934012 - DNA, 15 bp, Homo sapiens
tccggtgttctaaga

SEQ ID NO: 4934013 - DNA, 18 bp, Homo sapiens
tccggttgcatactggac

SEQ ID NO: 4934014 - DNA, 15 bp, Homo sapiens
tcctaaaacaaatag

SEQ ID NO: 4934015 - DNA, 20 bp, Homo sapiens
tcctaacaaaagatgaaagc

SEQ ID NO: 4934016 - DNA, 18 bp, Homo sapiens
tcctaactgaagagacag

SEQ ID NO: 4934017 - DNA, 13 bp, Homo sapiens
tcctaagaagctt

SEQ ID NO: 4934018 - DNA, 19 bp, Homo sapiens
tcctaagaagcttctaata

SEQ ID NO: 4934019 - DNA, 22 bp, Homo sapiens
tcctaagaagcttctaataaat

SEQ ID NO: 4934020 - DNA, 19 bp, Homo sapiens
tcctaagacacaaatgcat

SEQ ID NO: 4934021 - DNA, 13 bp, Homo sapiens
tcctaagcatcta

SEQ ID NO: 4934022 - DNA, 14 bp, Homo sapiens
tcctaagcatctaa

SEQ ID NO: 4934023 - DNA, 17 bp, Homo sapiens
tcctaagcatctaagtt

SEQ ID NO: 4934024 - DNA, 21 bp, Homo sapiens
tcctaagggtcgaaagctcta

SEQ ID NO: 4934025 - DNA, 19 bp, Homo sapiens
tcctacaagagcagcctgt

SEQ ID NO: 4934026 - DNA, 22 bp, Homo sapiens
tcctacaagagcagcctgtggc

SEQ ID NO: 4934027 - DNA, 23 bp, Homo sapiens
tcctacaagagcagcctgtggca

SEQ ID NO: 4934028 - DNA, 20 bp, Homo sapiens
tcctacagcactactgggtg

SEQ ID NO: 4934029 - DNA, 21 bp, Homo sapiens
tcctacagcactactgggtgt

SEQ ID NO: 4934030 - DNA, 16 bp, Homo sapiens
tcctacaggcagtctc

SEQ ID NO: 4934031 - DNA, 22 bp, Homo sapiens
tcctacaggcagtctctctctt

SEQ ID NO: 4934032 - DNA, 18 bp, Homo sapiens
tcctacccaccctccttt

SEQ ID NO: 4934033 - DNA, 14 bp, Homo sapiens
tcctacccttttct

SEQ ID NO: 4934034 - DNA, 14 bp, Homo sapiens
tcctactcctgact

SEQ ID NO: 4934035 - DNA, 12 bp, Homo sapiens
tcctactctgtg

SEQ ID NO: 4934036 - DNA, 13 bp, Homo sapiens
tcctactctgtgt

SEQ ID NO: 4934037 - DNA, 17 bp, Homo sapiens
tcctagagaacgcagcc

SEQ ID NO: 4934038 - DNA, 18 bp, Homo sapiens
tcctagagaacgcagccc

SEQ ID NO: 4934039 - DNA, 14 bp, Homo sapiens
tcctagatcctaag

SEQ ID NO: 4934040 - DNA, 16 bp, Homo sapiens
tcctagcctgtttctt

SEQ ID NO: 4934041 - DNA, 17 bp, Homo sapiens
tcctagcctgtttcttc

SEQ ID NO: 4934042 - DNA, 15 bp, Homo sapiens
tcctagtttgacctc

SEQ ID NO: 4934043 - DNA, 16 bp, Homo sapiens
tcctagtttgacctca

SEQ ID NO: 4934044 - DNA, 23 bp, Homo sapiens
tcctagtttgacctcacagtgac

SEQ ID NO: 4934045 - DNA, 14 bp, Homo sapiens
tcctataacttgat

SEQ ID NO: 4934046 - DNA, 15 bp, Homo sapiens
tcctataatctgtca

SEQ ID NO: 4934047 - DNA, 16 bp, Homo sapiens
tcctataatctgtcaa

SEQ ID NO: 4934048 - DNA, 18 bp, Homo sapiens
tcctatatcctgtgactg

SEQ ID NO: 4934049 - DNA, 19 bp, Homo sapiens
tcctatcacctatttccat

SEQ ID NO: 4934050 - DNA, 21 bp, Homo sapiens
tcctatccactgggcacaact

SEQ ID NO: 4934051 - DNA, 19 bp, Homo sapiens
tcctcacacaccctgaggt

SEQ ID NO: 4934052 - DNA, 13 bp, Homo sapiens
tcctcacccctgt

SEQ ID NO: 4934053 - DNA, 17 bp, Homo sapiens
tcctcacccctgtcctc

SEQ ID NO: 4934054 - DNA, 13 bp, Homo sapiens
tcctcacctctgg

SEQ ID NO: 4934055 - DNA, 17 bp, Homo sapiens
tcctcactgctccctga

SEQ ID NO: 4934056 - DNA, 19 bp, Homo sapiens
tccttgaatatctttcgat

SEQ ID NO: 4934057 - DNA, 17 bp, Homo sapiens
tccttgaccttcctctg

SEQ ID NO: 4934058 - DNA, 21 bp, Homo sapiens
tccttgaccttcctctggggc

SEQ ID NO: 4934059 - DNA, 17 bp, Homo sapiens
tccttgagacacggagc

SEQ ID NO: 4934060 - DNA, 23 bp, Homo sapiens
tccttgagacacggagcccagcc

SEQ ID NO: 4934061 - DNA, 14 bp, Homo sapiens
tccttgcacccctc

SEQ ID NO: 4934062 - DNA, 15 bp, Homo sapiens
tccttgcacccctca

SEQ ID NO: 4934063 - DNA, 21 bp, Homo sapiens
tccttgcacccctcactctgg

SEQ ID NO: 4934064 - DNA, 22 bp, Homo sapiens
tccttgcttatgacatcacttg

SEQ ID NO: 4934065 - DNA, 23 bp, Homo sapiens
tccttgtttatcagatacatcac

SEQ ID NO: 4934066 - DNA, 16 bp, Homo sapiens
tcctttaaagatgaac

SEQ ID NO: 4934067 - DNA, 21 bp, Homo sapiens
tcctttaattaagactgaaaa

SEQ ID NO: 4934068 - DNA, 15 bp, Homo sapiens
tcctttacaaaagaa

SEQ ID NO: 4934069 - DNA, 14 bp, Homo sapiens
tcctttacgtgttt

SEQ ID NO: 4934070 - DNA, 18 bp, Homo sapiens
tcctttactttcccttgc

SEQ ID NO: 4934071 - DNA, 15 bp, Homo sapiens
tcctttagcgcccag

SEQ ID NO: 4934072 - DNA, 19 bp, Homo sapiens
tcctttagcgcccagttgg

SEQ ID NO: 4934073 - DNA, 20 bp, Homo sapiens
tcctttcacaaccttctgtg

SEQ ID NO: 4934074 - DNA, 16 bp, Homo sapiens
tcctttcccaagcctt

SEQ ID NO: 4934075 - DNA, 14 bp, Homo sapiens
tcctttccccagcc

SEQ ID NO: 4934076 - DNA, 15 bp, Homo sapiens
tcctttccccagccc

SEQ ID NO: 4934077 - DNA, 17 bp, Homo sapiens
tcctttccccagcccag

SEQ ID NO: 4934078 - DNA, 20 bp, Homo sapiens
tcctttccccagcccagggt

SEQ ID NO: 4934079 - DNA, 13 bp, Homo sapiens
tcctttcccttcc

SEQ ID NO: 4934080 - DNA, 22 bp, Homo sapiens
tcctttctaacaaaaaaatata

SEQ ID NO: 4934081 - DNA, 11 bp, Homo sapiens
tcctttctatc

SEQ ID NO: 4934082 - DNA, 23 bp, Homo sapiens
tcctttctctttctctcttccct

SEQ ID NO: 4934083 - DNA, 14 bp, Homo sapiens
tcctttgcagggca

SEQ ID NO: 4934084 - DNA, 17 bp, Homo sapiens
tcctttgtggttttatg

SEQ ID NO: 4934085 - DNA, 20 bp, Homo sapiens
tcctttgtgtgtactcactg

SEQ ID NO: 4934086 - DNA, 24 bp, Homo sapiens
tcctttgttcttacctgtatgtct

SEQ ID NO: 4934087 - DNA, 18 bp, Homo sapiens
tcctttgttttctgacta

SEQ ID NO: 4934088 - DNA, 12 bp, Homo sapiens
tccttttatgtg

SEQ ID NO: 4934089 - DNA, 15 bp, Homo sapiens
tccttttcctctctc

SEQ ID NO: 4934090 - DNA, 13 bp, Homo sapiens
tccttttctttaa

SEQ ID NO: 4934091 - DNA, 18 bp, Homo sapiens
tccttttcttttgttact

SEQ ID NO: 4934092 - DNA, 19 bp, Homo sapiens
tccttttcttttgttactg

SEQ ID NO: 4934093 - DNA, 20 bp, Homo sapiens
tccttttcttttgttactgt

SEQ ID NO: 4934094 - DNA, 21 bp, Homo sapiens
tccttttcttttgttactgtt

SEQ ID NO: 4934095 - DNA, 15 bp, Homo sapiens
tccttttggtgtgtt

SEQ ID NO: 4934096 - DNA, 14 bp, Homo sapiens
tccttttgtcttct

SEQ ID NO: 4934097 - DNA, 21 bp, Homo sapiens
tcctttttatgaggcaacctg

SEQ ID NO: 4934098 - DNA, 23 bp, Homo sapiens
tcctttttctgattagctttgtg

SEQ ID NO: 4934099 - DNA, 24 bp, Homo sapiens
tcgaaaattcatttcacattaatg

SEQ ID NO: 4934100 - DNA, 14 bp, Homo sapiens
tcgaaagctctaga

SEQ ID NO: 4934101 - DNA, 12 bp, Homo sapiens
tcgaaataacaa

SEQ ID NO: 4934102 - DNA, 19 bp, Homo sapiens
tcgaaataacaatgttaag

SEQ ID NO: 4934103 - DNA, 20 bp, Homo sapiens
tcgaaataacaatgttaagg

SEQ ID NO: 4934104 - DNA, 15 bp, Homo sapiens
tcgaaccgttttgaa

SEQ ID NO: 4934105 - DNA, 16 bp, Homo sapiens
tcgaattaatagcttt

SEQ ID NO: 4934106 - DNA, 17 bp, Homo sapiens
tcgagcagtcctgcctc

SEQ ID NO: 4934107 - DNA, 14 bp, Homo sapiens
tcgaggacagggag

SEQ ID NO: 4934108 - DNA, 16 bp, Homo sapiens
tcgaggggctctcagc

SEQ ID NO: 4934109 - DNA, 18 bp, Homo sapiens
tcgagttcggctctgggt

SEQ ID NO: 4934110 - DNA, 15 bp, Homo sapiens
tcgatccaaattgtg

SEQ ID NO: 4934111 - DNA, 15 bp, Homo sapiens
tcgcacccccctgtt

SEQ ID NO: 4934112 - DNA, 19 bp, Homo sapiens
tcgcacccccctgttctaa

SEQ ID NO: 4934113 - DNA, 22 bp, Homo sapiens
tcgcacccccctgttctaaggg

SEQ ID NO: 4934114 - DNA, 19 bp, Homo sapiens
tcgcatggtcacacactga

SEQ ID NO: 4934115 - DNA, 19 bp, Homo sapiens
tcgcccaggctggagtgca

SEQ ID NO: 4934116 - DNA, 14 bp, Homo sapiens
tcgcccagtctgga

SEQ ID NO: 4934117 - DNA, 18 bp, Homo sapiens
tcgcctgtggagctcagc

SEQ ID NO: 4934118 - DNA, 19 bp, Homo sapiens
tcgcgcccgcccctgcagc

SEQ ID NO: 4934119 - DNA, 18 bp, Homo sapiens
tcgcgtgccctcgctgct

SEQ ID NO: 4934120 - DNA, 13 bp, Homo sapiens
tcgctatgtgcac

SEQ ID NO: 4934121 - DNA, 12 bp, Homo sapiens
tcgctcctgtgt

SEQ ID NO: 4934122 - DNA, 18 bp, Homo sapiens
tcgctgacttcatggaat

SEQ ID NO: 4934123 - DNA, 14 bp, Homo sapiens
tcgcttcccccata

SEQ ID NO: 4934124 - DNA, 16 bp, Homo sapiens
tcgcttcccccatagc

SEQ ID NO: 4934125 - DNA, 22 bp, Homo sapiens
tcgcttggctccatgctcctca

SEQ ID NO: 4934126 - DNA, 20 bp, Homo sapiens
tcggaacccaagcttagaac

SEQ ID NO: 4934127 - DNA, 16 bp, Homo sapiens
tcggaaccgctcacct

SEQ ID NO: 4934128 - DNA, 22 bp, Homo sapiens
tcggactaagcctacctgctct

SEQ ID NO: 4934129 - DNA, 21 bp, Homo sapiens
tcggagcatcccggaggaaat

SEQ ID NO: 4934130 - DNA, 19 bp, Homo sapiens
tcggaggccccactgatgc

SEQ ID NO: 4934131 - DNA, 13 bp, Homo sapiens
tcggctctgggtg

SEQ ID NO: 4934132 - DNA, 19 bp, Homo sapiens
tcgggacacctgccctgcc

SEQ ID NO: 4934133 - DNA, 13 bp, Homo sapiens
tcgtgacaacact

SEQ ID NO: 4934134 - DNA, 19 bp, Homo sapiens
tcgtgagtcatttaaatgt

SEQ ID NO: 4934135 - DNA, 13 bp, Homo sapiens
tcgtgatggggca

SEQ ID NO: 4934136 - DNA, 22 bp, Homo sapiens
tcgtggcagataatcagcctct

SEQ ID NO: 4934137 - DNA, 17 bp, Homo sapiens
tcgtgtgcaacagacaa

SEQ ID NO: 4934138 - DNA, 12 bp, Homo sapiens
tcgttcctttct

SEQ ID NO: 4934139 - DNA, 13 bp, Homo sapiens
tcgtttctgtata

SEQ ID NO: 4934140 - DNA, 21 bp, Homo sapiens
tctaaaatgtgatgttctaag

SEQ ID NO: 4934141 - DNA, 19 bp, Homo sapiens
tctaaacccaatccaaatg

SEQ ID NO: 4934142 - DNA, 13 bp, Homo sapiens
tctaaagaccaaa

SEQ ID NO: 4934143 - DNA, 18 bp, Homo sapiens
tctaaagaccaaacttca

SEQ ID NO: 4934144 - DNA, 20 bp, Homo sapiens
tctaaagaccaaacttcact

SEQ ID NO: 4934145 - DNA, 19 bp, Homo sapiens
tctaaagatggagtttcta

SEQ ID NO: 4934146 - DNA, 15 bp, Homo sapiens
tctaaagattctata

SEQ ID NO: 4934147 - DNA, 16 bp, Homo sapiens
tctaaagattctatag

SEQ ID NO: 4934148 - DNA, 22 bp, Homo sapiens
tctaaagattctatagttctag

SEQ ID NO: 4934149 - DNA, 23 bp, Homo sapiens
tctaaagattctatagttctaga

SEQ ID NO: 4934150 - DNA, 15 bp, Homo sapiens
tctaaagttctaaga

SEQ ID NO: 4934151 - DNA, 18 bp, Homo sapiens
tctaaagttctaagattc

SEQ ID NO: 4934152 - DNA, 19 bp, Homo sapiens
tctaaagttctaagattct

SEQ ID NO: 4934153 - DNA, 21 bp, Homo sapiens
tctaaatctatttattaatat

SEQ ID NO: 4934154 - DNA, 20 bp, Homo sapiens
tctaaattaaagcctttagt

SEQ ID NO: 4934155 - DNA, 17 bp, Homo sapiens
tctaaatttgaatgtta

SEQ ID NO: 4934156 - DNA, 23 bp, Homo sapiens
tctaaatttgaatgttaagcaga

SEQ ID NO: 4934157 - DNA, 16 bp, Homo sapiens
tctaagactcaaatgt

SEQ ID NO: 4934158 - DNA, 21 bp, Homo sapiens
tctaagatcttagattctctg

SEQ ID NO: 4934159 - DNA, 21 bp, Homo sapiens
tctaagatgtgatattctaag

SEQ ID NO: 4934160 - DNA, 22 bp, Homo sapiens
tctaagatgtgatattctaaga

SEQ ID NO: 4934161 - DNA, 14 bp, Homo sapiens
tctaagattctaaa

SEQ ID NO: 4934162 - DNA, 15 bp, Homo sapiens
tctaagattctaaag

SEQ ID NO: 4934163 - DNA, 16 bp, Homo sapiens
tctaagattctaaagg

SEQ ID NO: 4934164 - DNA, 18 bp, Homo sapiens
tctaagattctaaaggtc

SEQ ID NO: 4934165 - DNA, 18 bp, Homo sapiens
tctcaaagttttgaaaag

SEQ ID NO: 4934166 - DNA, 21 bp, Homo sapiens
tctcaacaaagcacagtgtta

SEQ ID NO: 4934167 - DNA, 17 bp, Homo sapiens
tctcaagagggcactgg

SEQ ID NO: 4934168 - DNA, 12 bp, Homo sapiens
tctcaagttcta

SEQ ID NO: 4934169 - DNA, 13 bp, Homo sapiens
tctcaagttctaa

SEQ ID NO: 4934170 - DNA, 14 bp, Homo sapiens
tctcaagttctaag

SEQ ID NO: 4934171 - DNA, 16 bp, Homo sapiens
tctcaagttctaagat

SEQ ID NO: 4934172 - DNA, 16 bp, Homo sapiens
tctcaatgaagccagc

SEQ ID NO: 4934173 - DNA, 12 bp, Homo sapiens
tctcaatgtgaa

SEQ ID NO: 4934174 - DNA, 14 bp, Homo sapiens
tctcacacacatag

SEQ ID NO: 4934175 - DNA, 15 bp, Homo sapiens
tctcacacacataga

SEQ ID NO: 4934176 - DNA, 20 bp, Homo sapiens
tctcacagcacatgctggcc

SEQ ID NO: 4934177 - DNA, 17 bp, Homo sapiens
tctcaccagctgctgct

SEQ ID NO: 4934178 - DNA, 17 bp, Homo sapiens
tctcactaaactttacc

SEQ ID NO: 4934179 - DNA, 16 bp, Homo sapiens
tctcactatgttgccc

SEQ ID NO: 4934180 - DNA, 19 bp, Homo sapiens
tctcactatgttgcccagg

SEQ ID NO: 4934181 - DNA, 20 bp, Homo sapiens
tctcactatgttgcccaggc

SEQ ID NO: 4934182 - DNA, 23 bp, Homo sapiens
tctcactatgttgcccaggcagg

SEQ ID NO: 4934183 - DNA, 16 bp, Homo sapiens
tctcactcctacctgg

SEQ ID NO: 4934184 - DNA, 16 bp, Homo sapiens
tctcactctgtcgccc

SEQ ID NO: 4934185 - DNA, 17 bp, Homo sapiens
tctcactggatgcaaag

SEQ ID NO: 4934186 - DNA, 15 bp, Homo sapiens
tctcactgttgccca

SEQ ID NO: 4934187 - DNA, 13 bp, Homo sapiens
tctcagcccagaa

SEQ ID NO: 4934188 - DNA, 16 bp, Homo sapiens
tctcagcccagaagaa

SEQ ID NO: 4934189 - DNA, 20 bp, Homo sapiens
tctcagcccagaagaaaatt

SEQ ID NO: 4934190 - DNA, 21 bp, Homo sapiens
tctcagccgcttctgactgct

SEQ ID NO: 4934191 - DNA, 13 bp, Homo sapiens
tctcaggatccaa

SEQ ID NO: 4934192 - DNA, 14 bp, Homo sapiens
tctcaggatccaag

SEQ ID NO: 4934193 - DNA, 20 bp, Homo sapiens
tctcaggggccagaggaact

SEQ ID NO: 4934194 - DNA, 14 bp, Homo sapiens
tctcagtcatgcat

SEQ ID NO: 4934195 - DNA, 20 bp, Homo sapiens
tctcagtggcttcatctgtc

SEQ ID NO: 4934196 - DNA, 21 bp, Homo sapiens
tctcagttaaaatgtgaggaa

SEQ ID NO: 4934197 - DNA, 18 bp, Homo sapiens
tctcataattcctacagc

SEQ ID NO: 4934198 - DNA, 22 bp, Homo sapiens
tctcatccccaggggtcccagc

SEQ ID NO: 4934199 - DNA, 13 bp, Homo sapiens
tctcatcctcctg

SEQ ID NO: 4934200 - DNA, 14 bp, Homo sapiens
tctcatcctcctgg

SEQ ID NO: 4934201 - DNA, 15 bp, Homo sapiens
tctcatcctcctgga

SEQ ID NO: 4934202 - DNA, 13 bp, Homo sapiens
tctcatctgcacc

SEQ ID NO: 4934203 - DNA, 19 bp, Homo sapiens
tctcatctgcacccttctt

SEQ ID NO: 4934204 - DNA, 15 bp, Homo sapiens
tctcatgtgtttgca

SEQ ID NO: 4934205 - DNA, 17 bp, Homo sapiens
tctcattccaacagtga

SEQ ID NO: 4934206 - DNA, 16 bp, Homo sapiens
tctcattttaatgtaa

SEQ ID NO: 4934207 - DNA, 19 bp, Homo sapiens
tctcattttaatgtaaaga

SEQ ID NO: 4934208 - DNA, 18 bp, Homo sapiens
tctccagatgtttccaga

SEQ ID NO: 4934209 - DNA, 19 bp, Homo sapiens
tctccagatgtttccagac

SEQ ID NO: 4934210 - DNA, 20 bp, Homo sapiens
tctccagctcagaacccagg

SEQ ID NO: 4934211 - DNA, 22 bp, Homo sapiens
tctccagctcagaacccagggc

SEQ ID NO: 4934212 - DNA, 23 bp, Homo sapiens
tctccagctcagaacccagggct

SEQ ID NO: 4934213 - DNA, 20 bp, Homo sapiens
tctccatcaccctcttcctg

SEQ ID NO: 4934214 - DNA, 13 bp, Homo sapiens
tctccatctgtca

SEQ ID NO: 4934215 - DNA, 15 bp, Homo sapiens
tctcccacgtgggag

SEQ ID NO: 4934216 - DNA, 17 bp, Homo sapiens
tctcccagaatcccagc

SEQ ID NO: 4934217 - DNA, 23 bp, Homo sapiens
tctccccaacccccattctcatc

SEQ ID NO: 4934218 - DNA, 22 bp, Homo sapiens
tctccccacactaacctgggtt

SEQ ID NO: 4934219 - DNA, 22 bp, Homo sapiens
tctccccgctaaggaagatatc

SEQ ID NO: 4934220 - DNA, 15 bp, Homo sapiens
tctcccctccagcct

SEQ ID NO: 4934221 - DNA, 12 bp, Homo sapiens
tctccctcccct

SEQ ID NO: 4934222 - DNA, 18 bp, Homo sapiens
tctccctcccctgccatt

SEQ ID NO: 4934223 - DNA, 16 bp, Homo sapiens
tctcctactcctgact

SEQ ID NO: 4934224 - DNA, 16 bp, Homo sapiens
tctcctataatctgtc

SEQ ID NO: 4934225 - DNA, 18 bp, Homo sapiens
tctcctccccacccgccc

SEQ ID NO: 4934226 - DNA, 16 bp, Homo sapiens
tctcctcttgccactg

SEQ ID NO: 4934227 - DNA, 17 bp, Homo sapiens
tctcctgcctcagcctc

SEQ ID NO: 4934228 - DNA, 13 bp, Homo sapiens
tctcctgcctgta

SEQ ID NO: 4934229 - DNA, 12 bp, Homo sapiens
tctcctggagga

SEQ ID NO: 4934230 - DNA, 13 bp, Homo sapiens
tctcctggaggat

SEQ ID NO: 4934231 - DNA, 23 bp, Homo sapiens
tctcctgtaagccaaagaaatga

SEQ ID NO: 4934232 - DNA, 17 bp, Homo sapiens
tctcctgtttttctggg

SEQ ID NO: 4934233 - DNA, 14 bp, Homo sapiens
tctccttccttacc

SEQ ID NO: 4934234 - DNA, 19 bp, Homo sapiens
tctccttgccctagatgag

SEQ ID NO: 4934235 - DNA, 16 bp, Homo sapiens
tctcctttcacaacct

SEQ ID NO: 4934236 - DNA, 12 bp, Homo sapiens
tctcctttgaaa

SEQ ID NO: 4934237 - DNA, 17 bp, Homo sapiens
tctccttttcctctctc

SEQ ID NO: 4934238 - DNA, 12 bp, Homo sapiens
tctccttttctt

SEQ ID NO: 4934239 - DNA, 14 bp, Homo sapiens
tctccttttctttt

SEQ ID NO: 4934240 - DNA, 18 bp, Homo sapiens
tctccttttcttttgtta

SEQ ID NO: 4934241 - DNA, 23 bp, Homo sapiens
tctccttttcttttgttactgtt

SEQ ID NO: 4934242 - DNA, 20 bp, Homo sapiens
tctcgtgagtcatttaaatg

SEQ ID NO: 4934243 - DNA, 23 bp, Homo sapiens
tctctaaagcactaccgattctt

SEQ ID NO: 4934244 - DNA, 13 bp, Homo sapiens
tctctaacttatt

SEQ ID NO: 4934245 - DNA, 21 bp, Homo sapiens
tctctcaaaagagaaaaacaa

SEQ ID NO: 4934246 - DNA, 14 bp, Homo sapiens
tctctccctcccct

SEQ ID NO: 4934247 - DNA, 21 bp, Homo sapiens
tctctccctcccctgccattt

SEQ ID NO: 4934248 - DNA, 15 bp, Homo sapiens
tctctcggctcccca

SEQ ID NO: 4934249 - DNA, 15 bp, Homo sapiens
tctctctgcagctgc

SEQ ID NO: 4934250 - DNA, 18 bp, Homo sapiens
tctctctgcagctgccgg

SEQ ID NO: 4934251 - DNA, 16 bp, Homo sapiens
tctctcttaaagttgg

SEQ ID NO: 4934252 - DNA, 20 bp, Homo sapiens
tctctcttcagactctcagc

SEQ ID NO: 4934253 - DNA, 14 bp, Homo sapiens
tctctcttccctca

SEQ ID NO: 4934254 - DNA, 11 bp, Homo sapiens
tctctcttctg

SEQ ID NO: 4934255 - DNA, 20 bp, Homo sapiens
tctctcttctgctccaccct

SEQ ID NO: 4934256 - DNA, 15 bp, Homo sapiens
tctctgaacacaggc

SEQ ID NO: 4934257 - DNA, 19 bp, Homo sapiens
tctctgaacacaggcagct

SEQ ID NO: 4934258 - DNA, 13 bp, Homo sapiens
tctctgaggacac

SEQ ID NO: 4934259 - DNA, 20 bp, Homo sapiens
tctctgattttcaaagcttt

SEQ ID NO: 4934260 - DNA, 14 bp, Homo sapiens
tctctgcagctgcc

SEQ ID NO: 4934261 - DNA, 19 bp, Homo sapiens
tctctgcctttgacattta

SEQ ID NO: 4934262 - DNA, 13 bp, Homo sapiens
tctctgctccacc

SEQ ID NO: 4934263 - DNA, 14 bp, Homo sapiens
tctctgctccacca

SEQ ID NO: 4934264 - DNA, 17 bp, Homo sapiens
tctctgctccaccacat

SEQ ID NO: 4934265 - DNA, 19 bp, Homo sapiens
tctctgctccaccacatcc

SEQ ID NO: 4934266 - DNA, 14 bp, Homo sapiens
tctctgctggccca

SEQ ID NO: 4934267 - DNA, 16 bp, Homo sapiens
tctctgctggcccagc

SEQ ID NO: 4934268 - DNA, 20 bp, Homo sapiens
tctctggctgtaaggctcta

SEQ ID NO: 4934269 - DNA, 16 bp, Homo sapiens
tctctggggcaggctg

SEQ ID NO: 4934270 - DNA, 20 bp, Homo sapiens
tctctggggcaggctgcttc

SEQ ID NO: 4934271 - DNA, 13 bp, Homo sapiens
tctctggtccgga

SEQ ID NO: 4934272 - DNA, 15 bp, Homo sapiens
tctctgtataaacat

SEQ ID NO: 4934273 - DNA, 21 bp, Homo sapiens
tctctgtgtctaagattctag

SEQ ID NO: 4934274 - DNA, 18 bp, Homo sapiens
tctctgtgtgcacaaata

SEQ ID NO: 4934275 - DNA, 22 bp, Homo sapiens
tctctgttctacccgttccaaa

SEQ ID NO: 4934276 - DNA, 18 bp, Homo sapiens
tcttaaagaaacagcttt

SEQ ID NO: 4934277 - DNA, 19 bp, Homo sapiens
tcttaaagcaaaaaatgaa

SEQ ID NO: 4934278 - DNA, 16 bp, Homo sapiens
tcttaaagctgcctgt

SEQ ID NO: 4934279 - DNA, 23 bp, Homo sapiens
tcttaaattgggttcatgatgca

SEQ ID NO: 4934280 - DNA, 18 bp, Homo sapiens
tcttaagcctaaatgcct

SEQ ID NO: 4934281 - DNA, 20 bp, Homo sapiens
tcttaagcctaaatgcctta

SEQ ID NO: 4934282 - DNA, 15 bp, Homo sapiens
tcttaatatatttga

SEQ ID NO: 4934283 - DNA, 10 bp, Homo sapiens
tcttaatttt

SEQ ID NO: 4934284 - DNA, 23 bp, Homo sapiens
tcttacacatacagttttatgct

SEQ ID NO: 4934285 - DNA, 17 bp, Homo sapiens
tcttacactgcctgtat

SEQ ID NO: 4934286 - DNA, 16 bp, Homo sapiens
tcttacccaatttccc

SEQ ID NO: 4934287 - DNA, 21 bp, Homo sapiens
tcttactcctcctctttctct

SEQ ID NO: 4934288 - DNA, 23 bp, Homo sapiens
tcttacttactaaaatatatata

SEQ ID NO: 4934289 - DNA, 22 bp, Homo sapiens
tcttactttcctttccccagcc

SEQ ID NO: 4934290 - DNA, 15 bp, Homo sapiens
tcttagaaatgaagg

SEQ ID NO: 4934291 - DNA, 20 bp, Homo sapiens
tcttagactacatttagaga

SEQ ID NO: 4934292 - DNA, 21 bp, Homo sapiens
tcttagctttttaattgttgt

SEQ ID NO: 4934293 - DNA, 20 bp, Homo sapiens
tcttataatactctgttgta

SEQ ID NO: 4934294 - DNA, 19 bp, Homo sapiens
tcttatagcactttgaaat

SEQ ID NO: 4934295 - DNA, 23 bp, Homo sapiens
tcttatagcactttgaaatacct

SEQ ID NO: 4934296 - DNA, 16 bp, Homo sapiens
tcttatagttctaggc

SEQ ID NO: 4934297 - DNA, 15 bp, Homo sapiens
tcttatgcaaaatgg

SEQ ID NO: 4934298 - DNA, 14 bp, Homo sapiens
tcttatggaattga

SEQ ID NO: 4934299 - DNA, 15 bp, Homo sapiens
tcttatggaattgat

SEQ ID NO: 4934300 - DNA, 18 bp, Homo sapiens
tcttatggaattgatttg

SEQ ID NO: 4934301 - DNA, 16 bp, Homo sapiens
tcttattgcgctgcta

SEQ ID NO: 4934302 - DNA, 19 bp, Homo sapiens
tcttcaaaatgtatatatt

SEQ ID NO: 4934303 - DNA, 22 bp, Homo sapiens
tcttcaaatccttccaaaaatt

SEQ ID NO: 4934304 - DNA, 17 bp, Homo sapiens
tcttcaacatcctgcca

SEQ ID NO: 4934305 - DNA, 18 bp, Homo sapiens
tcttcaccccggcaggcc

SEQ ID NO: 4934306 - DNA, 21 bp, Homo sapiens
tcttcaccccggcaggccctg

SEQ ID NO: 4934307 - DNA, 23 bp, Homo sapiens
tcttcaccccggcaggccctgca

SEQ ID NO: 4934308 - DNA, 19 bp, Homo sapiens
tcttcagatacaaactgca

SEQ ID NO: 4934309 - DNA, 16 bp, Homo sapiens
tcttcagcgtaaaatg

SEQ ID NO: 4934310 - DNA, 17 bp, Homo sapiens
tcttcaggcttcctgca

SEQ ID NO: 4934311 - DNA, 15 bp, Homo sapiens
tcttcatactttttt

SEQ ID NO: 4934312 - DNA, 20 bp, Homo sapiens
tcttcattctatcaagccca

SEQ ID NO: 4934313 - DNA, 14 bp, Homo sapiens
tcttcatttcattg

SEQ ID NO: 4934314 - DNA, 15 bp, Homo sapiens
tcttcatttcattgt

SEQ ID NO: 4934315 - DNA, 16 bp, Homo sapiens
tcttcatttcattgta

SEQ ID NO: 4934316 - DNA, 20 bp, Homo sapiens
tcttccaaagtaaaattgct

SEQ ID NO: 4934317 - DNA, 21 bp, Homo sapiens
tcttccctacctcaggcagga

SEQ ID NO: 4934318 - DNA, 16 bp, Homo sapiens
tcttccgcccctgcct

SEQ ID NO: 4934319 - DNA, 17 bp, Homo sapiens
tcttccgcccctgcctg

SEQ ID NO: 4934320 - DNA, 18 bp, Homo sapiens
tcttccgcccctgcctgc

SEQ ID NO: 4934321 - DNA, 19 bp, Homo sapiens
tcttccgcccctgcctgcc

SEQ ID NO: 4934322 - DNA, 19 bp, Homo sapiens
tcttcctagttttctcctc

SEQ ID NO: 4934323 - DNA, 14 bp, Homo sapiens
tcttcctccagctg

SEQ ID NO: 4934324 - DNA, 17 bp, Homo sapiens
tcttcctccagctgcac

SEQ ID NO: 4934325 - DNA, 23 bp, Homo sapiens
tcttcctgacgaaactggccccg

SEQ ID NO: 4934326 - DNA, 15 bp, Homo sapiens
tcttcctgcccctct

SEQ ID NO: 4934327 - DNA, 18 bp, Homo sapiens
tcttcctgcccctctttc

SEQ ID NO: 4934328 - DNA, 22 bp, Homo sapiens
tcttcctgcccctctttctctt

SEQ ID NO: 4934329 - DNA, 13 bp, Homo sapiens
tcttcctgtgatc

SEQ ID NO: 4934330 - DNA, 18 bp, Homo sapiens
tcttcctgttttgtacat

SEQ ID NO: 4934331 - DNA, 18 bp, Homo sapiens
tcttcgaagccttgccta

SEQ ID NO: 4934332 - DNA, 20 bp, Homo sapiens
tcttcgcgcccgcccctgca

SEQ ID NO: 4934333 - DNA, 22 bp, Homo sapiens
tcttcggccctcagatgtccct

SEQ ID NO: 4934334 - DNA, 17 bp, Homo sapiens
tcttctagagttcagag

SEQ ID NO: 4934335 - DNA, 13 bp, Homo sapiens
tcttctattttgt

SEQ ID NO: 4934336 - DNA, 23 bp, Homo sapiens
tcttctcaagttctaagattcta

SEQ ID NO: 4934337 - DNA, 13 bp, Homo sapiens
tcttctccactgg

SEQ ID NO: 4934338 - DNA, 15 bp, Homo sapiens
tcttctccagatttt

SEQ ID NO: 4934339 - DNA, 16 bp, Homo sapiens
tcttctgacaaactgt

SEQ ID NO: 4934340 - DNA, 17 bp, Homo sapiens
tcttctgacaaactgtg

SEQ ID NO: 4934341 - DNA, 20 bp, Homo sapiens
tcttctgctccacccttggc

SEQ ID NO: 4934342 - DNA, 23 bp, Homo sapiens
tcttctgctccacccttggcctg

SEQ ID NO: 4934343 - DNA, 18 bp, Homo sapiens
tcttctggctcaaaaaga

SEQ ID NO: 4934344 - DNA, 18 bp, Homo sapiens
tcttctggggcaggctgg

SEQ ID NO: 4934345 - DNA, 21 bp, Homo sapiens
tcttctggggcaggctgggcc

SEQ ID NO: 4934346 - DNA, 21 bp, Homo sapiens
tcttctgtacgtctgacaggc

SEQ ID NO: 4934347 - DNA, 13 bp, Homo sapiens
tcttctgtggacc

SEQ ID NO: 4934348 - DNA, 21 bp, Homo sapiens
tcttctgtgtttataaaatat

SEQ ID NO: 4934349 - DNA, 18 bp, Homo sapiens
tcttcttaagacttttgg

SEQ ID NO: 4934350 - DNA, 18 bp, Homo sapiens
tcttctttttttgtgatg

SEQ ID NO: 4934351 - DNA, 14 bp, Homo sapiens
tcttgaaattaaga

SEQ ID NO: 4934352 - DNA, 18 bp, Homo sapiens
tcttgaactcctggcctc

SEQ ID NO: 4934353 - DNA, 16 bp, Homo sapiens
tcttgaatgtcttttg

SEQ ID NO: 4934354 - DNA, 15 bp, Homo sapiens
tcttgaggccaggag

SEQ ID NO: 4934355 - DNA, 16 bp, Homo sapiens
tcttgaggccaggagt

SEQ ID NO: 4934356 - DNA, 19 bp, Homo sapiens
tcttgagtataagaaatgc

SEQ ID NO: 4934357 - DNA, 20 bp, Homo sapiens
tcttgagtataagaaatgca

SEQ ID NO: 4934358 - DNA, 13 bp, Homo sapiens
tcttgatttgagt

SEQ ID NO: 4934359 - DNA, 13 bp, Homo sapiens
tcttgcaatggca

SEQ ID NO: 4934360 - DNA, 16 bp, Homo sapiens
tcttgcaatggcagcc

SEQ ID NO: 4934361 - DNA, 23 bp, Homo sapiens
tcttgcaatggcagccttggcaa

SEQ ID NO: 4934362 - DNA, 21 bp, Homo sapiens
tcttgcatccttcctataact

SEQ ID NO: 4934363 - DNA, 16 bp, Homo sapiens
tcttgccttacacaaa

SEQ ID NO: 4934364 - DNA, 23 bp, Homo sapiens
tcttgcgaatccaagctccctgc

SEQ ID NO: 4934365 - DNA, 22 bp, Homo sapiens
tcttgctcccttcagcccccag

SEQ ID NO: 4934366 - DNA, 14 bp, Homo sapiens
tcttgctctgctga

SEQ ID NO: 4934367 - DNA, 20 bp, Homo sapiens
tcttgctgctagaacttttt

SEQ ID NO: 4934368 - DNA, 22 bp, Homo sapiens
tcttgctgctagaactttttta

SEQ ID NO: 4934369 - DNA, 16 bp, Homo sapiens
tcttgctgtctctgct

SEQ ID NO: 4934370 - DNA, 14 bp, Homo sapiens
tcttgcttgtacct

SEQ ID NO: 4934371 - DNA, 17 bp, Homo sapiens
tcttgcttgtacctctg

SEQ ID NO: 4934372 - DNA, 18 bp, Homo sapiens
tcttgcttgtacctctgg

SEQ ID NO: 4934373 - DNA, 22 bp, Homo sapiens
tcttgcttgtacctctggctga

SEQ ID NO: 4934374 - DNA, 16 bp, Homo sapiens
tcttggacactgtaca

SEQ ID NO: 4934375 - DNA, 17 bp, Homo sapiens
tcttggagaccttaccc

SEQ ID NO: 4934376 - DNA, 22 bp, Homo sapiens
tcttggcaaaagccttgtgtat

SEQ ID NO: 4934377 - DNA, 13 bp, Homo sapiens
tcttgggaactga

SEQ ID NO: 4934378 - DNA, 19 bp, Homo sapiens
tcttgtaatattttgtatt

SEQ ID NO: 4934379 - DNA, 14 bp, Homo sapiens
tcttgtacatgtgt

SEQ ID NO: 4934380 - DNA, 20 bp, Homo sapiens
tcttgtataagatcctagat

SEQ ID NO: 4934381 - DNA, 21 bp, Homo sapiens
tcttgtataagatcctagatc

SEQ ID NO: 4934382 - DNA, 20 bp, Homo sapiens
tcttgtcagacataaagcca

SEQ ID NO: 4934383 - DNA, 21 bp, Homo sapiens
tcttgtcagacataaagccat

SEQ ID NO: 4934384 - DNA, 23 bp, Homo sapiens
tcttgtcagacataaagccatgt

SEQ ID NO: 4934385 - DNA, 17 bp, Homo sapiens
tgaaagggcccagagag

SEQ ID NO: 4934386 - DNA, 13 bp, Homo sapiens
tgaaaggtactat

SEQ ID NO: 4934387 - DNA, 14 bp, Homo sapiens
tgaaaggtactata

SEQ ID NO: 4934388 - DNA, 14 bp, Homo sapiens
tgaaagtacatttg

SEQ ID NO: 4934389 - DNA, 21 bp, Homo sapiens
tgaaagtgaataaacttcagc

SEQ ID NO: 4934390 - DNA, 14 bp, Homo sapiens
tgaaagttcttgct

SEQ ID NO: 4934391 - DNA, 22 bp, Homo sapiens
tgaaagttttgagtagatatta

SEQ ID NO: 4934392 - DNA, 21 bp, Homo sapiens
tgaaataaagacccaggggga

SEQ ID NO: 4934393 - DNA, 19 bp, Homo sapiens
tgaaatacctcatgtttat

SEQ ID NO: 4934394 - DNA, 22 bp, Homo sapiens
tgaaatacctcatgtttatgaa

SEQ ID NO: 4934395 - DNA, 17 bp, Homo sapiens
tgaaataggaaacaagt

SEQ ID NO: 4934396 - DNA, 17 bp, Homo sapiens
tgaaatagtctgtgtga

SEQ ID NO: 4934397 - DNA, 15 bp, Homo sapiens
tgaaatatgtgaagt

SEQ ID NO: 4934398 - DNA, 21 bp, Homo sapiens
tgaaatattttttaatttaaa

SEQ ID NO: 4934399 - DNA, 19 bp, Homo sapiens
tgaaatcaatgcaagagtg

SEQ ID NO: 4934400 - DNA, 18 bp, Homo sapiens
tgaaatccttgactggac

SEQ ID NO: 4934401 - DNA, 17 bp, Homo sapiens
tgaaatgaaatttaaac

SEQ ID NO: 4934402 - DNA, 20 bp, Homo sapiens
tgaaatgaggtcagagcctg

SEQ ID NO: 4934403 - DNA, 21 bp, Homo sapiens
tgaaatgaggtcagagcctgc

SEQ ID NO: 4934404 - DNA, 22 bp, Homo sapiens
tgaaatgaggtcagagcctgca

SEQ ID NO: 4934405 - DNA, 17 bp, Homo sapiens
tgaaatgaggtctgttt

SEQ ID NO: 4934406 - DNA, 19 bp, Homo sapiens
tgaaatgaggtctgtttaa

SEQ ID NO: 4934407 - DNA, 23 bp, Homo sapiens
tgaaatgaggtctgtttaaagtg

SEQ ID NO: 4934408 - DNA, 20 bp, Homo sapiens
tgaaatgcatcaggtccttt

SEQ ID NO: 4934409 - DNA, 16 bp, Homo sapiens
tgaaattccaaagtct

SEQ ID NO: 4934410 - DNA, 14 bp, Homo sapiens
tgaaatttaaacat

SEQ ID NO: 4934411 - DNA, 14 bp, Homo sapiens
tgaaatttatttaa

SEQ ID NO: 4934412 - DNA, 21 bp, Homo sapiens
tgaaatttatttaatgtgagt

SEQ ID NO: 4934413 - DNA, 17 bp, Homo sapiens
tgaaattttctagactt

SEQ ID NO: 4934414 - DNA, 20 bp, Homo sapiens
tgaaattttctagactttct

SEQ ID NO: 4934415 - DNA, 20 bp, Homo sapiens
tgaaattttcttgatttgag

SEQ ID NO: 4934416 - DNA, 18 bp, Homo sapiens
tgaacaaaatctgttgcc

SEQ ID NO: 4934417 - DNA, 12 bp, Homo sapiens
tgaacattccaa

SEQ ID NO: 4934418 - DNA, 22 bp, Homo sapiens
tgaaccaccacacccagcccac

SEQ ID NO: 4934419 - DNA, 16 bp, Homo sapiens
tgaaccacgcgggggc

SEQ ID NO: 4934420 - DNA, 15 bp, Homo sapiens
tgaaccacttcattc

SEQ ID NO: 4934421 - DNA, 13 bp, Homo sapiens
tgaaccctccagg

SEQ ID NO: 4934422 - DNA, 17 bp, Homo sapiens
tgaaccctttgtttctt

SEQ ID NO: 4934423 - DNA, 12 bp, Homo sapiens
tgaactcctggc

SEQ ID NO: 4934424 - DNA, 14 bp, Homo sapiens
tgaactcctggcct

SEQ ID NO: 4934425 - DNA, 17 bp, Homo sapiens
tgaactggcaattgtct

SEQ ID NO: 4934426 - DNA, 21 bp, Homo sapiens
tgaactggcaattgtctattt

SEQ ID NO: 4934427 - DNA, 13 bp, Homo sapiens
tgaactggttcat

SEQ ID NO: 4934428 - DNA, 22 bp, Homo sapiens
tgaacttctctcagacttactt

SEQ ID NO: 4934429 - DNA, 17 bp, Homo sapiens
tgaacttctttgaattt

SEQ ID NO: 4934430 - DNA, 21 bp, Homo sapiens
tgaacttgtagctgtaaaacg

SEQ ID NO: 4934431 - DNA, 18 bp, Homo sapiens
tgaagaaacagataccat

SEQ ID NO: 4934432 - DNA, 18 bp, Homo sapiens
tgaagaaggtggaccttt

SEQ ID NO: 4934433 - DNA, 20 bp, Homo sapiens
tgaagaatacagttaggcac

SEQ ID NO: 4934434 - DNA, 17 bp, Homo sapiens
tgaagaattaagataca

SEQ ID NO: 4934435 - DNA, 13 bp, Homo sapiens
tgaagacaatttg

SEQ ID NO: 4934436 - DNA, 20 bp, Homo sapiens
tgaagacaatttgatacata

SEQ ID NO: 4934437 - DNA, 14 bp, Homo sapiens
tgaagacaggatgg

SEQ ID NO: 4934438 - DNA, 15 bp, Homo sapiens
tgaagactggaagct

SEQ ID NO: 4934439 - DNA, 18 bp, Homo sapiens
tgaagactggaagctaat

SEQ ID NO: 4934440 - DNA, 24 bp, Homo sapiens
tgaagagaaccgagcaaagatcaa

SEQ ID NO: 4934441 - DNA, 21 bp, Homo sapiens
tgaagagagatatatctgaaa

SEQ ID NO: 4934442 - DNA, 22 bp, Homo sapiens
tgaagagagatatatctgaaaa

SEQ ID NO: 4934443 - DNA, 14 bp, Homo sapiens
tgaagagcttgctt

SEQ ID NO: 4934444 - DNA, 15 bp, Homo sapiens
tgaagagcttgcttt

SEQ ID NO: 4934445 - DNA, 17 bp, Homo sapiens
tgaagagggagaaggga

SEQ ID NO: 4934446 - DNA, 21 bp, Homo sapiens
tgaagcaaggaagatatacat

SEQ ID NO: 4934447 - DNA, 19 bp, Homo sapiens
tgaagcatgtttcatgttt

SEQ ID NO: 4934448 - DNA, 13 bp, Homo sapiens
tgaagcctgtgga

SEQ ID NO: 4934449 - DNA, 13 bp, Homo sapiens
tgaagccttttga

SEQ ID NO: 4934450 - DNA, 16 bp, Homo sapiens
tgaagccttttgaaag

SEQ ID NO: 4934451 - DNA, 15 bp, Homo sapiens
tgaaggaaaatgata

SEQ ID NO: 4934452 - DNA, 20 bp, Homo sapiens
tgaaggaagccaaatttatc

SEQ ID NO: 4934453 - DNA, 20 bp, Homo sapiens
tgaaggagagcccttcattt

SEQ ID NO: 4934454 - DNA, 18 bp, Homo sapiens
tgaaggaggtgagagaag

SEQ ID NO: 4934455 - DNA, 17 bp, Homo sapiens
tgaaggcaaaattgcaa

SEQ ID NO: 4934456 - DNA, 17 bp, Homo sapiens
tgaagggcattctttcc

SEQ ID NO: 4934457 - DNA, 19 bp, Homo sapiens
tgaagtaaagccattaaat

SEQ ID NO: 4934458 - DNA, 13 bp, Homo sapiens
tgaagtcacacag

SEQ ID NO: 4934459 - DNA, 14 bp, Homo sapiens
tgaagtcacacagt

SEQ ID NO: 4934460 - DNA, 18 bp, Homo sapiens
tgaagtcacatcacagga

SEQ ID NO: 4934461 - DNA, 14 bp, Homo sapiens
tgaagtcactgcac

SEQ ID NO: 4934462 - DNA, 18 bp, Homo sapiens
tgaagtgagcacagccta

SEQ ID NO: 4934463 - DNA, 13 bp, Homo sapiens
tgaagtgcgtgaa

SEQ ID NO: 4934464 - DNA, 21 bp, Homo sapiens
tgaagtgcgtgaatgtatgta

SEQ ID NO: 4934465 - DNA, 20 bp, Homo sapiens
tgaagtgttttgttctttct

SEQ ID NO: 4934466 - DNA, 16 bp, Homo sapiens
tgaagttactttatgt

SEQ ID NO: 4934467 - DNA, 20 bp, Homo sapiens
tgaagtttaaaacagtattt

SEQ ID NO: 4934468 - DNA, 20 bp, Homo sapiens
tgaagtttacattgtaaata

SEQ ID NO: 4934469 - DNA, 14 bp, Homo sapiens
tgaagtttacattt

SEQ ID NO: 4934470 - DNA, 16 bp, Homo sapiens
tgaagtttacattttt

SEQ ID NO: 4934471 - DNA, 14 bp, Homo sapiens
tgaagttttacatt

SEQ ID NO: 4934472 - DNA, 17 bp, Homo sapiens
tgaataaacttcagcac

SEQ ID NO: 4934473 - DNA, 19 bp, Homo sapiens
tgaataaacttcagcacca

SEQ ID NO: 4934474 - DNA, 12 bp, Homo sapiens
tgaataaagtgt

SEQ ID NO: 4934475 - DNA, 17 bp, Homo sapiens
tgaataccattaaaact

SEQ ID NO: 4934476 - DNA, 16 bp, Homo sapiens
tgaatactttttacaa

SEQ ID NO: 4934477 - DNA, 22 bp, Homo sapiens
tgaatatggacaagaggtacag

SEQ ID NO: 4934478 - DNA, 15 bp, Homo sapiens
tgaatattttgataa

SEQ ID NO: 4934479 - DNA, 17 bp, Homo sapiens
tgaatcctcttctttat

SEQ ID NO: 4934480 - DNA, 15 bp, Homo sapiens
tgaatcctttgcctg

SEQ ID NO: 4934481 - DNA, 19 bp, Homo sapiens
tgaatgaaagattaaacag

SEQ ID NO: 4934482 - DNA, 11 bp, Homo sapiens
tgaatgaacac

SEQ ID NO: 4934483 - DNA, 12 bp, Homo sapiens
tgaatgaacact

SEQ ID NO: 4934484 - DNA, 15 bp, Homo sapiens
tgaatgaacactctt

SEQ ID NO: 4934485 - DNA, 17 bp, Homo sapiens
tgaatgacaacagaagc

SEQ ID NO: 4934486 - DNA, 17 bp, Homo sapiens
tgaatgaggtcccaggc

SEQ ID NO: 4934487 - DNA, 19 bp, Homo sapiens
tgaatgaggtcccaggcag

SEQ ID NO: 4934488 - DNA, 17 bp, Homo sapiens
tgaatgattcatgttat

SEQ ID NO: 4934489 - DNA, 18 bp, Homo sapiens
tgaatgattcatgttata

SEQ ID NO: 4934490 - DNA, 12 bp, Homo sapiens
tgaatgcttttt

SEQ ID NO: 4934491 - DNA, 23 bp, Homo sapiens
tgaatgctttttgaatgttattt

SEQ ID NO: 4934492 - DNA, 14 bp, Homo sapiens
tgaatggattggat

SEQ ID NO: 4934493 - DNA, 17 bp, Homo sapiens
tgaatggattggattat

SEQ ID NO: 4934494 - DNA, 15 bp, Homo sapiens
tgaatgtcttttgaa

SEQ ID NO: 4934495 - DNA, 19 bp, Homo sapiens
tgactgtatctgtgtagac

SEQ ID NO: 4934496 - DNA, 19 bp, Homo sapiens
tgacttcatggaatggaca

SEQ ID NO: 4934497 - DNA, 17 bp, Homo sapiens
tgacttctaatatcatt

SEQ ID NO: 4934498 - DNA, 15 bp, Homo sapiens
tgacttctccaggtc

SEQ ID NO: 4934499 - DNA, 23 bp, Homo sapiens
tgacttctccaggtctcacgggc

SEQ ID NO: 4934500 - DNA, 17 bp, Homo sapiens
tgacttgcatgaagaga

SEQ ID NO: 4934501 - DNA, 18 bp, Homo sapiens
tgacttggggagatggag

SEQ ID NO: 4934502 - DNA, 14 bp, Homo sapiens
tgactttcagtaaa

SEQ ID NO: 4934503 - DNA, 16 bp, Homo sapiens
tgagaaaaagctcctg

SEQ ID NO: 4934504 - DNA, 13 bp, Homo sapiens
tgagaaaacaagc

SEQ ID NO: 4934505 - DNA, 23 bp, Homo sapiens
tgagaaaacaagcaagttctgag

SEQ ID NO: 4934506 - DNA, 17 bp, Homo sapiens
tgagaaatatggacact

SEQ ID NO: 4934507 - DNA, 21 bp, Homo sapiens
tgagaaatatggacacttaat

SEQ ID NO: 4934508 - DNA, 14 bp, Homo sapiens
tgagaaatgttaaa

SEQ ID NO: 4934509 - DNA, 12 bp, Homo sapiens
tgagaacaaagc

SEQ ID NO: 4934510 - DNA, 16 bp, Homo sapiens
tgagaacaaagctgtt

SEQ ID NO: 4934511 - DNA, 15 bp, Homo sapiens
tgagaactcctgact

SEQ ID NO: 4934512 - DNA, 20 bp, Homo sapiens
tgagaagctgctccaggcct

SEQ ID NO: 4934513 - DNA, 21 bp, Homo sapiens
tgagaagctgctccaggcctg

SEQ ID NO: 4934514 - DNA, 16 bp, Homo sapiens
tgagaaggagagaaag

SEQ ID NO: 4934515 - DNA, 13 bp, Homo sapiens
tgagaaggcagcc

SEQ ID NO: 4934516 - DNA, 16 bp, Homo sapiens
tgagaaggcagccacc

SEQ ID NO: 4934517 - DNA, 20 bp, Homo sapiens
tgagaatcccaaatttgatt

SEQ ID NO: 4934518 - DNA, 22 bp, Homo sapiens
tgagaatcccaaatttgattga

SEQ ID NO: 4934519 - DNA, 12 bp, Homo sapiens
tgagaatctacc

SEQ ID NO: 4934520 - DNA, 18 bp, Homo sapiens
tgagaatctatatttaac

SEQ ID NO: 4934521 - DNA, 13 bp, Homo sapiens
tgagaatttctaa

SEQ ID NO: 4934522 - DNA, 14 bp, Homo sapiens
tgagaatttctaaa

SEQ ID NO: 4934523 - DNA, 22 bp, Homo sapiens
tgagaatttctaaaaagattag

SEQ ID NO: 4934524 - DNA, 11 bp, Homo sapiens
tgagacagagt

SEQ ID NO: 4934525 - DNA, 14 bp, Homo sapiens
tgagacagtttctt

SEQ ID NO: 4934526 - DNA, 21 bp, Homo sapiens
tgagaccacagagagagggga

SEQ ID NO: 4934527 - DNA, 17 bp, Homo sapiens
tgagaccagcctgggca

SEQ ID NO: 4934528 - DNA, 21 bp, Homo sapiens
tgagaccagttgaataaaagt

SEQ ID NO: 4934529 - DNA, 14 bp, Homo sapiens
tgagacccccacac

SEQ ID NO: 4934530 - DNA, 18 bp, Homo sapiens
tgagactcacaggaagga

SEQ ID NO: 4934531 - DNA, 14 bp, Homo sapiens
tgagactctgtctc

SEQ ID NO: 4934532 - DNA, 14 bp, Homo sapiens
tgagagaattggct

SEQ ID NO: 4934533 - DNA, 16 bp, Homo sapiens
tgagagagatgggagc

SEQ ID NO: 4934534 - DNA, 16 bp, Homo sapiens
tgagagcccagaggta

SEQ ID NO: 4934535 - DNA, 14 bp, Homo sapiens
tgagagctgggtgt

SEQ ID NO: 4934536 - DNA, 16 bp, Homo sapiens
tgagaggggaagcggc

SEQ ID NO: 4934537 - DNA, 22 bp, Homo sapiens
tgagaggtttgactagatgatg

SEQ ID NO: 4934538 - DNA, 16 bp, Homo sapiens
tgagagtgtctctgat

SEQ ID NO: 4934539 - DNA, 21 bp, Homo sapiens
tgagagttttgtcttgaatgt

SEQ ID NO: 4934540 - DNA, 15 bp, Homo sapiens
tgagatactttttct

SEQ ID NO: 4934541 - DNA, 23 bp, Homo sapiens
tgagatactttttcttttgtaag

SEQ ID NO: 4934542 - DNA, 21 bp, Homo sapiens
tgagatgagggatgggcctgg

SEQ ID NO: 4934543 - DNA, 13 bp, Homo sapiens
tgagatgctggag

SEQ ID NO: 4934544 - DNA, 17 bp, Homo sapiens
tgagatgctggagaaga

SEQ ID NO: 4934545 - DNA, 19 bp, Homo sapiens
tgagatgctggagaagaga

SEQ ID NO: 4934546 - DNA, 13 bp, Homo sapiens
tgagatgctggtt

SEQ ID NO: 4934547 - DNA, 17 bp, Homo sapiens
tgagatgctggttttct

SEQ ID NO: 4934548 - DNA, 12 bp, Homo sapiens
tgagatgctgta

SEQ ID NO: 4934549 - DNA, 17 bp, Homo sapiens
tgagatgtatgaaggct

SEQ ID NO: 4934550 - DNA, 20 bp, Homo sapiens
tgagatgtgtggactgtggc

SEQ ID NO: 4934551 - DNA, 18 bp, Homo sapiens
tgagattgccccaggtct

SEQ ID NO: 4934552 - DNA, 16 bp, Homo sapiens
tgagattggcatggct

SEQ ID NO: 4934553 - DNA, 15 bp, Homo sapiens
tgagatttcctcctg

SEQ ID NO: 4934554 - DNA, 17 bp, Homo sapiens
tgagattttttattgct

SEQ ID NO: 4934555 - DNA, 23 bp, Homo sapiens
tgagattttttattgctagtatt

SEQ ID NO: 4934556 - DNA, 18 bp, Homo sapiens
tgagcaaatgtggctcct

SEQ ID NO: 4934557 - DNA, 16 bp, Homo sapiens
tgagcaactcttgatt

SEQ ID NO: 4934558 - DNA, 17 bp, Homo sapiens
tgagcacagcctagggc

SEQ ID NO: 4934559 - DNA, 20 bp, Homo sapiens
tgagcactaaggtgtgctct

SEQ ID NO: 4934560 - DNA, 22 bp, Homo sapiens
tgagcactaaggtgtgctctga

SEQ ID NO: 4934561 - DNA, 13 bp, Homo sapiens
tgagcagggctca

SEQ ID NO: 4934562 - DNA, 14 bp, Homo sapiens
tgagcagggctcag

SEQ ID NO: 4934563 - DNA, 16 bp, Homo sapiens
tgagcagggctcagcg

SEQ ID NO: 4934564 - DNA, 19 bp, Homo sapiens
tgagcagggctcagcgggg

SEQ ID NO: 4934565 - DNA, 19 bp, Homo sapiens
tgagcatcctgagccccgc

SEQ ID NO: 4934566 - DNA, 11 bp, Homo sapiens
tgagccactgc

SEQ ID NO: 4934567 - DNA, 13 bp, Homo sapiens
tgagccactgcac

SEQ ID NO: 4934568 - DNA, 18 bp, Homo sapiens
tgagccactgcaccgggc

SEQ ID NO: 4934569 - DNA, 16 bp, Homo sapiens
tgagcccagagaacag

SEQ ID NO: 4934570 - DNA, 12 bp, Homo sapiens
tgagcccaggag

SEQ ID NO: 4934571 - DNA, 21 bp, Homo sapiens
tgagccccagggtgcccagaa

SEQ ID NO: 4934572 - DNA, 19 bp, Homo sapiens
tgagccccgccctcttcct

SEQ ID NO: 4934573 - DNA, 15 bp, Homo sapiens
tgagcccctggaggc

SEQ ID NO: 4934574 - DNA, 23 bp, Homo sapiens
tgagccgagatcacgccactgca

SEQ ID NO: 4934575 - DNA, 21 bp, Homo sapiens
tgagcctcagcatcctggcac

SEQ ID NO: 4934576 - DNA, 16 bp, Homo sapiens
tgagcctctgctcccc

SEQ ID NO: 4934577 - DNA, 18 bp, Homo sapiens
tgagcgcctgtgcacaca

SEQ ID NO: 4934578 - DNA, 12 bp, Homo sapiens
tgagcgggaggc

SEQ ID NO: 4934579 - DNA, 21 bp, Homo sapiens
tgagctggcctctctagcaca

SEQ ID NO: 4934580 - DNA, 14 bp, Homo sapiens
tgagctgggcatgg

SEQ ID NO: 4934581 - DNA, 19 bp, Homo sapiens
tgaggaactgtacagaaaa

SEQ ID NO: 4934582 - DNA, 21 bp, Homo sapiens
tgaggaactgtagatgatgta

SEQ ID NO: 4934583 - DNA, 23 bp, Homo sapiens
tgaggaaggaggggaagctgcag

SEQ ID NO: 4934584 - DNA, 20 bp, Homo sapiens
tgaggacaaccattccagac

SEQ ID NO: 4934585 - DNA, 23 bp, Homo sapiens
tgaggacttaaaatattcctgca

SEQ ID NO: 4934586 - DNA, 20 bp, Homo sapiens
tgaggagcccatactcagcc

SEQ ID NO: 4934587 - DNA, 11 bp, Homo sapiens
tgaggagcccc

SEQ ID NO: 4934588 - DNA, 12 bp, Homo sapiens
tgaggagctgct

SEQ ID NO: 4934589 - DNA, 13 bp, Homo sapiens
tgaggagctgctg

SEQ ID NO: 4934590 - DNA, 17 bp, Homo sapiens
tgaggaggcctccatct

SEQ ID NO: 4934591 - DNA, 18 bp, Homo sapiens
tgaggcagggcaaatgac

SEQ ID NO: 4934592 - DNA, 12 bp, Homo sapiens
tgaggccaggag

SEQ ID NO: 4934593 - DNA, 22 bp, Homo sapiens
tgaggcctccagcttcaggcag

SEQ ID NO: 4934594 - DNA, 19 bp, Homo sapiens
tgagggactgcctctgcca

SEQ ID NO: 4934595 - DNA, 15 bp, Homo sapiens
tgagggaggacctgg

SEQ ID NO: 4934596 - DNA, 22 bp, Homo sapiens
tgagggaggacctggggcacag

SEQ ID NO: 4934597 - DNA, 13 bp, Homo sapiens
tgagggcccagag

SEQ ID NO: 4934598 - DNA, 17 bp, Homo sapiens
tgagggcccagagcagg

SEQ ID NO: 4934599 - DNA, 22 bp, Homo sapiens
tgaggggcatctgcccctcccc

SEQ ID NO: 4934600 - DNA, 15 bp, Homo sapiens
tgagggtccccacct

SEQ ID NO: 4934601 - DNA, 21 bp, Homo sapiens
tgagggtgcttgttccctctc

SEQ ID NO: 4934602 - DNA, 14 bp, Homo sapiens
tgaggtcagagcct

SEQ ID NO: 4934603 - DNA, 19 bp, Homo sapiens
tgaggtcagagcctgcagt

SEQ ID NO: 4934604 - DNA, 12 bp, Homo sapiens
tgaggtcaggga

SEQ ID NO: 4934605 - DNA, 17 bp, Homo sapiens
tgcacttgtgattattt

SEQ ID NO: 4934606 - DNA, 19 bp, Homo sapiens
tgcactttctaatgtttct

SEQ ID NO: 4934607 - DNA, 19 bp, Homo sapiens
tgcactttgatgtcatgtg

SEQ ID NO: 4934608 - DNA, 20 bp, Homo sapiens
tgcactttgatgtcatgtgt

SEQ ID NO: 4934609 - DNA, 12 bp, Homo sapiens
tgcagaactgcc

SEQ ID NO: 4934610 - DNA, 14 bp, Homo sapiens
tgcagaactgccat

SEQ ID NO: 4934611 - DNA, 19 bp, Homo sapiens
tgcagacagaagtctcctc

SEQ ID NO: 4934612 - DNA, 13 bp, Homo sapiens
tgcagacaggcaa

SEQ ID NO: 4934613 - DNA, 21 bp, Homo sapiens
tgcagacaggcaagcacctcc

SEQ ID NO: 4934614 - DNA, 18 bp, Homo sapiens
tgcagactctacagaggc

SEQ ID NO: 4934615 - DNA, 22 bp, Homo sapiens
tgcagactctacagaggccatg

SEQ ID NO: 4934616 - DNA, 12 bp, Homo sapiens
tgcagactgcta

SEQ ID NO: 4934617 - DNA, 22 bp, Homo sapiens
tgcagactgctagtgttctgtc

SEQ ID NO: 4934618 - DNA, 15 bp, Homo sapiens
tgcagatgcaattgt

SEQ ID NO: 4934619 - DNA, 17 bp, Homo sapiens
tgcagatgcaattgttt

SEQ ID NO: 4934620 - DNA, 20 bp, Homo sapiens
tgcagatgccaccctagcca

SEQ ID NO: 4934621 - DNA, 20 bp, Homo sapiens
tgcagcaaggccctgctgcc

SEQ ID NO: 4934622 - DNA, 16 bp, Homo sapiens
tgcagcacggacaata

SEQ ID NO: 4934623 - DNA, 19 bp, Homo sapiens
tgcagcacggacaataaac

SEQ ID NO: 4934624 - DNA, 13 bp, Homo sapiens
tgcagcaggagtg

SEQ ID NO: 4934625 - DNA, 14 bp, Homo sapiens
tgcagcaggagtgg

SEQ ID NO: 4934626 - DNA, 19 bp, Homo sapiens
tgcagcatggtccctgcct

SEQ ID NO: 4934627 - DNA, 22 bp, Homo sapiens
tgcagcatttgataatgataaa

SEQ ID NO: 4934628 - DNA, 13 bp, Homo sapiens
tgcagcccatgcc

SEQ ID NO: 4934629 - DNA, 20 bp, Homo sapiens
tgcagcctcaacctcctggg

SEQ ID NO: 4934630 - DNA, 21 bp, Homo sapiens
tgcagcctcaacctcctgggc

SEQ ID NO: 4934631 - DNA, 23 bp, Homo sapiens
tgcagcctcaacctcctgggcta

SEQ ID NO: 4934632 - DNA, 12 bp, Homo sapiens
tgcagctggaca

SEQ ID NO: 4934633 - DNA, 16 bp, Homo sapiens
tgcagctggacagagg

SEQ ID NO: 4934634 - DNA, 13 bp, Homo sapiens
tgcagcttcctgt

SEQ ID NO: 4934635 - DNA, 15 bp, Homo sapiens
tgcagcttcctgtca

SEQ ID NO: 4934636 - DNA, 16 bp, Homo sapiens
tgcagctttacatgca

SEQ ID NO: 4934637 - DNA, 13 bp, Homo sapiens
tgcagctttatgt

SEQ ID NO: 4934638 - DNA, 15 bp, Homo sapiens
tgcaggaatcaaaaa

SEQ ID NO: 4934639 - DNA, 21 bp, Homo sapiens
tgcaggaatcaaaaattgaag

SEQ ID NO: 4934640 - DNA, 15 bp, Homo sapiens
tgcaggacttgagaa

SEQ ID NO: 4934641 - DNA, 18 bp, Homo sapiens
tgcaggacttgagaagac

SEQ ID NO: 4934642 - DNA, 20 bp, Homo sapiens
tgcagggcagccccacaact

SEQ ID NO: 4934643 - DNA, 23 bp, Homo sapiens
tgcagggccaggactgagccccg

SEQ ID NO: 4934644 - DNA, 13 bp, Homo sapiens
tgcaggggctctg

SEQ ID NO: 4934645 - DNA, 18 bp, Homo sapiens
tgcaggggctctggagag

SEQ ID NO: 4934646 - DNA, 16 bp, Homo sapiens
tgcagggggctcctgg

SEQ ID NO: 4934647 - DNA, 23 bp, Homo sapiens
tgcagggttctccctcccacctt

SEQ ID NO: 4934648 - DNA, 16 bp, Homo sapiens
tgcaggttggacccca

SEQ ID NO: 4934649 - DNA, 13 bp, Homo sapiens
tgcagtaaatctt

SEQ ID NO: 4934650 - DNA, 18 bp, Homo sapiens
tgcagtaaatcttttaca

SEQ ID NO: 4934651 - DNA, 15 bp, Homo sapiens
tgcagtctcctcttt

SEQ ID NO: 4934652 - DNA, 21 bp, Homo sapiens
tgcagtctcctctttaaaaca

SEQ ID NO: 4934653 - DNA, 20 bp, Homo sapiens
tgcagtgatatggcagaaga

SEQ ID NO: 4934654 - DNA, 23 bp, Homo sapiens
tgcagtgatatggcagaagacac

SEQ ID NO: 4934655 - DNA, 20 bp, Homo sapiens
tgcagtggtgcgatctgggt

SEQ ID NO: 4934656 - DNA, 16 bp, Homo sapiens
tgcagtgttcgcttgg

SEQ ID NO: 4934657 - DNA, 18 bp, Homo sapiens
tgcagtgttcgcttggct

SEQ ID NO: 4934658 - DNA, 15 bp, Homo sapiens
tgcagttcagcacca

SEQ ID NO: 4934659 - DNA, 18 bp, Homo sapiens
tgcagttttggtgtgtaa

SEQ ID NO: 4934660 - DNA, 15 bp, Homo sapiens
tgcagtttttcagga

SEQ ID NO: 4934661 - DNA, 15 bp, Homo sapiens
tgcataaatatgcag

SEQ ID NO: 4934662 - DNA, 19 bp, Homo sapiens
tgcataaatatgcagtgat

SEQ ID NO: 4934663 - DNA, 19 bp, Homo sapiens
tgcatatgtcactagaatg

SEQ ID NO: 4934664 - DNA, 13 bp, Homo sapiens
tgcatatgttgaa

SEQ ID NO: 4934665 - DNA, 12 bp, Homo sapiens
tgcatcccagca

SEQ ID NO: 4934666 - DNA, 14 bp, Homo sapiens
tgcatcccagcacc

SEQ ID NO: 4934667 - DNA, 14 bp, Homo sapiens
tgcatctcaaaatt

SEQ ID NO: 4934668 - DNA, 13 bp, Homo sapiens
tgcatctcagccc

SEQ ID NO: 4934669 - DNA, 14 bp, Homo sapiens
tgcatctcagccca

SEQ ID NO: 4934670 - DNA, 22 bp, Homo sapiens
tgcatctgaaataggaaacaag

SEQ ID NO: 4934671 - DNA, 21 bp, Homo sapiens
tgcatcttatagcactttgaa

SEQ ID NO: 4934672 - DNA, 19 bp, Homo sapiens
tgcatgaatatcatacaaa

SEQ ID NO: 4934673 - DNA, 15 bp, Homo sapiens
tgcatggaaacctga

SEQ ID NO: 4934674 - DNA, 13 bp, Homo sapiens
tgcatggagcagg

SEQ ID NO: 4934675 - DNA, 18 bp, Homo sapiens
tgcatggaggccctcctg

SEQ ID NO: 4934676 - DNA, 18 bp, Homo sapiens
tgcatggctccagaaatg

SEQ ID NO: 4934677 - DNA, 19 bp, Homo sapiens
tgcatggctccagaaatgt

SEQ ID NO: 4934678 - DNA, 20 bp, Homo sapiens
tgcatggctccagaaatgtc

SEQ ID NO: 4934679 - DNA, 15 bp, Homo sapiens
tgcatgtatgtcttg

SEQ ID NO: 4934680 - DNA, 16 bp, Homo sapiens
tgcatgtatgtcttgg

SEQ ID NO: 4934681 - DNA, 15 bp, Homo sapiens
tgcatgtggcttttt

SEQ ID NO: 4934682 - DNA, 22 bp, Homo sapiens
tgcatgtggtttggttcctctc

SEQ ID NO: 4934683 - DNA, 13 bp, Homo sapiens
tgcattaaattca

SEQ ID NO: 4934684 - DNA, 16 bp, Homo sapiens
tgcattagcacagatt

SEQ ID NO: 4934685 - DNA, 18 bp, Homo sapiens
tgcattagcacagatttt

SEQ ID NO: 4934686 - DNA, 22 bp, Homo sapiens
tgcattagggatgcctcctttc

SEQ ID NO: 4934687 - DNA, 15 bp, Homo sapiens
tgcattcctttgtct

SEQ ID NO: 4934688 - DNA, 13 bp, Homo sapiens
tgcattctattgc

SEQ ID NO: 4934689 - DNA, 16 bp, Homo sapiens
tgcattctattgcctt

SEQ ID NO: 4934690 - DNA, 19 bp, Homo sapiens
tgcattctattgccttctt

SEQ ID NO: 4934691 - DNA, 14 bp, Homo sapiens
tgcattctgcctct

SEQ ID NO: 4934692 - DNA, 15 bp, Homo sapiens
tgcattctgcctctc

SEQ ID NO: 4934693 - DNA, 20 bp, Homo sapiens
tgcattctgcctctctagga

SEQ ID NO: 4934694 - DNA, 18 bp, Homo sapiens
tgcattgaacacaaactg

SEQ ID NO: 4934695 - DNA, 19 bp, Homo sapiens
tgcattgaacacaaactgt

SEQ ID NO: 4934696 - DNA, 21 bp, Homo sapiens
tgcattgaacacaaactgtaa

SEQ ID NO: 4934697 - DNA, 22 bp, Homo sapiens
tgcattgaacacaaactgtaaa

SEQ ID NO: 4934698 - DNA, 16 bp, Homo sapiens
tgcattgctagataaa

SEQ ID NO: 4934699 - DNA, 17 bp, Homo sapiens
tgcattgctagataaaa

SEQ ID NO: 4934700 - DNA, 18 bp, Homo sapiens
tgcattgctagataaaag

SEQ ID NO: 4934701 - DNA, 19 bp, Homo sapiens
tgcattgttagcactaggc

SEQ ID NO: 4934702 - DNA, 16 bp, Homo sapiens
tgcatttatatgtacc

SEQ ID NO: 4934703 - DNA, 19 bp, Homo sapiens
tgcatttctgaatagaaat

SEQ ID NO: 4934704 - DNA, 16 bp, Homo sapiens
tgcatttgtaaatgct

SEQ ID NO: 4934705 - DNA, 19 bp, Homo sapiens
tgccaaaatcattttaatg

SEQ ID NO: 4934706 - DNA, 17 bp, Homo sapiens
tgccaaagtctcccttc

SEQ ID NO: 4934707 - DNA, 23 bp, Homo sapiens
tgccaactgttgtaactaggctc

SEQ ID NO: 4934708 - DNA, 12 bp, Homo sapiens
tgccaagacaaa

SEQ ID NO: 4934709 - DNA, 22 bp, Homo sapiens
tgccaagacaaatcaacagaag

SEQ ID NO: 4934710 - DNA, 23 bp, Homo sapiens
tgccaagacaaatcaacagaagc

SEQ ID NO: 4934711 - DNA, 21 bp, Homo sapiens
tgccaatactagtcaccccaa

SEQ ID NO: 4934712 - DNA, 15 bp, Homo sapiens
tgccaatatgtattg

SEQ ID NO: 4934713 - DNA, 19 bp, Homo sapiens
tgccaatattaaatctgct

SEQ ID NO: 4934714 - DNA, 13 bp, Homo sapiens
tgccacaccctcc

SEQ ID NO: 4934715 - DNA, 12 bp, Homo sapiens
tgcctcagcctc

SEQ ID NO: 4934716 - DNA, 14 bp, Homo sapiens
tgcctcagcctccg

SEQ ID NO: 4934717 - DNA, 18 bp, Homo sapiens
tgcctccccggctcgagc

SEQ ID NO: 4934718 - DNA, 14 bp, Homo sapiens
tgcctcctcttcaa

SEQ ID NO: 4934719 - DNA, 16 bp, Homo sapiens
tgcctcctcttcaact

SEQ ID NO: 4934720 - DNA, 14 bp, Homo sapiens
tgcctcctgtgtac

SEQ ID NO: 4934721 - DNA, 23 bp, Homo sapiens
tgcctcgaaacacagaaaccttt

SEQ ID NO: 4934722 - DNA, 18 bp, Homo sapiens
tgcctcgaactggctgca

SEQ ID NO: 4934723 - DNA, 19 bp, Homo sapiens
tgcctcgaactggctgcaa

SEQ ID NO: 4934724 - DNA, 20 bp, Homo sapiens
tgcctcggcctcccaaagtg

SEQ ID NO: 4934725 - DNA, 12 bp, Homo sapiens
tgcctctcacac

SEQ ID NO: 4934726 - DNA, 15 bp, Homo sapiens
tgcctctctaggacc

SEQ ID NO: 4934727 - DNA, 22 bp, Homo sapiens
tgcctctgacacacagctctgt

SEQ ID NO: 4934728 - DNA, 11 bp, Homo sapiens
tgcctctgcca

SEQ ID NO: 4934729 - DNA, 13 bp, Homo sapiens
tgcctctgcctgt

SEQ ID NO: 4934730 - DNA, 13 bp, Homo sapiens
tgcctctgcctta

SEQ ID NO: 4934731 - DNA, 13 bp, Homo sapiens
tgcctcttcctcc

SEQ ID NO: 4934732 - DNA, 22 bp, Homo sapiens
tgcctgaagtcacacagtgagt

SEQ ID NO: 4934733 - DNA, 12 bp, Homo sapiens
tgcctgccatgt

SEQ ID NO: 4934734 - DNA, 23 bp, Homo sapiens
tgcctgccatgtacctcccctgc

SEQ ID NO: 4934735 - DNA, 13 bp, Homo sapiens
tgcctgcccaggc

SEQ ID NO: 4934736 - DNA, 15 bp, Homo sapiens
tgcctgcccaggccc

SEQ ID NO: 4934737 - DNA, 16 bp, Homo sapiens
tgcctgcccaggcccc

SEQ ID NO: 4934738 - DNA, 20 bp, Homo sapiens
tgcctgccccaaacaaatat

SEQ ID NO: 4934739 - DNA, 20 bp, Homo sapiens
tgcctgcccgcacagcagcc

SEQ ID NO: 4934740 - DNA, 13 bp, Homo sapiens
tgcctgcgtcttc

SEQ ID NO: 4934741 - DNA, 18 bp, Homo sapiens
tgcctgcgtcttccgccc

SEQ ID NO: 4934742 - DNA, 21 bp, Homo sapiens
tgcctggacatttgccttgct

SEQ ID NO: 4934743 - DNA, 18 bp, Homo sapiens
tgcctggagacgtggaac

SEQ ID NO: 4934744 - DNA, 22 bp, Homo sapiens
tgcctggagacgtggaacctct

SEQ ID NO: 4934745 - DNA, 23 bp, Homo sapiens
tgcctggatcccctctgtctaca

SEQ ID NO: 4934746 - DNA, 16 bp, Homo sapiens
tgcctggcctggcaca

SEQ ID NO: 4934747 - DNA, 18 bp, Homo sapiens
tgcctggccttcctgtct

SEQ ID NO: 4934748 - DNA, 19 bp, Homo sapiens
tgcctgggggagttttcct

SEQ ID NO: 4934749 - DNA, 20 bp, Homo sapiens
tgcctgggggagttttcctc

SEQ ID NO: 4934750 - DNA, 15 bp, Homo sapiens
tgcctggtggcagct

SEQ ID NO: 4934751 - DNA, 18 bp, Homo sapiens
tgcctggtggcagctgcg

SEQ ID NO: 4934752 - DNA, 19 bp, Homo sapiens
tgcctggtggcagctgcgg

SEQ ID NO: 4934753 - DNA, 19 bp, Homo sapiens
tgcctgtagttaggaaata

SEQ ID NO: 4934754 - DNA, 21 bp, Homo sapiens
tgcctgtagttaggaaataaa

SEQ ID NO: 4934755 - DNA, 16 bp, Homo sapiens
tgcctgtccagcctgg

SEQ ID NO: 4934756 - DNA, 16 bp, Homo sapiens
tgcctgtcccaccccc

SEQ ID NO: 4934757 - DNA, 22 bp, Homo sapiens
tgcctgtggaagagtgtgtgtg

SEQ ID NO: 4934758 - DNA, 16 bp, Homo sapiens
tgcctgttcagctcca

SEQ ID NO: 4934759 - DNA, 20 bp, Homo sapiens
tgcctgttcagctccagctc

SEQ ID NO: 4934760 - DNA, 21 bp, Homo sapiens
tgcctgttcagctccagctca

SEQ ID NO: 4934761 - DNA, 22 bp, Homo sapiens
tgccttagaaatgtaaactgcc

SEQ ID NO: 4934762 - DNA, 23 bp, Homo sapiens
tgccttagaaatgtaaactgcca

SEQ ID NO: 4934763 - DNA, 18 bp, Homo sapiens
tgccttagaggagcccac

SEQ ID NO: 4934764 - DNA, 19 bp, Homo sapiens
tgccttagaggagcccacg

SEQ ID NO: 4934765 - DNA, 16 bp, Homo sapiens
tgccttaggcctacct

SEQ ID NO: 4934766 - DNA, 18 bp, Homo sapiens
tgccttcagctctacagc

SEQ ID NO: 4934767 - DNA, 22 bp, Homo sapiens
tgccttcctttctccaggacca

SEQ ID NO: 4934768 - DNA, 22 bp, Homo sapiens
tgccttctgacggccctgcaat

SEQ ID NO: 4934769 - DNA, 14 bp, Homo sapiens
tgccttctttgaag

SEQ ID NO: 4934770 - DNA, 15 bp, Homo sapiens
tgccttctttgaaga

SEQ ID NO: 4934771 - DNA, 13 bp, Homo sapiens
tgccttcttttgt

SEQ ID NO: 4934772 - DNA, 14 bp, Homo sapiens
tgccttcttttgta

SEQ ID NO: 4934773 - DNA, 19 bp, Homo sapiens
tgccttgaacctgtgagta

SEQ ID NO: 4934774 - DNA, 16 bp, Homo sapiens
tgccttgcagaactgc

SEQ ID NO: 4934775 - DNA, 17 bp, Homo sapiens
tgccttgggctgctcct

SEQ ID NO: 4934776 - DNA, 20 bp, Homo sapiens
tgcctttctgcagtttttca

SEQ ID NO: 4934777 - DNA, 15 bp, Homo sapiens
tgcctttgagacagt

SEQ ID NO: 4934778 - DNA, 18 bp, Homo sapiens
tgcctttgagacagtttc

SEQ ID NO: 4934779 - DNA, 23 bp, Homo sapiens
tgcctttgagacagtttcttagc

SEQ ID NO: 4934780 - DNA, 15 bp, Homo sapiens
tgcctttgttttgat

SEQ ID NO: 4934781 - DNA, 13 bp, Homo sapiens
tgcctttttattt

SEQ ID NO: 4934782 - DNA, 15 bp, Homo sapiens
tgcctttttatttat

SEQ ID NO: 4934783 - DNA, 22 bp, Homo sapiens
tgcgaatccaagctccctgccc

SEQ ID NO: 4934784 - DNA, 16 bp, Homo sapiens
tgcgatagagtctcac

SEQ ID NO: 4934785 - DNA, 15 bp, Homo sapiens
tgcgatctgggttca

SEQ ID NO: 4934786 - DNA, 19 bp, Homo sapiens
tgcgatctgggttcactgc

SEQ ID NO: 4934787 - DNA, 20 bp, Homo sapiens
tgcgatctgggttcactgca

SEQ ID NO: 4934788 - DNA, 19 bp, Homo sapiens
tgcgattttgcctgtgtct

SEQ ID NO: 4934789 - DNA, 18 bp, Homo sapiens
tgcgcctgtgatgctggg

SEQ ID NO: 4934790 - DNA, 23 bp, Homo sapiens
tgcggacagccacggccaggcca

SEQ ID NO: 4934791 - DNA, 23 bp, Homo sapiens
tgcggaccccagctgtgagcctt

SEQ ID NO: 4934792 - DNA, 14 bp, Homo sapiens
tgcgtcttccgccc

SEQ ID NO: 4934793 - DNA, 19 bp, Homo sapiens
tgcgtcttccgcccctgcc

SEQ ID NO: 4934794 - DNA, 20 bp, Homo sapiens
tgcgtcttccgcccctgcct

SEQ ID NO: 4934795 - DNA, 19 bp, Homo sapiens
tgcgtgtgtagagttaaga

SEQ ID NO: 4934796 - DNA, 20 bp, Homo sapiens
tgcgtgtgtagagttaagaa

SEQ ID NO: 4934797 - DNA, 13 bp, Homo sapiens
tgcgttttggaag

SEQ ID NO: 4934798 - DNA, 22 bp, Homo sapiens
tgctaaatggtcgcccaggaga

SEQ ID NO: 4934799 - DNA, 13 bp, Homo sapiens
tgctaaggttcta

SEQ ID NO: 4934800 - DNA, 17 bp, Homo sapiens
tgctaatcaaagccagg

SEQ ID NO: 4934801 - DNA, 17 bp, Homo sapiens
tgctaattaaaaagtta

SEQ ID NO: 4934802 - DNA, 18 bp, Homo sapiens
tgctaatttatcctgaaa

SEQ ID NO: 4934803 - DNA, 20 bp, Homo sapiens
tgctacagatgatagaggat

SEQ ID NO: 4934804 - DNA, 14 bp, Homo sapiens
tgctacataaattg

SEQ ID NO: 4934805 - DNA, 23 bp, Homo sapiens
tgctacccatgactttatatgga

SEQ ID NO: 4934806 - DNA, 18 bp, Homo sapiens
tgctaccgttgacttcca

SEQ ID NO: 4934807 - DNA, 14 bp, Homo sapiens
tgctagataaaagc

SEQ ID NO: 4934808 - DNA, 22 bp, Homo sapiens
tgctagcagtaaaagatgaagt

SEQ ID NO: 4934809 - DNA, 20 bp, Homo sapiens
tgctaggatgcggaaatccc

SEQ ID NO: 4934810 - DNA, 12 bp, Homo sapiens
tgctagtatttg

SEQ ID NO: 4934811 - DNA, 13 bp, Homo sapiens
tgctagtatttga

SEQ ID NO: 4934812 - DNA, 23 bp, Homo sapiens
tgctagtatttgaattaaaactt

SEQ ID NO: 4934813 - DNA, 13 bp, Homo sapiens
tgctagtgagctg

SEQ ID NO: 4934814 - DNA, 15 bp, Homo sapiens
tgctatatatataaa

SEQ ID NO: 4934815 - DNA, 17 bp, Homo sapiens
tgctatatatataaata

SEQ ID NO: 4934816 - DNA, 20 bp, Homo sapiens
tgctatctctgtgtgcacaa

SEQ ID NO: 4934817 - DNA, 23 bp, Homo sapiens
tgctatctggaggccttccagct

SEQ ID NO: 4934818 - DNA, 19 bp, Homo sapiens
tgctatgttactattttct

SEQ ID NO: 4934819 - DNA, 20 bp, Homo sapiens
tgctattgttactcttacga

SEQ ID NO: 4934820 - DNA, 17 bp, Homo sapiens
tgctcacaacttagtgt

SEQ ID NO: 4934821 - DNA, 19 bp, Homo sapiens
tgctcaggctgcagctgga

SEQ ID NO: 4934822 - DNA, 16 bp, Homo sapiens
tgctcagggtcaattt

SEQ ID NO: 4934823 - DNA, 19 bp, Homo sapiens
tgctcatactacattgagt

SEQ ID NO: 4934824 - DNA, 15 bp, Homo sapiens
tgcttctccccagaa

SEQ ID NO: 4934825 - DNA, 18 bp, Homo sapiens
tgcttctgaatgtgctga

SEQ ID NO: 4934826 - DNA, 14 bp, Homo sapiens
tgcttgagcccagg

SEQ ID NO: 4934827 - DNA, 20 bp, Homo sapiens
tgcttgatgaagcaaggaag

SEQ ID NO: 4934828 - DNA, 19 bp, Homo sapiens
tgcttgcctgcgttttgga

SEQ ID NO: 4934829 - DNA, 12 bp, Homo sapiens
tgcttgtacctc

SEQ ID NO: 4934830 - DNA, 14 bp, Homo sapiens
tgcttgtacctctg

SEQ ID NO: 4934831 - DNA, 16 bp, Homo sapiens
tgcttgtgaaaatgtg

SEQ ID NO: 4934832 - DNA, 20 bp, Homo sapiens
tgcttgtgaaaatgtgttct

SEQ ID NO: 4934833 - DNA, 16 bp, Homo sapiens
tgctttaaagataaaa

SEQ ID NO: 4934834 - DNA, 15 bp, Homo sapiens
tgctttaaagtgtaa

SEQ ID NO: 4934835 - DNA, 15 bp, Homo sapiens
tgctttatgccttct

SEQ ID NO: 4934836 - DNA, 21 bp, Homo sapiens
tgctttctatgctgtttgtag

SEQ ID NO: 4934837 - DNA, 22 bp, Homo sapiens
tgctttgaagcagttgtgtcag

SEQ ID NO: 4934838 - DNA, 22 bp, Homo sapiens
tgctttgatttacagcaagtag

SEQ ID NO: 4934839 - DNA, 16 bp, Homo sapiens
tgctttgggctgccct

SEQ ID NO: 4934840 - DNA, 16 bp, Homo sapiens
tgcttttaattaaata

SEQ ID NO: 4934841 - DNA, 16 bp, Homo sapiens
tgcttttattttgaaa

SEQ ID NO: 4934842 - DNA, 19 bp, Homo sapiens
tgcttttccctcttttctt

SEQ ID NO: 4934843 - DNA, 17 bp, Homo sapiens
tgcttttggtctgtgtg

SEQ ID NO: 4934844 - DNA, 18 bp, Homo sapiens
tgcttttggtctgtgtga

SEQ ID NO: 4934845 - DNA, 20 bp, Homo sapiens
tgcttttgtctatgggactc

SEQ ID NO: 4934846 - DNA, 18 bp, Homo sapiens
tgctttttatttctgcat

SEQ ID NO: 4934847 - DNA, 19 bp, Homo sapiens
tgctttttatttctgcata

SEQ ID NO: 4934848 - DNA, 15 bp, Homo sapiens
tgctttttcaccaga

SEQ ID NO: 4934849 - DNA, 13 bp, Homo sapiens
tgctttttgaaat

SEQ ID NO: 4934850 - DNA, 14 bp, Homo sapiens
tgctttttgaaatg

SEQ ID NO: 4934851 - DNA, 17 bp, Homo sapiens
tgctttttgaaatgaaa

SEQ ID NO: 4934852 - DNA, 13 bp, Homo sapiens
tgcttttttgtat

SEQ ID NO: 4934853 - DNA, 17 bp, Homo sapiens
tgcttttttttttccag

SEQ ID NO: 4934854 - DNA, 22 bp, Homo sapiens
tgcttttttttttccagcaagt

SEQ ID NO: 4934855 - DNA, 23 bp, Homo sapiens
tggaaaaatcacaatttttaatg

SEQ ID NO: 4934856 - DNA, 16 bp, Homo sapiens
tggaaaaattccagaa

SEQ ID NO: 4934857 - DNA, 15 bp, Homo sapiens
tggaaaagaactgtt

SEQ ID NO: 4934858 - DNA, 17 bp, Homo sapiens
tggaaacctctacatat

SEQ ID NO: 4934859 - DNA, 17 bp, Homo sapiens
tggaaataataaaagat

SEQ ID NO: 4934860 - DNA, 19 bp, Homo sapiens
tggaaatcctagtttcctc

SEQ ID NO: 4934861 - DNA, 16 bp, Homo sapiens
tggaacaaagtgaagg

SEQ ID NO: 4934862 - DNA, 20 bp, Homo sapiens
tggaacataaaaaggacatc

SEQ ID NO: 4934863 - DNA, 22 bp, Homo sapiens
tggaacatcctttgcagggcag

SEQ ID NO: 4934864 - DNA, 13 bp, Homo sapiens
tggaaccttgctg

SEQ ID NO: 4934865 - DNA, 14 bp, Homo sapiens
tggaactaataaat

SEQ ID NO: 4934866 - DNA, 22 bp, Homo sapiens
tggaactctatctgggcctggg

SEQ ID NO: 4934867 - DNA, 23 bp, Homo sapiens
tggaactctatctgggcctgggc

SEQ ID NO: 4934868 - DNA, 13 bp, Homo sapiens
tggaacttctaat

SEQ ID NO: 4934869 - DNA, 16 bp, Homo sapiens
tggaacttttattaga

SEQ ID NO: 4934870 - DNA, 12 bp, Homo sapiens
tggaagagaatc

SEQ ID NO: 4934871 - DNA, 17 bp, Homo sapiens
tggaagattttcagtct

SEQ ID NO: 4934872 - DNA, 14 bp, Homo sapiens
tggaagcaaagtat

SEQ ID NO: 4934873 - DNA, 23 bp, Homo sapiens
tggaaggcagacagcaggcagcg

SEQ ID NO: 4934874 - DNA, 15 bp, Homo sapiens
tggaagggtttgtgg

SEQ ID NO: 4934875 - DNA, 18 bp, Homo sapiens
tggaataaaaggcttgaa

SEQ ID NO: 4934876 - DNA, 18 bp, Homo sapiens
tggaatactttttgttat

SEQ ID NO: 4934877 - DNA, 14 bp, Homo sapiens
tggaataggaataa

SEQ ID NO: 4934878 - DNA, 17 bp, Homo sapiens
tggaatctggagaccag

SEQ ID NO: 4934879 - DNA, 18 bp, Homo sapiens
tggaatgaattaaataaa

SEQ ID NO: 4934880 - DNA, 18 bp, Homo sapiens
tggaatgagtgtgcatgg

SEQ ID NO: 4934881 - DNA, 21 bp, Homo sapiens
tggaatgagtgtgcatggagg

SEQ ID NO: 4934882 - DNA, 16 bp, Homo sapiens
tggaatggtttgggaa

SEQ ID NO: 4934883 - DNA, 21 bp, Homo sapiens
tggaatgtggcccctgaacaa

SEQ ID NO: 4934884 - DNA, 17 bp, Homo sapiens
tggaattgatttgcatt

SEQ ID NO: 4934885 - DNA, 19 bp, Homo sapiens
tggaattgatttgcattga

SEQ ID NO: 4934886 - DNA, 20 bp, Homo sapiens
tggaattgatttgcattgaa

SEQ ID NO: 4934887 - DNA, 22 bp, Homo sapiens
tggaattgatttgcattgaaca

SEQ ID NO: 4934888 - DNA, 13 bp, Homo sapiens
tggaatttcttgt

SEQ ID NO: 4934889 - DNA, 22 bp, Homo sapiens
tggaatttcttgtttctccaga

SEQ ID NO: 4934890 - DNA, 13 bp, Homo sapiens
tggaatttgttca

SEQ ID NO: 4934891 - DNA, 16 bp, Homo sapiens
tggacaaactggagtc

SEQ ID NO: 4934892 - DNA, 20 bp, Homo sapiens
tggacaaactggagtctgga

SEQ ID NO: 4934893 - DNA, 22 bp, Homo sapiens
tggacaagcagaggtggccaga

SEQ ID NO: 4934894 - DNA, 13 bp, Homo sapiens
tggacacagctct

SEQ ID NO: 4934895 - DNA, 18 bp, Homo sapiens
tggacacagctcttctcc

SEQ ID NO: 4934896 - DNA, 21 bp, Homo sapiens
tggacacagctcttctccagg

SEQ ID NO: 4934897 - DNA, 15 bp, Homo sapiens
tggacactcagacct

SEQ ID NO: 4934898 - DNA, 21 bp, Homo sapiens
tggacactccagtgccagcaa

SEQ ID NO: 4934899 - DNA, 23 bp, Homo sapiens
tggacacttaatactaccttgaa

SEQ ID NO: 4934900 - DNA, 20 bp, Homo sapiens
tggacagaggggactctggg

SEQ ID NO: 4934901 - DNA, 12 bp, Homo sapiens
tggacaggcatg

SEQ ID NO: 4934902 - DNA, 14 bp, Homo sapiens
tggacaggctctgc

SEQ ID NO: 4934903 - DNA, 13 bp, Homo sapiens
tggacagtcactg

SEQ ID NO: 4934904 - DNA, 22 bp, Homo sapiens
tggacatagatattttcacaat

SEQ ID NO: 4934905 - DNA, 15 bp, Homo sapiens
tggacattgtctgcg

SEQ ID NO: 4934906 - DNA, 17 bp, Homo sapiens
tggacatttgccttgct

SEQ ID NO: 4934907 - DNA, 18 bp, Homo sapiens
tggacatttgccttgctg

SEQ ID NO: 4934908 - DNA, 20 bp, Homo sapiens
tggaccaattattgatatat

SEQ ID NO: 4934909 - DNA, 21 bp, Homo sapiens
tggaccaattattgatatata

SEQ ID NO: 4934910 - DNA, 19 bp, Homo sapiens
tggaccactgggcaatgat

SEQ ID NO: 4934911 - DNA, 21 bp, Homo sapiens
tggaccactgtttcttgcttg

SEQ ID NO: 4934912 - DNA, 13 bp, Homo sapiens
tggaccccagaga

SEQ ID NO: 4934913 - DNA, 20 bp, Homo sapiens
tggacctctactttccaggc

SEQ ID NO: 4934914 - DNA, 18 bp, Homo sapiens
tggacctgcctcctgcct

SEQ ID NO: 4934915 - DNA, 21 bp, Homo sapiens
tggaccttttaaagtgtttca

SEQ ID NO: 4934916 - DNA, 22 bp, Homo sapiens
tggactaaatgcctagttttta

SEQ ID NO: 4934917 - DNA, 14 bp, Homo sapiens
tggactctgcacat

SEQ ID NO: 4934918 - DNA, 13 bp, Homo sapiens
tggactctgcatc

SEQ ID NO: 4934919 - DNA, 21 bp, Homo sapiens
tggactctggtgcctccagag

SEQ ID NO: 4934920 - DNA, 20 bp, Homo sapiens
tggactcttcaaaaactgtt

SEQ ID NO: 4934921 - DNA, 21 bp, Homo sapiens
tggactgacagcatgtgccct

SEQ ID NO: 4934922 - DNA, 20 bp, Homo sapiens
tggactggcccctgggtcag

SEQ ID NO: 4934923 - DNA, 13 bp, Homo sapiens
tggactgggaggt

SEQ ID NO: 4934924 - DNA, 18 bp, Homo sapiens
tggactgtggcacttgcc

SEQ ID NO: 4934925 - DNA, 20 bp, Homo sapiens
tggactgttttctctcggct

SEQ ID NO: 4934926 - DNA, 21 bp, Homo sapiens
tggacttagaaagcaggggct

SEQ ID NO: 4934927 - DNA, 19 bp, Homo sapiens
tggagaaattatttaataa

SEQ ID NO: 4934928 - DNA, 17 bp, Homo sapiens
tggagaagaccctcccc

SEQ ID NO: 4934929 - DNA, 12 bp, Homo sapiens
tggagaagagag

SEQ ID NO: 4934930 - DNA, 16 bp, Homo sapiens
tggagaagagaggaga

SEQ ID NO: 4934931 - DNA, 17 bp, Homo sapiens
tggagacacaactattt

SEQ ID NO: 4934932 - DNA, 20 bp, Homo sapiens
tggagacagccccagagcag

SEQ ID NO: 4934933 - DNA, 12 bp, Homo sapiens
tgggatgctcct

SEQ ID NO: 4934934 - DNA, 15 bp, Homo sapiens
tgggatggaggggag

SEQ ID NO: 4934935 - DNA, 16 bp, Homo sapiens
tgggattacaggtgtg

SEQ ID NO: 4934936 - DNA, 14 bp, Homo sapiens
tgggatttaatttc

SEQ ID NO: 4934937 - DNA, 17 bp, Homo sapiens
tgggatttaatttccag

SEQ ID NO: 4934938 - DNA, 19 bp, Homo sapiens
tgggcaaggaaaaagaaaa

SEQ ID NO: 4934939 - DNA, 22 bp, Homo sapiens
tgggcacaactgcaataacttc

SEQ ID NO: 4934940 - DNA, 16 bp, Homo sapiens
tgggcactggcccagg

SEQ ID NO: 4934941 - DNA, 12 bp, Homo sapiens
tgggcagcaatt

SEQ ID NO: 4934942 - DNA, 21 bp, Homo sapiens
tgggcagcaatttaaatgtta

SEQ ID NO: 4934943 - DNA, 15 bp, Homo sapiens
tgggcagccaggctg

SEQ ID NO: 4934944 - DNA, 15 bp, Homo sapiens
tgggcataaactgtt

SEQ ID NO: 4934945 - DNA, 23 bp, Homo sapiens
tgggcattgacaaatctgtgtat

SEQ ID NO: 4934946 - DNA, 22 bp, Homo sapiens
tgggccagggctgccctgagaa

SEQ ID NO: 4934947 - DNA, 19 bp, Homo sapiens
tgggccagggtctgtgtga

SEQ ID NO: 4934948 - DNA, 14 bp, Homo sapiens
tgggccatgtccaa

SEQ ID NO: 4934949 - DNA, 23 bp, Homo sapiens
tgggcccaagacagatgccccag

SEQ ID NO: 4934950 - DNA, 18 bp, Homo sapiens
tgggccccccagctcagg

SEQ ID NO: 4934951 - DNA, 20 bp, Homo sapiens
tgggcctctgcttctctcac

SEQ ID NO: 4934952 - DNA, 16 bp, Homo sapiens
tgggcctgggctaggg

SEQ ID NO: 4934953 - DNA, 17 bp, Homo sapiens
tgggctaattaaataaa

SEQ ID NO: 4934954 - DNA, 23 bp, Homo sapiens
tgggctaggtagaaaaagggtca

SEQ ID NO: 4934955 - DNA, 16 bp, Homo sapiens
tgggctagttgggctt

SEQ ID NO: 4934956 - DNA, 13 bp, Homo sapiens
tgggctatggaca

SEQ ID NO: 4934957 - DNA, 21 bp, Homo sapiens
tgggctatggacacagggtga

SEQ ID NO: 4934958 - DNA, 12 bp, Homo sapiens
tgggctcctggc

SEQ ID NO: 4934959 - DNA, 15 bp, Homo sapiens
tgggctgccctggtg

SEQ ID NO: 4934960 - DNA, 15 bp, Homo sapiens
tgggctgctcctcat

SEQ ID NO: 4934961 - DNA, 17 bp, Homo sapiens
tgggctggtgtcacctg

SEQ ID NO: 4934962 - DNA, 17 bp, Homo sapiens
tgggcttcagtggcagc

SEQ ID NO: 4934963 - DNA, 21 bp, Homo sapiens
tgggcttcagtggcagctgct

SEQ ID NO: 4934964 - DNA, 22 bp, Homo sapiens
tgggcttcagtggcagctgctt

SEQ ID NO: 4934965 - DNA, 14 bp, Homo sapiens
tgggcttgattctg

SEQ ID NO: 4934966 - DNA, 16 bp, Homo sapiens
tgggctttgatttcca

SEQ ID NO: 4934967 - DNA, 22 bp, Homo sapiens
tggggaaagacactgcctgggc

SEQ ID NO: 4934968 - DNA, 11 bp, Homo sapiens
tggggaaaggg

SEQ ID NO: 4934969 - DNA, 21 bp, Homo sapiens
tggggacagattcagtcttgc

SEQ ID NO: 4934970 - DNA, 13 bp, Homo sapiens
tggggacccaggc

SEQ ID NO: 4934971 - DNA, 14 bp, Homo sapiens
tggggacccaggct

SEQ ID NO: 4934972 - DNA, 22 bp, Homo sapiens
tggggacccaggctccgccctt

SEQ ID NO: 4934973 - DNA, 22 bp, Homo sapiens
tggggagaggaactccttggcc

SEQ ID NO: 4934974 - DNA, 23 bp, Homo sapiens
tggggatgagaaaggttgaagca

SEQ ID NO: 4934975 - DNA, 16 bp, Homo sapiens
tggggatgtgggaggg

SEQ ID NO: 4934976 - DNA, 17 bp, Homo sapiens
tggggcacagtccagga

SEQ ID NO: 4934977 - DNA, 13 bp, Homo sapiens
tggggcagagcct

SEQ ID NO: 4934978 - DNA, 16 bp, Homo sapiens
tggggcagcttgaggg

SEQ ID NO: 4934979 - DNA, 14 bp, Homo sapiens
tggggcaggctggg

SEQ ID NO: 4934980 - DNA, 15 bp, Homo sapiens
tggggcaggctgggc

SEQ ID NO: 4934981 - DNA, 16 bp, Homo sapiens
tggggcaggctgggcc

SEQ ID NO: 4934982 - DNA, 20 bp, Homo sapiens
tggggccaccaaagctgccc

SEQ ID NO: 4934983 - DNA, 21 bp, Homo sapiens
tggggccaccaaagctgccca

SEQ ID NO: 4934984 - DNA, 14 bp, Homo sapiens
tggggcctcagacg

SEQ ID NO: 4934985 - DNA, 13 bp, Homo sapiens
tggggcctgagag

SEQ ID NO: 4934986 - DNA, 20 bp, Homo sapiens
tggggcctggacctgcctcc

SEQ ID NO: 4934987 - DNA, 16 bp, Homo sapiens
tggggcctgtggaatg

SEQ ID NO: 4934988 - DNA, 21 bp, Homo sapiens
tggggcctgtggaatgagtgt

SEQ ID NO: 4934989 - DNA, 18 bp, Homo sapiens
tggggcggtgagagggga

SEQ ID NO: 4934990 - DNA, 21 bp, Homo sapiens
tgggggagtagatctttctag

SEQ ID NO: 4934991 - DNA, 17 bp, Homo sapiens
tgggggagttttcctct

SEQ ID NO: 4934992 - DNA, 22 bp, Homo sapiens
tgggggcaggagggccctacct

SEQ ID NO: 4934993 - DNA, 17 bp, Homo sapiens
tgggggccacctgcctg

SEQ ID NO: 4934994 - DNA, 21 bp, Homo sapiens
tgggggggccaaaaggaaaaa

SEQ ID NO: 4934995 - DNA, 15 bp, Homo sapiens
tgggggtgagggtcc

SEQ ID NO: 4934996 - DNA, 19 bp, Homo sapiens
tgggggttctttcttcctc

SEQ ID NO: 4934997 - DNA, 15 bp, Homo sapiens
tggggtacccactgc

SEQ ID NO: 4934998 - DNA, 17 bp, Homo sapiens
tggggtacccactgctc

SEQ ID NO: 4934999 - DNA, 18 bp, Homo sapiens
tggggtacccactgctct

SEQ ID NO: 4935000 - DNA, 13 bp, Homo sapiens
tggggtagggctg

SEQ ID NO: 4935001 - DNA, 16 bp, Homo sapiens
tggggtagggctgact

SEQ ID NO: 4935002 - DNA, 10 bp, Homo sapiens
tggggtctct

SEQ ID NO: 4935003 - DNA, 12 bp, Homo sapiens
tggggtgacagt

SEQ ID NO: 4935004 - DNA, 14 bp, Homo sapiens
tggggtgacagtca

SEQ ID NO: 4935005 - DNA, 17 bp, Homo sapiens
tggggtgacagtcatca

SEQ ID NO: 4935006 - DNA, 23 bp, Homo sapiens
tggggtgacagtcatcatcaggg

SEQ ID NO: 4935007 - DNA, 18 bp, Homo sapiens
tgggtaaatgcaaagttc

SEQ ID NO: 4935008 - DNA, 18 bp, Homo sapiens
tgggtacttgtggacaca

SEQ ID NO: 4935009 - DNA, 23 bp, Homo sapiens
tgggtacttgtggacacagctct

SEQ ID NO: 4935010 - DNA, 22 bp, Homo sapiens
tgggtagctgccacttgaacaa

SEQ ID NO: 4935011 - DNA, 18 bp, Homo sapiens
tgggtccccctcagcaag

SEQ ID NO: 4935012 - DNA, 21 bp, Homo sapiens
tgggtccgataatatctttgt

SEQ ID NO: 4935013 - DNA, 19 bp, Homo sapiens
tgggtgagatgctggagaa

SEQ ID NO: 4935014 - DNA, 20 bp, Homo sapiens
tgggtgattcctaagccact

SEQ ID NO: 4935015 - DNA, 22 bp, Homo sapiens
tgggtgctcagaataaggcagg

SEQ ID NO: 4935016 - DNA, 17 bp, Homo sapiens
tgggtggaaactaagac

SEQ ID NO: 4935017 - DNA, 23 bp, Homo sapiens
tgggtggatgcctggtggcagct

SEQ ID NO: 4935018 - DNA, 13 bp, Homo sapiens
tgggtggtaccct

SEQ ID NO: 4935019 - DNA, 14 bp, Homo sapiens
tgggtgtagccagg

SEQ ID NO: 4935020 - DNA, 21 bp, Homo sapiens
tgggtgtcaagagggtctgag

SEQ ID NO: 4935021 - DNA, 20 bp, Homo sapiens
tgggtgtcatttcattccat

SEQ ID NO: 4935022 - DNA, 16 bp, Homo sapiens
tgggttattctggagt

SEQ ID NO: 4935023 - DNA, 20 bp, Homo sapiens
tgggttccctttccttccat

SEQ ID NO: 4935024 - DNA, 21 bp, Homo sapiens
tgggtttttttttttaaaaaa

SEQ ID NO: 4935025 - DNA, 21 bp, Homo sapiens
tggtaaactatttgtctttca

SEQ ID NO: 4935026 - DNA, 22 bp, Homo sapiens
tggtaagagacagaatgtatct

SEQ ID NO: 4935027 - DNA, 13 bp, Homo sapiens
tggtaccagccct

SEQ ID NO: 4935028 - DNA, 18 bp, Homo sapiens
tggtaccagccctggggc

SEQ ID NO: 4935029 - DNA, 14 bp, Homo sapiens
tggtaccctctgga

SEQ ID NO: 4935030 - DNA, 17 bp, Homo sapiens
tggtacttttgagtgtg

SEQ ID NO: 4935031 - DNA, 17 bp, Homo sapiens
tggtagaccaaaataaa

SEQ ID NO: 4935032 - DNA, 16 bp, Homo sapiens
tggtaggcatttccta

SEQ ID NO: 4935033 - DNA, 15 bp, Homo sapiens
tggtcacacactgat

SEQ ID NO: 4935034 - DNA, 16 bp, Homo sapiens
tggtcacacactgatg

SEQ ID NO: 4935035 - DNA, 17 bp, Homo sapiens
tggtcacagcctcctct

SEQ ID NO: 4935036 - DNA, 19 bp, Homo sapiens
tggtcacaggactctgcct

SEQ ID NO: 4935037 - DNA, 20 bp, Homo sapiens
tggtcatgtgggtcttccag

SEQ ID NO: 4935038 - DNA, 12 bp, Homo sapiens
tggtccagagcg

SEQ ID NO: 4935039 - DNA, 17 bp, Homo sapiens
tggtccagggaagctgg

SEQ ID NO: 4935040 - DNA, 19 bp, Homo sapiens
tggtccagggaagctggcc

SEQ ID NO: 4935041 - DNA, 15 bp, Homo sapiens
tggtccatgcagggg

SEQ ID NO: 4935042 - DNA, 13 bp, Homo sapiens
tggtcccactcag

SEQ ID NO: 4935043 - DNA, 22 bp, Homo sapiens
tgtatttatgtaatgaagtaaa

SEQ ID NO: 4935044 - DNA, 17 bp, Homo sapiens
tgtatttatgtgtgagg

SEQ ID NO: 4935045 - DNA, 16 bp, Homo sapiens
tgtatttgttcatgtt

SEQ ID NO: 4935046 - DNA, 19 bp, Homo sapiens
tgtatttgttcatgtttgg

SEQ ID NO: 4935047 - DNA, 18 bp, Homo sapiens
tgtatttttcaataataa

SEQ ID NO: 4935048 - DNA, 13 bp, Homo sapiens
tgtcaaaacactg

SEQ ID NO: 4935049 - DNA, 17 bp, Homo sapiens
tgtcaaaagttggacta

SEQ ID NO: 4935050 - DNA, 22 bp, Homo sapiens
tgtcaacaaaccaagcatcagg

SEQ ID NO: 4935051 - DNA, 23 bp, Homo sapiens
tgtcaacaaaccaagcatcaggg

SEQ ID NO: 4935052 - DNA, 16 bp, Homo sapiens
tgtcaagtctctgctg

SEQ ID NO: 4935053 - DNA, 17 bp, Homo sapiens
tgtcaagtctctgctgg

SEQ ID NO: 4935054 - DNA, 18 bp, Homo sapiens
tgtcaagtctctgctggc

SEQ ID NO: 4935055 - DNA, 14 bp, Homo sapiens
tgtcacaccagcca

SEQ ID NO: 4935056 - DNA, 15 bp, Homo sapiens
tgtcacaggcaggtc

SEQ ID NO: 4935057 - DNA, 11 bp, Homo sapiens
tgtcacagggc

SEQ ID NO: 4935058 - DNA, 14 bp, Homo sapiens
tgtcacattgcatt

SEQ ID NO: 4935059 - DNA, 21 bp, Homo sapiens
tgtcacattgcattctattgc

SEQ ID NO: 4935060 - DNA, 13 bp, Homo sapiens
tgtcacctgaaga

SEQ ID NO: 4935061 - DNA, 18 bp, Homo sapiens
tgtcacgtactgtctgat

SEQ ID NO: 4935062 - DNA, 19 bp, Homo sapiens
tgtcacgtactgtctgatt

SEQ ID NO: 4935063 - DNA, 16 bp, Homo sapiens
tgtcactcattgctga

SEQ ID NO: 4935064 - DNA, 21 bp, Homo sapiens
tgtcactggtagaccaaaata

SEQ ID NO: 4935065 - DNA, 18 bp, Homo sapiens
tgtcacttgtgctttgct

SEQ ID NO: 4935066 - DNA, 20 bp, Homo sapiens
tgtcacttgtgctttgctct

SEQ ID NO: 4935067 - DNA, 23 bp, Homo sapiens
tgtcagacagaacttgaatgtgt

SEQ ID NO: 4935068 - DNA, 23 bp, Homo sapiens
tgtcagacatccatgtttgtaaa

SEQ ID NO: 4935069 - DNA, 21 bp, Homo sapiens
tgtcagatgagaacaaagctg

SEQ ID NO: 4935070 - DNA, 23 bp, Homo sapiens
tgtcagatgagaacaaagctgtt

SEQ ID NO: 4935071 - DNA, 17 bp, Homo sapiens
tgtcaggaacagaagga

SEQ ID NO: 4935072 - DNA, 16 bp, Homo sapiens
tgtcatagaaattaca

SEQ ID NO: 4935073 - DNA, 16 bp, Homo sapiens
tgtcatatactgccat

SEQ ID NO: 4935074 - DNA, 20 bp, Homo sapiens
tgtcatcagagctcctctgt

SEQ ID NO: 4935075 - DNA, 15 bp, Homo sapiens
tgtcatcagccacca

SEQ ID NO: 4935076 - DNA, 18 bp, Homo sapiens
tgtcatcagccaccatcc

SEQ ID NO: 4935077 - DNA, 21 bp, Homo sapiens
tgtcatcagccaccatcctat

SEQ ID NO: 4935078 - DNA, 19 bp, Homo sapiens
tgtcatgaattcttatgct

SEQ ID NO: 4935079 - DNA, 21 bp, Homo sapiens
tgtcatgaattcttatgctta

SEQ ID NO: 4935080 - DNA, 17 bp, Homo sapiens
tgtcatgtgttcccttt

SEQ ID NO: 4935081 - DNA, 18 bp, Homo sapiens
tgtcatgtgttccctttg

SEQ ID NO: 4935082 - DNA, 19 bp, Homo sapiens
tgtcatgtgttccctttgt

SEQ ID NO: 4935083 - DNA, 22 bp, Homo sapiens
tgtcatgtgttccctttgtctt

SEQ ID NO: 4935084 - DNA, 14 bp, Homo sapiens
tgtcattgtaaaca

SEQ ID NO: 4935085 - DNA, 18 bp, Homo sapiens
tgtcattgtaaacaaact

SEQ ID NO: 4935086 - DNA, 16 bp, Homo sapiens
tgtcatttcattccat

SEQ ID NO: 4935087 - DNA, 17 bp, Homo sapiens
tgtcatttgttgtgatg

SEQ ID NO: 4935088 - DNA, 11 bp, Homo sapiens
tgtccaaagag

SEQ ID NO: 4935089 - DNA, 19 bp, Homo sapiens
tgtccaaagaggctgcccc

SEQ ID NO: 4935090 - DNA, 20 bp, Homo sapiens
tgtccaaagaggctgcccct

SEQ ID NO: 4935091 - DNA, 19 bp, Homo sapiens
tgtccaaaggaggctggca

SEQ ID NO: 4935092 - DNA, 14 bp, Homo sapiens
tgtccacctgtggg

SEQ ID NO: 4935093 - DNA, 13 bp, Homo sapiens
tgtccactgtgta

SEQ ID NO: 4935094 - DNA, 19 bp, Homo sapiens
tgtccagcctgggcagcca

SEQ ID NO: 4935095 - DNA, 22 bp, Homo sapiens
tgtccagcctgggcagccaggc

SEQ ID NO: 4935096 - DNA, 23 bp, Homo sapiens
tgtccagcctgggcagccaggct

SEQ ID NO: 4935097 - DNA, 15 bp, Homo sapiens
tgtccatgcttctca

SEQ ID NO: 4935098 - DNA, 20 bp, Homo sapiens
tgtccatgtggttcttcaaa

SEQ ID NO: 4935099 - DNA, 19 bp, Homo sapiens
tgtcccatggacactccag

SEQ ID NO: 4935100 - DNA, 22 bp, Homo sapiens
tgtcccatggacactccagtgc

SEQ ID NO: 4935101 - DNA, 17 bp, Homo sapiens
tgtccccgtgttgcatg

SEQ ID NO: 4935102 - DNA, 12 bp, Homo sapiens
tgtccctcccac

SEQ ID NO: 4935103 - DNA, 14 bp, Homo sapiens
tgtccctcccacct

SEQ ID NO: 4935104 - DNA, 15 bp, Homo sapiens
tgtccctcccacctc

SEQ ID NO: 4935105 - DNA, 16 bp, Homo sapiens
tgtccctcccacctct

SEQ ID NO: 4935106 - DNA, 14 bp, Homo sapiens
tgtccctgcacttg

SEQ ID NO: 4935107 - DNA, 23 bp, Homo sapiens
tgtccctgcacttgcagactcta

SEQ ID NO: 4935108 - DNA, 20 bp, Homo sapiens
tgtccctgggccagggtctg

SEQ ID NO: 4935109 - DNA, 20 bp, Homo sapiens
tgtccgctgggtggtaccct

SEQ ID NO: 4935110 - DNA, 19 bp, Homo sapiens
tgtcctaaggaaccttcct

SEQ ID NO: 4935111 - DNA, 14 bp, Homo sapiens
tgtcctcactgctc

SEQ ID NO: 4935112 - DNA, 22 bp, Homo sapiens
tgtcctcactgctccctgaagc

SEQ ID NO: 4935113 - DNA, 22 bp, Homo sapiens
tgtcctccagaagcctctggct

SEQ ID NO: 4935114 - DNA, 19 bp, Homo sapiens
tgtcctccctccacctacc

SEQ ID NO: 4935115 - DNA, 22 bp, Homo sapiens
tgtcctctcccctccagccttt

SEQ ID NO: 4935116 - DNA, 20 bp, Homo sapiens
tgtcctgggagtgagctggt

SEQ ID NO: 4935117 - DNA, 15 bp, Homo sapiens
tgtcctggttcccgt

SEQ ID NO: 4935118 - DNA, 24 bp, Homo sapiens
tgtcctgtagttgcgtggactctg

SEQ ID NO: 4935119 - DNA, 22 bp, Homo sapiens
tgtccttccctgcatttctgag

SEQ ID NO: 4935120 - DNA, 13 bp, Homo sapiens
tgtcctttccctt

SEQ ID NO: 4935121 - DNA, 14 bp, Homo sapiens
tgtcctttcccttc

SEQ ID NO: 4935122 - DNA, 16 bp, Homo sapiens
tgtccttttgtcttct

SEQ ID NO: 4935123 - DNA, 14 bp, Homo sapiens
tgtcgcccagtctg

SEQ ID NO: 4935124 - DNA, 15 bp, Homo sapiens
tgtcgcccagtctgg

SEQ ID NO: 4935125 - DNA, 15 bp, Homo sapiens
tgtctaaaaaccaga

SEQ ID NO: 4935126 - DNA, 17 bp, Homo sapiens
tgtctaaacaatgctga

SEQ ID NO: 4935127 - DNA, 13 bp, Homo sapiens
tgtctaagattct

SEQ ID NO: 4935128 - DNA, 15 bp, Homo sapiens
tgtctaagattctag

SEQ ID NO: 4935129 - DNA, 16 bp, Homo sapiens
tgtctatgggactcaa

SEQ ID NO: 4935130 - DNA, 22 bp, Homo sapiens
tgtctattttaaaataaattag

SEQ ID NO: 4935131 - DNA, 21 bp, Homo sapiens
tgtctcaagagggcactggtg

SEQ ID NO: 4935132 - DNA, 17 bp, Homo sapiens
tgtctcactgaaacatt

SEQ ID NO: 4935133 - DNA, 20 bp, Homo sapiens
tgtctcagacttttgtacat

SEQ ID NO: 4935134 - DNA, 23 bp, Homo sapiens
tgtctcatccccaggggtcccag

SEQ ID NO: 4935135 - DNA, 14 bp, Homo sapiens
tgtctcatcctcct

SEQ ID NO: 4935136 - DNA, 15 bp, Homo sapiens
tgtctcatcctcctg

SEQ ID NO: 4935137 - DNA, 23 bp, Homo sapiens
tgtctcattttaatgtaaagatt

SEQ ID NO: 4935138 - DNA, 14 bp, Homo sapiens
tgtctcctactcct

SEQ ID NO: 4935139 - DNA, 21 bp, Homo sapiens
tgtctctcttcagactctcag

SEQ ID NO: 4935140 - DNA, 15 bp, Homo sapiens
tgtctcttgaaaaat

SEQ ID NO: 4935141 - DNA, 21 bp, Homo sapiens
tgtctgattggcttgtagaat

SEQ ID NO: 4935142 - DNA, 16 bp, Homo sapiens
tgtctgcccttcaccc

SEQ ID NO: 4935143 - DNA, 23 bp, Homo sapiens
tgtctgcttagtatctcatcaac

SEQ ID NO: 4935144 - DNA, 20 bp, Homo sapiens
tgtctgctttaaagggcctg

SEQ ID NO: 4935145 - DNA, 22 bp, Homo sapiens
tgtctgctttaaagggcctgcc

SEQ ID NO: 4935146 - DNA, 21 bp, Homo sapiens
tgtctggtggtggcaccatct

SEQ ID NO: 4935147 - DNA, 16 bp, Homo sapiens
tgtctggttttaacaa

SEQ ID NO: 4935148 - DNA, 12 bp, Homo sapiens
tgtctgtaaata

SEQ ID NO: 4935149 - DNA, 13 bp, Homo sapiens
tgtctgtacacgt

SEQ ID NO: 4935150 - DNA, 19 bp, Homo sapiens
tgtctgtacacgtgtcctg

SEQ ID NO: 4935151 - DNA, 20 bp, Homo sapiens
tgtctgtacacgtgtcctgt

SEQ ID NO: 4935152 - DNA, 17 bp, Homo sapiens
tgtctgtttaagaaaag

SEQ ID NO: 4935153 - DNA, 13 bp, Homo sapiens
tgtctgtttgttt

SEQ ID NO: 4935154 - DNA, 15 bp, Homo sapiens
tgtctgtttgtttca

SEQ ID NO: 4935155 - DNA, 14 bp, Homo sapiens
tgtcttaattatta

SEQ ID NO: 4935156 - DNA, 15 bp, Homo sapiens
tgtcttaattattat

SEQ ID NO: 4935157 - DNA, 14 bp, Homo sapiens
tgtcttatatagca

SEQ ID NO: 4935158 - DNA, 19 bp, Homo sapiens
tgtcttcacagctctgtgt

SEQ ID NO: 4935159 - DNA, 22 bp, Homo sapiens
tgtcttcagcctctccaggcac

SEQ ID NO: 4935160 - DNA, 17 bp, Homo sapiens
tgtcttcataaagtact

SEQ ID NO: 4935161 - DNA, 21 bp, Homo sapiens
tgtcttcatttcattgtatga

SEQ ID NO: 4935162 - DNA, 16 bp, Homo sapiens
tgtcttccatgtatct

SEQ ID NO: 4935163 - DNA, 22 bp, Homo sapiens
tgtcttctctgtctcagacttt

SEQ ID NO: 4935164 - DNA, 19 bp, Homo sapiens
tgtcttgaaagattcaggt

SEQ ID NO: 4935165 - DNA, 15 bp, Homo sapiens
tgtcttgcaatggca

SEQ ID NO: 4935166 - DNA, 18 bp, Homo sapiens
tgtcttgcaatggcagcc

SEQ ID NO: 4935167 - DNA, 13 bp, Homo sapiens
tgtcttggacact

SEQ ID NO: 4935168 - DNA, 18 bp, Homo sapiens
tgtcttgtaatattttgt

SEQ ID NO: 4935169 - DNA, 19 bp, Homo sapiens
tgtcttgtaatattttgta

SEQ ID NO: 4935170 - DNA, 13 bp, Homo sapiens
tgtcttgtacatg

SEQ ID NO: 4935171 - DNA, 17 bp, Homo sapiens
tgtcttgtacatgtgta

SEQ ID NO: 4935172 - DNA, 14 bp, Homo sapiens
tgtctttaaataga

SEQ ID NO: 4935173 - DNA, 19 bp, Homo sapiens
tgtctttaaatagatacaa

SEQ ID NO: 4935174 - DNA, 14 bp, Homo sapiens
tgtctttaaggaaa

SEQ ID NO: 4935175 - DNA, 13 bp, Homo sapiens
tgtctttcaaact

SEQ ID NO: 4935176 - DNA, 15 bp, Homo sapiens
tgtctttctgagcac

SEQ ID NO: 4935177 - DNA, 21 bp, Homo sapiens
tgtctttggaaaaatgtttgt

SEQ ID NO: 4935178 - DNA, 12 bp, Homo sapiens
tgtctttgtaag

SEQ ID NO: 4935179 - DNA, 14 bp, Homo sapiens
tgtcttttaatgct

SEQ ID NO: 4935180 - DNA, 20 bp, Homo sapiens
tgtcttttaatgcttcattc

SEQ ID NO: 4935181 - DNA, 22 bp, Homo sapiens
tgtcttttatagtggaaaaaca

SEQ ID NO: 4935182 - DNA, 16 bp, Homo sapiens
tgtcttttatatttgt

SEQ ID NO: 4935183 - DNA, 19 bp, Homo sapiens
tgtcttttatgcagataga

SEQ ID NO: 4935184 - DNA, 14 bp, Homo sapiens
tgtcttttgaatat

SEQ ID NO: 4935185 - DNA, 22 bp, Homo sapiens
tgtgaaaaagatgccaattatt

SEQ ID NO: 4935186 - DNA, 15 bp, Homo sapiens
tgtgaaacacagctg

SEQ ID NO: 4935187 - DNA, 16 bp, Homo sapiens
tgtgaaacacagctgt

SEQ ID NO: 4935188 - DNA, 19 bp, Homo sapiens
tgtgaaccaccacacccag

SEQ ID NO: 4935189 - DNA, 12 bp, Homo sapiens
tgtgaactcatt

SEQ ID NO: 4935190 - DNA, 21 bp, Homo sapiens
tgtgaacttgtagctgtaaaa

SEQ ID NO: 4935191 - DNA, 15 bp, Homo sapiens
tgtgaagcatttaca

SEQ ID NO: 4935192 - DNA, 17 bp, Homo sapiens
tgtgaatgaacactctt

SEQ ID NO: 4935193 - DNA, 19 bp, Homo sapiens
tgtgaatgattcatgttat

SEQ ID NO: 4935194 - DNA, 22 bp, Homo sapiens
tgtgaatgattcatgttatatt

SEQ ID NO: 4935195 - DNA, 14 bp, Homo sapiens
tgtgaatgcttctc

SEQ ID NO: 4935196 - DNA, 17 bp, Homo sapiens
tgtgaatgcttctcact

SEQ ID NO: 4935197 - DNA, 16 bp, Homo sapiens
tgtgaatggattggat

SEQ ID NO: 4935198 - DNA, 22 bp, Homo sapiens
tgtgaatggattggattattta

SEQ ID NO: 4935199 - DNA, 12 bp, Homo sapiens
tgtgaatgtggg

SEQ ID NO: 4935200 - DNA, 15 bp, Homo sapiens
tgtgaattgactacc

SEQ ID NO: 4935201 - DNA, 18 bp, Homo sapiens
tgtgaattgcatgacttg

SEQ ID NO: 4935202 - DNA, 21 bp, Homo sapiens
tgtgacaaggattgctactgt

SEQ ID NO: 4935203 - DNA, 20 bp, Homo sapiens
tgtgacaataatattgttgt

SEQ ID NO: 4935204 - DNA, 22 bp, Homo sapiens
tgtgacaataatattgttgtat

SEQ ID NO: 4935205 - DNA, 12 bp, Homo sapiens
tgtgacagggcc

SEQ ID NO: 4935206 - DNA, 14 bp, Homo sapiens
tgtgacagggccag

SEQ ID NO: 4935207 - DNA, 17 bp, Homo sapiens
tgtgacattttacatta

SEQ ID NO: 4935208 - DNA, 18 bp, Homo sapiens
tgtgacattttacattaa

SEQ ID NO: 4935209 - DNA, 13 bp, Homo sapiens
tgtgaccaccacc

SEQ ID NO: 4935210 - DNA, 13 bp, Homo sapiens
tgtgacctgaggg

SEQ ID NO: 4935211 - DNA, 19 bp, Homo sapiens
tgtgacttcagctctgttt

SEQ ID NO: 4935212 - DNA, 13 bp, Homo sapiens
tgtgagaccccca

SEQ ID NO: 4935213 - DNA, 14 bp, Homo sapiens
tgtgagacccccac

SEQ ID NO: 4935214 - DNA, 19 bp, Homo sapiens
tgtgagacccccacacctc

SEQ ID NO: 4935215 - DNA, 15 bp, Homo sapiens
tgtgagaggtttgac

SEQ ID NO: 4935216 - DNA, 16 bp, Homo sapiens
tgtgagaggtttgact

SEQ ID NO: 4935217 - DNA, 12 bp, Homo sapiens
tgtgagcccctg

SEQ ID NO: 4935218 - DNA, 13 bp, Homo sapiens
tgtgaggagctgc

SEQ ID NO: 4935219 - DNA, 21 bp, Homo sapiens
tgtgagtctttggttctaagg

SEQ ID NO: 4935220 - DNA, 17 bp, Homo sapiens
tgtgagtgtttggggga

SEQ ID NO: 4935221 - DNA, 20 bp, Homo sapiens
tgtgagtttggtctggactg

SEQ ID NO: 4935222 - DNA, 13 bp, Homo sapiens
tgtgataatttaa

SEQ ID NO: 4935223 - DNA, 15 bp, Homo sapiens
tgtgatattctaaga

SEQ ID NO: 4935224 - DNA, 13 bp, Homo sapiens
tgtgatctgtctt

SEQ ID NO: 4935225 - DNA, 14 bp, Homo sapiens
tgtgatctgtcttg

SEQ ID NO: 4935226 - DNA, 20 bp, Homo sapiens
tgtgatctgtcttgtaatat

SEQ ID NO: 4935227 - DNA, 16 bp, Homo sapiens
tgtgatcttttaaagt

SEQ ID NO: 4935228 - DNA, 13 bp, Homo sapiens
tgtgatgagctga

SEQ ID NO: 4935229 - DNA, 14 bp, Homo sapiens
tgtgatgagctgat

SEQ ID NO: 4935230 - DNA, 14 bp, Homo sapiens
tgtgatgttctaag

SEQ ID NO: 4935231 - DNA, 15 bp, Homo sapiens
tgtgatgttctaagg

SEQ ID NO: 4935232 - DNA, 18 bp, Homo sapiens
tgtgatgttctaaggctc

SEQ ID NO: 4935233 - DNA, 17 bp, Homo sapiens
tgtgattctaatgtctt

SEQ ID NO: 4935234 - DNA, 14 bp, Homo sapiens
tgtgcaacagacaa

SEQ ID NO: 4935235 - DNA, 15 bp, Homo sapiens
tgtgcaacagacaag

SEQ ID NO: 4935236 - DNA, 20 bp, Homo sapiens
tgtgcacacacacacacatg

SEQ ID NO: 4935237 - DNA, 16 bp, Homo sapiens
tgtgcacatgcacgtg

SEQ ID NO: 4935238 - DNA, 14 bp, Homo sapiens
tgtgcacgtacaca

SEQ ID NO: 4935239 - DNA, 15 bp, Homo sapiens
tgtgcagcgcagctg

SEQ ID NO: 4935240 - DNA, 17 bp, Homo sapiens
tgtgcagggagggcagt

SEQ ID NO: 4935241 - DNA, 17 bp, Homo sapiens
tgtgcatagtgctggga

SEQ ID NO: 4935242 - DNA, 19 bp, Homo sapiens
tgtgcatggaggccctcct

SEQ ID NO: 4935243 - DNA, 15 bp, Homo sapiens
tgtgcatgtgtgtat

SEQ ID NO: 4935244 - DNA, 15 bp, Homo sapiens
tgtgcatgtgtgtgt

SEQ ID NO: 4935245 - DNA, 16 bp, Homo sapiens
tgtgccaatatgtatt

SEQ ID NO: 4935246 - DNA, 18 bp, Homo sapiens
tgtgccaatatgtattgt

SEQ ID NO: 4935247 - DNA, 20 bp, Homo sapiens
tgtgccagaggaatcctggc

SEQ ID NO: 4935248 - DNA, 22 bp, Homo sapiens
tgtgccagaggaatcctggcag

SEQ ID NO: 4935249 - DNA, 21 bp, Homo sapiens
tgtgccagggcaatgatgaat

SEQ ID NO: 4935250 - DNA, 22 bp, Homo sapiens
tgtgccatagagtttaacacaa

SEQ ID NO: 4935251 - DNA, 19 bp, Homo sapiens
tgtgcccagcccggacctt

SEQ ID NO: 4935252 - DNA, 15 bp, Homo sapiens
tgtgccccatgcctg

SEQ ID NO: 4935253 - DNA, 13 bp, Homo sapiens
tgtgcctctgcct

SEQ ID NO: 4935254 - DNA, 15 bp, Homo sapiens
tgtgcctctttgtct

SEQ ID NO: 4935255 - DNA, 15 bp, Homo sapiens
tgtgcctgaccctac

SEQ ID NO: 4935256 - DNA, 22 bp, Homo sapiens
tgtgcctgggggagttttcctc

SEQ ID NO: 4935257 - DNA, 18 bp, Homo sapiens
tgtgccttttatagctat

SEQ ID NO: 4935258 - DNA, 19 bp, Homo sapiens
tgtgcgcctacaggagtga

SEQ ID NO: 4935259 - DNA, 15 bp, Homo sapiens
tgtgcgctctgtgga

SEQ ID NO: 4935260 - DNA, 15 bp, Homo sapiens
tgtgctcatttaagt

SEQ ID NO: 4935261 - DNA, 12 bp, Homo sapiens
tgtgctctgatc

SEQ ID NO: 4935262 - DNA, 22 bp, Homo sapiens
tgtgctctgatcatccactgtg

SEQ ID NO: 4935263 - DNA, 15 bp, Homo sapiens
tgtttctcaaatctt

SEQ ID NO: 4935264 - DNA, 17 bp, Homo sapiens
tgtttctccttctgaaa

SEQ ID NO: 4935265 - DNA, 22 bp, Homo sapiens
tgtttctctgttgtaagaatag

SEQ ID NO: 4935266 - DNA, 20 bp, Homo sapiens
tgtttctgggtcctgaagaa

SEQ ID NO: 4935267 - DNA, 12 bp, Homo sapiens
tgtttctgttat

SEQ ID NO: 4935268 - DNA, 15 bp, Homo sapiens
tgtttctgttattaa

SEQ ID NO: 4935269 - DNA, 22 bp, Homo sapiens
tgtttcttaactataaatatgt

SEQ ID NO: 4935270 - DNA, 14 bp, Homo sapiens
tgtttgcaagcagg

SEQ ID NO: 4935271 - DNA, 13 bp, Homo sapiens
tgtttgctgctat

SEQ ID NO: 4935272 - DNA, 14 bp, Homo sapiens
tgtttgctgtgaac

SEQ ID NO: 4935273 - DNA, 21 bp, Homo sapiens
tgtttggatgtaatttagggt

SEQ ID NO: 4935274 - DNA, 19 bp, Homo sapiens
tgtttgggggacgtttctc

SEQ ID NO: 4935275 - DNA, 20 bp, Homo sapiens
tgtttgggggacgtttctca

SEQ ID NO: 4935276 - DNA, 21 bp, Homo sapiens
tgtttgggggacgtttctcat

SEQ ID NO: 4935277 - DNA, 19 bp, Homo sapiens
tgtttggtgcatagaactg

SEQ ID NO: 4935278 - DNA, 15 bp, Homo sapiens
tgtttgtctctcctt

SEQ ID NO: 4935279 - DNA, 16 bp, Homo sapiens
tgtttgtctctccttt

SEQ ID NO: 4935280 - DNA, 13 bp, Homo sapiens
tgtttgtggcctc

SEQ ID NO: 4935281 - DNA, 15 bp, Homo sapiens
tgtttgtggcctcag

SEQ ID NO: 4935282 - DNA, 12 bp, Homo sapiens
tgtttgtgtatt

SEQ ID NO: 4935283 - DNA, 13 bp, Homo sapiens
tgtttgtttgtct

SEQ ID NO: 4935284 - DNA, 13 bp, Homo sapiens
tgttttaaattct

SEQ ID NO: 4935285 - DNA, 22 bp, Homo sapiens
tgttttaaattctgagacatgt

SEQ ID NO: 4935286 - DNA, 20 bp, Homo sapiens
tgttttaagaggcagggtct

SEQ ID NO: 4935287 - DNA, 18 bp, Homo sapiens
tgttttactgtgaaactg

SEQ ID NO: 4935288 - DNA, 19 bp, Homo sapiens
tgttttataaaattttgct

SEQ ID NO: 4935289 - DNA, 12 bp, Homo sapiens
tgttttatcatg

SEQ ID NO: 4935290 - DNA, 23 bp, Homo sapiens
tgttttatcatgacatgttatat

SEQ ID NO: 4935291 - DNA, 15 bp, Homo sapiens
tgttttattcctgta

SEQ ID NO: 4935292 - DNA, 23 bp, Homo sapiens
tgttttattttttattgttttca

SEQ ID NO: 4935293 - DNA, 19 bp, Homo sapiens
tgttttccgtgaaaacgga

SEQ ID NO: 4935294 - DNA, 17 bp, Homo sapiens
tgttttgaaactcagta

SEQ ID NO: 4935295 - DNA, 20 bp, Homo sapiens
tgttttgatgtttgtggcct

SEQ ID NO: 4935296 - DNA, 13 bp, Homo sapiens
tgttttgtataca

SEQ ID NO: 4935297 - DNA, 16 bp, Homo sapiens
tgttttgtatacaaat

SEQ ID NO: 4935298 - DNA, 22 bp, Homo sapiens
tgttttgtatacaaatatattg

SEQ ID NO: 4935299 - DNA, 13 bp, Homo sapiens
tgttttgtgcatt

SEQ ID NO: 4935300 - DNA, 15 bp, Homo sapiens
tgttttgtgcatttg

SEQ ID NO: 4935301 - DNA, 23 bp, Homo sapiens
tgttttgtttgtctctccttttc

SEQ ID NO: 4935302 - DNA, 17 bp, Homo sapiens
tgtttttattgttttct

SEQ ID NO: 4935303 - DNA, 12 bp, Homo sapiens
tgtttttctcca

SEQ ID NO: 4935304 - DNA, 20 bp, Homo sapiens
tgtttttgcttgttatatta

SEQ ID NO: 4935305 - DNA, 14 bp, Homo sapiens
tgtttttgttgtgt

SEQ ID NO: 4935306 - DNA, 17 bp, Homo sapiens
tgttttttatgaagtgc

SEQ ID NO: 4935307 - DNA, 19 bp, Homo sapiens
ttaaaaaaaaaaaaaagct

SEQ ID NO: 4935308 - DNA, 22 bp, Homo sapiens
ttaaaaaaaaaaaaaagcttta

SEQ ID NO: 4935309 - DNA, 23 bp, Homo sapiens
ttaaaaaaaaaaaaaagctttat

SEQ ID NO: 4935310 - DNA, 23 bp, Homo sapiens
ttaaaaaaatcacaaaaatttga

SEQ ID NO: 4935311 - DNA, 15 bp, Homo sapiens
ttaaaaaatatttat

SEQ ID NO: 4935312 - DNA, 21 bp, Homo sapiens
ttaaaaaatatttattaaata

SEQ ID NO: 4935313 - DNA, 15 bp, Homo sapiens
ttaaaaaatcttaat

SEQ ID NO: 4935314 - DNA, 12 bp, Homo sapiens
ttaaaaaatgaa

SEQ ID NO: 4935315 - DNA, 16 bp, Homo sapiens
ttaaaaacatagaaaa

SEQ ID NO: 4935316 - DNA, 12 bp, Homo sapiens
ttaaaaatacat

SEQ ID NO: 4935317 - DNA, 22 bp, Homo sapiens
ttaaaaatatggaacttctaat

SEQ ID NO: 4935318 - DNA, 17 bp, Homo sapiens
ttaaaacaacactcaca

SEQ ID NO: 4935319 - DNA, 20 bp, Homo sapiens
ttaaaacacatgtttttata

SEQ ID NO: 4935320 - DNA, 13 bp, Homo sapiens
ttaaaacagtatt

SEQ ID NO: 4935321 - DNA, 12 bp, Homo sapiens
ttaaaactgctt

SEQ ID NO: 4935322 - DNA, 14 bp, Homo sapiens
ttaaaacttcttaa

SEQ ID NO: 4935323 - DNA, 15 bp, Homo sapiens
ttaaaacttcttaaa

SEQ ID NO: 4935324 - DNA, 17 bp, Homo sapiens
ttaaaagccacatagag

SEQ ID NO: 4935325 - DNA, 17 bp, Homo sapiens
ttaaaagtttcaatgtg

SEQ ID NO: 4935326 - DNA, 19 bp, Homo sapiens
ttaaaagtttcaatgtgat

SEQ ID NO: 4935327 - DNA, 18 bp, Homo sapiens
ttaaaataggggatattt

SEQ ID NO: 4935328 - DNA, 23 bp, Homo sapiens
ttaaaatctattctgtgttgcat

SEQ ID NO: 4935329 - DNA, 24 bp, Homo sapiens
ttaaaatgtaagattatagattct

SEQ ID NO: 4935330 - DNA, 20 bp, Homo sapiens
ttaaacaaaatagaagctgt

SEQ ID NO: 4935331 - DNA, 14 bp, Homo sapiens
ttaaacaaaggttg

SEQ ID NO: 4935332 - DNA, 16 bp, Homo sapiens
ttaaacagtatttcat

SEQ ID NO: 4935333 - DNA, 21 bp, Homo sapiens
ttaaacattaaaaatggaact

SEQ ID NO: 4935334 - DNA, 19 bp, Homo sapiens
ttaaacctgtctccactgt

SEQ ID NO: 4935335 - DNA, 14 bp, Homo sapiens
ttaaactatcttgt

SEQ ID NO: 4935336 - DNA, 20 bp, Homo sapiens
ttaaactcagggacagagcc

SEQ ID NO: 4935337 - DNA, 16 bp, Homo sapiens
ttaaactgttagcact

SEQ ID NO: 4935338 - DNA, 19 bp, Homo sapiens
ttaaactgttagcactgtt

SEQ ID NO: 4935339 - DNA, 16 bp, Homo sapiens
ttaaacttataaatca

SEQ ID NO: 4935340 - DNA, 15 bp, Homo sapiens
ttaaacttgtgaatg

SEQ ID NO: 4935341 - DNA, 11 bp, Homo sapiens
ttaaagaaagt

SEQ ID NO: 4935342 - DNA, 18 bp, Homo sapiens
ttaaagagtctagattca

SEQ ID NO: 4935343 - DNA, 19 bp, Homo sapiens
ttaaagagtctagattcaa

SEQ ID NO: 4935344 - DNA, 19 bp, Homo sapiens
ttaaagatattgttcaaac

SEQ ID NO: 4935345 - DNA, 22 bp, Homo sapiens
ttaaagcctttagtatcagtgt

SEQ ID NO: 4935346 - DNA, 15 bp, Homo sapiens
ttaaagctgcctgta

SEQ ID NO: 4935347 - DNA, 18 bp, Homo sapiens
ttaaagctgcctgtagtt

SEQ ID NO: 4935348 - DNA, 16 bp, Homo sapiens
ttaaaggcccagcccc

SEQ ID NO: 4935349 - DNA, 20 bp, Homo sapiens
ttaaaggcccagcccctaga

SEQ ID NO: 4935350 - DNA, 12 bp, Homo sapiens
ttaaagtctgaa

SEQ ID NO: 4935351 - DNA, 17 bp, Homo sapiens
ttaaagtggcaatctca

SEQ ID NO: 4935352 - DNA, 14 bp, Homo sapiens
ttaaagtgtttcag

SEQ ID NO: 4935353 - DNA, 17 bp, Homo sapiens
ttaaagtgtttcagcta

SEQ ID NO: 4935354 - DNA, 13 bp, Homo sapiens
ttaaataaaagct

SEQ ID NO: 4935355 - DNA, 13 bp, Homo sapiens
ttaaataaaatca

SEQ ID NO: 4935356 - DNA, 15 bp, Homo sapiens
ttaaataaaatcaat

SEQ ID NO: 4935357 - DNA, 13 bp, Homo sapiens
ttaaataaacttt

SEQ ID NO: 4935358 - DNA, 15 bp, Homo sapiens
ttaaataaacttttt

SEQ ID NO: 4935359 - DNA, 16 bp, Homo sapiens
ttaaataagattctaa

SEQ ID NO: 4935360 - DNA, 15 bp, Homo sapiens
ttaaataatatggct

SEQ ID NO: 4935361 - DNA, 14 bp, Homo sapiens
ttaaataatttaac

SEQ ID NO: 4935362 - DNA, 18 bp, Homo sapiens
ttaaatagagtttgctat

SEQ ID NO: 4935363 - DNA, 13 bp, Homo sapiens
ttaaatagataca

SEQ ID NO: 4935364 - DNA, 18 bp, Homo sapiens
ttaaatagttatataatt

SEQ ID NO: 4935365 - DNA, 20 bp, Homo sapiens
ttaaatataattctgtaaat

SEQ ID NO: 4935366 - DNA, 18 bp, Homo sapiens
ttaaatatagattagaaa

SEQ ID NO: 4935367 - DNA, 22 bp, Homo sapiens
ttaaatatcttttatgtttgaa

SEQ ID NO: 4935368 - DNA, 16 bp, Homo sapiens
ttaaatctgtccctga

SEQ ID NO: 4935369 - DNA, 19 bp, Homo sapiens
ttaaatgtcttatatagca

SEQ ID NO: 4935370 - DNA, 17 bp, Homo sapiens
ttaaatgtgtacaatgt

SEQ ID NO: 4935371 - DNA, 18 bp, Homo sapiens
ttaaatgtgtacaatgta

SEQ ID NO: 4935372 - DNA, 12 bp, Homo sapiens
ttaaattctgag

SEQ ID NO: 4935373 - DNA, 14 bp, Homo sapiens
ttaaattctgagac

SEQ ID NO: 4935374 - DNA, 18 bp, Homo sapiens
ttaaatttaaagatattg

SEQ ID NO: 4935375 - DNA, 17 bp, Homo sapiens
ttaaatttgtaagtttc

SEQ ID NO: 4935376 - DNA, 20 bp, Homo sapiens
ttaaattttaccctttagac

SEQ ID NO: 4935377 - DNA, 23 bp, Homo sapiens
ttaacaaacatcactctgctgct

SEQ ID NO: 4935378 - DNA, 16 bp, Homo sapiens
ttaacacaagtcctgt

SEQ ID NO: 4935379 - DNA, 18 bp, Homo sapiens
ttaacagcagtcctttgt

SEQ ID NO: 4935380 - DNA, 23 bp, Homo sapiens
ttaacatagtaagttcagcactt

SEQ ID NO: 4935381 - DNA, 13 bp, Homo sapiens
ttaacattattta

SEQ ID NO: 4935382 - DNA, 14 bp, Homo sapiens
ttaacattttgttc

SEQ ID NO: 4935383 - DNA, 22 bp, Homo sapiens
ttaacattttgttcttacacat

SEQ ID NO: 4935384 - DNA, 14 bp, Homo sapiens
ttaactacatttat

SEQ ID NO: 4935385 - DNA, 21 bp, Homo sapiens
ttaactacccttaattactta

SEQ ID NO: 4935386 - DNA, 14 bp, Homo sapiens
ttaactattgcatt

SEQ ID NO: 4935387 - DNA, 21 bp, Homo sapiens
ttaactattgcatttatatgt

SEQ ID NO: 4935388 - DNA, 18 bp, Homo sapiens
ttaactttttttcttcta

SEQ ID NO: 4935389 - DNA, 22 bp, Homo sapiens
ttaactttttttcttctacttt

SEQ ID NO: 4935390 - DNA, 20 bp, Homo sapiens
ttaagaaaaaataacacaca

SEQ ID NO: 4935391 - DNA, 15 bp, Homo sapiens
ttaagaaaagtattt

SEQ ID NO: 4935392 - DNA, 21 bp, Homo sapiens
ttaagaaaagtattttgaagt

SEQ ID NO: 4935393 - DNA, 14 bp, Homo sapiens
ttaagaaggcaaaa

SEQ ID NO: 4935394 - DNA, 18 bp, Homo sapiens
ttaagaaggcaaaaatgt

SEQ ID NO: 4935395 - DNA, 16 bp, Homo sapiens
ttaagaatatgtttcc

SEQ ID NO: 4935396 - DNA, 10 bp, Homo sapiens
ttaagacaag

SEQ ID NO: 4935397 - DNA, 13 bp, Homo sapiens
ttaagagaaatgg

SEQ ID NO: 4935398 - DNA, 14 bp, Homo sapiens
ttaagagagaaatc

SEQ ID NO: 4935399 - DNA, 22 bp, Homo sapiens
ttaagagccatataagtttgaa

SEQ ID NO: 4935400 - DNA, 23 bp, Homo sapiens
ttaagagccatataagtttgaag

SEQ ID NO: 4935401 - DNA, 15 bp, Homo sapiens
ttaagaggcagggtc

SEQ ID NO: 4935402 - DNA, 19 bp, Homo sapiens
ttaagagtccaagaatcca

SEQ ID NO: 4935403 - DNA, 15 bp, Homo sapiens
ttaagattttacaaa

SEQ ID NO: 4935404 - DNA, 15 bp, Homo sapiens
ttaagatttttctca

SEQ ID NO: 4935405 - DNA, 16 bp, Homo sapiens
ttaagatttttctcaa

SEQ ID NO: 4935406 - DNA, 21 bp, Homo sapiens
ttaagatttttctcaaagttt

SEQ ID NO: 4935407 - DNA, 22 bp, Homo sapiens
ttaagcctcatatttaaagaca

SEQ ID NO: 4935408 - DNA, 12 bp, Homo sapiens
ttaaggaaacaa

SEQ ID NO: 4935409 - DNA, 20 bp, Homo sapiens
ttaaggaaactcttatctca

SEQ ID NO: 4935410 - DNA, 16 bp, Homo sapiens
ttaaggctaaaaagta

SEQ ID NO: 4935411 - DNA, 15 bp, Homo sapiens
ttaagtaatgtggaa

SEQ ID NO: 4935412 - DNA, 21 bp, Homo sapiens
ttaagtaatgtggaagaaaat

SEQ ID NO: 4935413 - DNA, 14 bp, Homo sapiens
ttaagtatatcatg

SEQ ID NO: 4935414 - DNA, 17 bp, Homo sapiens
ttaagtgcgtgtgtaga

SEQ ID NO: 4935415 - DNA, 16 bp, Homo sapiens
ttaagtttcaaactta

SEQ ID NO: 4935416 - DNA, 22 bp, Homo sapiens
ttaagtttcaaacttactattt

SEQ ID NO: 4935417 - DNA, 20 bp, Homo sapiens
ttaataaaaaaacaatcatt

SEQ ID NO: 4935418 - DNA, 16 bp, Homo sapiens
ttaataaaataattct

SEQ ID NO: 4935419 - DNA, 20 bp, Homo sapiens
ttaataaaataattctaaag

SEQ ID NO: 4935420 - DNA, 12 bp, Homo sapiens
ttaataacaatt

SEQ ID NO: 4935421 - DNA, 15 bp, Homo sapiens
ttaataacattacct

SEQ ID NO: 4935422 - DNA, 16 bp, Homo sapiens
ttaataataatctagg

SEQ ID NO: 4935423 - DNA, 22 bp, Homo sapiens
ttaatacagtttatttttaaag

SEQ ID NO: 4935424 - DNA, 21 bp, Homo sapiens
ttaatacgcaggcatctgatt

SEQ ID NO: 4935425 - DNA, 17 bp, Homo sapiens
ttaatagatcttagggt

SEQ ID NO: 4935426 - DNA, 18 bp, Homo sapiens
ttaatagcttttattgta

SEQ ID NO: 4935427 - DNA, 22 bp, Homo sapiens
ttaatagcttttattgtataaa

SEQ ID NO: 4935428 - DNA, 15 bp, Homo sapiens
ttaatagtcattcca

SEQ ID NO: 4935429 - DNA, 19 bp, Homo sapiens
ttaatatatgtattattta

SEQ ID NO: 4935430 - DNA, 12 bp, Homo sapiens
ttaatatggatt

SEQ ID NO: 4935431 - DNA, 17 bp, Homo sapiens
ttaatatttaaacagca

SEQ ID NO: 4935432 - DNA, 18 bp, Homo sapiens
ttaatatttaaacagcag

SEQ ID NO: 4935433 - DNA, 16 bp, Homo sapiens
ttaatatttaacatta

SEQ ID NO: 4935434 - DNA, 21 bp, Homo sapiens
ttaatcatctataaagaagaa

SEQ ID NO: 4935435 - DNA, 23 bp, Homo sapiens
ttaatcctttgttttctgactaa

SEQ ID NO: 4935436 - DNA, 19 bp, Homo sapiens
ttaatctctgttatgtact

SEQ ID NO: 4935437 - DNA, 21 bp, Homo sapiens
ttaatctctgttatgtactgt

SEQ ID NO: 4935438 - DNA, 18 bp, Homo sapiens
ttaatctgaaattctaaa

SEQ ID NO: 4935439 - DNA, 12 bp, Homo sapiens
ttaatcttggat

SEQ ID NO: 4935440 - DNA, 16 bp, Homo sapiens
ttaatgataagtaaat

SEQ ID NO: 4935441 - DNA, 19 bp, Homo sapiens
ttaatgcattaaacctgtc

SEQ ID NO: 4935442 - DNA, 20 bp, Homo sapiens
ttaatggattgttaatttca

SEQ ID NO: 4935443 - DNA, 21 bp, Homo sapiens
ttaatggattgttaatttcag

SEQ ID NO: 4935444 - DNA, 17 bp, Homo sapiens
ttaatgtatttgttcat

SEQ ID NO: 4935445 - DNA, 13 bp, Homo sapiens
ttaatgtgagttt

SEQ ID NO: 4935446 - DNA, 15 bp, Homo sapiens
ttaattaaacattgt

SEQ ID NO: 4935447 - DNA, 16 bp, Homo sapiens
ttaattaagactgaaa

SEQ ID NO: 4935448 - DNA, 13 bp, Homo sapiens
ttaattaatttga

SEQ ID NO: 4935449 - DNA, 21 bp, Homo sapiens
ttaattaatttgattaacaaa

SEQ ID NO: 4935450 - DNA, 23 bp, Homo sapiens
ttaattataggagccttaatttt

SEQ ID NO: 4935451 - DNA, 16 bp, Homo sapiens
ttaattattaactaca

SEQ ID NO: 4935452 - DNA, 19 bp, Homo sapiens
ttaattccaatatgatgac

SEQ ID NO: 4935453 - DNA, 17 bp, Homo sapiens
ttaattccaattatatg

SEQ ID NO: 4935454 - DNA, 19 bp, Homo sapiens
ttaattgttgtttctttct

SEQ ID NO: 4935455 - DNA, 18 bp, Homo sapiens
ttaattgttttgcacttt

SEQ ID NO: 4935456 - DNA, 17 bp, Homo sapiens
ttaatttatctaaatta

SEQ ID NO: 4935457 - DNA, 14 bp, Homo sapiens
ttaatttcttcaaa

SEQ ID NO: 4935458 - DNA, 15 bp, Homo sapiens
ttaatttcttcaaaa

SEQ ID NO: 4935459 - DNA, 18 bp, Homo sapiens
ttaatttgcatctgaaat

SEQ ID NO: 4935460 - DNA, 20 bp, Homo sapiens
ttacaaaagaaataccttga

SEQ ID NO: 4935461 - DNA, 13 bp, Homo sapiens
ttacaaactacag

SEQ ID NO: 4935462 - DNA, 14 bp, Homo sapiens
ttacaaactacaga

SEQ ID NO: 4935463 - DNA, 19 bp, Homo sapiens
ttacaacataatctagttt

SEQ ID NO: 4935464 - DNA, 22 bp, Homo sapiens
ttacaactgcctcgaaacacag

SEQ ID NO: 4935465 - DNA, 20 bp, Homo sapiens
ttacaagcgtgagccactgc

SEQ ID NO: 4935466 - DNA, 14 bp, Homo sapiens
ttacaatggaaaca

SEQ ID NO: 4935467 - DNA, 16 bp, Homo sapiens
ttacacaattcttacc

SEQ ID NO: 4935468 - DNA, 20 bp, Homo sapiens
ttacacaattcttaccctgt

SEQ ID NO: 4935469 - DNA, 18 bp, Homo sapiens
ttacacagaaacactgcc

SEQ ID NO: 4935470 - DNA, 19 bp, Homo sapiens
ttacacagaaacactgcct

SEQ ID NO: 4935471 - DNA, 14 bp, Homo sapiens
ttacacatacagtt

SEQ ID NO: 4935472 - DNA, 14 bp, Homo sapiens
ttacacattaagta

SEQ ID NO: 4935473 - DNA, 16 bp, Homo sapiens
ttacacattagatttt

SEQ ID NO: 4935474 - DNA, 13 bp, Homo sapiens
ttacagaaaaaga

SEQ ID NO: 4935475 - DNA, 16 bp, Homo sapiens
ttacagaaatactata

SEQ ID NO: 4935476 - DNA, 20 bp, Homo sapiens
ttacagatgaatgtatttat

SEQ ID NO: 4935477 - DNA, 16 bp, Homo sapiens
ttacagtccttcaaaa

SEQ ID NO: 4935478 - DNA, 17 bp, Homo sapiens
ttacataactgccttga

SEQ ID NO: 4935479 - DNA, 18 bp, Homo sapiens
ttacatgtgtagcctatg

SEQ ID NO: 4935480 - DNA, 16 bp, Homo sapiens
ttacatttaaagcatt

SEQ ID NO: 4935481 - DNA, 22 bp, Homo sapiens
ttacatttaaagcattgctgtt

SEQ ID NO: 4935482 - DNA, 21 bp, Homo sapiens
ttacatttttatttatgaagt

SEQ ID NO: 4935483 - DNA, 19 bp, Homo sapiens
ttattggcctgaaatgatc

SEQ ID NO: 4935484 - DNA, 19 bp, Homo sapiens
ttattgtacagctgtttaa

SEQ ID NO: 4935485 - DNA, 14 bp, Homo sapiens
ttatttaaagcatt

SEQ ID NO: 4935486 - DNA, 14 bp, Homo sapiens
ttatttaataacaa

SEQ ID NO: 4935487 - DNA, 20 bp, Homo sapiens
ttatttacagatgaatgtat

SEQ ID NO: 4935488 - DNA, 17 bp, Homo sapiens
ttatttagactcatctt

SEQ ID NO: 4935489 - DNA, 14 bp, Homo sapiens
ttatttatatgtac

SEQ ID NO: 4935490 - DNA, 18 bp, Homo sapiens
ttatttatatgtactgtt

SEQ ID NO: 4935491 - DNA, 15 bp, Homo sapiens
ttatttatgaagttt

SEQ ID NO: 4935492 - DNA, 16 bp, Homo sapiens
ttatttatgtactttt

SEQ ID NO: 4935493 - DNA, 22 bp, Homo sapiens
ttatttattcagcttcatttgt

SEQ ID NO: 4935494 - DNA, 23 bp, Homo sapiens
ttatttcacacgctgttctaatg

SEQ ID NO: 4935495 - DNA, 14 bp, Homo sapiens
ttatttcacttgat

SEQ ID NO: 4935496 - DNA, 17 bp, Homo sapiens
ttatttcagattttgat

SEQ ID NO: 4935497 - DNA, 18 bp, Homo sapiens
ttatttcagattttgata

SEQ ID NO: 4935498 - DNA, 21 bp, Homo sapiens
ttatttccatcatgtcagagc

SEQ ID NO: 4935499 - DNA, 17 bp, Homo sapiens
ttatttctgcaaacaaa

SEQ ID NO: 4935500 - DNA, 13 bp, Homo sapiens
ttatttctgcata

SEQ ID NO: 4935501 - DNA, 12 bp, Homo sapiens
ttatttcttcaa

SEQ ID NO: 4935502 - DNA, 22 bp, Homo sapiens
ttatttggcagtttggtatttg

SEQ ID NO: 4935503 - DNA, 16 bp, Homo sapiens
ttattttaaacaaaat

SEQ ID NO: 4935504 - DNA, 17 bp, Homo sapiens
ttattttaaacaaaata

SEQ ID NO: 4935505 - DNA, 14 bp, Homo sapiens
ttattttaatgtga

SEQ ID NO: 4935506 - DNA, 16 bp, Homo sapiens
ttattttaatgtgatg

SEQ ID NO: 4935507 - DNA, 16 bp, Homo sapiens
ttattttacacagaaa

SEQ ID NO: 4935508 - DNA, 19 bp, Homo sapiens
ttattttacacagaaacac

SEQ ID NO: 4935509 - DNA, 12 bp, Homo sapiens
ttattttcactg

SEQ ID NO: 4935510 - DNA, 12 bp, Homo sapiens
ttattttcatta

SEQ ID NO: 4935511 - DNA, 18 bp, Homo sapiens
ttattttcccctatcatt

SEQ ID NO: 4935512 - DNA, 22 bp, Homo sapiens
ttattttcccctatcatttatt

SEQ ID NO: 4935513 - DNA, 14 bp, Homo sapiens
ttattttctgtcag

SEQ ID NO: 4935514 - DNA, 18 bp, Homo sapiens
ttatttttagacagagtc

SEQ ID NO: 4935515 - DNA, 16 bp, Homo sapiens
ttatttttcatattgt

SEQ ID NO: 4935516 - DNA, 23 bp, Homo sapiens
ttatttttgacagtgttgaaaat

SEQ ID NO: 4935517 - DNA, 18 bp, Homo sapiens
ttattttttttttttgaa

SEQ ID NO: 4935518 - DNA, 13 bp, Homo sapiens
ttcaaaaactgtt

SEQ ID NO: 4935519 - DNA, 14 bp, Homo sapiens
ttcaaaagttccaa

SEQ ID NO: 4935520 - DNA, 16 bp, Homo sapiens
ttcaaaatccttccaa

SEQ ID NO: 4935521 - DNA, 17 bp, Homo sapiens
ttcaaaatccttccaaa

SEQ ID NO: 4935522 - DNA, 22 bp, Homo sapiens
ttcaaactccaaggttcccttg

SEQ ID NO: 4935523 - DNA, 15 bp, Homo sapiens
ttcaaactggggcct

SEQ ID NO: 4935524 - DNA, 19 bp, Homo sapiens
ttcaaactgtgaagcattt

SEQ ID NO: 4935525 - DNA, 13 bp, Homo sapiens
ttcaaagatgctg

SEQ ID NO: 4935526 - DNA, 13 bp, Homo sapiens
ttcaaagccacat

SEQ ID NO: 4935527 - DNA, 12 bp, Homo sapiens
ttcaaaggttct

SEQ ID NO: 4935528 - DNA, 15 bp, Homo sapiens
ttcaaatccttccaa

SEQ ID NO: 4935529 - DNA, 19 bp, Homo sapiens
ttcaaatgggctgctgctt

SEQ ID NO: 4935530 - DNA, 16 bp, Homo sapiens
ttcaaatgggttttcc

SEQ ID NO: 4935531 - DNA, 18 bp, Homo sapiens
ttcaaattggactttcaa

SEQ ID NO: 4935532 - DNA, 19 bp, Homo sapiens
ttcaaattggactttcaaa

SEQ ID NO: 4935533 - DNA, 13 bp, Homo sapiens
ttcaaatttcaca

SEQ ID NO: 4935534 - DNA, 19 bp, Homo sapiens
ttcaacaaatatcttgtgt

SEQ ID NO: 4935535 - DNA, 14 bp, Homo sapiens
ttcaaccatggact

SEQ ID NO: 4935536 - DNA, 15 bp, Homo sapiens
ttcaaccattcccca

SEQ ID NO: 4935537 - DNA, 17 bp, Homo sapiens
ttcaaccattccccatg

SEQ ID NO: 4935538 - DNA, 17 bp, Homo sapiens
ttcaacccacagctact

SEQ ID NO: 4935539 - DNA, 14 bp, Homo sapiens
ttcaacgcagccct

SEQ ID NO: 4935540 - DNA, 13 bp, Homo sapiens
ttcaagaaactga

SEQ ID NO: 4935541 - DNA, 16 bp, Homo sapiens
ttcaaggcttccactg

SEQ ID NO: 4935542 - DNA, 20 bp, Homo sapiens
ttcaaggtggccaaattatt

SEQ ID NO: 4935543 - DNA, 21 bp, Homo sapiens
ttcaagtgcctttctgcagtt

SEQ ID NO: 4935544 - DNA, 20 bp, Homo sapiens
ttcaagttattgtacagctg

SEQ ID NO: 4935545 - DNA, 13 bp, Homo sapiens
ttcaataaatctt

SEQ ID NO: 4935546 - DNA, 18 bp, Homo sapiens
ttcaataaatgtctgttg

SEQ ID NO: 4935547 - DNA, 16 bp, Homo sapiens
ttcaataataaatatt

SEQ ID NO: 4935548 - DNA, 23 bp, Homo sapiens
ttcaatacaaacaatctcttaaa

SEQ ID NO: 4935549 - DNA, 17 bp, Homo sapiens
ttcaatattgacatttg

SEQ ID NO: 4935550 - DNA, 18 bp, Homo sapiens
ttcaatattgacatttgt

SEQ ID NO: 4935551 - DNA, 21 bp, Homo sapiens
ttcaatattgacatttgtagt

SEQ ID NO: 4935552 - DNA, 22 bp, Homo sapiens
ttcaatattgacatttgtagtt

SEQ ID NO: 4935553 - DNA, 13 bp, Homo sapiens
ttcaattctcaaa

SEQ ID NO: 4935554 - DNA, 18 bp, Homo sapiens
ttcaattctcatttgtca

SEQ ID NO: 4935555 - DNA, 11 bp, Homo sapiens
ttcacaccctg

SEQ ID NO: 4935556 - DNA, 13 bp, Homo sapiens
ttcacaccctgca

SEQ ID NO: 4935557 - DNA, 13 bp, Homo sapiens
ttcacagctcctc

SEQ ID NO: 4935558 - DNA, 17 bp, Homo sapiens
ttcacagctcctcccac

SEQ ID NO: 4935559 - DNA, 15 bp, Homo sapiens
ttcacagtagagcca

SEQ ID NO: 4935560 - DNA, 16 bp, Homo sapiens
ttcacagtcactgatg

SEQ ID NO: 4935561 - DNA, 23 bp, Homo sapiens
ttcacattaaaaaatgaaatatt

SEQ ID NO: 4935562 - DNA, 18 bp, Homo sapiens
ttcaccagatttgctaat

SEQ ID NO: 4935563 - DNA, 23 bp, Homo sapiens
ttcaccccccactcaccagtgtc

SEQ ID NO: 4935564 - DNA, 18 bp, Homo sapiens
ttcaccccggcaggccct

SEQ ID NO: 4935565 - DNA, 20 bp, Homo sapiens
ttcaccccggcaggccctgc

SEQ ID NO: 4935566 - DNA, 21 bp, Homo sapiens
ttcaccccggcaggccctgca

SEQ ID NO: 4935567 - DNA, 22 bp, Homo sapiens
ttcaccccggcaggccctgcag

SEQ ID NO: 4935568 - DNA, 19 bp, Homo sapiens
ttcacctaagtctctgtga

SEQ ID NO: 4935569 - DNA, 21 bp, Homo sapiens
ttcacctaagtctctgtgaat

SEQ ID NO: 4935570 - DNA, 16 bp, Homo sapiens
ttcacgcaacttgaaa

SEQ ID NO: 4935571 - DNA, 17 bp, Homo sapiens
ttcactactttaataaa

SEQ ID NO: 4935572 - DNA, 19 bp, Homo sapiens
ttcactcactgtcaatgat

SEQ ID NO: 4935573 - DNA, 15 bp, Homo sapiens
ttcactgctggctgc

SEQ ID NO: 4935574 - DNA, 16 bp, Homo sapiens
ttcactgctggctgcc

SEQ ID NO: 4935575 - DNA, 17 bp, Homo sapiens
ttcactgctggctgcct

SEQ ID NO: 4935576 - DNA, 18 bp, Homo sapiens
ttcactgctggctgcctt

SEQ ID NO: 4935577 - DNA, 19 bp, Homo sapiens
ttcactgctggctgcctta

SEQ ID NO: 4935578 - DNA, 20 bp, Homo sapiens
ttcactgtaagactcattcc

SEQ ID NO: 4935579 - DNA, 22 bp, Homo sapiens
ttcactgtagaatgatttcatg

SEQ ID NO: 4935580 - DNA, 13 bp, Homo sapiens
ttcactgtataaa

SEQ ID NO: 4935581 - DNA, 15 bp, Homo sapiens
ttcactgtataaata

SEQ ID NO: 4935582 - DNA, 18 bp, Homo sapiens
ttcactgtataaatagga

SEQ ID NO: 4935583 - DNA, 22 bp, Homo sapiens
ttcactgtataaataggagagg

SEQ ID NO: 4935584 - DNA, 13 bp, Homo sapiens
ttcagaaaatatt

SEQ ID NO: 4935585 - DNA, 22 bp, Homo sapiens
ttcagaacaactgcaaagaaag

SEQ ID NO: 4935586 - DNA, 16 bp, Homo sapiens
ttcagaacctcttccc

SEQ ID NO: 4935587 - DNA, 23 bp, Homo sapiens
ttcagaagtttggcaatagtttg

SEQ ID NO: 4935588 - DNA, 23 bp, Homo sapiens
ttcagagatttatataaatgtaa

SEQ ID NO: 4935589 - DNA, 17 bp, Homo sapiens
ttcagatacaaactgca

SEQ ID NO: 4935590 - DNA, 15 bp, Homo sapiens
ttcagatatatatca

SEQ ID NO: 4935591 - DNA, 16 bp, Homo sapiens
ttcagatcactgaatt

SEQ ID NO: 4935592 - DNA, 21 bp, Homo sapiens
ttcagatcactgaatttataa

SEQ ID NO: 4935593 - DNA, 13 bp, Homo sapiens
ttctaaagataat

SEQ ID NO: 4935594 - DNA, 17 bp, Homo sapiens
ttctaaagctctgacat

SEQ ID NO: 4935595 - DNA, 13 bp, Homo sapiens
ttctaaagttcta

SEQ ID NO: 4935596 - DNA, 17 bp, Homo sapiens
ttctaaagttctaagat

SEQ ID NO: 4935597 - DNA, 19 bp, Homo sapiens
ttctaacaaaaaaatatat

SEQ ID NO: 4935598 - DNA, 20 bp, Homo sapiens
ttctaaccttgaatgctgcc

SEQ ID NO: 4935599 - DNA, 22 bp, Homo sapiens
ttctaaccttgaatgctgccag

SEQ ID NO: 4935600 - DNA, 12 bp, Homo sapiens
ttctaagactca

SEQ ID NO: 4935601 - DNA, 13 bp, Homo sapiens
ttctaagactcaa

SEQ ID NO: 4935602 - DNA, 20 bp, Homo sapiens
ttctaagactcaaatgttct

SEQ ID NO: 4935603 - DNA, 22 bp, Homo sapiens
ttctaagactcaaatgttctaa

SEQ ID NO: 4935604 - DNA, 20 bp, Homo sapiens
ttctaagatgtgatattcta

SEQ ID NO: 4935605 - DNA, 15 bp, Homo sapiens
ttctaagattctaat

SEQ ID NO: 4935606 - DNA, 14 bp, Homo sapiens
ttctaagattctga

SEQ ID NO: 4935607 - DNA, 22 bp, Homo sapiens
ttctaaggacctgaaattccaa

SEQ ID NO: 4935608 - DNA, 23 bp, Homo sapiens
ttctaaggacctgaaattccaaa

SEQ ID NO: 4935609 - DNA, 20 bp, Homo sapiens
ttctaaggcctaggattcta

SEQ ID NO: 4935610 - DNA, 17 bp, Homo sapiens
ttctaaggctctgagag

SEQ ID NO: 4935611 - DNA, 21 bp, Homo sapiens
ttctaaggtccggtgttctaa

SEQ ID NO: 4935612 - DNA, 23 bp, Homo sapiens
ttctaaggtccggtgttctaaga

SEQ ID NO: 4935613 - DNA, 22 bp, Homo sapiens
ttctaagtgaaatttctagcct

SEQ ID NO: 4935614 - DNA, 14 bp, Homo sapiens
ttctaagtttctaa

SEQ ID NO: 4935615 - DNA, 13 bp, Homo sapiens
ttctaatcaaaag

SEQ ID NO: 4935616 - DNA, 13 bp, Homo sapiens
ttctaatgtcttc

SEQ ID NO: 4935617 - DNA, 17 bp, Homo sapiens
ttctaatgtcttcattt

SEQ ID NO: 4935618 - DNA, 23 bp, Homo sapiens
ttctaatgtgtgaatcagagcac

SEQ ID NO: 4935619 - DNA, 22 bp, Homo sapiens
ttctacataagtaattcaagaa

SEQ ID NO: 4935620 - DNA, 18 bp, Homo sapiens
ttctacattattgcttat

SEQ ID NO: 4935621 - DNA, 16 bp, Homo sapiens
ttctacatttcttaga

SEQ ID NO: 4935622 - DNA, 15 bp, Homo sapiens
ttctaccatttcaga

SEQ ID NO: 4935623 - DNA, 16 bp, Homo sapiens
ttctacccgttccaaa

SEQ ID NO: 4935624 - DNA, 19 bp, Homo sapiens
ttctacggatcatcaacaa

SEQ ID NO: 4935625 - DNA, 22 bp, Homo sapiens
ttctacggatcatcaacaagat

SEQ ID NO: 4935626 - DNA, 15 bp, Homo sapiens
ttctagaatttatca

SEQ ID NO: 4935627 - DNA, 21 bp, Homo sapiens
ttctagaatttatcacacttc

SEQ ID NO: 4935628 - DNA, 20 bp, Homo sapiens
ttctagacatggaggttcta

SEQ ID NO: 4935629 - DNA, 19 bp, Homo sapiens
ttctagagttcagagtcct

SEQ ID NO: 4935630 - DNA, 22 bp, Homo sapiens
ttctagatgattaaataagatt

SEQ ID NO: 4935631 - DNA, 20 bp, Homo sapiens
ttctaggcatctctgtactt

SEQ ID NO: 4935632 - DNA, 20 bp, Homo sapiens
ttctaggtttcaaagatgct

SEQ ID NO: 4935633 - DNA, 19 bp, Homo sapiens
ttctagtacacttttatga

SEQ ID NO: 4935634 - DNA, 20 bp, Homo sapiens
ttctagtggtctttgtaaga

SEQ ID NO: 4935635 - DNA, 15 bp, Homo sapiens
ttctagtttgctcat

SEQ ID NO: 4935636 - DNA, 15 bp, Homo sapiens
ttctataacagatat

SEQ ID NO: 4935637 - DNA, 15 bp, Homo sapiens
ttctatagttctaga

SEQ ID NO: 4935638 - DNA, 23 bp, Homo sapiens
ttctatggttatgaaagaatata

SEQ ID NO: 4935639 - DNA, 15 bp, Homo sapiens
ttctatgtactagta

SEQ ID NO: 4935640 - DNA, 21 bp, Homo sapiens
ttctatgtactagtactgtgt

SEQ ID NO: 4935641 - DNA, 24 bp, Homo sapiens
ttctatgtactagtactgtgtact

SEQ ID NO: 4935642 - DNA, 15 bp, Homo sapiens
ttctattaaagtgct

SEQ ID NO: 4935643 - DNA, 13 bp, Homo sapiens
ttctattttgtaa

SEQ ID NO: 4935644 - DNA, 21 bp, Homo sapiens
ttctcaaaagcatttatcatt

SEQ ID NO: 4935645 - DNA, 17 bp, Homo sapiens
ttctcaaagttttgaaa

SEQ ID NO: 4935646 - DNA, 21 bp, Homo sapiens
ttctcaaagttttgaaaagct

SEQ ID NO: 4935647 - DNA, 21 bp, Homo sapiens
ttctcaacaaagcacagtgtt

SEQ ID NO: 4935648 - DNA, 14 bp, Homo sapiens
ttctcaagttctaa

SEQ ID NO: 4935649 - DNA, 18 bp, Homo sapiens
ttctcaagttctaagatt

SEQ ID NO: 4935650 - DNA, 23 bp, Homo sapiens
ttctcaagttctaagattctaat

SEQ ID NO: 4935651 - DNA, 22 bp, Homo sapiens
ttctcacagcacatgctggcca

SEQ ID NO: 4935652 - DNA, 16 bp, Homo sapiens
ttctcactcctacctg

SEQ ID NO: 4935653 - DNA, 18 bp, Homo sapiens
ttctcactcctacctggt

SEQ ID NO: 4935654 - DNA, 13 bp, Homo sapiens
ttctcagctccca

SEQ ID NO: 4935655 - DNA, 23 bp, Homo sapiens
ttctcataattcctacagcacta

SEQ ID NO: 4935656 - DNA, 19 bp, Homo sapiens
ttctcatctgcacccttct

SEQ ID NO: 4935657 - DNA, 20 bp, Homo sapiens
ttctcatctgcacccttctt

SEQ ID NO: 4935658 - DNA, 19 bp, Homo sapiens
ttctcatttgtttttctca

SEQ ID NO: 4935659 - DNA, 16 bp, Homo sapiens
ttctcattttcttttc

SEQ ID NO: 4935660 - DNA, 15 bp, Homo sapiens
ttctccaaggaaacc

SEQ ID NO: 4935661 - DNA, 13 bp, Homo sapiens
ttctccaccctgc

SEQ ID NO: 4935662 - DNA, 16 bp, Homo sapiens
ttctccaccctgctct

SEQ ID NO: 4935663 - DNA, 21 bp, Homo sapiens
ttctccacctagactgtaaac

SEQ ID NO: 4935664 - DNA, 23 bp, Homo sapiens
ttctccagatttttcggaggccc

SEQ ID NO: 4935665 - DNA, 13 bp, Homo sapiens
ttctccagctcag

SEQ ID NO: 4935666 - DNA, 20 bp, Homo sapiens
ttctccagctcagaacccag

SEQ ID NO: 4935667 - DNA, 12 bp, Homo sapiens
ttctccagctgg

SEQ ID NO: 4935668 - DNA, 18 bp, Homo sapiens
ttctccctcccaccttaa

SEQ ID NO: 4935669 - DNA, 13 bp, Homo sapiens
ttctcctcccagg

SEQ ID NO: 4935670 - DNA, 20 bp, Homo sapiens
ttctcctgtttattcccatc

SEQ ID NO: 4935671 - DNA, 21 bp, Homo sapiens
ttctccttgaatatctttcga

SEQ ID NO: 4935672 - DNA, 17 bp, Homo sapiens
ttctcctttcacaacct

SEQ ID NO: 4935673 - DNA, 13 bp, Homo sapiens
ttctccttttcct

SEQ ID NO: 4935674 - DNA, 18 bp, Homo sapiens
ttctccttttcctctctc

SEQ ID NO: 4935675 - DNA, 21 bp, Homo sapiens
ttctctaacttcaaggcccat

SEQ ID NO: 4935676 - DNA, 24 bp, Homo sapiens
ttctctgaacacaggcagctttct

SEQ ID NO: 4935677 - DNA, 14 bp, Homo sapiens
ttctctgaggacac

SEQ ID NO: 4935678 - DNA, 14 bp, Homo sapiens
ttctctgctccacc

SEQ ID NO: 4935679 - DNA, 17 bp, Homo sapiens
ttctctgtgtctaagat

SEQ ID NO: 4935680 - DNA, 21 bp, Homo sapiens
ttctctgtgtctaagattcta

SEQ ID NO: 4935681 - DNA, 23 bp, Homo sapiens
ttctctgtgtctaagattctaga

SEQ ID NO: 4935682 - DNA, 18 bp, Homo sapiens
ttctcttaaacttgtgaa

SEQ ID NO: 4935683 - DNA, 17 bp, Homo sapiens
ttctcttgggaactgaa

SEQ ID NO: 4935684 - DNA, 22 bp, Homo sapiens
ttctcttgggaactgaactcac

SEQ ID NO: 4935685 - DNA, 11 bp, Homo sapiens
ttctctttctc

SEQ ID NO: 4935686 - DNA, 17 bp, Homo sapiens
ttctctttctctcttcc

SEQ ID NO: 4935687 - DNA, 19 bp, Homo sapiens
ttctgaaagttacccactg

SEQ ID NO: 4935688 - DNA, 19 bp, Homo sapiens
ttctgaatgtgctgatcat

SEQ ID NO: 4935689 - DNA, 13 bp, Homo sapiens
ttctgacggccct

SEQ ID NO: 4935690 - DNA, 16 bp, Homo sapiens
ttctgaggctttatga

SEQ ID NO: 4935691 - DNA, 13 bp, Homo sapiens
ttctgagtacaga

SEQ ID NO: 4935692 - DNA, 23 bp, Homo sapiens
ttctgattttaggagctaaggct

SEQ ID NO: 4935693 - DNA, 21 bp, Homo sapiens
ttctgcaagcacatctgcatt

SEQ ID NO: 4935694 - DNA, 14 bp, Homo sapiens
ttctgcactgaaaa

SEQ ID NO: 4935695 - DNA, 15 bp, Homo sapiens
ttctgcactgaaaag

SEQ ID NO: 4935696 - DNA, 22 bp, Homo sapiens
ttctgcagtaaatcttttacaa

SEQ ID NO: 4935697 - DNA, 17 bp, Homo sapiens
ttctgcatatgttgaat

SEQ ID NO: 4935698 - DNA, 13 bp, Homo sapiens
ttctgcattgcta

SEQ ID NO: 4935699 - DNA, 20 bp, Homo sapiens
ttctgcattgctagataaaa

SEQ ID NO: 4935700 - DNA, 22 bp, Homo sapiens
ttctgcattgctagataaaagc

SEQ ID NO: 4935701 - DNA, 15 bp, Homo sapiens
ttctgccatattctg

SEQ ID NO: 4935702 - DNA, 13 bp, Homo sapiens
ttctgcccccagc

SEQ ID NO: 4935703 - DNA, 21 bp, Homo sapiens
ttctgccgccccctcctgaac

SEQ ID NO: 4935704 - DNA, 22 bp, Homo sapiens
ttctgccgccccctcctgaacc

SEQ ID NO: 4935705 - DNA, 17 bp, Homo sapiens
ttctgcctctctaggac

SEQ ID NO: 4935706 - DNA, 16 bp, Homo sapiens
ttctgcctgcccaggc

SEQ ID NO: 4935707 - DNA, 18 bp, Homo sapiens
ttctgcctgcccaggccc

SEQ ID NO: 4935708 - DNA, 16 bp, Homo sapiens
ttctgccttttcactg

SEQ ID NO: 4935709 - DNA, 9 bp, Homo sapiens
ttctgctcc

SEQ ID NO: 4935710 - DNA, 15 bp, Homo sapiens
ttctgctccaccctt

SEQ ID NO: 4935711 - DNA, 19 bp, Homo sapiens
ttctgcttcaataaatctt

SEQ ID NO: 4935712 - DNA, 18 bp, Homo sapiens
ttctgcttgtgttaagta

SEQ ID NO: 4935713 - DNA, 15 bp, Homo sapiens
ttctgctttctttga

SEQ ID NO: 4935714 - DNA, 17 bp, Homo sapiens
ttctggaatacatgaaa

SEQ ID NO: 4935715 - DNA, 14 bp, Homo sapiens
ttctggaatttgtt

SEQ ID NO: 4935716 - DNA, 19 bp, Homo sapiens
ttctggaatttgttcaagt

SEQ ID NO: 4935717 - DNA, 21 bp, Homo sapiens
ttctggaatttgttcaagttt

SEQ ID NO: 4935718 - DNA, 22 bp, Homo sapiens
ttctggaatttgttcaagtttt

SEQ ID NO: 4935719 - DNA, 10 bp, Homo sapiens
ttctggagtt

SEQ ID NO: 4935720 - DNA, 21 bp, Homo sapiens
ttctggcctttcctctctcct

SEQ ID NO: 4935721 - DNA, 11 bp, Homo sapiens
ttctggctgcc

SEQ ID NO: 4935722 - DNA, 11 bp, Homo sapiens
ttctgggacac

SEQ ID NO: 4935723 - DNA, 13 bp, Homo sapiens
ttctgggctcttt

SEQ ID NO: 4935724 - DNA, 23 bp, Homo sapiens
ttctggggaaagacactgcctgg

SEQ ID NO: 4935725 - DNA, 18 bp, Homo sapiens
ttctggggcaggctgggc

SEQ ID NO: 4935726 - DNA, 12 bp, Homo sapiens
ttctggttctaa

SEQ ID NO: 4935727 - DNA, 17 bp, Homo sapiens
ttctggtttaaacttgt

SEQ ID NO: 4935728 - DNA, 22 bp, Homo sapiens
ttctggtttaaacttgtttgct

SEQ ID NO: 4935729 - DNA, 19 bp, Homo sapiens
ttctgtaaactcaaaactt

SEQ ID NO: 4935730 - DNA, 13 bp, Homo sapiens
ttctgtacttcct

SEQ ID NO: 4935731 - DNA, 16 bp, Homo sapiens
ttctgtaggttctgtg

SEQ ID NO: 4935732 - DNA, 20 bp, Homo sapiens
ttctgtagtcatttactaaa

SEQ ID NO: 4935733 - DNA, 15 bp, Homo sapiens
ttctgtatatacttt

SEQ ID NO: 4935734 - DNA, 24 bp, Homo sapiens
ttctgtcagatgagaacaaagctg

SEQ ID NO: 4935735 - DNA, 19 bp, Homo sapiens
ttctgtcctactctgtgtc

SEQ ID NO: 4935736 - DNA, 17 bp, Homo sapiens
ttctgtgatgagctgat

SEQ ID NO: 4935737 - DNA, 18 bp, Homo sapiens
ttctgtgatgagctgatc

SEQ ID NO: 4935738 - DNA, 16 bp, Homo sapiens
ttctgtgccctactca

SEQ ID NO: 4935739 - DNA, 12 bp, Homo sapiens
ttctgtgtcttt

SEQ ID NO: 4935740 - DNA, 12 bp, Homo sapiens
ttctgtgtttat

SEQ ID NO: 4935741 - DNA, 18 bp, Homo sapiens
ttctgtgtttataaaata

SEQ ID NO: 4935742 - DNA, 13 bp, Homo sapiens
ttctgttaaaatc

SEQ ID NO: 4935743 - DNA, 14 bp, Homo sapiens
ttctgttaaaatct

SEQ ID NO: 4935744 - DNA, 22 bp, Homo sapiens
ttctgttggattccatgctaag

SEQ ID NO: 4935745 - DNA, 15 bp, Homo sapiens
ttctgttgtaactta

SEQ ID NO: 4935746 - DNA, 17 bp, Homo sapiens
ttctgttgtaacttatg

SEQ ID NO: 4935747 - DNA, 14 bp, Homo sapiens
ttctgtttgattct

SEQ ID NO: 4935748 - DNA, 12 bp, Homo sapiens
ttctgtttgtta

SEQ ID NO: 4935749 - DNA, 16 bp, Homo sapiens
ttcttaaataatgctt

SEQ ID NO: 4935750 - DNA, 13 bp, Homo sapiens
ttcttaattaatt

SEQ ID NO: 4935751 - DNA, 22 bp, Homo sapiens
ttcttacacgactaagttgaat

SEQ ID NO: 4935752 - DNA, 16 bp, Homo sapiens
ttcttactcctcctct

SEQ ID NO: 4935753 - DNA, 19 bp, Homo sapiens
ttcttagctttttaattgt

SEQ ID NO: 4935754 - DNA, 13 bp, Homo sapiens
ttcttagtgactt

SEQ ID NO: 4935755 - DNA, 17 bp, Homo sapiens
ttcttataatactctgt

SEQ ID NO: 4935756 - DNA, 19 bp, Homo sapiens
ttcttataatactctgttg

SEQ ID NO: 4935757 - DNA, 17 bp, Homo sapiens
ttcttatgcaaaatgga

SEQ ID NO: 4935758 - DNA, 15 bp, Homo sapiens
ttcttattgctttta

SEQ ID NO: 4935759 - DNA, 22 bp, Homo sapiens
ttcttatttttcctaacaaaag

SEQ ID NO: 4935760 - DNA, 15 bp, Homo sapiens
ttcttcaaaatgtat

SEQ ID NO: 4935761 - DNA, 19 bp, Homo sapiens
ttcttcaaaatgtatatat

SEQ ID NO: 4935762 - DNA, 19 bp, Homo sapiens
ttcttcaaatccttccaaa

SEQ ID NO: 4935763 - DNA, 18 bp, Homo sapiens
ttcttcagcgtaaaatgg

SEQ ID NO: 4935764 - DNA, 19 bp, Homo sapiens
ttcttcagcgtaaaatggt

SEQ ID NO: 4935765 - DNA, 18 bp, Homo sapiens
ttcttcatctgtgactcc

SEQ ID NO: 4935766 - DNA, 17 bp, Homo sapiens
ttcttccaaaaagattt

SEQ ID NO: 4935767 - DNA, 16 bp, Homo sapiens
ttcttccatcccagga

SEQ ID NO: 4935768 - DNA, 21 bp, Homo sapiens
ttcttcctatttgccatgggc

SEQ ID NO: 4935769 - DNA, 16 bp, Homo sapiens
ttcttcctccagctgc

SEQ ID NO: 4935770 - DNA, 11 bp, Homo sapiens
ttcttcctctg

SEQ ID NO: 4935771 - DNA, 13 bp, Homo sapiens
ttcttcctctgct

SEQ ID NO: 4935772 - DNA, 18 bp, Homo sapiens
ttcttcctttactttccc

SEQ ID NO: 4935773 - DNA, 14 bp, Homo sapiens
ttcttctagagttc

SEQ ID NO: 4935774 - DNA, 15 bp, Homo sapiens
ttcttctagagttca

SEQ ID NO: 4935775 - DNA, 20 bp, Homo sapiens
ttcttctgtgtttataaaat

SEQ ID NO: 4935776 - DNA, 21 bp, Homo sapiens
ttcttctgtgtttataaaata

SEQ ID NO: 4935777 - DNA, 18 bp, Homo sapiens
ttcttgctgctagaactt

SEQ ID NO: 4935778 - DNA, 20 bp, Homo sapiens
ttcttgctgctagaactttt

SEQ ID NO: 4935779 - DNA, 12 bp, Homo sapiens
ttcttgcttgta

SEQ ID NO: 4935780 - DNA, 23 bp, Homo sapiens
ttcttgcttgtacctctggctga

SEQ ID NO: 4935781 - DNA, 15 bp, Homo sapiens
ttcttgtctatagtt

SEQ ID NO: 4935782 - DNA, 14 bp, Homo sapiens
ttcttgtgcttttc

SEQ ID NO: 4935783 - DNA, 15 bp, Homo sapiens
ttcttgtttattgag

SEQ ID NO: 4935784 - DNA, 13 bp, Homo sapiens
ttcttgtttctcc

SEQ ID NO: 4935785 - DNA, 23 bp, Homo sapiens
ttctttaaaaaacaactatggat

SEQ ID NO: 4935786 - DNA, 14 bp, Homo sapiens
ttctttaaagaagt

SEQ ID NO: 4935787 - DNA, 13 bp, Homo sapiens
ttctttaaatgtt

SEQ ID NO: 4935788 - DNA, 18 bp, Homo sapiens
ttctttcagctatcagta

SEQ ID NO: 4935789 - DNA, 16 bp, Homo sapiens
ttctttcccagtgagt

SEQ ID NO: 4935790 - DNA, 23 bp, Homo sapiens
ttctttctctcagccttacattt

SEQ ID NO: 4935791 - DNA, 15 bp, Homo sapiens
ttctttcttcctctg

SEQ ID NO: 4935792 - DNA, 12 bp, Homo sapiens
ttctttgaagaa

SEQ ID NO: 4935793 - DNA, 21 bp, Homo sapiens
ttctttgagggactgcctctg

SEQ ID NO: 4935794 - DNA, 16 bp, Homo sapiens
ttctttgataatgtta

SEQ ID NO: 4935795 - DNA, 18 bp, Homo sapiens
ttctttgataatgttaaa

SEQ ID NO: 4935796 - DNA, 13 bp, Homo sapiens
ttctttgattctc

SEQ ID NO: 4935797 - DNA, 10 bp, Homo sapiens
ttctttgtgt

SEQ ID NO: 4935798 - DNA, 19 bp, Homo sapiens
ttctttgtgtagctttgct

SEQ ID NO: 4935799 - DNA, 19 bp, Homo sapiens
ttcttttaacttctttcta

SEQ ID NO: 4935800 - DNA, 12 bp, Homo sapiens
ttcttttctcat

SEQ ID NO: 4935801 - DNA, 15 bp, Homo sapiens
ttcttttgttactgt

SEQ ID NO: 4935802 - DNA, 16 bp, Homo sapiens
ttcttttgttactgtt

SEQ ID NO: 4935803 - DNA, 17 bp, Homo sapiens
ttcttttgttactgttc

SEQ ID NO: 4935804 - DNA, 18 bp, Homo sapiens
ttcttttgttactgttct

SEQ ID NO: 4935805 - DNA, 21 bp, Homo sapiens
ttcttttgttactgttcttgc

SEQ ID NO: 4935806 - DNA, 23 bp, Homo sapiens
ttcttttgttactgttcttgctg

SEQ ID NO: 4935807 - DNA, 14 bp, Homo sapiens
ttctttttacataa

SEQ ID NO: 4935808 - DNA, 16 bp, Homo sapiens
ttctttttacataact

SEQ ID NO: 4935809 - DNA, 12 bp, Homo sapiens
ttctttttctga

SEQ ID NO: 4935810 - DNA, 17 bp, Homo sapiens
ttcttttttaaaatcaa

SEQ ID NO: 4935811 - DNA, 18 bp, Homo sapiens
ttcttttttttcattata

SEQ ID NO: 4935812 - DNA, 20 bp, Homo sapiens
ttgaaaaaaacttcattctc

SEQ ID NO: 4935813 - DNA, 18 bp, Homo sapiens
ttgcttgagcccaggagt

SEQ ID NO: 4935814 - DNA, 18 bp, Homo sapiens
ttgcttgtacctctggct

SEQ ID NO: 4935815 - DNA, 20 bp, Homo sapiens
ttgctttatgccttcttatt

SEQ ID NO: 4935816 - DNA, 15 bp, Homo sapiens
ttgctttattccaga

SEQ ID NO: 4935817 - DNA, 15 bp, Homo sapiens
ttgctttgaagcagt

SEQ ID NO: 4935818 - DNA, 16 bp, Homo sapiens
ttgctttgaagcagtt

SEQ ID NO: 4935819 - DNA, 16 bp, Homo sapiens
ttgcttttccctcttt

SEQ ID NO: 4935820 - DNA, 15 bp, Homo sapiens
ttgctttttcaccag

SEQ ID NO: 4935821 - DNA, 19 bp, Homo sapiens
ttggaaatcctagtttcct

SEQ ID NO: 4935822 - DNA, 14 bp, Homo sapiens
ttggaacagaatgt

SEQ ID NO: 4935823 - DNA, 22 bp, Homo sapiens
ttggaaccacggagatctcctt

SEQ ID NO: 4935824 - DNA, 22 bp, Homo sapiens
ttggaagaaaaaaatcttctcc

SEQ ID NO: 4935825 - DNA, 19 bp, Homo sapiens
ttggaagctccgctttcta

SEQ ID NO: 4935826 - DNA, 17 bp, Homo sapiens
ttggaagctctgaagtc

SEQ ID NO: 4935827 - DNA, 13 bp, Homo sapiens
ttggaagtttcat

SEQ ID NO: 4935828 - DNA, 13 bp, Homo sapiens
ttggaatactttt

SEQ ID NO: 4935829 - DNA, 16 bp, Homo sapiens
ttggacatagatattt

SEQ ID NO: 4935830 - DNA, 23 bp, Homo sapiens
ttggactaaatgcctagttttta

SEQ ID NO: 4935831 - DNA, 20 bp, Homo sapiens
ttggagacacaactattttt

SEQ ID NO: 4935832 - DNA, 22 bp, Homo sapiens
ttggagggcccacttgtatcct

SEQ ID NO: 4935833 - DNA, 16 bp, Homo sapiens
ttggagggtgtcccaa

SEQ ID NO: 4935834 - DNA, 23 bp, Homo sapiens
ttggagtcccctcacctcctcta

SEQ ID NO: 4935835 - DNA, 15 bp, Homo sapiens
ttggatgtaatttag

SEQ ID NO: 4935836 - DNA, 15 bp, Homo sapiens
ttggattcttatgta

SEQ ID NO: 4935837 - DNA, 18 bp, Homo sapiens
ttggattgtatattgtgt

SEQ ID NO: 4935838 - DNA, 15 bp, Homo sapiens
ttggcaaaagccttg

SEQ ID NO: 4935839 - DNA, 16 bp, Homo sapiens
ttggcaaattcctagt

SEQ ID NO: 4935840 - DNA, 15 bp, Homo sapiens
ttggcaacagaagca

SEQ ID NO: 4935841 - DNA, 16 bp, Homo sapiens
ttggcaatagtttgca

SEQ ID NO: 4935842 - DNA, 16 bp, Homo sapiens
ttggcaatattcctta

SEQ ID NO: 4935843 - DNA, 12 bp, Homo sapiens
ttggcaccaaag

SEQ ID NO: 4935844 - DNA, 16 bp, Homo sapiens
ttggcaggtcctggcc

SEQ ID NO: 4935845 - DNA, 14 bp, Homo sapiens
ttggccctttcctt

SEQ ID NO: 4935846 - DNA, 19 bp, Homo sapiens
ttggccggctgtgctcaga

SEQ ID NO: 4935847 - DNA, 12 bp, Homo sapiens
ttggcctcagaa

SEQ ID NO: 4935848 - DNA, 16 bp, Homo sapiens
ttggcctgtctcatcc

SEQ ID NO: 4935849 - DNA, 22 bp, Homo sapiens
ttggcctgtctcatccccaggg

SEQ ID NO: 4935850 - DNA, 23 bp, Homo sapiens
ttggcctgtctcatccccagggg

SEQ ID NO: 4935851 - DNA, 21 bp, Homo sapiens
ttggccttggcttttctagcc

SEQ ID NO: 4935852 - DNA, 15 bp, Homo sapiens
ttggcgctattacaa

SEQ ID NO: 4935853 - DNA, 17 bp, Homo sapiens
ttggcgctattacaaat

SEQ ID NO: 4935854 - DNA, 18 bp, Homo sapiens
ttggcgctattacaaata

SEQ ID NO: 4935855 - DNA, 14 bp, Homo sapiens
ttggcgtggagcag

SEQ ID NO: 4935856 - DNA, 13 bp, Homo sapiens
ttggctcagacat

SEQ ID NO: 4935857 - DNA, 14 bp, Homo sapiens
ttggctctggagac

SEQ ID NO: 4935858 - DNA, 17 bp, Homo sapiens
ttggctctggagacagc

SEQ ID NO: 4935859 - DNA, 22 bp, Homo sapiens
ttggctctggagacagccccag

SEQ ID NO: 4935860 - DNA, 13 bp, Homo sapiens
ttggctgcaggga

SEQ ID NO: 4935861 - DNA, 14 bp, Homo sapiens
ttggctgcagggag

SEQ ID NO: 4935862 - DNA, 23 bp, Homo sapiens
ttggctggatgaaattttctaga

SEQ ID NO: 4935863 - DNA, 16 bp, Homo sapiens
ttggcttacctgacct

SEQ ID NO: 4935864 - DNA, 22 bp, Homo sapiens
ttggcttctgtgatgagctgat

SEQ ID NO: 4935865 - DNA, 18 bp, Homo sapiens
ttgggaatggatcctgga

SEQ ID NO: 4935866 - DNA, 12 bp, Homo sapiens
ttgggagtccag

SEQ ID NO: 4935867 - DNA, 18 bp, Homo sapiens
ttgggcagcaatttaaat

SEQ ID NO: 4935868 - DNA, 20 bp, Homo sapiens
ttggggaaacctagagaaga

SEQ ID NO: 4935869 - DNA, 17 bp, Homo sapiens
ttggggggactctgagc

SEQ ID NO: 4935870 - DNA, 15 bp, Homo sapiens
ttggggtctgacccc

SEQ ID NO: 4935871 - DNA, 15 bp, Homo sapiens
ttggggttgtgttgt

SEQ ID NO: 4935872 - DNA, 20 bp, Homo sapiens
ttgggtagctgccacttgaa

SEQ ID NO: 4935873 - DNA, 17 bp, Homo sapiens
ttgggttcatgatgcag

SEQ ID NO: 4935874 - DNA, 14 bp, Homo sapiens
ttggtaagagacag

SEQ ID NO: 4935875 - DNA, 18 bp, Homo sapiens
ttggtaagagacagaatg

SEQ ID NO: 4935876 - DNA, 19 bp, Homo sapiens
ttggtcatgtgggtcttcc

SEQ ID NO: 4935877 - DNA, 23 bp, Homo sapiens
ttggtcatgtgggtcttccaggg

SEQ ID NO: 4935878 - DNA, 13 bp, Homo sapiens
ttggtctggactg

SEQ ID NO: 4935879 - DNA, 13 bp, Homo sapiens
ttggtctttgtat

SEQ ID NO: 4935880 - DNA, 16 bp, Homo sapiens
ttggtgattcaaatgg

SEQ ID NO: 4935881 - DNA, 16 bp, Homo sapiens
ttggtgcaacccttac

SEQ ID NO: 4935882 - DNA, 21 bp, Homo sapiens
ttggtgcaacccttacccctt

SEQ ID NO: 4935883 - DNA, 15 bp, Homo sapiens
ttggtggcttatggg

SEQ ID NO: 4935884 - DNA, 15 bp, Homo sapiens
ttggtgttgtcattg

SEQ ID NO: 4935885 - DNA, 18 bp, Homo sapiens
ttggtgttgtcattgtaa

SEQ ID NO: 4935886 - DNA, 20 bp, Homo sapiens
ttggttcattaattctataa

SEQ ID NO: 4935887 - DNA, 18 bp, Homo sapiens
ttggttgttttttccttt

SEQ ID NO: 4935888 - DNA, 13 bp, Homo sapiens
ttggtttacattt

SEQ ID NO: 4935889 - DNA, 14 bp, Homo sapiens
ttggtttacattta

SEQ ID NO: 4935890 - DNA, 15 bp, Homo sapiens
ttggtttactttcaa

SEQ ID NO: 4935891 - DNA, 16 bp, Homo sapiens
ttgtaaaaaaaaatgc

SEQ ID NO: 4935892 - DNA, 17 bp, Homo sapiens
ttgtaaaaaaaaatgcc

SEQ ID NO: 4935893 - DNA, 19 bp, Homo sapiens
ttgtaaaaaaaaatgcctt

SEQ ID NO: 4935894 - DNA, 21 bp, Homo sapiens
ttgtaaaaaaaaatgcctttg

SEQ ID NO: 4935895 - DNA, 22 bp, Homo sapiens
ttgtaaaaaaaaatgcctttga

SEQ ID NO: 4935896 - DNA, 23 bp, Homo sapiens
ttgtaaaaaaaaatgcctttgag

SEQ ID NO: 4935897 - DNA, 12 bp, Homo sapiens
ttgtaaaaagaa

SEQ ID NO: 4935898 - DNA, 13 bp, Homo sapiens
ttgtaaaaagaaa

SEQ ID NO: 4935899 - DNA, 14 bp, Homo sapiens
ttgtaaacaaactc

SEQ ID NO: 4935900 - DNA, 22 bp, Homo sapiens
ttgtaaactcaaaatatttgta

SEQ ID NO: 4935901 - DNA, 21 bp, Homo sapiens
ttgtaaagaaatttactatat

SEQ ID NO: 4935902 - DNA, 12 bp, Homo sapiens
ttgtaaatgtta

SEQ ID NO: 4935903 - DNA, 14 bp, Homo sapiens
ttgtaaatgttatt

SEQ ID NO: 4935904 - DNA, 18 bp, Homo sapiens
ttgtaaatgttatttctg

SEQ ID NO: 4935905 - DNA, 14 bp, Homo sapiens
ttgtaacttatatt

SEQ ID NO: 4935906 - DNA, 13 bp, Homo sapiens
ttgtaacttatgt

SEQ ID NO: 4935907 - DNA, 18 bp, Homo sapiens
ttgtaagacaaaggtttt

SEQ ID NO: 4935908 - DNA, 22 bp, Homo sapiens
ttgtaagacaaaggttttcctc

SEQ ID NO: 4935909 - DNA, 17 bp, Homo sapiens
ttgtaagtgctacataa

SEQ ID NO: 4935910 - DNA, 16 bp, Homo sapiens
ttgtaagtttcaggtg

SEQ ID NO: 4935911 - DNA, 22 bp, Homo sapiens
ttgtaagtttcaggtgacatgt

SEQ ID NO: 4935912 - DNA, 18 bp, Homo sapiens
ttgtaatattttgtatta

SEQ ID NO: 4935913 - DNA, 14 bp, Homo sapiens
ttgtaatgctgcac

SEQ ID NO: 4935914 - DNA, 17 bp, Homo sapiens
ttgtaattatgatttgg

SEQ ID NO: 4935915 - DNA, 17 bp, Homo sapiens
ttgtaattcttcagttg

SEQ ID NO: 4935916 - DNA, 12 bp, Homo sapiens
ttgtaattgctt

SEQ ID NO: 4935917 - DNA, 23 bp, Homo sapiens
ttgtacaaaataaacaaataaca

SEQ ID NO: 4935918 - DNA, 16 bp, Homo sapiens
ttgtacatagttattt

SEQ ID NO: 4935919 - DNA, 23 bp, Homo sapiens
ttgtacatttatgatttaataaa

SEQ ID NO: 4935920 - DNA, 21 bp, Homo sapiens
ttgtacctgtaggactctcat

SEQ ID NO: 4935921 - DNA, 13 bp, Homo sapiens
ttgtagaattgtt

SEQ ID NO: 4935922 - DNA, 15 bp, Homo sapiens
ttgtagatttagtgt

SEQ ID NO: 4935923 - DNA, 19 bp, Homo sapiens
tttaaaaaagcaacagaaa

SEQ ID NO: 4935924 - DNA, 19 bp, Homo sapiens
tttaaaaaatatttattaa

SEQ ID NO: 4935925 - DNA, 16 bp, Homo sapiens
tttaaaacacatgttt

SEQ ID NO: 4935926 - DNA, 23 bp, Homo sapiens
tttaaaacacatgtttttataca

SEQ ID NO: 4935927 - DNA, 16 bp, Homo sapiens
tttaaaagaaatttat

SEQ ID NO: 4935928 - DNA, 21 bp, Homo sapiens
tttaaaagagagagagagaaa

SEQ ID NO: 4935929 - DNA, 22 bp, Homo sapiens
tttaaaagagagagagagaaaa

SEQ ID NO: 4935930 - DNA, 23 bp, Homo sapiens
tttaaaagagagagagagaaaaa

SEQ ID NO: 4935931 - DNA, 20 bp, Homo sapiens
tttaaaaggtattttgaata

SEQ ID NO: 4935932 - DNA, 21 bp, Homo sapiens
tttaaaaggtattttgaatac

SEQ ID NO: 4935933 - DNA, 19 bp, Homo sapiens
tttaaaatttaagtatctt

SEQ ID NO: 4935934 - DNA, 20 bp, Homo sapiens
tttaaacaaaatagaagctg

SEQ ID NO: 4935935 - DNA, 23 bp, Homo sapiens
tttaaacaaacattgtgttgaca

SEQ ID NO: 4935936 - DNA, 23 bp, Homo sapiens
tttaaacaaattcatattctgtc

SEQ ID NO: 4935937 - DNA, 13 bp, Homo sapiens
tttaaacattaaa

SEQ ID NO: 4935938 - DNA, 17 bp, Homo sapiens
tttaaagagtctagatt

SEQ ID NO: 4935939 - DNA, 16 bp, Homo sapiens
tttaaagcattgcttt

SEQ ID NO: 4935940 - DNA, 19 bp, Homo sapiens
tttaaaggcccagccccta

SEQ ID NO: 4935941 - DNA, 18 bp, Homo sapiens
tttaaaggctttttggtg

SEQ ID NO: 4935942 - DNA, 23 bp, Homo sapiens
tttaaaggtggattttgtttaaa

SEQ ID NO: 4935943 - DNA, 18 bp, Homo sapiens
tttaaagtggcaatctca

SEQ ID NO: 4935944 - DNA, 18 bp, Homo sapiens
tttaaagtgtaataatat

SEQ ID NO: 4935945 - DNA, 18 bp, Homo sapiens
tttaaagtgtttcagcta

SEQ ID NO: 4935946 - DNA, 12 bp, Homo sapiens
tttaaataaact

SEQ ID NO: 4935947 - DNA, 13 bp, Homo sapiens
tttaaataaactt

SEQ ID NO: 4935948 - DNA, 16 bp, Homo sapiens
tttaaataatttaact

SEQ ID NO: 4935949 - DNA, 15 bp, Homo sapiens
tttaaatataattct

SEQ ID NO: 4935950 - DNA, 21 bp, Homo sapiens
tttaaatataattctgtaaat

SEQ ID NO: 4935951 - DNA, 22 bp, Homo sapiens
tttaaatctaaatctatttatt

SEQ ID NO: 4935952 - DNA, 18 bp, Homo sapiens
tttaaatgcataaatgca

SEQ ID NO: 4935953 - DNA, 16 bp, Homo sapiens
tttaaatgtaaaacat

SEQ ID NO: 4935954 - DNA, 12 bp, Homo sapiens
tttaaatgtata

SEQ ID NO: 4935955 - DNA, 13 bp, Homo sapiens
tttaaatgtatac

SEQ ID NO: 4935956 - DNA, 14 bp, Homo sapiens
tttaaatgtatact

SEQ ID NO: 4935957 - DNA, 14 bp, Homo sapiens
tttaaattctgaga

SEQ ID NO: 4935958 - DNA, 19 bp, Homo sapiens
tttaacacaagtcctgtga

SEQ ID NO: 4935959 - DNA, 12 bp, Homo sapiens
tttaacattatt

SEQ ID NO: 4935960 - DNA, 11 bp, Homo sapiens
tttaacatttt

SEQ ID NO: 4935961 - DNA, 17 bp, Homo sapiens
tttaacattttgttctt

SEQ ID NO: 4935962 - DNA, 23 bp, Homo sapiens
tttaacattttgttcttacacat

SEQ ID NO: 4935963 - DNA, 15 bp, Homo sapiens
tttaaccatctgata

SEQ ID NO: 4935964 - DNA, 17 bp, Homo sapiens
tttaactacccttaatt

SEQ ID NO: 4935965 - DNA, 18 bp, Homo sapiens
tttaactacccttaatta

SEQ ID NO: 4935966 - DNA, 14 bp, Homo sapiens
tttaactgagaaat

SEQ ID NO: 4935967 - DNA, 12 bp, Homo sapiens
tttaagaaaagt

SEQ ID NO: 4935968 - DNA, 15 bp, Homo sapiens
tttaagaaaagtatt

SEQ ID NO: 4935969 - DNA, 19 bp, Homo sapiens
tttaagaaaagtattttga

SEQ ID NO: 4935970 - DNA, 22 bp, Homo sapiens
tttaagaaaagtattttgaagt

SEQ ID NO: 4935971 - DNA, 13 bp, Homo sapiens
tttaagagagaaa

SEQ ID NO: 4935972 - DNA, 14 bp, Homo sapiens
tttaagaggcaggg

SEQ ID NO: 4935973 - DNA, 18 bp, Homo sapiens
tttaagatttttctcaaa

SEQ ID NO: 4935974 - DNA, 15 bp, Homo sapiens
tttaagcactcttaa

SEQ ID NO: 4935975 - DNA, 19 bp, Homo sapiens
tttaagcctcatatttaaa

SEQ ID NO: 4935976 - DNA, 20 bp, Homo sapiens
tttaaggatggggttatgaa

SEQ ID NO: 4935977 - DNA, 19 bp, Homo sapiens
tttaagggcatgccttgtg

SEQ ID NO: 4935978 - DNA, 17 bp, Homo sapiens
tttaagggtttgtggaa

SEQ ID NO: 4935979 - DNA, 20 bp, Homo sapiens
tttaagggtttgtggaaaat

SEQ ID NO: 4935980 - DNA, 19 bp, Homo sapiens
tttaaggtagcttcagcta

SEQ ID NO: 4935981 - DNA, 13 bp, Homo sapiens
tttaagtatttag

SEQ ID NO: 4935982 - DNA, 18 bp, Homo sapiens
tttaagtatttaggtttt

SEQ ID NO: 4935983 - DNA, 18 bp, Homo sapiens
tttaagtgcgtgtgtaga

SEQ ID NO: 4935984 - DNA, 21 bp, Homo sapiens
tttaagtgcgtgtgtagagtt

SEQ ID NO: 4935985 - DNA, 22 bp, Homo sapiens
tttaagtttcaaacttactatt

SEQ ID NO: 4935986 - DNA, 20 bp, Homo sapiens
tttaataaaataattctaaa

SEQ ID NO: 4935987 - DNA, 12 bp, Homo sapiens
tttaataacatt

SEQ ID NO: 4935988 - DNA, 15 bp, Homo sapiens
tttaatataaagcct

SEQ ID NO: 4935989 - DNA, 15 bp, Homo sapiens
tttaatatttaaaca

SEQ ID NO: 4935990 - DNA, 19 bp, Homo sapiens
tttaatgcttcattcaata

SEQ ID NO: 4935991 - DNA, 22 bp, Homo sapiens
tttaatggacttatttcttcaa

SEQ ID NO: 4935992 - DNA, 17 bp, Homo sapiens
tttaatggattgttaat

SEQ ID NO: 4935993 - DNA, 21 bp, Homo sapiens
tttaatggcagcagaaaactt

SEQ ID NO: 4935994 - DNA, 14 bp, Homo sapiens
tttaattgtcatgg

SEQ ID NO: 4935995 - DNA, 21 bp, Homo sapiens
tttaattgttgtttctttcta

SEQ ID NO: 4935996 - DNA, 20 bp, Homo sapiens
tttaatttctgtcagaatgc

SEQ ID NO: 4935997 - DNA, 17 bp, Homo sapiens
tttaattttttttagta

SEQ ID NO: 4935998 - DNA, 21 bp, Homo sapiens
tttacaagaagtttattctca

SEQ ID NO: 4935999 - DNA, 15 bp, Homo sapiens
tttacaagtgtatat

SEQ ID NO: 4936000 - DNA, 21 bp, Homo sapiens
tttacaatcagccacattcta

SEQ ID NO: 4936001 - DNA, 14 bp, Homo sapiens
tttacacagaaaca

SEQ ID NO: 4936002 - DNA, 16 bp, Homo sapiens
tttacagctttacaca

SEQ ID NO: 4936003 - DNA, 18 bp, Homo sapiens
tttacagctttacacaca

SEQ ID NO: 4936004 - DNA, 19 bp, Homo sapiens
tttacagctttacacacac

SEQ ID NO: 4936005 - DNA, 22 bp, Homo sapiens
tttacaggccctgctcctgcag

SEQ ID NO: 4936006 - DNA, 16 bp, Homo sapiens
tttacataactgcctt

SEQ ID NO: 4936007 - DNA, 23 bp, Homo sapiens
tttacataactgccttgaacctg

SEQ ID NO: 4936008 - DNA, 20 bp, Homo sapiens
tttacatgcaatttattaaa

SEQ ID NO: 4936009 - DNA, 13 bp, Homo sapiens
tttacattgtaaa

SEQ ID NO: 4936010 - DNA, 16 bp, Homo sapiens
tttacattgttgagct

SEQ ID NO: 4936011 - DNA, 18 bp, Homo sapiens
tttacatttaaagcattg

SEQ ID NO: 4936012 - DNA, 19 bp, Homo sapiens
tttacatttttatttatga

SEQ ID NO: 4936013 - DNA, 20 bp, Homo sapiens
tttaccagttaattactcag

SEQ ID NO: 4936014 - DNA, 18 bp, Homo sapiens
tttacccaaaaactaaat

SEQ ID NO: 4936015 - DNA, 16 bp, Homo sapiens
tttacccacctagaac

SEQ ID NO: 4936016 - DNA, 19 bp, Homo sapiens
tttaccctaatgtcttcat

SEQ ID NO: 4936017 - DNA, 14 bp, Homo sapiens
tttacctagagaac

SEQ ID NO: 4936018 - DNA, 15 bp, Homo sapiens
tttacctgtcacatt

SEQ ID NO: 4936019 - DNA, 20 bp, Homo sapiens
tttacctgtcacattgcatt

SEQ ID NO: 4936020 - DNA, 18 bp, Homo sapiens
tttacgctttgattcata

SEQ ID NO: 4936021 - DNA, 14 bp, Homo sapiens
tttactaaacatat

SEQ ID NO: 4936022 - DNA, 21 bp, Homo sapiens
tttactaagccacaagaaatt

SEQ ID NO: 4936023 - DNA, 16 bp, Homo sapiens
tttactcattgaaatg

SEQ ID NO: 4936024 - DNA, 22 bp, Homo sapiens
tttactgccaaagggaaatatc

SEQ ID NO: 4936025 - DNA, 16 bp, Homo sapiens
tttacttcacttcaaa

SEQ ID NO: 4936026 - DNA, 11 bp, Homo sapiens
tttactttcaa

SEQ ID NO: 4936027 - DNA, 17 bp, Homo sapiens
tttactttcccttgctt

SEQ ID NO: 4936028 - DNA, 15 bp, Homo sapiens
tttacttttaaacag

SEQ ID NO: 4936029 - DNA, 12 bp, Homo sapiens
tttagacagagt

SEQ ID NO: 4936030 - DNA, 20 bp, Homo sapiens
tttagacagtctcactttgt

SEQ ID NO: 4936031 - DNA, 17 bp, Homo sapiens
tttagatgaggaaatga

SEQ ID NO: 4936032 - DNA, 24 bp, Homo sapiens
tttcactgctggctgccttagaac

SEQ ID NO: 4936033 - DNA, 24 bp, Homo sapiens
tttcactgtagaatgatttcatgc

SEQ ID NO: 4936034 - DNA, 20 bp, Homo sapiens
tttcagaacctcttccccag

SEQ ID NO: 4936035 - DNA, 23 bp, Homo sapiens
tttcagaacctcttccccagaaa

SEQ ID NO: 4936036 - DNA, 23 bp, Homo sapiens
tttcagagacagctgatacttca

SEQ ID NO: 4936037 - DNA, 15 bp, Homo sapiens
tttcagatatatatc

SEQ ID NO: 4936038 - DNA, 23 bp, Homo sapiens
tttcagctaagggaagacatttc

SEQ ID NO: 4936039 - DNA, 15 bp, Homo sapiens
tttcagctatcagta

SEQ ID NO: 4936040 - DNA, 12 bp, Homo sapiens
tttcagctctct

SEQ ID NO: 4936041 - DNA, 16 bp, Homo sapiens
tttcagggttttctga

SEQ ID NO: 4936042 - DNA, 13 bp, Homo sapiens
tttcaggtgacat

SEQ ID NO: 4936043 - DNA, 19 bp, Homo sapiens
tttcaggtgacatgtgaaa

SEQ ID NO: 4936044 - DNA, 12 bp, Homo sapiens
tttcataactta

SEQ ID NO: 4936045 - DNA, 16 bp, Homo sapiens
tttcatctcttgtata

SEQ ID NO: 4936046 - DNA, 20 bp, Homo sapiens
tttcatggtgaaaatgtact

SEQ ID NO: 4936047 - DNA, 16 bp, Homo sapiens
tttcatgttttgtgac

SEQ ID NO: 4936048 - DNA, 18 bp, Homo sapiens
tttcatgttttgtgacta

SEQ ID NO: 4936049 - DNA, 16 bp, Homo sapiens
tttcattacaatggaa

SEQ ID NO: 4936050 - DNA, 13 bp, Homo sapiens
tttcattattagt

SEQ ID NO: 4936051 - DNA, 17 bp, Homo sapiens
tttcattccattgccta

SEQ ID NO: 4936052 - DNA, 17 bp, Homo sapiens
tttcattgcctgtgtat

SEQ ID NO: 4936053 - DNA, 16 bp, Homo sapiens
tttcattgtatgatgt

SEQ ID NO: 4936054 - DNA, 18 bp, Homo sapiens
tttcattgtatgatgtgt

SEQ ID NO: 4936055 - DNA, 19 bp, Homo sapiens
tttcatttggttcattaat

SEQ ID NO: 4936056 - DNA, 20 bp, Homo sapiens
tttcattttttgcatcagta

SEQ ID NO: 4936057 - DNA, 23 bp, Homo sapiens
tttccaacaccacagacacacac

SEQ ID NO: 4936058 - DNA, 15 bp, Homo sapiens
tttccacatgctctg

SEQ ID NO: 4936059 - DNA, 16 bp, Homo sapiens
tttccacttcttcctt

SEQ ID NO: 4936060 - DNA, 23 bp, Homo sapiens
tttccagcagaagacaaaaagac

SEQ ID NO: 4936061 - DNA, 12 bp, Homo sapiens
tttccatcttta

SEQ ID NO: 4936062 - DNA, 10 bp, Homo sapiens
tttcccaagc

SEQ ID NO: 4936063 - DNA, 11 bp, Homo sapiens
tttccccagcc

SEQ ID NO: 4936064 - DNA, 13 bp, Homo sapiens
tttccccagccca

SEQ ID NO: 4936065 - DNA, 19 bp, Homo sapiens
tttccctaaaatacattta

SEQ ID NO: 4936066 - DNA, 16 bp, Homo sapiens
tttcctaacaaaagat

SEQ ID NO: 4936067 - DNA, 23 bp, Homo sapiens
tttcctagccctctcacatttat

SEQ ID NO: 4936068 - DNA, 22 bp, Homo sapiens
tttcctcctgaggctttggatt

SEQ ID NO: 4936069 - DNA, 15 bp, Homo sapiens
tttcctcctttatca

SEQ ID NO: 4936070 - DNA, 22 bp, Homo sapiens
tttcctctatacatctctcccc

SEQ ID NO: 4936071 - DNA, 15 bp, Homo sapiens
tttcctcttccaaag

SEQ ID NO: 4936072 - DNA, 22 bp, Homo sapiens
tttcctcttctattttgtaaac

SEQ ID NO: 4936073 - DNA, 16 bp, Homo sapiens
tttcctggacactcag

SEQ ID NO: 4936074 - DNA, 20 bp, Homo sapiens
tttcctggacactcagacct

SEQ ID NO: 4936075 - DNA, 14 bp, Homo sapiens
tttccttatttgct

SEQ ID NO: 4936076 - DNA, 12 bp, Homo sapiens
tttccttcctaa

SEQ ID NO: 4936077 - DNA, 18 bp, Homo sapiens
tttccttgtggcagagga

SEQ ID NO: 4936078 - DNA, 21 bp, Homo sapiens
tttcctttaaaaaaatttaag

SEQ ID NO: 4936079 - DNA, 16 bp, Homo sapiens
tttcctttccccagcc

SEQ ID NO: 4936080 - DNA, 13 bp, Homo sapiens
tttcgtatgaaaa

SEQ ID NO: 4936081 - DNA, 14 bp, Homo sapiens
tttcgtatgaaaat

SEQ ID NO: 4936082 - DNA, 20 bp, Homo sapiens
tttctaaaaagattagcaag

SEQ ID NO: 4936083 - DNA, 12 bp, Homo sapiens
tttctaaaagaa

SEQ ID NO: 4936084 - DNA, 17 bp, Homo sapiens
tttctaaccttgaatgc

SEQ ID NO: 4936085 - DNA, 23 bp, Homo sapiens
tttctaaccttgaatgctgccag

SEQ ID NO: 4936086 - DNA, 15 bp, Homo sapiens
tttctaagattctaa

SEQ ID NO: 4936087 - DNA, 21 bp, Homo sapiens
tttctacaattaatagtttgt

SEQ ID NO: 4936088 - DNA, 21 bp, Homo sapiens
tttctacccaacggccctgca

SEQ ID NO: 4936089 - DNA, 18 bp, Homo sapiens
tttctacccagcgagccc

SEQ ID NO: 4936090 - DNA, 20 bp, Homo sapiens
tttctagtggtctttgtaag

SEQ ID NO: 4936091 - DNA, 16 bp, Homo sapiens
tttctataacagatat

SEQ ID NO: 4936092 - DNA, 16 bp, Homo sapiens
tttctatctaaatgat

SEQ ID NO: 4936093 - DNA, 18 bp, Homo sapiens
tttctatgtactagtact

SEQ ID NO: 4936094 - DNA, 20 bp, Homo sapiens
tttctattaaatagttatat

SEQ ID NO: 4936095 - DNA, 14 bp, Homo sapiens
tttctattccaaag

SEQ ID NO: 4936096 - DNA, 17 bp, Homo sapiens
tttctatttatgccttg

SEQ ID NO: 4936097 - DNA, 14 bp, Homo sapiens
tttctatttgactt

SEQ ID NO: 4936098 - DNA, 19 bp, Homo sapiens
tttctcaaaagcatttatc

SEQ ID NO: 4936099 - DNA, 22 bp, Homo sapiens
tttctcaaaagcatttatcatt

SEQ ID NO: 4936100 - DNA, 18 bp, Homo sapiens
tttctcaaagttttgaaa

SEQ ID NO: 4936101 - DNA, 13 bp, Homo sapiens
tttctcaaatctt

SEQ ID NO: 4936102 - DNA, 16 bp, Homo sapiens
tttctcagtttgtata

SEQ ID NO: 4936103 - DNA, 19 bp, Homo sapiens
tttctcatgtgtttgcata

SEQ ID NO: 4936104 - DNA, 14 bp, Homo sapiens
tttctcattcttgt

SEQ ID NO: 4936105 - DNA, 16 bp, Homo sapiens
tttctcattcttgttt

SEQ ID NO: 4936106 - DNA, 12 bp, Homo sapiens
tttctccccgct

SEQ ID NO: 4936107 - DNA, 17 bp, Homo sapiens
tttctccctaaactgta

SEQ ID NO: 4936108 - DNA, 21 bp, Homo sapiens
tttctcctgtttattcccatc

SEQ ID NO: 4936109 - DNA, 18 bp, Homo sapiens
tttctctctacagtgcca

SEQ ID NO: 4936110 - DNA, 13 bp, Homo sapiens
tttctctcttccc

SEQ ID NO: 4936111 - DNA, 14 bp, Homo sapiens
tttctctcttccct

SEQ ID NO: 4936112 - DNA, 16 bp, Homo sapiens
tttctctcttccctca

SEQ ID NO: 4936113 - DNA, 17 bp, Homo sapiens
tttctctcttccctcag

SEQ ID NO: 4936114 - DNA, 14 bp, Homo sapiens
tttctctgttgtaa

SEQ ID NO: 4936115 - DNA, 15 bp, Homo sapiens
tttctcttgagctgg

SEQ ID NO: 4936116 - DNA, 17 bp, Homo sapiens
tttctcttgagctggcc

SEQ ID NO: 4936117 - DNA, 15 bp, Homo sapiens
tttctctttttagtt

SEQ ID NO: 4936118 - DNA, 16 bp, Homo sapiens
tttctgagcacacttt

SEQ ID NO: 4936119 - DNA, 20 bp, Homo sapiens
tttctgattagctttgtgtt

SEQ ID NO: 4936120 - DNA, 14 bp, Homo sapiens
tttctgcaaaatag

SEQ ID NO: 4936121 - DNA, 16 bp, Homo sapiens
tttctgccagggagct

SEQ ID NO: 4936122 - DNA, 18 bp, Homo sapiens
tttctggaatacatgaaa

SEQ ID NO: 4936123 - DNA, 21 bp, Homo sapiens
tttctggaatacatgaaatat

SEQ ID NO: 4936124 - DNA, 15 bp, Homo sapiens
tttctggggaaagac

SEQ ID NO: 4936125 - DNA, 15 bp, Homo sapiens
tttctgggtcttttg

SEQ ID NO: 4936126 - DNA, 15 bp, Homo sapiens
tttctggttctaaca

SEQ ID NO: 4936127 - DNA, 15 bp, Homo sapiens
tttctgtcaagaaga

SEQ ID NO: 4936128 - DNA, 17 bp, Homo sapiens
tttctgtcagatgagaa

SEQ ID NO: 4936129 - DNA, 22 bp, Homo sapiens
tttctgtcagatgagaacaaag

SEQ ID NO: 4936130 - DNA, 14 bp, Homo sapiens
tttctgttgtaact

SEQ ID NO: 4936131 - DNA, 17 bp, Homo sapiens
tttctgttgtaacttat

SEQ ID NO: 4936132 - DNA, 21 bp, Homo sapiens
tttcttaaataatgcttcaga

SEQ ID NO: 4936133 - DNA, 22 bp, Homo sapiens
tttcttaaataatgcttcagat

SEQ ID NO: 4936134 - DNA, 21 bp, Homo sapiens
tttcttagctttttaattgtt

SEQ ID NO: 4936135 - DNA, 17 bp, Homo sapiens
tttcttattgcgctgct

SEQ ID NO: 4936136 - DNA, 15 bp, Homo sapiens
tttcttcaaaatgta

SEQ ID NO: 4936137 - DNA, 14 bp, Homo sapiens
tttcttcctctgct

SEQ ID NO: 4936138 - DNA, 16 bp, Homo sapiens
tttcttcctctgctga

SEQ ID NO: 4936139 - DNA, 20 bp, Homo sapiens
tttcttgacaaaacctaact

SEQ ID NO: 4936140 - DNA, 15 bp, Homo sapiens
tttcttgcttgtacc

SEQ ID NO: 4936141 - DNA, 22 bp, Homo sapiens
tttcttggcaaaagccttgtgt

SEQ ID NO: 4936142 - DNA, 19 bp, Homo sapiens
tttgtacatagttatttat

SEQ ID NO: 4936143 - DNA, 14 bp, Homo sapiens
tttgtactgaaaaa

SEQ ID NO: 4936144 - DNA, 23 bp, Homo sapiens
tttgtaggaaggtctcattcttc

SEQ ID NO: 4936145 - DNA, 19 bp, Homo sapiens
tttgtaggggtcaaagaaa

SEQ ID NO: 4936146 - DNA, 20 bp, Homo sapiens
tttgtaggggtcaaagaaat

SEQ ID NO: 4936147 - DNA, 15 bp, Homo sapiens
tttgtaggtaaaatg

SEQ ID NO: 4936148 - DNA, 15 bp, Homo sapiens
tttgtagtagcgttt

SEQ ID NO: 4936149 - DNA, 23 bp, Homo sapiens
tttgtagtggaaacatttatatt

SEQ ID NO: 4936150 - DNA, 19 bp, Homo sapiens
tttgtataacttcttaaaa

SEQ ID NO: 4936151 - DNA, 19 bp, Homo sapiens
tttgtatacaaatatattg

SEQ ID NO: 4936152 - DNA, 20 bp, Homo sapiens
tttgtatactttaaataatt

SEQ ID NO: 4936153 - DNA, 22 bp, Homo sapiens
tttgtatactttaaataattta

SEQ ID NO: 4936154 - DNA, 14 bp, Homo sapiens
tttgtatattacac

SEQ ID NO: 4936155 - DNA, 13 bp, Homo sapiens
tttgtatgtgtgt

SEQ ID NO: 4936156 - DNA, 15 bp, Homo sapiens
tttgtattattgctg

SEQ ID NO: 4936157 - DNA, 19 bp, Homo sapiens
tttgtcatcagatggaaat

SEQ ID NO: 4936158 - DNA, 22 bp, Homo sapiens
tttgtcatcagatggaaatatt

SEQ ID NO: 4936159 - DNA, 17 bp, Homo sapiens
tttgtcatcagccacca

SEQ ID NO: 4936160 - DNA, 21 bp, Homo sapiens
tttgtcatgaattcttatgct

SEQ ID NO: 4936161 - DNA, 15 bp, Homo sapiens
tttgtccatttgtaa

SEQ ID NO: 4936162 - DNA, 21 bp, Homo sapiens
tttgtcccccaacttgagatg

SEQ ID NO: 4936163 - DNA, 12 bp, Homo sapiens
tttgtcctcaaa

SEQ ID NO: 4936164 - DNA, 22 bp, Homo sapiens
tttgtctcagaagtgaaaatct

SEQ ID NO: 4936165 - DNA, 18 bp, Homo sapiens
tttgtctcagttggaaat

SEQ ID NO: 4936166 - DNA, 17 bp, Homo sapiens
tttgtctctccttttct

SEQ ID NO: 4936167 - DNA, 14 bp, Homo sapiens
tttgtctgaaaaat

SEQ ID NO: 4936168 - DNA, 18 bp, Homo sapiens
tttgtctgtttgtttcaa

SEQ ID NO: 4936169 - DNA, 16 bp, Homo sapiens
tttgtcttgaatgtct

SEQ ID NO: 4936170 - DNA, 17 bp, Homo sapiens
tttgtgaatggattgga

SEQ ID NO: 4936171 - DNA, 19 bp, Homo sapiens
tttgtgaatggattggatt

SEQ ID NO: 4936172 - DNA, 14 bp, Homo sapiens
tttgtgactatata

SEQ ID NO: 4936173 - DNA, 14 bp, Homo sapiens
tttgtgataattta

SEQ ID NO: 4936174 - DNA, 21 bp, Homo sapiens
tttgtgcaaaagcttcaaatt

SEQ ID NO: 4936175 - DNA, 12 bp, Homo sapiens
tttgtggaataa

SEQ ID NO: 4936176 - DNA, 16 bp, Homo sapiens
tttgtggttttatgga

SEQ ID NO: 4936177 - DNA, 19 bp, Homo sapiens
tttgtgtaatagaaaactg

SEQ ID NO: 4936178 - DNA, 22 bp, Homo sapiens
tttgtgtcaatgggcaatgaca

SEQ ID NO: 4936179 - DNA, 13 bp, Homo sapiens
tttgtgtgtctta

SEQ ID NO: 4936180 - DNA, 15 bp, Homo sapiens
tttgtgtgttgtctt

SEQ ID NO: 4936181 - DNA, 17 bp, Homo sapiens
tttgtgtgttgtcttga

SEQ ID NO: 4936182 - DNA, 14 bp, Homo sapiens
tttgtgttcttctt

SEQ ID NO: 4936183 - DNA, 13 bp, Homo sapiens
tttgtgttgtaat

SEQ ID NO: 4936184 - DNA, 23 bp, Homo sapiens
tttgtgttgtaattcttcagttg

SEQ ID NO: 4936185 - DNA, 22 bp, Homo sapiens
tttgttaaaattatcaatatct

SEQ ID NO: 4936186 - DNA, 24 bp, Homo sapiens
tttgttacctccaacagaactaaa

SEQ ID NO: 4936187 - DNA, 9 bp, Homo sapiens
tttgttact

SEQ ID NO: 4936188 - DNA, 17 bp, Homo sapiens
tttgttactgttcttgc

SEQ ID NO: 4936189 - DNA, 22 bp, Homo sapiens
tttgttactgttcttgctgcta

SEQ ID NO: 4936190 - DNA, 21 bp, Homo sapiens
tttgttagttcctgtatgaaa

SEQ ID NO: 4936191 - DNA, 20 bp, Homo sapiens
tttgttattttcagtatttt

SEQ ID NO: 4936192 - DNA, 23 bp, Homo sapiens
tttgttcaagttttgggtatgtt

SEQ ID NO: 4936193 - DNA, 17 bp, Homo sapiens
tttgttcactgaaggtg

SEQ ID NO: 4936194 - DNA, 12 bp, Homo sapiens
tttgttcatgtt

SEQ ID NO: 4936195 - DNA, 19 bp, Homo sapiens
tttgttgacaaaattttct

SEQ ID NO: 4936196 - DNA, 21 bp, Homo sapiens
tttgtttcaagaacctggaaa

SEQ ID NO: 4936197 - DNA, 10 bp, Homo sapiens
tttgtttctt

SEQ ID NO: 4936198 - DNA, 14 bp, Homo sapiens
tttgttttcatggt

SEQ ID NO: 4936199 - DNA, 13 bp, Homo sapiens
tttgtttttaatt

SEQ ID NO: 4936200 - DNA, 13 bp, Homo sapiens
tttgtttttctca

SEQ ID NO: 4936201 - DNA, 22 bp, Homo sapiens
ttttaaaaaatgaaaataagtg

SEQ ID NO: 4936202 - DNA, 20 bp, Homo sapiens
ttttaaaacacatgttttta

SEQ ID NO: 4936203 - DNA, 21 bp, Homo sapiens
ttttaaaaggtattttgaata

SEQ ID NO: 4936204 - DNA, 21 bp, Homo sapiens
ttttaaaatggtgcttaagtt

SEQ ID NO: 4936205 - DNA, 13 bp, Homo sapiens
ttttaaagtgttt

SEQ ID NO: 4936206 - DNA, 14 bp, Homo sapiens
ttttaaataaactt

SEQ ID NO: 4936207 - DNA, 15 bp, Homo sapiens
ttttaaataaacttt

SEQ ID NO: 4936208 - DNA, 13 bp, Homo sapiens
ttttaaattctga

SEQ ID NO: 4936209 - DNA, 19 bp, Homo sapiens
ttttaacattttgttctta

SEQ ID NO: 4936210 - DNA, 17 bp, Homo sapiens
ttttaagatttttctca

SEQ ID NO: 4936211 - DNA, 17 bp, Homo sapiens
ttttaagtaatgtggaa

SEQ ID NO: 4936212 - DNA, 15 bp, Homo sapiens
ttttaagtggtttga

SEQ ID NO: 4936213 - DNA, 17 bp, Homo sapiens
ttttaatctgaaattct

SEQ ID NO: 4936214 - DNA, 22 bp, Homo sapiens
ttttaatggcagcagaaaactt

SEQ ID NO: 4936215 - DNA, 12 bp, Homo sapiens
ttttaatgtaaa

SEQ ID NO: 4936216 - DNA, 14 bp, Homo sapiens
ttttaattgtcatg

SEQ ID NO: 4936217 - DNA, 17 bp, Homo sapiens
ttttacaataaaatctt

SEQ ID NO: 4936218 - DNA, 18 bp, Homo sapiens
ttttacacagaaacactg

SEQ ID NO: 4936219 - DNA, 19 bp, Homo sapiens
ttttacacattagatttta

SEQ ID NO: 4936220 - DNA, 16 bp, Homo sapiens
ttttacagctgcctgc

SEQ ID NO: 4936221 - DNA, 19 bp, Homo sapiens
ttttacagctttacacaca

SEQ ID NO: 4936222 - DNA, 15 bp, Homo sapiens
ttttaccagctttta

SEQ ID NO: 4936223 - DNA, 16 bp, Homo sapiens
ttttaccagcttttaa

SEQ ID NO: 4936224 - DNA, 22 bp, Homo sapiens
ttttaccctaatgtcttcataa

SEQ ID NO: 4936225 - DNA, 21 bp, Homo sapiens
ttttacctgtcacattgcatt

SEQ ID NO: 4936226 - DNA, 17 bp, Homo sapiens
ttttagatggtttcttg

SEQ ID NO: 4936227 - DNA, 21 bp, Homo sapiens
ttttagcaatttatacaatat

SEQ ID NO: 4936228 - DNA, 20 bp, Homo sapiens
ttttaggagctaaggctcta

SEQ ID NO: 4936229 - DNA, 23 bp, Homo sapiens
ttttaggagctaaggctctatga

SEQ ID NO: 4936230 - DNA, 12 bp, Homo sapiens
ttttaggttcta

SEQ ID NO: 4936231 - DNA, 13 bp, Homo sapiens
ttttaggttctaa

SEQ ID NO: 4936232 - DNA, 14 bp, Homo sapiens
ttttaggttctaaa

SEQ ID NO: 4936233 - DNA, 16 bp, Homo sapiens
ttttaggttctaaagt

SEQ ID NO: 4936234 - DNA, 14 bp, Homo sapiens
ttttagtaatctgt

SEQ ID NO: 4936235 - DNA, 19 bp, Homo sapiens
ttttagtatttatttatgt

SEQ ID NO: 4936236 - DNA, 20 bp, Homo sapiens
ttttagtatttatttatgta

SEQ ID NO: 4936237 - DNA, 23 bp, Homo sapiens
ttttagtatttatttatgtactt

SEQ ID NO: 4936238 - DNA, 18 bp, Homo sapiens
ttttatactctttctgta

SEQ ID NO: 4936239 - DNA, 22 bp, Homo sapiens
ttttatatacagaggaaatctg

SEQ ID NO: 4936240 - DNA, 15 bp, Homo sapiens
ttttatatatacagt

SEQ ID NO: 4936241 - DNA, 13 bp, Homo sapiens
ttttatatttagt

SEQ ID NO: 4936242 - DNA, 16 bp, Homo sapiens
ttttatatttgtatcg

SEQ ID NO: 4936243 - DNA, 22 bp, Homo sapiens
ttttatctattctgagaaaaca

SEQ ID NO: 4936244 - DNA, 16 bp, Homo sapiens
ttttatgagcttccaa

SEQ ID NO: 4936245 - DNA, 16 bp, Homo sapiens
ttttatgatgatgaaa

SEQ ID NO: 4936246 - DNA, 19 bp, Homo sapiens
ttttatgctcttttttact

SEQ ID NO: 4936247 - DNA, 22 bp, Homo sapiens
ttttatgctcttttttactcat

SEQ ID NO: 4936248 - DNA, 12 bp, Homo sapiens
ttttattaaatt

SEQ ID NO: 4936249 - DNA, 13 bp, Homo sapiens
ttttattaattta

SEQ ID NO: 4936250 - DNA, 20 bp, Homo sapiens
ttttattgctagtatttgaa

SEQ ID NO: 4936251 - DNA, 23 bp, Homo sapiens
ttttattgctagtatttgaatta

SEQ ID NO: 4936252 - DNA, 22 bp, Homo sapiens
cagtaggggcttataataaagg

SEQ ID NO: 4936253 - DNA, 22 bp, Homo sapiens
cagtaggtgacactatagttta

SEQ ID NO: 4936254 - DNA, 23 bp, Homo sapiens
cagtagtcttgatgaccaaagtc

SEQ ID NO: 4936255 - DNA, 15 bp, Homo sapiens
cagtatatttaaact

SEQ ID NO: 4936256 - DNA, 12 bp, Homo sapiens
cagtatcccaca

SEQ ID NO: 4936257 - DNA, 13 bp, Homo sapiens
cagtatcccacat

SEQ ID NO: 4936258 - DNA, 14 bp, Homo sapiens
cagtatcccacatc

SEQ ID NO: 4936259 - DNA, 20 bp, Homo sapiens
cagtatctatatatgtgtat

SEQ ID NO: 4936260 - DNA, 21 bp, Homo sapiens
cagtatctatatatgtgtatg

SEQ ID NO: 4936261 - DNA, 20 bp, Homo sapiens
cagtattaatactaaaatat

SEQ ID NO: 4936262 - DNA, 16 bp, Homo sapiens
cagtattacttctgct

SEQ ID NO: 4936263 - DNA, 19 bp, Homo sapiens
cagtattacttctgctaca

SEQ ID NO: 4936264 - DNA, 19 bp, Homo sapiens
cagtattttggagaaatta

SEQ ID NO: 4936265 - DNA, 20 bp, Homo sapiens
cagtattttggagaaattat

SEQ ID NO: 4936266 - DNA, 21 bp, Homo sapiens
cagtattttggagaaattatt

SEQ ID NO: 4936267 - DNA, 23 bp, Homo sapiens
cagtattttggagaaattattta

SEQ ID NO: 4936268 - DNA, 19 bp, Homo sapiens
cagtcagaaaactttaaaa

SEQ ID NO: 4936269 - DNA, 15 bp, Homo sapiens
cagtcatcatcaggg

SEQ ID NO: 4936270 - DNA, 19 bp, Homo sapiens
cagtcatcatcagggcctg

SEQ ID NO: 4936271 - DNA, 22 bp, Homo sapiens
cagtcatcatcagggcctgggg

SEQ ID NO: 4936272 - DNA, 23 bp, Homo sapiens
cagtcatcatcagggcctggggc

SEQ ID NO: 4936273 - DNA, 18 bp, Homo sapiens
cagtcattagactcctcc

SEQ ID NO: 4936274 - DNA, 23 bp, Homo sapiens
cagtccaaatgtcctccagaagc

SEQ ID NO: 4936275 - DNA, 15 bp, Homo sapiens
cagtccaggaacaag

SEQ ID NO: 4936276 - DNA, 19 bp, Homo sapiens
cagtccatgcatgacagcc

SEQ ID NO: 4936277 - DNA, 19 bp, Homo sapiens
cagtcccatcagagagcga

SEQ ID NO: 4936278 - DNA, 19 bp, Homo sapiens
cagtccccagcccttcaca

SEQ ID NO: 4936279 - DNA, 23 bp, Homo sapiens
cagtccccctatccttggcacca

SEQ ID NO: 4936280 - DNA, 16 bp, Homo sapiens
cagtccccctgcccca

SEQ ID NO: 4936281 - DNA, 17 bp, Homo sapiens
cagtccccctgccccag

SEQ ID NO: 4936282 - DNA, 23 bp, Homo sapiens
cagtccccgtggccatccctgtg

SEQ ID NO: 4936283 - DNA, 14 bp, Homo sapiens
cagtccctaaagaa

SEQ ID NO: 4936284 - DNA, 23 bp, Homo sapiens
cagtccctgagaccatttaacat

SEQ ID NO: 4936285 - DNA, 18 bp, Homo sapiens
cagtcctcccctcacagc

SEQ ID NO: 4936286 - DNA, 22 bp, Homo sapiens
cagtcctcccctcacagcctct

SEQ ID NO: 4936287 - DNA, 20 bp, Homo sapiens
cagtcctccggttgcatact

SEQ ID NO: 4936288 - DNA, 14 bp, Homo sapiens
cagtcctgcctggc

SEQ ID NO: 4936289 - DNA, 15 bp, Homo sapiens
cagtcctgctccaga

SEQ ID NO: 4936290 - DNA, 20 bp, Homo sapiens
cagtcctttgtaaacagtgt

SEQ ID NO: 4936291 - DNA, 19 bp, Homo sapiens
cagtctaaaatgcttcagt

SEQ ID NO: 4936292 - DNA, 23 bp, Homo sapiens
cagtctcaaaaatacaaaataaa

SEQ ID NO: 4936293 - DNA, 16 bp, Homo sapiens
cagtctcctctttaaa

SEQ ID NO: 4936294 - DNA, 20 bp, Homo sapiens
cagtctcctctttaaaacaa

SEQ ID NO: 4936295 - DNA, 22 bp, Homo sapiens
cagtctcctctttaaaacaaaa

SEQ ID NO: 4936296 - DNA, 23 bp, Homo sapiens
cagtctcctctttaaaacaaaac

SEQ ID NO: 4936297 - DNA, 20 bp, Homo sapiens
cagtctgaatgctgccacaa

SEQ ID NO: 4936298 - DNA, 23 bp, Homo sapiens
cagtctgattcccaagctctgct

SEQ ID NO: 4936299 - DNA, 19 bp, Homo sapiens
cagtctggaatgcagtggt

SEQ ID NO: 4936300 - DNA, 15 bp, Homo sapiens
cagtcttgaatttct

SEQ ID NO: 4936301 - DNA, 18 bp, Homo sapiens
cagtctttaaaggcccag

SEQ ID NO: 4936302 - DNA, 18 bp, Homo sapiens
cagtctttttctgttgta

SEQ ID NO: 4936303 - DNA, 12 bp, Homo sapiens
cagtgaattctt

SEQ ID NO: 4936304 - DNA, 24 bp, Homo sapiens
cagtgacccttcccaatcagcact

SEQ ID NO: 4936305 - DNA, 18 bp, Homo sapiens
cagtgagattacagagga

SEQ ID NO: 4936306 - DNA, 22 bp, Homo sapiens
cagtgagtcgaggacagggagg

SEQ ID NO: 4936307 - DNA, 14 bp, Homo sapiens
cagtgagtgagcct

SEQ ID NO: 4936308 - DNA, 16 bp, Homo sapiens
cagtgagtgagcctgg

SEQ ID NO: 4936309 - DNA, 19 bp, Homo sapiens
cagtgagtgagcctggctc

SEQ ID NO: 4936310 - DNA, 20 bp, Homo sapiens
cagtgagtgagcctggctct

SEQ ID NO: 4936311 - DNA, 14 bp, Homo sapiens
cagtgattagcact

SEQ ID NO: 4936312 - DNA, 22 bp, Homo sapiens
cagtgcaatggtataaatttca

SEQ ID NO: 4936313 - DNA, 15 bp, Homo sapiens
cagtgcatctcagcc

SEQ ID NO: 4936314 - DNA, 17 bp, Homo sapiens
cagtgcatctcagccca

SEQ ID NO: 4936315 - DNA, 13 bp, Homo sapiens
cagtgccaaggac

SEQ ID NO: 4936316 - DNA, 15 bp, Homo sapiens
cagtgccagcaatga

SEQ ID NO: 4936317 - DNA, 13 bp, Homo sapiens
caggactccctcc

SEQ ID NO: 4936318 - DNA, 23 bp, Homo sapiens
caggactccctcctcacctctgg

SEQ ID NO: 4936319 - DNA, 15 bp, Homo sapiens
caggactctgcctcc

SEQ ID NO: 4936320 - DNA, 17 bp, Homo sapiens
caggactgagccccgca

SEQ ID NO: 4936321 - DNA, 18 bp, Homo sapiens
caggactgagccccgcag

SEQ ID NO: 4936322 - DNA, 19 bp, Homo sapiens
caggactgcaacaggcttg

SEQ ID NO: 4936323 - DNA, 12 bp, Homo sapiens
caggagacatcc

SEQ ID NO: 4936324 - DNA, 14 bp, Homo sapiens
caggagagagaaag

SEQ ID NO: 4936325 - DNA, 21 bp, Homo sapiens
caggagattgagaaggagaga

SEQ ID NO: 4936326 - DNA, 18 bp, Homo sapiens
caggagccccgaggcctt

SEQ ID NO: 4936327 - DNA, 16 bp, Homo sapiens
caggagcctgtgcctc

SEQ ID NO: 4936328 - DNA, 13 bp, Homo sapiens
caggagcgcaaga

SEQ ID NO: 4936329 - DNA, 16 bp, Homo sapiens
caggagcgcaagatag

SEQ ID NO: 4936330 - DNA, 18 bp, Homo sapiens
caggagctcttcaggcct

SEQ ID NO: 4936331 - DNA, 19 bp, Homo sapiens
caggagctcttcaggcctc

SEQ ID NO: 4936332 - DNA, 23 bp, Homo sapiens
caggaggattgcttgagcccagg

SEQ ID NO: 4936333 - DNA, 13 bp, Homo sapiens
caggaggcgccct

SEQ ID NO: 4936334 - DNA, 17 bp, Homo sapiens
caggaggcgcccttggc

SEQ ID NO: 4936335 - DNA, 16 bp, Homo sapiens
caggaggctgaggcag

SEQ ID NO: 4936336 - DNA, 18 bp, Homo sapiens
caggaggctgaggcagga

SEQ ID NO: 4936337 - DNA, 19 bp, Homo sapiens
caggaggctgaggcaggag

SEQ ID NO: 4936338 - DNA, 20 bp, Homo sapiens
caggaggctgaggcaggagg

SEQ ID NO: 4936339 - DNA, 12 bp, Homo sapiens
caggagggaggg

SEQ ID NO: 4936340 - DNA, 15 bp, Homo sapiens
caggagggtctatgg

SEQ ID NO: 4936341 - DNA, 15 bp, Homo sapiens
caggagtcccaagga

SEQ ID NO: 4936342 - DNA, 21 bp, Homo sapiens
caggagttcaataaatgtctg

SEQ ID NO: 4936343 - DNA, 19 bp, Homo sapiens
caggagttcgaggctgcag

SEQ ID NO: 4936344 - DNA, 13 bp, Homo sapiens
caggatcagtctg

SEQ ID NO: 4936345 - DNA, 14 bp, Homo sapiens
caggatcagtctga

SEQ ID NO: 4936346 - DNA, 23 bp, Homo sapiens
caggatcatggtgtaataagaca

SEQ ID NO: 4936347 - DNA, 21 bp, Homo sapiens
caggatcccaggggcccaagg

SEQ ID NO: 4936348 - DNA, 13 bp, Homo sapiens
caggatgctggcc

SEQ ID NO: 4936349 - DNA, 15 bp, Homo sapiens
caggatgctgggtgg

SEQ ID NO: 4936350 - DNA, 19 bp, Homo sapiens
caggatgggggctggcctc

SEQ ID NO: 4936351 - DNA, 18 bp, Homo sapiens
caggcaaaatccttgctt

SEQ ID NO: 4936352 - DNA, 19 bp, Homo sapiens
caggcaacttcagtcctgg

SEQ ID NO: 4936353 - DNA, 22 bp, Homo sapiens
caggcaacttcagtcctgggag

SEQ ID NO: 4936354 - DNA, 14 bp, Homo sapiens
caggcaatgctggc

SEQ ID NO: 4936355 - DNA, 21 bp, Homo sapiens
caggcaatgctggctgttggc

SEQ ID NO: 4936356 - DNA, 20 bp, Homo sapiens
caggcacaggatgctgtgtt

SEQ ID NO: 4936357 - DNA, 23 bp, Homo sapiens
caggcacccaccatcatgtctgg

SEQ ID NO: 4936358 - DNA, 19 bp, Homo sapiens
caggcacctagcaattcca

SEQ ID NO: 4936359 - DNA, 16 bp, Homo sapiens
caggcactagcctttg

SEQ ID NO: 4936360 - DNA, 23 bp, Homo sapiens
caggcagagaatcatacttagca

SEQ ID NO: 4936361 - DNA, 13 bp, Homo sapiens
caggcagatctgt

SEQ ID NO: 4936362 - DNA, 15 bp, Homo sapiens
caggcagatctgtgc

SEQ ID NO: 4936363 - DNA, 18 bp, Homo sapiens
caggcagatctgtgcccc

SEQ ID NO: 4936364 - DNA, 21 bp, Homo sapiens
caggcagatctgtgccccatg

SEQ ID NO: 4936365 - DNA, 21 bp, Homo sapiens
caggcagcgatggtctcagaa

SEQ ID NO: 4936366 - DNA, 19 bp, Homo sapiens
caggcagcgccaagtgcgt

SEQ ID NO: 4936367 - DNA, 14 bp, Homo sapiens
caggcagctttcta

SEQ ID NO: 4936368 - DNA, 19 bp, Homo sapiens
caggcaggaagggcaggaa

SEQ ID NO: 4936369 - DNA, 20 bp, Homo sapiens
caggcaggtagccaggggga

SEQ ID NO: 4936370 - DNA, 23 bp, Homo sapiens
caggcaggtcttgaactcctggc

SEQ ID NO: 4936371 - DNA, 13 bp, Homo sapiens
caggcagtctctc

SEQ ID NO: 4936372 - DNA, 15 bp, Homo sapiens
caggcatctgatttg

SEQ ID NO: 4936373 - DNA, 15 bp, Homo sapiens
caggcatgttctctg

SEQ ID NO: 4936374 - DNA, 18 bp, Homo sapiens
caggcatgttctctgagg

SEQ ID NO: 4936375 - DNA, 21 bp, Homo sapiens
caggcatttgactgaagatgc

SEQ ID NO: 4936376 - DNA, 13 bp, Homo sapiens
caggcatttgttc

SEQ ID NO: 4936377 - DNA, 15 bp, Homo sapiens
caggccagagggagt

SEQ ID NO: 4936378 - DNA, 17 bp, Homo sapiens
cagcgaccgccccctcc

SEQ ID NO: 4936379 - DNA, 18 bp, Homo sapiens
cagcgaccgccccctcct

SEQ ID NO: 4936380 - DNA, 13 bp, Homo sapiens
cagcgagccctgg

SEQ ID NO: 4936381 - DNA, 17 bp, Homo sapiens
cagcgagccctggtggc

SEQ ID NO: 4936382 - DNA, 16 bp, Homo sapiens
cagcgagggcagctgc

SEQ ID NO: 4936383 - DNA, 16 bp, Homo sapiens
cagcggcccctgcatc

SEQ ID NO: 4936384 - DNA, 20 bp, Homo sapiens
cagcggcccctgcatcccct

SEQ ID NO: 4936385 - DNA, 14 bp, Homo sapiens
cagcggggacagct

SEQ ID NO: 4936386 - DNA, 17 bp, Homo sapiens
cagcggggacagctcct

SEQ ID NO: 4936387 - DNA, 21 bp, Homo sapiens
cagcggggacagctccttctg

SEQ ID NO: 4936388 - DNA, 14 bp, Homo sapiens
cagcgtaaaatggt

SEQ ID NO: 4936389 - DNA, 15 bp, Homo sapiens
cagcgtaaaatggtg

SEQ ID NO: 4936390 - DNA, 21 bp, Homo sapiens
cagcgtcccagtctctggcag

SEQ ID NO: 4936391 - DNA, 18 bp, Homo sapiens
cagctaagctaggaatga

SEQ ID NO: 4936392 - DNA, 19 bp, Homo sapiens
cagctaagggaagacattt

SEQ ID NO: 4936393 - DNA, 16 bp, Homo sapiens
cagctaatgggacact

SEQ ID NO: 4936394 - DNA, 20 bp, Homo sapiens
cagctacagctttcttgctc

SEQ ID NO: 4936395 - DNA, 18 bp, Homo sapiens
cagctacccactatcctt

SEQ ID NO: 4936396 - DNA, 24 bp, Homo sapiens
cagctaccctttttctccagctgg

SEQ ID NO: 4936397 - DNA, 19 bp, Homo sapiens
cagctatcgaacttcacaa

SEQ ID NO: 4936398 - DNA, 13 bp, Homo sapiens
cagctatgggagc

SEQ ID NO: 4936399 - DNA, 15 bp, Homo sapiens
cagctatgggagccc

SEQ ID NO: 4936400 - DNA, 22 bp, Homo sapiens
cagctatgggagccccagggtc

SEQ ID NO: 4936401 - DNA, 16 bp, Homo sapiens
cagctcaatggactgg

SEQ ID NO: 4936402 - DNA, 20 bp, Homo sapiens
cagctcacagtgctgtgtgc

SEQ ID NO: 4936403 - DNA, 12 bp, Homo sapiens
cagctcagaacc

SEQ ID NO: 4936404 - DNA, 16 bp, Homo sapiens
cagctcagaacccagg

SEQ ID NO: 4936405 - DNA, 14 bp, Homo sapiens
cagctcaggggcag

SEQ ID NO: 4936406 - DNA, 15 bp, Homo sapiens
cagctcaggggcagc

SEQ ID NO: 4936407 - DNA, 17 bp, Homo sapiens
cagctcaggggcagctc

SEQ ID NO: 4936408 - DNA, 20 bp, Homo sapiens
cagctcatagagtcccccct

SEQ ID NO: 4936409 - DNA, 13 bp, Homo sapiens
cagctccagctca

SEQ ID NO: 4936410 - DNA, 16 bp, Homo sapiens
cagctccagctcacca

SEQ ID NO: 4936411 - DNA, 18 bp, Homo sapiens
cagctccagctcaccagc

SEQ ID NO: 4936412 - DNA, 22 bp, Homo sapiens
cagctccagctcaccagcccca

SEQ ID NO: 4936413 - DNA, 20 bp, Homo sapiens
cagctccagggaatccaagc

SEQ ID NO: 4936414 - DNA, 21 bp, Homo sapiens
cagctccagggaatccaagcc

SEQ ID NO: 4936415 - DNA, 22 bp, Homo sapiens
cagctccagggaatccaagcct

SEQ ID NO: 4936416 - DNA, 18 bp, Homo sapiens
cagctccctaggagacca

SEQ ID NO: 4936417 - DNA, 20 bp, Homo sapiens
cagctccctaggagaccaag

SEQ ID NO: 4936418 - DNA, 17 bp, Homo sapiens
cagctccgcctctgtcc

SEQ ID NO: 4936419 - DNA, 18 bp, Homo sapiens
cagctcgatccaaattgt

SEQ ID NO: 4936420 - DNA, 19 bp, Homo sapiens
cagctcgcacccccctgtt

SEQ ID NO: 4936421 - DNA, 23 bp, Homo sapiens
cagctcgcacccccctgttctaa

SEQ ID NO: 4936422 - DNA, 16 bp, Homo sapiens
cagctcggggagcctt

SEQ ID NO: 4936423 - DNA, 13 bp, Homo sapiens
cagctctgtcctg

SEQ ID NO: 4936424 - DNA, 14 bp, Homo sapiens
cagctctgtcctgg

SEQ ID NO: 4936425 - DNA, 16 bp, Homo sapiens
cagctctgtcctggga

SEQ ID NO: 4936426 - DNA, 13 bp, Homo sapiens
cagctcttctcca

SEQ ID NO: 4936427 - DNA, 17 bp, Homo sapiens
cagctcttctccaggct

SEQ ID NO: 4936428 - DNA, 22 bp, Homo sapiens
cagctctttgaaatagtctgtg

SEQ ID NO: 4936429 - DNA, 21 bp, Homo sapiens
cagctgaatgcctcctgtggg

SEQ ID NO: 4936430 - DNA, 22 bp, Homo sapiens
cagctgagaaaatgagtgacta

SEQ ID NO: 4936431 - DNA, 14 bp, Homo sapiens
cagctgagttatga

SEQ ID NO: 4936432 - DNA, 20 bp, Homo sapiens
cagctgatacttcatttaaa

SEQ ID NO: 4936433 - DNA, 19 bp, Homo sapiens
cagctgcaccagagcaacc

SEQ ID NO: 4936434 - DNA, 20 bp, Homo sapiens
cagctgcggtccacccagga

SEQ ID NO: 4936435 - DNA, 24 bp, Homo sapiens
cagctgcggtccacccaggagccc

SEQ ID NO: 4936436 - DNA, 15 bp, Homo sapiens
gtgaccaactgtgtt

SEQ ID NO: 4936437 - DNA, 12 bp, Homo sapiens
gtgacccttccc

SEQ ID NO: 4936438 - DNA, 12 bp, Homo sapiens
gtgacctcaggc

SEQ ID NO: 4936439 - DNA, 15 bp, Homo sapiens
gtgacctctgcctga

SEQ ID NO: 4936440 - DNA, 13 bp, Homo sapiens
gtgacctgtttat

SEQ ID NO: 4936441 - DNA, 16 bp, Homo sapiens
gtgacggccctcatct

SEQ ID NO: 4936442 - DNA, 15 bp, Homo sapiens
gtgactatatagaga

SEQ ID NO: 4936443 - DNA, 22 bp, Homo sapiens
gtgactctttttagggccaggc

SEQ ID NO: 4936444 - DNA, 16 bp, Homo sapiens
gtgacttcagctctgt

SEQ ID NO: 4936445 - DNA, 17 bp, Homo sapiens
gtgagaaaaagctcctg

SEQ ID NO: 4936446 - DNA, 20 bp, Homo sapiens
gtgagaaatttctgtgaaac

SEQ ID NO: 4936447 - DNA, 14 bp, Homo sapiens
gtgagacccccaca

SEQ ID NO: 4936448 - DNA, 15 bp, Homo sapiens
gtgagacccccacac

SEQ ID NO: 4936449 - DNA, 16 bp, Homo sapiens
gtgagacccccacacc

SEQ ID NO: 4936450 - DNA, 12 bp, Homo sapiens
gtgagagctggg

SEQ ID NO: 4936451 - DNA, 19 bp, Homo sapiens
gtgagatgagggatgggcc

SEQ ID NO: 4936452 - DNA, 21 bp, Homo sapiens
gtgagatgagggatgggcctg

SEQ ID NO: 4936453 - DNA, 22 bp, Homo sapiens
gtgagatgagggatgggcctgg

SEQ ID NO: 4936454 - DNA, 17 bp, Homo sapiens
gtgagatgctggagaag

SEQ ID NO: 4936455 - DNA, 18 bp, Homo sapiens
gtgagatgctggagaaga

SEQ ID NO: 4936456 - DNA, 12 bp, Homo sapiens
gtgagatttttt

SEQ ID NO: 4936457 - DNA, 14 bp, Homo sapiens
gtgagattttttat

SEQ ID NO: 4936458 - DNA, 19 bp, Homo sapiens
gtgagattttttattgcta

SEQ ID NO: 4936459 - DNA, 21 bp, Homo sapiens
gtgagattttttattgctagt

SEQ ID NO: 4936460 - DNA, 17 bp, Homo sapiens
gtgagcaggaaggcctg

SEQ ID NO: 4936461 - DNA, 18 bp, Homo sapiens
gtgagcaggaaggcctgg

SEQ ID NO: 4936462 - DNA, 20 bp, Homo sapiens
gtgagcaggaaggcctgggt

SEQ ID NO: 4936463 - DNA, 14 bp, Homo sapiens
gtgagccactgcac

SEQ ID NO: 4936464 - DNA, 19 bp, Homo sapiens
gtgagccgagatcacgcca

SEQ ID NO: 4936465 - DNA, 23 bp, Homo sapiens
gtgagcctggctcttgtgctgga

SEQ ID NO: 4936466 - DNA, 15 bp, Homo sapiens
gtgagctacagagcc

SEQ ID NO: 4936467 - DNA, 18 bp, Homo sapiens
gtgaggaaagcacacagt

SEQ ID NO: 4936468 - DNA, 19 bp, Homo sapiens
gtgagtctttggttctaag

SEQ ID NO: 4936469 - DNA, 16 bp, Homo sapiens
gtgagtttggtctgga

SEQ ID NO: 4936470 - DNA, 18 bp, Homo sapiens
gtgagtttggtctggact

SEQ ID NO: 4936471 - DNA, 19 bp, Homo sapiens
gtgagtttggtctggactg

SEQ ID NO: 4936472 - DNA, 12 bp, Homo sapiens
gtgatagcattg

SEQ ID NO: 4936473 - DNA, 18 bp, Homo sapiens
gtgatagctaacatttta

SEQ ID NO: 4936474 - DNA, 17 bp, Homo sapiens
gtgatagttcaccccct

SEQ ID NO: 4936475 - DNA, 16 bp, Homo sapiens
gtgatatggcagaaga

SEQ ID NO: 4936476 - DNA, 18 bp, Homo sapiens
gtgatccacccacctcag

SEQ ID NO: 4936477 - DNA, 24 bp, Homo sapiens
gtgatccacccacctcagcctccc

SEQ ID NO: 4936478 - DNA, 22 bp, Homo sapiens
gtgatcctcccacctcagcctc

SEQ ID NO: 4936479 - DNA, 13 bp, Homo sapiens
gtgatctgtcttg

SEQ ID NO: 4936480 - DNA, 21 bp, Homo sapiens
gtgatcttaatatatttgaaa

SEQ ID NO: 4936481 - DNA, 15 bp, Homo sapiens
gtgatcttttaaagt

SEQ ID NO: 4936482 - DNA, 14 bp, Homo sapiens
gtgatgaactttct

SEQ ID NO: 4936483 - DNA, 18 bp, Homo sapiens
gtgatgtcttttcttggc

SEQ ID NO: 4936484 - DNA, 13 bp, Homo sapiens
gtgatgttagtgt

SEQ ID NO: 4936485 - DNA, 16 bp, Homo sapiens
gtgatgttctaaggct

SEQ ID NO: 4936486 - DNA, 18 bp, Homo sapiens
gtgatgttctaaggctct

SEQ ID NO: 4936487 - DNA, 22 bp, Homo sapiens
gtgatgttctaaggctctgaga

SEQ ID NO: 4936488 - DNA, 16 bp, Homo sapiens
gtgattctcctgcctc

SEQ ID NO: 4936489 - DNA, 18 bp, Homo sapiens
gtgattctcctgcctcag

SEQ ID NO: 4936490 - DNA, 19 bp, Homo sapiens
gtgattctcctgcctcagc

SEQ ID NO: 4936491 - DNA, 20 bp, Homo sapiens
gtgattctcctgcctcagcc

SEQ ID NO: 4936492 - DNA, 14 bp, Homo sapiens
gtgattgtggaatg

SEQ ID NO: 4936493 - DNA, 19 bp, Homo sapiens
gtgattgtggaatggagat

SEQ ID NO: 4936494 - DNA, 18 bp, Homo sapiens
gtgatttagaactgtatg

SEQ ID NO: 4936495 - DNA, 14 bp, Homo sapiens
gtgcaacagacaag

SEQ ID NO: 4936496 - DNA, 13 bp, Homo sapiens
gtgcaacccaagg

SEQ ID NO: 4936497 - DNA, 19 bp, Homo sapiens
gtgcaagcgacgacagatg

SEQ ID NO: 4936498 - DNA, 18 bp, Homo sapiens
gtgcaatttcaaggttct

SEQ ID NO: 4936499 - DNA, 20 bp, Homo sapiens
gtgcacaaatatttattttc

SEQ ID NO: 4936500 - DNA, 14 bp, Homo sapiens
gtgcacacaccaga

SEQ ID NO: 4936501 - DNA, 21 bp, Homo sapiens
gtgcacacagaaatatatata

SEQ ID NO: 4936502 - DNA, 22 bp, Homo sapiens
gtgcacacagaaatatatatac

SEQ ID NO: 4936503 - DNA, 19 bp, Homo sapiens
gtgcacccatgggctctga

SEQ ID NO: 4936504 - DNA, 23 bp, Homo sapiens
gtgcacccatgggctctgacaga

SEQ ID NO: 4936505 - DNA, 20 bp, Homo sapiens
gtgcaccttaccaactttct

SEQ ID NO: 4936506 - DNA, 21 bp, Homo sapiens
gtgcaccttaccaactttctg

SEQ ID NO: 4936507 - DNA, 18 bp, Homo sapiens
gtgcacgtacacacacat

SEQ ID NO: 4936508 - DNA, 17 bp, Homo sapiens
gtgcactttctaatgtt

SEQ ID NO: 4936509 - DNA, 20 bp, Homo sapiens
gtgcagtggtgcgatctggg

SEQ ID NO: 4936510 - DNA, 18 bp, Homo sapiens
gtgcatctcagcccacat

SEQ ID NO: 4936511 - DNA, 16 bp, Homo sapiens
gtgcatgtatgtcttg

SEQ ID NO: 4936512 - DNA, 23 bp, Homo sapiens
gtgcatgtatgtcttggacactg

SEQ ID NO: 4936513 - DNA, 14 bp, Homo sapiens
gtgcatgtcctttg

SEQ ID NO: 4936514 - DNA, 18 bp, Homo sapiens
gtgcattagcacagattt

SEQ ID NO: 4936515 - DNA, 15 bp, Homo sapiens
gtgccaaatgctctc

SEQ ID NO: 4936516 - DNA, 21 bp, Homo sapiens
gtgccaatatgtattgtaaac

SEQ ID NO: 4936517 - DNA, 21 bp, Homo sapiens
gtgccagaggaatcctggcag

SEQ ID NO: 4936518 - DNA, 20 bp, Homo sapiens
gtgccaggtttttggtctga

SEQ ID NO: 4936519 - DNA, 16 bp, Homo sapiens
gtgccatgtgccaggt

SEQ ID NO: 4936520 - DNA, 23 bp, Homo sapiens
gtgcccaccctgggagacagacc

SEQ ID NO: 4936521 - DNA, 19 bp, Homo sapiens
gtgcccagaacttccctga

SEQ ID NO: 4936522 - DNA, 18 bp, Homo sapiens
gtgccccatgcctgtcca

SEQ ID NO: 4936523 - DNA, 21 bp, Homo sapiens
gtgcccccttcaagcctgtgc

SEQ ID NO: 4936524 - DNA, 20 bp, Homo sapiens
gtgccctactcattggggtt

SEQ ID NO: 4936525 - DNA, 20 bp, Homo sapiens
gtgccgtgtgagtgtgacag

SEQ ID NO: 4936526 - DNA, 22 bp, Homo sapiens
gtgcctggacatttgccttgct

SEQ ID NO: 4936527 - DNA, 15 bp, Homo sapiens
gtgcctggcctggca

SEQ ID NO: 4936528 - DNA, 14 bp, Homo sapiens
gtgcctgggggagt

SEQ ID NO: 4936529 - DNA, 16 bp, Homo sapiens
gtgcctgggggagttt

SEQ ID NO: 4936530 - DNA, 18 bp, Homo sapiens
gtgcctttatgtatttgc

SEQ ID NO: 4936531 - DNA, 15 bp, Homo sapiens
gtgcgctctgtggat

SEQ ID NO: 4936532 - DNA, 22 bp, Homo sapiens
gtgcgtgccgtgtgagtgtgac

SEQ ID NO: 4936533 - DNA, 13 bp, Homo sapiens
gtgcgtgtgtaga

SEQ ID NO: 4936534 - DNA, 16 bp, Homo sapiens
gtgctaaggttctaag

SEQ ID NO: 4936535 - DNA, 17 bp, Homo sapiens
gtgctaaggttctaagg

SEQ ID NO: 4936536 - DNA, 15 bp, Homo sapiens
gtgctactgtctttg

SEQ ID NO: 4936537 - DNA, 14 bp, Homo sapiens
gtgctagtgagctg

SEQ ID NO: 4936538 - DNA, 22 bp, Homo sapiens
gtgctcagaataaggcaggcat

SEQ ID NO: 4936539 - DNA, 16 bp, Homo sapiens
gtgctctgatcatcca

SEQ ID NO: 4936540 - DNA, 13 bp, Homo sapiens
gtgctctggacag

SEQ ID NO: 4936541 - DNA, 14 bp, Homo sapiens
gtgctctggacagg

SEQ ID NO: 4936542 - DNA, 22 bp, Homo sapiens
gtctaattgcatctcaaaatta

SEQ ID NO: 4936543 - DNA, 19 bp, Homo sapiens
gtctagattcaaaggttct

SEQ ID NO: 4936544 - DNA, 19 bp, Homo sapiens
atattgtgccaatatgtat

SEQ ID NO: 4936545 - DNA, 14 bp, Homo sapiens
atattgttaatctc

SEQ ID NO: 4936546 - DNA, 21 bp, Homo sapiens
atattgttcaaacaatatcat

SEQ ID NO: 4936547 - DNA, 22 bp, Homo sapiens
atattgttcaaacaatatcata

SEQ ID NO: 4936548 - DNA, 18 bp, Homo sapiens
atattgttgtataatttc

SEQ ID NO: 4936549 - DNA, 12 bp, Homo sapiens
atatttaaacag

SEQ ID NO: 4936550 - DNA, 14 bp, Homo sapiens
atatttaaacagca

SEQ ID NO: 4936551 - DNA, 18 bp, Homo sapiens
atatttaaacagcagtgt

SEQ ID NO: 4936552 - DNA, 22 bp, Homo sapiens
atatttaacattatttatatgg

SEQ ID NO: 4936553 - DNA, 13 bp, Homo sapiens
atatttaatgata

SEQ ID NO: 4936554 - DNA, 21 bp, Homo sapiens
atatttaatgcattaaacctg

SEQ ID NO: 4936555 - DNA, 23 bp, Homo sapiens
atatttaatgcattaaacctgtc

SEQ ID NO: 4936556 - DNA, 21 bp, Homo sapiens
atatttagttatagtttcaga

SEQ ID NO: 4936557 - DNA, 14 bp, Homo sapiens
atatttatccacta

SEQ ID NO: 4936558 - DNA, 23 bp, Homo sapiens
atatttattaaataaaatcaatt

SEQ ID NO: 4936559 - DNA, 22 bp, Homo sapiens
atatttattttcttttgaattg

SEQ ID NO: 4936560 - DNA, 19 bp, Homo sapiens
atatttccctaaaatacat

SEQ ID NO: 4936561 - DNA, 20 bp, Homo sapiens
atatttccctaaaatacatt

SEQ ID NO: 4936562 - DNA, 15 bp, Homo sapiens
atatttcgaaagctg

SEQ ID NO: 4936563 - DNA, 20 bp, Homo sapiens
atatttctgctttctttgat

SEQ ID NO: 4936564 - DNA, 15 bp, Homo sapiens
atatttgactattct

SEQ ID NO: 4936565 - DNA, 20 bp, Homo sapiens
atatttgacttgcatgaaga

SEQ ID NO: 4936566 - DNA, 21 bp, Homo sapiens
atatttggaagaaaaaaatct

SEQ ID NO: 4936567 - DNA, 23 bp, Homo sapiens
atatttggaagaaaaaaatcttc

SEQ ID NO: 4936568 - DNA, 13 bp, Homo sapiens
atatttgtacata

SEQ ID NO: 4936569 - DNA, 17 bp, Homo sapiens
atattttcacaatgtca

SEQ ID NO: 4936570 - DNA, 14 bp, Homo sapiens
atattttcagtaat

SEQ ID NO: 4936571 - DNA, 17 bp, Homo sapiens
atattttcgtatgaaaa

SEQ ID NO: 4936572 - DNA, 19 bp, Homo sapiens
atattttcgtatgaaaatg

SEQ ID NO: 4936573 - DNA, 23 bp, Homo sapiens
atattttgataataaattgaaat

SEQ ID NO: 4936574 - DNA, 14 bp, Homo sapiens
atattttgtatata

SEQ ID NO: 4936575 - DNA, 17 bp, Homo sapiens
atatttttaaaaaatga

SEQ ID NO: 4936576 - DNA, 19 bp, Homo sapiens
atatttttaaaaaatgaaa

SEQ ID NO: 4936577 - DNA, 16 bp, Homo sapiens
atatttttagactcat

SEQ ID NO: 4936578 - DNA, 17 bp, Homo sapiens
atatttttataataaac

SEQ ID NO: 4936579 - DNA, 21 bp, Homo sapiens
atattttttaatttaaagctt

SEQ ID NO: 4936580 - DNA, 19 bp, Homo sapiens
atcaaaaattgaagagaga

SEQ ID NO: 4936581 - DNA, 16 bp, Homo sapiens
atcaaaacaagtgaaa

SEQ ID NO: 4936582 - DNA, 14 bp, Homo sapiens
atcaaaataaaaag

SEQ ID NO: 4936583 - DNA, 20 bp, Homo sapiens
atcaaagtcaaaaatagcaa

SEQ ID NO: 4936584 - DNA, 18 bp, Homo sapiens
atcaaataagtatttata

SEQ ID NO: 4936585 - DNA, 15 bp, Homo sapiens
atcaacaaagaaata

SEQ ID NO: 4936586 - DNA, 13 bp, Homo sapiens
atcaacagaagca

SEQ ID NO: 4936587 - DNA, 22 bp, Homo sapiens
atcaaccccttcgctcctgtgt

SEQ ID NO: 4936588 - DNA, 15 bp, Homo sapiens
atcaactttaatcaa

SEQ ID NO: 4936589 - DNA, 16 bp, Homo sapiens
atcaagagctgccctc

SEQ ID NO: 4936590 - DNA, 19 bp, Homo sapiens
atcaagagctgccctcctt

SEQ ID NO: 4936591 - DNA, 18 bp, Homo sapiens
atcaagtcaatcatttct

SEQ ID NO: 4936592 - DNA, 13 bp, Homo sapiens
atcaatcaaataa

SEQ ID NO: 4936593 - DNA, 16 bp, Homo sapiens
atcaatgaatattgaa

SEQ ID NO: 4936594 - DNA, 16 bp, Homo sapiens
atcaattatagtttct

SEQ ID NO: 4936595 - DNA, 18 bp, Homo sapiens
atcaattatagtttctga

SEQ ID NO: 4936596 - DNA, 15 bp, Homo sapiens
atcaatttttaggaa

SEQ ID NO: 4936597 - DNA, 19 bp, Homo sapiens
atcacaaatttcacttata

SEQ ID NO: 4936598 - DNA, 16 bp, Homo sapiens
atcacacttctgtgag

SEQ ID NO: 4936599 - DNA, 12 bp, Homo sapiens
atcacagcagcc

SEQ ID NO: 4936600 - DNA, 19 bp, Homo sapiens
atcacagggttgggcccag

SEQ ID NO: 4936601 - DNA, 15 bp, Homo sapiens
atcaccctcttcctg

SEQ ID NO: 4936602 - DNA, 22 bp, Homo sapiens
atcacctatttccattcaacaa

SEQ ID NO: 4936603 - DNA, 13 bp, Homo sapiens
atcacgccactgc

SEQ ID NO: 4936604 - DNA, 19 bp, Homo sapiens
atcacggctcactgcagcc

SEQ ID NO: 4936605 - DNA, 15 bp, Homo sapiens
atcactatccatgca

SEQ ID NO: 4936606 - DNA, 20 bp, Homo sapiens
atcactgaacaaactaaagg

SEQ ID NO: 4936607 - DNA, 20 bp, Homo sapiens
atcactgaatttataaagta

SEQ ID NO: 4936608 - DNA, 16 bp, Homo sapiens
atcactttttgaacta

SEQ ID NO: 4936609 - DNA, 18 bp, Homo sapiens
atcactttttgaactaag

SEQ ID NO: 4936610 - DNA, 22 bp, Homo sapiens
atcagaagaccacaaaaattga

SEQ ID NO: 4936611 - DNA, 12 bp, Homo sapiens
atcagaagagag

SEQ ID NO: 4936612 - DNA, 18 bp, Homo sapiens
atcagaagtttctcagct

SEQ ID NO: 4936613 - DNA, 22 bp, Homo sapiens
atcagaccttggatcagatgaa

SEQ ID NO: 4936614 - DNA, 20 bp, Homo sapiens
atcagagctcctctgtcctg

SEQ ID NO: 4936615 - DNA, 21 bp, Homo sapiens
atcagagctcctctgtcctgc

SEQ ID NO: 4936616 - DNA, 15 bp, Homo sapiens
atcagagtagaaata

SEQ ID NO: 4936617 - DNA, 20 bp, Homo sapiens
atcagagtagaaataaaagt

SEQ ID NO: 4936618 - DNA, 21 bp, Homo sapiens
atcagagtagaaataaaagtg

SEQ ID NO: 4936619 - DNA, 15 bp, Homo sapiens
atcagataagacata

SEQ ID NO: 4936620 - DNA, 19 bp, Homo sapiens
atcagataagacatatctc

SEQ ID NO: 4936621 - DNA, 22 bp, Homo sapiens
atcagatgaactcttagaaatg

SEQ ID NO: 4936622 - DNA, 23 bp, Homo sapiens
atcagatgaactcttagaaatga

SEQ ID NO: 4936623 - DNA, 21 bp, Homo sapiens
atcagatgctccaagattcta

SEQ ID NO: 4936624 - DNA, 22 bp, Homo sapiens
atcagatgctccaagattctag

SEQ ID NO: 4936625 - DNA, 14 bp, Homo sapiens
atcagatggaaata

SEQ ID NO: 4936626 - DNA, 23 bp, Homo sapiens
atcagatggaaatattttgataa

SEQ ID NO: 4936627 - DNA, 18 bp, Homo sapiens
atcagctacttaagagaa

SEQ ID NO: 4936628 - DNA, 19 bp, Homo sapiens
atcagctacttaagagaaa

SEQ ID NO: 4936629 - DNA, 11 bp, Homo sapiens
atcagggcctg

SEQ ID NO: 4936630 - DNA, 13 bp, Homo sapiens
atcagggcctggg

SEQ ID NO: 4936631 - DNA, 14 bp, Homo sapiens
atcagggcctgggg

SEQ ID NO: 4936632 - DNA, 15 bp, Homo sapiens
atcagggcctggggc

SEQ ID NO: 4936633 - DNA, 22 bp, Homo sapiens
atcagggcctggggcctgagag

SEQ ID NO: 4936634 - DNA, 23 bp, Homo sapiens
atcagggcctggggcctgagaga

SEQ ID NO: 4936635 - DNA, 24 bp, Homo sapiens
atcagggcctggggcctgagagaa

SEQ ID NO: 4936636 - DNA, 19 bp, Homo sapiens
atcagtaagaaaaagaaga

SEQ ID NO: 4936637 - DNA, 16 bp, Homo sapiens
atcagtaggctaatgt

SEQ ID NO: 4936638 - DNA, 15 bp, Homo sapiens
atcagtattaatact

SEQ ID NO: 4936639 - DNA, 23 bp, Homo sapiens
atcagtattaatactaaaatatg

SEQ ID NO: 4936640 - DNA, 21 bp, Homo sapiens
atcagtccctatgtatttgca

SEQ ID NO: 4936641 - DNA, 20 bp, Homo sapiens
atcagtgggcaggataaact

SEQ ID NO: 4936642 - DNA, 18 bp, Homo sapiens
atcagtgttttaaattct

SEQ ID NO: 4936643 - DNA, 18 bp, Homo sapiens
atcagttaactattgcat

SEQ ID NO: 4936644 - DNA, 16 bp, Homo sapiens
atcagttattcattct

SEQ ID NO: 4936645 - DNA, 14 bp, Homo sapiens
atcataaaatcaaa

SEQ ID NO: 4936646 - DNA, 15 bp, Homo sapiens
atcataaagttagaa

SEQ ID NO: 4936647 - DNA, 15 bp, Homo sapiens
atcataagtgaattt

SEQ ID NO: 4936648 - DNA, 19 bp, Homo sapiens
atcataagtgaatttatac

SEQ ID NO: 4936649 - DNA, 16 bp, Homo sapiens
atcataggtatttcaa

SEQ ID NO: 4936650 - DNA, 17 bp, Homo sapiens
atcataggtatttcaaa

SEQ ID NO: 4936651 - DNA, 23 bp, Homo sapiens
atcatagtggcttaaaacaacac

SEQ ID NO: 4936652 - DNA, 14 bp, Homo sapiens
atcatattgatgaa

SEQ ID NO: 4936653 - DNA, 17 bp, Homo sapiens
gtcatttgagcagggct

SEQ ID NO: 4936654 - DNA, 21 bp, Homo sapiens
gtcatttgagcagggctcagc

SEQ ID NO: 4936655 - DNA, 20 bp, Homo sapiens
gtccaaaaagctcctggggc

SEQ ID NO: 4936656 - DNA, 16 bp, Homo sapiens
gtccaaagaggctgcc

SEQ ID NO: 4936657 - DNA, 14 bp, Homo sapiens
gtccaaaggaggct

SEQ ID NO: 4936658 - DNA, 20 bp, Homo sapiens
gtccaaaggaggctggcagg

SEQ ID NO: 4936659 - DNA, 20 bp, Homo sapiens
gtccaagattccggatccta

SEQ ID NO: 4936660 - DNA, 13 bp, Homo sapiens
gtccacagagagg

SEQ ID NO: 4936661 - DNA, 13 bp, Homo sapiens
gtccacccaggag

SEQ ID NO: 4936662 - DNA, 16 bp, Homo sapiens
gtccacccaggagccc

SEQ ID NO: 4936663 - DNA, 23 bp, Homo sapiens
gtccactgtgtatagaagtagat

SEQ ID NO: 4936664 - DNA, 15 bp, Homo sapiens
gtccagcccatctcg

SEQ ID NO: 4936665 - DNA, 20 bp, Homo sapiens
gtccagccgccattgccacc

SEQ ID NO: 4936666 - DNA, 13 bp, Homo sapiens
gtccagctggcct

SEQ ID NO: 4936667 - DNA, 14 bp, Homo sapiens
gtccagctggcctg

SEQ ID NO: 4936668 - DNA, 18 bp, Homo sapiens
gtccagctggcctggaca

SEQ ID NO: 4936669 - DNA, 14 bp, Homo sapiens
gtccaggcacagga

SEQ ID NO: 4936670 - DNA, 15 bp, Homo sapiens
gtccaggcacaggat

SEQ ID NO: 4936671 - DNA, 17 bp, Homo sapiens
gtccatcagccaggaca

SEQ ID NO: 4936672 - DNA, 22 bp, Homo sapiens
gtccatgcagggggctcctggg

SEQ ID NO: 4936673 - DNA, 22 bp, Homo sapiens
gtccatgcatgacagcctctat

SEQ ID NO: 4936674 - DNA, 14 bp, Homo sapiens
gtccatgcttctca

SEQ ID NO: 4936675 - DNA, 16 bp, Homo sapiens
gtcccaaggaaagccc

SEQ ID NO: 4936676 - DNA, 23 bp, Homo sapiens
gtcccaaggaaagccccagcact

SEQ ID NO: 4936677 - DNA, 21 bp, Homo sapiens
gtcccacccccacccccagct

SEQ ID NO: 4936678 - DNA, 16 bp, Homo sapiens
gtcccacctccagccc

SEQ ID NO: 4936679 - DNA, 22 bp, Homo sapiens
gtcccacctccagcccgggagc

SEQ ID NO: 4936680 - DNA, 14 bp, Homo sapiens
gtcccaccttggct

SEQ ID NO: 4936681 - DNA, 16 bp, Homo sapiens
gtcccaccttggctgc

SEQ ID NO: 4936682 - DNA, 20 bp, Homo sapiens
gtcccaccttggctgcaggg

SEQ ID NO: 4936683 - DNA, 23 bp, Homo sapiens
gtcccaccttggctgcagggagt

SEQ ID NO: 4936684 - DNA, 20 bp, Homo sapiens
gtcccacgaatttgctgggg

SEQ ID NO: 4936685 - DNA, 16 bp, Homo sapiens
gtcccacgtgtcttcc

SEQ ID NO: 4936686 - DNA, 14 bp, Homo sapiens
gtcccactcagtcc

SEQ ID NO: 4936687 - DNA, 14 bp, Homo sapiens
gtcccactgtgcag

SEQ ID NO: 4936688 - DNA, 14 bp, Homo sapiens
gtcccagccacccc

SEQ ID NO: 4936689 - DNA, 23 bp, Homo sapiens
gtcccagccaccccgggctctct

SEQ ID NO: 4936690 - DNA, 22 bp, Homo sapiens
gtcccatggacactccagtgcc

SEQ ID NO: 4936691 - DNA, 23 bp, Homo sapiens
gtcccatggacactccagtgcca

SEQ ID NO: 4936692 - DNA, 22 bp, Homo sapiens
gtcccattggtgttgtcattgt

SEQ ID NO: 4936693 - DNA, 15 bp, Homo sapiens
gtccccacctgggac

SEQ ID NO: 4936694 - DNA, 19 bp, Homo sapiens
gtcccccaactctgagccc

SEQ ID NO: 4936695 - DNA, 16 bp, Homo sapiens
gtcccccaacttgaga

SEQ ID NO: 4936696 - DNA, 13 bp, Homo sapiens
gtccccgcagccc

SEQ ID NO: 4936697 - DNA, 12 bp, Homo sapiens
gtcccctcacct

SEQ ID NO: 4936698 - DNA, 15 bp, Homo sapiens
gtcccgaatccacag

SEQ ID NO: 4936699 - DNA, 23 bp, Homo sapiens
gtccctaccgagtctcttctcca

SEQ ID NO: 4936700 - DNA, 16 bp, Homo sapiens
gtccctcccacctctg

SEQ ID NO: 4936701 - DNA, 17 bp, Homo sapiens
gtccctcccacctctgt

SEQ ID NO: 4936702 - DNA, 16 bp, Homo sapiens
gtccctcccccttgtc

SEQ ID NO: 4936703 - DNA, 21 bp, Homo sapiens
gtccctgcacttgcagactct

SEQ ID NO: 4936704 - DNA, 14 bp, Homo sapiens
gtccctgggccagg

SEQ ID NO: 4936705 - DNA, 19 bp, Homo sapiens
gtccctgggccagggtctg

SEQ ID NO: 4936706 - DNA, 12 bp, Homo sapiens
gtcccttcccct

SEQ ID NO: 4936707 - DNA, 13 bp, Homo sapiens
gtcccttcccctc

SEQ ID NO: 4936708 - DNA, 19 bp, Homo sapiens
gtcccttgatgcacagaga

SEQ ID NO: 4936709 - DNA, 15 bp, Homo sapiens
gtccgataatatctt

SEQ ID NO: 4936710 - DNA, 22 bp, Homo sapiens
gtccgctgggtggtaccctctg

SEQ ID NO: 4936711 - DNA, 17 bp, Homo sapiens
gtccggacactcctaga

SEQ ID NO: 4936712 - DNA, 19 bp, Homo sapiens
gtccggacccacctcaccc

SEQ ID NO: 4936713 - DNA, 16 bp, Homo sapiens
gtcctaactggtatag

SEQ ID NO: 4936714 - DNA, 18 bp, Homo sapiens
gtcctaaggaaccttcct

SEQ ID NO: 4936715 - DNA, 13 bp, Homo sapiens
gtcctactctgtg

SEQ ID NO: 4936716 - DNA, 15 bp, Homo sapiens
gtcctactctgtgtc

SEQ ID NO: 4936717 - DNA, 23 bp, Homo sapiens
gtcctactctgtgtcaggtgggg

SEQ ID NO: 4936718 - DNA, 19 bp, Homo sapiens
gtcctagccactcaggagg

SEQ ID NO: 4936719 - DNA, 20 bp, Homo sapiens
gtcctcacccctgtcctcac

SEQ ID NO: 4936720 - DNA, 14 bp, Homo sapiens
gtcctcactcccag

SEQ ID NO: 4936721 - DNA, 20 bp, Homo sapiens
gtcctcactgctccctgaag

SEQ ID NO: 4936722 - DNA, 20 bp, Homo sapiens
gtcctcagagaatttctacc

SEQ ID NO: 4936723 - DNA, 22 bp, Homo sapiens
gtcctcagggagcagggaaggc

SEQ ID NO: 4936724 - DNA, 15 bp, Homo sapiens
gtcctcagtccattt

SEQ ID NO: 4936725 - DNA, 22 bp, Homo sapiens
gtcctccagaagcctctggcta

SEQ ID NO: 4936726 - DNA, 21 bp, Homo sapiens
gtcctcccatcccctggactg

SEQ ID NO: 4936727 - DNA, 16 bp, Homo sapiens
gtcctcccctcacagc

SEQ ID NO: 4936728 - DNA, 17 bp, Homo sapiens
gtcctcccctcacagcc

SEQ ID NO: 4936729 - DNA, 19 bp, Homo sapiens
gtcctctcccaagtccaca

SEQ ID NO: 4936730 - DNA, 17 bp, Homo sapiens
gtcctctcccctccagc

SEQ ID NO: 4936731 - DNA, 18 bp, Homo sapiens
gtcctctggagccctaac

SEQ ID NO: 4936732 - DNA, 21 bp, Homo sapiens
gtcctggaagcgcgagggcct

SEQ ID NO: 4936733 - DNA, 15 bp, Homo sapiens
gtcctgggagtgagc

SEQ ID NO: 4936734 - DNA, 18 bp, Homo sapiens
gtcctgggagtgagctgg

SEQ ID NO: 4936735 - DNA, 21 bp, Homo sapiens
gtcctgtagttgcgtggactc

SEQ ID NO: 4936736 - DNA, 23 bp, Homo sapiens
gtcctgtagttgcgtggactctg

SEQ ID NO: 4936737 - DNA, 15 bp, Homo sapiens
gtcctgtgaatttct

SEQ ID NO: 4936738 - DNA, 18 bp, Homo sapiens
gtccttgcacccctcact

SEQ ID NO: 4936739 - DNA, 16 bp, Homo sapiens
gtcctttatgtggaaa

SEQ ID NO: 4936740 - DNA, 20 bp, Homo sapiens
gtcctttatgtggaaaacag

SEQ ID NO: 4936741 - DNA, 22 bp, Homo sapiens
gtcctttatgtggaaaacagaa

SEQ ID NO: 4936742 - DNA, 22 bp, Homo sapiens
gtcctttccaaggcttctccaa

SEQ ID NO: 4936743 - DNA, 19 bp, Homo sapiens
gtcctttttttccatcttt

SEQ ID NO: 4936744 - DNA, 17 bp, Homo sapiens
gtcgaattaatagcttt

SEQ ID NO: 4936745 - DNA, 14 bp, Homo sapiens
gtcgaggacaggga

SEQ ID NO: 4936746 - DNA, 12 bp, Homo sapiens
gtcgcccaggag

SEQ ID NO: 4936747 - DNA, 15 bp, Homo sapiens
gtcggaacagcagat

SEQ ID NO: 4936748 - DNA, 15 bp, Homo sapiens
gtcgtggcagataat

SEQ ID NO: 4936749 - DNA, 22 bp, Homo sapiens
gtcgtggcagataatcagcctc

SEQ ID NO: 4936750 - DNA, 17 bp, Homo sapiens
gtcgttttccaaactga

SEQ ID NO: 4936751 - DNA, 12 bp, Homo sapiens
gtctaaaaacac

SEQ ID NO: 4936752 - DNA, 11 bp, Homo sapiens
gtctaaaactc

SEQ ID NO: 4936753 - DNA, 16 bp, Homo sapiens
gtctaactcagaatta

SEQ ID NO: 4936754 - DNA, 21 bp, Homo sapiens
gtctaagatagtaacaatgaa

SEQ ID NO: 4936755 - DNA, 23 bp, Homo sapiens
gtctaagatagtaacaatgaaga

SEQ ID NO: 4936756 - DNA, 13 bp, Homo sapiens
gtctaagattcta

SEQ ID NO: 4936757 - DNA, 22 bp, Homo sapiens
gttctatccaaacatgtattta

SEQ ID NO: 4936758 - DNA, 17 bp, Homo sapiens
gttctatggttatgaaa

SEQ ID NO: 4936759 - DNA, 18 bp, Homo sapiens
gttctccttttcctctct

SEQ ID NO: 4936760 - DNA, 22 bp, Homo sapiens
gttctccttttcctctctcccg

SEQ ID NO: 4936761 - DNA, 15 bp, Homo sapiens
gttctgaaataaact

SEQ ID NO: 4936762 - DNA, 16 bp, Homo sapiens
gttctgcccccagccc

SEQ ID NO: 4936763 - DNA, 19 bp, Homo sapiens
gttctgcccccagcccaaa

SEQ ID NO: 4936764 - DNA, 21 bp, Homo sapiens
gttctgcttcaataaatcttt

SEQ ID NO: 4936765 - DNA, 20 bp, Homo sapiens
gttctggaaaagaactgttt

SEQ ID NO: 4936766 - DNA, 22 bp, Homo sapiens
gttctggctgccccaacctgct

SEQ ID NO: 4936767 - DNA, 12 bp, Homo sapiens
gttctgggacac

SEQ ID NO: 4936768 - DNA, 15 bp, Homo sapiens
gttctgggacacagt

SEQ ID NO: 4936769 - DNA, 22 bp, Homo sapiens
gttctgtgtttaatttcttcaa

SEQ ID NO: 4936770 - DNA, 21 bp, Homo sapiens
gttctgttatatcccctgcta

SEQ ID NO: 4936771 - DNA, 14 bp, Homo sapiens
gttctgtttcaagg

SEQ ID NO: 4936772 - DNA, 18 bp, Homo sapiens
gttctgtttgttattgtt

SEQ ID NO: 4936773 - DNA, 13 bp, Homo sapiens
gttcttacacata

SEQ ID NO: 4936774 - DNA, 22 bp, Homo sapiens
gttcttacacatacagttttat

SEQ ID NO: 4936775 - DNA, 14 bp, Homo sapiens
gttcttatgcaaaa

SEQ ID NO: 4936776 - DNA, 21 bp, Homo sapiens
gttcttgcagtcatcagaagt

SEQ ID NO: 4936777 - DNA, 13 bp, Homo sapiens
gttcttgctgcta

SEQ ID NO: 4936778 - DNA, 14 bp, Homo sapiens
gttcttgctgctag

SEQ ID NO: 4936779 - DNA, 16 bp, Homo sapiens
gttcttgctgctagaa

SEQ ID NO: 4936780 - DNA, 14 bp, Homo sapiens
gttctttcttcctc

SEQ ID NO: 4936781 - DNA, 24 bp, Homo sapiens
gttgaaattttgcaaatataaaca

SEQ ID NO: 4936782 - DNA, 22 bp, Homo sapiens
gttgaagggaggtggcaagagt

SEQ ID NO: 4936783 - DNA, 12 bp, Homo sapiens
gttgaagtcacc

SEQ ID NO: 4936784 - DNA, 13 bp, Homo sapiens
gttgaatactttt

SEQ ID NO: 4936785 - DNA, 16 bp, Homo sapiens
gttgacagttctgaag

SEQ ID NO: 4936786 - DNA, 19 bp, Homo sapiens
gttgacttatagtacatga

SEQ ID NO: 4936787 - DNA, 22 bp, Homo sapiens
gttgacttccaggcacggtttg

SEQ ID NO: 4936788 - DNA, 14 bp, Homo sapiens
gttgagccttttcc

SEQ ID NO: 4936789 - DNA, 17 bp, Homo sapiens
gttgaggaactgtacag

SEQ ID NO: 4936790 - DNA, 12 bp, Homo sapiens
gttgatagttta

SEQ ID NO: 4936791 - DNA, 14 bp, Homo sapiens
gttgcactgatatt

SEQ ID NO: 4936792 - DNA, 18 bp, Homo sapiens
gttgcattcctttgtctt

SEQ ID NO: 4936793 - DNA, 14 bp, Homo sapiens
gttgccaagacaaa

SEQ ID NO: 4936794 - DNA, 19 bp, Homo sapiens
gttgccaccacctctgtgg

SEQ ID NO: 4936795 - DNA, 21 bp, Homo sapiens
gttgccaccacctctgtggca

SEQ ID NO: 4936796 - DNA, 15 bp, Homo sapiens
gttgcccaggcaggt

SEQ ID NO: 4936797 - DNA, 17 bp, Homo sapiens
gttgcccaggcaggtct

SEQ ID NO: 4936798 - DNA, 18 bp, Homo sapiens
gttgcccaggcaggtctt

SEQ ID NO: 4936799 - DNA, 21 bp, Homo sapiens
gttgcctaagtattaaaacat

SEQ ID NO: 4936800 - DNA, 22 bp, Homo sapiens
gttgcctaagtattaaaacatt

SEQ ID NO: 4936801 - DNA, 20 bp, Homo sapiens
gttgcctttttcattttcca

SEQ ID NO: 4936802 - DNA, 15 bp, Homo sapiens
gttggactaaatgcc

SEQ ID NO: 4936803 - DNA, 18 bp, Homo sapiens
gttggactaaatgcctag

SEQ ID NO: 4936804 - DNA, 14 bp, Homo sapiens
gttggatgtagcat

SEQ ID NO: 4936805 - DNA, 13 bp, Homo sapiens
gttggcccctgcc

SEQ ID NO: 4936806 - DNA, 14 bp, Homo sapiens
gttggcccctgccc

SEQ ID NO: 4936807 - DNA, 13 bp, Homo sapiens
gttggcctgcact

SEQ ID NO: 4936808 - DNA, 19 bp, Homo sapiens
gttggctgggggcctcagt

SEQ ID NO: 4936809 - DNA, 13 bp, Homo sapiens
gttgggagctgat

SEQ ID NO: 4936810 - DNA, 18 bp, Homo sapiens
gttgggatactgcagggc

SEQ ID NO: 4936811 - DNA, 16 bp, Homo sapiens
gttgggcccagatctg

SEQ ID NO: 4936812 - DNA, 13 bp, Homo sapiens
gttgggctggtgt

SEQ ID NO: 4936813 - DNA, 15 bp, Homo sapiens
gttgggctggtgtca

SEQ ID NO: 4936814 - DNA, 22 bp, Homo sapiens
gttggggggactctgagcggga

SEQ ID NO: 4936815 - DNA, 15 bp, Homo sapiens
gttggggtgacagtc

SEQ ID NO: 4936816 - DNA, 19 bp, Homo sapiens
gttggggtgacagtcatca

SEQ ID NO: 4936817 - DNA, 13 bp, Homo sapiens
gttggtagtttct

SEQ ID NO: 4936818 - DNA, 22 bp, Homo sapiens
gttggtccagagcggaggctgt

SEQ ID NO: 4936819 - DNA, 14 bp, Homo sapiens
gttggtttactttc

SEQ ID NO: 4936820 - DNA, 15 bp, Homo sapiens
gttggtttactttca

SEQ ID NO: 4936821 - DNA, 21 bp, Homo sapiens
gttgtaactaggctcagagat

SEQ ID NO: 4936822 - DNA, 15 bp, Homo sapiens
gttgtaacttatatt

SEQ ID NO: 4936823 - DNA, 19 bp, Homo sapiens
gttgtaacttatgtagata

SEQ ID NO: 4936824 - DNA, 23 bp, Homo sapiens
gttgtactatggaaaatcagctg

SEQ ID NO: 4936825 - DNA, 16 bp, Homo sapiens
gttgtattaacaaaag

SEQ ID NO: 4936826 - DNA, 22 bp, Homo sapiens
gttgtcaagtctctgctggccc

SEQ ID NO: 4936827 - DNA, 18 bp, Homo sapiens
gttgtccatattttcaca

SEQ ID NO: 4936828 - DNA, 19 bp, Homo sapiens
gttgtgaaagttttgagta

SEQ ID NO: 4936829 - DNA, 17 bp, Homo sapiens
gttgtgcaaattaacag

SEQ ID NO: 4936830 - DNA, 12 bp, Homo sapiens
gttgtgttgtca

SEQ ID NO: 4936831 - DNA, 17 bp, Homo sapiens
gttgttgcatgtttgaa

SEQ ID NO: 4936832 - DNA, 13 bp, Homo sapiens
gttgtttctttct

SEQ ID NO: 4936833 - DNA, 20 bp, Homo sapiens
gttgttttttcctttgctct

SEQ ID NO: 4936834 - DNA, 14 bp, Homo sapiens
gtttaaagagtcta

SEQ ID NO: 4936835 - DNA, 13 bp, Homo sapiens
gtttaacatttgc

SEQ ID NO: 4936836 - DNA, 21 bp, Homo sapiens
gtttaacatttgccttgcaga

SEQ ID NO: 4936837 - DNA, 19 bp, Homo sapiens
gtttaattgtttgtcctca

SEQ ID NO: 4936838 - DNA, 18 bp, Homo sapiens
gtttacaagtgtatatca

SEQ ID NO: 4936839 - DNA, 19 bp, Homo sapiens
gtttacaagtgtatatcag

SEQ ID NO: 4936840 - DNA, 23 bp, Homo sapiens
gtttacaagtgtatatcagaaaa

SEQ ID NO: 4936841 - DNA, 19 bp, Homo sapiens
gtttacaggccctgctcct

SEQ ID NO: 4936842 - DNA, 15 bp, Homo sapiens
gtttacatttaaagc

SEQ ID NO: 4936843 - DNA, 12 bp, Homo sapiens
gtttacattttt

SEQ ID NO: 4936844 - DNA, 16 bp, Homo sapiens
gtttaccatttttcat

SEQ ID NO: 4936845 - DNA, 17 bp, Homo sapiens
gtttaccatttttcatt

SEQ ID NO: 4936846 - DNA, 16 bp, Homo sapiens
gtttacccggtttctt

SEQ ID NO: 4936847 - DNA, 23 bp, Homo sapiens
gtttacctagaagaagctatgtc

SEQ ID NO: 4936848 - DNA, 16 bp, Homo sapiens
gtttacctgaataaat

SEQ ID NO: 4936849 - DNA, 14 bp, Homo sapiens
gtttagaagctgag

SEQ ID NO: 4936850 - DNA, 19 bp, Homo sapiens
gtttataaaatataaacaa

SEQ ID NO: 4936851 - DNA, 17 bp, Homo sapiens
gtttataattttctgaa

SEQ ID NO: 4936852 - DNA, 20 bp, Homo sapiens
gtttatagagggccaagact

SEQ ID NO: 4936853 - DNA, 21 bp, Homo sapiens
gtttatagagggccaagactt

SEQ ID NO: 4936854 - DNA, 19 bp, Homo sapiens
gtttatcagatacatcact

SEQ ID NO: 4936855 - DNA, 21 bp, Homo sapiens
gtttatgagatgctggttttc

SEQ ID NO: 4936856 - DNA, 15 bp, Homo sapiens
gtttattcttctaga

SEQ ID NO: 4936857 - DNA, 16 bp, Homo sapiens
gtttattcttctagag

SEQ ID NO: 4936858 - DNA, 13 bp, Homo sapiens
gtttatttcacac

SEQ ID NO: 4936859 - DNA, 21 bp, Homo sapiens
gtttatttccaaataaaatga

SEQ ID NO: 4936860 - DNA, 14 bp, Homo sapiens
gtttatttttcata

SEQ ID NO: 4936861 - DNA, 20 bp, Homo sapiens
gtttcaaagatgctgtgagt

SEQ ID NO: 4936862 - DNA, 18 bp, Homo sapiens
gtttcaaggcactctaga

SEQ ID NO: 4936863 - DNA, 21 bp, Homo sapiens
gtttcagctaagggaagacat

SEQ ID NO: 4936864 - DNA, 10 bp, Homo sapiens
gtttcaggtg

SEQ ID NO: 4936865 - DNA, 16 bp, Homo sapiens
gtttcaggtgacatgt

SEQ ID NO: 4936866 - DNA, 20 bp, Homo sapiens
gtttcaggtgacatgtgaaa

SEQ ID NO: 4936867 - DNA, 13 bp, Homo sapiens
aaaatatatacta

SEQ ID NO: 4936868 - DNA, 17 bp, Homo sapiens
aaaatatatactaaaca

SEQ ID NO: 4936869 - DNA, 13 bp, Homo sapiens
aaaatatatatag

SEQ ID NO: 4936870 - DNA, 23 bp, Homo sapiens
aaaatatatatagaaatatatac

SEQ ID NO: 4936871 - DNA, 16 bp, Homo sapiens
aaaatatatttaatga

SEQ ID NO: 4936872 - DNA, 16 bp, Homo sapiens
aaaatatggaacttct

SEQ ID NO: 4936873 - DNA, 21 bp, Homo sapiens
aaaatatggaacttctaatat

SEQ ID NO: 4936874 - DNA, 13 bp, Homo sapiens
aaaatatgtctcg

SEQ ID NO: 4936875 - DNA, 14 bp, Homo sapiens
aaaatattatgtgt

SEQ ID NO: 4936876 - DNA, 20 bp, Homo sapiens
aaaatattttttatatatac

SEQ ID NO: 4936877 - DNA, 23 bp, Homo sapiens
aaaatattttttatatatacagt

SEQ ID NO: 4936878 - DNA, 16 bp, Homo sapiens
aaaatcaaaacaagtg

SEQ ID NO: 4936879 - DNA, 16 bp, Homo sapiens
aaaatcaaagctgagg

SEQ ID NO: 4936880 - DNA, 11 bp, Homo sapiens
aaaatcaactt

SEQ ID NO: 4936881 - DNA, 20 bp, Homo sapiens
aaaatcacaatttttaatgg

SEQ ID NO: 4936882 - DNA, 21 bp, Homo sapiens
aaaatcactttgtctaactca

SEQ ID NO: 4936883 - DNA, 19 bp, Homo sapiens
aaaatcatctattttgatg

SEQ ID NO: 4936884 - DNA, 15 bp, Homo sapiens
aaaatccaaaaagaa

SEQ ID NO: 4936885 - DNA, 21 bp, Homo sapiens
aaaatcctaagacacaaatgc

SEQ ID NO: 4936886 - DNA, 19 bp, Homo sapiens
aaaatcttatagttctagg

SEQ ID NO: 4936887 - DNA, 20 bp, Homo sapiens
aaaatcttatagttctaggc

SEQ ID NO: 4936888 - DNA, 23 bp, Homo sapiens
aaaatgaatgaggtctgggctag

SEQ ID NO: 4936889 - DNA, 16 bp, Homo sapiens
aaaatgacatcttttt

SEQ ID NO: 4936890 - DNA, 16 bp, Homo sapiens
aaaatgattgtaaaat

SEQ ID NO: 4936891 - DNA, 19 bp, Homo sapiens
aaaatgattgtaaaatagc

SEQ ID NO: 4936892 - DNA, 11 bp, Homo sapiens
aaaatgccttt

SEQ ID NO: 4936893 - DNA, 17 bp, Homo sapiens
aaaatgcctttgagaca

SEQ ID NO: 4936894 - DNA, 13 bp, Homo sapiens
aaaatgcttttta

SEQ ID NO: 4936895 - DNA, 19 bp, Homo sapiens
aaaatggccatttgctttt

SEQ ID NO: 4936896 - DNA, 23 bp, Homo sapiens
aaaatggccatttgctttttcac

SEQ ID NO: 4936897 - DNA, 18 bp, Homo sapiens
aaaatggtttattttgta

SEQ ID NO: 4936898 - DNA, 20 bp, Homo sapiens
aaaatgtaaatattctatat

SEQ ID NO: 4936899 - DNA, 22 bp, Homo sapiens
aaaatgtcaaagagaaaactta

SEQ ID NO: 4936900 - DNA, 11 bp, Homo sapiens
aaaatgtctgt

SEQ ID NO: 4936901 - DNA, 12 bp, Homo sapiens
aaaatgtctgta

SEQ ID NO: 4936902 - DNA, 17 bp, Homo sapiens
aaaatgtgatgttctaa

SEQ ID NO: 4936903 - DNA, 18 bp, Homo sapiens
aaaattaaacacaaagtg

SEQ ID NO: 4936904 - DNA, 14 bp, Homo sapiens
aaaattagaaattg

SEQ ID NO: 4936905 - DNA, 14 bp, Homo sapiens
aaaattatgaatct

SEQ ID NO: 4936906 - DNA, 16 bp, Homo sapiens
aaaattatgaatctga

SEQ ID NO: 4936907 - DNA, 19 bp, Homo sapiens
aaaattatgaatctgattt

SEQ ID NO: 4936908 - DNA, 19 bp, Homo sapiens
aaaattattttaaacaaaa

SEQ ID NO: 4936909 - DNA, 14 bp, Homo sapiens
aaaattcaaaaagt

SEQ ID NO: 4936910 - DNA, 16 bp, Homo sapiens
aaaattcaaaaagtgt

SEQ ID NO: 4936911 - DNA, 16 bp, Homo sapiens
aaaattcagcaaacca

SEQ ID NO: 4936912 - DNA, 18 bp, Homo sapiens
aaaattcagcaaaccatt

SEQ ID NO: 4936913 - DNA, 20 bp, Homo sapiens
aaaattctgtaggttctgtg

SEQ ID NO: 4936914 - DNA, 22 bp, Homo sapiens
aaaattgaagagagatatatct

SEQ ID NO: 4936915 - DNA, 20 bp, Homo sapiens
aaaattgctatgttactatt

SEQ ID NO: 4936916 - DNA, 15 bp, Homo sapiens
aaaattttataagca

SEQ ID NO: 4936917 - DNA, 19 bp, Homo sapiens
aaaattttctcattttctt

SEQ ID NO: 4936918 - DNA, 16 bp, Homo sapiens
aaaattttgcttttaa

SEQ ID NO: 4936919 - DNA, 17 bp, Homo sapiens
aaaattttgcttttaat

SEQ ID NO: 4936920 - DNA, 13 bp, Homo sapiens
aaacaaaaacact

SEQ ID NO: 4936921 - DNA, 13 bp, Homo sapiens
aaacaaaacaaaa

SEQ ID NO: 4936922 - DNA, 15 bp, Homo sapiens
aaacaaaacaaaact

SEQ ID NO: 4936923 - DNA, 20 bp, Homo sapiens
aaacaaaactatacttgaac

SEQ ID NO: 4936924 - DNA, 23 bp, Homo sapiens
aaacaaacttttcaaggcttata

SEQ ID NO: 4936925 - DNA, 17 bp, Homo sapiens
aaacaaaggttgagatg

SEQ ID NO: 4936926 - DNA, 13 bp, Homo sapiens
aaacaaataaaaa

SEQ ID NO: 4936927 - DNA, 13 bp, Homo sapiens
aaacaaatatgca

SEQ ID NO: 4936928 - DNA, 21 bp, Homo sapiens
aaacaaattcatattctgtct

SEQ ID NO: 4936929 - DNA, 16 bp, Homo sapiens
aaacaacaacacaata

SEQ ID NO: 4936930 - DNA, 12 bp, Homo sapiens
aaacaagaatgt

SEQ ID NO: 4936931 - DNA, 15 bp, Homo sapiens
aaacaataaagagat

SEQ ID NO: 4936932 - DNA, 15 bp, Homo sapiens
aaacaataaatgtgc

SEQ ID NO: 4936933 - DNA, 16 bp, Homo sapiens
aaacaataaatgtgca

SEQ ID NO: 4936934 - DNA, 15 bp, Homo sapiens
aaacaatcacactca

SEQ ID NO: 4936935 - DNA, 12 bp, Homo sapiens
aaacacagctgt

SEQ ID NO: 4936936 - DNA, 23 bp, Homo sapiens
aaacacagcttacaatcgcaaat

SEQ ID NO: 4936937 - DNA, 15 bp, Homo sapiens
aaacacctagcttta

SEQ ID NO: 4936938 - DNA, 15 bp, Homo sapiens
aaacacgaaacttgt

SEQ ID NO: 4936939 - DNA, 18 bp, Homo sapiens
aaacacgaaacttgttat

SEQ ID NO: 4936940 - DNA, 20 bp, Homo sapiens
aaacactcggcatttcaaat

SEQ ID NO: 4936941 - DNA, 21 bp, Homo sapiens
aaacactcggcatttcaaatg

SEQ ID NO: 4936942 - DNA, 20 bp, Homo sapiens
aaacagaggccatggcagaa

SEQ ID NO: 4936943 - DNA, 13 bp, Homo sapiens
aaacagataccat

SEQ ID NO: 4936944 - DNA, 14 bp, Homo sapiens
aaacagataccata

SEQ ID NO: 4936945 - DNA, 18 bp, Homo sapiens
aaacagctgcattagaaa

SEQ ID NO: 4936946 - DNA, 20 bp, Homo sapiens
aaacagctgcattagaaaaa

SEQ ID NO: 4936947 - DNA, 15 bp, Homo sapiens
aaacagtatttattt

SEQ ID NO: 4936948 - DNA, 17 bp, Homo sapiens
aaacagtatttcattgc

SEQ ID NO: 4936949 - DNA, 18 bp, Homo sapiens
aaacataatgaaaatatt

SEQ ID NO: 4936950 - DNA, 13 bp, Homo sapiens
aaacatatgattt

SEQ ID NO: 4936951 - DNA, 22 bp, Homo sapiens
aaacatcacacacacagacaga

SEQ ID NO: 4936952 - DNA, 18 bp, Homo sapiens
aaacatccttcaagaact

SEQ ID NO: 4936953 - DNA, 20 bp, Homo sapiens
aaacatccttcaagaactct

SEQ ID NO: 4936954 - DNA, 15 bp, Homo sapiens
aaacatgacactgac

SEQ ID NO: 4936955 - DNA, 14 bp, Homo sapiens
aaacatgtgtttta

SEQ ID NO: 4936956 - DNA, 17 bp, Homo sapiens
aaacattaaaaatggaa

SEQ ID NO: 4936957 - DNA, 20 bp, Homo sapiens
aaacattaaatgtcttatat

SEQ ID NO: 4936958 - DNA, 15 bp, Homo sapiens
aaacattggattatc

SEQ ID NO: 4936959 - DNA, 11 bp, Homo sapiens
aaacatttata

SEQ ID NO: 4936960 - DNA, 13 bp, Homo sapiens
aaaccaaaatgac

SEQ ID NO: 4936961 - DNA, 19 bp, Homo sapiens
aaaccaaaatgacatcttt

SEQ ID NO: 4936962 - DNA, 22 bp, Homo sapiens
aaaccaaaatgacatcttttta

SEQ ID NO: 4936963 - DNA, 16 bp, Homo sapiens
aaaccaagcatcaggg

SEQ ID NO: 4936964 - DNA, 12 bp, Homo sapiens
aaaccacaaagg

SEQ ID NO: 4936965 - DNA, 16 bp, Homo sapiens
aaaccactagaactct

SEQ ID NO: 4936966 - DNA, 15 bp, Homo sapiens
aaaccatctggcctg

SEQ ID NO: 4936967 - DNA, 15 bp, Homo sapiens
aaacccaatccaaat

SEQ ID NO: 4936968 - DNA, 13 bp, Homo sapiens
aaacccctgtccc

SEQ ID NO: 4936969 - DNA, 17 bp, Homo sapiens
aaacctagagaagataa

SEQ ID NO: 4936970 - DNA, 18 bp, Homo sapiens
aaacctatcctcactgcc

SEQ ID NO: 4936971 - DNA, 17 bp, Homo sapiens
aaacctcaaaatgtcta

SEQ ID NO: 4936972 - DNA, 22 bp, Homo sapiens
aaacctcaaaatgtctaagata

SEQ ID NO: 4936973 - DNA, 16 bp, Homo sapiens
aaacctgaaaaaaagt

SEQ ID NO: 4936974 - DNA, 22 bp, Homo sapiens
aaacctgaaaaaaagtttacaa

SEQ ID NO: 4936975 - DNA, 15 bp, Homo sapiens
aaacctgaagactga

SEQ ID NO: 4936976 - DNA, 18 bp, Homo sapiens
aaacctgtgaagctgaaa

SEQ ID NO: 4936977 - DNA, 18 bp, Homo sapiens
aaagcctgcaatttcata

SEQ ID NO: 4936978 - DNA, 12 bp, Homo sapiens
aaagccttgtgt

SEQ ID NO: 4936979 - DNA, 17 bp, Homo sapiens
aaagctaggcctggcca

SEQ ID NO: 4936980 - DNA, 18 bp, Homo sapiens
aaagctaggcctggccag

SEQ ID NO: 4936981 - DNA, 15 bp, Homo sapiens
aaagctattagccag

SEQ ID NO: 4936982 - DNA, 18 bp, Homo sapiens
aaagctattagccaggat

SEQ ID NO: 4936983 - DNA, 19 bp, Homo sapiens
aaagctcatttcatgctct

SEQ ID NO: 4936984 - DNA, 19 bp, Homo sapiens
aaagctccatgtgcctctt

SEQ ID NO: 4936985 - DNA, 22 bp, Homo sapiens
aaagctccatgtgcctctttgt

SEQ ID NO: 4936986 - DNA, 17 bp, Homo sapiens
aaagctgagaactcctg

SEQ ID NO: 4936987 - DNA, 18 bp, Homo sapiens
aaagctgagaactcctga

SEQ ID NO: 4936988 - DNA, 15 bp, Homo sapiens
aaagctgcctgtagt

SEQ ID NO: 4936989 - DNA, 13 bp, Homo sapiens
aaagctgctgaca

SEQ ID NO: 4936990 - DNA, 18 bp, Homo sapiens
aaagctgttaaactgtta

SEQ ID NO: 4936991 - DNA, 23 bp, Homo sapiens
aaagctgttaaactgttagcact

SEQ ID NO: 4936992 - DNA, 20 bp, Homo sapiens
aaagctttatgattttcata

SEQ ID NO: 4936993 - DNA, 17 bp, Homo sapiens
aaagctttttcctcctg

SEQ ID NO: 4936994 - DNA, 12 bp, Homo sapiens
aaaggaaaagaa

SEQ ID NO: 4936995 - DNA, 13 bp, Homo sapiens
aaaggaaaagaaa

SEQ ID NO: 4936996 - DNA, 16 bp, Homo sapiens
aaaggaaaagaaaaaa

SEQ ID NO: 4936997 - DNA, 17 bp, Homo sapiens
aaaggaaaagaaaaaaa

SEQ ID NO: 4936998 - DNA, 17 bp, Homo sapiens
aaaggaagtgccccctc

SEQ ID NO: 4936999 - DNA, 15 bp, Homo sapiens
aaaggacatcagcaa

SEQ ID NO: 4937000 - DNA, 19 bp, Homo sapiens
aaaggagacaagttccatg

SEQ ID NO: 4937001 - DNA, 16 bp, Homo sapiens
aaaggatgttggtgtt

SEQ ID NO: 4937002 - DNA, 16 bp, Homo sapiens
aaaggcaaatgtgtac

SEQ ID NO: 4937003 - DNA, 13 bp, Homo sapiens
aaaggccaaactg

SEQ ID NO: 4937004 - DNA, 18 bp, Homo sapiens
aaaggccaaactgctgga

SEQ ID NO: 4937005 - DNA, 14 bp, Homo sapiens
aaaggcccagcccc

SEQ ID NO: 4937006 - DNA, 12 bp, Homo sapiens
aaaggcccccta

SEQ ID NO: 4937007 - DNA, 16 bp, Homo sapiens
aaaggcttgaagctgt

SEQ ID NO: 4937008 - DNA, 18 bp, Homo sapiens
aaagggaagttgtgcctt

SEQ ID NO: 4937009 - DNA, 20 bp, Homo sapiens
aaagggatcatcatgcagct

SEQ ID NO: 4937010 - DNA, 15 bp, Homo sapiens
aaaggggacaggcct

SEQ ID NO: 4937011 - DNA, 22 bp, Homo sapiens
aaaggggttggggtgacagtca

SEQ ID NO: 4937012 - DNA, 20 bp, Homo sapiens
aaaggtccacaggtctagac

SEQ ID NO: 4937013 - DNA, 15 bp, Homo sapiens
aaaggtgtatttaaa

SEQ ID NO: 4937014 - DNA, 17 bp, Homo sapiens
aaaggttcactaaagca

SEQ ID NO: 4937015 - DNA, 13 bp, Homo sapiens
aaaggttctaggt

SEQ ID NO: 4937016 - DNA, 21 bp, Homo sapiens
aaaggttctaggtttcaaaga

SEQ ID NO: 4937017 - DNA, 14 bp, Homo sapiens
aaaggttcttcatc

SEQ ID NO: 4937018 - DNA, 15 bp, Homo sapiens
aaaggttcttcatcc

SEQ ID NO: 4937019 - DNA, 20 bp, Homo sapiens
aaagtaactcatttgttaaa

SEQ ID NO: 4937020 - DNA, 22 bp, Homo sapiens
aaagtaactcatttgttaaaat

SEQ ID NO: 4937021 - DNA, 12 bp, Homo sapiens
aaagtaatgtaa

SEQ ID NO: 4937022 - DNA, 17 bp, Homo sapiens
aaagtacaatgtgtttt

SEQ ID NO: 4937023 - DNA, 17 bp, Homo sapiens
aaagtacatatttattt

SEQ ID NO: 4937024 - DNA, 19 bp, Homo sapiens
aaagtacttctccaccctg

SEQ ID NO: 4937025 - DNA, 20 bp, Homo sapiens
aaagtacttctccaccctgc

SEQ ID NO: 4937026 - DNA, 21 bp, Homo sapiens
aaagtacttctccaccctgct

SEQ ID NO: 4937027 - DNA, 11 bp, Homo sapiens
aaagtagaggt

SEQ ID NO: 4937028 - DNA, 20 bp, Homo sapiens
aaagtatgtaaagtatgtaa

SEQ ID NO: 4937029 - DNA, 14 bp, Homo sapiens
aaagtattttgaag

SEQ ID NO: 4937030 - DNA, 22 bp, Homo sapiens
aaagtattttgaagtttacatt

SEQ ID NO: 4937031 - DNA, 23 bp, Homo sapiens
aaagtattttgaagtttacattt

SEQ ID NO: 4937032 - DNA, 22 bp, Homo sapiens
aaagtcctttttttccatcttt

SEQ ID NO: 4937033 - DNA, 22 bp, Homo sapiens
aaagtctgtgtgatgaactttc

SEQ ID NO: 4937034 - DNA, 23 bp, Homo sapiens
aaagtctgtgtgatgaactttct

SEQ ID NO: 4937035 - DNA, 16 bp, Homo sapiens
aaagtgaataaacttc

SEQ ID NO: 4937036 - DNA, 13 bp, Homo sapiens
aaagtgacacagc

SEQ ID NO: 4937037 - DNA, 13 bp, Homo sapiens
aaagtgcacacct

SEQ ID NO: 4937038 - DNA, 14 bp, Homo sapiens
aaagtgctgggatt

SEQ ID NO: 4937039 - DNA, 18 bp, Homo sapiens
aaagtggaatttcttgtt

SEQ ID NO: 4937040 - DNA, 21 bp, Homo sapiens
aaagtgggttattctggagtt

SEQ ID NO: 4937041 - DNA, 11 bp, Homo sapiens
aaagtgttact

SEQ ID NO: 4937042 - DNA, 14 bp, Homo sapiens
aaagtgttactttt

SEQ ID NO: 4937043 - DNA, 21 bp, Homo sapiens
aaagtgtttatttttcatatt

SEQ ID NO: 4937044 - DNA, 13 bp, Homo sapiens
aaagtgtttcagc

SEQ ID NO: 4937045 - DNA, 16 bp, Homo sapiens
aaagttaacagatttt

SEQ ID NO: 4937046 - DNA, 20 bp, Homo sapiens
aaagttccaagagtctaaag

SEQ ID NO: 4937047 - DNA, 23 bp, Homo sapiens
aaagttccctacttcctgtgact

SEQ ID NO: 4937048 - DNA, 19 bp, Homo sapiens
aaagttctaataatttcta

SEQ ID NO: 4937049 - DNA, 21 bp, Homo sapiens
aaagttctaataatttctaat

SEQ ID NO: 4937050 - DNA, 14 bp, Homo sapiens
aaagttggactaaa

SEQ ID NO: 4937051 - DNA, 12 bp, Homo sapiens
aaagtttacaac

SEQ ID NO: 4937052 - DNA, 13 bp, Homo sapiens
aaagtttccatat

SEQ ID NO: 4937053 - DNA, 14 bp, Homo sapiens
aaagtttccatatg

SEQ ID NO: 4937054 - DNA, 23 bp, Homo sapiens
aaagtttctcttttcaaaacatt

SEQ ID NO: 4937055 - DNA, 15 bp, Homo sapiens
aaagtttgcttagaa

SEQ ID NO: 4937056 - DNA, 15 bp, Homo sapiens
aaagttttcctgaga

SEQ ID NO: 4937057 - DNA, 18 bp, Homo sapiens
aaagttttgaaaagctat

SEQ ID NO: 4937058 - DNA, 19 bp, Homo sapiens
aaagttttgaaaagctatt

SEQ ID NO: 4937059 - DNA, 23 bp, Homo sapiens
aaagttttgagtagatattactt

SEQ ID NO: 4937060 - DNA, 18 bp, Homo sapiens
aaataaaaacaaacgttt

SEQ ID NO: 4937061 - DNA, 13 bp, Homo sapiens
aaataaaaagaaa

SEQ ID NO: 4937062 - DNA, 14 bp, Homo sapiens
aaataaaaagtgac

SEQ ID NO: 4937063 - DNA, 19 bp, Homo sapiens
aaataaaaagtgacacagc

SEQ ID NO: 4937064 - DNA, 21 bp, Homo sapiens
aaataaaaagtgacacagcag

SEQ ID NO: 4937065 - DNA, 11 bp, Homo sapiens
aaataaaacct

SEQ ID NO: 4937066 - DNA, 13 bp, Homo sapiens
aaataaaaccttt

SEQ ID NO: 4937067 - DNA, 14 bp, Homo sapiens
aaataaaacctttc

SEQ ID NO: 4937068 - DNA, 15 bp, Homo sapiens
aaataaaacctttca

SEQ ID NO: 4937069 - DNA, 22 bp, Homo sapiens
aaataaaagtgaatgaaagatt

SEQ ID NO: 4937070 - DNA, 14 bp, Homo sapiens
aaataaaataaagc

SEQ ID NO: 4937071 - DNA, 19 bp, Homo sapiens
aaataaacctcaaaatgtc

SEQ ID NO: 4937072 - DNA, 11 bp, Homo sapiens
aaataaacttt

SEQ ID NO: 4937073 - DNA, 19 bp, Homo sapiens
aaataaactttttttcaat

SEQ ID NO: 4937074 - DNA, 15 bp, Homo sapiens
aaataaatagaaaag

SEQ ID NO: 4937075 - DNA, 14 bp, Homo sapiens
aaataaatggaaat

SEQ ID NO: 4937076 - DNA, 21 bp, Homo sapiens
aaataaatgtatcatagaaat

SEQ ID NO: 4937077 - DNA, 22 bp, Homo sapiens
aaataacaagtaccaaagtttt

SEQ ID NO: 4937078 - DNA, 14 bp, Homo sapiens
aaataacaatgtta

SEQ ID NO: 4937079 - DNA, 16 bp, Homo sapiens
aaataacaatgttaag

SEQ ID NO: 4937080 - DNA, 21 bp, Homo sapiens
aaataacacacatataaacat

SEQ ID NO: 4937081 - DNA, 20 bp, Homo sapiens
aaataacaggcatttgttca

SEQ ID NO: 4937082 - DNA, 15 bp, Homo sapiens
aaataacttcaagca

SEQ ID NO: 4937083 - DNA, 15 bp, Homo sapiens
aaataacttcagtcc

SEQ ID NO: 4937084 - DNA, 16 bp, Homo sapiens
aaataacttcagtcct

SEQ ID NO: 4937085 - DNA, 20 bp, Homo sapiens
aaataagaacgaggatttta

SEQ ID NO: 4937086 - DNA, 16 bp, Homo sapiens
aaataagattctaacg

SEQ ID NO: 4937087 - DNA, 17 bp, Homo sapiens
aaatgcctttgagacag

SEQ ID NO: 4937088 - DNA, 22 bp, Homo sapiens
aaatgctctctcaaattgtcag

SEQ ID NO: 4937089 - DNA, 18 bp, Homo sapiens
aaatgctttttatttctg

SEQ ID NO: 4937090 - DNA, 16 bp, Homo sapiens
aaatggacactgtgcc

SEQ ID NO: 4937091 - DNA, 17 bp, Homo sapiens
aaatggcaagttttgat

SEQ ID NO: 4937092 - DNA, 13 bp, Homo sapiens
aaatggccatttg

SEQ ID NO: 4937093 - DNA, 23 bp, Homo sapiens
aaatggccatttgctttttcacc

SEQ ID NO: 4937094 - DNA, 18 bp, Homo sapiens
aaatggtcgcccaggaga

SEQ ID NO: 4937095 - DNA, 23 bp, Homo sapiens
aaatggtgaaaataaaataaagc

SEQ ID NO: 4937096 - DNA, 23 bp, Homo sapiens
aaatggtttattttgtattgtgg

SEQ ID NO: 4937097 - DNA, 14 bp, Homo sapiens
aaatgtaaactgcc

SEQ ID NO: 4937098 - DNA, 17 bp, Homo sapiens
aaatgtaaatattctat

SEQ ID NO: 4937099 - DNA, 19 bp, Homo sapiens
aaatgtagttgatgtatcc

SEQ ID NO: 4937100 - DNA, 13 bp, Homo sapiens
aaatgtatatatt

SEQ ID NO: 4937101 - DNA, 14 bp, Homo sapiens
aaatgtatttttct

SEQ ID NO: 4937102 - DNA, 15 bp, Homo sapiens
aaatgtatttttcta

SEQ ID NO: 4937103 - DNA, 15 bp, Homo sapiens
aaatgtcttaatttt

SEQ ID NO: 4937104 - DNA, 15 bp, Homo sapiens
aaatgtctttgtaag

SEQ ID NO: 4937105 - DNA, 21 bp, Homo sapiens
aaatgtctttgtaagtcagtg

SEQ ID NO: 4937106 - DNA, 17 bp, Homo sapiens
aaatgtcttttagaaga

SEQ ID NO: 4937107 - DNA, 20 bp, Homo sapiens
aaatgtgtcctatctatctt

SEQ ID NO: 4937108 - DNA, 21 bp, Homo sapiens
aaatgtgtcctatctatcttc

SEQ ID NO: 4937109 - DNA, 22 bp, Homo sapiens
aaatgttatgactatgtaaact

SEQ ID NO: 4937110 - DNA, 12 bp, Homo sapiens
aaatgttatttc

SEQ ID NO: 4937111 - DNA, 13 bp, Homo sapiens
aaatgttctaagt

SEQ ID NO: 4937112 - DNA, 19 bp, Homo sapiens
aaatgttctaagtttctaa

SEQ ID NO: 4937113 - DNA, 21 bp, Homo sapiens
aaatgtttgtctcagttggaa

SEQ ID NO: 4937114 - DNA, 22 bp, Homo sapiens
aaatgttttataagttcacaaa

SEQ ID NO: 4937115 - DNA, 23 bp, Homo sapiens
aaatgtttttctgccagggagct

SEQ ID NO: 4937116 - DNA, 23 bp, Homo sapiens
aaattaaaaagattctttttctg

SEQ ID NO: 4937117 - DNA, 18 bp, Homo sapiens
aaattaaacataaaacaa

SEQ ID NO: 4937118 - DNA, 13 bp, Homo sapiens
aaattaatcacaa

SEQ ID NO: 4937119 - DNA, 23 bp, Homo sapiens
aaattagaaaccttaatatgtgg

SEQ ID NO: 4937120 - DNA, 14 bp, Homo sapiens
aaattagggcaatt

SEQ ID NO: 4937121 - DNA, 20 bp, Homo sapiens
aaattatgtgacattttaca

SEQ ID NO: 4937122 - DNA, 16 bp, Homo sapiens
aaattattataagcat

SEQ ID NO: 4937123 - DNA, 13 bp, Homo sapiens
aaattatttgtgt

SEQ ID NO: 4937124 - DNA, 21 bp, Homo sapiens
aaattcagcaaaccattttta

SEQ ID NO: 4937125 - DNA, 16 bp, Homo sapiens
aaattcatttcacatt

SEQ ID NO: 4937126 - DNA, 17 bp, Homo sapiens
aaattcatttcacatta

SEQ ID NO: 4937127 - DNA, 12 bp, Homo sapiens
aaattccaaagt

SEQ ID NO: 4937128 - DNA, 21 bp, Homo sapiens
aaattccaaagtctctaattc

SEQ ID NO: 4937129 - DNA, 19 bp, Homo sapiens
aaattcgcccgagctgttt

SEQ ID NO: 4937130 - DNA, 9 bp, Homo sapiens
aaattctgt

SEQ ID NO: 4937131 - DNA, 20 bp, Homo sapiens
aaattctgttaaaatctatt

SEQ ID NO: 4937132 - DNA, 15 bp, Homo sapiens
aaattctttatttct

SEQ ID NO: 4937133 - DNA, 17 bp, Homo sapiens
aaattctttatttctgt

SEQ ID NO: 4937134 - DNA, 19 bp, Homo sapiens
aaattgcaaatcttgaaat

SEQ ID NO: 4937135 - DNA, 14 bp, Homo sapiens
aaattgctgtgctt

SEQ ID NO: 4937136 - DNA, 23 bp, Homo sapiens
aaattgctgtgctttatggatag

SEQ ID NO: 4937137 - DNA, 23 bp, Homo sapiens
aaattggactttcaaaattaaat

SEQ ID NO: 4937138 - DNA, 21 bp, Homo sapiens
aaattggcctggtatggctgc

SEQ ID NO: 4937139 - DNA, 22 bp, Homo sapiens
aaattggcctggtatggctgca

SEQ ID NO: 4937140 - DNA, 16 bp, Homo sapiens
aaattgggttcatgat

SEQ ID NO: 4937141 - DNA, 12 bp, Homo sapiens
aaattgtacata

SEQ ID NO: 4937142 - DNA, 15 bp, Homo sapiens
aaattgtacatattt

SEQ ID NO: 4937143 - DNA, 19 bp, Homo sapiens
aaattgtgaactcattgct

SEQ ID NO: 4937144 - DNA, 19 bp, Homo sapiens
aaattgtttggcttcctcc

SEQ ID NO: 4937145 - DNA, 13 bp, Homo sapiens
aaatttactatat

SEQ ID NO: 4937146 - DNA, 12 bp, Homo sapiens
aaatttatcaaa

SEQ ID NO: 4937147 - DNA, 13 bp, Homo sapiens
aaatttatcaaag

SEQ ID NO: 4937148 - DNA, 13 bp, Homo sapiens
aaatttcaaaaga

SEQ ID NO: 4937149 - DNA, 22 bp, Homo sapiens
aaatttctagcctgcactttga

SEQ ID NO: 4937150 - DNA, 15 bp, Homo sapiens
aaatttgatacttat

SEQ ID NO: 4937151 - DNA, 16 bp, Homo sapiens
aaatttgatacttata

SEQ ID NO: 4937152 - DNA, 18 bp, Homo sapiens
aaatttgatacttatatt

SEQ ID NO: 4937153 - DNA, 15 bp, Homo sapiens
aaatttgattgattt

SEQ ID NO: 4937154 - DNA, 17 bp, Homo sapiens
aaatttgattgatttga

SEQ ID NO: 4937155 - DNA, 21 bp, Homo sapiens
aaatttggggacagattcagt

SEQ ID NO: 4937156 - DNA, 19 bp, Homo sapiens
aaatttgtaagtttcaggt

SEQ ID NO: 4937157 - DNA, 22 bp, Homo sapiens
aaatttgtaagtttcaggtgac

SEQ ID NO: 4937158 - DNA, 14 bp, Homo sapiens
aaatttgtttgaaa

SEQ ID NO: 4937159 - DNA, 18 bp, Homo sapiens
aaatttgtttgaaatctt

SEQ ID NO: 4937160 - DNA, 19 bp, Homo sapiens
aaattttctagactttctg

SEQ ID NO: 4937161 - DNA, 17 bp, Homo sapiens
aaattttcttgatttga

SEQ ID NO: 4937162 - DNA, 20 bp, Homo sapiens
aaattttgcaaatataaaca

SEQ ID NO: 4937163 - DNA, 15 bp, Homo sapiens
aaattttttttacat

SEQ ID NO: 4937164 - DNA, 17 bp, Homo sapiens
aaattttttttacattt

SEQ ID NO: 4937165 - DNA, 19 bp, Homo sapiens
aacaaaaacactaaaaata

SEQ ID NO: 4937166 - DNA, 13 bp, Homo sapiens
aacaaaagggtca

SEQ ID NO: 4937167 - DNA, 13 bp, Homo sapiens
aacaaaagttccc

SEQ ID NO: 4937168 - DNA, 15 bp, Homo sapiens
aacaaaattacagac

SEQ ID NO: 4937169 - DNA, 21 bp, Homo sapiens
aacaaacattgtgttgacatt

SEQ ID NO: 4937170 - DNA, 10 bp, Homo sapiens
aacaaaccat

SEQ ID NO: 4937171 - DNA, 14 bp, Homo sapiens
aacaaagaaatatt

SEQ ID NO: 4937172 - DNA, 15 bp, Homo sapiens
aacaaagcacagtgt

SEQ ID NO: 4937173 - DNA, 17 bp, Homo sapiens
aacaaagcacagtgtta

SEQ ID NO: 4937174 - DNA, 20 bp, Homo sapiens
aacaaaggcaagttaagaga

SEQ ID NO: 4937175 - DNA, 16 bp, Homo sapiens
aacaaataatcacatt

SEQ ID NO: 4937176 - DNA, 22 bp, Homo sapiens
aacaacgcttgtgaatgtattt

SEQ ID NO: 4937177 - DNA, 12 bp, Homo sapiens
aacaagaattgg

SEQ ID NO: 4937178 - DNA, 15 bp, Homo sapiens
aacaataaaacatta

SEQ ID NO: 4937179 - DNA, 18 bp, Homo sapiens
aacaatatcatatcatca

SEQ ID NO: 4937180 - DNA, 11 bp, Homo sapiens
aacaatgttaa

SEQ ID NO: 4937181 - DNA, 18 bp, Homo sapiens
aacaatgttaaggaaact

SEQ ID NO: 4937182 - DNA, 22 bp, Homo sapiens
aacaatgttaaggaaactctta

SEQ ID NO: 4937183 - DNA, 16 bp, Homo sapiens
aacacagcctgggccc

SEQ ID NO: 4937184 - DNA, 11 bp, Homo sapiens
aacacagctgt

SEQ ID NO: 4937185 - DNA, 17 bp, Homo sapiens
aacacagctgttcttct

SEQ ID NO: 4937186 - DNA, 20 bp, Homo sapiens
aacacagcttacaatcgcaa

SEQ ID NO: 4937187 - DNA, 15 bp, Homo sapiens
aacacaggcaaaatc

SEQ ID NO: 4937188 - DNA, 22 bp, Homo sapiens
aacacaggcaaaatccttgctt

SEQ ID NO: 4937189 - DNA, 15 bp, Homo sapiens
aacacaggcagcttt

SEQ ID NO: 4937190 - DNA, 22 bp, Homo sapiens
aacacaggcagctttctagaag

SEQ ID NO: 4937191 - DNA, 21 bp, Homo sapiens
aacacatggggaaaaaaatca

SEQ ID NO: 4937192 - DNA, 14 bp, Homo sapiens
aacacattgcctaa

SEQ ID NO: 4937193 - DNA, 13 bp, Homo sapiens
aacaccacagaca

SEQ ID NO: 4937194 - DNA, 15 bp, Homo sapiens
aacaccacagacaca

SEQ ID NO: 4937195 - DNA, 15 bp, Homo sapiens
aacacccttagaaaa

SEQ ID NO: 4937196 - DNA, 20 bp, Homo sapiens
aacacccttagaaaatgtgt

SEQ ID NO: 4937197 - DNA, 18 bp, Homo sapiens
aaccgttttgaagctact

SEQ ID NO: 4937198 - DNA, 15 bp, Homo sapiens
aacctacatattcca

SEQ ID NO: 4937199 - DNA, 15 bp, Homo sapiens
aacctagagaagata

SEQ ID NO: 4937200 - DNA, 16 bp, Homo sapiens
aacctatatgatttat

SEQ ID NO: 4937201 - DNA, 20 bp, Homo sapiens
aacctcaagtaaactcccct

SEQ ID NO: 4937202 - DNA, 17 bp, Homo sapiens
aacctcccagaggtcca

SEQ ID NO: 4937203 - DNA, 21 bp, Homo sapiens
aacctcccagaggtccagccc

SEQ ID NO: 4937204 - DNA, 24 bp, Homo sapiens
aacctcccagaggtccagcccatc

SEQ ID NO: 4937205 - DNA, 14 bp, Homo sapiens
aacctccctcttgt

SEQ ID NO: 4937206 - DNA, 17 bp, Homo sapiens
aacctccgcctcttggg

SEQ ID NO: 4937207 - DNA, 14 bp, Homo sapiens
aacctcctgggcta

SEQ ID NO: 4937208 - DNA, 14 bp, Homo sapiens
aacctctgtctcat

SEQ ID NO: 4937209 - DNA, 17 bp, Homo sapiens
aacctcttctggctcaa

SEQ ID NO: 4937210 - DNA, 11 bp, Homo sapiens
aacctgctctc

SEQ ID NO: 4937211 - DNA, 15 bp, Homo sapiens
aacctgctctcctct

SEQ ID NO: 4937212 - DNA, 19 bp, Homo sapiens
aacctggaaaaattccaga

SEQ ID NO: 4937213 - DNA, 16 bp, Homo sapiens
aaccttagctccctcc

SEQ ID NO: 4937214 - DNA, 17 bp, Homo sapiens
aaccttatcctgcattg

SEQ ID NO: 4937215 - DNA, 19 bp, Homo sapiens
aaccttccttcctgcttga

SEQ ID NO: 4937216 - DNA, 15 bp, Homo sapiens
aaccttttttaagat

SEQ ID NO: 4937217 - DNA, 17 bp, Homo sapiens
aaccttttttaagattt

SEQ ID NO: 4937218 - DNA, 11 bp, Homo sapiens
aacgcagccct

SEQ ID NO: 4937219 - DNA, 13 bp, Homo sapiens
aacgcagccctag

SEQ ID NO: 4937220 - DNA, 22 bp, Homo sapiens
aacgcagccctagagcctgcct

SEQ ID NO: 4937221 - DNA, 12 bp, Homo sapiens
aacgcagccctg

SEQ ID NO: 4937222 - DNA, 18 bp, Homo sapiens
aacgcctcccctgcccca

SEQ ID NO: 4937223 - DNA, 17 bp, Homo sapiens
aacgtaaccacggaaaa

SEQ ID NO: 4937224 - DNA, 13 bp, Homo sapiens
aactaaatgttct

SEQ ID NO: 4937225 - DNA, 13 bp, Homo sapiens
aactacaaatcaa

SEQ ID NO: 4937226 - DNA, 22 bp, Homo sapiens
aactacttctcttgttaggtaa

SEQ ID NO: 4937227 - DNA, 17 bp, Homo sapiens
aactatacttgaacaaa

SEQ ID NO: 4937228 - DNA, 11 bp, Homo sapiens
aactatcttgg

SEQ ID NO: 4937229 - DNA, 16 bp, Homo sapiens
aactatttctacacag

SEQ ID NO: 4937230 - DNA, 18 bp, Homo sapiens
aactatttgtctttcagg

SEQ ID NO: 4937231 - DNA, 16 bp, Homo sapiens
aactcaaaatatttgt

SEQ ID NO: 4937232 - DNA, 21 bp, Homo sapiens
aactcaactgggctctgtccc

SEQ ID NO: 4937233 - DNA, 16 bp, Homo sapiens
aactcaagacaatgca

SEQ ID NO: 4937234 - DNA, 17 bp, Homo sapiens
aactcagcctgggacag

SEQ ID NO: 4937235 - DNA, 19 bp, Homo sapiens
aactcatttgttaaaatta

SEQ ID NO: 4937236 - DNA, 19 bp, Homo sapiens
aactcatttttgccataca

SEQ ID NO: 4937237 - DNA, 13 bp, Homo sapiens
aactccagcaact

SEQ ID NO: 4937238 - DNA, 16 bp, Homo sapiens
aactcccatcacctct

SEQ ID NO: 4937239 - DNA, 14 bp, Homo sapiens
aactccgcccccag

SEQ ID NO: 4937240 - DNA, 21 bp, Homo sapiens
aactcctcacacaccctgagg

SEQ ID NO: 4937241 - DNA, 12 bp, Homo sapiens
aactccttggcc

SEQ ID NO: 4937242 - DNA, 18 bp, Homo sapiens
aactctatctgggcctgg

SEQ ID NO: 4937243 - DNA, 22 bp, Homo sapiens
aactctctccaccctatatgta

SEQ ID NO: 4937244 - DNA, 16 bp, Homo sapiens
aactctgaactttgga

SEQ ID NO: 4937245 - DNA, 17 bp, Homo sapiens
aactctgaactttggag

SEQ ID NO: 4937246 - DNA, 19 bp, Homo sapiens
aactctgacaagggctgac

SEQ ID NO: 4937247 - DNA, 21 bp, Homo sapiens
aactctgggctgctacccaga

SEQ ID NO: 4937248 - DNA, 22 bp, Homo sapiens
aactctgggctgctacccagaa

SEQ ID NO: 4937249 - DNA, 13 bp, Homo sapiens
aactcttatctca

SEQ ID NO: 4937250 - DNA, 14 bp, Homo sapiens
aactcttatctcag

SEQ ID NO: 4937251 - DNA, 11 bp, Homo sapiens
aactcttgatt

SEQ ID NO: 4937252 - DNA, 21 bp, Homo sapiens
aactgaaaactcccatttacg

SEQ ID NO: 4937253 - DNA, 13 bp, Homo sapiens
aactgaagagaca

SEQ ID NO: 4937254 - DNA, 14 bp, Homo sapiens
aactgaccagcctc

SEQ ID NO: 4937255 - DNA, 18 bp, Homo sapiens
aactgactatcataaaat

SEQ ID NO: 4937256 - DNA, 12 bp, Homo sapiens
aactgaggaatt

SEQ ID NO: 4937257 - DNA, 13 bp, Homo sapiens
aactgaggaattt

SEQ ID NO: 4937258 - DNA, 23 bp, Homo sapiens
aactgccattattttctgtcaga

SEQ ID NO: 4937259 - DNA, 19 bp, Homo sapiens
aactggaacggtgaaggtg

SEQ ID NO: 4937260 - DNA, 19 bp, Homo sapiens
aactggcaattgtctattt

SEQ ID NO: 4937261 - DNA, 14 bp, Homo sapiens
aactgtacatttaa

SEQ ID NO: 4937262 - DNA, 13 bp, Homo sapiens
aactgtacatttc

SEQ ID NO: 4937263 - DNA, 18 bp, Homo sapiens
aactgtacttttaaggca

SEQ ID NO: 4937264 - DNA, 20 bp, Homo sapiens
aactgtagatgatgtatttt

SEQ ID NO: 4937265 - DNA, 20 bp, Homo sapiens
aactgtggccgttatctgga

SEQ ID NO: 4937266 - DNA, 14 bp, Homo sapiens
aactgttagcactg

SEQ ID NO: 4937267 - DNA, 17 bp, Homo sapiens
aactgttagcactgttg

SEQ ID NO: 4937268 - DNA, 18 bp, Homo sapiens
aactgttagcactgttga

SEQ ID NO: 4937269 - DNA, 20 bp, Homo sapiens
aactgttagcactgttgatg

SEQ ID NO: 4937270 - DNA, 14 bp, Homo sapiens
aactgttatgaaat

SEQ ID NO: 4937271 - DNA, 16 bp, Homo sapiens
aactgtttatatgtgt

SEQ ID NO: 4937272 - DNA, 18 bp, Homo sapiens
aactgtttatatgtgttg

SEQ ID NO: 4937273 - DNA, 13 bp, Homo sapiens
aacttaaaaatgt

SEQ ID NO: 4937274 - DNA, 15 bp, Homo sapiens
aacttaacatgggct

SEQ ID NO: 4937275 - DNA, 13 bp, Homo sapiens
aacttaactttaa

SEQ ID NO: 4937276 - DNA, 22 bp, Homo sapiens
aacttaatgttcttatgcaaaa

SEQ ID NO: 4937277 - DNA, 23 bp, Homo sapiens
aacttacctaagtgacatttgta

SEQ ID NO: 4937278 - DNA, 15 bp, Homo sapiens
aacttactgattatt

SEQ ID NO: 4937279 - DNA, 20 bp, Homo sapiens
aacttagatcatcagtcacc

SEQ ID NO: 4937280 - DNA, 16 bp, Homo sapiens
aacttaggtggcaagc

SEQ ID NO: 4937281 - DNA, 15 bp, Homo sapiens
aacttataaatcata

SEQ ID NO: 4937282 - DNA, 19 bp, Homo sapiens
aacttataaatcatattga

SEQ ID NO: 4937283 - DNA, 14 bp, Homo sapiens
aacttatgtagata

SEQ ID NO: 4937284 - DNA, 20 bp, Homo sapiens
aacttatgtagatatttggc

SEQ ID NO: 4937285 - DNA, 21 bp, Homo sapiens
aacttattgctgattttaatg

SEQ ID NO: 4937286 - DNA, 13 bp, Homo sapiens
aacttatttagag

SEQ ID NO: 4937287 - DNA, 16 bp, Homo sapiens
aacttcacattaaaaa

SEQ ID NO: 4937288 - DNA, 17 bp, Homo sapiens
aacttcagctgtacttc

SEQ ID NO: 4937289 - DNA, 13 bp, Homo sapiens
aacttcagtcctg

SEQ ID NO: 4937290 - DNA, 15 bp, Homo sapiens
aacttcagtcctggg

SEQ ID NO: 4937291 - DNA, 14 bp, Homo sapiens
aacttctaatatat

SEQ ID NO: 4937292 - DNA, 18 bp, Homo sapiens
aacttcttaaatatcttt

SEQ ID NO: 4937293 - DNA, 20 bp, Homo sapiens
aacttcttaaatatctttta

SEQ ID NO: 4937294 - DNA, 16 bp, Homo sapiens
aacttcttatggaatt

SEQ ID NO: 4937295 - DNA, 24 bp, Homo sapiens
aacttcttatggaattgatttgca

SEQ ID NO: 4937296 - DNA, 13 bp, Homo sapiens
aacttcttgtcag

SEQ ID NO: 4937297 - DNA, 16 bp, Homo sapiens
aacttcttgtcagaca

SEQ ID NO: 4937298 - DNA, 20 bp, Homo sapiens
aacttcttgtcagacataaa

SEQ ID NO: 4937299 - DNA, 21 bp, Homo sapiens
aacttcttgtcagacataaag

SEQ ID NO: 4937300 - DNA, 22 bp, Homo sapiens
aacttcttgtcagacataaagc

SEQ ID NO: 4937301 - DNA, 14 bp, Homo sapiens
aacttgaaaatata

SEQ ID NO: 4937302 - DNA, 19 bp, Homo sapiens
aacttgaaattatatctgt

SEQ ID NO: 4937303 - DNA, 16 bp, Homo sapiens
aacttgaatgtgtcag

SEQ ID NO: 4937304 - DNA, 15 bp, Homo sapiens
aacttgagatgtatg

SEQ ID NO: 4937305 - DNA, 19 bp, Homo sapiens
aacttgagggcccagagca

SEQ ID NO: 4937306 - DNA, 12 bp, Homo sapiens
aacttgatgcat

SEQ ID NO: 4937307 - DNA, 21 bp, Homo sapiens
aacttgcatccaactccagga

SEQ ID NO: 4937308 - DNA, 12 bp, Homo sapiens
aaaactcagcct

SEQ ID NO: 4937309 - DNA, 16 bp, Homo sapiens
aaaactcccatttacg

SEQ ID NO: 4937310 - DNA, 16 bp, Homo sapiens
aaaactccgcccccag

SEQ ID NO: 4937311 - DNA, 19 bp, Homo sapiens
aaaactccgcccccagcct

SEQ ID NO: 4937312 - DNA, 17 bp, Homo sapiens
aaaactggaataagaag

SEQ ID NO: 4937313 - DNA, 23 bp, Homo sapiens
aaaactgttttgggtagctgcca

SEQ ID NO: 4937314 - DNA, 10 bp, Homo sapiens
aaaacttctt

SEQ ID NO: 4937315 - DNA, 23 bp, Homo sapiens
aaaacttcttaaatatcttttat

SEQ ID NO: 4937316 - DNA, 18 bp, Homo sapiens
aaaacttcttgtcagaca

SEQ ID NO: 4937317 - DNA, 19 bp, Homo sapiens
aaaacttgtgtgaaatttt

SEQ ID NO: 4937318 - DNA, 10 bp, Homo sapiens
aaaagaaaat

SEQ ID NO: 4937319 - DNA, 19 bp, Homo sapiens
aaaagaaaatgaaaaacaa

SEQ ID NO: 4937320 - DNA, 14 bp, Homo sapiens
aaaagaatattcag

SEQ ID NO: 4937321 - DNA, 12 bp, Homo sapiens
aaaagagaagaa

SEQ ID NO: 4937322 - DNA, 14 bp, Homo sapiens
aaaagagaattaga

SEQ ID NO: 4937323 - DNA, 23 bp, Homo sapiens
aaaagagaattagattatattgg

SEQ ID NO: 4937324 - DNA, 18 bp, Homo sapiens
aaaagattctttttctga

SEQ ID NO: 4937325 - DNA, 17 bp, Homo sapiens
aaaagccactagactct

SEQ ID NO: 4937326 - DNA, 11 bp, Homo sapiens
aaaagccttgt

SEQ ID NO: 4937327 - DNA, 14 bp, Homo sapiens
aaaagccttgtgta

SEQ ID NO: 4937328 - DNA, 14 bp, Homo sapiens
aaaagctcatattt

SEQ ID NO: 4937329 - DNA, 18 bp, Homo sapiens
aaaagctcatattttgta

SEQ ID NO: 4937330 - DNA, 15 bp, Homo sapiens
aaaagctcatttcat

SEQ ID NO: 4937331 - DNA, 15 bp, Homo sapiens
aaaagctcctggggc

SEQ ID NO: 4937332 - DNA, 12 bp, Homo sapiens
aaaagctcctgt

SEQ ID NO: 4937333 - DNA, 20 bp, Homo sapiens
aaaagctcttacactacatt

SEQ ID NO: 4937334 - DNA, 15 bp, Homo sapiens
aaaagcttcttaatt

SEQ ID NO: 4937335 - DNA, 12 bp, Homo sapiens
aaaaggaaaaga

SEQ ID NO: 4937336 - DNA, 15 bp, Homo sapiens
aaaaggaaaagaaaa

SEQ ID NO: 4937337 - DNA, 19 bp, Homo sapiens
aaaaggacatcagcaaaca

SEQ ID NO: 4937338 - DNA, 22 bp, Homo sapiens
aaaaggagagactcccatgaag

SEQ ID NO: 4937339 - DNA, 16 bp, Homo sapiens
aaaaggatagtatttt

SEQ ID NO: 4937340 - DNA, 20 bp, Homo sapiens
aaaagggaagttgtgccttt

SEQ ID NO: 4937341 - DNA, 10 bp, Homo sapiens
aaaagggtca

SEQ ID NO: 4937342 - DNA, 13 bp, Homo sapiens
aaaagggtcagag

SEQ ID NO: 4937343 - DNA, 22 bp, Homo sapiens
aaaaggtagcttacctgacaca

SEQ ID NO: 4937344 - DNA, 19 bp, Homo sapiens
aaaaggtattttgaatacc

SEQ ID NO: 4937345 - DNA, 21 bp, Homo sapiens
aaaaggtattttgaataccat

SEQ ID NO: 4937346 - DNA, 13 bp, Homo sapiens
aaaagtaatgtaa

SEQ ID NO: 4937347 - DNA, 21 bp, Homo sapiens
aaaagtacatatttattttct

SEQ ID NO: 4937348 - DNA, 18 bp, Homo sapiens
aaaagtattttgaagttt

SEQ ID NO: 4937349 - DNA, 20 bp, Homo sapiens
aaaagtattttgaagtttac

SEQ ID NO: 4937350 - DNA, 15 bp, Homo sapiens
aaaagtcacttacta

SEQ ID NO: 4937351 - DNA, 15 bp, Homo sapiens
aaaagtgacacagca

SEQ ID NO: 4937352 - DNA, 18 bp, Homo sapiens
aaaagtgggcttgattct

SEQ ID NO: 4937353 - DNA, 13 bp, Homo sapiens
aaaagtggggcag

SEQ ID NO: 4937354 - DNA, 13 bp, Homo sapiens
aaaagtgtttatt

SEQ ID NO: 4937355 - DNA, 22 bp, Homo sapiens
aaaagttccaagagtctaaaga

SEQ ID NO: 4937356 - DNA, 16 bp, Homo sapiens
aaaagttggactaaat

SEQ ID NO: 4937357 - DNA, 23 bp, Homo sapiens
aaaagttggactaaatgcctagt

SEQ ID NO: 4937358 - DNA, 12 bp, Homo sapiens
aaaagtttcaat

SEQ ID NO: 4937359 - DNA, 12 bp, Homo sapiens
aaaataaacaaa

SEQ ID NO: 4937360 - DNA, 14 bp, Homo sapiens
aaaataaacaaata

SEQ ID NO: 4937361 - DNA, 20 bp, Homo sapiens
aaaataaaccaaaggacatt

SEQ ID NO: 4937362 - DNA, 11 bp, Homo sapiens
aaaataaatgg

SEQ ID NO: 4937363 - DNA, 14 bp, Homo sapiens
aaaataacacacat

SEQ ID NO: 4937364 - DNA, 13 bp, Homo sapiens
aaaataagtgaat

SEQ ID NO: 4937365 - DNA, 14 bp, Homo sapiens
aaaataattctaaa

SEQ ID NO: 4937366 - DNA, 17 bp, Homo sapiens
aaaataatttctctaca

SEQ ID NO: 4937367 - DNA, 15 bp, Homo sapiens
aaaatagaagctgta

SEQ ID NO: 4937368 - DNA, 16 bp, Homo sapiens
aaaatagagcttttaa

SEQ ID NO: 4937369 - DNA, 20 bp, Homo sapiens
aaaatagagtgtagtttaca

SEQ ID NO: 4937370 - DNA, 23 bp, Homo sapiens
aaaatagttaagacatgatttcc

SEQ ID NO: 4937371 - DNA, 17 bp, Homo sapiens
aaaatagtttgtttaat

SEQ ID NO: 4937372 - DNA, 16 bp, Homo sapiens
aaaatataaacaaaga

SEQ ID NO: 4937373 - DNA, 10 bp, Homo sapiens
aaaatatata

SEQ ID NO: 4937374 - DNA, 14 bp, Homo sapiens
aaaatatatactaa

SEQ ID NO: 4937375 - DNA, 19 bp, Homo sapiens
aaaatatatatagtgctat

SEQ ID NO: 4937376 - DNA, 20 bp, Homo sapiens
aaaatatggaacttctaata

SEQ ID NO: 4937377 - DNA, 22 bp, Homo sapiens
aaaatattactcagtttatgtt

SEQ ID NO: 4937378 - DNA, 15 bp, Homo sapiens
aaaatattatgtgtt

SEQ ID NO: 4937379 - DNA, 14 bp, Homo sapiens
aaaatcaaaacaag

SEQ ID NO: 4937380 - DNA, 16 bp, Homo sapiens
aaaatcatctattttg

SEQ ID NO: 4937381 - DNA, 18 bp, Homo sapiens
aaaatcatctattttgat

SEQ ID NO: 4937382 - DNA, 14 bp, Homo sapiens
aaaatccaaaaaga

SEQ ID NO: 4937383 - DNA, 21 bp, Homo sapiens
aaaatccttccaaagaattct

SEQ ID NO: 4937384 - DNA, 13 bp, Homo sapiens
aaaatctattctg

SEQ ID NO: 4937385 - DNA, 18 bp, Homo sapiens
aaaatcttatagttctag

SEQ ID NO: 4937386 - DNA, 14 bp, Homo sapiens
aaaatcttggaagt

SEQ ID NO: 4937387 - DNA, 14 bp, Homo sapiens
aaaatgaatatcta

SEQ ID NO: 4937388 - DNA, 19 bp, Homo sapiens
aaaatgactacttagcatc

SEQ ID NO: 4937389 - DNA, 20 bp, Homo sapiens
aaaatgagttgtgaaagttt

SEQ ID NO: 4937390 - DNA, 17 bp, Homo sapiens
aaaatgcccttaaatca

SEQ ID NO: 4937391 - DNA, 14 bp, Homo sapiens
aaaatgcctttgag

SEQ ID NO: 4937392 - DNA, 15 bp, Homo sapiens
aaaatgcctttgaga

SEQ ID NO: 4937393 - DNA, 22 bp, Homo sapiens
aaaatgcctttgagacagtttc

SEQ ID NO: 4937394 - DNA, 23 bp, Homo sapiens
aaaatgcctttgagacagtttct

SEQ ID NO: 4937395 - DNA, 18 bp, Homo sapiens
aaaatgctttttatttct

SEQ ID NO: 4937396 - DNA, 19 bp, Homo sapiens
aaaatgctttttatttctg

SEQ ID NO: 4937397 - DNA, 22 bp, Homo sapiens
aaaatgctttttatttctgcat

SEQ ID NO: 4937398 - DNA, 13 bp, Homo sapiens
aaaatggaaagaa

SEQ ID NO: 4937399 - DNA, 23 bp, Homo sapiens
aaaatggacatggtggctttgtt

SEQ ID NO: 4937400 - DNA, 22 bp, Homo sapiens
aaaatgtaagattatagattct

SEQ ID NO: 4937401 - DNA, 23 bp, Homo sapiens
aaaatgtaagattatagattcta

SEQ ID NO: 4937402 - DNA, 16 bp, Homo sapiens
aaaatgtcctgccttt

SEQ ID NO: 4937403 - DNA, 18 bp, Homo sapiens
aaaatgtcctgcctttta

SEQ ID NO: 4937404 - DNA, 15 bp, Homo sapiens
aaaatgtgatgttct

SEQ ID NO: 4937405 - DNA, 13 bp, Homo sapiens
aaaatgtgttgaa

SEQ ID NO: 4937406 - DNA, 22 bp, Homo sapiens
aaaatgttatcttctcaagttc

SEQ ID NO: 4937407 - DNA, 12 bp, Homo sapiens
aaaatgttcatc

SEQ ID NO: 4937408 - DNA, 22 bp, Homo sapiens
aaaatgttcatcaattcccatt

SEQ ID NO: 4937409 - DNA, 14 bp, Homo sapiens
aaaatgttgagaat

SEQ ID NO: 4937410 - DNA, 15 bp, Homo sapiens
aaaattactaatttt

SEQ ID NO: 4937411 - DNA, 22 bp, Homo sapiens
aaaattatactaacttatttat

SEQ ID NO: 4937412 - DNA, 18 bp, Homo sapiens
aaaattcaaaaagtgttt

SEQ ID NO: 4937413 - DNA, 13 bp, Homo sapiens
aaaattcagtgga

SEQ ID NO: 4937414 - DNA, 13 bp, Homo sapiens
aaaattcatttca

SEQ ID NO: 4937415 - DNA, 14 bp, Homo sapiens
aaaattcatttcac

SEQ ID NO: 4937416 - DNA, 16 bp, Homo sapiens
aaaattcatttcacat

SEQ ID NO: 4937417 - DNA, 13 bp, Homo sapiens
aaaattctcctga

SEQ ID NO: 4937418 - DNA, 15 bp, Homo sapiens
aaaattgcaaatctt

SEQ ID NO: 4937419 - DNA, 10 bp, Homo sapiens
aaatatttat

SEQ ID NO: 4937420 - DNA, 15 bp, Homo sapiens
aaatatttatttatt

SEQ ID NO: 4937421 - DNA, 17 bp, Homo sapiens
aaatatttgactattct

SEQ ID NO: 4937422 - DNA, 20 bp, Homo sapiens
aaatatttgacttgcatgaa

SEQ ID NO: 4937423 - DNA, 12 bp, Homo sapiens
aaatatttggag

SEQ ID NO: 4937424 - DNA, 21 bp, Homo sapiens
aaatatttggtctctatttca

SEQ ID NO: 4937425 - DNA, 21 bp, Homo sapiens
aaatcaaaactcacaagtgct

SEQ ID NO: 4937426 - DNA, 17 bp, Homo sapiens
aaatcaacagaagcatt

SEQ ID NO: 4937427 - DNA, 18 bp, Homo sapiens
aaatcaacagaagcattt

SEQ ID NO: 4937428 - DNA, 18 bp, Homo sapiens
aaatcaagtatttgggaa

SEQ ID NO: 4937429 - DNA, 17 bp, Homo sapiens
aaatcaggtattaatct

SEQ ID NO: 4937430 - DNA, 17 bp, Homo sapiens
aaatcatcgaaaattca

SEQ ID NO: 4937431 - DNA, 16 bp, Homo sapiens
aaatcatctattttga

SEQ ID NO: 4937432 - DNA, 20 bp, Homo sapiens
aaatccatatcttaaagaaa

SEQ ID NO: 4937433 - DNA, 15 bp, Homo sapiens
aaatctaaatctatt

SEQ ID NO: 4937434 - DNA, 17 bp, Homo sapiens
aaatctaaatctattta

SEQ ID NO: 4937435 - DNA, 17 bp, Homo sapiens
aaatctaatattaaaaa

SEQ ID NO: 4937436 - DNA, 11 bp, Homo sapiens
aaatctcatac

SEQ ID NO: 4937437 - DNA, 12 bp, Homo sapiens
aaatctctaata

SEQ ID NO: 4937438 - DNA, 15 bp, Homo sapiens
aaatctctaatatgg

SEQ ID NO: 4937439 - DNA, 13 bp, Homo sapiens
aaatctgcagagg

SEQ ID NO: 4937440 - DNA, 22 bp, Homo sapiens
aaatctgctggagtttcatgta

SEQ ID NO: 4937441 - DNA, 20 bp, Homo sapiens
aaatctggtcttgttagaaa

SEQ ID NO: 4937442 - DNA, 22 bp, Homo sapiens
aaatctggtcttgttagaaaac

SEQ ID NO: 4937443 - DNA, 22 bp, Homo sapiens
aaatctgtaacaggtattttgt

SEQ ID NO: 4937444 - DNA, 20 bp, Homo sapiens
aaatctgtgtatattatttg

SEQ ID NO: 4937445 - DNA, 22 bp, Homo sapiens
aaatctgtgtatattatttggc

SEQ ID NO: 4937446 - DNA, 12 bp, Homo sapiens
aaatctgttgcc

SEQ ID NO: 4937447 - DNA, 22 bp, Homo sapiens
aaatcttaatgaatgagtctgt

SEQ ID NO: 4937448 - DNA, 22 bp, Homo sapiens
aaatcttttaaaaattcaaatg

SEQ ID NO: 4937449 - DNA, 11 bp, Homo sapiens
aaatcttttac

SEQ ID NO: 4937450 - DNA, 20 bp, Homo sapiens
aaatgaaaaacaaccaagcg

SEQ ID NO: 4937451 - DNA, 11 bp, Homo sapiens
aaatgaaaata

SEQ ID NO: 4937452 - DNA, 17 bp, Homo sapiens
aaatgaaaatcgtgaca

SEQ ID NO: 4937453 - DNA, 21 bp, Homo sapiens
aaatgaaacaaataatcacat

SEQ ID NO: 4937454 - DNA, 15 bp, Homo sapiens
aaatgaaatttaaac

SEQ ID NO: 4937455 - DNA, 16 bp, Homo sapiens
aaatgaatatctatta

SEQ ID NO: 4937456 - DNA, 17 bp, Homo sapiens
aaatgaatatctattaa

SEQ ID NO: 4937457 - DNA, 18 bp, Homo sapiens
aaatgaatattttgataa

SEQ ID NO: 4937458 - DNA, 11 bp, Homo sapiens
aaatgaatgag

SEQ ID NO: 4937459 - DNA, 15 bp, Homo sapiens
aaatgacatcttttt

SEQ ID NO: 4937460 - DNA, 16 bp, Homo sapiens
aaatgacatcttttta

SEQ ID NO: 4937461 - DNA, 14 bp, Homo sapiens
aaatgaggacatgt

SEQ ID NO: 4937462 - DNA, 19 bp, Homo sapiens
aaatgaggtcagagcctgc

SEQ ID NO: 4937463 - DNA, 21 bp, Homo sapiens
aaatgaggtctgtttaaagtg

SEQ ID NO: 4937464 - DNA, 14 bp, Homo sapiens
aaatgagttgtgaa

SEQ ID NO: 4937465 - DNA, 23 bp, Homo sapiens
aaatgccttagaaatgtaaactg

SEQ ID NO: 4937466 - DNA, 16 bp, Homo sapiens
aaatgctgtgttgggt

SEQ ID NO: 4937467 - DNA, 20 bp, Homo sapiens
aaatggaacgctaatgaaac

SEQ ID NO: 4937468 - DNA, 19 bp, Homo sapiens
aaatggactggtttgagat

SEQ ID NO: 4937469 - DNA, 21 bp, Homo sapiens
aaatggatactacatctttaa

SEQ ID NO: 4937470 - DNA, 19 bp, Homo sapiens
aaatggatattattagaaa

SEQ ID NO: 4937471 - DNA, 17 bp, Homo sapiens
aaatggatgcaaagtac

SEQ ID NO: 4937472 - DNA, 19 bp, Homo sapiens
aaatggccatttgcttttt

SEQ ID NO: 4937473 - DNA, 19 bp, Homo sapiens
aaatggtgctcaccatgct

SEQ ID NO: 4937474 - DNA, 15 bp, Homo sapiens
aaatgtaaactgcca

SEQ ID NO: 4937475 - DNA, 16 bp, Homo sapiens
aaatgtaaactgccat

SEQ ID NO: 4937476 - DNA, 15 bp, Homo sapiens
aaatgtaaatattct

SEQ ID NO: 4937477 - DNA, 17 bp, Homo sapiens
aaatgtaacttttgtaa

SEQ ID NO: 4937478 - DNA, 20 bp, Homo sapiens
aaatgtaagattatagattc

SEQ ID NO: 4937479 - DNA, 21 bp, Homo sapiens
aaatgtaagattatagattct

SEQ ID NO: 4937480 - DNA, 15 bp, Homo sapiens
aaatgtactgagatt

SEQ ID NO: 4937481 - DNA, 21 bp, Homo sapiens
aaatgtaggcatcatgcatgt

SEQ ID NO: 4937482 - DNA, 16 bp, Homo sapiens
aaatgtagttgatgta

SEQ ID NO: 4937483 - DNA, 14 bp, Homo sapiens
aaatgtatatacac

SEQ ID NO: 4937484 - DNA, 14 bp, Homo sapiens
aaatgtatatattt

SEQ ID NO: 4937485 - DNA, 17 bp, Homo sapiens
aaatgtatatatttagt

SEQ ID NO: 4937486 - DNA, 18 bp, Homo sapiens
aaatgtatatatttagtg

SEQ ID NO: 4937487 - DNA, 20 bp, Homo sapiens
aaatgtatcatagaaatgta

SEQ ID NO: 4937488 - DNA, 10 bp, Homo sapiens
aaatgtattt

SEQ ID NO: 4937489 - DNA, 22 bp, Homo sapiens
aaatgtcctccagaagcctctg

SEQ ID NO: 4937490 - DNA, 20 bp, Homo sapiens
aaatgtctgtaaatatgttt

SEQ ID NO: 4937491 - DNA, 13 bp, Homo sapiens
aaatgtctttgta

SEQ ID NO: 4937492 - DNA, 14 bp, Homo sapiens
aaatgtctttgtaa

SEQ ID NO: 4937493 - DNA, 16 bp, Homo sapiens
aaatgtctttgtaagt

SEQ ID NO: 4937494 - DNA, 14 bp, Homo sapiens
aaatgtgaggaaga

SEQ ID NO: 4937495 - DNA, 18 bp, Homo sapiens
aaatgtgatgttctaagg

SEQ ID NO: 4937496 - DNA, 19 bp, Homo sapiens
aaatgtgatgttctaaggc

SEQ ID NO: 4937497 - DNA, 22 bp, Homo sapiens
aaatgtgatgttctaaggctct

SEQ ID NO: 4937498 - DNA, 12 bp, Homo sapiens
aaatgtgtacat

SEQ ID NO: 4937499 - DNA, 17 bp, Homo sapiens
aaatgttatttctgcaa

SEQ ID NO: 4937500 - DNA, 15 bp, Homo sapiens
aaatgttcagaaggt

SEQ ID NO: 4937501 - DNA, 21 bp, Homo sapiens
aaatgttcagaaggttgctct

SEQ ID NO: 4937502 - DNA, 17 bp, Homo sapiens
aaatgttctaagtttct

SEQ ID NO: 4937503 - DNA, 21 bp, Homo sapiens
aaatgttctaagtttctaaga

SEQ ID NO: 4937504 - DNA, 19 bp, Homo sapiens
aaatgttgagaatcccaaa

SEQ ID NO: 4937505 - DNA, 14 bp, Homo sapiens
aaatgttttataag

SEQ ID NO: 4937506 - DNA, 21 bp, Homo sapiens
aaatgtttttctgccagggag

SEQ ID NO: 4937507 - DNA, 16 bp, Homo sapiens
aaattaaacacaaagt

SEQ ID NO: 4937508 - DNA, 13 bp, Homo sapiens
aaattaaatctgt

SEQ ID NO: 4937509 - DNA, 14 bp, Homo sapiens
aaattaagaaggca

SEQ ID NO: 4937510 - DNA, 15 bp, Homo sapiens
aaattaagaaggcaa

SEQ ID NO: 4937511 - DNA, 22 bp, Homo sapiens
aaattacacccaaagaggtatt

SEQ ID NO: 4937512 - DNA, 22 bp, Homo sapiens
aaattactaattttacacatta

SEQ ID NO: 4937513 - DNA, 12 bp, Homo sapiens
aaattagaaaaa

SEQ ID NO: 4937514 - DNA, 19 bp, Homo sapiens
aaattagaaaaaaattact

SEQ ID NO: 4937515 - DNA, 22 bp, Homo sapiens
aaattaggaggctcaacaataa

SEQ ID NO: 4937516 - DNA, 23 bp, Homo sapiens
aaattaggaggctcaacaataaa

SEQ ID NO: 4937517 - DNA, 19 bp, Homo sapiens
aaattaggatttcatgatt

SEQ ID NO: 4937518 - DNA, 13 bp, Homo sapiens
aaattatgacaat

SEQ ID NO: 4937519 - DNA, 22 bp, Homo sapiens
aaattatgtgacattttacatt

SEQ ID NO: 4937520 - DNA, 19 bp, Homo sapiens
aaattattataagcattga

SEQ ID NO: 4937521 - DNA, 21 bp, Homo sapiens
aaattatttgtgtaatagaaa

SEQ ID NO: 4937522 - DNA, 16 bp, Homo sapiens
aaattattttaaacaa

SEQ ID NO: 4937523 - DNA, 14 bp, Homo sapiens
aaattcaaaaagtg

SEQ ID NO: 4937524 - DNA, 17 bp, Homo sapiens
aaattcacaaactttta

SEQ ID NO: 4937525 - DNA, 19 bp, Homo sapiens
aaattcatttcacattaat

SEQ ID NO: 4937526 - DNA, 14 bp, Homo sapiens
aaattccaaagtct

SEQ ID NO: 4937527 - DNA, 13 bp, Homo sapiens
aaattgaaattgt

SEQ ID NO: 4937528 - DNA, 21 bp, Homo sapiens
aaattgatgtgtttatttata

SEQ ID NO: 4937529 - DNA, 22 bp, Homo sapiens
aactatacttgaacaaaagggt

SEQ ID NO: 4937530 - DNA, 13 bp, Homo sapiens
aactatattttct

SEQ ID NO: 4937531 - DNA, 16 bp, Homo sapiens
aactatattttcttta

SEQ ID NO: 4937532 - DNA, 13 bp, Homo sapiens
aactatcttgtgt

SEQ ID NO: 4937533 - DNA, 23 bp, Homo sapiens
aactatgagcttgctcattaatt

SEQ ID NO: 4937534 - DNA, 18 bp, Homo sapiens
aactatggatcagaatag

SEQ ID NO: 4937535 - DNA, 20 bp, Homo sapiens
aactattcgaatgaaaagac

SEQ ID NO: 4937536 - DNA, 19 bp, Homo sapiens
aactatttgtctttcagga

SEQ ID NO: 4937537 - DNA, 19 bp, Homo sapiens
aactcaaaacttaacatat

SEQ ID NO: 4937538 - DNA, 14 bp, Homo sapiens
aactcactttcctc

SEQ ID NO: 4937539 - DNA, 21 bp, Homo sapiens
aactcagaattatttttaaaa

SEQ ID NO: 4937540 - DNA, 16 bp, Homo sapiens
aactcagcctgggaca

SEQ ID NO: 4937541 - DNA, 13 bp, Homo sapiens
aactcagggacag

SEQ ID NO: 4937542 - DNA, 23 bp, Homo sapiens
aactcagtcattagactcctcct

SEQ ID NO: 4937543 - DNA, 20 bp, Homo sapiens
aactcatttttgccatacat

SEQ ID NO: 4937544 - DNA, 19 bp, Homo sapiens
aactccccttcctcactgc

SEQ ID NO: 4937545 - DNA, 23 bp, Homo sapiens
aactccccttcctcactgcccaa

SEQ ID NO: 4937546 - DNA, 15 bp, Homo sapiens
aactccgcccccagc

SEQ ID NO: 4937547 - DNA, 19 bp, Homo sapiens
aactccgcccccagcctat

SEQ ID NO: 4937548 - DNA, 12 bp, Homo sapiens
aactccggattg

SEQ ID NO: 4937549 - DNA, 21 bp, Homo sapiens
aactccggattgcgttcctcc

SEQ ID NO: 4937550 - DNA, 22 bp, Homo sapiens
aactcctcacacaccctgaggt

SEQ ID NO: 4937551 - DNA, 14 bp, Homo sapiens
aactctatctgggc

SEQ ID NO: 4937552 - DNA, 21 bp, Homo sapiens
aactctatctgggcctgggct

SEQ ID NO: 4937553 - DNA, 18 bp, Homo sapiens
aactctgaactttggaga

SEQ ID NO: 4937554 - DNA, 22 bp, Homo sapiens
aactctgacaagggctgacctg

SEQ ID NO: 4937555 - DNA, 16 bp, Homo sapiens
aactctgtggcattat

SEQ ID NO: 4937556 - DNA, 15 bp, Homo sapiens
aactcttatctcagt

SEQ ID NO: 4937557 - DNA, 17 bp, Homo sapiens
aactcttgattatccat

SEQ ID NO: 4937558 - DNA, 19 bp, Homo sapiens
aactgaaaatctaatatta

SEQ ID NO: 4937559 - DNA, 14 bp, Homo sapiens
aactgaagagacag

SEQ ID NO: 4937560 - DNA, 15 bp, Homo sapiens
aactgaagagacagt

SEQ ID NO: 4937561 - DNA, 20 bp, Homo sapiens
aactgaatgtttattccttg

SEQ ID NO: 4937562 - DNA, 11 bp, Homo sapiens
aactgacacag

SEQ ID NO: 4937563 - DNA, 12 bp, Homo sapiens
aactgacacagg

SEQ ID NO: 4937564 - DNA, 13 bp, Homo sapiens
aactgacacagga

SEQ ID NO: 4937565 - DNA, 18 bp, Homo sapiens
aactgaggaattttcttt

SEQ ID NO: 4937566 - DNA, 20 bp, Homo sapiens
aactgaggaattttctttgt

SEQ ID NO: 4937567 - DNA, 11 bp, Homo sapiens
aactgccatta

SEQ ID NO: 4937568 - DNA, 12 bp, Homo sapiens
aactgccattat

SEQ ID NO: 4937569 - DNA, 21 bp, Homo sapiens
aactgccattattttctgtca

SEQ ID NO: 4937570 - DNA, 23 bp, Homo sapiens
aactgctggacgtctttcttttt

SEQ ID NO: 4937571 - DNA, 22 bp, Homo sapiens
aactgcttttttttttccagca

SEQ ID NO: 4937572 - DNA, 20 bp, Homo sapiens
aactggagtctggagtgggc

SEQ ID NO: 4937573 - DNA, 20 bp, Homo sapiens
aactggccccggatcagagc

SEQ ID NO: 4937574 - DNA, 21 bp, Homo sapiens
aactggccccggatcagagca

SEQ ID NO: 4937575 - DNA, 11 bp, Homo sapiens
aactggctgca

SEQ ID NO: 4937576 - DNA, 23 bp, Homo sapiens
aactgggtaaatgcaaagttctg

SEQ ID NO: 4937577 - DNA, 18 bp, Homo sapiens
aactgtctttaaaagaga

SEQ ID NO: 4937578 - DNA, 21 bp, Homo sapiens
aactgtgctgaatgctttaga

SEQ ID NO: 4937579 - DNA, 11 bp, Homo sapiens
aactgtggccg

SEQ ID NO: 4937580 - DNA, 17 bp, Homo sapiens
aactgtgttcattagaa

SEQ ID NO: 4937581 - DNA, 16 bp, Homo sapiens
aactgtgttgtattaa

SEQ ID NO: 4937582 - DNA, 20 bp, Homo sapiens
aactgtgttgtattaacaaa

SEQ ID NO: 4937583 - DNA, 15 bp, Homo sapiens
aactgttagcactgt

SEQ ID NO: 4937584 - DNA, 22 bp, Homo sapiens
aactgttagcactgttgatgta

SEQ ID NO: 4937585 - DNA, 19 bp, Homo sapiens
aactgtttatatgtgttga

SEQ ID NO: 4937586 - DNA, 22 bp, Homo sapiens
aactgtttatatgtgttgaaaa

SEQ ID NO: 4937587 - DNA, 15 bp, Homo sapiens
aactgttttgggtag

SEQ ID NO: 4937588 - DNA, 14 bp, Homo sapiens
aacttaacatattt

SEQ ID NO: 4937589 - DNA, 16 bp, Homo sapiens
aacttaacatatttac

SEQ ID NO: 4937590 - DNA, 23 bp, Homo sapiens
aacttaatgttcttatgcaaaat

SEQ ID NO: 4937591 - DNA, 21 bp, Homo sapiens
aacttatgtagatatttggct

SEQ ID NO: 4937592 - DNA, 16 bp, Homo sapiens
aacttattgctgattt

SEQ ID NO: 4937593 - DNA, 17 bp, Homo sapiens
aacttattgctgatttt

SEQ ID NO: 4937594 - DNA, 22 bp, Homo sapiens
aacttattgctgattttaatgg

SEQ ID NO: 4937595 - DNA, 21 bp, Homo sapiens
aacttcagatgggaggaaaga

SEQ ID NO: 4937596 - DNA, 13 bp, Homo sapiens
aacttcagcacca

SEQ ID NO: 4937597 - DNA, 20 bp, Homo sapiens
aacttcatatatgaggactt

SEQ ID NO: 4937598 - DNA, 18 bp, Homo sapiens
aacttcccagtgaattct

SEQ ID NO: 4937599 - DNA, 13 bp, Homo sapiens
aacttcttaaata

SEQ ID NO: 4937600 - DNA, 23 bp, Homo sapiens
aacttcttgtcagacataaagcc

SEQ ID NO: 4937601 - DNA, 22 bp, Homo sapiens
aacttgaaaatatatgatggct

SEQ ID NO: 4937602 - DNA, 19 bp, Homo sapiens
aacttgagcgtgaatctgt

SEQ ID NO: 4937603 - DNA, 22 bp, Homo sapiens
aacttgagggcccagagcagga

SEQ ID NO: 4937604 - DNA, 11 bp, Homo sapiens
aacttgatgca

SEQ ID NO: 4937605 - DNA, 14 bp, Homo sapiens
aacttgatgcatgt

SEQ ID NO: 4937606 - DNA, 16 bp, Homo sapiens
aacttggttctgcttc

SEQ ID NO: 4937607 - DNA, 17 bp, Homo sapiens
aacttgtagctgtaaaa

SEQ ID NO: 4937608 - DNA, 19 bp, Homo sapiens
aacttgttattgtgaatga

SEQ ID NO: 4937609 - DNA, 17 bp, Homo sapiens
aacttgtttgctgtgaa

SEQ ID NO: 4937610 - DNA, 19 bp, Homo sapiens
aactttaaaaaatatttat

SEQ ID NO: 4937611 - DNA, 20 bp, Homo sapiens
aactttacccaaaaactaaa

SEQ ID NO: 4937612 - DNA, 13 bp, Homo sapiens
aactttatacatt

SEQ ID NO: 4937613 - DNA, 15 bp, Homo sapiens
aactttatacattag

SEQ ID NO: 4937614 - DNA, 16 bp, Homo sapiens
aactttatacattagt

SEQ ID NO: 4937615 - DNA, 18 bp, Homo sapiens
aactttctcttcatactt

SEQ ID NO: 4937616 - DNA, 23 bp, Homo sapiens
aactttctgttggattccatgct

SEQ ID NO: 4937617 - DNA, 11 bp, Homo sapiens
aacttttgtaa

SEQ ID NO: 4937618 - DNA, 20 bp, Homo sapiens
aacttttgtgtaatgaaaat

SEQ ID NO: 4937619 - DNA, 16 bp, Homo sapiens
aacttttttaaataaa

SEQ ID NO: 4937620 - DNA, 18 bp, Homo sapiens
aacttttttaaataaact

SEQ ID NO: 4937621 - DNA, 22 bp, Homo sapiens
aacttttttaaataaacttttt

SEQ ID NO: 4937622 - DNA, 13 bp, Homo sapiens
aactttttttcaa

SEQ ID NO: 4937623 - DNA, 15 bp, Homo sapiens
aagaaaaaaaaaaga

SEQ ID NO: 4937624 - DNA, 17 bp, Homo sapiens
aagaaaaaaaaaagaag

SEQ ID NO: 4937625 - DNA, 19 bp, Homo sapiens
aagaaaaaaaaaagaagaa

SEQ ID NO: 4937626 - DNA, 15 bp, Homo sapiens
aagaaaaagaagaac

SEQ ID NO: 4937627 - DNA, 12 bp, Homo sapiens
aagaaaaagatt

SEQ ID NO: 4937628 - DNA, 18 bp, Homo sapiens
aagaaaagacttgtaata

SEQ ID NO: 4937629 - DNA, 22 bp, Homo sapiens
aagaaaagtaggtttacattca

SEQ ID NO: 4937630 - DNA, 16 bp, Homo sapiens
aagaaaagtggttgtt

SEQ ID NO: 4937631 - DNA, 17 bp, Homo sapiens
aagaaacttttgtaaag

SEQ ID NO: 4937632 - DNA, 14 bp, Homo sapiens
aagaaagaaggaag

SEQ ID NO: 4937633 - DNA, 22 bp, Homo sapiens
aagaaagactctattctcaaag

SEQ ID NO: 4937634 - DNA, 17 bp, Homo sapiens
aagaaagctggtaaact

SEQ ID NO: 4937635 - DNA, 22 bp, Homo sapiens
aagaaagcttcaaactgcatga

SEQ ID NO: 4937636 - DNA, 16 bp, Homo sapiens
aagaaatatgtgagat

SEQ ID NO: 4937637 - DNA, 14 bp, Homo sapiens
aagaaatccctgtt

SEQ ID NO: 4937638 - DNA, 19 bp, Homo sapiens
aagcttctaataaattata

SEQ ID NO: 4937639 - DNA, 18 bp, Homo sapiens
aagctttatgattttcat

SEQ ID NO: 4937640 - DNA, 16 bp, Homo sapiens
aagctttattaccagt

SEQ ID NO: 4937641 - DNA, 12 bp, Homo sapiens
aaggaaaaagct

SEQ ID NO: 4937642 - DNA, 14 bp, Homo sapiens
aaggaaaaagctcc

SEQ ID NO: 4937643 - DNA, 14 bp, Homo sapiens
aaggaaaagaaaaa

SEQ ID NO: 4937644 - DNA, 12 bp, Homo sapiens
aaggaaaatgat

SEQ ID NO: 4937645 - DNA, 14 bp, Homo sapiens
aaggaaaatgatac

SEQ ID NO: 4937646 - DNA, 21 bp, Homo sapiens
aaggaaaccgcctagtttact

SEQ ID NO: 4937647 - DNA, 12 bp, Homo sapiens
aaggaaactctt

SEQ ID NO: 4937648 - DNA, 19 bp, Homo sapiens
aaggaaactcttatctcag

SEQ ID NO: 4937649 - DNA, 20 bp, Homo sapiens
aaggaaatacccttctttta

SEQ ID NO: 4937650 - DNA, 15 bp, Homo sapiens
aaggaaatatatttt

SEQ ID NO: 4937651 - DNA, 16 bp, Homo sapiens
aaggaaatctcacccc

SEQ ID NO: 4937652 - DNA, 21 bp, Homo sapiens
aaggaagagccaatgttttcc

SEQ ID NO: 4937653 - DNA, 16 bp, Homo sapiens
aaggaagccaaattta

SEQ ID NO: 4937654 - DNA, 18 bp, Homo sapiens
aaggaagccaaatttatc

SEQ ID NO: 4937655 - DNA, 13 bp, Homo sapiens
aaggaaggaaaga

SEQ ID NO: 4937656 - DNA, 16 bp, Homo sapiens
aaggaagtgccccctc

SEQ ID NO: 4937657 - DNA, 15 bp, Homo sapiens
aaggacatcagcaaa

SEQ ID NO: 4937658 - DNA, 21 bp, Homo sapiens
aaggacccggaggggcctggc

SEQ ID NO: 4937659 - DNA, 23 bp, Homo sapiens
aaggactctggtttctcattctt

SEQ ID NO: 4937660 - DNA, 14 bp, Homo sapiens
aaggactgtaatct

SEQ ID NO: 4937661 - DNA, 12 bp, Homo sapiens
aaggagaacaaa

SEQ ID NO: 4937662 - DNA, 14 bp, Homo sapiens
aaggagacaagttc

SEQ ID NO: 4937663 - DNA, 11 bp, Homo sapiens
aaggagagaaa

SEQ ID NO: 4937664 - DNA, 16 bp, Homo sapiens
aaggagagaaagtggg

SEQ ID NO: 4937665 - DNA, 22 bp, Homo sapiens
aaggagagactcccatgaagcc

SEQ ID NO: 4937666 - DNA, 13 bp, Homo sapiens
aaggagagcctgc

SEQ ID NO: 4937667 - DNA, 13 bp, Homo sapiens
aaggagcacaagc

SEQ ID NO: 4937668 - DNA, 12 bp, Homo sapiens
aaggagcacagg

SEQ ID NO: 4937669 - DNA, 18 bp, Homo sapiens
aaggaggcatgcctctga

SEQ ID NO: 4937670 - DNA, 20 bp, Homo sapiens
aaggaggcatgcctctgata

SEQ ID NO: 4937671 - DNA, 18 bp, Homo sapiens
aaggaggggaagctgcag

SEQ ID NO: 4937672 - DNA, 19 bp, Homo sapiens
aaggatagatcaaagtcaa

SEQ ID NO: 4937673 - DNA, 17 bp, Homo sapiens
aaggatagtatttttat

SEQ ID NO: 4937674 - DNA, 23 bp, Homo sapiens
aaggatgaatgaggtcccaggca

SEQ ID NO: 4937675 - DNA, 17 bp, Homo sapiens
aaggatggggttatgaa

SEQ ID NO: 4937676 - DNA, 14 bp, Homo sapiens
aaggatgtcacagg

SEQ ID NO: 4937677 - DNA, 16 bp, Homo sapiens
aaggatgtcacagggc

SEQ ID NO: 4937678 - DNA, 15 bp, Homo sapiens
aaggattgctactgt

SEQ ID NO: 4937679 - DNA, 13 bp, Homo sapiens
aaggattgtaaaa

SEQ ID NO: 4937680 - DNA, 14 bp, Homo sapiens
aaggattgtaaaaa

SEQ ID NO: 4937681 - DNA, 23 bp, Homo sapiens
aaggattgtaaaaaaaaatgcct

SEQ ID NO: 4937682 - DNA, 21 bp, Homo sapiens
aaggcaagttaagagaaactt

SEQ ID NO: 4937683 - DNA, 14 bp, Homo sapiens
aaggcagacagcag

SEQ ID NO: 4937684 - DNA, 21 bp, Homo sapiens
aaggccagagtggcctggcca

SEQ ID NO: 4937685 - DNA, 18 bp, Homo sapiens
aaggccagtggaaattca

SEQ ID NO: 4937686 - DNA, 16 bp, Homo sapiens
aaggcccagcccctag

SEQ ID NO: 4937687 - DNA, 15 bp, Homo sapiens
aaggcctaggattct

SEQ ID NO: 4937688 - DNA, 16 bp, Homo sapiens
aaggcctcttggagac

SEQ ID NO: 4937689 - DNA, 20 bp, Homo sapiens
aaggcctcttggagacctta

SEQ ID NO: 4937690 - DNA, 23 bp, Homo sapiens
aaggcctcttggagaccttaccc

SEQ ID NO: 4937691 - DNA, 14 bp, Homo sapiens
aaggcctgcacaca

SEQ ID NO: 4937692 - DNA, 12 bp, Homo sapiens
aaggccttctcc

SEQ ID NO: 4937693 - DNA, 13 bp, Homo sapiens
aaggcggcccctc

SEQ ID NO: 4937694 - DNA, 22 bp, Homo sapiens
aaggcgtagcatcatcctgcag

SEQ ID NO: 4937695 - DNA, 12 bp, Homo sapiens
aaggctctgaga

SEQ ID NO: 4937696 - DNA, 14 bp, Homo sapiens
aaggctctgagagt

SEQ ID NO: 4937697 - DNA, 20 bp, Homo sapiens
aaggctctgagagtctagat

SEQ ID NO: 4937698 - DNA, 23 bp, Homo sapiens
aaggctctgagcaaatgtggctc

SEQ ID NO: 4937699 - DNA, 14 bp, Homo sapiens
aaggcttgaagctg

SEQ ID NO: 4937700 - DNA, 14 bp, Homo sapiens
aagggaacagaaag

SEQ ID NO: 4937701 - DNA, 18 bp, Homo sapiens
aagggaagacatttcttt

SEQ ID NO: 4937702 - DNA, 22 bp, Homo sapiens
aagggaggacgggagctgggga

SEQ ID NO: 4937703 - DNA, 16 bp, Homo sapiens
aagggatcatcatgca

SEQ ID NO: 4937704 - DNA, 21 bp, Homo sapiens
aagggcaggaaggagagcctg

SEQ ID NO: 4937705 - DNA, 17 bp, Homo sapiens
aagggcataaaacagct

SEQ ID NO: 4937706 - DNA, 16 bp, Homo sapiens
aagggcatgccttgtg

SEQ ID NO: 4937707 - DNA, 22 bp, Homo sapiens
aagggccagtcctgcctggcca

SEQ ID NO: 4937708 - DNA, 14 bp, Homo sapiens
aagggcttactatt

SEQ ID NO: 4937709 - DNA, 23 bp, Homo sapiens
aaggggaatgtttgcctctgcct

SEQ ID NO: 4937710 - DNA, 19 bp, Homo sapiens
aaggggagtcaccttccct

SEQ ID NO: 4937711 - DNA, 12 bp, Homo sapiens
aaggggcaaatt

SEQ ID NO: 4937712 - DNA, 18 bp, Homo sapiens
aaggggcaaatttttatt

SEQ ID NO: 4937713 - DNA, 18 bp, Homo sapiens
aagggggaggggaagtcc

SEQ ID NO: 4937714 - DNA, 19 bp, Homo sapiens
aaggggttggggtgacagt

SEQ ID NO: 4937715 - DNA, 19 bp, Homo sapiens
aagggtatcaggtgctgcc

SEQ ID NO: 4937716 - DNA, 17 bp, Homo sapiens
aaggtagaacctcacct

SEQ ID NO: 4937717 - DNA, 20 bp, Homo sapiens
aaggtagcttacctgacaca

SEQ ID NO: 4937718 - DNA, 22 bp, Homo sapiens
aaggtattaaattgatgttgct

SEQ ID NO: 4937719 - DNA, 19 bp, Homo sapiens
aaggtattttgaataccat

SEQ ID NO: 4937720 - DNA, 19 bp, Homo sapiens
aaggtcaccagcaccaaca

SEQ ID NO: 4937721 - DNA, 14 bp, Homo sapiens
aaggtcatttcttc

SEQ ID NO: 4937722 - DNA, 13 bp, Homo sapiens
aaggtctgagcca

SEQ ID NO: 4937723 - DNA, 16 bp, Homo sapiens
aaggtggaccttttaa

SEQ ID NO: 4937724 - DNA, 22 bp, Homo sapiens
aaggtggaccttttaaagtgtt

SEQ ID NO: 4937725 - DNA, 23 bp, Homo sapiens
aaggtggaccttttaaagtgttt

SEQ ID NO: 4937726 - DNA, 16 bp, Homo sapiens
aaggtggtgtgatctt

SEQ ID NO: 4937727 - DNA, 17 bp, Homo sapiens
aaggttcactaaagcag

SEQ ID NO: 4937728 - DNA, 14 bp, Homo sapiens
aaggttctaaggcc

SEQ ID NO: 4937729 - DNA, 16 bp, Homo sapiens
aaggttgggcagggtg

SEQ ID NO: 4937730 - DNA, 21 bp, Homo sapiens
aaggtttcgtttctgtataca

SEQ ID NO: 4937731 - DNA, 16 bp, Homo sapiens
aaggttttaggttcta

SEQ ID NO: 4937732 - DNA, 17 bp, Homo sapiens
aaggttttaggttctaa

SEQ ID NO: 4937733 - DNA, 20 bp, Homo sapiens
aaggttttaggttctaaagt

SEQ ID NO: 4937734 - DNA, 20 bp, Homo sapiens
aaggttttcctcttctattt

SEQ ID NO: 4937735 - DNA, 23 bp, Homo sapiens
aaggttttggatcttgaatgtgg

SEQ ID NO: 4937736 - DNA, 15 bp, Homo sapiens
aagtaacgcaataaa

SEQ ID NO: 4937737 - DNA, 16 bp, Homo sapiens
aagtaactcatttgtt

SEQ ID NO: 4937738 - DNA, 14 bp, Homo sapiens
aagtaattcctctc

SEQ ID NO: 4937739 - DNA, 17 bp, Homo sapiens
aagtacatgaatacaaa

SEQ ID NO: 4937740 - DNA, 18 bp, Homo sapiens
aagtactacacattttta

SEQ ID NO: 4937741 - DNA, 14 bp, Homo sapiens
aagtactgtaataa

SEQ ID NO: 4937742 - DNA, 22 bp, Homo sapiens
aagtactgtaataatacctcaa

SEQ ID NO: 4937743 - DNA, 21 bp, Homo sapiens
aagtacttctccaccctgctc

SEQ ID NO: 4937744 - DNA, 20 bp, Homo sapiens
aagtagaggttgtatacacc

SEQ ID NO: 4937745 - DNA, 14 bp, Homo sapiens
aagtagtctgctca

SEQ ID NO: 4937746 - DNA, 23 bp, Homo sapiens
aagtagttctgtttggtgtgtcc

SEQ ID NO: 4937747 - DNA, 12 bp, Homo sapiens
aagtagtttgta

SEQ ID NO: 4937748 - DNA, 15 bp, Homo sapiens
aatattcctgcattt

SEQ ID NO: 4937749 - DNA, 16 bp, Homo sapiens
aatattctatatgaat

SEQ ID NO: 4937750 - DNA, 20 bp, Homo sapiens
aatattctatatgaatttaa

SEQ ID NO: 4937751 - DNA, 20 bp, Homo sapiens
aatattgacatttgtagttg

SEQ ID NO: 4937752 - DNA, 14 bp, Homo sapiens
aatattgaggcttt

SEQ ID NO: 4937753 - DNA, 22 bp, Homo sapiens
aatattgaggctttgtgttgta

SEQ ID NO: 4937754 - DNA, 20 bp, Homo sapiens
aatattgctttggtcatatg

SEQ ID NO: 4937755 - DNA, 10 bp, Homo sapiens
aatattgtgt

SEQ ID NO: 4937756 - DNA, 14 bp, Homo sapiens
aatatttaaacagc

SEQ ID NO: 4937757 - DNA, 14 bp, Homo sapiens
aatatttatatatt

SEQ ID NO: 4937758 - DNA, 13 bp, Homo sapiens
aatatttatggat

SEQ ID NO: 4937759 - DNA, 19 bp, Homo sapiens
aatatttatgtctatttaa

SEQ ID NO: 4937760 - DNA, 12 bp, Homo sapiens
aatatttattaa

SEQ ID NO: 4937761 - DNA, 18 bp, Homo sapiens
aatatttattaaataaaa

SEQ ID NO: 4937762 - DNA, 21 bp, Homo sapiens
aatatttattaaataaaatca

SEQ ID NO: 4937763 - DNA, 22 bp, Homo sapiens
aatatttattaaataaaatcaa

SEQ ID NO: 4937764 - DNA, 11 bp, Homo sapiens
aatatttattt

SEQ ID NO: 4937765 - DNA, 12 bp, Homo sapiens
aatatttgtaca

SEQ ID NO: 4937766 - DNA, 14 bp, Homo sapiens
aatatttgtacata

SEQ ID NO: 4937767 - DNA, 15 bp, Homo sapiens
aatattttctgggtt

SEQ ID NO: 4937768 - DNA, 12 bp, Homo sapiens
aatattttgtat

SEQ ID NO: 4937769 - DNA, 23 bp, Homo sapiens
aatatttttgaaaggcatgttcc

SEQ ID NO: 4937770 - DNA, 17 bp, Homo sapiens
aatattttttatatata

SEQ ID NO: 4937771 - DNA, 19 bp, Homo sapiens
aatattttttatatataca

SEQ ID NO: 4937772 - DNA, 17 bp, Homo sapiens
aatcaaaaattgaagag

SEQ ID NO: 4937773 - DNA, 14 bp, Homo sapiens
aatcaaaacaagtg

SEQ ID NO: 4937774 - DNA, 14 bp, Homo sapiens
aatcaaataagtat

SEQ ID NO: 4937775 - DNA, 14 bp, Homo sapiens
aatcaacagaagca

SEQ ID NO: 4937776 - DNA, 14 bp, Homo sapiens
aatcaagagctgcc

SEQ ID NO: 4937777 - DNA, 23 bp, Homo sapiens
aatcaagggcaaaaagtctacat

SEQ ID NO: 4937778 - DNA, 16 bp, Homo sapiens
aatcactttgtctaac

SEQ ID NO: 4937779 - DNA, 14 bp, Homo sapiens
aatcagcactgaaa

SEQ ID NO: 4937780 - DNA, 19 bp, Homo sapiens
aatcagcattctcactcct

SEQ ID NO: 4937781 - DNA, 24 bp, Homo sapiens
aatcagtgggcaggataaactgaa

SEQ ID NO: 4937782 - DNA, 17 bp, Homo sapiens
aatcagtgtgtctaaat

SEQ ID NO: 4937783 - DNA, 17 bp, Homo sapiens
aatcatatgtgatctgt

SEQ ID NO: 4937784 - DNA, 19 bp, Homo sapiens
aatcatcgaaaattcattt

SEQ ID NO: 4937785 - DNA, 16 bp, Homo sapiens
aatcatgaaatatgca

SEQ ID NO: 4937786 - DNA, 19 bp, Homo sapiens
aatcatgaatctttgtttc

SEQ ID NO: 4937787 - DNA, 22 bp, Homo sapiens
aatcattgctttgaagcagttg

SEQ ID NO: 4937788 - DNA, 14 bp, Homo sapiens
aatcattgttgcct

SEQ ID NO: 4937789 - DNA, 17 bp, Homo sapiens
aatccaagcctccacag

SEQ ID NO: 4937790 - DNA, 18 bp, Homo sapiens
aatccaagcctccacagc

SEQ ID NO: 4937791 - DNA, 22 bp, Homo sapiens
aatccaagcctccacagcgagg

SEQ ID NO: 4937792 - DNA, 14 bp, Homo sapiens
aatccaagctccct

SEQ ID NO: 4937793 - DNA, 18 bp, Homo sapiens
aatccaagctccctgccc

SEQ ID NO: 4937794 - DNA, 15 bp, Homo sapiens
aatccacatttctaa

SEQ ID NO: 4937795 - DNA, 18 bp, Homo sapiens
aatccaggcacagctgag

SEQ ID NO: 4937796 - DNA, 17 bp, Homo sapiens
aatcccacccacatgtg

SEQ ID NO: 4937797 - DNA, 23 bp, Homo sapiens
aatcccagccggccaatggaaac

SEQ ID NO: 4937798 - DNA, 15 bp, Homo sapiens
aatccccttatgact

SEQ ID NO: 4937799 - DNA, 13 bp, Homo sapiens
aatccctgtttaa

SEQ ID NO: 4937800 - DNA, 21 bp, Homo sapiens
aatccgaccactaattgccaa

SEQ ID NO: 4937801 - DNA, 13 bp, Homo sapiens
aatccgctctctt

SEQ ID NO: 4937802 - DNA, 18 bp, Homo sapiens
aatccgctctcttcctgc

SEQ ID NO: 4937803 - DNA, 14 bp, Homo sapiens
aatcctaagacaca

SEQ ID NO: 4937804 - DNA, 15 bp, Homo sapiens
aatcctaagacacaa

SEQ ID NO: 4937805 - DNA, 14 bp, Homo sapiens
aatcctgcaatgaa

SEQ ID NO: 4937806 - DNA, 13 bp, Homo sapiens
aatcctggcagcc

SEQ ID NO: 4937807 - DNA, 20 bp, Homo sapiens
aatccttccaaaaattatta

SEQ ID NO: 4937808 - DNA, 13 bp, Homo sapiens
aatccttgcttat

SEQ ID NO: 4937809 - DNA, 17 bp, Homo sapiens
aatccttgcttatgaca

SEQ ID NO: 4937810 - DNA, 17 bp, Homo sapiens
aatctaaatctatttat

SEQ ID NO: 4937811 - DNA, 18 bp, Homo sapiens
aatctaatatccccaaat

SEQ ID NO: 4937812 - DNA, 14 bp, Homo sapiens
aatctaattttttc

SEQ ID NO: 4937813 - DNA, 15 bp, Homo sapiens
aatctactaattcca

SEQ ID NO: 4937814 - DNA, 19 bp, Homo sapiens
aatctagtatttcatgctg

SEQ ID NO: 4937815 - DNA, 15 bp, Homo sapiens
aatctagtttacaga

SEQ ID NO: 4937816 - DNA, 17 bp, Homo sapiens
aatctagtttacagaaa

SEQ ID NO: 4937817 - DNA, 18 bp, Homo sapiens
aatctagtttacagaaaa

SEQ ID NO: 4937818 - DNA, 17 bp, Homo sapiens
aatctatttattaatat

SEQ ID NO: 4937819 - DNA, 18 bp, Homo sapiens
aatctatttattaatatt

SEQ ID NO: 4937820 - DNA, 17 bp, Homo sapiens
aatctatttcacttatt

SEQ ID NO: 4937821 - DNA, 19 bp, Homo sapiens
aatctattttctatgtact

SEQ ID NO: 4937822 - DNA, 15 bp, Homo sapiens
aatctcaaggaatct

SEQ ID NO: 4937823 - DNA, 13 bp, Homo sapiens
aatctcaccccat

SEQ ID NO: 4937824 - DNA, 13 bp, Homo sapiens
aatctctgttatg

SEQ ID NO: 4937825 - DNA, 14 bp, Homo sapiens
aatctctgttatgt

SEQ ID NO: 4937826 - DNA, 14 bp, Homo sapiens
aatctgaaattcta

SEQ ID NO: 4937827 - DNA, 13 bp, Homo sapiens
aatctgattttta

SEQ ID NO: 4937828 - DNA, 19 bp, Homo sapiens
aatctgcaattcaaaagtt

SEQ ID NO: 4937829 - DNA, 16 bp, Homo sapiens
aatctggactcctctg

SEQ ID NO: 4937830 - DNA, 17 bp, Homo sapiens
aatctggactcctctgt

SEQ ID NO: 4937831 - DNA, 20 bp, Homo sapiens
aatctggtcttgttagaaaa

SEQ ID NO: 4937832 - DNA, 12 bp, Homo sapiens
aatctgtcaaaa

SEQ ID NO: 4937833 - DNA, 17 bp, Homo sapiens
aatctgtcaaaacactg

SEQ ID NO: 4937834 - DNA, 20 bp, Homo sapiens
aatctgtccaaaggaggctg

SEQ ID NO: 4937835 - DNA, 21 bp, Homo sapiens
aatctgtgtatattatttggc

SEQ ID NO: 4937836 - DNA, 14 bp, Homo sapiens
aatctgttatccca

SEQ ID NO: 4937837 - DNA, 20 bp, Homo sapiens
aatctgttatgtactagtgt

SEQ ID NO: 4937838 - DNA, 16 bp, Homo sapiens
aatcttctccagattt

SEQ ID NO: 4937839 - DNA, 12 bp, Homo sapiens
aatcttggaagt

SEQ ID NO: 4937840 - DNA, 23 bp, Homo sapiens
aatcttggaagtacatgaataca

SEQ ID NO: 4937841 - DNA, 14 bp, Homo sapiens
aatcttgtgctaga

SEQ ID NO: 4937842 - DNA, 21 bp, Homo sapiens
aatcttttacaactgcctcga

SEQ ID NO: 4937843 - DNA, 20 bp, Homo sapiens
aatgaaaagtcgttttccaa

SEQ ID NO: 4937844 - DNA, 16 bp, Homo sapiens
aatgaaaatgaatatc

SEQ ID NO: 4937845 - DNA, 21 bp, Homo sapiens
aatgaaataatgtacatctgg

SEQ ID NO: 4937846 - DNA, 17 bp, Homo sapiens
aatgaaatccttttcct

SEQ ID NO: 4937847 - DNA, 17 bp, Homo sapiens
aatgaaccacatcttgc

SEQ ID NO: 4937848 - DNA, 23 bp, Homo sapiens
aatgaaccacatcttgctctgct

SEQ ID NO: 4937849 - DNA, 19 bp, Homo sapiens
aatgaatattgaagtttca

SEQ ID NO: 4937850 - DNA, 16 bp, Homo sapiens
aatgaatgaggtctgg

SEQ ID NO: 4937851 - DNA, 14 bp, Homo sapiens
aatgacaacagaag

SEQ ID NO: 4937852 - DNA, 15 bp, Homo sapiens
aatgacaacagaagc

SEQ ID NO: 4937853 - DNA, 19 bp, Homo sapiens
aatgacatctttttaaagc

SEQ ID NO: 4937854 - DNA, 22 bp, Homo sapiens
aatgacatctttttaaagctta

SEQ ID NO: 4937855 - DNA, 12 bp, Homo sapiens
aatgacatgcac

SEQ ID NO: 4937856 - DNA, 15 bp, Homo sapiens
aatgacatgcactga

SEQ ID NO: 4937857 - DNA, 16 bp, Homo sapiens
aatgacatgcactgac

SEQ ID NO: 4937858 - DNA, 23 bp, Homo sapiens
aatgagcacccattccaaagctt

SEQ ID NO: 4937859 - DNA, 16 bp, Homo sapiens
aattgttgaaattttg

SEQ ID NO: 4937860 - DNA, 23 bp, Homo sapiens
aattgttgaaattttgcaaatat

SEQ ID NO: 4937861 - DNA, 18 bp, Homo sapiens
aattgttgacagttctga

SEQ ID NO: 4937862 - DNA, 23 bp, Homo sapiens
aattgttgctaatcttcttatgc

SEQ ID NO: 4937863 - DNA, 20 bp, Homo sapiens
aattgttgtttctttctagt

SEQ ID NO: 4937864 - DNA, 21 bp, Homo sapiens
aattgttgtttctttctagtg

SEQ ID NO: 4937865 - DNA, 23 bp, Homo sapiens
aattgttgtttctttctagtggt

SEQ ID NO: 4937866 - DNA, 15 bp, Homo sapiens
aattgtttgtcctca

SEQ ID NO: 4937867 - DNA, 19 bp, Homo sapiens
aattgttttctttaaagat

SEQ ID NO: 4937868 - DNA, 13 bp, Homo sapiens
aatttaaaaaata

SEQ ID NO: 4937869 - DNA, 14 bp, Homo sapiens
aatttaaaaaataa

SEQ ID NO: 4937870 - DNA, 14 bp, Homo sapiens
aatttaaacattaa

SEQ ID NO: 4937871 - DNA, 12 bp, Homo sapiens
aatttaaagata

SEQ ID NO: 4937872 - DNA, 13 bp, Homo sapiens
aatttaaagatat

SEQ ID NO: 4937873 - DNA, 17 bp, Homo sapiens
aatttaaagatattgtt

SEQ ID NO: 4937874 - DNA, 14 bp, Homo sapiens
aatttaagtatctt

SEQ ID NO: 4937875 - DNA, 14 bp, Homo sapiens
aatttaagtgcgtg

SEQ ID NO: 4937876 - DNA, 20 bp, Homo sapiens
aatttaagtgcgtgtgtaga

SEQ ID NO: 4937877 - DNA, 17 bp, Homo sapiens
aatttaatgctgccttt

SEQ ID NO: 4937878 - DNA, 15 bp, Homo sapiens
aatttacactgccat

SEQ ID NO: 4937879 - DNA, 12 bp, Homo sapiens
aatttactatat

SEQ ID NO: 4937880 - DNA, 23 bp, Homo sapiens
aatttagtgatcttagcatagct

SEQ ID NO: 4937881 - DNA, 14 bp, Homo sapiens
aatttataaaatta

SEQ ID NO: 4937882 - DNA, 15 bp, Homo sapiens
aatttatacaatatc

SEQ ID NO: 4937883 - DNA, 22 bp, Homo sapiens
aatttatcaaagcatagatgtt

SEQ ID NO: 4937884 - DNA, 17 bp, Homo sapiens
aatttattagttaatat

SEQ ID NO: 4937885 - DNA, 15 bp, Homo sapiens
aatttcaaaagacat

SEQ ID NO: 4937886 - DNA, 21 bp, Homo sapiens
aatttcaccaccaaatgccaa

SEQ ID NO: 4937887 - DNA, 23 bp, Homo sapiens
aatttcagtcctgtagttttatt

SEQ ID NO: 4937888 - DNA, 16 bp, Homo sapiens
aatttcatatgctgta

SEQ ID NO: 4937889 - DNA, 18 bp, Homo sapiens
aatttcccacccccaccc

SEQ ID NO: 4937890 - DNA, 21 bp, Homo sapiens
aatttcgccgttgaagaggaa

SEQ ID NO: 4937891 - DNA, 23 bp, Homo sapiens
aatttctaaagataatattactg

SEQ ID NO: 4937892 - DNA, 16 bp, Homo sapiens
aatttctgtcagaatg

SEQ ID NO: 4937893 - DNA, 14 bp, Homo sapiens
aatttcttcaaaat

SEQ ID NO: 4937894 - DNA, 19 bp, Homo sapiens
aatttcttcaaaatgtata

SEQ ID NO: 4937895 - DNA, 21 bp, Homo sapiens
aatttcttcactgttgaaaat

SEQ ID NO: 4937896 - DNA, 21 bp, Homo sapiens
aatttcttgctctatctctca

SEQ ID NO: 4937897 - DNA, 17 bp, Homo sapiens
aatttcttggtaagaag

SEQ ID NO: 4937898 - DNA, 14 bp, Homo sapiens
aatttgatacataa

SEQ ID NO: 4937899 - DNA, 18 bp, Homo sapiens
aatttgatacataataaa

SEQ ID NO: 4937900 - DNA, 13 bp, Homo sapiens
aatttgattaaca

SEQ ID NO: 4937901 - DNA, 13 bp, Homo sapiens
aatttgattgatt

SEQ ID NO: 4937902 - DNA, 14 bp, Homo sapiens
aatttgattgattt

SEQ ID NO: 4937903 - DNA, 18 bp, Homo sapiens
aatttggcctgcactaat

SEQ ID NO: 4937904 - DNA, 13 bp, Homo sapiens
aatttgtaagttt

SEQ ID NO: 4937905 - DNA, 23 bp, Homo sapiens
aatttgtaagtttcaggtgacat

SEQ ID NO: 4937906 - DNA, 17 bp, Homo sapiens
aattttaccctttagac

SEQ ID NO: 4937907 - DNA, 19 bp, Homo sapiens
aattttagtagagacaggg

SEQ ID NO: 4937908 - DNA, 17 bp, Homo sapiens
aattttagtccaaataa

SEQ ID NO: 4937909 - DNA, 13 bp, Homo sapiens
aattttattttgt

SEQ ID NO: 4937910 - DNA, 20 bp, Homo sapiens
aattttctacaaataatttt

SEQ ID NO: 4937911 - DNA, 15 bp, Homo sapiens
aattttctagacttt

SEQ ID NO: 4937912 - DNA, 17 bp, Homo sapiens
aattttctcaaaagcat

SEQ ID NO: 4937913 - DNA, 17 bp, Homo sapiens
aattttctcattttctt

SEQ ID NO: 4937914 - DNA, 22 bp, Homo sapiens
aattttctggaatacatgaaat

SEQ ID NO: 4937915 - DNA, 17 bp, Homo sapiens
aattttgacttaatgtg

SEQ ID NO: 4937916 - DNA, 21 bp, Homo sapiens
aattttgcaaatataaacatc

SEQ ID NO: 4937917 - DNA, 18 bp, Homo sapiens
aattttggaagattttca

SEQ ID NO: 4937918 - DNA, 20 bp, Homo sapiens
aatttttaccctaatgtctt

SEQ ID NO: 4937919 - DNA, 22 bp, Homo sapiens
aatttttatatttaattattaa

SEQ ID NO: 4937920 - DNA, 21 bp, Homo sapiens
aatttttcagctctctgtata

SEQ ID NO: 4937921 - DNA, 15 bp, Homo sapiens
aatttttgtctcaga

SEQ ID NO: 4937922 - DNA, 15 bp, Homo sapiens
aattttttttagtat

SEQ ID NO: 4937923 - DNA, 13 bp, Homo sapiens
aattttttttcat

SEQ ID NO: 4937924 - DNA, 19 bp, Homo sapiens
aatttttttttcctagccc

SEQ ID NO: 4937925 - DNA, 11 bp, Homo sapiens
acaaaacaaaa

SEQ ID NO: 4937926 - DNA, 12 bp, Homo sapiens
acaaaacaaaac

SEQ ID NO: 4937927 - DNA, 15 bp, Homo sapiens
acaaaacaaaacaaa

SEQ ID NO: 4937928 - DNA, 14 bp, Homo sapiens
acaaaacaaaacta

SEQ ID NO: 4937929 - DNA, 15 bp, Homo sapiens
acaaaacaaaactat

SEQ ID NO: 4937930 - DNA, 21 bp, Homo sapiens
acaaaacctaacttgcgcaga

SEQ ID NO: 4937931 - DNA, 23 bp, Homo sapiens
acaaaactacatgagaacaaaca

SEQ ID NO: 4937932 - DNA, 10 bp, Homo sapiens
acaaaactat

SEQ ID NO: 4937933 - DNA, 11 bp, Homo sapiens
acaaaacttct

SEQ ID NO: 4937934 - DNA, 13 bp, Homo sapiens
acaaaacttcttg

SEQ ID NO: 4937935 - DNA, 17 bp, Homo sapiens
acaaaacttcttgtcag

SEQ ID NO: 4937936 - DNA, 15 bp, Homo sapiens
acaaaagaaaagact

SEQ ID NO: 4937937 - DNA, 15 bp, Homo sapiens
acaaaagaaatacct

SEQ ID NO: 4937938 - DNA, 18 bp, Homo sapiens
acaaaagaaataccttga

SEQ ID NO: 4937939 - DNA, 14 bp, Homo sapiens
acaaaataaacaaa

SEQ ID NO: 4937940 - DNA, 12 bp, Homo sapiens
acaaaatagaag

SEQ ID NO: 4937941 - DNA, 14 bp, Homo sapiens
acaaaatctcctct

SEQ ID NO: 4937942 - DNA, 21 bp, Homo sapiens
acaaacaccttcttattatat

SEQ ID NO: 4937943 - DNA, 16 bp, Homo sapiens
acaaacattgtgttga

SEQ ID NO: 4937944 - DNA, 20 bp, Homo sapiens
acaaacattgtgttgacatt

SEQ ID NO: 4937945 - DNA, 11 bp, Homo sapiens
acaaacatttt

SEQ ID NO: 4937946 - DNA, 15 bp, Homo sapiens
acaaacatttttcaa

SEQ ID NO: 4937947 - DNA, 15 bp, Homo sapiens
acaaaccacaactga

SEQ ID NO: 4937948 - DNA, 13 bp, Homo sapiens
acaaactgtaaat

SEQ ID NO: 4937949 - DNA, 16 bp, Homo sapiens
acaaactgtgtacata

SEQ ID NO: 4937950 - DNA, 22 bp, Homo sapiens
acaaactttagggtaaaaattg

SEQ ID NO: 4937951 - DNA, 13 bp, Homo sapiens
acaaacttttata

SEQ ID NO: 4937952 - DNA, 14 bp, Homo sapiens
acaaagaatttaaa

SEQ ID NO: 4937953 - DNA, 15 bp, Homo sapiens
acaaagcacagtgtt

SEQ ID NO: 4937954 - DNA, 15 bp, Homo sapiens
acaaagcgtgcacaa

SEQ ID NO: 4937955 - DNA, 14 bp, Homo sapiens
acaaagctgttaaa

SEQ ID NO: 4937956 - DNA, 19 bp, Homo sapiens
acaaaggcaagttaagaga

SEQ ID NO: 4937957 - DNA, 15 bp, Homo sapiens
acaaaggccaaactg

SEQ ID NO: 4937958 - DNA, 19 bp, Homo sapiens
acaaaggggatcataaagt

SEQ ID NO: 4937959 - DNA, 21 bp, Homo sapiens
acaaaggttttcctcttctat

SEQ ID NO: 4937960 - DNA, 16 bp, Homo sapiens
acaaagtctttggggt

SEQ ID NO: 4937961 - DNA, 16 bp, Homo sapiens
acaaataacaatgtgc

SEQ ID NO: 4937962 - DNA, 12 bp, Homo sapiens
acaaataatcac

SEQ ID NO: 4937963 - DNA, 14 bp, Homo sapiens
acaaatataagatt

SEQ ID NO: 4937964 - DNA, 21 bp, Homo sapiens
acaaatatcttgtgttgtcct

SEQ ID NO: 4937965 - DNA, 12 bp, Homo sapiens
acaaatatgcaa

SEQ ID NO: 4937966 - DNA, 22 bp, Homo sapiens
acaaatatttattttctttctg

SEQ ID NO: 4937967 - DNA, 21 bp, Homo sapiens
acaaatcaacagaagcatttg

SEQ ID NO: 4937968 - DNA, 21 bp, Homo sapiens
acaaatccaaaggaaagaata

SEQ ID NO: 4937969 - DNA, 19 bp, Homo sapiens
acaaatctgtgtatattat

SEQ ID NO: 4937970 - DNA, 15 bp, Homo sapiens
acatgtgtgtatata

SEQ ID NO: 4937971 - DNA, 21 bp, Homo sapiens
acatgtgttttaattccaata

SEQ ID NO: 4937972 - DNA, 14 bp, Homo sapiens
acattaaaaatgga

SEQ ID NO: 4937973 - DNA, 14 bp, Homo sapiens
acattaaatgtctt

SEQ ID NO: 4937974 - DNA, 17 bp, Homo sapiens
acattaaatgtcttata

SEQ ID NO: 4937975 - DNA, 21 bp, Homo sapiens
acattaatcaatcatctgtgt

SEQ ID NO: 4937976 - DNA, 17 bp, Homo sapiens
acattaatggtctaaaa

SEQ ID NO: 4937977 - DNA, 16 bp, Homo sapiens
acattaccttactgtg

SEQ ID NO: 4937978 - DNA, 19 bp, Homo sapiens
acattaccttactgtggag

SEQ ID NO: 4937979 - DNA, 20 bp, Homo sapiens
acattagaataaaaggtagt

SEQ ID NO: 4937980 - DNA, 22 bp, Homo sapiens
acattagcagtttgctttgtat

SEQ ID NO: 4937981 - DNA, 15 bp, Homo sapiens
acattagtaaatgtc

SEQ ID NO: 4937982 - DNA, 20 bp, Homo sapiens
acattagtaaatgtctttgt

SEQ ID NO: 4937983 - DNA, 13 bp, Homo sapiens
acattatgtgtgc

SEQ ID NO: 4937984 - DNA, 20 bp, Homo sapiens
acattatgtgtgcatgtgtg

SEQ ID NO: 4937985 - DNA, 15 bp, Homo sapiens
acattattgcttatt

SEQ ID NO: 4937986 - DNA, 19 bp, Homo sapiens
acattctgatttggaaaaa

SEQ ID NO: 4937987 - DNA, 19 bp, Homo sapiens
acattgacgattccttctc

SEQ ID NO: 4937988 - DNA, 16 bp, Homo sapiens
acattgattcagcctg

SEQ ID NO: 4937989 - DNA, 19 bp, Homo sapiens
acattgcattctattgcct

SEQ ID NO: 4937990 - DNA, 17 bp, Homo sapiens
acattgttgagctattg

SEQ ID NO: 4937991 - DNA, 15 bp, Homo sapiens
acattgttgctccct

SEQ ID NO: 4937992 - DNA, 14 bp, Homo sapiens
acattgttgttttt

SEQ ID NO: 4937993 - DNA, 17 bp, Homo sapiens
acatttaaaattgctat

SEQ ID NO: 4937994 - DNA, 14 bp, Homo sapiens
acatttaaagcatt

SEQ ID NO: 4937995 - DNA, 23 bp, Homo sapiens
acatttaaattttaccctttaga

SEQ ID NO: 4937996 - DNA, 21 bp, Homo sapiens
acatttaaggatggggttatg

SEQ ID NO: 4937997 - DNA, 21 bp, Homo sapiens
acatttcacaggctaatggga

SEQ ID NO: 4937998 - DNA, 19 bp, Homo sapiens
acatttctgtaaataccat

SEQ ID NO: 4937999 - DNA, 23 bp, Homo sapiens
acatttcttagactacatttaga

SEQ ID NO: 4938000 - DNA, 21 bp, Homo sapiens
acatttcttttctttttacat

SEQ ID NO: 4938001 - DNA, 23 bp, Homo sapiens
acatttgccttgcagaactgcca

SEQ ID NO: 4938002 - DNA, 12 bp, Homo sapiens
acatttggaata

SEQ ID NO: 4938003 - DNA, 16 bp, Homo sapiens
acatttggaatacttt

SEQ ID NO: 4938004 - DNA, 18 bp, Homo sapiens
acatttggaatacttttt

SEQ ID NO: 4938005 - DNA, 19 bp, Homo sapiens
acatttggataaacaacat

SEQ ID NO: 4938006 - DNA, 18 bp, Homo sapiens
acattttagctctattga

SEQ ID NO: 4938007 - DNA, 18 bp, Homo sapiens
acattttgttcttacaca

SEQ ID NO: 4938008 - DNA, 15 bp, Homo sapiens
acattttgttgtaaa

SEQ ID NO: 4938009 - DNA, 17 bp, Homo sapiens
acattttgttgtaaaaa

SEQ ID NO: 4938010 - DNA, 20 bp, Homo sapiens
acattttgttgtaaaaagaa

SEQ ID NO: 4938011 - DNA, 20 bp, Homo sapiens
acatttttaaattgttagct

SEQ ID NO: 4938012 - DNA, 15 bp, Homo sapiens
acatttttatttatg

SEQ ID NO: 4938013 - DNA, 16 bp, Homo sapiens
acatttttatttatga

SEQ ID NO: 4938014 - DNA, 18 bp, Homo sapiens
acattttttttttaaatc

SEQ ID NO: 4938015 - DNA, 12 bp, Homo sapiens
accaaagccacc

SEQ ID NO: 4938016 - DNA, 13 bp, Homo sapiens
accaaagctgccc

SEQ ID NO: 4938017 - DNA, 14 bp, Homo sapiens
accaaagctgccca

SEQ ID NO: 4938018 - DNA, 18 bp, Homo sapiens
accaaagctgcccactgt

SEQ ID NO: 4938019 - DNA, 19 bp, Homo sapiens
accaaaggacattatgtgt

SEQ ID NO: 4938020 - DNA, 21 bp, Homo sapiens
accaaagggagagttccagag

SEQ ID NO: 4938021 - DNA, 21 bp, Homo sapiens
accaaagtcctttttttccat

SEQ ID NO: 4938022 - DNA, 14 bp, Homo sapiens
accaaagttctaat

SEQ ID NO: 4938023 - DNA, 21 bp, Homo sapiens
accaaagttctaataatttct

SEQ ID NO: 4938024 - DNA, 18 bp, Homo sapiens
accaaataaaaatattgt

SEQ ID NO: 4938025 - DNA, 17 bp, Homo sapiens
accaaatttttctatca

SEQ ID NO: 4938026 - DNA, 21 bp, Homo sapiens
accaacgttactcagggctcc

SEQ ID NO: 4938027 - DNA, 14 bp, Homo sapiens
accaactgggccca

SEQ ID NO: 4938028 - DNA, 10 bp, Homo sapiens
accaactgtg

SEQ ID NO: 4938029 - DNA, 15 bp, Homo sapiens
accaactgtgttgta

SEQ ID NO: 4938030 - DNA, 23 bp, Homo sapiens
accaactgtgttgtattaacaaa

SEQ ID NO: 4938031 - DNA, 22 bp, Homo sapiens
accaacttggttctgcttcaat

SEQ ID NO: 4938032 - DNA, 18 bp, Homo sapiens
accaactttctgtaaact

SEQ ID NO: 4938033 - DNA, 14 bp, Homo sapiens
accaagatctataa

SEQ ID NO: 4938034 - DNA, 15 bp, Homo sapiens
accaagccgtggctt

SEQ ID NO: 4938035 - DNA, 16 bp, Homo sapiens
accaagccgtggcttc

SEQ ID NO: 4938036 - DNA, 18 bp, Homo sapiens
accaagccgtggcttccc

SEQ ID NO: 4938037 - DNA, 14 bp, Homo sapiens
accaagctattcct

SEQ ID NO: 4938038 - DNA, 15 bp, Homo sapiens
accaagtatttatta

SEQ ID NO: 4938039 - DNA, 16 bp, Homo sapiens
accaatgccaagataa

SEQ ID NO: 4938040 - DNA, 18 bp, Homo sapiens
accaatgcttttatcaaa

SEQ ID NO: 4938041 - DNA, 14 bp, Homo sapiens
accaattattgata

SEQ ID NO: 4938042 - DNA, 15 bp, Homo sapiens
accaattgtgctgcc

SEQ ID NO: 4938043 - DNA, 17 bp, Homo sapiens
accaattgtgctgccat

SEQ ID NO: 4938044 - DNA, 18 bp, Homo sapiens
accaatttacactgccat

SEQ ID NO: 4938045 - DNA, 20 bp, Homo sapiens
accacaaagcacagtttgaa

SEQ ID NO: 4938046 - DNA, 10 bp, Homo sapiens
accacaaagg

SEQ ID NO: 4938047 - DNA, 15 bp, Homo sapiens
accacaactgacaca

SEQ ID NO: 4938048 - DNA, 16 bp, Homo sapiens
accacaactgacacag

SEQ ID NO: 4938049 - DNA, 11 bp, Homo sapiens
accacacaaag

SEQ ID NO: 4938050 - DNA, 15 bp, Homo sapiens
accacacatctatga

SEQ ID NO: 4938051 - DNA, 12 bp, Homo sapiens
accacacccagc

SEQ ID NO: 4938052 - DNA, 23 bp, Homo sapiens
accacacccagcccacttctgcc

SEQ ID NO: 4938053 - DNA, 14 bp, Homo sapiens
accacagacacaca

SEQ ID NO: 4938054 - DNA, 18 bp, Homo sapiens
accacagacacacacacg

SEQ ID NO: 4938055 - DNA, 14 bp, Homo sapiens
accacatcctccgt

SEQ ID NO: 4938056 - DNA, 22 bp, Homo sapiens
accacatcctccgtccagccgc

SEQ ID NO: 4938057 - DNA, 17 bp, Homo sapiens
accacatcttgctctgc

SEQ ID NO: 4938058 - DNA, 19 bp, Homo sapiens
accacatcttgctctgctg

SEQ ID NO: 4938059 - DNA, 15 bp, Homo sapiens
accaccacacccagc

SEQ ID NO: 4938060 - DNA, 18 bp, Homo sapiens
accaccccaacaaaccat

SEQ ID NO: 4938061 - DNA, 16 bp, Homo sapiens
accacgctggaccttg

SEQ ID NO: 4938062 - DNA, 15 bp, Homo sapiens
accactcagccccta

SEQ ID NO: 4938063 - DNA, 18 bp, Homo sapiens
accactcagcccctagga

SEQ ID NO: 4938064 - DNA, 19 bp, Homo sapiens
accactgtttcttgcttgt

SEQ ID NO: 4938065 - DNA, 13 bp, Homo sapiens
accacttcactga

SEQ ID NO: 4938066 - DNA, 20 bp, Homo sapiens
accacttccaggggaacctg

SEQ ID NO: 4938067 - DNA, 23 bp, Homo sapiens
accacttccaggggaacctgcca

SEQ ID NO: 4938068 - DNA, 16 bp, Homo sapiens
accagaaaatgagggc

SEQ ID NO: 4938069 - DNA, 23 bp, Homo sapiens
accagacaaggaaatacccttct

SEQ ID NO: 4938070 - DNA, 17 bp, Homo sapiens
accagacaccttgacag

SEQ ID NO: 4938071 - DNA, 12 bp, Homo sapiens
accagagcagat

SEQ ID NO: 4938072 - DNA, 16 bp, Homo sapiens
accagagcagatgcag

SEQ ID NO: 4938073 - DNA, 20 bp, Homo sapiens
accagagcatttccaacacc

SEQ ID NO: 4938074 - DNA, 14 bp, Homo sapiens
accagagcccacct

SEQ ID NO: 4938075 - DNA, 22 bp, Homo sapiens
accagagcccaccttggctcaa

SEQ ID NO: 4938076 - DNA, 22 bp, Homo sapiens
accagatgcgtcccaagatgtt

SEQ ID NO: 4938077 - DNA, 16 bp, Homo sapiens
accagcatcacctgcc

SEQ ID NO: 4938078 - DNA, 11 bp, Homo sapiens
accagccagcg

SEQ ID NO: 4938079 - DNA, 20 bp, Homo sapiens
accagcccatggccctgtgc

SEQ ID NO: 4938080 - DNA, 20 bp, Homo sapiens
acgatcctgccaccctgtag

SEQ ID NO: 4938081 - DNA, 21 bp, Homo sapiens
acgatcctgccaccctgtagc

SEQ ID NO: 4938082 - DNA, 23 bp, Homo sapiens
acgatgtgtctgtatttcatgtg

SEQ ID NO: 4938083 - DNA, 18 bp, Homo sapiens
acgcaaaaccactttcct

SEQ ID NO: 4938084 - DNA, 14 bp, Homo sapiens
acgcacacacacaa

SEQ ID NO: 4938085 - DNA, 14 bp, Homo sapiens
acgcacgcacacac

SEQ ID NO: 4938086 - DNA, 15 bp, Homo sapiens
acgcacgcacacaca

SEQ ID NO: 4938087 - DNA, 19 bp, Homo sapiens
acgcagatgatccatgagt

SEQ ID NO: 4938088 - DNA, 14 bp, Homo sapiens
acgcagccctagag

SEQ ID NO: 4938089 - DNA, 18 bp, Homo sapiens
acgcagccctagagcctg

SEQ ID NO: 4938090 - DNA, 21 bp, Homo sapiens
acgcagccctagagcctgcct

SEQ ID NO: 4938091 - DNA, 12 bp, Homo sapiens
acgcagccctgc

SEQ ID NO: 4938092 - DNA, 22 bp, Homo sapiens
acgcagccctgctttgggctgc

SEQ ID NO: 4938093 - DNA, 23 bp, Homo sapiens
acgcagccctgctttgggctgcc

SEQ ID NO: 4938094 - DNA, 13 bp, Homo sapiens
acgccctattttt

SEQ ID NO: 4938095 - DNA, 14 bp, Homo sapiens
acgccctctcccca

SEQ ID NO: 4938096 - DNA, 23 bp, Homo sapiens
acgccctctccccacccctaccc

SEQ ID NO: 4938097 - DNA, 17 bp, Homo sapiens
acgccttcccctcagcc

SEQ ID NO: 4938098 - DNA, 15 bp, Homo sapiens
acgcgcgcacacaca

SEQ ID NO: 4938099 - DNA, 18 bp, Homo sapiens
acgctactataaagagaa

SEQ ID NO: 4938100 - DNA, 19 bp, Homo sapiens
acgctactataaagagaag

SEQ ID NO: 4938101 - DNA, 15 bp, Homo sapiens
acgctggagtgcagt

SEQ ID NO: 4938102 - DNA, 16 bp, Homo sapiens
acgctggagtgcagtg

SEQ ID NO: 4938103 - DNA, 22 bp, Homo sapiens
acgctgttctaatggcacttat

SEQ ID NO: 4938104 - DNA, 13 bp, Homo sapiens
acgctttgattca

SEQ ID NO: 4938105 - DNA, 19 bp, Homo sapiens
acggaatagttggctagga

SEQ ID NO: 4938106 - DNA, 15 bp, Homo sapiens
acggacaataaacct

SEQ ID NO: 4938107 - DNA, 21 bp, Homo sapiens
acggagtcccaccttggctgc

SEQ ID NO: 4938108 - DNA, 23 bp, Homo sapiens
acggagtcccaccttggctgcag

SEQ ID NO: 4938109 - DNA, 22 bp, Homo sapiens
acggccatctctttgtacagga

SEQ ID NO: 4938110 - DNA, 22 bp, Homo sapiens
acggcctgatgctccctcccct

SEQ ID NO: 4938111 - DNA, 19 bp, Homo sapiens
acggcgttgtacctgtagg

SEQ ID NO: 4938112 - DNA, 15 bp, Homo sapiens
acggctaagaggctg

SEQ ID NO: 4938113 - DNA, 15 bp, Homo sapiens
acggctcactgcagc

SEQ ID NO: 4938114 - DNA, 17 bp, Homo sapiens
acggctcactgcagcct

SEQ ID NO: 4938115 - DNA, 18 bp, Homo sapiens
acggctcactgcagcctc

SEQ ID NO: 4938116 - DNA, 15 bp, Homo sapiens
acgggaagcaacctc

SEQ ID NO: 4938117 - DNA, 23 bp, Homo sapiens
acgggagctggggagaggaaaga

SEQ ID NO: 4938118 - DNA, 18 bp, Homo sapiens
acgggcatgggcactccc

SEQ ID NO: 4938119 - DNA, 17 bp, Homo sapiens
acggtcaggtttaacat

SEQ ID NO: 4938120 - DNA, 21 bp, Homo sapiens
acggttcagtttcttctgcgc

SEQ ID NO: 4938121 - DNA, 18 bp, Homo sapiens
acgtcagacttggctcag

SEQ ID NO: 4938122 - DNA, 21 bp, Homo sapiens
acgtccaggttcaacccacag

SEQ ID NO: 4938123 - DNA, 22 bp, Homo sapiens
acgtctgaagcttgactcccaa

SEQ ID NO: 4938124 - DNA, 14 bp, Homo sapiens
acgtctgtcttcac

SEQ ID NO: 4938125 - DNA, 18 bp, Homo sapiens
acgtggaacctctgtctc

SEQ ID NO: 4938126 - DNA, 20 bp, Homo sapiens
acgtggaacctctgtctcat

SEQ ID NO: 4938127 - DNA, 17 bp, Homo sapiens
acgtggacgtttttaat

SEQ ID NO: 4938128 - DNA, 14 bp, Homo sapiens
acgtggagagctgg

SEQ ID NO: 4938129 - DNA, 15 bp, Homo sapiens
acgtggagagctggt

SEQ ID NO: 4938130 - DNA, 16 bp, Homo sapiens
acgtggagagctggtg

SEQ ID NO: 4938131 - DNA, 18 bp, Homo sapiens
acgtggagagctggtgcc

SEQ ID NO: 4938132 - DNA, 22 bp, Homo sapiens
acgtggagcggggtatgaagag

SEQ ID NO: 4938133 - DNA, 11 bp, Homo sapiens
acgtgggagac

SEQ ID NO: 4938134 - DNA, 23 bp, Homo sapiens
acgttactcagggctcctcccag

SEQ ID NO: 4938135 - DNA, 13 bp, Homo sapiens
acgttccacagtt

SEQ ID NO: 4938136 - DNA, 16 bp, Homo sapiens
acgttgagcccctgga

SEQ ID NO: 4938137 - DNA, 15 bp, Homo sapiens
acgtttcctgagaag

SEQ ID NO: 4938138 - DNA, 12 bp, Homo sapiens
acgtttctcatt

SEQ ID NO: 4938139 - DNA, 20 bp, Homo sapiens
acgtttttaatataaagcct

SEQ ID NO: 4938140 - DNA, 13 bp, Homo sapiens
actaaaagacatt

SEQ ID NO: 4938141 - DNA, 15 bp, Homo sapiens
actaaaagacatttg

SEQ ID NO: 4938142 - DNA, 12 bp, Homo sapiens
actaaaatatat

SEQ ID NO: 4938143 - DNA, 14 bp, Homo sapiens
actaaaatatgtct

SEQ ID NO: 4938144 - DNA, 22 bp, Homo sapiens
actaaaattttaggcactctta

SEQ ID NO: 4938145 - DNA, 16 bp, Homo sapiens
actaaagccagcctga

SEQ ID NO: 4938146 - DNA, 22 bp, Homo sapiens
actaaagtatgtaaagtatgta

SEQ ID NO: 4938147 - DNA, 13 bp, Homo sapiens
actaaatgttcta

SEQ ID NO: 4938148 - DNA, 14 bp, Homo sapiens
actaaatgttctat

SEQ ID NO: 4938149 - DNA, 19 bp, Homo sapiens
actaaatttaaatttaaag

SEQ ID NO: 4938150 - DNA, 20 bp, Homo sapiens
actaaatttgatacttatat

SEQ ID NO: 4938151 - DNA, 21 bp, Homo sapiens
actaaatttgatacttatatt

SEQ ID NO: 4938152 - DNA, 14 bp, Homo sapiens
actaaccaaatctc

SEQ ID NO: 4938153 - DNA, 12 bp, Homo sapiens
actaaccacgct

SEQ ID NO: 4938154 - DNA, 13 bp, Homo sapiens
actaaccacgctg

SEQ ID NO: 4938155 - DNA, 23 bp, Homo sapiens
actaaccagggaagctgtccctc

SEQ ID NO: 4938156 - DNA, 21 bp, Homo sapiens
actaaccccaacgcacaggaa

SEQ ID NO: 4938157 - DNA, 21 bp, Homo sapiens
actaactcctgagaaatgtta

SEQ ID NO: 4938158 - DNA, 13 bp, Homo sapiens
actaagaaacttt

SEQ ID NO: 4938159 - DNA, 14 bp, Homo sapiens
actaagaaactttt

SEQ ID NO: 4938160 - DNA, 18 bp, Homo sapiens
actaatggggcggtgaga

SEQ ID NO: 4938161 - DNA, 15 bp, Homo sapiens
actaatgtaaaatga

SEQ ID NO: 4938162 - DNA, 16 bp, Homo sapiens
actaatgtaaaatgat

SEQ ID NO: 4938163 - DNA, 13 bp, Homo sapiens
actaattccacac

SEQ ID NO: 4938164 - DNA, 23 bp, Homo sapiens
actaattccacaccttttattga

SEQ ID NO: 4938165 - DNA, 14 bp, Homo sapiens
actaatttcaaaat

SEQ ID NO: 4938166 - DNA, 16 bp, Homo sapiens
actaatttcaaaatgc

SEQ ID NO: 4938167 - DNA, 20 bp, Homo sapiens
actaatttcaaaatgctttt

SEQ ID NO: 4938168 - DNA, 21 bp, Homo sapiens
actaattttagtattcattct

SEQ ID NO: 4938169 - DNA, 16 bp, Homo sapiens
actacacatttttaaa

SEQ ID NO: 4938170 - DNA, 21 bp, Homo sapiens
actacacatttttaaattgtt

SEQ ID NO: 4938171 - DNA, 16 bp, Homo sapiens
actacactgaggagag

SEQ ID NO: 4938172 - DNA, 19 bp, Homo sapiens
actacagctcttaaatgta

SEQ ID NO: 4938173 - DNA, 18 bp, Homo sapiens
actacatctttaaacagt

SEQ ID NO: 4938174 - DNA, 19 bp, Homo sapiens
actacatgtggtttataga

SEQ ID NO: 4938175 - DNA, 11 bp, Homo sapiens
actacatttat

SEQ ID NO: 4938176 - DNA, 13 bp, Homo sapiens
actacatttatga

SEQ ID NO: 4938177 - DNA, 18 bp, Homo sapiens
actaccctattctctctt

SEQ ID NO: 4938178 - DNA, 16 bp, Homo sapiens
actacccttaattact

SEQ ID NO: 4938179 - DNA, 17 bp, Homo sapiens
actaccttgaaaataag

SEQ ID NO: 4938180 - DNA, 13 bp, Homo sapiens
actactattcaaa

SEQ ID NO: 4938181 - DNA, 15 bp, Homo sapiens
actactctttgattt

SEQ ID NO: 4938182 - DNA, 18 bp, Homo sapiens
actactgggtgtcatttc

SEQ ID NO: 4938183 - DNA, 19 bp, Homo sapiens
actactgggtgtcatttca

SEQ ID NO: 4938184 - DNA, 21 bp, Homo sapiens
actactgggtgtcatttcatt

SEQ ID NO: 4938185 - DNA, 17 bp, Homo sapiens
actacttagcatcctaa

SEQ ID NO: 4938186 - DNA, 21 bp, Homo sapiens
actacttagcatcctaagaaa

SEQ ID NO: 4938187 - DNA, 15 bp, Homo sapiens
actagaactctccat

SEQ ID NO: 4938188 - DNA, 23 bp, Homo sapiens
actagaagggccagtcctgcctg

SEQ ID NO: 4938189 - DNA, 13 bp, Homo sapiens
actagatgatgga

SEQ ID NO: 4938190 - DNA, 17 bp, Homo sapiens
actggggtgggaggtct

SEQ ID NO: 4938191 - DNA, 22 bp, Homo sapiens
actggggtgggaggtcttgcta

SEQ ID NO: 4938192 - DNA, 21 bp, Homo sapiens
actgggtgtcatttcattcca

SEQ ID NO: 4938193 - DNA, 16 bp, Homo sapiens
actggtacttagagtt

SEQ ID NO: 4938194 - DNA, 17 bp, Homo sapiens
actggtacttagagttt

SEQ ID NO: 4938195 - DNA, 20 bp, Homo sapiens
actggtacttagagtttctg

SEQ ID NO: 4938196 - DNA, 23 bp, Homo sapiens
actggtacttagagtttctgttt

SEQ ID NO: 4938197 - DNA, 15 bp, Homo sapiens
actggtcctgtgtgc

SEQ ID NO: 4938198 - DNA, 12 bp, Homo sapiens
actggtggcccg

SEQ ID NO: 4938199 - DNA, 14 bp, Homo sapiens
actggtgtgacctg

SEQ ID NO: 4938200 - DNA, 17 bp, Homo sapiens
actggtgtgacctgagg

SEQ ID NO: 4938201 - DNA, 21 bp, Homo sapiens
actggtgtgacctgagggcag

SEQ ID NO: 4938202 - DNA, 16 bp, Homo sapiens
actggttccttcttcc

SEQ ID NO: 4938203 - DNA, 17 bp, Homo sapiens
actggtttacaggccct

SEQ ID NO: 4938204 - DNA, 22 bp, Homo sapiens
actggtttacaggccctgctcc

SEQ ID NO: 4938205 - DNA, 21 bp, Homo sapiens
actgtaagactcattccctag

SEQ ID NO: 4938206 - DNA, 13 bp, Homo sapiens
actgtaataatac

SEQ ID NO: 4938207 - DNA, 17 bp, Homo sapiens
actgtaataatacctca

SEQ ID NO: 4938208 - DNA, 22 bp, Homo sapiens
actgtaatcttatttaggaagt

SEQ ID NO: 4938209 - DNA, 14 bp, Homo sapiens
actgtacatttaaa

SEQ ID NO: 4938210 - DNA, 15 bp, Homo sapiens
actgtacatttaaaa

SEQ ID NO: 4938211 - DNA, 17 bp, Homo sapiens
actgtacccaaatggaa

SEQ ID NO: 4938212 - DNA, 14 bp, Homo sapiens
actgtactaattct

SEQ ID NO: 4938213 - DNA, 13 bp, Homo sapiens
actgtactcctcc

SEQ ID NO: 4938214 - DNA, 15 bp, Homo sapiens
actgtagatgatgta

SEQ ID NO: 4938215 - DNA, 12 bp, Homo sapiens
actgtatgctca

SEQ ID NO: 4938216 - DNA, 13 bp, Homo sapiens
actgtatttgtat

SEQ ID NO: 4938217 - DNA, 14 bp, Homo sapiens
actgtcaccctcca

SEQ ID NO: 4938218 - DNA, 15 bp, Homo sapiens
actgtcactgttcct

SEQ ID NO: 4938219 - DNA, 14 bp, Homo sapiens
actgtccagagagc

SEQ ID NO: 4938220 - DNA, 18 bp, Homo sapiens
actgtcctctcccctcca

SEQ ID NO: 4938221 - DNA, 19 bp, Homo sapiens
actgtctcaagagggcact

SEQ ID NO: 4938222 - DNA, 23 bp, Homo sapiens
actgtctcaagagggcactggtg

SEQ ID NO: 4938223 - DNA, 18 bp, Homo sapiens
actgtctgattggcttgt

SEQ ID NO: 4938224 - DNA, 13 bp, Homo sapiens
actgtctggtttt

SEQ ID NO: 4938225 - DNA, 22 bp, Homo sapiens
actgtctttggaaaaatgtttg

SEQ ID NO: 4938226 - DNA, 19 bp, Homo sapiens
actgtgcatagtgctggga

SEQ ID NO: 4938227 - DNA, 16 bp, Homo sapiens
actgtgccatgtgcca

SEQ ID NO: 4938228 - DNA, 19 bp, Homo sapiens
actgtgcctttgcaaatca

SEQ ID NO: 4938229 - DNA, 15 bp, Homo sapiens
actgtgctactgtct

SEQ ID NO: 4938230 - DNA, 22 bp, Homo sapiens
actgtgctactgtctttggaaa

SEQ ID NO: 4938231 - DNA, 12 bp, Homo sapiens
actgtggaggaa

SEQ ID NO: 4938232 - DNA, 15 bp, Homo sapiens
actgtggaggaagga

SEQ ID NO: 4938233 - DNA, 17 bp, Homo sapiens
actgtggaggaaggatt

SEQ ID NO: 4938234 - DNA, 18 bp, Homo sapiens
actgtggaggaaggattg

SEQ ID NO: 4938235 - DNA, 23 bp, Homo sapiens
actgtggccgttatctggaagta

SEQ ID NO: 4938236 - DNA, 12 bp, Homo sapiens
actgtgtataga

SEQ ID NO: 4938237 - DNA, 13 bp, Homo sapiens
actgtgtggaact

SEQ ID NO: 4938238 - DNA, 16 bp, Homo sapiens
actgtgtgtgtgaatg

SEQ ID NO: 4938239 - DNA, 18 bp, Homo sapiens
actgtgtgtgtgaatgaa

SEQ ID NO: 4938240 - DNA, 17 bp, Homo sapiens
actgtgttgtattaaca

SEQ ID NO: 4938241 - DNA, 21 bp, Homo sapiens
actgtgttgtattaacaaaag

SEQ ID NO: 4938242 - DNA, 18 bp, Homo sapiens
actgttaaccatttaagt

SEQ ID NO: 4938243 - DNA, 17 bp, Homo sapiens
actgttaatagttcagg

SEQ ID NO: 4938244 - DNA, 14 bp, Homo sapiens
actgttagcactgt

SEQ ID NO: 4938245 - DNA, 16 bp, Homo sapiens
actgttagcactgttg

SEQ ID NO: 4938246 - DNA, 18 bp, Homo sapiens
actgttagcactgttgat

SEQ ID NO: 4938247 - DNA, 21 bp, Homo sapiens
actgttagctttttaaaacat

SEQ ID NO: 4938248 - DNA, 23 bp, Homo sapiens
actgttatgaaataaagaaattg

SEQ ID NO: 4938249 - DNA, 13 bp, Homo sapiens
actgttctaaagc

SEQ ID NO: 4938250 - DNA, 14 bp, Homo sapiens
actgttctaaagct

SEQ ID NO: 4938251 - DNA, 16 bp, Homo sapiens
actgttctgtgtcttt

SEQ ID NO: 4938252 - DNA, 11 bp, Homo sapiens
actgttcttgc

SEQ ID NO: 4938253 - DNA, 14 bp, Homo sapiens
actgttcttgctgc

SEQ ID NO: 4938254 - DNA, 23 bp, Homo sapiens
actgttcttgctgctagaacttt

SEQ ID NO: 4938255 - DNA, 15 bp, Homo sapiens
actgttgatgtatct

SEQ ID NO: 4938256 - DNA, 20 bp, Homo sapiens
actgttgatgtatctgagtt

SEQ ID NO: 4938257 - DNA, 18 bp, Homo sapiens
actgttgcccaggctggc

SEQ ID NO: 4938258 - DNA, 20 bp, Homo sapiens
actgttgtaactaggctcag

SEQ ID NO: 4938259 - DNA, 16 bp, Homo sapiens
actgtttctcttgagc

SEQ ID NO: 4938260 - DNA, 17 bp, Homo sapiens
actgtttctcttgagct

SEQ ID NO: 4938261 - DNA, 22 bp, Homo sapiens
actgtttctcttgagctggcct

SEQ ID NO: 4938262 - DNA, 14 bp, Homo sapiens
actgtttcttgctt

SEQ ID NO: 4938263 - DNA, 19 bp, Homo sapiens
actgtttcttgcttgtacc

SEQ ID NO: 4938264 - DNA, 21 bp, Homo sapiens
actgtttcttgcttgtacctc

SEQ ID NO: 4938265 - DNA, 23 bp, Homo sapiens
acttaaaataggggatatttaag

SEQ ID NO: 4938266 - DNA, 22 bp, Homo sapiens
acttaaaatattcctgcatttg

SEQ ID NO: 4938267 - DNA, 14 bp, Homo sapiens
acttaacatattta

SEQ ID NO: 4938268 - DNA, 16 bp, Homo sapiens
acttaactttaactga

SEQ ID NO: 4938269 - DNA, 12 bp, Homo sapiens
acttaagagaaa

SEQ ID NO: 4938270 - DNA, 14 bp, Homo sapiens
acttaagagaaatg

SEQ ID NO: 4938271 - DNA, 17 bp, Homo sapiens
acttaagagaaatggca

SEQ ID NO: 4938272 - DNA, 19 bp, Homo sapiens
acttaagcaaaagaaaaag

SEQ ID NO: 4938273 - DNA, 15 bp, Homo sapiens
acttaagcacaagca

SEQ ID NO: 4938274 - DNA, 21 bp, Homo sapiens
acttaatactaccttgaaaat

SEQ ID NO: 4938275 - DNA, 12 bp, Homo sapiens
acttactatttt

SEQ ID NO: 4938276 - DNA, 13 bp, Homo sapiens
acttactctaaga

SEQ ID NO: 4938277 - DNA, 14 bp, Homo sapiens
acttactctaagat

SEQ ID NO: 4938278 - DNA, 16 bp, Homo sapiens
acttactctaagatct

SEQ ID NO: 4938279 - DNA, 19 bp, Homo sapiens
acttagaaagcaggggcta

SEQ ID NO: 4938280 - DNA, 22 bp, Homo sapiens
acttagagtttctgtttgattc

SEQ ID NO: 4938281 - DNA, 19 bp, Homo sapiens
acttataaatcatattgat

SEQ ID NO: 4938282 - DNA, 20 bp, Homo sapiens
acttataaatcatattgatg

SEQ ID NO: 4938283 - DNA, 14 bp, Homo sapiens
acttatagtacatg

SEQ ID NO: 4938284 - DNA, 18 bp, Homo sapiens
acttatagtacatgataa

SEQ ID NO: 4938285 - DNA, 12 bp, Homo sapiens
acttatattgaa

SEQ ID NO: 4938286 - DNA, 18 bp, Homo sapiens
acttatattgaagacaat

SEQ ID NO: 4938287 - DNA, 19 bp, Homo sapiens
acttatattttcgtatgaa

SEQ ID NO: 4938288 - DNA, 19 bp, Homo sapiens
acttatcctaaaacaaata

SEQ ID NO: 4938289 - DNA, 16 bp, Homo sapiens
acttatctctctgtgc

SEQ ID NO: 4938290 - DNA, 13 bp, Homo sapiens
acttatgtagata

SEQ ID NO: 4938291 - DNA, 19 bp, Homo sapiens
acttatgtagatatttggc

SEQ ID NO: 4938292 - DNA, 20 bp, Homo sapiens
acttatgtagatatttggct

SEQ ID NO: 4938293 - DNA, 21 bp, Homo sapiens
acttatgtagatatttggctt

SEQ ID NO: 4938294 - DNA, 20 bp, Homo sapiens
acttattacaatttgttcat

SEQ ID NO: 4938295 - DNA, 15 bp, Homo sapiens
acttattgctgattt

SEQ ID NO: 4938296 - DNA, 14 bp, Homo sapiens
acttatttttgaca

SEQ ID NO: 4938297 - DNA, 16 bp, Homo sapiens
acttatttttgacagt

SEQ ID NO: 4938298 - DNA, 13 bp, Homo sapiens
acttcaaggccca

SEQ ID NO: 4938299 - DNA, 15 bp, Homo sapiens
acttcaatgatagta

SEQ ID NO: 4938300 - DNA, 13 bp, Homo sapiens
agaagacactgat

SEQ ID NO: 4938301 - DNA, 21 bp, Homo sapiens
agaagacactgatgggcaacc

SEQ ID NO: 4938302 - DNA, 16 bp, Homo sapiens
agaagagaagctgctg

SEQ ID NO: 4938303 - DNA, 13 bp, Homo sapiens
agaagagaggaga

SEQ ID NO: 4938304 - DNA, 15 bp, Homo sapiens
agaagagaggagagg

SEQ ID NO: 4938305 - DNA, 21 bp, Homo sapiens
agaagagaggagaggagagag

SEQ ID NO: 4938306 - DNA, 13 bp, Homo sapiens
agaagataattgt

SEQ ID NO: 4938307 - DNA, 22 bp, Homo sapiens
agaagataattgttgaaatttt

SEQ ID NO: 4938308 - DNA, 13 bp, Homo sapiens
agaagatcccctc

SEQ ID NO: 4938309 - DNA, 14 bp, Homo sapiens
agaagatgctccag

SEQ ID NO: 4938310 - DNA, 14 bp, Homo sapiens
agaagcattccttc

SEQ ID NO: 4938311 - DNA, 15 bp, Homo sapiens
agaagcattccttct

SEQ ID NO: 4938312 - DNA, 19 bp, Homo sapiens
agaagcattccttctttga

SEQ ID NO: 4938313 - DNA, 22 bp, Homo sapiens
agaagcattccttctttgataa

SEQ ID NO: 4938314 - DNA, 10 bp, Homo sapiens
agaagcattt

SEQ ID NO: 4938315 - DNA, 13 bp, Homo sapiens
agaagcatttgta

SEQ ID NO: 4938316 - DNA, 15 bp, Homo sapiens
agaagcatttgtatt

SEQ ID NO: 4938317 - DNA, 18 bp, Homo sapiens
agaagccgggaacagaca

SEQ ID NO: 4938318 - DNA, 12 bp, Homo sapiens
agaagcctctgg

SEQ ID NO: 4938319 - DNA, 14 bp, Homo sapiens
agaagcctctggct

SEQ ID NO: 4938320 - DNA, 22 bp, Homo sapiens
agaagctgctccaggcctgcag

SEQ ID NO: 4938321 - DNA, 16 bp, Homo sapiens
agaagctgctgaccaa

SEQ ID NO: 4938322 - DNA, 20 bp, Homo sapiens
agaagctgttgtacatttat

SEQ ID NO: 4938323 - DNA, 23 bp, Homo sapiens
agaagctgttgtacatttatgat

SEQ ID NO: 4938324 - DNA, 16 bp, Homo sapiens
agaagcttcagaagtt

SEQ ID NO: 4938325 - DNA, 18 bp, Homo sapiens
agaagcttctaataaatt

SEQ ID NO: 4938326 - DNA, 19 bp, Homo sapiens
agaaggagagaaagtgggt

SEQ ID NO: 4938327 - DNA, 20 bp, Homo sapiens
agaaggagtcagaaactgtt

SEQ ID NO: 4938328 - DNA, 14 bp, Homo sapiens
agaaggatgaatga

SEQ ID NO: 4938329 - DNA, 21 bp, Homo sapiens
agaaggatgaatgaggtccca

SEQ ID NO: 4938330 - DNA, 15 bp, Homo sapiens
agaaggcaaaaatgt

SEQ ID NO: 4938331 - DNA, 17 bp, Homo sapiens
agaagggctcctgcagg

SEQ ID NO: 4938332 - DNA, 15 bp, Homo sapiens
agaaggggaagcact

SEQ ID NO: 4938333 - DNA, 13 bp, Homo sapiens
agaagtcatgaag

SEQ ID NO: 4938334 - DNA, 19 bp, Homo sapiens
agaagtgcatttctgaata

SEQ ID NO: 4938335 - DNA, 20 bp, Homo sapiens
agaagttgaggattgttgaa

SEQ ID NO: 4938336 - DNA, 14 bp, Homo sapiens
agaagtttcccttc

SEQ ID NO: 4938337 - DNA, 19 bp, Homo sapiens
agaagtttgtccatttgta

SEQ ID NO: 4938338 - DNA, 16 bp, Homo sapiens
agaataaggcaggcat

SEQ ID NO: 4938339 - DNA, 13 bp, Homo sapiens
agaataatctttg

SEQ ID NO: 4938340 - DNA, 16 bp, Homo sapiens
agaatagatgctgact

SEQ ID NO: 4938341 - DNA, 19 bp, Homo sapiens
agaatataggtctcttctc

SEQ ID NO: 4938342 - DNA, 20 bp, Homo sapiens
agaatatatttatttaaagc

SEQ ID NO: 4938343 - DNA, 23 bp, Homo sapiens
agaatatatttatttaaagcatt

SEQ ID NO: 4938344 - DNA, 16 bp, Homo sapiens
agaatccacatttcta

SEQ ID NO: 4938345 - DNA, 17 bp, Homo sapiens
agaatccacatttctaa

SEQ ID NO: 4938346 - DNA, 23 bp, Homo sapiens
agaatcccagccggccaatggaa

SEQ ID NO: 4938347 - DNA, 13 bp, Homo sapiens
agaatctattttc

SEQ ID NO: 4938348 - DNA, 17 bp, Homo sapiens
agaatctgcaattcaaa

SEQ ID NO: 4938349 - DNA, 18 bp, Homo sapiens
agaatgaaagggcccaga

SEQ ID NO: 4938350 - DNA, 20 bp, Homo sapiens
agaatgatgataacagaact

SEQ ID NO: 4938351 - DNA, 16 bp, Homo sapiens
agaatgatttttagat

SEQ ID NO: 4938352 - DNA, 22 bp, Homo sapiens
agaatgcacagatatactttgt

SEQ ID NO: 4938353 - DNA, 13 bp, Homo sapiens
agaatgctgtaca

SEQ ID NO: 4938354 - DNA, 14 bp, Homo sapiens
agaatgctgtacat

SEQ ID NO: 4938355 - DNA, 15 bp, Homo sapiens
agaatggagaggaac

SEQ ID NO: 4938356 - DNA, 18 bp, Homo sapiens
agaatggataaaataatg

SEQ ID NO: 4938357 - DNA, 22 bp, Homo sapiens
agaatggcccagtcctctccca

SEQ ID NO: 4938358 - DNA, 23 bp, Homo sapiens
agaatggttgccttaaagaaagt

SEQ ID NO: 4938359 - DNA, 17 bp, Homo sapiens
agaatgtatctgtgaag

SEQ ID NO: 4938360 - DNA, 16 bp, Homo sapiens
agaatgttggtttact

SEQ ID NO: 4938361 - DNA, 17 bp, Homo sapiens
agaatgttggtttactt

SEQ ID NO: 4938362 - DNA, 23 bp, Homo sapiens
agaatgttggtttactttcaaat

SEQ ID NO: 4938363 - DNA, 18 bp, Homo sapiens
agaattatttttaaaaag

SEQ ID NO: 4938364 - DNA, 20 bp, Homo sapiens
agaattcaaactggggcctc

SEQ ID NO: 4938365 - DNA, 18 bp, Homo sapiens
agaattgtgcaaatggaa

SEQ ID NO: 4938366 - DNA, 20 bp, Homo sapiens
agaattttaggaacttcaga

SEQ ID NO: 4938367 - DNA, 16 bp, Homo sapiens
agaatttttttgtctt

SEQ ID NO: 4938368 - DNA, 13 bp, Homo sapiens
agacaaaatttta

SEQ ID NO: 4938369 - DNA, 20 bp, Homo sapiens
agacaaaattttagtccaaa

SEQ ID NO: 4938370 - DNA, 15 bp, Homo sapiens
agacaaatatttgga

SEQ ID NO: 4938371 - DNA, 13 bp, Homo sapiens
agacaacagaagt

SEQ ID NO: 4938372 - DNA, 14 bp, Homo sapiens
agacaacagaagtc

SEQ ID NO: 4938373 - DNA, 19 bp, Homo sapiens
agacaagatattgtacata

SEQ ID NO: 4938374 - DNA, 20 bp, Homo sapiens
agacaagatattgtacataa

SEQ ID NO: 4938375 - DNA, 23 bp, Homo sapiens
agacaattgaggtaagttttttg

SEQ ID NO: 4938376 - DNA, 13 bp, Homo sapiens
agacaatttgata

SEQ ID NO: 4938377 - DNA, 22 bp, Homo sapiens
agacaatttgatacataataaa

SEQ ID NO: 4938378 - DNA, 23 bp, Homo sapiens
agacaatttgatacataataaaa

SEQ ID NO: 4938379 - DNA, 14 bp, Homo sapiens
agacacaactattt

SEQ ID NO: 4938380 - DNA, 13 bp, Homo sapiens
agacacacacaca

SEQ ID NO: 4938381 - DNA, 16 bp, Homo sapiens
agacacacacacgcac

SEQ ID NO: 4938382 - DNA, 20 bp, Homo sapiens
agacacacacacgcacgcac

SEQ ID NO: 4938383 - DNA, 12 bp, Homo sapiens
agacacagactg

SEQ ID NO: 4938384 - DNA, 14 bp, Homo sapiens
agacacagataata

SEQ ID NO: 4938385 - DNA, 13 bp, Homo sapiens
agacacaggcccg

SEQ ID NO: 4938386 - DNA, 17 bp, Homo sapiens
agacacaggcccggctc

SEQ ID NO: 4938387 - DNA, 19 bp, Homo sapiens
agacacaggcccggctcca

SEQ ID NO: 4938388 - DNA, 12 bp, Homo sapiens
agacaccaaagt

SEQ ID NO: 4938389 - DNA, 14 bp, Homo sapiens
agacaccaaagttc

SEQ ID NO: 4938390 - DNA, 17 bp, Homo sapiens
agacaccaaagttctaa

SEQ ID NO: 4938391 - DNA, 13 bp, Homo sapiens
agacaccagagca

SEQ ID NO: 4938392 - DNA, 16 bp, Homo sapiens
agacactcaaatatga

SEQ ID NO: 4938393 - DNA, 13 bp, Homo sapiens
agacactggcccc

SEQ ID NO: 4938394 - DNA, 17 bp, Homo sapiens
agacagaagtctcctca

SEQ ID NO: 4938395 - DNA, 15 bp, Homo sapiens
agacagaatgtatct

SEQ ID NO: 4938396 - DNA, 19 bp, Homo sapiens
agacagaatgtatctgtga

SEQ ID NO: 4938397 - DNA, 20 bp, Homo sapiens
agacagaatgtatctgtgaa

SEQ ID NO: 4938398 - DNA, 15 bp, Homo sapiens
agacagacacacaca

SEQ ID NO: 4938399 - DNA, 19 bp, Homo sapiens
agacagagaccctctgcca

SEQ ID NO: 4938400 - DNA, 22 bp, Homo sapiens
agacagagaccctctgccacca

SEQ ID NO: 4938401 - DNA, 11 bp, Homo sapiens
agacagagtct

SEQ ID NO: 4938402 - DNA, 20 bp, Homo sapiens
agacagagtctcactgttgc

SEQ ID NO: 4938403 - DNA, 16 bp, Homo sapiens
agacagatgccccaga

SEQ ID NO: 4938404 - DNA, 12 bp, Homo sapiens
agacagccccag

SEQ ID NO: 4938405 - DNA, 13 bp, Homo sapiens
agacagccccaga

SEQ ID NO: 4938406 - DNA, 19 bp, Homo sapiens
agacagccccagagcaggg

SEQ ID NO: 4938407 - DNA, 20 bp, Homo sapiens
agacagctgatacttcattt

SEQ ID NO: 4938408 - DNA, 23 bp, Homo sapiens
agacagggtttcaccatgttgcc

SEQ ID NO: 4938409 - DNA, 21 bp, Homo sapiens
agacagggttttgccatgttg

SEQ ID NO: 4938410 - DNA, 22 bp, Homo sapiens
agacaggtccctccccttctct

SEQ ID NO: 4938411 - DNA, 14 bp, Homo sapiens
agacagtttcttag

SEQ ID NO: 4938412 - DNA, 15 bp, Homo sapiens
agacagtttcttagc

SEQ ID NO: 4938413 - DNA, 21 bp, Homo sapiens
agacagtttcttagcttttta

SEQ ID NO: 4938414 - DNA, 15 bp, Homo sapiens
agacagtttgtaaat

SEQ ID NO: 4938415 - DNA, 16 bp, Homo sapiens
agacagtttgtaaatg

SEQ ID NO: 4938416 - DNA, 19 bp, Homo sapiens
agacagtttgtaaatgtta

SEQ ID NO: 4938417 - DNA, 17 bp, Homo sapiens
agacataacgtttttcc

SEQ ID NO: 4938418 - DNA, 16 bp, Homo sapiens
agacatacgaaacaca

SEQ ID NO: 4938419 - DNA, 20 bp, Homo sapiens
agacatcatgaattttacat

SEQ ID NO: 4938420 - DNA, 21 bp, Homo sapiens
agacatccatgtttgtaaaac

SEQ ID NO: 4938421 - DNA, 16 bp, Homo sapiens
agacatctctgcaccc

SEQ ID NO: 4938422 - DNA, 15 bp, Homo sapiens
agacatggaggttct

SEQ ID NO: 4938423 - DNA, 16 bp, Homo sapiens
agacatggaggttcta

SEQ ID NO: 4938424 - DNA, 20 bp, Homo sapiens
agacatggctttcagaaaac

SEQ ID NO: 4938425 - DNA, 15 bp, Homo sapiens
agacatgtgtcaaca

SEQ ID NO: 4938426 - DNA, 22 bp, Homo sapiens
agacatttcttttctttttaca

SEQ ID NO: 4938427 - DNA, 13 bp, Homo sapiens
agaccaaacttca

SEQ ID NO: 4938428 - DNA, 24 bp, Homo sapiens
agaccaaacttcactctgggcaca

SEQ ID NO: 4938429 - DNA, 11 bp, Homo sapiens
agaccaaggaa

SEQ ID NO: 4938430 - DNA, 12 bp, Homo sapiens
agaccaaggaac

SEQ ID NO: 4938431 - DNA, 13 bp, Homo sapiens
agaccacatcttt

SEQ ID NO: 4938432 - DNA, 15 bp, Homo sapiens
agaccagggagcctt

SEQ ID NO: 4938433 - DNA, 15 bp, Homo sapiens
agaccatttaacatg

SEQ ID NO: 4938434 - DNA, 16 bp, Homo sapiens
agaccatttaacatgc

SEQ ID NO: 4938435 - DNA, 14 bp, Homo sapiens
agacccccacacct

SEQ ID NO: 4938436 - DNA, 21 bp, Homo sapiens
agacccctggcttttcactgc

SEQ ID NO: 4938437 - DNA, 21 bp, Homo sapiens
agaccctgcaaacagaacagg

SEQ ID NO: 4938438 - DNA, 14 bp, Homo sapiens
agaccctggtgcct

SEQ ID NO: 4938439 - DNA, 18 bp, Homo sapiens
agaccctggtgcctggct

SEQ ID NO: 4938440 - DNA, 19 bp, Homo sapiens
agaccctggtgcctggctc

SEQ ID NO: 4938441 - DNA, 15 bp, Homo sapiens
agacctactgttcta

SEQ ID NO: 4938442 - DNA, 21 bp, Homo sapiens
agacctactgttctaaagctc

SEQ ID NO: 4938443 - DNA, 17 bp, Homo sapiens
agacctccccagcccct

SEQ ID NO: 4938444 - DNA, 23 bp, Homo sapiens
agacctccccagcccctagccca

SEQ ID NO: 4938445 - DNA, 15 bp, Homo sapiens
agacctctccttcct

SEQ ID NO: 4938446 - DNA, 15 bp, Homo sapiens
agacctgaattcttt

SEQ ID NO: 4938447 - DNA, 22 bp, Homo sapiens
agacctgctttttgaaatgaaa

SEQ ID NO: 4938448 - DNA, 11 bp, Homo sapiens
agaccttaccc

SEQ ID NO: 4938449 - DNA, 17 bp, Homo sapiens
agacgatttgtcagtta

SEQ ID NO: 4938450 - DNA, 19 bp, Homo sapiens
agacggagtcccaccttgg

SEQ ID NO: 4938451 - DNA, 18 bp, Homo sapiens
agacgtggaacctctgtc

SEQ ID NO: 4938452 - DNA, 20 bp, Homo sapiens
agacgtggaacctctgtctc

SEQ ID NO: 4938453 - DNA, 14 bp, Homo sapiens
agactaatttaaaa

SEQ ID NO: 4938454 - DNA, 15 bp, Homo sapiens
agactacacaggatg

SEQ ID NO: 4938455 - DNA, 15 bp, Homo sapiens
agactatatacatgt

SEQ ID NO: 4938456 - DNA, 22 bp, Homo sapiens
agactcaaggtggtcagtaaat

SEQ ID NO: 4938457 - DNA, 14 bp, Homo sapiens
agactcacaggaag

SEQ ID NO: 4938458 - DNA, 16 bp, Homo sapiens
agactcacaggaagga

SEQ ID NO: 4938459 - DNA, 22 bp, Homo sapiens
agactcacaggaaggaggagcc

SEQ ID NO: 4938460 - DNA, 20 bp, Homo sapiens
agactcaggccaagaaacgt

SEQ ID NO: 4938461 - DNA, 23 bp, Homo sapiens
agactcaggccaagaaacgtctt

SEQ ID NO: 4938462 - DNA, 17 bp, Homo sapiens
agactcatcttactgta

SEQ ID NO: 4938463 - DNA, 18 bp, Homo sapiens
agactcatcttactgtac

SEQ ID NO: 4938464 - DNA, 18 bp, Homo sapiens
agactcattcttctgtac

SEQ ID NO: 4938465 - DNA, 16 bp, Homo sapiens
agactcccatgaagcc

SEQ ID NO: 4938466 - DNA, 18 bp, Homo sapiens
agactcccatgaagcctt

SEQ ID NO: 4938467 - DNA, 23 bp, Homo sapiens
agactcccatgaagccttttgaa

SEQ ID NO: 4938468 - DNA, 19 bp, Homo sapiens
agactctacagaggccatg

SEQ ID NO: 4938469 - DNA, 23 bp, Homo sapiens
agactctagacaagatattgtac

SEQ ID NO: 4938470 - DNA, 16 bp, Homo sapiens
agactctagagtccaa

SEQ ID NO: 4938471 - DNA, 20 bp, Homo sapiens
agactctagagtccaaggtt

SEQ ID NO: 4938472 - DNA, 15 bp, Homo sapiens
agactctattctcaa

SEQ ID NO: 4938473 - DNA, 16 bp, Homo sapiens
agactgaggacaaagt

SEQ ID NO: 4938474 - DNA, 17 bp, Homo sapiens
agactgaggacaaagtg

SEQ ID NO: 4938475 - DNA, 23 bp, Homo sapiens
agactgcgatttgtcccaggtcc

SEQ ID NO: 4938476 - DNA, 14 bp, Homo sapiens
agactggaaaaaat

SEQ ID NO: 4938477 - DNA, 17 bp, Homo sapiens
agactggaaaaaatgag

SEQ ID NO: 4938478 - DNA, 18 bp, Homo sapiens
agactggaaaaaatgagc

SEQ ID NO: 4938479 - DNA, 19 bp, Homo sapiens
agactggaagcacagcttc

SEQ ID NO: 4938480 - DNA, 19 bp, Homo sapiens
agactggaagttcatacct

SEQ ID NO: 4938481 - DNA, 14 bp, Homo sapiens
agactgtctcaaga

SEQ ID NO: 4938482 - DNA, 18 bp, Homo sapiens
agactgtgacaactgtct

SEQ ID NO: 4938483 - DNA, 15 bp, Homo sapiens
agacttactattaca

SEQ ID NO: 4938484 - DNA, 14 bp, Homo sapiens
agacttccttgaga

SEQ ID NO: 4938485 - DNA, 16 bp, Homo sapiens
agacttgccagagccg

SEQ ID NO: 4938486 - DNA, 18 bp, Homo sapiens
agacttgtatgaaagatg

SEQ ID NO: 4938487 - DNA, 18 bp, Homo sapiens
agagaaacaataaagaga

SEQ ID NO: 4938488 - DNA, 15 bp, Homo sapiens
agagaaagaaaatga

SEQ ID NO: 4938489 - DNA, 18 bp, Homo sapiens
agagaaagcacgtgtctc

SEQ ID NO: 4938490 - DNA, 14 bp, Homo sapiens
agagaaagccaggc

SEQ ID NO: 4938491 - DNA, 19 bp, Homo sapiens
agagaaagccaggcaggta

SEQ ID NO: 4938492 - DNA, 20 bp, Homo sapiens
agagaaaggcctgcacacaa

SEQ ID NO: 4938493 - DNA, 24 bp, Homo sapiens
agagaaagtgggtgagatgctgga

SEQ ID NO: 4938494 - DNA, 11 bp, Homo sapiens
agagaaatctc

SEQ ID NO: 4938495 - DNA, 12 bp, Homo sapiens
agagaaattctg

SEQ ID NO: 4938496 - DNA, 15 bp, Homo sapiens
agagaaccgagcaaa

SEQ ID NO: 4938497 - DNA, 15 bp, Homo sapiens
agagaagaagaaaaa

SEQ ID NO: 4938498 - DNA, 14 bp, Homo sapiens
agagaagctgctga

SEQ ID NO: 4938499 - DNA, 14 bp, Homo sapiens
agagaatgcacaga

SEQ ID NO: 4938500 - DNA, 19 bp, Homo sapiens
agagaatgcacagatatac

SEQ ID NO: 4938501 - DNA, 23 bp, Homo sapiens
agagaatttctaccatttcagag

SEQ ID NO: 4938502 - DNA, 13 bp, Homo sapiens
agagacaaaatat

SEQ ID NO: 4938503 - DNA, 20 bp, Homo sapiens
agagacaaacacctcccagg

SEQ ID NO: 4938504 - DNA, 21 bp, Homo sapiens
agagactcccatgaagccttt

SEQ ID NO: 4938505 - DNA, 16 bp, Homo sapiens
agagacttttaatcag

SEQ ID NO: 4938506 - DNA, 19 bp, Homo sapiens
agagacttttaatcagaca

SEQ ID NO: 4938507 - DNA, 13 bp, Homo sapiens
agagagaaaaaaa

SEQ ID NO: 4938508 - DNA, 19 bp, Homo sapiens
agagagaaaaaaaaaatag

SEQ ID NO: 4938509 - DNA, 14 bp, Homo sapiens
agagagaaagccag

SEQ ID NO: 4938510 - DNA, 12 bp, Homo sapiens
agagagaaatct

SEQ ID NO: 4938511 - DNA, 13 bp, Homo sapiens
agagagaaattct

SEQ ID NO: 4938512 - DNA, 14 bp, Homo sapiens
agagagaaattctg

SEQ ID NO: 4938513 - DNA, 21 bp, Homo sapiens
agagagaaattctgttaaaat

SEQ ID NO: 4938514 - DNA, 16 bp, Homo sapiens
agagagaccacttttc

SEQ ID NO: 4938515 - DNA, 10 bp, Homo sapiens
agagagagag

SEQ ID NO: 4938516 - DNA, 17 bp, Homo sapiens
agagagatgggagctcc

SEQ ID NO: 4938517 - DNA, 18 bp, Homo sapiens
agagagatgggagctcct

SEQ ID NO: 4938518 - DNA, 19 bp, Homo sapiens
agagagatgggagctcctc

SEQ ID NO: 4938519 - DNA, 19 bp, Homo sapiens
agagagccattttgtgaat

SEQ ID NO: 4938520 - DNA, 13 bp, Homo sapiens
agcagtccatgca

SEQ ID NO: 4938521 - DNA, 22 bp, Homo sapiens
agcagtgagaaaaagctcctgt

SEQ ID NO: 4938522 - DNA, 17 bp, Homo sapiens
agcagtgggctcctggc

SEQ ID NO: 4938523 - DNA, 23 bp, Homo sapiens
agcagttgagtcgtcatcacttt

SEQ ID NO: 4938524 - DNA, 22 bp, Homo sapiens
agcatacatgcaaaaagaaatg

SEQ ID NO: 4938525 - DNA, 20 bp, Homo sapiens
agcatagcttattattgaag

SEQ ID NO: 4938526 - DNA, 21 bp, Homo sapiens
agcatattcttttctgcaaaa

SEQ ID NO: 4938527 - DNA, 12 bp, Homo sapiens
agcatcactccc

SEQ ID NO: 4938528 - DNA, 14 bp, Homo sapiens
agcatcatcctgca

SEQ ID NO: 4938529 - DNA, 20 bp, Homo sapiens
agcatccctgaggagccagg

SEQ ID NO: 4938530 - DNA, 21 bp, Homo sapiens
agcatcctaagaaatatgtga

SEQ ID NO: 4938531 - DNA, 23 bp, Homo sapiens
agcatcctaagaaatatgtgaga

SEQ ID NO: 4938532 - DNA, 19 bp, Homo sapiens
agcatcctgagccccgccc

SEQ ID NO: 4938533 - DNA, 17 bp, Homo sapiens
agcatcctggcacccgg

SEQ ID NO: 4938534 - DNA, 22 bp, Homo sapiens
agcatcctggcacccggcccct

SEQ ID NO: 4938535 - DNA, 23 bp, Homo sapiens
agcatcctggcacccggcccctg

SEQ ID NO: 4938536 - DNA, 20 bp, Homo sapiens
agcatctcagcctaccatga

SEQ ID NO: 4938537 - DNA, 17 bp, Homo sapiens
agcatctcttgaggcca

SEQ ID NO: 4938538 - DNA, 22 bp, Homo sapiens
agcatgcttgtgaaaatgtgtt

SEQ ID NO: 4938539 - DNA, 23 bp, Homo sapiens
agcatgcttgtgaaaatgtgttc

SEQ ID NO: 4938540 - DNA, 23 bp, Homo sapiens
agcatggactaaccccaacgcac

SEQ ID NO: 4938541 - DNA, 19 bp, Homo sapiens
agcatgggcctggccacct

SEQ ID NO: 4938542 - DNA, 17 bp, Homo sapiens
agcatggtccctgcctt

SEQ ID NO: 4938543 - DNA, 16 bp, Homo sapiens
agcatgtgccctcctg

SEQ ID NO: 4938544 - DNA, 14 bp, Homo sapiens
agcatgtttcatgt

SEQ ID NO: 4938545 - DNA, 16 bp, Homo sapiens
agcatgttttgtatac

SEQ ID NO: 4938546 - DNA, 17 bp, Homo sapiens
agcatgttttgtataca

SEQ ID NO: 4938547 - DNA, 16 bp, Homo sapiens
agcattatgcaattag

SEQ ID NO: 4938548 - DNA, 18 bp, Homo sapiens
agcattccttctttgata

SEQ ID NO: 4938549 - DNA, 18 bp, Homo sapiens
agcattctcactcctacc

SEQ ID NO: 4938550 - DNA, 20 bp, Homo sapiens
agcattctcactcctacctg

SEQ ID NO: 4938551 - DNA, 13 bp, Homo sapiens
agcattctcccca

SEQ ID NO: 4938552 - DNA, 17 bp, Homo sapiens
agcattgcctggccttc

SEQ ID NO: 4938553 - DNA, 21 bp, Homo sapiens
agcattgcctggccttcctgt

SEQ ID NO: 4938554 - DNA, 15 bp, Homo sapiens
agcattgctgttatg

SEQ ID NO: 4938555 - DNA, 16 bp, Homo sapiens
agcattgctgttatgt

SEQ ID NO: 4938556 - DNA, 23 bp, Homo sapiens
agcattgcttttattttgaaaag

SEQ ID NO: 4938557 - DNA, 16 bp, Homo sapiens
agcatttatcattctt

SEQ ID NO: 4938558 - DNA, 18 bp, Homo sapiens
agcatttccaacaccaca

SEQ ID NO: 4938559 - DNA, 17 bp, Homo sapiens
agcatttgataatgata

SEQ ID NO: 4938560 - DNA, 22 bp, Homo sapiens
agcatttgataatgataaaaca

SEQ ID NO: 4938561 - DNA, 14 bp, Homo sapiens
agcatttgtatttt

SEQ ID NO: 4938562 - DNA, 14 bp, Homo sapiens
agccaaaccctgtc

SEQ ID NO: 4938563 - DNA, 16 bp, Homo sapiens
agccaaagaaatgaac

SEQ ID NO: 4938564 - DNA, 18 bp, Homo sapiens
agccaaagaaatgaacat

SEQ ID NO: 4938565 - DNA, 16 bp, Homo sapiens
agccaaagctaggcct

SEQ ID NO: 4938566 - DNA, 19 bp, Homo sapiens
agccaaagctaggcctggc

SEQ ID NO: 4938567 - DNA, 23 bp, Homo sapiens
agccaacaccctgtctaaaaaac

SEQ ID NO: 4938568 - DNA, 15 bp, Homo sapiens
agccaacttttgcat

SEQ ID NO: 4938569 - DNA, 19 bp, Homo sapiens
agccaagtgccaaatgctc

SEQ ID NO: 4938570 - DNA, 23 bp, Homo sapiens
agccaatccctcaccttctgagt

SEQ ID NO: 4938571 - DNA, 14 bp, Homo sapiens
agccaatgttttcc

SEQ ID NO: 4938572 - DNA, 16 bp, Homo sapiens
agccacagcagcattt

SEQ ID NO: 4938573 - DNA, 23 bp, Homo sapiens
agccacatttggaatactttttg

SEQ ID NO: 4938574 - DNA, 20 bp, Homo sapiens
agccaccccagaaatggtga

SEQ ID NO: 4938575 - DNA, 21 bp, Homo sapiens
agccaccccgggctctctgct

SEQ ID NO: 4938576 - DNA, 23 bp, Homo sapiens
agccaccccgggctctctgctgt

SEQ ID NO: 4938577 - DNA, 15 bp, Homo sapiens
agccacggccaggcc

SEQ ID NO: 4938578 - DNA, 14 bp, Homo sapiens
agccactagactct

SEQ ID NO: 4938579 - DNA, 22 bp, Homo sapiens
agccactagactcttcactgtt

SEQ ID NO: 4938580 - DNA, 22 bp, Homo sapiens
agccactcaggaggctgaggca

SEQ ID NO: 4938581 - DNA, 16 bp, Homo sapiens
agccactctcttccct

SEQ ID NO: 4938582 - DNA, 20 bp, Homo sapiens
agccactctcttccctttcc

SEQ ID NO: 4938583 - DNA, 17 bp, Homo sapiens
agccactctgtcccttc

SEQ ID NO: 4938584 - DNA, 20 bp, Homo sapiens
agccactgcaccgggccaca

SEQ ID NO: 4938585 - DNA, 18 bp, Homo sapiens
agccagaatcagcacaga

SEQ ID NO: 4938586 - DNA, 15 bp, Homo sapiens
agccagacagaccct

SEQ ID NO: 4938587 - DNA, 14 bp, Homo sapiens
agccagatcctctt

SEQ ID NO: 4938588 - DNA, 15 bp, Homo sapiens
agccagatcctcttg

SEQ ID NO: 4938589 - DNA, 17 bp, Homo sapiens
agccagatcctcttggt

SEQ ID NO: 4938590 - DNA, 11 bp, Homo sapiens
agccagcctga

SEQ ID NO: 4938591 - DNA, 13 bp, Homo sapiens
agccagcctggtc

SEQ ID NO: 4938592 - DNA, 18 bp, Homo sapiens
agccagccttcttccatc

SEQ ID NO: 4938593 - DNA, 23 bp, Homo sapiens
agccagctcacagtgctgtgtgc

SEQ ID NO: 4938594 - DNA, 15 bp, Homo sapiens
agccagctccctcta

SEQ ID NO: 4938595 - DNA, 17 bp, Homo sapiens
agccagctccctctatt

SEQ ID NO: 4938596 - DNA, 19 bp, Homo sapiens
agccagctgcagctgggct

SEQ ID NO: 4938597 - DNA, 14 bp, Homo sapiens
agccaggatcatgg

SEQ ID NO: 4938598 - DNA, 15 bp, Homo sapiens
agccaggctcaggcc

SEQ ID NO: 4938599 - DNA, 20 bp, Homo sapiens
agccaggctgccaaggccag

SEQ ID NO: 4938600 - DNA, 20 bp, Homo sapiens
agccagggcttacctgtaca

SEQ ID NO: 4938601 - DNA, 21 bp, Homo sapiens
agccagggggactagcccctg

SEQ ID NO: 4938602 - DNA, 12 bp, Homo sapiens
agccagggtctc

SEQ ID NO: 4938603 - DNA, 22 bp, Homo sapiens
agccagggtctctccctcaggt

SEQ ID NO: 4938604 - DNA, 16 bp, Homo sapiens
agccatacttatctct

SEQ ID NO: 4938605 - DNA, 19 bp, Homo sapiens
agccatacttatctctctg

SEQ ID NO: 4938606 - DNA, 15 bp, Homo sapiens
agccatcaaaatgct

SEQ ID NO: 4938607 - DNA, 16 bp, Homo sapiens
agccatcaaaatgctt

SEQ ID NO: 4938608 - DNA, 15 bp, Homo sapiens
agccatgtataaatg

SEQ ID NO: 4938609 - DNA, 17 bp, Homo sapiens
agccatgtataaatgtg

SEQ ID NO: 4938610 - DNA, 14 bp, Homo sapiens
agccattttgtgaa

SEQ ID NO: 4938611 - DNA, 15 bp, Homo sapiens
agccattttgtgaat

SEQ ID NO: 4938612 - DNA, 12 bp, Homo sapiens
agcccagaagaa

SEQ ID NO: 4938613 - DNA, 15 bp, Homo sapiens
agcccagagaacagc

SEQ ID NO: 4938614 - DNA, 20 bp, Homo sapiens
agcccagaggtaacagaaca

SEQ ID NO: 4938615 - DNA, 17 bp, Homo sapiens
agcccagccctgttctg

SEQ ID NO: 4938616 - DNA, 14 bp, Homo sapiens
agcccagcgctctg

SEQ ID NO: 4938617 - DNA, 23 bp, Homo sapiens
agcccagcttggccctttccttc

SEQ ID NO: 4938618 - DNA, 13 bp, Homo sapiens
agcccaggagaga

SEQ ID NO: 4938619 - DNA, 14 bp, Homo sapiens
agcccaggagagag

SEQ ID NO: 4938620 - DNA, 19 bp, Homo sapiens
agcccaggagagagaaagc

SEQ ID NO: 4938621 - DNA, 23 bp, Homo sapiens
agcccaggagggcatccatacca

SEQ ID NO: 4938622 - DNA, 16 bp, Homo sapiens
agcccatactcagcct

SEQ ID NO: 4938623 - DNA, 17 bp, Homo sapiens
agcccatactcagcctg

SEQ ID NO: 4938624 - DNA, 18 bp, Homo sapiens
agcccatactcagcctgc

SEQ ID NO: 4938625 - DNA, 13 bp, Homo sapiens
agcccatccctgc

SEQ ID NO: 4938626 - DNA, 17 bp, Homo sapiens
agcccatccctgcctgg

SEQ ID NO: 4938627 - DNA, 15 bp, Homo sapiens
agcccatctcggagc

SEQ ID NO: 4938628 - DNA, 11 bp, Homo sapiens
agcccatgccc

SEQ ID NO: 4938629 - DNA, 21 bp, Homo sapiens
agctcctgtcctcccatcccc

SEQ ID NO: 4938630 - DNA, 12 bp, Homo sapiens
agctccttctgt

SEQ ID NO: 4938631 - DNA, 13 bp, Homo sapiens
agctccttctgtc

SEQ ID NO: 4938632 - DNA, 16 bp, Homo sapiens
agctccttctgtccta

SEQ ID NO: 4938633 - DNA, 13 bp, Homo sapiens
agctcgatccaaa

SEQ ID NO: 4938634 - DNA, 16 bp, Homo sapiens
agctcgatccaaattg

SEQ ID NO: 4938635 - DNA, 19 bp, Homo sapiens
agctcgcacccccctgttc

SEQ ID NO: 4938636 - DNA, 15 bp, Homo sapiens
agctctagaatctgc

SEQ ID NO: 4938637 - DNA, 18 bp, Homo sapiens
agctctctgtataaacat

SEQ ID NO: 4938638 - DNA, 19 bp, Homo sapiens
agctctctgtataaacatt

SEQ ID NO: 4938639 - DNA, 21 bp, Homo sapiens
agctctcttgccgaggagcca

SEQ ID NO: 4938640 - DNA, 21 bp, Homo sapiens
agctctgaagtcacatcacag

SEQ ID NO: 4938641 - DNA, 22 bp, Homo sapiens
agctctggccacaacagggcat

SEQ ID NO: 4938642 - DNA, 14 bp, Homo sapiens
agctctgtcctggg

SEQ ID NO: 4938643 - DNA, 23 bp, Homo sapiens
agctctgtcctgggagtgagctg

SEQ ID NO: 4938644 - DNA, 21 bp, Homo sapiens
agctctgttgcaattaggatt

SEQ ID NO: 4938645 - DNA, 15 bp, Homo sapiens
agctcttcaggcctc

SEQ ID NO: 4938646 - DNA, 16 bp, Homo sapiens
agctcttcaggcctcc

SEQ ID NO: 4938647 - DNA, 17 bp, Homo sapiens
agctcttcaggcctccc

SEQ ID NO: 4938648 - DNA, 16 bp, Homo sapiens
agctcttctccaggct

SEQ ID NO: 4938649 - DNA, 21 bp, Homo sapiens
agctcttttttgtttgtttct

SEQ ID NO: 4938650 - DNA, 22 bp, Homo sapiens
agctgaacaataggctgttccc

SEQ ID NO: 4938651 - DNA, 23 bp, Homo sapiens
agctgaacaataggctgttccca

SEQ ID NO: 4938652 - DNA, 17 bp, Homo sapiens
agctgaatgcctcctgt

SEQ ID NO: 4938653 - DNA, 21 bp, Homo sapiens
agctgaatgcctcctgtgggg

SEQ ID NO: 4938654 - DNA, 14 bp, Homo sapiens
agctgagagacttt

SEQ ID NO: 4938655 - DNA, 15 bp, Homo sapiens
agctgagagactttt

SEQ ID NO: 4938656 - DNA, 16 bp, Homo sapiens
agctgagttatgatgt

SEQ ID NO: 4938657 - DNA, 16 bp, Homo sapiens
agctgatacttcattt

SEQ ID NO: 4938658 - DNA, 20 bp, Homo sapiens
agctgatacttcatttaaaa

SEQ ID NO: 4938659 - DNA, 16 bp, Homo sapiens
agctgatataaattct

SEQ ID NO: 4938660 - DNA, 17 bp, Homo sapiens
agctgatataaattctg

SEQ ID NO: 4938661 - DNA, 19 bp, Homo sapiens
agctgatataaattctgtg

SEQ ID NO: 4938662 - DNA, 20 bp, Homo sapiens
agctgatgaacttattctgt

SEQ ID NO: 4938663 - DNA, 21 bp, Homo sapiens
agctgatgttggaagagaaag

SEQ ID NO: 4938664 - DNA, 15 bp, Homo sapiens
agctgcaccagagca

SEQ ID NO: 4938665 - DNA, 11 bp, Homo sapiens
agctgcagctt

SEQ ID NO: 4938666 - DNA, 15 bp, Homo sapiens
agctgcagcttcctg

SEQ ID NO: 4938667 - DNA, 16 bp, Homo sapiens
agctgcagcttcctgt

SEQ ID NO: 4938668 - DNA, 14 bp, Homo sapiens
agctgcagcttggg

SEQ ID NO: 4938669 - DNA, 23 bp, Homo sapiens
agctgcatgtggcttttttaaaa

SEQ ID NO: 4938670 - DNA, 22 bp, Homo sapiens
agctgccctccttgtccaccca

SEQ ID NO: 4938671 - DNA, 21 bp, Homo sapiens
agctgcctagcaagctggcct

SEQ ID NO: 4938672 - DNA, 22 bp, Homo sapiens
agctgcctagcaagctggcctc

SEQ ID NO: 4938673 - DNA, 21 bp, Homo sapiens
agctgcctgttcagctccagc

SEQ ID NO: 4938674 - DNA, 17 bp, Homo sapiens
agctgcggtccacccag

SEQ ID NO: 4938675 - DNA, 20 bp, Homo sapiens
agctgctatttattttccta

SEQ ID NO: 4938676 - DNA, 15 bp, Homo sapiens
agctgctccaggcct

SEQ ID NO: 4938677 - DNA, 18 bp, Homo sapiens
agctgctccaggcctgca

SEQ ID NO: 4938678 - DNA, 21 bp, Homo sapiens
agctgctgaccaattgtgctg

SEQ ID NO: 4938679 - DNA, 22 bp, Homo sapiens
agctgctgaccaattgtgctgc

SEQ ID NO: 4938680 - DNA, 23 bp, Homo sapiens
agctgctgaccaattgtgctgcc

SEQ ID NO: 4938681 - DNA, 18 bp, Homo sapiens
agctgctgtcttctggac

SEQ ID NO: 4938682 - DNA, 21 bp, Homo sapiens
agctgcttttgtctatgggac

SEQ ID NO: 4938683 - DNA, 13 bp, Homo sapiens
agctggacagagg

SEQ ID NO: 4938684 - DNA, 23 bp, Homo sapiens
agctggacagaggggactctggg

SEQ ID NO: 4938685 - DNA, 19 bp, Homo sapiens
agctggactctgcatccca

SEQ ID NO: 4938686 - DNA, 21 bp, Homo sapiens
agctggccgagggtcctggct

SEQ ID NO: 4938687 - DNA, 14 bp, Homo sapiens
agctggcctctacc

SEQ ID NO: 4938688 - DNA, 12 bp, Homo sapiens
agctggcctgag

SEQ ID NO: 4938689 - DNA, 21 bp, Homo sapiens
agctggcctgagaggggaagc

SEQ ID NO: 4938690 - DNA, 14 bp, Homo sapiens
agctggctcacctt

SEQ ID NO: 4938691 - DNA, 18 bp, Homo sapiens
agctgggactacaggcac

SEQ ID NO: 4938692 - DNA, 19 bp, Homo sapiens
agctgggactacaggcacc

SEQ ID NO: 4938693 - DNA, 20 bp, Homo sapiens
agctgggactacaggcaccc

SEQ ID NO: 4938694 - DNA, 17 bp, Homo sapiens
agctgggactacaggtg

SEQ ID NO: 4938695 - DNA, 19 bp, Homo sapiens
agctgggactacaggtgtg

SEQ ID NO: 4938696 - DNA, 16 bp, Homo sapiens
agctgggaggcatggc

SEQ ID NO: 4938697 - DNA, 21 bp, Homo sapiens
agctgggaggcatggccctgg

SEQ ID NO: 4938698 - DNA, 17 bp, Homo sapiens
agctgggcatggtacca

SEQ ID NO: 4938699 - DNA, 22 bp, Homo sapiens
agctgggcatggtaccagccct

SEQ ID NO: 4938700 - DNA, 16 bp, Homo sapiens
agctgggctggggagg

SEQ ID NO: 4938701 - DNA, 18 bp, Homo sapiens
agctggggaggagctttg

SEQ ID NO: 4938702 - DNA, 22 bp, Homo sapiens
agctgggtgtcaagagggtctg

SEQ ID NO: 4938703 - DNA, 21 bp, Homo sapiens
agctggtcccactcagtccat

SEQ ID NO: 4938704 - DNA, 14 bp, Homo sapiens
agctggtgcccgga

SEQ ID NO: 4938705 - DNA, 19 bp, Homo sapiens
agctgtaaaacgctgtcaa

SEQ ID NO: 4938706 - DNA, 21 bp, Homo sapiens
agctgtacttcgtcttctaat

SEQ ID NO: 4938707 - DNA, 11 bp, Homo sapiens
agctgtagtgg

SEQ ID NO: 4938708 - DNA, 17 bp, Homo sapiens
agctgtcctccctccac

SEQ ID NO: 4938709 - DNA, 11 bp, Homo sapiens
agctgtctgct

SEQ ID NO: 4938710 - DNA, 12 bp, Homo sapiens
agctgtgatttt

SEQ ID NO: 4938711 - DNA, 20 bp, Homo sapiens
agctgtgctctggacaggca

SEQ ID NO: 4938712 - DNA, 21 bp, Homo sapiens
agctgtgctctggacaggcat

SEQ ID NO: 4938713 - DNA, 23 bp, Homo sapiens
agctgtgctctggacaggcatgt

SEQ ID NO: 4938714 - DNA, 19 bp, Homo sapiens
agctgttaaactgttagca

SEQ ID NO: 4938715 - DNA, 23 bp, Homo sapiens
agctgttaaactgttagcactgt

SEQ ID NO: 4938716 - DNA, 19 bp, Homo sapiens
agctgttaccattcacaat

SEQ ID NO: 4938717 - DNA, 16 bp, Homo sapiens
agctgttgtacattta

SEQ ID NO: 4938718 - DNA, 12 bp, Homo sapiens
agctgtttaaga

SEQ ID NO: 4938719 - DNA, 18 bp, Homo sapiens
agctgtttatagagaatg

SEQ ID NO: 4938720 - DNA, 19 bp, Homo sapiens
agctgtttatggcctcagc

SEQ ID NO: 4938721 - DNA, 17 bp, Homo sapiens
agctgtttatgttttta

SEQ ID NO: 4938722 - DNA, 21 bp, Homo sapiens
agcttacaatcgcaaatcaaa

SEQ ID NO: 4938723 - DNA, 16 bp, Homo sapiens
agcttcagaagtttgg

SEQ ID NO: 4938724 - DNA, 18 bp, Homo sapiens
agcttcagctagctttta

SEQ ID NO: 4938725 - DNA, 11 bp, Homo sapiens
agcttcaggtt

SEQ ID NO: 4938726 - DNA, 23 bp, Homo sapiens
agcttcaggttatcgaaataaca

SEQ ID NO: 4938727 - DNA, 16 bp, Homo sapiens
agcttcattctccttg

SEQ ID NO: 4938728 - DNA, 13 bp, Homo sapiens
agcttcatttgtg

SEQ ID NO: 4938729 - DNA, 20 bp, Homo sapiens
agcttccaaggggcaaattt

SEQ ID NO: 4938730 - DNA, 22 bp, Homo sapiens
agcttccaaggggcaaattttt

SEQ ID NO: 4938731 - DNA, 15 bp, Homo sapiens
agcttccagctctaa

SEQ ID NO: 4938732 - DNA, 22 bp, Homo sapiens
agcttcctacccacacctctgc

SEQ ID NO: 4938733 - DNA, 18 bp, Homo sapiens
agcttctaataaattata

SEQ ID NO: 4938734 - DNA, 23 bp, Homo sapiens
agcttctaataaattatacaaat

SEQ ID NO: 4938735 - DNA, 21 bp, Homo sapiens
agcttctggaatttgttcaag

SEQ ID NO: 4938736 - DNA, 13 bp, Homo sapiens
agcttgactccca

SEQ ID NO: 4938737 - DNA, 14 bp, Homo sapiens
agcttgagggttgg

SEQ ID NO: 4938738 - DNA, 14 bp, Homo sapiens
aggccctgctgccc

SEQ ID NO: 4938739 - DNA, 22 bp, Homo sapiens
aggccctggtgcgaatggactt

SEQ ID NO: 4938740 - DNA, 13 bp, Homo sapiens
aggccctgtctgt

SEQ ID NO: 4938741 - DNA, 20 bp, Homo sapiens
aggcccttattttcaagaaa

SEQ ID NO: 4938742 - DNA, 17 bp, Homo sapiens
aggcccttcctctccac

SEQ ID NO: 4938743 - DNA, 19 bp, Homo sapiens
aggcccttcctctccactg

SEQ ID NO: 4938744 - DNA, 22 bp, Homo sapiens
aggcccttcctctccactgcct

SEQ ID NO: 4938745 - DNA, 21 bp, Homo sapiens
aggccctttgaagcctcagct

SEQ ID NO: 4938746 - DNA, 19 bp, Homo sapiens
aggccgatttgggaaccaa

SEQ ID NO: 4938747 - DNA, 14 bp, Homo sapiens
aggccggccagcct

SEQ ID NO: 4938748 - DNA, 22 bp, Homo sapiens
aggcctaatctcatacctctga

SEQ ID NO: 4938749 - DNA, 20 bp, Homo sapiens
aggcctctgtgtccttccct

SEQ ID NO: 4938750 - DNA, 19 bp, Homo sapiens
aggcctgacttctgctggc

SEQ ID NO: 4938751 - DNA, 21 bp, Homo sapiens
aggcctgacttctgctggcat

SEQ ID NO: 4938752 - DNA, 24 bp, Homo sapiens
aggcctgcacacaagcccacagca

SEQ ID NO: 4938753 - DNA, 13 bp, Homo sapiens
aggcctggccaga

SEQ ID NO: 4938754 - DNA, 17 bp, Homo sapiens
aggcctggccagatgca

SEQ ID NO: 4938755 - DNA, 23 bp, Homo sapiens
aggcctgtgtgtgaaaggaagct

SEQ ID NO: 4938756 - DNA, 17 bp, Homo sapiens
aggccttccagctgctg

SEQ ID NO: 4938757 - DNA, 13 bp, Homo sapiens
aggccttctcctc

SEQ ID NO: 4938758 - DNA, 18 bp, Homo sapiens
aggccttctctgaaggac

SEQ ID NO: 4938759 - DNA, 17 bp, Homo sapiens
aggccttttaacatttt

SEQ ID NO: 4938760 - DNA, 16 bp, Homo sapiens
aggccttttggaatgt

SEQ ID NO: 4938761 - DNA, 14 bp, Homo sapiens
aggctaatgtcaaa

SEQ ID NO: 4938762 - DNA, 18 bp, Homo sapiens
aggctactagaattctgt

SEQ ID NO: 4938763 - DNA, 22 bp, Homo sapiens
aggctactagaattctgtattg

SEQ ID NO: 4938764 - DNA, 18 bp, Homo sapiens
aggctagtccggacccac

SEQ ID NO: 4938765 - DNA, 22 bp, Homo sapiens
aggctatggacagggcatgcca

SEQ ID NO: 4938766 - DNA, 14 bp, Homo sapiens
aggctatgtgatta

SEQ ID NO: 4938767 - DNA, 17 bp, Homo sapiens
aggctcaacaataaaac

SEQ ID NO: 4938768 - DNA, 11 bp, Homo sapiens
aggctcagaga

SEQ ID NO: 4938769 - DNA, 18 bp, Homo sapiens
aggctcagcggcgaccgc

SEQ ID NO: 4938770 - DNA, 20 bp, Homo sapiens
aggctcccgaggggaagggg

SEQ ID NO: 4938771 - DNA, 19 bp, Homo sapiens
aggctctatgagtctagat

SEQ ID NO: 4938772 - DNA, 20 bp, Homo sapiens
aggctctatgagtctagatg

SEQ ID NO: 4938773 - DNA, 21 bp, Homo sapiens
aggctctatgagtctagatgt

SEQ ID NO: 4938774 - DNA, 19 bp, Homo sapiens
aggctctgacccagtgaga

SEQ ID NO: 4938775 - DNA, 20 bp, Homo sapiens
aggctctgagagtctagatt

SEQ ID NO: 4938776 - DNA, 13 bp, Homo sapiens
aggctcttctcct

SEQ ID NO: 4938777 - DNA, 14 bp, Homo sapiens
aggctcttctcctt

SEQ ID NO: 4938778 - DNA, 16 bp, Homo sapiens
aggctgacgtgtgagg

SEQ ID NO: 4938779 - DNA, 20 bp, Homo sapiens
aggctgacgtgtgagggagg

SEQ ID NO: 4938780 - DNA, 17 bp, Homo sapiens
aggctgaggcaggagga

SEQ ID NO: 4938781 - DNA, 15 bp, Homo sapiens
aggctgcagctggac

SEQ ID NO: 4938782 - DNA, 16 bp, Homo sapiens
aggctgcagctggaca

SEQ ID NO: 4938783 - DNA, 18 bp, Homo sapiens
aggctgcagctggacaga

SEQ ID NO: 4938784 - DNA, 22 bp, Homo sapiens
aggctgcagctggacagagggg

SEQ ID NO: 4938785 - DNA, 17 bp, Homo sapiens
aggctgccaaggccaga

SEQ ID NO: 4938786 - DNA, 17 bp, Homo sapiens
aggctgcccctctcacc

SEQ ID NO: 4938787 - DNA, 20 bp, Homo sapiens
aggctgctggggcctcagac

SEQ ID NO: 4938788 - DNA, 22 bp, Homo sapiens
aggctgctggggcctcagacga

SEQ ID NO: 4938789 - DNA, 13 bp, Homo sapiens
aggctgcttggga

SEQ ID NO: 4938790 - DNA, 20 bp, Homo sapiens
aggctggagtggagtggcgt

SEQ ID NO: 4938791 - DNA, 15 bp, Homo sapiens
aggctggcaggtatg

SEQ ID NO: 4938792 - DNA, 18 bp, Homo sapiens
aggctggcgtgcagtggt

SEQ ID NO: 4938793 - DNA, 17 bp, Homo sapiens
aggctggtctaaaactc

SEQ ID NO: 4938794 - DNA, 24 bp, Homo sapiens
aggctgtatcccatgagcctcagc

SEQ ID NO: 4938795 - DNA, 22 bp, Homo sapiens
aggctgtgtccctcttctcttc

SEQ ID NO: 4938796 - DNA, 20 bp, Homo sapiens
aggctgttcccatgtagccc

SEQ ID NO: 4938797 - DNA, 19 bp, Homo sapiens
aggctgttctgcactgaaa

SEQ ID NO: 4938798 - DNA, 19 bp, Homo sapiens
aggcttcaaaatgttatct

SEQ ID NO: 4938799 - DNA, 20 bp, Homo sapiens
aggcttctgttcctctcttt

SEQ ID NO: 4938800 - DNA, 22 bp, Homo sapiens
aggctttatgataatagattct

SEQ ID NO: 4938801 - DNA, 19 bp, Homo sapiens
aggctttggatttgacatt

SEQ ID NO: 4938802 - DNA, 17 bp, Homo sapiens
aggctttgtgttgtaat

SEQ ID NO: 4938803 - DNA, 10 bp, Homo sapiens
agggaaaagg

SEQ ID NO: 4938804 - DNA, 16 bp, Homo sapiens
agggaagacatttctt

SEQ ID NO: 4938805 - DNA, 13 bp, Homo sapiens
agggaagctggcc

SEQ ID NO: 4938806 - DNA, 16 bp, Homo sapiens
agggaagctggccgag

SEQ ID NO: 4938807 - DNA, 17 bp, Homo sapiens
agggaagctggcctgag

SEQ ID NO: 4938808 - DNA, 13 bp, Homo sapiens
agggaaggcctga

SEQ ID NO: 4938809 - DNA, 15 bp, Homo sapiens
agggaagtagtcctt

SEQ ID NO: 4938810 - DNA, 22 bp, Homo sapiens
agggaatccaagcctccacagc

SEQ ID NO: 4938811 - DNA, 16 bp, Homo sapiens
agggaatccccgaagg

SEQ ID NO: 4938812 - DNA, 20 bp, Homo sapiens
agggaatccccgaaggtgct

SEQ ID NO: 4938813 - DNA, 19 bp, Homo sapiens
agggactctgaagcctctg

SEQ ID NO: 4938814 - DNA, 16 bp, Homo sapiens
agggactgcctctgcc

SEQ ID NO: 4938815 - DNA, 17 bp, Homo sapiens
agggactgcctctgcca

SEQ ID NO: 4938816 - DNA, 18 bp, Homo sapiens
agggacttggaagctccg

SEQ ID NO: 4938817 - DNA, 20 bp, Homo sapiens
agggacttggaagctccgct

SEQ ID NO: 4938818 - DNA, 18 bp, Homo sapiens
agggagaagggatggagg

SEQ ID NO: 4938819 - DNA, 14 bp, Homo sapiens
agggagcagacagg

SEQ ID NO: 4938820 - DNA, 19 bp, Homo sapiens
agggagcagggaaggcctg

SEQ ID NO: 4938821 - DNA, 13 bp, Homo sapiens
agggaggacctgg

SEQ ID NO: 4938822 - DNA, 14 bp, Homo sapiens
agggaggacctggg

SEQ ID NO: 4938823 - DNA, 17 bp, Homo sapiens
agggaggacctggggca

SEQ ID NO: 4938824 - DNA, 15 bp, Homo sapiens
agggaggcagcctcc

SEQ ID NO: 4938825 - DNA, 17 bp, Homo sapiens
agggagggcagttttct

SEQ ID NO: 4938826 - DNA, 23 bp, Homo sapiens
agggagtccgaaagggacttgga

SEQ ID NO: 4938827 - DNA, 18 bp, Homo sapiens
agggagtgacagaggcag

SEQ ID NO: 4938828 - DNA, 19 bp, Homo sapiens
agggagtgacagaggcagc

SEQ ID NO: 4938829 - DNA, 15 bp, Homo sapiens
agggagtgctggctc

SEQ ID NO: 4938830 - DNA, 18 bp, Homo sapiens
agggagtgctggctcaca

SEQ ID NO: 4938831 - DNA, 22 bp, Homo sapiens
agggatgactaaaatatttatt

SEQ ID NO: 4938832 - DNA, 16 bp, Homo sapiens
agggatgggcctggca

SEQ ID NO: 4938833 - DNA, 17 bp, Homo sapiens
agggatgggcctggcat

SEQ ID NO: 4938834 - DNA, 23 bp, Homo sapiens
agggcaaaatattcactgggcca

SEQ ID NO: 4938835 - DNA, 21 bp, Homo sapiens
agggcaaatccagtcccaatg

SEQ ID NO: 4938836 - DNA, 18 bp, Homo sapiens
agggcaaatgacatgcac

SEQ ID NO: 4938837 - DNA, 22 bp, Homo sapiens
agggcaaatgacatgcactgac

SEQ ID NO: 4938838 - DNA, 23 bp, Homo sapiens
agggcaaatgacatgcactgacc

SEQ ID NO: 4938839 - DNA, 14 bp, Homo sapiens
agggcaattggaac

SEQ ID NO: 4938840 - DNA, 20 bp, Homo sapiens
agggcacaccgggcactcag

SEQ ID NO: 4938841 - DNA, 14 bp, Homo sapiens
agggcactggtggc

SEQ ID NO: 4938842 - DNA, 20 bp, Homo sapiens
agggcagaaaggttctgccc

SEQ ID NO: 4938843 - DNA, 15 bp, Homo sapiens
agggcagaaagtaga

SEQ ID NO: 4938844 - DNA, 12 bp, Homo sapiens
agggcagctgct

SEQ ID NO: 4938845 - DNA, 16 bp, Homo sapiens
agggcaggaaggagag

SEQ ID NO: 4938846 - DNA, 21 bp, Homo sapiens
agggcaggaaggagagcctgc

SEQ ID NO: 4938847 - DNA, 14 bp, Homo sapiens
agtatgagccctaa

SEQ ID NO: 4938848 - DNA, 15 bp, Homo sapiens
agtatgtaaagtatg

SEQ ID NO: 4938849 - DNA, 15 bp, Homo sapiens
agtattaaaacattg

SEQ ID NO: 4938850 - DNA, 18 bp, Homo sapiens
agtattacttctgctaca

SEQ ID NO: 4938851 - DNA, 18 bp, Homo sapiens
agtattattctactatac

SEQ ID NO: 4938852 - DNA, 22 bp, Homo sapiens
agtatttattttgtaattatga

SEQ ID NO: 4938853 - DNA, 14 bp, Homo sapiens
agtatttcagtgta

SEQ ID NO: 4938854 - DNA, 23 bp, Homo sapiens
agtatttcagtgtagttaattta

SEQ ID NO: 4938855 - DNA, 21 bp, Homo sapiens
agtatttcattgcctgtgtat

SEQ ID NO: 4938856 - DNA, 18 bp, Homo sapiens
agtatttccacttgttct

SEQ ID NO: 4938857 - DNA, 23 bp, Homo sapiens
agtatttgaaactgaatgtttat

SEQ ID NO: 4938858 - DNA, 15 bp, Homo sapiens
agtatttgaattaaa

SEQ ID NO: 4938859 - DNA, 21 bp, Homo sapiens
agtatttgaattaaaacttct

SEQ ID NO: 4938860 - DNA, 22 bp, Homo sapiens
agtatttgaattaaaacttctt

SEQ ID NO: 4938861 - DNA, 16 bp, Homo sapiens
agtatttgagagttct

SEQ ID NO: 4938862 - DNA, 21 bp, Homo sapiens
agtatttgggaagtgaagact

SEQ ID NO: 4938863 - DNA, 23 bp, Homo sapiens
agtattttgaagtttacattttt

SEQ ID NO: 4938864 - DNA, 19 bp, Homo sapiens
agtatttttatacaaacct

SEQ ID NO: 4938865 - DNA, 14 bp, Homo sapiens
agtatttttatcca

SEQ ID NO: 4938866 - DNA, 14 bp, Homo sapiens
agtcaaaataattc

SEQ ID NO: 4938867 - DNA, 14 bp, Homo sapiens
agtcaagaagaaaa

SEQ ID NO: 4938868 - DNA, 15 bp, Homo sapiens
agtcaagaagaaaaa

SEQ ID NO: 4938869 - DNA, 16 bp, Homo sapiens
agtcaatcatttctca

SEQ ID NO: 4938870 - DNA, 22 bp, Homo sapiens
agtcaatcatttctcactgtgt

SEQ ID NO: 4938871 - DNA, 22 bp, Homo sapiens
agtcacacagtattacttctgc

SEQ ID NO: 4938872 - DNA, 16 bp, Homo sapiens
agtcacactgctagca

SEQ ID NO: 4938873 - DNA, 14 bp, Homo sapiens
agtcaccaagccca

SEQ ID NO: 4938874 - DNA, 21 bp, Homo sapiens
agtcaccccaagtagtctgct

SEQ ID NO: 4938875 - DNA, 19 bp, Homo sapiens
agtcaccctacctgtgcct

SEQ ID NO: 4938876 - DNA, 13 bp, Homo sapiens
agtcaccttccag

SEQ ID NO: 4938877 - DNA, 14 bp, Homo sapiens
agtcaccttccagg

SEQ ID NO: 4938878 - DNA, 15 bp, Homo sapiens
agtcaccttcccttg

SEQ ID NO: 4938879 - DNA, 21 bp, Homo sapiens
agtcaccttcccttgccactt

SEQ ID NO: 4938880 - DNA, 16 bp, Homo sapiens
agtcactgatgtacaa

SEQ ID NO: 4938881 - DNA, 23 bp, Homo sapiens
agtcactgatgtacaattaaaaa

SEQ ID NO: 4938882 - DNA, 18 bp, Homo sapiens
agtcactgccactttgca

SEQ ID NO: 4938883 - DNA, 13 bp, Homo sapiens
agtcagaaaactt

SEQ ID NO: 4938884 - DNA, 17 bp, Homo sapiens
agtcagaaaactttaaa

SEQ ID NO: 4938885 - DNA, 23 bp, Homo sapiens
agtcagaaaactttaaaaaatat

SEQ ID NO: 4938886 - DNA, 16 bp, Homo sapiens
agtcagtgttgagatg

SEQ ID NO: 4938887 - DNA, 14 bp, Homo sapiens
agtcatagaaatag

SEQ ID NO: 4938888 - DNA, 13 bp, Homo sapiens
agtcatcatcagg

SEQ ID NO: 4938889 - DNA, 14 bp, Homo sapiens
agtcatgaagccca

SEQ ID NO: 4938890 - DNA, 22 bp, Homo sapiens
agtcatgcataaatatgcagtg

SEQ ID NO: 4938891 - DNA, 20 bp, Homo sapiens
agtcattagactcctcctcc

SEQ ID NO: 4938892 - DNA, 13 bp, Homo sapiens
agtcatttactaa

SEQ ID NO: 4938893 - DNA, 23 bp, Homo sapiens
agtcatttactaaacatatgatt

SEQ ID NO: 4938894 - DNA, 20 bp, Homo sapiens
agtcatttattttaaaaaat

SEQ ID NO: 4938895 - DNA, 23 bp, Homo sapiens
agtccaaatgtcctccagaagcc

SEQ ID NO: 4938896 - DNA, 14 bp, Homo sapiens
agtccaatgtggca

SEQ ID NO: 4938897 - DNA, 16 bp, Homo sapiens
agtccatttatatatg

SEQ ID NO: 4938898 - DNA, 15 bp, Homo sapiens
agtcccaccttggct

SEQ ID NO: 4938899 - DNA, 16 bp, Homo sapiens
agtcccaccttggctg

SEQ ID NO: 4938900 - DNA, 19 bp, Homo sapiens
agtcccaccttggctgcag

SEQ ID NO: 4938901 - DNA, 21 bp, Homo sapiens
agtcccaccttggctgcaggg

SEQ ID NO: 4938902 - DNA, 23 bp, Homo sapiens
agtcccaccttggctgcagggag

SEQ ID NO: 4938903 - DNA, 23 bp, Homo sapiens
agtcccccaactctgagcccatg

SEQ ID NO: 4938904 - DNA, 22 bp, Homo sapiens
agtccccctatccttggcacca

SEQ ID NO: 4938905 - DNA, 20 bp, Homo sapiens
agtccctatgtatttgcagt

SEQ ID NO: 4938906 - DNA, 13 bp, Homo sapiens
agtcccttcccct

SEQ ID NO: 4938907 - DNA, 14 bp, Homo sapiens
agtcccttcccctc

SEQ ID NO: 4938908 - DNA, 19 bp, Homo sapiens
agtcccttcccctccctgg

SEQ ID NO: 4938909 - DNA, 22 bp, Homo sapiens
agtcccttcccctccctggctc

SEQ ID NO: 4938910 - DNA, 23 bp, Homo sapiens
agtcccttcccctccctggctcc

SEQ ID NO: 4938911 - DNA, 18 bp, Homo sapiens
agtccgcagaagccctga

SEQ ID NO: 4938912 - DNA, 18 bp, Homo sapiens
agtccgtgtggatccaat

SEQ ID NO: 4938913 - DNA, 15 bp, Homo sapiens
agtcctcactcccag

SEQ ID NO: 4938914 - DNA, 17 bp, Homo sapiens
agtcctcactcccagtc

SEQ ID NO: 4938915 - DNA, 12 bp, Homo sapiens
agtcctcccctc

SEQ ID NO: 4938916 - DNA, 15 bp, Homo sapiens
agtcctcccctcaca

SEQ ID NO: 4938917 - DNA, 19 bp, Homo sapiens
agtcctcccctcacagcct

SEQ ID NO: 4938918 - DNA, 19 bp, Homo sapiens
agtcctccggttgcatact

SEQ ID NO: 4938919 - DNA, 13 bp, Homo sapiens
agtcctgcctggc

SEQ ID NO: 4938920 - DNA, 16 bp, Homo sapiens
agtcctgcctggccag

SEQ ID NO: 4938921 - DNA, 17 bp, Homo sapiens
agtcctgcctggccagg

SEQ ID NO: 4938922 - DNA, 14 bp, Homo sapiens
agtcctgctccaga

SEQ ID NO: 4938923 - DNA, 15 bp, Homo sapiens
agtcctgctccagaa

SEQ ID NO: 4938924 - DNA, 18 bp, Homo sapiens
agtcctggatgttgtgtg

SEQ ID NO: 4938925 - DNA, 23 bp, Homo sapiens
agtcctgtagttttattttatgt

SEQ ID NO: 4938926 - DNA, 14 bp, Homo sapiens
agtcctgtgaattt

SEQ ID NO: 4938927 - DNA, 16 bp, Homo sapiens
agtcgaggacagggag

SEQ ID NO: 4938928 - DNA, 23 bp, Homo sapiens
agtcgattatttccagtgttcta

SEQ ID NO: 4938929 - DNA, 23 bp, Homo sapiens
agtctagatgtttattcttctag

SEQ ID NO: 4938930 - DNA, 14 bp, Homo sapiens
agtctagattcaaa

SEQ ID NO: 4938931 - DNA, 14 bp, Homo sapiens
agtctagattctct

SEQ ID NO: 4938932 - DNA, 16 bp, Homo sapiens
agtctcactgttgccc

SEQ ID NO: 4938933 - DNA, 17 bp, Homo sapiens
agtctcactgttgccca

SEQ ID NO: 4938934 - DNA, 18 bp, Homo sapiens
agtctcagtttgtgtgtc

SEQ ID NO: 4938935 - DNA, 11 bp, Homo sapiens
agtctcctcaa

SEQ ID NO: 4938936 - DNA, 18 bp, Homo sapiens
agtctcctctttaaaaca

SEQ ID NO: 4938937 - DNA, 14 bp, Homo sapiens
agtctctaattcta

SEQ ID NO: 4938938 - DNA, 16 bp, Homo sapiens
agtctctggggcaggc

SEQ ID NO: 4938939 - DNA, 18 bp, Homo sapiens
agtctctggggcaggctg

SEQ ID NO: 4938940 - DNA, 17 bp, Homo sapiens
agtctcttctccactgg

SEQ ID NO: 4938941 - DNA, 17 bp, Homo sapiens
agtctgaatgctgccac

SEQ ID NO: 4938942 - DNA, 16 bp, Homo sapiens
agtctgattcccaagc

SEQ ID NO: 4938943 - DNA, 22 bp, Homo sapiens
agtctgattcccaagctctgct

SEQ ID NO: 4938944 - DNA, 17 bp, Homo sapiens
agtctggaatgcagtgg

SEQ ID NO: 4938945 - DNA, 18 bp, Homo sapiens
agtctggaatgcagtggt

SEQ ID NO: 4938946 - DNA, 16 bp, Homo sapiens
agtctggagtgggcag

SEQ ID NO: 4938947 - DNA, 18 bp, Homo sapiens
agtctggagtgggcagag

SEQ ID NO: 4938948 - DNA, 13 bp, Homo sapiens
agtctgtcctgtg

SEQ ID NO: 4938949 - DNA, 16 bp, Homo sapiens
agtctgtcctgtgacg

SEQ ID NO: 4938950 - DNA, 21 bp, Homo sapiens
agtctgtgtgatgaactttct

SEQ ID NO: 4938951 - DNA, 16 bp, Homo sapiens
agtctgttgtgtgtca

SEQ ID NO: 4938952 - DNA, 22 bp, Homo sapiens
agtcttcaacataacccacttg

SEQ ID NO: 4938953 - DNA, 11 bp, Homo sapiens
agtcttgtata

SEQ ID NO: 4938954 - DNA, 15 bp, Homo sapiens
agtcttgtataacta

SEQ ID NO: 4938955 - DNA, 15 bp, Homo sapiens
agtcttgtgcttttc

SEQ ID NO: 4938956 - DNA, 20 bp, Homo sapiens
agtcttgtgcttttcctatt

SEQ ID NO: 4938957 - DNA, 22 bp, Homo sapiens
agttttcactcttattgcccac

SEQ ID NO: 4938958 - DNA, 22 bp, Homo sapiens
agttttcagaacctcttcccca

SEQ ID NO: 4938959 - DNA, 21 bp, Homo sapiens
agttttcatttagaaaataga

SEQ ID NO: 4938960 - DNA, 22 bp, Homo sapiens
agttttcctctatacatctctc

SEQ ID NO: 4938961 - DNA, 12 bp, Homo sapiens
agttttctctta

SEQ ID NO: 4938962 - DNA, 21 bp, Homo sapiens
agttttctctttgtggggctt

SEQ ID NO: 4938963 - DNA, 13 bp, Homo sapiens
agttttgaatgtt

SEQ ID NO: 4938964 - DNA, 18 bp, Homo sapiens
agttttgatatgagtata

SEQ ID NO: 4938965 - DNA, 17 bp, Homo sapiens
agttttggccaccacat

SEQ ID NO: 4938966 - DNA, 12 bp, Homo sapiens
agttttgtcttg

SEQ ID NO: 4938967 - DNA, 13 bp, Homo sapiens
agttttgtcttga

SEQ ID NO: 4938968 - DNA, 14 bp, Homo sapiens
agttttgtcttgaa

SEQ ID NO: 4938969 - DNA, 18 bp, Homo sapiens
agtttttacagctgtgtt

SEQ ID NO: 4938970 - DNA, 18 bp, Homo sapiens
agtttttagtaatctgta

SEQ ID NO: 4938971 - DNA, 18 bp, Homo sapiens
agtttttattccttgtga

SEQ ID NO: 4938972 - DNA, 20 bp, Homo sapiens
agtttttcaggagcgcaaga

SEQ ID NO: 4938973 - DNA, 22 bp, Homo sapiens
ataaaaaaaaatagatgtcttt

SEQ ID NO: 4938974 - DNA, 19 bp, Homo sapiens
ataaaaaaacaatcatttg

SEQ ID NO: 4938975 - DNA, 15 bp, Homo sapiens
ataaaaaattatgac

SEQ ID NO: 4938976 - DNA, 17 bp, Homo sapiens
ataaaaagcttccatga

SEQ ID NO: 4938977 - DNA, 21 bp, Homo sapiens
ataaaaagcttccatgattct

SEQ ID NO: 4938978 - DNA, 11 bp, Homo sapiens
ataaaaaggac

SEQ ID NO: 4938979 - DNA, 19 bp, Homo sapiens
ataaaaagtgacacagcag

SEQ ID NO: 4938980 - DNA, 19 bp, Homo sapiens
ataaaaatcatggcaacat

SEQ ID NO: 4938981 - DNA, 12 bp, Homo sapiens
ataaaacaggta

SEQ ID NO: 4938982 - DNA, 13 bp, Homo sapiens
ataaaacctttca

SEQ ID NO: 4938983 - DNA, 20 bp, Homo sapiens
ataaaacctttcaaatttca

SEQ ID NO: 4938984 - DNA, 17 bp, Homo sapiens
ataaaactttgctgcca

SEQ ID NO: 4938985 - DNA, 15 bp, Homo sapiens
ataaaataattctaa

SEQ ID NO: 4938986 - DNA, 16 bp, Homo sapiens
ataaaataattctaaa

SEQ ID NO: 4938987 - DNA, 21 bp, Homo sapiens
ataaaatcaaaacaagtgaaa

SEQ ID NO: 4938988 - DNA, 12 bp, Homo sapiens
ataaaatgacta

SEQ ID NO: 4938989 - DNA, 15 bp, Homo sapiens
ataaaatgactactt

SEQ ID NO: 4938990 - DNA, 11 bp, Homo sapiens
ataaaatgtgc

SEQ ID NO: 4938991 - DNA, 16 bp, Homo sapiens
ataaacaaagattcat

SEQ ID NO: 4938992 - DNA, 18 bp, Homo sapiens
ataaacaatgatgccctg

SEQ ID NO: 4938993 - DNA, 20 bp, Homo sapiens
ataaaccaaaggacattatg

SEQ ID NO: 4938994 - DNA, 16 bp, Homo sapiens
ataaacctcaaaatgt

SEQ ID NO: 4938995 - DNA, 14 bp, Homo sapiens
ataaacctccgcca

SEQ ID NO: 4938996 - DNA, 19 bp, Homo sapiens
ataaactactctttgattt

SEQ ID NO: 4938997 - DNA, 14 bp, Homo sapiens
ataaactatcagtt

SEQ ID NO: 4938998 - DNA, 12 bp, Homo sapiens
ataaactgaaaa

SEQ ID NO: 4938999 - DNA, 16 bp, Homo sapiens
ataaacttcagcacca

SEQ ID NO: 4939000 - DNA, 15 bp, Homo sapiens
ataaactttttttca

SEQ ID NO: 4939001 - DNA, 19 bp, Homo sapiens
ataaactttttttcaatgt

SEQ ID NO: 4939002 - DNA, 19 bp, Homo sapiens
ataaagaaaacttccatag

SEQ ID NO: 4939003 - DNA, 19 bp, Homo sapiens
ataaagacaaccatattta

SEQ ID NO: 4939004 - DNA, 22 bp, Homo sapiens
ataaagacaaccatatttagca

SEQ ID NO: 4939005 - DNA, 13 bp, Homo sapiens
ataaagagttaga

SEQ ID NO: 4939006 - DNA, 18 bp, Homo sapiens
ataaagcctcaaggtttt

SEQ ID NO: 4939007 - DNA, 14 bp, Homo sapiens
ataaaggatgtgat

SEQ ID NO: 4939008 - DNA, 16 bp, Homo sapiens
ataaaggctaactatg

SEQ ID NO: 4939009 - DNA, 20 bp, Homo sapiens
ataaagtatagagagaagtt

SEQ ID NO: 4939010 - DNA, 12 bp, Homo sapiens
ataaagttagaa

SEQ ID NO: 4939011 - DNA, 16 bp, Homo sapiens
ataaagttagaatcta

SEQ ID NO: 4939012 - DNA, 19 bp, Homo sapiens
ataaatacatacggtcagg

SEQ ID NO: 4939013 - DNA, 21 bp, Homo sapiens
ataaatatatataaagaatat

SEQ ID NO: 4939014 - DNA, 22 bp, Homo sapiens
ataaatctgttctgggctcttt

SEQ ID NO: 4939015 - DNA, 15 bp, Homo sapiens
ataaatgtatataca

SEQ ID NO: 4939016 - DNA, 16 bp, Homo sapiens
ataaatgtatatacac

SEQ ID NO: 4939017 - DNA, 17 bp, Homo sapiens
ataaatgtatatacaca

SEQ ID NO: 4939018 - DNA, 20 bp, Homo sapiens
ataaatgtatatacacatat

SEQ ID NO: 4939019 - DNA, 21 bp, Homo sapiens
ataaatgtatcatagaaatgt

SEQ ID NO: 4939020 - DNA, 12 bp, Homo sapiens
ataaatgtctgt

SEQ ID NO: 4939021 - DNA, 14 bp, Homo sapiens
ataaattagttgtt

SEQ ID NO: 4939022 - DNA, 17 bp, Homo sapiens
ataaattgaaattgtga

SEQ ID NO: 4939023 - DNA, 13 bp, Homo sapiens
ataaattgctcct

SEQ ID NO: 4939024 - DNA, 16 bp, Homo sapiens
ataaattgctccttga

SEQ ID NO: 4939025 - DNA, 18 bp, Homo sapiens
ataaattgctccttgaca

SEQ ID NO: 4939026 - DNA, 20 bp, Homo sapiens
ataaattgtttggcttcctc

SEQ ID NO: 4939027 - DNA, 16 bp, Homo sapiens
ataacaatgttaagga

SEQ ID NO: 4939028 - DNA, 15 bp, Homo sapiens
ataacaattgtttgg

SEQ ID NO: 4939029 - DNA, 21 bp, Homo sapiens
ataacacccttccttctgtaa

SEQ ID NO: 4939030 - DNA, 14 bp, Homo sapiens
ataacattacctta

SEQ ID NO: 4939031 - DNA, 14 bp, Homo sapiens
ataaccagctgtaa

SEQ ID NO: 4939032 - DNA, 19 bp, Homo sapiens
ataaccagctgtaacacag

SEQ ID NO: 4939033 - DNA, 13 bp, Homo sapiens
ataacctatatga

SEQ ID NO: 4939034 - DNA, 18 bp, Homo sapiens
ataacctatatgatttat

SEQ ID NO: 4939035 - DNA, 16 bp, Homo sapiens
ataacgcttaaaggaa

SEQ ID NO: 4939036 - DNA, 18 bp, Homo sapiens
ataacgcttaaaggaagt

SEQ ID NO: 4939037 - DNA, 16 bp, Homo sapiens
ataactaaatttgata

SEQ ID NO: 4939038 - DNA, 20 bp, Homo sapiens
ataacttaaaaatgtaaata

SEQ ID NO: 4939039 - DNA, 11 bp, Homo sapiens
ataacttctga

SEQ ID NO: 4939040 - DNA, 20 bp, Homo sapiens
ataacttgatgcatgtggtt

SEQ ID NO: 4939041 - DNA, 18 bp, Homo sapiens
ataagaatggttgcctta

SEQ ID NO: 4939042 - DNA, 23 bp, Homo sapiens
ataagacataacgtttttccttt

SEQ ID NO: 4939043 - DNA, 17 bp, Homo sapiens
ataagacttagattgtg

SEQ ID NO: 4939044 - DNA, 14 bp, Homo sapiens
ataagagaaagaaa

SEQ ID NO: 4939045 - DNA, 13 bp, Homo sapiens
ataagattctaac

SEQ ID NO: 4939046 - DNA, 15 bp, Homo sapiens
ataagcaaatttcaa

SEQ ID NO: 4939047 - DNA, 21 bp, Homo sapiens
ataagcaaatttcaaaagaca

SEQ ID NO: 4939048 - DNA, 20 bp, Homo sapiens
ataagcactgaaaaacaaca

SEQ ID NO: 4939049 - DNA, 16 bp, Homo sapiens
ataagcattgaaatta

SEQ ID NO: 4939050 - DNA, 18 bp, Homo sapiens
ataagcattgaaattata

SEQ ID NO: 4939051 - DNA, 19 bp, Homo sapiens
ataaggccataaaacaggt

SEQ ID NO: 4939052 - DNA, 18 bp, Homo sapiens
ataaggggtttgccattt

SEQ ID NO: 4939053 - DNA, 21 bp, Homo sapiens
ataaggggtttgccatttgat

SEQ ID NO: 4939054 - DNA, 23 bp, Homo sapiens
ataaggtttcgtttctgtataca

SEQ ID NO: 4939055 - DNA, 15 bp, Homo sapiens
ataagtaaatgctag

SEQ ID NO: 4939056 - DNA, 15 bp, Homo sapiens
ataagtatacagttc

SEQ ID NO: 4939057 - DNA, 15 bp, Homo sapiens
ataagtatttataat

SEQ ID NO: 4939058 - DNA, 21 bp, Homo sapiens
ataagtgaaatggatactaca

SEQ ID NO: 4939059 - DNA, 20 bp, Homo sapiens
ataagtgcacacagaaatat

SEQ ID NO: 4939060 - DNA, 23 bp, Homo sapiens
ataagtgcacacagaaatatata

SEQ ID NO: 4939061 - DNA, 19 bp, Homo sapiens
ataagtgtacgattcttaa

SEQ ID NO: 4939062 - DNA, 15 bp, Homo sapiens
ataagtttgaaggaa

SEQ ID NO: 4939063 - DNA, 11 bp, Homo sapiens
ataataaagga

SEQ ID NO: 4939064 - DNA, 12 bp, Homo sapiens
ataataaattga

SEQ ID NO: 4939065 - DNA, 19 bp, Homo sapiens
ataataatctaggcatgaa

SEQ ID NO: 4939066 - DNA, 22 bp, Homo sapiens
ataatacactaattcctttcta

SEQ ID NO: 4939067 - DNA, 15 bp, Homo sapiens
atatataaagtatag

SEQ ID NO: 4939068 - DNA, 18 bp, Homo sapiens
atatataacagatacatt

SEQ ID NO: 4939069 - DNA, 23 bp, Homo sapiens
atatataagctcagattatttaa

SEQ ID NO: 4939070 - DNA, 16 bp, Homo sapiens
atatatacagtaactt

SEQ ID NO: 4939071 - DNA, 20 bp, Homo sapiens
atatatacagtaactttatg

SEQ ID NO: 4939072 - DNA, 23 bp, Homo sapiens
atatatacagtaactttatgtgt

SEQ ID NO: 4939073 - DNA, 13 bp, Homo sapiens
atatatacatatg

SEQ ID NO: 4939074 - DNA, 14 bp, Homo sapiens
atatatacatatgt

SEQ ID NO: 4939075 - DNA, 19 bp, Homo sapiens
atatatacccccccatgca

SEQ ID NO: 4939076 - DNA, 11 bp, Homo sapiens
atatatataaa

SEQ ID NO: 4939077 - DNA, 12 bp, Homo sapiens
atatatataaag

SEQ ID NO: 4939078 - DNA, 13 bp, Homo sapiens
atatatataaaga

SEQ ID NO: 4939079 - DNA, 13 bp, Homo sapiens
atatatataaata

SEQ ID NO: 4939080 - DNA, 14 bp, Homo sapiens
atatatataaatat

SEQ ID NO: 4939081 - DNA, 15 bp, Homo sapiens
atatatataatatat

SEQ ID NO: 4939082 - DNA, 13 bp, Homo sapiens
atatatatacata

SEQ ID NO: 4939083 - DNA, 11 bp, Homo sapiens
atatatatata

SEQ ID NO: 4939084 - DNA, 15 bp, Homo sapiens
atatatatataaagt

SEQ ID NO: 4939085 - DNA, 16 bp, Homo sapiens
atatatatatcagttt

SEQ ID NO: 4939086 - DNA, 19 bp, Homo sapiens
atatatattataaatatat

SEQ ID NO: 4939087 - DNA, 13 bp, Homo sapiens
atatatcatattg

SEQ ID NO: 4939088 - DNA, 16 bp, Homo sapiens
atatatcccagaaatt

SEQ ID NO: 4939089 - DNA, 18 bp, Homo sapiens
atatatctgaaaactgga

SEQ ID NO: 4939090 - DNA, 15 bp, Homo sapiens
atatatctgcttcag

SEQ ID NO: 4939091 - DNA, 13 bp, Homo sapiens
atatatgaaaact

SEQ ID NO: 4939092 - DNA, 15 bp, Homo sapiens
atatatgaaaactat

SEQ ID NO: 4939093 - DNA, 12 bp, Homo sapiens
atatatgaataa

SEQ ID NO: 4939094 - DNA, 13 bp, Homo sapiens
atatatgaggact

SEQ ID NO: 4939095 - DNA, 16 bp, Homo sapiens
atatatgcctttttcc

SEQ ID NO: 4939096 - DNA, 18 bp, Homo sapiens
atatatgcctttttccta

SEQ ID NO: 4939097 - DNA, 12 bp, Homo sapiens
atatatggacat

SEQ ID NO: 4939098 - DNA, 19 bp, Homo sapiens
atatatgtattatttataa

SEQ ID NO: 4939099 - DNA, 20 bp, Homo sapiens
atatatgtattatttataat

SEQ ID NO: 4939100 - DNA, 21 bp, Homo sapiens
atatatgtgtatatatacata

SEQ ID NO: 4939101 - DNA, 21 bp, Homo sapiens
atatatgttttaagaggcagg

SEQ ID NO: 4939102 - DNA, 14 bp, Homo sapiens
atatattgttaatc

SEQ ID NO: 4939103 - DNA, 13 bp, Homo sapiens
atatatttaatga

SEQ ID NO: 4939104 - DNA, 16 bp, Homo sapiens
atatatttatttaaag

SEQ ID NO: 4939105 - DNA, 15 bp, Homo sapiens
atatatttttatatt

SEQ ID NO: 4939106 - DNA, 14 bp, Homo sapiens
atatcagaaaaggg

SEQ ID NO: 4939107 - DNA, 14 bp, Homo sapiens
atatcatattggta

SEQ ID NO: 4939108 - DNA, 19 bp, Homo sapiens
atatcatgtaaagaaatgt

SEQ ID NO: 4939109 - DNA, 21 bp, Homo sapiens
atatcatttattttttacatt

SEQ ID NO: 4939110 - DNA, 13 bp, Homo sapiens
atatcccctgcta

SEQ ID NO: 4939111 - DNA, 17 bp, Homo sapiens
atatccttatcagagct

SEQ ID NO: 4939112 - DNA, 22 bp, Homo sapiens
atatctattaatatatgtatta

SEQ ID NO: 4939113 - DNA, 17 bp, Homo sapiens
atatctgaaaactggaa

SEQ ID NO: 4939114 - DNA, 16 bp, Homo sapiens
atatctgcttcagtgg

SEQ ID NO: 4939115 - DNA, 20 bp, Homo sapiens
atatctggcctaaaatcttg

SEQ ID NO: 4939116 - DNA, 18 bp, Homo sapiens
atatctgtggtcttcaaa

SEQ ID NO: 4939117 - DNA, 23 bp, Homo sapiens
atatctttgtgataatttaagag

SEQ ID NO: 4939118 - DNA, 13 bp, Homo sapiens
atatgaaaactat

SEQ ID NO: 4939119 - DNA, 17 bp, Homo sapiens
atatgaaaactatacaa

SEQ ID NO: 4939120 - DNA, 18 bp, Homo sapiens
atatgaaccctttgtttc

SEQ ID NO: 4939121 - DNA, 19 bp, Homo sapiens
atatgaaccctttgtttct

SEQ ID NO: 4939122 - DNA, 21 bp, Homo sapiens
atatgaatttaaatataattc

SEQ ID NO: 4939123 - DNA, 22 bp, Homo sapiens
atatgagcttccttctgtgaaa

SEQ ID NO: 4939124 - DNA, 14 bp, Homo sapiens
atatgagtatacaa

SEQ ID NO: 4939125 - DNA, 14 bp, Homo sapiens
atatgatttatagt

SEQ ID NO: 4939126 - DNA, 16 bp, Homo sapiens
atatgattttttaaaa

SEQ ID NO: 4939127 - DNA, 17 bp, Homo sapiens
atatgattttttaaaag

SEQ ID NO: 4939128 - DNA, 19 bp, Homo sapiens
atatgattttttaaaagaa

SEQ ID NO: 4939129 - DNA, 15 bp, Homo sapiens
atatgcaccttgtgt

SEQ ID NO: 4939130 - DNA, 17 bp, Homo sapiens
atatgcaccttgtgtct

SEQ ID NO: 4939131 - DNA, 15 bp, Homo sapiens
atatggacaagaggt

SEQ ID NO: 4939132 - DNA, 20 bp, Homo sapiens
atatggacacttaatactac

SEQ ID NO: 4939133 - DNA, 16 bp, Homo sapiens
atatggactctgcaca

SEQ ID NO: 4939134 - DNA, 16 bp, Homo sapiens
atatggcaaaaatggc

SEQ ID NO: 4939135 - DNA, 19 bp, Homo sapiens
atatggcaagaaagctggt

SEQ ID NO: 4939136 - DNA, 15 bp, Homo sapiens
atatggcagaagaca

SEQ ID NO: 4939137 - DNA, 13 bp, Homo sapiens
atatggccacagt

SEQ ID NO: 4939138 - DNA, 22 bp, Homo sapiens
atatggggtattggacatagat

SEQ ID NO: 4939139 - DNA, 22 bp, Homo sapiens
atatgggtttataattttctga

SEQ ID NO: 4939140 - DNA, 20 bp, Homo sapiens
atatgtaaacataagtgtac

SEQ ID NO: 4939141 - DNA, 17 bp, Homo sapiens
atatgtaacaagccacc

SEQ ID NO: 4939142 - DNA, 15 bp, Homo sapiens
atatgtacataaatt

SEQ ID NO: 4939143 - DNA, 13 bp, Homo sapiens
atatgtactgttt

SEQ ID NO: 4939144 - DNA, 16 bp, Homo sapiens
atatgtagaaggcaca

SEQ ID NO: 4939145 - DNA, 13 bp, Homo sapiens
atatgtagactat

SEQ ID NO: 4939146 - DNA, 18 bp, Homo sapiens
atatgtagactatataca

SEQ ID NO: 4939147 - DNA, 19 bp, Homo sapiens
atatgtagactatatacat

SEQ ID NO: 4939148 - DNA, 20 bp, Homo sapiens
atatgtagactatatacatg

SEQ ID NO: 4939149 - DNA, 17 bp, Homo sapiens
atatgtattatttataa

SEQ ID NO: 4939150 - DNA, 21 bp, Homo sapiens
atatgtctcgctagtgatgtt

SEQ ID NO: 4939151 - DNA, 13 bp, Homo sapiens
atatgtgatctgt

SEQ ID NO: 4939152 - DNA, 15 bp, Homo sapiens
atatgtgatctgtct

SEQ ID NO: 4939153 - DNA, 14 bp, Homo sapiens
atatgtgtatgtac

SEQ ID NO: 4939154 - DNA, 14 bp, Homo sapiens
atatgtgttgaaaa

SEQ ID NO: 4939155 - DNA, 17 bp, Homo sapiens
atatgttgaatactttt

SEQ ID NO: 4939156 - DNA, 18 bp, Homo sapiens
atatgttttaagaggcag

SEQ ID NO: 4939157 - DNA, 20 bp, Homo sapiens
atatgttttaagaggcaggg

SEQ ID NO: 4939158 - DNA, 13 bp, Homo sapiens
atattaaatctgc

SEQ ID NO: 4939159 - DNA, 15 bp, Homo sapiens
atattaattttctac

SEQ ID NO: 4939160 - DNA, 15 bp, Homo sapiens
atattacacatttgt

SEQ ID NO: 4939161 - DNA, 16 bp, Homo sapiens
atattacacatttgta

SEQ ID NO: 4939162 - DNA, 15 bp, Homo sapiens
atattaccagcaaga

SEQ ID NO: 4939163 - DNA, 21 bp, Homo sapiens
atattactcctatttttgtaa

SEQ ID NO: 4939164 - DNA, 21 bp, Homo sapiens
atattactgtttatttctgtt

SEQ ID NO: 4939165 - DNA, 16 bp, Homo sapiens
atattactttatcact

SEQ ID NO: 4939166 - DNA, 17 bp, Homo sapiens
atattactttatcactt

SEQ ID NO: 4939167 - DNA, 19 bp, Homo sapiens
atattactttatcactttt

SEQ ID NO: 4939168 - DNA, 13 bp, Homo sapiens
atattatgtgttt

SEQ ID NO: 4939169 - DNA, 13 bp, Homo sapiens
atattattagaaa

SEQ ID NO: 4939170 - DNA, 18 bp, Homo sapiens
atattatttggcagtttg

SEQ ID NO: 4939171 - DNA, 19 bp, Homo sapiens
atattatttggcagtttgg

SEQ ID NO: 4939172 - DNA, 12 bp, Homo sapiens
atattcaaccat

SEQ ID NO: 4939173 - DNA, 16 bp, Homo sapiens
atattcactgggccaa

SEQ ID NO: 4939174 - DNA, 19 bp, Homo sapiens
atattcatattggaaaaat

SEQ ID NO: 4939175 - DNA, 20 bp, Homo sapiens
atattcatgcttcttcctta

SEQ ID NO: 4939176 - DNA, 16 bp, Homo sapiens
atattctgttggccag

SEQ ID NO: 4939177 - DNA, 13 bp, Homo sapiens
atattcttgtcaa

SEQ ID NO: 4939178 - DNA, 14 bp, Homo sapiens
atcctgagccccgc

SEQ ID NO: 4939179 - DNA, 23 bp, Homo sapiens
atcctgagccccgccctcttcct

SEQ ID NO: 4939180 - DNA, 13 bp, Homo sapiens
atcctgccattta

SEQ ID NO: 4939181 - DNA, 16 bp, Homo sapiens
atcctgccatttaaaa

SEQ ID NO: 4939182 - DNA, 15 bp, Homo sapiens
atcctggcagcccag

SEQ ID NO: 4939183 - DNA, 19 bp, Homo sapiens
atcctggcagcccagagac

SEQ ID NO: 4939184 - DNA, 20 bp, Homo sapiens
atcctggcagcccagagact

SEQ ID NO: 4939185 - DNA, 24 bp, Homo sapiens
atcctggcagcccagagactttgt

SEQ ID NO: 4939186 - DNA, 11 bp, Homo sapiens
atcctgggtaa

SEQ ID NO: 4939187 - DNA, 23 bp, Homo sapiens
atcctgtataagcactgaaaaac

SEQ ID NO: 4939188 - DNA, 19 bp, Homo sapiens
atcctgtctttaaggaaaa

SEQ ID NO: 4939189 - DNA, 23 bp, Homo sapiens
atcctgtctttctgagcacactt

SEQ ID NO: 4939190 - DNA, 20 bp, Homo sapiens
atccttcaagaactctgggc

SEQ ID NO: 4939191 - DNA, 18 bp, Homo sapiens
atccttccaaaaattatt

SEQ ID NO: 4939192 - DNA, 14 bp, Homo sapiens
atccttccaaagaa

SEQ ID NO: 4939193 - DNA, 18 bp, Homo sapiens
atccttccaaagaattct

SEQ ID NO: 4939194 - DNA, 14 bp, Homo sapiens
atccttcctataac

SEQ ID NO: 4939195 - DNA, 20 bp, Homo sapiens
atcctttgcagggcagcccc

SEQ ID NO: 4939196 - DNA, 17 bp, Homo sapiens
atcgaaaattcatttca

SEQ ID NO: 4939197 - DNA, 18 bp, Homo sapiens
atcgaaataacaatgtta

SEQ ID NO: 4939198 - DNA, 22 bp, Homo sapiens
atcgaaataacaatgttaagga

SEQ ID NO: 4939199 - DNA, 15 bp, Homo sapiens
atcgaaccgttttga

SEQ ID NO: 4939200 - DNA, 21 bp, Homo sapiens
atcgagtgagacaaaatttta

SEQ ID NO: 4939201 - DNA, 16 bp, Homo sapiens
atcgtaaccagccaga

SEQ ID NO: 4939202 - DNA, 19 bp, Homo sapiens
atcgtccagcgaccttcct

SEQ ID NO: 4939203 - DNA, 14 bp, Homo sapiens
atcgtgacaacact

SEQ ID NO: 4939204 - DNA, 13 bp, Homo sapiens
atctaaagtttgt

SEQ ID NO: 4939205 - DNA, 20 bp, Homo sapiens
atctaaatctatttattaat

SEQ ID NO: 4939206 - DNA, 16 bp, Homo sapiens
atctaagctgcagctt

SEQ ID NO: 4939207 - DNA, 19 bp, Homo sapiens
atctaatacctctgtgtgc

SEQ ID NO: 4939208 - DNA, 22 bp, Homo sapiens
atctaatacctctgtgtgctcc

SEQ ID NO: 4939209 - DNA, 15 bp, Homo sapiens
atctaatatatatga

SEQ ID NO: 4939210 - DNA, 18 bp, Homo sapiens
atctaatatatatgaata

SEQ ID NO: 4939211 - DNA, 20 bp, Homo sapiens
atctaatatatatgaataaa

SEQ ID NO: 4939212 - DNA, 16 bp, Homo sapiens
atctaatatggccaca

SEQ ID NO: 4939213 - DNA, 23 bp, Homo sapiens
atctaatatggccacagtagtct

SEQ ID NO: 4939214 - DNA, 20 bp, Homo sapiens
atctaatatgtaacaagcca

SEQ ID NO: 4939215 - DNA, 22 bp, Homo sapiens
atctagtttacagaaaaatctt

SEQ ID NO: 4939216 - DNA, 13 bp, Homo sapiens
atctataaagaag

SEQ ID NO: 4939217 - DNA, 18 bp, Homo sapiens
atctatatatgtgtatgt

SEQ ID NO: 4939218 - DNA, 15 bp, Homo sapiens
atctatgatataacc

SEQ ID NO: 4939219 - DNA, 14 bp, Homo sapiens
atctattaatatat

SEQ ID NO: 4939220 - DNA, 13 bp, Homo sapiens
atctatttattaa

SEQ ID NO: 4939221 - DNA, 16 bp, Homo sapiens
atctatttattaagtt

SEQ ID NO: 4939222 - DNA, 19 bp, Homo sapiens
atctatttattaatattta

SEQ ID NO: 4939223 - DNA, 20 bp, Homo sapiens
atctattttgatgcagcatt

SEQ ID NO: 4939224 - DNA, 18 bp, Homo sapiens
atctcaaggaatctttaa

SEQ ID NO: 4939225 - DNA, 20 bp, Homo sapiens
atctcagatcagtgtaccat

SEQ ID NO: 4939226 - DNA, 23 bp, Homo sapiens
atctcaggggccagaggaactgt

SEQ ID NO: 4939227 - DNA, 18 bp, Homo sapiens
atctcagtcatgcataaa

SEQ ID NO: 4939228 - DNA, 15 bp, Homo sapiens
atctcatacctctga

SEQ ID NO: 4939229 - DNA, 16 bp, Homo sapiens
atctcatgtatcatct

SEQ ID NO: 4939230 - DNA, 15 bp, Homo sapiens
atctccatctgtcaa

SEQ ID NO: 4939231 - DNA, 20 bp, Homo sapiens
atctcccaagctatctaaag

SEQ ID NO: 4939232 - DNA, 15 bp, Homo sapiens
atctcccgctgctgc

SEQ ID NO: 4939233 - DNA, 12 bp, Homo sapiens
atctcccttcct

SEQ ID NO: 4939234 - DNA, 17 bp, Homo sapiens
atctcctataatctgtc

SEQ ID NO: 4939235 - DNA, 19 bp, Homo sapiens
atctcctataatctgtcaa

SEQ ID NO: 4939236 - DNA, 20 bp, Homo sapiens
atctcctataatctgtcaaa

SEQ ID NO: 4939237 - DNA, 17 bp, Homo sapiens
atctcctgacagaaggt

SEQ ID NO: 4939238 - DNA, 18 bp, Homo sapiens
atctcctgacagaaggtg

SEQ ID NO: 4939239 - DNA, 23 bp, Homo sapiens
atctcgtttttcttcttaagact

SEQ ID NO: 4939240 - DNA, 15 bp, Homo sapiens
atctctatttaatat

SEQ ID NO: 4939241 - DNA, 17 bp, Homo sapiens
atctctctgcagctgcc

SEQ ID NO: 4939242 - DNA, 18 bp, Homo sapiens
atctctctgcagctgccg

SEQ ID NO: 4939243 - DNA, 18 bp, Homo sapiens
atctctgtactttgcttg

SEQ ID NO: 4939244 - DNA, 13 bp, Homo sapiens
atctctgttatgt

SEQ ID NO: 4939245 - DNA, 23 bp, Homo sapiens
atctcttaaattgggttcatgat

SEQ ID NO: 4939246 - DNA, 16 bp, Homo sapiens
atctcttattttacaa

SEQ ID NO: 4939247 - DNA, 19 bp, Homo sapiens
atctcttattttacaataa

SEQ ID NO: 4939248 - DNA, 13 bp, Homo sapiens
atctgaaaactgg

SEQ ID NO: 4939249 - DNA, 14 bp, Homo sapiens
atctgaaaactgga

SEQ ID NO: 4939250 - DNA, 15 bp, Homo sapiens
atctgaaaactggaa

SEQ ID NO: 4939251 - DNA, 20 bp, Homo sapiens
atctgaagcttcactcactg

SEQ ID NO: 4939252 - DNA, 14 bp, Homo sapiens
atctgagttgccaa

SEQ ID NO: 4939253 - DNA, 16 bp, Homo sapiens
atctgcacccttcttt

SEQ ID NO: 4939254 - DNA, 19 bp, Homo sapiens
atctgcacccttcttttct

SEQ ID NO: 4939255 - DNA, 20 bp, Homo sapiens
atctgcacccttcttttctc

SEQ ID NO: 4939256 - DNA, 11 bp, Homo sapiens
atctgcccctc

SEQ ID NO: 4939257 - DNA, 15 bp, Homo sapiens
atctgcccctccccc

SEQ ID NO: 4939258 - DNA, 16 bp, Homo sapiens
atctgcccctccccca

SEQ ID NO: 4939259 - DNA, 12 bp, Homo sapiens
atctgcttcagt

SEQ ID NO: 4939260 - DNA, 14 bp, Homo sapiens
atctgcttcagtgg

SEQ ID NO: 4939261 - DNA, 14 bp, Homo sapiens
atctggaagaaaaa

SEQ ID NO: 4939262 - DNA, 19 bp, Homo sapiens
atctggactcctctgtcca

SEQ ID NO: 4939263 - DNA, 20 bp, Homo sapiens
atctggagaccagggagcct

SEQ ID NO: 4939264 - DNA, 22 bp, Homo sapiens
atctggagaccagggagccttt

SEQ ID NO: 4939265 - DNA, 19 bp, Homo sapiens
atctggaggccttccagct

SEQ ID NO: 4939266 - DNA, 23 bp, Homo sapiens
atctggaggccttccagctgctg

SEQ ID NO: 4939267 - DNA, 18 bp, Homo sapiens
atctggataggagcctgc

SEQ ID NO: 4939268 - DNA, 20 bp, Homo sapiens
atctggataggagcctgctg

SEQ ID NO: 4939269 - DNA, 21 bp, Homo sapiens
atctggataggagcctgctgg

SEQ ID NO: 4939270 - DNA, 18 bp, Homo sapiens
atctggcctaaaatcttg

SEQ ID NO: 4939271 - DNA, 19 bp, Homo sapiens
atctggcctaaaatcttgg

SEQ ID NO: 4939272 - DNA, 13 bp, Homo sapiens
atctggcctggcc

SEQ ID NO: 4939273 - DNA, 16 bp, Homo sapiens
atctggcctggcctgg

SEQ ID NO: 4939274 - DNA, 17 bp, Homo sapiens
atctggcctggcctggc

SEQ ID NO: 4939275 - DNA, 23 bp, Homo sapiens
atctggcctggcctggccctgcc

SEQ ID NO: 4939276 - DNA, 22 bp, Homo sapiens
atctggcttattttaatgtgat

SEQ ID NO: 4939277 - DNA, 12 bp, Homo sapiens
atctgggcctgg

SEQ ID NO: 4939278 - DNA, 14 bp, Homo sapiens
atctgggcctgggc

SEQ ID NO: 4939279 - DNA, 14 bp, Homo sapiens
atctgggtccttgc

SEQ ID NO: 4939280 - DNA, 17 bp, Homo sapiens
atctggtcccttgcagc

SEQ ID NO: 4939281 - DNA, 18 bp, Homo sapiens
atctggtcttgttagaaa

SEQ ID NO: 4939282 - DNA, 20 bp, Homo sapiens
atctgtaacaggtattttgt

SEQ ID NO: 4939283 - DNA, 23 bp, Homo sapiens
atctgtaacaggtattttgtttc

SEQ ID NO: 4939284 - DNA, 19 bp, Homo sapiens
atctgtaagtaacttcaca

SEQ ID NO: 4939285 - DNA, 16 bp, Homo sapiens
atctgtacattttgtt

SEQ ID NO: 4939286 - DNA, 15 bp, Homo sapiens
atctgtcaaaacact

SEQ ID NO: 4939287 - DNA, 17 bp, Homo sapiens
atctgtcaaaacactgt

SEQ ID NO: 4939288 - DNA, 14 bp, Homo sapiens
atgccctgctccag

SEQ ID NO: 4939289 - DNA, 18 bp, Homo sapiens
atgcctggtctttcctct

SEQ ID NO: 4939290 - DNA, 11 bp, Homo sapiens
atgcctggtgg

SEQ ID NO: 4939291 - DNA, 15 bp, Homo sapiens
atgcctggtggcagc

SEQ ID NO: 4939292 - DNA, 17 bp, Homo sapiens
atgcctggtggcagctg

SEQ ID NO: 4939293 - DNA, 16 bp, Homo sapiens
atgcctgtccagcctg

SEQ ID NO: 4939294 - DNA, 17 bp, Homo sapiens
atgcctgtccagcctgg

SEQ ID NO: 4939295 - DNA, 16 bp, Homo sapiens
atgccttaaaatggaa

SEQ ID NO: 4939296 - DNA, 22 bp, Homo sapiens
atgccttaaaatggaattgaaa

SEQ ID NO: 4939297 - DNA, 20 bp, Homo sapiens
atgccttggggaggacaaaa

SEQ ID NO: 4939298 - DNA, 12 bp, Homo sapiens
atgcggccaaga

SEQ ID NO: 4939299 - DNA, 19 bp, Homo sapiens
atgcgtcccaagatgttga

SEQ ID NO: 4939300 - DNA, 17 bp, Homo sapiens
atgctaatttaaagaga

SEQ ID NO: 4939301 - DNA, 23 bp, Homo sapiens
atgctactgtctcactgaaacat

SEQ ID NO: 4939302 - DNA, 15 bp, Homo sapiens
atgctccaagattct

SEQ ID NO: 4939303 - DNA, 17 bp, Homo sapiens
atgctccaagattctag

SEQ ID NO: 4939304 - DNA, 22 bp, Homo sapiens
atgctccagcaacacagcctgg

SEQ ID NO: 4939305 - DNA, 20 bp, Homo sapiens
atgctccctcccctgccctg

SEQ ID NO: 4939306 - DNA, 13 bp, Homo sapiens
atgctcctagttt

SEQ ID NO: 4939307 - DNA, 22 bp, Homo sapiens
atgctcctagtttgacctcaca

SEQ ID NO: 4939308 - DNA, 16 bp, Homo sapiens
atgctcctcactgccc

SEQ ID NO: 4939309 - DNA, 15 bp, Homo sapiens
atgctcttttttact

SEQ ID NO: 4939310 - DNA, 20 bp, Homo sapiens
atgctcttttttactcattg

SEQ ID NO: 4939311 - DNA, 19 bp, Homo sapiens
atgctgcaggacttgagaa

SEQ ID NO: 4939312 - DNA, 12 bp, Homo sapiens
atgctgccagtg

SEQ ID NO: 4939313 - DNA, 22 bp, Homo sapiens
atgctgccttcccatgaatctg

SEQ ID NO: 4939314 - DNA, 17 bp, Homo sapiens
atgctggagaagagagg

SEQ ID NO: 4939315 - DNA, 23 bp, Homo sapiens
atgctggagaagagaggagagga

SEQ ID NO: 4939316 - DNA, 23 bp, Homo sapiens
atgctggcatttgcacctacctc

SEQ ID NO: 4939317 - DNA, 15 bp, Homo sapiens
atgctggccagcctg

SEQ ID NO: 4939318 - DNA, 17 bp, Homo sapiens
atgctggcctttgctct

SEQ ID NO: 4939319 - DNA, 22 bp, Homo sapiens
atgctggctgttggctgggggc

SEQ ID NO: 4939320 - DNA, 18 bp, Homo sapiens
atgctgtaggtggtatgt

SEQ ID NO: 4939321 - DNA, 19 bp, Homo sapiens
atgctgtatatcctttcta

SEQ ID NO: 4939322 - DNA, 22 bp, Homo sapiens
atgctgtgagtctttggttcta

SEQ ID NO: 4939323 - DNA, 19 bp, Homo sapiens
atgcttaatttctaaagat

SEQ ID NO: 4939324 - DNA, 19 bp, Homo sapiens
atgcttacggccatctctt

SEQ ID NO: 4939325 - DNA, 15 bp, Homo sapiens
atgcttatgacaatg

SEQ ID NO: 4939326 - DNA, 19 bp, Homo sapiens
atgcttctcatcttgtgaa

SEQ ID NO: 4939327 - DNA, 21 bp, Homo sapiens
atgcttctcatcttgtgaaat

SEQ ID NO: 4939328 - DNA, 15 bp, Homo sapiens
atgcttcttccttac

SEQ ID NO: 4939329 - DNA, 22 bp, Homo sapiens
atgctttgtcttcagcctctcc

SEQ ID NO: 4939330 - DNA, 19 bp, Homo sapiens
atgctttttatttctgcat

SEQ ID NO: 4939331 - DNA, 21 bp, Homo sapiens
atggaaaaaccatttgaagtg

SEQ ID NO: 4939332 - DNA, 17 bp, Homo sapiens
atggaaacctcacgctg

SEQ ID NO: 4939333 - DNA, 11 bp, Homo sapiens
atggaaagaat

SEQ ID NO: 4939334 - DNA, 12 bp, Homo sapiens
atggaagagaaa

SEQ ID NO: 4939335 - DNA, 14 bp, Homo sapiens
atggaagagaaatc

SEQ ID NO: 4939336 - DNA, 13 bp, Homo sapiens
atggaattgattt

SEQ ID NO: 4939337 - DNA, 16 bp, Homo sapiens
atggaattgatttgca

SEQ ID NO: 4939338 - DNA, 18 bp, Homo sapiens
atggaattgatttgcatt

SEQ ID NO: 4939339 - DNA, 19 bp, Homo sapiens
atggaattgatttgcattg

SEQ ID NO: 4939340 - DNA, 13 bp, Homo sapiens
atggacactccag

SEQ ID NO: 4939341 - DNA, 19 bp, Homo sapiens
atggacactccagtgccag

SEQ ID NO: 4939342 - DNA, 18 bp, Homo sapiens
atggacagggcatgccac

SEQ ID NO: 4939343 - DNA, 18 bp, Homo sapiens
atggacagttcacaccct

SEQ ID NO: 4939344 - DNA, 21 bp, Homo sapiens
atggacagttcacaccctgca

SEQ ID NO: 4939345 - DNA, 15 bp, Homo sapiens
atggacatcctgtat

SEQ ID NO: 4939346 - DNA, 22 bp, Homo sapiens
atggaccactgtttcttgcttg

SEQ ID NO: 4939347 - DNA, 15 bp, Homo sapiens
atggactggtttgag

SEQ ID NO: 4939348 - DNA, 17 bp, Homo sapiens
atggactggtttgagat

SEQ ID NO: 4939349 - DNA, 18 bp, Homo sapiens
atggacttatttcttcaa

SEQ ID NO: 4939350 - DNA, 17 bp, Homo sapiens
atggactttggaagcag

SEQ ID NO: 4939351 - DNA, 18 bp, Homo sapiens
atggactttggaagcagg

SEQ ID NO: 4939352 - DNA, 19 bp, Homo sapiens
atggagattcagttttcat

SEQ ID NO: 4939353 - DNA, 12 bp, Homo sapiens
atggagcccagg

SEQ ID NO: 4939354 - DNA, 15 bp, Homo sapiens
atggagcctcttctg

SEQ ID NO: 4939355 - DNA, 20 bp, Homo sapiens
atggagcctggcacaggact

SEQ ID NO: 4939356 - DNA, 23 bp, Homo sapiens
atggagcctggcacaggactgat

SEQ ID NO: 4939357 - DNA, 12 bp, Homo sapiens
atggaggttcta

SEQ ID NO: 4939358 - DNA, 13 bp, Homo sapiens
atggaggttctaa

SEQ ID NO: 4939359 - DNA, 16 bp, Homo sapiens
atggaggttctaaggc

SEQ ID NO: 4939360 - DNA, 17 bp, Homo sapiens
atggaggttctaaggcc

SEQ ID NO: 4939361 - DNA, 13 bp, Homo sapiens
atggagtagaggt

SEQ ID NO: 4939362 - DNA, 22 bp, Homo sapiens
atggagtagaggtactagaatg

SEQ ID NO: 4939363 - DNA, 15 bp, Homo sapiens
atggagttcttgtgc

SEQ ID NO: 4939364 - DNA, 16 bp, Homo sapiens
atggatagagtattga

SEQ ID NO: 4939365 - DNA, 22 bp, Homo sapiens
atggatgaatctcccactccag

SEQ ID NO: 4939366 - DNA, 13 bp, Homo sapiens
atggatgcaaagt

SEQ ID NO: 4939367 - DNA, 19 bp, Homo sapiens
atggatgcaaagtacaatg

SEQ ID NO: 4939368 - DNA, 22 bp, Homo sapiens
atggatgccaatattaaatctg

SEQ ID NO: 4939369 - DNA, 15 bp, Homo sapiens
atggattggattatt

SEQ ID NO: 4939370 - DNA, 22 bp, Homo sapiens
atggattgttaatttcagtcct

SEQ ID NO: 4939371 - DNA, 17 bp, Homo sapiens
atggatttgatgctgtt

SEQ ID NO: 4939372 - DNA, 20 bp, Homo sapiens
atggcacttagctatcagaa

SEQ ID NO: 4939373 - DNA, 22 bp, Homo sapiens
atggcacttagctatcagaaga

SEQ ID NO: 4939374 - DNA, 13 bp, Homo sapiens
atggcagaagaca

SEQ ID NO: 4939375 - DNA, 19 bp, Homo sapiens
atggccaggatcctctcct

SEQ ID NO: 4939376 - DNA, 11 bp, Homo sapiens
atggcccctct

SEQ ID NO: 4939377 - DNA, 11 bp, Homo sapiens
atggccctggg

SEQ ID NO: 4939378 - DNA, 21 bp, Homo sapiens
atggccctgtagccagcacct

SEQ ID NO: 4939379 - DNA, 15 bp, Homo sapiens
atggcctcagctgcc

SEQ ID NO: 4939380 - DNA, 17 bp, Homo sapiens
atggcctcagctgcctc

SEQ ID NO: 4939381 - DNA, 19 bp, Homo sapiens
atggcctcagctgcctcac

SEQ ID NO: 4939382 - DNA, 21 bp, Homo sapiens
atggcctcttactaatgtaaa

SEQ ID NO: 4939383 - DNA, 22 bp, Homo sapiens
atggcctcttactaatgtaaaa

SEQ ID NO: 4939384 - DNA, 19 bp, Homo sapiens
atggctatatggcaagaaa

SEQ ID NO: 4939385 - DNA, 15 bp, Homo sapiens
atggctccagaaatg

SEQ ID NO: 4939386 - DNA, 17 bp, Homo sapiens
atggctgtgcctctgcc

SEQ ID NO: 4939387 - DNA, 20 bp, Homo sapiens
atggctgtgcctctgcctgt

SEQ ID NO: 4939388 - DNA, 16 bp, Homo sapiens
atggctttcagaaaac

SEQ ID NO: 4939389 - DNA, 23 bp, Homo sapiens
atggctttcagaaaacgggaagc

SEQ ID NO: 4939390 - DNA, 23 bp, Homo sapiens
atgggaaaggaggcatgcctctg

SEQ ID NO: 4939391 - DNA, 15 bp, Homo sapiens
atgggagagtagatg

SEQ ID NO: 4939392 - DNA, 22 bp, Homo sapiens
atgggagcagtccatgcatgac

SEQ ID NO: 4939393 - DNA, 18 bp, Homo sapiens
atgggaggaaagagagca

SEQ ID NO: 4939394 - DNA, 17 bp, Homo sapiens
atgggatacaacctccc

SEQ ID NO: 4939395 - DNA, 21 bp, Homo sapiens
atgggatacaacctccctctt

SEQ ID NO: 4939396 - DNA, 16 bp, Homo sapiens
atgggcattgacaaat

SEQ ID NO: 4939397 - DNA, 21 bp, Homo sapiens
attatttgggagggaaaaggg

SEQ ID NO: 4939398 - DNA, 23 bp, Homo sapiens
attatttgtgtaatagaaaactg

SEQ ID NO: 4939399 - DNA, 22 bp, Homo sapiens
attatttgtgttttaatttaaa

SEQ ID NO: 4939400 - DNA, 17 bp, Homo sapiens
attattttcattacaat

SEQ ID NO: 4939401 - DNA, 21 bp, Homo sapiens
attattttcattacaatggaa

SEQ ID NO: 4939402 - DNA, 16 bp, Homo sapiens
attattttggggtctc

SEQ ID NO: 4939403 - DNA, 21 bp, Homo sapiens
attcaaaagttccaagagtct

SEQ ID NO: 4939404 - DNA, 19 bp, Homo sapiens
attcaaactggggcctcca

SEQ ID NO: 4939405 - DNA, 17 bp, Homo sapiens
attcaaccatggacttt

SEQ ID NO: 4939406 - DNA, 19 bp, Homo sapiens
attcaaccatggactttat

SEQ ID NO: 4939407 - DNA, 22 bp, Homo sapiens
attcaatacaaacaatctctta

SEQ ID NO: 4939408 - DNA, 13 bp, Homo sapiens
attcaatattgac

SEQ ID NO: 4939409 - DNA, 16 bp, Homo sapiens
attcaatattgacatt

SEQ ID NO: 4939410 - DNA, 21 bp, Homo sapiens
attcaatattgacatttgtag

SEQ ID NO: 4939411 - DNA, 16 bp, Homo sapiens
attcaccccctttcct

SEQ ID NO: 4939412 - DNA, 20 bp, Homo sapiens
attcacggagatatgaagag

SEQ ID NO: 4939413 - DNA, 21 bp, Homo sapiens
attcactcaagcactgatatc

SEQ ID NO: 4939414 - DNA, 14 bp, Homo sapiens
attcagaaattgga

SEQ ID NO: 4939415 - DNA, 16 bp, Homo sapiens
attcagatcactgaat

SEQ ID NO: 4939416 - DNA, 19 bp, Homo sapiens
attcagatcactgaattta

SEQ ID NO: 4939417 - DNA, 21 bp, Homo sapiens
attcaggagagtagaacagat

SEQ ID NO: 4939418 - DNA, 13 bp, Homo sapiens
attcaggctgctt

SEQ ID NO: 4939419 - DNA, 18 bp, Homo sapiens
attcaggtatgttgcctt

SEQ ID NO: 4939420 - DNA, 12 bp, Homo sapiens
attcagtcttgc

SEQ ID NO: 4939421 - DNA, 20 bp, Homo sapiens
attcatggaccactgtttct

SEQ ID NO: 4939422 - DNA, 15 bp, Homo sapiens
attcattaaatgttt

SEQ ID NO: 4939423 - DNA, 22 bp, Homo sapiens
attcattctcataattcctaca

SEQ ID NO: 4939424 - DNA, 22 bp, Homo sapiens
attcatttcacattaatggtct

SEQ ID NO: 4939425 - DNA, 20 bp, Homo sapiens
attccaaatgtcttttagaa

SEQ ID NO: 4939426 - DNA, 17 bp, Homo sapiens
attccaatatgatgact

SEQ ID NO: 4939427 - DNA, 15 bp, Homo sapiens
attccaatatttctg

SEQ ID NO: 4939428 - DNA, 19 bp, Homo sapiens
attccagaagaagagaagc

SEQ ID NO: 4939429 - DNA, 22 bp, Homo sapiens
attccagaagaagagaagctgc

SEQ ID NO: 4939430 - DNA, 23 bp, Homo sapiens
attccattggtccaagattccgg

SEQ ID NO: 4939431 - DNA, 17 bp, Homo sapiens
attcccaactagacatt

SEQ ID NO: 4939432 - DNA, 16 bp, Homo sapiens
attcccaagctctgct

SEQ ID NO: 4939433 - DNA, 15 bp, Homo sapiens
attcccatctgtcac

SEQ ID NO: 4939434 - DNA, 15 bp, Homo sapiens
attccccattcttcc

SEQ ID NO: 4939435 - DNA, 17 bp, Homo sapiens
attccctagatctttct

SEQ ID NO: 4939436 - DNA, 15 bp, Homo sapiens
attccggatcctaag

SEQ ID NO: 4939437 - DNA, 19 bp, Homo sapiens
attccggatcctaagcatc

SEQ ID NO: 4939438 - DNA, 14 bp, Homo sapiens
attcctaagaatca

SEQ ID NO: 4939439 - DNA, 16 bp, Homo sapiens
attcctacagcactac

SEQ ID NO: 4939440 - DNA, 23 bp, Homo sapiens
attcctacagcactactgggtgt

SEQ ID NO: 4939441 - DNA, 22 bp, Homo sapiens
attccttccactaactcatagt

SEQ ID NO: 4939442 - DNA, 11 bp, Homo sapiens
attccttctct

SEQ ID NO: 4939443 - DNA, 12 bp, Homo sapiens
attccttgtgaa

SEQ ID NO: 4939444 - DNA, 13 bp, Homo sapiens
attcctttccctt

SEQ ID NO: 4939445 - DNA, 15 bp, Homo sapiens
attcctttcccttcc

SEQ ID NO: 4939446 - DNA, 17 bp, Homo sapiens
attcctttcccttcctc

SEQ ID NO: 4939447 - DNA, 16 bp, Homo sapiens
attcctttgtcttcaa

SEQ ID NO: 4939448 - DNA, 14 bp, Homo sapiens
attctaaaaccatt

SEQ ID NO: 4939449 - DNA, 22 bp, Homo sapiens
attctaaaatgtgatgttctaa

SEQ ID NO: 4939450 - DNA, 18 bp, Homo sapiens
attctaaagattctatag

SEQ ID NO: 4939451 - DNA, 19 bp, Homo sapiens
attctaaagattctatagt

SEQ ID NO: 4939452 - DNA, 14 bp, Homo sapiens
attctaaaggtcca

SEQ ID NO: 4939453 - DNA, 12 bp, Homo sapiens
attctaagactt

SEQ ID NO: 4939454 - DNA, 23 bp, Homo sapiens
attctaagacttactctaagatc

SEQ ID NO: 4939455 - DNA, 18 bp, Homo sapiens
attctaatgtcttcattt

SEQ ID NO: 4939456 - DNA, 15 bp, Homo sapiens
attctataaggccat

SEQ ID NO: 4939457 - DNA, 16 bp, Homo sapiens
attctatagttctaga

SEQ ID NO: 4939458 - DNA, 15 bp, Homo sapiens
attctatatgaattt

SEQ ID NO: 4939459 - DNA, 14 bp, Homo sapiens
attctattaacttt

SEQ ID NO: 4939460 - DNA, 20 bp, Homo sapiens
attctattgccttctttgaa

SEQ ID NO: 4939461 - DNA, 23 bp, Homo sapiens
attctattgccttctttgaagaa

SEQ ID NO: 4939462 - DNA, 19 bp, Homo sapiens
attctcaaagtttcctaat

SEQ ID NO: 4939463 - DNA, 18 bp, Homo sapiens
attctcataattcctaca

SEQ ID NO: 4939464 - DNA, 22 bp, Homo sapiens
attctcataattcctacagcac

SEQ ID NO: 4939465 - DNA, 13 bp, Homo sapiens
attctcatctgca

SEQ ID NO: 4939466 - DNA, 11 bp, Homo sapiens
attctcctgcc

SEQ ID NO: 4939467 - DNA, 17 bp, Homo sapiens
attctcctgcctcagcc

SEQ ID NO: 4939468 - DNA, 22 bp, Homo sapiens
attctcctgcctgtagcagtga

SEQ ID NO: 4939469 - DNA, 18 bp, Homo sapiens
attctccttgttgttggt

SEQ ID NO: 4939470 - DNA, 18 bp, Homo sapiens
attctccttttatgtgta

SEQ ID NO: 4939471 - DNA, 19 bp, Homo sapiens
attctcgtgagtcatttaa

SEQ ID NO: 4939472 - DNA, 22 bp, Homo sapiens
attctctgtgtctaagattcta

SEQ ID NO: 4939473 - DNA, 19 bp, Homo sapiens
attctcttttatctgttta

SEQ ID NO: 4939474 - DNA, 19 bp, Homo sapiens
attctgaagcaacatttta

SEQ ID NO: 4939475 - DNA, 20 bp, Homo sapiens
attctgaccacccttctcat

SEQ ID NO: 4939476 - DNA, 15 bp, Homo sapiens
attctgaggccctgc

SEQ ID NO: 4939477 - DNA, 19 bp, Homo sapiens
attctgatttggaaaaaga

SEQ ID NO: 4939478 - DNA, 20 bp, Homo sapiens
attctgcagtaaatctttta

SEQ ID NO: 4939479 - DNA, 21 bp, Homo sapiens
attctgcagtaaatcttttac

SEQ ID NO: 4939480 - DNA, 22 bp, Homo sapiens
attctgcattgctagataaaag

SEQ ID NO: 4939481 - DNA, 16 bp, Homo sapiens
attctgcccaaaaata

SEQ ID NO: 4939482 - DNA, 19 bp, Homo sapiens
attctgccctccttaattt

SEQ ID NO: 4939483 - DNA, 20 bp, Homo sapiens
attctgccgccccctcctga

SEQ ID NO: 4939484 - DNA, 22 bp, Homo sapiens
attctgccgccccctcctgaac

SEQ ID NO: 4939485 - DNA, 17 bp, Homo sapiens
attctgcctctctagga

SEQ ID NO: 4939486 - DNA, 16 bp, Homo sapiens
attctgcctgcccagg

SEQ ID NO: 4939487 - DNA, 18 bp, Homo sapiens
attctgcctgcccaggcc

SEQ ID NO: 4939488 - DNA, 20 bp, Homo sapiens
attctgcctgcccaggcccc

SEQ ID NO: 4939489 - DNA, 21 bp, Homo sapiens
attctgcctgcccaggcccct

SEQ ID NO: 4939490 - DNA, 21 bp, Homo sapiens
attctgctcacatatctgtca

SEQ ID NO: 4939491 - DNA, 12 bp, Homo sapiens
attctgtaaatg

SEQ ID NO: 4939492 - DNA, 14 bp, Homo sapiens
attctgttggccag

SEQ ID NO: 4939493 - DNA, 21 bp, Homo sapiens
attctgttggccagtgtgaca

SEQ ID NO: 4939494 - DNA, 22 bp, Homo sapiens
attcttaagggaacttccacat

SEQ ID NO: 4939495 - DNA, 22 bp, Homo sapiens
attcttacactgcctgtatact

SEQ ID NO: 4939496 - DNA, 22 bp, Homo sapiens
attcttcaggcttcctgcaatt

SEQ ID NO: 4939497 - DNA, 12 bp, Homo sapiens
attcttcctagt

SEQ ID NO: 4939498 - DNA, 17 bp, Homo sapiens
attcttcctagttttct

SEQ ID NO: 4939499 - DNA, 12 bp, Homo sapiens
attcttctagag

SEQ ID NO: 4939500 - DNA, 19 bp, Homo sapiens
attcttctgcttcagcctc

SEQ ID NO: 4939501 - DNA, 22 bp, Homo sapiens
attcttctgtacgtctgacagg

SEQ ID NO: 4939502 - DNA, 13 bp, Homo sapiens
attcttctgtgtt

SEQ ID NO: 4939503 - DNA, 14 bp, Homo sapiens
attcttctgtgttt

SEQ ID NO: 4939504 - DNA, 18 bp, Homo sapiens
attcttgaaggaaaatga

SEQ ID NO: 4939505 - DNA, 14 bp, Homo sapiens
attcttgtcaaaaa

SEQ ID NO: 4939506 - DNA, 15 bp, Homo sapiens
attttatgtttagat

SEQ ID NO: 4939507 - DNA, 17 bp, Homo sapiens
attttatttgtttttca

SEQ ID NO: 4939508 - DNA, 23 bp, Homo sapiens
attttattttgtgctcatttaag

SEQ ID NO: 4939509 - DNA, 22 bp, Homo sapiens
attttcaaaagcattaattttt

SEQ ID NO: 4939510 - DNA, 18 bp, Homo sapiens
attttcaacgcagccctg

SEQ ID NO: 4939511 - DNA, 20 bp, Homo sapiens
attttcaagcagcatcttct

SEQ ID NO: 4939512 - DNA, 22 bp, Homo sapiens
attttcacattcccatctgtca

SEQ ID NO: 4939513 - DNA, 15 bp, Homo sapiens
attttcaccccaccc

SEQ ID NO: 4939514 - DNA, 14 bp, Homo sapiens
attttcagaaaata

SEQ ID NO: 4939515 - DNA, 17 bp, Homo sapiens
attttcagaaaatatta

SEQ ID NO: 4939516 - DNA, 17 bp, Homo sapiens
attttcatgtatatgtg

SEQ ID NO: 4939517 - DNA, 20 bp, Homo sapiens
attttccccccactctcccc

SEQ ID NO: 4939518 - DNA, 21 bp, Homo sapiens
attttccccccactctcccca

SEQ ID NO: 4939519 - DNA, 17 bp, Homo sapiens
attttcgtatgaaaatg

SEQ ID NO: 4939520 - DNA, 19 bp, Homo sapiens
attttctacaaataatttt

SEQ ID NO: 4939521 - DNA, 18 bp, Homo sapiens
attttctagactttctgt

SEQ ID NO: 4939522 - DNA, 21 bp, Homo sapiens
attttctatgtactagtactg

SEQ ID NO: 4939523 - DNA, 23 bp, Homo sapiens
attttctatgtactagtactgtg

SEQ ID NO: 4939524 - DNA, 23 bp, Homo sapiens
attttctcaaaagcatttatcat

SEQ ID NO: 4939525 - DNA, 14 bp, Homo sapiens
attttctccagctc

SEQ ID NO: 4939526 - DNA, 12 bp, Homo sapiens
attttctgaaag

SEQ ID NO: 4939527 - DNA, 18 bp, Homo sapiens
attttctgaaagttaccc

SEQ ID NO: 4939528 - DNA, 19 bp, Homo sapiens
attttctggaatacatgaa

SEQ ID NO: 4939529 - DNA, 22 bp, Homo sapiens
attttctggggctcctcacata

SEQ ID NO: 4939530 - DNA, 14 bp, Homo sapiens
attttctggttcta

SEQ ID NO: 4939531 - DNA, 14 bp, Homo sapiens
attttctgtcagat

SEQ ID NO: 4939532 - DNA, 18 bp, Homo sapiens
attttctgtcagatgaga

SEQ ID NO: 4939533 - DNA, 19 bp, Homo sapiens
attttcttattgcgctgct

SEQ ID NO: 4939534 - DNA, 21 bp, Homo sapiens
attttcttattgcgctgctac

SEQ ID NO: 4939535 - DNA, 23 bp, Homo sapiens
attttctttgtgtagctttgctc

SEQ ID NO: 4939536 - DNA, 13 bp, Homo sapiens
attttgaaaagct

SEQ ID NO: 4939537 - DNA, 19 bp, Homo sapiens
attttgaaaagcttcttaa

SEQ ID NO: 4939538 - DNA, 12 bp, Homo sapiens
attttgaagttt

SEQ ID NO: 4939539 - DNA, 15 bp, Homo sapiens
attttgaagtttaca

SEQ ID NO: 4939540 - DNA, 12 bp, Homo sapiens
attttgaatacc

SEQ ID NO: 4939541 - DNA, 18 bp, Homo sapiens
attttgataataaattga

SEQ ID NO: 4939542 - DNA, 21 bp, Homo sapiens
attttgataataatattgttt

SEQ ID NO: 4939543 - DNA, 19 bp, Homo sapiens
attttgatccaagctggtc

SEQ ID NO: 4939544 - DNA, 20 bp, Homo sapiens
attttgatgcagcatttgat

SEQ ID NO: 4939545 - DNA, 21 bp, Homo sapiens
attttgatgcagcatttgata

SEQ ID NO: 4939546 - DNA, 18 bp, Homo sapiens
attttgatgtgacaataa

SEQ ID NO: 4939547 - DNA, 21 bp, Homo sapiens
attttgatgtgacaataatat

SEQ ID NO: 4939548 - DNA, 19 bp, Homo sapiens
attttgcaaatataaacat

SEQ ID NO: 4939549 - DNA, 19 bp, Homo sapiens
attttggcgctattacaaa

SEQ ID NO: 4939550 - DNA, 20 bp, Homo sapiens
attttggcgctattacaaat

SEQ ID NO: 4939551 - DNA, 21 bp, Homo sapiens
attttgggacaattgttttaa

SEQ ID NO: 4939552 - DNA, 22 bp, Homo sapiens
attttggggtacccactgctct

SEQ ID NO: 4939553 - DNA, 23 bp, Homo sapiens
attttggggtacccactgctctg

SEQ ID NO: 4939554 - DNA, 19 bp, Homo sapiens
attttgggttttgggtctt

SEQ ID NO: 4939555 - DNA, 10 bp, Homo sapiens
attttgtaaa

SEQ ID NO: 4939556 - DNA, 19 bp, Homo sapiens
attttgtaacgaagacaca

SEQ ID NO: 4939557 - DNA, 15 bp, Homo sapiens
attttgtaattatga

SEQ ID NO: 4939558 - DNA, 17 bp, Homo sapiens
attttgtattattgctg

SEQ ID NO: 4939559 - DNA, 22 bp, Homo sapiens
attttgtattattgctgttgct

SEQ ID NO: 4939560 - DNA, 14 bp, Homo sapiens
attttgtattgtgg

SEQ ID NO: 4939561 - DNA, 22 bp, Homo sapiens
attttgtgtgaccaactgtgtt

SEQ ID NO: 4939562 - DNA, 13 bp, Homo sapiens
attttgttgtaaa

SEQ ID NO: 4939563 - DNA, 16 bp, Homo sapiens
attttgtttcttttaa

SEQ ID NO: 4939564 - DNA, 16 bp, Homo sapiens
atttttaaaaaatgaa

SEQ ID NO: 4939565 - DNA, 17 bp, Homo sapiens
atttttaaaaagaaatc

SEQ ID NO: 4939566 - DNA, 23 bp, Homo sapiens
atttttaaaaagaaatctggtct

SEQ ID NO: 4939567 - DNA, 16 bp, Homo sapiens
atttttaaaatattta

SEQ ID NO: 4939568 - DNA, 14 bp, Homo sapiens
atttttaaagtaga

SEQ ID NO: 4939569 - DNA, 19 bp, Homo sapiens
atttttaaagtagaagagg

SEQ ID NO: 4939570 - DNA, 19 bp, Homo sapiens
atttttaaatgtaaaacat

SEQ ID NO: 4939571 - DNA, 17 bp, Homo sapiens
atttttaccctaatgtc

SEQ ID NO: 4939572 - DNA, 19 bp, Homo sapiens
atttttaccctaatgtctt

SEQ ID NO: 4939573 - DNA, 22 bp, Homo sapiens
atttttaccctaatgtcttcat

SEQ ID NO: 4939574 - DNA, 22 bp, Homo sapiens
atttttaggaagttttctgtag

SEQ ID NO: 4939575 - DNA, 17 bp, Homo sapiens
atttttatacaaaccta

SEQ ID NO: 4939576 - DNA, 11 bp, Homo sapiens
atttttatcag

SEQ ID NO: 4939577 - DNA, 14 bp, Homo sapiens
atttttatttatga

SEQ ID NO: 4939578 - DNA, 14 bp, Homo sapiens
atttttatttcaga

SEQ ID NO: 4939579 - DNA, 20 bp, Homo sapiens
atttttatttcagattttga

SEQ ID NO: 4939580 - DNA, 20 bp, Homo sapiens
atttttcaacaaatatcttg

SEQ ID NO: 4939581 - DNA, 18 bp, Homo sapiens
atttttcagctctctgta

SEQ ID NO: 4939582 - DNA, 15 bp, Homo sapiens
atttttcagttccaa

SEQ ID NO: 4939583 - DNA, 16 bp, Homo sapiens
atttttcagttccaag

SEQ ID NO: 4939584 - DNA, 18 bp, Homo sapiens
atttttcatattgtgcca

SEQ ID NO: 4939585 - DNA, 15 bp, Homo sapiens
atttttccaaaataa

SEQ ID NO: 4939586 - DNA, 21 bp, Homo sapiens
atttttgataaagcctcaagg

SEQ ID NO: 4939587 - DNA, 12 bp, Homo sapiens
atttttgtaatt

SEQ ID NO: 4939588 - DNA, 19 bp, Homo sapiens
attttttaatttaaagctt

SEQ ID NO: 4939589 - DNA, 19 bp, Homo sapiens
attttttacagctgcctgc

SEQ ID NO: 4939590 - DNA, 22 bp, Homo sapiens
attttttatgggcattgacaaa

SEQ ID NO: 4939591 - DNA, 12 bp, Homo sapiens
attttttattgt

SEQ ID NO: 4939592 - DNA, 14 bp, Homo sapiens
attttttcagttgt

SEQ ID NO: 4939593 - DNA, 22 bp, Homo sapiens
attttttgggcagcaatttaaa

SEQ ID NO: 4939594 - DNA, 13 bp, Homo sapiens
atttttttgtctt

SEQ ID NO: 4939595 - DNA, 16 bp, Homo sapiens
attttttttttaaatc

SEQ ID NO: 4939596 - DNA, 23 bp, Homo sapiens
atttttttttttgtttctgagaa

SEQ ID NO: 4939597 - DNA, 14 bp, Homo sapiens
caaaaacaaaaaga

SEQ ID NO: 4939598 - DNA, 13 bp, Homo sapiens
caaaaactgtttt

SEQ ID NO: 4939599 - DNA, 23 bp, Homo sapiens
caaaaactttggagtcccctcac

SEQ ID NO: 4939600 - DNA, 14 bp, Homo sapiens
caaaaagaaatgac

SEQ ID NO: 4939601 - DNA, 16 bp, Homo sapiens
caaaaagaaatgacta

SEQ ID NO: 4939602 - DNA, 22 bp, Homo sapiens
caaaaagctcttacactacatt

SEQ ID NO: 4939603 - DNA, 21 bp, Homo sapiens
caaaaagtggggcagagcctc

SEQ ID NO: 4939604 - DNA, 17 bp, Homo sapiens
caaaaagtgtttatttt

SEQ ID NO: 4939605 - DNA, 15 bp, Homo sapiens
caaaaagtttccata

SEQ ID NO: 4939606 - DNA, 17 bp, Homo sapiens
caaaaatatcccttccg

SEQ ID NO: 4939607 - DNA, 14 bp, Homo sapiens
caaaaatgttgaac

SEQ ID NO: 4939608 - DNA, 17 bp, Homo sapiens
caaaaattatctatagc

SEQ ID NO: 4939609 - DNA, 19 bp, Homo sapiens
caaaaattatctatagcta

SEQ ID NO: 4939610 - DNA, 14 bp, Homo sapiens
caaaacaaaacaaa

SEQ ID NO: 4939611 - DNA, 16 bp, Homo sapiens
caaaacaaagtctttg

SEQ ID NO: 4939612 - DNA, 20 bp, Homo sapiens
caaaacaagtttttctgtca

SEQ ID NO: 4939613 - DNA, 19 bp, Homo sapiens
caaaacactcggcatttca

SEQ ID NO: 4939614 - DNA, 13 bp, Homo sapiens
caaaacactgtgg

SEQ ID NO: 4939615 - DNA, 9 bp, Homo sapiens
caacttgag

SEQ ID NO: 4939616 - DNA, 16 bp, Homo sapiens
caacttgagatgtatg

SEQ ID NO: 4939617 - DNA, 13 bp, Homo sapiens
caacttgagggcc

SEQ ID NO: 4939618 - DNA, 19 bp, Homo sapiens
caacttgagggcccagagc

SEQ ID NO: 4939619 - DNA, 22 bp, Homo sapiens
caacttgcatccaactccagga

SEQ ID NO: 4939620 - DNA, 18 bp, Homo sapiens
caacttggttctgcttca

SEQ ID NO: 4939621 - DNA, 15 bp, Homo sapiens
caagaaaaaataaat

SEQ ID NO: 4939622 - DNA, 18 bp, Homo sapiens
caagaaaatcaggtatta

SEQ ID NO: 4939623 - DNA, 15 bp, Homo sapiens
caagaacctggaaaa

SEQ ID NO: 4939624 - DNA, 19 bp, Homo sapiens
caagaagaagggcacccta

SEQ ID NO: 4939625 - DNA, 22 bp, Homo sapiens
caagaagctttaatatttaaat

SEQ ID NO: 4939626 - DNA, 14 bp, Homo sapiens
caagaagtttattc

SEQ ID NO: 4939627 - DNA, 12 bp, Homo sapiens
caagacaaatca

SEQ ID NO: 4939628 - DNA, 14 bp, Homo sapiens
caagacaaatcaac

SEQ ID NO: 4939629 - DNA, 19 bp, Homo sapiens
caagaccaccacttcgaaa

SEQ ID NO: 4939630 - DNA, 15 bp, Homo sapiens
caagacctaggctca

SEQ ID NO: 4939631 - DNA, 14 bp, Homo sapiens
caagactctagagt

SEQ ID NO: 4939632 - DNA, 20 bp, Homo sapiens
caagagaaaggcctgcacac

SEQ ID NO: 4939633 - DNA, 22 bp, Homo sapiens
caagagaaaggcctgcacacaa

SEQ ID NO: 4939634 - DNA, 24 bp, Homo sapiens
caagagagggccatgcaattcatc

SEQ ID NO: 4939635 - DNA, 21 bp, Homo sapiens
caagagcagcctgtggcatct

SEQ ID NO: 4939636 - DNA, 22 bp, Homo sapiens
caagagcccccttgacaccggg

SEQ ID NO: 4939637 - DNA, 16 bp, Homo sapiens
caagagcctgatctct

SEQ ID NO: 4939638 - DNA, 21 bp, Homo sapiens
caagagcctgatctcttcctg

SEQ ID NO: 4939639 - DNA, 20 bp, Homo sapiens
caagagctgccctccttgtc

SEQ ID NO: 4939640 - DNA, 16 bp, Homo sapiens
caagaggctcctgtcc

SEQ ID NO: 4939641 - DNA, 13 bp, Homo sapiens
caagagggcactg

SEQ ID NO: 4939642 - DNA, 15 bp, Homo sapiens
caagagggcactggt

SEQ ID NO: 4939643 - DNA, 20 bp, Homo sapiens
caagagggcactggtggccc

SEQ ID NO: 4939644 - DNA, 12 bp, Homo sapiens
caagagggtctg

SEQ ID NO: 4939645 - DNA, 17 bp, Homo sapiens
caagagggtctgaggaa

SEQ ID NO: 4939646 - DNA, 21 bp, Homo sapiens
caagaggtacagggtttttac

SEQ ID NO: 4939647 - DNA, 14 bp, Homo sapiens
caagagtctaaaga

SEQ ID NO: 4939648 - DNA, 22 bp, Homo sapiens
caagagtttatttccaaataaa

SEQ ID NO: 4939649 - DNA, 17 bp, Homo sapiens
caagatagatttggaat

SEQ ID NO: 4939650 - DNA, 18 bp, Homo sapiens
caagatgaaggagaggca

SEQ ID NO: 4939651 - DNA, 16 bp, Homo sapiens
caagatgactggggtg

SEQ ID NO: 4939652 - DNA, 12 bp, Homo sapiens
caagattagaag

SEQ ID NO: 4939653 - DNA, 14 bp, Homo sapiens
caagattctagatg

SEQ ID NO: 4939654 - DNA, 15 bp, Homo sapiens
caagatttagaaaaa

SEQ ID NO: 4939655 - DNA, 13 bp, Homo sapiens
caagatttccttg

SEQ ID NO: 4939656 - DNA, 22 bp, Homo sapiens
caagcaagctctcttgccgagg

SEQ ID NO: 4939657 - DNA, 18 bp, Homo sapiens
caagcacctagcctcgct

SEQ ID NO: 4939658 - DNA, 13 bp, Homo sapiens
caagcacctcctg

SEQ ID NO: 4939659 - DNA, 18 bp, Homo sapiens
caagcagaggtggccaga

SEQ ID NO: 4939660 - DNA, 23 bp, Homo sapiens
caagccaaagtggcatgttttgt

SEQ ID NO: 4939661 - DNA, 19 bp, Homo sapiens
caagccacaagtcttccag

SEQ ID NO: 4939662 - DNA, 15 bp, Homo sapiens
caagcccaggccacc

SEQ ID NO: 4939663 - DNA, 21 bp, Homo sapiens
caagcccaggtgccagcctga

SEQ ID NO: 4939664 - DNA, 21 bp, Homo sapiens
caagccctccccatcccatgt

SEQ ID NO: 4939665 - DNA, 14 bp, Homo sapiens
caagccgtggcttc

SEQ ID NO: 4939666 - DNA, 15 bp, Homo sapiens
caagccgtggcttcc

SEQ ID NO: 4939667 - DNA, 17 bp, Homo sapiens
caagccgtggcttcccg

SEQ ID NO: 4939668 - DNA, 13 bp, Homo sapiens
caagcctccacag

SEQ ID NO: 4939669 - DNA, 22 bp, Homo sapiens
caagcgattcttctgcttcagc

SEQ ID NO: 4939670 - DNA, 18 bp, Homo sapiens
caagcgtgagccactgca

SEQ ID NO: 4939671 - DNA, 14 bp, Homo sapiens
caagctaagcactg

SEQ ID NO: 4939672 - DNA, 16 bp, Homo sapiens
caagctatctaaagtt

SEQ ID NO: 4939673 - DNA, 17 bp, Homo sapiens
caagctatctaaagttt

SEQ ID NO: 4939674 - DNA, 18 bp, Homo sapiens
caagctattcctttccct

SEQ ID NO: 4939675 - DNA, 13 bp, Homo sapiens
caagctccctgcc

SEQ ID NO: 4939676 - DNA, 16 bp, Homo sapiens
caagctccctgcccca

SEQ ID NO: 4939677 - DNA, 20 bp, Homo sapiens
caagctccgcctcccgggtt

SEQ ID NO: 4939678 - DNA, 14 bp, Homo sapiens
caagctcctcctcg

SEQ ID NO: 4939679 - DNA, 16 bp, Homo sapiens
caagctcctcctcgga

SEQ ID NO: 4939680 - DNA, 21 bp, Homo sapiens
caagctggtcccactcagtcc

SEQ ID NO: 4939681 - DNA, 22 bp, Homo sapiens
caagctggtcccactcagtcca

SEQ ID NO: 4939682 - DNA, 14 bp, Homo sapiens
caagctgttttctt

SEQ ID NO: 4939683 - DNA, 15 bp, Homo sapiens
caaggaaaaacaggt

SEQ ID NO: 4939684 - DNA, 16 bp, Homo sapiens
caaggaagatatacat

SEQ ID NO: 4939685 - DNA, 17 bp, Homo sapiens
caaggaagatatacatg

SEQ ID NO: 4939686 - DNA, 12 bp, Homo sapiens
caaggaaggaaa

SEQ ID NO: 4939687 - DNA, 13 bp, Homo sapiens
caaggaaggaaag

SEQ ID NO: 4939688 - DNA, 16 bp, Homo sapiens
caaggaaggaaagaaa

SEQ ID NO: 4939689 - DNA, 17 bp, Homo sapiens
caaggaaggaaagaaag

SEQ ID NO: 4939690 - DNA, 20 bp, Homo sapiens
caaggaccaggactccctcc

SEQ ID NO: 4939691 - DNA, 19 bp, Homo sapiens
caaggacctcctcttcccc

SEQ ID NO: 4939692 - DNA, 15 bp, Homo sapiens
caaggactgagggac

SEQ ID NO: 4939693 - DNA, 22 bp, Homo sapiens
caaggactgcagggactgccag

SEQ ID NO: 4939694 - DNA, 15 bp, Homo sapiens
caaggattgaaaatt

SEQ ID NO: 4939695 - DNA, 15 bp, Homo sapiens
caaggcactctagat

SEQ ID NO: 4939696 - DNA, 18 bp, Homo sapiens
caaggccagagtggcctg

SEQ ID NO: 4939697 - DNA, 20 bp, Homo sapiens
caaggccagagtggcctggc

SEQ ID NO: 4939698 - DNA, 21 bp, Homo sapiens
caaggccagagtggcctggcc

SEQ ID NO: 4939699 - DNA, 15 bp, Homo sapiens
caaggcccacaggag

SEQ ID NO: 4939700 - DNA, 13 bp, Homo sapiens
caaggccctgctg

SEQ ID NO: 4939701 - DNA, 14 bp, Homo sapiens
caaggccctgctgc

SEQ ID NO: 4939702 - DNA, 16 bp, Homo sapiens
caaggccctgctgccc

SEQ ID NO: 4939703 - DNA, 22 bp, Homo sapiens
caaggccctgctgcccaatctc

SEQ ID NO: 4939704 - DNA, 19 bp, Homo sapiens
caaggcgggagcatctctt

SEQ ID NO: 4939705 - DNA, 17 bp, Homo sapiens
caaggcttatattcaac

SEQ ID NO: 4939706 - DNA, 21 bp, Homo sapiens
caaggggaatgtttgcctctg

SEQ ID NO: 4939707 - DNA, 15 bp, Homo sapiens
caaggtctgagccac

SEQ ID NO: 4939708 - DNA, 20 bp, Homo sapiens
caaggtctgagccacagcag

SEQ ID NO: 4939709 - DNA, 14 bp, Homo sapiens
caaggtctttggtt

SEQ ID NO: 4939710 - DNA, 15 bp, Homo sapiens
caaggtgcaaatcaa

SEQ ID NO: 4939711 - DNA, 17 bp, Homo sapiens
caaggtggtcagtaaat

SEQ ID NO: 4939712 - DNA, 13 bp, Homo sapiens
caaggttttaggt

SEQ ID NO: 4939713 - DNA, 20 bp, Homo sapiens
caaggttttaggttctaaag

SEQ ID NO: 4939714 - DNA, 23 bp, Homo sapiens
caaggttttaggttctaaagttc

SEQ ID NO: 4939715 - DNA, 15 bp, Homo sapiens
caagtagtctgctca

SEQ ID NO: 4939716 - DNA, 20 bp, Homo sapiens
caagtataattttttgtaat

SEQ ID NO: 4939717 - DNA, 18 bp, Homo sapiens
caagtatagcctatggca

SEQ ID NO: 4939718 - DNA, 16 bp, Homo sapiens
caagtatgaataaaga

SEQ ID NO: 4939719 - DNA, 14 bp, Homo sapiens
caagtcaatcattt

SEQ ID NO: 4939720 - DNA, 18 bp, Homo sapiens
caagtcacatgcgtaaac

SEQ ID NO: 4939721 - DNA, 19 bp, Homo sapiens
caagtcaggcccttatttt

SEQ ID NO: 4939722 - DNA, 16 bp, Homo sapiens
caagtcatgtgcattt

SEQ ID NO: 4939723 - DNA, 14 bp, Homo sapiens
caagtcctcttttc

SEQ ID NO: 4939724 - DNA, 15 bp, Homo sapiens
caagtcctgtgaatt

SEQ ID NO: 4939725 - DNA, 14 bp, Homo sapiens
cacaggtctagact

SEQ ID NO: 4939726 - DNA, 16 bp, Homo sapiens
cacaggtgtggtgtaa

SEQ ID NO: 4939727 - DNA, 19 bp, Homo sapiens
cacaggtgtggtgtaattt

SEQ ID NO: 4939728 - DNA, 15 bp, Homo sapiens
cacaggttggaagag

SEQ ID NO: 4939729 - DNA, 16 bp, Homo sapiens
cacaggttggaagaga

SEQ ID NO: 4939730 - DNA, 20 bp, Homo sapiens
cacaggttggaagagaatca

SEQ ID NO: 4939731 - DNA, 17 bp, Homo sapiens
cacagtacagcatgtgc

SEQ ID NO: 4939732 - DNA, 21 bp, Homo sapiens
cacagtattacttctgctaca

SEQ ID NO: 4939733 - DNA, 11 bp, Homo sapiens
cacagtgaccc

SEQ ID NO: 4939734 - DNA, 19 bp, Homo sapiens
cacagtgagtcgaggacag

SEQ ID NO: 4939735 - DNA, 21 bp, Homo sapiens
cacagtgagtcgaggacaggg

SEQ ID NO: 4939736 - DNA, 14 bp, Homo sapiens
cacagtgcatctca

SEQ ID NO: 4939737 - DNA, 19 bp, Homo sapiens
cacagtgttgcccaggctg

SEQ ID NO: 4939738 - DNA, 17 bp, Homo sapiens
cacagttgccaccacct

SEQ ID NO: 4939739 - DNA, 20 bp, Homo sapiens
cacagttgccaccacctctg

SEQ ID NO: 4939740 - DNA, 12 bp, Homo sapiens
cacagtttgaac

SEQ ID NO: 4939741 - DNA, 15 bp, Homo sapiens
cacatacacgaaaga

SEQ ID NO: 4939742 - DNA, 22 bp, Homo sapiens
cacatagattaatggcactgat

SEQ ID NO: 4939743 - DNA, 14 bp, Homo sapiens
cacatatacctata

SEQ ID NO: 4939744 - DNA, 21 bp, Homo sapiens
cacatatgcaccttgtgtctg

SEQ ID NO: 4939745 - DNA, 19 bp, Homo sapiens
cacatccaactccagcaac

SEQ ID NO: 4939746 - DNA, 14 bp, Homo sapiens
cacatccattccca

SEQ ID NO: 4939747 - DNA, 17 bp, Homo sapiens
cacatccgccttttgta

SEQ ID NO: 4939748 - DNA, 13 bp, Homo sapiens
cacatcttgctct

SEQ ID NO: 4939749 - DNA, 24 bp, Homo sapiens
cacatgaatcccacccacatgtga

SEQ ID NO: 4939750 - DNA, 15 bp, Homo sapiens
cacatgctggccagc

SEQ ID NO: 4939751 - DNA, 22 bp, Homo sapiens
cacatgggagcagtccatgcat

SEQ ID NO: 4939752 - DNA, 22 bp, Homo sapiens
cacattaaaaaatgaaatattt

SEQ ID NO: 4939753 - DNA, 18 bp, Homo sapiens
cacattaatggtctaaaa

SEQ ID NO: 4939754 - DNA, 23 bp, Homo sapiens
cacattagattttattttactat

SEQ ID NO: 4939755 - DNA, 13 bp, Homo sapiens
cacattatttcta

SEQ ID NO: 4939756 - DNA, 14 bp, Homo sapiens
cacattgcattcta

SEQ ID NO: 4939757 - DNA, 22 bp, Homo sapiens
cacattgttgtttttttaatag

SEQ ID NO: 4939758 - DNA, 11 bp, Homo sapiens
cacatttaagg

SEQ ID NO: 4939759 - DNA, 17 bp, Homo sapiens
cacatttattctgctca

SEQ ID NO: 4939760 - DNA, 12 bp, Homo sapiens
cacatttgtaca

SEQ ID NO: 4939761 - DNA, 18 bp, Homo sapiens
cacattttagtccagaga

SEQ ID NO: 4939762 - DNA, 12 bp, Homo sapiens
cacattttttat

SEQ ID NO: 4939763 - DNA, 18 bp, Homo sapiens
caccaaagatgcagccgc

SEQ ID NO: 4939764 - DNA, 16 bp, Homo sapiens
caccaaagttctaata

SEQ ID NO: 4939765 - DNA, 15 bp, Homo sapiens
caccacacccagccc

SEQ ID NO: 4939766 - DNA, 19 bp, Homo sapiens
caccacacccagcccactt

SEQ ID NO: 4939767 - DNA, 15 bp, Homo sapiens
caccacagacacaca

SEQ ID NO: 4939768 - DNA, 20 bp, Homo sapiens
caccacagacacacacacgc

SEQ ID NO: 4939769 - DNA, 21 bp, Homo sapiens
caccacagacacacacacgca

SEQ ID NO: 4939770 - DNA, 15 bp, Homo sapiens
caccacgtccagctg

SEQ ID NO: 4939771 - DNA, 21 bp, Homo sapiens
caccagagaccgtcctcaccc

SEQ ID NO: 4939772 - DNA, 18 bp, Homo sapiens
caccagagcaacctctca

SEQ ID NO: 4939773 - DNA, 17 bp, Homo sapiens
caccagagcccaccttg

SEQ ID NO: 4939774 - DNA, 20 bp, Homo sapiens
caccagagcccaccttggct

SEQ ID NO: 4939775 - DNA, 11 bp, Homo sapiens
caccagcacca

SEQ ID NO: 4939776 - DNA, 19 bp, Homo sapiens
caccagcatcacctgcctg

SEQ ID NO: 4939777 - DNA, 19 bp, Homo sapiens
caccagcccatggccctgt

SEQ ID NO: 4939778 - DNA, 21 bp, Homo sapiens
caccagcccatggccctgtgc

SEQ ID NO: 4939779 - DNA, 16 bp, Homo sapiens
caccagccccagtgcc

SEQ ID NO: 4939780 - DNA, 23 bp, Homo sapiens
caccagtcacatgacctgatcac

SEQ ID NO: 4939781 - DNA, 18 bp, Homo sapiens
caccagtgtggggttctg

SEQ ID NO: 4939782 - DNA, 15 bp, Homo sapiens
caccatcatgtctgg

SEQ ID NO: 4939783 - DNA, 17 bp, Homo sapiens
caccatcatgtctggct

SEQ ID NO: 4939784 - DNA, 16 bp, Homo sapiens
caccatggccagccaa

SEQ ID NO: 4939785 - DNA, 20 bp, Homo sapiens
caccatgttgcccaggctgg

SEQ ID NO: 4939786 - DNA, 22 bp, Homo sapiens
cacccaaagaggtatttatctt

SEQ ID NO: 4939787 - DNA, 17 bp, Homo sapiens
cacccaaagcatggact

SEQ ID NO: 4939788 - DNA, 19 bp, Homo sapiens
cacccaagagattgttgtt

SEQ ID NO: 4939789 - DNA, 19 bp, Homo sapiens
cacccacatgtgacacata

SEQ ID NO: 4939790 - DNA, 21 bp, Homo sapiens
cacccacatgtgacacatatg

SEQ ID NO: 4939791 - DNA, 12 bp, Homo sapiens
cacccacctcag

SEQ ID NO: 4939792 - DNA, 16 bp, Homo sapiens
cacccacctcagcctc

SEQ ID NO: 4939793 - DNA, 18 bp, Homo sapiens
cacccacctcagcctccc

SEQ ID NO: 4939794 - DNA, 12 bp, Homo sapiens
cacccagcccac

SEQ ID NO: 4939795 - DNA, 11 bp, Homo sapiens
cacccagcctc

SEQ ID NO: 4939796 - DNA, 19 bp, Homo sapiens
cacccagcctcagtcctcc

SEQ ID NO: 4939797 - DNA, 13 bp, Homo sapiens
cacccatgggctc

SEQ ID NO: 4939798 - DNA, 18 bp, Homo sapiens
cacccatgggctctgaca

SEQ ID NO: 4939799 - DNA, 22 bp, Homo sapiens
caccccaagtagtctgctcaca

SEQ ID NO: 4939800 - DNA, 13 bp, Homo sapiens
caccccaccctcc

SEQ ID NO: 4939801 - DNA, 19 bp, Homo sapiens
caccccaccctccctggag

SEQ ID NO: 4939802 - DNA, 20 bp, Homo sapiens
caccccaccctccctggagt

SEQ ID NO: 4939803 - DNA, 11 bp, Homo sapiens
caccccacctg

SEQ ID NO: 4939804 - DNA, 22 bp, Homo sapiens
caccccactgcaatcctgtctt

SEQ ID NO: 4939805 - DNA, 12 bp, Homo sapiens
caccccatccca

SEQ ID NO: 4939806 - DNA, 13 bp, Homo sapiens
cacccccagctca

SEQ ID NO: 4939807 - DNA, 14 bp, Homo sapiens
cacccccagctcaa

SEQ ID NO: 4939808 - DNA, 16 bp, Homo sapiens
cacccccctgttctaa

SEQ ID NO: 4939809 - DNA, 16 bp, Homo sapiens
cacccccttctctgct

SEQ ID NO: 4939810 - DNA, 17 bp, Homo sapiens
cacccccttctctgctc

SEQ ID NO: 4939811 - DNA, 14 bp, Homo sapiens
caccccctttcctg

SEQ ID NO: 4939812 - DNA, 18 bp, Homo sapiens
caccccggcaggccctgc

SEQ ID NO: 4939813 - DNA, 20 bp, Homo sapiens
caccccggcaggccctgcag

SEQ ID NO: 4939814 - DNA, 22 bp, Homo sapiens
caccccggcaggccctgcagtg

SEQ ID NO: 4939815 - DNA, 18 bp, Homo sapiens
caccccgggctctctgct

SEQ ID NO: 4939816 - DNA, 24 bp, Homo sapiens
cacccctacccctggctgtactgc

SEQ ID NO: 4939817 - DNA, 12 bp, Homo sapiens
cacccctcactc

SEQ ID NO: 4939818 - DNA, 17 bp, Homo sapiens
cacccctcactctggcc

SEQ ID NO: 4939819 - DNA, 13 bp, Homo sapiens
cacccctccagga

SEQ ID NO: 4939820 - DNA, 13 bp, Homo sapiens
cacccctccctct

SEQ ID NO: 4939821 - DNA, 13 bp, Homo sapiens
cacccggcccctg

SEQ ID NO: 4939822 - DNA, 16 bp, Homo sapiens
cacccggcccctgctg

SEQ ID NO: 4939823 - DNA, 18 bp, Homo sapiens
caccctagtcccttcccc

SEQ ID NO: 4939824 - DNA, 20 bp, Homo sapiens
caccctagtcccttcccctc

SEQ ID NO: 4939825 - DNA, 15 bp, Homo sapiens
caccctcactctgcc

SEQ ID NO: 4939826 - DNA, 16 bp, Homo sapiens
caccctcactctgcca

SEQ ID NO: 4939827 - DNA, 15 bp, Homo sapiens
caccctccctggagt

SEQ ID NO: 4939828 - DNA, 19 bp, Homo sapiens
caccctcgaagcgcgccac

SEQ ID NO: 4939829 - DNA, 11 bp, Homo sapiens
caccctgcaag

SEQ ID NO: 4939830 - DNA, 14 bp, Homo sapiens
caccctgcaaggcc

SEQ ID NO: 4939831 - DNA, 21 bp, Homo sapiens
caccctgcaaggcccacagga

SEQ ID NO: 4939832 - DNA, 12 bp, Homo sapiens
caccctgctctc

SEQ ID NO: 4939833 - DNA, 16 bp, Homo sapiens
caccctgggagacaga

SEQ ID NO: 4939834 - DNA, 15 bp, Homo sapiens
caccctggggagaaa

SEQ ID NO: 4939835 - DNA, 13 bp, Homo sapiens
cactttcccaccc

SEQ ID NO: 4939836 - DNA, 17 bp, Homo sapiens
cactttctaatgtttct

SEQ ID NO: 4939837 - DNA, 18 bp, Homo sapiens
cactttctaatgtttctg

SEQ ID NO: 4939838 - DNA, 13 bp, Homo sapiens
cactttgatgtca

SEQ ID NO: 4939839 - DNA, 20 bp, Homo sapiens
cactttgatgtcatgtgttc

SEQ ID NO: 4939840 - DNA, 17 bp, Homo sapiens
cactttgcacagctctc

SEQ ID NO: 4939841 - DNA, 23 bp, Homo sapiens
cactttgcacgacgccctctccc

SEQ ID NO: 4939842 - DNA, 17 bp, Homo sapiens
cactttgcctcctgtgt

SEQ ID NO: 4939843 - DNA, 16 bp, Homo sapiens
cacttttatgagcttc

SEQ ID NO: 4939844 - DNA, 16 bp, Homo sapiens
cactttttgaactaag

SEQ ID NO: 4939845 - DNA, 20 bp, Homo sapiens
cagaaaaaatgtctgtaaat

SEQ ID NO: 4939846 - DNA, 21 bp, Homo sapiens
cagaaacactgcctttttatt

SEQ ID NO: 4939847 - DNA, 17 bp, Homo sapiens
cagaaacgcatccagca

SEQ ID NO: 4939848 - DNA, 12 bp, Homo sapiens
cagaaactagaa

SEQ ID NO: 4939849 - DNA, 18 bp, Homo sapiens
cagaaaggaaaacctgaa

SEQ ID NO: 4939850 - DNA, 19 bp, Homo sapiens
cagaaatatatatacatat

SEQ ID NO: 4939851 - DNA, 20 bp, Homo sapiens
cagaaattggaacagaatgt

SEQ ID NO: 4939852 - DNA, 15 bp, Homo sapiens
cagaacaacaactat

SEQ ID NO: 4939853 - DNA, 16 bp, Homo sapiens
cagaacagcttcaggt

SEQ ID NO: 4939854 - DNA, 14 bp, Homo sapiens
cagaacagtatctt

SEQ ID NO: 4939855 - DNA, 15 bp, Homo sapiens
cagaacatcattaga

SEQ ID NO: 4939856 - DNA, 13 bp, Homo sapiens
cagaacccagggc

SEQ ID NO: 4939857 - DNA, 20 bp, Homo sapiens
cagaacccagggctctgccc

SEQ ID NO: 4939858 - DNA, 21 bp, Homo sapiens
cagaacctcttccccagaaag

SEQ ID NO: 4939859 - DNA, 21 bp, Homo sapiens
cagaacggagccccaggcctc

SEQ ID NO: 4939860 - DNA, 14 bp, Homo sapiens
cagaactaaatgtt

SEQ ID NO: 4939861 - DNA, 20 bp, Homo sapiens
cagaactgccattattttct

SEQ ID NO: 4939862 - DNA, 16 bp, Homo sapiens
cagaacttgaatgtgt

SEQ ID NO: 4939863 - DNA, 14 bp, Homo sapiens
cagaagaaaattct

SEQ ID NO: 4939864 - DNA, 14 bp, Homo sapiens
cagaagaagagaag

SEQ ID NO: 4939865 - DNA, 14 bp, Homo sapiens
cagaagacaccaga

SEQ ID NO: 4939866 - DNA, 15 bp, Homo sapiens
cagaagacaccagag

SEQ ID NO: 4939867 - DNA, 16 bp, Homo sapiens
cagaagacaccagagc

SEQ ID NO: 4939868 - DNA, 18 bp, Homo sapiens
cagaagacaccagagcag

SEQ ID NO: 4939869 - DNA, 20 bp, Homo sapiens
cagaagacaccagagcagat

SEQ ID NO: 4939870 - DNA, 20 bp, Homo sapiens
cagaagagttgtgcacgcag

SEQ ID NO: 4939871 - DNA, 19 bp, Homo sapiens
cagaagatcccctcaggac

SEQ ID NO: 4939872 - DNA, 20 bp, Homo sapiens
cagaagcatttgtattttgt

SEQ ID NO: 4939873 - DNA, 13 bp, Homo sapiens
cagaagcctctgg

SEQ ID NO: 4939874 - DNA, 15 bp, Homo sapiens
cagaagcctctggct

SEQ ID NO: 4939875 - DNA, 17 bp, Homo sapiens
cagaaggatgaatgagg

SEQ ID NO: 4939876 - DNA, 18 bp, Homo sapiens
cagaagtcatgaagccca

SEQ ID NO: 4939877 - DNA, 19 bp, Homo sapiens
cagaagtcatgaagcccaa

SEQ ID NO: 4939878 - DNA, 15 bp, Homo sapiens
cagaataatgttcta

SEQ ID NO: 4939879 - DNA, 15 bp, Homo sapiens
cagaatagccacatt

SEQ ID NO: 4939880 - DNA, 22 bp, Homo sapiens
cagaatagccacatttggaata

SEQ ID NO: 4939881 - DNA, 13 bp, Homo sapiens
cagaatattgctt

SEQ ID NO: 4939882 - DNA, 13 bp, Homo sapiens
cagaatcccagcc

SEQ ID NO: 4939883 - DNA, 16 bp, Homo sapiens
cagaatgctgtacatc

SEQ ID NO: 4939884 - DNA, 19 bp, Homo sapiens
cagaatggtgatcactcca

SEQ ID NO: 4939885 - DNA, 16 bp, Homo sapiens
cagaatgttttactgt

SEQ ID NO: 4939886 - DNA, 13 bp, Homo sapiens
cagaattattttt

SEQ ID NO: 4939887 - DNA, 15 bp, Homo sapiens
cagaattatttttaa

SEQ ID NO: 4939888 - DNA, 22 bp, Homo sapiens
cagaatttggaaatcctagttt

SEQ ID NO: 4939889 - DNA, 15 bp, Homo sapiens
cagaattttaggaac

SEQ ID NO: 4939890 - DNA, 21 bp, Homo sapiens
cagacaaagtaattcctctca

SEQ ID NO: 4939891 - DNA, 14 bp, Homo sapiens
cagacacacacaca

SEQ ID NO: 4939892 - DNA, 14 bp, Homo sapiens
cagacacaggcccg

SEQ ID NO: 4939893 - DNA, 17 bp, Homo sapiens
cagacacaggcccggct

SEQ ID NO: 4939894 - DNA, 21 bp, Homo sapiens
cagacacaggcccggctccag

SEQ ID NO: 4939895 - DNA, 23 bp, Homo sapiens
cagacacaggcccggctccaggc

SEQ ID NO: 4939896 - DNA, 20 bp, Homo sapiens
cagacaccttgacagggcac

SEQ ID NO: 4939897 - DNA, 22 bp, Homo sapiens
cagacaccttgacagggcacac

SEQ ID NO: 4939898 - DNA, 15 bp, Homo sapiens
cagacagaacttgaa

SEQ ID NO: 4939899 - DNA, 15 bp, Homo sapiens
cagacagcaggcagc

SEQ ID NO: 4939900 - DNA, 19 bp, Homo sapiens
cagacagcaggcagcgcca

SEQ ID NO: 4939901 - DNA, 12 bp, Homo sapiens
cagacaggagga

SEQ ID NO: 4939902 - DNA, 20 bp, Homo sapiens
cagacaggcaagcacctcct

SEQ ID NO: 4939903 - DNA, 11 bp, Homo sapiens
cagacataaag

SEQ ID NO: 4939904 - DNA, 15 bp, Homo sapiens
cagacatcatgaatt

SEQ ID NO: 4939905 - DNA, 19 bp, Homo sapiens
cagacatccatgtttgtaa

SEQ ID NO: 4939906 - DNA, 22 bp, Homo sapiens
cagacatccatgtttgtaaaac

SEQ ID NO: 4939907 - DNA, 15 bp, Homo sapiens
cagacatctctgcac

SEQ ID NO: 4939908 - DNA, 12 bp, Homo sapiens
cagacatgtttt

SEQ ID NO: 4939909 - DNA, 18 bp, Homo sapiens
cagacatgttttccgtga

SEQ ID NO: 4939910 - DNA, 22 bp, Homo sapiens
cagacatgttttccgtgaaaac

SEQ ID NO: 4939911 - DNA, 21 bp, Homo sapiens
cagaccaacgttactcagggc

SEQ ID NO: 4939912 - DNA, 13 bp, Homo sapiens
cagaccaccccgc

SEQ ID NO: 4939913 - DNA, 15 bp, Homo sapiens
cagaccaccccgcct

SEQ ID NO: 4939914 - DNA, 19 bp, Homo sapiens
cagaccaccccgcctgccc

SEQ ID NO: 4939915 - DNA, 13 bp, Homo sapiens
cagaccccaggct

SEQ ID NO: 4939916 - DNA, 21 bp, Homo sapiens
cagacccctggcttttcactg

SEQ ID NO: 4939917 - DNA, 12 bp, Homo sapiens
cagacccggctg

SEQ ID NO: 4939918 - DNA, 14 bp, Homo sapiens
cagacctccccagc

SEQ ID NO: 4939919 - DNA, 15 bp, Homo sapiens
cagacctccccagcc

SEQ ID NO: 4939920 - DNA, 16 bp, Homo sapiens
cagacctccccagccc

SEQ ID NO: 4939921 - DNA, 22 bp, Homo sapiens
cagacctccccagcccctagcc

SEQ ID NO: 4939922 - DNA, 15 bp, Homo sapiens
cagactactattttc

SEQ ID NO: 4939923 - DNA, 19 bp, Homo sapiens
cagactactattttctttt

SEQ ID NO: 4939924 - DNA, 17 bp, Homo sapiens
cagactctacagaggcc

SEQ ID NO: 4939925 - DNA, 18 bp, Homo sapiens
cagactctacagaggcca

SEQ ID NO: 4939926 - DNA, 19 bp, Homo sapiens
cagactctacagaggccat

SEQ ID NO: 4939927 - DNA, 15 bp, Homo sapiens
cagactctcagccca

SEQ ID NO: 4939928 - DNA, 17 bp, Homo sapiens
cagactctcagcccaga

SEQ ID NO: 4939929 - DNA, 18 bp, Homo sapiens
cagactctcagcccagaa

SEQ ID NO: 4939930 - DNA, 21 bp, Homo sapiens
cagactgcaggttggacccca

SEQ ID NO: 4939931 - DNA, 19 bp, Homo sapiens
cagactgctagtgttctgt

SEQ ID NO: 4939932 - DNA, 14 bp, Homo sapiens
cagactgcttccaa

SEQ ID NO: 4939933 - DNA, 21 bp, Homo sapiens
cagactggaagcacagcttca

SEQ ID NO: 4939934 - DNA, 16 bp, Homo sapiens
cagactgttaattata

SEQ ID NO: 4939935 - DNA, 24 bp, Homo sapiens
cagacttccttgagacacggagcc

SEQ ID NO: 4939936 - DNA, 11 bp, Homo sapiens
cagagaagggc

SEQ ID NO: 4939937 - DNA, 20 bp, Homo sapiens
cagagaatgaaagggcccag

SEQ ID NO: 4939938 - DNA, 16 bp, Homo sapiens
cagagaatttctacca

SEQ ID NO: 4939939 - DNA, 23 bp, Homo sapiens
cagagaatttctaccatttcaga

SEQ ID NO: 4939940 - DNA, 12 bp, Homo sapiens
cagagacaaaat

SEQ ID NO: 4939941 - DNA, 18 bp, Homo sapiens
cagagaccaggctgtgtc

SEQ ID NO: 4939942 - DNA, 13 bp, Homo sapiens
cagagaccgtcct

SEQ ID NO: 4939943 - DNA, 16 bp, Homo sapiens
cagagaccgtcctcac

SEQ ID NO: 4939944 - DNA, 15 bp, Homo sapiens
cagagacctgaagtg

SEQ ID NO: 4939945 - DNA, 19 bp, Homo sapiens
cagcctgggcagccaggct

SEQ ID NO: 4939946 - DNA, 20 bp, Homo sapiens
cagcctgggcagccaggctg

SEQ ID NO: 4939947 - DNA, 21 bp, Homo sapiens
cagcctgggcagccaggctgc

SEQ ID NO: 4939948 - DNA, 15 bp, Homo sapiens
cagcctgggccccag

SEQ ID NO: 4939949 - DNA, 13 bp, Homo sapiens
cagcctggggcct

SEQ ID NO: 4939950 - DNA, 15 bp, Homo sapiens
cagcctggggcctgg

SEQ ID NO: 4939951 - DNA, 16 bp, Homo sapiens
cagcctggggcctggc

SEQ ID NO: 4939952 - DNA, 18 bp, Homo sapiens
cagcctggggcctggcag

SEQ ID NO: 4939953 - DNA, 22 bp, Homo sapiens
cagcctggggcctggcagggag

SEQ ID NO: 4939954 - DNA, 12 bp, Homo sapiens
cagcctgtggca

SEQ ID NO: 4939955 - DNA, 19 bp, Homo sapiens
cagcctgtggcatctttgc

SEQ ID NO: 4939956 - DNA, 18 bp, Homo sapiens
cagccttcttccatccca

SEQ ID NO: 4939957 - DNA, 16 bp, Homo sapiens
cagcgaagtagcttgc

SEQ ID NO: 4939958 - DNA, 20 bp, Homo sapiens
cagcgagccctggtggcagt

SEQ ID NO: 4939959 - DNA, 14 bp, Homo sapiens
cagcgagggcagct

SEQ ID NO: 4939960 - DNA, 15 bp, Homo sapiens
cagcgagggcagctg

SEQ ID NO: 4939961 - DNA, 18 bp, Homo sapiens
cagcgagggcagctgcta

SEQ ID NO: 4939962 - DNA, 18 bp, Homo sapiens
cagcgccaagtgcgtgcc

SEQ ID NO: 4939963 - DNA, 23 bp, Homo sapiens
cagcgccaagtgcgtgccgtgtg

SEQ ID NO: 4939964 - DNA, 24 bp, Homo sapiens
cagcgccaagtgcgtgccgtgtga

SEQ ID NO: 4939965 - DNA, 13 bp, Homo sapiens
cagcgctctgcct

SEQ ID NO: 4939966 - DNA, 21 bp, Homo sapiens
cagcggagtctgtcctgtgac

SEQ ID NO: 4939967 - DNA, 14 bp, Homo sapiens
cagcggcccctgca

SEQ ID NO: 4939968 - DNA, 16 bp, Homo sapiens
cagcggggacagctcc

SEQ ID NO: 4939969 - DNA, 19 bp, Homo sapiens
cagcggggacagctccttc

SEQ ID NO: 4939970 - DNA, 17 bp, Homo sapiens
cagcgtccctagcagtg

SEQ ID NO: 4939971 - DNA, 18 bp, Homo sapiens
cagctaagggaagacatt

SEQ ID NO: 4939972 - DNA, 16 bp, Homo sapiens
gtacaaaataaacaaa

SEQ ID NO: 4939973 - DNA, 22 bp, Homo sapiens
gtacaaattataaaaagccact

SEQ ID NO: 4939974 - DNA, 17 bp, Homo sapiens
gtacaatgtgtttttct

SEQ ID NO: 4939975 - DNA, 20 bp, Homo sapiens
gtacacaataagcaaaaaca

SEQ ID NO: 4939976 - DNA, 20 bp, Homo sapiens
gtacacagctctagacactg

SEQ ID NO: 4939977 - DNA, 16 bp, Homo sapiens
gtacactgacttgaga

SEQ ID NO: 4939978 - DNA, 21 bp, Homo sapiens
gtacagagtgtggactctggt

SEQ ID NO: 4939979 - DNA, 20 bp, Homo sapiens
gtacataaattgcataaagc

SEQ ID NO: 4939980 - DNA, 19 bp, Homo sapiens
gtacataccctggccgccc

SEQ ID NO: 4939981 - DNA, 19 bp, Homo sapiens
gtacatatttgtggaataa

SEQ ID NO: 4939982 - DNA, 14 bp, Homo sapiens
gtacatctggctta

SEQ ID NO: 4939983 - DNA, 16 bp, Homo sapiens
gtacatctggcttatt

SEQ ID NO: 4939984 - DNA, 20 bp, Homo sapiens
gtacatctggcttattttaa

SEQ ID NO: 4939985 - DNA, 23 bp, Homo sapiens
gtacatctggcttattttaatgt

SEQ ID NO: 4939986 - DNA, 14 bp, Homo sapiens
gtacatgaaagtag

SEQ ID NO: 4939987 - DNA, 14 bp, Homo sapiens
gtacatttataatt

SEQ ID NO: 4939988 - DNA, 15 bp, Homo sapiens
gtacatttataattg

SEQ ID NO: 4939989 - DNA, 16 bp, Homo sapiens
gtacatttatgattta

SEQ ID NO: 4939990 - DNA, 19 bp, Homo sapiens
gtacatttatgatttaata

SEQ ID NO: 4939991 - DNA, 19 bp, Homo sapiens
gtacattttgttgtaaaaa

SEQ ID NO: 4939992 - DNA, 22 bp, Homo sapiens
gtacattttgttgtaaaaagaa

SEQ ID NO: 4939993 - DNA, 23 bp, Homo sapiens
gtacattttgttgtaaaaagaaa

SEQ ID NO: 4939994 - DNA, 18 bp, Homo sapiens
gtaccaaagttttatcaa

SEQ ID NO: 4939995 - DNA, 16 bp, Homo sapiens
gtaccagccctggggc

SEQ ID NO: 4939996 - DNA, 17 bp, Homo sapiens
gtaccagccctggggct

SEQ ID NO: 4939997 - DNA, 21 bp, Homo sapiens
gtaccagcgctctaaaagcac

SEQ ID NO: 4939998 - DNA, 23 bp, Homo sapiens
gtaccaggaaaggattttataat

SEQ ID NO: 4939999 - DNA, 20 bp, Homo sapiens
gtacccacttagtcatgtaa

SEQ ID NO: 4940000 - DNA, 17 bp, Homo sapiens
gtacccatctagtactt

SEQ ID NO: 4940001 - DNA, 19 bp, Homo sapiens
gtaccctctcagctccagg

SEQ ID NO: 4940002 - DNA, 15 bp, Homo sapiens
gtaccctctggaggg

SEQ ID NO: 4940003 - DNA, 14 bp, Homo sapiens
gtacctcatcccat

SEQ ID NO: 4940004 - DNA, 16 bp, Homo sapiens
gtacctcatcccatga

SEQ ID NO: 4940005 - DNA, 16 bp, Homo sapiens
gtacctcccctgcctt

SEQ ID NO: 4940006 - DNA, 14 bp, Homo sapiens
gtacctctggctga

SEQ ID NO: 4940007 - DNA, 15 bp, Homo sapiens
gtacctctggctgac

SEQ ID NO: 4940008 - DNA, 21 bp, Homo sapiens
gtacctctggctgactaaatt

SEQ ID NO: 4940009 - DNA, 12 bp, Homo sapiens
gtacctgaaaag

SEQ ID NO: 4940010 - DNA, 14 bp, Homo sapiens
gtacctgaaaagta

SEQ ID NO: 4940011 - DNA, 17 bp, Homo sapiens
gtacgtctgacaggcaa

SEQ ID NO: 4940012 - DNA, 17 bp, Homo sapiens
gtactaaatttaaattt

SEQ ID NO: 4940013 - DNA, 23 bp, Homo sapiens
gtactacacatttttaaattgtt

SEQ ID NO: 4940014 - DNA, 15 bp, Homo sapiens
gtactacctgtgtat

SEQ ID NO: 4940015 - DNA, 17 bp, Homo sapiens
gtactagtactgtgtac

SEQ ID NO: 4940016 - DNA, 14 bp, Homo sapiens
gtactagtgttctg

SEQ ID NO: 4940017 - DNA, 16 bp, Homo sapiens
gtactccctctcagga

SEQ ID NO: 4940018 - DNA, 20 bp, Homo sapiens
gtactccctctcaggatcca

SEQ ID NO: 4940019 - DNA, 14 bp, Homo sapiens
gtactcctcccagg

SEQ ID NO: 4940020 - DNA, 14 bp, Homo sapiens
gtactgaaagcctt

SEQ ID NO: 4940021 - DNA, 19 bp, Homo sapiens
gtactgccccccatgagga

SEQ ID NO: 4940022 - DNA, 19 bp, Homo sapiens
gtactgtaataatacctca

SEQ ID NO: 4940023 - DNA, 20 bp, Homo sapiens
gtactgtaataatacctcaa

SEQ ID NO: 4940024 - DNA, 12 bp, Homo sapiens
gtactgtactaa

SEQ ID NO: 4940025 - DNA, 16 bp, Homo sapiens
gtactgtatagacagt

SEQ ID NO: 4940026 - DNA, 17 bp, Homo sapiens
gtactgtatagacagtt

SEQ ID NO: 4940027 - DNA, 20 bp, Homo sapiens
gtactgtatagacagtttgt

SEQ ID NO: 4940028 - DNA, 14 bp, Homo sapiens
gtacttaactattc

SEQ ID NO: 4940029 - DNA, 18 bp, Homo sapiens
gtacttcaggggcacttc

SEQ ID NO: 4940030 - DNA, 18 bp, Homo sapiens
gtacttgagtgtaatgtt

SEQ ID NO: 4940031 - DNA, 21 bp, Homo sapiens
gtacttggagtattggggtct

SEQ ID NO: 4940032 - DNA, 22 bp, Homo sapiens
gtacttgtgaaacacagctgtt

SEQ ID NO: 4940033 - DNA, 16 bp, Homo sapiens
gtacttgtttctctgt

SEQ ID NO: 4940034 - DNA, 23 bp, Homo sapiens
gtacttttattttacacagaaac

SEQ ID NO: 4940035 - DNA, 19 bp, Homo sapiens
gtagaacgtaaccacggaa

SEQ ID NO: 4940036 - DNA, 15 bp, Homo sapiens
gtagaagcattcctt

SEQ ID NO: 4940037 - DNA, 22 bp, Homo sapiens
gtagaagcattccttctttgat

SEQ ID NO: 4940038 - DNA, 14 bp, Homo sapiens
gtagaattgcattg

SEQ ID NO: 4940039 - DNA, 11 bp, Homo sapiens
gtagagccagg

SEQ ID NO: 4940040 - DNA, 15 bp, Homo sapiens
gtagagccagggtct

SEQ ID NO: 4940041 - DNA, 14 bp, Homo sapiens
gtagagttaagaag

SEQ ID NO: 4940042 - DNA, 18 bp, Homo sapiens
gtagagttaagaagctgt

SEQ ID NO: 4940043 - DNA, 13 bp, Homo sapiens
gtagatattactt

SEQ ID NO: 4940044 - DNA, 21 bp, Homo sapiens
gtagatatttggcttaaatat

SEQ ID NO: 4940045 - DNA, 22 bp, Homo sapiens
gtagccagggggactagcccct

SEQ ID NO: 4940046 - DNA, 23 bp, Homo sapiens
gtagccagggggactagcccctg

SEQ ID NO: 4940047 - DNA, 18 bp, Homo sapiens
gtagccaggtatggctct

SEQ ID NO: 4940048 - DNA, 16 bp, Homo sapiens
gtagcctatgttgtgg

SEQ ID NO: 4940049 - DNA, 22 bp, Homo sapiens
gtagcctggatattattcttgt

SEQ ID NO: 4940050 - DNA, 17 bp, Homo sapiens
gtagcgttttttaaatg

SEQ ID NO: 4940051 - DNA, 18 bp, Homo sapiens
gtagctgggactacaggc

SEQ ID NO: 4940052 - DNA, 21 bp, Homo sapiens
gtagctgggactacaggcacc

SEQ ID NO: 4940053 - DNA, 16 bp, Homo sapiens
gtagctgtaaaacgct

SEQ ID NO: 4940054 - DNA, 22 bp, Homo sapiens
gtagcttaccagaagcttccat

SEQ ID NO: 4940055 - DNA, 12 bp, Homo sapiens
gtagctttgctc

SEQ ID NO: 4940056 - DNA, 22 bp, Homo sapiens
gtaggagctgccttggctcaga

SEQ ID NO: 4940057 - DNA, 15 bp, Homo sapiens
gtaggatgaaaagat

SEQ ID NO: 4940058 - DNA, 14 bp, Homo sapiens
gtaggcatttccta

SEQ ID NO: 4940059 - DNA, 19 bp, Homo sapiens
gtaggccttttaacatttt

SEQ ID NO: 4940060 - DNA, 14 bp, Homo sapiens
gtagggaggcagcc

SEQ ID NO: 4940061 - DNA, 21 bp, Homo sapiens
gtagggcgggaggatgttctg

SEQ ID NO: 4940062 - DNA, 23 bp, Homo sapiens
gtagggcgggaggatgttctggg

SEQ ID NO: 4940063 - DNA, 20 bp, Homo sapiens
gtaggggtcaaagaaatgct

SEQ ID NO: 4940064 - DNA, 22 bp, Homo sapiens
gtaggtaaaatgtatttttcta

SEQ ID NO: 4940065 - DNA, 20 bp, Homo sapiens
gtagtagccctttctgtgtg

SEQ ID NO: 4940066 - DNA, 22 bp, Homo sapiens
gtagtagcgttttttaaatgta

SEQ ID NO: 4940067 - DNA, 14 bp, Homo sapiens
gtagtccttggcat

SEQ ID NO: 4940068 - DNA, 15 bp, Homo sapiens
gtagttaatttatct

SEQ ID NO: 4940069 - DNA, 15 bp, Homo sapiens
gtagttaggaaataa

SEQ ID NO: 4940070 - DNA, 22 bp, Homo sapiens
gtagttaggaaataaaaccttt

SEQ ID NO: 4940071 - DNA, 21 bp, Homo sapiens
gtagttctgtttggtgtgtcc

SEQ ID NO: 4940072 - DNA, 20 bp, Homo sapiens
gtagttttattttatgttta

SEQ ID NO: 4940073 - DNA, 22 bp, Homo sapiens
gtagtttttacagctgtgttat

SEQ ID NO: 4940074 - DNA, 23 bp, Homo sapiens
gtagttttttttttttttatgtg

SEQ ID NO: 4940075 - DNA, 11 bp, Homo sapiens
gtataaacatt

SEQ ID NO: 4940076 - DNA, 18 bp, Homo sapiens
gtataaacattaaatgtc

SEQ ID NO: 4940077 - DNA, 13 bp, Homo sapiens
gtataaagaaaag

SEQ ID NO: 4940078 - DNA, 20 bp, Homo sapiens
gtataaagcaactgttatga

SEQ ID NO: 4940079 - DNA, 11 bp, Homo sapiens
gtataaatgta

SEQ ID NO: 4940080 - DNA, 14 bp, Homo sapiens
gtataagaaatgca

SEQ ID NO: 4940081 - DNA, 16 bp, Homo sapiens
gtctttaaatagatac

SEQ ID NO: 4940082 - DNA, 21 bp, Homo sapiens
gtctttcaggaccttttgaag

SEQ ID NO: 4940083 - DNA, 18 bp, Homo sapiens
gtctttggaaaaatgttt

SEQ ID NO: 4940084 - DNA, 19 bp, Homo sapiens
gtctttggaaaaatgtttg

SEQ ID NO: 4940085 - DNA, 14 bp, Homo sapiens
gtctttgtaagagt

SEQ ID NO: 4940086 - DNA, 21 bp, Homo sapiens
gtctttgtaagagtgtagaag

SEQ ID NO: 4940087 - DNA, 23 bp, Homo sapiens
gtcttttatagtggaaaaacaca

SEQ ID NO: 4940088 - DNA, 15 bp, Homo sapiens
gtcttttgttcgcat

SEQ ID NO: 4940089 - DNA, 16 bp, Homo sapiens
gtctttttatgcattt

SEQ ID NO: 4940090 - DNA, 23 bp, Homo sapiens
gtctttttttggtgattcaaatg

SEQ ID NO: 4940091 - DNA, 14 bp, Homo sapiens
gtgaaaatgtactg

SEQ ID NO: 4940092 - DNA, 13 bp, Homo sapiens
gtgaaacacagct

SEQ ID NO: 4940093 - DNA, 17 bp, Homo sapiens
gtgaaacctgtgaagct

SEQ ID NO: 4940094 - DNA, 13 bp, Homo sapiens
gtgaaaccttttt

SEQ ID NO: 4940095 - DNA, 22 bp, Homo sapiens
gtgaaaccttttttaagatttt

SEQ ID NO: 4940096 - DNA, 18 bp, Homo sapiens
gtgaaccacttcattctg

SEQ ID NO: 4940097 - DNA, 19 bp, Homo sapiens
gtgaactatttctacacag

SEQ ID NO: 4940098 - DNA, 20 bp, Homo sapiens
gtgaactatttctacacagt

SEQ ID NO: 4940099 - DNA, 13 bp, Homo sapiens
gtgaacttgtagc

SEQ ID NO: 4940100 - DNA, 20 bp, Homo sapiens
gtgaacttgtagctgtaaaa

SEQ ID NO: 4940101 - DNA, 21 bp, Homo sapiens
gtgaacttgtagctgtaaaac

SEQ ID NO: 4940102 - DNA, 16 bp, Homo sapiens
gtgaaggtgacagcag

SEQ ID NO: 4940103 - DNA, 17 bp, Homo sapiens
gtgaaggtgacagcagt

SEQ ID NO: 4940104 - DNA, 16 bp, Homo sapiens
gtgaagtgaatgaaac

SEQ ID NO: 4940105 - DNA, 18 bp, Homo sapiens
gtgaataaacttcagcac

SEQ ID NO: 4940106 - DNA, 18 bp, Homo sapiens
gtgaatgaaagattaaac

SEQ ID NO: 4940107 - DNA, 13 bp, Homo sapiens
gtgaatgaacact

SEQ ID NO: 4940108 - DNA, 19 bp, Homo sapiens
gtgaatgattcatgttata

SEQ ID NO: 4940109 - DNA, 13 bp, Homo sapiens
gtgaattgactac

SEQ ID NO: 4940110 - DNA, 18 bp, Homo sapiens
gtgacaaaattttataag

SEQ ID NO: 4940111 - DNA, 20 bp, Homo sapiens
gtgacaaaattttataagca

SEQ ID NO: 4940112 - DNA, 12 bp, Homo sapiens
gtgacaaaccat

SEQ ID NO: 4940113 - DNA, 16 bp, Homo sapiens
gtgacaaaccatccag

SEQ ID NO: 4940114 - DNA, 23 bp, Homo sapiens
gtgacaaaccatccagtggaggt

SEQ ID NO: 4940115 - DNA, 12 bp, Homo sapiens
gtgacagaggca

SEQ ID NO: 4940116 - DNA, 20 bp, Homo sapiens
gtgacagagtgagactctgt

SEQ ID NO: 4940117 - DNA, 22 bp, Homo sapiens
gtgacagagtgagactctgtct

SEQ ID NO: 4940118 - DNA, 13 bp, Homo sapiens
gtgacagggccag

SEQ ID NO: 4940119 - DNA, 20 bp, Homo sapiens
gtgacagggccagtggggcc

SEQ ID NO: 4940120 - DNA, 13 bp, Homo sapiens
gtgacagtcatca

SEQ ID NO: 4940121 - DNA, 16 bp, Homo sapiens
gtgacagtcatcatca

SEQ ID NO: 4940122 - DNA, 18 bp, Homo sapiens
gtgacagtcatcatcagg

SEQ ID NO: 4940123 - DNA, 20 bp, Homo sapiens
gtgacagtcatcatcagggc

SEQ ID NO: 4940124 - DNA, 21 bp, Homo sapiens
gtgacagtcatcatcagggcc

SEQ ID NO: 4940125 - DNA, 22 bp, Homo sapiens
gtgacagtcatcatcagggcct

SEQ ID NO: 4940126 - DNA, 14 bp, Homo sapiens
gtgacatgtgaaac

SEQ ID NO: 4940127 - DNA, 17 bp, Homo sapiens
gtgacatgtgaaacctt

SEQ ID NO: 4940128 - DNA, 19 bp, Homo sapiens
gtgacatgtgaaacctttt

SEQ ID NO: 4940129 - DNA, 20 bp, Homo sapiens
gtgacatgtgaaaccttttt

SEQ ID NO: 4940130 - DNA, 19 bp, Homo sapiens
gtgacattttacattaaat

SEQ ID NO: 4940131 - DNA, 19 bp, Homo sapiens
gtgaccaactgtgttgtat

SEQ ID NO: 4940132 - DNA, 22 bp, Homo sapiens
gtgaccaactgtgttgtattaa

SEQ ID NO: 4940133 - DNA, 12 bp, Homo sapiens
gtgaccccaggt

SEQ ID NO: 4940134 - DNA, 12 bp, Homo sapiens
gtgacctctgcc

SEQ ID NO: 4940135 - DNA, 13 bp, Homo sapiens
gtgacctctgcct

SEQ ID NO: 4940136 - DNA, 14 bp, Homo sapiens
gtgacctctgcctg

SEQ ID NO: 4940137 - DNA, 13 bp, Homo sapiens
gtgacctgagggc

SEQ ID NO: 4940138 - DNA, 23 bp, Homo sapiens
gtgactaactagacaccaaagtt

SEQ ID NO: 4940139 - DNA, 19 bp, Homo sapiens
gtgactagtacaaattata

SEQ ID NO: 4940140 - DNA, 14 bp, Homo sapiens
gtgactatgaactt

SEQ ID NO: 4940141 - DNA, 19 bp, Homo sapiens
gtgactgtatctgtgtaga

SEQ ID NO: 4940142 - DNA, 21 bp, Homo sapiens
gtgacttcctcgcctctccca

SEQ ID NO: 4940143 - DNA, 17 bp, Homo sapiens
gtgagagagatgggagc

SEQ ID NO: 4940144 - DNA, 16 bp, Homo sapiens
gtgagaggggaacaga

SEQ ID NO: 4940145 - DNA, 12 bp, Homo sapiens
gtgagatgaggg

SEQ ID NO: 4940146 - DNA, 15 bp, Homo sapiens
gtgagatgctggaga

SEQ ID NO: 4940147 - DNA, 22 bp, Homo sapiens
gtgagatgctggagaagagagg

SEQ ID NO: 4940148 - DNA, 13 bp, Homo sapiens
gtgagatttttta

SEQ ID NO: 4940149 - DNA, 15 bp, Homo sapiens
gtgagattttttatt

SEQ ID NO: 4940150 - DNA, 18 bp, Homo sapiens
gtgagattttttattgct

SEQ ID NO: 4940151 - DNA, 21 bp, Homo sapiens
gtgagcactaaggtgtgctct

SEQ ID NO: 4940152 - DNA, 20 bp, Homo sapiens
gtgagccactgcaccgggcc

SEQ ID NO: 4940153 - DNA, 14 bp, Homo sapiens
gtgagcccctggtc

SEQ ID NO: 4940154 - DNA, 16 bp, Homo sapiens
gtgagcctggctcttg

SEQ ID NO: 4940155 - DNA, 12 bp, Homo sapiens
gtgagctgggca

SEQ ID NO: 4940156 - DNA, 18 bp, Homo sapiens
gtgaggagctgctggctt

SEQ ID NO: 4940157 - DNA, 16 bp, Homo sapiens
gtgagggtcccatgtg

SEQ ID NO: 4940158 - DNA, 17 bp, Homo sapiens
gtgagtcatttaaatgt

SEQ ID NO: 4940159 - DNA, 13 bp, Homo sapiens
gtgagtgtgacag

SEQ ID NO: 4940160 - DNA, 15 bp, Homo sapiens
gtgagtgtgacaggg

SEQ ID NO: 4940161 - DNA, 16 bp, Homo sapiens
gtgagtgtgacagggc

SEQ ID NO: 4940162 - DNA, 20 bp, Homo sapiens
gtgagtgtgtgtttgtgctg

SEQ ID NO: 4940163 - DNA, 21 bp, Homo sapiens
gtgagtttggtctggactgac

SEQ ID NO: 4940164 - DNA, 19 bp, Homo sapiens
gtgatagcattgctttcgt

SEQ ID NO: 4940165 - DNA, 13 bp, Homo sapiens
gtgatattctaag

SEQ ID NO: 4940166 - DNA, 14 bp, Homo sapiens
gtgatctcagatca

SEQ ID NO: 4940167 - DNA, 15 bp, Homo sapiens
gtgatctgtcttgta

SEQ ID NO: 4940168 - DNA, 19 bp, Homo sapiens
gtgatctgtcttgtaatat

SEQ ID NO: 4940169 - DNA, 15 bp, Homo sapiens
gtgatgaactttctc

SEQ ID NO: 4940170 - DNA, 12 bp, Homo sapiens
gtgatgagctga

SEQ ID NO: 4940171 - DNA, 15 bp, Homo sapiens
gtgatgatgtaattg

SEQ ID NO: 4940172 - DNA, 14 bp, Homo sapiens
gtgatggggcaagg

SEQ ID NO: 4940173 - DNA, 16 bp, Homo sapiens
gtgatggttcccctgt

SEQ ID NO: 4940174 - DNA, 22 bp, Homo sapiens
gtgatggttcccctgttcactc

SEQ ID NO: 4940175 - DNA, 23 bp, Homo sapiens
gtgatggttcccctgttcactct

SEQ ID NO: 4940176 - DNA, 16 bp, Homo sapiens
gtgatgtttttatgat

SEQ ID NO: 4940177 - DNA, 22 bp, Homo sapiens
gtgattagagggaggagaatga

SEQ ID NO: 4940178 - DNA, 12 bp, Homo sapiens
gtgattcaaatg

SEQ ID NO: 4940179 - DNA, 17 bp, Homo sapiens
gtgattctcctgcctca

SEQ ID NO: 4940180 - DNA, 23 bp, Homo sapiens
gtgattctcctgcctcagcctcc

SEQ ID NO: 4940181 - DNA, 19 bp, Homo sapiens
gtgattgcagctttatgtt

SEQ ID NO: 4940182 - DNA, 17 bp, Homo sapiens
gtgattttcaagcagca

SEQ ID NO: 4940183 - DNA, 17 bp, Homo sapiens
gtgcaaatggaagacaa

SEQ ID NO: 4940184 - DNA, 13 bp, Homo sapiens
gtgcaacagacaa

SEQ ID NO: 4940185 - DNA, 16 bp, Homo sapiens
gtgcaacgccgtgggc

SEQ ID NO: 4940186 - DNA, 19 bp, Homo sapiens
gtgcaatttcaaggttcta

SEQ ID NO: 4940187 - DNA, 13 bp, Homo sapiens
gtgcacaaaatga

SEQ ID NO: 4940188 - DNA, 17 bp, Homo sapiens
gtgcacacaccagagcc

SEQ ID NO: 4940189 - DNA, 21 bp, Homo sapiens
gtgcacacaccagagcccacc

SEQ ID NO: 4940190 - DNA, 11 bp, Homo sapiens
gtgcacagctg

SEQ ID NO: 4940191 - DNA, 16 bp, Homo sapiens
tacatgcaaaaagaaa

SEQ ID NO: 4940192 - DNA, 20 bp, Homo sapiens
tacatgcaatttattaaaat

SEQ ID NO: 4940193 - DNA, 19 bp, Homo sapiens
tacatggcagagtttgtgt

SEQ ID NO: 4940194 - DNA, 14 bp, Homo sapiens
tacatgtgtagcct

SEQ ID NO: 4940195 - DNA, 19 bp, Homo sapiens
tacatgtgtgtatatatgt

SEQ ID NO: 4940196 - DNA, 20 bp, Homo sapiens
tacattagcagtttgctttg

SEQ ID NO: 4940197 - DNA, 15 bp, Homo sapiens
tacattagtaaatgt

SEQ ID NO: 4940198 - DNA, 19 bp, Homo sapiens
tacattagtaaatgtcttt

SEQ ID NO: 4940199 - DNA, 13 bp, Homo sapiens
tacattataaacg

SEQ ID NO: 4940200 - DNA, 14 bp, Homo sapiens
tacattattgctta

SEQ ID NO: 4940201 - DNA, 15 bp, Homo sapiens
tacattcaatgttta

SEQ ID NO: 4940202 - DNA, 17 bp, Homo sapiens
tacatttaaaattgcta

SEQ ID NO: 4940203 - DNA, 11 bp, Homo sapiens
tacatttaaag

SEQ ID NO: 4940204 - DNA, 12 bp, Homo sapiens
tacatttataat

SEQ ID NO: 4940205 - DNA, 12 bp, Homo sapiens
tacatttatgat

SEQ ID NO: 4940206 - DNA, 16 bp, Homo sapiens
tacatttatgatttaa

SEQ ID NO: 4940207 - DNA, 18 bp, Homo sapiens
tacatttcacaggctaat

SEQ ID NO: 4940208 - DNA, 13 bp, Homo sapiens
tacattttgttgt

SEQ ID NO: 4940209 - DNA, 21 bp, Homo sapiens
tacattttgttgtaaaaagaa

SEQ ID NO: 4940210 - DNA, 19 bp, Homo sapiens
taccaaagtgacctaccca

SEQ ID NO: 4940211 - DNA, 17 bp, Homo sapiens
taccacacatctatgat

SEQ ID NO: 4940212 - DNA, 14 bp, Homo sapiens
taccagactgcagg

SEQ ID NO: 4940213 - DNA, 21 bp, Homo sapiens
taccagcaagaataaaaaaga

SEQ ID NO: 4940214 - DNA, 16 bp, Homo sapiens
taccagccctggggct

SEQ ID NO: 4940215 - DNA, 17 bp, Homo sapiens
taccagccctggggctg

SEQ ID NO: 4940216 - DNA, 20 bp, Homo sapiens
taccagccctggggctgggc

SEQ ID NO: 4940217 - DNA, 17 bp, Homo sapiens
taccagctaccctgtgt

SEQ ID NO: 4940218 - DNA, 13 bp, Homo sapiens
taccagcttttaa

SEQ ID NO: 4940219 - DNA, 16 bp, Homo sapiens
taccagcttttaacca

SEQ ID NO: 4940220 - DNA, 16 bp, Homo sapiens
taccagggatgtagat

SEQ ID NO: 4940221 - DNA, 17 bp, Homo sapiens
taccagggatgtagatt

SEQ ID NO: 4940222 - DNA, 19 bp, Homo sapiens
taccaggtattattatctt

SEQ ID NO: 4940223 - DNA, 17 bp, Homo sapiens
taccatcttacttgagc

SEQ ID NO: 4940224 - DNA, 15 bp, Homo sapiens
taccatgaaacaaag

SEQ ID NO: 4940225 - DNA, 18 bp, Homo sapiens
taccattaaaactgcttt

SEQ ID NO: 4940226 - DNA, 17 bp, Homo sapiens
taccattcacaataaaa

SEQ ID NO: 4940227 - DNA, 17 bp, Homo sapiens
tacccaaaagagaaaaa

SEQ ID NO: 4940228 - DNA, 19 bp, Homo sapiens
tacccacacctctgccaga

SEQ ID NO: 4940229 - DNA, 13 bp, Homo sapiens
tacccactgctct

SEQ ID NO: 4940230 - DNA, 16 bp, Homo sapiens
tacccagcgagccctg

SEQ ID NO: 4940231 - DNA, 16 bp, Homo sapiens
tacccaggaccaagcc

SEQ ID NO: 4940232 - DNA, 21 bp, Homo sapiens
tacccatctagtacttgaaaa

SEQ ID NO: 4940233 - DNA, 18 bp, Homo sapiens
tacccatgactttatatg

SEQ ID NO: 4940234 - DNA, 16 bp, Homo sapiens
tacccccaacctcatt

SEQ ID NO: 4940235 - DNA, 13 bp, Homo sapiens
taccccctccttc

SEQ ID NO: 4940236 - DNA, 22 bp, Homo sapiens
taccctaatgtcttcataaagt

SEQ ID NO: 4940237 - DNA, 15 bp, Homo sapiens
taccctcctggctct

SEQ ID NO: 4940238 - DNA, 13 bp, Homo sapiens
taccctctcagct

SEQ ID NO: 4940239 - DNA, 15 bp, Homo sapiens
taccctctcagctcc

SEQ ID NO: 4940240 - DNA, 16 bp, Homo sapiens
taccctctcagctcca

SEQ ID NO: 4940241 - DNA, 14 bp, Homo sapiens
taccctctggaggg

SEQ ID NO: 4940242 - DNA, 20 bp, Homo sapiens
taccctgcgattttgcctgt

SEQ ID NO: 4940243 - DNA, 13 bp, Homo sapiens
tacccttaattac

SEQ ID NO: 4940244 - DNA, 17 bp, Homo sapiens
tacccttccctgcacta

SEQ ID NO: 4940245 - DNA, 20 bp, Homo sapiens
tacccttggctcaatcctct

SEQ ID NO: 4940246 - DNA, 20 bp, Homo sapiens
taccctttagactgtagcct

SEQ ID NO: 4940247 - DNA, 16 bp, Homo sapiens
tacccttttcctttgt

SEQ ID NO: 4940248 - DNA, 21 bp, Homo sapiens
tacccttttcctttgtggttt

SEQ ID NO: 4940249 - DNA, 18 bp, Homo sapiens
taccctttttctccagct

SEQ ID NO: 4940250 - DNA, 20 bp, Homo sapiens
taccgagttcaagtgatttt

SEQ ID NO: 4940251 - DNA, 16 bp, Homo sapiens
tacctaagtactgtaa

SEQ ID NO: 4940252 - DNA, 17 bp, Homo sapiens
tacctaagtactgtaat

SEQ ID NO: 4940253 - DNA, 20 bp, Homo sapiens
tacctaagtgacatttgtag

SEQ ID NO: 4940254 - DNA, 14 bp, Homo sapiens
tacctacctgtgtg

SEQ ID NO: 4940255 - DNA, 14 bp, Homo sapiens
tacctataatgtgt

SEQ ID NO: 4940256 - DNA, 19 bp, Homo sapiens
tacctataatgtgtgtatg

SEQ ID NO: 4940257 - DNA, 15 bp, Homo sapiens
tacctcaaactatct

SEQ ID NO: 4940258 - DNA, 14 bp, Homo sapiens
tacctcaggcagct

SEQ ID NO: 4940259 - DNA, 17 bp, Homo sapiens
tacctcaggcagctcaa

SEQ ID NO: 4940260 - DNA, 18 bp, Homo sapiens
tacctcaggcagctcaag

SEQ ID NO: 4940261 - DNA, 14 bp, Homo sapiens
tacctcatgtttat

SEQ ID NO: 4940262 - DNA, 15 bp, Homo sapiens
tacctcatgtttatg

SEQ ID NO: 4940263 - DNA, 18 bp, Homo sapiens
tacctcatgtttatgaaa

SEQ ID NO: 4940264 - DNA, 23 bp, Homo sapiens
tacctccaacagaactaaatgtt

SEQ ID NO: 4940265 - DNA, 13 bp, Homo sapiens
tacctcccctgcc

SEQ ID NO: 4940266 - DNA, 17 bp, Homo sapiens
tacctctggctgactaa

SEQ ID NO: 4940267 - DNA, 17 bp, Homo sapiens
tacctcttattgcaaaa

SEQ ID NO: 4940268 - DNA, 16 bp, Homo sapiens
tacctgacctcttgct

SEQ ID NO: 4940269 - DNA, 17 bp, Homo sapiens
tacctgacctcttgctg

SEQ ID NO: 4940270 - DNA, 19 bp, Homo sapiens
tacctgacctcttgctgtc

SEQ ID NO: 4940271 - DNA, 13 bp, Homo sapiens
tacctgccctgga

SEQ ID NO: 4940272 - DNA, 14 bp, Homo sapiens
tacctgtacactga

SEQ ID NO: 4940273 - DNA, 14 bp, Homo sapiens
tacctgtcacattg

SEQ ID NO: 4940274 - DNA, 21 bp, Homo sapiens
tacctgtcacattgcattcta

SEQ ID NO: 4940275 - DNA, 12 bp, Homo sapiens
tacctgtgcctg

SEQ ID NO: 4940276 - DNA, 22 bp, Homo sapiens
taccttactgtggaggaaggat

SEQ ID NO: 4940277 - DNA, 18 bp, Homo sapiens
taccttatcactgcatta

SEQ ID NO: 4940278 - DNA, 12 bp, Homo sapiens
tacgaacaaaac

SEQ ID NO: 4940279 - DNA, 17 bp, Homo sapiens
tacgcaggcatctgatt

SEQ ID NO: 4940280 - DNA, 14 bp, Homo sapiens
tacgctttgattca

SEQ ID NO: 4940281 - DNA, 15 bp, Homo sapiens
tacgctttgattcat

SEQ ID NO: 4940282 - DNA, 20 bp, Homo sapiens
tacgctttgtcacacaaaaa

SEQ ID NO: 4940283 - DNA, 15 bp, Homo sapiens
tacgtctgacaggca

SEQ ID NO: 4940284 - DNA, 20 bp, Homo sapiens
tactaaaagttcttctccaa

SEQ ID NO: 4940285 - DNA, 22 bp, Homo sapiens
tactaaatttaaatttaaagat

SEQ ID NO: 4940286 - DNA, 14 bp, Homo sapiens
tactaacacaagga

SEQ ID NO: 4940287 - DNA, 14 bp, Homo sapiens
tactaagttcacat

SEQ ID NO: 4940288 - DNA, 20 bp, Homo sapiens
tactaatgtaaaatgatttg

SEQ ID NO: 4940289 - DNA, 15 bp, Homo sapiens
tactacacattttta

SEQ ID NO: 4940290 - DNA, 22 bp, Homo sapiens
tactacacatttttaaattgtt

SEQ ID NO: 4940291 - DNA, 22 bp, Homo sapiens
tactacctgtgtatatagtttt

SEQ ID NO: 4940292 - DNA, 16 bp, Homo sapiens
tactagtgttctgttt

SEQ ID NO: 4940293 - DNA, 19 bp, Homo sapiens
tactagttttagttttctc

SEQ ID NO: 4940294 - DNA, 14 bp, Homo sapiens
tactataacatatg

SEQ ID NO: 4940295 - DNA, 13 bp, Homo sapiens
tactatatttgct

SEQ ID NO: 4940296 - DNA, 17 bp, Homo sapiens
tactatccagttactgc

SEQ ID NO: 4940297 - DNA, 16 bp, Homo sapiens
tactatggctgagttc

SEQ ID NO: 4940298 - DNA, 23 bp, Homo sapiens
tactattgttgctgaaacttgct

SEQ ID NO: 4940299 - DNA, 19 bp, Homo sapiens
tactattttctacaattaa

SEQ ID NO: 4940300 - DNA, 14 bp, Homo sapiens
tactcaatggattt

SEQ ID NO: 4940301 - DNA, 12 bp, Homo sapiens
tactcagcctgc

SEQ ID NO: 4940302 - DNA, 14 bp, Homo sapiens
tagcctgcactttg

SEQ ID NO: 4940303 - DNA, 22 bp, Homo sapiens
tagcctggatattattcttgta

SEQ ID NO: 4940304 - DNA, 20 bp, Homo sapiens
tagcctgtttcttcctgtta

SEQ ID NO: 4940305 - DNA, 17 bp, Homo sapiens
tagcgcccagttgggtg

SEQ ID NO: 4940306 - DNA, 19 bp, Homo sapiens
tagcgtgcccgtgtgcatg

SEQ ID NO: 4940307 - DNA, 13 bp, Homo sapiens
tagcgttcccaac

SEQ ID NO: 4940308 - DNA, 18 bp, Homo sapiens
tagcgttttttaaatgta

SEQ ID NO: 4940309 - DNA, 20 bp, Homo sapiens
tagctaaacggattccaaag

SEQ ID NO: 4940310 - DNA, 14 bp, Homo sapiens
tagctaagtacaca

SEQ ID NO: 4940311 - DNA, 12 bp, Homo sapiens
tagctaatgtaa

SEQ ID NO: 4940312 - DNA, 23 bp, Homo sapiens
tagctacaggaagcaccccatgc

SEQ ID NO: 4940313 - DNA, 19 bp, Homo sapiens
tagctacccaaaagagaaa

SEQ ID NO: 4940314 - DNA, 16 bp, Homo sapiens
tagctatgtgaccttg

SEQ ID NO: 4940315 - DNA, 15 bp, Homo sapiens
tagctattactgtct

SEQ ID NO: 4940316 - DNA, 20 bp, Homo sapiens
tagctcaggtgtccctgcac

SEQ ID NO: 4940317 - DNA, 21 bp, Homo sapiens
tagctcaggtgtccctgcact

SEQ ID NO: 4940318 - DNA, 22 bp, Homo sapiens
tagctcttttttgtttgtttct

SEQ ID NO: 4940319 - DNA, 23 bp, Homo sapiens
tagctcttttttgtttgtttctt

SEQ ID NO: 4940320 - DNA, 15 bp, Homo sapiens
tagctgccacttgaa

SEQ ID NO: 4940321 - DNA, 12 bp, Homo sapiens
tagctgggacta

SEQ ID NO: 4940322 - DNA, 17 bp, Homo sapiens
tagctgggactacaggc

SEQ ID NO: 4940323 - DNA, 12 bp, Homo sapiens
tagctgtaaaac

SEQ ID NO: 4940324 - DNA, 14 bp, Homo sapiens
tagctgtgggggtg

SEQ ID NO: 4940325 - DNA, 19 bp, Homo sapiens
tagcttacctgacacaaga

SEQ ID NO: 4940326 - DNA, 16 bp, Homo sapiens
tagcttgcaccttgtc

SEQ ID NO: 4940327 - DNA, 18 bp, Homo sapiens
tagctttatatatggaca

SEQ ID NO: 4940328 - DNA, 19 bp, Homo sapiens
tagctttatatatggacat

SEQ ID NO: 4940329 - DNA, 14 bp, Homo sapiens
tagctttattcttc

SEQ ID NO: 4940330 - DNA, 19 bp, Homo sapiens
tagctttcccaaataaact

SEQ ID NO: 4940331 - DNA, 14 bp, Homo sapiens
tagctttgtgtttg

SEQ ID NO: 4940332 - DNA, 23 bp, Homo sapiens
tagctttgtgtttggtttacatt

SEQ ID NO: 4940333 - DNA, 20 bp, Homo sapiens
tagcttttaggaaaatcact

SEQ ID NO: 4940334 - DNA, 21 bp, Homo sapiens
taggaaagcctcactgatata

SEQ ID NO: 4940335 - DNA, 17 bp, Homo sapiens
taggaaataaaaccttt

SEQ ID NO: 4940336 - DNA, 19 bp, Homo sapiens
taggaaataaaacctttca

SEQ ID NO: 4940337 - DNA, 21 bp, Homo sapiens
taggaaggtctcattcttcca

SEQ ID NO: 4940338 - DNA, 22 bp, Homo sapiens
taggaagttttctgtagtcatt

SEQ ID NO: 4940339 - DNA, 18 bp, Homo sapiens
taggacaaagtatttgaa

SEQ ID NO: 4940340 - DNA, 19 bp, Homo sapiens
taggaccatggttaagagt

SEQ ID NO: 4940341 - DNA, 21 bp, Homo sapiens
taggagaccaaggcgggagca

SEQ ID NO: 4940342 - DNA, 20 bp, Homo sapiens
taggagacttgccagagccg

SEQ ID NO: 4940343 - DNA, 23 bp, Homo sapiens
taggagacttgccagagccgggc

SEQ ID NO: 4940344 - DNA, 11 bp, Homo sapiens
taggagcctgc

SEQ ID NO: 4940345 - DNA, 13 bp, Homo sapiens
taggagctaaggc

SEQ ID NO: 4940346 - DNA, 18 bp, Homo sapiens
taggagctgccttggctc

SEQ ID NO: 4940347 - DNA, 23 bp, Homo sapiens
taggagctgccttggctcagaca

SEQ ID NO: 4940348 - DNA, 21 bp, Homo sapiens
taggagtgggtgacaagagcc

SEQ ID NO: 4940349 - DNA, 19 bp, Homo sapiens
taggcactgtagttctaag

SEQ ID NO: 4940350 - DNA, 23 bp, Homo sapiens
taggcatgaagagcaaaaatatc

SEQ ID NO: 4940351 - DNA, 12 bp, Homo sapiens
taggcatttcct

SEQ ID NO: 4940352 - DNA, 20 bp, Homo sapiens
taggccatgaaaaaaatgat

SEQ ID NO: 4940353 - DNA, 13 bp, Homo sapiens
taggcctggccag

SEQ ID NO: 4940354 - DNA, 21 bp, Homo sapiens
taggccttcctctctccagat

SEQ ID NO: 4940355 - DNA, 18 bp, Homo sapiens
taggccttttaacatttt

SEQ ID NO: 4940356 - DNA, 16 bp, Homo sapiens
taggcgtgagaagcat

SEQ ID NO: 4940357 - DNA, 16 bp, Homo sapiens
tagggaggcagcctcc

SEQ ID NO: 4940358 - DNA, 15 bp, Homo sapiens
tagggattcaggctg

SEQ ID NO: 4940359 - DNA, 11 bp, Homo sapiens
tagggccaggc

SEQ ID NO: 4940360 - DNA, 21 bp, Homo sapiens
tagggccaggcaggtgcctgg

SEQ ID NO: 4940361 - DNA, 21 bp, Homo sapiens
taggggcttataataaaggac

SEQ ID NO: 4940362 - DNA, 14 bp, Homo sapiens
taggggtcaaagaa

SEQ ID NO: 4940363 - DNA, 13 bp, Homo sapiens
tagggtaaaaatt

SEQ ID NO: 4940364 - DNA, 14 bp, Homo sapiens
tagggtaaaaattg

SEQ ID NO: 4940365 - DNA, 16 bp, Homo sapiens
tagggtacatttataa

SEQ ID NO: 4940366 - DNA, 18 bp, Homo sapiens
tagggtacatttataatt

SEQ ID NO: 4940367 - DNA, 18 bp, Homo sapiens
tagggtactaaatttaaa

SEQ ID NO: 4940368 - DNA, 20 bp, Homo sapiens
tagggtactaaatttaaatt

SEQ ID NO: 4940369 - DNA, 14 bp, Homo sapiens
taggtaaaatgtat

SEQ ID NO: 4940370 - DNA, 21 bp, Homo sapiens
taggtaaaatgtatttttcta

SEQ ID NO: 4940371 - DNA, 20 bp, Homo sapiens
taggtaatcaatgaatattg

SEQ ID NO: 4940372 - DNA, 14 bp, Homo sapiens
taggtacacagctc

SEQ ID NO: 4940373 - DNA, 14 bp, Homo sapiens
taggtagaaaaagg

SEQ ID NO: 4940374 - DNA, 17 bp, Homo sapiens
taggtctcttctcccag

SEQ ID NO: 4940375 - DNA, 18 bp, Homo sapiens
taggtctcttctcccaga

SEQ ID NO: 4940376 - DNA, 19 bp, Homo sapiens
taggtctcttctcccagaa

SEQ ID NO: 4940377 - DNA, 11 bp, Homo sapiens
taggtgacaga

SEQ ID NO: 4940378 - DNA, 22 bp, Homo sapiens
taggttaattccaattatatga

SEQ ID NO: 4940379 - DNA, 22 bp, Homo sapiens
taggttccctgttcttcctcca

SEQ ID NO: 4940380 - DNA, 13 bp, Homo sapiens
taggttctaaagt

SEQ ID NO: 4940381 - DNA, 18 bp, Homo sapiens
taggttctttgctgcatt

SEQ ID NO: 4940382 - DNA, 12 bp, Homo sapiens
tagtaaatgtct

SEQ ID NO: 4940383 - DNA, 13 bp, Homo sapiens
tagtaaatgtctt

SEQ ID NO: 4940384 - DNA, 14 bp, Homo sapiens
tagtaaatgtcttt

SEQ ID NO: 4940385 - DNA, 18 bp, Homo sapiens
tagtaaatgtctttgtaa

SEQ ID NO: 4940386 - DNA, 22 bp, Homo sapiens
tagtaaatgtctttgtaagtca

SEQ ID NO: 4940387 - DNA, 16 bp, Homo sapiens
tagtaagtaattatgc

SEQ ID NO: 4940388 - DNA, 18 bp, Homo sapiens
tagtaagttcagcacttg

SEQ ID NO: 4940389 - DNA, 20 bp, Homo sapiens
tagtaatagagcaaaattga

SEQ ID NO: 4940390 - DNA, 14 bp, Homo sapiens
tagtaatcacagtt

SEQ ID NO: 4940391 - DNA, 15 bp, Homo sapiens
tagtaatcacagttg

SEQ ID NO: 4940392 - DNA, 14 bp, Homo sapiens
tagtaattgacatg

SEQ ID NO: 4940393 - DNA, 16 bp, Homo sapiens
tagtacctgaaaagta

SEQ ID NO: 4940394 - DNA, 18 bp, Homo sapiens
tagtactgtgtactgtat

SEQ ID NO: 4940395 - DNA, 15 bp, Homo sapiens
tagtagacacactat

SEQ ID NO: 4940396 - DNA, 22 bp, Homo sapiens
tagtagagacagggttttgcca

SEQ ID NO: 4940397 - DNA, 16 bp, Homo sapiens
tagtagccctttctgt

SEQ ID NO: 4940398 - DNA, 18 bp, Homo sapiens
tagtagccctttctgtgt

SEQ ID NO: 4940399 - DNA, 14 bp, Homo sapiens
tagtataaagaaaa

SEQ ID NO: 4940400 - DNA, 13 bp, Homo sapiens
tagtatcagtgtt

SEQ ID NO: 4940401 - DNA, 22 bp, Homo sapiens
tagtatcagtgttttaaattct

SEQ ID NO: 4940402 - DNA, 16 bp, Homo sapiens
tagtatttatttatgt

SEQ ID NO: 4940403 - DNA, 13 bp, Homo sapiens
tagtatttttatc

SEQ ID NO: 4940404 - DNA, 16 bp, Homo sapiens
tagtcaaattatgtat

SEQ ID NO: 4940405 - DNA, 19 bp, Homo sapiens
tagtcaccccaagtagtct

SEQ ID NO: 4940406 - DNA, 18 bp, Homo sapiens
tagtcatttactaaacat

SEQ ID NO: 4940407 - DNA, 14 bp, Homo sapiens
tagtcccttcccct

SEQ ID NO: 4940408 - DNA, 14 bp, Homo sapiens
tagtccttggcata

SEQ ID NO: 4940409 - DNA, 22 bp, Homo sapiens
tagtgaccccttccctgtcctt

SEQ ID NO: 4940410 - DNA, 14 bp, Homo sapiens
tagtgatggttccc

SEQ ID NO: 4940411 - DNA, 21 bp, Homo sapiens
tagtgccagaattttaggaac

SEQ ID NO: 4940412 - DNA, 23 bp, Homo sapiens
tattaacaaacatcactctgctg

SEQ ID NO: 4940413 - DNA, 15 bp, Homo sapiens
tattaactacattta

SEQ ID NO: 4940414 - DNA, 18 bp, Homo sapiens
tattaactacatttatga

SEQ ID NO: 4940415 - DNA, 14 bp, Homo sapiens
tattaatatatgta

SEQ ID NO: 4940416 - DNA, 13 bp, Homo sapiens
tattaatatttaa

SEQ ID NO: 4940417 - DNA, 22 bp, Homo sapiens
tattaatcttggatagctaata

SEQ ID NO: 4940418 - DNA, 21 bp, Homo sapiens
tattaattgttttgcactttt

SEQ ID NO: 4940419 - DNA, 19 bp, Homo sapiens
tattacactgtatttgtat

SEQ ID NO: 4940420 - DNA, 22 bp, Homo sapiens
tattacccaagaagtaaagatg

SEQ ID NO: 4940421 - DNA, 18 bp, Homo sapiens
tattactgtttatttctg

SEQ ID NO: 4940422 - DNA, 13 bp, Homo sapiens
tattacttctgct

SEQ ID NO: 4940423 - DNA, 21 bp, Homo sapiens
tattacttgttgcaaaggtct

SEQ ID NO: 4940424 - DNA, 23 bp, Homo sapiens
tattagccaggatcatggtgtaa

SEQ ID NO: 4940425 - DNA, 19 bp, Homo sapiens
tattagttaatggattaaa

SEQ ID NO: 4940426 - DNA, 23 bp, Homo sapiens
tattagttccctgtctcttgaaa

SEQ ID NO: 4940427 - DNA, 19 bp, Homo sapiens
tattataacaagtgtgtct

SEQ ID NO: 4940428 - DNA, 20 bp, Homo sapiens
tattataacaagtgtgtctt

SEQ ID NO: 4940429 - DNA, 12 bp, Homo sapiens
tattatgtgttt

SEQ ID NO: 4940430 - DNA, 15 bp, Homo sapiens
tattattatctttaa

SEQ ID NO: 4940431 - DNA, 16 bp, Homo sapiens
tattattgctgttgct

SEQ ID NO: 4940432 - DNA, 20 bp, Homo sapiens
tattattgtggtaggccttt

SEQ ID NO: 4940433 - DNA, 15 bp, Homo sapiens
tattatttatttctg

SEQ ID NO: 4940434 - DNA, 12 bp, Homo sapiens
tattatttctat

SEQ ID NO: 4940435 - DNA, 23 bp, Homo sapiens
tattatttggcagtttggtattt

SEQ ID NO: 4940436 - DNA, 20 bp, Homo sapiens
tattcaagttattgtacagc

SEQ ID NO: 4940437 - DNA, 21 bp, Homo sapiens
tattcacatcgcttctgtgta

SEQ ID NO: 4940438 - DNA, 21 bp, Homo sapiens
tattcactgaagttctcctga

SEQ ID NO: 4940439 - DNA, 15 bp, Homo sapiens
tattcagaatattca

SEQ ID NO: 4940440 - DNA, 17 bp, Homo sapiens
tattcagagaatatcaa

SEQ ID NO: 4940441 - DNA, 14 bp, Homo sapiens
tattcagcttcatt

SEQ ID NO: 4940442 - DNA, 16 bp, Homo sapiens
tattcaggagagtaga

SEQ ID NO: 4940443 - DNA, 17 bp, Homo sapiens
tattcatattggaaaaa

SEQ ID NO: 4940444 - DNA, 18 bp, Homo sapiens
tattcattaaatgtttga

SEQ ID NO: 4940445 - DNA, 20 bp, Homo sapiens
tattccagaatgctgtacat

SEQ ID NO: 4940446 - DNA, 22 bp, Homo sapiens
tattcccaagcccatgagtcct

SEQ ID NO: 4940447 - DNA, 21 bp, Homo sapiens
tattcctgcatttgtgaaatg

SEQ ID NO: 4940448 - DNA, 16 bp, Homo sapiens
tattccttctggcctt

SEQ ID NO: 4940449 - DNA, 15 bp, Homo sapiens
tattcctttcccttc

SEQ ID NO: 4940450 - DNA, 19 bp, Homo sapiens
tattcctttcccttcctct

SEQ ID NO: 4940451 - DNA, 17 bp, Homo sapiens
tattcgaatgaaaagac

SEQ ID NO: 4940452 - DNA, 15 bp, Homo sapiens
tattctatatgaatt

SEQ ID NO: 4940453 - DNA, 19 bp, Homo sapiens
tattctgtagattctgtgg

SEQ ID NO: 4940454 - DNA, 16 bp, Homo sapiens
tattctgttggccagt

SEQ ID NO: 4940455 - DNA, 17 bp, Homo sapiens
tattcttctagagttca

SEQ ID NO: 4940456 - DNA, 13 bp, Homo sapiens
tattcttgtgctt

SEQ ID NO: 4940457 - DNA, 22 bp, Homo sapiens
tattgaagaaacagataccata

SEQ ID NO: 4940458 - DNA, 14 bp, Homo sapiens
tattgaagacaatt

SEQ ID NO: 4940459 - DNA, 17 bp, Homo sapiens
tattgaagacaatttga

SEQ ID NO: 4940460 - DNA, 20 bp, Homo sapiens
tattgaagacaatttgatac

SEQ ID NO: 4940461 - DNA, 21 bp, Homo sapiens
tattgaagacaatttgataca

SEQ ID NO: 4940462 - DNA, 20 bp, Homo sapiens
tattgaaggaagccaaattt

SEQ ID NO: 4940463 - DNA, 22 bp, Homo sapiens
tattgaaggaagccaaatttat

SEQ ID NO: 4940464 - DNA, 16 bp, Homo sapiens
tattgaagtttcagct

SEQ ID NO: 4940465 - DNA, 15 bp, Homo sapiens
tattgaatattgtgt

SEQ ID NO: 4940466 - DNA, 12 bp, Homo sapiens
tattgaatgttt

SEQ ID NO: 4940467 - DNA, 19 bp, Homo sapiens
tattgacttcaatgatagt

SEQ ID NO: 4940468 - DNA, 18 bp, Homo sapiens
tattgagatttcttaaat

SEQ ID NO: 4940469 - DNA, 16 bp, Homo sapiens
tattgaggctttgtgt

SEQ ID NO: 4940470 - DNA, 19 bp, Homo sapiens
tattgaggctttgtgttgt

SEQ ID NO: 4940471 - DNA, 21 bp, Homo sapiens
tattgagtttgtaggtaaaat

SEQ ID NO: 4940472 - DNA, 18 bp, Homo sapiens
tattgatatatattataa

SEQ ID NO: 4940473 - DNA, 17 bp, Homo sapiens
tattgatgaaaagattt

SEQ ID NO: 4940474 - DNA, 18 bp, Homo sapiens
tattgatgaaaagattta

SEQ ID NO: 4940475 - DNA, 23 bp, Homo sapiens
tattgatgaaaagatttaagcac

SEQ ID NO: 4940476 - DNA, 13 bp, Homo sapiens
tattgcatttata

SEQ ID NO: 4940477 - DNA, 15 bp, Homo sapiens
tattgcccacgctgg

SEQ ID NO: 4940478 - DNA, 16 bp, Homo sapiens
tattgccttctttgaa

SEQ ID NO: 4940479 - DNA, 15 bp, Homo sapiens
tattgctagtatttg

SEQ ID NO: 4940480 - DNA, 16 bp, Homo sapiens
tattgctgttgcttga

SEQ ID NO: 4940481 - DNA, 17 bp, Homo sapiens
tattgctgttgcttgaa

SEQ ID NO: 4940482 - DNA, 18 bp, Homo sapiens
tattgctgttgcttgaat

SEQ ID NO: 4940483 - DNA, 16 bp, Homo sapiens
tattgcttagtaaaat

SEQ ID NO: 4940484 - DNA, 16 bp, Homo sapiens
tattggggtctgaccc

SEQ ID NO: 4940485 - DNA, 17 bp, Homo sapiens
tattggtggctttcctt

SEQ ID NO: 4940486 - DNA, 20 bp, Homo sapiens
tattgtacagctgtttaaga

SEQ ID NO: 4940487 - DNA, 11 bp, Homo sapiens
tattgtacata

SEQ ID NO: 4940488 - DNA, 16 bp, Homo sapiens
tattgtacataaaaga

SEQ ID NO: 4940489 - DNA, 17 bp, Homo sapiens
tattgtacataaaagaa

SEQ ID NO: 4940490 - DNA, 16 bp, Homo sapiens
tattgtataaactatc

SEQ ID NO: 4940491 - DNA, 21 bp, Homo sapiens
tattgtataaactatcagttt

SEQ ID NO: 4940492 - DNA, 16 bp, Homo sapiens
tattgtgtttgtgtat

SEQ ID NO: 4940493 - DNA, 14 bp, Homo sapiens
tattgttcaaacaa

SEQ ID NO: 4940494 - DNA, 19 bp, Homo sapiens
tattgttgacaactgtgac

SEQ ID NO: 4940495 - DNA, 12 bp, Homo sapiens
tatttaaactat

SEQ ID NO: 4940496 - DNA, 20 bp, Homo sapiens
tatttaaacttataaatcat

SEQ ID NO: 4940497 - DNA, 22 bp, Homo sapiens
tatttaaagacagggaagagca

SEQ ID NO: 4940498 - DNA, 13 bp, Homo sapiens
tatttaaagcatt

SEQ ID NO: 4940499 - DNA, 15 bp, Homo sapiens
tatttaacattattt

SEQ ID NO: 4940500 - DNA, 21 bp, Homo sapiens
tatttaagcctcatatttaaa

SEQ ID NO: 4940501 - DNA, 13 bp, Homo sapiens
tatttaataacat

SEQ ID NO: 4940502 - DNA, 19 bp, Homo sapiens
tatttaatgataagtaaat

SEQ ID NO: 4940503 - DNA, 21 bp, Homo sapiens
tatttaatgcattaaacctgt

SEQ ID NO: 4940504 - DNA, 23 bp, Homo sapiens
tatttaattattaactacattta

SEQ ID NO: 4940505 - DNA, 14 bp, Homo sapiens
tatttacgctttga

SEQ ID NO: 4940506 - DNA, 22 bp, Homo sapiens
tatttacgctttgattcatagt

SEQ ID NO: 4940507 - DNA, 15 bp, Homo sapiens
tatttaggaagtgtt

SEQ ID NO: 4940508 - DNA, 14 bp, Homo sapiens
tatttagtgctgca

SEQ ID NO: 4940509 - DNA, 17 bp, Homo sapiens
tatttagttatagtttc

SEQ ID NO: 4940510 - DNA, 15 bp, Homo sapiens
tatttataattccta

SEQ ID NO: 4940511 - DNA, 17 bp, Homo sapiens
tatttatatgtactgtt

SEQ ID NO: 4940512 - DNA, 15 bp, Homo sapiens
tatttatccatttgt

SEQ ID NO: 4940513 - DNA, 15 bp, Homo sapiens
tatttatctgattaa

SEQ ID NO: 4940514 - DNA, 16 bp, Homo sapiens
tatttatctgattaag

SEQ ID NO: 4940515 - DNA, 21 bp, Homo sapiens
tatttatgccttgatgattta

SEQ ID NO: 4940516 - DNA, 22 bp, Homo sapiens
tatttatgccttgatgatttaa

SEQ ID NO: 4940517 - DNA, 19 bp, Homo sapiens
tatttatggatgcaacacg

SEQ ID NO: 4940518 - DNA, 20 bp, Homo sapiens
tatttattatgctttattgg

SEQ ID NO: 4940519 - DNA, 13 bp, Homo sapiens
tatttatttatgt

SEQ ID NO: 4940520 - DNA, 13 bp, Homo sapiens
tatttattttctt

SEQ ID NO: 4940521 - DNA, 13 bp, Homo sapiens
tatttattttgta

SEQ ID NO: 4940522 - DNA, 13 bp, Homo sapiens
tcagatgagaaca

SEQ ID NO: 4940523 - DNA, 15 bp, Homo sapiens
tcagatgagaacaaa

SEQ ID NO: 4940524 - DNA, 14 bp, Homo sapiens
tcagatgctccaag

SEQ ID NO: 4940525 - DNA, 15 bp, Homo sapiens
tcagatgctccaaga

SEQ ID NO: 4940526 - DNA, 22 bp, Homo sapiens
tcagatgctccaagattctaga

SEQ ID NO: 4940527 - DNA, 20 bp, Homo sapiens
tcagatgggaggaaagagag

SEQ ID NO: 4940528 - DNA, 22 bp, Homo sapiens
tcagatgggaggaaagagagca

SEQ ID NO: 4940529 - DNA, 13 bp, Homo sapiens
tcagatgtccctt

SEQ ID NO: 4940530 - DNA, 12 bp, Homo sapiens
tcagattttgat

SEQ ID NO: 4940531 - DNA, 13 bp, Homo sapiens
tcagcaaaccatt

SEQ ID NO: 4940532 - DNA, 20 bp, Homo sapiens
tcagcaaaccatttttaaag

SEQ ID NO: 4940533 - DNA, 18 bp, Homo sapiens
tcagcacagataaaaagt

SEQ ID NO: 4940534 - DNA, 12 bp, Homo sapiens
tcagcactgaaa

SEQ ID NO: 4940535 - DNA, 14 bp, Homo sapiens
tcagcactgaaaat

SEQ ID NO: 4940536 - DNA, 15 bp, Homo sapiens
tcagcactgaaaata

SEQ ID NO: 4940537 - DNA, 14 bp, Homo sapiens
tcagcacttgtctc

SEQ ID NO: 4940538 - DNA, 17 bp, Homo sapiens
tcagcacttgtctcatt

SEQ ID NO: 4940539 - DNA, 18 bp, Homo sapiens
tcagcacttgtctcattt

SEQ ID NO: 4940540 - DNA, 22 bp, Homo sapiens
tcagcagccgccttaagctgat

SEQ ID NO: 4940541 - DNA, 23 bp, Homo sapiens
tcagcagccgccttaagctgatc

SEQ ID NO: 4940542 - DNA, 17 bp, Homo sapiens
tcagcagctagaaaaca

SEQ ID NO: 4940543 - DNA, 15 bp, Homo sapiens
tcagcatcctggcac

SEQ ID NO: 4940544 - DNA, 17 bp, Homo sapiens
tcagcatctgtgatggg

SEQ ID NO: 4940545 - DNA, 14 bp, Homo sapiens
tcagcattccctcc

SEQ ID NO: 4940546 - DNA, 20 bp, Homo sapiens
tcagcattctcactcctacc

SEQ ID NO: 4940547 - DNA, 13 bp, Homo sapiens
tcagcatttcttt

SEQ ID NO: 4940548 - DNA, 12 bp, Homo sapiens
tcagcccagaag

SEQ ID NO: 4940549 - DNA, 24 bp, Homo sapiens
tcagcccagaagaaaattctcctg

SEQ ID NO: 4940550 - DNA, 13 bp, Homo sapiens
tcagcccccagcc

SEQ ID NO: 4940551 - DNA, 16 bp, Homo sapiens
tcagccccgagctgtc

SEQ ID NO: 4940552 - DNA, 19 bp, Homo sapiens
tcagccccgagctgtcccc

SEQ ID NO: 4940553 - DNA, 13 bp, Homo sapiens
tcagcccctagga

SEQ ID NO: 4940554 - DNA, 16 bp, Homo sapiens
tcagcccctaggagta

SEQ ID NO: 4940555 - DNA, 22 bp, Homo sapiens
tcagcccctaggagtatatttc

SEQ ID NO: 4940556 - DNA, 16 bp, Homo sapiens
tcagccctccctgccc

SEQ ID NO: 4940557 - DNA, 17 bp, Homo sapiens
tcagccctccctgcccc

SEQ ID NO: 4940558 - DNA, 22 bp, Homo sapiens
tcagccggcgtggcaaatataa

SEQ ID NO: 4940559 - DNA, 16 bp, Homo sapiens
tcagcctcccaaagtg

SEQ ID NO: 4940560 - DNA, 19 bp, Homo sapiens
tcagcctcccaaagtgctg

SEQ ID NO: 4940561 - DNA, 21 bp, Homo sapiens
tcagcctcccaaagtgctggg

SEQ ID NO: 4940562 - DNA, 20 bp, Homo sapiens
tcagcctcccaagtagctgg

SEQ ID NO: 4940563 - DNA, 20 bp, Homo sapiens
tcagcctcccgaatagctgg

SEQ ID NO: 4940564 - DNA, 22 bp, Homo sapiens
tcagcctcccgaatagctggga

SEQ ID NO: 4940565 - DNA, 21 bp, Homo sapiens
tcagcctcttaaagctgcctg

SEQ ID NO: 4940566 - DNA, 15 bp, Homo sapiens
tcagccttacatttg

SEQ ID NO: 4940567 - DNA, 16 bp, Homo sapiens
tcagccttacatttgt

SEQ ID NO: 4940568 - DNA, 19 bp, Homo sapiens
tcagcggcgaccgccctcc

SEQ ID NO: 4940569 - DNA, 15 bp, Homo sapiens
tcagcggggacagct

SEQ ID NO: 4940570 - DNA, 15 bp, Homo sapiens
tcagcgtaaaatggt

SEQ ID NO: 4940571 - DNA, 14 bp, Homo sapiens
tcagctactgattt

SEQ ID NO: 4940572 - DNA, 15 bp, Homo sapiens
tcagctactgatttt

SEQ ID NO: 4940573 - DNA, 19 bp, Homo sapiens
tcagctacttaagagaaat

SEQ ID NO: 4940574 - DNA, 19 bp, Homo sapiens
tcagctatttactgccaaa

SEQ ID NO: 4940575 - DNA, 15 bp, Homo sapiens
tcagctccagctcac

SEQ ID NO: 4940576 - DNA, 22 bp, Homo sapiens
tcagctccagggaatccaagcc

SEQ ID NO: 4940577 - DNA, 14 bp, Homo sapiens
tcagctccaggtgg

SEQ ID NO: 4940578 - DNA, 18 bp, Homo sapiens
tcagctcggggagcctta

SEQ ID NO: 4940579 - DNA, 24 bp, Homo sapiens
tcagctgcctcacttcctacaaga

SEQ ID NO: 4940580 - DNA, 22 bp, Homo sapiens
tcagctgctcagcaacctttca

SEQ ID NO: 4940581 - DNA, 12 bp, Homo sapiens
tcagctgtactt

SEQ ID NO: 4940582 - DNA, 17 bp, Homo sapiens
tcagctgtacttcgtct

SEQ ID NO: 4940583 - DNA, 14 bp, Homo sapiens
tcagctgtcctccc

SEQ ID NO: 4940584 - DNA, 18 bp, Homo sapiens
tcagctgtcctccctcca

SEQ ID NO: 4940585 - DNA, 17 bp, Homo sapiens
tcagctgtctgtggctt

SEQ ID NO: 4940586 - DNA, 21 bp, Homo sapiens
tcagcttaaaataaacagttg

SEQ ID NO: 4940587 - DNA, 16 bp, Homo sapiens
tcagcttcatttgtgt

SEQ ID NO: 4940588 - DNA, 9 bp, Homo sapiens
tcaggaaac

SEQ ID NO: 4940589 - DNA, 18 bp, Homo sapiens
tcaggaacagctatggga

SEQ ID NO: 4940590 - DNA, 12 bp, Homo sapiens
tcaggaggctga

SEQ ID NO: 4940591 - DNA, 16 bp, Homo sapiens
tcaggatttaaaaact

SEQ ID NO: 4940592 - DNA, 21 bp, Homo sapiens
tcaggcactagcctttggctc

SEQ ID NO: 4940593 - DNA, 12 bp, Homo sapiens
tcaggcagccag

SEQ ID NO: 4940594 - DNA, 21 bp, Homo sapiens
tcaggcaggaagggcaggaag

SEQ ID NO: 4940595 - DNA, 19 bp, Homo sapiens
tcaggcccttattttcaag

SEQ ID NO: 4940596 - DNA, 22 bp, Homo sapiens
tcaggcctataaccccagctcc

SEQ ID NO: 4940597 - DNA, 18 bp, Homo sapiens
tcaggcctccctctctct

SEQ ID NO: 4940598 - DNA, 15 bp, Homo sapiens
tcaggctcttctcct

SEQ ID NO: 4940599 - DNA, 16 bp, Homo sapiens
tcaggctcttctcctt

SEQ ID NO: 4940600 - DNA, 22 bp, Homo sapiens
tcaggctgcagctggacagagg

SEQ ID NO: 4940601 - DNA, 24 bp, Homo sapiens
tcaggctgctggggcctcagacga

SEQ ID NO: 4940602 - DNA, 14 bp, Homo sapiens
tcaggctggtggga

SEQ ID NO: 4940603 - DNA, 16 bp, Homo sapiens
tcaggctggtgggagg

SEQ ID NO: 4940604 - DNA, 13 bp, Homo sapiens
tcagggagtgctg

SEQ ID NO: 4940605 - DNA, 17 bp, Homo sapiens
tcagggagtgctggctc

SEQ ID NO: 4940606 - DNA, 22 bp, Homo sapiens
tcagggagtgctggctcacagt

SEQ ID NO: 4940607 - DNA, 14 bp, Homo sapiens
tcagggcccagagg

SEQ ID NO: 4940608 - DNA, 21 bp, Homo sapiens
tcagggcctggggcctgagag

SEQ ID NO: 4940609 - DNA, 13 bp, Homo sapiens
tcagggctcctcc

SEQ ID NO: 4940610 - DNA, 16 bp, Homo sapiens
tcagggctcctcccag

SEQ ID NO: 4940611 - DNA, 17 bp, Homo sapiens
tcagggctcctcccagc

SEQ ID NO: 4940612 - DNA, 17 bp, Homo sapiens
tcaggggaaaactgtta

SEQ ID NO: 4940613 - DNA, 18 bp, Homo sapiens
tcaggggactcagccctg

SEQ ID NO: 4940614 - DNA, 16 bp, Homo sapiens
tcagggggaagaagca

SEQ ID NO: 4940615 - DNA, 23 bp, Homo sapiens
tcagggttggcccctgcccggct

SEQ ID NO: 4940616 - DNA, 15 bp, Homo sapiens
tcaggtaacaggcag

SEQ ID NO: 4940617 - DNA, 23 bp, Homo sapiens
tcaggtaacaggcagatacagga

SEQ ID NO: 4940618 - DNA, 21 bp, Homo sapiens
tcaggtatgttgcctttatgg

SEQ ID NO: 4940619 - DNA, 19 bp, Homo sapiens
tcaggtctcccacgtggga

SEQ ID NO: 4940620 - DNA, 13 bp, Homo sapiens
tcaggtgaaaatg

SEQ ID NO: 4940621 - DNA, 16 bp, Homo sapiens
tcaggtgacatgtgaa

SEQ ID NO: 4940622 - DNA, 14 bp, Homo sapiens
tcaggtgctgccat

SEQ ID NO: 4940623 - DNA, 15 bp, Homo sapiens
tcaggtgtccctgca

SEQ ID NO: 4940624 - DNA, 17 bp, Homo sapiens
tcaggtgtccctgcact

SEQ ID NO: 4940625 - DNA, 22 bp, Homo sapiens
tcaggtgtccctgcacttgcag

SEQ ID NO: 4940626 - DNA, 18 bp, Homo sapiens
tcaggttatcgaaataac

SEQ ID NO: 4940627 - DNA, 20 bp, Homo sapiens
tcaggttatcgaaataacaa

SEQ ID NO: 4940628 - DNA, 22 bp, Homo sapiens
tcaggttgtctgaagtcactgc

SEQ ID NO: 4940629 - DNA, 19 bp, Homo sapiens
tcaggtttgtcatcagatg

SEQ ID NO: 4940630 - DNA, 17 bp, Homo sapiens
tcagtaagaaaaagaag

SEQ ID NO: 4940631 - DNA, 19 bp, Homo sapiens
tcagtaagaaaaagaagaa

SEQ ID NO: 4940632 - DNA, 16 bp, Homo sapiens
tcccaattgagaaaaa

SEQ ID NO: 4940633 - DNA, 15 bp, Homo sapiens
tcccacaggcccttc

SEQ ID NO: 4940634 - DNA, 16 bp, Homo sapiens
tcccacccacatgtga

SEQ ID NO: 4940635 - DNA, 18 bp, Homo sapiens
tcccacccacatgtgaca

SEQ ID NO: 4940636 - DNA, 22 bp, Homo sapiens
tcccacccccacccccagctca

SEQ ID NO: 4940637 - DNA, 19 bp, Homo sapiens
tcccacccccttctctgct

SEQ ID NO: 4940638 - DNA, 22 bp, Homo sapiens
tcccacccccttctctgctcca

SEQ ID NO: 4940639 - DNA, 16 bp, Homo sapiens
tcccacctccagcccg

SEQ ID NO: 4940640 - DNA, 15 bp, Homo sapiens
tcccacctccatccc

SEQ ID NO: 4940641 - DNA, 14 bp, Homo sapiens
tcccacctccctgc

SEQ ID NO: 4940642 - DNA, 15 bp, Homo sapiens
tcccacctccctgcc

SEQ ID NO: 4940643 - DNA, 19 bp, Homo sapiens
tcccacctccctgcccagg

SEQ ID NO: 4940644 - DNA, 21 bp, Homo sapiens
tcccacctctgtgacctcagg

SEQ ID NO: 4940645 - DNA, 22 bp, Homo sapiens
tcccacctctgtgacctcaggc

SEQ ID NO: 4940646 - DNA, 14 bp, Homo sapiens
tcccacgtgtcttc

SEQ ID NO: 4940647 - DNA, 18 bp, Homo sapiens
tcccacgtgtcttccact

SEQ ID NO: 4940648 - DNA, 19 bp, Homo sapiens
tcccagaatcccagccggc

SEQ ID NO: 4940649 - DNA, 16 bp, Homo sapiens
tcccagactactattt

SEQ ID NO: 4940650 - DNA, 23 bp, Homo sapiens
tcccagactactattttcttttt

SEQ ID NO: 4940651 - DNA, 18 bp, Homo sapiens
tcccagaggtccagccca

SEQ ID NO: 4940652 - DNA, 19 bp, Homo sapiens
tcccagaggtccagcccat

SEQ ID NO: 4940653 - DNA, 12 bp, Homo sapiens
tcccagcacctg

SEQ ID NO: 4940654 - DNA, 15 bp, Homo sapiens
tcccagcacctgcct

SEQ ID NO: 4940655 - DNA, 13 bp, Homo sapiens
tcccagcactttg

SEQ ID NO: 4940656 - DNA, 14 bp, Homo sapiens
tcccagccaccccg

SEQ ID NO: 4940657 - DNA, 24 bp, Homo sapiens
tcccagccaccccgggctctctgc

SEQ ID NO: 4940658 - DNA, 10 bp, Homo sapiens
tcccagcctg

SEQ ID NO: 4940659 - DNA, 20 bp, Homo sapiens
tcccagctgtgctctggaca

SEQ ID NO: 4940660 - DNA, 16 bp, Homo sapiens
tcccaggaactgggcc

SEQ ID NO: 4940661 - DNA, 15 bp, Homo sapiens
tcccaggacaccaca

SEQ ID NO: 4940662 - DNA, 19 bp, Homo sapiens
tcccagtgagtctctgggg

SEQ ID NO: 4940663 - DNA, 21 bp, Homo sapiens
tcccatattggcatggatttc

SEQ ID NO: 4940664 - DNA, 22 bp, Homo sapiens
tcccatcattacccttccctgc

SEQ ID NO: 4940665 - DNA, 18 bp, Homo sapiens
tcccatctaagctgcagc

SEQ ID NO: 4940666 - DNA, 19 bp, Homo sapiens
tcccatctaagctgcagct

SEQ ID NO: 4940667 - DNA, 21 bp, Homo sapiens
tcccatgaagccttttgaaag

SEQ ID NO: 4940668 - DNA, 21 bp, Homo sapiens
tcccatgagaccctggtgcct

SEQ ID NO: 4940669 - DNA, 15 bp, Homo sapiens
tcccatgagcctcag

SEQ ID NO: 4940670 - DNA, 22 bp, Homo sapiens
tcccatggacactccagtgcca

SEQ ID NO: 4940671 - DNA, 20 bp, Homo sapiens
tccccaaccctaggttccct

SEQ ID NO: 4940672 - DNA, 15 bp, Homo sapiens
tccccacccctaccc

SEQ ID NO: 4940673 - DNA, 13 bp, Homo sapiens
tccccacctggga

SEQ ID NO: 4940674 - DNA, 14 bp, Homo sapiens
tccccacctgggac

SEQ ID NO: 4940675 - DNA, 23 bp, Homo sapiens
tccccacggggcctcgggacctc

SEQ ID NO: 4940676 - DNA, 16 bp, Homo sapiens
tccccactgacagcct

SEQ ID NO: 4940677 - DNA, 19 bp, Homo sapiens
tccccactgacagcctccc

SEQ ID NO: 4940678 - DNA, 17 bp, Homo sapiens
tccccagaaaggagact

SEQ ID NO: 4940679 - DNA, 19 bp, Homo sapiens
tccccagattgcaacaggc

SEQ ID NO: 4940680 - DNA, 22 bp, Homo sapiens
tccccagattgcaacaggctgg

SEQ ID NO: 4940681 - DNA, 23 bp, Homo sapiens
tccccagattgcaacaggctggg

SEQ ID NO: 4940682 - DNA, 13 bp, Homo sapiens
tccccagcccagg

SEQ ID NO: 4940683 - DNA, 11 bp, Homo sapiens
tccccagcccc

SEQ ID NO: 4940684 - DNA, 15 bp, Homo sapiens
tccccagcccctagc

SEQ ID NO: 4940685 - DNA, 21 bp, Homo sapiens
tccccagcccctagcccagga

SEQ ID NO: 4940686 - DNA, 18 bp, Homo sapiens
tccccaggggtcccagcc

SEQ ID NO: 4940687 - DNA, 22 bp, Homo sapiens
tccccaggggtcccagccaccc

SEQ ID NO: 4940688 - DNA, 20 bp, Homo sapiens
tccccatgccacgttccaca

SEQ ID NO: 4940689 - DNA, 14 bp, Homo sapiens
tcccccaaccccca

SEQ ID NO: 4940690 - DNA, 15 bp, Homo sapiens
tcccccaacccccac

SEQ ID NO: 4940691 - DNA, 21 bp, Homo sapiens
tcccccaacccccaccccaca

SEQ ID NO: 4940692 - DNA, 19 bp, Homo sapiens
tcccccacagtttgatgtc

SEQ ID NO: 4940693 - DNA, 22 bp, Homo sapiens
tcccccaccggtccagctggcc

SEQ ID NO: 4940694 - DNA, 23 bp, Homo sapiens
tcccccaccggtccagctggcct

SEQ ID NO: 4940695 - DNA, 13 bp, Homo sapiens
tcccccatctccc

SEQ ID NO: 4940696 - DNA, 13 bp, Homo sapiens
tcccccctcccac

SEQ ID NO: 4940697 - DNA, 16 bp, Homo sapiens
tccccctggttgggtg

SEQ ID NO: 4940698 - DNA, 20 bp, Homo sapiens
tcccccttccaaataataaa

SEQ ID NO: 4940699 - DNA, 13 bp, Homo sapiens
tcccccttgccac

SEQ ID NO: 4940700 - DNA, 14 bp, Homo sapiens
tcccccttgccacc

SEQ ID NO: 4940701 - DNA, 18 bp, Homo sapiens
tccccgacgcccacccaa

SEQ ID NO: 4940702 - DNA, 21 bp, Homo sapiens
tccccgcaccccccaagctgt

SEQ ID NO: 4940703 - DNA, 18 bp, Homo sapiens
tccccgcagccctggcag

SEQ ID NO: 4940704 - DNA, 15 bp, Homo sapiens
tccccgctaaggaag

SEQ ID NO: 4940705 - DNA, 19 bp, Homo sapiens
tccccggcaccctctggcc

SEQ ID NO: 4940706 - DNA, 20 bp, Homo sapiens
tccccgttcctgacatcaca

SEQ ID NO: 4940707 - DNA, 14 bp, Homo sapiens
tcccctcacagcct

SEQ ID NO: 4940708 - DNA, 17 bp, Homo sapiens
tcccctcacagcctctg

SEQ ID NO: 4940709 - DNA, 15 bp, Homo sapiens
tcccctcacctcctc

SEQ ID NO: 4940710 - DNA, 15 bp, Homo sapiens
tcccctccactgtca

SEQ ID NO: 4940711 - DNA, 13 bp, Homo sapiens
tcccctcccctgc

SEQ ID NO: 4940712 - DNA, 15 bp, Homo sapiens
tcccctccctggctc

SEQ ID NO: 4940713 - DNA, 16 bp, Homo sapiens
tcccctccctggctcc

SEQ ID NO: 4940714 - DNA, 18 bp, Homo sapiens
tcccctccttctcccttt

SEQ ID NO: 4940715 - DNA, 13 bp, Homo sapiens
tcccctctgctgc

SEQ ID NO: 4940716 - DNA, 15 bp, Homo sapiens
tcccctctgctgctg

SEQ ID NO: 4940717 - DNA, 23 bp, Homo sapiens
tcccctcttttgttaaataatat

SEQ ID NO: 4940718 - DNA, 19 bp, Homo sapiens
tcccctgccccttccttta

SEQ ID NO: 4940719 - DNA, 12 bp, Homo sapiens
tcccctgccctg

SEQ ID NO: 4940720 - DNA, 16 bp, Homo sapiens
tcccctgccctgctgc

SEQ ID NO: 4940721 - DNA, 15 bp, Homo sapiens
tcccctgccctggtc

SEQ ID NO: 4940722 - DNA, 17 bp, Homo sapiens
tcccctgccctggtcca

SEQ ID NO: 4940723 - DNA, 15 bp, Homo sapiens
tcccctgccttgctg

SEQ ID NO: 4940724 - DNA, 17 bp, Homo sapiens
tcccctgctgcaggggc

SEQ ID NO: 4940725 - DNA, 23 bp, Homo sapiens
tccccttggcaggtcctggccag

SEQ ID NO: 4940726 - DNA, 16 bp, Homo sapiens
tcccgaatagctggga

SEQ ID NO: 4940727 - DNA, 16 bp, Homo sapiens
tcccgagtacagtctg

SEQ ID NO: 4940728 - DNA, 18 bp, Homo sapiens
tcccgagtacagtctgta

SEQ ID NO: 4940729 - DNA, 17 bp, Homo sapiens
tcccgccagagggcttg

SEQ ID NO: 4940730 - DNA, 23 bp, Homo sapiens
tcccgcgggttccgcaggcagac

SEQ ID NO: 4940731 - DNA, 20 bp, Homo sapiens
tcccgctcagccctccctgc

SEQ ID NO: 4940732 - DNA, 15 bp, Homo sapiens
tcccgtgttctcctt

SEQ ID NO: 4940733 - DNA, 20 bp, Homo sapiens
tcccgtttctccacctagac

SEQ ID NO: 4940734 - DNA, 22 bp, Homo sapiens
tccctaccgagtctcttctcca

SEQ ID NO: 4940735 - DNA, 23 bp, Homo sapiens
tccctaccgagtctcttctccac

SEQ ID NO: 4940736 - DNA, 15 bp, Homo sapiens
tccctacttcctgtg

SEQ ID NO: 4940737 - DNA, 17 bp, Homo sapiens
tccctacttcctgtgac

SEQ ID NO: 4940738 - DNA, 16 bp, Homo sapiens
tccctagatctttcta

SEQ ID NO: 4940739 - DNA, 15 bp, Homo sapiens
tccctaggagaccaa

SEQ ID NO: 4940740 - DNA, 18 bp, Homo sapiens
tccctatgtatttgcagt

SEQ ID NO: 4940741 - DNA, 13 bp, Homo sapiens
tccctcccacctc

SEQ ID NO: 4940742 - DNA, 13 bp, Homo sapiens
tctaagattctag

SEQ ID NO: 4940743 - DNA, 15 bp, Homo sapiens
tctaagattctagat

SEQ ID NO: 4940744 - DNA, 12 bp, Homo sapiens
tctaagattctg

SEQ ID NO: 4940745 - DNA, 23 bp, Homo sapiens
tctaaggacctgaaattccaaag

SEQ ID NO: 4940746 - DNA, 18 bp, Homo sapiens
tctaaggcctaggattct

SEQ ID NO: 4940747 - DNA, 20 bp, Homo sapiens
tctaaggcctaggattctaa

SEQ ID NO: 4940748 - DNA, 22 bp, Homo sapiens
tctaaggcctaggattctaaaa

SEQ ID NO: 4940749 - DNA, 13 bp, Homo sapiens
tctaaggctctga

SEQ ID NO: 4940750 - DNA, 15 bp, Homo sapiens
tctaaggctctgaga

SEQ ID NO: 4940751 - DNA, 20 bp, Homo sapiens
tctaaggctctgagagtcta

SEQ ID NO: 4940752 - DNA, 23 bp, Homo sapiens
tctaaggctctgagagtctagat

SEQ ID NO: 4940753 - DNA, 14 bp, Homo sapiens
tctaagggggaggg

SEQ ID NO: 4940754 - DNA, 16 bp, Homo sapiens
tctaagtatttgaaac

SEQ ID NO: 4940755 - DNA, 14 bp, Homo sapiens
tctaagttataaga

SEQ ID NO: 4940756 - DNA, 12 bp, Homo sapiens
tctaagtttcta

SEQ ID NO: 4940757 - DNA, 13 bp, Homo sapiens
tctaagtttctaa

SEQ ID NO: 4940758 - DNA, 17 bp, Homo sapiens
tctaagtttctaagatt

SEQ ID NO: 4940759 - DNA, 22 bp, Homo sapiens
tctaataaaacagctgtctcta

SEQ ID NO: 4940760 - DNA, 13 bp, Homo sapiens
tctaataaattat

SEQ ID NO: 4940761 - DNA, 16 bp, Homo sapiens
tctaataatttctaat

SEQ ID NO: 4940762 - DNA, 17 bp, Homo sapiens
tctaatacctctgtgtg

SEQ ID NO: 4940763 - DNA, 15 bp, Homo sapiens
tctaatatattttta

SEQ ID NO: 4940764 - DNA, 20 bp, Homo sapiens
tctaatatccccaaattagg

SEQ ID NO: 4940765 - DNA, 20 bp, Homo sapiens
tctaatatggcaaaaatggc

SEQ ID NO: 4940766 - DNA, 14 bp, Homo sapiens
tctaatatggccac

SEQ ID NO: 4940767 - DNA, 17 bp, Homo sapiens
tctaatattaaaaatat

SEQ ID NO: 4940768 - DNA, 18 bp, Homo sapiens
tctaatattaaaaatatg

SEQ ID NO: 4940769 - DNA, 20 bp, Homo sapiens
tctaatcgaaagaaaatggg

SEQ ID NO: 4940770 - DNA, 20 bp, Homo sapiens
tctaatggcacttatcatta

SEQ ID NO: 4940771 - DNA, 14 bp, Homo sapiens
tctaatgtcttcat

SEQ ID NO: 4940772 - DNA, 17 bp, Homo sapiens
tctaatgtcttcatttc

SEQ ID NO: 4940773 - DNA, 14 bp, Homo sapiens
tctaatgtgtgaat

SEQ ID NO: 4940774 - DNA, 19 bp, Homo sapiens
tctaattgcatctcaaaat

SEQ ID NO: 4940775 - DNA, 13 bp, Homo sapiens
tctacaaataatt

SEQ ID NO: 4940776 - DNA, 18 bp, Homo sapiens
tctacaaatataagattt

SEQ ID NO: 4940777 - DNA, 16 bp, Homo sapiens
tctacactgcaatcat

SEQ ID NO: 4940778 - DNA, 19 bp, Homo sapiens
tctacactgcaatcatatg

SEQ ID NO: 4940779 - DNA, 21 bp, Homo sapiens
tctacagaggccatgggcctc

SEQ ID NO: 4940780 - DNA, 17 bp, Homo sapiens
tctacataagtaattca

SEQ ID NO: 4940781 - DNA, 20 bp, Homo sapiens
tctacataagtaattcaaga

SEQ ID NO: 4940782 - DNA, 15 bp, Homo sapiens
tctacatcttctgcc

SEQ ID NO: 4940783 - DNA, 20 bp, Homo sapiens
tctacatgaggaactgtaga

SEQ ID NO: 4940784 - DNA, 18 bp, Homo sapiens
tctaccatttcagagagg

SEQ ID NO: 4940785 - DNA, 16 bp, Homo sapiens
tctacccaaaccctag

SEQ ID NO: 4940786 - DNA, 20 bp, Homo sapiens
tctacccaagggcagaaagt

SEQ ID NO: 4940787 - DNA, 19 bp, Homo sapiens
tctacccagcgagccctgg

SEQ ID NO: 4940788 - DNA, 15 bp, Homo sapiens
tctacctcaggcagc

SEQ ID NO: 4940789 - DNA, 14 bp, Homo sapiens
tctactttattaat

SEQ ID NO: 4940790 - DNA, 21 bp, Homo sapiens
tctactttattaattgttttg

SEQ ID NO: 4940791 - DNA, 15 bp, Homo sapiens
tctagaacacaggca

SEQ ID NO: 4940792 - DNA, 16 bp, Homo sapiens
tctagaacacaggcaa

SEQ ID NO: 4940793 - DNA, 17 bp, Homo sapiens
tctagaacacaggcaaa

SEQ ID NO: 4940794 - DNA, 22 bp, Homo sapiens
tctagaatctgcaattcaaaag

SEQ ID NO: 4940795 - DNA, 23 bp, Homo sapiens
tctagaatctgcaattcaaaagt

SEQ ID NO: 4940796 - DNA, 14 bp, Homo sapiens
tctagacaagatat

SEQ ID NO: 4940797 - DNA, 15 bp, Homo sapiens
tctagagtccaaggt

SEQ ID NO: 4940798 - DNA, 18 bp, Homo sapiens
tctagatcagatgctcca

SEQ ID NO: 4940799 - DNA, 22 bp, Homo sapiens
tctagatgtttattcttctaga

SEQ ID NO: 4940800 - DNA, 20 bp, Homo sapiens
tctagattcaaaggttctag

SEQ ID NO: 4940801 - DNA, 22 bp, Homo sapiens
tctagattccattggtccaaga

SEQ ID NO: 4940802 - DNA, 21 bp, Homo sapiens
tctagattctctggctgtaag

SEQ ID NO: 4940803 - DNA, 22 bp, Homo sapiens
tctagcaaccgcctcaaaatgt

SEQ ID NO: 4940804 - DNA, 17 bp, Homo sapiens
tctagcactcattttct

SEQ ID NO: 4940805 - DNA, 11 bp, Homo sapiens
tctagcctgca

SEQ ID NO: 4940806 - DNA, 22 bp, Homo sapiens
tctagcctgcactttgatgtca

SEQ ID NO: 4940807 - DNA, 19 bp, Homo sapiens
tctaggagggagacactgg

SEQ ID NO: 4940808 - DNA, 17 bp, Homo sapiens
tctaggtttcaaagatg

SEQ ID NO: 4940809 - DNA, 19 bp, Homo sapiens
tctaggtttcaaagatgct

SEQ ID NO: 4940810 - DNA, 15 bp, Homo sapiens
tctagtggtctttgt

SEQ ID NO: 4940811 - DNA, 18 bp, Homo sapiens
tctagtggtctttgtaag

SEQ ID NO: 4940812 - DNA, 19 bp, Homo sapiens
tctagtggtctttgtaaga

SEQ ID NO: 4940813 - DNA, 21 bp, Homo sapiens
tctagttgccaaatctggctc

SEQ ID NO: 4940814 - DNA, 20 bp, Homo sapiens
tctataaagcgatatacaga

SEQ ID NO: 4940815 - DNA, 13 bp, Homo sapiens
tctataacagata

SEQ ID NO: 4940816 - DNA, 16 bp, Homo sapiens
tctataaggccataaa

SEQ ID NO: 4940817 - DNA, 18 bp, Homo sapiens
tctatacatctctcccca

SEQ ID NO: 4940818 - DNA, 20 bp, Homo sapiens
tctatacctgtctcctttct

SEQ ID NO: 4940819 - DNA, 14 bp, Homo sapiens
tctatagttctaga

SEQ ID NO: 4940820 - DNA, 16 bp, Homo sapiens
tctatatatgtgtatg

SEQ ID NO: 4940821 - DNA, 19 bp, Homo sapiens
tctatatatgtgtatgtac

SEQ ID NO: 4940822 - DNA, 23 bp, Homo sapiens
tctatcaactttaatcaagttgt

SEQ ID NO: 4940823 - DNA, 22 bp, Homo sapiens
tctatcaagtcaatcatttctc

SEQ ID NO: 4940824 - DNA, 14 bp, Homo sapiens
tctatcagagaaaa

SEQ ID NO: 4940825 - DNA, 18 bp, Homo sapiens
tctatccaaatctgaaga

SEQ ID NO: 4940826 - DNA, 16 bp, Homo sapiens
tctatcctacaacaag

SEQ ID NO: 4940827 - DNA, 17 bp, Homo sapiens
tctatctgggcctgggc

SEQ ID NO: 4940828 - DNA, 18 bp, Homo sapiens
tctatctgggcctgggct

SEQ ID NO: 4940829 - DNA, 17 bp, Homo sapiens
tctatcttccaaatgca

SEQ ID NO: 4940830 - DNA, 23 bp, Homo sapiens
tctatcttccaaatgcaatttga

SEQ ID NO: 4940831 - DNA, 15 bp, Homo sapiens
tctatgagtctagat

SEQ ID NO: 4940832 - DNA, 18 bp, Homo sapiens
tctatgagtctagatgtt

SEQ ID NO: 4940833 - DNA, 21 bp, Homo sapiens
tctatgctgtttgtagtgaaa

SEQ ID NO: 4940834 - DNA, 21 bp, Homo sapiens
tctatggacagggctgtctct

SEQ ID NO: 4940835 - DNA, 12 bp, Homo sapiens
tctatgggactc

SEQ ID NO: 4940836 - DNA, 19 bp, Homo sapiens
tctatgggactcaatgcac

SEQ ID NO: 4940837 - DNA, 19 bp, Homo sapiens
tctatggggagaggaactc

SEQ ID NO: 4940838 - DNA, 14 bp, Homo sapiens
tctatggttatgaa

SEQ ID NO: 4940839 - DNA, 16 bp, Homo sapiens
tctattaatatatgta

SEQ ID NO: 4940840 - DNA, 21 bp, Homo sapiens
tctattaatatatgtattatt

SEQ ID NO: 4940841 - DNA, 13 bp, Homo sapiens
tctattgccttct

SEQ ID NO: 4940842 - DNA, 19 bp, Homo sapiens
tctattgccttctttgaag

SEQ ID NO: 4940843 - DNA, 12 bp, Homo sapiens
tctatttaagcc

SEQ ID NO: 4940844 - DNA, 12 bp, Homo sapiens
tctatttaatat

SEQ ID NO: 4940845 - DNA, 13 bp, Homo sapiens
tctatttaatatt

SEQ ID NO: 4940846 - DNA, 18 bp, Homo sapiens
tctatttgacttgtggtt

SEQ ID NO: 4940847 - DNA, 16 bp, Homo sapiens
tctattttctatgtac

SEQ ID NO: 4940848 - DNA, 18 bp, Homo sapiens
tctattttctatgtacta

SEQ ID NO: 4940849 - DNA, 13 bp, Homo sapiens
tctatttttgtct

SEQ ID NO: 4940850 - DNA, 14 bp, Homo sapiens
tctcaaaagcattt

SEQ ID NO: 4940851 - DNA, 17 bp, Homo sapiens
tctcaaactaaaagaca

SEQ ID NO: 4940852 - DNA, 21 bp, Homo sapiens
tctgctcgccctcctttctgt

SEQ ID NO: 4940853 - DNA, 20 bp, Homo sapiens
tctgctgacagacacaggcc

SEQ ID NO: 4940854 - DNA, 13 bp, Homo sapiens
tctgctggagttt

SEQ ID NO: 4940855 - DNA, 22 bp, Homo sapiens
tctgctgtccccttggcaggtc

SEQ ID NO: 4940856 - DNA, 13 bp, Homo sapiens
tctgcttcagtgg

SEQ ID NO: 4940857 - DNA, 22 bp, Homo sapiens
tctgctttctttgattctcctt

SEQ ID NO: 4940858 - DNA, 13 bp, Homo sapiens
tctggaagaaaaa

SEQ ID NO: 4940859 - DNA, 14 bp, Homo sapiens
tctggaagaaaaaa

SEQ ID NO: 4940860 - DNA, 14 bp, Homo sapiens
tctggacaggcatg

SEQ ID NO: 4940861 - DNA, 20 bp, Homo sapiens
tctggacaggctctgcttct

SEQ ID NO: 4940862 - DNA, 18 bp, Homo sapiens
tctggactcctctgtcca

SEQ ID NO: 4940863 - DNA, 18 bp, Homo sapiens
tctggactctaaagacca

SEQ ID NO: 4940864 - DNA, 17 bp, Homo sapiens
tctggagacagccccag

SEQ ID NO: 4940865 - DNA, 22 bp, Homo sapiens
tctggaggccttccagctgctg

SEQ ID NO: 4940866 - DNA, 13 bp, Homo sapiens
tctggagtgggca

SEQ ID NO: 4940867 - DNA, 22 bp, Homo sapiens
tctggagtttttgtttggagag

SEQ ID NO: 4940868 - DNA, 14 bp, Homo sapiens
tctggataggagcc

SEQ ID NO: 4940869 - DNA, 20 bp, Homo sapiens
tctggataggagcctgctgg

SEQ ID NO: 4940870 - DNA, 18 bp, Homo sapiens
tctggcagttctggaatg

SEQ ID NO: 4940871 - DNA, 21 bp, Homo sapiens
tctggccatatttactacctt

SEQ ID NO: 4940872 - DNA, 12 bp, Homo sapiens
tctggcctggcc

SEQ ID NO: 4940873 - DNA, 13 bp, Homo sapiens
tctggcctggcct

SEQ ID NO: 4940874 - DNA, 14 bp, Homo sapiens
tctggcctggcctg

SEQ ID NO: 4940875 - DNA, 20 bp, Homo sapiens
tctggcctggcctggccctg

SEQ ID NO: 4940876 - DNA, 21 bp, Homo sapiens
tctggctagaggccagcccca

SEQ ID NO: 4940877 - DNA, 22 bp, Homo sapiens
tctggctagaggccagccccac

SEQ ID NO: 4940878 - DNA, 22 bp, Homo sapiens
tctggctgactaaatttgggga

SEQ ID NO: 4940879 - DNA, 22 bp, Homo sapiens
tctggctgccccaacctgctga

SEQ ID NO: 4940880 - DNA, 22 bp, Homo sapiens
tctggctgtaaggctctagatc

SEQ ID NO: 4940881 - DNA, 18 bp, Homo sapiens
tctggcttattttaatgt

SEQ ID NO: 4940882 - DNA, 20 bp, Homo sapiens
tctggcttattttaatgtga

SEQ ID NO: 4940883 - DNA, 18 bp, Homo sapiens
tctgggcacactctgcca

SEQ ID NO: 4940884 - DNA, 20 bp, Homo sapiens
tctgggcggcgggcggctgg

SEQ ID NO: 4940885 - DNA, 17 bp, Homo sapiens
tctgggctaggtagaaa

SEQ ID NO: 4940886 - DNA, 17 bp, Homo sapiens
tctgggctatggacaca

SEQ ID NO: 4940887 - DNA, 18 bp, Homo sapiens
tctgggctatggacacag

SEQ ID NO: 4940888 - DNA, 22 bp, Homo sapiens
tctgggctgctacccagaaatc

SEQ ID NO: 4940889 - DNA, 20 bp, Homo sapiens
tctggggaaagacactgcct

SEQ ID NO: 4940890 - DNA, 23 bp, Homo sapiens
tctggggaaagacactgcctggg

SEQ ID NO: 4940891 - DNA, 19 bp, Homo sapiens
tctggggcaggctgggcca

SEQ ID NO: 4940892 - DNA, 13 bp, Homo sapiens
tctgggtggcctc

SEQ ID NO: 4940893 - DNA, 16 bp, Homo sapiens
tctgggttcactgcaa

SEQ ID NO: 4940894 - DNA, 14 bp, Homo sapiens
tctggttctgatgc

SEQ ID NO: 4940895 - DNA, 16 bp, Homo sapiens
tctggtttctcattct

SEQ ID NO: 4940896 - DNA, 12 bp, Homo sapiens
tctgtaaatatg

SEQ ID NO: 4940897 - DNA, 23 bp, Homo sapiens
tctgtaacaggtattttgtttct

SEQ ID NO: 4940898 - DNA, 17 bp, Homo sapiens
tctgtacacgtgtcctg

SEQ ID NO: 4940899 - DNA, 21 bp, Homo sapiens
tctgtacattttgttgtaaaa

SEQ ID NO: 4940900 - DNA, 16 bp, Homo sapiens
tctgtaccatttattt

SEQ ID NO: 4940901 - DNA, 14 bp, Homo sapiens
tctgtacttcctga

SEQ ID NO: 4940902 - DNA, 16 bp, Homo sapiens
tctgtagattctgtgg

SEQ ID NO: 4940903 - DNA, 21 bp, Homo sapiens
tctgtataaacattaaatgtc

SEQ ID NO: 4940904 - DNA, 23 bp, Homo sapiens
tctgtatttatgtgtgaggagct

SEQ ID NO: 4940905 - DNA, 19 bp, Homo sapiens
tctgtcagatgagaacaaa

SEQ ID NO: 4940906 - DNA, 20 bp, Homo sapiens
tctgtcagatgagaacaaag

SEQ ID NO: 4940907 - DNA, 21 bp, Homo sapiens
tctgtcagatgagaacaaagc

SEQ ID NO: 4940908 - DNA, 23 bp, Homo sapiens
tctgtcagatgagaacaaagctg

SEQ ID NO: 4940909 - DNA, 24 bp, Homo sapiens
tctgtcagatgagaacaaagctgt

SEQ ID NO: 4940910 - DNA, 15 bp, Homo sapiens
tctgtcatttgagca

SEQ ID NO: 4940911 - DNA, 15 bp, Homo sapiens
tctgtccaaaggagg

SEQ ID NO: 4940912 - DNA, 22 bp, Homo sapiens
tctgtccaaaggaggctggcag

SEQ ID NO: 4940913 - DNA, 16 bp, Homo sapiens
tctgtcctgcttctga

SEQ ID NO: 4940914 - DNA, 21 bp, Homo sapiens
tctgtcctgggagtgagctgg

SEQ ID NO: 4940915 - DNA, 16 bp, Homo sapiens
tctgtctaaaaaccag

SEQ ID NO: 4940916 - DNA, 14 bp, Homo sapiens
tctgtctacaaata

SEQ ID NO: 4940917 - DNA, 12 bp, Homo sapiens
tctgtctcatcc

SEQ ID NO: 4940918 - DNA, 13 bp, Homo sapiens
tctgtctgccctt

SEQ ID NO: 4940919 - DNA, 18 bp, Homo sapiens
tctgtctggagtgacaga

SEQ ID NO: 4940920 - DNA, 22 bp, Homo sapiens
tctgtcttcacagctctgtgtt

SEQ ID NO: 4940921 - DNA, 13 bp, Homo sapiens
tctgtcttgtaat

SEQ ID NO: 4940922 - DNA, 19 bp, Homo sapiens
tctgtcttgtaatattttg

SEQ ID NO: 4940923 - DNA, 20 bp, Homo sapiens
tctgtcttgtaatattttgt

SEQ ID NO: 4940924 - DNA, 16 bp, Homo sapiens
tctgtgaaagtacatt

SEQ ID NO: 4940925 - DNA, 13 bp, Homo sapiens
tctgtgacctcag

SEQ ID NO: 4940926 - DNA, 14 bp, Homo sapiens
tctgtgacctcagg

SEQ ID NO: 4940927 - DNA, 17 bp, Homo sapiens
tctgtgatgagctgatc

SEQ ID NO: 4940928 - DNA, 14 bp, Homo sapiens
tctgtgccccatgc

SEQ ID NO: 4940929 - DNA, 22 bp, Homo sapiens
tctgtgccccatgcctgtccag

SEQ ID NO: 4940930 - DNA, 18 bp, Homo sapiens
tctgtgccttcttttgat

SEQ ID NO: 4940931 - DNA, 22 bp, Homo sapiens
tctgtggaccactgcatgagct

SEQ ID NO: 4940932 - DNA, 20 bp, Homo sapiens
tctgtgtcaggtggggcagc

SEQ ID NO: 4940933 - DNA, 11 bp, Homo sapiens
tctgtgtcctt

SEQ ID NO: 4940934 - DNA, 16 bp, Homo sapiens
tctgtgtctaagattc

SEQ ID NO: 4940935 - DNA, 13 bp, Homo sapiens
tctgtgtgaaaat

SEQ ID NO: 4940936 - DNA, 15 bp, Homo sapiens
tctgtgtgaatgtgg

SEQ ID NO: 4940937 - DNA, 22 bp, Homo sapiens
tctgtgtgaatgtgggcactgg

SEQ ID NO: 4940938 - DNA, 18 bp, Homo sapiens
tctgtgtgatgaactttc

SEQ ID NO: 4940939 - DNA, 19 bp, Homo sapiens
tctgtgtgcaccttaccaa

SEQ ID NO: 4940940 - DNA, 22 bp, Homo sapiens
tctgtgtgcaccttaccaactt

SEQ ID NO: 4940941 - DNA, 22 bp, Homo sapiens
tctgtgtttaatttcttcaaaa

SEQ ID NO: 4940942 - DNA, 15 bp, Homo sapiens
tctgttaaaatctat

SEQ ID NO: 4940943 - DNA, 16 bp, Homo sapiens
tctgttatgtactgta

SEQ ID NO: 4940944 - DNA, 17 bp, Homo sapiens
tctgttatgtactgtac

SEQ ID NO: 4940945 - DNA, 14 bp, Homo sapiens
tctgttctacccgt

SEQ ID NO: 4940946 - DNA, 16 bp, Homo sapiens
tctgttgcaattagga

SEQ ID NO: 4940947 - DNA, 22 bp, Homo sapiens
tctgttgcaattaggattttga

SEQ ID NO: 4940948 - DNA, 22 bp, Homo sapiens
tctgttggaagcttgttttcca

SEQ ID NO: 4940949 - DNA, 17 bp, Homo sapiens
tctgttggccagtgtga

SEQ ID NO: 4940950 - DNA, 12 bp, Homo sapiens
tctgttgtaact

SEQ ID NO: 4940951 - DNA, 14 bp, Homo sapiens
tctgttgtaactta

SEQ ID NO: 4940952 - DNA, 21 bp, Homo sapiens
tctgttgtaacttatgtagat

SEQ ID NO: 4940953 - DNA, 19 bp, Homo sapiens
tctgtttaaagcatataga

SEQ ID NO: 4940954 - DNA, 14 bp, Homo sapiens
tctgtttaaagtgg

SEQ ID NO: 4940955 - DNA, 13 bp, Homo sapiens
tctgtttaagaaa

SEQ ID NO: 4940956 - DNA, 20 bp, Homo sapiens
tctgtttatggccacattta

SEQ ID NO: 4940957 - DNA, 13 bp, Homo sapiens
tctgtttgattct

SEQ ID NO: 4940958 - DNA, 13 bp, Homo sapiens
tctgtttgttatt

SEQ ID NO: 4940959 - DNA, 21 bp, Homo sapiens
tctgtttgtttcaagaacctg

SEQ ID NO: 4940960 - DNA, 17 bp, Homo sapiens
tctgttttgtatcttaa

SEQ ID NO: 4940961 - DNA, 21 bp, Homo sapiens
tgaatgtgggcactggcccag

SEQ ID NO: 4940962 - DNA, 17 bp, Homo sapiens
tgaatgttaagaattga

SEQ ID NO: 4940963 - DNA, 23 bp, Homo sapiens
tgaatgttatttgttattttcag

SEQ ID NO: 4940964 - DNA, 22 bp, Homo sapiens
tgaatgtttccaacctggagta

SEQ ID NO: 4940965 - DNA, 22 bp, Homo sapiens
tgaattaaaacttcttaaatat

SEQ ID NO: 4940966 - DNA, 15 bp, Homo sapiens
tgaatttaaatataa

SEQ ID NO: 4940967 - DNA, 20 bp, Homo sapiens
tgaatttaaatataattctg

SEQ ID NO: 4940968 - DNA, 19 bp, Homo sapiens
tgaatttagtgagatttac

SEQ ID NO: 4940969 - DNA, 17 bp, Homo sapiens
tgaatttataaagtacc

SEQ ID NO: 4940970 - DNA, 21 bp, Homo sapiens
tgaatttatacctacctgtgt

SEQ ID NO: 4940971 - DNA, 20 bp, Homo sapiens
tgaatttcttcactgttgaa

SEQ ID NO: 4940972 - DNA, 16 bp, Homo sapiens
tgacaaaacctaactt

SEQ ID NO: 4940973 - DNA, 23 bp, Homo sapiens
tgacaaagatggctcagaggggg

SEQ ID NO: 4940974 - DNA, 14 bp, Homo sapiens
tgacaaagttactg

SEQ ID NO: 4940975 - DNA, 12 bp, Homo sapiens
tgacaacacagc

SEQ ID NO: 4940976 - DNA, 21 bp, Homo sapiens
tgacaactgtctaactttaga

SEQ ID NO: 4940977 - DNA, 14 bp, Homo sapiens
tgacaactgtgact

SEQ ID NO: 4940978 - DNA, 22 bp, Homo sapiens
tgacaacttcccagtgaattct

SEQ ID NO: 4940979 - DNA, 23 bp, Homo sapiens
tgacaaggattgctactgtccta

SEQ ID NO: 4940980 - DNA, 22 bp, Homo sapiens
tgacaataatattgttgtataa

SEQ ID NO: 4940981 - DNA, 17 bp, Homo sapiens
tgacacaagtggacctt

SEQ ID NO: 4940982 - DNA, 16 bp, Homo sapiens
tgacacacagctctgt

SEQ ID NO: 4940983 - DNA, 19 bp, Homo sapiens
tgacacacagctctgtcct

SEQ ID NO: 4940984 - DNA, 18 bp, Homo sapiens
tgacacagaaaatgttga

SEQ ID NO: 4940985 - DNA, 23 bp, Homo sapiens
tgacacagaaaatgttgagaatc

SEQ ID NO: 4940986 - DNA, 22 bp, Homo sapiens
tgacacatatgcaccttgtgtc

SEQ ID NO: 4940987 - DNA, 22 bp, Homo sapiens
tgacacatccgccttttgtata

SEQ ID NO: 4940988 - DNA, 21 bp, Homo sapiens
tgacaccggggtggtgggaac

SEQ ID NO: 4940989 - DNA, 19 bp, Homo sapiens
tgacacgcctaaggtcaca

SEQ ID NO: 4940990 - DNA, 23 bp, Homo sapiens
tgacactgaccttggagagacac

SEQ ID NO: 4940991 - DNA, 17 bp, Homo sapiens
tgacagacacaggcccg

SEQ ID NO: 4940992 - DNA, 18 bp, Homo sapiens
tgacagaccacatcttta

SEQ ID NO: 4940993 - DNA, 13 bp, Homo sapiens
tgacagaggcagc

SEQ ID NO: 4940994 - DNA, 17 bp, Homo sapiens
tgacagagtgagactct

SEQ ID NO: 4940995 - DNA, 20 bp, Homo sapiens
tgacagcagtcggttggagc

SEQ ID NO: 4940996 - DNA, 17 bp, Homo sapiens
tgacaggcaatgctggc

SEQ ID NO: 4940997 - DNA, 18 bp, Homo sapiens
tgacaggcctgaagatat

SEQ ID NO: 4940998 - DNA, 11 bp, Homo sapiens
tgacagggcca

SEQ ID NO: 4940999 - DNA, 21 bp, Homo sapiens
tgacagggccagtggggcctg

SEQ ID NO: 4941000 - DNA, 11 bp, Homo sapiens
tgacagtcatc

SEQ ID NO: 4941001 - DNA, 14 bp, Homo sapiens
tgacagtcatcatc

SEQ ID NO: 4941002 - DNA, 17 bp, Homo sapiens
tgacagtcatcatcagg

SEQ ID NO: 4941003 - DNA, 20 bp, Homo sapiens
tgacagtcatcatcagggcc

SEQ ID NO: 4941004 - DNA, 21 bp, Homo sapiens
tgacagtcatcatcagggcct

SEQ ID NO: 4941005 - DNA, 22 bp, Homo sapiens
tgacagtcatcatcagggcctg

SEQ ID NO: 4941006 - DNA, 23 bp, Homo sapiens
tgacagtcttgtgcttttcctat

SEQ ID NO: 4941007 - DNA, 13 bp, Homo sapiens
tgacagttatttt

SEQ ID NO: 4941008 - DNA, 16 bp, Homo sapiens
tgacataatatattct

SEQ ID NO: 4941009 - DNA, 14 bp, Homo sapiens
tgacatctggaatc

SEQ ID NO: 4941010 - DNA, 17 bp, Homo sapiens
tgacatctttttaaagc

SEQ ID NO: 4941011 - DNA, 19 bp, Homo sapiens
tgacatctttttaaagctt

SEQ ID NO: 4941012 - DNA, 20 bp, Homo sapiens
tgacatctttttaaagctta

SEQ ID NO: 4941013 - DNA, 17 bp, Homo sapiens
tgacatgcactgaccct

SEQ ID NO: 4941014 - DNA, 15 bp, Homo sapiens
tgacatgtgaaacct

SEQ ID NO: 4941015 - DNA, 16 bp, Homo sapiens
tgacatgtgaaacctt

SEQ ID NO: 4941016 - DNA, 19 bp, Homo sapiens
tgacatgtgaaaccttttt

SEQ ID NO: 4941017 - DNA, 21 bp, Homo sapiens
tgacatgtgaaacctttttta

SEQ ID NO: 4941018 - DNA, 19 bp, Homo sapiens
tgacatgttatatattttt

SEQ ID NO: 4941019 - DNA, 19 bp, Homo sapiens
tgacattgcgtttgacctt

SEQ ID NO: 4941020 - DNA, 19 bp, Homo sapiens
tgacattgtatgtatctat

SEQ ID NO: 4941021 - DNA, 20 bp, Homo sapiens
tgacattgttggccaaagcc

SEQ ID NO: 4941022 - DNA, 14 bp, Homo sapiens
tgacatttgtagtt

SEQ ID NO: 4941023 - DNA, 23 bp, Homo sapiens
tgaccaccaccccaacaaaccat

SEQ ID NO: 4941024 - DNA, 23 bp, Homo sapiens
tgaccatccactctaccctccca

SEQ ID NO: 4941025 - DNA, 12 bp, Homo sapiens
tgacccactgct

SEQ ID NO: 4941026 - DNA, 13 bp, Homo sapiens
tgacccactgctt

SEQ ID NO: 4941027 - DNA, 21 bp, Homo sapiens
tgaccccaaacaccttccagc

SEQ ID NO: 4941028 - DNA, 22 bp, Homo sapiens
tgaccccaaacaccttccagct

SEQ ID NO: 4941029 - DNA, 20 bp, Homo sapiens
tgacccctcctcactggcca

SEQ ID NO: 4941030 - DNA, 17 bp, Homo sapiens
tgaccctactcccttgc

SEQ ID NO: 4941031 - DNA, 18 bp, Homo sapiens
tgaccctagctctttcct

SEQ ID NO: 4941032 - DNA, 15 bp, Homo sapiens
tgacctcacagtgac

SEQ ID NO: 4941033 - DNA, 18 bp, Homo sapiens
tgacctcacagtgaccct

SEQ ID NO: 4941034 - DNA, 21 bp, Homo sapiens
tgacctctcataaatttactt

SEQ ID NO: 4941035 - DNA, 13 bp, Homo sapiens
tgacctcttgctg

SEQ ID NO: 4941036 - DNA, 16 bp, Homo sapiens
tgacctcttgctgtct

SEQ ID NO: 4941037 - DNA, 15 bp, Homo sapiens
tgacctgcctctcac

SEQ ID NO: 4941038 - DNA, 15 bp, Homo sapiens
tgacctgctccgctg

SEQ ID NO: 4941039 - DNA, 17 bp, Homo sapiens
tgacctgctccgctgct

SEQ ID NO: 4941040 - DNA, 23 bp, Homo sapiens
tgaccttttatgtagtaattgac

SEQ ID NO: 4941041 - DNA, 18 bp, Homo sapiens
tgacgaaactggccccgg

SEQ ID NO: 4941042 - DNA, 16 bp, Homo sapiens
tgacgattccttctct

SEQ ID NO: 4941043 - DNA, 14 bp, Homo sapiens
tgacgctgatacat

SEQ ID NO: 4941044 - DNA, 23 bp, Homo sapiens
tgacgtggagcggggtatgaaga

SEQ ID NO: 4941045 - DNA, 11 bp, Homo sapiens
tgactaattag

SEQ ID NO: 4941046 - DNA, 21 bp, Homo sapiens
tgactaattagggtacattta

SEQ ID NO: 4941047 - DNA, 19 bp, Homo sapiens
tgactacttagcatcctaa

SEQ ID NO: 4941048 - DNA, 15 bp, Homo sapiens
tgactactttgcctt

SEQ ID NO: 4941049 - DNA, 21 bp, Homo sapiens
tgactagaagggccagtcctg

SEQ ID NO: 4941050 - DNA, 23 bp, Homo sapiens
tgactagatgatggatgccaata

SEQ ID NO: 4941051 - DNA, 20 bp, Homo sapiens
tgactagggattcaggctgc

SEQ ID NO: 4941052 - DNA, 13 bp, Homo sapiens
tgactagtacaaa

SEQ ID NO: 4941053 - DNA, 16 bp, Homo sapiens
tgactagtacaaatta

SEQ ID NO: 4941054 - DNA, 16 bp, Homo sapiens
tgactatatagagatg

SEQ ID NO: 4941055 - DNA, 18 bp, Homo sapiens
tgactatatagagatgtt

SEQ ID NO: 4941056 - DNA, 14 bp, Homo sapiens
tgactatcataaaa

SEQ ID NO: 4941057 - DNA, 17 bp, Homo sapiens
tgactcctacctgccct

SEQ ID NO: 4941058 - DNA, 14 bp, Homo sapiens
tgactctgccccct

SEQ ID NO: 4941059 - DNA, 22 bp, Homo sapiens
tgactctttttagggccaggca

SEQ ID NO: 4941060 - DNA, 23 bp, Homo sapiens
tgactctttttagggccaggcag

SEQ ID NO: 4941061 - DNA, 21 bp, Homo sapiens
tgactgctccccagccctggc

SEQ ID NO: 4941062 - DNA, 17 bp, Homo sapiens
tgactggggtgggaggt

SEQ ID NO: 4941063 - DNA, 20 bp, Homo sapiens
tgactggtttacaggccctg

SEQ ID NO: 4941064 - DNA, 23 bp, Homo sapiens
tgactggtttacaggccctgctc

SEQ ID NO: 4941065 - DNA, 16 bp, Homo sapiens
tgactgtactcctccc

SEQ ID NO: 4941066 - DNA, 18 bp, Homo sapiens
tgactgtactcctcccag

SEQ ID NO: 4941067 - DNA, 22 bp, Homo sapiens
tgactgtactcctcccaggcgc

SEQ ID NO: 4941068 - DNA, 18 bp, Homo sapiens
tgactgtatctgtgtaga

SEQ ID NO: 4941069 - DNA, 17 bp, Homo sapiens
tgatgtaatctctctgc

SEQ ID NO: 4941070 - DNA, 14 bp, Homo sapiens
tgatgtattctagc

SEQ ID NO: 4941071 - DNA, 14 bp, Homo sapiens
tgatgtcatgtgtt

SEQ ID NO: 4941072 - DNA, 15 bp, Homo sapiens
tgatgtcatgtgttc

SEQ ID NO: 4941073 - DNA, 17 bp, Homo sapiens
tgatgtgacaataatat

SEQ ID NO: 4941074 - DNA, 18 bp, Homo sapiens
tgatgttctaaggctctg

SEQ ID NO: 4941075 - DNA, 13 bp, Homo sapiens
tgatgttggaaga

SEQ ID NO: 4941076 - DNA, 13 bp, Homo sapiens
tgatgtttgctct

SEQ ID NO: 4941077 - DNA, 18 bp, Homo sapiens
tgattaaataagattcta

SEQ ID NO: 4941078 - DNA, 19 bp, Homo sapiens
tgattaaataagattctaa

SEQ ID NO: 4941079 - DNA, 17 bp, Homo sapiens
tgattaacaaatatgct

SEQ ID NO: 4941080 - DNA, 13 bp, Homo sapiens
tgattaagatttt

SEQ ID NO: 4941081 - DNA, 14 bp, Homo sapiens
tgattagctttgtg

SEQ ID NO: 4941082 - DNA, 22 bp, Homo sapiens
tgattatgtcttttatatttgt

SEQ ID NO: 4941083 - DNA, 19 bp, Homo sapiens
tgattattttcttcatcca

SEQ ID NO: 4941084 - DNA, 13 bp, Homo sapiens
tgattcaaatggg

SEQ ID NO: 4941085 - DNA, 18 bp, Homo sapiens
tgattcccaagctctgct

SEQ ID NO: 4941086 - DNA, 15 bp, Homo sapiens
tgattctaatgtctt

SEQ ID NO: 4941087 - DNA, 18 bp, Homo sapiens
tgattctttttaaagtgt

SEQ ID NO: 4941088 - DNA, 15 bp, Homo sapiens
tgattgacctgctcc

SEQ ID NO: 4941089 - DNA, 16 bp, Homo sapiens
tgattgacctgctccg

SEQ ID NO: 4941090 - DNA, 14 bp, Homo sapiens
tgattgcagcttta

SEQ ID NO: 4941091 - DNA, 19 bp, Homo sapiens
tgattggtgcaacccttac

SEQ ID NO: 4941092 - DNA, 14 bp, Homo sapiens
tgattgtaaaatag

SEQ ID NO: 4941093 - DNA, 17 bp, Homo sapiens
tgattgtaaaatagctt

SEQ ID NO: 4941094 - DNA, 18 bp, Homo sapiens
tgattgtggaatggagat

SEQ ID NO: 4941095 - DNA, 19 bp, Homo sapiens
tgattgtttctcaaatctt

SEQ ID NO: 4941096 - DNA, 20 bp, Homo sapiens
tgatttaataaaataattct

SEQ ID NO: 4941097 - DNA, 15 bp, Homo sapiens
tgatttaatatggat

SEQ ID NO: 4941098 - DNA, 21 bp, Homo sapiens
tgatttagaactgtatgtcag

SEQ ID NO: 4941099 - DNA, 20 bp, Homo sapiens
tgatttataaatgccattta

SEQ ID NO: 4941100 - DNA, 14 bp, Homo sapiens
tgatttcactagaa

SEQ ID NO: 4941101 - DNA, 16 bp, Homo sapiens
tgatttccaagtaata

SEQ ID NO: 4941102 - DNA, 13 bp, Homo sapiens
tgatttcccctct

SEQ ID NO: 4941103 - DNA, 13 bp, Homo sapiens
tgatttctattca

SEQ ID NO: 4941104 - DNA, 18 bp, Homo sapiens
tgatttgcattgaacaca

SEQ ID NO: 4941105 - DNA, 12 bp, Homo sapiens
tgattttaatgg

SEQ ID NO: 4941106 - DNA, 20 bp, Homo sapiens
tgattttaggagctaaggct

SEQ ID NO: 4941107 - DNA, 20 bp, Homo sapiens
tgattttcaaagctttttcc

SEQ ID NO: 4941108 - DNA, 14 bp, Homo sapiens
tgatttttgttgat

SEQ ID NO: 4941109 - DNA, 13 bp, Homo sapiens
tgattttttaaaa

SEQ ID NO: 4941110 - DNA, 23 bp, Homo sapiens
tgcaaaaggttcactaaagcagt

SEQ ID NO: 4941111 - DNA, 22 bp, Homo sapiens
tgcaaaatttgatgccaggaca

SEQ ID NO: 4941112 - DNA, 16 bp, Homo sapiens
tgcaaagaaaatcaga

SEQ ID NO: 4941113 - DNA, 15 bp, Homo sapiens
tgcaaagtacaatgt

SEQ ID NO: 4941114 - DNA, 18 bp, Homo sapiens
tgcaaagtacaatgtgtt

SEQ ID NO: 4941115 - DNA, 19 bp, Homo sapiens
tgcaaagtacaatgtgttt

SEQ ID NO: 4941116 - DNA, 23 bp, Homo sapiens
tgcaaagttccctacttcctgtg

SEQ ID NO: 4941117 - DNA, 13 bp, Homo sapiens
tgcaaagttctgt

SEQ ID NO: 4941118 - DNA, 21 bp, Homo sapiens
tgcaaatgctatgagatgcat

SEQ ID NO: 4941119 - DNA, 13 bp, Homo sapiens
tgcaacagacaag

SEQ ID NO: 4941120 - DNA, 16 bp, Homo sapiens
tgcaacaggctgggct

SEQ ID NO: 4941121 - DNA, 14 bp, Homo sapiens
tgcaacaggcttgt

SEQ ID NO: 4941122 - DNA, 20 bp, Homo sapiens
tgcaacccaaggactgaggg

SEQ ID NO: 4941123 - DNA, 15 bp, Homo sapiens
tgcaacccttacccc

SEQ ID NO: 4941124 - DNA, 18 bp, Homo sapiens
tgcaacctccgcctcttg

SEQ ID NO: 4941125 - DNA, 21 bp, Homo sapiens
tgcaacctccgcctcttgggt

SEQ ID NO: 4941126 - DNA, 14 bp, Homo sapiens
tgcaaccttcacct

SEQ ID NO: 4941127 - DNA, 19 bp, Homo sapiens
tgcaagcctgtctgagact

SEQ ID NO: 4941128 - DNA, 16 bp, Homo sapiens
tgcaaggaaggaaaga

SEQ ID NO: 4941129 - DNA, 13 bp, Homo sapiens
tgcaaggaccagg

SEQ ID NO: 4941130 - DNA, 16 bp, Homo sapiens
tgcaaggcccacagga

SEQ ID NO: 4941131 - DNA, 17 bp, Homo sapiens
tgcaaggcccacaggag

SEQ ID NO: 4941132 - DNA, 24 bp, Homo sapiens
tgcaataaaaatgatactgatggt

SEQ ID NO: 4941133 - DNA, 19 bp, Homo sapiens
tgcaataacttctgacctt

SEQ ID NO: 4941134 - DNA, 15 bp, Homo sapiens
tgcaatcatatgtga

SEQ ID NO: 4941135 - DNA, 13 bp, Homo sapiens
tgcaatggatttt

SEQ ID NO: 4941136 - DNA, 16 bp, Homo sapiens
tgcaatggcagccttg

SEQ ID NO: 4941137 - DNA, 19 bp, Homo sapiens
tgcaatgtatcccttctca

SEQ ID NO: 4941138 - DNA, 18 bp, Homo sapiens
tgcaattcccctctgctg

SEQ ID NO: 4941139 - DNA, 13 bp, Homo sapiens
tgcaatttcaagg

SEQ ID NO: 4941140 - DNA, 18 bp, Homo sapiens
tgcaatttcaaggttcta

SEQ ID NO: 4941141 - DNA, 19 bp, Homo sapiens
tgcaatttcaaggttctaa

SEQ ID NO: 4941142 - DNA, 23 bp, Homo sapiens
tgcaattttctaagcaatttctt

SEQ ID NO: 4941143 - DNA, 15 bp, Homo sapiens
tgcacaaagcccttc

SEQ ID NO: 4941144 - DNA, 21 bp, Homo sapiens
tgcacaaatatttattttctt

SEQ ID NO: 4941145 - DNA, 18 bp, Homo sapiens
tgcacacacacacacatg

SEQ ID NO: 4941146 - DNA, 17 bp, Homo sapiens
tgcacacaccagagccc

SEQ ID NO: 4941147 - DNA, 18 bp, Homo sapiens
tgcacacaccagagccca

SEQ ID NO: 4941148 - DNA, 22 bp, Homo sapiens
tgcacacaccagagcccacctt

SEQ ID NO: 4941149 - DNA, 20 bp, Homo sapiens
tgcacacagaaatatatata

SEQ ID NO: 4941150 - DNA, 22 bp, Homo sapiens
tgcacacagaaatatatataca

SEQ ID NO: 4941151 - DNA, 15 bp, Homo sapiens
tgcacagagaagctg

SEQ ID NO: 4941152 - DNA, 19 bp, Homo sapiens
tgcacagatatactttgtg

SEQ ID NO: 4941153 - DNA, 14 bp, Homo sapiens
tgcacagctgtcca

SEQ ID NO: 4941154 - DNA, 17 bp, Homo sapiens
tgcacagtgcatctcag

SEQ ID NO: 4941155 - DNA, 14 bp, Homo sapiens
tgcacatatggact

SEQ ID NO: 4941156 - DNA, 18 bp, Homo sapiens
tgcacatccattcccaag

SEQ ID NO: 4941157 - DNA, 15 bp, Homo sapiens
tgcacatgtcttgta

SEQ ID NO: 4941158 - DNA, 19 bp, Homo sapiens
tgcacatgtcttgtacatg

SEQ ID NO: 4941159 - DNA, 15 bp, Homo sapiens
tgcacccatgggctc

SEQ ID NO: 4941160 - DNA, 18 bp, Homo sapiens
tgcacccatgggctctga

SEQ ID NO: 4941161 - DNA, 21 bp, Homo sapiens
tgcacccatgggctctgacag

SEQ ID NO: 4941162 - DNA, 22 bp, Homo sapiens
tgcacccatgggctctgacaga

SEQ ID NO: 4941163 - DNA, 15 bp, Homo sapiens
tgcaccctggggcct

SEQ ID NO: 4941164 - DNA, 14 bp, Homo sapiens
tgcacccttctttt

SEQ ID NO: 4941165 - DNA, 23 bp, Homo sapiens
tgcacccttcttttctcatgtgt

SEQ ID NO: 4941166 - DNA, 20 bp, Homo sapiens
tgcacctagctgtgcaagac

SEQ ID NO: 4941167 - DNA, 13 bp, Homo sapiens
tgcaccttaccaa

SEQ ID NO: 4941168 - DNA, 16 bp, Homo sapiens
tgcaccttgtgtctgt

SEQ ID NO: 4941169 - DNA, 21 bp, Homo sapiens
tgcacgcagattagcaggcca

SEQ ID NO: 4941170 - DNA, 16 bp, Homo sapiens
tgcacgtggagagctg

SEQ ID NO: 4941171 - DNA, 17 bp, Homo sapiens
tgcactaaagccagcct

SEQ ID NO: 4941172 - DNA, 20 bp, Homo sapiens
tgcactaaagccagcctgac

SEQ ID NO: 4941173 - DNA, 18 bp, Homo sapiens
tgcactaaagtatgtaaa

SEQ ID NO: 4941174 - DNA, 15 bp, Homo sapiens
tgcactatgaggaat

SEQ ID NO: 4941175 - DNA, 18 bp, Homo sapiens
tgcactgacattgttggc

SEQ ID NO: 4941176 - DNA, 15 bp, Homo sapiens
tgcactgacccttcc

SEQ ID NO: 4941177 - DNA, 20 bp, Homo sapiens
tgcactggggagcccgtctc

SEQ ID NO: 4941178 - DNA, 21 bp, Homo sapiens
tgcacttgcagactctacaga

SEQ ID NO: 4941179 - DNA, 15 bp, Homo sapiens
tgctcattaattttg

SEQ ID NO: 4941180 - DNA, 12 bp, Homo sapiens
tgctcatttaag

SEQ ID NO: 4941181 - DNA, 18 bp, Homo sapiens
tgctcatttaagtttcaa

SEQ ID NO: 4941182 - DNA, 17 bp, Homo sapiens
tgctccaagattctaga

SEQ ID NO: 4941183 - DNA, 18 bp, Homo sapiens
tgctccaagattctagat

SEQ ID NO: 4941184 - DNA, 19 bp, Homo sapiens
tgctccaagattctagatg

SEQ ID NO: 4941185 - DNA, 19 bp, Homo sapiens
tgctccacccttggcctgt

SEQ ID NO: 4941186 - DNA, 19 bp, Homo sapiens
tgctccagaatttggaaat

SEQ ID NO: 4941187 - DNA, 22 bp, Homo sapiens
tgctccagaatttggaaatcct

SEQ ID NO: 4941188 - DNA, 16 bp, Homo sapiens
tgctccagggagattt

SEQ ID NO: 4941189 - DNA, 22 bp, Homo sapiens
tgctccccagccctggctctgc

SEQ ID NO: 4941190 - DNA, 18 bp, Homo sapiens
tgctccctaagccagcct

SEQ ID NO: 4941191 - DNA, 19 bp, Homo sapiens
tgctccctaagccagcctg

SEQ ID NO: 4941192 - DNA, 13 bp, Homo sapiens
tgctccctgaagc

SEQ ID NO: 4941193 - DNA, 17 bp, Homo sapiens
tgctccctgaagccagc

SEQ ID NO: 4941194 - DNA, 20 bp, Homo sapiens
tgctccctgaagccagcctt

SEQ ID NO: 4941195 - DNA, 12 bp, Homo sapiens
tgctccctgtgt

SEQ ID NO: 4941196 - DNA, 23 bp, Homo sapiens
tgctccctgtgtccacctgtggg

SEQ ID NO: 4941197 - DNA, 20 bp, Homo sapiens
tgctccgctgctccttggct

SEQ ID NO: 4941198 - DNA, 23 bp, Homo sapiens
tgctccgctgctccttggcttac

SEQ ID NO: 4941199 - DNA, 19 bp, Homo sapiens
tgctcctcactgcccgcac

SEQ ID NO: 4941200 - DNA, 19 bp, Homo sapiens
tgctcctccttggtgcctg

SEQ ID NO: 4941201 - DNA, 13 bp, Homo sapiens
tgctcctgcagca

SEQ ID NO: 4941202 - DNA, 15 bp, Homo sapiens
tgctcctgcagcatg

SEQ ID NO: 4941203 - DNA, 17 bp, Homo sapiens
tgctctatctctcaaaa

SEQ ID NO: 4941204 - DNA, 23 bp, Homo sapiens
tgctctccgaccagacaccttga

SEQ ID NO: 4941205 - DNA, 12 bp, Homo sapiens
tgctctcctctt

SEQ ID NO: 4941206 - DNA, 20 bp, Homo sapiens
tgctctctcaaattgtcagc

SEQ ID NO: 4941207 - DNA, 23 bp, Homo sapiens
tgctctgagaagaggagccctca

SEQ ID NO: 4941208 - DNA, 22 bp, Homo sapiens
tgctctgatcatccactgtgcc

SEQ ID NO: 4941209 - DNA, 21 bp, Homo sapiens
tgctctgctgacagacacagg

SEQ ID NO: 4941210 - DNA, 15 bp, Homo sapiens
tgctctggacaggca

SEQ ID NO: 4941211 - DNA, 19 bp, Homo sapiens
tgctcttactacactgagg

SEQ ID NO: 4941212 - DNA, 15 bp, Homo sapiens
tgctcttagctgtct

SEQ ID NO: 4941213 - DNA, 18 bp, Homo sapiens
tgctcttagctgtctgct

SEQ ID NO: 4941214 - DNA, 13 bp, Homo sapiens
tgctcttctgtgg

SEQ ID NO: 4941215 - DNA, 23 bp, Homo sapiens
tgctcttctgtggaccactgcat

SEQ ID NO: 4941216 - DNA, 16 bp, Homo sapiens
tgctcttgtcccacgt

SEQ ID NO: 4941217 - DNA, 23 bp, Homo sapiens
tgctcttgtcccacgtgtcttcc

SEQ ID NO: 4941218 - DNA, 18 bp, Homo sapiens
tgctctttcatctctgct

SEQ ID NO: 4941219 - DNA, 17 bp, Homo sapiens
tgctcttttttactcat

SEQ ID NO: 4941220 - DNA, 18 bp, Homo sapiens
tgctcttttttactcatt

SEQ ID NO: 4941221 - DNA, 22 bp, Homo sapiens
tgctcttttttactcattgaaa

SEQ ID NO: 4941222 - DNA, 18 bp, Homo sapiens
tgctgaacaaaaaataaa

SEQ ID NO: 4941223 - DNA, 20 bp, Homo sapiens
tgctgacatggctctggact

SEQ ID NO: 4941224 - DNA, 18 bp, Homo sapiens
tgctgaccaattgtgctg

SEQ ID NO: 4941225 - DNA, 23 bp, Homo sapiens
tgctgactccacgatcctgccac

SEQ ID NO: 4941226 - DNA, 16 bp, Homo sapiens
tgctgactgtactcct

SEQ ID NO: 4941227 - DNA, 19 bp, Homo sapiens
tgctgactgtactcctccc

SEQ ID NO: 4941228 - DNA, 21 bp, Homo sapiens
tgctgactgtactcctcccag

SEQ ID NO: 4941229 - DNA, 12 bp, Homo sapiens
tgctgagcctct

SEQ ID NO: 4941230 - DNA, 18 bp, Homo sapiens
tgctgatttggtgaccaa

SEQ ID NO: 4941231 - DNA, 16 bp, Homo sapiens
tgctgcaaacttaatg

SEQ ID NO: 4941232 - DNA, 17 bp, Homo sapiens
tgctgcacttcctgttt

SEQ ID NO: 4941233 - DNA, 21 bp, Homo sapiens
tgctgcaggacttgagaagac

SEQ ID NO: 4941234 - DNA, 13 bp, Homo sapiens
tgctgcaggggct

SEQ ID NO: 4941235 - DNA, 17 bp, Homo sapiens
tgctgcaggggctctgg

SEQ ID NO: 4941236 - DNA, 19 bp, Homo sapiens
tgctgcaggggctctggag

SEQ ID NO: 4941237 - DNA, 23 bp, Homo sapiens
tgctgcatcttatagcactttga

SEQ ID NO: 4941238 - DNA, 19 bp, Homo sapiens
tgctgcatttgtgtcatct

SEQ ID NO: 4941239 - DNA, 22 bp, Homo sapiens
tgctgccacacttcaggctctt

SEQ ID NO: 4941240 - DNA, 20 bp, Homo sapiens
tgctgccatttgatttttct

SEQ ID NO: 4941241 - DNA, 21 bp, Homo sapiens
tgctgccatttgatttttcta

SEQ ID NO: 4941242 - DNA, 16 bp, Homo sapiens
tgctgccgcctcccag

SEQ ID NO: 4941243 - DNA, 17 bp, Homo sapiens
tgctgccgcctcccagc

SEQ ID NO: 4941244 - DNA, 19 bp, Homo sapiens
tgctgccgcctcccagcct

SEQ ID NO: 4941245 - DNA, 16 bp, Homo sapiens
tgctgcgcccttacct

SEQ ID NO: 4941246 - DNA, 14 bp, Homo sapiens
tgctgctagaactt

SEQ ID NO: 4941247 - DNA, 16 bp, Homo sapiens
tgctgctagaactttt

SEQ ID NO: 4941248 - DNA, 19 bp, Homo sapiens
tgctgctagaactttttta

SEQ ID NO: 4941249 - DNA, 16 bp, Homo sapiens
tgctgctgcctggcca

SEQ ID NO: 4941250 - DNA, 20 bp, Homo sapiens
tgctgcttccggtagggagg

SEQ ID NO: 4941251 - DNA, 21 bp, Homo sapiens
tgctggacggggactggggat

SEQ ID NO: 4941252 - DNA, 14 bp, Homo sapiens
tgctggactgtcat

SEQ ID NO: 4941253 - DNA, 19 bp, Homo sapiens
tgctggactgtcatagaaa

SEQ ID NO: 4941254 - DNA, 13 bp, Homo sapiens
tgctggagaagag

SEQ ID NO: 4941255 - DNA, 18 bp, Homo sapiens
tgctggagaagagaggag

SEQ ID NO: 4941256 - DNA, 23 bp, Homo sapiens
tgctggaggtgggagcaggagat

SEQ ID NO: 4941257 - DNA, 22 bp, Homo sapiens
tgctggccagcctggggcctgg

SEQ ID NO: 4941258 - DNA, 18 bp, Homo sapiens
tgctggctgttggctggg

SEQ ID NO: 4941259 - DNA, 18 bp, Homo sapiens
tgctggggcctcagacga

SEQ ID NO: 4941260 - DNA, 15 bp, Homo sapiens
tgctgggggaatgag

SEQ ID NO: 4941261 - DNA, 21 bp, Homo sapiens
tgctgggggaatgagcccaga

SEQ ID NO: 4941262 - DNA, 15 bp, Homo sapiens
tgctgtacatctatt

SEQ ID NO: 4941263 - DNA, 20 bp, Homo sapiens
tgctgtcaagttcctttggg

SEQ ID NO: 4941264 - DNA, 20 bp, Homo sapiens
tgctgtccccttggcaggtc

SEQ ID NO: 4941265 - DNA, 11 bp, Homo sapiens
tgctgtgttaa

SEQ ID NO: 4941266 - DNA, 16 bp, Homo sapiens
tgctgtgtttaatttg

SEQ ID NO: 4941267 - DNA, 14 bp, Homo sapiens
tgctgttgcttgaa

SEQ ID NO: 4941268 - DNA, 15 bp, Homo sapiens
tgctgttgcttgaat

SEQ ID NO: 4941269 - DNA, 13 bp, Homo sapiens
tgctgtttcacaa

SEQ ID NO: 4941270 - DNA, 16 bp, Homo sapiens
tgctgtttgtagtgaa

SEQ ID NO: 4941271 - DNA, 18 bp, Homo sapiens
tgctgttttgatttgtac

SEQ ID NO: 4941272 - DNA, 13 bp, Homo sapiens
tgcttaagttcca

SEQ ID NO: 4941273 - DNA, 14 bp, Homo sapiens
tgcttaagttccag

SEQ ID NO: 4941274 - DNA, 14 bp, Homo sapiens
tgcttaatttctaa

SEQ ID NO: 4941275 - DNA, 14 bp, Homo sapiens
tgcttacttatgcc

SEQ ID NO: 4941276 - DNA, 21 bp, Homo sapiens
tgcttattgcttagtaaaatt

SEQ ID NO: 4941277 - DNA, 16 bp, Homo sapiens
tgcttcaaggcttcca

SEQ ID NO: 4941278 - DNA, 13 bp, Homo sapiens
tgcttcacagtag

SEQ ID NO: 4941279 - DNA, 16 bp, Homo sapiens
tgcttcacagtagagc

SEQ ID NO: 4941280 - DNA, 14 bp, Homo sapiens
tgcttcagcctccc

SEQ ID NO: 4941281 - DNA, 18 bp, Homo sapiens
tgcttcagtggagaatta

SEQ ID NO: 4941282 - DNA, 17 bp, Homo sapiens
tgcttcccacctccctg

SEQ ID NO: 4941283 - DNA, 23 bp, Homo sapiens
tgcttcccacctccctgcccagg

SEQ ID NO: 4941284 - DNA, 14 bp, Homo sapiens
tgcttctcatcccc

SEQ ID NO: 4941285 - DNA, 17 bp, Homo sapiens
tgcttctcatcttgtga

SEQ ID NO: 4941286 - DNA, 13 bp, Homo sapiens
tgcttctccccag

SEQ ID NO: 4941287 - DNA, 14 bp, Homo sapiens
tgcttctccccaga

SEQ ID NO: 4941288 - DNA, 21 bp, Homo sapiens
tggcccctgcccggctgcgga

SEQ ID NO: 4941289 - DNA, 14 bp, Homo sapiens
tggcccggatgctg

SEQ ID NO: 4941290 - DNA, 17 bp, Homo sapiens
tggcccggatgctgctt

SEQ ID NO: 4941291 - DNA, 15 bp, Homo sapiens
tggccctgccctgag

SEQ ID NO: 4941292 - DNA, 19 bp, Homo sapiens
tggccctggctctgctgtc

SEQ ID NO: 4941293 - DNA, 12 bp, Homo sapiens
tggccctggggt

SEQ ID NO: 4941294 - DNA, 19 bp, Homo sapiens
tggccctggggtcccacga

SEQ ID NO: 4941295 - DNA, 15 bp, Homo sapiens
tggccctgtccctcc

SEQ ID NO: 4941296 - DNA, 20 bp, Homo sapiens
tggccctgtccctcccacct

SEQ ID NO: 4941297 - DNA, 23 bp, Homo sapiens
tggccctgtccctcccacctctg

SEQ ID NO: 4941298 - DNA, 18 bp, Homo sapiens
tggccctttccttccaga

SEQ ID NO: 4941299 - DNA, 16 bp, Homo sapiens
tggccgaggactttga

SEQ ID NO: 4941300 - DNA, 18 bp, Homo sapiens
tggcctaaaactggcctg

SEQ ID NO: 4941301 - DNA, 15 bp, Homo sapiens
tggcctaaaatcttg

SEQ ID NO: 4941302 - DNA, 14 bp, Homo sapiens
tggcctagcccacc

SEQ ID NO: 4941303 - DNA, 23 bp, Homo sapiens
tggcctagcccaccctgctgcct

SEQ ID NO: 4941304 - DNA, 13 bp, Homo sapiens
tggcctatgcaca

SEQ ID NO: 4941305 - DNA, 18 bp, Homo sapiens
tggcctcagctgaatgcc

SEQ ID NO: 4941306 - DNA, 16 bp, Homo sapiens
tggcctcagctgcctc

SEQ ID NO: 4941307 - DNA, 17 bp, Homo sapiens
tggcctcagctgcctca

SEQ ID NO: 4941308 - DNA, 19 bp, Homo sapiens
tggcctcagctgcctcact

SEQ ID NO: 4941309 - DNA, 19 bp, Homo sapiens
tggcctcgggacacctgcc

SEQ ID NO: 4941310 - DNA, 17 bp, Homo sapiens
tggcctctaccacaagg

SEQ ID NO: 4941311 - DNA, 17 bp, Homo sapiens
tggcctgacttggggga

SEQ ID NO: 4941312 - DNA, 14 bp, Homo sapiens
tggcctgcactaat

SEQ ID NO: 4941313 - DNA, 10 bp, Homo sapiens
tggcctggcc

SEQ ID NO: 4941314 - DNA, 12 bp, Homo sapiens
tggcctggccag

SEQ ID NO: 4941315 - DNA, 15 bp, Homo sapiens
tggcctggccaggag

SEQ ID NO: 4941316 - DNA, 16 bp, Homo sapiens
tggcctggccaggagc

SEQ ID NO: 4941317 - DNA, 13 bp, Homo sapiens
tggcctggccctg

SEQ ID NO: 4941318 - DNA, 15 bp, Homo sapiens
tggcctggccctgcc

SEQ ID NO: 4941319 - DNA, 16 bp, Homo sapiens
tggcctggccctgccc

SEQ ID NO: 4941320 - DNA, 18 bp, Homo sapiens
tggcctggccctgccctg

SEQ ID NO: 4941321 - DNA, 18 bp, Homo sapiens
tggcctgtttcaacacag

SEQ ID NO: 4941322 - DNA, 14 bp, Homo sapiens
tggcggccccagca

SEQ ID NO: 4941323 - DNA, 12 bp, Homo sapiens
tggctaaagata

SEQ ID NO: 4941324 - DNA, 18 bp, Homo sapiens
tggctaaagataattgct

SEQ ID NO: 4941325 - DNA, 22 bp, Homo sapiens
tggctactttggtttctgtctg

SEQ ID NO: 4941326 - DNA, 21 bp, Homo sapiens
tggctagaggccagccccacc

SEQ ID NO: 4941327 - DNA, 18 bp, Homo sapiens
tggctcaagtcctctttt

SEQ ID NO: 4941328 - DNA, 24 bp, Homo sapiens
tggctcacagtacagcatgtgcct

SEQ ID NO: 4941329 - DNA, 18 bp, Homo sapiens
tggctcagacatgttttc

SEQ ID NO: 4941330 - DNA, 15 bp, Homo sapiens
tggctccagaaatgt

SEQ ID NO: 4941331 - DNA, 14 bp, Homo sapiens
tggctcccacaggc

SEQ ID NO: 4941332 - DNA, 14 bp, Homo sapiens
tggctcccatgacc

SEQ ID NO: 4941333 - DNA, 19 bp, Homo sapiens
tggctccgaacaccctcga

SEQ ID NO: 4941334 - DNA, 20 bp, Homo sapiens
tggctcctgaggggcatctg

SEQ ID NO: 4941335 - DNA, 23 bp, Homo sapiens
tggctcctgaggggcatctgccc

SEQ ID NO: 4941336 - DNA, 15 bp, Homo sapiens
tggctcctttacaaa

SEQ ID NO: 4941337 - DNA, 18 bp, Homo sapiens
tggctcctttacaaaaga

SEQ ID NO: 4941338 - DNA, 14 bp, Homo sapiens
tggctctggagaca

SEQ ID NO: 4941339 - DNA, 23 bp, Homo sapiens
tggctcttgatacccccctctgt

SEQ ID NO: 4941340 - DNA, 16 bp, Homo sapiens
tggctctttgggctgg

SEQ ID NO: 4941341 - DNA, 20 bp, Homo sapiens
tggctgactaaatttgggga

SEQ ID NO: 4941342 - DNA, 23 bp, Homo sapiens
tggctgaggaggcctccatctca

SEQ ID NO: 4941343 - DNA, 23 bp, Homo sapiens
tggctgcaaagggtatcaggtgc

SEQ ID NO: 4941344 - DNA, 19 bp, Homo sapiens
tggctgcagtccgtgtgga

SEQ ID NO: 4941345 - DNA, 15 bp, Homo sapiens
tggctgggggcctca

SEQ ID NO: 4941346 - DNA, 16 bp, Homo sapiens
tggctgggggcctcag

SEQ ID NO: 4941347 - DNA, 17 bp, Homo sapiens
tggctgggggcctcagt

SEQ ID NO: 4941348 - DNA, 21 bp, Homo sapiens
tggctgggggcctcagtgcca

SEQ ID NO: 4941349 - DNA, 22 bp, Homo sapiens
tggctggtaacagttcatgttt

SEQ ID NO: 4941350 - DNA, 16 bp, Homo sapiens
tggctgtaaggctcta

SEQ ID NO: 4941351 - DNA, 21 bp, Homo sapiens
tggctgtaaggctctagatca

SEQ ID NO: 4941352 - DNA, 17 bp, Homo sapiens
tggctgtagatcccaag

SEQ ID NO: 4941353 - DNA, 14 bp, Homo sapiens
tggctgtgcctctg

SEQ ID NO: 4941354 - DNA, 17 bp, Homo sapiens
tggctgtgcctctgcct

SEQ ID NO: 4941355 - DNA, 19 bp, Homo sapiens
tggctgtgcctctgcctgt

SEQ ID NO: 4941356 - DNA, 22 bp, Homo sapiens
tggctgtgcctctgcctgtctc

SEQ ID NO: 4941357 - DNA, 17 bp, Homo sapiens
tggcttaaaacaacact

SEQ ID NO: 4941358 - DNA, 19 bp, Homo sapiens
tggcttacctgacctcttg

SEQ ID NO: 4941359 - DNA, 21 bp, Homo sapiens
tggcttacctgacctcttgct

SEQ ID NO: 4941360 - DNA, 19 bp, Homo sapiens
tggcttattttaatgtgat

SEQ ID NO: 4941361 - DNA, 16 bp, Homo sapiens
tggcttcatctgtcaa

SEQ ID NO: 4941362 - DNA, 15 bp, Homo sapiens
tggcttcccatgtct

SEQ ID NO: 4941363 - DNA, 17 bp, Homo sapiens
tggcttcccgctcagcc

SEQ ID NO: 4941364 - DNA, 20 bp, Homo sapiens
tggcttcccgctcagccctc

SEQ ID NO: 4941365 - DNA, 21 bp, Homo sapiens
tggcttcccgctcagccctcc

SEQ ID NO: 4941366 - DNA, 22 bp, Homo sapiens
tggcttcccgctcagccctccc

SEQ ID NO: 4941367 - DNA, 22 bp, Homo sapiens
tggcttcctaaaattcagtgga

SEQ ID NO: 4941368 - DNA, 14 bp, Homo sapiens
tggcttcctcctga

SEQ ID NO: 4941369 - DNA, 19 bp, Homo sapiens
tggctttccttgtggcaga

SEQ ID NO: 4941370 - DNA, 16 bp, Homo sapiens
tggcttttcactgctg

SEQ ID NO: 4941371 - DNA, 23 bp, Homo sapiens
tgggaaaaatgcccttaaatcat

SEQ ID NO: 4941372 - DNA, 20 bp, Homo sapiens
tgggaaccaagctattcctt

SEQ ID NO: 4941373 - DNA, 19 bp, Homo sapiens
tgggaacctcccagaggtc

SEQ ID NO: 4941374 - DNA, 22 bp, Homo sapiens
tgggaaggcctcttggagacct

SEQ ID NO: 4941375 - DNA, 15 bp, Homo sapiens
tgggaatgagacata

SEQ ID NO: 4941376 - DNA, 16 bp, Homo sapiens
tgggacaattgtttta

SEQ ID NO: 4941377 - DNA, 23 bp, Homo sapiens
tgggacagtttatcatgaagcct

SEQ ID NO: 4941378 - DNA, 22 bp, Homo sapiens
tgggagacaagaaatccctgtt

SEQ ID NO: 4941379 - DNA, 14 bp, Homo sapiens
tgggagagcccctg

SEQ ID NO: 4941380 - DNA, 22 bp, Homo sapiens
tgggagcaggagattgagaagg

SEQ ID NO: 4941381 - DNA, 22 bp, Homo sapiens
tgggagccccagggtcttccct

SEQ ID NO: 4941382 - DNA, 19 bp, Homo sapiens
tgggagctcctctcctgga

SEQ ID NO: 4941383 - DNA, 12 bp, Homo sapiens
tgggagctgcct

SEQ ID NO: 4941384 - DNA, 21 bp, Homo sapiens
tgggagctgcctgttcagctc

SEQ ID NO: 4941385 - DNA, 24 bp, Homo sapiens
tgggagctgcctgttcagctccag

SEQ ID NO: 4941386 - DNA, 20 bp, Homo sapiens
tgggagctggttagaaatgc

SEQ ID NO: 4941387 - DNA, 16 bp, Homo sapiens
tgggagcttgggaatg

SEQ ID NO: 4941388 - DNA, 18 bp, Homo sapiens
tgggaggaaagagagcag

SEQ ID NO: 4941389 - DNA, 13 bp, Homo sapiens
tgggaggagcaga

SEQ ID NO: 4941390 - DNA, 18 bp, Homo sapiens
tgggaggcatggccctgg

SEQ ID NO: 4941391 - DNA, 14 bp, Homo sapiens
tgggagggaaaagg

SEQ ID NO: 4941392 - DNA, 18 bp, Homo sapiens
tgggagggagcagacagg

SEQ ID NO: 4941393 - DNA, 20 bp, Homo sapiens
tgggaggggcgcccacctcc

SEQ ID NO: 4941394 - DNA, 12 bp, Homo sapiens
tgggagtccagg

SEQ ID NO: 4941395 - DNA, 12 bp, Homo sapiens
tgggatacaacc

SEQ ID NO: 4941396 - DNA, 15 bp, Homo sapiens
tgggatacaacctcc

SEQ ID NO: 4941397 - DNA, 22 bp, Homo sapiens
tgtacacactggtacttagagt

SEQ ID NO: 4941398 - DNA, 11 bp, Homo sapiens
tgtacataaaa

SEQ ID NO: 4941399 - DNA, 13 bp, Homo sapiens
tgtacataaaaga

SEQ ID NO: 4941400 - DNA, 23 bp, Homo sapiens
tgtacataatgcttaatttctaa

SEQ ID NO: 4941401 - DNA, 16 bp, Homo sapiens
tgtacatagtgtaatg

SEQ ID NO: 4941402 - DNA, 20 bp, Homo sapiens
tgtacatatttgagactagt

SEQ ID NO: 4941403 - DNA, 19 bp, Homo sapiens
tgtacatatttgtggaata

SEQ ID NO: 4941404 - DNA, 20 bp, Homo sapiens
tgtacatctattttggattg

SEQ ID NO: 4941405 - DNA, 21 bp, Homo sapiens
tgtacatctattttggattgt

SEQ ID NO: 4941406 - DNA, 23 bp, Homo sapiens
tgtacatctattttggattgtat

SEQ ID NO: 4941407 - DNA, 16 bp, Homo sapiens
tgtacatctggcttat

SEQ ID NO: 4941408 - DNA, 19 bp, Homo sapiens
tgtacatggcagagtttgt

SEQ ID NO: 4941409 - DNA, 17 bp, Homo sapiens
tgtacatgtgtagcctg

SEQ ID NO: 4941410 - DNA, 20 bp, Homo sapiens
tgtacatttaaaattgctat

SEQ ID NO: 4941411 - DNA, 21 bp, Homo sapiens
tgtacatttatgatttaataa

SEQ ID NO: 4941412 - DNA, 14 bp, Homo sapiens
tgtaccatttgcct

SEQ ID NO: 4941413 - DNA, 22 bp, Homo sapiens
tgtaccgtaggctttgtattca

SEQ ID NO: 4941414 - DNA, 13 bp, Homo sapiens
tgtacctcccctg

SEQ ID NO: 4941415 - DNA, 20 bp, Homo sapiens
tgtacctctggctgactaaa

SEQ ID NO: 4941416 - DNA, 15 bp, Homo sapiens
tgtacgtctgacagg

SEQ ID NO: 4941417 - DNA, 17 bp, Homo sapiens
tgtacgtctgacaggca

SEQ ID NO: 4941418 - DNA, 16 bp, Homo sapiens
tgtacgtttgtatgtg

SEQ ID NO: 4941419 - DNA, 16 bp, Homo sapiens
tgtactaattcttaca

SEQ ID NO: 4941420 - DNA, 17 bp, Homo sapiens
tgtactacctgtgtata

SEQ ID NO: 4941421 - DNA, 16 bp, Homo sapiens
tgtactagtactgtgt

SEQ ID NO: 4941422 - DNA, 15 bp, Homo sapiens
tgtactgtactaatt

SEQ ID NO: 4941423 - DNA, 19 bp, Homo sapiens
tgtactgtatagacagttt

SEQ ID NO: 4941424 - DNA, 23 bp, Homo sapiens
tgtactgtatagacagtttgtaa

SEQ ID NO: 4941425 - DNA, 19 bp, Homo sapiens
tgtactgtgtcataaacag

SEQ ID NO: 4941426 - DNA, 19 bp, Homo sapiens
tgtactgttctgtgtcttt

SEQ ID NO: 4941427 - DNA, 14 bp, Homo sapiens
tgtacttgtttgca

SEQ ID NO: 4941428 - DNA, 15 bp, Homo sapiens
tgtactttgcttgct

SEQ ID NO: 4941429 - DNA, 18 bp, Homo sapiens
tgtactttttagttgttc

SEQ ID NO: 4941430 - DNA, 13 bp, Homo sapiens
tgtagaaggcaca

SEQ ID NO: 4941431 - DNA, 14 bp, Homo sapiens
tgtagaattgttat

SEQ ID NO: 4941432 - DNA, 16 bp, Homo sapiens
tgtagactatatacat

SEQ ID NO: 4941433 - DNA, 22 bp, Homo sapiens
tgtagactatatacatgtgtgt

SEQ ID NO: 4941434 - DNA, 17 bp, Homo sapiens
tgtagagttaagaagct

SEQ ID NO: 4941435 - DNA, 21 bp, Homo sapiens
tgtagagttaagaagctgttg

SEQ ID NO: 4941436 - DNA, 14 bp, Homo sapiens
tgtagatatttggc

SEQ ID NO: 4941437 - DNA, 19 bp, Homo sapiens
tgtagatatttggcttaaa

SEQ ID NO: 4941438 - DNA, 22 bp, Homo sapiens
tgtagatatttggcttaaatat

SEQ ID NO: 4941439 - DNA, 21 bp, Homo sapiens
tgtagattaaggtgatgtgat

SEQ ID NO: 4941440 - DNA, 22 bp, Homo sapiens
tgtagatttagtgtaataagac

SEQ ID NO: 4941441 - DNA, 14 bp, Homo sapiens
tgtagcctgtgcat

SEQ ID NO: 4941442 - DNA, 15 bp, Homo sapiens
tgtagcctgtgcatg

SEQ ID NO: 4941443 - DNA, 20 bp, Homo sapiens
tgtagcctgtgcatgtatgt

SEQ ID NO: 4941444 - DNA, 17 bp, Homo sapiens
tgtagcgtgtttacatg

SEQ ID NO: 4941445 - DNA, 13 bp, Homo sapiens
tgtagctttgctc

SEQ ID NO: 4941446 - DNA, 15 bp, Homo sapiens
tgtagctttgctctt

SEQ ID NO: 4941447 - DNA, 17 bp, Homo sapiens
tgtaggagctgaggttt

SEQ ID NO: 4941448 - DNA, 22 bp, Homo sapiens
tgtaggagctgccttggctcag

SEQ ID NO: 4941449 - DNA, 13 bp, Homo sapiens
tgtaggtaaaatg

SEQ ID NO: 4941450 - DNA, 15 bp, Homo sapiens
tgtaggtaaaatgta

SEQ ID NO: 4941451 - DNA, 20 bp, Homo sapiens
tgtaggtgcaagatggaaag

SEQ ID NO: 4941452 - DNA, 14 bp, Homo sapiens
tgtagtaattgaca

SEQ ID NO: 4941453 - DNA, 15 bp, Homo sapiens
tgtagtaattgacat

SEQ ID NO: 4941454 - DNA, 23 bp, Homo sapiens
tgtagtagcgttttttaaatgta

SEQ ID NO: 4941455 - DNA, 15 bp, Homo sapiens
tgtagtataaagaaa

SEQ ID NO: 4941456 - DNA, 14 bp, Homo sapiens
tgtagtcatttact

SEQ ID NO: 4941457 - DNA, 23 bp, Homo sapiens
tgtagttaggaaataaaaccttt

SEQ ID NO: 4941458 - DNA, 13 bp, Homo sapiens
tgtagttctaaga

SEQ ID NO: 4941459 - DNA, 17 bp, Homo sapiens
tgtagttttattttatg

SEQ ID NO: 4941460 - DNA, 20 bp, Homo sapiens
tgtataaatgtatatacaca

SEQ ID NO: 4941461 - DNA, 18 bp, Homo sapiens
tgtataacttcttaaaag

SEQ ID NO: 4941462 - DNA, 20 bp, Homo sapiens
tgtataagtgcacacagaaa

SEQ ID NO: 4941463 - DNA, 23 bp, Homo sapiens
tgtataagtgcacacagaaatat

SEQ ID NO: 4941464 - DNA, 22 bp, Homo sapiens
tgtatacaaatatattgttaat

SEQ ID NO: 4941465 - DNA, 14 bp, Homo sapiens
tgtatactatagta

SEQ ID NO: 4941466 - DNA, 15 bp, Homo sapiens
tgtatactttaaata

SEQ ID NO: 4941467 - DNA, 17 bp, Homo sapiens
tgtatactttaaataat

SEQ ID NO: 4941468 - DNA, 21 bp, Homo sapiens
tgtatactttaaataatttaa

SEQ ID NO: 4941469 - DNA, 22 bp, Homo sapiens
tgtatagacagtttgtaaatgt

SEQ ID NO: 4941470 - DNA, 16 bp, Homo sapiens
tgtatagtgtaaaata

SEQ ID NO: 4941471 - DNA, 24 bp, Homo sapiens
tgtatagtgtaaaataagaatgat

SEQ ID NO: 4941472 - DNA, 20 bp, Homo sapiens
tgtatagttaggatagcatt

SEQ ID NO: 4941473 - DNA, 16 bp, Homo sapiens
tgtatatacacatata

SEQ ID NO: 4941474 - DNA, 17 bp, Homo sapiens
tgtatatacacatatac

SEQ ID NO: 4941475 - DNA, 17 bp, Homo sapiens
tgtatatacgcatctat

SEQ ID NO: 4941476 - DNA, 21 bp, Homo sapiens
tgtatatacgcatctataaat

SEQ ID NO: 4941477 - DNA, 19 bp, Homo sapiens
tgtatatatacatacactt

SEQ ID NO: 4941478 - DNA, 20 bp, Homo sapiens
tgtatatatacatacacttg

SEQ ID NO: 4941479 - DNA, 17 bp, Homo sapiens
tgtatatatattaagag

SEQ ID NO: 4941480 - DNA, 17 bp, Homo sapiens
tgtatatatctgcttca

SEQ ID NO: 4941481 - DNA, 16 bp, Homo sapiens
tgtatatatgtgtata

SEQ ID NO: 4941482 - DNA, 18 bp, Homo sapiens
tgtatatatgtgtatata

SEQ ID NO: 4941483 - DNA, 20 bp, Homo sapiens
tgtatatatgtgtatatata

SEQ ID NO: 4941484 - DNA, 23 bp, Homo sapiens
tgtatatatgtgtatatatacat

SEQ ID NO: 4941485 - DNA, 13 bp, Homo sapiens
tgtatatcagaaa

SEQ ID NO: 4941486 - DNA, 18 bp, Homo sapiens
tgtatattacacatttgt

SEQ ID NO: 4941487 - DNA, 20 bp, Homo sapiens
tgtatattgtgtttgtgtat

SEQ ID NO: 4941488 - DNA, 19 bp, Homo sapiens
tgtatatttgtatattaca

SEQ ID NO: 4941489 - DNA, 17 bp, Homo sapiens
tgtatcaaacccacgat

SEQ ID NO: 4941490 - DNA, 15 bp, Homo sapiens
tgtatcatagaaatg

SEQ ID NO: 4941491 - DNA, 16 bp, Homo sapiens
tgtatcatagaaatgt

SEQ ID NO: 4941492 - DNA, 19 bp, Homo sapiens
tgtatcccatgagcctcag

SEQ ID NO: 4941493 - DNA, 18 bp, Homo sapiens
tgtatctctgaagcatgt

SEQ ID NO: 4941494 - DNA, 20 bp, Homo sapiens
tgtatgaactttatctaaag

SEQ ID NO: 4941495 - DNA, 16 bp, Homo sapiens
tgtatgtgccatttat

SEQ ID NO: 4941496 - DNA, 14 bp, Homo sapiens
tgtattaacaaaag

SEQ ID NO: 4941497 - DNA, 14 bp, Homo sapiens
tgtattacagatgc

SEQ ID NO: 4941498 - DNA, 15 bp, Homo sapiens
tgtattattgctgtt

SEQ ID NO: 4941499 - DNA, 14 bp, Homo sapiens
tgtattatttataa

SEQ ID NO: 4941500 - DNA, 20 bp, Homo sapiens
tgtattctagctaatgtaat

SEQ ID NO: 4941501 - DNA, 22 bp, Homo sapiens
tgtattctagctaatgtaataa

SEQ ID NO: 4941502 - DNA, 15 bp, Homo sapiens
tgtattgagatttct

SEQ ID NO: 4941503 - DNA, 16 bp, Homo sapiens
tgtattggttaaaact

SEQ ID NO: 4941504 - DNA, 14 bp, Homo sapiens
tgtatttaagcaaa

SEQ ID NO: 4941505 - DNA, 19 bp, Homo sapiens
tgtatttaagcaaatactt

SEQ ID NO: 4941506 - DNA, 23 bp, Homo sapiens
tgttactgttcttgctgctagaa

SEQ ID NO: 4941507 - DNA, 21 bp, Homo sapiens
tgttagatagaatttccaata

SEQ ID NO: 4941508 - DNA, 16 bp, Homo sapiens
tgttagcactgttgat

SEQ ID NO: 4941509 - DNA, 20 bp, Homo sapiens
tgttagcttccttaagtata

SEQ ID NO: 4941510 - DNA, 16 bp, Homo sapiens
tgttatatcccctgct

SEQ ID NO: 4941511 - DNA, 18 bp, Homo sapiens
tgttatatttaatgcatt

SEQ ID NO: 4941512 - DNA, 20 bp, Homo sapiens
tgttatcttctcaagttcta

SEQ ID NO: 4941513 - DNA, 23 bp, Homo sapiens
tgttatcttctcaagttctaaga

SEQ ID NO: 4941514 - DNA, 14 bp, Homo sapiens
tgttatgtactgta

SEQ ID NO: 4941515 - DNA, 15 bp, Homo sapiens
tgttattgtgaatga

SEQ ID NO: 4941516 - DNA, 22 bp, Homo sapiens
tgttattgttttgttaattaca

SEQ ID NO: 4941517 - DNA, 15 bp, Homo sapiens
tgttatttctgcaaa

SEQ ID NO: 4941518 - DNA, 18 bp, Homo sapiens
tgttattttcagtatttt

SEQ ID NO: 4941519 - DNA, 22 bp, Homo sapiens
tgttcaaacaatatcatatcat

SEQ ID NO: 4941520 - DNA, 20 bp, Homo sapiens
tgttcaaagccacattattt

SEQ ID NO: 4941521 - DNA, 21 bp, Homo sapiens
tgttcaatggttctgaaataa

SEQ ID NO: 4941522 - DNA, 17 bp, Homo sapiens
tgttcacgcaacttgaa

SEQ ID NO: 4941523 - DNA, 18 bp, Homo sapiens
tgttcactgaaggtgatt

SEQ ID NO: 4941524 - DNA, 16 bp, Homo sapiens
tgttcagctccagctc

SEQ ID NO: 4941525 - DNA, 21 bp, Homo sapiens
tgttcagctccagctcaccag

SEQ ID NO: 4941526 - DNA, 17 bp, Homo sapiens
tgttccaagtttccaaa

SEQ ID NO: 4941527 - DNA, 14 bp, Homo sapiens
tgttccagctcttt

SEQ ID NO: 4941528 - DNA, 18 bp, Homo sapiens
tgttccctctccctgttg

SEQ ID NO: 4941529 - DNA, 20 bp, Homo sapiens
tgttccctttgtctttcaaa

SEQ ID NO: 4941530 - DNA, 14 bp, Homo sapiens
tgttctaaggctct

SEQ ID NO: 4941531 - DNA, 15 bp, Homo sapiens
tgttctaaggctctg

SEQ ID NO: 4941532 - DNA, 16 bp, Homo sapiens
tgttctaaggctctga

SEQ ID NO: 4941533 - DNA, 19 bp, Homo sapiens
tgttctaaggctctgagag

SEQ ID NO: 4941534 - DNA, 11 bp, Homo sapiens
tgttctaaggg

SEQ ID NO: 4941535 - DNA, 19 bp, Homo sapiens
tgttctaagtttctaagat

SEQ ID NO: 4941536 - DNA, 14 bp, Homo sapiens
tgttctatccaaac

SEQ ID NO: 4941537 - DNA, 15 bp, Homo sapiens
tgttctatgaacaac

SEQ ID NO: 4941538 - DNA, 21 bp, Homo sapiens
tgttctccttttcctctctcc

SEQ ID NO: 4941539 - DNA, 16 bp, Homo sapiens
tgttctctgaggacac

SEQ ID NO: 4941540 - DNA, 18 bp, Homo sapiens
tgttctctgaggacacta

SEQ ID NO: 4941541 - DNA, 20 bp, Homo sapiens
tgttctcttcttcattctat

SEQ ID NO: 4941542 - DNA, 23 bp, Homo sapiens
tgttctcttgggaactgaactca

SEQ ID NO: 4941543 - DNA, 13 bp, Homo sapiens
tgttctgcactga

SEQ ID NO: 4941544 - DNA, 17 bp, Homo sapiens
tgttctgcactgaaaag

SEQ ID NO: 4941545 - DNA, 12 bp, Homo sapiens
tgttctgggaca

SEQ ID NO: 4941546 - DNA, 14 bp, Homo sapiens
tgttctgtgtcttt

SEQ ID NO: 4941547 - DNA, 13 bp, Homo sapiens
tgttcttacacat

SEQ ID NO: 4941548 - DNA, 22 bp, Homo sapiens
tgttcttacctgtatgtctcca

SEQ ID NO: 4941549 - DNA, 23 bp, Homo sapiens
tgttcttgctgctagaacttttt

SEQ ID NO: 4941550 - DNA, 14 bp, Homo sapiens
tgttgaaaatgttc

SEQ ID NO: 4941551 - DNA, 13 bp, Homo sapiens
tgttgaagtcacc

SEQ ID NO: 4941552 - DNA, 22 bp, Homo sapiens
tgttgacaaaattttctcattt

SEQ ID NO: 4941553 - DNA, 18 bp, Homo sapiens
tgttgacattaagaatgt

SEQ ID NO: 4941554 - DNA, 22 bp, Homo sapiens
tgttgacattaagaatgttggt

SEQ ID NO: 4941555 - DNA, 22 bp, Homo sapiens
tgttgagaatcccaaatttgat

SEQ ID NO: 4941556 - DNA, 22 bp, Homo sapiens
tgttgatgggcacttgagaact

SEQ ID NO: 4941557 - DNA, 19 bp, Homo sapiens
tgttgatgtatctgagttg

SEQ ID NO: 4941558 - DNA, 21 bp, Homo sapiens
tgttgatgtatctgagttgcc

SEQ ID NO: 4941559 - DNA, 14 bp, Homo sapiens
tgttgattaaaaca

SEQ ID NO: 4941560 - DNA, 15 bp, Homo sapiens
tgttgcaattaggat

SEQ ID NO: 4941561 - DNA, 17 bp, Homo sapiens
tgttgcccaggcaggtc

SEQ ID NO: 4941562 - DNA, 13 bp, Homo sapiens
tgttgcccaggct

SEQ ID NO: 4941563 - DNA, 22 bp, Homo sapiens
tgttgcctttttcattttccaa

SEQ ID NO: 4941564 - DNA, 15 bp, Homo sapiens
tgttggccaggctgg

SEQ ID NO: 4941565 - DNA, 16 bp, Homo sapiens
tgttggccaggctggt

SEQ ID NO: 4941566 - DNA, 23 bp, Homo sapiens
tgttgggaaaaaggcctctgtcc

SEQ ID NO: 4941567 - DNA, 14 bp, Homo sapiens
tgttggtttacttt

SEQ ID NO: 4941568 - DNA, 19 bp, Homo sapiens
tgttggtttactttcaaat

SEQ ID NO: 4941569 - DNA, 21 bp, Homo sapiens
tgttggttttgggggtgtgag

SEQ ID NO: 4941570 - DNA, 15 bp, Homo sapiens
tgttgtaaaaagaaa

SEQ ID NO: 4941571 - DNA, 13 bp, Homo sapiens
tgttgtaaattag

SEQ ID NO: 4941572 - DNA, 12 bp, Homo sapiens
tgttgtaactta

SEQ ID NO: 4941573 - DNA, 13 bp, Homo sapiens
tgttgtaacttat

SEQ ID NO: 4941574 - DNA, 15 bp, Homo sapiens
tgttgtaatgctgca

SEQ ID NO: 4941575 - DNA, 16 bp, Homo sapiens
tgttgtaatgctgcac

SEQ ID NO: 4941576 - DNA, 13 bp, Homo sapiens
tgttgtacattta

SEQ ID NO: 4941577 - DNA, 14 bp, Homo sapiens
tgttgtacatttat

SEQ ID NO: 4941578 - DNA, 16 bp, Homo sapiens
tgttgtacatttatga

SEQ ID NO: 4941579 - DNA, 13 bp, Homo sapiens
tgttgtattaaca

SEQ ID NO: 4941580 - DNA, 14 bp, Homo sapiens
tgttgtattaacaa

SEQ ID NO: 4941581 - DNA, 15 bp, Homo sapiens
tgttgtattaacaaa

SEQ ID NO: 4941582 - DNA, 16 bp, Homo sapiens
tgttgtcttgaaagat

SEQ ID NO: 4941583 - DNA, 12 bp, Homo sapiens
tgttgtgaatgt

SEQ ID NO: 4941584 - DNA, 13 bp, Homo sapiens
tgttgtgaatgtt

SEQ ID NO: 4941585 - DNA, 14 bp, Homo sapiens
tgttgtgatgtctt

SEQ ID NO: 4941586 - DNA, 13 bp, Homo sapiens
tgtttaaagtggc

SEQ ID NO: 4941587 - DNA, 20 bp, Homo sapiens
tgtttaatctgttatgtact

SEQ ID NO: 4941588 - DNA, 13 bp, Homo sapiens
tgtttaatgtgaa

SEQ ID NO: 4941589 - DNA, 14 bp, Homo sapiens
tgtttaatgtgaac

SEQ ID NO: 4941590 - DNA, 16 bp, Homo sapiens
tgtttaatgtgaactt

SEQ ID NO: 4941591 - DNA, 18 bp, Homo sapiens
tgtttaatgtgaacttgt

SEQ ID NO: 4941592 - DNA, 19 bp, Homo sapiens
tgtttaatgtgaacttgta

SEQ ID NO: 4941593 - DNA, 23 bp, Homo sapiens
tgtttaatgtgaacttgtagctg

SEQ ID NO: 4941594 - DNA, 15 bp, Homo sapiens
tgtttaatttcttca

SEQ ID NO: 4941595 - DNA, 21 bp, Homo sapiens
tgtttaatttcttcaaaatgt

SEQ ID NO: 4941596 - DNA, 23 bp, Homo sapiens
tgtttaatttcttcaaaatgtat

SEQ ID NO: 4941597 - DNA, 22 bp, Homo sapiens
tgtttacatgtgtagcctatgt

SEQ ID NO: 4941598 - DNA, 23 bp, Homo sapiens
tgtttataaaatataaacaaaga

SEQ ID NO: 4941599 - DNA, 15 bp, Homo sapiens
tgtttatatgtgttg

SEQ ID NO: 4941600 - DNA, 17 bp, Homo sapiens
tgtttatcagatacatc

SEQ ID NO: 4941601 - DNA, 12 bp, Homo sapiens
tgtttatgaaaa

SEQ ID NO: 4941602 - DNA, 21 bp, Homo sapiens
tgtttatgaaaataaatagct

SEQ ID NO: 4941603 - DNA, 15 bp, Homo sapiens
tgtttatggcctcag

SEQ ID NO: 4941604 - DNA, 23 bp, Homo sapiens
tgtttatggcctcagctgcctca

SEQ ID NO: 4941605 - DNA, 14 bp, Homo sapiens
tgtttattgagttt

SEQ ID NO: 4941606 - DNA, 12 bp, Homo sapiens
tgtttatttttc

SEQ ID NO: 4941607 - DNA, 16 bp, Homo sapiens
tgtttatttttcatat

SEQ ID NO: 4941608 - DNA, 19 bp, Homo sapiens
tgtttcaagaacctggaaa

SEQ ID NO: 4941609 - DNA, 21 bp, Homo sapiens
tgtttcaaggcactctagatt

SEQ ID NO: 4941610 - DNA, 23 bp, Homo sapiens
tgtttcacaccggaaggttttta

SEQ ID NO: 4941611 - DNA, 19 bp, Homo sapiens
tgtttcagctaagggaaga

SEQ ID NO: 4941612 - DNA, 13 bp, Homo sapiens
tgtttcatgtttt

SEQ ID NO: 4941613 - DNA, 18 bp, Homo sapiens
tgtttccagcagaagaca

SEQ ID NO: 4941614 - DNA, 15 bp, Homo sapiens
tgtttcctcttccaa

SEQ ID NO: 4941615 - DNA, 16 bp, Homo sapiens
tgtttctatctgattt

SEQ ID NO: 4941616 - DNA, 18 bp, Homo sapiens
ttataaaattttgctttt

SEQ ID NO: 4941617 - DNA, 19 bp, Homo sapiens
ttataaagaatgtttctta

SEQ ID NO: 4941618 - DNA, 21 bp, Homo sapiens
ttataaatataagccttttat

SEQ ID NO: 4941619 - DNA, 17 bp, Homo sapiens
ttataaatatatataaa

SEQ ID NO: 4941620 - DNA, 12 bp, Homo sapiens
ttataagcattg

SEQ ID NO: 4941621 - DNA, 13 bp, Homo sapiens
ttataagcattga

SEQ ID NO: 4941622 - DNA, 18 bp, Homo sapiens
ttataagtcattgtatgt

SEQ ID NO: 4941623 - DNA, 17 bp, Homo sapiens
ttataagttcacaaaat

SEQ ID NO: 4941624 - DNA, 18 bp, Homo sapiens
ttataataaaggactgta

SEQ ID NO: 4941625 - DNA, 19 bp, Homo sapiens
ttataataaaggactgtaa

SEQ ID NO: 4941626 - DNA, 12 bp, Homo sapiens
ttataattttct

SEQ ID NO: 4941627 - DNA, 15 bp, Homo sapiens
ttataattttctgaa

SEQ ID NO: 4941628 - DNA, 18 bp, Homo sapiens
ttataccccaataatcaa

SEQ ID NO: 4941629 - DNA, 16 bp, Homo sapiens
ttatacctacctgtgt

SEQ ID NO: 4941630 - DNA, 19 bp, Homo sapiens
ttatacctcaaactatctg

SEQ ID NO: 4941631 - DNA, 19 bp, Homo sapiens
ttatagagggccaagactt

SEQ ID NO: 4941632 - DNA, 12 bp, Homo sapiens
ttatagattcta

SEQ ID NO: 4941633 - DNA, 16 bp, Homo sapiens
ttatagattctaaaga

SEQ ID NO: 4941634 - DNA, 19 bp, Homo sapiens
ttatagattctaaagattc

SEQ ID NO: 4941635 - DNA, 20 bp, Homo sapiens
ttatagattctaaagattct

SEQ ID NO: 4941636 - DNA, 21 bp, Homo sapiens
ttatagattctaaagattcta

SEQ ID NO: 4941637 - DNA, 22 bp, Homo sapiens
ttatagcactttgaaatacctc

SEQ ID NO: 4941638 - DNA, 23 bp, Homo sapiens
ttatagcactttgaaatacctca

SEQ ID NO: 4941639 - DNA, 14 bp, Homo sapiens
ttataggtgagaaa

SEQ ID NO: 4941640 - DNA, 13 bp, Homo sapiens
ttatagtacatga

SEQ ID NO: 4941641 - DNA, 16 bp, Homo sapiens
ttatagtggaaaaaca

SEQ ID NO: 4941642 - DNA, 22 bp, Homo sapiens
ttatataattcactcaagcact

SEQ ID NO: 4941643 - DNA, 18 bp, Homo sapiens
ttatataggttgtgcaaa

SEQ ID NO: 4941644 - DNA, 12 bp, Homo sapiens
ttatatatataa

SEQ ID NO: 4941645 - DNA, 16 bp, Homo sapiens
ttatatatgaaaacta

SEQ ID NO: 4941646 - DNA, 22 bp, Homo sapiens
ttatatggatgattcagaaatt

SEQ ID NO: 4941647 - DNA, 14 bp, Homo sapiens
ttatatgtaccgta

SEQ ID NO: 4941648 - DNA, 11 bp, Homo sapiens
ttatattcaac

SEQ ID NO: 4941649 - DNA, 17 bp, Homo sapiens
ttatattcaaccatgga

SEQ ID NO: 4941650 - DNA, 15 bp, Homo sapiens
ttatattgaagacaa

SEQ ID NO: 4941651 - DNA, 23 bp, Homo sapiens
ttatatttccctaaaatacattt

SEQ ID NO: 4941652 - DNA, 20 bp, Homo sapiens
ttatattttcgtatgaaaat

SEQ ID NO: 4941653 - DNA, 13 bp, Homo sapiens
ttatatttttaaa

SEQ ID NO: 4941654 - DNA, 16 bp, Homo sapiens
ttatattttttcagtt

SEQ ID NO: 4941655 - DNA, 15 bp, Homo sapiens
ttatcaaagcataga

SEQ ID NO: 4941656 - DNA, 19 bp, Homo sapiens
ttatcaatatctaatatat

SEQ ID NO: 4941657 - DNA, 17 bp, Homo sapiens
ttatcactttttgaact

SEQ ID NO: 4941658 - DNA, 22 bp, Homo sapiens
ttatcactttttgaactaagaa

SEQ ID NO: 4941659 - DNA, 14 bp, Homo sapiens
ttatcagtcaatat

SEQ ID NO: 4941660 - DNA, 13 bp, Homo sapiens
ttatcagtttcca

SEQ ID NO: 4941661 - DNA, 12 bp, Homo sapiens
ttatcatgaagc

SEQ ID NO: 4941662 - DNA, 14 bp, Homo sapiens
ttatccatttgtaa

SEQ ID NO: 4941663 - DNA, 16 bp, Homo sapiens
ttatcctgaaatttca

SEQ ID NO: 4941664 - DNA, 13 bp, Homo sapiens
ttatcctgcattg

SEQ ID NO: 4941665 - DNA, 19 bp, Homo sapiens
ttatctaatacctctgtgt

SEQ ID NO: 4941666 - DNA, 21 bp, Homo sapiens
ttatctacccaagggcagaaa

SEQ ID NO: 4941667 - DNA, 18 bp, Homo sapiens
ttatctatagctaagtac

SEQ ID NO: 4941668 - DNA, 22 bp, Homo sapiens
ttatctcagtcatgcataaata

SEQ ID NO: 4941669 - DNA, 15 bp, Homo sapiens
ttatctctatttaat

SEQ ID NO: 4941670 - DNA, 18 bp, Homo sapiens
ttatgaaaggtttacatt

SEQ ID NO: 4941671 - DNA, 19 bp, Homo sapiens
ttatgaaattcaccccctt

SEQ ID NO: 4941672 - DNA, 20 bp, Homo sapiens
ttatgaacccttcctgagct

SEQ ID NO: 4941673 - DNA, 14 bp, Homo sapiens
ttatgaagtttaaa

SEQ ID NO: 4941674 - DNA, 22 bp, Homo sapiens
ttatgaagtttaaaacagtatt

SEQ ID NO: 4941675 - DNA, 16 bp, Homo sapiens
ttatgacatcacttgt

SEQ ID NO: 4941676 - DNA, 16 bp, Homo sapiens
ttatgactatgtaaac

SEQ ID NO: 4941677 - DNA, 22 bp, Homo sapiens
ttatgaggcaacctgattgtaa

SEQ ID NO: 4941678 - DNA, 20 bp, Homo sapiens
ttatgagtaactattattat

SEQ ID NO: 4941679 - DNA, 16 bp, Homo sapiens
ttatgataatagattc

SEQ ID NO: 4941680 - DNA, 23 bp, Homo sapiens
ttatgatgaaaacctacatattc

SEQ ID NO: 4941681 - DNA, 20 bp, Homo sapiens
ttatgatttaataaaataat

SEQ ID NO: 4941682 - DNA, 14 bp, Homo sapiens
ttatgattttcata

SEQ ID NO: 4941683 - DNA, 19 bp, Homo sapiens
ttatgattttcataactta

SEQ ID NO: 4941684 - DNA, 15 bp, Homo sapiens
ttatgcaaaatggaa

SEQ ID NO: 4941685 - DNA, 17 bp, Homo sapiens
ttatgcaaggaaggaaa

SEQ ID NO: 4941686 - DNA, 22 bp, Homo sapiens
ttatgcaaggaaggaaagaaag

SEQ ID NO: 4941687 - DNA, 14 bp, Homo sapiens
ttatgctcagggtc

SEQ ID NO: 4941688 - DNA, 20 bp, Homo sapiens
ttatgctcttttttactcat

SEQ ID NO: 4941689 - DNA, 21 bp, Homo sapiens
ttatggagacctctccttcct

SEQ ID NO: 4941690 - DNA, 11 bp, Homo sapiens
ttatggatgca

SEQ ID NO: 4941691 - DNA, 13 bp, Homo sapiens
ttatggcctcagc

SEQ ID NO: 4941692 - DNA, 15 bp, Homo sapiens
ttatggcctcagctg

SEQ ID NO: 4941693 - DNA, 17 bp, Homo sapiens
ttatgtactgtactaat

SEQ ID NO: 4941694 - DNA, 14 bp, Homo sapiens
ttatgtctgtttaa

SEQ ID NO: 4941695 - DNA, 16 bp, Homo sapiens
ttatgtctgtttaaga

SEQ ID NO: 4941696 - DNA, 19 bp, Homo sapiens
ttatgtggttttagatttt

SEQ ID NO: 4941697 - DNA, 20 bp, Homo sapiens
ttatgtggttttagattttc

SEQ ID NO: 4941698 - DNA, 15 bp, Homo sapiens
ttatgtgtaaataca

SEQ ID NO: 4941699 - DNA, 22 bp, Homo sapiens
ttatgtgtagttgtctctcttc

SEQ ID NO: 4941700 - DNA, 19 bp, Homo sapiens
ttatgtgtatgtgccattt

SEQ ID NO: 4941701 - DNA, 18 bp, Homo sapiens
ttatgtgtgcatgtgtgt

SEQ ID NO: 4941702 - DNA, 13 bp, Homo sapiens
ttatgttaaaatc

SEQ ID NO: 4941703 - DNA, 12 bp, Homo sapiens
ttatgtttgaat

SEQ ID NO: 4941704 - DNA, 13 bp, Homo sapiens
ttatgtttgaata

SEQ ID NO: 4941705 - DNA, 14 bp, Homo sapiens
ttatgtttgaatat

SEQ ID NO: 4941706 - DNA, 14 bp, Homo sapiens
ttattaaaatgatt

SEQ ID NO: 4941707 - DNA, 20 bp, Homo sapiens
ttattaaataaaatcaattt

SEQ ID NO: 4941708 - DNA, 11 bp, Homo sapiens
ttattaatatt

SEQ ID NO: 4941709 - DNA, 18 bp, Homo sapiens
ttattaatatttaacatt

SEQ ID NO: 4941710 - DNA, 22 bp, Homo sapiens
ttattaattgttttgcactttt

SEQ ID NO: 4941711 - DNA, 23 bp, Homo sapiens
ttattacagggcattcaaatggg

SEQ ID NO: 4941712 - DNA, 20 bp, Homo sapiens
ttattacttgttgcaaaggt

SEQ ID NO: 4941713 - DNA, 20 bp, Homo sapiens
ttattagtaaatgcttatca

SEQ ID NO: 4941714 - DNA, 11 bp, Homo sapiens
ttattattgtg

SEQ ID NO: 4941715 - DNA, 16 bp, Homo sapiens
ttattcaagttattgt

SEQ ID NO: 4941716 - DNA, 11 bp, Homo sapiens
ttattcattgg

SEQ ID NO: 4941717 - DNA, 17 bp, Homo sapiens
ttattccagaatgctgt

SEQ ID NO: 4941718 - DNA, 22 bp, Homo sapiens
ttattccagaatgctgtacatc

SEQ ID NO: 4941719 - DNA, 20 bp, Homo sapiens
ttattccccattcttcctag

SEQ ID NO: 4941720 - DNA, 13 bp, Homo sapiens
ttattcttctaga

SEQ ID NO: 4941721 - DNA, 14 bp, Homo sapiens
ttattgacacagaa

SEQ ID NO: 4941722 - DNA, 21 bp, Homo sapiens
ttattgcaaaatagcatttgt

SEQ ID NO: 4941723 - DNA, 13 bp, Homo sapiens
ttattgcattata

SEQ ID NO: 4941724 - DNA, 15 bp, Homo sapiens
ttattgcgctgctac

SEQ ID NO: 4941725 - DNA, 17 bp, Homo sapiens
ttattgcttagtaaaat

SEQ ID NO: 4941726 - DNA, 18 bp, Homo sapiens
ttccatgtcgcctctgca

SEQ ID NO: 4941727 - DNA, 20 bp, Homo sapiens
ttccatgtcgcctctgcatt

SEQ ID NO: 4941728 - DNA, 16 bp, Homo sapiens
ttccattggtccaaga

SEQ ID NO: 4941729 - DNA, 17 bp, Homo sapiens
ttccattggtccaagat

SEQ ID NO: 4941730 - DNA, 20 bp, Homo sapiens
ttccattggtccaagattcc

SEQ ID NO: 4941731 - DNA, 17 bp, Homo sapiens
ttcccaatcagcactga

SEQ ID NO: 4941732 - DNA, 17 bp, Homo sapiens
ttcccactttcccaccc

SEQ ID NO: 4941733 - DNA, 18 bp, Homo sapiens
ttcccaggttctgtttat

SEQ ID NO: 4941734 - DNA, 20 bp, Homo sapiens
ttcccagtcttctgacaaac

SEQ ID NO: 4941735 - DNA, 17 bp, Homo sapiens
ttcccagtgaattcttg

SEQ ID NO: 4941736 - DNA, 17 bp, Homo sapiens
ttcccatgtagccccct

SEQ ID NO: 4941737 - DNA, 23 bp, Homo sapiens
ttcccattgcatcacctctgtaa

SEQ ID NO: 4941738 - DNA, 20 bp, Homo sapiens
ttcccatttgtgccagagga

SEQ ID NO: 4941739 - DNA, 15 bp, Homo sapiens
ttccccagcccaggg

SEQ ID NO: 4941740 - DNA, 23 bp, Homo sapiens
ttccccataactcaatggcctaa

SEQ ID NO: 4941741 - DNA, 18 bp, Homo sapiens
ttcccccaccggtccagc

SEQ ID NO: 4941742 - DNA, 23 bp, Homo sapiens
ttcccccaccggtccagctggcc

SEQ ID NO: 4941743 - DNA, 15 bp, Homo sapiens
ttcccccatagccac

SEQ ID NO: 4941744 - DNA, 21 bp, Homo sapiens
ttccccccactctccccacac

SEQ ID NO: 4941745 - DNA, 19 bp, Homo sapiens
ttccccctccaatcccacc

SEQ ID NO: 4941746 - DNA, 17 bp, Homo sapiens
ttcccctccttctccct

SEQ ID NO: 4941747 - DNA, 17 bp, Homo sapiens
ttcccctgttcactcta

SEQ ID NO: 4941748 - DNA, 22 bp, Homo sapiens
ttcccgcgggttccgcaggcag

SEQ ID NO: 4941749 - DNA, 21 bp, Homo sapiens
ttcccgctcagccctccctgc

SEQ ID NO: 4941750 - DNA, 15 bp, Homo sapiens
ttcccggtcccgagt

SEQ ID NO: 4941751 - DNA, 14 bp, Homo sapiens
ttcccgtttctcca

SEQ ID NO: 4941752 - DNA, 19 bp, Homo sapiens
ttccctaaaatacatttaa

SEQ ID NO: 4941753 - DNA, 14 bp, Homo sapiens
ttccctacttcctg

SEQ ID NO: 4941754 - DNA, 16 bp, Homo sapiens
ttccctacttcctgtg

SEQ ID NO: 4941755 - DNA, 15 bp, Homo sapiens
ttccctctgctcagc

SEQ ID NO: 4941756 - DNA, 15 bp, Homo sapiens
ttccctcttttctta

SEQ ID NO: 4941757 - DNA, 22 bp, Homo sapiens
ttccctgaaacacgaaacttgt

SEQ ID NO: 4941758 - DNA, 22 bp, Homo sapiens
ttccctgcactaaagccagcct

SEQ ID NO: 4941759 - DNA, 19 bp, Homo sapiens
ttccctgcgcctgtgatgc

SEQ ID NO: 4941760 - DNA, 20 bp, Homo sapiens
ttccctgtctcttgaaaaat

SEQ ID NO: 4941761 - DNA, 15 bp, Homo sapiens
ttccctgttcttcct

SEQ ID NO: 4941762 - DNA, 17 bp, Homo sapiens
ttccctgttcttcctcc

SEQ ID NO: 4941763 - DNA, 19 bp, Homo sapiens
ttccctgttcttcctccag

SEQ ID NO: 4941764 - DNA, 15 bp, Homo sapiens
ttcccttccactgcc

SEQ ID NO: 4941765 - DNA, 19 bp, Homo sapiens
ttcccttgcttttccctct

SEQ ID NO: 4941766 - DNA, 17 bp, Homo sapiens
ttccgccccttcccttc

SEQ ID NO: 4941767 - DNA, 22 bp, Homo sapiens
ttccggatcctaagcatctaag

SEQ ID NO: 4941768 - DNA, 17 bp, Homo sapiens
ttccggtagggaggcag

SEQ ID NO: 4941769 - DNA, 18 bp, Homo sapiens
ttccgtgacgtcactgga

SEQ ID NO: 4941770 - DNA, 21 bp, Homo sapiens
ttcctaagccacttgaaatgt

SEQ ID NO: 4941771 - DNA, 22 bp, Homo sapiens
ttcctaagccacttgaaatgtt

SEQ ID NO: 4941772 - DNA, 17 bp, Homo sapiens
ttcctaatcagaaattt

SEQ ID NO: 4941773 - DNA, 23 bp, Homo sapiens
ttcctaatcagaaatttttatca

SEQ ID NO: 4941774 - DNA, 20 bp, Homo sapiens
ttcctacaagagcagcctgt

SEQ ID NO: 4941775 - DNA, 23 bp, Homo sapiens
ttcctacaagagcagcctgtggc

SEQ ID NO: 4941776 - DNA, 17 bp, Homo sapiens
ttcctacagcactactg

SEQ ID NO: 4941777 - DNA, 21 bp, Homo sapiens
ttcctacagcactactgggtg

SEQ ID NO: 4941778 - DNA, 22 bp, Homo sapiens
ttcctacagcactactgggtgt

SEQ ID NO: 4941779 - DNA, 21 bp, Homo sapiens
ttcctacccacacctctgcca

SEQ ID NO: 4941780 - DNA, 23 bp, Homo sapiens
ttcctacccacacctctgccaga

SEQ ID NO: 4941781 - DNA, 14 bp, Homo sapiens
ttcctagccctctc

SEQ ID NO: 4941782 - DNA, 13 bp, Homo sapiens
ttcctagcctgtt

SEQ ID NO: 4941783 - DNA, 14 bp, Homo sapiens
ttcctatatcctgt

SEQ ID NO: 4941784 - DNA, 18 bp, Homo sapiens
ttcctatttgccatgggc

SEQ ID NO: 4941785 - DNA, 14 bp, Homo sapiens
ttcctcacagtccc

SEQ ID NO: 4941786 - DNA, 19 bp, Homo sapiens
ttcctcatccaccccatcc

SEQ ID NO: 4941787 - DNA, 11 bp, Homo sapiens
ttcctcctgga

SEQ ID NO: 4941788 - DNA, 14 bp, Homo sapiens
ttcctcctttatca

SEQ ID NO: 4941789 - DNA, 13 bp, Homo sapiens
ttcctctccactg

SEQ ID NO: 4941790 - DNA, 19 bp, Homo sapiens
ttcctctccactgccttcg

SEQ ID NO: 4941791 - DNA, 19 bp, Homo sapiens
ttcctctccttcgtatccc

SEQ ID NO: 4941792 - DNA, 12 bp, Homo sapiens
ttcctcttccaa

SEQ ID NO: 4941793 - DNA, 20 bp, Homo sapiens
ttcctcttctattttgtaaa

SEQ ID NO: 4941794 - DNA, 16 bp, Homo sapiens
ttcctgacatcacagc

SEQ ID NO: 4941795 - DNA, 18 bp, Homo sapiens
ttcctgagatttcctcct

SEQ ID NO: 4941796 - DNA, 21 bp, Homo sapiens
ttcctgccttggcctcccaag

SEQ ID NO: 4941797 - DNA, 19 bp, Homo sapiens
ttcctggacactcagacct

SEQ ID NO: 4941798 - DNA, 22 bp, Homo sapiens
ttcctgtgatccacccaaccct

SEQ ID NO: 4941799 - DNA, 12 bp, Homo sapiens
ttccttaagtat

SEQ ID NO: 4941800 - DNA, 20 bp, Homo sapiens
ttccttccatccctaccccc

SEQ ID NO: 4941801 - DNA, 17 bp, Homo sapiens
ttccttcctaaaataat

SEQ ID NO: 4941802 - DNA, 13 bp, Homo sapiens
ttccttctggcct

SEQ ID NO: 4941803 - DNA, 20 bp, Homo sapiens
ttccttctgtgaaagtacat

SEQ ID NO: 4941804 - DNA, 12 bp, Homo sapiens
ttccttctttga

SEQ ID NO: 4941805 - DNA, 18 bp, Homo sapiens
ttccttgaccttcctctg

SEQ ID NO: 4941806 - DNA, 16 bp, Homo sapiens
ttccttgtcactggta

SEQ ID NO: 4941807 - DNA, 21 bp, Homo sapiens
ttccttgtttatcagatacat

SEQ ID NO: 4941808 - DNA, 17 bp, Homo sapiens
ttcctttaaaaaaattt

SEQ ID NO: 4941809 - DNA, 13 bp, Homo sapiens
ttcctttactttc

SEQ ID NO: 4941810 - DNA, 20 bp, Homo sapiens
ttcctttactttcccttgct

SEQ ID NO: 4941811 - DNA, 14 bp, Homo sapiens
ttcctttcccaagc

SEQ ID NO: 4941812 - DNA, 14 bp, Homo sapiens
ttcctttccccagc

SEQ ID NO: 4941813 - DNA, 12 bp, Homo sapiens
ttcctttccctt

SEQ ID NO: 4941814 - DNA, 15 bp, Homo sapiens
ttcctttcccttcct

SEQ ID NO: 4941815 - DNA, 19 bp, Homo sapiens
ttcctttctccaggaccaa

SEQ ID NO: 4941816 - DNA, 16 bp, Homo sapiens
ttcctttgtcttcaaa

SEQ ID NO: 4941817 - DNA, 21 bp, Homo sapiens
ttccttttctattccttctgg

SEQ ID NO: 4941818 - DNA, 18 bp, Homo sapiens
ttcctttttatgaggcaa

SEQ ID NO: 4941819 - DNA, 15 bp, Homo sapiens
ttcctttttctgatt

SEQ ID NO: 4941820 - DNA, 20 bp, Homo sapiens
ttcgatacaccgggcctgga

SEQ ID NO: 4941821 - DNA, 16 bp, Homo sapiens
ttcgatgaaggctgcc

SEQ ID NO: 4941822 - DNA, 16 bp, Homo sapiens
ttcgcatggtcacaca

SEQ ID NO: 4941823 - DNA, 13 bp, Homo sapiens
ttcgctcctgtgt

SEQ ID NO: 4941824 - DNA, 17 bp, Homo sapiens
ttcgcttggctccatgc

SEQ ID NO: 4941825 - DNA, 19 bp, Homo sapiens
ttcgtagctttcccaaata

SEQ ID NO: 4941826 - DNA, 13 bp, Homo sapiens
ttcgtatgaaaat

SEQ ID NO: 4941827 - DNA, 13 bp, Homo sapiens
ttcgtcttctaat

SEQ ID NO: 4941828 - DNA, 13 bp, Homo sapiens
ttctaaaaaacag

SEQ ID NO: 4941829 - DNA, 17 bp, Homo sapiens
ttctaaaaagattagca

SEQ ID NO: 4941830 - DNA, 13 bp, Homo sapiens
ttctaaaagaata

SEQ ID NO: 4941831 - DNA, 14 bp, Homo sapiens
ttctaaaagaatat

SEQ ID NO: 4941832 - DNA, 15 bp, Homo sapiens
ttctaaaatgtgatg

SEQ ID NO: 4941833 - DNA, 20 bp, Homo sapiens
ttctaaaatgtgatgttcta

SEQ ID NO: 4941834 - DNA, 18 bp, Homo sapiens
ttctaaacccaatccaaa

SEQ ID NO: 4941835 - DNA, 20 bp, Homo sapiens
ttctaaagagcacttactgt

SEQ ID NO: 4941836 - DNA, 18 bp, Homo sapiens
ttgatatgagtatacaat

SEQ ID NO: 4941837 - DNA, 14 bp, Homo sapiens
ttgatcacactatt

SEQ ID NO: 4941838 - DNA, 17 bp, Homo sapiens
ttgatcatttcttgtga

SEQ ID NO: 4941839 - DNA, 19 bp, Homo sapiens
ttgatgaaaagatttaagc

SEQ ID NO: 4941840 - DNA, 14 bp, Homo sapiens
ttgatgcacagaga

SEQ ID NO: 4941841 - DNA, 15 bp, Homo sapiens
ttgatgccaggacac

SEQ ID NO: 4941842 - DNA, 15 bp, Homo sapiens
ttgatgtgacaataa

SEQ ID NO: 4941843 - DNA, 20 bp, Homo sapiens
ttgatgtgtttatttataga

SEQ ID NO: 4941844 - DNA, 15 bp, Homo sapiens
ttgatgttacagatt

SEQ ID NO: 4941845 - DNA, 16 bp, Homo sapiens
ttgatgtttgtggcct

SEQ ID NO: 4941846 - DNA, 18 bp, Homo sapiens
ttgatgtttgtggcctca

SEQ ID NO: 4941847 - DNA, 20 bp, Homo sapiens
ttgatgtttgtggcctcaga

SEQ ID NO: 4941848 - DNA, 14 bp, Homo sapiens
ttgattaacaaata

SEQ ID NO: 4941849 - DNA, 12 bp, Homo sapiens
ttgattcttcct

SEQ ID NO: 4941850 - DNA, 17 bp, Homo sapiens
ttgatttaaacacacag

SEQ ID NO: 4941851 - DNA, 13 bp, Homo sapiens
ttgatttgaagaa

SEQ ID NO: 4941852 - DNA, 14 bp, Homo sapiens
ttgatttgaagaac

SEQ ID NO: 4941853 - DNA, 18 bp, Homo sapiens
ttgatttgaagaacatgt

SEQ ID NO: 4941854 - DNA, 13 bp, Homo sapiens
ttgatttgcattg

SEQ ID NO: 4941855 - DNA, 15 bp, Homo sapiens
ttgatttttgtctca

SEQ ID NO: 4941856 - DNA, 12 bp, Homo sapiens
ttgcaaatagtc

SEQ ID NO: 4941857 - DNA, 12 bp, Homo sapiens
ttgcaaatataa

SEQ ID NO: 4941858 - DNA, 16 bp, Homo sapiens
ttgcaaatataaacat

SEQ ID NO: 4941859 - DNA, 15 bp, Homo sapiens
ttgcaaatcttgaaa

SEQ ID NO: 4941860 - DNA, 14 bp, Homo sapiens
ttgcaacgtttaca

SEQ ID NO: 4941861 - DNA, 22 bp, Homo sapiens
ttgcaatatctgaagccctccc

SEQ ID NO: 4941862 - DNA, 16 bp, Homo sapiens
ttgcaatggcagcctt

SEQ ID NO: 4941863 - DNA, 17 bp, Homo sapiens
ttgcaatggcagccttg

SEQ ID NO: 4941864 - DNA, 19 bp, Homo sapiens
ttgcaatggcagccttggc

SEQ ID NO: 4941865 - DNA, 18 bp, Homo sapiens
ttgcacacactcagtgca

SEQ ID NO: 4941866 - DNA, 16 bp, Homo sapiens
ttgcacattttgattt

SEQ ID NO: 4941867 - DNA, 16 bp, Homo sapiens
ttgcacgacgccctct

SEQ ID NO: 4941868 - DNA, 20 bp, Homo sapiens
ttgcacgacgccctctcccc

SEQ ID NO: 4941869 - DNA, 15 bp, Homo sapiens
ttgcactaaagtatg

SEQ ID NO: 4941870 - DNA, 11 bp, Homo sapiens
ttgcagaactg

SEQ ID NO: 4941871 - DNA, 14 bp, Homo sapiens
ttgcagaactgcca

SEQ ID NO: 4941872 - DNA, 16 bp, Homo sapiens
ttgcagacaggcaagc

SEQ ID NO: 4941873 - DNA, 17 bp, Homo sapiens
ttgcagtcatcagaagt

SEQ ID NO: 4941874 - DNA, 13 bp, Homo sapiens
ttgcagttcacct

SEQ ID NO: 4941875 - DNA, 16 bp, Homo sapiens
ttgcatactgagccaa

SEQ ID NO: 4941876 - DNA, 13 bp, Homo sapiens
ttgcatattcatt

SEQ ID NO: 4941877 - DNA, 21 bp, Homo sapiens
ttgcatcagtattaatactaa

SEQ ID NO: 4941878 - DNA, 21 bp, Homo sapiens
ttgcatccttcctataacttg

SEQ ID NO: 4941879 - DNA, 20 bp, Homo sapiens
ttgcatctaggtaattttta

SEQ ID NO: 4941880 - DNA, 17 bp, Homo sapiens
ttgcatctcaaaattat

SEQ ID NO: 4941881 - DNA, 17 bp, Homo sapiens
ttgcatctgaaatagga

SEQ ID NO: 4941882 - DNA, 16 bp, Homo sapiens
ttgcatgaagagaagc

SEQ ID NO: 4941883 - DNA, 22 bp, Homo sapiens
ttgcattaaattcacaaacttt

SEQ ID NO: 4941884 - DNA, 17 bp, Homo sapiens
ttgcattattcatttag

SEQ ID NO: 4941885 - DNA, 12 bp, Homo sapiens
ttgcattctatt

SEQ ID NO: 4941886 - DNA, 14 bp, Homo sapiens
ttgcattgaacaca

SEQ ID NO: 4941887 - DNA, 15 bp, Homo sapiens
ttgcattgaacacaa

SEQ ID NO: 4941888 - DNA, 22 bp, Homo sapiens
ttgcattgaacacaaactgtaa

SEQ ID NO: 4941889 - DNA, 15 bp, Homo sapiens
ttgcatttgctcttt

SEQ ID NO: 4941890 - DNA, 16 bp, Homo sapiens
ttgccaagacaaatca

SEQ ID NO: 4941891 - DNA, 22 bp, Homo sapiens
ttgccaagacaaatcaacagaa

SEQ ID NO: 4941892 - DNA, 22 bp, Homo sapiens
ttgccacagctggagctctcaa

SEQ ID NO: 4941893 - DNA, 13 bp, Homo sapiens
ttgccaccaggag

SEQ ID NO: 4941894 - DNA, 17 bp, Homo sapiens
ttgccaccccaccctcc

SEQ ID NO: 4941895 - DNA, 18 bp, Homo sapiens
ttgccaccccaccctccc

SEQ ID NO: 4941896 - DNA, 22 bp, Homo sapiens
ttgccaccccaccctccctgga

SEQ ID NO: 4941897 - DNA, 18 bp, Homo sapiens
ttgccactgcctcttcct

SEQ ID NO: 4941898 - DNA, 15 bp, Homo sapiens
ttgccactttgcacg

SEQ ID NO: 4941899 - DNA, 20 bp, Homo sapiens
ttgccatggagttgtgatca

SEQ ID NO: 4941900 - DNA, 21 bp, Homo sapiens
ttgccatgggcttcactgtat

SEQ ID NO: 4941901 - DNA, 19 bp, Homo sapiens
ttgccatgttggccaggct

SEQ ID NO: 4941902 - DNA, 17 bp, Homo sapiens
ttgccattggacagttg

SEQ ID NO: 4941903 - DNA, 21 bp, Homo sapiens
ttgccatttgatacccctggg

SEQ ID NO: 4941904 - DNA, 11 bp, Homo sapiens
ttgcccaggca

SEQ ID NO: 4941905 - DNA, 14 bp, Homo sapiens
ttgcccaggcaggt

SEQ ID NO: 4941906 - DNA, 12 bp, Homo sapiens
ttgcccaggctg

SEQ ID NO: 4941907 - DNA, 23 bp, Homo sapiens
ttgcccaggctggcgtgcagtgg

SEQ ID NO: 4941908 - DNA, 21 bp, Homo sapiens
ttgcccccgtgagccaatccc

SEQ ID NO: 4941909 - DNA, 16 bp, Homo sapiens
ttgccctagatagttt

SEQ ID NO: 4941910 - DNA, 15 bp, Homo sapiens
ttgccctagatgagc

SEQ ID NO: 4941911 - DNA, 17 bp, Homo sapiens
ttgccgaggagccaggc

SEQ ID NO: 4941912 - DNA, 19 bp, Homo sapiens
ttgcctaagcattgcctgg

SEQ ID NO: 4941913 - DNA, 20 bp, Homo sapiens
ttgcctaagtattaaaacat

SEQ ID NO: 4941914 - DNA, 19 bp, Homo sapiens
ttgcctcctgtgtactgtg

SEQ ID NO: 4941915 - DNA, 20 bp, Homo sapiens
ttgccttcctttctccagga

SEQ ID NO: 4941916 - DNA, 15 bp, Homo sapiens
ttgccttgcagaact

SEQ ID NO: 4941917 - DNA, 20 bp, Homo sapiens
ttgccttgggctgctcctca

SEQ ID NO: 4941918 - DNA, 18 bp, Homo sapiens
ttgcgtggactctgcaca

SEQ ID NO: 4941919 - DNA, 21 bp, Homo sapiens
ttgctaatcaaagccagggtc

SEQ ID NO: 4941920 - DNA, 22 bp, Homo sapiens
ttgctaatcaaagccagggtct

SEQ ID NO: 4941921 - DNA, 16 bp, Homo sapiens
ttgctaattaaaaagt

SEQ ID NO: 4941922 - DNA, 23 bp, Homo sapiens
ttgctaattttctcaaaagcatt

SEQ ID NO: 4941923 - DNA, 19 bp, Homo sapiens
ttgctagaatgggaagggt

SEQ ID NO: 4941924 - DNA, 22 bp, Homo sapiens
ttgctatctggaggccttccag

SEQ ID NO: 4941925 - DNA, 18 bp, Homo sapiens
ttgctatgttactatttt

SEQ ID NO: 4941926 - DNA, 21 bp, Homo sapiens
ttgctatgttactattttcta

SEQ ID NO: 4941927 - DNA, 23 bp, Homo sapiens
ttgctatgttactattttctaca

SEQ ID NO: 4941928 - DNA, 14 bp, Homo sapiens
ttgctattagagca

SEQ ID NO: 4941929 - DNA, 14 bp, Homo sapiens
ttgctgagcctctg

SEQ ID NO: 4941930 - DNA, 15 bp, Homo sapiens
ttgctgagcctctgc

SEQ ID NO: 4941931 - DNA, 24 bp, Homo sapiens
ttgctgagctgtttatagagaatg

SEQ ID NO: 4941932 - DNA, 17 bp, Homo sapiens
ttgctgatttcccctct

SEQ ID NO: 4941933 - DNA, 14 bp, Homo sapiens
ttgctgctagaact

SEQ ID NO: 4941934 - DNA, 18 bp, Homo sapiens
ttgctgctagaacttttt

SEQ ID NO: 4941935 - DNA, 12 bp, Homo sapiens
ttgctgtctctg

SEQ ID NO: 4941936 - DNA, 14 bp, Homo sapiens
ttgctgtctctgct

SEQ ID NO: 4941937 - DNA, 18 bp, Homo sapiens
ttgctgtgaacaattgtc

SEQ ID NO: 4941938 - DNA, 15 bp, Homo sapiens
ttgctgtgtttaatt

SEQ ID NO: 4941939 - DNA, 21 bp, Homo sapiens
ttgctgtgtttaatttgactt

SEQ ID NO: 4941940 - DNA, 22 bp, Homo sapiens
ttgctgttatgtctgtttaaga

SEQ ID NO: 4941941 - DNA, 12 bp, Homo sapiens
ttgcttagtaaa

SEQ ID NO: 4941942 - DNA, 14 bp, Homo sapiens
ttgcttcataaatg

SEQ ID NO: 4941943 - DNA, 15 bp, Homo sapiens
ttgcttcataaatga

SEQ ID NO: 4941944 - DNA, 14 bp, Homo sapiens
ttgcttcctcctcc

SEQ ID NO: 4941945 - DNA, 15 bp, Homo sapiens
ttgcttcctcctccc

SEQ ID NO: 4941946 - DNA, 21 bp, Homo sapiens
tttagctgatgaacttattct

SEQ ID NO: 4941947 - DNA, 23 bp, Homo sapiens
tttagctgatgaacttattctgt

SEQ ID NO: 4941948 - DNA, 15 bp, Homo sapiens
tttaggaacttcaga

SEQ ID NO: 4941949 - DNA, 22 bp, Homo sapiens
tttaggcactcttaaatgatct

SEQ ID NO: 4941950 - DNA, 16 bp, Homo sapiens
tttagggtaaaaattg

SEQ ID NO: 4941951 - DNA, 22 bp, Homo sapiens
tttaggtgaattaattaaacat

SEQ ID NO: 4941952 - DNA, 12 bp, Homo sapiens
tttaggttctaa

SEQ ID NO: 4941953 - DNA, 13 bp, Homo sapiens
tttaggttctaaa

SEQ ID NO: 4941954 - DNA, 18 bp, Homo sapiens
tttaggttctaaagttct

SEQ ID NO: 4941955 - DNA, 23 bp, Homo sapiens
tttaggttctttgctgcattctg

SEQ ID NO: 4941956 - DNA, 17 bp, Homo sapiens
tttagtaatctgtacat

SEQ ID NO: 4941957 - DNA, 21 bp, Homo sapiens
tttagtacctgaaaagtaact

SEQ ID NO: 4941958 - DNA, 22 bp, Homo sapiens
tttagtatcagtgttttaaatt

SEQ ID NO: 4941959 - DNA, 20 bp, Homo sapiens
tttagtatgacgctgataca

SEQ ID NO: 4941960 - DNA, 16 bp, Homo sapiens
tttagtgtaataagac

SEQ ID NO: 4941961 - DNA, 15 bp, Homo sapiens
tttagttatagtttc

SEQ ID NO: 4941962 - DNA, 14 bp, Homo sapiens
tttagtttactcaa

SEQ ID NO: 4941963 - DNA, 13 bp, Homo sapiens
tttagttttctct

SEQ ID NO: 4941964 - DNA, 22 bp, Homo sapiens
tttataaaattagaaagcaact

SEQ ID NO: 4941965 - DNA, 17 bp, Homo sapiens
tttataaaattttgctt

SEQ ID NO: 4941966 - DNA, 17 bp, Homo sapiens
tttataagcaaatttca

SEQ ID NO: 4941967 - DNA, 22 bp, Homo sapiens
tttataagccagtgttgcctaa

SEQ ID NO: 4941968 - DNA, 19 bp, Homo sapiens
tttataagtcattgtatgt

SEQ ID NO: 4941969 - DNA, 12 bp, Homo sapiens
tttatacaaaat

SEQ ID NO: 4941970 - DNA, 16 bp, Homo sapiens
tttatacattagtaaa

SEQ ID NO: 4941971 - DNA, 19 bp, Homo sapiens
tttatactccagtgtacat

SEQ ID NO: 4941972 - DNA, 18 bp, Homo sapiens
tttatactctttctgtat

SEQ ID NO: 4941973 - DNA, 20 bp, Homo sapiens
tttatactctttctgtatat

SEQ ID NO: 4941974 - DNA, 20 bp, Homo sapiens
tttatactgattatgtcttt

SEQ ID NO: 4941975 - DNA, 19 bp, Homo sapiens
tttatagtgcacaaaatga

SEQ ID NO: 4941976 - DNA, 17 bp, Homo sapiens
tttatagtttgtacatg

SEQ ID NO: 4941977 - DNA, 15 bp, Homo sapiens
tttatatatggacat

SEQ ID NO: 4941978 - DNA, 21 bp, Homo sapiens
tttatatgtaccgtaggcttt

SEQ ID NO: 4941979 - DNA, 14 bp, Homo sapiens
tttatattaatgta

SEQ ID NO: 4941980 - DNA, 18 bp, Homo sapiens
tttatatttaattattaa

SEQ ID NO: 4941981 - DNA, 22 bp, Homo sapiens
tttatcaaacagaattttaaag

SEQ ID NO: 4941982 - DNA, 22 bp, Homo sapiens
tttatcaaagcatagatgtttt

SEQ ID NO: 4941983 - DNA, 22 bp, Homo sapiens
tttatcacaaccaccgttacaa

SEQ ID NO: 4941984 - DNA, 20 bp, Homo sapiens
tttatcagatacatcactgc

SEQ ID NO: 4941985 - DNA, 15 bp, Homo sapiens
tttatcatgaagcct

SEQ ID NO: 4941986 - DNA, 16 bp, Homo sapiens
tttatcatgaagcctg

SEQ ID NO: 4941987 - DNA, 23 bp, Homo sapiens
tttatcatgacatgttatatatt

SEQ ID NO: 4941988 - DNA, 22 bp, Homo sapiens
tttatctacccaagggcagaaa

SEQ ID NO: 4941989 - DNA, 13 bp, Homo sapiens
tttatctgattaa

SEQ ID NO: 4941990 - DNA, 18 bp, Homo sapiens
tttatgaaaataaatagc

SEQ ID NO: 4941991 - DNA, 20 bp, Homo sapiens
tttatgaatgaaaaaacagt

SEQ ID NO: 4941992 - DNA, 20 bp, Homo sapiens
tttatgagatgctggttttc

SEQ ID NO: 4941993 - DNA, 18 bp, Homo sapiens
tttatgagtaactattat

SEQ ID NO: 4941994 - DNA, 22 bp, Homo sapiens
tttatgagtaactattattata

SEQ ID NO: 4941995 - DNA, 12 bp, Homo sapiens
tttatgatttaa

SEQ ID NO: 4941996 - DNA, 14 bp, Homo sapiens
tttatgattttcat

SEQ ID NO: 4941997 - DNA, 19 bp, Homo sapiens
tttatgattttcataactt

SEQ ID NO: 4941998 - DNA, 22 bp, Homo sapiens
tttatgattttcataacttatt

SEQ ID NO: 4941999 - DNA, 18 bp, Homo sapiens
tttatgcaaggaaggaaa

SEQ ID NO: 4942000 - DNA, 12 bp, Homo sapiens
tttatggcctca

SEQ ID NO: 4942001 - DNA, 13 bp, Homo sapiens
tttatggcctcag

SEQ ID NO: 4942002 - DNA, 21 bp, Homo sapiens
tttatggtcctaaaagcaaaa

SEQ ID NO: 4942003 - DNA, 21 bp, Homo sapiens
tttatggtttcccccttctac

SEQ ID NO: 4942004 - DNA, 13 bp, Homo sapiens
tttatgtaatgaa

SEQ ID NO: 4942005 - DNA, 19 bp, Homo sapiens
tttatgtaatgaagtaaag

SEQ ID NO: 4942006 - DNA, 14 bp, Homo sapiens
tttatgtagcacat

SEQ ID NO: 4942007 - DNA, 22 bp, Homo sapiens
tttatgtgtgaggagctgctgg

SEQ ID NO: 4942008 - DNA, 17 bp, Homo sapiens
tttatgttaaaagattt

SEQ ID NO: 4942009 - DNA, 13 bp, Homo sapiens
tttatgtttgaat

SEQ ID NO: 4942010 - DNA, 23 bp, Homo sapiens
tttatgtttgcacttgtgattat

SEQ ID NO: 4942011 - DNA, 22 bp, Homo sapiens
tttattaaaatgattgtaaaat

SEQ ID NO: 4942012 - DNA, 16 bp, Homo sapiens
tttattatttatttat

SEQ ID NO: 4942013 - DNA, 13 bp, Homo sapiens
tttattatttcta

SEQ ID NO: 4942014 - DNA, 21 bp, Homo sapiens
tttattcagcttcatttgtgt

SEQ ID NO: 4942015 - DNA, 22 bp, Homo sapiens
tttattcattggtctaatttat

SEQ ID NO: 4942016 - DNA, 14 bp, Homo sapiens
tttattcttctaga

SEQ ID NO: 4942017 - DNA, 12 bp, Homo sapiens
tttattgacaca

SEQ ID NO: 4942018 - DNA, 17 bp, Homo sapiens
tttattgctagtatttg

SEQ ID NO: 4942019 - DNA, 20 bp, Homo sapiens
tttattgctagtatttgaat

SEQ ID NO: 4942020 - DNA, 14 bp, Homo sapiens
tttatttaaagcat

SEQ ID NO: 4942021 - DNA, 13 bp, Homo sapiens
tttatttatgaag

SEQ ID NO: 4942022 - DNA, 15 bp, Homo sapiens
tttatttatgtactt

SEQ ID NO: 4942023 - DNA, 13 bp, Homo sapiens
tttattttacaca

SEQ ID NO: 4942024 - DNA, 10 bp, Homo sapiens
tttattttct

SEQ ID NO: 4942025 - DNA, 16 bp, Homo sapiens
tttattttcttttgaa

SEQ ID NO: 4942026 - DNA, 22 bp, Homo sapiens
tttattttgtgctcatttaagt

SEQ ID NO: 4942027 - DNA, 23 bp, Homo sapiens
tttatttttacaagaagtttatt

SEQ ID NO: 4942028 - DNA, 16 bp, Homo sapiens
tttatttttcatattg

SEQ ID NO: 4942029 - DNA, 15 bp, Homo sapiens
tttatttttttaagt

SEQ ID NO: 4942030 - DNA, 13 bp, Homo sapiens
tttcaaaaacatt

SEQ ID NO: 4942031 - DNA, 17 bp, Homo sapiens
tttcaaaaatataactt

SEQ ID NO: 4942032 - DNA, 13 bp, Homo sapiens
tttcaaaagacat

SEQ ID NO: 4942033 - DNA, 12 bp, Homo sapiens
tttcaaaagcat

SEQ ID NO: 4942034 - DNA, 21 bp, Homo sapiens
tttcaaaatccaaaaagaaat

SEQ ID NO: 4942035 - DNA, 16 bp, Homo sapiens
tttcaaacttactatt

SEQ ID NO: 4942036 - DNA, 14 bp, Homo sapiens
tttcaaagatgctg

SEQ ID NO: 4942037 - DNA, 19 bp, Homo sapiens
tttcaaagatgctgtgagt

SEQ ID NO: 4942038 - DNA, 21 bp, Homo sapiens
tttcaaattggactttcaaaa

SEQ ID NO: 4942039 - DNA, 20 bp, Homo sapiens
tttcaaccagataacatacc

SEQ ID NO: 4942040 - DNA, 21 bp, Homo sapiens
tttcaacgcagccctgctttg

SEQ ID NO: 4942041 - DNA, 17 bp, Homo sapiens
tttcaagaaactgagga

SEQ ID NO: 4942042 - DNA, 17 bp, Homo sapiens
tttcaaggcactctaga

SEQ ID NO: 4942043 - DNA, 19 bp, Homo sapiens
tttcaaggcactctagatt

SEQ ID NO: 4942044 - DNA, 20 bp, Homo sapiens
tttcaaggcactctagattc

SEQ ID NO: 4942045 - DNA, 21 bp, Homo sapiens
tttcaaggcactctagattcc

SEQ ID NO: 4942046 - DNA, 14 bp, Homo sapiens
tttcaaggttctaa

SEQ ID NO: 4942047 - DNA, 13 bp, Homo sapiens
tttcaatgtgatt

SEQ ID NO: 4942048 - DNA, 20 bp, Homo sapiens
tttcaatgtgattctaatgt

SEQ ID NO: 4942049 - DNA, 23 bp, Homo sapiens
tttcaattaatattaattttcta

SEQ ID NO: 4942050 - DNA, 14 bp, Homo sapiens
tttcaattctcaaa

SEQ ID NO: 4942051 - DNA, 21 bp, Homo sapiens
tttcacccttaacccaaggag

SEQ ID NO: 4942052 - DNA, 18 bp, Homo sapiens
tttcactgctggctgcct

SEQ ID NO: 4942053 - DNA, 20 bp, Homo sapiens
tttcactgctggctgcctta

SEQ ID NO: 4942054 - DNA, 22 bp, Homo sapiens
tttcactgctggctgccttaga

SEQ ID NO: 4942055 - DNA, 20 bp, Homo sapiens
ttttattgtataaactatca

SEQ ID NO: 4942056 - DNA, 15 bp, Homo sapiens
ttttatttatgaagt

SEQ ID NO: 4942057 - DNA, 23 bp, Homo sapiens
ttttatttcagattttgataact

SEQ ID NO: 4942058 - DNA, 14 bp, Homo sapiens
ttttatttccatca

SEQ ID NO: 4942059 - DNA, 14 bp, Homo sapiens
ttttattttgtttt

SEQ ID NO: 4942060 - DNA, 22 bp, Homo sapiens
ttttcaacaaatatcttgtgtt

SEQ ID NO: 4942061 - DNA, 21 bp, Homo sapiens
ttttcaacgcagccctgcttt

SEQ ID NO: 4942062 - DNA, 14 bp, Homo sapiens
ttttcaagaaactg

SEQ ID NO: 4942063 - DNA, 15 bp, Homo sapiens
ttttcaagaaactga

SEQ ID NO: 4942064 - DNA, 17 bp, Homo sapiens
ttttcacaatgtcagta

SEQ ID NO: 4942065 - DNA, 15 bp, Homo sapiens
ttttcagaaaatatt

SEQ ID NO: 4942066 - DNA, 17 bp, Homo sapiens
ttttcagaacctcttcc

SEQ ID NO: 4942067 - DNA, 16 bp, Homo sapiens
ttttcagttgtttgtt

SEQ ID NO: 4942068 - DNA, 22 bp, Homo sapiens
ttttcagttgtttgtttttgct

SEQ ID NO: 4942069 - DNA, 21 bp, Homo sapiens
ttttcataacttattgctgat

SEQ ID NO: 4942070 - DNA, 23 bp, Homo sapiens
ttttcccagactactattttctt

SEQ ID NO: 4942071 - DNA, 19 bp, Homo sapiens
ttttcccctcttttgttaa

SEQ ID NO: 4942072 - DNA, 22 bp, Homo sapiens
ttttccctctttggctcccctg

SEQ ID NO: 4942073 - DNA, 13 bp, Homo sapiens
ttttcctttgtgg

SEQ ID NO: 4942074 - DNA, 19 bp, Homo sapiens
ttttcgtatgaaaatgagt

SEQ ID NO: 4942075 - DNA, 19 bp, Homo sapiens
ttttctaagcaatttcttg

SEQ ID NO: 4942076 - DNA, 21 bp, Homo sapiens
ttttctaagcaatttcttgct

SEQ ID NO: 4942077 - DNA, 16 bp, Homo sapiens
ttttctagtttgctca

SEQ ID NO: 4942078 - DNA, 23 bp, Homo sapiens
ttttctagtttgctcatactaca

SEQ ID NO: 4942079 - DNA, 12 bp, Homo sapiens
ttttctatgtac

SEQ ID NO: 4942080 - DNA, 18 bp, Homo sapiens
ttttctatgtactagtac

SEQ ID NO: 4942081 - DNA, 21 bp, Homo sapiens
ttttctatgtactagtactgt

SEQ ID NO: 4942082 - DNA, 19 bp, Homo sapiens
ttttctattccttctggcc

SEQ ID NO: 4942083 - DNA, 17 bp, Homo sapiens
ttttctatttatgcctt

SEQ ID NO: 4942084 - DNA, 22 bp, Homo sapiens
ttttctcaaaagcatttatcat

SEQ ID NO: 4942085 - DNA, 20 bp, Homo sapiens
ttttctcaaagttttgaaaa

SEQ ID NO: 4942086 - DNA, 11 bp, Homo sapiens
ttttctgatta

SEQ ID NO: 4942087 - DNA, 18 bp, Homo sapiens
ttttctgattagctttgt

SEQ ID NO: 4942088 - DNA, 15 bp, Homo sapiens
ttttctggttctaac

SEQ ID NO: 4942089 - DNA, 14 bp, Homo sapiens
ttttctgtagtcat

SEQ ID NO: 4942090 - DNA, 18 bp, Homo sapiens
ttttctgtagtcatttac

SEQ ID NO: 4942091 - DNA, 20 bp, Homo sapiens
ttttctgtcagatgagaaca

SEQ ID NO: 4942092 - DNA, 13 bp, Homo sapiens
ttttctgttgtaa

SEQ ID NO: 4942093 - DNA, 17 bp, Homo sapiens
ttttcttactcctcctc

SEQ ID NO: 4942094 - DNA, 19 bp, Homo sapiens
ttttcttggcaaaagcctt

SEQ ID NO: 4942095 - DNA, 24 bp, Homo sapiens
ttttcttggcaaaagccttgtgta

SEQ ID NO: 4942096 - DNA, 15 bp, Homo sapiens
ttttcttttgttact

SEQ ID NO: 4942097 - DNA, 20 bp, Homo sapiens
ttttcttttgttactgttct

SEQ ID NO: 4942098 - DNA, 16 bp, Homo sapiens
ttttgaaaaaagctca

SEQ ID NO: 4942099 - DNA, 16 bp, Homo sapiens
ttttgaaaagctatta

SEQ ID NO: 4942100 - DNA, 23 bp, Homo sapiens
ttttgaaaagctattagccagga

SEQ ID NO: 4942101 - DNA, 16 bp, Homo sapiens
ttttgaaatgaaattt

SEQ ID NO: 4942102 - DNA, 18 bp, Homo sapiens
ttttgaactaagaaactt

SEQ ID NO: 4942103 - DNA, 23 bp, Homo sapiens
ttttgaactaagaaacttttgta

SEQ ID NO: 4942104 - DNA, 21 bp, Homo sapiens
ttttgaataccattaaaactg

SEQ ID NO: 4942105 - DNA, 19 bp, Homo sapiens
ttttgacagtgttgaaaat

SEQ ID NO: 4942106 - DNA, 15 bp, Homo sapiens
ttttgacttaatgtg

SEQ ID NO: 4942107 - DNA, 16 bp, Homo sapiens
ttttgaggcttctgtt

SEQ ID NO: 4942108 - DNA, 23 bp, Homo sapiens
ttttgaggtaaagatatggagaa

SEQ ID NO: 4942109 - DNA, 18 bp, Homo sapiens
ttttgagtgtgtgtgtgc

SEQ ID NO: 4942110 - DNA, 14 bp, Homo sapiens
ttttgagttctaca

SEQ ID NO: 4942111 - DNA, 13 bp, Homo sapiens
ttttgataacaat

SEQ ID NO: 4942112 - DNA, 20 bp, Homo sapiens
ttttgataataatattgttt

SEQ ID NO: 4942113 - DNA, 21 bp, Homo sapiens
ttttgatgcagcatttgataa

SEQ ID NO: 4942114 - DNA, 12 bp, Homo sapiens
ttttgattatgt

SEQ ID NO: 4942115 - DNA, 15 bp, Homo sapiens
ttttgatttatgcat

SEQ ID NO: 4942116 - DNA, 20 bp, Homo sapiens
ttttgatttgtactgaaaaa

SEQ ID NO: 4942117 - DNA, 13 bp, Homo sapiens
ttttgcaaatata

SEQ ID NO: 4942118 - DNA, 17 bp, Homo sapiens
ttttgcaatggctatat

SEQ ID NO: 4942119 - DNA, 12 bp, Homo sapiens
ttttgcactttt

SEQ ID NO: 4942120 - DNA, 15 bp, Homo sapiens
ttttgcctcttttct

SEQ ID NO: 4942121 - DNA, 20 bp, Homo sapiens
ttttggaagattttcagtct

SEQ ID NO: 4942122 - DNA, 17 bp, Homo sapiens
ttttggatcttgaatgt

SEQ ID NO: 4942123 - DNA, 17 bp, Homo sapiens
ttttgggacaattgttt

SEQ ID NO: 4942124 - DNA, 18 bp, Homo sapiens
ttttgggggtcaggcagc

SEQ ID NO: 4942125 - DNA, 16 bp, Homo sapiens
ttttggtagattaaat

SEQ ID NO: 4942126 - DNA, 15 bp, Homo sapiens
ttttggtctgtgtga

SEQ ID NO: 4942127 - DNA, 19 bp, Homo sapiens
ttttgtaaacgacaagaat

SEQ ID NO: 4942128 - DNA, 18 bp, Homo sapiens
ttttgtaaactcaaaata

SEQ ID NO: 4942129 - DNA, 21 bp, Homo sapiens
ttttgtaaactggaattaaaa

SEQ ID NO: 4942130 - DNA, 13 bp, Homo sapiens
ttttgtaaattaa

SEQ ID NO: 4942131 - DNA, 14 bp, Homo sapiens
ttttgtaattgctt

SEQ ID NO: 4942132 - DNA, 12 bp, Homo sapiens
ttttgtacatct

SEQ ID NO: 4942133 - DNA, 18 bp, Homo sapiens
ttttgtacatctggctta

SEQ ID NO: 4942134 - DNA, 19 bp, Homo sapiens
ttttgtatacaaatatatt

SEQ ID NO: 4942135 - DNA, 14 bp, Homo sapiens
ttttgtcttttatg

SEQ ID NO: 4942136 - DNA, 18 bp, Homo sapiens
ttttgtgaaaatgtcaaa

SEQ ID NO: 4942137 - DNA, 19 bp, Homo sapiens
ttttgtgaatggattggat

SEQ ID NO: 4942138 - DNA, 23 bp, Homo sapiens
ttttgtgaatggattggattatt

SEQ ID NO: 4942139 - DNA, 16 bp, Homo sapiens
ttttgtgatttagaac

SEQ ID NO: 4942140 - DNA, 22 bp, Homo sapiens
ttttgtgcaaaagcttcaaatt

SEQ ID NO: 4942141 - DNA, 13 bp, Homo sapiens
ttttgtgcatttg

SEQ ID NO: 4942142 - DNA, 20 bp, Homo sapiens
ttttgtgtgaccaactgtgt

SEQ ID NO: 4942143 - DNA, 16 bp, Homo sapiens
ttttgttaactgattt

SEQ ID NO: 4942144 - DNA, 10 bp, Homo sapiens
ttttgttact

SEQ ID NO: 4942145 - DNA, 12 bp, Homo sapiens
ttttgttactgt

SEQ ID NO: 4942146 - DNA, 13 bp, Homo sapiens
ttttgttactgtt

SEQ ID NO: 4942147 - DNA, 18 bp, Homo sapiens
ttttgttactgttcttgc

SEQ ID NO: 4942148 - DNA, 23 bp, Homo sapiens
ttttgttactgttcttgctgcta

SEQ ID NO: 4942149 - DNA, 16 bp, Homo sapiens
ttttgttgtaaaaaga

SEQ ID NO: 4942150 - DNA, 13 bp, Homo sapiens
ttttgttgtgtgt

SEQ ID NO: 4942151 - DNA, 12 bp, Homo sapiens
ttttgtttgtct

SEQ ID NO: 4942152 - DNA, 20 bp, Homo sapiens
ttttgtttgtctctcctttt

SEQ ID NO: 4942153 - DNA, 16 bp, Homo sapiens
ttttgttttacaatgt

SEQ ID NO: 4942154 - DNA, 15 bp, Homo sapiens
tttttaaaaaaagaa

SEQ ID NO: 4942155 - DNA, 19 bp, Homo sapiens
tttttaaaatggtgcttaa

SEQ ID NO: 4942156 - DNA, 11 bp, Homo sapiens
tttttaaataa

SEQ ID NO: 4942157 - DNA, 23 bp, Homo sapiens
tttttaaataaactttttttcaa

SEQ ID NO: 4942158 - DNA, 21 bp, Homo sapiens
tttttaagtaatgtggaagaa

SEQ ID NO: 4942159 - DNA, 15 bp, Homo sapiens
tttttaataaactac

SEQ ID NO: 4942160 - DNA, 11 bp, Homo sapiens
tttttaattta

SEQ ID NO: 4942161 - DNA, 13 bp, Homo sapiens
tttttacaagaag

SEQ ID NO: 4942162 - DNA, 19 bp, Homo sapiens
tttttacaagttttaaata

SEQ ID NO: 4942163 - DNA, 19 bp, Homo sapiens
tttttacagctgtgttatt

SEQ ID NO: 4942164 - DNA, 11 bp, Homo sapiens
tttttactgtg

SEQ ID NO: 4942165 - DNA, 18 bp, Homo sapiens
tgtgagacccccacacct

SEQ ID NO: 4942166 - DNA, 18 bp, Homo sapiens
tgtgagattttttattgc

SEQ ID NO: 4942167 - DNA, 14 bp, Homo sapiens
tgtgagcccctggt

SEQ ID NO: 4942168 - DNA, 18 bp, Homo sapiens
tgtgaggagctgctggct

SEQ ID NO: 4942169 - DNA, 20 bp, Homo sapiens
tgtgaggagctgctggcttg

SEQ ID NO: 4942170 - DNA, 12 bp, Homo sapiens
tgtgagtaaata

SEQ ID NO: 4942171 - DNA, 21 bp, Homo sapiens
tgtgagtcaccaagcccagtt

SEQ ID NO: 4942172 - DNA, 18 bp, Homo sapiens
tgtgagtctttggttcta

SEQ ID NO: 4942173 - DNA, 11 bp, Homo sapiens
tgtgagtgtga

SEQ ID NO: 4942174 - DNA, 14 bp, Homo sapiens
tgtgagtgtgacag

SEQ ID NO: 4942175 - DNA, 16 bp, Homo sapiens
tgtgagtgtgacaggg

SEQ ID NO: 4942176 - DNA, 22 bp, Homo sapiens
tgtgagtgtgtgtttgtgctga

SEQ ID NO: 4942177 - DNA, 15 bp, Homo sapiens
tgtgatctgtcttgt

SEQ ID NO: 4942178 - DNA, 16 bp, Homo sapiens
tgtgatctgtcttgta

SEQ ID NO: 4942179 - DNA, 17 bp, Homo sapiens
tgtgatctgtcttgtaa

SEQ ID NO: 4942180 - DNA, 21 bp, Homo sapiens
tgtgatcttaatatatttgaa

SEQ ID NO: 4942181 - DNA, 15 bp, Homo sapiens
tgtgatgaactttct

SEQ ID NO: 4942182 - DNA, 22 bp, Homo sapiens
tgtgatgatgaaatgaggtcag

SEQ ID NO: 4942183 - DNA, 14 bp, Homo sapiens
tgtgatgtattcta

SEQ ID NO: 4942184 - DNA, 15 bp, Homo sapiens
tgtgattcaaaagat

SEQ ID NO: 4942185 - DNA, 16 bp, Homo sapiens
tgtgattctaatgtct

SEQ ID NO: 4942186 - DNA, 23 bp, Homo sapiens
tgtgatttagaactgtatgtcag

SEQ ID NO: 4942187 - DNA, 23 bp, Homo sapiens
tgtgcaagcgacgacagatgcta

SEQ ID NO: 4942188 - DNA, 22 bp, Homo sapiens
tgtgcaccttaccaactttctg

SEQ ID NO: 4942189 - DNA, 20 bp, Homo sapiens
tgtgcagcgcagctggactc

SEQ ID NO: 4942190 - DNA, 15 bp, Homo sapiens
tgtgcagggagggca

SEQ ID NO: 4942191 - DNA, 18 bp, Homo sapiens
tgtgcaggtgctattgtt

SEQ ID NO: 4942192 - DNA, 20 bp, Homo sapiens
tgtgcagtgaaggttgctga

SEQ ID NO: 4942193 - DNA, 20 bp, Homo sapiens
tgtgcatgtatgtcttggac

SEQ ID NO: 4942194 - DNA, 17 bp, Homo sapiens
tgtgcatgtgtgtataa

SEQ ID NO: 4942195 - DNA, 21 bp, Homo sapiens
tgtgccagaggaatcctggca

SEQ ID NO: 4942196 - DNA, 23 bp, Homo sapiens
tgtgccagaggaatcctggcagc

SEQ ID NO: 4942197 - DNA, 20 bp, Homo sapiens
tgtgccaggtttttggtctg

SEQ ID NO: 4942198 - DNA, 21 bp, Homo sapiens
tgtgccatagagtttaacaca

SEQ ID NO: 4942199 - DNA, 16 bp, Homo sapiens
tgtgccatagtcacat

SEQ ID NO: 4942200 - DNA, 23 bp, Homo sapiens
tgtgccccatgcctgtccagcct

SEQ ID NO: 4942201 - DNA, 12 bp, Homo sapiens
tgtgccctcctg

SEQ ID NO: 4942202 - DNA, 14 bp, Homo sapiens
tgtgcctcctcacc

SEQ ID NO: 4942203 - DNA, 15 bp, Homo sapiens
tgtgcctcctcaccc

SEQ ID NO: 4942204 - DNA, 22 bp, Homo sapiens
tgtgcctggcttctttctctca

SEQ ID NO: 4942205 - DNA, 20 bp, Homo sapiens
tgtgcctttgcaaatcagtg

SEQ ID NO: 4942206 - DNA, 14 bp, Homo sapiens
tgtgcgcctacagg

SEQ ID NO: 4942207 - DNA, 14 bp, Homo sapiens
tgtgctacagatga

SEQ ID NO: 4942208 - DNA, 14 bp, Homo sapiens
tgtgctagaatact

SEQ ID NO: 4942209 - DNA, 15 bp, Homo sapiens
tgtgctataaatcct

SEQ ID NO: 4942210 - DNA, 19 bp, Homo sapiens
tgtgctctggacaggcatg

SEQ ID NO: 4942211 - DNA, 23 bp, Homo sapiens
tgtgctgccatttgatttttcta

SEQ ID NO: 4942212 - DNA, 22 bp, Homo sapiens
tgtgcttcacagtagagccagc

SEQ ID NO: 4942213 - DNA, 15 bp, Homo sapiens
tgtgcttctccccag

SEQ ID NO: 4942214 - DNA, 14 bp, Homo sapiens
tgtgcttgttttat

SEQ ID NO: 4942215 - DNA, 13 bp, Homo sapiens
tgtgctttgctct

SEQ ID NO: 4942216 - DNA, 22 bp, Homo sapiens
tgtgctttgctcttgtcccacg

SEQ ID NO: 4942217 - DNA, 19 bp, Homo sapiens
aaaaccaagccgtggcttc

SEQ ID NO: 4942218 - DNA, 14 bp, Homo sapiens
aaaaccacaaaggc

SEQ ID NO: 4942219 - DNA, 16 bp, Homo sapiens
aaaaccactagaactc

SEQ ID NO: 4942220 - DNA, 13 bp, Homo sapiens
aaaaccatttgaa

SEQ ID NO: 4942221 - DNA, 21 bp, Homo sapiens
aaaacccacaaaaatgttgaa

SEQ ID NO: 4942222 - DNA, 20 bp, Homo sapiens
aaaacctaagtcctttatgt

SEQ ID NO: 4942223 - DNA, 21 bp, Homo sapiens
aaaacctaagtcctttatgtg

SEQ ID NO: 4942224 - DNA, 15 bp, Homo sapiens
aaaacctacatattc

SEQ ID NO: 4942225 - DNA, 16 bp, Homo sapiens
aaaacctacatattcc

SEQ ID NO: 4942226 - DNA, 13 bp, Homo sapiens
aaaacctgacaaa

SEQ ID NO: 4942227 - DNA, 20 bp, Homo sapiens
aaaacctttcaaatttcaca

SEQ ID NO: 4942228 - DNA, 19 bp, Homo sapiens
aaaactaaatctctaatat

SEQ ID NO: 4942229 - DNA, 12 bp, Homo sapiens
aaaactatacaa

SEQ ID NO: 4942230 - DNA, 20 bp, Homo sapiens
aaaactccgcccccagccta

SEQ ID NO: 4942231 - DNA, 13 bp, Homo sapiens
aaaactggcctga

SEQ ID NO: 4942232 - DNA, 17 bp, Homo sapiens
aaaacttaacatattta

SEQ ID NO: 4942233 - DNA, 18 bp, Homo sapiens
aaaacttcttaaatatct

SEQ ID NO: 4942234 - DNA, 20 bp, Homo sapiens
aaaacttcttgtcagacata

SEQ ID NO: 4942235 - DNA, 22 bp, Homo sapiens
aaaacttcttgtcagacataaa

SEQ ID NO: 4942236 - DNA, 24 bp, Homo sapiens
aaaacttcttgtcagacataaagc

SEQ ID NO: 4942237 - DNA, 21 bp, Homo sapiens
aaaacttgactccatttcatc

SEQ ID NO: 4942238 - DNA, 24 bp, Homo sapiens
aaaactttgacgagtcaccttcca

SEQ ID NO: 4942239 - DNA, 15 bp, Homo sapiens
aaaacttttctgctg

SEQ ID NO: 4942240 - DNA, 21 bp, Homo sapiens
aaaagaaaaaaaaaagaagaa

SEQ ID NO: 4942241 - DNA, 13 bp, Homo sapiens
aaaagaaaaacca

SEQ ID NO: 4942242 - DNA, 22 bp, Homo sapiens
aaaagaaaatgaaaaacaacca

SEQ ID NO: 4942243 - DNA, 15 bp, Homo sapiens
aaaagaaaatttttg

SEQ ID NO: 4942244 - DNA, 11 bp, Homo sapiens
aaaagaagaag

SEQ ID NO: 4942245 - DNA, 22 bp, Homo sapiens
aaaggttcttcatccctttcca

SEQ ID NO: 4942246 - DNA, 19 bp, Homo sapiens
aaaggttgctgtttcacaa

SEQ ID NO: 4942247 - DNA, 23 bp, Homo sapiens
aaaggttttggatcttgaatgtg

SEQ ID NO: 4942248 - DNA, 18 bp, Homo sapiens
aaagtaactcatttgtta

SEQ ID NO: 4942249 - DNA, 13 bp, Homo sapiens
aaagtaatgtaaa

SEQ ID NO: 4942250 - DNA, 16 bp, Homo sapiens
aaagtacaatgtgttt

SEQ ID NO: 4942251 - DNA, 18 bp, Homo sapiens
aaagtacttgagtgtaat

SEQ ID NO: 4942252 - DNA, 20 bp, Homo sapiens
aaagtagaagagggttttag

SEQ ID NO: 4942253 - DNA, 19 bp, Homo sapiens
aaagtatgtaaagtatgta

SEQ ID NO: 4942254 - DNA, 10 bp, Homo sapiens
aaagtatttt

SEQ ID NO: 4942255 - DNA, 15 bp, Homo sapiens
aaagtattttgaagt

SEQ ID NO: 4942256 - DNA, 22 bp, Homo sapiens
aaagtcacttactattgttgct

SEQ ID NO: 4942257 - DNA, 16 bp, Homo sapiens
aaagtcctttttttcc

SEQ ID NO: 4942258 - DNA, 15 bp, Homo sapiens
aaagtcgttttccaa

SEQ ID NO: 4942259 - DNA, 14 bp, Homo sapiens
aaagtgaataaact

SEQ ID NO: 4942260 - DNA, 15 bp, Homo sapiens
aaagtgaataaactt

SEQ ID NO: 4942261 - DNA, 18 bp, Homo sapiens
aaagtgaataaacttcag

SEQ ID NO: 4942262 - DNA, 19 bp, Homo sapiens
aaagtgaataaacttcagc

SEQ ID NO: 4942263 - DNA, 20 bp, Homo sapiens
aaagtgaataaacttcagca

SEQ ID NO: 4942264 - DNA, 16 bp, Homo sapiens
aaagtgaatgaaagat

SEQ ID NO: 4942265 - DNA, 14 bp, Homo sapiens
aaagtgacacagca

SEQ ID NO: 4942266 - DNA, 13 bp, Homo sapiens
aaagtgctaaggt

SEQ ID NO: 4942267 - DNA, 16 bp, Homo sapiens
aaagtgctaaggttct

SEQ ID NO: 4942268 - DNA, 21 bp, Homo sapiens
aaagtgctaaggttctaaggc

SEQ ID NO: 4942269 - DNA, 23 bp, Homo sapiens
aaagtgctaaggttctaaggcct

SEQ ID NO: 4942270 - DNA, 15 bp, Homo sapiens
aaagtggaatttctt

SEQ ID NO: 4942271 - DNA, 13 bp, Homo sapiens
aaagtgttacttt

SEQ ID NO: 4942272 - DNA, 17 bp, Homo sapiens
aaagtgtttatttttca

SEQ ID NO: 4942273 - DNA, 21 bp, Homo sapiens
aaagtgtttcagctaagggaa

SEQ ID NO: 4942274 - DNA, 15 bp, Homo sapiens
aaagtgtttctgtta

SEQ ID NO: 4942275 - DNA, 14 bp, Homo sapiens
aaagttacagaaat

SEQ ID NO: 4942276 - DNA, 22 bp, Homo sapiens
aaagttactgattcactgcatg

SEQ ID NO: 4942277 - DNA, 19 bp, Homo sapiens
aaagttagaatctattttc

SEQ ID NO: 4942278 - DNA, 16 bp, Homo sapiens
aaagttccaagagtct

SEQ ID NO: 4942279 - DNA, 18 bp, Homo sapiens
aaagttccaagagtctaa

SEQ ID NO: 4942280 - DNA, 21 bp, Homo sapiens
aaagttccaagagtctaaaga

SEQ ID NO: 4942281 - DNA, 21 bp, Homo sapiens
aaagttccctacttcctgtga

SEQ ID NO: 4942282 - DNA, 11 bp, Homo sapiens
aaagttctaag

SEQ ID NO: 4942283 - DNA, 20 bp, Homo sapiens
aaagttctaataatttctaa

SEQ ID NO: 4942284 - DNA, 17 bp, Homo sapiens
aaagttctgtgtttaat

SEQ ID NO: 4942285 - DNA, 19 bp, Homo sapiens
aaagtttacaagtgtatat

SEQ ID NO: 4942286 - DNA, 13 bp, Homo sapiens
aaagtttcaatgt

SEQ ID NO: 4942287 - DNA, 20 bp, Homo sapiens
aaagtttcctaatcagaaat

SEQ ID NO: 4942288 - DNA, 13 bp, Homo sapiens
aaagttttatcaa

SEQ ID NO: 4942289 - DNA, 15 bp, Homo sapiens
aaataaaaagtgaca

SEQ ID NO: 4942290 - DNA, 20 bp, Homo sapiens
aaataaaaatattgtgttgt

SEQ ID NO: 4942291 - DNA, 23 bp, Homo sapiens
aaataaaaattattattgatttt

SEQ ID NO: 4942292 - DNA, 12 bp, Homo sapiens
aaataaaacctt

SEQ ID NO: 4942293 - DNA, 12 bp, Homo sapiens
aaataaactttt

SEQ ID NO: 4942294 - DNA, 17 bp, Homo sapiens
aaataaactttttttca

SEQ ID NO: 4942295 - DNA, 19 bp, Homo sapiens
aaataaagacaaccatatt

SEQ ID NO: 4942296 - DNA, 20 bp, Homo sapiens
aaataaagtttgcttagaaa

SEQ ID NO: 4942297 - DNA, 14 bp, Homo sapiens
aaataacaatgtgc

SEQ ID NO: 4942298 - DNA, 17 bp, Homo sapiens
aaataacaatgttaagg

SEQ ID NO: 4942299 - DNA, 18 bp, Homo sapiens
aaataacaatgttaagga

SEQ ID NO: 4942300 - DNA, 19 bp, Homo sapiens
aaataacaatgttaaggaa

SEQ ID NO: 4942301 - DNA, 13 bp, Homo sapiens
aaataacacacat

SEQ ID NO: 4942302 - DNA, 16 bp, Homo sapiens
aaataacttcaagcaa

SEQ ID NO: 4942303 - DNA, 14 bp, Homo sapiens
aaataagaatagaa

SEQ ID NO: 4942304 - DNA, 12 bp, Homo sapiens
aaataagattct

SEQ ID NO: 4942305 - DNA, 13 bp, Homo sapiens
aaataagattcta

SEQ ID NO: 4942306 - DNA, 12 bp, Homo sapiens
aaataagtattt

SEQ ID NO: 4942307 - DNA, 14 bp, Homo sapiens
aaataagtatttat

SEQ ID NO: 4942308 - DNA, 20 bp, Homo sapiens
aaataagtggttatttctca

SEQ ID NO: 4942309 - DNA, 14 bp, Homo sapiens
aaataataaaagat

SEQ ID NO: 4942310 - DNA, 11 bp, Homo sapiens
aaataataaag

SEQ ID NO: 4942311 - DNA, 13 bp, Homo sapiens
aaataatatgcat

SEQ ID NO: 4942312 - DNA, 14 bp, Homo sapiens
aaataatatgcatt

SEQ ID NO: 4942313 - DNA, 13 bp, Homo sapiens
aaataattctaaa

SEQ ID NO: 4942314 - DNA, 14 bp, Homo sapiens
aaataatttaacta

SEQ ID NO: 4942315 - DNA, 19 bp, Homo sapiens
aaataatttaactaccctt

SEQ ID NO: 4942316 - DNA, 12 bp, Homo sapiens
aaataattttaa

SEQ ID NO: 4942317 - DNA, 18 bp, Homo sapiens
aaataattttaaacaaag

SEQ ID NO: 4942318 - DNA, 13 bp, Homo sapiens
aaataattttagt

SEQ ID NO: 4942319 - DNA, 16 bp, Homo sapiens
aaatacatacggtcag

SEQ ID NO: 4942320 - DNA, 16 bp, Homo sapiens
aaataccattgacaca

SEQ ID NO: 4942321 - DNA, 14 bp, Homo sapiens
aaatacctcatgtt

SEQ ID NO: 4942322 - DNA, 20 bp, Homo sapiens
aaatactatttaaagcctcc

SEQ ID NO: 4942323 - DNA, 14 bp, Homo sapiens
aaatacttagcaaa

SEQ ID NO: 4942324 - DNA, 18 bp, Homo sapiens
aaatagaaaagtagacaa

SEQ ID NO: 4942325 - DNA, 14 bp, Homo sapiens
aaatagaaataagt

SEQ ID NO: 4942326 - DNA, 17 bp, Homo sapiens
aaatagagtatatgcac

SEQ ID NO: 4942327 - DNA, 13 bp, Homo sapiens
aaatagcatttgt

SEQ ID NO: 4942328 - DNA, 24 bp, Homo sapiens
aaatagctcaggtgtccctgcact

SEQ ID NO: 4942329 - DNA, 15 bp, Homo sapiens
aaatagcttgtatag

SEQ ID NO: 4942330 - DNA, 16 bp, Homo sapiens
aaatagcttgtatagt

SEQ ID NO: 4942331 - DNA, 16 bp, Homo sapiens
aaataggaaacaagtg

SEQ ID NO: 4942332 - DNA, 16 bp, Homo sapiens
aaataggagaggatga

SEQ ID NO: 4942333 - DNA, 21 bp, Homo sapiens
aaatagtgacataatatattc

SEQ ID NO: 4942334 - DNA, 20 bp, Homo sapiens
aaatagtgcagaatctcata

SEQ ID NO: 4942335 - DNA, 22 bp, Homo sapiens
aaatagttaagacatgatttcc

SEQ ID NO: 4942336 - DNA, 13 bp, Homo sapiens
aaatataaacaaa

SEQ ID NO: 4942337 - DNA, 22 bp, Homo sapiens
aaatataaacaaagattcatga

SEQ ID NO: 4942338 - DNA, 12 bp, Homo sapiens
aaatataaacat

SEQ ID NO: 4942339 - DNA, 18 bp, Homo sapiens
aaatataattctgtaaat

SEQ ID NO: 4942340 - DNA, 18 bp, Homo sapiens
aaatatagattagaaaaa

SEQ ID NO: 4942341 - DNA, 21 bp, Homo sapiens
aaatatatataaagaatatat

SEQ ID NO: 4942342 - DNA, 16 bp, Homo sapiens
aaatatatatacatat

SEQ ID NO: 4942343 - DNA, 13 bp, Homo sapiens
aaatatatatagt

SEQ ID NO: 4942344 - DNA, 14 bp, Homo sapiens
aaatatatttaatg

SEQ ID NO: 4942345 - DNA, 18 bp, Homo sapiens
aaatatcatttatttttt

SEQ ID NO: 4942346 - DNA, 14 bp, Homo sapiens
aaatatcttttatg

SEQ ID NO: 4942347 - DNA, 22 bp, Homo sapiens
aaatatcttttatgtttgaata

SEQ ID NO: 4942348 - DNA, 18 bp, Homo sapiens
aaatatgaaccctttgtt

SEQ ID NO: 4942349 - DNA, 18 bp, Homo sapiens
aaatatgcagtgatatgg

SEQ ID NO: 4942350 - DNA, 19 bp, Homo sapiens
aaatatgctaatttgggga

SEQ ID NO: 4942351 - DNA, 16 bp, Homo sapiens
aaatatggaacttcta

SEQ ID NO: 4942352 - DNA, 17 bp, Homo sapiens
aaatatggaacttctaa

SEQ ID NO: 4942353 - DNA, 15 bp, Homo sapiens
aaatatggacactta

SEQ ID NO: 4942354 - DNA, 16 bp, Homo sapiens
aaatatggacacttaa

SEQ ID NO: 4942355 - DNA, 14 bp, Homo sapiens
aaatattatgtgtt

SEQ ID NO: 4942356 - DNA, 20 bp, Homo sapiens
aaatattattttatgaaagg

SEQ ID NO: 4942357 - DNA, 15 bp, Homo sapiens
aaatattgaggcttt

SEQ ID NO: 4942358 - DNA, 22 bp, Homo sapiens
aaatatttattaaataaaatca

SEQ ID NO: 4942359 - DNA, 17 bp, Homo sapiens
aaatatttggtctctat

SEQ ID NO: 4942360 - DNA, 16 bp, Homo sapiens
aaatattttctgggtt

SEQ ID NO: 4942361 - DNA, 21 bp, Homo sapiens
aaatattttgataataaattg

SEQ ID NO: 4942362 - DNA, 14 bp, Homo sapiens
aaatatttttagta

SEQ ID NO: 4942363 - DNA, 22 bp, Homo sapiens
aaatcaacagaagcatttgtat

SEQ ID NO: 4942364 - DNA, 13 bp, Homo sapiens
aaatcaataagaa

SEQ ID NO: 4942365 - DNA, 22 bp, Homo sapiens
aaatcataggaaagtatttttt

SEQ ID NO: 4942366 - DNA, 12 bp, Homo sapiens
aaatcatctatt

SEQ ID NO: 4942367 - DNA, 17 bp, Homo sapiens
aaatcatctattttgat

SEQ ID NO: 4942368 - DNA, 21 bp, Homo sapiens
aaatcattgctttgaagcagt

SEQ ID NO: 4942369 - DNA, 18 bp, Homo sapiens
aaatccgctctcttcctg

SEQ ID NO: 4942370 - DNA, 16 bp, Homo sapiens
aaatcctgccatttaa

SEQ ID NO: 4942371 - DNA, 18 bp, Homo sapiens
aaatcctgccatttaaaa

SEQ ID NO: 4942372 - DNA, 20 bp, Homo sapiens
aaatctaaatctatttatta

SEQ ID NO: 4942373 - DNA, 19 bp, Homo sapiens
aaatctatttattaatatt

SEQ ID NO: 4942374 - DNA, 23 bp, Homo sapiens
aaatctcatactcccccacagtt

SEQ ID NO: 4942375 - DNA, 15 bp, Homo sapiens
aaatctgaagattgc

SEQ ID NO: 4942376 - DNA, 15 bp, Homo sapiens
aaatctggtcttgtt

SEQ ID NO: 4942377 - DNA, 19 bp, Homo sapiens
aaatctgtaacaggtattt

SEQ ID NO: 4942378 - DNA, 23 bp, Homo sapiens
aaatctgtaacaggtattttgtt

SEQ ID NO: 4942379 - DNA, 12 bp, Homo sapiens
aaatctgtgtat

SEQ ID NO: 4942380 - DNA, 14 bp, Homo sapiens
aaatcttctccaga

SEQ ID NO: 4942381 - DNA, 20 bp, Homo sapiens
aaatcttggaagtacatgaa

SEQ ID NO: 4942382 - DNA, 23 bp, Homo sapiens
aaatcttggaagtacatgaatac

SEQ ID NO: 4942383 - DNA, 20 bp, Homo sapiens
aaatcttgtgctagaatact

SEQ ID NO: 4942384 - DNA, 17 bp, Homo sapiens
aaatgaaatttaaacat

SEQ ID NO: 4942385 - DNA, 16 bp, Homo sapiens
aaatgaatattttgat

SEQ ID NO: 4942386 - DNA, 19 bp, Homo sapiens
aaatgaatgtctaaaattg

SEQ ID NO: 4942387 - DNA, 22 bp, Homo sapiens
aaatgacatctttttaaagctt

SEQ ID NO: 4942388 - DNA, 17 bp, Homo sapiens
aaatgacatgcactgac

SEQ ID NO: 4942389 - DNA, 18 bp, Homo sapiens
aaatgaggattattgata

SEQ ID NO: 4942390 - DNA, 17 bp, Homo sapiens
aaatgaggtcagagcct

SEQ ID NO: 4942391 - DNA, 15 bp, Homo sapiens
aaatgaggtctgttt

SEQ ID NO: 4942392 - DNA, 16 bp, Homo sapiens
aaatgaggtctgttta

SEQ ID NO: 4942393 - DNA, 21 bp, Homo sapiens
aaatgatagttgattttcaaa

SEQ ID NO: 4942394 - DNA, 15 bp, Homo sapiens
aaatgattcttagtg

SEQ ID NO: 4942395 - DNA, 15 bp, Homo sapiens
aaatgattgtaaaat

SEQ ID NO: 4942396 - DNA, 22 bp, Homo sapiens
aaatgattgtaaaatagcttgt

SEQ ID NO: 4942397 - DNA, 23 bp, Homo sapiens
aaatgatttttacaagttttaaa

SEQ ID NO: 4942398 - DNA, 14 bp, Homo sapiens
aaatgcatgaacaa

SEQ ID NO: 4942399 - DNA, 20 bp, Homo sapiens
aaatgccatttatttattga

SEQ ID NO: 4942400 - DNA, 21 bp, Homo sapiens
aaatgccatttatttattgat

SEQ ID NO: 4942401 - DNA, 22 bp, Homo sapiens
aaatgccatttatttattgatt

SEQ ID NO: 4942402 - DNA, 19 bp, Homo sapiens
aaatgcctagtttttagta

SEQ ID NO: 4942403 - DNA, 17 bp, Homo sapiens
aaatgccttaaaatgga

SEQ ID NO: 4942404 - DNA, 18 bp, Homo sapiens
aaatgccttaaaatggaa

SEQ ID NO: 4942405 - DNA, 17 bp, Homo sapiens
aaatgccttagaaatgt

SEQ ID NO: 4942406 - DNA, 14 bp, Homo sapiens
aaatgcctttgaga

SEQ ID NO: 4942407 - DNA, 19 bp, Homo sapiens
aaatgcctttgagacagtt

SEQ ID NO: 4942408 - DNA, 16 bp, Homo sapiens
aaatgctctctcaaat

SEQ ID NO: 4942409 - DNA, 15 bp, Homo sapiens
aaatggacatggtgg

SEQ ID NO: 4942410 - DNA, 21 bp, Homo sapiens
aaatggcgtctggaagtccaa

SEQ ID NO: 4942411 - DNA, 20 bp, Homo sapiens
aaatgggttggtgcttctaa

SEQ ID NO: 4942412 - DNA, 16 bp, Homo sapiens
aaatggtcgcccagga

SEQ ID NO: 4942413 - DNA, 17 bp, Homo sapiens
aaatggtcgcccaggag

SEQ ID NO: 4942414 - DNA, 17 bp, Homo sapiens
aaatggtttattttgta

SEQ ID NO: 4942415 - DNA, 18 bp, Homo sapiens
aaatgtaacttttgtaag

SEQ ID NO: 4942416 - DNA, 22 bp, Homo sapiens
aaatgtaagattatagattcta

SEQ ID NO: 4942417 - DNA, 17 bp, Homo sapiens
aaatgtaccttctttca

SEQ ID NO: 4942418 - DNA, 11 bp, Homo sapiens
aaatgtatact

SEQ ID NO: 4942419 - DNA, 13 bp, Homo sapiens
aaatgtatataca

SEQ ID NO: 4942420 - DNA, 17 bp, Homo sapiens
aaatgtatatacacata

SEQ ID NO: 4942421 - DNA, 18 bp, Homo sapiens
aaatgtatatacacatat

SEQ ID NO: 4942422 - DNA, 23 bp, Homo sapiens
aaatgtatatacacatataccta

SEQ ID NO: 4942423 - DNA, 14 bp, Homo sapiens
aaatgtctgtaaat

SEQ ID NO: 4942424 - DNA, 18 bp, Homo sapiens
aaatgtcttaatttttga

SEQ ID NO: 4942425 - DNA, 17 bp, Homo sapiens
aaatgtctttgtaagtc

SEQ ID NO: 4942426 - DNA, 18 bp, Homo sapiens
aaatgtcttttagaagat

SEQ ID NO: 4942427 - DNA, 23 bp, Homo sapiens
aaatgtgtacaatgtacacactg

SEQ ID NO: 4942428 - DNA, 18 bp, Homo sapiens
aaatgttagtcattgtta

SEQ ID NO: 4942429 - DNA, 17 bp, Homo sapiens
aaatgttatcttctcaa

SEQ ID NO: 4942430 - DNA, 18 bp, Homo sapiens
aaatgttatcttctcaag

SEQ ID NO: 4942431 - DNA, 23 bp, Homo sapiens
aaatgttatcttctcaagttcta

SEQ ID NO: 4942432 - DNA, 18 bp, Homo sapiens
aaatgttcatcaattccc

SEQ ID NO: 4942433 - DNA, 14 bp, Homo sapiens
aaatgttctaagtt

SEQ ID NO: 4942434 - DNA, 18 bp, Homo sapiens
aaatgttctatggttatg

SEQ ID NO: 4942435 - DNA, 15 bp, Homo sapiens
aaatgttgaataaaa

SEQ ID NO: 4942436 - DNA, 23 bp, Homo sapiens
aaatgttgaataaaaatatgtac

SEQ ID NO: 4942437 - DNA, 13 bp, Homo sapiens
aaattaaaaagat

SEQ ID NO: 4942438 - DNA, 21 bp, Homo sapiens
aaattaaagcctttagtatca

SEQ ID NO: 4942439 - DNA, 23 bp, Homo sapiens
aaattaaagcctttagtatcagt

SEQ ID NO: 4942440 - DNA, 23 bp, Homo sapiens
aaattaaatctgtccctgagagt

SEQ ID NO: 4942441 - DNA, 17 bp, Homo sapiens
aaattaacagtcctaac

SEQ ID NO: 4942442 - DNA, 14 bp, Homo sapiens
aaattaattttact

SEQ ID NO: 4942443 - DNA, 20 bp, Homo sapiens
aaattagaaagcaacttatc

SEQ ID NO: 4942444 - DNA, 18 bp, Homo sapiens
aaattaggatttcatgat

SEQ ID NO: 4942445 - DNA, 16 bp, Homo sapiens
aaattatctatagcta

SEQ ID NO: 4942446 - DNA, 17 bp, Homo sapiens
aaattattttaaacaaa

SEQ ID NO: 4942447 - DNA, 21 bp, Homo sapiens
aaattcaaaaagtgtttattt

SEQ ID NO: 4942448 - DNA, 18 bp, Homo sapiens
aaattcacaaacttttat

SEQ ID NO: 4942449 - DNA, 22 bp, Homo sapiens
aaattcaccccctttcctggac

SEQ ID NO: 4942450 - DNA, 16 bp, Homo sapiens
aaattcatattctgtc

SEQ ID NO: 4942451 - DNA, 14 bp, Homo sapiens
aaattcatttcaca

SEQ ID NO: 4942452 - DNA, 18 bp, Homo sapiens
aaattccaaagtctctaa

SEQ ID NO: 4942453 - DNA, 22 bp, Homo sapiens
aaattccaaagtctctaattct

SEQ ID NO: 4942454 - DNA, 14 bp, Homo sapiens
aaattgatgtgttt

SEQ ID NO: 4942455 - DNA, 14 bp, Homo sapiens
aaattgcaaatctt

SEQ ID NO: 4942456 - DNA, 18 bp, Homo sapiens
aaattgcatttcctgaca

SEQ ID NO: 4942457 - DNA, 13 bp, Homo sapiens
aaattgctatgtt

SEQ ID NO: 4942458 - DNA, 21 bp, Homo sapiens
aaattgctatgttactatttt

SEQ ID NO: 4942459 - DNA, 22 bp, Homo sapiens
aaattgctcctaagcttcaaat

SEQ ID NO: 4942460 - DNA, 16 bp, Homo sapiens
aaattggaacagaatg

SEQ ID NO: 4942461 - DNA, 19 bp, Homo sapiens
aaattggaacagaatgttt

SEQ ID NO: 4942462 - DNA, 19 bp, Homo sapiens
aaattgggttcatgatgca

SEQ ID NO: 4942463 - DNA, 22 bp, Homo sapiens
aaattgtacatatttgtggaat

SEQ ID NO: 4942464 - DNA, 21 bp, Homo sapiens
aaattgtcttttgtcatgtgg

SEQ ID NO: 4942465 - DNA, 20 bp, Homo sapiens
aacataacccacttgtcact

SEQ ID NO: 4942466 - DNA, 21 bp, Homo sapiens
aacataacccacttgtcactg

SEQ ID NO: 4942467 - DNA, 15 bp, Homo sapiens
aacataatgaaaata

SEQ ID NO: 4942468 - DNA, 13 bp, Homo sapiens
aacatagaaaaat

SEQ ID NO: 4942469 - DNA, 19 bp, Homo sapiens
aacatagtaagttcagcac

SEQ ID NO: 4942470 - DNA, 14 bp, Homo sapiens
aacatcattagaac

SEQ ID NO: 4942471 - DNA, 11 bp, Homo sapiens
aacatccaaaa

SEQ ID NO: 4942472 - DNA, 22 bp, Homo sapiens
aacatcctttgcagggcagccc

SEQ ID NO: 4942473 - DNA, 22 bp, Homo sapiens
aacatctttgacactctgcaga

SEQ ID NO: 4942474 - DNA, 20 bp, Homo sapiens
aacatgaaagtctagaaata

SEQ ID NO: 4942475 - DNA, 20 bp, Homo sapiens
aacatgaacacccttagaaa

SEQ ID NO: 4942476 - DNA, 21 bp, Homo sapiens
aacatgcctgccccaaacaaa

SEQ ID NO: 4942477 - DNA, 21 bp, Homo sapiens
aacatgggctcttcactagtg

SEQ ID NO: 4942478 - DNA, 21 bp, Homo sapiens
aacatgtatttatgtaatgaa

SEQ ID NO: 4942479 - DNA, 15 bp, Homo sapiens
aacattaaatgtctt

SEQ ID NO: 4942480 - DNA, 18 bp, Homo sapiens
aacattaaatgtcttata

SEQ ID NO: 4942481 - DNA, 21 bp, Homo sapiens
aacattatagattttcatgtt

SEQ ID NO: 4942482 - DNA, 16 bp, Homo sapiens
aacattctgatttgga

SEQ ID NO: 4942483 - DNA, 17 bp, Homo sapiens
aacattctgatttggaa

SEQ ID NO: 4942484 - DNA, 20 bp, Homo sapiens
aacatttgccttgcagaact

SEQ ID NO: 4942485 - DNA, 22 bp, Homo sapiens
aacattttaaaaacatagaaaa

SEQ ID NO: 4942486 - DNA, 14 bp, Homo sapiens
aacattttgttctt

SEQ ID NO: 4942487 - DNA, 18 bp, Homo sapiens
aacattttgttcttacac

SEQ ID NO: 4942488 - DNA, 11 bp, Homo sapiens
aaccaaaatga

SEQ ID NO: 4942489 - DNA, 17 bp, Homo sapiens
aaccaaaatgacatctt

SEQ ID NO: 4942490 - DNA, 21 bp, Homo sapiens
aaccaaaatgacatcttttta

SEQ ID NO: 4942491 - DNA, 13 bp, Homo sapiens
aaccaaaggacat

SEQ ID NO: 4942492 - DNA, 22 bp, Homo sapiens
aaccaagcatcagggggaagaa

SEQ ID NO: 4942493 - DNA, 16 bp, Homo sapiens
aaccaagccgtggctt

SEQ ID NO: 4942494 - DNA, 21 bp, Homo sapiens
aaccaaggaaatatattttac

SEQ ID NO: 4942495 - DNA, 16 bp, Homo sapiens
aaccaagtcatgtgca

SEQ ID NO: 4942496 - DNA, 11 bp, Homo sapiens
aaccacaaagg

SEQ ID NO: 4942497 - DNA, 21 bp, Homo sapiens
aaccacaaaggccaaactgct

SEQ ID NO: 4942498 - DNA, 20 bp, Homo sapiens
aaccacatcttgctctgctg

SEQ ID NO: 4942499 - DNA, 22 bp, Homo sapiens
aaccacatcttgctctgctgac

SEQ ID NO: 4942500 - DNA, 21 bp, Homo sapiens
aaccaccacacccagcccact

SEQ ID NO: 4942501 - DNA, 21 bp, Homo sapiens
aaccaccccggccccctgccc

SEQ ID NO: 4942502 - DNA, 13 bp, Homo sapiens
aaccacgctggac

SEQ ID NO: 4942503 - DNA, 20 bp, Homo sapiens
aagtttgtccatttgtaaaa

SEQ ID NO: 4942504 - DNA, 14 bp, Homo sapiens
aagttttaatgtat

SEQ ID NO: 4942505 - DNA, 13 bp, Homo sapiens
aagttttcctgag

SEQ ID NO: 4942506 - DNA, 21 bp, Homo sapiens
aagttttctgtagtcatttac

SEQ ID NO: 4942507 - DNA, 12 bp, Homo sapiens
aagttttgaaaa

SEQ ID NO: 4942508 - DNA, 12 bp, Homo sapiens
aataaaaactat

SEQ ID NO: 4942509 - DNA, 13 bp, Homo sapiens
aataaaaccagct

SEQ ID NO: 4942510 - DNA, 13 bp, Homo sapiens
aataaaacctttc

SEQ ID NO: 4942511 - DNA, 23 bp, Homo sapiens
aataaaacctttcaaatttcaca

SEQ ID NO: 4942512 - DNA, 14 bp, Homo sapiens
aataaaagtgcaca

SEQ ID NO: 4942513 - DNA, 16 bp, Homo sapiens
aataaaataattctaa

SEQ ID NO: 4942514 - DNA, 13 bp, Homo sapiens
aataaacatcctt

SEQ ID NO: 4942515 - DNA, 14 bp, Homo sapiens
aataaactactctt

SEQ ID NO: 4942516 - DNA, 15 bp, Homo sapiens
aataaactctaaaca

SEQ ID NO: 4942517 - DNA, 17 bp, Homo sapiens
aataaactgtgtttact

SEQ ID NO: 4942518 - DNA, 16 bp, Homo sapiens
aataaactttttttca

SEQ ID NO: 4942519 - DNA, 18 bp, Homo sapiens
aataaactttttttcaat

SEQ ID NO: 4942520 - DNA, 18 bp, Homo sapiens
aataaagagttagaatga

SEQ ID NO: 4942521 - DNA, 18 bp, Homo sapiens
aataaaggactgtaatct

SEQ ID NO: 4942522 - DNA, 22 bp, Homo sapiens
aataaaggactgtaatcttatt

SEQ ID NO: 4942523 - DNA, 15 bp, Homo sapiens
aataaatctttggaa

SEQ ID NO: 4942524 - DNA, 16 bp, Homo sapiens
aataaatctttggaaa

SEQ ID NO: 4942525 - DNA, 15 bp, Homo sapiens
aataaatggaaatca

SEQ ID NO: 4942526 - DNA, 14 bp, Homo sapiens
aataaattagttgt

SEQ ID NO: 4942527 - DNA, 21 bp, Homo sapiens
aataaattcccaacttctctt

SEQ ID NO: 4942528 - DNA, 15 bp, Homo sapiens
aataacaaaatggac

SEQ ID NO: 4942529 - DNA, 13 bp, Homo sapiens
aataacaatgtta

SEQ ID NO: 4942530 - DNA, 15 bp, Homo sapiens
aataacaatgttaag

SEQ ID NO: 4942531 - DNA, 24 bp, Homo sapiens
aataacaatgttaaggaaactctt

SEQ ID NO: 4942532 - DNA, 21 bp, Homo sapiens
aataacaggcatttgttcact

SEQ ID NO: 4942533 - DNA, 13 bp, Homo sapiens
aataacattacct

SEQ ID NO: 4942534 - DNA, 14 bp, Homo sapiens
aataacattacctt

SEQ ID NO: 4942535 - DNA, 19 bp, Homo sapiens
aataaccttccatacattt

SEQ ID NO: 4942536 - DNA, 15 bp, Homo sapiens
aataagaaagtttca

SEQ ID NO: 4942537 - DNA, 15 bp, Homo sapiens
aataagaagcaaata

SEQ ID NO: 4942538 - DNA, 18 bp, Homo sapiens
aataagaatagaaataaa

SEQ ID NO: 4942539 - DNA, 14 bp, Homo sapiens
aataagattctaac

SEQ ID NO: 4942540 - DNA, 15 bp, Homo sapiens
aataagctctagttc

SEQ ID NO: 4942541 - DNA, 22 bp, Homo sapiens
aataagctctagttcttaacaa

SEQ ID NO: 4942542 - DNA, 21 bp, Homo sapiens
aataaggcaggcattgaggaa

SEQ ID NO: 4942543 - DNA, 15 bp, Homo sapiens
aataatatgcattgt

SEQ ID NO: 4942544 - DNA, 19 bp, Homo sapiens
aataatatggctatgctta

SEQ ID NO: 4942545 - DNA, 17 bp, Homo sapiens
aataatcacattgactt

SEQ ID NO: 4942546 - DNA, 20 bp, Homo sapiens
aataatgagctattaaaact

SEQ ID NO: 4942547 - DNA, 18 bp, Homo sapiens
aataatgggtttctttca

SEQ ID NO: 4942548 - DNA, 19 bp, Homo sapiens
aataatgtacatctggcct

SEQ ID NO: 4942549 - DNA, 22 bp, Homo sapiens
aataattaggttaacattgttg

SEQ ID NO: 4942550 - DNA, 18 bp, Homo sapiens
aataatttaactaccctt

SEQ ID NO: 4942551 - DNA, 15 bp, Homo sapiens
aataatttctaatgt

SEQ ID NO: 4942552 - DNA, 15 bp, Homo sapiens
aataatttctctaca

SEQ ID NO: 4942553 - DNA, 19 bp, Homo sapiens
aataatttttatatttaat

SEQ ID NO: 4942554 - DNA, 20 bp, Homo sapiens
aatacactaattcctttcta

SEQ ID NO: 4942555 - DNA, 22 bp, Homo sapiens
aatacacttgtgattataaaat

SEQ ID NO: 4942556 - DNA, 12 bp, Homo sapiens
aatacagataac

SEQ ID NO: 4942557 - DNA, 21 bp, Homo sapiens
aatacatacggtcaggtttaa

SEQ ID NO: 4942558 - DNA, 16 bp, Homo sapiens
aatacatttaaaactt

SEQ ID NO: 4942559 - DNA, 22 bp, Homo sapiens
aataccattttttaaggaaaca

SEQ ID NO: 4942560 - DNA, 15 bp, Homo sapiens
aatacctcaatgttt

SEQ ID NO: 4942561 - DNA, 17 bp, Homo sapiens
aatacctcaatgtttga

SEQ ID NO: 4942562 - DNA, 14 bp, Homo sapiens
aatacctcatgttt

SEQ ID NO: 4942563 - DNA, 23 bp, Homo sapiens
aatacctcatgtttatgaaaata

SEQ ID NO: 4942564 - DNA, 16 bp, Homo sapiens
aatacctctgtgtgct

SEQ ID NO: 4942565 - DNA, 20 bp, Homo sapiens
aatacgacactgaaatatgt

SEQ ID NO: 4942566 - DNA, 19 bp, Homo sapiens
aatacgcaggcatctgatt

SEQ ID NO: 4942567 - DNA, 15 bp, Homo sapiens
aatactaccttgaaa

SEQ ID NO: 4942568 - DNA, 13 bp, Homo sapiens
aatagaaaactga

SEQ ID NO: 4942569 - DNA, 17 bp, Homo sapiens
aatagaaaactgaaaat

SEQ ID NO: 4942570 - DNA, 18 bp, Homo sapiens
aatagaaaagtagacaat

SEQ ID NO: 4942571 - DNA, 22 bp, Homo sapiens
aatagaaataaaggatgtgatt

SEQ ID NO: 4942572 - DNA, 16 bp, Homo sapiens
aatagaaataagtggt

SEQ ID NO: 4942573 - DNA, 15 bp, Homo sapiens
aatagagtatatgca

SEQ ID NO: 4942574 - DNA, 16 bp, Homo sapiens
aatagatgctgactgt

SEQ ID NO: 4942575 - DNA, 12 bp, Homo sapiens
aatagatgtctt

SEQ ID NO: 4942576 - DNA, 19 bp, Homo sapiens
aatagcaacttttgtgtaa

SEQ ID NO: 4942577 - DNA, 22 bp, Homo sapiens
aatagccacatttggaatactt

SEQ ID NO: 4942578 - DNA, 23 bp, Homo sapiens
aatagccacatttggaatacttt

SEQ ID NO: 4942579 - DNA, 18 bp, Homo sapiens
aatagctaataatgttaa

SEQ ID NO: 4942580 - DNA, 13 bp, Homo sapiens
aatagctgggact

SEQ ID NO: 4942581 - DNA, 14 bp, Homo sapiens
aatagcttgtatag

SEQ ID NO: 4942582 - DNA, 20 bp, Homo sapiens
aataggagaggatgagagcc

SEQ ID NO: 4942583 - DNA, 16 bp, Homo sapiens
aataggcattaacaca

SEQ ID NO: 4942584 - DNA, 22 bp, Homo sapiens
aataggcattaacacaaaggag

SEQ ID NO: 4942585 - DNA, 21 bp, Homo sapiens
aatagttcaggtaacaggcag

SEQ ID NO: 4942586 - DNA, 13 bp, Homo sapiens
aatagttggctag

SEQ ID NO: 4942587 - DNA, 14 bp, Homo sapiens
aatagtttgtctat

SEQ ID NO: 4942588 - DNA, 18 bp, Homo sapiens
aatagtttgtctatttta

SEQ ID NO: 4942589 - DNA, 22 bp, Homo sapiens
aatataaaaggcaaatgtgtac

SEQ ID NO: 4942590 - DNA, 22 bp, Homo sapiens
aatataaacaaagattcatgat

SEQ ID NO: 4942591 - DNA, 13 bp, Homo sapiens
aatataattctgt

SEQ ID NO: 4942592 - DNA, 18 bp, Homo sapiens
aatatagattagaaaaat

SEQ ID NO: 4942593 - DNA, 15 bp, Homo sapiens
aatatagttcctaag

SEQ ID NO: 4942594 - DNA, 20 bp, Homo sapiens
aatatagttcctaagaagct

SEQ ID NO: 4942595 - DNA, 20 bp, Homo sapiens
aatatataaaaatatatata

SEQ ID NO: 4942596 - DNA, 19 bp, Homo sapiens
aatatatataaagaatata

SEQ ID NO: 4942597 - DNA, 22 bp, Homo sapiens
aatatatataaagaatatatat

SEQ ID NO: 4942598 - DNA, 14 bp, Homo sapiens
aatatatatacata

SEQ ID NO: 4942599 - DNA, 22 bp, Homo sapiens
aatatatatagtgctatatata

SEQ ID NO: 4942600 - DNA, 16 bp, Homo sapiens
aatatatcccagaaat

SEQ ID NO: 4942601 - DNA, 18 bp, Homo sapiens
aatatatgtattatttat

SEQ ID NO: 4942602 - DNA, 20 bp, Homo sapiens
aatatattaccagcaagaat

SEQ ID NO: 4942603 - DNA, 23 bp, Homo sapiens
aatatattaccagcaagaataaa

SEQ ID NO: 4942604 - DNA, 23 bp, Homo sapiens
aatatattcctgagatttcctcc

SEQ ID NO: 4942605 - DNA, 14 bp, Homo sapiens
aatatatttaatga

SEQ ID NO: 4942606 - DNA, 15 bp, Homo sapiens
aatatatttttagac

SEQ ID NO: 4942607 - DNA, 18 bp, Homo sapiens
aatatatttttagactca

SEQ ID NO: 4942608 - DNA, 22 bp, Homo sapiens
aatatcatatcatcacattgag

SEQ ID NO: 4942609 - DNA, 21 bp, Homo sapiens
aatatctaatatatatgaata

SEQ ID NO: 4942610 - DNA, 14 bp, Homo sapiens
aatatcttgtgttg

SEQ ID NO: 4942611 - DNA, 17 bp, Homo sapiens
aatatgagtacaaatgc

SEQ ID NO: 4942612 - DNA, 21 bp, Homo sapiens
aatatgagtacaaatgcctta

SEQ ID NO: 4942613 - DNA, 22 bp, Homo sapiens
aatatgattttttaaaagaaat

SEQ ID NO: 4942614 - DNA, 21 bp, Homo sapiens
aaggcttatattcaaccatgg

SEQ ID NO: 4942615 - DNA, 14 bp, Homo sapiens
aagggaaatatcat

SEQ ID NO: 4942616 - DNA, 13 bp, Homo sapiens
aagggaagacatt

SEQ ID NO: 4942617 - DNA, 18 bp, Homo sapiens
aagggagctatcaggaac

SEQ ID NO: 4942618 - DNA, 14 bp, Homo sapiens
aagggcatgccttg

SEQ ID NO: 4942619 - DNA, 15 bp, Homo sapiens
aagggcatgccttgt

SEQ ID NO: 4942620 - DNA, 17 bp, Homo sapiens
aagggcatgccttgtgc

SEQ ID NO: 4942621 - DNA, 14 bp, Homo sapiens
aagggccagtcctg

SEQ ID NO: 4942622 - DNA, 16 bp, Homo sapiens
aagggccagtcctgcc

SEQ ID NO: 4942623 - DNA, 15 bp, Homo sapiens
aagggcccagagagg

SEQ ID NO: 4942624 - DNA, 18 bp, Homo sapiens
aagggctgacctgcctct

SEQ ID NO: 4942625 - DNA, 15 bp, Homo sapiens
aagggcttactattt

SEQ ID NO: 4942626 - DNA, 18 bp, Homo sapiens
aaggggaagcactcgtgt

SEQ ID NO: 4942627 - DNA, 12 bp, Homo sapiens
aaggggacaggc

SEQ ID NO: 4942628 - DNA, 21 bp, Homo sapiens
aaggggatcataaagttagaa

SEQ ID NO: 4942629 - DNA, 14 bp, Homo sapiens
aaggggcaaatttt

SEQ ID NO: 4942630 - DNA, 18 bp, Homo sapiens
aagggggggctacattat

SEQ ID NO: 4942631 - DNA, 16 bp, Homo sapiens
aaggggttggattgca

SEQ ID NO: 4942632 - DNA, 22 bp, Homo sapiens
aaggggttggggtgacagtcat

SEQ ID NO: 4942633 - DNA, 22 bp, Homo sapiens
aagggtcagaggacctgtattt

SEQ ID NO: 4942634 - DNA, 18 bp, Homo sapiens
aagggtcgaaagctctag

SEQ ID NO: 4942635 - DNA, 19 bp, Homo sapiens
aagggtcgaaagctctaga

SEQ ID NO: 4942636 - DNA, 21 bp, Homo sapiens
aagggtcgaaagctctagaat

SEQ ID NO: 4942637 - DNA, 19 bp, Homo sapiens
aagggtgggtgctcagaat

SEQ ID NO: 4942638 - DNA, 17 bp, Homo sapiens
aagggttctggctgccc

SEQ ID NO: 4942639 - DNA, 20 bp, Homo sapiens
aagggtttgtggctgggggc

SEQ ID NO: 4942640 - DNA, 19 bp, Homo sapiens
aaggtccacaggtctagac

SEQ ID NO: 4942641 - DNA, 13 bp, Homo sapiens
aaggtctttggtt

SEQ ID NO: 4942642 - DNA, 15 bp, Homo sapiens
aaggtgctggaggtg

SEQ ID NO: 4942643 - DNA, 20 bp, Homo sapiens
aaggtgctggaggtgggagc

SEQ ID NO: 4942644 - DNA, 22 bp, Homo sapiens
aaggtggattttgtttaaaaaa

SEQ ID NO: 4942645 - DNA, 21 bp, Homo sapiens
aaggtgtatttaaactatctt

SEQ ID NO: 4942646 - DNA, 22 bp, Homo sapiens
aaggtgttcattcacttgcatt

SEQ ID NO: 4942647 - DNA, 13 bp, Homo sapiens
aaggttctaggtt

SEQ ID NO: 4942648 - DNA, 19 bp, Homo sapiens
aaggttcttcatccctttc

SEQ ID NO: 4942649 - DNA, 20 bp, Homo sapiens
aaggttcttcatccctttcc

SEQ ID NO: 4942650 - DNA, 12 bp, Homo sapiens
aaggttttaagt

SEQ ID NO: 4942651 - DNA, 23 bp, Homo sapiens
aaggttttaggttctaaagttct

SEQ ID NO: 4942652 - DNA, 12 bp, Homo sapiens
aagtaactcatt

SEQ ID NO: 4942653 - DNA, 21 bp, Homo sapiens
aagtaactcatttgttaaaat

SEQ ID NO: 4942654 - DNA, 21 bp, Homo sapiens
aagtaatataatggaagagaa

SEQ ID NO: 4942655 - DNA, 23 bp, Homo sapiens
aagtaatataatggaagagaaat

SEQ ID NO: 4942656 - DNA, 14 bp, Homo sapiens
aagtaatgtggaag

SEQ ID NO: 4942657 - DNA, 16 bp, Homo sapiens
aagtaattatgcacta

SEQ ID NO: 4942658 - DNA, 21 bp, Homo sapiens
aagtacaataattcatattct

SEQ ID NO: 4942659 - DNA, 19 bp, Homo sapiens
aagtacaatgtgtttttct

SEQ ID NO: 4942660 - DNA, 19 bp, Homo sapiens
aagtacacaataagcaaaa

SEQ ID NO: 4942661 - DNA, 18 bp, Homo sapiens
aaaatgtactgagatttt

SEQ ID NO: 4942662 - DNA, 12 bp, Homo sapiens
aaaatgtatata

SEQ ID NO: 4942663 - DNA, 13 bp, Homo sapiens
aaaatgtattttt

SEQ ID NO: 4942664 - DNA, 16 bp, Homo sapiens
aaaatgtatttttcta

SEQ ID NO: 4942665 - DNA, 23 bp, Homo sapiens
aaaatgtgaattgcatgacttgt

SEQ ID NO: 4942666 - DNA, 15 bp, Homo sapiens
aaaatgtgaggaaga

SEQ ID NO: 4942667 - DNA, 19 bp, Homo sapiens
aaaatgtgatgttctaagg

SEQ ID NO: 4942668 - DNA, 16 bp, Homo sapiens
aaaatgttcagaaggt

SEQ ID NO: 4942669 - DNA, 19 bp, Homo sapiens
aaaattaggatttcatgat

SEQ ID NO: 4942670 - DNA, 21 bp, Homo sapiens
aaaattatactaacttattta

SEQ ID NO: 4942671 - DNA, 13 bp, Homo sapiens
aaaattatgaatc

SEQ ID NO: 4942672 - DNA, 17 bp, Homo sapiens
aaaattcaaaaagtgtt

SEQ ID NO: 4942673 - DNA, 22 bp, Homo sapiens
aaaattcgcccgagctgtttat

SEQ ID NO: 4942674 - DNA, 14 bp, Homo sapiens
aaaattgatgtgtt

SEQ ID NO: 4942675 - DNA, 21 bp, Homo sapiens
aaaattgatgtgtttatttat

SEQ ID NO: 4942676 - DNA, 19 bp, Homo sapiens
aaaatttaagtatcttttt

SEQ ID NO: 4942677 - DNA, 18 bp, Homo sapiens
aaaatttaagtgcgtgtg

SEQ ID NO: 4942678 - DNA, 14 bp, Homo sapiens
aaaatttatttcat

SEQ ID NO: 4942679 - DNA, 13 bp, Homo sapiens
aaaatttgagact

SEQ ID NO: 4942680 - DNA, 9 bp, Homo sapiens
aaacaaaac

SEQ ID NO: 4942681 - DNA, 18 bp, Homo sapiens
aaacaaaactatacttga

SEQ ID NO: 4942682 - DNA, 20 bp, Homo sapiens
aaacaaaatttgtttgaaat

SEQ ID NO: 4942683 - DNA, 12 bp, Homo sapiens
aaacaaatatgc

SEQ ID NO: 4942684 - DNA, 19 bp, Homo sapiens
aaacaaattcatattctgt

SEQ ID NO: 4942685 - DNA, 22 bp, Homo sapiens
aaacaacagctcgatccaaatt

SEQ ID NO: 4942686 - DNA, 17 bp, Homo sapiens
aaacaatgcaaaacctt

SEQ ID NO: 4942687 - DNA, 21 bp, Homo sapiens
aaacacacagatacacacaca

SEQ ID NO: 4942688 - DNA, 20 bp, Homo sapiens
aaacacagtcaaaataattc

SEQ ID NO: 4942689 - DNA, 13 bp, Homo sapiens
aaacacattgcct

SEQ ID NO: 4942690 - DNA, 13 bp, Homo sapiens
aaacacgaaactt

SEQ ID NO: 4942691 - DNA, 16 bp, Homo sapiens
aagcaaataaatatca

SEQ ID NO: 4942692 - DNA, 13 bp, Homo sapiens
aagcaaatttcaa

SEQ ID NO: 4942693 - DNA, 19 bp, Homo sapiens
aagcaacctcccaacccag

SEQ ID NO: 4942694 - DNA, 20 bp, Homo sapiens
aagcaaggaagatatacatg

SEQ ID NO: 4942695 - DNA, 14 bp, Homo sapiens
aagcacacttgtag

SEQ ID NO: 4942696 - DNA, 18 bp, Homo sapiens
aagcacaggagacactgt

SEQ ID NO: 4942697 - DNA, 20 bp, Homo sapiens
aagcacagtgttaaatgaaa

SEQ ID NO: 4942698 - DNA, 15 bp, Homo sapiens
aagcacagtttgaac

SEQ ID NO: 4942699 - DNA, 16 bp, Homo sapiens
aagcacagtttgaaca

SEQ ID NO: 4942700 - DNA, 13 bp, Homo sapiens
aagcacctcctgc

SEQ ID NO: 4942701 - DNA, 16 bp, Homo sapiens
aagcacctcctgcctc

SEQ ID NO: 4942702 - DNA, 20 bp, Homo sapiens
aagcactagagaatgcacag

SEQ ID NO: 4942703 - DNA, 17 bp, Homo sapiens
aagcactcttaaagcaa

SEQ ID NO: 4942704 - DNA, 17 bp, Homo sapiens
aagcagagtgcacagct

SEQ ID NO: 4942705 - DNA, 20 bp, Homo sapiens
aagcagagtgcacagctgtc

SEQ ID NO: 4942706 - DNA, 17 bp, Homo sapiens
aagcagatggaatgctg

SEQ ID NO: 4942707 - DNA, 19 bp, Homo sapiens
aagcagcgaccgccccctc

SEQ ID NO: 4942708 - DNA, 23 bp, Homo sapiens
aagcaggactttgaggcaagtgt

SEQ ID NO: 4942709 - DNA, 17 bp, Homo sapiens
aagcagggaatttctat

SEQ ID NO: 4942710 - DNA, 17 bp, Homo sapiens
aagcagtaaatttgcta

SEQ ID NO: 4942711 - DNA, 20 bp, Homo sapiens
aagcagtagaaataatatgc

SEQ ID NO: 4942712 - DNA, 15 bp, Homo sapiens
aagcataaaaacatt

SEQ ID NO: 4942713 - DNA, 14 bp, Homo sapiens
aagcatagatgttt

SEQ ID NO: 4942714 - DNA, 19 bp, Homo sapiens
aagcatatgggttagatgt

SEQ ID NO: 4942715 - DNA, 18 bp, Homo sapiens
aagcatcagggggaagaa

SEQ ID NO: 4942716 - DNA, 23 bp, Homo sapiens
aagcatcagggggaagaagcaga

SEQ ID NO: 4942717 - DNA, 19 bp, Homo sapiens
aagcatcagttctacggat

SEQ ID NO: 4942718 - DNA, 21 bp, Homo sapiens
aagcatgcttgtgaaaatgtg

SEQ ID NO: 4942719 - DNA, 11 bp, Homo sapiens
aagcatggact

SEQ ID NO: 4942720 - DNA, 16 bp, Homo sapiens
aagcatgtttcatgtt

SEQ ID NO: 4942721 - DNA, 23 bp, Homo sapiens
aagcattctccccagtgtatgtc

SEQ ID NO: 4942722 - DNA, 16 bp, Homo sapiens
aagcatttactttgtg

SEQ ID NO: 4942723 - DNA, 19 bp, Homo sapiens
aagcatttatcattcttgt

SEQ ID NO: 4942724 - DNA, 14 bp, Homo sapiens
aagcatttgtattt

SEQ ID NO: 4942725 - DNA, 21 bp, Homo sapiens
aagcatttgtattttgtgtga

SEQ ID NO: 4942726 - DNA, 15 bp, Homo sapiens
aagccaaagaaatga

SEQ ID NO: 4942727 - DNA, 23 bp, Homo sapiens
aagccaaagaaatgaacattcca

SEQ ID NO: 4942728 - DNA, 18 bp, Homo sapiens
aagccaaagctaggcctg

SEQ ID NO: 4942729 - DNA, 18 bp, Homo sapiens
aagccacaagtcttccag

SEQ ID NO: 4942730 - DNA, 18 bp, Homo sapiens
aagccacattatttctag

SEQ ID NO: 4942731 - DNA, 19 bp, Homo sapiens
aagccacattatttctagt

SEQ ID NO: 4942732 - DNA, 15 bp, Homo sapiens
aagccactagactct

SEQ ID NO: 4942733 - DNA, 13 bp, Homo sapiens
aagccacttgaaa

SEQ ID NO: 4942734 - DNA, 18 bp, Homo sapiens
aagccacttgaaatgtta

SEQ ID NO: 4942735 - DNA, 16 bp, Homo sapiens
aagccagcccggccgc

SEQ ID NO: 4942736 - DNA, 13 bp, Homo sapiens
aagccagcctggt

SEQ ID NO: 4942737 - DNA, 21 bp, Homo sapiens
aagccagcctggtccatgcag

SEQ ID NO: 4942738 - DNA, 21 bp, Homo sapiens
aagccagctgcagctgggctg

SEQ ID NO: 4942739 - DNA, 19 bp, Homo sapiens
aagccagggtctctccctc

SEQ ID NO: 4942740 - DNA, 23 bp, Homo sapiens
aagccagggtctctccctcaggt

SEQ ID NO: 4942741 - DNA, 16 bp, Homo sapiens
aagccatgtataaatg

SEQ ID NO: 4942742 - DNA, 21 bp, Homo sapiens
aagccatgtataaatgtgata

SEQ ID NO: 4942743 - DNA, 18 bp, Homo sapiens
aagccattaaatgaatat

SEQ ID NO: 4942744 - DNA, 23 bp, Homo sapiens
aagcccacagcacagctccctgc

SEQ ID NO: 4942745 - DNA, 21 bp, Homo sapiens
aagcccaggtgccagcctgag

SEQ ID NO: 4942746 - DNA, 19 bp, Homo sapiens
aagcccgcctgacagaaac

SEQ ID NO: 4942747 - DNA, 19 bp, Homo sapiens
aagccctacagagctgtgg

SEQ ID NO: 4942748 - DNA, 13 bp, Homo sapiens
aagccctcccagg

SEQ ID NO: 4942749 - DNA, 20 bp, Homo sapiens
aagccctcccaggtgttaac

SEQ ID NO: 4942750 - DNA, 15 bp, Homo sapiens
aagcccttccatgtc

SEQ ID NO: 4942751 - DNA, 20 bp, Homo sapiens
aagcccttccatgtcgcctc

SEQ ID NO: 4942752 - DNA, 16 bp, Homo sapiens
aagcctacctgctctc

SEQ ID NO: 4942753 - DNA, 21 bp, Homo sapiens
aagcctcaaggttttaggttc

SEQ ID NO: 4942754 - DNA, 20 bp, Homo sapiens
aagcctcatatttaaagaca

SEQ ID NO: 4942755 - DNA, 12 bp, Homo sapiens
aagcctccacag

SEQ ID NO: 4942756 - DNA, 12 bp, Homo sapiens
aagcctctggct

SEQ ID NO: 4942757 - DNA, 14 bp, Homo sapiens
aagcctctggctag

SEQ ID NO: 4942758 - DNA, 23 bp, Homo sapiens
aagcctctggctagaggccagcc

SEQ ID NO: 4942759 - DNA, 21 bp, Homo sapiens
aagcctgcgttggtccagagc

SEQ ID NO: 4942760 - DNA, 17 bp, Homo sapiens
aagcctgggattgacag

SEQ ID NO: 4942761 - DNA, 19 bp, Homo sapiens
aagccttcagctccaggga

SEQ ID NO: 4942762 - DNA, 13 bp, Homo sapiens
aagccttgtgtat

SEQ ID NO: 4942763 - DNA, 19 bp, Homo sapiens
aagccttgtgtatatttgt

SEQ ID NO: 4942764 - DNA, 22 bp, Homo sapiens
aagcgatatacagatgaaaatt

SEQ ID NO: 4942765 - DNA, 17 bp, Homo sapiens
aagcgattcttctgctt

SEQ ID NO: 4942766 - DNA, 22 bp, Homo sapiens
aagcgcatccaatctcaaggaa

SEQ ID NO: 4942767 - DNA, 20 bp, Homo sapiens
aagcggccctaagggagtgt

SEQ ID NO: 4942768 - DNA, 21 bp, Homo sapiens
aagcggccctaagggagtgtc

SEQ ID NO: 4942769 - DNA, 21 bp, Homo sapiens
aagcgtgcacaaggattgaaa

SEQ ID NO: 4942770 - DNA, 19 bp, Homo sapiens
aagctactgtgtgtgtgaa

SEQ ID NO: 4942771 - DNA, 22 bp, Homo sapiens
aagctactgtgtgtgtgaatga

SEQ ID NO: 4942772 - DNA, 22 bp, Homo sapiens
aagctaggcctggccagatgca

SEQ ID NO: 4942773 - DNA, 21 bp, Homo sapiens
aagctattagccaggatcatg

SEQ ID NO: 4942774 - DNA, 13 bp, Homo sapiens
aagctattccttt

SEQ ID NO: 4942775 - DNA, 18 bp, Homo sapiens
aagctcaaataaaaataa

SEQ ID NO: 4942776 - DNA, 16 bp, Homo sapiens
aagctcacaccaaatt

SEQ ID NO: 4942777 - DNA, 12 bp, Homo sapiens
aagctcatattt

SEQ ID NO: 4942778 - DNA, 23 bp, Homo sapiens
aagctcatattttgtatatatct

SEQ ID NO: 4942779 - DNA, 15 bp, Homo sapiens
aagctcatttcatgc

SEQ ID NO: 4942780 - DNA, 14 bp, Homo sapiens
aagctccatctcca

SEQ ID NO: 4942781 - DNA, 14 bp, Homo sapiens
aagctcctcctcgg

SEQ ID NO: 4942782 - DNA, 22 bp, Homo sapiens
aagctctcttgccgaggagcca

SEQ ID NO: 4942783 - DNA, 23 bp, Homo sapiens
aagctctcttgccgaggagccag

SEQ ID NO: 4942784 - DNA, 22 bp, Homo sapiens
aagctcttacactacattagaa

SEQ ID NO: 4942785 - DNA, 14 bp, Homo sapiens
aagctgaaaatata

SEQ ID NO: 4942786 - DNA, 12 bp, Homo sapiens
aagctgcagctt

SEQ ID NO: 4942787 - DNA, 13 bp, Homo sapiens
aagctgcagcttc

SEQ ID NO: 4942788 - DNA, 15 bp, Homo sapiens
aagctgcagcttcct

SEQ ID NO: 4942789 - DNA, 20 bp, Homo sapiens
aagctgccgaaccaaaagaa

SEQ ID NO: 4942790 - DNA, 16 bp, Homo sapiens
aagctgctccaggcct

SEQ ID NO: 4942791 - DNA, 17 bp, Homo sapiens
aagctgctccaggcctg

SEQ ID NO: 4942792 - DNA, 14 bp, Homo sapiens
aagctgctgacagt

SEQ ID NO: 4942793 - DNA, 21 bp, Homo sapiens
aagctgctttaaaaaaataca

SEQ ID NO: 4942794 - DNA, 13 bp, Homo sapiens
aagctggggagga

SEQ ID NO: 4942795 - DNA, 17 bp, Homo sapiens
aagctggtaaactattt

SEQ ID NO: 4942796 - DNA, 18 bp, Homo sapiens
aagctggtcccactcagt

SEQ ID NO: 4942797 - DNA, 21 bp, Homo sapiens
aagctggtcccactcagtcca

SEQ ID NO: 4942798 - DNA, 17 bp, Homo sapiens
aagctggtggccttggc

SEQ ID NO: 4942799 - DNA, 12 bp, Homo sapiens
aagctgttgtac

SEQ ID NO: 4942800 - DNA, 13 bp, Homo sapiens
aagctgttgtaca

SEQ ID NO: 4942801 - DNA, 17 bp, Homo sapiens
aagctgttgtacattta

SEQ ID NO: 4942802 - DNA, 20 bp, Homo sapiens
aagaattgaccatctgcttt

SEQ ID NO: 4942803 - DNA, 20 bp, Homo sapiens
aagaatttcttggtaagaag

SEQ ID NO: 4942804 - DNA, 13 bp, Homo sapiens
aagaatttttaaa

SEQ ID NO: 4942805 - DNA, 14 bp, Homo sapiens
aagaatttttttgt

SEQ ID NO: 4942806 - DNA, 17 bp, Homo sapiens
aagacaaaggttttcct

SEQ ID NO: 4942807 - DNA, 17 bp, Homo sapiens
aagacaaccatatttag

SEQ ID NO: 4942808 - DNA, 19 bp, Homo sapiens
aagacaatttgatacataa

SEQ ID NO: 4942809 - DNA, 14 bp, Homo sapiens
aagacaccagagca

SEQ ID NO: 4942810 - DNA, 21 bp, Homo sapiens
aagacaccagagcagatgcag

SEQ ID NO: 4942811 - DNA, 14 bp, Homo sapiens
aagacactgcctgg

SEQ ID NO: 4942812 - DNA, 17 bp, Homo sapiens
aagacagatgccccaga

SEQ ID NO: 4942813 - DNA, 22 bp, Homo sapiens
aagacaggatgggggctggcct

SEQ ID NO: 4942814 - DNA, 16 bp, Homo sapiens
aagacatatctctaat

SEQ ID NO: 4942815 - DNA, 19 bp, Homo sapiens
aagacatgttgtaaattag

SEQ ID NO: 4942816 - DNA, 14 bp, Homo sapiens
aagacatttctttt

SEQ ID NO: 4942817 - DNA, 21 bp, Homo sapiens
aagacatttcttttcttttta

SEQ ID NO: 4942818 - DNA, 22 bp, Homo sapiens
aagacatttcttttctttttac

SEQ ID NO: 4942819 - DNA, 23 bp, Homo sapiens
aagacatttcttttctttttaca

SEQ ID NO: 4942820 - DNA, 12 bp, Homo sapiens
aagaccagtcca

SEQ ID NO: 4942821 - DNA, 22 bp, Homo sapiens
aagacctactgttctaaagctc

SEQ ID NO: 4942822 - DNA, 18 bp, Homo sapiens
aagacctagtgctcttaa

SEQ ID NO: 4942823 - DNA, 23 bp, Homo sapiens
aagaccttgcttatgattgcaga

SEQ ID NO: 4942824 - DNA, 19 bp, Homo sapiens
aagactaatttaaaaaata

SEQ ID NO: 4942825 - DNA, 15 bp, Homo sapiens
aagactctagagtcc

SEQ ID NO: 4942826 - DNA, 19 bp, Homo sapiens
aagactctagagtccaagg

SEQ ID NO: 4942827 - DNA, 17 bp, Homo sapiens
aagactctattctcaaa

SEQ ID NO: 4942828 - DNA, 20 bp, Homo sapiens
aagactggaagctaatttgc

SEQ ID NO: 4942829 - DNA, 17 bp, Homo sapiens
aagacttagattgtgct

SEQ ID NO: 4942830 - DNA, 19 bp, Homo sapiens
aagacttggcaacagaagc

SEQ ID NO: 4942831 - DNA, 19 bp, Homo sapiens
aagacttgtaatattttta

SEQ ID NO: 4942832 - DNA, 20 bp, Homo sapiens
aagagaaactttatacatta

SEQ ID NO: 4942833 - DNA, 19 bp, Homo sapiens
aagagaaaggcctgcacac

SEQ ID NO: 4942834 - DNA, 16 bp, Homo sapiens
aagagaaccgagcaaa

SEQ ID NO: 4942835 - DNA, 21 bp, Homo sapiens
aagagaaccgagcaaagatca

SEQ ID NO: 4942836 - DNA, 22 bp, Homo sapiens
aagagaaccgagcaaagatcaa

SEQ ID NO: 4942837 - DNA, 13 bp, Homo sapiens
aagagaagaagaa

SEQ ID NO: 4942838 - DNA, 16 bp, Homo sapiens
aagagaagaagaaaaa

SEQ ID NO: 4942839 - DNA, 13 bp, Homo sapiens
aagagaagctgct

SEQ ID NO: 4942840 - DNA, 14 bp, Homo sapiens
aagagaagctgctg

SEQ ID NO: 4942841 - DNA, 17 bp, Homo sapiens
aagagaagctgctgacc

SEQ ID NO: 4942842 - DNA, 19 bp, Homo sapiens
aagagacaaacacctccca

SEQ ID NO: 4942843 - DNA, 13 bp, Homo sapiens
aagagagaaatct

SEQ ID NO: 4942844 - DNA, 19 bp, Homo sapiens
aagagagagagagaaaaaa

SEQ ID NO: 4942845 - DNA, 19 bp, Homo sapiens
aagagagagagagagagaa

SEQ ID NO: 4942846 - DNA, 16 bp, Homo sapiens
aagagagatatatctg

SEQ ID NO: 4942847 - DNA, 20 bp, Homo sapiens
aagagagatatatctgaaaa

SEQ ID NO: 4942848 - DNA, 19 bp, Homo sapiens
aagagaggatgtgcaagcg

SEQ ID NO: 4942849 - DNA, 20 bp, Homo sapiens
aagagaggatgtgcaagcga

SEQ ID NO: 4942850 - DNA, 17 bp, Homo sapiens
aagagattgttgtttgc

SEQ ID NO: 4942851 - DNA, 18 bp, Homo sapiens
aagagcagcctgtggcat

SEQ ID NO: 4942852 - DNA, 20 bp, Homo sapiens
aagagccatataagtttgaa

SEQ ID NO: 4942853 - DNA, 19 bp, Homo sapiens
aagagcctgatctcttcct

SEQ ID NO: 4942854 - DNA, 21 bp, Homo sapiens
aagagcctgatctcttcctgt

SEQ ID NO: 4942855 - DNA, 14 bp, Homo sapiens
aagagcttgctttg

SEQ ID NO: 4942856 - DNA, 16 bp, Homo sapiens
aagaggaactgggcct

SEQ ID NO: 4942857 - DNA, 22 bp, Homo sapiens
aagaggactcgcttgtaaatac

SEQ ID NO: 4942858 - DNA, 13 bp, Homo sapiens
aagaggagcactt

SEQ ID NO: 4942859 - DNA, 22 bp, Homo sapiens
aagaggctgcccctctcaccaa

SEQ ID NO: 4942860 - DNA, 23 bp, Homo sapiens
aagaggctgcccctctcaccaaa

SEQ ID NO: 4942861 - DNA, 22 bp, Homo sapiens
aagagggttttaggtagaaaaa

SEQ ID NO: 4942862 - DNA, 15 bp, Homo sapiens
aagaggtacagggtt

SEQ ID NO: 4942863 - DNA, 15 bp, Homo sapiens
aagaggtgggagggc

SEQ ID NO: 4942864 - DNA, 22 bp, Homo sapiens
aagagtgacagtggattgcatt

SEQ ID NO: 4942865 - DNA, 18 bp, Homo sapiens
aagagtgactagtacaaa

SEQ ID NO: 4942866 - DNA, 17 bp, Homo sapiens
aagagtgattgcagctt

SEQ ID NO: 4942867 - DNA, 14 bp, Homo sapiens
aagagtgtagaagc

SEQ ID NO: 4942868 - DNA, 16 bp, Homo sapiens
aagagtgtagaagcat

SEQ ID NO: 4942869 - DNA, 15 bp, Homo sapiens
aatttagttattgat

SEQ ID NO: 4942870 - DNA, 21 bp, Homo sapiens
aatttatacctacctgtgtgg

SEQ ID NO: 4942871 - DNA, 15 bp, Homo sapiens
aatttatcaaagcat

SEQ ID NO: 4942872 - DNA, 16 bp, Homo sapiens
aatttatcaaagcata

SEQ ID NO: 4942873 - DNA, 18 bp, Homo sapiens
aatttatcctgaaatttc

SEQ ID NO: 4942874 - DNA, 19 bp, Homo sapiens
aatttatcctgaaatttca

SEQ ID NO: 4942875 - DNA, 12 bp, Homo sapiens
aatttatctaaa

SEQ ID NO: 4942876 - DNA, 21 bp, Homo sapiens
aatttatctaaattaaagcct

SEQ ID NO: 4942877 - DNA, 15 bp, Homo sapiens
aatttattaaaatga

SEQ ID NO: 4942878 - DNA, 18 bp, Homo sapiens
aatttattattgaaattg

SEQ ID NO: 4942879 - DNA, 15 bp, Homo sapiens
aatttcaaaaatata

SEQ ID NO: 4942880 - DNA, 16 bp, Homo sapiens
aatttcaaaaatataa

SEQ ID NO: 4942881 - DNA, 19 bp, Homo sapiens
aatttcaaaaatataactt

SEQ ID NO: 4942882 - DNA, 12 bp, Homo sapiens
aatttcaaaatg

SEQ ID NO: 4942883 - DNA, 15 bp, Homo sapiens
aatttcaaggttcta

SEQ ID NO: 4942884 - DNA, 16 bp, Homo sapiens
aatttcaaggttctaa

SEQ ID NO: 4942885 - DNA, 16 bp, Homo sapiens
aatttcacttatacct

SEQ ID NO: 4942886 - DNA, 13 bp, Homo sapiens
aatttcccacccc

SEQ ID NO: 4942887 - DNA, 16 bp, Homo sapiens
aatttcctttatattt

SEQ ID NO: 4942888 - DNA, 18 bp, Homo sapiens
aatttcgccgttgaagag

SEQ ID NO: 4942889 - DNA, 13 bp, Homo sapiens
aatttctaaagat

SEQ ID NO: 4942890 - DNA, 16 bp, Homo sapiens
aatttctaaagataat

SEQ ID NO: 4942891 - DNA, 16 bp, Homo sapiens
aatttctaccatttca

SEQ ID NO: 4942892 - DNA, 18 bp, Homo sapiens
aatttctgtcagaatgct

SEQ ID NO: 4942893 - DNA, 20 bp, Homo sapiens
aatttcttggtaagaagccg

SEQ ID NO: 4942894 - DNA, 11 bp, Homo sapiens
aatttcttgtt

SEQ ID NO: 4942895 - DNA, 17 bp, Homo sapiens
aatttgatacataataa

SEQ ID NO: 4942896 - DNA, 13 bp, Homo sapiens
aatttgatactta

SEQ ID NO: 4942897 - DNA, 15 bp, Homo sapiens
aatttgattaacaaa

SEQ ID NO: 4942898 - DNA, 12 bp, Homo sapiens
aatttgattgat

SEQ ID NO: 4942899 - DNA, 16 bp, Homo sapiens
aatttgattgatttga

SEQ ID NO: 4942900 - DNA, 20 bp, Homo sapiens
aatttgcactaaatcagaga

SEQ ID NO: 4942901 - DNA, 17 bp, Homo sapiens
aatttgcattaaattca

SEQ ID NO: 4942902 - DNA, 21 bp, Homo sapiens
aatttgcattaaattcacaaa

SEQ ID NO: 4942903 - DNA, 14 bp, Homo sapiens
aatttggaaatcct

SEQ ID NO: 4942904 - DNA, 16 bp, Homo sapiens
aatttggattgctaat

SEQ ID NO: 4942905 - DNA, 11 bp, Homo sapiens
aatttggggac

SEQ ID NO: 4942906 - DNA, 23 bp, Homo sapiens
aatttggggacagattcagtctt

SEQ ID NO: 4942907 - DNA, 24 bp, Homo sapiens
aatttggggacagattcagtcttg

SEQ ID NO: 4942908 - DNA, 16 bp, Homo sapiens
aatttgtaagtttcag

SEQ ID NO: 4942909 - DNA, 18 bp, Homo sapiens
aatttgtaagtttcaggt

SEQ ID NO: 4942910 - DNA, 13 bp, Homo sapiens
aattttacacatt

SEQ ID NO: 4942911 - DNA, 23 bp, Homo sapiens
aattttactccataaacagactg

SEQ ID NO: 4942912 - DNA, 12 bp, Homo sapiens
aattttaggaac

SEQ ID NO: 4942913 - DNA, 21 bp, Homo sapiens
aattttaggaacttcagagat

SEQ ID NO: 4942914 - DNA, 21 bp, Homo sapiens
aattttataagcaaatttcaa

SEQ ID NO: 4942915 - DNA, 12 bp, Homo sapiens
aattttctagac

SEQ ID NO: 4942916 - DNA, 17 bp, Homo sapiens
aattttctagactttct

SEQ ID NO: 4942917 - DNA, 23 bp, Homo sapiens
aattttctcaaaagcatttatca

SEQ ID NO: 4942918 - DNA, 20 bp, Homo sapiens
aattttgagttctacataag

SEQ ID NO: 4942919 - DNA, 16 bp, Homo sapiens
aattttgcaaatataa

SEQ ID NO: 4942920 - DNA, 16 bp, Homo sapiens
aattttgcttttaatt

SEQ ID NO: 4942921 - DNA, 15 bp, Homo sapiens
aattttgtaacgaag

SEQ ID NO: 4942922 - DNA, 13 bp, Homo sapiens
aatttttttcacc

SEQ ID NO: 4942923 - DNA, 20 bp, Homo sapiens
aatttttttcacctagattt

SEQ ID NO: 4942924 - DNA, 17 bp, Homo sapiens
aatttttttgagacaga

SEQ ID NO: 4942925 - DNA, 12 bp, Homo sapiens
aattttttttac

SEQ ID NO: 4942926 - DNA, 20 bp, Homo sapiens
aattttttttagtatttatt

SEQ ID NO: 4942927 - DNA, 14 bp, Homo sapiens
acaaaaagaaaaga

SEQ ID NO: 4942928 - DNA, 18 bp, Homo sapiens
acaaaaagtttccatatg

SEQ ID NO: 4942929 - DNA, 23 bp, Homo sapiens
acaaaacactcggcatttcaaat

SEQ ID NO: 4942930 - DNA, 15 bp, Homo sapiens
acaaaactacatgag

SEQ ID NO: 4942931 - DNA, 14 bp, Homo sapiens
acaaaactatactt

SEQ ID NO: 4942932 - DNA, 18 bp, Homo sapiens
acaaaacttcttgtcaga

SEQ ID NO: 4942933 - DNA, 19 bp, Homo sapiens
acaaaacttcttgtcagac

SEQ ID NO: 4942934 - DNA, 20 bp, Homo sapiens
acaaaacttcttgtcagaca

SEQ ID NO: 4942935 - DNA, 16 bp, Homo sapiens
acaaaagaaatacctt

SEQ ID NO: 4942936 - DNA, 18 bp, Homo sapiens
acaaaatagaagctgtag

SEQ ID NO: 4942937 - DNA, 16 bp, Homo sapiens
acaaaatatttcccat

SEQ ID NO: 4942938 - DNA, 17 bp, Homo sapiens
acaaaatctgttgccac

SEQ ID NO: 4942939 - DNA, 11 bp, Homo sapiens
acaaaatggac

SEQ ID NO: 4942940 - DNA, 14 bp, Homo sapiens
acaaacaatctctt

SEQ ID NO: 4942941 - DNA, 15 bp, Homo sapiens
acaaacacctcccag

SEQ ID NO: 4942942 - DNA, 13 bp, Homo sapiens
acaaacattgtgt

SEQ ID NO: 4942943 - DNA, 12 bp, Homo sapiens
acaaacattttt

SEQ ID NO: 4942944 - DNA, 12 bp, Homo sapiens
acaaaccaagtc

SEQ ID NO: 4942945 - DNA, 20 bp, Homo sapiens
acaaaccacaactgacacag

SEQ ID NO: 4942946 - DNA, 18 bp, Homo sapiens
acaaacctaccaaaatgg

SEQ ID NO: 4942947 - DNA, 21 bp, Homo sapiens
acaaacctaccaaaatggaat

SEQ ID NO: 4942948 - DNA, 21 bp, Homo sapiens
acaaactacagacctgctttt

SEQ ID NO: 4942949 - DNA, 14 bp, Homo sapiens
acaaactggagtct

SEQ ID NO: 4942950 - DNA, 12 bp, Homo sapiens
acaaagaaatat

SEQ ID NO: 4942951 - DNA, 15 bp, Homo sapiens
acaaagacattgatt

SEQ ID NO: 4942952 - DNA, 16 bp, Homo sapiens
acaaagcacagtgtta

SEQ ID NO: 4942953 - DNA, 18 bp, Homo sapiens
acaaagcacagtttgaac

SEQ ID NO: 4942954 - DNA, 23 bp, Homo sapiens
acaaaggcaagttaagagaaact

SEQ ID NO: 4942955 - DNA, 14 bp, Homo sapiens
acaaaggccaaact

SEQ ID NO: 4942956 - DNA, 15 bp, Homo sapiens
acaaatatattgtta

SEQ ID NO: 4942957 - DNA, 22 bp, Homo sapiens
acaaatatcttgtgttgtcctt

SEQ ID NO: 4942958 - DNA, 19 bp, Homo sapiens
acaaatatgcaaaaggttc

SEQ ID NO: 4942959 - DNA, 16 bp, Homo sapiens
acaaatatgctaattt

SEQ ID NO: 4942960 - DNA, 12 bp, Homo sapiens
acaaatatttat

SEQ ID NO: 4942961 - DNA, 19 bp, Homo sapiens
acaaatcaacagaagcatt

SEQ ID NO: 4942962 - DNA, 17 bp, Homo sapiens
acaaatgcatgaacaag

SEQ ID NO: 4942963 - DNA, 18 bp, Homo sapiens
acaaatgcatgaacaagt

SEQ ID NO: 4942964 - DNA, 23 bp, Homo sapiens
acaacaaaggcaagttaagagaa

SEQ ID NO: 4942965 - DNA, 19 bp, Homo sapiens
acaacagaagcttcagaag

SEQ ID NO: 4942966 - DNA, 19 bp, Homo sapiens
acaacatccatgtcctatg

SEQ ID NO: 4942967 - DNA, 14 bp, Homo sapiens
acaaccattccaga

SEQ ID NO: 4942968 - DNA, 15 bp, Homo sapiens
acaacctccctcttg

SEQ ID NO: 4942969 - DNA, 16 bp, Homo sapiens
acaacctccctcttgt

SEQ ID NO: 4942970 - DNA, 22 bp, Homo sapiens
acaacctccctcttgttttgtt

SEQ ID NO: 4942971 - DNA, 14 bp, Homo sapiens
acaactgacacagg

SEQ ID NO: 4942972 - DNA, 15 bp, Homo sapiens
acaactgacacagga

SEQ ID NO: 4942973 - DNA, 18 bp, Homo sapiens
acaactgcaataacttct

SEQ ID NO: 4942974 - DNA, 17 bp, Homo sapiens
acaactgtctaacttta

SEQ ID NO: 4942975 - DNA, 18 bp, Homo sapiens
acaagaaatttgatttct

SEQ ID NO: 4942976 - DNA, 14 bp, Homo sapiens
acaagaagaagggc

SEQ ID NO: 4942977 - DNA, 14 bp, Homo sapiens
acaagaagtttatt

SEQ ID NO: 4942978 - DNA, 19 bp, Homo sapiens
acaagaccaccacttcgaa

SEQ ID NO: 4942979 - DNA, 19 bp, Homo sapiens
acaagaccccgtctcaaaa

SEQ ID NO: 4942980 - DNA, 18 bp, Homo sapiens
acaagagcagcctgtggc

SEQ ID NO: 4942981 - DNA, 12 bp, Homo sapiens
aatgtggcttga

SEQ ID NO: 4942982 - DNA, 16 bp, Homo sapiens
aatgtggcttgagaaa

SEQ ID NO: 4942983 - DNA, 21 bp, Homo sapiens
aatgtggcttgagaaatatgg

SEQ ID NO: 4942984 - DNA, 18 bp, Homo sapiens
aatgtggtttcaatctaa

SEQ ID NO: 4942985 - DNA, 14 bp, Homo sapiens
aatgtgtcctatct

SEQ ID NO: 4942986 - DNA, 13 bp, Homo sapiens
aatgtgtgaaaaa

SEQ ID NO: 4942987 - DNA, 16 bp, Homo sapiens
aatgtgtggcctgcac

SEQ ID NO: 4942988 - DNA, 16 bp, Homo sapiens
aatgtgtggtggcctc

SEQ ID NO: 4942989 - DNA, 21 bp, Homo sapiens
aatgtgtggtggcctcagctg

SEQ ID NO: 4942990 - DNA, 18 bp, Homo sapiens
aatgtgtgtatgtgtatt

SEQ ID NO: 4942991 - DNA, 22 bp, Homo sapiens
aatgtgttctcggagtgtgtat

SEQ ID NO: 4942992 - DNA, 12 bp, Homo sapiens
aatgttaaattt

SEQ ID NO: 4942993 - DNA, 18 bp, Homo sapiens
aatgttaaatttgtaagt

SEQ ID NO: 4942994 - DNA, 21 bp, Homo sapiens
aatgttaaatttgtaagtttc

SEQ ID NO: 4942995 - DNA, 13 bp, Homo sapiens
aatgttaagcaga

SEQ ID NO: 4942996 - DNA, 22 bp, Homo sapiens
aatgttatcttctcaagttcta

SEQ ID NO: 4942997 - DNA, 19 bp, Homo sapiens
aatgttatgactatgtaaa

SEQ ID NO: 4942998 - DNA, 19 bp, Homo sapiens
aatgttatttctgcaaaca

SEQ ID NO: 4942999 - DNA, 16 bp, Homo sapiens
aatgttctaagtttct

SEQ ID NO: 4943000 - DNA, 17 bp, Homo sapiens
aatgttctaagtttcta

SEQ ID NO: 4943001 - DNA, 21 bp, Homo sapiens
aatgttggacacctttaggtt

SEQ ID NO: 4943002 - DNA, 13 bp, Homo sapiens
aatgttggtttac

SEQ ID NO: 4943003 - DNA, 21 bp, Homo sapiens
aatgttggtttactttcaaat

SEQ ID NO: 4943004 - DNA, 14 bp, Homo sapiens
aatgtttaatgctg

SEQ ID NO: 4943005 - DNA, 20 bp, Homo sapiens
aatgtttgtctcagttggaa

SEQ ID NO: 4943006 - DNA, 21 bp, Homo sapiens
aattaaaaaaaaagatctgtt

SEQ ID NO: 4943007 - DNA, 15 bp, Homo sapiens
aattaaaaagattct

SEQ ID NO: 4943008 - DNA, 23 bp, Homo sapiens
aattaaaaagattctttttctga

SEQ ID NO: 4943009 - DNA, 16 bp, Homo sapiens
aattaaaacttcttaa

SEQ ID NO: 4943010 - DNA, 22 bp, Homo sapiens
aattaaaaggatagtattttta

SEQ ID NO: 4943011 - DNA, 21 bp, Homo sapiens
aattaaaattgtcccatttgc

SEQ ID NO: 4943012 - DNA, 22 bp, Homo sapiens
aattaaattttgagttctacat

SEQ ID NO: 4943013 - DNA, 14 bp, Homo sapiens
aattaagaaggcaa

SEQ ID NO: 4943014 - DNA, 16 bp, Homo sapiens
aattaagaaggcaaaa

SEQ ID NO: 4943015 - DNA, 13 bp, Homo sapiens
aattaatagcttt

SEQ ID NO: 4943016 - DNA, 20 bp, Homo sapiens
aattaatagtttgtctattt

SEQ ID NO: 4943017 - DNA, 22 bp, Homo sapiens
aattaatagtttgtctatttta

SEQ ID NO: 4943018 - DNA, 16 bp, Homo sapiens
aattaatggaatcttc

SEQ ID NO: 4943019 - DNA, 14 bp, Homo sapiens
aattaatttgatta

SEQ ID NO: 4943020 - DNA, 13 bp, Homo sapiens
aattactaatttt

SEQ ID NO: 4943021 - DNA, 15 bp, Homo sapiens
aattacttaaaaaaa

SEQ ID NO: 4943022 - DNA, 20 bp, Homo sapiens
aattaggcaaggctatgtga

SEQ ID NO: 4943023 - DNA, 23 bp, Homo sapiens
aattaggcaaggctatgtgatta

SEQ ID NO: 4943024 - DNA, 16 bp, Homo sapiens
aattagggtacattta

SEQ ID NO: 4943025 - DNA, 20 bp, Homo sapiens
aattagggtacatttataat

SEQ ID NO: 4943026 - DNA, 15 bp, Homo sapiens
aattaggttaacatt

SEQ ID NO: 4943027 - DNA, 17 bp, Homo sapiens
aattaggtttttcctta

SEQ ID NO: 4943028 - DNA, 21 bp, Homo sapiens
aattaggtttttccttatttg

SEQ ID NO: 4943029 - DNA, 16 bp, Homo sapiens
aattataagtcacaaa

SEQ ID NO: 4943030 - DNA, 20 bp, Homo sapiens
aattatacaaattaaaaaga

SEQ ID NO: 4943031 - DNA, 14 bp, Homo sapiens
aattatagtttctg

SEQ ID NO: 4943032 - DNA, 15 bp, Homo sapiens
aattatagtttctga

SEQ ID NO: 4943033 - DNA, 17 bp, Homo sapiens
aattatagtttctgagg

SEQ ID NO: 4943034 - DNA, 20 bp, Homo sapiens
aattatataggttgtgcaaa

SEQ ID NO: 4943035 - DNA, 21 bp, Homo sapiens
aattatatctgtggtcttcaa

SEQ ID NO: 4943036 - DNA, 15 bp, Homo sapiens
aattatgatttgggt

SEQ ID NO: 4943037 - DNA, 21 bp, Homo sapiens
aattatgggaataattgcttt

SEQ ID NO: 4943038 - DNA, 22 bp, Homo sapiens
aattatgggaataattgctttt

SEQ ID NO: 4943039 - DNA, 18 bp, Homo sapiens
aattatgtaatgcaaaat

SEQ ID NO: 4943040 - DNA, 15 bp, Homo sapiens
aattatgtgacattt

SEQ ID NO: 4943041 - DNA, 19 bp, Homo sapiens
aattattaactacatttat

SEQ ID NO: 4943042 - DNA, 23 bp, Homo sapiens
aattattaactacatttatgagt

SEQ ID NO: 4943043 - DNA, 16 bp, Homo sapiens
aattattgatatatat

SEQ ID NO: 4943044 - DNA, 14 bp, Homo sapiens
aattcaaaaagtgt

SEQ ID NO: 4943045 - DNA, 15 bp, Homo sapiens
aattcaaaaagtgtt

SEQ ID NO: 4943046 - DNA, 23 bp, Homo sapiens
aattcaaaagttccaagagtcta

SEQ ID NO: 4943047 - DNA, 17 bp, Homo sapiens
aattcaattttaaagac

SEQ ID NO: 4943048 - DNA, 19 bp, Homo sapiens
aattcacaaacttttatac

SEQ ID NO: 4943049 - DNA, 15 bp, Homo sapiens
aattcagcaaaccat

SEQ ID NO: 4943050 - DNA, 13 bp, Homo sapiens
aattcatattctg

SEQ ID NO: 4943051 - DNA, 12 bp, Homo sapiens
aattccaaagtc

SEQ ID NO: 4943052 - DNA, 13 bp, Homo sapiens
aattccaaagtct

SEQ ID NO: 4943053 - DNA, 22 bp, Homo sapiens
aattccactgtcaagaaagagc

SEQ ID NO: 4943054 - DNA, 18 bp, Homo sapiens
aattcctacagcactact

SEQ ID NO: 4943055 - DNA, 19 bp, Homo sapiens
aattcctacagcactactg

SEQ ID NO: 4943056 - DNA, 16 bp, Homo sapiens
aattctataaggccat

SEQ ID NO: 4943057 - DNA, 12 bp, Homo sapiens
aattctgtaaat

SEQ ID NO: 4943058 - DNA, 23 bp, Homo sapiens
aattctgtgggtccgataatatc

SEQ ID NO: 4943059 - DNA, 23 bp, Homo sapiens
aattcttacactgcctgtatact

SEQ ID NO: 4943060 - DNA, 19 bp, Homo sapiens
aattcttcagcgtaaaatg

SEQ ID NO: 4943061 - DNA, 20 bp, Homo sapiens
aattctttatttctgtcatt

SEQ ID NO: 4943062 - DNA, 17 bp, Homo sapiens
aattgaccatctgcttt

SEQ ID NO: 4943063 - DNA, 19 bp, Homo sapiens
aattgaccatctgctttta

SEQ ID NO: 4943064 - DNA, 16 bp, Homo sapiens
aattgatttgcattga

SEQ ID NO: 4943065 - DNA, 18 bp, Homo sapiens
aattgcaaatcttgaaat

SEQ ID NO: 4943066 - DNA, 13 bp, Homo sapiens
aattgctatgtta

SEQ ID NO: 4943067 - DNA, 14 bp, Homo sapiens
aattgctatgttac

SEQ ID NO: 4943068 - DNA, 20 bp, Homo sapiens
aattgctatgttactatttt

SEQ ID NO: 4943069 - DNA, 14 bp, Homo sapiens
aattgctcaagttc

SEQ ID NO: 4943070 - DNA, 20 bp, Homo sapiens
aattgctcctaagcttcaaa

SEQ ID NO: 4943071 - DNA, 23 bp, Homo sapiens
aattgctgaagggcattctttcc

SEQ ID NO: 4943072 - DNA, 15 bp, Homo sapiens
aattgggttcatgat

SEQ ID NO: 4943073 - DNA, 21 bp, Homo sapiens
aattgtacatatttgtggaat

SEQ ID NO: 4943074 - DNA, 16 bp, Homo sapiens
aattgtgctgccattt

SEQ ID NO: 4943075 - DNA, 13 bp, Homo sapiens
aattgtgcttctc

SEQ ID NO: 4943076 - DNA, 20 bp, Homo sapiens
aattgtgcttctccccagaa

SEQ ID NO: 4943077 - DNA, 18 bp, Homo sapiens
aattgtgggcataaactg

SEQ ID NO: 4943078 - DNA, 17 bp, Homo sapiens
aattgttgtttctttct

SEQ ID NO: 4943079 - DNA, 18 bp, Homo sapiens
aattgttgtttctttcta

SEQ ID NO: 4943080 - DNA, 22 bp, Homo sapiens
aattgtttggggatgagaaagg

SEQ ID NO: 4943081 - DNA, 15 bp, Homo sapiens
aattgttttctttaa

SEQ ID NO: 4943082 - DNA, 10 bp, Homo sapiens
aatttaaaca

SEQ ID NO: 4943083 - DNA, 23 bp, Homo sapiens
aatttaaatataattctgtaaat

SEQ ID NO: 4943084 - DNA, 13 bp, Homo sapiens
aatttaaatgtta

SEQ ID NO: 4943085 - DNA, 11 bp, Homo sapiens
aatttaaattt

SEQ ID NO: 4943086 - DNA, 21 bp, Homo sapiens
aatttaactacccttaattac

SEQ ID NO: 4943087 - DNA, 14 bp, Homo sapiens
aatttaatgctgcc

SEQ ID NO: 4943088 - DNA, 15 bp, Homo sapiens
aatttaatgctgcct

SEQ ID NO: 4943089 - DNA, 13 bp, Homo sapiens
aatttactatata

SEQ ID NO: 4943090 - DNA, 16 bp, Homo sapiens
aatttactatatatat

SEQ ID NO: 4943091 - DNA, 16 bp, Homo sapiens
aatttagggtactaaa

SEQ ID NO: 4943092 - DNA, 19 bp, Homo sapiens
acaagagcagcctgtggca

SEQ ID NO: 4943093 - DNA, 19 bp, Homo sapiens
acaagaggtacagggtttt

SEQ ID NO: 4943094 - DNA, 18 bp, Homo sapiens
acaagagtttatttccaa

SEQ ID NO: 4943095 - DNA, 15 bp, Homo sapiens
acaagatattgtaca

SEQ ID NO: 4943096 - DNA, 16 bp, Homo sapiens
acaagatttagaaaaa

SEQ ID NO: 4943097 - DNA, 20 bp, Homo sapiens
acaagatttccttgtgcaaa

SEQ ID NO: 4943098 - DNA, 11 bp, Homo sapiens
acaagcagagg

SEQ ID NO: 4943099 - DNA, 20 bp, Homo sapiens
acaagcagagtgcacagctg

SEQ ID NO: 4943100 - DNA, 22 bp, Homo sapiens
acaagcagagtgcacagctgtc

SEQ ID NO: 4943101 - DNA, 18 bp, Homo sapiens
acaagcctggcaacacac

SEQ ID NO: 4943102 - DNA, 21 bp, Homo sapiens
acaagcgtgagccactgcacc

SEQ ID NO: 4943103 - DNA, 22 bp, Homo sapiens
acaagctaattgggagtccagg

SEQ ID NO: 4943104 - DNA, 13 bp, Homo sapiens
acaaggattgaaa

SEQ ID NO: 4943105 - DNA, 16 bp, Homo sapiens
acaaggattgaaaatt

SEQ ID NO: 4943106 - DNA, 21 bp, Homo sapiens
acaagggctgacctgcctctc

SEQ ID NO: 4943107 - DNA, 21 bp, Homo sapiens
acaaggtacccctttctggct

SEQ ID NO: 4943108 - DNA, 21 bp, Homo sapiens
acaagtatgaataaagacacc

SEQ ID NO: 4943109 - DNA, 16 bp, Homo sapiens
acaagtcctgtgaatt

SEQ ID NO: 4943110 - DNA, 23 bp, Homo sapiens
acaagtgaaataacaaaatggac

SEQ ID NO: 4943111 - DNA, 22 bp, Homo sapiens
acaagtgactgtatctgtgtag

SEQ ID NO: 4943112 - DNA, 18 bp, Homo sapiens
acaagtgtatatcagaaa

SEQ ID NO: 4943113 - DNA, 19 bp, Homo sapiens
acaagtgtatatcagaaaa

SEQ ID NO: 4943114 - DNA, 20 bp, Homo sapiens
acaagtgtatatcagaaaag

SEQ ID NO: 4943115 - DNA, 13 bp, Homo sapiens
acaagttccatgg

SEQ ID NO: 4943116 - DNA, 15 bp, Homo sapiens
acaagtttttctgtc

SEQ ID NO: 4943117 - DNA, 13 bp, Homo sapiens
acaataaaagctt

SEQ ID NO: 4943118 - DNA, 12 bp, Homo sapiens
acaataaacctc

SEQ ID NO: 4943119 - DNA, 15 bp, Homo sapiens
acaataagcaaaaac

SEQ ID NO: 4943120 - DNA, 17 bp, Homo sapiens
acaatatataaaaatat

SEQ ID NO: 4943121 - DNA, 17 bp, Homo sapiens
acaatatcatatcatca

SEQ ID NO: 4943122 - DNA, 15 bp, Homo sapiens
acaatatttataaag

SEQ ID NO: 4943123 - DNA, 17 bp, Homo sapiens
acaatcattgttttgaa

SEQ ID NO: 4943124 - DNA, 18 bp, Homo sapiens
acaatctggaagaaaaaa

SEQ ID NO: 4943125 - DNA, 16 bp, Homo sapiens
acaatgaacacttata

SEQ ID NO: 4943126 - DNA, 18 bp, Homo sapiens
acaatgaagataaaaaga

SEQ ID NO: 4943127 - DNA, 20 bp, Homo sapiens
acaatgatgccctgctccag

SEQ ID NO: 4943128 - DNA, 16 bp, Homo sapiens
acaatgcaaaaccttt

SEQ ID NO: 4943129 - DNA, 19 bp, Homo sapiens
acaatgcacctagctgtgc

SEQ ID NO: 4943130 - DNA, 17 bp, Homo sapiens
acaatgctgatttggtg

SEQ ID NO: 4943131 - DNA, 22 bp, Homo sapiens
acaatgtcatatactgccatgt

SEQ ID NO: 4943132 - DNA, 21 bp, Homo sapiens
acaatgtggccgaggactttg

SEQ ID NO: 4943133 - DNA, 18 bp, Homo sapiens
acaatgtgtttttctcca

SEQ ID NO: 4943134 - DNA, 14 bp, Homo sapiens
acaatgttaaggaa

SEQ ID NO: 4943135 - DNA, 20 bp, Homo sapiens
acaatgttaaggaaactctt

SEQ ID NO: 4943136 - DNA, 15 bp, Homo sapiens
acaattctacattgt

SEQ ID NO: 4943137 - DNA, 22 bp, Homo sapiens
acaattgaggtaagttttttga

SEQ ID NO: 4943138 - DNA, 17 bp, Homo sapiens
acaatttcctttatatt

SEQ ID NO: 4943139 - DNA, 23 bp, Homo sapiens
acaatttcctttatatttagtga

SEQ ID NO: 4943140 - DNA, 15 bp, Homo sapiens
acaatttgatacata

SEQ ID NO: 4943141 - DNA, 17 bp, Homo sapiens
acaatttgatacataat

SEQ ID NO: 4943142 - DNA, 15 bp, Homo sapiens
acacttcaggctctt

SEQ ID NO: 4943143 - DNA, 23 bp, Homo sapiens
acacttctgtgagacccccacac

SEQ ID NO: 4943144 - DNA, 17 bp, Homo sapiens
acacttgtataaatgta

SEQ ID NO: 4943145 - DNA, 20 bp, Homo sapiens
acacttgtataaatgtatat

SEQ ID NO: 4943146 - DNA, 19 bp, Homo sapiens
acacttgttccagctcttt

SEQ ID NO: 4943147 - DNA, 16 bp, Homo sapiens
acactttgcctcctgt

SEQ ID NO: 4943148 - DNA, 23 bp, Homo sapiens
acactttgcctcctgtgtactgt

SEQ ID NO: 4943149 - DNA, 11 bp, Homo sapiens
acacttttatg

SEQ ID NO: 4943150 - DNA, 15 bp, Homo sapiens
acagaaaaatcttgt

SEQ ID NO: 4943151 - DNA, 13 bp, Homo sapiens
acagaaacactgc

SEQ ID NO: 4943152 - DNA, 14 bp, Homo sapiens
acagaaatatatat

SEQ ID NO: 4943153 - DNA, 17 bp, Homo sapiens
acagaaatatatataca

SEQ ID NO: 4943154 - DNA, 18 bp, Homo sapiens
acagaaatatatatacat

SEQ ID NO: 4943155 - DNA, 22 bp, Homo sapiens
acagaaatatatatacatatgt

SEQ ID NO: 4943156 - DNA, 13 bp, Homo sapiens
acagaacagcttc

SEQ ID NO: 4943157 - DNA, 15 bp, Homo sapiens
acagaacagcttcag

SEQ ID NO: 4943158 - DNA, 16 bp, Homo sapiens
acagaacagcttcagg

SEQ ID NO: 4943159 - DNA, 18 bp, Homo sapiens
acagaacagcttcaggtt

SEQ ID NO: 4943160 - DNA, 15 bp, Homo sapiens
acagaactaaatgtt

SEQ ID NO: 4943161 - DNA, 17 bp, Homo sapiens
acagaacttgaatgtgt

SEQ ID NO: 4943162 - DNA, 19 bp, Homo sapiens
acagaacttgaatgtgtca

SEQ ID NO: 4943163 - DNA, 13 bp, Homo sapiens
acagaagcatttg

SEQ ID NO: 4943164 - DNA, 23 bp, Homo sapiens
acagaagcatttgtattttgtgt

SEQ ID NO: 4943165 - DNA, 18 bp, Homo sapiens
acagaagcttcagaagtt

SEQ ID NO: 4943166 - DNA, 15 bp, Homo sapiens
acagaatgtatctgt

SEQ ID NO: 4943167 - DNA, 17 bp, Homo sapiens
acagaatgtatctgtga

SEQ ID NO: 4943168 - DNA, 18 bp, Homo sapiens
acagacacacacacgcac

SEQ ID NO: 4943169 - DNA, 13 bp, Homo sapiens
acagacacaggcc

SEQ ID NO: 4943170 - DNA, 15 bp, Homo sapiens
acagacacaggcccg

SEQ ID NO: 4943171 - DNA, 18 bp, Homo sapiens
acagacacaggcccggct

SEQ ID NO: 4943172 - DNA, 22 bp, Homo sapiens
acagacacaggcccggctccag

SEQ ID NO: 4943173 - DNA, 20 bp, Homo sapiens
acagaccacatctttatctg

SEQ ID NO: 4943174 - DNA, 22 bp, Homo sapiens
acagaccacatctttatctgtt

SEQ ID NO: 4943175 - DNA, 21 bp, Homo sapiens
acagacctgctttttgaaatg

SEQ ID NO: 4943176 - DNA, 14 bp, Homo sapiens
acagactggaagca

SEQ ID NO: 4943177 - DNA, 17 bp, Homo sapiens
acagactggaagcacag

SEQ ID NO: 4943178 - DNA, 18 bp, Homo sapiens
acagagaaagtacttctc

SEQ ID NO: 4943179 - DNA, 17 bp, Homo sapiens
acagagaagctggggag

SEQ ID NO: 4943180 - DNA, 20 bp, Homo sapiens
acagagattgaactccaaga

SEQ ID NO: 4943181 - DNA, 22 bp, Homo sapiens
acagagcactaggttcaattcc

SEQ ID NO: 4943182 - DNA, 21 bp, Homo sapiens
acagaggaatttatacctcaa

SEQ ID NO: 4943183 - DNA, 23 bp, Homo sapiens
acagaggccatgggcctcctgtg

SEQ ID NO: 4943184 - DNA, 14 bp, Homo sapiens
acagaggcctgccc

SEQ ID NO: 4943185 - DNA, 15 bp, Homo sapiens
acagaggggactctg

SEQ ID NO: 4943186 - DNA, 18 bp, Homo sapiens
acagagtgtggactctgg

SEQ ID NO: 4943187 - DNA, 18 bp, Homo sapiens
acagagttttcactctta

SEQ ID NO: 4943188 - DNA, 15 bp, Homo sapiens
acagatacacacaca

SEQ ID NO: 4943189 - DNA, 13 bp, Homo sapiens
acagatacatttc

SEQ ID NO: 4943190 - DNA, 13 bp, Homo sapiens
acagatgaaaatt

SEQ ID NO: 4943191 - DNA, 17 bp, Homo sapiens
acagatgaatgtattta

SEQ ID NO: 4943192 - DNA, 13 bp, Homo sapiens
acagatgccccag

SEQ ID NO: 4943193 - DNA, 16 bp, Homo sapiens
acagatgccccagagc

SEQ ID NO: 4943194 - DNA, 21 bp, Homo sapiens
acagatgccccagagctgttt

SEQ ID NO: 4943195 - DNA, 22 bp, Homo sapiens
acagatgccccagagctgttta

SEQ ID NO: 4943196 - DNA, 19 bp, Homo sapiens
acagatgccttttttgtag

SEQ ID NO: 4943197 - DNA, 13 bp, Homo sapiens
acagattcagtct

SEQ ID NO: 4943198 - DNA, 14 bp, Homo sapiens
acagattcagtctt

SEQ ID NO: 4943199 - DNA, 17 bp, Homo sapiens
acagattcagtcttgcc

SEQ ID NO: 4943200 - DNA, 18 bp, Homo sapiens
acagattcagtcttgcct

SEQ ID NO: 4943201 - DNA, 15 bp, Homo sapiens
acagatttcatacct

SEQ ID NO: 4943202 - DNA, 17 bp, Homo sapiens
acagatttcatacctca

SEQ ID NO: 4943203 - DNA, 11 bp, Homo sapiens
acagattttaa

SEQ ID NO: 4943204 - DNA, 14 bp, Homo sapiens
acagattttaattg

SEQ ID NO: 4943205 - DNA, 14 bp, Homo sapiens
acagctccttctgt

SEQ ID NO: 4943206 - DNA, 23 bp, Homo sapiens
acagctccttctgtcctactctg

SEQ ID NO: 4943207 - DNA, 15 bp, Homo sapiens
acagctctggccaca

SEQ ID NO: 4943208 - DNA, 14 bp, Homo sapiens
acagctctgtcctg

SEQ ID NO: 4943209 - DNA, 18 bp, Homo sapiens
acagctcttctccaggct

SEQ ID NO: 4943210 - DNA, 20 bp, Homo sapiens
acagctcttctccaggctgt

SEQ ID NO: 4943211 - DNA, 19 bp, Homo sapiens
acagctgagagacttttaa

SEQ ID NO: 4943212 - DNA, 16 bp, Homo sapiens
acagctgcctgcagta

SEQ ID NO: 4943213 - DNA, 15 bp, Homo sapiens
acagctggagctctc

SEQ ID NO: 4943214 - DNA, 21 bp, Homo sapiens
acagcttcatttcctgtgtct

SEQ ID NO: 4943215 - DNA, 16 bp, Homo sapiens
acagctttacacacac

SEQ ID NO: 4943216 - DNA, 17 bp, Homo sapiens
acagctttcttgctccc

SEQ ID NO: 4943217 - DNA, 16 bp, Homo sapiens
acaggaaagtgttatt

SEQ ID NO: 4943218 - DNA, 20 bp, Homo sapiens
acaggaaggtggtgcttaca

SEQ ID NO: 4943219 - DNA, 15 bp, Homo sapiens
acaggactctgcctc

SEQ ID NO: 4943220 - DNA, 21 bp, Homo sapiens
acaggatgaggtggtggagtg

SEQ ID NO: 4943221 - DNA, 19 bp, Homo sapiens
acaggatgggggctggcct

SEQ ID NO: 4943222 - DNA, 18 bp, Homo sapiens
acaggcaagcacctcctg

SEQ ID NO: 4943223 - DNA, 16 bp, Homo sapiens
acaggcaatgctggct

SEQ ID NO: 4943224 - DNA, 23 bp, Homo sapiens
acaggcaatgctggctgttggct

SEQ ID NO: 4943225 - DNA, 17 bp, Homo sapiens
acaggcagctttctaga

SEQ ID NO: 4943226 - DNA, 19 bp, Homo sapiens
acaggcagctttctagaag

SEQ ID NO: 4943227 - DNA, 16 bp, Homo sapiens
acaggcaggtccaggg

SEQ ID NO: 4943228 - DNA, 20 bp, Homo sapiens
acaggcagtctctctcttcc

SEQ ID NO: 4943229 - DNA, 21 bp, Homo sapiens
acaggcataaaatagagtaaa

SEQ ID NO: 4943230 - DNA, 21 bp, Homo sapiens
acaggcatgggtgcaaggaaa

SEQ ID NO: 4943231 - DNA, 19 bp, Homo sapiens
acaggcatgttctctgagg

SEQ ID NO: 4943232 - DNA, 20 bp, Homo sapiens
acaggcatgttctctgagga

SEQ ID NO: 4943233 - DNA, 22 bp, Homo sapiens
acaggcatgttctctgaggaca

SEQ ID NO: 4943234 - DNA, 18 bp, Homo sapiens
acaggcatttgttcactg

SEQ ID NO: 4943235 - DNA, 21 bp, Homo sapiens
acaggcccccttgagtggggt

SEQ ID NO: 4943236 - DNA, 15 bp, Homo sapiens
acaggccctgctcct

SEQ ID NO: 4943237 - DNA, 19 bp, Homo sapiens
acaggccctgctcctgcag

SEQ ID NO: 4943238 - DNA, 22 bp, Homo sapiens
acaggcccttcctctccactgc

SEQ ID NO: 4943239 - DNA, 13 bp, Homo sapiens
acaggcctcacct

SEQ ID NO: 4943240 - DNA, 15 bp, Homo sapiens
acaggcctcacctct

SEQ ID NO: 4943241 - DNA, 20 bp, Homo sapiens
acaggcctgaagatattact

SEQ ID NO: 4943242 - DNA, 19 bp, Homo sapiens
acaggcgagagaggagcca

SEQ ID NO: 4943243 - DNA, 14 bp, Homo sapiens
acaggctgggcttc

SEQ ID NO: 4943244 - DNA, 19 bp, Homo sapiens
acaggctgttctgcactga

SEQ ID NO: 4943245 - DNA, 12 bp, Homo sapiens
acagggcacacc

SEQ ID NO: 4943246 - DNA, 22 bp, Homo sapiens
acagggcatgccccggccacct

SEQ ID NO: 4943247 - DNA, 23 bp, Homo sapiens
acagggcatgccccggccacctc

SEQ ID NO: 4943248 - DNA, 18 bp, Homo sapiens
acagggccagtggggcct

SEQ ID NO: 4943249 - DNA, 20 bp, Homo sapiens
acagggccagtggggcctgt

SEQ ID NO: 4943250 - DNA, 15 bp, Homo sapiens
acagggtttcaccat

SEQ ID NO: 4943251 - DNA, 18 bp, Homo sapiens
acaggtaaactatcttgg

SEQ ID NO: 4943252 - DNA, 17 bp, Homo sapiens
acaggtattttgtttct

SEQ ID NO: 4943253 - DNA, 19 bp, Homo sapiens
acaggtcccacctccagcc

SEQ ID NO: 4943254 - DNA, 20 bp, Homo sapiens
acaggtcccacctccagccc

SEQ ID NO: 4943255 - DNA, 21 bp, Homo sapiens
acaggtcccacctccagcccg

SEQ ID NO: 4943256 - DNA, 15 bp, Homo sapiens
acaggtccctcccct

SEQ ID NO: 4943257 - DNA, 16 bp, Homo sapiens
acaggtcttcatcgaa

SEQ ID NO: 4943258 - DNA, 19 bp, Homo sapiens
acaggtgtgaaccaccaca

SEQ ID NO: 4943259 - DNA, 23 bp, Homo sapiens
acaggtgtgagtcaccaagccca

SEQ ID NO: 4943260 - DNA, 18 bp, Homo sapiens
acaggtgtggtgtaattt

SEQ ID NO: 4943261 - DNA, 20 bp, Homo sapiens
acaggttggaagagaatcac

SEQ ID NO: 4943262 - DNA, 10 bp, Homo sapiens
acagtaactt

SEQ ID NO: 4943263 - DNA, 19 bp, Homo sapiens
acagtaactttatgtgtaa

SEQ ID NO: 4943264 - DNA, 21 bp, Homo sapiens
acagtaactttatgtgtaaat

SEQ ID NO: 4943265 - DNA, 15 bp, Homo sapiens
acagtacagcatgtg

SEQ ID NO: 4943266 - DNA, 17 bp, Homo sapiens
acagtacagcatgtgcc

SEQ ID NO: 4943267 - DNA, 14 bp, Homo sapiens
acagtagagccagc

SEQ ID NO: 4943268 - DNA, 16 bp, Homo sapiens
acagtattacttctgc

SEQ ID NO: 4943269 - DNA, 17 bp, Homo sapiens
acagtattacttctgct

SEQ ID NO: 4943270 - DNA, 15 bp, Homo sapiens
acagtatttcattgc

SEQ ID NO: 4943271 - DNA, 17 bp, Homo sapiens
accagccccagtgccca

SEQ ID NO: 4943272 - DNA, 20 bp, Homo sapiens
accagccctggggctgggcc

SEQ ID NO: 4943273 - DNA, 14 bp, Homo sapiens
accagcctccatgc

SEQ ID NO: 4943274 - DNA, 16 bp, Homo sapiens
accagctaccctgtgt

SEQ ID NO: 4943275 - DNA, 17 bp, Homo sapiens
accagctgtaacacagc

SEQ ID NO: 4943276 - DNA, 18 bp, Homo sapiens
accagcttgcgaataaca

SEQ ID NO: 4943277 - DNA, 13 bp, Homo sapiens
accagcttttaac

SEQ ID NO: 4943278 - DNA, 15 bp, Homo sapiens
accagcttttaacca

SEQ ID NO: 4943279 - DNA, 21 bp, Homo sapiens
accaggaaaggattttataat

SEQ ID NO: 4943280 - DNA, 15 bp, Homo sapiens
accaggactccctcc

SEQ ID NO: 4943281 - DNA, 14 bp, Homo sapiens
accaggatttctaa

SEQ ID NO: 4943282 - DNA, 20 bp, Homo sapiens
accagtctttaaaggcccag

SEQ ID NO: 4943283 - DNA, 21 bp, Homo sapiens
accagtctttaaaggcccagc

SEQ ID NO: 4943284 - DNA, 15 bp, Homo sapiens
accagtgccaaggac

SEQ ID NO: 4943285 - DNA, 16 bp, Homo sapiens
accagtgccaaggacc

SEQ ID NO: 4943286 - DNA, 21 bp, Homo sapiens
accagtggcgttgttgcatgt

SEQ ID NO: 4943287 - DNA, 24 bp, Homo sapiens
accagttgaataaaagtgcacacc

SEQ ID NO: 4943288 - DNA, 18 bp, Homo sapiens
accataaatgaatcatca

SEQ ID NO: 4943289 - DNA, 22 bp, Homo sapiens
accataaggtttcgtttctgta

SEQ ID NO: 4943290 - DNA, 23 bp, Homo sapiens
accatataaagggggagggaaat

SEQ ID NO: 4943291 - DNA, 23 bp, Homo sapiens
accatatactgttcttcatttta

SEQ ID NO: 4943292 - DNA, 21 bp, Homo sapiens
accatatttatccatttgtaa

SEQ ID NO: 4943293 - DNA, 14 bp, Homo sapiens
accatcatgtctgg

SEQ ID NO: 4943294 - DNA, 17 bp, Homo sapiens
accatcatgtctggcta

SEQ ID NO: 4943295 - DNA, 23 bp, Homo sapiens
accatccactctaccctcccacc

SEQ ID NO: 4943296 - DNA, 14 bp, Homo sapiens
accatcctggctgc

SEQ ID NO: 4943297 - DNA, 14 bp, Homo sapiens
accatctgctttta

SEQ ID NO: 4943298 - DNA, 15 bp, Homo sapiens
accatgaagacagga

SEQ ID NO: 4943299 - DNA, 15 bp, Homo sapiens
accatggccagccaa

SEQ ID NO: 4943300 - DNA, 15 bp, Homo sapiens
accatgtgtcacttg

SEQ ID NO: 4943301 - DNA, 13 bp, Homo sapiens
accattaaaactg

SEQ ID NO: 4943302 - DNA, 17 bp, Homo sapiens
accattcacaataaaag

SEQ ID NO: 4943303 - DNA, 11 bp, Homo sapiens
accatttcaga

SEQ ID NO: 4943304 - DNA, 23 bp, Homo sapiens
accatttgaagtgtacctgtgta

SEQ ID NO: 4943305 - DNA, 18 bp, Homo sapiens
accatttgctactgtaca

SEQ ID NO: 4943306 - DNA, 21 bp, Homo sapiens
accattttggggtacccactg

SEQ ID NO: 4943307 - DNA, 14 bp, Homo sapiens
acccaaaccctagg

SEQ ID NO: 4943308 - DNA, 15 bp, Homo sapiens
acccaaaccctaggt

SEQ ID NO: 4943309 - DNA, 17 bp, Homo sapiens
acccaaagcatggacta

SEQ ID NO: 4943310 - DNA, 15 bp, Homo sapiens
accccttcgctcctg

SEQ ID NO: 4943311 - DNA, 17 bp, Homo sapiens
acccctttctggctctc

SEQ ID NO: 4943312 - DNA, 21 bp, Homo sapiens
acccgaccccccgtgggctcc

SEQ ID NO: 4943313 - DNA, 21 bp, Homo sapiens
acccggaggggcctggcagcc

SEQ ID NO: 4943314 - DNA, 15 bp, Homo sapiens
acccggcccctgctg

SEQ ID NO: 4943315 - DNA, 16 bp, Homo sapiens
acccggcccctgctgg

SEQ ID NO: 4943316 - DNA, 16 bp, Homo sapiens
acccggtttcttttta

SEQ ID NO: 4943317 - DNA, 19 bp, Homo sapiens
acccggtttctttttaagt

SEQ ID NO: 4943318 - DNA, 12 bp, Homo sapiens
acccgttccaaa

SEQ ID NO: 4943319 - DNA, 13 bp, Homo sapiens
accctaatgtctt

SEQ ID NO: 4943320 - DNA, 13 bp, Homo sapiens
accctacctgtgc

SEQ ID NO: 4943321 - DNA, 14 bp, Homo sapiens
accctacttctttt

SEQ ID NO: 4943322 - DNA, 19 bp, Homo sapiens
accctaggttccctgttct

SEQ ID NO: 4943323 - DNA, 16 bp, Homo sapiens
accctagtttccctga

SEQ ID NO: 4943324 - DNA, 15 bp, Homo sapiens
accctatctcctgac

SEQ ID NO: 4943325 - DNA, 15 bp, Homo sapiens
accctcactctgcca

SEQ ID NO: 4943326 - DNA, 16 bp, Homo sapiens
accctcactctgccag

SEQ ID NO: 4943327 - DNA, 14 bp, Homo sapiens
accctcccaccccc

SEQ ID NO: 4943328 - DNA, 20 bp, Homo sapiens
accctcccacccccttctct

SEQ ID NO: 4943329 - DNA, 23 bp, Homo sapiens
accctcccccaggaggtcgaccc

SEQ ID NO: 4943330 - DNA, 14 bp, Homo sapiens
accctccctggagt

SEQ ID NO: 4943331 - DNA, 15 bp, Homo sapiens
accctccctggagtg

SEQ ID NO: 4943332 - DNA, 21 bp, Homo sapiens
accctcctttcaccacatgtg

SEQ ID NO: 4943333 - DNA, 16 bp, Homo sapiens
accctcgaagcgcgcc

SEQ ID NO: 4943334 - DNA, 15 bp, Homo sapiens
accctctcagctcca

SEQ ID NO: 4943335 - DNA, 15 bp, Homo sapiens
accctctgaccctag

SEQ ID NO: 4943336 - DNA, 14 bp, Homo sapiens
accctctgccacca

SEQ ID NO: 4943337 - DNA, 12 bp, Homo sapiens
accctctgggaa

SEQ ID NO: 4943338 - DNA, 15 bp, Homo sapiens
accctctgggaacct

SEQ ID NO: 4943339 - DNA, 23 bp, Homo sapiens
accctctgggaacctcccagagg

SEQ ID NO: 4943340 - DNA, 15 bp, Homo sapiens
accctcttcctgtga

SEQ ID NO: 4943341 - DNA, 20 bp, Homo sapiens
accctgaggtcagggagtgc

SEQ ID NO: 4943342 - DNA, 16 bp, Homo sapiens
accctgagttcatcca

SEQ ID NO: 4943343 - DNA, 19 bp, Homo sapiens
accctgcaaacagaacagg

SEQ ID NO: 4943344 - DNA, 15 bp, Homo sapiens
accctgcaaggccca

SEQ ID NO: 4943345 - DNA, 18 bp, Homo sapiens
accctgcaaggcccacag

SEQ ID NO: 4943346 - DNA, 14 bp, Homo sapiens
accctggaaatgga

SEQ ID NO: 4943347 - DNA, 13 bp, Homo sapiens
acctgcctcctgc

SEQ ID NO: 4943348 - DNA, 17 bp, Homo sapiens
acctgcctcctgcctgc

SEQ ID NO: 4943349 - DNA, 15 bp, Homo sapiens
acctgcctctcacac

SEQ ID NO: 4943350 - DNA, 19 bp, Homo sapiens
acctgcctctcacacacat

SEQ ID NO: 4943351 - DNA, 22 bp, Homo sapiens
acctgcctctcacacacataga

SEQ ID NO: 4943352 - DNA, 10 bp, Homo sapiens
acctgcctgc

SEQ ID NO: 4943353 - DNA, 20 bp, Homo sapiens
acctgcctgcgtcttccgcc

SEQ ID NO: 4943354 - DNA, 22 bp, Homo sapiens
acctgcctgcgtcttccgcccc

SEQ ID NO: 4943355 - DNA, 15 bp, Homo sapiens
acctgctatcagcag

SEQ ID NO: 4943356 - DNA, 15 bp, Homo sapiens
acctgctccgctgct

SEQ ID NO: 4943357 - DNA, 16 bp, Homo sapiens
acctgctccgctgctc

SEQ ID NO: 4943358 - DNA, 18 bp, Homo sapiens
acctggggcacagtccag

SEQ ID NO: 4943359 - DNA, 22 bp, Homo sapiens
acctggggcacagtccaggaac

SEQ ID NO: 4943360 - DNA, 19 bp, Homo sapiens
acctggtaccctcctggct

SEQ ID NO: 4943361 - DNA, 21 bp, Homo sapiens
acctggtcacaggactctgcc

SEQ ID NO: 4943362 - DNA, 22 bp, Homo sapiens
acctggtcacaggactctgcct

SEQ ID NO: 4943363 - DNA, 23 bp, Homo sapiens
acctggtcacaggactctgcctc

SEQ ID NO: 4943364 - DNA, 14 bp, Homo sapiens
acctgtatttaagc

SEQ ID NO: 4943365 - DNA, 15 bp, Homo sapiens
acctgtatttaagca

SEQ ID NO: 4943366 - DNA, 20 bp, Homo sapiens
acctgtcacattgcattcta

SEQ ID NO: 4943367 - DNA, 22 bp, Homo sapiens
acctgtcacattgcattctatt

SEQ ID NO: 4943368 - DNA, 22 bp, Homo sapiens
acctgtcctaaggaaccttcct

SEQ ID NO: 4943369 - DNA, 23 bp, Homo sapiens
acctgtggaacataaaaaggaca

SEQ ID NO: 4943370 - DNA, 16 bp, Homo sapiens
acctgtgtacataact

SEQ ID NO: 4943371 - DNA, 15 bp, Homo sapiens
acctgttgctgtgtt

SEQ ID NO: 4943372 - DNA, 17 bp, Homo sapiens
accttaccaactttctg

SEQ ID NO: 4943373 - DNA, 19 bp, Homo sapiens
accttaccaactttctgta

SEQ ID NO: 4943374 - DNA, 20 bp, Homo sapiens
accttaccaactttctgtaa

SEQ ID NO: 4943375 - DNA, 14 bp, Homo sapiens
accttacccctggc

SEQ ID NO: 4943376 - DNA, 22 bp, Homo sapiens
accttacccctggctgtttgga

SEQ ID NO: 4943377 - DNA, 15 bp, Homo sapiens
accttactgtggagg

SEQ ID NO: 4943378 - DNA, 14 bp, Homo sapiens
accttaggccttcc

SEQ ID NO: 4943379 - DNA, 21 bp, Homo sapiens
accttaggccttcctctctcc

SEQ ID NO: 4943380 - DNA, 22 bp, Homo sapiens
accttatttgctaatcaaagcc

SEQ ID NO: 4943381 - DNA, 15 bp, Homo sapiens
accttccaggacccc

SEQ ID NO: 4943382 - DNA, 19 bp, Homo sapiens
accttcccaaacgcctccc

SEQ ID NO: 4943383 - DNA, 22 bp, Homo sapiens
accttcccaaacgcctcccctg

SEQ ID NO: 4943384 - DNA, 12 bp, Homo sapiens
accttccttcct

SEQ ID NO: 4943385 - DNA, 15 bp, Homo sapiens
accttctgagtacag

SEQ ID NO: 4943386 - DNA, 20 bp, Homo sapiens
accttgaaaataagaataga

SEQ ID NO: 4943387 - DNA, 20 bp, Homo sapiens
accttgaactgggtacttgt

SEQ ID NO: 4943388 - DNA, 13 bp, Homo sapiens
accttgaatgctg

SEQ ID NO: 4943389 - DNA, 16 bp, Homo sapiens
accttgaatgctgcca

SEQ ID NO: 4943390 - DNA, 17 bp, Homo sapiens
accttgaatgctgccag

SEQ ID NO: 4943391 - DNA, 15 bp, Homo sapiens
accttgacagggcac

SEQ ID NO: 4943392 - DNA, 17 bp, Homo sapiens
accttgacttgattagt

SEQ ID NO: 4943393 - DNA, 11 bp, Homo sapiens
accttgctgtc

SEQ ID NO: 4943394 - DNA, 19 bp, Homo sapiens
accttgctgtcctgatctg

SEQ ID NO: 4943395 - DNA, 12 bp, Homo sapiens
accttggctcaa

SEQ ID NO: 4943396 - DNA, 14 bp, Homo sapiens
accttggctgcagg

SEQ ID NO: 4943397 - DNA, 12 bp, Homo sapiens
accttgtgtctg

SEQ ID NO: 4943398 - DNA, 15 bp, Homo sapiens
accttgtgtctgtac

SEQ ID NO: 4943399 - DNA, 14 bp, Homo sapiens
acctttaggttctt

SEQ ID NO: 4943400 - DNA, 21 bp, Homo sapiens
acctttcacctttgtgtattt

SEQ ID NO: 4943401 - DNA, 23 bp, Homo sapiens
acctttccaaagttaacagattt

SEQ ID NO: 4943402 - DNA, 18 bp, Homo sapiens
acctttggagcaaagctg

SEQ ID NO: 4943403 - DNA, 14 bp, Homo sapiens
accttttaaagtgt

SEQ ID NO: 4943404 - DNA, 15 bp, Homo sapiens
accttttatgtagta

SEQ ID NO: 4943405 - DNA, 20 bp, Homo sapiens
accttttatgtagtaattga

SEQ ID NO: 4943406 - DNA, 14 bp, Homo sapiens
accttttattacat

SEQ ID NO: 4943407 - DNA, 15 bp, Homo sapiens
accttttttaagatt

SEQ ID NO: 4943408 - DNA, 16 bp, Homo sapiens
accttttttaagattt

SEQ ID NO: 4943409 - DNA, 22 bp, Homo sapiens
accttttttaagatttttctca

SEQ ID NO: 4943410 - DNA, 14 bp, Homo sapiens
acgaaagaaatgta

SEQ ID NO: 4943411 - DNA, 21 bp, Homo sapiens
acgaccggggccagcaccact

SEQ ID NO: 4943412 - DNA, 14 bp, Homo sapiens
acgagaccccggct

SEQ ID NO: 4943413 - DNA, 23 bp, Homo sapiens
acgatacgctactataaagagaa

SEQ ID NO: 4943414 - DNA, 19 bp, Homo sapiens
acgatcctgccaccctgta

SEQ ID NO: 4943415 - DNA, 13 bp, Homo sapiens
acgattccttctc

SEQ ID NO: 4943416 - DNA, 16 bp, Homo sapiens
acgcacgcacacacac

SEQ ID NO: 4943417 - DNA, 17 bp, Homo sapiens
acgcagatgatccatga

SEQ ID NO: 4943418 - DNA, 19 bp, Homo sapiens
acgcagccctagagcctgc

SEQ ID NO: 4943419 - DNA, 20 bp, Homo sapiens
acgcagccctagagcctgcc

SEQ ID NO: 4943420 - DNA, 22 bp, Homo sapiens
acgcagccctagagcctgcctg

SEQ ID NO: 4943421 - DNA, 24 bp, Homo sapiens
acgcagccctagagcctgcctgga

SEQ ID NO: 4943422 - DNA, 15 bp, Homo sapiens
acgcatccagcaaga

SEQ ID NO: 4943423 - DNA, 23 bp, Homo sapiens
acatgtgtcaacacccctgtgtg

SEQ ID NO: 4943424 - DNA, 12 bp, Homo sapiens
acatgtgtgtat

SEQ ID NO: 4943425 - DNA, 14 bp, Homo sapiens
acatgtgtgtatat

SEQ ID NO: 4943426 - DNA, 17 bp, Homo sapiens
acatgtgtgtatatatg

SEQ ID NO: 4943427 - DNA, 15 bp, Homo sapiens
acatgttatatattt

SEQ ID NO: 4943428 - DNA, 19 bp, Homo sapiens
acatgtttttatacaaaat

SEQ ID NO: 4943429 - DNA, 22 bp, Homo sapiens
acattaaattttttttacattt

SEQ ID NO: 4943430 - DNA, 13 bp, Homo sapiens
acattaagaatgt

SEQ ID NO: 4943431 - DNA, 14 bp, Homo sapiens
acattaagaatgtt

SEQ ID NO: 4943432 - DNA, 15 bp, Homo sapiens
acattaagaatgttg

SEQ ID NO: 4943433 - DNA, 19 bp, Homo sapiens
acattaagaatgttggttt

SEQ ID NO: 4943434 - DNA, 15 bp, Homo sapiens
acattaccttactgt

SEQ ID NO: 4943435 - DNA, 17 bp, Homo sapiens
acattagtaaatgtctt

SEQ ID NO: 4943436 - DNA, 15 bp, Homo sapiens
acattatagattttc

SEQ ID NO: 4943437 - DNA, 19 bp, Homo sapiens
acattatgtgtgcatgtgt

SEQ ID NO: 4943438 - DNA, 22 bp, Homo sapiens
acattatgtgtgcatgtgtgta

SEQ ID NO: 4943439 - DNA, 12 bp, Homo sapiens
acattatttcta

SEQ ID NO: 4943440 - DNA, 20 bp, Homo sapiens
acattcttttaacttctttc

SEQ ID NO: 4943441 - DNA, 17 bp, Homo sapiens
acattgacgattccttc

SEQ ID NO: 4943442 - DNA, 20 bp, Homo sapiens
acattgagctgatataaatt

SEQ ID NO: 4943443 - DNA, 14 bp, Homo sapiens
acattgagtagaca

SEQ ID NO: 4943444 - DNA, 17 bp, Homo sapiens
acattgcattctattgc

SEQ ID NO: 4943445 - DNA, 22 bp, Homo sapiens
acattgcattctattgccttct

SEQ ID NO: 4943446 - DNA, 20 bp, Homo sapiens
acattgcttgtgccacaccc

SEQ ID NO: 4943447 - DNA, 18 bp, Homo sapiens
acattggattatcctgag

SEQ ID NO: 4943448 - DNA, 21 bp, Homo sapiens
acattgtaaatagtatttgag

SEQ ID NO: 4943449 - DNA, 12 bp, Homo sapiens
acattgtctgcg

SEQ ID NO: 4943450 - DNA, 17 bp, Homo sapiens
acattgtttgctgctat

SEQ ID NO: 4943451 - DNA, 18 bp, Homo sapiens
acattgtttgctgctatt

SEQ ID NO: 4943452 - DNA, 13 bp, Homo sapiens
acatttaaagcat

SEQ ID NO: 4943453 - DNA, 19 bp, Homo sapiens
acatttaaagcattgctgt

SEQ ID NO: 4943454 - DNA, 19 bp, Homo sapiens
acatttaatttagtgatct

SEQ ID NO: 4943455 - DNA, 18 bp, Homo sapiens
acatttatgagtaactat

SEQ ID NO: 4943456 - DNA, 14 bp, Homo sapiens
acatttatgattta

SEQ ID NO: 4943457 - DNA, 15 bp, Homo sapiens
acatttatgatttaa

SEQ ID NO: 4943458 - DNA, 14 bp, Homo sapiens
acatttattctgct

SEQ ID NO: 4943459 - DNA, 15 bp, Homo sapiens
acatttattctgctc

SEQ ID NO: 4943460 - DNA, 18 bp, Homo sapiens
acatttctgtaaatacca

SEQ ID NO: 4943461 - DNA, 15 bp, Homo sapiens
acatttcttttcttt

SEQ ID NO: 4943462 - DNA, 14 bp, Homo sapiens
acatttgccttgca

SEQ ID NO: 4943463 - DNA, 16 bp, Homo sapiens
acatttgccttgcaga

SEQ ID NO: 4943464 - DNA, 22 bp, Homo sapiens
ggctgggcttcagtggcagctg

SEQ ID NO: 4943465 - DNA, 15 bp, Homo sapiens
ggctggggaggacct

SEQ ID NO: 4943466 - DNA, 16 bp, Homo sapiens
ggctgggggcctcagt

SEQ ID NO: 4943467 - DNA, 14 bp, Homo sapiens
ggctgtaaggctct

SEQ ID NO: 4943468 - DNA, 18 bp, Homo sapiens
ggctgtatcccatgagcc

SEQ ID NO: 4943469 - DNA, 16 bp, Homo sapiens
ggctgtgcctctgcct

SEQ ID NO: 4943470 - DNA, 13 bp, Homo sapiens
ggctgtgctcaga

SEQ ID NO: 4943471 - DNA, 14 bp, Homo sapiens
ggctgtgctcagag

SEQ ID NO: 4943472 - DNA, 12 bp, Homo sapiens
ggctgtggaagg

SEQ ID NO: 4943473 - DNA, 17 bp, Homo sapiens
ggctgttggcagtgagt

SEQ ID NO: 4943474 - DNA, 19 bp, Homo sapiens
ggcttaagaaatctagtat

SEQ ID NO: 4943475 - DNA, 14 bp, Homo sapiens
ggcttatattcaac

SEQ ID NO: 4943476 - DNA, 15 bp, Homo sapiens
ggcttatattcaacc

SEQ ID NO: 4943477 - DNA, 20 bp, Homo sapiens
ggcttatattcaaccatgga

SEQ ID NO: 4943478 - DNA, 23 bp, Homo sapiens
ggcttatattcaaccatggactt

SEQ ID NO: 4943479 - DNA, 17 bp, Homo sapiens
ggcttattttaatgtga

SEQ ID NO: 4943480 - DNA, 20 bp, Homo sapiens
ggcttattttaatgtgatga

SEQ ID NO: 4943481 - DNA, 22 bp, Homo sapiens
ggcttcactgtataaataggag

SEQ ID NO: 4943482 - DNA, 16 bp, Homo sapiens
ggcttcagtggcagct

SEQ ID NO: 4943483 - DNA, 15 bp, Homo sapiens
ggcttcccgctcagc

SEQ ID NO: 4943484 - DNA, 16 bp, Homo sapiens
ggcttcccgctcagcc

SEQ ID NO: 4943485 - DNA, 22 bp, Homo sapiens
ggcttcccgctcagccctccct

SEQ ID NO: 4943486 - DNA, 19 bp, Homo sapiens
ggcttcgttagaccgctct

SEQ ID NO: 4943487 - DNA, 11 bp, Homo sapiens
ggctttgtgtt

SEQ ID NO: 4943488 - DNA, 16 bp, Homo sapiens
gggaaaaaaatcatct

SEQ ID NO: 4943489 - DNA, 22 bp, Homo sapiens
gggaaagacactgcctgggctg

SEQ ID NO: 4943490 - DNA, 20 bp, Homo sapiens
gggaaaggggttggggtgac

SEQ ID NO: 4943491 - DNA, 19 bp, Homo sapiens
gggaacagacaacagaagt

SEQ ID NO: 4943492 - DNA, 14 bp, Homo sapiens
gggaacagactgga

SEQ ID NO: 4943493 - DNA, 22 bp, Homo sapiens
gggaacagactggaagcacagc

SEQ ID NO: 4943494 - DNA, 22 bp, Homo sapiens
gggaacatttctgtaaatacca

SEQ ID NO: 4943495 - DNA, 11 bp, Homo sapiens
gggaacctccc

SEQ ID NO: 4943496 - DNA, 21 bp, Homo sapiens
gggaactctgacaagggctga

SEQ ID NO: 4943497 - DNA, 21 bp, Homo sapiens
gggaagaaacactttctcttc

SEQ ID NO: 4943498 - DNA, 19 bp, Homo sapiens
gggaagaagcagagagatg

SEQ ID NO: 4943499 - DNA, 14 bp, Homo sapiens
gggaaggggcggtg

SEQ ID NO: 4943500 - DNA, 16 bp, Homo sapiens
gggaagggtttgaatt

SEQ ID NO: 4943501 - DNA, 15 bp, Homo sapiens
gggaagtagtccttg

SEQ ID NO: 4943502 - DNA, 19 bp, Homo sapiens
gggaagtccctgggaggcc

SEQ ID NO: 4943503 - DNA, 24 bp, Homo sapiens
gggaataaaatcctaagacacaaa

SEQ ID NO: 4943504 - DNA, 14 bp, Homo sapiens
gggaataaccttcc

SEQ ID NO: 4943505 - DNA, 21 bp, Homo sapiens
gggaatccaagcctccacagc

SEQ ID NO: 4943506 - DNA, 22 bp, Homo sapiens
gggaatccaagcctccacagcg

SEQ ID NO: 4943507 - DNA, 14 bp, Homo sapiens
gggaatgagcccag

SEQ ID NO: 4943508 - DNA, 15 bp, Homo sapiens
gggaatgagcccaga

SEQ ID NO: 4943509 - DNA, 17 bp, Homo sapiens
gggaatgagcccagaga

SEQ ID NO: 4943510 - DNA, 21 bp, Homo sapiens
gggaatgagcccagagaacag

SEQ ID NO: 4943511 - DNA, 20 bp, Homo sapiens
gggacacaaaactccgcccc

SEQ ID NO: 4943512 - DNA, 14 bp, Homo sapiens
gggacacctgccct

SEQ ID NO: 4943513 - DNA, 17 bp, Homo sapiens
gggacacctgccctgcc

SEQ ID NO: 4943514 - DNA, 14 bp, Homo sapiens
gggacagaggcctg

SEQ ID NO: 4943515 - DNA, 15 bp, Homo sapiens
gggacagaggcctgc

SEQ ID NO: 4943516 - DNA, 18 bp, Homo sapiens
gggacagaggcctgcccg

SEQ ID NO: 4943517 - DNA, 22 bp, Homo sapiens
gggacagattcagtcttgcctt

SEQ ID NO: 4943518 - DNA, 12 bp, Homo sapiens
gggacagctcct

SEQ ID NO: 4943519 - DNA, 12 bp, Homo sapiens
gggacaggcctc

SEQ ID NO: 4943520 - DNA, 20 bp, Homo sapiens
gggacagtttatcatgaagc

SEQ ID NO: 4943521 - DNA, 17 bp, Homo sapiens
gggaccatgtgtcactt

SEQ ID NO: 4943522 - DNA, 21 bp, Homo sapiens
gggacccaatgtaggagctgc

SEQ ID NO: 4943523 - DNA, 15 bp, Homo sapiens
gggactagcccctgt

SEQ ID NO: 4943524 - DNA, 23 bp, Homo sapiens
gggactcaatgcactgacattgt

SEQ ID NO: 4943525 - DNA, 19 bp, Homo sapiens
gggactctgaagcctctgg

SEQ ID NO: 4943526 - DNA, 19 bp, Homo sapiens
gggactctgagcgggaggc

SEQ ID NO: 4943527 - DNA, 14 bp, Homo sapiens
gggactgcctctgc

SEQ ID NO: 4943528 - DNA, 17 bp, Homo sapiens
gggactgcctctgccac

SEQ ID NO: 4943529 - DNA, 15 bp, Homo sapiens
gggactgctgctgcc

SEQ ID NO: 4943530 - DNA, 18 bp, Homo sapiens
gggactgctgctgcctgg

SEQ ID NO: 4943531 - DNA, 21 bp, Homo sapiens
gggagaaaaggaaaagaaaaa

SEQ ID NO: 4943532 - DNA, 22 bp, Homo sapiens
gggagaaaaggaaaagaaaaaa

SEQ ID NO: 4943533 - DNA, 16 bp, Homo sapiens
gggagcagacaggagg

SEQ ID NO: 4943534 - DNA, 12 bp, Homo sapiens
gggagcaggaga

SEQ ID NO: 4943535 - DNA, 13 bp, Homo sapiens
gggagcaggagat

SEQ ID NO: 4943536 - DNA, 15 bp, Homo sapiens
gggagcagggaaggc

SEQ ID NO: 4943537 - DNA, 17 bp, Homo sapiens
gggagcagtccatgcat

SEQ ID NO: 4943538 - DNA, 13 bp, Homo sapiens
gggagccccaggg

SEQ ID NO: 4943539 - DNA, 16 bp, Homo sapiens
gggagccccagggtct

SEQ ID NO: 4943540 - DNA, 22 bp, Homo sapiens
gggagcctttggttctggccag

SEQ ID NO: 4943541 - DNA, 20 bp, Homo sapiens
gggagctcctctcctggagg

SEQ ID NO: 4943542 - DNA, 21 bp, Homo sapiens
gggagctcctctcctggagga

SEQ ID NO: 4943543 - DNA, 21 bp, Homo sapiens
gggagctgcctgttcagctcc

SEQ ID NO: 4943544 - DNA, 23 bp, Homo sapiens
gggaggacaaaacttcttgtcag

SEQ ID NO: 4943545 - DNA, 12 bp, Homo sapiens
gggaggacaggc

SEQ ID NO: 4943546 - DNA, 13 bp, Homo sapiens
gggaggacctggg

SEQ ID NO: 4943547 - DNA, 16 bp, Homo sapiens
gggaggacctggggca

SEQ ID NO: 4943548 - DNA, 16 bp, Homo sapiens
gggaggcatggccctg

SEQ ID NO: 4943549 - DNA, 12 bp, Homo sapiens
gggaggggaagt

SEQ ID NO: 4943550 - DNA, 16 bp, Homo sapiens
gggagggggagaaaag

SEQ ID NO: 4943551 - DNA, 16 bp, Homo sapiens
gggaggtcaggccctg

SEQ ID NO: 4943552 - DNA, 16 bp, Homo sapiens
gggagtccaggcacag

SEQ ID NO: 4943553 - DNA, 19 bp, Homo sapiens
gggagtccaggcacaggat

SEQ ID NO: 4943554 - DNA, 16 bp, Homo sapiens
gggagtgctggctcac

SEQ ID NO: 4943555 - DNA, 19 bp, Homo sapiens
gggagtgctggctcacagt

SEQ ID NO: 4943556 - DNA, 11 bp, Homo sapiens
gggagtgggtg

SEQ ID NO: 4943557 - DNA, 18 bp, Homo sapiens
gggatcatcatgcagctc

SEQ ID NO: 4943558 - DNA, 15 bp, Homo sapiens
gggatttaatttcca

SEQ ID NO: 4943559 - DNA, 21 bp, Homo sapiens
gggcaaatgacatgcactgac

SEQ ID NO: 4943560 - DNA, 22 bp, Homo sapiens
gggcaacagagcaagatcctgt

SEQ ID NO: 4943561 - DNA, 20 bp, Homo sapiens
gggcaacccccagcctgcta

SEQ ID NO: 4943562 - DNA, 16 bp, Homo sapiens
gggcaaggaaaaagaa

SEQ ID NO: 4943563 - DNA, 13 bp, Homo sapiens
gggcacactctgc

SEQ ID NO: 4943564 - DNA, 16 bp, Homo sapiens
gggcagcaatttaaat

SEQ ID NO: 4943565 - DNA, 16 bp, Homo sapiens
gggcagccaggctgcc

SEQ ID NO: 4943566 - DNA, 21 bp, Homo sapiens
gggcaggaaggagagcctgct

SEQ ID NO: 4943567 - DNA, 14 bp, Homo sapiens
gggcaggctgggcc

SEQ ID NO: 4943568 - DNA, 21 bp, Homo sapiens
gggcaggttctgcctgctttg

SEQ ID NO: 4943569 - DNA, 19 bp, Homo sapiens
gggcatccataccagctcg

SEQ ID NO: 4943570 - DNA, 20 bp, Homo sapiens
gggcatctgcccctccccca

SEQ ID NO: 4943571 - DNA, 16 bp, Homo sapiens
gggcatgccccggcca

SEQ ID NO: 4943572 - DNA, 23 bp, Homo sapiens
gggcatgccccggccacctctgc

SEQ ID NO: 4943573 - DNA, 13 bp, Homo sapiens
gggcatgccttgt

SEQ ID NO: 4943574 - DNA, 20 bp, Homo sapiens
gggcatggccaggtggccac

SEQ ID NO: 4943575 - DNA, 14 bp, Homo sapiens
gcttctcatcccca

SEQ ID NO: 4943576 - DNA, 14 bp, Homo sapiens
gcttctccccagaa

SEQ ID NO: 4943577 - DNA, 17 bp, Homo sapiens
gcttcttaattaatttg

SEQ ID NO: 4943578 - DNA, 20 bp, Homo sapiens
gcttgagaaatatggacact

SEQ ID NO: 4943579 - DNA, 12 bp, Homo sapiens
gcttgagcccag

SEQ ID NO: 4943580 - DNA, 16 bp, Homo sapiens
gcttgagcccaggagt

SEQ ID NO: 4943581 - DNA, 18 bp, Homo sapiens
gcttgagggttgggctgg

SEQ ID NO: 4943582 - DNA, 22 bp, Homo sapiens
gcttgagggttgggctggtgtc

SEQ ID NO: 4943583 - DNA, 14 bp, Homo sapiens
gcttgcctggagac

SEQ ID NO: 4943584 - DNA, 20 bp, Homo sapiens
gcttgggagagcccctgggg

SEQ ID NO: 4943585 - DNA, 22 bp, Homo sapiens
gcttggggccaccaaagctgcc

SEQ ID NO: 4943586 - DNA, 18 bp, Homo sapiens
gcttgtaaatagctcagg

SEQ ID NO: 4943587 - DNA, 16 bp, Homo sapiens
gcttgtacctctggct

SEQ ID NO: 4943588 - DNA, 12 bp, Homo sapiens
gcttgtgaacag

SEQ ID NO: 4943589 - DNA, 17 bp, Homo sapiens
gcttgttatcagctttc

SEQ ID NO: 4943590 - DNA, 21 bp, Homo sapiens
gctttaaactcagggacagag

SEQ ID NO: 4943591 - DNA, 15 bp, Homo sapiens
gctttaaagtgtaat

SEQ ID NO: 4943592 - DNA, 12 bp, Homo sapiens
gctttacatgca

SEQ ID NO: 4943593 - DNA, 16 bp, Homo sapiens
gctttatatatggaca

SEQ ID NO: 4943594 - DNA, 19 bp, Homo sapiens
gctttatatatggacatgg

SEQ ID NO: 4943595 - DNA, 18 bp, Homo sapiens
gctttatgattttcataa

SEQ ID NO: 4943596 - DNA, 22 bp, Homo sapiens
gctttattcttcagatacaaac

SEQ ID NO: 4943597 - DNA, 18 bp, Homo sapiens
gctttcagaaaacgggaa

SEQ ID NO: 4943598 - DNA, 21 bp, Homo sapiens
gctttcagggccatggttcac

SEQ ID NO: 4943599 - DNA, 19 bp, Homo sapiens
gctttccttgtggcagagg

SEQ ID NO: 4943600 - DNA, 18 bp, Homo sapiens
gctttctatgctgtttgt

SEQ ID NO: 4943601 - DNA, 15 bp, Homo sapiens
gctttcttgctccct

SEQ ID NO: 4943602 - DNA, 17 bp, Homo sapiens
gctttctttgattctcc

SEQ ID NO: 4943603 - DNA, 16 bp, Homo sapiens
gctttgagaagccttc

SEQ ID NO: 4943604 - DNA, 15 bp, Homo sapiens
gctttgatccctgac

SEQ ID NO: 4943605 - DNA, 13 bp, Homo sapiens
gctttgtgttgta

SEQ ID NO: 4943606 - DNA, 15 bp, Homo sapiens
gcttttaattaaata

SEQ ID NO: 4943607 - DNA, 15 bp, Homo sapiens
gcttttattttgaaa

SEQ ID NO: 4943608 - DNA, 22 bp, Homo sapiens
gcttttattttgaaaagcttct

SEQ ID NO: 4943609 - DNA, 13 bp, Homo sapiens
gcttttcactgct

SEQ ID NO: 4943610 - DNA, 23 bp, Homo sapiens
gcttttcactgctggctgcctta

SEQ ID NO: 4943611 - DNA, 12 bp, Homo sapiens
gcttttccctct

SEQ ID NO: 4943612 - DNA, 15 bp, Homo sapiens
gcttttccctctttt

SEQ ID NO: 4943613 - DNA, 15 bp, Homo sapiens
gcttttggtctgtgt

SEQ ID NO: 4943614 - DNA, 17 bp, Homo sapiens
gctttttaaaacattag

SEQ ID NO: 4943615 - DNA, 22 bp, Homo sapiens
gctttttaattgttgtttcttt

SEQ ID NO: 4943616 - DNA, 13 bp, Homo sapiens
gctttttgaaatg

SEQ ID NO: 4943617 - DNA, 18 bp, Homo sapiens
gctttttgaaatgaaatt

SEQ ID NO: 4943618 - DNA, 14 bp, Homo sapiens
gctttttggtgtat

SEQ ID NO: 4943619 - DNA, 21 bp, Homo sapiens
gcttttttttttccagcaagt

SEQ ID NO: 4943620 - DNA, 21 bp, Homo sapiens
ggaaaaaaatcatctattttg

SEQ ID NO: 4943621 - DNA, 14 bp, Homo sapiens
ggaaaaagaaaata

SEQ ID NO: 4943622 - DNA, 13 bp, Homo sapiens
ggaaaaatgtttg

SEQ ID NO: 4943623 - DNA, 22 bp, Homo sapiens
ggaaaaccaagccgtggcttcc

SEQ ID NO: 4943624 - DNA, 16 bp, Homo sapiens
ggaaaacctgaagact

SEQ ID NO: 4943625 - DNA, 9 bp, Homo sapiens
ggaaaagaa

SEQ ID NO: 4943626 - DNA, 13 bp, Homo sapiens
ggaaaagaaaaaa

SEQ ID NO: 4943627 - DNA, 14 bp, Homo sapiens
ggaaaagctgctga

SEQ ID NO: 4943628 - DNA, 18 bp, Homo sapiens
ggaaaagctgctgacagt

SEQ ID NO: 4943629 - DNA, 16 bp, Homo sapiens
ggaaagaaagaaggaa

SEQ ID NO: 4943630 - DNA, 15 bp, Homo sapiens
ggaaagacactgcct

SEQ ID NO: 4943631 - DNA, 20 bp, Homo sapiens
ggaaagacactgcctgggct

SEQ ID NO: 4943632 - DNA, 21 bp, Homo sapiens
ggaaaggggttggggtgacag

SEQ ID NO: 4943633 - DNA, 16 bp, Homo sapiens
ggaaataaaacctttc

SEQ ID NO: 4943634 - DNA, 20 bp, Homo sapiens
ggaaataaaacctttcaaat

SEQ ID NO: 4943635 - DNA, 20 bp, Homo sapiens
ggaaatattttgataataaa

SEQ ID NO: 4943636 - DNA, 18 bp, Homo sapiens
gcgtgagccactgcaccg

SEQ ID NO: 4943637 - DNA, 19 bp, Homo sapiens
gcgtgcacacaccagagcc

SEQ ID NO: 4943638 - DNA, 23 bp, Homo sapiens
gcgtgcacacaccagagcccacc

SEQ ID NO: 4943639 - DNA, 24 bp, Homo sapiens
gcgtgccgtgtgagtgtgacaggg

SEQ ID NO: 4943640 - DNA, 14 bp, Homo sapiens
gcgtggactctgca

SEQ ID NO: 4943641 - DNA, 14 bp, Homo sapiens
gcgtggagcaggcg

SEQ ID NO: 4943642 - DNA, 14 bp, Homo sapiens
gcgtggtgccatcc

SEQ ID NO: 4943643 - DNA, 16 bp, Homo sapiens
gcgttactaattggcc

SEQ ID NO: 4943644 - DNA, 18 bp, Homo sapiens
gcgttatagtaactccca

SEQ ID NO: 4943645 - DNA, 16 bp, Homo sapiens
gcgtttagaccaagga

SEQ ID NO: 4943646 - DNA, 13 bp, Homo sapiens
gctaacattttaa

SEQ ID NO: 4943647 - DNA, 20 bp, Homo sapiens
gctaaccttatcctgcattg

SEQ ID NO: 4943648 - DNA, 18 bp, Homo sapiens
gctaagggaagacatttc

SEQ ID NO: 4943649 - DNA, 22 bp, Homo sapiens
gctaagggaagacatttctttt

SEQ ID NO: 4943650 - DNA, 21 bp, Homo sapiens
gctaagggtgggtgctcagaa

SEQ ID NO: 4943651 - DNA, 22 bp, Homo sapiens
gctaagtgatcctcccacctca

SEQ ID NO: 4943652 - DNA, 18 bp, Homo sapiens
gctaataatgagctatta

SEQ ID NO: 4943653 - DNA, 20 bp, Homo sapiens
gctaataatgagctattaaa

SEQ ID NO: 4943654 - DNA, 17 bp, Homo sapiens
gctaataatgttaacca

SEQ ID NO: 4943655 - DNA, 20 bp, Homo sapiens
gctaatcaaagccagggtct

SEQ ID NO: 4943656 - DNA, 21 bp, Homo sapiens
gctaatcaaagccagggtctc

SEQ ID NO: 4943657 - DNA, 14 bp, Homo sapiens
gctaatcagcattc

SEQ ID NO: 4943658 - DNA, 15 bp, Homo sapiens
gctaattaaaaagtt

SEQ ID NO: 4943659 - DNA, 19 bp, Homo sapiens
gctaattgggagtccaggc

SEQ ID NO: 4943660 - DNA, 20 bp, Homo sapiens
gctaatttatcctgaaattt

SEQ ID NO: 4943661 - DNA, 15 bp, Homo sapiens
gctaatttttgtaat

SEQ ID NO: 4943662 - DNA, 16 bp, Homo sapiens
gctaatttttgtaatt

SEQ ID NO: 4943663 - DNA, 12 bp, Homo sapiens
gctacagagccg

SEQ ID NO: 4943664 - DNA, 19 bp, Homo sapiens
gctacagctttcttgctcc

SEQ ID NO: 4943665 - DNA, 23 bp, Homo sapiens
gctacaggaagcaccccatgcca

SEQ ID NO: 4943666 - DNA, 23 bp, Homo sapiens
gctacataaattggcctggtatg

SEQ ID NO: 4943667 - DNA, 15 bp, Homo sapiens
gctggccgagggtcc

SEQ ID NO: 4943668 - DNA, 19 bp, Homo sapiens
gctggccgagggtcctggc

SEQ ID NO: 4943669 - DNA, 14 bp, Homo sapiens
gctggcgtgcagtg

SEQ ID NO: 4943670 - DNA, 20 bp, Homo sapiens
gctggcgtgcagtggtgcga

SEQ ID NO: 4943671 - DNA, 17 bp, Homo sapiens
gctggctcacagtacag

SEQ ID NO: 4943672 - DNA, 16 bp, Homo sapiens
gctggctcttctgccc

SEQ ID NO: 4943673 - DNA, 14 bp, Homo sapiens
gctggctgccttag

SEQ ID NO: 4943674 - DNA, 20 bp, Homo sapiens
gctggctgccttagaacctt

SEQ ID NO: 4943675 - DNA, 23 bp, Homo sapiens
gctggctgttggctgggggcctc

SEQ ID NO: 4943676 - DNA, 20 bp, Homo sapiens
gctgggactacaggcaccca

SEQ ID NO: 4943677 - DNA, 20 bp, Homo sapiens
gctgggaggcatggccctgg

SEQ ID NO: 4943678 - DNA, 16 bp, Homo sapiens
gctgggattacaggtg

SEQ ID NO: 4943679 - DNA, 19 bp, Homo sapiens
gctgggattacaggtgtga

SEQ ID NO: 4943680 - DNA, 19 bp, Homo sapiens
gctgggcaaggaaaaagaa

SEQ ID NO: 4943681 - DNA, 20 bp, Homo sapiens
gctgggcaaggaaaaagaaa

SEQ ID NO: 4943682 - DNA, 22 bp, Homo sapiens
gctgggcatggtaccagccctg

SEQ ID NO: 4943683 - DNA, 19 bp, Homo sapiens
gctgggccatgtccaaaga

SEQ ID NO: 4943684 - DNA, 20 bp, Homo sapiens
gctgggccatgtccaaagag

SEQ ID NO: 4943685 - DNA, 18 bp, Homo sapiens
gctgggccccccagctca

SEQ ID NO: 4943686 - DNA, 19 bp, Homo sapiens
gctgggccccccagctcag

SEQ ID NO: 4943687 - DNA, 17 bp, Homo sapiens
gctgggcttcagtggca

SEQ ID NO: 4943688 - DNA, 20 bp, Homo sapiens
gctgggcttcagtggcagct

SEQ ID NO: 4943689 - DNA, 15 bp, Homo sapiens
gctggggagaggaaa

SEQ ID NO: 4943690 - DNA, 16 bp, Homo sapiens
gctggggcctcagacg

SEQ ID NO: 4943691 - DNA, 21 bp, Homo sapiens
gctgggggaatgagcccagag

SEQ ID NO: 4943692 - DNA, 15 bp, Homo sapiens
gctgggtattggaaa

SEQ ID NO: 4943693 - DNA, 16 bp, Homo sapiens
gctggtaacagttcat

SEQ ID NO: 4943694 - DNA, 22 bp, Homo sapiens
gctggtaacagttcatgtttgc

SEQ ID NO: 4943695 - DNA, 19 bp, Homo sapiens
gctggtaggctcctgccag

SEQ ID NO: 4943696 - DNA, 15 bp, Homo sapiens
gctggtcacagcctc

SEQ ID NO: 4943697 - DNA, 22 bp, Homo sapiens
gctggtcacagcctcctctgtc

SEQ ID NO: 4943698 - DNA, 15 bp, Homo sapiens
gctggtcccactcag

SEQ ID NO: 4943699 - DNA, 19 bp, Homo sapiens
gctggtcccactcagtcca

SEQ ID NO: 4943700 - DNA, 13 bp, Homo sapiens
gctggtgcccgga

SEQ ID NO: 4943701 - DNA, 18 bp, Homo sapiens
gctggtgtcacctgaaga

SEQ ID NO: 4943702 - DNA, 23 bp, Homo sapiens
gctggttcagggttggcccctgc

SEQ ID NO: 4943703 - DNA, 15 bp, Homo sapiens
gctgtaaaacgctgt

SEQ ID NO: 4943704 - DNA, 22 bp, Homo sapiens
gctgtacatctattttggattg

SEQ ID NO: 4943705 - DNA, 23 bp, Homo sapiens
gctgtactgctcaggctgcagct

SEQ ID NO: 4943706 - DNA, 21 bp, Homo sapiens
gctgtagtagccctttctgtg

SEQ ID NO: 4943707 - DNA, 19 bp, Homo sapiens
gctgtatcccatgagcctc

SEQ ID NO: 4943708 - DNA, 16 bp, Homo sapiens
gctgtccagagaaaag

SEQ ID NO: 4943709 - DNA, 16 bp, Homo sapiens
gctgtccatgcttctc

SEQ ID NO: 4943710 - DNA, 23 bp, Homo sapiens
gctgtccccttggcaggtcctgg

SEQ ID NO: 4943711 - DNA, 14 bp, Homo sapiens
gctgtcctgatctg

SEQ ID NO: 4943712 - DNA, 14 bp, Homo sapiens
gctgtctctgctcg

SEQ ID NO: 4943713 - DNA, 17 bp, Homo sapiens
gctgtgacttctccagg

SEQ ID NO: 4943714 - DNA, 12 bp, Homo sapiens
gctgtgagcccc

SEQ ID NO: 4943715 - DNA, 17 bp, Homo sapiens
gctgtgagccttggctg

SEQ ID NO: 4943716 - DNA, 20 bp, Homo sapiens
gctgtgagtctttggttcta

SEQ ID NO: 4943717 - DNA, 22 bp, Homo sapiens
gctgtgagtctttggttctaag

SEQ ID NO: 4943718 - DNA, 19 bp, Homo sapiens
gctgtgctctcaccagctg

SEQ ID NO: 4943719 - DNA, 13 bp, Homo sapiens
gctgtgctctgga

SEQ ID NO: 4943720 - DNA, 18 bp, Homo sapiens
gctgtgctctggacaggc

SEQ ID NO: 4943721 - DNA, 21 bp, Homo sapiens
gctgtgctctggacaggcatg

SEQ ID NO: 4943722 - DNA, 23 bp, Homo sapiens
gctgtggaggattgctatctgga

SEQ ID NO: 4943723 - DNA, 14 bp, Homo sapiens
gctgttaaactgtt

SEQ ID NO: 4943724 - DNA, 22 bp, Homo sapiens
gctgttcccatgtagccccctg

SEQ ID NO: 4943725 - DNA, 12 bp, Homo sapiens
gctgttcttctg

SEQ ID NO: 4943726 - DNA, 20 bp, Homo sapiens
gctgttcttctgttctgcag

SEQ ID NO: 4943727 - DNA, 14 bp, Homo sapiens
gctgttggctgggg

SEQ ID NO: 4943728 - DNA, 16 bp, Homo sapiens
gctgttggctgggggc

SEQ ID NO: 4943729 - DNA, 21 bp, Homo sapiens
gctgttggctgggggcctcag

SEQ ID NO: 4943730 - DNA, 14 bp, Homo sapiens
gctgttgtacattt

SEQ ID NO: 4943731 - DNA, 15 bp, Homo sapiens
gctgttgtacattta

SEQ ID NO: 4943732 - DNA, 16 bp, Homo sapiens
gctccaggctccttta

SEQ ID NO: 4943733 - DNA, 23 bp, Homo sapiens
gctccagggaatccaagcctcca

SEQ ID NO: 4943734 - DNA, 22 bp, Homo sapiens
gctcccacaggcccttcctctc

SEQ ID NO: 4943735 - DNA, 16 bp, Homo sapiens
gctccccagccctggc

SEQ ID NO: 4943736 - DNA, 18 bp, Homo sapiens
gctccccagccctggctc

SEQ ID NO: 4943737 - DNA, 20 bp, Homo sapiens
gctccccagccctggctctg

SEQ ID NO: 4943738 - DNA, 12 bp, Homo sapiens
gctccccatgtg

SEQ ID NO: 4943739 - DNA, 23 bp, Homo sapiens
gctccctaagccagcctggtcca

SEQ ID NO: 4943740 - DNA, 19 bp, Homo sapiens
gctccctcccctgccctgg

SEQ ID NO: 4943741 - DNA, 13 bp, Homo sapiens
gctccctcccgca

SEQ ID NO: 4943742 - DNA, 20 bp, Homo sapiens
gctccctgaagccagccttc

SEQ ID NO: 4943743 - DNA, 22 bp, Homo sapiens
gctccctgtgtccacctgtggg

SEQ ID NO: 4943744 - DNA, 12 bp, Homo sapiens
gctcccttcagc

SEQ ID NO: 4943745 - DNA, 14 bp, Homo sapiens
gctcccttcagccc

SEQ ID NO: 4943746 - DNA, 12 bp, Homo sapiens
gctccgccctta

SEQ ID NO: 4943747 - DNA, 16 bp, Homo sapiens
gctccgcccttagtcc

SEQ ID NO: 4943748 - DNA, 12 bp, Homo sapiens
gctccgctgctc

SEQ ID NO: 4943749 - DNA, 24 bp, Homo sapiens
gctccgctttctacccagcgagcc

SEQ ID NO: 4943750 - DNA, 23 bp, Homo sapiens
gctccgtccaggagcctgtgcct

SEQ ID NO: 4943751 - DNA, 18 bp, Homo sapiens
gctcctcactgcccgcac

SEQ ID NO: 4943752 - DNA, 11 bp, Homo sapiens
gctcctcccac

SEQ ID NO: 4943753 - DNA, 14 bp, Homo sapiens
gctcctctcctgga

SEQ ID NO: 4943754 - DNA, 15 bp, Homo sapiens
gctcctctcctggag

SEQ ID NO: 4943755 - DNA, 20 bp, Homo sapiens
gctcctctgtcctgcttctg

SEQ ID NO: 4943756 - DNA, 18 bp, Homo sapiens
gctcctggcagaagggag

SEQ ID NO: 4943757 - DNA, 22 bp, Homo sapiens
gctcctggcagaagggagcagc

SEQ ID NO: 4943758 - DNA, 18 bp, Homo sapiens
gctccttcccatcgctgt

SEQ ID NO: 4943759 - DNA, 23 bp, Homo sapiens
gctcctttacaaaagaaatacct

SEQ ID NO: 4943760 - DNA, 21 bp, Homo sapiens
gctcgatccaaattgtgcttc

SEQ ID NO: 4943761 - DNA, 20 bp, Homo sapiens
gctcgcacccccctgttcta

SEQ ID NO: 4943762 - DNA, 19 bp, Homo sapiens
gctcgccctcctttctgtg

SEQ ID NO: 4943763 - DNA, 20 bp, Homo sapiens
gctcgccctcctttctgtgc

SEQ ID NO: 4943764 - DNA, 15 bp, Homo sapiens
gctcggaggctgccc

SEQ ID NO: 4943765 - DNA, 23 bp, Homo sapiens
gctcggaggctgcccccggcccc

SEQ ID NO: 4943766 - DNA, 13 bp, Homo sapiens
gctctacgggggc

SEQ ID NO: 4943767 - DNA, 13 bp, Homo sapiens
gctctagaatctg

SEQ ID NO: 4943768 - DNA, 15 bp, Homo sapiens
gggccaaaaggaaaa

SEQ ID NO: 4943769 - DNA, 17 bp, Homo sapiens
gggccaaaaggaaaaag

SEQ ID NO: 4943770 - DNA, 22 bp, Homo sapiens
gggccaaatccgctctcttcct

SEQ ID NO: 4943771 - DNA, 16 bp, Homo sapiens
gggccaccaaagctgc

SEQ ID NO: 4943772 - DNA, 17 bp, Homo sapiens
gggccaccaaagctgcc

SEQ ID NO: 4943773 - DNA, 14 bp, Homo sapiens
gggccacccctcct

SEQ ID NO: 4943774 - DNA, 13 bp, Homo sapiens
gggccacctgcct

SEQ ID NO: 4943775 - DNA, 15 bp, Homo sapiens
gggccacctgcctgc

SEQ ID NO: 4943776 - DNA, 14 bp, Homo sapiens
gggccaggactgag

SEQ ID NO: 4943777 - DNA, 21 bp, Homo sapiens
gggccagggctgccctgagaa

SEQ ID NO: 4943778 - DNA, 15 bp, Homo sapiens
gggccagtcctgcct

SEQ ID NO: 4943779 - DNA, 19 bp, Homo sapiens
gggccagtcctgcctggcc

SEQ ID NO: 4943780 - DNA, 16 bp, Homo sapiens
gggccagtggggcctg

SEQ ID NO: 4943781 - DNA, 14 bp, Homo sapiens
gggccatgtccaaa

SEQ ID NO: 4943782 - DNA, 21 bp, Homo sapiens
gggccatgtccaaagaggctg

SEQ ID NO: 4943783 - DNA, 19 bp, Homo sapiens
gggcccaagacagatgccc

SEQ ID NO: 4943784 - DNA, 12 bp, Homo sapiens
gggcccagagca

SEQ ID NO: 4943785 - DNA, 13 bp, Homo sapiens
gggcccagatctg

SEQ ID NO: 4943786 - DNA, 11 bp, Homo sapiens
gggccccagct

SEQ ID NO: 4943787 - DNA, 20 bp, Homo sapiens
gggcctcaccgagtgggggc

SEQ ID NO: 4943788 - DNA, 13 bp, Homo sapiens
gggcctggacctg

SEQ ID NO: 4943789 - DNA, 22 bp, Homo sapiens
gggcctggcagccgtgccttca

SEQ ID NO: 4943790 - DNA, 16 bp, Homo sapiens
gggcctgtggaatgag

SEQ ID NO: 4943791 - DNA, 21 bp, Homo sapiens
gggcgcccacctccccacgcc

SEQ ID NO: 4943792 - DNA, 15 bp, Homo sapiens
gggcgcggccagccc

SEQ ID NO: 4943793 - DNA, 18 bp, Homo sapiens
gggcgcggccagccccgg

SEQ ID NO: 4943794 - DNA, 15 bp, Homo sapiens
gggcgggaggatgtt

SEQ ID NO: 4943795 - DNA, 15 bp, Homo sapiens
gggctagttgggctt

SEQ ID NO: 4943796 - DNA, 18 bp, Homo sapiens
gggctagttgggcttcct

SEQ ID NO: 4943797 - DNA, 14 bp, Homo sapiens
gggctatggacaca

SEQ ID NO: 4943798 - DNA, 15 bp, Homo sapiens
gggctatggacacag

SEQ ID NO: 4943799 - DNA, 18 bp, Homo sapiens
ggtgtcatttcattccat

SEQ ID NO: 4943800 - DNA, 13 bp, Homo sapiens
ggtgttctaagat

SEQ ID NO: 4943801 - DNA, 17 bp, Homo sapiens
ggttatcgaaataacaa

SEQ ID NO: 4943802 - DNA, 12 bp, Homo sapiens
ggttatgaaaga

SEQ ID NO: 4943803 - DNA, 17 bp, Homo sapiens
ggttatgtatcagaaga

SEQ ID NO: 4943804 - DNA, 21 bp, Homo sapiens
ggttcagggttggcccctgcc

SEQ ID NO: 4943805 - DNA, 12 bp, Homo sapiens
ggttcagtttct

SEQ ID NO: 4943806 - DNA, 21 bp, Homo sapiens
ggttcatgtagagaaaagcac

SEQ ID NO: 4943807 - DNA, 16 bp, Homo sapiens
ggttccaatcctggct

SEQ ID NO: 4943808 - DNA, 18 bp, Homo sapiens
ggttccaatcctggctct

SEQ ID NO: 4943809 - DNA, 16 bp, Homo sapiens
ggttcccggtcccgag

SEQ ID NO: 4943810 - DNA, 13 bp, Homo sapiens
ggttccctgttct

SEQ ID NO: 4943811 - DNA, 17 bp, Homo sapiens
ggttccctttccttcca

SEQ ID NO: 4943812 - DNA, 13 bp, Homo sapiens
ggttcctctctgg

SEQ ID NO: 4943813 - DNA, 14 bp, Homo sapiens
ggttctaaagttct

SEQ ID NO: 4943814 - DNA, 22 bp, Homo sapiens
ggttctaaagttctaagattct

SEQ ID NO: 4943815 - DNA, 19 bp, Homo sapiens
ggttctgcttcaaggcttc

SEQ ID NO: 4943816 - DNA, 18 bp, Homo sapiens
ggtttacatttaaagcat

SEQ ID NO: 4943817 - DNA, 20 bp, Homo sapiens
ggtttcacccttaacccaag

SEQ ID NO: 4943818 - DNA, 14 bp, Homo sapiens
ggtttccacatgct

SEQ ID NO: 4943819 - DNA, 15 bp, Homo sapiens
ggtttctttcagatt

SEQ ID NO: 4943820 - DNA, 17 bp, Homo sapiens
ggtttggttcctctctg

SEQ ID NO: 4943821 - DNA, 15 bp, Homo sapiens
ggttttaggttctaa

SEQ ID NO: 4943822 - DNA, 19 bp, Homo sapiens
gtaaaaaaaaaaacaatta

SEQ ID NO: 4943823 - DNA, 22 bp, Homo sapiens
gtaaaaacactgaaaaattata

SEQ ID NO: 4943824 - DNA, 15 bp, Homo sapiens
gtaaaatgttgaata

SEQ ID NO: 4943825 - DNA, 19 bp, Homo sapiens
gtaaacagatggcactttg

SEQ ID NO: 4943826 - DNA, 14 bp, Homo sapiens
gtaaacatgtgttt

SEQ ID NO: 4943827 - DNA, 18 bp, Homo sapiens
gtaaactggaattaaaag

SEQ ID NO: 4943828 - DNA, 16 bp, Homo sapiens
gtaaactgtggatgat

SEQ ID NO: 4943829 - DNA, 19 bp, Homo sapiens
gtaaatacacaacacacac

SEQ ID NO: 4943830 - DNA, 13 bp, Homo sapiens
gtaaatattctat

SEQ ID NO: 4943831 - DNA, 14 bp, Homo sapiens
gtaaatattctata

SEQ ID NO: 4943832 - DNA, 15 bp, Homo sapiens
gtaaatattctatat

SEQ ID NO: 4943833 - DNA, 22 bp, Homo sapiens
gtaaatattgaggctttgtgtt

SEQ ID NO: 4943834 - DNA, 16 bp, Homo sapiens
gtaaatcctgccattt

SEQ ID NO: 4943835 - DNA, 19 bp, Homo sapiens
gtaaatcctgccatttaaa

SEQ ID NO: 4943836 - DNA, 17 bp, Homo sapiens
gtaaatgcaaagttctg

SEQ ID NO: 4943837 - DNA, 13 bp, Homo sapiens
gtaaatgtctttg

SEQ ID NO: 4943838 - DNA, 14 bp, Homo sapiens
gtaaatgtctttgt

SEQ ID NO: 4943839 - DNA, 18 bp, Homo sapiens
gtaaatgtctttgtaagt

SEQ ID NO: 4943840 - DNA, 18 bp, Homo sapiens
gtaaatgttatttctgca

SEQ ID NO: 4943841 - DNA, 17 bp, Homo sapiens
gtaacaatgaagataaa

SEQ ID NO: 4943842 - DNA, 22 bp, Homo sapiens
gtaacacagctgagagactttt

SEQ ID NO: 4943843 - DNA, 18 bp, Homo sapiens
gtaacagaacagcttcag

SEQ ID NO: 4943844 - DNA, 22 bp, Homo sapiens
gtaacagaacagcttcaggtta

SEQ ID NO: 4943845 - DNA, 17 bp, Homo sapiens
gtaacagttcatgtttg

SEQ ID NO: 4943846 - DNA, 22 bp, Homo sapiens
gtaacagttcatgtttgcttca

SEQ ID NO: 4943847 - DNA, 12 bp, Homo sapiens
gtaaccagccag

SEQ ID NO: 4943848 - DNA, 14 bp, Homo sapiens
gtaacttatattga

SEQ ID NO: 4943849 - DNA, 15 bp, Homo sapiens
gtaacttatattgaa

SEQ ID NO: 4943850 - DNA, 22 bp, Homo sapiens
gtaacttatattgaagacaatt

SEQ ID NO: 4943851 - DNA, 23 bp, Homo sapiens
gtaacttatattgaagacaattt

SEQ ID NO: 4943852 - DNA, 16 bp, Homo sapiens
gtaacttatgtagata

SEQ ID NO: 4943853 - DNA, 18 bp, Homo sapiens
gtaacttcttatggaatt

SEQ ID NO: 4943854 - DNA, 12 bp, Homo sapiens
gtaactttatgt

SEQ ID NO: 4943855 - DNA, 14 bp, Homo sapiens
gtaactttatgtgt

SEQ ID NO: 4943856 - DNA, 15 bp, Homo sapiens
gtaactttatgtgta

SEQ ID NO: 4943857 - DNA, 14 bp, Homo sapiens
gtaacttttgtaag

SEQ ID NO: 4943858 - DNA, 15 bp, Homo sapiens
gtaagacaaaggttt

SEQ ID NO: 4943859 - DNA, 23 bp, Homo sapiens
gtaagagacagaatgtatctgtg

SEQ ID NO: 4943860 - DNA, 14 bp, Homo sapiens
gtaagagtgtagaa

SEQ ID NO: 4943861 - DNA, 17 bp, Homo sapiens
gtaagagtgtagaagca

SEQ ID NO: 4943862 - DNA, 22 bp, Homo sapiens
gtaagagtgtagaagcattcct

SEQ ID NO: 4943863 - DNA, 23 bp, Homo sapiens
gtaagattatagattctaaagat

SEQ ID NO: 4943864 - DNA, 20 bp, Homo sapiens
gtaagcaggagagaaatttc

SEQ ID NO: 4943865 - DNA, 17 bp, Homo sapiens
gtaagccaaagaaatga

SEQ ID NO: 4943866 - DNA, 24 bp, Homo sapiens
gtaagctcctttgtggagtgctgg

SEQ ID NO: 4943867 - DNA, 16 bp, Homo sapiens
gtaaggctctagatca

SEQ ID NO: 4943868 - DNA, 15 bp, Homo sapiens
gtaagtaattatgca

SEQ ID NO: 4943869 - DNA, 17 bp, Homo sapiens
gtaagttcagcacttgt

SEQ ID NO: 4943870 - DNA, 21 bp, Homo sapiens
gtaagtttaaaggatgttggt

SEQ ID NO: 4943871 - DNA, 13 bp, Homo sapiens
gtaagtttcaggt

SEQ ID NO: 4943872 - DNA, 13 bp, Homo sapiens
gtaagttttttga

SEQ ID NO: 4943873 - DNA, 17 bp, Homo sapiens
gtaataacacccttcct

SEQ ID NO: 4943874 - DNA, 13 bp, Homo sapiens
gtaataatacctc

SEQ ID NO: 4943875 - DNA, 15 bp, Homo sapiens
gtaatagaaaactga

SEQ ID NO: 4943876 - DNA, 19 bp, Homo sapiens
gtaatagaaaactgaaaat

SEQ ID NO: 4943877 - DNA, 19 bp, Homo sapiens
gtaatataatggaagagaa

SEQ ID NO: 4943878 - DNA, 22 bp, Homo sapiens
gtaatataatggaagagaaatc

SEQ ID NO: 4943879 - DNA, 18 bp, Homo sapiens
gtaatcaatgaatattga

SEQ ID NO: 4943880 - DNA, 19 bp, Homo sapiens
gtaatcccccaggagaaca

SEQ ID NO: 4943881 - DNA, 19 bp, Homo sapiens
gtaatctctctgcagctgc

SEQ ID NO: 4943882 - DNA, 19 bp, Homo sapiens
gtaatgcatacagaaatat

SEQ ID NO: 4943883 - DNA, 20 bp, Homo sapiens
gtaatgcttagagaatgttc

SEQ ID NO: 4943884 - DNA, 20 bp, Homo sapiens
gtaatgtagcgtgtttacat

SEQ ID NO: 4943885 - DNA, 21 bp, Homo sapiens
gtaattcctctcactaaactt

SEQ ID NO: 4943886 - DNA, 21 bp, Homo sapiens
gtaattgttgctaatcttctt

SEQ ID NO: 4943887 - DNA, 14 bp, Homo sapiens
gtaatttataaaat

SEQ ID NO: 4943888 - DNA, 15 bp, Homo sapiens
gtaatttataaaatt

SEQ ID NO: 4943889 - DNA, 18 bp, Homo sapiens
gtaatttataaaattaga

SEQ ID NO: 4943890 - DNA, 23 bp, Homo sapiens
gtatagacagtttgtaaatgtta

SEQ ID NO: 4943891 - DNA, 21 bp, Homo sapiens
gtatagcctatggcagaaaaa

SEQ ID NO: 4943892 - DNA, 19 bp, Homo sapiens
gtatagttaggatagcatt

SEQ ID NO: 4943893 - DNA, 15 bp, Homo sapiens
gtatatacacatata

SEQ ID NO: 4943894 - DNA, 16 bp, Homo sapiens
gtatatacgcatctat

SEQ ID NO: 4943895 - DNA, 13 bp, Homo sapiens
gtatatatacata

SEQ ID NO: 4943896 - DNA, 15 bp, Homo sapiens
gtatatatacataca

SEQ ID NO: 4943897 - DNA, 13 bp, Homo sapiens
gtatatatgtgta

SEQ ID NO: 4943898 - DNA, 23 bp, Homo sapiens
gtatatatgtgtatatatacata

SEQ ID NO: 4943899 - DNA, 14 bp, Homo sapiens
gtatatcagaaaag

SEQ ID NO: 4943900 - DNA, 14 bp, Homo sapiens
gtatatctgggctg

SEQ ID NO: 4943901 - DNA, 21 bp, Homo sapiens
gtatatgtctcaggtccctgc

SEQ ID NO: 4943902 - DNA, 23 bp, Homo sapiens
gttattcattctgtgatcattta

SEQ ID NO: 4943903 - DNA, 13 bp, Homo sapiens
gttattctggagt

SEQ ID NO: 4943904 - DNA, 15 bp, Homo sapiens
gttattgtgaatgat

SEQ ID NO: 4943905 - DNA, 19 bp, Homo sapiens
gttatttatagtcatttat

SEQ ID NO: 4943906 - DNA, 17 bp, Homo sapiens
gttatttgtttaccact

SEQ ID NO: 4943907 - DNA, 12 bp, Homo sapiens
gttattttcagt

SEQ ID NO: 4943908 - DNA, 15 bp, Homo sapiens
gttattttcagtatt

SEQ ID NO: 4943909 - DNA, 16 bp, Homo sapiens
gttcaaacaatatcat

SEQ ID NO: 4943910 - DNA, 23 bp, Homo sapiens
gttcaaagccacattatttctag

SEQ ID NO: 4943911 - DNA, 20 bp, Homo sapiens
gttcaagcgattcttctgct

SEQ ID NO: 4943912 - DNA, 16 bp, Homo sapiens
gttcaattctcatttg

SEQ ID NO: 4943913 - DNA, 16 bp, Homo sapiens
gttcacaccctgcaag

SEQ ID NO: 4943914 - DNA, 16 bp, Homo sapiens
gttcacgcaacttgaa

SEQ ID NO: 4943915 - DNA, 19 bp, Homo sapiens
gttcactgcaacctccgcc

SEQ ID NO: 4943916 - DNA, 15 bp, Homo sapiens
gttcagcacttgtct

SEQ ID NO: 4943917 - DNA, 20 bp, Homo sapiens
gttcagcacttgtctcattt

SEQ ID NO: 4943918 - DNA, 16 bp, Homo sapiens
gtaatttgaggacaac

SEQ ID NO: 4943919 - DNA, 20 bp, Homo sapiens
gtacaaaatccagctatgaa

SEQ ID NO: 4943920 - DNA, 22 bp, Homo sapiens
gtacaataagtgtttttgtatt

SEQ ID NO: 4943921 - DNA, 18 bp, Homo sapiens
gtacacaataagcaaaaa

SEQ ID NO: 4943922 - DNA, 14 bp, Homo sapiens
gtacacgtgtcctg

SEQ ID NO: 4943923 - DNA, 15 bp, Homo sapiens
gtacacgtgtcctgt

SEQ ID NO: 4943924 - DNA, 16 bp, Homo sapiens
gtacagggtttttacc

SEQ ID NO: 4943925 - DNA, 16 bp, Homo sapiens
gtacataaaagaattt

SEQ ID NO: 4943926 - DNA, 17 bp, Homo sapiens
gtacatagttatttatt

SEQ ID NO: 4943927 - DNA, 17 bp, Homo sapiens
gtacatatgtaaacata

SEQ ID NO: 4943928 - DNA, 19 bp, Homo sapiens
gtacatatttattttcttt

SEQ ID NO: 4943929 - DNA, 20 bp, Homo sapiens
gtacatatttgtggaataat

SEQ ID NO: 4943930 - DNA, 18 bp, Homo sapiens
gtacatctattttggatt

SEQ ID NO: 4943931 - DNA, 14 bp, Homo sapiens
gtacatctggcctt

SEQ ID NO: 4943932 - DNA, 13 bp, Homo sapiens
gtacatctggctt

SEQ ID NO: 4943933 - DNA, 18 bp, Homo sapiens
gtacatctggcttatttt

SEQ ID NO: 4943934 - DNA, 21 bp, Homo sapiens
gtacatctggcttattttaat

SEQ ID NO: 4943935 - DNA, 21 bp, Homo sapiens
taccattttttaaggaaacaa

SEQ ID NO: 4943936 - DNA, 18 bp, Homo sapiens
tacccaagggcagaaagt

SEQ ID NO: 4943937 - DNA, 18 bp, Homo sapiens
tacccacatgtacagaca

SEQ ID NO: 4943938 - DNA, 14 bp, Homo sapiens
tacccactgctctg

SEQ ID NO: 4943939 - DNA, 15 bp, Homo sapiens
tacccactgctctgg

SEQ ID NO: 4943940 - DNA, 21 bp, Homo sapiens
tacccacttctaaatagcaat

SEQ ID NO: 4943941 - DNA, 12 bp, Homo sapiens
tacccccaacct

SEQ ID NO: 4943942 - DNA, 15 bp, Homo sapiens
tacccccctctgtct

SEQ ID NO: 4943943 - DNA, 16 bp, Homo sapiens
taccccctaagagcca

SEQ ID NO: 4943944 - DNA, 16 bp, Homo sapiens
taccccctccttcaga

SEQ ID NO: 4943945 - DNA, 12 bp, Homo sapiens
tacccctggctg

SEQ ID NO: 4943946 - DNA, 18 bp, Homo sapiens
tacccctttctggctctc

SEQ ID NO: 4943947 - DNA, 13 bp, Homo sapiens
taccctaatgtct

SEQ ID NO: 4943948 - DNA, 17 bp, Homo sapiens
taccctaatgtcttcat

SEQ ID NO: 4943949 - DNA, 16 bp, Homo sapiens
taccctattctctctt

SEQ ID NO: 4943950 - DNA, 18 bp, Homo sapiens
taccctcctgcactgttt

SEQ ID NO: 4943951 - DNA, 12 bp, Homo sapiens
taccctcctggc

SEQ ID NO: 4943952 - DNA, 18 bp, Homo sapiens
taccctgggaaggcctct

SEQ ID NO: 4943953 - DNA, 17 bp, Homo sapiens
taccctgtacatatgta

SEQ ID NO: 4943954 - DNA, 14 bp, Homo sapiens
tacccttcttttat

SEQ ID NO: 4943955 - DNA, 20 bp, Homo sapiens
tacccttcttttatgagcag

SEQ ID NO: 4943956 - DNA, 17 bp, Homo sapiens
taccgagtctcttctcc

SEQ ID NO: 4943957 - DNA, 21 bp, Homo sapiens
taccgagtctcttctccactg

SEQ ID NO: 4943958 - DNA, 22 bp, Homo sapiens
taccgagtctcttctccactgg

SEQ ID NO: 4943959 - DNA, 20 bp, Homo sapiens
taccgtaggctttgtattca

SEQ ID NO: 4943960 - DNA, 19 bp, Homo sapiens
tacctaaaaggaaatctca

SEQ ID NO: 4943961 - DNA, 20 bp, Homo sapiens
tacctaaagtatttttataa

SEQ ID NO: 4943962 - DNA, 15 bp, Homo sapiens
tacctaagtactgta

SEQ ID NO: 4943963 - DNA, 13 bp, Homo sapiens
tacctagaagaag

SEQ ID NO: 4943964 - DNA, 23 bp, Homo sapiens
tacctataatgtgtgtatgtgta

SEQ ID NO: 4943965 - DNA, 14 bp, Homo sapiens
tacctcaaactatc

SEQ ID NO: 4943966 - DNA, 15 bp, Homo sapiens
tacctcaatgtttga

SEQ ID NO: 4943967 - DNA, 16 bp, Homo sapiens
tacctcaatgtttgag

SEQ ID NO: 4943968 - DNA, 15 bp, Homo sapiens
tacctcaccctgcta

SEQ ID NO: 4943969 - DNA, 17 bp, Homo sapiens
tacctcatgtttatgaa

SEQ ID NO: 4943970 - DNA, 19 bp, Homo sapiens
tacctcatgtttatgaaaa

SEQ ID NO: 4943971 - DNA, 15 bp, Homo sapiens
tacctcccctgcctt

SEQ ID NO: 4943972 - DNA, 17 bp, Homo sapiens
tacctcccctgccttgc

SEQ ID NO: 4943973 - DNA, 14 bp, Homo sapiens
tacctctgtgtgct

SEQ ID NO: 4943974 - DNA, 14 bp, Homo sapiens
tacctcttattgca

SEQ ID NO: 4943975 - DNA, 18 bp, Homo sapiens
tacctgcaggctgagcca

SEQ ID NO: 4943976 - DNA, 15 bp, Homo sapiens
tacctgccctggaac

SEQ ID NO: 4943977 - DNA, 19 bp, Homo sapiens
tacctgtcacattgcattc

SEQ ID NO: 4943978 - DNA, 14 bp, Homo sapiens
tacctgtgtatata

SEQ ID NO: 4943979 - DNA, 21 bp, Homo sapiens
tacctgtgtggtactctgaaa

SEQ ID NO: 4943980 - DNA, 13 bp, Homo sapiens
tacctgttcctta

SEQ ID NO: 4943981 - DNA, 18 bp, Homo sapiens
taccttttaccagctttt

SEQ ID NO: 4943982 - DNA, 15 bp, Homo sapiens
tacgaatattttcag

SEQ ID NO: 4943983 - DNA, 12 bp, Homo sapiens
tacgctttgtca

SEQ ID NO: 4943984 - DNA, 19 bp, Homo sapiens
tacggatcatcaacaagat

SEQ ID NO: 4943985 - DNA, 14 bp, Homo sapiens
tacgtctgacaggc

SEQ ID NO: 4943986 - DNA, 14 bp, Homo sapiens
tactaaatttaaat

SEQ ID NO: 4943987 - DNA, 15 bp, Homo sapiens
tactaaatttaaatt

SEQ ID NO: 4943988 - DNA, 16 bp, Homo sapiens
tactaattttctagat

SEQ ID NO: 4943989 - DNA, 18 bp, Homo sapiens
tactacattgagtagaca

SEQ ID NO: 4943990 - DNA, 15 bp, Homo sapiens
tactaccaatgccaa

SEQ ID NO: 4943991 - DNA, 13 bp, Homo sapiens
tactagaatgctt

SEQ ID NO: 4943992 - DNA, 17 bp, Homo sapiens
tactagtactgtgtact

SEQ ID NO: 4943993 - DNA, 15 bp, Homo sapiens
tactagtgttctgtt

SEQ ID NO: 4943994 - DNA, 13 bp, Homo sapiens
tactataacatat

SEQ ID NO: 4943995 - DNA, 13 bp, Homo sapiens
taaccacggaaaa

SEQ ID NO: 4943996 - DNA, 20 bp, Homo sapiens
taaccagccagatcctcttg

SEQ ID NO: 4943997 - DNA, 22 bp, Homo sapiens
taaccagttaccacacatctat

SEQ ID NO: 4943998 - DNA, 18 bp, Homo sapiens
taacccaaggagcacagg

SEQ ID NO: 4943999 - DNA, 19 bp, Homo sapiens
taaccccagctccctagga

SEQ ID NO: 4944000 - DNA, 21 bp, Homo sapiens
taaccggcatgtttccagcag

SEQ ID NO: 4944001 - DNA, 22 bp, Homo sapiens
taacctatatgatttatagttt

SEQ ID NO: 4944002 - DNA, 18 bp, Homo sapiens
taaccttatcctgcattg

SEQ ID NO: 4944003 - DNA, 18 bp, Homo sapiens
taaccttgaatgctgcca

SEQ ID NO: 4944004 - DNA, 19 bp, Homo sapiens
taaccttgaatgctgccag

SEQ ID NO: 4944005 - DNA, 20 bp, Homo sapiens
taaccttgaatgctgccagt

SEQ ID NO: 4944006 - DNA, 15 bp, Homo sapiens
taacgtaaatacaca

SEQ ID NO: 4944007 - DNA, 15 bp, Homo sapiens
taactacaaatgatc

SEQ ID NO: 4944008 - DNA, 20 bp, Homo sapiens
taactagacaccaaagttct

SEQ ID NO: 4944009 - DNA, 16 bp, Homo sapiens
taactaggctcagaga

SEQ ID NO: 4944010 - DNA, 13 bp, Homo sapiens
taactagtggctc

SEQ ID NO: 4944011 - DNA, 15 bp, Homo sapiens
taactattgcattta

SEQ ID NO: 4944012 - DNA, 21 bp, Homo sapiens
taactgccttgaacctgtgag

SEQ ID NO: 4944013 - DNA, 21 bp, Homo sapiens
taacttaaaaatgtaaatatt

SEQ ID NO: 4944014 - DNA, 22 bp, Homo sapiens
taacttattgctgattttaatg

SEQ ID NO: 4944015 - DNA, 23 bp, Homo sapiens
taacttattgctgattttaatgg

SEQ ID NO: 4944016 - DNA, 13 bp, Homo sapiens
taacttcagtcct

SEQ ID NO: 4944017 - DNA, 18 bp, Homo sapiens
taacttcttaaaagttgt

SEQ ID NO: 4944018 - DNA, 17 bp, Homo sapiens
taacttcttatggaatt

SEQ ID NO: 4944019 - DNA, 18 bp, Homo sapiens
taacttcttatggaattg

SEQ ID NO: 4944020 - DNA, 19 bp, Homo sapiens
taacttcttatggaattga

SEQ ID NO: 4944021 - DNA, 16 bp, Homo sapiens
taacttgatgcatgtg

SEQ ID NO: 4944022 - DNA, 22 bp, Homo sapiens
taactttagaagtgcatttctg

SEQ ID NO: 4944023 - DNA, 16 bp, Homo sapiens
taactttatgtgtaaa

SEQ ID NO: 4944024 - DNA, 22 bp, Homo sapiens
taactttgctttcatgaccatc

SEQ ID NO: 4944025 - DNA, 18 bp, Homo sapiens
taacttttgtaagacaaa

SEQ ID NO: 4944026 - DNA, 16 bp, Homo sapiens
taagaaaacaatcaca

SEQ ID NO: 4944027 - DNA, 22 bp, Homo sapiens
taagaaaagtattttgaagttt

SEQ ID NO: 4944028 - DNA, 12 bp, Homo sapiens
taagaaacagag

SEQ ID NO: 4944029 - DNA, 12 bp, Homo sapiens
taagaaatatgt

SEQ ID NO: 4944030 - DNA, 16 bp, Homo sapiens
taagaaatatgtgaga

SEQ ID NO: 4944031 - DNA, 17 bp, Homo sapiens
taagaaatatgtgagat

SEQ ID NO: 4944032 - DNA, 18 bp, Homo sapiens
taagaacaaaagcgaccc

SEQ ID NO: 4944033 - DNA, 19 bp, Homo sapiens
taagaagcttctaataaat

SEQ ID NO: 4944034 - DNA, 22 bp, Homo sapiens
taatacaacatgtagctgagtt

SEQ ID NO: 4944035 - DNA, 18 bp, Homo sapiens
taatacctcaatgtttga

SEQ ID NO: 4944036 - DNA, 13 bp, Homo sapiens
taatacctctgtg

SEQ ID NO: 4944037 - DNA, 14 bp, Homo sapiens
taatacctctgtgt

SEQ ID NO: 4944038 - DNA, 13 bp, Homo sapiens
taatactaaaata

SEQ ID NO: 4944039 - DNA, 15 bp, Homo sapiens
taatagaaaactgaa

SEQ ID NO: 4944040 - DNA, 16 bp, Homo sapiens
taatagaaaactgaaa

SEQ ID NO: 4944041 - DNA, 18 bp, Homo sapiens
taatagaaaactgaaaat

SEQ ID NO: 4944042 - DNA, 19 bp, Homo sapiens
taatagaaaactgaaaatc

SEQ ID NO: 4944043 - DNA, 12 bp, Homo sapiens
taatagattctc

SEQ ID NO: 4944044 - DNA, 20 bp, Homo sapiens
taatagcaacttttgtgtaa

SEQ ID NO: 4944045 - DNA, 21 bp, Homo sapiens
taatagcaacttttgtgtaat

SEQ ID NO: 4944046 - DNA, 21 bp, Homo sapiens
taatagttcaggtaacaggca

SEQ ID NO: 4944047 - DNA, 18 bp, Homo sapiens
taatataatggaagagaa

SEQ ID NO: 4944048 - DNA, 20 bp, Homo sapiens
taatatatatatatatcagt

SEQ ID NO: 4944049 - DNA, 14 bp, Homo sapiens
taatatcattcact

SEQ ID NO: 4944050 - DNA, 19 bp, Homo sapiens
taatatctttgtgataatt

SEQ ID NO: 4944051 - DNA, 20 bp, Homo sapiens
taatatctttgtgataattt

SEQ ID NO: 4944052 - DNA, 21 bp, Homo sapiens
taatatctttgtgataattta

SEQ ID NO: 4944053 - DNA, 12 bp, Homo sapiens
taatatggattt

SEQ ID NO: 4944054 - DNA, 15 bp, Homo sapiens
taatatggcaaaaat

SEQ ID NO: 4944055 - DNA, 22 bp, Homo sapiens
taatatggccacagtagtcttg

SEQ ID NO: 4944056 - DNA, 18 bp, Homo sapiens
taatattaaaaatatgga

SEQ ID NO: 4944057 - DNA, 22 bp, Homo sapiens
taatattaaaaatatggaactt

SEQ ID NO: 4944058 - DNA, 22 bp, Homo sapiens
taatattaattttctacaaata

SEQ ID NO: 4944059 - DNA, 20 bp, Homo sapiens
taatattgtttttctttcta

SEQ ID NO: 4944060 - DNA, 23 bp, Homo sapiens
taatattgtttttctttctacaa

SEQ ID NO: 4944061 - DNA, 21 bp, Homo sapiens
taatatttaacattatttata

SEQ ID NO: 4944062 - DNA, 23 bp, Homo sapiens
taatatttatgtctatttaagcc

SEQ ID NO: 4944063 - DNA, 15 bp, Homo sapiens
taatattttgtatta

SEQ ID NO: 4944064 - DNA, 20 bp, Homo sapiens
taatcaatgaatattgaagt

SEQ ID NO: 4944065 - DNA, 13 bp, Homo sapiens
taatcagaaattt

SEQ ID NO: 4944066 - DNA, 15 bp, Homo sapiens
taatcagaaattttt

SEQ ID NO: 4944067 - DNA, 11 bp, Homo sapiens
taatcagcctc

SEQ ID NO: 4944068 - DNA, 19 bp, Homo sapiens
taatcaggtcctcagagaa

SEQ ID NO: 4944069 - DNA, 22 bp, Homo sapiens
taatcaggtcctcagagaattt

SEQ ID NO: 4944070 - DNA, 17 bp, Homo sapiens
taatcagtgtgtctaaa

SEQ ID NO: 4944071 - DNA, 14 bp, Homo sapiens
taatcccccaggag

SEQ ID NO: 4944072 - DNA, 22 bp, Homo sapiens
taatcctttgttttctgactaa

SEQ ID NO: 4944073 - DNA, 13 bp, Homo sapiens
taatcgaaagaaa

SEQ ID NO: 4944074 - DNA, 17 bp, Homo sapiens
taatctagtttacagaa

SEQ ID NO: 4944075 - DNA, 13 bp, Homo sapiens
taatctccacagt

SEQ ID NO: 4944076 - DNA, 18 bp, Homo sapiens
taatctctctgcagctgc

SEQ ID NO: 4944077 - DNA, 20 bp, Homo sapiens
taatctctctgcagctgccg

SEQ ID NO: 4944078 - DNA, 16 bp, Homo sapiens
taatctctgttatgta

SEQ ID NO: 4944079 - DNA, 16 bp, Homo sapiens
taatctgaaattctaa

SEQ ID NO: 4944080 - DNA, 21 bp, Homo sapiens
taatctgcaaagaatgagaag

SEQ ID NO: 4944081 - DNA, 19 bp, Homo sapiens
taatctggactcctctgtc

SEQ ID NO: 4944082 - DNA, 21 bp, Homo sapiens
taatctggactcctctgtcca

SEQ ID NO: 4944083 - DNA, 17 bp, Homo sapiens
taatctgggaagggaag

SEQ ID NO: 4944084 - DNA, 18 bp, Homo sapiens
taatctgtacattttgtt

SEQ ID NO: 4944085 - DNA, 22 bp, Homo sapiens
taatctgtacattttgttgtaa

SEQ ID NO: 4944086 - DNA, 11 bp, Homo sapiens
taatctgtcaa

SEQ ID NO: 4944087 - DNA, 19 bp, Homo sapiens
taatctgtcaaaacactgt

SEQ ID NO: 4944088 - DNA, 21 bp, Homo sapiens
taatctgtcaaaacactgtgg

SEQ ID NO: 4944089 - DNA, 23 bp, Homo sapiens
taatctgtcaaaacactgtggaa

SEQ ID NO: 4944090 - DNA, 20 bp, Homo sapiens
taatctgttatgtactagtg

SEQ ID NO: 4944091 - DNA, 15 bp, Homo sapiens
taatcttatttagga

SEQ ID NO: 4944092 - DNA, 22 bp, Homo sapiens
taatctttgggtaacttcaaaa

SEQ ID NO: 4944093 - DNA, 21 bp, Homo sapiens
taatgcaaaatttttttaatc

SEQ ID NO: 4944094 - DNA, 13 bp, Homo sapiens
taatgctactgtc

SEQ ID NO: 4944095 - DNA, 16 bp, Homo sapiens
taatgctgcacttcct

SEQ ID NO: 4944096 - DNA, 15 bp, Homo sapiens
tacagaaaaatcttg

SEQ ID NO: 4944097 - DNA, 14 bp, Homo sapiens
tacagaaatactat

SEQ ID NO: 4944098 - DNA, 16 bp, Homo sapiens
tacagacctgcttttt

SEQ ID NO: 4944099 - DNA, 18 bp, Homo sapiens
tacagacctgctttttga

SEQ ID NO: 4944100 - DNA, 17 bp, Homo sapiens
tacagaggaaatctgta

SEQ ID NO: 4944101 - DNA, 19 bp, Homo sapiens
tacagagtgtggactctgg

SEQ ID NO: 4944102 - DNA, 13 bp, Homo sapiens
tacagataacatt

SEQ ID NO: 4944103 - DNA, 12 bp, Homo sapiens
tacagatgaaaa

SEQ ID NO: 4944104 - DNA, 18 bp, Homo sapiens
tacagctaatcagcattc

SEQ ID NO: 4944105 - DNA, 13 bp, Homo sapiens
tacagctgcctgc

SEQ ID NO: 4944106 - DNA, 14 bp, Homo sapiens
tacagctgtttaag

SEQ ID NO: 4944107 - DNA, 19 bp, Homo sapiens
tacagctttgatccctgac

SEQ ID NO: 4944108 - DNA, 17 bp, Homo sapiens
tacaggaaaagctgctg

SEQ ID NO: 4944109 - DNA, 21 bp, Homo sapiens
tacaggaagcaccccatgcca

SEQ ID NO: 4944110 - DNA, 13 bp, Homo sapiens
tacaggcaattcc

SEQ ID NO: 4944111 - DNA, 14 bp, Homo sapiens
tacaggcaattccg

SEQ ID NO: 4944112 - DNA, 16 bp, Homo sapiens
tacaggcacccaccat

SEQ ID NO: 4944113 - DNA, 15 bp, Homo sapiens
tacaggccctgctcc

SEQ ID NO: 4944114 - DNA, 19 bp, Homo sapiens
tacagggtaactgtgctga

SEQ ID NO: 4944115 - DNA, 17 bp, Homo sapiens
tacagggtttttacctg

SEQ ID NO: 4944116 - DNA, 16 bp, Homo sapiens
tacaggtgtgagtcac

SEQ ID NO: 4944117 - DNA, 22 bp, Homo sapiens
tacaggtgtgtgccaccacacc

SEQ ID NO: 4944118 - DNA, 16 bp, Homo sapiens
tacagtaactttatgt

SEQ ID NO: 4944119 - DNA, 17 bp, Homo sapiens
tacagtaactttatgtg

SEQ ID NO: 4944120 - DNA, 23 bp, Homo sapiens
tacagttaggcaccagaagaaca

SEQ ID NO: 4944121 - DNA, 16 bp, Homo sapiens
tacagttcaataaact

SEQ ID NO: 4944122 - DNA, 19 bp, Homo sapiens
tacagttttatgctctttt

SEQ ID NO: 4944123 - DNA, 16 bp, Homo sapiens
tacataaaagaatttt

SEQ ID NO: 4944124 - DNA, 21 bp, Homo sapiens
tacataaattgcataaagcat

SEQ ID NO: 4944125 - DNA, 22 bp, Homo sapiens
tacataaattgcataaagcata

SEQ ID NO: 4944126 - DNA, 13 bp, Homo sapiens
tacataacaagaa

SEQ ID NO: 4944127 - DNA, 18 bp, Homo sapiens
tacataactaaatttgat

SEQ ID NO: 4944128 - DNA, 14 bp, Homo sapiens
tacataactgcctt

SEQ ID NO: 4944129 - DNA, 22 bp, Homo sapiens
tacataactgccttgaacctgt

SEQ ID NO: 4944130 - DNA, 19 bp, Homo sapiens
tacataagtaattcaagaa

SEQ ID NO: 4944131 - DNA, 22 bp, Homo sapiens
tacatacacttgtataaatgta

SEQ ID NO: 4944132 - DNA, 17 bp, Homo sapiens
tacatacggtcaggttt

SEQ ID NO: 4944133 - DNA, 15 bp, Homo sapiens
tacatatatttttaa

SEQ ID NO: 4944134 - DNA, 20 bp, Homo sapiens
tacatatcgctgacttcatg

SEQ ID NO: 4944135 - DNA, 12 bp, Homo sapiens
tacatatgtaaa

SEQ ID NO: 4944136 - DNA, 17 bp, Homo sapiens
tacatatgtaaacataa

SEQ ID NO: 4944137 - DNA, 19 bp, Homo sapiens
tacatatgtagactatata

SEQ ID NO: 4944138 - DNA, 20 bp, Homo sapiens
tacatatgtagactatatac

SEQ ID NO: 4944139 - DNA, 22 bp, Homo sapiens
tacatatgtagactatatacat

SEQ ID NO: 4944140 - DNA, 22 bp, Homo sapiens
tacatcactgcttgatgaagca

SEQ ID NO: 4944141 - DNA, 23 bp, Homo sapiens
tacatcactgcttgatgaagcaa

SEQ ID NO: 4944142 - DNA, 20 bp, Homo sapiens
tacatcagttattcattctg

SEQ ID NO: 4944143 - DNA, 13 bp, Homo sapiens
tacatcctgggta

SEQ ID NO: 4944144 - DNA, 19 bp, Homo sapiens
tacatctattttggattgt

SEQ ID NO: 4944145 - DNA, 23 bp, Homo sapiens
tacatctattttggattgtatat

SEQ ID NO: 4944146 - DNA, 15 bp, Homo sapiens
tacatctctccccaa

SEQ ID NO: 4944147 - DNA, 13 bp, Homo sapiens
tacatctggctta

SEQ ID NO: 4944148 - DNA, 15 bp, Homo sapiens
tacatctggcttatt

SEQ ID NO: 4944149 - DNA, 17 bp, Homo sapiens
tacatctggcttatttt

SEQ ID NO: 4944150 - DNA, 19 bp, Homo sapiens
tattttcttttgaattgtt

SEQ ID NO: 4944151 - DNA, 14 bp, Homo sapiens
tattttgaaaagct

SEQ ID NO: 4944152 - DNA, 16 bp, Homo sapiens
tattttgaaaagcttc

SEQ ID NO: 4944153 - DNA, 20 bp, Homo sapiens
tatgctcttttttactcatt

SEQ ID NO: 4944154 - DNA, 21 bp, Homo sapiens
tatggaaaaaccatttgaagt

SEQ ID NO: 4944155 - DNA, 16 bp, Homo sapiens
tatggaaaatcagctg

SEQ ID NO: 4944156 - DNA, 17 bp, Homo sapiens
tatggaaataaatgtat

SEQ ID NO: 4944157 - DNA, 13 bp, Homo sapiens
tatggaacttcta

SEQ ID NO: 4944158 - DNA, 20 bp, Homo sapiens
tatggaacttctaatatatt

SEQ ID NO: 4944159 - DNA, 18 bp, Homo sapiens
tatggaagttgcataatt

SEQ ID NO: 4944160 - DNA, 22 bp, Homo sapiens
tatggaattacatgtaaaacat

SEQ ID NO: 4944161 - DNA, 18 bp, Homo sapiens
tatggaattgatttgcat

SEQ ID NO: 4944162 - DNA, 16 bp, Homo sapiens
tatggactctgcacat

SEQ ID NO: 4944163 - DNA, 16 bp, Homo sapiens
tatggagaattgctga

SEQ ID NO: 4944164 - DNA, 23 bp, Homo sapiens
tatggattgggggggccaaaagg

SEQ ID NO: 4944165 - DNA, 22 bp, Homo sapiens
tatggcagaagacaccagagca

SEQ ID NO: 4944166 - DNA, 18 bp, Homo sapiens
tataagatcctagatcct

SEQ ID NO: 4944167 - DNA, 18 bp, Homo sapiens
tataagcattgaaattat

SEQ ID NO: 4944168 - DNA, 21 bp, Homo sapiens
tataagccagtgttgcctaag

SEQ ID NO: 4944169 - DNA, 16 bp, Homo sapiens
tataagcccactgtta

SEQ ID NO: 4944170 - DNA, 14 bp, Homo sapiens
tataagtgaagtga

SEQ ID NO: 4944171 - DNA, 22 bp, Homo sapiens
tataagtgcacacagaaatata

SEQ ID NO: 4944172 - DNA, 14 bp, Homo sapiens
tataatatatatat

SEQ ID NO: 4944173 - DNA, 20 bp, Homo sapiens
tataatctgtcaaaacactg

SEQ ID NO: 4944174 - DNA, 21 bp, Homo sapiens
tataatctgtcaaaacactgt

SEQ ID NO: 4944175 - DNA, 17 bp, Homo sapiens
tataatggaagagaaat

SEQ ID NO: 4944176 - DNA, 21 bp, Homo sapiens
tataatggaagagaaatctca

SEQ ID NO: 4944177 - DNA, 13 bp, Homo sapiens
tataatgtgtgta

SEQ ID NO: 4944178 - DNA, 22 bp, Homo sapiens
tataatgtgtgtatgtgtattt

SEQ ID NO: 4944179 - DNA, 21 bp, Homo sapiens
tataattcctatatcctgtga

SEQ ID NO: 4944180 - DNA, 16 bp, Homo sapiens
tataatttcgagattt

SEQ ID NO: 4944181 - DNA, 19 bp, Homo sapiens
tataattttttgtaatgtg

SEQ ID NO: 4944182 - DNA, 14 bp, Homo sapiens
tatacaaatatatt

SEQ ID NO: 4944183 - DNA, 20 bp, Homo sapiens
tatacaaatatattgttaat

SEQ ID NO: 4944184 - DNA, 14 bp, Homo sapiens
tatacaatatataa

SEQ ID NO: 4944185 - DNA, 15 bp, Homo sapiens
tatacaatatataaa

SEQ ID NO: 4944186 - DNA, 15 bp, Homo sapiens
tatacagatgaaaat

SEQ ID NO: 4944187 - DNA, 18 bp, Homo sapiens
tatacagatgaaaatttg

SEQ ID NO: 4944188 - DNA, 16 bp, Homo sapiens
tatacagttcaataaa

SEQ ID NO: 4944189 - DNA, 14 bp, Homo sapiens
tcggaggctgcccc

SEQ ID NO: 4944190 - DNA, 19 bp, Homo sapiens
tcggatatgattgtttctc

SEQ ID NO: 4944191 - DNA, 18 bp, Homo sapiens
tcggcaactaagcagtcc

SEQ ID NO: 4944192 - DNA, 16 bp, Homo sapiens
tcggcatttcaaatgt

SEQ ID NO: 4944193 - DNA, 14 bp, Homo sapiens
tcggctctgggtgg

SEQ ID NO: 4944194 - DNA, 16 bp, Homo sapiens
tcgggacacctgccct

SEQ ID NO: 4944195 - DNA, 20 bp, Homo sapiens
tcgggacacctgccctgccc

SEQ ID NO: 4944196 - DNA, 16 bp, Homo sapiens
tcgggcaccagccagc

SEQ ID NO: 4944197 - DNA, 13 bp, Homo sapiens
tcggggagcctta

SEQ ID NO: 4944198 - DNA, 12 bp, Homo sapiens
tcgtagctttcc

SEQ ID NO: 4944199 - DNA, 12 bp, Homo sapiens
tcgtatgaaaat

SEQ ID NO: 4944200 - DNA, 13 bp, Homo sapiens
tcgtatgaaaatg

SEQ ID NO: 4944201 - DNA, 15 bp, Homo sapiens
tcgtatgaaaatgag

SEQ ID NO: 4944202 - DNA, 14 bp, Homo sapiens
tcgtgaacatcccc

SEQ ID NO: 4944203 - DNA, 20 bp, Homo sapiens
tcgtgattttcaagcagcat

SEQ ID NO: 4944204 - DNA, 20 bp, Homo sapiens
tcgtgcccccccttccccct

SEQ ID NO: 4944205 - DNA, 21 bp, Homo sapiens
tcgtggcagataatcagcctc

SEQ ID NO: 4944206 - DNA, 13 bp, Homo sapiens
tcgttttccaaac

SEQ ID NO: 4944207 - DNA, 18 bp, Homo sapiens
tctaaaaagattagcaag

SEQ ID NO: 4944208 - DNA, 12 bp, Homo sapiens
tctaaaagcacc

SEQ ID NO: 4944209 - DNA, 18 bp, Homo sapiens
tctaaaatgtgatgttct

SEQ ID NO: 4944210 - DNA, 13 bp, Homo sapiens
tctaaacattaat

SEQ ID NO: 4944211 - DNA, 17 bp, Homo sapiens
tctaaacttccccatct

SEQ ID NO: 4944212 - DNA, 12 bp, Homo sapiens
tctaaagagcac

SEQ ID NO: 4944213 - DNA, 20 bp, Homo sapiens
tctaaagatggagtttctaa

SEQ ID NO: 4944214 - DNA, 23 bp, Homo sapiens
tctaaagatggagtttctaaggt

SEQ ID NO: 4944215 - DNA, 13 bp, Homo sapiens
tctaaagattcta

SEQ ID NO: 4944216 - DNA, 20 bp, Homo sapiens
tctaaagattctatagttct

SEQ ID NO: 4944217 - DNA, 14 bp, Homo sapiens
tctaaagctctgac

SEQ ID NO: 4944218 - DNA, 14 bp, Homo sapiens
tctaaaggtccaca

SEQ ID NO: 4944219 - DNA, 15 bp, Homo sapiens
tctaaaggtccacag

SEQ ID NO: 4944220 - DNA, 23 bp, Homo sapiens
tctaaaggtccacaggtctagac

SEQ ID NO: 4944221 - DNA, 17 bp, Homo sapiens
tctaaagttctaagatt

SEQ ID NO: 4944222 - DNA, 17 bp, Homo sapiens
tctaaatctatttatta

SEQ ID NO: 4944223 - DNA, 20 bp, Homo sapiens
tctaaatctatttattaata

SEQ ID NO: 4944224 - DNA, 18 bp, Homo sapiens
tctaaattaaagccttta

SEQ ID NO: 4944225 - DNA, 19 bp, Homo sapiens
tctaaccctatactgtagt

SEQ ID NO: 4944226 - DNA, 18 bp, Homo sapiens
tctaaccttgaatgctgc

SEQ ID NO: 4944227 - DNA, 20 bp, Homo sapiens
tctaaccttgaatgctgcca

SEQ ID NO: 4944228 - DNA, 14 bp, Homo sapiens
tctaactcagaatt

SEQ ID NO: 4944229 - DNA, 18 bp, Homo sapiens
tctaactcagaattattt

SEQ ID NO: 4944230 - DNA, 12 bp, Homo sapiens
tctaagaaaccc

SEQ ID NO: 4944231 - DNA, 22 bp, Homo sapiens
tctaagactcaaatgttctaag

SEQ ID NO: 4944232 - DNA, 19 bp, Homo sapiens
tctaagacttactctaaga

SEQ ID NO: 4944233 - DNA, 20 bp, Homo sapiens
tctaagacttactctaagat

SEQ ID NO: 4944234 - DNA, 21 bp, Homo sapiens
tctaagatagtaacaatgaag

SEQ ID NO: 4944235 - DNA, 12 bp, Homo sapiens
tctaagatgtga

SEQ ID NO: 4944236 - DNA, 18 bp, Homo sapiens
tctaagatgtgatattct

SEQ ID NO: 4944237 - DNA, 24 bp, Homo sapiens
tctaagatgtgatattctaagact

SEQ ID NO: 4944238 - DNA, 13 bp, Homo sapiens
tctaagattctaa

SEQ ID NO: 4944239 - DNA, 19 bp, Homo sapiens
tctaagattctaaaggtcc

SEQ ID NO: 4944240 - DNA, 15 bp, Homo sapiens
tctaagattctaatg

SEQ ID NO: 4944241 - DNA, 20 bp, Homo sapiens
tctaagattctaatgatgat

SEQ ID NO: 4944242 - DNA, 14 bp, Homo sapiens
tctaagattctaga

SEQ ID NO: 4944243 - DNA, 18 bp, Homo sapiens
tctaagctgcagcttcct

SEQ ID NO: 4944244 - DNA, 19 bp, Homo sapiens
tctaaggatgtcacagggc

SEQ ID NO: 4944245 - DNA, 14 bp, Homo sapiens
tctaaggctctgag

SEQ ID NO: 4944246 - DNA, 22 bp, Homo sapiens
tctaaggctctgagagtctaga

SEQ ID NO: 4944247 - DNA, 23 bp, Homo sapiens
tctaaggtccggtgttctaagat

SEQ ID NO: 4944248 - DNA, 16 bp, Homo sapiens
tctaagttataagact

SEQ ID NO: 4944249 - DNA, 20 bp, Homo sapiens
tctaagttataagactctca

SEQ ID NO: 4944250 - DNA, 22 bp, Homo sapiens
tctaagttataagactctcaca

SEQ ID NO: 4944251 - DNA, 14 bp, Homo sapiens
tctaataaattata

SEQ ID NO: 4944252 - DNA, 17 bp, Homo sapiens
tctaataatttctaatg

SEQ ID NO: 4944253 - DNA, 18 bp, Homo sapiens
tctaataatttctaatgt

SEQ ID NO: 4944254 - DNA, 20 bp, Homo sapiens
tctaatacctctgtgtgctc

SEQ ID NO: 4944255 - DNA, 13 bp, Homo sapiens
tccgcctctgtcc

SEQ ID NO: 4944256 - DNA, 13 bp, Homo sapiens
tccgctctcttcc

SEQ ID NO: 4944257 - DNA, 14 bp, Homo sapiens
tccgctgccgtgcc

SEQ ID NO: 4944258 - DNA, 12 bp, Homo sapiens
tccgctgctcct

SEQ ID NO: 4944259 - DNA, 16 bp, Homo sapiens
tccgctttctacccag

SEQ ID NO: 4944260 - DNA, 20 bp, Homo sapiens
tccgctttctacccagcgag

SEQ ID NO: 4944261 - DNA, 16 bp, Homo sapiens
tccggtgttctaagat

SEQ ID NO: 4944262 - DNA, 14 bp, Homo sapiens
tccggttgcatact

SEQ ID NO: 4944263 - DNA, 16 bp, Homo sapiens
tccgtgtggatccaat

SEQ ID NO: 4944264 - DNA, 17 bp, Homo sapiens
tccgtgtggatccaatg

SEQ ID NO: 4944265 - DNA, 14 bp, Homo sapiens
tcctaaaagcaaaa

SEQ ID NO: 4944266 - DNA, 22 bp, Homo sapiens
tcctaaaagcaaaataaaaact

SEQ ID NO: 4944267 - DNA, 15 bp, Homo sapiens
tcctaagaaatatgt

SEQ ID NO: 4944268 - DNA, 19 bp, Homo sapiens
tcctaagaaatatgtgaga

SEQ ID NO: 4944269 - DNA, 20 bp, Homo sapiens
tcctaagaaatatgtgagat

SEQ ID NO: 4944270 - DNA, 15 bp, Homo sapiens
tcctaagaagcttct

SEQ ID NO: 4944271 - DNA, 16 bp, Homo sapiens
tcctaagaagcttcta

SEQ ID NO: 4944272 - DNA, 16 bp, Homo sapiens
tcctaagacacaaatg

SEQ ID NO: 4944273 - DNA, 16 bp, Homo sapiens
tcctaagagtgctggg

SEQ ID NO: 4944274 - DNA, 17 bp, Homo sapiens
tcctaagagtgctgggc

SEQ ID NO: 4944275 - DNA, 16 bp, Homo sapiens
tcctaagcatctaagt

SEQ ID NO: 4944276 - DNA, 13 bp, Homo sapiens
tcctaaggaacct

SEQ ID NO: 4944277 - DNA, 16 bp, Homo sapiens
tcctaagggtcgaaag

SEQ ID NO: 4944278 - DNA, 20 bp, Homo sapiens
tcctaagggtcgaaagctct

SEQ ID NO: 4944279 - DNA, 23 bp, Homo sapiens
tcctaagggtcgaaagctctaga

SEQ ID NO: 4944280 - DNA, 18 bp, Homo sapiens
tcctaatttcccttcttg

SEQ ID NO: 4944281 - DNA, 17 bp, Homo sapiens
tcctacaagatttagaa

SEQ ID NO: 4944282 - DNA, 19 bp, Homo sapiens
tcctacaagatttagaaaa

SEQ ID NO: 4944283 - DNA, 15 bp, Homo sapiens
tcctacagcactact

SEQ ID NO: 4944284 - DNA, 14 bp, Homo sapiens
tcctacctgccctg

SEQ ID NO: 4944285 - DNA, 15 bp, Homo sapiens
tcctacctgccctgg

SEQ ID NO: 4944286 - DNA, 18 bp, Homo sapiens
tcctacctgccctggaac

SEQ ID NO: 4944287 - DNA, 12 bp, Homo sapiens
tcctactcctga

SEQ ID NO: 4944288 - DNA, 13 bp, Homo sapiens
tcctactcctgac

SEQ ID NO: 4944289 - DNA, 23 bp, Homo sapiens
tcctagagaacgcagccctagag

SEQ ID NO: 4944290 - DNA, 13 bp, Homo sapiens
tcctagccactca

SEQ ID NO: 4944291 - DNA, 14 bp, Homo sapiens
tcctagcctgtttc

SEQ ID NO: 4944292 - DNA, 15 bp, Homo sapiens
tcctagcctgtttct

SEQ ID NO: 4944293 - DNA, 19 bp, Homo sapiens
tcctagcctgtttcttcct

SEQ ID NO: 4944294 - DNA, 12 bp, Homo sapiens
tcctatgtgtga

SEQ ID NO: 4944295 - DNA, 18 bp, Homo sapiens
tcctatttgccatgggct

SEQ ID NO: 4944296 - DNA, 19 bp, Homo sapiens
tcctcacagtcccactgtg

SEQ ID NO: 4944297 - DNA, 15 bp, Homo sapiens
tcctcacccctgtcc

SEQ ID NO: 4944298 - DNA, 19 bp, Homo sapiens
tcctcacccctgtcctcac

SEQ ID NO: 4944299 - DNA, 20 bp, Homo sapiens
tcctcacccctgtcctcact

SEQ ID NO: 4944300 - DNA, 22 bp, Homo sapiens
tcctcaccctgatttcttgctt

SEQ ID NO: 4944301 - DNA, 12 bp, Homo sapiens
tcctcacctctg

SEQ ID NO: 4944302 - DNA, 21 bp, Homo sapiens
tcctcacctctggactggcta

SEQ ID NO: 4944303 - DNA, 15 bp, Homo sapiens
tcctcactgcccgca

SEQ ID NO: 4944304 - DNA, 15 bp, Homo sapiens
tcctcactgctccct

SEQ ID NO: 4944305 - DNA, 20 bp, Homo sapiens
tcctcactgctccctgaagc

SEQ ID NO: 4944306 - DNA, 20 bp, Homo sapiens
tcctcagagaatttctacca

SEQ ID NO: 4944307 - DNA, 12 bp, Homo sapiens
tcctcagggcag

SEQ ID NO: 4944308 - DNA, 17 bp, Homo sapiens
tcctcagggcagcctcc

SEQ ID NO: 4944309 - DNA, 16 bp, Homo sapiens
tcctcagtccatttat

SEQ ID NO: 4944310 - DNA, 18 bp, Homo sapiens
tcctcagtccatttatat

SEQ ID NO: 4944311 - DNA, 21 bp, Homo sapiens
tcctcagtccatttatatatg

SEQ ID NO: 4944312 - DNA, 17 bp, Homo sapiens
tcctcatccaccccatc

SEQ ID NO: 4944313 - DNA, 14 bp, Homo sapiens
tcctccagaagcct

SEQ ID NO: 4944314 - DNA, 14 bp, Homo sapiens
tcctccagctgcac

SEQ ID NO: 4944315 - DNA, 12 bp, Homo sapiens
tcctcccacctc

SEQ ID NO: 4944316 - DNA, 18 bp, Homo sapiens
tcctcccacctcagcctc

SEQ ID NO: 4944317 - DNA, 13 bp, Homo sapiens
tcctcccaggcgc

SEQ ID NO: 4944318 - DNA, 15 bp, Homo sapiens
tcctcccatcccctg

SEQ ID NO: 4944319 - DNA, 18 bp, Homo sapiens
tcctcccatcccctggac

SEQ ID NO: 4944320 - DNA, 23 bp, Homo sapiens
tcctcccatcccctggactggga

SEQ ID NO: 4944321 - DNA, 16 bp, Homo sapiens
tcctcccctcacagcc

SEQ ID NO: 4944322 - DNA, 21 bp, Homo sapiens
tcctcccctcacagcctctga

SEQ ID NO: 4944323 - DNA, 17 bp, Homo sapiens
tcctccggttgcatact

SEQ ID NO: 4944324 - DNA, 20 bp, Homo sapiens
tcctccggttgcatactgga

SEQ ID NO: 4944325 - DNA, 23 bp, Homo sapiens
tcctcctcggaaccgctcaccta

SEQ ID NO: 4944326 - DNA, 17 bp, Homo sapiens
tcctcctctttctctcc

SEQ ID NO: 4944327 - DNA, 19 bp, Homo sapiens
tcctcctctttctctcccc

SEQ ID NO: 4944328 - DNA, 22 bp, Homo sapiens
tcctcctggaaccttgctgtcc

SEQ ID NO: 4944329 - DNA, 17 bp, Homo sapiens
tcctccttggtgcctgg

SEQ ID NO: 4944330 - DNA, 13 bp, Homo sapiens
tcctcctttctcc

SEQ ID NO: 4944331 - DNA, 15 bp, Homo sapiens
tccttttataggtga

SEQ ID NO: 4944332 - DNA, 10 bp, Homo sapiens
tccttttctt

SEQ ID NO: 4944333 - DNA, 16 bp, Homo sapiens
tccttttcttttgtta

SEQ ID NO: 4944334 - DNA, 17 bp, Homo sapiens
tccttttcttttgttac

SEQ ID NO: 4944335 - DNA, 12 bp, Homo sapiens
tcctttttatga

SEQ ID NO: 4944336 - DNA, 14 bp, Homo sapiens
tcctttttctgatt

SEQ ID NO: 4944337 - DNA, 22 bp, Homo sapiens
tcctttttctgattagctttgt

SEQ ID NO: 4944338 - DNA, 21 bp, Homo sapiens
tcctttttttccatctttaca

SEQ ID NO: 4944339 - DNA, 19 bp, Homo sapiens
tcgaaacctgggattcagg

SEQ ID NO: 4944340 - DNA, 19 bp, Homo sapiens
tcgaaagctctagaatctg

SEQ ID NO: 4944341 - DNA, 14 bp, Homo sapiens
tcgaactggctgca

SEQ ID NO: 4944342 - DNA, 15 bp, Homo sapiens
tcgaactggctgcaa

SEQ ID NO: 4944343 - DNA, 14 bp, Homo sapiens
tcgaacttcacaac

SEQ ID NO: 4944344 - DNA, 15 bp, Homo sapiens
tcgaatgaaaagaca

SEQ ID NO: 4944345 - DNA, 15 bp, Homo sapiens
tcgaattaatagctt

SEQ ID NO: 4944346 - DNA, 21 bp, Homo sapiens
tcgaattaatagcttttattg

SEQ ID NO: 4944347 - DNA, 19 bp, Homo sapiens
tcgacactcaccatgaagc

SEQ ID NO: 4944348 - DNA, 19 bp, Homo sapiens
tcgaccccaaagccccttg

SEQ ID NO: 4944349 - DNA, 21 bp, Homo sapiens
tcgatacccaggaccaagcca

SEQ ID NO: 4944350 - DNA, 22 bp, Homo sapiens
tcgatgttttattatttctatt

SEQ ID NO: 4944351 - DNA, 12 bp, Homo sapiens
tcgcacctacca

SEQ ID NO: 4944352 - DNA, 20 bp, Homo sapiens
tcgcatggtcacacactgat

SEQ ID NO: 4944353 - DNA, 11 bp, Homo sapiens
tcgcccaggag

SEQ ID NO: 4944354 - DNA, 12 bp, Homo sapiens
tcgcccaggaga

SEQ ID NO: 4944355 - DNA, 19 bp, Homo sapiens
tcgcccagtctggaatgca

SEQ ID NO: 4944356 - DNA, 20 bp, Homo sapiens
tcgcctgtggagctcagccc

SEQ ID NO: 4944357 - DNA, 21 bp, Homo sapiens
tcgcctgtggagctcagcccc

SEQ ID NO: 4944358 - DNA, 16 bp, Homo sapiens
tcgcgtgccctcgctg

SEQ ID NO: 4944359 - DNA, 18 bp, Homo sapiens
tcgctcaatcaagaaaat

SEQ ID NO: 4944360 - DNA, 21 bp, Homo sapiens
tcgctcccacattctgatgag

SEQ ID NO: 4944361 - DNA, 16 bp, Homo sapiens
tcgctgtcacaggcgg

SEQ ID NO: 4944362 - DNA, 15 bp, Homo sapiens
tcgcttcccccatag

SEQ ID NO: 4944363 - DNA, 19 bp, Homo sapiens
tcgcttcccccatagccac

SEQ ID NO: 4944364 - DNA, 22 bp, Homo sapiens
tcgcttctgtgtatctctttca

SEQ ID NO: 4944365 - DNA, 16 bp, Homo sapiens
tcgcttgtaaatacca

SEQ ID NO: 4944366 - DNA, 17 bp, Homo sapiens
tcgcttgtaaataccag

SEQ ID NO: 4944367 - DNA, 19 bp, Homo sapiens
tcggaaccgctcacctaga

SEQ ID NO: 4944368 - DNA, 22 bp, Homo sapiens
tcggaaccgctcacctagagcc

SEQ ID NO: 4944369 - DNA, 23 bp, Homo sapiens
tcggaccgcttgtggggacccag

SEQ ID NO: 4944370 - DNA, 23 bp, Homo sapiens
tcggagcatcccggaggaaatct

SEQ ID NO: 4944371 - DNA, 18 bp, Homo sapiens
ggagcagcctggagaccc

SEQ ID NO: 4944372 - DNA, 16 bp, Homo sapiens
ggagcagggaaggcct

SEQ ID NO: 4944373 - DNA, 13 bp, Homo sapiens
ggagcatcccgga

SEQ ID NO: 4944374 - DNA, 14 bp, Homo sapiens
ggagcatcccggag

SEQ ID NO: 4944375 - DNA, 21 bp, Homo sapiens
ggagccagctccctctattta

SEQ ID NO: 4944376 - DNA, 19 bp, Homo sapiens
ggagcccaggcgggagcgg

SEQ ID NO: 4944377 - DNA, 19 bp, Homo sapiens
ggagcccatactcagcctg

SEQ ID NO: 4944378 - DNA, 21 bp, Homo sapiens
ggagcccatactcagcctgct

SEQ ID NO: 4944379 - DNA, 17 bp, Homo sapiens
ggagccccagctaccct

SEQ ID NO: 4944380 - DNA, 13 bp, Homo sapiens
ggagccccaggcc

SEQ ID NO: 4944381 - DNA, 20 bp, Homo sapiens
ggagccccaggcctctgtgt

SEQ ID NO: 4944382 - DNA, 23 bp, Homo sapiens
ggagccccaggcctctgtgtcct

SEQ ID NO: 4944383 - DNA, 16 bp, Homo sapiens
ggagccccgaggcctt

SEQ ID NO: 4944384 - DNA, 16 bp, Homo sapiens
ggagcccgtctcagtg

SEQ ID NO: 4944385 - DNA, 16 bp, Homo sapiens
ggagcctagaagctgg

SEQ ID NO: 4944386 - DNA, 23 bp, Homo sapiens
ggagcctgagtcagggcccagag

SEQ ID NO: 4944387 - DNA, 18 bp, Homo sapiens
ggagctcctctcctggag

SEQ ID NO: 4944388 - DNA, 19 bp, Homo sapiens
ggagctcctctcctggagg

SEQ ID NO: 4944389 - DNA, 17 bp, Homo sapiens
ggagctcttcaggcctc

SEQ ID NO: 4944390 - DNA, 18 bp, Homo sapiens
ggagctcttcaggcctcc

SEQ ID NO: 4944391 - DNA, 18 bp, Homo sapiens
ggagctgccttggctcag

SEQ ID NO: 4944392 - DNA, 23 bp, Homo sapiens
ggagctgctggcttgcagtgcgc

SEQ ID NO: 4944393 - DNA, 23 bp, Homo sapiens
ggagctggttagaaatgcagaat

SEQ ID NO: 4944394 - DNA, 22 bp, Homo sapiens
ggaggaaaaccaagccgtggct

SEQ ID NO: 4944395 - DNA, 12 bp, Homo sapiens
ggaggaaagcaa

SEQ ID NO: 4944396 - DNA, 15 bp, Homo sapiens
ggaggatgttctggg

SEQ ID NO: 4944397 - DNA, 12 bp, Homo sapiens
ggaggcaagcaa

SEQ ID NO: 4944398 - DNA, 17 bp, Homo sapiens
ggaggcagccagggctt

SEQ ID NO: 4944399 - DNA, 18 bp, Homo sapiens
ggaggccccactgatgct

SEQ ID NO: 4944400 - DNA, 21 bp, Homo sapiens
ggaggccttccagctgctgtc

SEQ ID NO: 4944401 - DNA, 20 bp, Homo sapiens
ggaggcgggggctgcccttg

SEQ ID NO: 4944402 - DNA, 19 bp, Homo sapiens
ggaggctgaggcaggagga

SEQ ID NO: 4944403 - DNA, 10 bp, Homo sapiens
ggaggctgcc

SEQ ID NO: 4944404 - DNA, 17 bp, Homo sapiens
ggaggctgcccccggcc

SEQ ID NO: 4944405 - DNA, 21 bp, Homo sapiens
ggaggctgcccccggccccct

SEQ ID NO: 4944406 - DNA, 19 bp, Homo sapiens
ggagggaaaagggaagtag

SEQ ID NO: 4944407 - DNA, 17 bp, Homo sapiens
ggagggcggcacaggtc

SEQ ID NO: 4944408 - DNA, 14 bp, Homo sapiens
ggaggggcctggca

SEQ ID NO: 4944409 - DNA, 23 bp, Homo sapiens
ggagggggagaaaaggaaaagaa

SEQ ID NO: 4944410 - DNA, 20 bp, Homo sapiens
ggagggtgggggccacctgc

SEQ ID NO: 4944411 - DNA, 22 bp, Homo sapiens
ggaggtcgaccccaaagcccct

SEQ ID NO: 4944412 - DNA, 14 bp, Homo sapiens
ggaggtgaccccag

SEQ ID NO: 4944413 - DNA, 18 bp, Homo sapiens
ggaggtgatagcattgct

SEQ ID NO: 4944414 - DNA, 20 bp, Homo sapiens
ggagtcccaccttggctgca

SEQ ID NO: 4944415 - DNA, 21 bp, Homo sapiens
ggagtgacagaggcagcccca

SEQ ID NO: 4944416 - DNA, 12 bp, Homo sapiens
ggagtgagctgg

SEQ ID NO: 4944417 - DNA, 14 bp, Homo sapiens
ggagtgagctggtt

SEQ ID NO: 4944418 - DNA, 22 bp, Homo sapiens
ggagtgctggctcacagtacag

SEQ ID NO: 4944419 - DNA, 19 bp, Homo sapiens
ggagtgggtgacaagagcc

SEQ ID NO: 4944420 - DNA, 17 bp, Homo sapiens
ggagtgggtggaggcag

SEQ ID NO: 4944421 - DNA, 17 bp, Homo sapiens
tcccccttgccacccca

SEQ ID NO: 4944422 - DNA, 23 bp, Homo sapiens
tcccccttgccaccccaccctcc

SEQ ID NO: 4944423 - DNA, 19 bp, Homo sapiens
tcccccttttttgtccccc

SEQ ID NO: 4944424 - DNA, 17 bp, Homo sapiens
tccccggcaccctctgg

SEQ ID NO: 4944425 - DNA, 19 bp, Homo sapiens
tcccctcacagcctctgac

SEQ ID NO: 4944426 - DNA, 21 bp, Homo sapiens
tcccctcagccacacccaggc

SEQ ID NO: 4944427 - DNA, 12 bp, Homo sapiens
tcccctccactg

SEQ ID NO: 4944428 - DNA, 13 bp, Homo sapiens
tcccctccagcct

SEQ ID NO: 4944429 - DNA, 17 bp, Homo sapiens
tcccctcccctgctgca

SEQ ID NO: 4944430 - DNA, 13 bp, Homo sapiens
tcccctccctggc

SEQ ID NO: 4944431 - DNA, 18 bp, Homo sapiens
tcccctcttcccttcaac

SEQ ID NO: 4944432 - DNA, 15 bp, Homo sapiens
tcccctgccctgctg

SEQ ID NO: 4944433 - DNA, 13 bp, Homo sapiens
tcccctgccctgg

SEQ ID NO: 4944434 - DNA, 15 bp, Homo sapiens
tcccctgctgcaggg

SEQ ID NO: 4944435 - DNA, 21 bp, Homo sapiens
tcccctgctgcaggggctctg

SEQ ID NO: 4944436 - DNA, 15 bp, Homo sapiens
tcccctggactggga

SEQ ID NO: 4944437 - DNA, 17 bp, Homo sapiens
tcccctggactgggagg

SEQ ID NO: 4944438 - DNA, 23 bp, Homo sapiens
tccccttgatttaaacacacaga

SEQ ID NO: 4944439 - DNA, 21 bp, Homo sapiens
tcccgaagaatggagaggaac

SEQ ID NO: 4944440 - DNA, 18 bp, Homo sapiens
tcccgaatagctgggact

SEQ ID NO: 4944441 - DNA, 15 bp, Homo sapiens
tcccgagtagctggg

SEQ ID NO: 4944442 - DNA, 18 bp, Homo sapiens
tcccgagtagctgggact

SEQ ID NO: 4944443 - DNA, 14 bp, Homo sapiens
tcccgagtctggga

SEQ ID NO: 4944444 - DNA, 13 bp, Homo sapiens
tcccgctcagccc

SEQ ID NO: 4944445 - DNA, 15 bp, Homo sapiens
tcccgctcagccctc

SEQ ID NO: 4944446 - DNA, 13 bp, Homo sapiens
tcccgctgctgct

SEQ ID NO: 4944447 - DNA, 19 bp, Homo sapiens
tccctaaaatacatttaaa

SEQ ID NO: 4944448 - DNA, 13 bp, Homo sapiens
tccctaaactgta

SEQ ID NO: 4944449 - DNA, 18 bp, Homo sapiens
tccctaaagaaaaaaaat

SEQ ID NO: 4944450 - DNA, 19 bp, Homo sapiens
tccctaccgagtctcttct

SEQ ID NO: 4944451 - DNA, 13 bp, Homo sapiens
tccctagcagtga

SEQ ID NO: 4944452 - DNA, 16 bp, Homo sapiens
tccctagcagtgaact

SEQ ID NO: 4944453 - DNA, 21 bp, Homo sapiens
tccctagggctggcagaaagg

SEQ ID NO: 4944454 - DNA, 23 bp, Homo sapiens
tccctcattccaccttcccatgc

SEQ ID NO: 4944455 - DNA, 14 bp, Homo sapiens
tccctcccacctct

SEQ ID NO: 4944456 - DNA, 16 bp, Homo sapiens
tccctcccctgccatt

SEQ ID NO: 4944457 - DNA, 15 bp, Homo sapiens
tccctcccctgccct

SEQ ID NO: 4944458 - DNA, 15 bp, Homo sapiens
tccctccccttctct

SEQ ID NO: 4944459 - DNA, 12 bp, Homo sapiens
tccctcctcacc

SEQ ID NO: 4944460 - DNA, 13 bp, Homo sapiens
tccctcctcacct

SEQ ID NO: 4944461 - DNA, 14 bp, Homo sapiens
tccctcctcacctc

SEQ ID NO: 4944462 - DNA, 15 bp, Homo sapiens
tccctcctttagtga

SEQ ID NO: 4944463 - DNA, 17 bp, Homo sapiens
tccctctaatgagactg

SEQ ID NO: 4944464 - DNA, 19 bp, Homo sapiens
tccctctaatgagactgac

SEQ ID NO: 4944465 - DNA, 13 bp, Homo sapiens
tccctctatttat

SEQ ID NO: 4944466 - DNA, 19 bp, Homo sapiens
tccctctatttatgtttgc

SEQ ID NO: 4944467 - DNA, 19 bp, Homo sapiens
tccctctctcttctgctcc

SEQ ID NO: 4944468 - DNA, 20 bp, Homo sapiens
tccctctctcttctgctcca

SEQ ID NO: 4944469 - DNA, 12 bp, Homo sapiens
tccctctgctca

SEQ ID NO: 4944470 - DNA, 18 bp, Homo sapiens
tccctctgtccaccagcc

SEQ ID NO: 4944471 - DNA, 13 bp, Homo sapiens
tccctcttgtttt

SEQ ID NO: 4944472 - DNA, 15 bp, Homo sapiens
tccctcttgttttgt

SEQ ID NO: 4944473 - DNA, 19 bp, Homo sapiens
tccctcttgttttgtttgt

SEQ ID NO: 4944474 - DNA, 21 bp, Homo sapiens
tccctcttgttttgtttgtct

SEQ ID NO: 4944475 - DNA, 18 bp, Homo sapiens
tccctctttggctcccct

SEQ ID NO: 4944476 - DNA, 17 bp, Homo sapiens
tccctgaaaatgttttt

SEQ ID NO: 4944477 - DNA, 17 bp, Homo sapiens
tccctgaagccagcctt

SEQ ID NO: 4944478 - DNA, 19 bp, Homo sapiens
tccctgaagccagccttct

SEQ ID NO: 4944479 - DNA, 19 bp, Homo sapiens
tccctgattgacctgctcc

SEQ ID NO: 4944480 - DNA, 20 bp, Homo sapiens
tccctgcactaaagccagcc

SEQ ID NO: 4944481 - DNA, 14 bp, Homo sapiens
tccctgcacttgca

SEQ ID NO: 4944482 - DNA, 16 bp, Homo sapiens
tccctgcagatgccac

SEQ ID NO: 4944483 - DNA, 23 bp, Homo sapiens
tccctgcagatgccaccctagcc

SEQ ID NO: 4944484 - DNA, 15 bp, Homo sapiens
tccctgccaaactga

SEQ ID NO: 4944485 - DNA, 12 bp, Homo sapiens
tccctgcccagg

SEQ ID NO: 4944486 - DNA, 20 bp, Homo sapiens
tccctgcccctcccttcaac

SEQ ID NO: 4944487 - DNA, 16 bp, Homo sapiens
tccctgcgcctgtgat

SEQ ID NO: 4944488 - DNA, 17 bp, Homo sapiens
tccctgggccagggtct

SEQ ID NO: 4944489 - DNA, 22 bp, Homo sapiens
tccctgtgtccacctgtgggtg

SEQ ID NO: 4944490 - DNA, 14 bp, Homo sapiens
tccctgttcttcct

SEQ ID NO: 4944491 - DNA, 21 bp, Homo sapiens
tccctgttcttcctccagctg

SEQ ID NO: 4944492 - DNA, 18 bp, Homo sapiens
tccctgttggtcggtggg

SEQ ID NO: 4944493 - DNA, 15 bp, Homo sapiens
tccctgtttaatatt

SEQ ID NO: 4944494 - DNA, 22 bp, Homo sapiens
tccctgtttaatatttaaacag

SEQ ID NO: 4944495 - DNA, 10 bp, Homo sapiens
tcccttaccc

SEQ ID NO: 4944496 - DNA, 22 bp, Homo sapiens
tcccttcaaccattccccatgg

SEQ ID NO: 4944497 - DNA, 14 bp, Homo sapiens
tcccttcacctcct

SEQ ID NO: 4944498 - DNA, 14 bp, Homo sapiens
tcccttcagccccc

SEQ ID NO: 4944499 - DNA, 16 bp, Homo sapiens
tcccttcagtaccctc

SEQ ID NO: 4944500 - DNA, 18 bp, Homo sapiens
tcccttcagtaccctctc

SEQ ID NO: 4944501 - DNA, 13 bp, Homo sapiens
tcccttccactgc

SEQ ID NO: 4944502 - DNA, 17 bp, Homo sapiens
tctgatcatccactgtg

SEQ ID NO: 4944503 - DNA, 17 bp, Homo sapiens
tctgattagctttgtgt

SEQ ID NO: 4944504 - DNA, 21 bp, Homo sapiens
tctgattcccaagctctgctc

SEQ ID NO: 4944505 - DNA, 21 bp, Homo sapiens
tctgattggcttgtagaattg

SEQ ID NO: 4944506 - DNA, 22 bp, Homo sapiens
tctgcaaacaaacaccttctta

SEQ ID NO: 4944507 - DNA, 18 bp, Homo sapiens
tctgcaaagaatgagaag

SEQ ID NO: 4944508 - DNA, 16 bp, Homo sapiens
tctgcaatgggcactg

SEQ ID NO: 4944509 - DNA, 19 bp, Homo sapiens
tctgcaatgggcactggga

SEQ ID NO: 4944510 - DNA, 16 bp, Homo sapiens
tctgcaattcccctct

SEQ ID NO: 4944511 - DNA, 20 bp, Homo sapiens
tctgcacatgtcttgtacat

SEQ ID NO: 4944512 - DNA, 22 bp, Homo sapiens
tctgcacatgtcttgtacatgt

SEQ ID NO: 4944513 - DNA, 13 bp, Homo sapiens
tctgcacccctct

SEQ ID NO: 4944514 - DNA, 21 bp, Homo sapiens
tctgcacccctctgccctcat

SEQ ID NO: 4944515 - DNA, 21 bp, Homo sapiens
tctgcacccttcttttctcat

SEQ ID NO: 4944516 - DNA, 21 bp, Homo sapiens
tctgcacctatgtagctctgc

SEQ ID NO: 4944517 - DNA, 19 bp, Homo sapiens
tctgcagacacgccttccc

SEQ ID NO: 4944518 - DNA, 23 bp, Homo sapiens
tctgcagactgctagtgttctgt

SEQ ID NO: 4944519 - DNA, 12 bp, Homo sapiens
tctgcagagcag

SEQ ID NO: 4944520 - DNA, 15 bp, Homo sapiens
tctgcagtaaatctt

SEQ ID NO: 4944521 - DNA, 15 bp, Homo sapiens
tctgcatatgttgaa

SEQ ID NO: 4944522 - DNA, 16 bp, Homo sapiens
tctgcatatgttgaat

SEQ ID NO: 4944523 - DNA, 18 bp, Homo sapiens
tctgcatatgttgaatac

SEQ ID NO: 4944524 - DNA, 14 bp, Homo sapiens
tctgcatcccagca

SEQ ID NO: 4944525 - DNA, 21 bp, Homo sapiens
tctgcatcccagcacctgcct

SEQ ID NO: 4944526 - DNA, 22 bp, Homo sapiens
tctgcatcccagcacctgcctc

SEQ ID NO: 4944527 - DNA, 17 bp, Homo sapiens
tctgcatctcctgtctt

SEQ ID NO: 4944528 - DNA, 18 bp, Homo sapiens
tctgcattgctagataaa

SEQ ID NO: 4944529 - DNA, 21 bp, Homo sapiens
tctgcattgctagataaaagc

SEQ ID NO: 4944530 - DNA, 21 bp, Homo sapiens
tctgccagaagatcccctcag

SEQ ID NO: 4944531 - DNA, 22 bp, Homo sapiens
tctgccagaagatcccctcagg

SEQ ID NO: 4944532 - DNA, 23 bp, Homo sapiens
tctgccagaagatcccctcagga

SEQ ID NO: 4944533 - DNA, 16 bp, Homo sapiens
tctgccagggcagtgc

SEQ ID NO: 4944534 - DNA, 22 bp, Homo sapiens
tctgcccacctcagcctcccaa

SEQ ID NO: 4944535 - DNA, 11 bp, Homo sapiens
tctgccccagt

SEQ ID NO: 4944536 - DNA, 14 bp, Homo sapiens
tctgcccccagccc

SEQ ID NO: 4944537 - DNA, 18 bp, Homo sapiens
tctgcccccagcccaaag

SEQ ID NO: 4944538 - DNA, 15 bp, Homo sapiens
tctgcccctccccca

SEQ ID NO: 4944539 - DNA, 22 bp, Homo sapiens
tctgcctctgacacacagctct

SEQ ID NO: 4944540 - DNA, 23 bp, Homo sapiens
tctgcctctgacacacagctctg

SEQ ID NO: 4944541 - DNA, 15 bp, Homo sapiens
tctgcctgcccaggc

SEQ ID NO: 4944542 - DNA, 16 bp, Homo sapiens
tctgcctgcccaggcc

SEQ ID NO: 4944543 - DNA, 14 bp, Homo sapiens
tctgcctttgacat

SEQ ID NO: 4944544 - DNA, 11 bp, Homo sapiens
tctgccttttc

SEQ ID NO: 4944545 - DNA, 13 bp, Homo sapiens
tctgcgcctcagg

SEQ ID NO: 4944546 - DNA, 17 bp, Homo sapiens
tctgcggaccccagctg

SEQ ID NO: 4944547 - DNA, 17 bp, Homo sapiens
tctgcggatctcagctt

SEQ ID NO: 4944548 - DNA, 19 bp, Homo sapiens
tctgcggatctcagctttg

SEQ ID NO: 4944549 - DNA, 17 bp, Homo sapiens
tctcctggaggattgca

SEQ ID NO: 4944550 - DNA, 11 bp, Homo sapiens
tctccttcctt

SEQ ID NO: 4944551 - DNA, 22 bp, Homo sapiens
tctccttttacttcacttcaaa

SEQ ID NO: 4944552 - DNA, 19 bp, Homo sapiens
tctccttttcctctctccc

SEQ ID NO: 4944553 - DNA, 17 bp, Homo sapiens
tctccttttcttttgtt

SEQ ID NO: 4944554 - DNA, 20 bp, Homo sapiens
tctccttttcttttgttact

SEQ ID NO: 4944555 - DNA, 19 bp, Homo sapiens
tctcggactaagcctacct

SEQ ID NO: 4944556 - DNA, 14 bp, Homo sapiens
tctcgggagaggat

SEQ ID NO: 4944557 - DNA, 13 bp, Homo sapiens
tctctaaagcact

SEQ ID NO: 4944558 - DNA, 11 bp, Homo sapiens
tctctaatatg

SEQ ID NO: 4944559 - DNA, 15 bp, Homo sapiens
tctctaatcgaaaga

SEQ ID NO: 4944560 - DNA, 15 bp, Homo sapiens
tctctcaaattgtca

SEQ ID NO: 4944561 - DNA, 16 bp, Homo sapiens
tctctcaatatgctta

SEQ ID NO: 4944562 - DNA, 16 bp, Homo sapiens
tctctccagatgtttc

SEQ ID NO: 4944563 - DNA, 18 bp, Homo sapiens
tctctccctctccctgtc

SEQ ID NO: 4944564 - DNA, 11 bp, Homo sapiens
tctctccctgc

SEQ ID NO: 4944565 - DNA, 22 bp, Homo sapiens
tctctccctgccagaggggaag

SEQ ID NO: 4944566 - DNA, 20 bp, Homo sapiens
tctctcctgtaagccaaaga

SEQ ID NO: 4944567 - DNA, 10 bp, Homo sapiens
tctctccttt

SEQ ID NO: 4944568 - DNA, 20 bp, Homo sapiens
tctctcggctccccatgtgt

SEQ ID NO: 4944569 - DNA, 23 bp, Homo sapiens
tctctcggctccccatgtgtcct

SEQ ID NO: 4944570 - DNA, 13 bp, Homo sapiens
tctctctctacaa

SEQ ID NO: 4944571 - DNA, 14 bp, Homo sapiens
tctctctctacaaa

SEQ ID NO: 4944572 - DNA, 12 bp, Homo sapiens
tctctctgcagc

SEQ ID NO: 4944573 - DNA, 17 bp, Homo sapiens
tctctctgtgctgtgga

SEQ ID NO: 4944574 - DNA, 21 bp, Homo sapiens
tctctctgtgctgtggaagca

SEQ ID NO: 4944575 - DNA, 14 bp, Homo sapiens
tctctcttaaagtt

SEQ ID NO: 4944576 - DNA, 16 bp, Homo sapiens
tctctcttcagactct

SEQ ID NO: 4944577 - DNA, 18 bp, Homo sapiens
tctctcttcagactctca

SEQ ID NO: 4944578 - DNA, 16 bp, Homo sapiens
tctctcttctgctcca

SEQ ID NO: 4944579 - DNA, 19 bp, Homo sapiens
tctctcttctgctccaccc

SEQ ID NO: 4944580 - DNA, 16 bp, Homo sapiens
tctctgaacacaggca

SEQ ID NO: 4944581 - DNA, 17 bp, Homo sapiens
tctctgaacacaggcag

SEQ ID NO: 4944582 - DNA, 19 bp, Homo sapiens
tctctgaagcatgtttcat

SEQ ID NO: 4944583 - DNA, 21 bp, Homo sapiens
tctctgaagcatgtttcatgt

SEQ ID NO: 4944584 - DNA, 22 bp, Homo sapiens
tctctgaagcatgtttcatgtt

SEQ ID NO: 4944585 - DNA, 11 bp, Homo sapiens
tctctgcaccc

SEQ ID NO: 4944586 - DNA, 21 bp, Homo sapiens
tctctgcctttgacatttaat

SEQ ID NO: 4944587 - DNA, 15 bp, Homo sapiens
tctctgctccaccac

SEQ ID NO: 4944588 - DNA, 20 bp, Homo sapiens
tctctggtccggacactcct

SEQ ID NO: 4944589 - DNA, 21 bp, Homo sapiens
tctctgtataaacattaaatg

SEQ ID NO: 4944590 - DNA, 19 bp, Homo sapiens
tctctgtgcttcaattaat

SEQ ID NO: 4944591 - DNA, 16 bp, Homo sapiens
tctctgtgtctaagat

SEQ ID NO: 4944592 - DNA, 17 bp, Homo sapiens
tctctgtgtctaagatt

SEQ ID NO: 4944593 - DNA, 10 bp, Homo sapiens
tctctgtgtt

SEQ ID NO: 4944594 - DNA, 13 bp, Homo sapiens
tctcttaaagttg

SEQ ID NO: 4944595 - DNA, 22 bp, Homo sapiens
tctcttcagactctcagcccag

SEQ ID NO: 4944596 - DNA, 17 bp, Homo sapiens
tctcttccctgcgcctg

SEQ ID NO: 4944597 - DNA, 11 bp, Homo sapiens
tctcttcctgc

SEQ ID NO: 4944598 - DNA, 14 bp, Homo sapiens
tctcttcctgcccc

SEQ ID NO: 4944599 - DNA, 22 bp, Homo sapiens
tctcttcctgcccctctttctc

SEQ ID NO: 4944600 - DNA, 11 bp, Homo sapiens
tctcttctcca

SEQ ID NO: 4944601 - DNA, 15 bp, Homo sapiens
tctcttctccactgg

SEQ ID NO: 4944602 - DNA, 16 bp, Homo sapiens
tctcttctcccagaat

SEQ ID NO: 4944603 - DNA, 14 bp, Homo sapiens
tctcttctgctcca

SEQ ID NO: 4944604 - DNA, 16 bp, Homo sapiens
tctcttctgctccacc

SEQ ID NO: 4944605 - DNA, 19 bp, Homo sapiens
tctcttctgctccaccctt

SEQ ID NO: 4944606 - DNA, 16 bp, Homo sapiens
tctcttcttttggctt

SEQ ID NO: 4944607 - DNA, 17 bp, Homo sapiens
tctcttgagctggcctc

SEQ ID NO: 4944608 - DNA, 18 bp, Homo sapiens
tctcttgaggccaggagt

SEQ ID NO: 4944609 - DNA, 21 bp, Homo sapiens
tctctttaagggcatgccttg

SEQ ID NO: 4944610 - DNA, 22 bp, Homo sapiens
tctctttcacattgtttgctgc

SEQ ID NO: 4944611 - DNA, 16 bp, Homo sapiens
tctctttgtggggctt

SEQ ID NO: 4944612 - DNA, 21 bp, Homo sapiens
tctctttgtggggcttggcgt

SEQ ID NO: 4944613 - DNA, 19 bp, Homo sapiens
tctcttttatctgtttaaa

SEQ ID NO: 4944614 - DNA, 16 bp, Homo sapiens
tctcttttcaaaacat

SEQ ID NO: 4944615 - DNA, 14 bp, Homo sapiens
tctcttttctagtt

SEQ ID NO: 4944616 - DNA, 23 bp, Homo sapiens
tctgaaaaattcctttgtgtttc

SEQ ID NO: 4944617 - DNA, 14 bp, Homo sapiens
tctgaaaactggaa

SEQ ID NO: 4944618 - DNA, 22 bp, Homo sapiens
tctgaaaatgttgttatgctat

SEQ ID NO: 4944619 - DNA, 18 bp, Homo sapiens
tctgaaacacactgaaag

SEQ ID NO: 4944620 - DNA, 20 bp, Homo sapiens
tctgaaacacactgaaagct

SEQ ID NO: 4944621 - DNA, 23 bp, Homo sapiens
tctgaaagcacaggagacactgt

SEQ ID NO: 4944622 - DNA, 17 bp, Homo sapiens
tctgaaataggaaacaa

SEQ ID NO: 4944623 - DNA, 15 bp, Homo sapiens
tctgaacacaggcag

SEQ ID NO: 4944624 - DNA, 18 bp, Homo sapiens
tctgaacacaggcagctt

SEQ ID NO: 4944625 - DNA, 13 bp, Homo sapiens
tctgaagcatgtt

SEQ ID NO: 4944626 - DNA, 20 bp, Homo sapiens
tctgaagcatgtttcatgtt

SEQ ID NO: 4944627 - DNA, 20 bp, Homo sapiens
tctgaagcttcactcactgt

SEQ ID NO: 4944628 - DNA, 14 bp, Homo sapiens
tctgaagcttgact

SEQ ID NO: 4944629 - DNA, 16 bp, Homo sapiens
tctgaagcttgactcc

SEQ ID NO: 4944630 - DNA, 17 bp, Homo sapiens
tctgaagcttgactccc

SEQ ID NO: 4944631 - DNA, 18 bp, Homo sapiens
tctgaagcttgactccca

SEQ ID NO: 4944632 - DNA, 15 bp, Homo sapiens
tctgaagtcactgca

SEQ ID NO: 4944633 - DNA, 18 bp, Homo sapiens
tctgaagtcactgcacag

SEQ ID NO: 4944634 - DNA, 22 bp, Homo sapiens
tctgaatcgagtgagacaaaat

SEQ ID NO: 4944635 - DNA, 12 bp, Homo sapiens
tctgacaagggc

SEQ ID NO: 4944636 - DNA, 20 bp, Homo sapiens
tctgacaagggctgacctgc

SEQ ID NO: 4944637 - DNA, 12 bp, Homo sapiens
tctgacacacag

SEQ ID NO: 4944638 - DNA, 14 bp, Homo sapiens
tctgacacacagct

SEQ ID NO: 4944639 - DNA, 16 bp, Homo sapiens
tctgacacacagctct

SEQ ID NO: 4944640 - DNA, 23 bp, Homo sapiens
tctgacattatgtggttttagat

SEQ ID NO: 4944641 - DNA, 15 bp, Homo sapiens
tctgacccactgctt

SEQ ID NO: 4944642 - DNA, 14 bp, Homo sapiens
tctgacccagtgag

SEQ ID NO: 4944643 - DNA, 21 bp, Homo sapiens
tctgacccagtgagattacag

SEQ ID NO: 4944644 - DNA, 16 bp, Homo sapiens
tctgacccctcctcac

SEQ ID NO: 4944645 - DNA, 21 bp, Homo sapiens
tctgaccctagctctttcctt

SEQ ID NO: 4944646 - DNA, 15 bp, Homo sapiens
tctgacggccctgca

SEQ ID NO: 4944647 - DNA, 16 bp, Homo sapiens
tctgacggccctgcaa

SEQ ID NO: 4944648 - DNA, 17 bp, Homo sapiens
tctgacggccctgcaat

SEQ ID NO: 4944649 - DNA, 9 bp, Homo sapiens
tctgagaaa

SEQ ID NO: 4944650 - DNA, 12 bp, Homo sapiens
tctgagaaaaca

SEQ ID NO: 4944651 - DNA, 18 bp, Homo sapiens
tctgagaggacttttctt

SEQ ID NO: 4944652 - DNA, 17 bp, Homo sapiens
tctgagagtctagattc

SEQ ID NO: 4944653 - DNA, 16 bp, Homo sapiens
tctgagcgggaggcag

SEQ ID NO: 4944654 - DNA, 17 bp, Homo sapiens
tctgagcgggaggcaga

SEQ ID NO: 4944655 - DNA, 23 bp, Homo sapiens
tctgaggaatccagacccggctg

SEQ ID NO: 4944656 - DNA, 16 bp, Homo sapiens
tctgagggaaagtgca

SEQ ID NO: 4944657 - DNA, 12 bp, Homo sapiens
tctgagttatgt

SEQ ID NO: 4944658 - DNA, 20 bp, Homo sapiens
tctgagtttcattctcctgc

SEQ ID NO: 4944659 - DNA, 23 bp, Homo sapiens
tctgataggaatgtgaaagcacg

SEQ ID NO: 4944660 - DNA, 20 bp, Homo sapiens
tctgatatctatagtagaca

SEQ ID NO: 4944661 - DNA, 18 bp, Homo sapiens
tctgtagtcatttactaa

SEQ ID NO: 4944662 - DNA, 22 bp, Homo sapiens
tctgtataaacattaaatgtct

SEQ ID NO: 4944663 - DNA, 16 bp, Homo sapiens
tctgtatatatatata

SEQ ID NO: 4944664 - DNA, 15 bp, Homo sapiens
tctgtcaaaacactg

SEQ ID NO: 4944665 - DNA, 16 bp, Homo sapiens
tctgtcaaaacactgt

SEQ ID NO: 4944666 - DNA, 17 bp, Homo sapiens
tctgtcaaaacactgtg

SEQ ID NO: 4944667 - DNA, 14 bp, Homo sapiens
tctgtcaatgaaaa

SEQ ID NO: 4944668 - DNA, 19 bp, Homo sapiens
tctgtcaccaattggttaa

SEQ ID NO: 4944669 - DNA, 22 bp, Homo sapiens
tctgtcagatgagaacaaagct

SEQ ID NO: 4944670 - DNA, 14 bp, Homo sapiens
tctgtccaccagcc

SEQ ID NO: 4944671 - DNA, 19 bp, Homo sapiens
tctgtccatttatccacag

SEQ ID NO: 4944672 - DNA, 23 bp, Homo sapiens
tctgtccctgagagtgtctctga

SEQ ID NO: 4944673 - DNA, 15 bp, Homo sapiens
tctgtcctactctgt

SEQ ID NO: 4944674 - DNA, 19 bp, Homo sapiens
tctgtcctactctgtgtca

SEQ ID NO: 4944675 - DNA, 12 bp, Homo sapiens
tctgtcctggga

SEQ ID NO: 4944676 - DNA, 13 bp, Homo sapiens
tctgtcctgtgac

SEQ ID NO: 4944677 - DNA, 15 bp, Homo sapiens
tctgtctcagacttt

SEQ ID NO: 4944678 - DNA, 18 bp, Homo sapiens
tctgtctcatcctcctgg

SEQ ID NO: 4944679 - DNA, 12 bp, Homo sapiens
tctgtcttcaca

SEQ ID NO: 4944680 - DNA, 22 bp, Homo sapiens
tctgtgaaacctgtgaagctga

SEQ ID NO: 4944681 - DNA, 20 bp, Homo sapiens
tctgtgaagtagttctgttt

SEQ ID NO: 4944682 - DNA, 23 bp, Homo sapiens
tctgtgacctcaggcactagcct

SEQ ID NO: 4944683 - DNA, 15 bp, Homo sapiens
tctgtgatcttttaa

SEQ ID NO: 4944684 - DNA, 22 bp, Homo sapiens
tctgtgggtccgataatatctt

SEQ ID NO: 4944685 - DNA, 18 bp, Homo sapiens
tctgtgtatattatttgg

SEQ ID NO: 4944686 - DNA, 19 bp, Homo sapiens
tctgtgtatattatttggc

SEQ ID NO: 4944687 - DNA, 17 bp, Homo sapiens
tctgtgtccttccctgc

SEQ ID NO: 4944688 - DNA, 18 bp, Homo sapiens
tctgtgtccttccctgca

SEQ ID NO: 4944689 - DNA, 14 bp, Homo sapiens
tctgtgtctaagat

SEQ ID NO: 4944690 - DNA, 20 bp, Homo sapiens
tctgtgtctaagattctaga

SEQ ID NO: 4944691 - DNA, 22 bp, Homo sapiens
tctgtgtctaagattctagatc

SEQ ID NO: 4944692 - DNA, 21 bp, Homo sapiens
tctgtgtctttcacagctcct

SEQ ID NO: 4944693 - DNA, 14 bp, Homo sapiens
tctgtgtgaatgtg

SEQ ID NO: 4944694 - DNA, 21 bp, Homo sapiens
tctgtgttgcattattcattt

SEQ ID NO: 4944695 - DNA, 17 bp, Homo sapiens
tctgtgtttaatttctt

SEQ ID NO: 4944696 - DNA, 19 bp, Homo sapiens
tctgtgtttaatttcttca

SEQ ID NO: 4944697 - DNA, 22 bp, Homo sapiens
tctgttatgtactgtactaatt

SEQ ID NO: 4944698 - DNA, 18 bp, Homo sapiens
tctgttatttagactcat

SEQ ID NO: 4944699 - DNA, 22 bp, Homo sapiens
tctgttcacttttcctccctca

SEQ ID NO: 4944700 - DNA, 16 bp, Homo sapiens
tctgttctgtttcaag

SEQ ID NO: 4944701 - DNA, 19 bp, Homo sapiens
tctgttgcaattaggattt

SEQ ID NO: 4944702 - DNA, 12 bp, Homo sapiens
tctgttggccag

SEQ ID NO: 4944703 - DNA, 15 bp, Homo sapiens
tctgttgtaacttat

SEQ ID NO: 4944704 - DNA, 22 bp, Homo sapiens
tcttgcatccttcctataactt

SEQ ID NO: 4944705 - DNA, 16 bp, Homo sapiens
tcttgccactgcctct

SEQ ID NO: 4944706 - DNA, 19 bp, Homo sapiens
tcttgccgaggagccaggc

SEQ ID NO: 4944707 - DNA, 17 bp, Homo sapiens
tcttgcgaatccaagct

SEQ ID NO: 4944708 - DNA, 14 bp, Homo sapiens
tcttgctcccttca

SEQ ID NO: 4944709 - DNA, 17 bp, Homo sapiens
tcttgctcccttcagcc

SEQ ID NO: 4944710 - DNA, 17 bp, Homo sapiens
tcttgctctatctctca

SEQ ID NO: 4944711 - DNA, 13 bp, Homo sapiens
tcttgctctgctg

SEQ ID NO: 4944712 - DNA, 23 bp, Homo sapiens
tcttgctctgctgacagacacag

SEQ ID NO: 4944713 - DNA, 14 bp, Homo sapiens
tcttgctgctagaa

SEQ ID NO: 4944714 - DNA, 18 bp, Homo sapiens
tcttgctgctagaacttt

SEQ ID NO: 4944715 - DNA, 17 bp, Homo sapiens
tcttggacactgtacaa

SEQ ID NO: 4944716 - DNA, 21 bp, Homo sapiens
tcttggcaaaagccttgtgta

SEQ ID NO: 4944717 - DNA, 14 bp, Homo sapiens
tcttggtattctta

SEQ ID NO: 4944718 - DNA, 22 bp, Homo sapiens
tcttggtttctctctacagtgc

SEQ ID NO: 4944719 - DNA, 17 bp, Homo sapiens
tcttgtaatattttgta

SEQ ID NO: 4944720 - DNA, 14 bp, Homo sapiens
tcttgtaatttcca

SEQ ID NO: 4944721 - DNA, 17 bp, Homo sapiens
tcttgtacatgtgtagc

SEQ ID NO: 4944722 - DNA, 24 bp, Homo sapiens
tcttgtacatgtgtagcctgtgca

SEQ ID NO: 4944723 - DNA, 13 bp, Homo sapiens
tcttgtcagacat

SEQ ID NO: 4944724 - DNA, 14 bp, Homo sapiens
tcttgtgctagaat

SEQ ID NO: 4944725 - DNA, 23 bp, Homo sapiens
tcttgtgctggatggagcccagg

SEQ ID NO: 4944726 - DNA, 18 bp, Homo sapiens
tcttgtgcttttcctgat

SEQ ID NO: 4944727 - DNA, 13 bp, Homo sapiens
tctttaaaacaaa

SEQ ID NO: 4944728 - DNA, 16 bp, Homo sapiens
tctttaaaacaaaaca

SEQ ID NO: 4944729 - DNA, 15 bp, Homo sapiens
tctttaaaagagaga

SEQ ID NO: 4944730 - DNA, 16 bp, Homo sapiens
tctttaaaagagagag

SEQ ID NO: 4944731 - DNA, 23 bp, Homo sapiens
tctttaaaagagagagagagaaa

SEQ ID NO: 4944732 - DNA, 21 bp, Homo sapiens
tctttaaaatttaagtatctt

SEQ ID NO: 4944733 - DNA, 23 bp, Homo sapiens
tctttaaacagtatttcattgcc

SEQ ID NO: 4944734 - DNA, 21 bp, Homo sapiens
tctttaaaggcccagccccta

SEQ ID NO: 4944735 - DNA, 22 bp, Homo sapiens
tctttaaaggcccagcccctag

SEQ ID NO: 4944736 - DNA, 23 bp, Homo sapiens
tctttaaaggcccagcccctaga

SEQ ID NO: 4944737 - DNA, 14 bp, Homo sapiens
tctttaaatagata

SEQ ID NO: 4944738 - DNA, 11 bp, Homo sapiens
tctttaaatgt

SEQ ID NO: 4944739 - DNA, 16 bp, Homo sapiens
tctttaaatgttttat

SEQ ID NO: 4944740 - DNA, 19 bp, Homo sapiens
tctttaaatgttttataag

SEQ ID NO: 4944741 - DNA, 15 bp, Homo sapiens
tctttaactcataaa

SEQ ID NO: 4944742 - DNA, 12 bp, Homo sapiens
tctttactttta

SEQ ID NO: 4944743 - DNA, 21 bp, Homo sapiens
tctttatagtgcacaaaatga

SEQ ID NO: 4944744 - DNA, 15 bp, Homo sapiens
tctttcaacttgcat

SEQ ID NO: 4944745 - DNA, 18 bp, Homo sapiens
tctttcacagctcctccc

SEQ ID NO: 4944746 - DNA, 18 bp, Homo sapiens
tctttcagctatcagtag

SEQ ID NO: 4944747 - DNA, 17 bp, Homo sapiens
tctttctagtggtcttt

SEQ ID NO: 4944748 - DNA, 21 bp, Homo sapiens
tctttctccaaagttatccag

SEQ ID NO: 4944749 - DNA, 14 bp, Homo sapiens
tctttctctcttcc

SEQ ID NO: 4944750 - DNA, 17 bp, Homo sapiens
tctttctctttcttcct

SEQ ID NO: 4944751 - DNA, 18 bp, Homo sapiens
tctttctgagcacacttt

SEQ ID NO: 4944752 - DNA, 10 bp, Homo sapiens
tctttctgta

SEQ ID NO: 4944753 - DNA, 14 bp, Homo sapiens
tctttcttcctctg

SEQ ID NO: 4944754 - DNA, 17 bp, Homo sapiens
tctttcttcctctgctg

SEQ ID NO: 4944755 - DNA, 12 bp, Homo sapiens
tctttcttcctt

SEQ ID NO: 4944756 - DNA, 16 bp, Homo sapiens
tctttctttaaatgtt

SEQ ID NO: 4944757 - DNA, 18 bp, Homo sapiens
tctttctttaaatgtttt

SEQ ID NO: 4944758 - DNA, 17 bp, Homo sapiens
tctttgacactctgcag

SEQ ID NO: 4944759 - DNA, 21 bp, Homo sapiens
tctttgataatgttaaatttg

SEQ ID NO: 4944760 - DNA, 20 bp, Homo sapiens
tctttgccttgggctgctcc

SEQ ID NO: 4944761 - DNA, 19 bp, Homo sapiens
tctttggaaaaatgtttgt

SEQ ID NO: 4944762 - DNA, 12 bp, Homo sapiens
tctttggttcta

SEQ ID NO: 4944763 - DNA, 21 bp, Homo sapiens
tctttggttctaaggacctga

SEQ ID NO: 4944764 - DNA, 14 bp, Homo sapiens
tctttgtaagagtg

SEQ ID NO: 4944765 - DNA, 21 bp, Homo sapiens
tctttgtaagagtgtagaagc

SEQ ID NO: 4944766 - DNA, 17 bp, Homo sapiens
tctttgtaagtcagtgt

SEQ ID NO: 4944767 - DNA, 21 bp, Homo sapiens
tctttgtaagtcagtgttgag

SEQ ID NO: 4944768 - DNA, 12 bp, Homo sapiens
tctttgtatctt

SEQ ID NO: 4944769 - DNA, 14 bp, Homo sapiens
tctttgtgataatt

SEQ ID NO: 4944770 - DNA, 21 bp, Homo sapiens
tctttgttatcaaacttcagc

SEQ ID NO: 4944771 - DNA, 12 bp, Homo sapiens
tcttttaatgct

SEQ ID NO: 4944772 - DNA, 19 bp, Homo sapiens
tcttttaatgcttcattca

SEQ ID NO: 4944773 - DNA, 12 bp, Homo sapiens
tcttttacaact

SEQ ID NO: 4944774 - DNA, 14 bp, Homo sapiens
tcttttacattctg

SEQ ID NO: 4944775 - DNA, 17 bp, Homo sapiens
tcttttagctgatgaac

SEQ ID NO: 4944776 - DNA, 20 bp, Homo sapiens
tcttttatagtggaaaaaca

SEQ ID NO: 4944777 - DNA, 22 bp, Homo sapiens
tgaagagtgactagtacaaatt

SEQ ID NO: 4944778 - DNA, 15 bp, Homo sapiens
tgaagatgcagctca

SEQ ID NO: 4944779 - DNA, 14 bp, Homo sapiens
tgaagcaaggaaga

SEQ ID NO: 4944780 - DNA, 19 bp, Homo sapiens
tgaagcagctttaaacaaa

SEQ ID NO: 4944781 - DNA, 14 bp, Homo sapiens
tgaagcagttgtgt

SEQ ID NO: 4944782 - DNA, 17 bp, Homo sapiens
tgaagcagttgtgtcag

SEQ ID NO: 4944783 - DNA, 16 bp, Homo sapiens
tgaagcatgtttcatg

SEQ ID NO: 4944784 - DNA, 18 bp, Homo sapiens
tgaagcattctccccagt

SEQ ID NO: 4944785 - DNA, 12 bp, Homo sapiens
tgaagccagcct

SEQ ID NO: 4944786 - DNA, 13 bp, Homo sapiens
tgaagccagcctt

SEQ ID NO: 4944787 - DNA, 14 bp, Homo sapiens
tgaagccagccttc

SEQ ID NO: 4944788 - DNA, 11 bp, Homo sapiens
tgaagccagct

SEQ ID NO: 4944789 - DNA, 22 bp, Homo sapiens
tgaagctactgtgtgtgtgaat

SEQ ID NO: 4944790 - DNA, 14 bp, Homo sapiens
tgaagctgaaaata

SEQ ID NO: 4944791 - DNA, 22 bp, Homo sapiens
tgaagcttcactcactgtcaat

SEQ ID NO: 4944792 - DNA, 14 bp, Homo sapiens
tgaagcttgactcc

SEQ ID NO: 4944793 - DNA, 15 bp, Homo sapiens
tgaagcttgactccc

SEQ ID NO: 4944794 - DNA, 12 bp, Homo sapiens
tgaaggaaacag

SEQ ID NO: 4944795 - DNA, 23 bp, Homo sapiens
tgaaggaagccaaatttatcaaa

SEQ ID NO: 4944796 - DNA, 14 bp, Homo sapiens
tgaaggcaaaattg

SEQ ID NO: 4944797 - DNA, 16 bp, Homo sapiens
tgaaggcaaaattgca

SEQ ID NO: 4944798 - DNA, 18 bp, Homo sapiens
tgaaggcaaaattgcaaa

SEQ ID NO: 4944799 - DNA, 20 bp, Homo sapiens
tgaaggcttttggtctccct

SEQ ID NO: 4944800 - DNA, 9 bp, Homo sapiens
tgaagggag

SEQ ID NO: 4944801 - DNA, 14 bp, Homo sapiens
tgaagggcccagga

SEQ ID NO: 4944802 - DNA, 14 bp, Homo sapiens
tgaagtcaccttgt

SEQ ID NO: 4944803 - DNA, 13 bp, Homo sapiens
tgaagtcttgtat

SEQ ID NO: 4944804 - DNA, 16 bp, Homo sapiens
tgaagtgcgtgaatgt

SEQ ID NO: 4944805 - DNA, 17 bp, Homo sapiens
tgaagtgcgtgaatgta

SEQ ID NO: 4944806 - DNA, 16 bp, Homo sapiens
tgaagtgtacctgtgt

SEQ ID NO: 4944807 - DNA, 22 bp, Homo sapiens
tgaagtgtacctgtgtacataa

SEQ ID NO: 4944808 - DNA, 13 bp, Homo sapiens
tgaagtttacatt

SEQ ID NO: 4944809 - DNA, 16 bp, Homo sapiens
tgaagtttacattgta

SEQ ID NO: 4944810 - DNA, 15 bp, Homo sapiens
tgaagtttacatttt

SEQ ID NO: 4944811 - DNA, 19 bp, Homo sapiens
tgaagtttacatttttatt

SEQ ID NO: 4944812 - DNA, 19 bp, Homo sapiens
tgaataaaaatatgtacaa

SEQ ID NO: 4944813 - DNA, 14 bp, Homo sapiens
tgaataaaagtgca

SEQ ID NO: 4944814 - DNA, 13 bp, Homo sapiens
tgaataaacttca

SEQ ID NO: 4944815 - DNA, 14 bp, Homo sapiens
tgaataaacttcag

SEQ ID NO: 4944816 - DNA, 14 bp, Homo sapiens
tgaataaagacacc

SEQ ID NO: 4944817 - DNA, 21 bp, Homo sapiens
tgaataccattaaaactgctt

SEQ ID NO: 4944818 - DNA, 12 bp, Homo sapiens
tgaatagaaatg

SEQ ID NO: 4944819 - DNA, 21 bp, Homo sapiens
tgaatatacagcaggtgctca

SEQ ID NO: 4944820 - DNA, 21 bp, Homo sapiens
tgaatatctattaatatatgt

SEQ ID NO: 4944821 - DNA, 19 bp, Homo sapiens
tgaatattactcctatttt

SEQ ID NO: 4944822 - DNA, 22 bp, Homo sapiens
tgaatattactcctatttttgt

SEQ ID NO: 4944823 - DNA, 20 bp, Homo sapiens
tgaatcccacccacatgtga

SEQ ID NO: 4944824 - DNA, 21 bp, Homo sapiens
tgaatcccccttgccacccca

SEQ ID NO: 4944825 - DNA, 14 bp, Homo sapiens
tgaatgaaagatta

SEQ ID NO: 4944826 - DNA, 15 bp, Homo sapiens
tgaatgacaacagaa

SEQ ID NO: 4944827 - DNA, 19 bp, Homo sapiens
tgaatgaggattattataa

SEQ ID NO: 4944828 - DNA, 21 bp, Homo sapiens
tgaatgagtctgttgtgtgtc

SEQ ID NO: 4944829 - DNA, 13 bp, Homo sapiens
tgaatgcctcctg

SEQ ID NO: 4944830 - DNA, 16 bp, Homo sapiens
tgaatgcctcctgtgg

SEQ ID NO: 4944831 - DNA, 18 bp, Homo sapiens
tgaatgcctcctgtgggg

SEQ ID NO: 4944832 - DNA, 13 bp, Homo sapiens
tgaatgctgccac

SEQ ID NO: 4944833 - DNA, 14 bp, Homo sapiens
tgaatgctgccagt

SEQ ID NO: 4944834 - DNA, 19 bp, Homo sapiens
tgaatgctttttgaatgtt

SEQ ID NO: 4944835 - DNA, 23 bp, Homo sapiens
tgaatggattggattatttaata

SEQ ID NO: 4944836 - DNA, 11 bp, Homo sapiens
tgaatgtattt

SEQ ID NO: 4944837 - DNA, 15 bp, Homo sapiens
tgaatgtatttattt

SEQ ID NO: 4944838 - DNA, 20 bp, Homo sapiens
tgaatgtgctgatcatttga

SEQ ID NO: 4944839 - DNA, 12 bp, Homo sapiens
tgaatgtgtcag

SEQ ID NO: 4944840 - DNA, 14 bp, Homo sapiens
tgaatgttatttgt

SEQ ID NO: 4944841 - DNA, 16 bp, Homo sapiens
tgaattaaaacttctt

SEQ ID NO: 4944842 - DNA, 18 bp, Homo sapiens
tgaattaaaacttcttaa

SEQ ID NO: 4944843 - DNA, 17 bp, Homo sapiens
tgaattaaataaaccct

SEQ ID NO: 4944844 - DNA, 23 bp, Homo sapiens
tgaattaatcatctataaagaag

SEQ ID NO: 4944845 - DNA, 17 bp, Homo sapiens
tgaattcttatgcttat

SEQ ID NO: 4944846 - DNA, 17 bp, Homo sapiens
tgaattgttttctttaa

SEQ ID NO: 4944847 - DNA, 14 bp, Homo sapiens
tgaatttaaatata

SEQ ID NO: 4944848 - DNA, 16 bp, Homo sapiens
tgaatttaaatataat

SEQ ID NO: 4944849 - DNA, 20 bp, Homo sapiens
tgaatttagtgagatttacc

SEQ ID NO: 4944850 - DNA, 13 bp, Homo sapiens
tgaatttctaaaa

SEQ ID NO: 4944851 - DNA, 21 bp, Homo sapiens
tgaatttcttcactgttgaaa

SEQ ID NO: 4944852 - DNA, 14 bp, Homo sapiens
tgaattttgttgct

SEQ ID NO: 4944853 - DNA, 17 bp, Homo sapiens
tgacaaaacctaacttg

SEQ ID NO: 4944854 - DNA, 12 bp, Homo sapiens
tgacaaactgtg

SEQ ID NO: 4944855 - DNA, 16 bp, Homo sapiens
tgacaaagatggctca

SEQ ID NO: 4944856 - DNA, 19 bp, Homo sapiens
tgacaaagatggctcagag

SEQ ID NO: 4944857 - DNA, 23 bp, Homo sapiens
tgacaaatctgtgtatattattt

SEQ ID NO: 4944858 - DNA, 22 bp, Homo sapiens
tgacaactgtctaactttagaa

SEQ ID NO: 4944859 - DNA, 12 bp, Homo sapiens
tgacaactgtga

SEQ ID NO: 4944860 - DNA, 16 bp, Homo sapiens
tgacaagggctgacct

SEQ ID NO: 4944861 - DNA, 22 bp, Homo sapiens
tgacaagggctgacctgcctct

SEQ ID NO: 4944862 - DNA, 18 bp, Homo sapiens
tgacaataatattgttgt

SEQ ID NO: 4944863 - DNA, 20 bp, Homo sapiens
tgacaataatattgttgtat

SEQ ID NO: 4944864 - DNA, 13 bp, Homo sapiens
tgacacaaaggaa

SEQ ID NO: 4944865 - DNA, 15 bp, Homo sapiens
tgacacaaaggaagt

SEQ ID NO: 4944866 - DNA, 17 bp, Homo sapiens
tgacacaattggaattg

SEQ ID NO: 4944867 - DNA, 14 bp, Homo sapiens
tgacacacagctct

SEQ ID NO: 4944868 - DNA, 16 bp, Homo sapiens
tgacacagcagcttca

SEQ ID NO: 4944869 - DNA, 16 bp, Homo sapiens
tgacacaggaaaccaa

SEQ ID NO: 4944870 - DNA, 22 bp, Homo sapiens
tgacacccgtgagcgcctgtgc

SEQ ID NO: 4944871 - DNA, 15 bp, Homo sapiens
tgacactagaaaact

SEQ ID NO: 4944872 - DNA, 13 bp, Homo sapiens
tgacagaaagcag

SEQ ID NO: 4944873 - DNA, 15 bp, Homo sapiens
tgacagaaggtgcca

SEQ ID NO: 4944874 - DNA, 17 bp, Homo sapiens
tgacagaaggtgccact

SEQ ID NO: 4944875 - DNA, 20 bp, Homo sapiens
tgacagaaggtgccacttta

SEQ ID NO: 4944876 - DNA, 14 bp, Homo sapiens
tgacagacacaggc

SEQ ID NO: 4944877 - DNA, 20 bp, Homo sapiens
tgacagacacaggcccggct

SEQ ID NO: 4944878 - DNA, 23 bp, Homo sapiens
tgacagacacaggcccggctcca

SEQ ID NO: 4944879 - DNA, 22 bp, Homo sapiens
tgacagaccacatctttatctg

SEQ ID NO: 4944880 - DNA, 16 bp, Homo sapiens
tgacagaggcagcccc

SEQ ID NO: 4944881 - DNA, 18 bp, Homo sapiens
tgacagaggcagccccat

SEQ ID NO: 4944882 - DNA, 23 bp, Homo sapiens
tgacagaggcagccccattctgc

SEQ ID NO: 4944883 - DNA, 23 bp, Homo sapiens
tgacagcatgtgccctcctgagg

SEQ ID NO: 4944884 - DNA, 20 bp, Homo sapiens
tgacaggcaatgctggctgt

SEQ ID NO: 4944885 - DNA, 13 bp, Homo sapiens
tgacagggccagt

SEQ ID NO: 4944886 - DNA, 17 bp, Homo sapiens
tgacagggccagtgggg

SEQ ID NO: 4944887 - DNA, 18 bp, Homo sapiens
tgacagggccagtggggc

SEQ ID NO: 4944888 - DNA, 21 bp, Homo sapiens
tgttaacattccaagactcta

SEQ ID NO: 4944889 - DNA, 23 bp, Homo sapiens
tctagtggtctttgtaagagtgt

SEQ ID NO: 4944890 - DNA, 16 bp, Homo sapiens
tctataaattgtccgt

SEQ ID NO: 4944891 - DNA, 14 bp, Homo sapiens
tctataaggccata

SEQ ID NO: 4944892 - DNA, 15 bp, Homo sapiens
tctatagttctagac

SEQ ID NO: 4944893 - DNA, 16 bp, Homo sapiens
tctatagttgtcagta

SEQ ID NO: 4944894 - DNA, 14 bp, Homo sapiens
tctatatgaattta

SEQ ID NO: 4944895 - DNA, 21 bp, Homo sapiens
tctatatgaatttaaatataa

SEQ ID NO: 4944896 - DNA, 20 bp, Homo sapiens
tctatcaactttaatcaagt

SEQ ID NO: 4944897 - DNA, 17 bp, Homo sapiens
tctatcaagtcaatcat

SEQ ID NO: 4944898 - DNA, 14 bp, Homo sapiens
tctatctaaatgat

SEQ ID NO: 4944899 - DNA, 16 bp, Homo sapiens
tctatctgggcctggg

SEQ ID NO: 4944900 - DNA, 14 bp, Homo sapiens
tctatcttccaaat

SEQ ID NO: 4944901 - DNA, 16 bp, Homo sapiens
tctatgagtctagatg

SEQ ID NO: 4944902 - DNA, 14 bp, Homo sapiens
tctatgccagctca

SEQ ID NO: 4944903 - DNA, 18 bp, Homo sapiens
tctatgccccaaatatag

SEQ ID NO: 4944904 - DNA, 12 bp, Homo sapiens
tctatgctctcg

SEQ ID NO: 4944905 - DNA, 18 bp, Homo sapiens
tctatggttatgaaagaa

SEQ ID NO: 4944906 - DNA, 12 bp, Homo sapiens
tctatgtactag

SEQ ID NO: 4944907 - DNA, 20 bp, Homo sapiens
tctatgtactagtactgtgt

SEQ ID NO: 4944908 - DNA, 21 bp, Homo sapiens
tctatgtactagtactgtgta

SEQ ID NO: 4944909 - DNA, 22 bp, Homo sapiens
tctatgtactagtactgtgtac

SEQ ID NO: 4944910 - DNA, 22 bp, Homo sapiens
tctattaaagtgctaaggttct

SEQ ID NO: 4944911 - DNA, 23 bp, Homo sapiens
tctattaaagtgctaaggttcta

SEQ ID NO: 4944912 - DNA, 10 bp, Homo sapiens
tctattaata

SEQ ID NO: 4944913 - DNA, 12 bp, Homo sapiens
tctattaatata

SEQ ID NO: 4944914 - DNA, 13 bp, Homo sapiens
tctattaatatat

SEQ ID NO: 4944915 - DNA, 16 bp, Homo sapiens
tctattccttctggcc

SEQ ID NO: 4944916 - DNA, 18 bp, Homo sapiens
tctattccttctggcctt

SEQ ID NO: 4944917 - DNA, 17 bp, Homo sapiens
tctattctgtgttgcat

SEQ ID NO: 4944918 - DNA, 16 bp, Homo sapiens
tctattgccttctttg

SEQ ID NO: 4944919 - DNA, 17 bp, Homo sapiens
tctattgccttctttga

SEQ ID NO: 4944920 - DNA, 15 bp, Homo sapiens
tctatttatgtttgc

SEQ ID NO: 4944921 - DNA, 16 bp, Homo sapiens
tctatttattaatatt

SEQ ID NO: 4944922 - DNA, 13 bp, Homo sapiens
tctatttcactta

SEQ ID NO: 4944923 - DNA, 15 bp, Homo sapiens
tctattttaaaataa

SEQ ID NO: 4944924 - DNA, 15 bp, Homo sapiens
tctcaaaaatacaaa

SEQ ID NO: 4944925 - DNA, 23 bp, Homo sapiens
tctcaaaaatacaaaataaaaac

SEQ ID NO: 4944926 - DNA, 13 bp, Homo sapiens
tctcaaaagcatt

SEQ ID NO: 4944927 - DNA, 19 bp, Homo sapiens
tctcaaactaaaagacatt

SEQ ID NO: 4944928 - DNA, 18 bp, Homo sapiens
tctcaagagggcactggt

SEQ ID NO: 4944929 - DNA, 19 bp, Homo sapiens
tctcaagagggcactggtg

SEQ ID NO: 4944930 - DNA, 18 bp, Homo sapiens
tctcaagttctaagattc

SEQ ID NO: 4944931 - DNA, 20 bp, Homo sapiens
tctcaagttctaagattcta

SEQ ID NO: 4944932 - DNA, 22 bp, Homo sapiens
tctcaagttctaagattctaat

SEQ ID NO: 4944933 - DNA, 14 bp, Homo sapiens
tctcaatatgctta

SEQ ID NO: 4944934 - DNA, 13 bp, Homo sapiens
tctcaatgtgaaa

SEQ ID NO: 4944935 - DNA, 11 bp, Homo sapiens
tctcacagcac

SEQ ID NO: 4944936 - DNA, 17 bp, Homo sapiens
tctcacagcacatgctg

SEQ ID NO: 4944937 - DNA, 15 bp, Homo sapiens
tctcaccccatccca

SEQ ID NO: 4944938 - DNA, 17 bp, Homo sapiens
tctcaccccatcccaca

SEQ ID NO: 4944939 - DNA, 19 bp, Homo sapiens
tctcacctaaaaaaagaga

SEQ ID NO: 4944940 - DNA, 21 bp, Homo sapiens
tctcacgggcatgggcactcc

SEQ ID NO: 4944941 - DNA, 15 bp, Homo sapiens
tctcactaaacttta

SEQ ID NO: 4944942 - DNA, 15 bp, Homo sapiens
tctcactccccatgc

SEQ ID NO: 4944943 - DNA, 18 bp, Homo sapiens
tctcactcctacctggta

SEQ ID NO: 4944944 - DNA, 20 bp, Homo sapiens
tctcactccttttggtgtgt

SEQ ID NO: 4944945 - DNA, 22 bp, Homo sapiens
tctcactctgtcgcccagtctg

SEQ ID NO: 4944946 - DNA, 23 bp, Homo sapiens
tctcactctgtcgcccagtctgg

SEQ ID NO: 4944947 - DNA, 17 bp, Homo sapiens
tctcactgttgcccagg

SEQ ID NO: 4944948 - DNA, 16 bp, Homo sapiens
tctcagactgcatgta

SEQ ID NO: 4944949 - DNA, 14 bp, Homo sapiens
tctcagcaagagaa

SEQ ID NO: 4944950 - DNA, 22 bp, Homo sapiens
ttaatgcattaaacctgtctcc

SEQ ID NO: 4944951 - DNA, 23 bp, Homo sapiens
ttaatgcattaaacctgtctcca

SEQ ID NO: 4944952 - DNA, 23 bp, Homo sapiens
ttaatgccgatatactctagatg

SEQ ID NO: 4944953 - DNA, 16 bp, Homo sapiens
ttaatggattgttaat

SEQ ID NO: 4944954 - DNA, 23 bp, Homo sapiens
ttaatgtatttgttcatgtttgg

SEQ ID NO: 4944955 - DNA, 17 bp, Homo sapiens
ttaatgtcacaggcagg

SEQ ID NO: 4944956 - DNA, 13 bp, Homo sapiens
ttaatgtgaactt

SEQ ID NO: 4944957 - DNA, 22 bp, Homo sapiens
ttaatgtgttgggaaaaaggcc

SEQ ID NO: 4944958 - DNA, 16 bp, Homo sapiens
ttaattaaacattgtg

SEQ ID NO: 4944959 - DNA, 16 bp, Homo sapiens
ttaattaatttgatta

SEQ ID NO: 4944960 - DNA, 22 bp, Homo sapiens
ttaattcttcagcgtaaaatgg

SEQ ID NO: 4944961 - DNA, 15 bp, Homo sapiens
ttaatttatctaaat

SEQ ID NO: 4944962 - DNA, 23 bp, Homo sapiens
ttaatttcagtcctgtagtttta

SEQ ID NO: 4944963 - DNA, 19 bp, Homo sapiens
ttaatttgattaacaaata

SEQ ID NO: 4944964 - DNA, 21 bp, Homo sapiens
ttaatttgattaacaaatatg

SEQ ID NO: 4944965 - DNA, 17 bp, Homo sapiens
ttaattttactccataa

SEQ ID NO: 4944966 - DNA, 19 bp, Homo sapiens
ttaatttttttgagacaga

SEQ ID NO: 4944967 - DNA, 17 bp, Homo sapiens
ttacaaaactacatgag

SEQ ID NO: 4944968 - DNA, 18 bp, Homo sapiens
ttacaaaactacatgaga

SEQ ID NO: 4944969 - DNA, 18 bp, Homo sapiens
ttacaagaagtttattct

SEQ ID NO: 4944970 - DNA, 21 bp, Homo sapiens
ttacaagaagtttattctcat

SEQ ID NO: 4944971 - DNA, 14 bp, Homo sapiens
ttacaagtgtatat

SEQ ID NO: 4944972 - DNA, 16 bp, Homo sapiens
ttacaagtgtatatca

SEQ ID NO: 4944973 - DNA, 21 bp, Homo sapiens
ttacaataaaactttgctgcc

SEQ ID NO: 4944974 - DNA, 23 bp, Homo sapiens
ttacaataaaatcttgaaaatgc

SEQ ID NO: 4944975 - DNA, 19 bp, Homo sapiens
ttacaatttgttcatccta

SEQ ID NO: 4944976 - DNA, 14 bp, Homo sapiens
ttacacagaaacac

SEQ ID NO: 4944977 - DNA, 20 bp, Homo sapiens
ttacacagaaacactgcctt

SEQ ID NO: 4944978 - DNA, 17 bp, Homo sapiens
ttacacatttgtacaga

SEQ ID NO: 4944979 - DNA, 18 bp, Homo sapiens
ttacaccgactagccagg

SEQ ID NO: 4944980 - DNA, 14 bp, Homo sapiens
ttacactgccatct

SEQ ID NO: 4944981 - DNA, 18 bp, Homo sapiens
ttacactgcctgtatact

SEQ ID NO: 4944982 - DNA, 20 bp, Homo sapiens
ttacagcaagtagataaata

SEQ ID NO: 4944983 - DNA, 20 bp, Homo sapiens
ttacaggcatgagccactgc

SEQ ID NO: 4944984 - DNA, 22 bp, Homo sapiens
ttacaggccctgctcctgcagc

SEQ ID NO: 4944985 - DNA, 14 bp, Homo sapiens
ttacaggtgtgaac

SEQ ID NO: 4944986 - DNA, 22 bp, Homo sapiens
ttacatagttttaaactcattt

SEQ ID NO: 4944987 - DNA, 22 bp, Homo sapiens
ttacatggttaaggtaaagtaa

SEQ ID NO: 4944988 - DNA, 12 bp, Homo sapiens
ttacatgtgatg

SEQ ID NO: 4944989 - DNA, 15 bp, Homo sapiens
ttacatttaaagcat

SEQ ID NO: 4944990 - DNA, 12 bp, Homo sapiens
ttaccagcaaga

SEQ ID NO: 4944991 - DNA, 19 bp, Homo sapiens
ttaccagcaagaataaaaa

SEQ ID NO: 4944992 - DNA, 16 bp, Homo sapiens
ttaccagcttttaacc

SEQ ID NO: 4944993 - DNA, 19 bp, Homo sapiens
ttaccagcttttaaccatc

SEQ ID NO: 4944994 - DNA, 23 bp, Homo sapiens
ttaccagtctttaaaggcccagc

SEQ ID NO: 4944995 - DNA, 24 bp, Homo sapiens
ttaccagtggcgttgttgcatgtt

SEQ ID NO: 4944996 - DNA, 16 bp, Homo sapiens
ttaccagttaattact

SEQ ID NO: 4944997 - DNA, 16 bp, Homo sapiens
ttacccacctagaaca

SEQ ID NO: 4944998 - DNA, 16 bp, Homo sapiens
ttaccccttagcctcc

SEQ ID NO: 4944999 - DNA, 18 bp, Homo sapiens
ttaccctaatgtcttcat

SEQ ID NO: 4945000 - DNA, 22 bp, Homo sapiens
ttaccctgcgattttgcctgtg

SEQ ID NO: 4945001 - DNA, 20 bp, Homo sapiens
ttacctaagtgacatttgta

SEQ ID NO: 4945002 - DNA, 21 bp, Homo sapiens
ttacctaagtgacatttgtag

SEQ ID NO: 4945003 - DNA, 13 bp, Homo sapiens
ttacctgtcacat

SEQ ID NO: 4945004 - DNA, 16 bp, Homo sapiens
ttacgaatattttcag

SEQ ID NO: 4945005 - DNA, 17 bp, Homo sapiens
ttacgaatattttcagt

SEQ ID NO: 4945006 - DNA, 15 bp, Homo sapiens
ttacgctttgattca

SEQ ID NO: 4945007 - DNA, 16 bp, Homo sapiens
ttacgctttgattcat

SEQ ID NO: 4945008 - DNA, 17 bp, Homo sapiens
ttacgtgtttaaaaaaa

SEQ ID NO: 4945009 - DNA, 14 bp, Homo sapiens
ttactaaaatatat

SEQ ID NO: 4945010 - DNA, 18 bp, Homo sapiens
ttactaaacatatgattt

SEQ ID NO: 4945011 - DNA, 22 bp, Homo sapiens
ttactaagccacaagaaatttg

SEQ ID NO: 4945012 - DNA, 13 bp, Homo sapiens
ttactaccttatc

SEQ ID NO: 4945013 - DNA, 15 bp, Homo sapiens
ttactagcttttcaa

SEQ ID NO: 4945014 - DNA, 14 bp, Homo sapiens
ttactatatatata

SEQ ID NO: 4945015 - DNA, 21 bp, Homo sapiens
ttactattcattaaatgtttg

SEQ ID NO: 4945016 - DNA, 21 bp, Homo sapiens
ttactattttctacaattaat

SEQ ID NO: 4945017 - DNA, 15 bp, Homo sapiens
ttactcagtttatgt

SEQ ID NO: 4945018 - DNA, 13 bp, Homo sapiens
ttactcattgaaa

SEQ ID NO: 4945019 - DNA, 14 bp, Homo sapiens
ttactcattgaaat

SEQ ID NO: 4945020 - DNA, 15 bp, Homo sapiens
ttactcattgaaatg

SEQ ID NO: 4945021 - DNA, 17 bp, Homo sapiens
ttactcattgaaatgtc

SEQ ID NO: 4945022 - DNA, 21 bp, Homo sapiens
ttactcatttttttaatttat

SEQ ID NO: 4945023 - DNA, 21 bp, Homo sapiens
ttactctaagatcttagattc

SEQ ID NO: 4945024 - DNA, 22 bp, Homo sapiens
ttactctaagatcttagattct

SEQ ID NO: 4945025 - DNA, 13 bp, Homo sapiens
ttactgattattt

SEQ ID NO: 4945026 - DNA, 22 bp, Homo sapiens
ttactgcagcctttgcctcccc

SEQ ID NO: 4945027 - DNA, 21 bp, Homo sapiens
ttactgcatggggaaagagat

SEQ ID NO: 4945028 - DNA, 16 bp, Homo sapiens
ttactggcttctcttg

SEQ ID NO: 4945029 - DNA, 18 bp, Homo sapiens
ttactgtaacctgttgct

SEQ ID NO: 4945030 - DNA, 23 bp, Homo sapiens
ttactgtggaggaaggattgtaa

SEQ ID NO: 4945031 - DNA, 13 bp, Homo sapiens
ttactgttcttgc

SEQ ID NO: 4945032 - DNA, 18 bp, Homo sapiens
ttactgttcttgctgcta

SEQ ID NO: 4945033 - DNA, 22 bp, Homo sapiens
ttactgttcttgctgctagaac

SEQ ID NO: 4945034 - DNA, 15 bp, Homo sapiens
ttactgtttatttct

SEQ ID NO: 4945035 - DNA, 11 bp, Homo sapiens
ttacttctgct

SEQ ID NO: 4945036 - DNA, 17 bp, Homo sapiens
ttactttaaaaggagcc

SEQ ID NO: 4945037 - DNA, 18 bp, Homo sapiens
ttactttaaaaggagcca

SEQ ID NO: 4945038 - DNA, 15 bp, Homo sapiens
ttactttatcacttt

SEQ ID NO: 4945039 - DNA, 17 bp, Homo sapiens
ttactttcccttgcttt

SEQ ID NO: 4945040 - DNA, 23 bp, Homo sapiens
ttactttcccttgcttttccctc

SEQ ID NO: 4945041 - DNA, 14 bp, Homo sapiens
ttactttgtgttca

SEQ ID NO: 4945042 - DNA, 16 bp, Homo sapiens
ttagaaaaaaattact

SEQ ID NO: 4945043 - DNA, 15 bp, Homo sapiens
ttagaaaacaaaatt

SEQ ID NO: 4945044 - DNA, 14 bp, Homo sapiens
ttagaaaccttaat

SEQ ID NO: 4945045 - DNA, 18 bp, Homo sapiens
ttagaaaccttaatatgt

SEQ ID NO: 4945046 - DNA, 21 bp, Homo sapiens
ttagaaatgtaaactgccata

SEQ ID NO: 4945047 - DNA, 17 bp, Homo sapiens
ttagaagtgcatttctg

SEQ ID NO: 4945048 - DNA, 20 bp, Homo sapiens
ttagaatcattaccttttac

SEQ ID NO: 4945049 - DNA, 16 bp, Homo sapiens
ttagaattatttaaac

SEQ ID NO: 4945050 - DNA, 13 bp, Homo sapiens
ttagacagagtct

SEQ ID NO: 4945051 - DNA, 18 bp, Homo sapiens
ttagactacatttagaga

SEQ ID NO: 4945052 - DNA, 21 bp, Homo sapiens
ttagactcatcaatcaaataa

SEQ ID NO: 4945053 - DNA, 19 bp, Homo sapiens
ttagactcatcttactgta

SEQ ID NO: 4945054 - DNA, 13 bp, Homo sapiens
ttagagtttctgt

SEQ ID NO: 4945055 - DNA, 15 bp, Homo sapiens
ttagagtttctgttt

SEQ ID NO: 4945056 - DNA, 19 bp, Homo sapiens
ttagatttcaagaaaaaat

SEQ ID NO: 4945057 - DNA, 21 bp, Homo sapiens
ttagattttattttactattg

SEQ ID NO: 4945058 - DNA, 19 bp, Homo sapiens
ttagattttctggttctaa

SEQ ID NO: 4945059 - DNA, 20 bp, Homo sapiens
ttagattttctggttctaac

SEQ ID NO: 4945060 - DNA, 11 bp, Homo sapiens
tgttgttttgt

SEQ ID NO: 4945061 - DNA, 14 bp, Homo sapiens
tgtttaagaaaagt

SEQ ID NO: 4945062 - DNA, 15 bp, Homo sapiens
tgtttaatatttaaa

SEQ ID NO: 4945063 - DNA, 14 bp, Homo sapiens
tgtttaatctgtta

SEQ ID NO: 4945064 - DNA, 17 bp, Homo sapiens
tgtttaatgtgaacttg

SEQ ID NO: 4945065 - DNA, 17 bp, Homo sapiens
tgtttaatttcttcaaa

SEQ ID NO: 4945066 - DNA, 20 bp, Homo sapiens
tgtttaatttcttcaaaatg

SEQ ID NO: 4945067 - DNA, 18 bp, Homo sapiens
tgtttactttaaacttgt

SEQ ID NO: 4945068 - DNA, 22 bp, Homo sapiens
tgtttataaaatataaacaaag

SEQ ID NO: 4945069 - DNA, 14 bp, Homo sapiens
tgtttatatgtgtt

SEQ ID NO: 4945070 - DNA, 16 bp, Homo sapiens
tgtttatcagatacat

SEQ ID NO: 4945071 - DNA, 22 bp, Homo sapiens
tgtttatcagatacatcactgc

SEQ ID NO: 4945072 - DNA, 14 bp, Homo sapiens
tgtttatgaaaata

SEQ ID NO: 4945073 - DNA, 18 bp, Homo sapiens
tgtttatgaaaataaata

SEQ ID NO: 4945074 - DNA, 13 bp, Homo sapiens
tgtttattccttg

SEQ ID NO: 4945075 - DNA, 14 bp, Homo sapiens
tgtttatttctgtt

SEQ ID NO: 4945076 - DNA, 15 bp, Homo sapiens
tgtttatttttcata

SEQ ID NO: 4945077 - DNA, 18 bp, Homo sapiens
tgtttatttttcatattg

SEQ ID NO: 4945078 - DNA, 16 bp, Homo sapiens
tgtttcaagaacctgg

SEQ ID NO: 4945079 - DNA, 15 bp, Homo sapiens
tgtttcaaggcactc

SEQ ID NO: 4945080 - DNA, 19 bp, Homo sapiens
tgtttcaaggcactctaga

SEQ ID NO: 4945081 - DNA, 17 bp, Homo sapiens
tgtttcagctaagggaa

SEQ ID NO: 4945082 - DNA, 24 bp, Homo sapiens
tgtttcagctaagggaagacattt

SEQ ID NO: 4945083 - DNA, 20 bp, Homo sapiens
tgtttccagcagaagacaaa

SEQ ID NO: 4945084 - DNA, 19 bp, Homo sapiens
tgtttccatattttatagg

SEQ ID NO: 4945085 - DNA, 18 bp, Homo sapiens
tgtttcccttcccttcca

SEQ ID NO: 4945086 - DNA, 18 bp, Homo sapiens
tgtttctcttgagctggc

SEQ ID NO: 4945087 - DNA, 20 bp, Homo sapiens
tgtttctcttgagctggcct

SEQ ID NO: 4945088 - DNA, 13 bp, Homo sapiens
tgtttctgttatt

SEQ ID NO: 4945089 - DNA, 21 bp, Homo sapiens
tgtttcttcctgttaatgtat

SEQ ID NO: 4945090 - DNA, 17 bp, Homo sapiens
tgtttcttgcttgtacc

SEQ ID NO: 4945091 - DNA, 13 bp, Homo sapiens
tgtttctttctag

SEQ ID NO: 4945092 - DNA, 14 bp, Homo sapiens
tgtttctttgtgtt

SEQ ID NO: 4945093 - DNA, 15 bp, Homo sapiens
tgtttcttttcacat

SEQ ID NO: 4945094 - DNA, 13 bp, Homo sapiens
tgtttgaaagtag

SEQ ID NO: 4945095 - DNA, 13 bp, Homo sapiens
tgtttgaaatctt

SEQ ID NO: 4945096 - DNA, 22 bp, Homo sapiens
tgtttgaaatgaggtctgttta

SEQ ID NO: 4945097 - DNA, 15 bp, Homo sapiens
tgtttgccatacttt

SEQ ID NO: 4945098 - DNA, 17 bp, Homo sapiens
tgtttggactttgtata

SEQ ID NO: 4945099 - DNA, 12 bp, Homo sapiens
tgtttggagagc

SEQ ID NO: 4945100 - DNA, 22 bp, Homo sapiens
tgtttggtgcatagaactgggt

SEQ ID NO: 4945101 - DNA, 16 bp, Homo sapiens
tgtttggtttacattt

SEQ ID NO: 4945102 - DNA, 16 bp, Homo sapiens
tgtttgtagtgaaata

SEQ ID NO: 4945103 - DNA, 17 bp, Homo sapiens
tgtttgtctctcctttt

SEQ ID NO: 4945104 - DNA, 20 bp, Homo sapiens
tgtttgtctgtttgtttcaa

SEQ ID NO: 4945105 - DNA, 12 bp, Homo sapiens
tgtttgtggcct

SEQ ID NO: 4945106 - DNA, 13 bp, Homo sapiens
tgtttgtttcttt

SEQ ID NO: 4945107 - DNA, 15 bp, Homo sapiens
tgtttgtttctttgt

SEQ ID NO: 4945108 - DNA, 16 bp, Homo sapiens
tgtttgtttgtctgtt

SEQ ID NO: 4945109 - DNA, 12 bp, Homo sapiens
tgttttaaaaaa

SEQ ID NO: 4945110 - DNA, 17 bp, Homo sapiens
tgttttaaattctgaga

SEQ ID NO: 4945111 - DNA, 23 bp, Homo sapiens
tgttttaagaaatgtagttgatg

SEQ ID NO: 4945112 - DNA, 20 bp, Homo sapiens
tgttttaatctgaaattcta

SEQ ID NO: 4945113 - DNA, 22 bp, Homo sapiens
tgttttaatttaaacacctcct

SEQ ID NO: 4945114 - DNA, 13 bp, Homo sapiens
tgttttacaatgt

SEQ ID NO: 4945115 - DNA, 13 bp, Homo sapiens
tgttttataaaat

SEQ ID NO: 4945116 - DNA, 22 bp, Homo sapiens
tgttttataagttcacaaaatg

SEQ ID NO: 4945117 - DNA, 23 bp, Homo sapiens
tgttttattatttctattaaata

SEQ ID NO: 4945118 - DNA, 20 bp, Homo sapiens
tgttttcatggtgaaaatgt

SEQ ID NO: 4945119 - DNA, 17 bp, Homo sapiens
tgttttctgactaatta

SEQ ID NO: 4945120 - DNA, 16 bp, Homo sapiens
tgttttctttctttaa

SEQ ID NO: 4945121 - DNA, 20 bp, Homo sapiens
tgttttctttctttaaatgt

SEQ ID NO: 4945122 - DNA, 17 bp, Homo sapiens
tgttttgaaggcaaaat

SEQ ID NO: 4945123 - DNA, 13 bp, Homo sapiens
tgttttgcacttt

SEQ ID NO: 4945124 - DNA, 14 bp, Homo sapiens
tgttttgcactttt

SEQ ID NO: 4945125 - DNA, 19 bp, Homo sapiens
tgttttggtagattaaata

SEQ ID NO: 4945126 - DNA, 21 bp, Homo sapiens
tgttttggtagattaaatata

SEQ ID NO: 4945127 - DNA, 18 bp, Homo sapiens
tgttttgtacatagattt

SEQ ID NO: 4945128 - DNA, 16 bp, Homo sapiens
tgtttttctttctaca

SEQ ID NO: 4945129 - DNA, 19 bp, Homo sapiens
tgttttttttttccactta

SEQ ID NO: 4945130 - DNA, 20 bp, Homo sapiens
ttaaaaaaaaaaaaaagctt

SEQ ID NO: 4945131 - DNA, 14 bp, Homo sapiens
ttaaaaaaagaaaa

SEQ ID NO: 4945132 - DNA, 19 bp, Homo sapiens
ttaaaaaatatttattaaa

SEQ ID NO: 4945133 - DNA, 16 bp, Homo sapiens
ttaaaaaatcttaatg

SEQ ID NO: 4945134 - DNA, 16 bp, Homo sapiens
ttaaaaaatgaaaata

SEQ ID NO: 4945135 - DNA, 13 bp, Homo sapiens
ttaaaaactggaa

SEQ ID NO: 4945136 - DNA, 20 bp, Homo sapiens
ttaaaaatatggaacttcta

SEQ ID NO: 4945137 - DNA, 17 bp, Homo sapiens
ttaaaaatggaactgtg

SEQ ID NO: 4945138 - DNA, 13 bp, Homo sapiens
ttaaaaatgtaaa

SEQ ID NO: 4945139 - DNA, 21 bp, Homo sapiens
ttaaaacagctgcattagaaa

SEQ ID NO: 4945140 - DNA, 19 bp, Homo sapiens
ttaaaactcagcctgggac

SEQ ID NO: 4945141 - DNA, 9 bp, Homo sapiens
ttaaaagaa

SEQ ID NO: 4945142 - DNA, 23 bp, Homo sapiens
ttaaaagagagagagagaaaaaa

SEQ ID NO: 4945143 - DNA, 15 bp, Homo sapiens
ttaaaaggatagtat

SEQ ID NO: 4945144 - DNA, 19 bp, Homo sapiens
ttaaaataaacagttgtga

SEQ ID NO: 4945145 - DNA, 20 bp, Homo sapiens
ttaaaataaacagttgtgaa

SEQ ID NO: 4945146 - DNA, 15 bp, Homo sapiens
ttaaaatagaaataa

SEQ ID NO: 4945147 - DNA, 19 bp, Homo sapiens
ttaaaatattcctgcattt

SEQ ID NO: 4945148 - DNA, 17 bp, Homo sapiens
ttaaaatatttatttat

SEQ ID NO: 4945149 - DNA, 17 bp, Homo sapiens
ttaaaatctattctgtg

SEQ ID NO: 4945150 - DNA, 24 bp, Homo sapiens
ttaaaatctattctgtgttgcatt

SEQ ID NO: 4945151 - DNA, 11 bp, Homo sapiens
ttaaaatggaa

SEQ ID NO: 4945152 - DNA, 17 bp, Homo sapiens
ttaaaatgtaagattat

SEQ ID NO: 4945153 - DNA, 23 bp, Homo sapiens
ttaaaattatcaatatctaatat

SEQ ID NO: 4945154 - DNA, 16 bp, Homo sapiens
ttaaaattatgaatct

SEQ ID NO: 4945155 - DNA, 12 bp, Homo sapiens
ttaaacacacag

SEQ ID NO: 4945156 - DNA, 22 bp, Homo sapiens
ttaaacacacagatacacacac

SEQ ID NO: 4945157 - DNA, 23 bp, Homo sapiens
ttaaacacacagatacacacaca

SEQ ID NO: 4945158 - DNA, 14 bp, Homo sapiens
ttaaacacattgtc

SEQ ID NO: 4945159 - DNA, 10 bp, Homo sapiens
ttaaacatta

SEQ ID NO: 4945160 - DNA, 13 bp, Homo sapiens
ttaaacattaaaa

SEQ ID NO: 4945161 - DNA, 18 bp, Homo sapiens
ttaaacattaaaaatgga

SEQ ID NO: 4945162 - DNA, 20 bp, Homo sapiens
ttaaacctgtctccactgtg

SEQ ID NO: 4945163 - DNA, 21 bp, Homo sapiens
ttaaacctgtctccactgtgc

SEQ ID NO: 4945164 - DNA, 16 bp, Homo sapiens
ttaaactcaagacaat

SEQ ID NO: 4945165 - DNA, 14 bp, Homo sapiens
ttaaactcagggac

SEQ ID NO: 4945166 - DNA, 18 bp, Homo sapiens
ttaaactgttagcactgt

SEQ ID NO: 4945167 - DNA, 21 bp, Homo sapiens
ttaaactgttagcactgttga

SEQ ID NO: 4945168 - DNA, 22 bp, Homo sapiens
ttaaactgttagcactgttgat

SEQ ID NO: 4945169 - DNA, 23 bp, Homo sapiens
ttaaacttataaatcatattgat

SEQ ID NO: 4945170 - DNA, 14 bp, Homo sapiens
ttaaacttgtgaat

SEQ ID NO: 4945171 - DNA, 17 bp, Homo sapiens
ttaaacttgtgaatgct

SEQ ID NO: 4945172 - DNA, 16 bp, Homo sapiens
ttaaagaaacagcttt

SEQ ID NO: 4945173 - DNA, 14 bp, Homo sapiens
ttaaagagtctaga

SEQ ID NO: 4945174 - DNA, 16 bp, Homo sapiens
ttaaagagtctagatt

SEQ ID NO: 4945175 - DNA, 22 bp, Homo sapiens
ttaaagatctgtaagtaacttc

SEQ ID NO: 4945176 - DNA, 16 bp, Homo sapiens
ttaaagcaagcaacac

SEQ ID NO: 4945177 - DNA, 22 bp, Homo sapiens
ttaaagcaagcaacacagagga

SEQ ID NO: 4945178 - DNA, 16 bp, Homo sapiens
ttaaagcattgctttt

SEQ ID NO: 4945179 - DNA, 22 bp, Homo sapiens
ttaaagcattgcttttattttg

SEQ ID NO: 4945180 - DNA, 18 bp, Homo sapiens
ttaaagcctttagtatca

SEQ ID NO: 4945181 - DNA, 17 bp, Homo sapiens
ttaaagctgcctgtagt

SEQ ID NO: 4945182 - DNA, 17 bp, Homo sapiens
ttaaaggatgttggtgt

SEQ ID NO: 4945183 - DNA, 22 bp, Homo sapiens
ttaaagtgtttcagctaaggga

SEQ ID NO: 4945184 - DNA, 19 bp, Homo sapiens
ttaaagttggaatttacca

SEQ ID NO: 4945185 - DNA, 19 bp, Homo sapiens
ttaaataaactttttttca

SEQ ID NO: 4945186 - DNA, 22 bp, Homo sapiens
ttaaataaactttttttcaatg

SEQ ID NO: 4945187 - DNA, 23 bp, Homo sapiens
ttaaataaactttttttcaatgt

SEQ ID NO: 4945188 - DNA, 13 bp, Homo sapiens
ttaaataagattc

SEQ ID NO: 4945189 - DNA, 17 bp, Homo sapiens
ttaaataagattctaac

SEQ ID NO: 4945190 - DNA, 24 bp, Homo sapiens
ttaaataatatggctatgcttaaa

SEQ ID NO: 4945191 - DNA, 15 bp, Homo sapiens
ttaaataatttaact

SEQ ID NO: 4945192 - DNA, 19 bp, Homo sapiens
ttaaatacgcactacatgt

SEQ ID NO: 4945193 - DNA, 14 bp, Homo sapiens
ttaaatataattct

SEQ ID NO: 4945194 - DNA, 16 bp, Homo sapiens
ttaaatataattctgt

SEQ ID NO: 4945195 - DNA, 18 bp, Homo sapiens
ttaaatataattctgtaa

SEQ ID NO: 4945196 - DNA, 19 bp, Homo sapiens
ttaaatataattctgtaaa

SEQ ID NO: 4945197 - DNA, 12 bp, Homo sapiens
ttaaatatagtt

SEQ ID NO: 4945198 - DNA, 14 bp, Homo sapiens
ttaaatatctttta

SEQ ID NO: 4945199 - DNA, 19 bp, Homo sapiens
ttaaatatcttttatgttt

SEQ ID NO: 4945200 - DNA, 20 bp, Homo sapiens
ttaaatattagttaatggat

SEQ ID NO: 4945201 - DNA, 11 bp, Homo sapiens
ttaaatgtttg

SEQ ID NO: 4945202 - DNA, 12 bp, Homo sapiens
ttaaatgtttga

SEQ ID NO: 4945203 - DNA, 17 bp, Homo sapiens
ttaaatgttttataagt

SEQ ID NO: 4945204 - DNA, 22 bp, Homo sapiens
ttaaatgttttataagttcaca

SEQ ID NO: 4945205 - DNA, 15 bp, Homo sapiens
ttaaatttaaagata

SEQ ID NO: 4945206 - DNA, 13 bp, Homo sapiens
ttaaatttgtaag

SEQ ID NO: 4945207 - DNA, 16 bp, Homo sapiens
ttaaattttaaggtag

SEQ ID NO: 4945208 - DNA, 15 bp, Homo sapiens
ttaaattttgagttc

SEQ ID NO: 4945209 - DNA, 16 bp, Homo sapiens
ttaaattttttttaca

SEQ ID NO: 4945210 - DNA, 19 bp, Homo sapiens
ttaaattttttttacattt

SEQ ID NO: 4945211 - DNA, 11 bp, Homo sapiens
ttaacaaaagt

SEQ ID NO: 4945212 - DNA, 21 bp, Homo sapiens
ttaacaaatatgctaatttgg

SEQ ID NO: 4945213 - DNA, 21 bp, Homo sapiens
ttaacaacaataacactgtct

SEQ ID NO: 4945214 - DNA, 22 bp, Homo sapiens
ttaacatgaacacccttagaaa

SEQ ID NO: 4945215 - DNA, 19 bp, Homo sapiens
ttaacatgcttatgacaat

SEQ ID NO: 4945216 - DNA, 19 bp, Homo sapiens
ttaacatgggctcttcact

SEQ ID NO: 4945217 - DNA, 12 bp, Homo sapiens
ttaacatttgcc

SEQ ID NO: 4945218 - DNA, 13 bp, Homo sapiens
ttaacatttgcct

SEQ ID NO: 4945219 - DNA, 13 bp, Homo sapiens
ttaacccaaggag

SEQ ID NO: 4945220 - DNA, 17 bp, Homo sapiens
ttaaccccatgtcctca

SEQ ID NO: 4945221 - DNA, 16 bp, Homo sapiens
ttaactacccttaatt

SEQ ID NO: 4945222 - DNA, 20 bp, Homo sapiens
ttaactacccttaattactt

SEQ ID NO: 4945223 - DNA, 17 bp, Homo sapiens
ttaactagacacagata

SEQ ID NO: 4945224 - DNA, 16 bp, Homo sapiens
ttaactgaacaatggc

SEQ ID NO: 4945225 - DNA, 21 bp, Homo sapiens
ttaactgaacaatggccctgt

SEQ ID NO: 4945226 - DNA, 17 bp, Homo sapiens
ttaacttatttagagat

SEQ ID NO: 4945227 - DNA, 14 bp, Homo sapiens
ttaagaaaagtatt

SEQ ID NO: 4945228 - DNA, 17 bp, Homo sapiens
ttaagaaaagtattttg

SEQ ID NO: 4945229 - DNA, 14 bp, Homo sapiens
ttaagaaatgtagt

SEQ ID NO: 4945230 - DNA, 11 bp, Homo sapiens
ttaagaagctg

SEQ ID NO: 4945231 - DNA, 13 bp, Homo sapiens
ttaagaagctgtt

SEQ ID NO: 4945232 - DNA, 16 bp, Homo sapiens
ttaagaagctgttgta

SEQ ID NO: 4945233 - DNA, 20 bp, Homo sapiens
ttaagaagctgttgtacatt

SEQ ID NO: 4945234 - DNA, 21 bp, Homo sapiens
ttaagaagctgttgtacattt

SEQ ID NO: 4945235 - DNA, 22 bp, Homo sapiens
ttaagaagctgttgtacattta

SEQ ID NO: 4945236 - DNA, 23 bp, Homo sapiens
ttaagaagctgttgtacatttat

SEQ ID NO: 4945237 - DNA, 12 bp, Homo sapiens
ttaagaaggcaa

SEQ ID NO: 4945238 - DNA, 22 bp, Homo sapiens
ttaagaatgttggtttactttc

SEQ ID NO: 4945239 - DNA, 21 bp, Homo sapiens
ttaagaattgaccatctgctt

SEQ ID NO: 4945240 - DNA, 19 bp, Homo sapiens
ttaagacaagcctggcaac

SEQ ID NO: 4945241 - DNA, 16 bp, Homo sapiens
ttaagacatgatttcc

SEQ ID NO: 4945242 - DNA, 18 bp, Homo sapiens
ttaagacatgatttcctt

SEQ ID NO: 4945243 - DNA, 18 bp, Homo sapiens
ttaagacctactgttcta

SEQ ID NO: 4945244 - DNA, 14 bp, Homo sapiens
ttaagagaaacttt

SEQ ID NO: 4945245 - DNA, 16 bp, Homo sapiens
ttaagagaaactttat

SEQ ID NO: 4945246 - DNA, 21 bp, Homo sapiens
ttaagagaaactttatacatt

SEQ ID NO: 4945247 - DNA, 23 bp, Homo sapiens
ttaagagaaactttatacattag

SEQ ID NO: 4945248 - DNA, 12 bp, Homo sapiens
ttaagagaaatg

SEQ ID NO: 4945249 - DNA, 15 bp, Homo sapiens
ttaagagaaatggca

SEQ ID NO: 4945250 - DNA, 13 bp, Homo sapiens
ttaagagtccaag

SEQ ID NO: 4945251 - DNA, 14 bp, Homo sapiens
ttaagatacaaatt

SEQ ID NO: 4945252 - DNA, 20 bp, Homo sapiens
ttaagatacaaattaatttt

SEQ ID NO: 4945253 - DNA, 14 bp, Homo sapiens
ttaagatttttctc

SEQ ID NO: 4945254 - DNA, 20 bp, Homo sapiens
ttaagatttttctcaaagtt

SEQ ID NO: 4945255 - DNA, 22 bp, Homo sapiens
ttaagatttttctcaaagtttt

SEQ ID NO: 4945256 - DNA, 13 bp, Homo sapiens
ttaagcattacca

SEQ ID NO: 4945257 - DNA, 18 bp, Homo sapiens
ttaagcattaccactcag

SEQ ID NO: 4945258 - DNA, 14 bp, Homo sapiens
ttaaggaaacaata

SEQ ID NO: 4945259 - DNA, 16 bp, Homo sapiens
ttaaggaaactcttat

SEQ ID NO: 4945260 - DNA, 18 bp, Homo sapiens
ttaaggatggggttatga

SEQ ID NO: 4945261 - DNA, 19 bp, Homo sapiens
ttaagggcatgccttgtgc

SEQ ID NO: 4945262 - DNA, 14 bp, Homo sapiens
ttaagtatcttttt

SEQ ID NO: 4945263 - DNA, 21 bp, Homo sapiens
ttaagtgcgtgtgtagagtta

SEQ ID NO: 4945264 - DNA, 13 bp, Homo sapiens
ttaagttccagca

SEQ ID NO: 4945265 - DNA, 15 bp, Homo sapiens
ttaagtttcaaactt

SEQ ID NO: 4945266 - DNA, 19 bp, Homo sapiens
ttaataaactactctttga

SEQ ID NO: 4945267 - DNA, 21 bp, Homo sapiens
ttaataacattaccttactgt

SEQ ID NO: 4945268 - DNA, 13 bp, Homo sapiens
ttaataataatct

SEQ ID NO: 4945269 - DNA, 15 bp, Homo sapiens
ttaatactaaaatat

SEQ ID NO: 4945270 - DNA, 15 bp, Homo sapiens
ttaatactaccttga

SEQ ID NO: 4945271 - DNA, 15 bp, Homo sapiens
ttaatagtttgtcta

SEQ ID NO: 4945272 - DNA, 19 bp, Homo sapiens
ttaatatatcccagaaatt

SEQ ID NO: 4945273 - DNA, 17 bp, Homo sapiens
ttaatatggatttgtta

SEQ ID NO: 4945274 - DNA, 16 bp, Homo sapiens
ttaatatttaaacagc

SEQ ID NO: 4945275 - DNA, 22 bp, Homo sapiens
ttaatatttaaacagcagtgtt

SEQ ID NO: 4945276 - DNA, 12 bp, Homo sapiens
ttaatatttaac

SEQ ID NO: 4945277 - DNA, 22 bp, Homo sapiens
ttaatcattttgcctcttttct

SEQ ID NO: 4945278 - DNA, 20 bp, Homo sapiens
ttaatctagacaatatacaa

SEQ ID NO: 4945279 - DNA, 15 bp, Homo sapiens
ttaatctctgttatg

SEQ ID NO: 4945280 - DNA, 19 bp, Homo sapiens
tgtattggatatataagag

SEQ ID NO: 4945281 - DNA, 13 bp, Homo sapiens
tgtattgtggtat

SEQ ID NO: 4945282 - DNA, 13 bp, Homo sapiens
tgtatttaagcaa

SEQ ID NO: 4945283 - DNA, 16 bp, Homo sapiens
tgtatttaagcaaata

SEQ ID NO: 4945284 - DNA, 20 bp, Homo sapiens
tgtatttacgctttgattca

SEQ ID NO: 4945285 - DNA, 14 bp, Homo sapiens
tgtatttttctaca

SEQ ID NO: 4945286 - DNA, 22 bp, Homo sapiens
tgtatttttctacattattgct

SEQ ID NO: 4945287 - DNA, 17 bp, Homo sapiens
tgtcaaaacactgtgga

SEQ ID NO: 4945288 - DNA, 21 bp, Homo sapiens
tgtcaaaagttggactaaatg

SEQ ID NO: 4945289 - DNA, 22 bp, Homo sapiens
tgtcaaaagttggactaaatgc

SEQ ID NO: 4945290 - DNA, 22 bp, Homo sapiens
tgtcaacacccctgtgtggatg

SEQ ID NO: 4945291 - DNA, 17 bp, Homo sapiens
tgtcaatgattattttc

SEQ ID NO: 4945292 - DNA, 13 bp, Homo sapiens
tgtcacaccagcc

SEQ ID NO: 4945293 - DNA, 15 bp, Homo sapiens
tgtcacaccagccat

SEQ ID NO: 4945294 - DNA, 13 bp, Homo sapiens
tgtcacaggcagg

SEQ ID NO: 4945295 - DNA, 14 bp, Homo sapiens
tgtcacaggcaggt

SEQ ID NO: 4945296 - DNA, 17 bp, Homo sapiens
tgtcacatggtgcccct

SEQ ID NO: 4945297 - DNA, 17 bp, Homo sapiens
tgtcacattgcattcta

SEQ ID NO: 4945298 - DNA, 19 bp, Homo sapiens
tgtcacattgcattctatt

SEQ ID NO: 4945299 - DNA, 22 bp, Homo sapiens
tgtcacattgcattctattgcc

SEQ ID NO: 4945300 - DNA, 13 bp, Homo sapiens
tgtcacgtactgt

SEQ ID NO: 4945301 - DNA, 15 bp, Homo sapiens
tgtcacgtactgtct

SEQ ID NO: 4945302 - DNA, 20 bp, Homo sapiens
tgtcactagaatggataaaa

SEQ ID NO: 4945303 - DNA, 20 bp, Homo sapiens
tgtcactgacacaaaggaag

SEQ ID NO: 4945304 - DNA, 22 bp, Homo sapiens
tgtcacttcgcgtgccctcgct

SEQ ID NO: 4945305 - DNA, 14 bp, Homo sapiens
tgtcacttgtgctt

SEQ ID NO: 4945306 - DNA, 15 bp, Homo sapiens
tgtcacttgtgcttt

SEQ ID NO: 4945307 - DNA, 21 bp, Homo sapiens
tgtcagacagaacttgaatgt

SEQ ID NO: 4945308 - DNA, 15 bp, Homo sapiens
tgtcagacataaagc

SEQ ID NO: 4945309 - DNA, 17 bp, Homo sapiens
tgtcagacataaagcca

SEQ ID NO: 4945310 - DNA, 17 bp, Homo sapiens
tgtcagatgagaacaaa

SEQ ID NO: 4945311 - DNA, 18 bp, Homo sapiens
tgtcagatgagaacaaag

SEQ ID NO: 4945312 - DNA, 23 bp, Homo sapiens
tgtcagctactgcggaaaaggaa

SEQ ID NO: 4945313 - DNA, 18 bp, Homo sapiens
tgtcaggaacagaaggat

SEQ ID NO: 4945314 - DNA, 17 bp, Homo sapiens
tgtcaggtggggcagct

SEQ ID NO: 4945315 - DNA, 18 bp, Homo sapiens
tgtcaggtggggcagctt

SEQ ID NO: 4945316 - DNA, 20 bp, Homo sapiens
tgtcaggtggggcagcttga

SEQ ID NO: 4945317 - DNA, 15 bp, Homo sapiens
tgtcagtatccaggc

SEQ ID NO: 4945318 - DNA, 16 bp, Homo sapiens
tgtcagtattattcta

SEQ ID NO: 4945319 - DNA, 17 bp, Homo sapiens
tgtcatatactgccatg

SEQ ID NO: 4945320 - DNA, 17 bp, Homo sapiens
tgtcatatcagcacata

SEQ ID NO: 4945321 - DNA, 18 bp, Homo sapiens
tgtcatcagagctcctct

SEQ ID NO: 4945322 - DNA, 17 bp, Homo sapiens
tgtcatggttacaaact

SEQ ID NO: 4945323 - DNA, 15 bp, Homo sapiens
tgtcatttcattcca

SEQ ID NO: 4945324 - DNA, 20 bp, Homo sapiens
tgtcatttgagcagggctca

SEQ ID NO: 4945325 - DNA, 12 bp, Homo sapiens
tgtcatttgctt

SEQ ID NO: 4945326 - DNA, 23 bp, Homo sapiens
tgtccaattgttgacagttctga

SEQ ID NO: 4945327 - DNA, 19 bp, Homo sapiens
tgtccaggcactgctgccc

SEQ ID NO: 4945328 - DNA, 21 bp, Homo sapiens
tgtccaggcactgctgcccag

SEQ ID NO: 4945329 - DNA, 16 bp, Homo sapiens
tgtcccaacttgtaaa

SEQ ID NO: 4945330 - DNA, 17 bp, Homo sapiens
tgtcccacccccacccc

SEQ ID NO: 4945331 - DNA, 22 bp, Homo sapiens
tgtcccacccccacccccagct

SEQ ID NO: 4945332 - DNA, 17 bp, Homo sapiens
tgtcccatggacactcc

SEQ ID NO: 4945333 - DNA, 9 bp, Homo sapiens
tgtccccca

SEQ ID NO: 4945334 - DNA, 13 bp, Homo sapiens
tgtcccccaactt

SEQ ID NO: 4945335 - DNA, 14 bp, Homo sapiens
tgtcccccaacttg

SEQ ID NO: 4945336 - DNA, 16 bp, Homo sapiens
tgtcccccaacttgag

SEQ ID NO: 4945337 - DNA, 20 bp, Homo sapiens
tgtcccccaggttccgaaga

SEQ ID NO: 4945338 - DNA, 16 bp, Homo sapiens
tgtccccgcagccctg

SEQ ID NO: 4945339 - DNA, 18 bp, Homo sapiens
tgtcccctccactgtcac

SEQ ID NO: 4945340 - DNA, 21 bp, Homo sapiens
tgtccccttggcaggtcctgg

SEQ ID NO: 4945341 - DNA, 20 bp, Homo sapiens
tgtccctaccgagtctcttc

SEQ ID NO: 4945342 - DNA, 21 bp, Homo sapiens
tgtccctcactgttgaatttt

SEQ ID NO: 4945343 - DNA, 18 bp, Homo sapiens
tgtccctcccacctctgt

SEQ ID NO: 4945344 - DNA, 20 bp, Homo sapiens
tgtccctcccacctctgtga

SEQ ID NO: 4945345 - DNA, 14 bp, Homo sapiens
tgtccctcttcact

SEQ ID NO: 4945346 - DNA, 15 bp, Homo sapiens
tgtccctgaaaccta

SEQ ID NO: 4945347 - DNA, 17 bp, Homo sapiens
tgtcccttgatgcacag

SEQ ID NO: 4945348 - DNA, 19 bp, Homo sapiens
tgtcccttgatgcacagag

SEQ ID NO: 4945349 - DNA, 20 bp, Homo sapiens
tgtcccttgatgcacagaga

SEQ ID NO: 4945350 - DNA, 23 bp, Homo sapiens
tgtccgctgggtggtaccctctg

SEQ ID NO: 4945351 - DNA, 17 bp, Homo sapiens
tgtcctactctgtgtca

SEQ ID NO: 4945352 - DNA, 13 bp, Homo sapiens
tgtcctatgtgtg

SEQ ID NO: 4945353 - DNA, 12 bp, Homo sapiens
tgtcctcaggga

SEQ ID NO: 4945354 - DNA, 14 bp, Homo sapiens
tgtcctcagggagc

SEQ ID NO: 4945355 - DNA, 17 bp, Homo sapiens
tgtcctccagaagcctc

SEQ ID NO: 4945356 - DNA, 21 bp, Homo sapiens
tgtcctccagaagcctctggc

SEQ ID NO: 4945357 - DNA, 13 bp, Homo sapiens
tgtcctcccatcc

SEQ ID NO: 4945358 - DNA, 22 bp, Homo sapiens
tgtcctcccatcccctggactg

SEQ ID NO: 4945359 - DNA, 23 bp, Homo sapiens
tgtcctcccatcccctggactgg

SEQ ID NO: 4945360 - DNA, 13 bp, Homo sapiens
tgtcctccctcca

SEQ ID NO: 4945361 - DNA, 15 bp, Homo sapiens
tgtcctgcttctgaa

SEQ ID NO: 4945362 - DNA, 17 bp, Homo sapiens
tgtcctggttagcagag

SEQ ID NO: 4945363 - DNA, 20 bp, Homo sapiens
tgtcctgtagaggttttgtt

SEQ ID NO: 4945364 - DNA, 14 bp, Homo sapiens
tgtccttccctgca

SEQ ID NO: 4945365 - DNA, 16 bp, Homo sapiens
tgtccttccctgcatt

SEQ ID NO: 4945366 - DNA, 22 bp, Homo sapiens
tgtcgaaaagagtcttccaatt

SEQ ID NO: 4945367 - DNA, 20 bp, Homo sapiens
tgtctaaacaatgctgattt

SEQ ID NO: 4945368 - DNA, 22 bp, Homo sapiens
tgtctaaacaatgctgatttgg

SEQ ID NO: 4945369 - DNA, 18 bp, Homo sapiens
tgtctaactcagaattat

SEQ ID NO: 4945370 - DNA, 22 bp, Homo sapiens
tgtctaactttagaagtgcatt

SEQ ID NO: 4945371 - DNA, 14 bp, Homo sapiens
tgtctaagatagta

SEQ ID NO: 4945372 - DNA, 15 bp, Homo sapiens
tgtctaagatagtaa

SEQ ID NO: 4945373 - DNA, 16 bp, Homo sapiens
tgtctaagattctaga

SEQ ID NO: 4945374 - DNA, 12 bp, Homo sapiens
tgtctattttaa

SEQ ID NO: 4945375 - DNA, 15 bp, Homo sapiens
tgtctcagacttttg

SEQ ID NO: 4945376 - DNA, 17 bp, Homo sapiens
tgtctcaggtccctgca

SEQ ID NO: 4945377 - DNA, 18 bp, Homo sapiens
tgtctcatcctcctggaa

SEQ ID NO: 4945378 - DNA, 14 bp, Homo sapiens
tgtctcattttaat

SEQ ID NO: 4945379 - DNA, 13 bp, Homo sapiens
tgtctccactgtg

SEQ ID NO: 4945380 - DNA, 16 bp, Homo sapiens
tgtctcctactcctga

SEQ ID NO: 4945381 - DNA, 16 bp, Homo sapiens
tgtctctaacttattt

SEQ ID NO: 4945382 - DNA, 21 bp, Homo sapiens
tgtctctccttttcttttgtt

SEQ ID NO: 4945383 - DNA, 18 bp, Homo sapiens
tgtctctcttcagactct

SEQ ID NO: 4945384 - DNA, 22 bp, Homo sapiens
tgtctctttaagggcatgcctt

SEQ ID NO: 4945385 - DNA, 22 bp, Homo sapiens
tgtctgaaaaattcctttgtgt

SEQ ID NO: 4945386 - DNA, 17 bp, Homo sapiens
tgtctgaagtcactgca

SEQ ID NO: 4945387 - DNA, 19 bp, Homo sapiens
tgtctgaagtcactgcaca

SEQ ID NO: 4945388 - DNA, 23 bp, Homo sapiens
tgtctgaatcgagtgagacaaaa

SEQ ID NO: 4945389 - DNA, 23 bp, Homo sapiens
tgtctgattggcttgtagaattg

SEQ ID NO: 4945390 - DNA, 21 bp, Homo sapiens
tgtctgctttaaagggcctgc

SEQ ID NO: 4945391 - DNA, 15 bp, Homo sapiens
tgtctggttttaaca

SEQ ID NO: 4945392 - DNA, 18 bp, Homo sapiens
tgtctgtaaaagagccta

SEQ ID NO: 4945393 - DNA, 17 bp, Homo sapiens
tgtctgtaaatatgttt

SEQ ID NO: 4945394 - DNA, 15 bp, Homo sapiens
tgtctgtacacgtgt

SEQ ID NO: 4945395 - DNA, 14 bp, Homo sapiens
tgtctgtatttcat

SEQ ID NO: 4945396 - DNA, 15 bp, Homo sapiens
tgtctgtttaagaaa

SEQ ID NO: 4945397 - DNA, 16 bp, Homo sapiens
tgtctgtttaagaaaa

SEQ ID NO: 4945398 - DNA, 16 bp, Homo sapiens
tgtctgtttgtttcaa

SEQ ID NO: 4945399 - DNA, 16 bp, Homo sapiens
tgtcttatctggccct

SEQ ID NO: 4945400 - DNA, 15 bp, Homo sapiens
tgtcttcataaagta

SEQ ID NO: 4945401 - DNA, 16 bp, Homo sapiens
tgtcttcatttcattg

SEQ ID NO: 4945402 - DNA, 23 bp, Homo sapiens
tgtcttcatttcattgtatgatg

SEQ ID NO: 4945403 - DNA, 15 bp, Homo sapiens
tgtcttccactttgc

SEQ ID NO: 4945404 - DNA, 20 bp, Homo sapiens
tgtcttctctaacaccttgt

SEQ ID NO: 4945405 - DNA, 14 bp, Homo sapiens
tgtcttctctgtct

SEQ ID NO: 4945406 - DNA, 23 bp, Homo sapiens
tgtcttctggacaggctctgctt

SEQ ID NO: 4945407 - DNA, 20 bp, Homo sapiens
tgtcttgcaatggcagcctt

SEQ ID NO: 4945408 - DNA, 21 bp, Homo sapiens
tgtcttgcaatggcagccttg

SEQ ID NO: 4945409 - DNA, 16 bp, Homo sapiens
tgtctttaaaagagag

SEQ ID NO: 4945410 - DNA, 22 bp, Homo sapiens
tgtctttaatttctgtcagaat

SEQ ID NO: 4945411 - DNA, 19 bp, Homo sapiens
tgtctttctccaaagttat

SEQ ID NO: 4945412 - DNA, 18 bp, Homo sapiens
tgtcttttaatgcttcat

SEQ ID NO: 4945413 - DNA, 17 bp, Homo sapiens
tgtcttttatgcagata

SEQ ID NO: 4945414 - DNA, 20 bp, Homo sapiens
tgtcttttatgcagatagaa

SEQ ID NO: 4945415 - DNA, 14 bp, Homo sapiens
tgtcttttcttggc

SEQ ID NO: 4945416 - DNA, 15 bp, Homo sapiens
tgtcttttcttggca

SEQ ID NO: 4945417 - DNA, 23 bp, Homo sapiens
tgtcttttcttggcaaaagcctt

SEQ ID NO: 4945418 - DNA, 14 bp, Homo sapiens
tgtgaaaatgggtt

SEQ ID NO: 4945419 - DNA, 14 bp, Homo sapiens
tgtgaaacctgtga

SEQ ID NO: 4945420 - DNA, 20 bp, Homo sapiens
tgtgaaaccttttttaagat

SEQ ID NO: 4945421 - DNA, 17 bp, Homo sapiens
tgtgaaagttttgagta

SEQ ID NO: 4945422 - DNA, 17 bp, Homo sapiens
tgtgaaccaccacaccc

SEQ ID NO: 4945423 - DNA, 20 bp, Homo sapiens
tgtgaacttgtagctgtaaa

SEQ ID NO: 4945424 - DNA, 14 bp, Homo sapiens
tgtgaagtttacat

SEQ ID NO: 4945425 - DNA, 14 bp, Homo sapiens
tgtgaatgaacact

SEQ ID NO: 4945426 - DNA, 20 bp, Homo sapiens
tgtgaatgattcatgttata

SEQ ID NO: 4945427 - DNA, 15 bp, Homo sapiens
tgtgaatggattgga

SEQ ID NO: 4945428 - DNA, 21 bp, Homo sapiens
tgtgaatgttgtgatgtattc

SEQ ID NO: 4945429 - DNA, 19 bp, Homo sapiens
tgtgaattgaaatgttcgt

SEQ ID NO: 4945430 - DNA, 12 bp, Homo sapiens
tgtgacaaaatt

SEQ ID NO: 4945431 - DNA, 19 bp, Homo sapiens
tgtgacaactgtctaactt

SEQ ID NO: 4945432 - DNA, 17 bp, Homo sapiens
tgtgacacatatgcacc

SEQ ID NO: 4945433 - DNA, 22 bp, Homo sapiens
tgtgacagggccagtggggcct

SEQ ID NO: 4945434 - DNA, 23 bp, Homo sapiens
tgtgacagggccagtggggcctg

SEQ ID NO: 4945435 - DNA, 17 bp, Homo sapiens
tgtgaccaactgtgttg

SEQ ID NO: 4945436 - DNA, 22 bp, Homo sapiens
tgtgaccaactgtgttgtatta

SEQ ID NO: 4945437 - DNA, 14 bp, Homo sapiens
tgtgacctgagggc

SEQ ID NO: 4945438 - DNA, 14 bp, Homo sapiens
tgtgaccttctcta

SEQ ID NO: 4945439 - DNA, 16 bp, Homo sapiens
tgtgacgcgcaagtct

SEQ ID NO: 4945440 - DNA, 22 bp, Homo sapiens
tgtgactatatagagatgtttt

SEQ ID NO: 4945441 - DNA, 15 bp, Homo sapiens
tgtgacttctccagg

SEQ ID NO: 4945442 - DNA, 22 bp, Homo sapiens
tgtgagattttttattgctagt

SEQ ID NO: 4945443 - DNA, 17 bp, Homo sapiens
tgtgagcccctggtcct

SEQ ID NO: 4945444 - DNA, 14 bp, Homo sapiens
tgtgagccttggct

SEQ ID NO: 4945445 - DNA, 14 bp, Homo sapiens
tgtgaggagctgct

SEQ ID NO: 4945446 - DNA, 14 bp, Homo sapiens
tgtgaggcccctgg

SEQ ID NO: 4945447 - DNA, 22 bp, Homo sapiens
tgtgaggcccctggacaagcag

SEQ ID NO: 4945448 - DNA, 15 bp, Homo sapiens
tgtgagtaaatattg

SEQ ID NO: 4945449 - DNA, 22 bp, Homo sapiens
tgtgagtctttggttctaagga

SEQ ID NO: 4945450 - DNA, 12 bp, Homo sapiens
tgtgagtgtgac

SEQ ID NO: 4945451 - DNA, 13 bp, Homo sapiens
tgtgagtgtgaca

SEQ ID NO: 4945452 - DNA, 17 bp, Homo sapiens
tgtgagtgtgacagggc

SEQ ID NO: 4945453 - DNA, 19 bp, Homo sapiens
tgtgagtgtgtgtttgtgc

SEQ ID NO: 4945454 - DNA, 19 bp, Homo sapiens
tgtgagtttggtctggact

SEQ ID NO: 4945455 - DNA, 21 bp, Homo sapiens
tgtgagtttggtctggactga

SEQ ID NO: 4945456 - DNA, 14 bp, Homo sapiens
tgtgatattaacag

SEQ ID NO: 4945457 - DNA, 19 bp, Homo sapiens
tgtgatattctaagactta

SEQ ID NO: 4945458 - DNA, 14 bp, Homo sapiens
tgtgatgatgtaat

SEQ ID NO: 4945459 - DNA, 16 bp, Homo sapiens
tgtgatgatgtaattg

SEQ ID NO: 4945460 - DNA, 13 bp, Homo sapiens
tgtgatgttctaa

SEQ ID NO: 4945461 - DNA, 16 bp, Homo sapiens
tgtgatgttctaaggc

SEQ ID NO: 4945462 - DNA, 21 bp, Homo sapiens
tgtgattctaatgtcttcatt

SEQ ID NO: 4945463 - DNA, 14 bp, Homo sapiens
tgtgattgtggaat

SEQ ID NO: 4945464 - DNA, 17 bp, Homo sapiens
tgtgattgtggaatgga

SEQ ID NO: 4945465 - DNA, 17 bp, Homo sapiens
tgtgatttagaactgta

SEQ ID NO: 4945466 - DNA, 18 bp, Homo sapiens
tgtgatttagaactgtat

SEQ ID NO: 4945467 - DNA, 15 bp, Homo sapiens
tgtgcaaattaacag

SEQ ID NO: 4945468 - DNA, 22 bp, Homo sapiens
tgtgcacatgcacgtgtgtgca

SEQ ID NO: 4945469 - DNA, 14 bp, Homo sapiens
tgtgcacccatggg

SEQ ID NO: 4945470 - DNA, 21 bp, Homo sapiens
tgtgcaccttaccaactttct

SEQ ID NO: 4945471 - DNA, 19 bp, Homo sapiens
tgtgcaggtgctattgtta

SEQ ID NO: 4945472 - DNA, 21 bp, Homo sapiens
tgtgcaggtgctattgttact

SEQ ID NO: 4945473 - DNA, 15 bp, Homo sapiens
tgtgcatagtgctgg

SEQ ID NO: 4945474 - DNA, 16 bp, Homo sapiens
tgtgcatggaggccct

SEQ ID NO: 4945475 - DNA, 22 bp, Homo sapiens
tgtgcatggaggccctcctgtg

SEQ ID NO: 4945476 - DNA, 16 bp, Homo sapiens
tgtgcatgtgtgtata

SEQ ID NO: 4945477 - DNA, 14 bp, Homo sapiens
tgtgcatttgtaaa

SEQ ID NO: 4945478 - DNA, 17 bp, Homo sapiens
tgtgccaatatgtattg

SEQ ID NO: 4945479 - DNA, 18 bp, Homo sapiens
tgtgccagggcaatgatg

SEQ ID NO: 4945480 - DNA, 12 bp, Homo sapiens
tgtgccatgtgc

SEQ ID NO: 4945481 - DNA, 16 bp, Homo sapiens
tgtgccatgtgccagg

SEQ ID NO: 4945482 - DNA, 16 bp, Homo sapiens
tgtgcctcctcacccc

SEQ ID NO: 4945483 - DNA, 12 bp, Homo sapiens
tgtgcctctgcc

SEQ ID NO: 4945484 - DNA, 14 bp, Homo sapiens
tgtgcctctgcctg

SEQ ID NO: 4945485 - DNA, 15 bp, Homo sapiens
tgtgcctctgcctgt

SEQ ID NO: 4945486 - DNA, 21 bp, Homo sapiens
tgtgcctgggggagttttcct

SEQ ID NO: 4945487 - DNA, 16 bp, Homo sapiens
tgtgccttcttttgat

SEQ ID NO: 4945488 - DNA, 16 bp, Homo sapiens
tgtgcctttgcaaatc

SEQ ID NO: 4945489 - DNA, 18 bp, Homo sapiens
tgtgcctttgcaaatcag

SEQ ID NO: 4945490 - DNA, 15 bp, Homo sapiens
tgtgccttttatagc

SEQ ID NO: 4945491 - DNA, 14 bp, Homo sapiens
tgtgctaaatatca

SEQ ID NO: 4945492 - DNA, 23 bp, Homo sapiens
tgtgctaaccacgtctgtcttca

SEQ ID NO: 4945493 - DNA, 18 bp, Homo sapiens
tgtgctagaatacttttt

SEQ ID NO: 4945494 - DNA, 22 bp, Homo sapiens
tgtgctcagagacctgaagtgt

SEQ ID NO: 4945495 - DNA, 16 bp, Homo sapiens
tgtgctcctccttggt

SEQ ID NO: 4945496 - DNA, 14 bp, Homo sapiens
tgggaacctcccag

SEQ ID NO: 4945497 - DNA, 21 bp, Homo sapiens
tgggaacgcagatgatccatg

SEQ ID NO: 4945498 - DNA, 22 bp, Homo sapiens
tgggaactctgacaagggctga

SEQ ID NO: 4945499 - DNA, 18 bp, Homo sapiens
tgggaagacgcctgagct

SEQ ID NO: 4945500 - DNA, 19 bp, Homo sapiens
tgggaagacgcctgagctc

SEQ ID NO: 4945501 - DNA, 21 bp, Homo sapiens
tgggaagacgcctgagctcac

SEQ ID NO: 4945502 - DNA, 16 bp, Homo sapiens
tgggaataattgcttt

SEQ ID NO: 4945503 - DNA, 22 bp, Homo sapiens
tgggacagtttatcatgaagcc

SEQ ID NO: 4945504 - DNA, 15 bp, Homo sapiens
tgggactacaggcac

SEQ ID NO: 4945505 - DNA, 16 bp, Homo sapiens
tgggactacaggtgtg

SEQ ID NO: 4945506 - DNA, 18 bp, Homo sapiens
tgggactcaatgcactga

SEQ ID NO: 4945507 - DNA, 20 bp, Homo sapiens
tgggactgagcctggcccat

SEQ ID NO: 4945508 - DNA, 21 bp, Homo sapiens
tgggagacaagaaatccctgt

SEQ ID NO: 4945509 - DNA, 20 bp, Homo sapiens
tgtaatttagggtactaaat

SEQ ID NO: 4945510 - DNA, 18 bp, Homo sapiens
tgtacaatgtacacactg

SEQ ID NO: 4945511 - DNA, 16 bp, Homo sapiens
tgtacataaaagaatt

SEQ ID NO: 4945512 - DNA, 18 bp, Homo sapiens
tgtacataaaagaatttt

SEQ ID NO: 4945513 - DNA, 14 bp, Homo sapiens
tgtacataaacaat

SEQ ID NO: 4945514 - DNA, 14 bp, Homo sapiens
tgtacataactctg

SEQ ID NO: 4945515 - DNA, 23 bp, Homo sapiens
tgtacataactctgtaaaaacac

SEQ ID NO: 4945516 - DNA, 22 bp, Homo sapiens
tgtacataatgcttaatttcta

SEQ ID NO: 4945517 - DNA, 21 bp, Homo sapiens
tgtacataccctggccgcccc

SEQ ID NO: 4945518 - DNA, 18 bp, Homo sapiens
tgtacatatttgtggaat

SEQ ID NO: 4945519 - DNA, 18 bp, Homo sapiens
tgtacatctattttggat

SEQ ID NO: 4945520 - DNA, 19 bp, Homo sapiens
tgtacatctattttggatt

SEQ ID NO: 4945521 - DNA, 14 bp, Homo sapiens
tgtacatctggctt

SEQ ID NO: 4945522 - DNA, 17 bp, Homo sapiens
tgtacatctggcttatt

SEQ ID NO: 4945523 - DNA, 15 bp, Homo sapiens
tgtacatgtgtagcc

SEQ ID NO: 4945524 - DNA, 20 bp, Homo sapiens
tgtacatgtgtagcctgtgc

SEQ ID NO: 4945525 - DNA, 14 bp, Homo sapiens
tgtacatttaaaat

SEQ ID NO: 4945526 - DNA, 20 bp, Homo sapiens
tgtacatttatgatttaata

SEQ ID NO: 4945527 - DNA, 19 bp, Homo sapiens
tgtacattttgttgtaaaa

SEQ ID NO: 4945528 - DNA, 21 bp, Homo sapiens
tgtacattttgttgtaaaaag

SEQ ID NO: 4945529 - DNA, 22 bp, Homo sapiens
tgtacattttgttgtaaaaaga

SEQ ID NO: 4945530 - DNA, 21 bp, Homo sapiens
tgtaccaggaaaggattttat

SEQ ID NO: 4945531 - DNA, 19 bp, Homo sapiens
tgtacctgtgtacataact

SEQ ID NO: 4945532 - DNA, 19 bp, Homo sapiens
tgtactagtactgtgtact

SEQ ID NO: 4945533 - DNA, 19 bp, Homo sapiens
tgtactatggaaaatcagc

SEQ ID NO: 4945534 - DNA, 12 bp, Homo sapiens
tgtactgaaaaa

SEQ ID NO: 4945535 - DNA, 20 bp, Homo sapiens
tgtactgaaaaatggtaatt

SEQ ID NO: 4945536 - DNA, 15 bp, Homo sapiens
tgtactgacttgagg

SEQ ID NO: 4945537 - DNA, 17 bp, Homo sapiens
tgtactgtatagacagt

SEQ ID NO: 4945538 - DNA, 15 bp, Homo sapiens
tgtactgttctgtgt

SEQ ID NO: 4945539 - DNA, 16 bp, Homo sapiens
tgtacttttaaggcag

SEQ ID NO: 4945540 - DNA, 13 bp, Homo sapiens
tgtagaagcattc

SEQ ID NO: 4945541 - DNA, 16 bp, Homo sapiens
tgtagaagcattcctt

SEQ ID NO: 4945542 - DNA, 17 bp, Homo sapiens
tgtagaagcattccttc

SEQ ID NO: 4945543 - DNA, 22 bp, Homo sapiens
tgtagaagcattccttctttga

SEQ ID NO: 4945544 - DNA, 18 bp, Homo sapiens
tgtagaatgatttcatgc

SEQ ID NO: 4945545 - DNA, 12 bp, Homo sapiens
tgtagactatat

SEQ ID NO: 4945546 - DNA, 17 bp, Homo sapiens
tgtagactatatacatg

SEQ ID NO: 4945547 - DNA, 12 bp, Homo sapiens
tgtagagccagg

SEQ ID NO: 4945548 - DNA, 16 bp, Homo sapiens
tgtagagccagggtct

SEQ ID NO: 4945549 - DNA, 13 bp, Homo sapiens
tgtagagttaaga

SEQ ID NO: 4945550 - DNA, 15 bp, Homo sapiens
tgtagagttaagaag

SEQ ID NO: 4945551 - DNA, 18 bp, Homo sapiens
tgtagagttaagaagctg

SEQ ID NO: 4945552 - DNA, 19 bp, Homo sapiens
tgtagagttaagaagctgt

SEQ ID NO: 4945553 - DNA, 12 bp, Homo sapiens
tgtagatgatgt

SEQ ID NO: 4945554 - DNA, 15 bp, Homo sapiens
tgtagattctgtgga

SEQ ID NO: 4945555 - DNA, 20 bp, Homo sapiens
tgtagccaggtatggctctg

SEQ ID NO: 4945556 - DNA, 21 bp, Homo sapiens
tgtagccaggtatggctctgc

SEQ ID NO: 4945557 - DNA, 16 bp, Homo sapiens
tgtagcctgtgcatgt

SEQ ID NO: 4945558 - DNA, 21 bp, Homo sapiens
tgtagcgtgtttacatgtgta

SEQ ID NO: 4945559 - DNA, 20 bp, Homo sapiens
tgtagctctgcatctcctgt

SEQ ID NO: 4945560 - DNA, 14 bp, Homo sapiens
tgtagctgtaaaac

SEQ ID NO: 4945561 - DNA, 18 bp, Homo sapiens
tgtaggagacttgccaga

SEQ ID NO: 4945562 - DNA, 12 bp, Homo sapiens
tgtaggagctgc

SEQ ID NO: 4945563 - DNA, 15 bp, Homo sapiens
tgtaggagctgcctt

SEQ ID NO: 4945564 - DNA, 18 bp, Homo sapiens
tgtaggcatcatgcatgt

SEQ ID NO: 4945565 - DNA, 16 bp, Homo sapiens
tgtagtaattgacatg

SEQ ID NO: 4945566 - DNA, 18 bp, Homo sapiens
tgtagtaattgacatgtg

SEQ ID NO: 4945567 - DNA, 21 bp, Homo sapiens
tgtagtagcgttttttaaatg

SEQ ID NO: 4945568 - DNA, 17 bp, Homo sapiens
tgtagttaatttatcta

SEQ ID NO: 4945569 - DNA, 18 bp, Homo sapiens
tgtagttaatttatctaa

SEQ ID NO: 4945570 - DNA, 14 bp, Homo sapiens
tgtagttaggaaat

SEQ ID NO: 4945571 - DNA, 15 bp, Homo sapiens
tgtagttctaagact

SEQ ID NO: 4945572 - DNA, 17 bp, Homo sapiens
tgtagttgatgtatcca

SEQ ID NO: 4945573 - DNA, 21 bp, Homo sapiens
tgtagttgttcgttggttata

SEQ ID NO: 4945574 - DNA, 19 bp, Homo sapiens
tgtagtttacctctttaaa

SEQ ID NO: 4945575 - DNA, 23 bp, Homo sapiens
tgtagttttattttatgtttaga

SEQ ID NO: 4945576 - DNA, 19 bp, Homo sapiens
tgtataaagcaactgttat

SEQ ID NO: 4945577 - DNA, 14 bp, Homo sapiens
tgtataaataggag

SEQ ID NO: 4945578 - DNA, 18 bp, Homo sapiens
tgtataaatgtatataca

SEQ ID NO: 4945579 - DNA, 14 bp, Homo sapiens
tgtataaatgtgat

SEQ ID NO: 4945580 - DNA, 16 bp, Homo sapiens
tgtataagcactgaaa

SEQ ID NO: 4945581 - DNA, 16 bp, Homo sapiens
tgtataagtgcacaca

SEQ ID NO: 4945582 - DNA, 22 bp, Homo sapiens
tgtataagtgcacacagaaata

SEQ ID NO: 4945583 - DNA, 12 bp, Homo sapiens
tgtatacaaata

SEQ ID NO: 4945584 - DNA, 13 bp, Homo sapiens
tgtatacaaatat

SEQ ID NO: 4945585 - DNA, 16 bp, Homo sapiens
tgtatacaaccctggc

SEQ ID NO: 4945586 - DNA, 15 bp, Homo sapiens
tgtatactatagtac

SEQ ID NO: 4945587 - DNA, 19 bp, Homo sapiens
tgtatactatagtaccagt

SEQ ID NO: 4945588 - DNA, 11 bp, Homo sapiens
tgtatacttta

SEQ ID NO: 4945589 - DNA, 13 bp, Homo sapiens
tgtatactttaaa

SEQ ID NO: 4945590 - DNA, 16 bp, Homo sapiens
tgtatactttaaataa

SEQ ID NO: 4945591 - DNA, 15 bp, Homo sapiens
tgtatagtgtaaaat

SEQ ID NO: 4945592 - DNA, 18 bp, Homo sapiens
tgtatatacacatatacc

SEQ ID NO: 4945593 - DNA, 19 bp, Homo sapiens
tgtatatacacatatacct

SEQ ID NO: 4945594 - DNA, 20 bp, Homo sapiens
tgtatatacacatataccta

SEQ ID NO: 4945595 - DNA, 12 bp, Homo sapiens
tgtatatacttt

SEQ ID NO: 4945596 - DNA, 14 bp, Homo sapiens
tgtatatagttttt

SEQ ID NO: 4945597 - DNA, 18 bp, Homo sapiens
tgtatatatacatacact

SEQ ID NO: 4945598 - DNA, 18 bp, Homo sapiens
tgtatatatttagtgctg

SEQ ID NO: 4945599 - DNA, 15 bp, Homo sapiens
tgtatattatttggc

SEQ ID NO: 4945600 - DNA, 16 bp, Homo sapiens
tgtatattatttggca

SEQ ID NO: 4945601 - DNA, 21 bp, Homo sapiens
tgtatattatttggcagtttg

SEQ ID NO: 4945602 - DNA, 23 bp, Homo sapiens
tgtatcccatgagcctcagcatc

SEQ ID NO: 4945603 - DNA, 22 bp, Homo sapiens
tgtatcccccccctgtatagtt

SEQ ID NO: 4945604 - DNA, 20 bp, Homo sapiens
tgtatcccttctcacagcac

SEQ ID NO: 4945605 - DNA, 21 bp, Homo sapiens
tgtatctctgaagcatgtttc

SEQ ID NO: 4945606 - DNA, 22 bp, Homo sapiens
tgtatctctgaagcatgtttca

SEQ ID NO: 4945607 - DNA, 23 bp, Homo sapiens
tgtatctgagttgccaagacaaa

SEQ ID NO: 4945608 - DNA, 18 bp, Homo sapiens
tgtatcttccatatttgg

SEQ ID NO: 4945609 - DNA, 21 bp, Homo sapiens
tgtatcttccatatttggaag

SEQ ID NO: 4945610 - DNA, 14 bp, Homo sapiens
tgtatgaaggcttt

SEQ ID NO: 4945611 - DNA, 12 bp, Homo sapiens
tgctgattttaa

SEQ ID NO: 4945612 - DNA, 20 bp, Homo sapiens
tgctgccacaaccagccagg

SEQ ID NO: 4945613 - DNA, 13 bp, Homo sapiens
tgctgccatccag

SEQ ID NO: 4945614 - DNA, 15 bp, Homo sapiens
tgctgccatccaggt

SEQ ID NO: 4945615 - DNA, 16 bp, Homo sapiens
tgctgcccagcctcca

SEQ ID NO: 4945616 - DNA, 14 bp, Homo sapiens
tgctgcctccagaa

SEQ ID NO: 4945617 - DNA, 14 bp, Homo sapiens
tgctgcctgaatcc

SEQ ID NO: 4945618 - DNA, 23 bp, Homo sapiens
tgctgcctgcccgcacagcagcc

SEQ ID NO: 4945619 - DNA, 14 bp, Homo sapiens
tgctgcctggccac

SEQ ID NO: 4945620 - DNA, 18 bp, Homo sapiens
tgctgcctggccactgct

SEQ ID NO: 4945621 - DNA, 20 bp, Homo sapiens
tgctgccttctgacggccct

SEQ ID NO: 4945622 - DNA, 23 bp, Homo sapiens
tgctgccttctgacggccctgca

SEQ ID NO: 4945623 - DNA, 13 bp, Homo sapiens
tgctgctgtccct

SEQ ID NO: 4945624 - DNA, 16 bp, Homo sapiens
tgctggacgtctttct

SEQ ID NO: 4945625 - DNA, 14 bp, Homo sapiens
tgctggaggtggga

SEQ ID NO: 4945626 - DNA, 15 bp, Homo sapiens
tgctggaggtgggag

SEQ ID NO: 4945627 - DNA, 22 bp, Homo sapiens
tgctggaggtgggagcaggaga

SEQ ID NO: 4945628 - DNA, 20 bp, Homo sapiens
tgctggagtttcatgtacaa

SEQ ID NO: 4945629 - DNA, 17 bp, Homo sapiens
tgctggatggagcccag

SEQ ID NO: 4945630 - DNA, 20 bp, Homo sapiens
tggacctgcctcctgcctgc

SEQ ID NO: 4945631 - DNA, 21 bp, Homo sapiens
tggaccttaggccttcctctc

SEQ ID NO: 4945632 - DNA, 20 bp, Homo sapiens
tggaccttgaactgggtact

SEQ ID NO: 4945633 - DNA, 13 bp, Homo sapiens
tggaccttttaaa

SEQ ID NO: 4945634 - DNA, 15 bp, Homo sapiens
tggaccttttaaagt

SEQ ID NO: 4945635 - DNA, 21 bp, Homo sapiens
tggactaaccccaacgcacag

SEQ ID NO: 4945636 - DNA, 15 bp, Homo sapiens
tggactcctctgtcc

SEQ ID NO: 4945637 - DNA, 17 bp, Homo sapiens
tggactctaaagaccaa

SEQ ID NO: 4945638 - DNA, 17 bp, Homo sapiens
tggactctgcacatgtc

SEQ ID NO: 4945639 - DNA, 22 bp, Homo sapiens
tggactctgcacatgtcttgta

SEQ ID NO: 4945640 - DNA, 13 bp, Homo sapiens
tggactcttcaaa

SEQ ID NO: 4945641 - DNA, 14 bp, Homo sapiens
tggactgacagcat

SEQ ID NO: 4945642 - DNA, 23 bp, Homo sapiens
tggactgacagcatgtgccctcc

SEQ ID NO: 4945643 - DNA, 14 bp, Homo sapiens
tggactggaagggg

SEQ ID NO: 4945644 - DNA, 16 bp, Homo sapiens
tggactggcccctggg

SEQ ID NO: 4945645 - DNA, 18 bp, Homo sapiens
tggacttagaaagcaggg

SEQ ID NO: 4945646 - DNA, 20 bp, Homo sapiens
tggacttagaaagcaggggc

SEQ ID NO: 4945647 - DNA, 12 bp, Homo sapiens
tggactttcaaa

SEQ ID NO: 4945648 - DNA, 15 bp, Homo sapiens
tggactttggaagca

SEQ ID NO: 4945649 - DNA, 15 bp, Homo sapiens
tggagaaattattta

SEQ ID NO: 4945650 - DNA, 17 bp, Homo sapiens
tggagaaattatttaat

SEQ ID NO: 4945651 - DNA, 21 bp, Homo sapiens
tggagaaattatttaataaaa

SEQ ID NO: 4945652 - DNA, 19 bp, Homo sapiens
tggagaagagaggagagga

SEQ ID NO: 4945653 - DNA, 14 bp, Homo sapiens
tggagaattatata

SEQ ID NO: 4945654 - DNA, 19 bp, Homo sapiens
tggagaattgctgaagggc

SEQ ID NO: 4945655 - DNA, 17 bp, Homo sapiens
tggagacagccccagag

SEQ ID NO: 4945656 - DNA, 19 bp, Homo sapiens
tggagacagccccagagca

SEQ ID NO: 4945657 - DNA, 18 bp, Homo sapiens
tggagaccagggagcctt

SEQ ID NO: 4945658 - DNA, 22 bp, Homo sapiens
tggagacccaccccacctgcag

SEQ ID NO: 4945659 - DNA, 23 bp, Homo sapiens
tggagacgtggaacctctgtctc

SEQ ID NO: 4945660 - DNA, 17 bp, Homo sapiens
tggagactgtctcaaga

SEQ ID NO: 4945661 - DNA, 15 bp, Homo sapiens
tggagagaaggcctc

SEQ ID NO: 4945662 - DNA, 11 bp, Homo sapiens
tggagagctgg

SEQ ID NO: 4945663 - DNA, 14 bp, Homo sapiens
tggagagctggtgc

SEQ ID NO: 4945664 - DNA, 11 bp, Homo sapiens
tggagaggaac

SEQ ID NO: 4945665 - DNA, 19 bp, Homo sapiens
tggagagggctctgtgctg

SEQ ID NO: 4945666 - DNA, 16 bp, Homo sapiens
tggagatactggtgga

SEQ ID NO: 4945667 - DNA, 13 bp, Homo sapiens
tggagcagaccac

SEQ ID NO: 4945668 - DNA, 17 bp, Homo sapiens
tggagcatgggcctggc

SEQ ID NO: 4945669 - DNA, 17 bp, Homo sapiens
tggagccaatggagact

SEQ ID NO: 4945670 - DNA, 22 bp, Homo sapiens
tggagcccaggcgggagcggtg

SEQ ID NO: 4945671 - DNA, 19 bp, Homo sapiens
tggagcctggcacaggact

SEQ ID NO: 4945672 - DNA, 18 bp, Homo sapiens
tggagcggggtatgaaga

SEQ ID NO: 4945673 - DNA, 12 bp, Homo sapiens
tggagctcagcc

SEQ ID NO: 4945674 - DNA, 13 bp, Homo sapiens
tggagctcagccc

SEQ ID NO: 4945675 - DNA, 22 bp, Homo sapiens
tggagctcagccccgagctgtc

SEQ ID NO: 4945676 - DNA, 19 bp, Homo sapiens
tggaggaacaactctccag

SEQ ID NO: 4945677 - DNA, 18 bp, Homo sapiens
tggaggaaggattgtaaa

SEQ ID NO: 4945678 - DNA, 19 bp, Homo sapiens
tggaggaaggattgtaaaa

SEQ ID NO: 4945679 - DNA, 19 bp, Homo sapiens
tggaggccttccagctgct

SEQ ID NO: 4945680 - DNA, 16 bp, Homo sapiens
tggaggggagtgttgg

SEQ ID NO: 4945681 - DNA, 14 bp, Homo sapiens
tggagtatgtctga

SEQ ID NO: 4945682 - DNA, 21 bp, Homo sapiens
tggagtcccctcacctcctct

SEQ ID NO: 4945683 - DNA, 18 bp, Homo sapiens
tggagtctggagtgggca

SEQ ID NO: 4945684 - DNA, 14 bp, Homo sapiens
tggagtgcagtgag

SEQ ID NO: 4945685 - DNA, 18 bp, Homo sapiens
tggagtgcccaccctggg

SEQ ID NO: 4945686 - DNA, 17 bp, Homo sapiens
tggagtgtggctgagga

SEQ ID NO: 4945687 - DNA, 15 bp, Homo sapiens
tggagttcttgtgcc

SEQ ID NO: 4945688 - DNA, 17 bp, Homo sapiens
tggagtttctaaggtcc

SEQ ID NO: 4945689 - DNA, 22 bp, Homo sapiens
tggagtttttgtttggagagca

SEQ ID NO: 4945690 - DNA, 16 bp, Homo sapiens
tggataggagcctgct

SEQ ID NO: 4945691 - DNA, 15 bp, Homo sapiens
tggatataaaatgtg

SEQ ID NO: 4945692 - DNA, 17 bp, Homo sapiens
tggatattattagaaat

SEQ ID NO: 4945693 - DNA, 20 bp, Homo sapiens
tggatcacgacgctgcagag

SEQ ID NO: 4945694 - DNA, 16 bp, Homo sapiens
tggatcttttcattct

SEQ ID NO: 4945695 - DNA, 20 bp, Homo sapiens
tggatgccaatattaaatct

SEQ ID NO: 4945696 - DNA, 18 bp, Homo sapiens
tggatgcctggtggcagc

SEQ ID NO: 4945697 - DNA, 13 bp, Homo sapiens
tggattaaattta

SEQ ID NO: 4945698 - DNA, 13 bp, Homo sapiens
tggattatttaat

SEQ ID NO: 4945699 - DNA, 18 bp, Homo sapiens
tggattatttaataacat

SEQ ID NO: 4945700 - DNA, 17 bp, Homo sapiens
tggattcattctcataa

SEQ ID NO: 4945701 - DNA, 23 bp, Homo sapiens
tggattggattatttaataacat

SEQ ID NO: 4945702 - DNA, 13 bp, Homo sapiens
tggatttgacatt

SEQ ID NO: 4945703 - DNA, 16 bp, Homo sapiens
tggcaaaagccttgtg

SEQ ID NO: 4945704 - DNA, 13 bp, Homo sapiens
tggcaagctgtga

SEQ ID NO: 4945705 - DNA, 15 bp, Homo sapiens
tggcaagtcacatgc

SEQ ID NO: 4945706 - DNA, 22 bp, Homo sapiens
tggcaagttttgatatgagtat

SEQ ID NO: 4945707 - DNA, 15 bp, Homo sapiens
tggcaatattcctta

SEQ ID NO: 4945708 - DNA, 13 bp, Homo sapiens
tggcaattgtcta

SEQ ID NO: 4945709 - DNA, 13 bp, Homo sapiens
tggcaattttgta

SEQ ID NO: 4945710 - DNA, 13 bp, Homo sapiens
tggcacaggactg

SEQ ID NO: 4945711 - DNA, 14 bp, Homo sapiens
tggcacaggactga

SEQ ID NO: 4945712 - DNA, 16 bp, Homo sapiens
tggcacagggcagtgg

SEQ ID NO: 4945713 - DNA, 21 bp, Homo sapiens
tggcaccactgcactccagcc

SEQ ID NO: 4945714 - DNA, 20 bp, Homo sapiens
tggcacccggcccctgctgg

SEQ ID NO: 4945715 - DNA, 21 bp, Homo sapiens
tggcacccggcccctgctggt

SEQ ID NO: 4945716 - DNA, 20 bp, Homo sapiens
tggcacggtggctcaggcct

SEQ ID NO: 4945717 - DNA, 21 bp, Homo sapiens
tggcacttagctatcagaaga

SEQ ID NO: 4945718 - DNA, 15 bp, Homo sapiens
tggcacttatcatta

SEQ ID NO: 4945719 - DNA, 18 bp, Homo sapiens
tggcacttgcctgggtca

SEQ ID NO: 4945720 - DNA, 18 bp, Homo sapiens
tggcagaagacaccagag

SEQ ID NO: 4945721 - DNA, 18 bp, Homo sapiens
tggcagaagggagcagca

SEQ ID NO: 4945722 - DNA, 21 bp, Homo sapiens
tggcagaagggagcagcacac

SEQ ID NO: 4945723 - DNA, 20 bp, Homo sapiens
tggcagaataatctttgggt

SEQ ID NO: 4945724 - DNA, 13 bp, Homo sapiens
tggcagagagaga

SEQ ID NO: 4945725 - DNA, 17 bp, Homo sapiens
tggcagagtttgtgtgt

SEQ ID NO: 4945726 - DNA, 18 bp, Homo sapiens
tggcagagtttgtgtgtt

SEQ ID NO: 4945727 - DNA, 21 bp, Homo sapiens
tggcagataatcagcctctta

SEQ ID NO: 4945728 - DNA, 12 bp, Homo sapiens
tggcagcccaga

SEQ ID NO: 4945729 - DNA, 17 bp, Homo sapiens
tggcagccgtgccttca

SEQ ID NO: 4945730 - DNA, 19 bp, Homo sapiens
tggcagccgtgccttcagc

SEQ ID NO: 4945731 - DNA, 20 bp, Homo sapiens
tggcagccgtgccttcagct

SEQ ID NO: 4945732 - DNA, 21 bp, Homo sapiens
tggcagctgcggtccacccag

SEQ ID NO: 4945733 - DNA, 23 bp, Homo sapiens
tggcagctgcggtccacccagga

SEQ ID NO: 4945734 - DNA, 21 bp, Homo sapiens
tggcagggctggccccagggc

SEQ ID NO: 4945735 - DNA, 14 bp, Homo sapiens
tggcagtgagtgag

SEQ ID NO: 4945736 - DNA, 18 bp, Homo sapiens
tggcagtgagtgagcctg

SEQ ID NO: 4945737 - DNA, 12 bp, Homo sapiens
tggcagtggagg

SEQ ID NO: 4945738 - DNA, 20 bp, Homo sapiens
tggcagtgggagctgcctgt

SEQ ID NO: 4945739 - DNA, 23 bp, Homo sapiens
tggcatcaagaggtgggagggcc

SEQ ID NO: 4945740 - DNA, 17 bp, Homo sapiens
tgactatatagagatgt

SEQ ID NO: 4945741 - DNA, 21 bp, Homo sapiens
tgactatatagagatgttttt

SEQ ID NO: 4945742 - DNA, 13 bp, Homo sapiens
tgactatgtaaac

SEQ ID NO: 4945743 - DNA, 13 bp, Homo sapiens
tgactattctgta

SEQ ID NO: 4945744 - DNA, 20 bp, Homo sapiens
tgactattctgtatctttca

SEQ ID NO: 4945745 - DNA, 19 bp, Homo sapiens
tgactccacgatcctgcca

SEQ ID NO: 4945746 - DNA, 20 bp, Homo sapiens
tgactccacgatcctgccac

SEQ ID NO: 4945747 - DNA, 15 bp, Homo sapiens
tgactctgccccctg

SEQ ID NO: 4945748 - DNA, 18 bp, Homo sapiens
tgactctgccccctgctg

SEQ ID NO: 4945749 - DNA, 20 bp, Homo sapiens
tgactgatgctgagattctt

SEQ ID NO: 4945750 - DNA, 20 bp, Homo sapiens
tgactgctccccagccctgg

SEQ ID NO: 4945751 - DNA, 23 bp, Homo sapiens
tgactgctccccagccctggctc

SEQ ID NO: 4945752 - DNA, 15 bp, Homo sapiens
tgactgctgattctc

SEQ ID NO: 4945753 - DNA, 21 bp, Homo sapiens
tgactggtttacaggccctgc

SEQ ID NO: 4945754 - DNA, 15 bp, Homo sapiens
tgactgtatctgtgt

SEQ ID NO: 4945755 - DNA, 16 bp, Homo sapiens
tgactgtatctgtgta

SEQ ID NO: 4945756 - DNA, 13 bp, Homo sapiens
tgactgtcactgt

SEQ ID NO: 4945757 - DNA, 16 bp, Homo sapiens
tgactgtgctactgtc

SEQ ID NO: 4945758 - DNA, 19 bp, Homo sapiens
tgacttaagcaaaagaaaa

SEQ ID NO: 4945759 - DNA, 14 bp, Homo sapiens
tgacttatagtaca

SEQ ID NO: 4945760 - DNA, 14 bp, Homo sapiens
tgacttatgggccc

SEQ ID NO: 4945761 - DNA, 23 bp, Homo sapiens
tgacttcaatgatagtaagaaaa

SEQ ID NO: 4945762 - DNA, 13 bp, Homo sapiens
tgacttcatggaa

SEQ ID NO: 4945763 - DNA, 20 bp, Homo sapiens
tgacttctaatatcattcac

SEQ ID NO: 4945764 - DNA, 16 bp, Homo sapiens
tgacttctccaggtct

SEQ ID NO: 4945765 - DNA, 18 bp, Homo sapiens
tgacttgtttgtcttcca

SEQ ID NO: 4945766 - DNA, 18 bp, Homo sapiens
tgagaaaaagctcctgtc

SEQ ID NO: 4945767 - DNA, 14 bp, Homo sapiens
tgagaaaacaagca

SEQ ID NO: 4945768 - DNA, 15 bp, Homo sapiens
tgagaacaaagctgt

SEQ ID NO: 4945769 - DNA, 23 bp, Homo sapiens
tgagaacaaagctgttaaactgt

SEQ ID NO: 4945770 - DNA, 13 bp, Homo sapiens
tgagaagccttca

SEQ ID NO: 4945771 - DNA, 14 bp, Homo sapiens
tgcccaggctccat

SEQ ID NO: 4945772 - DNA, 19 bp, Homo sapiens
tgcccaggctggcgtgcag

SEQ ID NO: 4945773 - DNA, 20 bp, Homo sapiens
tgcccaggctggcgtgcagt

SEQ ID NO: 4945774 - DNA, 16 bp, Homo sapiens
tgcccatgggagctgg

SEQ ID NO: 4945775 - DNA, 15 bp, Homo sapiens
tgccccagggctccc

SEQ ID NO: 4945776 - DNA, 14 bp, Homo sapiens
tgccccctgctggc

SEQ ID NO: 4945777 - DNA, 17 bp, Homo sapiens
tgccccggccacctctg

SEQ ID NO: 4945778 - DNA, 22 bp, Homo sapiens
tgcccctcccccaacccccacc

SEQ ID NO: 4945779 - DNA, 13 bp, Homo sapiens
tgcccctcccttc

SEQ ID NO: 4945780 - DNA, 15 bp, Homo sapiens
tgcccctcccttcaa

SEQ ID NO: 4945781 - DNA, 16 bp, Homo sapiens
tgcccctcccttcaac

SEQ ID NO: 4945782 - DNA, 15 bp, Homo sapiens
tgcccctctcaccaa

SEQ ID NO: 4945783 - DNA, 15 bp, Homo sapiens
tgcccctctccttct

SEQ ID NO: 4945784 - DNA, 14 bp, Homo sapiens
tgcccctctttctc

SEQ ID NO: 4945785 - DNA, 15 bp, Homo sapiens
tgcccctctttctct

SEQ ID NO: 4945786 - DNA, 16 bp, Homo sapiens
tgcccgcacaccctca

SEQ ID NO: 4945787 - DNA, 23 bp, Homo sapiens
tgcccggagattggacggcctga

SEQ ID NO: 4945788 - DNA, 20 bp, Homo sapiens
tgcccgggcgcggccagccc

SEQ ID NO: 4945789 - DNA, 22 bp, Homo sapiens
tgcccgggcgcggccagccccg

SEQ ID NO: 4945790 - DNA, 14 bp, Homo sapiens
tgcccgttcttgaa

SEQ ID NO: 4945791 - DNA, 19 bp, Homo sapiens
tgccctactcattggggtt

SEQ ID NO: 4945792 - DNA, 23 bp, Homo sapiens
tgccctcatggcccctctgacct

SEQ ID NO: 4945793 - DNA, 19 bp, Homo sapiens
tgccctcattactgggcct

SEQ ID NO: 4945794 - DNA, 18 bp, Homo sapiens
tgccctcattttatgtca

SEQ ID NO: 4945795 - DNA, 19 bp, Homo sapiens
tgccctccttgtccaccca

SEQ ID NO: 4945796 - DNA, 15 bp, Homo sapiens
tgccctctccttcct

SEQ ID NO: 4945797 - DNA, 17 bp, Homo sapiens
tgccctctccttcctta

SEQ ID NO: 4945798 - DNA, 11 bp, Homo sapiens
tgccctgctgc

SEQ ID NO: 4945799 - DNA, 21 bp, Homo sapiens
tgccctgctgccgcctcccag

SEQ ID NO: 4945800 - DNA, 16 bp, Homo sapiens
tgccctggtgctgcca

SEQ ID NO: 4945801 - DNA, 15 bp, Homo sapiens
tgccctggtttcact

SEQ ID NO: 4945802 - DNA, 17 bp, Homo sapiens
tgccctggtttcactgg

SEQ ID NO: 4945803 - DNA, 13 bp, Homo sapiens
tgcccttaggcca

SEQ ID NO: 4945804 - DNA, 20 bp, Homo sapiens
tgcccttcaccccagtggcc

SEQ ID NO: 4945805 - DNA, 13 bp, Homo sapiens
tgccgcctcccag

SEQ ID NO: 4945806 - DNA, 16 bp, Homo sapiens
tgccgcctgcactcct

SEQ ID NO: 4945807 - DNA, 19 bp, Homo sapiens
tgccgtgtgagtgtgacag

SEQ ID NO: 4945808 - DNA, 18 bp, Homo sapiens
tgcctaataaacatcctt

SEQ ID NO: 4945809 - DNA, 17 bp, Homo sapiens
tgcctagcaagctggcc

SEQ ID NO: 4945810 - DNA, 20 bp, Homo sapiens
tgcctagcaagctggcctct

SEQ ID NO: 4945811 - DNA, 14 bp, Homo sapiens
tgcctcctgcctgc

SEQ ID NO: 4945812 - DNA, 18 bp, Homo sapiens
tgcctcctgcctgcccct

SEQ ID NO: 4945813 - DNA, 14 bp, Homo sapiens
tgcctcctgtgggg

SEQ ID NO: 4945814 - DNA, 20 bp, Homo sapiens
tgcctcctgtgtactgtgtc

SEQ ID NO: 4945815 - DNA, 13 bp, Homo sapiens
tgcctctcacaca

SEQ ID NO: 4945816 - DNA, 16 bp, Homo sapiens
tgcctctgacacacag

SEQ ID NO: 4945817 - DNA, 20 bp, Homo sapiens
tgcctctgacacacagctct

SEQ ID NO: 4945818 - DNA, 19 bp, Homo sapiens
tgcctctgatatgggactg

SEQ ID NO: 4945819 - DNA, 12 bp, Homo sapiens
tgcctctgcctc

SEQ ID NO: 4945820 - DNA, 14 bp, Homo sapiens
tgcctctgcctctg

SEQ ID NO: 4945821 - DNA, 17 bp, Homo sapiens
tgcctctgcctctgaca

SEQ ID NO: 4945822 - DNA, 18 bp, Homo sapiens
tgcctctgcctctgacac

SEQ ID NO: 4945823 - DNA, 20 bp, Homo sapiens
tgcctctgcctctgacacac

SEQ ID NO: 4945824 - DNA, 14 bp, Homo sapiens
tgcctctgcctgtc

SEQ ID NO: 4945825 - DNA, 22 bp, Homo sapiens
tgcctctgccttagaggagccc

SEQ ID NO: 4945826 - DNA, 24 bp, Homo sapiens
tgcctgcccaggcccctgccaccc

SEQ ID NO: 4945827 - DNA, 18 bp, Homo sapiens
tgcctgcccccctcatct

SEQ ID NO: 4945828 - DNA, 17 bp, Homo sapiens
tgcctgcgtcttccgcc

SEQ ID NO: 4945829 - DNA, 21 bp, Homo sapiens
tgcctggagtgcccaccctgg

SEQ ID NO: 4945830 - DNA, 23 bp, Homo sapiens
tgcctggccactgctccctaagc

SEQ ID NO: 4945831 - DNA, 20 bp, Homo sapiens
tgcctggcctggcacacatc

SEQ ID NO: 4945832 - DNA, 21 bp, Homo sapiens
tgcctgggggagttttcctct

SEQ ID NO: 4945833 - DNA, 16 bp, Homo sapiens
tgcctggtcacagggc

SEQ ID NO: 4945834 - DNA, 19 bp, Homo sapiens
tgcctggtgcactgtgtct

SEQ ID NO: 4945835 - DNA, 13 bp, Homo sapiens
tgcctgtagttag

SEQ ID NO: 4945836 - DNA, 17 bp, Homo sapiens
tgcctgtagttaggaaa

SEQ ID NO: 4945837 - DNA, 20 bp, Homo sapiens
tgcctgtagttaggaaataa

SEQ ID NO: 4945838 - DNA, 16 bp, Homo sapiens
tgcctgtatactttag

SEQ ID NO: 4945839 - DNA, 18 bp, Homo sapiens
tgcctgtccagcctgggc

SEQ ID NO: 4945840 - DNA, 19 bp, Homo sapiens
tgcctgtccagcctgggca

SEQ ID NO: 4945841 - DNA, 20 bp, Homo sapiens
tgcctgtccagcctgggcag

SEQ ID NO: 4945842 - DNA, 17 bp, Homo sapiens
tgcctgttcagctccag

SEQ ID NO: 4945843 - DNA, 14 bp, Homo sapiens
tgcctgttcccatt

SEQ ID NO: 4945844 - DNA, 20 bp, Homo sapiens
tgccttaaaatggaattgaa

SEQ ID NO: 4945845 - DNA, 13 bp, Homo sapiens
tgccttaaagaaa

SEQ ID NO: 4945846 - DNA, 17 bp, Homo sapiens
tgccttagaacctttct

SEQ ID NO: 4945847 - DNA, 14 bp, Homo sapiens
tgccttagaggagc

SEQ ID NO: 4945848 - DNA, 21 bp, Homo sapiens
tgccttaggcctacctgatgg

SEQ ID NO: 4945849 - DNA, 15 bp, Homo sapiens
tgccttagtctcagt

SEQ ID NO: 4945850 - DNA, 16 bp, Homo sapiens
tgccttagtctcagtt

SEQ ID NO: 4945851 - DNA, 13 bp, Homo sapiens
tgccttcagctct

SEQ ID NO: 4945852 - DNA, 17 bp, Homo sapiens
tgccttcagctctacag

SEQ ID NO: 4945853 - DNA, 24 bp, Homo sapiens
tgccttcatggaactcagctgtct

SEQ ID NO: 4945854 - DNA, 16 bp, Homo sapiens
tgccttcctttctcca

SEQ ID NO: 4945855 - DNA, 21 bp, Homo sapiens
tgccttcctttctccaggacc

SEQ ID NO: 4945856 - DNA, 17 bp, Homo sapiens
tgccttctgacggccct

SEQ ID NO: 4945857 - DNA, 16 bp, Homo sapiens
tgccttcttttgatta

SEQ ID NO: 4945858 - DNA, 15 bp, Homo sapiens
tgccttgatgattta

SEQ ID NO: 4945859 - DNA, 19 bp, Homo sapiens
tgccttgcagaactgccat

SEQ ID NO: 4945860 - DNA, 20 bp, Homo sapiens
tgccttgcagaactgccatt

SEQ ID NO: 4945861 - DNA, 17 bp, Homo sapiens
tgccttggcctcccaag

SEQ ID NO: 4945862 - DNA, 16 bp, Homo sapiens
tgccttggctcagaca

SEQ ID NO: 4945863 - DNA, 15 bp, Homo sapiens
tgccttgggctgctc

SEQ ID NO: 4945864 - DNA, 23 bp, Homo sapiens
tgccttggggaggacaaaacttc

SEQ ID NO: 4945865 - DNA, 15 bp, Homo sapiens
tgccttgtgctgtta

SEQ ID NO: 4945866 - DNA, 20 bp, Homo sapiens
tgcctttgagacagtttctt

SEQ ID NO: 4945867 - DNA, 21 bp, Homo sapiens
tgcctttgagacagtttctta

SEQ ID NO: 4945868 - DNA, 21 bp, Homo sapiens
tgcctttttatttatatgtac

SEQ ID NO: 4945869 - DNA, 20 bp, Homo sapiens
tgcctttttcattttccaat

SEQ ID NO: 4945870 - DNA, 13 bp, Homo sapiens
tgcctttttccta

SEQ ID NO: 4945871 - DNA, 22 bp, Homo sapiens
tgcgaatggactttggaagcag

SEQ ID NO: 4945872 - DNA, 21 bp, Homo sapiens
tgcgagcgctatcttcacata

SEQ ID NO: 4945873 - DNA, 13 bp, Homo sapiens
tgcgcctacagga

SEQ ID NO: 4945874 - DNA, 14 bp, Homo sapiens
tgcgcctacaggag

SEQ ID NO: 4945875 - DNA, 14 bp, Homo sapiens
tgcgcctgtgacca

SEQ ID NO: 4945876 - DNA, 19 bp, Homo sapiens
tgcgcctgtgatgctgggc

SEQ ID NO: 4945877 - DNA, 20 bp, Homo sapiens
tgcggacagccacggccagg

SEQ ID NO: 4945878 - DNA, 21 bp, Homo sapiens
tgcggacagccacggccaggc

SEQ ID NO: 4945879 - DNA, 14 bp, Homo sapiens
tgcggaccccagct

SEQ ID NO: 4945880 - DNA, 15 bp, Homo sapiens
tgcgtacgtttcctg

SEQ ID NO: 4945881 - DNA, 23 bp, Homo sapiens
gactgcaggttggaccccagaga

SEQ ID NO: 4945882 - DNA, 20 bp, Homo sapiens
gactgccagtccccctgccc

SEQ ID NO: 4945883 - DNA, 16 bp, Homo sapiens
gactgctagtgttctg

SEQ ID NO: 4945884 - DNA, 20 bp, Homo sapiens
gactgctagtgttctgtcta

SEQ ID NO: 4945885 - DNA, 19 bp, Homo sapiens
gactgctccccagccctgg

SEQ ID NO: 4945886 - DNA, 24 bp, Homo sapiens
gactgctccccagccctggctctg

SEQ ID NO: 4945887 - DNA, 17 bp, Homo sapiens
gactgctgctgcctggc

SEQ ID NO: 4945888 - DNA, 19 bp, Homo sapiens
gactgctgctgcctggcca

SEQ ID NO: 4945889 - DNA, 20 bp, Homo sapiens
gactggaagctaatttgcat

SEQ ID NO: 4945890 - DNA, 16 bp, Homo sapiens
gactggcccctgggtc

SEQ ID NO: 4945891 - DNA, 17 bp, Homo sapiens
gactggctagagtcctc

SEQ ID NO: 4945892 - DNA, 18 bp, Homo sapiens
gactggggatgtgggagg

SEQ ID NO: 4945893 - DNA, 20 bp, Homo sapiens
gactggggatgtgggaggga

SEQ ID NO: 4945894 - DNA, 16 bp, Homo sapiens
gactggggtgggaggt

SEQ ID NO: 4945895 - DNA, 18 bp, Homo sapiens
gactgtactcctcccagg

SEQ ID NO: 4945896 - DNA, 23 bp, Homo sapiens
gactgtactcctcccaggcgccc

SEQ ID NO: 4945897 - DNA, 16 bp, Homo sapiens
gactgtcctctcccct

SEQ ID NO: 4945898 - DNA, 22 bp, Homo sapiens
gactgtcctctcccctccagcc

SEQ ID NO: 4945899 - DNA, 22 bp, Homo sapiens
gactgttagaaaatggacactg

SEQ ID NO: 4945900 - DNA, 14 bp, Homo sapiens
gacttaatgtgatt

SEQ ID NO: 4945901 - DNA, 15 bp, Homo sapiens
gacttaatgtgatta

SEQ ID NO: 4945902 - DNA, 14 bp, Homo sapiens
gacttactctaaga

SEQ ID NO: 4945903 - DNA, 14 bp, Homo sapiens
gacttagaaagcag

SEQ ID NO: 4945904 - DNA, 16 bp, Homo sapiens
gacttagaaagcaggg

SEQ ID NO: 4945905 - DNA, 16 bp, Homo sapiens
gacttatagtacatga

SEQ ID NO: 4945906 - DNA, 13 bp, Homo sapiens
gacttatgggccc

SEQ ID NO: 4945907 - DNA, 18 bp, Homo sapiens
gacttcctcgcctctccc

SEQ ID NO: 4945908 - DNA, 14 bp, Homo sapiens
gacttccttgagac

SEQ ID NO: 4945909 - DNA, 22 bp, Homo sapiens
gacttgccaacaccacagaaat

SEQ ID NO: 4945910 - DNA, 13 bp, Homo sapiens
gacttggaagctc

SEQ ID NO: 4945911 - DNA, 14 bp, Homo sapiens
gacttggaagctcc

SEQ ID NO: 4945912 - DNA, 13 bp, Homo sapiens
gacttgtgtctct

SEQ ID NO: 4945913 - DNA, 18 bp, Homo sapiens
gacttgtttgtcttccat

SEQ ID NO: 4945914 - DNA, 16 bp, Homo sapiens
gactttgtatacttta

SEQ ID NO: 4945915 - DNA, 15 bp, Homo sapiens
gacttttgtacatct

SEQ ID NO: 4945916 - DNA, 19 bp, Homo sapiens
gacttttgtacatctggct

SEQ ID NO: 4945917 - DNA, 19 bp, Homo sapiens
gagaaactttatacattag

SEQ ID NO: 4945918 - DNA, 16 bp, Homo sapiens
gagaaagccaggcagg

SEQ ID NO: 4945919 - DNA, 20 bp, Homo sapiens
gagaaagccaggcaggtagc

SEQ ID NO: 4945920 - DNA, 18 bp, Homo sapiens
gacccggaggggcctggc

SEQ ID NO: 4945921 - DNA, 12 bp, Homo sapiens
gacccggctgcg

SEQ ID NO: 4945922 - DNA, 13 bp, Homo sapiens
gacccggctgcgt

SEQ ID NO: 4945923 - DNA, 15 bp, Homo sapiens
gaccctccccgcacc

SEQ ID NO: 4945924 - DNA, 17 bp, Homo sapiens
gaccctccccgcacccc

SEQ ID NO: 4945925 - DNA, 20 bp, Homo sapiens
gaccctctgaccctagctct

SEQ ID NO: 4945926 - DNA, 14 bp, Homo sapiens
gaccctctgccacc

SEQ ID NO: 4945927 - DNA, 23 bp, Homo sapiens
gaccctctgggaacctcccagag

SEQ ID NO: 4945928 - DNA, 21 bp, Homo sapiens
gaccctgaaaagaaggacggg

SEQ ID NO: 4945929 - DNA, 22 bp, Homo sapiens
gaccctgcaaacagaacagggt

SEQ ID NO: 4945930 - DNA, 20 bp, Homo sapiens
gacccttccagacatacgaa

SEQ ID NO: 4945931 - DNA, 22 bp, Homo sapiens
gacccttcccaatcagcactga

SEQ ID NO: 4945932 - DNA, 15 bp, Homo sapiens
gaccgccccctcctc

SEQ ID NO: 4945933 - DNA, 13 bp, Homo sapiens
gaccgtggccctg

SEQ ID NO: 4945934 - DNA, 17 bp, Homo sapiens
gaccgtggccctgccct

SEQ ID NO: 4945935 - DNA, 18 bp, Homo sapiens
gacctactgttctaaagc

SEQ ID NO: 4945936 - DNA, 17 bp, Homo sapiens
gacctcaagtgatctgc

SEQ ID NO: 4945937 - DNA, 18 bp, Homo sapiens
gacctcacagtgaccctt

SEQ ID NO: 4945938 - DNA, 22 bp, Homo sapiens
gacctcacagtgacccttccca

SEQ ID NO: 4945939 - DNA, 21 bp, Homo sapiens
gacctcaggcactagcctttg

SEQ ID NO: 4945940 - DNA, 14 bp, Homo sapiens
gacctccccagccc

SEQ ID NO: 4945941 - DNA, 16 bp, Homo sapiens
gacctccccagcccct

SEQ ID NO: 4945942 - DNA, 19 bp, Homo sapiens
gacctcccttccgaccctc

SEQ ID NO: 4945943 - DNA, 23 bp, Homo sapiens
gacctcccttccgaccctctggg

SEQ ID NO: 4945944 - DNA, 21 bp, Homo sapiens
gacctctactttccaggctag

SEQ ID NO: 4945945 - DNA, 13 bp, Homo sapiens
gacctctgcctga

SEQ ID NO: 4945946 - DNA, 19 bp, Homo sapiens
gacctgaaattccaaagtc

SEQ ID NO: 4945947 - DNA, 16 bp, Homo sapiens
gacctgcactggggag

SEQ ID NO: 4945948 - DNA, 20 bp, Homo sapiens
gacctgcctctcacacacat

SEQ ID NO: 4945949 - DNA, 19 bp, Homo sapiens
gacctgctttttgaaatga

SEQ ID NO: 4945950 - DNA, 20 bp, Homo sapiens
gacctgctttttgaaatgaa

SEQ ID NO: 4945951 - DNA, 21 bp, Homo sapiens
gacctggggcacagtccagga

SEQ ID NO: 4945952 - DNA, 22 bp, Homo sapiens
gaccttacccctggctgtttgg

SEQ ID NO: 4945953 - DNA, 15 bp, Homo sapiens
gaccttaggccttcc

SEQ ID NO: 4945954 - DNA, 16 bp, Homo sapiens
gaattaaaacttctta

SEQ ID NO: 4945955 - DNA, 17 bp, Homo sapiens
gaattaaaacttcttaa

SEQ ID NO: 4945956 - DNA, 19 bp, Homo sapiens
gaattaaaaggatagtatt

SEQ ID NO: 4945957 - DNA, 20 bp, Homo sapiens
gaattaaaaggatagtattt

SEQ ID NO: 4945958 - DNA, 20 bp, Homo sapiens
gaattaaataaacccttcct

SEQ ID NO: 4945959 - DNA, 20 bp, Homo sapiens
gaattaagttatctttaaaa

SEQ ID NO: 4945960 - DNA, 15 bp, Homo sapiens
gaattaatagctttt

SEQ ID NO: 4945961 - DNA, 21 bp, Homo sapiens
gaattacatgtaaaacattat

SEQ ID NO: 4945962 - DNA, 18 bp, Homo sapiens
gaattcaaactggggcct

SEQ ID NO: 4945963 - DNA, 21 bp, Homo sapiens
gaattcaaactggggcctcca

SEQ ID NO: 4945964 - DNA, 22 bp, Homo sapiens
gaattcaaactggggcctccag

SEQ ID NO: 4945965 - DNA, 23 bp, Homo sapiens
gaattcaaactggggcctccaga

SEQ ID NO: 4945966 - DNA, 11 bp, Homo sapiens
gaattcttcct

SEQ ID NO: 4945967 - DNA, 18 bp, Homo sapiens
gaattgaccatctgcttt

SEQ ID NO: 4945968 - DNA, 21 bp, Homo sapiens
gaattgatcattttcccccca

SEQ ID NO: 4945969 - DNA, 14 bp, Homo sapiens
gaattgatttgcat

SEQ ID NO: 4945970 - DNA, 18 bp, Homo sapiens
gaattgatttgcattgaa

SEQ ID NO: 4945971 - DNA, 12 bp, Homo sapiens
gaattgcattga

SEQ ID NO: 4945972 - DNA, 13 bp, Homo sapiens
gaattgcattgac

SEQ ID NO: 4945973 - DNA, 16 bp, Homo sapiens
gaattgggagcttggg

SEQ ID NO: 4945974 - DNA, 17 bp, Homo sapiens
gaattgggagcttggga

SEQ ID NO: 4945975 - DNA, 9 bp, Homo sapiens
gaattgttt

SEQ ID NO: 4945976 - DNA, 13 bp, Homo sapiens
gaatttaaatata

SEQ ID NO: 4945977 - DNA, 14 bp, Homo sapiens
gaatttaaatataa

SEQ ID NO: 4945978 - DNA, 23 bp, Homo sapiens
gaatttaaatataattctgtaaa

SEQ ID NO: 4945979 - DNA, 20 bp, Homo sapiens
gaatttatcacacttctgtg

SEQ ID NO: 4945980 - DNA, 22 bp, Homo sapiens
gaatttatcacacttctgtgag

SEQ ID NO: 4945981 - DNA, 12 bp, Homo sapiens
gaatttctaaaa

SEQ ID NO: 4945982 - DNA, 18 bp, Homo sapiens
gaatttctaaaaagatta

SEQ ID NO: 4945983 - DNA, 19 bp, Homo sapiens
gaatttctatctaaatgat

SEQ ID NO: 4945984 - DNA, 11 bp, Homo sapiens
gaatttcttgt

SEQ ID NO: 4945985 - DNA, 13 bp, Homo sapiens
gaatttgctgggg

SEQ ID NO: 4945986 - DNA, 13 bp, Homo sapiens
gaatttggaaatc

SEQ ID NO: 4945987 - DNA, 19 bp, Homo sapiens
gaatttggcctgcactaat

SEQ ID NO: 4945988 - DNA, 14 bp, Homo sapiens
gaattttaggaact

SEQ ID NO: 4945989 - DNA, 18 bp, Homo sapiens
gacaaaaagtttccatat

SEQ ID NO: 4945990 - DNA, 18 bp, Homo sapiens
gacaaaacctaacttgcg

SEQ ID NO: 4945991 - DNA, 17 bp, Homo sapiens
gacaaacacctcccagg

SEQ ID NO: 4945992 - DNA, 17 bp, Homo sapiens
gacaaactggagtctgg

SEQ ID NO: 4945993 - DNA, 23 bp, Homo sapiens
gacaaagttactgattcactgca

SEQ ID NO: 4945994 - DNA, 14 bp, Homo sapiens
gacaaatctgtgta

SEQ ID NO: 4945995 - DNA, 16 bp, Homo sapiens
gacaacacagcctata

SEQ ID NO: 4945996 - DNA, 15 bp, Homo sapiens
gacaagaaatccctg

SEQ ID NO: 4945997 - DNA, 22 bp, Homo sapiens
gacaagagcctgatctcttcct

SEQ ID NO: 4945998 - DNA, 18 bp, Homo sapiens
gacaaggattgctactgt

SEQ ID NO: 4945999 - DNA, 19 bp, Homo sapiens
gacaagggctgacctgcct

SEQ ID NO: 4946000 - DNA, 21 bp, Homo sapiens
gacaagggctgacctgcctct

SEQ ID NO: 4946001 - DNA, 22 bp, Homo sapiens
gacaagggctgacctgcctctc

SEQ ID NO: 4946002 - DNA, 20 bp, Homo sapiens
gacaatcatgaaatatgcat

SEQ ID NO: 4946003 - DNA, 17 bp, Homo sapiens
gacaatttgatacataa

SEQ ID NO: 4946004 - DNA, 18 bp, Homo sapiens
gacaatttgatacataat

SEQ ID NO: 4946005 - DNA, 19 bp, Homo sapiens
gacaatttgatacataata

SEQ ID NO: 4946006 - DNA, 22 bp, Homo sapiens
gacacaaaactccgcccccagc

SEQ ID NO: 4946007 - DNA, 23 bp, Homo sapiens
gacacaaaactccgcccccagcc

SEQ ID NO: 4946008 - DNA, 15 bp, Homo sapiens
gacacacacacgcac

SEQ ID NO: 4946009 - DNA, 21 bp, Homo sapiens
gacacacacacgcacgcacac

SEQ ID NO: 4946010 - DNA, 22 bp, Homo sapiens
gacacacacacgcacgcacaca

SEQ ID NO: 4946011 - DNA, 13 bp, Homo sapiens
gacacacagctct

SEQ ID NO: 4946012 - DNA, 14 bp, Homo sapiens
gacacacagctctg

SEQ ID NO: 4946013 - DNA, 19 bp, Homo sapiens
gacacacagctctgtcctg

SEQ ID NO: 4946014 - DNA, 18 bp, Homo sapiens
gacacagaaaatgttgag

SEQ ID NO: 4946015 - DNA, 19 bp, Homo sapiens
gacacagaaaatgttgaga

SEQ ID NO: 4946016 - DNA, 12 bp, Homo sapiens
gacacagataat

SEQ ID NO: 4946017 - DNA, 22 bp, Homo sapiens
gacacagcgtccctagcagtga

SEQ ID NO: 4946018 - DNA, 21 bp, Homo sapiens
gacacagctcttctccaggct

SEQ ID NO: 4946019 - DNA, 23 bp, Homo sapiens
gacacagctcttctccaggctgt

SEQ ID NO: 4946020 - DNA, 12 bp, Homo sapiens
gacacaggcccg

SEQ ID NO: 4946021 - DNA, 17 bp, Homo sapiens
gacacaggcccggctcc

SEQ ID NO: 4946022 - DNA, 23 bp, Homo sapiens
gacacagggtgacggtgacaaag

SEQ ID NO: 4946023 - DNA, 14 bp, Homo sapiens
gacaccacacccag

SEQ ID NO: 4946024 - DNA, 15 bp, Homo sapiens
gacaccacacccagc

SEQ ID NO: 4946025 - DNA, 15 bp, Homo sapiens
gacaccagagcagat

SEQ ID NO: 4946026 - DNA, 19 bp, Homo sapiens
gacaccagagcagatgcag

SEQ ID NO: 4946027 - DNA, 10 bp, Homo sapiens
gacacccggc

SEQ ID NO: 4946028 - DNA, 19 bp, Homo sapiens
gacacccgtgagcgcctgt

SEQ ID NO: 4946029 - DNA, 17 bp, Homo sapiens
gacacctactgagtggc

SEQ ID NO: 4946030 - DNA, 17 bp, Homo sapiens
gacacctgaaccctcca

SEQ ID NO: 4946031 - DNA, 15 bp, Homo sapiens
gacaccttgacaggg

SEQ ID NO: 4946032 - DNA, 15 bp, Homo sapiens
gacacggggcagtgg

SEQ ID NO: 4946033 - DNA, 16 bp, Homo sapiens
gacactaaccacgctg

SEQ ID NO: 4946034 - DNA, 17 bp, Homo sapiens
gacactaaccacgctgg

SEQ ID NO: 4946035 - DNA, 20 bp, Homo sapiens
gacactaaccacgctggacc

SEQ ID NO: 4946036 - DNA, 22 bp, Homo sapiens
gacactcctagagaacgcagcc

SEQ ID NO: 4946037 - DNA, 15 bp, Homo sapiens
gacactctctggaag

SEQ ID NO: 4946038 - DNA, 13 bp, Homo sapiens
gacactggcccct

SEQ ID NO: 4946039 - DNA, 15 bp, Homo sapiens
gacactggcccctca

SEQ ID NO: 4946040 - DNA, 15 bp, Homo sapiens
gacagaagtctcctc

SEQ ID NO: 4946041 - DNA, 17 bp, Homo sapiens
gacagaagtctcctcaa

SEQ ID NO: 4946042 - DNA, 15 bp, Homo sapiens
gacagaatgtatctg

SEQ ID NO: 4946043 - DNA, 18 bp, Homo sapiens
gacagaatgtatctgtga

SEQ ID NO: 4946044 - DNA, 15 bp, Homo sapiens
gacagacacaggccc

SEQ ID NO: 4946045 - DNA, 22 bp, Homo sapiens
gacagaccacatctttatctgt

SEQ ID NO: 4946046 - DNA, 20 bp, Homo sapiens
gacagagaccctctgccacc

SEQ ID NO: 4946047 - DNA, 19 bp, Homo sapiens
gacagagccatgctgggaa

SEQ ID NO: 4946048 - DNA, 12 bp, Homo sapiens
gacagaggcagc

SEQ ID NO: 4946049 - DNA, 16 bp, Homo sapiens
gacagaggcagcccca

SEQ ID NO: 4946050 - DNA, 17 bp, Homo sapiens
gacagaggcagccccat

SEQ ID NO: 4946051 - DNA, 13 bp, Homo sapiens
gacagaggcctgc

SEQ ID NO: 4946052 - DNA, 15 bp, Homo sapiens
gacagatccccgttc

SEQ ID NO: 4946053 - DNA, 18 bp, Homo sapiens
gacagcatgtgccctcct

SEQ ID NO: 4946054 - DNA, 13 bp, Homo sapiens
gacagccacggcc

SEQ ID NO: 4946055 - DNA, 17 bp, Homo sapiens
gacagccacggccaggc

SEQ ID NO: 4946056 - DNA, 18 bp, Homo sapiens
gacagccacggccaggcc

SEQ ID NO: 4946057 - DNA, 14 bp, Homo sapiens
gacagccccagagc

SEQ ID NO: 4946058 - DNA, 16 bp, Homo sapiens
gacagccccagagcag

SEQ ID NO: 4946059 - DNA, 20 bp, Homo sapiens
gacagccccagagcagggtg

SEQ ID NO: 4946060 - DNA, 11 bp, Homo sapiens
gacagcctggc

SEQ ID NO: 4946061 - DNA, 12 bp, Homo sapiens
gacagcctggca

SEQ ID NO: 4946062 - DNA, 13 bp, Homo sapiens
gacagctccttct

SEQ ID NO: 4946063 - DNA, 18 bp, Homo sapiens
gacagctccttctgtcct

SEQ ID NO: 4946064 - DNA, 21 bp, Homo sapiens
gacaggcaagcacctcctgcc

SEQ ID NO: 4946065 - DNA, 14 bp, Homo sapiens
gacaggcaatgctg

SEQ ID NO: 4946066 - DNA, 13 bp, Homo sapiens
cttttattgtata

SEQ ID NO: 4946067 - DNA, 21 bp, Homo sapiens
cttttatttgcaacatttaca

SEQ ID NO: 4946068 - DNA, 20 bp, Homo sapiens
cttttattttacacagaaac

SEQ ID NO: 4946069 - DNA, 21 bp, Homo sapiens
cttttattttacacagaaaca

SEQ ID NO: 4946070 - DNA, 22 bp, Homo sapiens
cttttattttacacagaaacac

SEQ ID NO: 4946071 - DNA, 12 bp, Homo sapiens
cttttattttga

SEQ ID NO: 4946072 - DNA, 13 bp, Homo sapiens
cttttattttgaa

SEQ ID NO: 4946073 - DNA, 13 bp, Homo sapiens
cttttcaaggctt

SEQ ID NO: 4946074 - DNA, 22 bp, Homo sapiens
cttttcacttcgggctgtgtaa

SEQ ID NO: 4946075 - DNA, 21 bp, Homo sapiens
cttttcaggtttgtcatcaga

SEQ ID NO: 4946076 - DNA, 18 bp, Homo sapiens
cttttcatgcgtgtgtgt

SEQ ID NO: 4946077 - DNA, 13 bp, Homo sapiens
cttttccctcttt

SEQ ID NO: 4946078 - DNA, 18 bp, Homo sapiens
cttttcctctctcccgga

SEQ ID NO: 4946079 - DNA, 21 bp, Homo sapiens
cttttctattccttctggcct

SEQ ID NO: 4946080 - DNA, 19 bp, Homo sapiens
cttttcttactcctcctct

SEQ ID NO: 4946081 - DNA, 23 bp, Homo sapiens
cttttcttactcctcctctttct

SEQ ID NO: 4946082 - DNA, 12 bp, Homo sapiens
cttttcttggca

SEQ ID NO: 4946083 - DNA, 21 bp, Homo sapiens
cttttcttggcaaaagccttg

SEQ ID NO: 4946084 - DNA, 22 bp, Homo sapiens
cttttcttggcaaaagccttgt

SEQ ID NO: 4946085 - DNA, 23 bp, Homo sapiens
cttttcttggcaaaagccttgtg

SEQ ID NO: 4946086 - DNA, 17 bp, Homo sapiens
cttttctttaaagaagt

SEQ ID NO: 4946087 - DNA, 14 bp, Homo sapiens
cttttctttaactt

SEQ ID NO: 4946088 - DNA, 13 bp, Homo sapiens
cttttcttttgtt

SEQ ID NO: 4946089 - DNA, 15 bp, Homo sapiens
cttttcttttgttac

SEQ ID NO: 4946090 - DNA, 16 bp, Homo sapiens
cttttcttttgttact

SEQ ID NO: 4946091 - DNA, 18 bp, Homo sapiens
cttttcttttgttactgt

SEQ ID NO: 4946092 - DNA, 22 bp, Homo sapiens
cttttgaactggcaattgtcta

SEQ ID NO: 4946093 - DNA, 20 bp, Homo sapiens
cttttgaagtagtttgtata

SEQ ID NO: 4946094 - DNA, 13 bp, Homo sapiens
cttttgaatattc

SEQ ID NO: 4946095 - DNA, 15 bp, Homo sapiens
cttttgagtgtgtgt

SEQ ID NO: 4946096 - DNA, 22 bp, Homo sapiens
cttttgctcttagctgtctgct

SEQ ID NO: 4946097 - DNA, 16 bp, Homo sapiens
cttttggtctgtgtga

SEQ ID NO: 4946098 - DNA, 19 bp, Homo sapiens
cttttggtgtgttggacag

SEQ ID NO: 4946099 - DNA, 20 bp, Homo sapiens
cttttggtgtgttggacaga

SEQ ID NO: 4946100 - DNA, 21 bp, Homo sapiens
cttttgtaaagaaatttacta

SEQ ID NO: 4946101 - DNA, 14 bp, Homo sapiens
cttttgtaaattaa

SEQ ID NO: 4946102 - DNA, 20 bp, Homo sapiens
cttttgtaagacaaaggttt

SEQ ID NO: 4946103 - DNA, 14 bp, Homo sapiens
cttttgtacatctg

SEQ ID NO: 4946104 - DNA, 17 bp, Homo sapiens
cttttgtcatgtggcta

SEQ ID NO: 4946105 - DNA, 17 bp, Homo sapiens
cttttgtctatgggact

SEQ ID NO: 4946106 - DNA, 17 bp, Homo sapiens
cttttgtgtgaattgac

SEQ ID NO: 4946107 - DNA, 12 bp, Homo sapiens
cttttgttactg

SEQ ID NO: 4946108 - DNA, 20 bp, Homo sapiens
cttttgttactgttcttgct

SEQ ID NO: 4946109 - DNA, 19 bp, Homo sapiens
ctttttaaaaatagacact

SEQ ID NO: 4946110 - DNA, 22 bp, Homo sapiens
ctttttaaaaggtattttgaat

SEQ ID NO: 4946111 - DNA, 19 bp, Homo sapiens
ctttttaaagtgtttctgt

SEQ ID NO: 4946112 - DNA, 19 bp, Homo sapiens
ctttttaagtaatgtggaa

SEQ ID NO: 4946113 - DNA, 15 bp, Homo sapiens
ctttttaattgttgt

SEQ ID NO: 4946114 - DNA, 16 bp, Homo sapiens
ctttttaattgttgtt

SEQ ID NO: 4946115 - DNA, 22 bp, Homo sapiens
ctttttaattgttgtttctttc

SEQ ID NO: 4946116 - DNA, 23 bp, Homo sapiens
ctttttaattgttgtttctttct

SEQ ID NO: 4946117 - DNA, 18 bp, Homo sapiens
ctttttacataactgcct

SEQ ID NO: 4946118 - DNA, 21 bp, Homo sapiens
ctttttacataactgccttga

SEQ ID NO: 4946119 - DNA, 20 bp, Homo sapiens
ctttttatttatatgtactg

SEQ ID NO: 4946120 - DNA, 17 bp, Homo sapiens
ctttttcattttccaat

SEQ ID NO: 4946121 - DNA, 21 bp, Homo sapiens
ctttttctccagctgggctct

SEQ ID NO: 4946122 - DNA, 16 bp, Homo sapiens
ctttttctgattagct

SEQ ID NO: 4946123 - DNA, 14 bp, Homo sapiens
ctttttctgttgta

SEQ ID NO: 4946124 - DNA, 16 bp, Homo sapiens
ctttttcttttgtaag

SEQ ID NO: 4946125 - DNA, 13 bp, Homo sapiens
ctttttgaaatga

SEQ ID NO: 4946126 - DNA, 15 bp, Homo sapiens
ctttttgaaatgaaa

SEQ ID NO: 4946127 - DNA, 18 bp, Homo sapiens
cttttttaaaatcaactt

SEQ ID NO: 4946128 - DNA, 15 bp, Homo sapiens
cttttttaaataaac

SEQ ID NO: 4946129 - DNA, 17 bp, Homo sapiens
cttttttaaataaactt

SEQ ID NO: 4946130 - DNA, 19 bp, Homo sapiens
cttttttaaataaactttt

SEQ ID NO: 4946131 - DNA, 20 bp, Homo sapiens
cttttttaagatttttctca

SEQ ID NO: 4946132 - DNA, 13 bp, Homo sapiens
cttttttactcat

SEQ ID NO: 4946133 - DNA, 19 bp, Homo sapiens
cttttttactcattgaaat

SEQ ID NO: 4946134 - DNA, 14 bp, Homo sapiens
cttttttcaaaatc

SEQ ID NO: 4946135 - DNA, 15 bp, Homo sapiens
cttttttcactacat

SEQ ID NO: 4946136 - DNA, 19 bp, Homo sapiens
cttttttgtcccccaactt

SEQ ID NO: 4946137 - DNA, 18 bp, Homo sapiens
cttttttgtttgtttctt

SEQ ID NO: 4946138 - DNA, 12 bp, Homo sapiens
ctttttttcaat

SEQ ID NO: 4946139 - DNA, 13 bp, Homo sapiens
ctttttttcaatg

SEQ ID NO: 4946140 - DNA, 15 bp, Homo sapiens
ctttttttcaatgtg

SEQ ID NO: 4946141 - DNA, 13 bp, Homo sapiens
ctttttttccttt

SEQ ID NO: 4946142 - DNA, 14 bp, Homo sapiens
cttttttttcttta

SEQ ID NO: 4946143 - DNA, 19 bp, Homo sapiens
gaaaaaaaaaagaagaaga

SEQ ID NO: 4946144 - DNA, 16 bp, Homo sapiens
gaaaaaaaccacacaa

SEQ ID NO: 4946145 - DNA, 21 bp, Homo sapiens
gaaaaaaaccacacaaagaca

SEQ ID NO: 4946146 - DNA, 14 bp, Homo sapiens
gaaaaaaacttcat

SEQ ID NO: 4946147 - DNA, 15 bp, Homo sapiens
gaaaaaaatcatcta

SEQ ID NO: 4946148 - DNA, 10 bp, Homo sapiens
gaaaaaagct

SEQ ID NO: 4946149 - DNA, 23 bp, Homo sapiens
gaaaaacacatggggaaaaaaat

SEQ ID NO: 4946150 - DNA, 23 bp, Homo sapiens
gaaaaacaccgcttctgcctttt

SEQ ID NO: 4946151 - DNA, 19 bp, Homo sapiens
gaaaaactctttattttcc

SEQ ID NO: 4946152 - DNA, 14 bp, Homo sapiens
gaaaaagaaaataa

SEQ ID NO: 4946153 - DNA, 20 bp, Homo sapiens
gaaaaagactttaaaagtga

SEQ ID NO: 4946154 - DNA, 11 bp, Homo sapiens
gaaaaagctcc

SEQ ID NO: 4946155 - DNA, 19 bp, Homo sapiens
gaaaaataacttcaagcaa

SEQ ID NO: 4946156 - DNA, 11 bp, Homo sapiens
gaaaaatcttg

SEQ ID NO: 4946157 - DNA, 13 bp, Homo sapiens
gaaaaatgtttgt

SEQ ID NO: 4946158 - DNA, 20 bp, Homo sapiens
gaaaaattcagcaaaccatt

SEQ ID NO: 4946159 - DNA, 21 bp, Homo sapiens
gaaaacagaacatcattagaa

SEQ ID NO: 4946160 - DNA, 18 bp, Homo sapiens
gaaaaccaaaatgacatc

SEQ ID NO: 4946161 - DNA, 22 bp, Homo sapiens
gaaaaccagcttgcgaataaca

SEQ ID NO: 4946162 - DNA, 18 bp, Homo sapiens
gaaaaccatctggcctgg

SEQ ID NO: 4946163 - DNA, 21 bp, Homo sapiens
gaaaacctaagtcctttatgt

SEQ ID NO: 4946164 - DNA, 18 bp, Homo sapiens
gaaaactgaaaatctaat

SEQ ID NO: 4946165 - DNA, 23 bp, Homo sapiens
gaaaactgttacctaaagtattt

SEQ ID NO: 4946166 - DNA, 19 bp, Homo sapiens
gaaattgcatttcctgaca

SEQ ID NO: 4946167 - DNA, 14 bp, Homo sapiens
gaaattggctggat

SEQ ID NO: 4946168 - DNA, 19 bp, Homo sapiens
gaaatttattagttaatat

SEQ ID NO: 4946169 - DNA, 13 bp, Homo sapiens
gaaatttctgtga

SEQ ID NO: 4946170 - DNA, 21 bp, Homo sapiens
gaaatttgatttctattcaag

SEQ ID NO: 4946171 - DNA, 16 bp, Homo sapiens
gaaattttcttgattt

SEQ ID NO: 4946172 - DNA, 20 bp, Homo sapiens
gaaattttcttgatttgagt

SEQ ID NO: 4946173 - DNA, 17 bp, Homo sapiens
gaaattttgcaaatata

SEQ ID NO: 4946174 - DNA, 19 bp, Homo sapiens
gaaattttgcaaatataaa

SEQ ID NO: 4946175 - DNA, 24 bp, Homo sapiens
gaaattttgcaaatataaacatct

SEQ ID NO: 4946176 - DNA, 13 bp, Homo sapiens
gaaatttttatca

SEQ ID NO: 4946177 - DNA, 15 bp, Homo sapiens
gaacaaaatctgttg

SEQ ID NO: 4946178 - DNA, 15 bp, Homo sapiens
gaacaaagctgttaa

SEQ ID NO: 4946179 - DNA, 16 bp, Homo sapiens
gaacaaagctgttaaa

SEQ ID NO: 4946180 - DNA, 21 bp, Homo sapiens
gaacaaagctgttaaactgtt

SEQ ID NO: 4946181 - DNA, 15 bp, Homo sapiens
ctttctacccagcga

SEQ ID NO: 4946182 - DNA, 17 bp, Homo sapiens
ctttctacccagcgagc

SEQ ID NO: 4946183 - DNA, 18 bp, Homo sapiens
ctttctagtggtctttgt

SEQ ID NO: 4946184 - DNA, 20 bp, Homo sapiens
ctttctagtggtctttgtaa

SEQ ID NO: 4946185 - DNA, 22 bp, Homo sapiens
ctttctagtggtctttgtaaga

SEQ ID NO: 4946186 - DNA, 23 bp, Homo sapiens
ctttctagtggtctttgtaagag

SEQ ID NO: 4946187 - DNA, 18 bp, Homo sapiens
ctttctatttgacttgtg

SEQ ID NO: 4946188 - DNA, 21 bp, Homo sapiens
ctttctcagccgcttctgact

SEQ ID NO: 4946189 - DNA, 23 bp, Homo sapiens
ctttctccaaagttatccagagg

SEQ ID NO: 4946190 - DNA, 15 bp, Homo sapiens
ctttctccaggacca

SEQ ID NO: 4946191 - DNA, 18 bp, Homo sapiens
ctttctcccactgagttt

SEQ ID NO: 4946192 - DNA, 20 bp, Homo sapiens
ctttctccccgctaaggaag

SEQ ID NO: 4946193 - DNA, 22 bp, Homo sapiens
ctttctcctgtttattcccatc

SEQ ID NO: 4946194 - DNA, 13 bp, Homo sapiens
ctttctctttctc

SEQ ID NO: 4946195 - DNA, 15 bp, Homo sapiens
ctttctctttcttcc

SEQ ID NO: 4946196 - DNA, 16 bp, Homo sapiens
ctttctctttcttcct

SEQ ID NO: 4946197 - DNA, 12 bp, Homo sapiens
ctttctcttttc

SEQ ID NO: 4946198 - DNA, 17 bp, Homo sapiens
ctttctgagcacacttt

SEQ ID NO: 4946199 - DNA, 15 bp, Homo sapiens
ctttctgcagttttt

SEQ ID NO: 4946200 - DNA, 19 bp, Homo sapiens
ctttctgcagtttttcagg

SEQ ID NO: 4946201 - DNA, 21 bp, Homo sapiens
ctttctgcagtttttcaggag

SEQ ID NO: 4946202 - DNA, 18 bp, Homo sapiens
ctttctgccgacccctag

SEQ ID NO: 4946203 - DNA, 13 bp, Homo sapiens
ctttctggctctc

SEQ ID NO: 4946204 - DNA, 13 bp, Homo sapiens
ctttctgtaaact

SEQ ID NO: 4946205 - DNA, 13 bp, Homo sapiens
ctttctgtatata

SEQ ID NO: 4946206 - DNA, 14 bp, Homo sapiens
ctttctgtgcccta

SEQ ID NO: 4946207 - DNA, 13 bp, Homo sapiens
ctttcttcctctg

SEQ ID NO: 4946208 - DNA, 20 bp, Homo sapiens
ctttcttgacaaaacctaac

SEQ ID NO: 4946209 - DNA, 22 bp, Homo sapiens
ctttcttgacaaaacctaactt

SEQ ID NO: 4946210 - DNA, 12 bp, Homo sapiens
ctttctttgatt

SEQ ID NO: 4946211 - DNA, 17 bp, Homo sapiens
ctttgaaacctgctctg

SEQ ID NO: 4946212 - DNA, 20 bp, Homo sapiens
ctttgaaacctgctctgtag

SEQ ID NO: 4946213 - DNA, 15 bp, Homo sapiens
ctttgaaatacctca

SEQ ID NO: 4946214 - DNA, 18 bp, Homo sapiens
ctttgaaatacctcatgt

SEQ ID NO: 4946215 - DNA, 22 bp, Homo sapiens
ctttgaaatacctcatgtttat

SEQ ID NO: 4946216 - DNA, 21 bp, Homo sapiens
ctttgaaatagtctgtgtgaa

SEQ ID NO: 4946217 - DNA, 16 bp, Homo sapiens
ctttgaagaaggtgga

SEQ ID NO: 4946218 - DNA, 14 bp, Homo sapiens
ctttgaagcagttg

SEQ ID NO: 4946219 - DNA, 19 bp, Homo sapiens
ctttgaagctgaaaatata

SEQ ID NO: 4946220 - DNA, 19 bp, Homo sapiens
ctttgagaagccttcagct

SEQ ID NO: 4946221 - DNA, 22 bp, Homo sapiens
ctttgagaagccttcagctcca

SEQ ID NO: 4946222 - DNA, 13 bp, Homo sapiens
ctttgagacagtt

SEQ ID NO: 4946223 - DNA, 16 bp, Homo sapiens
ctttgagacagtttct

SEQ ID NO: 4946224 - DNA, 14 bp, Homo sapiens
ctttgagggactgc

SEQ ID NO: 4946225 - DNA, 20 bp, Homo sapiens
ctttgagggactgcctctgc

SEQ ID NO: 4946226 - DNA, 21 bp, Homo sapiens
ctttgagggactgcctctgcc

SEQ ID NO: 4946227 - DNA, 13 bp, Homo sapiens
ctttgataatgtt

SEQ ID NO: 4946228 - DNA, 16 bp, Homo sapiens
ctttgataatgttaaa

SEQ ID NO: 4946229 - DNA, 12 bp, Homo sapiens
ctttgattcata

SEQ ID NO: 4946230 - DNA, 22 bp, Homo sapiens
ctttgattctccttttatgtgt

SEQ ID NO: 4946231 - DNA, 18 bp, Homo sapiens
ctttgattgcacattgtt

SEQ ID NO: 4946232 - DNA, 21 bp, Homo sapiens
ctttgattgcacattgttgtt

SEQ ID NO: 4946233 - DNA, 13 bp, Homo sapiens
ctttgatttacag

SEQ ID NO: 4946234 - DNA, 18 bp, Homo sapiens
ctttgatttacagcaagt

SEQ ID NO: 4946235 - DNA, 18 bp, Homo sapiens
ctttgcacgacgccctct

SEQ ID NO: 4946236 - DNA, 22 bp, Homo sapiens
ctttgcacgacgccctctcccc

SEQ ID NO: 4946237 - DNA, 20 bp, Homo sapiens
ctttgcagacaggcaagcac

SEQ ID NO: 4946238 - DNA, 13 bp, Homo sapiens
ctttgccttgggc

SEQ ID NO: 4946239 - DNA, 16 bp, Homo sapiens
ctttgccttgggctgc

SEQ ID NO: 4946240 - DNA, 18 bp, Homo sapiens
ctttgccttgggctgctc

SEQ ID NO: 4946241 - DNA, 18 bp, Homo sapiens
ctttggaaaaatgtttgt

SEQ ID NO: 4946242 - DNA, 12 bp, Homo sapiens
ctttggaagcag

SEQ ID NO: 4946243 - DNA, 17 bp, Homo sapiens
ctttggatttgacattg

SEQ ID NO: 4946244 - DNA, 15 bp, Homo sapiens
ctttgggatttaatt

SEQ ID NO: 4946245 - DNA, 20 bp, Homo sapiens
ctttgggatttaatttccag

SEQ ID NO: 4946246 - DNA, 14 bp, Homo sapiens
ctttgggctgccct

SEQ ID NO: 4946247 - DNA, 22 bp, Homo sapiens
ctttggggtctacactgcaatc

SEQ ID NO: 4946248 - DNA, 20 bp, Homo sapiens
ctttgggttaagcattacca

SEQ ID NO: 4946249 - DNA, 14 bp, Homo sapiens
ctttggtagaaaag

SEQ ID NO: 4946250 - DNA, 14 bp, Homo sapiens
ctttggttctggcc

SEQ ID NO: 4946251 - DNA, 16 bp, Homo sapiens
ctttggtttctgtctg

SEQ ID NO: 4946252 - DNA, 22 bp, Homo sapiens
ctttgtaagagtgtagaagcat

SEQ ID NO: 4946253 - DNA, 15 bp, Homo sapiens
ctttgtacagagtgc

SEQ ID NO: 4946254 - DNA, 14 bp, Homo sapiens
ctttgtatacttta

SEQ ID NO: 4946255 - DNA, 16 bp, Homo sapiens
ctttgtatactttaaa

SEQ ID NO: 4946256 - DNA, 17 bp, Homo sapiens
ctttgtatactttaaat

SEQ ID NO: 4946257 - DNA, 19 bp, Homo sapiens
ctttgtatactttaaataa

SEQ ID NO: 4946258 - DNA, 20 bp, Homo sapiens
ctttgtctaactcagaatta

SEQ ID NO: 4946259 - DNA, 14 bp, Homo sapiens
ctttgtctttcaaa

SEQ ID NO: 4946260 - DNA, 15 bp, Homo sapiens
ctttgtgataattta

SEQ ID NO: 4946261 - DNA, 12 bp, Homo sapiens
ctttgtggggct

SEQ ID NO: 4946262 - DNA, 13 bp, Homo sapiens
ctttgtggggctt

SEQ ID NO: 4946263 - DNA, 17 bp, Homo sapiens
ctttgtgtagctttgct

SEQ ID NO: 4946264 - DNA, 22 bp, Homo sapiens
ctttgtgtatttttcaataata

SEQ ID NO: 4946265 - DNA, 11 bp, Homo sapiens
ctttgtgttgg

SEQ ID NO: 4946266 - DNA, 17 bp, Homo sapiens
ctttgtgtttggtttac

SEQ ID NO: 4946267 - DNA, 17 bp, Homo sapiens
ctttgttttctgactaa

SEQ ID NO: 4946268 - DNA, 20 bp, Homo sapiens
ctttgttttctgactaatta

SEQ ID NO: 4946269 - DNA, 17 bp, Homo sapiens
cttttaaagtgttactt

SEQ ID NO: 4946270 - DNA, 16 bp, Homo sapiens
cttttaaagtgtttca

SEQ ID NO: 4946271 - DNA, 17 bp, Homo sapiens
cttttaaagtgtttcag

SEQ ID NO: 4946272 - DNA, 10 bp, Homo sapiens
cttttaacat

SEQ ID NO: 4946273 - DNA, 12 bp, Homo sapiens
cttttaacattt

SEQ ID NO: 4946274 - DNA, 14 bp, Homo sapiens
cttttaacattttg

SEQ ID NO: 4946275 - DNA, 15 bp, Homo sapiens
cttttaacattttgt

SEQ ID NO: 4946276 - DNA, 18 bp, Homo sapiens
cttttaacattttgttct

SEQ ID NO: 4946277 - DNA, 21 bp, Homo sapiens
cttttaacattttgttcttac

SEQ ID NO: 4946278 - DNA, 16 bp, Homo sapiens
cttttaaccatctgat

SEQ ID NO: 4946279 - DNA, 17 bp, Homo sapiens
cttttaacttctttcta

SEQ ID NO: 4946280 - DNA, 14 bp, Homo sapiens
cttttaatcagaca

SEQ ID NO: 4946281 - DNA, 15 bp, Homo sapiens
cttttaccagctttt

SEQ ID NO: 4946282 - DNA, 21 bp, Homo sapiens
cttttaccagcttttaaccat

SEQ ID NO: 4946283 - DNA, 20 bp, Homo sapiens
cttttaggaaaatcactttg

SEQ ID NO: 4946284 - DNA, 17 bp, Homo sapiens
cttttatactctttctg

SEQ ID NO: 4946285 - DNA, 20 bp, Homo sapiens
cttttatactctttctgtat

SEQ ID NO: 4946286 - DNA, 17 bp, Homo sapiens
cttttatagctattact

SEQ ID NO: 4946287 - DNA, 14 bp, Homo sapiens
cttctgtacgtctg

SEQ ID NO: 4946288 - DNA, 17 bp, Homo sapiens
cttctgtcctactctgt

SEQ ID NO: 4946289 - DNA, 14 bp, Homo sapiens
cttctgtgaaagta

SEQ ID NO: 4946290 - DNA, 14 bp, Homo sapiens
cttctgtgatgagc

SEQ ID NO: 4946291 - DNA, 13 bp, Homo sapiens
cttctgtggctca

SEQ ID NO: 4946292 - DNA, 22 bp, Homo sapiens
cttctgtggctcacagaaccct

SEQ ID NO: 4946293 - DNA, 11 bp, Homo sapiens
cttctgtgttt

SEQ ID NO: 4946294 - DNA, 13 bp, Homo sapiens
cttcttaaatatc

SEQ ID NO: 4946295 - DNA, 18 bp, Homo sapiens
cttcttaaatatctttta

SEQ ID NO: 4946296 - DNA, 19 bp, Homo sapiens
cttcttaaatatcttttat

SEQ ID NO: 4946297 - DNA, 18 bp, Homo sapiens
cttcttaattaatttgat

SEQ ID NO: 4946298 - DNA, 21 bp, Homo sapiens
cttcttaattaatttgattaa

SEQ ID NO: 4946299 - DNA, 22 bp, Homo sapiens
cttcttatggaattgatttgca

SEQ ID NO: 4946300 - DNA, 19 bp, Homo sapiens
cttcttattatatatataa

SEQ ID NO: 4946301 - DNA, 15 bp, Homo sapiens
cttcttccatcccag

SEQ ID NO: 4946302 - DNA, 20 bp, Homo sapiens
cttcttccatcccaggacac

SEQ ID NO: 4946303 - DNA, 13 bp, Homo sapiens
cttcttgcatcct

SEQ ID NO: 4946304 - DNA, 18 bp, Homo sapiens
cttcttgcatccttccta

SEQ ID NO: 4946305 - DNA, 14 bp, Homo sapiens
cttcttgtcagaca

SEQ ID NO: 4946306 - DNA, 21 bp, Homo sapiens
cttcttgtcagacataaagcc

SEQ ID NO: 4946307 - DNA, 20 bp, Homo sapiens
cttctttatactgtaattta

SEQ ID NO: 4946308 - DNA, 14 bp, Homo sapiens
cttctttgataatg

SEQ ID NO: 4946309 - DNA, 17 bp, Homo sapiens
cttctttgataatgtta

SEQ ID NO: 4946310 - DNA, 19 bp, Homo sapiens
cttctttgataatgttaaa

SEQ ID NO: 4946311 - DNA, 20 bp, Homo sapiens
cttgaaattaagaaggcaaa

SEQ ID NO: 4946312 - DNA, 21 bp, Homo sapiens
cttgaaattaagaaggcaaaa

SEQ ID NO: 4946313 - DNA, 20 bp, Homo sapiens
cttgaacaaaagggtcagag

SEQ ID NO: 4946314 - DNA, 17 bp, Homo sapiens
cttgaacaaaatctgtt

SEQ ID NO: 4946315 - DNA, 13 bp, Homo sapiens
cttgaactcctgg

SEQ ID NO: 4946316 - DNA, 13 bp, Homo sapiens
cttgaagggccca

SEQ ID NO: 4946317 - DNA, 14 bp, Homo sapiens
cttgaagggcccag

SEQ ID NO: 4946318 - DNA, 15 bp, Homo sapiens
cttgaagggcccagg

SEQ ID NO: 4946319 - DNA, 19 bp, Homo sapiens
cttgaatgtggcttgagaa

SEQ ID NO: 4946320 - DNA, 17 bp, Homo sapiens
cttgaatgtggtctcag

SEQ ID NO: 4946321 - DNA, 19 bp, Homo sapiens
cttgaatgtggtctcagga

SEQ ID NO: 4946322 - DNA, 20 bp, Homo sapiens
cttgacaaaacctaacttgc

SEQ ID NO: 4946323 - DNA, 15 bp, Homo sapiens
cttgacagggcacac

SEQ ID NO: 4946324 - DNA, 19 bp, Homo sapiens
cttgacatctggaaacctc

SEQ ID NO: 4946325 - DNA, 12 bp, Homo sapiens
cttgaccttcct

SEQ ID NO: 4946326 - DNA, 18 bp, Homo sapiens
cttgaccttcctctgggg

SEQ ID NO: 4946327 - DNA, 19 bp, Homo sapiens
cttgactttgaactaatga

SEQ ID NO: 4946328 - DNA, 14 bp, Homo sapiens
cttgagcccaggag

SEQ ID NO: 4946329 - DNA, 12 bp, Homo sapiens
cttgagctggcc

SEQ ID NO: 4946330 - DNA, 23 bp, Homo sapiens
cttgagctggcctctctagcaca

SEQ ID NO: 4946331 - DNA, 14 bp, Homo sapiens
cttgaggccaggag

SEQ ID NO: 4946332 - DNA, 22 bp, Homo sapiens
cttgagtggggttatctctgtg

SEQ ID NO: 4946333 - DNA, 20 bp, Homo sapiens
cttgagtgtaatgtttgtta

SEQ ID NO: 4946334 - DNA, 13 bp, Homo sapiens
cttgatgaagcaa

SEQ ID NO: 4946335 - DNA, 14 bp, Homo sapiens
cttgatgaagcaag

SEQ ID NO: 4946336 - DNA, 21 bp, Homo sapiens
cttgatgaccaaagtcctttt

SEQ ID NO: 4946337 - DNA, 14 bp, Homo sapiens
cttgatgcacagag

SEQ ID NO: 4946338 - DNA, 19 bp, Homo sapiens
cttgatgcacagagaagct

SEQ ID NO: 4946339 - DNA, 13 bp, Homo sapiens
cttgatgcatgtg

SEQ ID NO: 4946340 - DNA, 16 bp, Homo sapiens
cttgattatccatatt

SEQ ID NO: 4946341 - DNA, 21 bp, Homo sapiens
cttgattctgcagtaaatctt

SEQ ID NO: 4946342 - DNA, 16 bp, Homo sapiens
cttgcaagcatgcttg

SEQ ID NO: 4946343 - DNA, 15 bp, Homo sapiens
cttgcaatggcagcc

SEQ ID NO: 4946344 - DNA, 17 bp, Homo sapiens
cttgcaatggcagcctt

SEQ ID NO: 4946345 - DNA, 16 bp, Homo sapiens
cttgcacccctcactc

SEQ ID NO: 4946346 - DNA, 20 bp, Homo sapiens
cttgcacccctcactctggc

SEQ ID NO: 4946347 - DNA, 13 bp, Homo sapiens
cttgcagaactgc

SEQ ID NO: 4946348 - DNA, 17 bp, Homo sapiens
cttgcagtcatcagaag

SEQ ID NO: 4946349 - DNA, 22 bp, Homo sapiens
cttgcagttcagcaccacccta

SEQ ID NO: 4946350 - DNA, 13 bp, Homo sapiens
cttgccaccccac

SEQ ID NO: 4946351 - DNA, 20 bp, Homo sapiens
cttgccaccccaccctccct

SEQ ID NO: 4946352 - DNA, 22 bp, Homo sapiens
cttgccaccccaccctccctgg

SEQ ID NO: 4946353 - DNA, 15 bp, Homo sapiens
cttgccgaggagcca

SEQ ID NO: 4946354 - DNA, 17 bp, Homo sapiens
cttgccgaggagccagg

SEQ ID NO: 4946355 - DNA, 21 bp, Homo sapiens
cttgcctaaatttaatgctgc

SEQ ID NO: 4946356 - DNA, 16 bp, Homo sapiens
cttgcctgggtcacac

SEQ ID NO: 4946357 - DNA, 20 bp, Homo sapiens
cttgcggaatcactctgtcc

SEQ ID NO: 4946358 - DNA, 17 bp, Homo sapiens
cttgctaattttctcaa

SEQ ID NO: 4946359 - DNA, 14 bp, Homo sapiens
cttgctcattaatt

SEQ ID NO: 4946360 - DNA, 13 bp, Homo sapiens
cttgctcccttca

SEQ ID NO: 4946361 - DNA, 19 bp, Homo sapiens
cttgctcccttcagccccc

SEQ ID NO: 4946362 - DNA, 18 bp, Homo sapiens
cttgctgagctgtttata

SEQ ID NO: 4946363 - DNA, 14 bp, Homo sapiens
cttgctgctagaac

SEQ ID NO: 4946364 - DNA, 18 bp, Homo sapiens
cttgctgctagaactttt

SEQ ID NO: 4946365 - DNA, 22 bp, Homo sapiens
cttgctggacggggactgggga

SEQ ID NO: 4946366 - DNA, 13 bp, Homo sapiens
cttgctgtcctga

SEQ ID NO: 4946367 - DNA, 14 bp, Homo sapiens
cttgctgtctctgc

SEQ ID NO: 4946368 - DNA, 17 bp, Homo sapiens
cttgctgtctctgctcg

SEQ ID NO: 4946369 - DNA, 11 bp, Homo sapiens
cttgctttcta

SEQ ID NO: 4946370 - DNA, 23 bp, Homo sapiens
cttgctttcttttttaaaatcaa

SEQ ID NO: 4946371 - DNA, 21 bp, Homo sapiens
cttgctttgatttacagcaag

SEQ ID NO: 4946372 - DNA, 15 bp, Homo sapiens
cttgcttttccctct

SEQ ID NO: 4946373 - DNA, 20 bp, Homo sapiens
cttgcttttccctcttttct

SEQ ID NO: 4946374 - DNA, 14 bp, Homo sapiens
cttggaagctccgc

SEQ ID NO: 4946375 - DNA, 20 bp, Homo sapiens
cttggaagctccgctttcta

SEQ ID NO: 4946376 - DNA, 22 bp, Homo sapiens
cttggacaagacaaaccaagtc

SEQ ID NO: 4946377 - DNA, 22 bp, Homo sapiens
cttggagccaatggagactgtc

SEQ ID NO: 4946378 - DNA, 20 bp, Homo sapiens
cttggagggcccacttgtat

SEQ ID NO: 4946379 - DNA, 16 bp, Homo sapiens
cttggcaaaagccttg

SEQ ID NO: 4946380 - DNA, 13 bp, Homo sapiens
cttggcaccaaag

SEQ ID NO: 4946381 - DNA, 19 bp, Homo sapiens
cttggcaccaaagatgcag

SEQ ID NO: 4946382 - DNA, 14 bp, Homo sapiens
cttggccctttcct

SEQ ID NO: 4946383 - DNA, 19 bp, Homo sapiens
cttggccggctgtgctcag

SEQ ID NO: 4946384 - DNA, 20 bp, Homo sapiens
cttggccggctgtgctcaga

SEQ ID NO: 4946385 - DNA, 22 bp, Homo sapiens
cttggcctgtctcatccccagg

SEQ ID NO: 4946386 - DNA, 12 bp, Homo sapiens
cttggctcagac

SEQ ID NO: 4946387 - DNA, 16 bp, Homo sapiens
cttggctccatgctcc

SEQ ID NO: 4946388 - DNA, 13 bp, Homo sapiens
cttggctgcaggg

SEQ ID NO: 4946389 - DNA, 12 bp, Homo sapiens
cttggctgtgag

SEQ ID NO: 4946390 - DNA, 13 bp, Homo sapiens
cttggctgtgagg

SEQ ID NO: 4946391 - DNA, 14 bp, Homo sapiens
cttggcttacctga

SEQ ID NO: 4946392 - DNA, 17 bp, Homo sapiens
cttggcttacctgacct

SEQ ID NO: 4946393 - DNA, 18 bp, Homo sapiens
cttggcttacctgacctc

SEQ ID NO: 4946394 - DNA, 19 bp, Homo sapiens
cttggcttacctgacctct

SEQ ID NO: 4946395 - DNA, 22 bp, Homo sapiens
cttggcttacctgacctcttgc

SEQ ID NO: 4946396 - DNA, 14 bp, Homo sapiens
ctgttagcactgtt

SEQ ID NO: 4946397 - DNA, 17 bp, Homo sapiens
ctgttagcactgttgat

SEQ ID NO: 4946398 - DNA, 18 bp, Homo sapiens
ctgttagcactgttgatg

SEQ ID NO: 4946399 - DNA, 19 bp, Homo sapiens
ctgttagctttttaaaaca

SEQ ID NO: 4946400 - DNA, 16 bp, Homo sapiens
ctgttatatcccctgc

SEQ ID NO: 4946401 - DNA, 18 bp, Homo sapiens
ctgttatatcccctgcta

SEQ ID NO: 4946402 - DNA, 12 bp, Homo sapiens
ctgttatgtact

SEQ ID NO: 4946403 - DNA, 16 bp, Homo sapiens
ctgttatgtactgtac

SEQ ID NO: 4946404 - DNA, 17 bp, Homo sapiens
ctgttcatacactaacc

SEQ ID NO: 4946405 - DNA, 21 bp, Homo sapiens
ctgttcatacactaaccaaat

SEQ ID NO: 4946406 - DNA, 21 bp, Homo sapiens
ctgttcctctcttttcctgtt

SEQ ID NO: 4946407 - DNA, 19 bp, Homo sapiens
ctgttctacccgttccaaa

SEQ ID NO: 4946408 - DNA, 20 bp, Homo sapiens
ctgttctacccgttccaaaa

SEQ ID NO: 4946409 - DNA, 15 bp, Homo sapiens
ctgttctcttgggaa

SEQ ID NO: 4946410 - DNA, 13 bp, Homo sapiens
ctgttctgcactg

SEQ ID NO: 4946411 - DNA, 14 bp, Homo sapiens
ctgttctgggctct

SEQ ID NO: 4946412 - DNA, 20 bp, Homo sapiens
ctgttctgggtgcagctgag

SEQ ID NO: 4946413 - DNA, 14 bp, Homo sapiens
ctgttcttcctcca

SEQ ID NO: 4946414 - DNA, 21 bp, Homo sapiens
ctgttcttcctccagctgcac

SEQ ID NO: 4946415 - DNA, 22 bp, Homo sapiens
ctgttcttcctccagctgcacc

SEQ ID NO: 4946416 - DNA, 13 bp, Homo sapiens
ctgttcttgctgc

SEQ ID NO: 4946417 - DNA, 14 bp, Homo sapiens
ctgttcttgctgct

SEQ ID NO: 4946418 - DNA, 17 bp, Homo sapiens
ctgttcttgctgctaga

SEQ ID NO: 4946419 - DNA, 18 bp, Homo sapiens
ctgttcttgctgctagaa

SEQ ID NO: 4946420 - DNA, 21 bp, Homo sapiens
ctgttcttgctgctagaactt

SEQ ID NO: 4946421 - DNA, 22 bp, Homo sapiens
ctgttcttgctgctagaacttt

SEQ ID NO: 4946422 - DNA, 14 bp, Homo sapiens
ctgttgaaaattat

SEQ ID NO: 4946423 - DNA, 18 bp, Homo sapiens
ctgttgaagtcaccttgt

SEQ ID NO: 4946424 - DNA, 14 bp, Homo sapiens
ctgttgatgtatct

SEQ ID NO: 4946425 - DNA, 18 bp, Homo sapiens
ctgttggattccatgcta

SEQ ID NO: 4946426 - DNA, 12 bp, Homo sapiens
ctgttggccagt

SEQ ID NO: 4946427 - DNA, 11 bp, Homo sapiens
ctgttgtaact

SEQ ID NO: 4946428 - DNA, 22 bp, Homo sapiens
ctgttgtaactaggctcagaga

SEQ ID NO: 4946429 - DNA, 18 bp, Homo sapiens
ctgttgtaacttatgtag

SEQ ID NO: 4946430 - DNA, 12 bp, Homo sapiens
ctgttgtacatt

SEQ ID NO: 4946431 - DNA, 13 bp, Homo sapiens
ctgttgtacattt

SEQ ID NO: 4946432 - DNA, 17 bp, Homo sapiens
ctgttgtacatttatga

SEQ ID NO: 4946433 - DNA, 18 bp, Homo sapiens
ctgttgtacatttatgat

SEQ ID NO: 4946434 - DNA, 15 bp, Homo sapiens
ctgttgtactatgga

SEQ ID NO: 4946435 - DNA, 16 bp, Homo sapiens
ctgttgttttgtttta

SEQ ID NO: 4946436 - DNA, 20 bp, Homo sapiens
ctgttgttttgttttaaata

SEQ ID NO: 4946437 - DNA, 22 bp, Homo sapiens
ctgtttaagaaaagtattttga

SEQ ID NO: 4946438 - DNA, 21 bp, Homo sapiens
ctgtttaatatttaaacagca

SEQ ID NO: 4946439 - DNA, 16 bp, Homo sapiens
ctgtttatatgtgttg

SEQ ID NO: 4946440 - DNA, 21 bp, Homo sapiens
ctgtttatggccacatttaat

SEQ ID NO: 4946441 - DNA, 13 bp, Homo sapiens
ctgtttatggcct

SEQ ID NO: 4946442 - DNA, 16 bp, Homo sapiens
ctgtttatggcctcag

SEQ ID NO: 4946443 - DNA, 18 bp, Homo sapiens
ctgtttatggcctcagct

SEQ ID NO: 4946444 - DNA, 15 bp, Homo sapiens
ctgtttattcccatc

SEQ ID NO: 4946445 - DNA, 16 bp, Homo sapiens
ctgtttctcttgagct

SEQ ID NO: 4946446 - DNA, 20 bp, Homo sapiens
ctgtttctcttgagctggcc

SEQ ID NO: 4946447 - DNA, 19 bp, Homo sapiens
ctgtttcttcctgttaatg

SEQ ID NO: 4946448 - DNA, 16 bp, Homo sapiens
ctgtttcttgcttgta

SEQ ID NO: 4946449 - DNA, 15 bp, Homo sapiens
ctgtttgtttcaaga

SEQ ID NO: 4946450 - DNA, 21 bp, Homo sapiens
ctgttttctctcggctcccca

SEQ ID NO: 4946451 - DNA, 12 bp, Homo sapiens
ctgttttcttct

SEQ ID NO: 4946452 - DNA, 18 bp, Homo sapiens
ctgttttcttctattcca

SEQ ID NO: 4946453 - DNA, 13 bp, Homo sapiens
ctgtttttgttgt

SEQ ID NO: 4946454 - DNA, 19 bp, Homo sapiens
cttaaaaaaaaaaaaaagc

SEQ ID NO: 4946455 - DNA, 22 bp, Homo sapiens
cttaaaaaaaaaaaaaagcttt

SEQ ID NO: 4946456 - DNA, 23 bp, Homo sapiens
cttaaaaaaaaaaaaaagcttta

SEQ ID NO: 4946457 - DNA, 17 bp, Homo sapiens
cttaaaaatgtaaatat

SEQ ID NO: 4946458 - DNA, 21 bp, Homo sapiens
cttaaaataaacagttgtgaa

SEQ ID NO: 4946459 - DNA, 23 bp, Homo sapiens
cttaaaataaacagttgtgaacc

SEQ ID NO: 4946460 - DNA, 22 bp, Homo sapiens
cttaaaataggggatatttaag

SEQ ID NO: 4946461 - DNA, 14 bp, Homo sapiens
cttaaaatggaatt

SEQ ID NO: 4946462 - DNA, 22 bp, Homo sapiens
cttaaagaaacagctttcaagt

SEQ ID NO: 4946463 - DNA, 23 bp, Homo sapiens
cttaaagctgcctgtagttagga

SEQ ID NO: 4946464 - DNA, 22 bp, Homo sapiens
cttaaatatagttcctaagaag

SEQ ID NO: 4946465 - DNA, 22 bp, Homo sapiens
cttaaatatcttttatgtttga

SEQ ID NO: 4946466 - DNA, 13 bp, Homo sapiens
cttaacatgggct

SEQ ID NO: 4946467 - DNA, 12 bp, Homo sapiens
cttaagagaaat

SEQ ID NO: 4946468 - DNA, 17 bp, Homo sapiens
cttaagcaaaagaaaaa

SEQ ID NO: 4946469 - DNA, 18 bp, Homo sapiens
cttaagcaaaagaaaaag

SEQ ID NO: 4946470 - DNA, 16 bp, Homo sapiens
cttaaggcactctgtt

SEQ ID NO: 4946471 - DNA, 19 bp, Homo sapiens
cttaagtatatcatgtaaa

SEQ ID NO: 4946472 - DNA, 22 bp, Homo sapiens
cttaatcaggtcctcagagaat

SEQ ID NO: 4946473 - DNA, 21 bp, Homo sapiens
cttaatgaatgagtctgttgt

SEQ ID NO: 4946474 - DNA, 20 bp, Homo sapiens
cttaatgtgattactgctct

SEQ ID NO: 4946475 - DNA, 14 bp, Homo sapiens
cttaattaatttga

SEQ ID NO: 4946476 - DNA, 12 bp, Homo sapiens
cttaattactta

SEQ ID NO: 4946477 - DNA, 16 bp, Homo sapiens
cttaattacttaaaaa

SEQ ID NO: 4946478 - DNA, 15 bp, Homo sapiens
cttaattattatttg

SEQ ID NO: 4946479 - DNA, 16 bp, Homo sapiens
cttacacaaaggggat

SEQ ID NO: 4946480 - DNA, 23 bp, Homo sapiens
cttacactgcctgtatactttag

SEQ ID NO: 4946481 - DNA, 22 bp, Homo sapiens
cttacatagttttaaactcatt

SEQ ID NO: 4946482 - DNA, 18 bp, Homo sapiens
cttacatttgtgagattc

SEQ ID NO: 4946483 - DNA, 20 bp, Homo sapiens
cttacatttgtgagattcct

SEQ ID NO: 4946484 - DNA, 17 bp, Homo sapiens
cttaccaactttctgta

SEQ ID NO: 4946485 - DNA, 23 bp, Homo sapiens
cttaccatttgctactgtacata

SEQ ID NO: 4946486 - DNA, 15 bp, Homo sapiens
cttacccaatttccc

SEQ ID NO: 4946487 - DNA, 19 bp, Homo sapiens
cttacccctggctgtttgg

SEQ ID NO: 4946488 - DNA, 22 bp, Homo sapiens
cttaccctttcctcctttatca

SEQ ID NO: 4946489 - DNA, 19 bp, Homo sapiens
cttacctaagtgacatttg

SEQ ID NO: 4946490 - DNA, 16 bp, Homo sapiens
cttacctgacacaaga

SEQ ID NO: 4946491 - DNA, 19 bp, Homo sapiens
cttacctgacacaagagga

SEQ ID NO: 4946492 - DNA, 20 bp, Homo sapiens
cttacctgacctcttgctgt

SEQ ID NO: 4946493 - DNA, 20 bp, Homo sapiens
cttacctgtatgtctccagt

SEQ ID NO: 4946494 - DNA, 22 bp, Homo sapiens
cttactaaaatatatatagaaa

SEQ ID NO: 4946495 - DNA, 22 bp, Homo sapiens
cttactattttgacagttattt

SEQ ID NO: 4946496 - DNA, 12 bp, Homo sapiens
cttactcctcct

SEQ ID NO: 4946497 - DNA, 22 bp, Homo sapiens
cttactcctcctctttctctcc

SEQ ID NO: 4946498 - DNA, 12 bp, Homo sapiens
cttactctaaga

SEQ ID NO: 4946499 - DNA, 17 bp, Homo sapiens
cttactctgtccattta

SEQ ID NO: 4946500 - DNA, 17 bp, Homo sapiens
cttactgtggaggaagg

SEQ ID NO: 4946501 - DNA, 19 bp, Homo sapiens
cttactgtggaggaaggat

SEQ ID NO: 4946502 - DNA, 16 bp, Homo sapiens
cttacttactaaaata

SEQ ID NO: 4946503 - DNA, 22 bp, Homo sapiens
cttagaaatgtaaactgccata

SEQ ID NO: 4946504 - DNA, 16 bp, Homo sapiens
cttagaccttccataa

SEQ ID NO: 4946505 - DNA, 24 bp, Homo sapiens
cttagattctctgtgtctaagatt

SEQ ID NO: 4946506 - DNA, 13 bp, Homo sapiens
cttaggccttcct

SEQ ID NO: 4946507 - DNA, 17 bp, Homo sapiens
cttaggccttcctctct

SEQ ID NO: 4946508 - DNA, 23 bp, Homo sapiens
cttaggccttcctctctccagat

SEQ ID NO: 4946509 - DNA, 17 bp, Homo sapiens
cttagtatctcatcaac

SEQ ID NO: 4946510 - DNA, 19 bp, Homo sapiens
cttagtatctcatcaacaa

SEQ ID NO: 4946511 - DNA, 12 bp, Homo sapiens
cttagtccccca

SEQ ID NO: 4946512 - DNA, 19 bp, Homo sapiens
cttagtctcagtttgtgtg

SEQ ID NO: 4946513 - DNA, 13 bp, Homo sapiens
cttagtgggccag

SEQ ID NO: 4946514 - DNA, 18 bp, Homo sapiens
cttagtgggccagggctg

SEQ ID NO: 4946515 - DNA, 21 bp, Homo sapiens
cttagtgggccagggctgccc

SEQ ID NO: 4946516 - DNA, 23 bp, Homo sapiens
cttagtgggccagggctgccctg

SEQ ID NO: 4946517 - DNA, 18 bp, Homo sapiens
cttataaatcatattgat

SEQ ID NO: 4946518 - DNA, 16 bp, Homo sapiens
cttataataaaggact

SEQ ID NO: 4946519 - DNA, 17 bp, Homo sapiens
cttataataaaggactg

SEQ ID NO: 4946520 - DNA, 20 bp, Homo sapiens
cttataataaaggactgtaa

SEQ ID NO: 4946521 - DNA, 12 bp, Homo sapiens
cttatacacatt

SEQ ID NO: 4946522 - DNA, 13 bp, Homo sapiens
cttatagtacatg

SEQ ID NO: 4946523 - DNA, 21 bp, Homo sapiens
cttatatagcagcaaaaatat

SEQ ID NO: 4946524 - DNA, 16 bp, Homo sapiens
cttatattgaagacaa

SEQ ID NO: 4946525 - DNA, 23 bp, Homo sapiens
cttatattgaagacaatttgata

SEQ ID NO: 4946526 - DNA, 21 bp, Homo sapiens
cttatcaaggactctggtttc

SEQ ID NO: 4946527 - DNA, 21 bp, Homo sapiens
cttatcactgcattattctct

SEQ ID NO: 4946528 - DNA, 12 bp, Homo sapiens
cttatcagagct

SEQ ID NO: 4946529 - DNA, 15 bp, Homo sapiens
cttatccataaaaaa

SEQ ID NO: 4946530 - DNA, 13 bp, Homo sapiens
cttatcctgcatt

SEQ ID NO: 4946531 - DNA, 17 bp, Homo sapiens
cttatcctgcattgtta

SEQ ID NO: 4946532 - DNA, 23 bp, Homo sapiens
cttatctcagtcatgcataaata

SEQ ID NO: 4946533 - DNA, 22 bp, Homo sapiens
cttatgacatcacttgtacaaa

SEQ ID NO: 4946534 - DNA, 15 bp, Homo sapiens
cttatgattgcagat

SEQ ID NO: 4946535 - DNA, 16 bp, Homo sapiens
cttatgcaaaatggaa

SEQ ID NO: 4946536 - DNA, 15 bp, Homo sapiens
cttatgtagatattt

SEQ ID NO: 4946537 - DNA, 17 bp, Homo sapiens
cttatgtagatatttgg

SEQ ID NO: 4946538 - DNA, 12 bp, Homo sapiens
cttattctgtag

SEQ ID NO: 4946539 - DNA, 12 bp, Homo sapiens
cttattgcaaaa

SEQ ID NO: 4946540 - DNA, 14 bp, Homo sapiens
cttattgcgctgct

SEQ ID NO: 4946541 - DNA, 16 bp, Homo sapiens
cttattgcgctgctac

SEQ ID NO: 4946542 - DNA, 14 bp, Homo sapiens
cttattgctgattt

SEQ ID NO: 4946543 - DNA, 16 bp, Homo sapiens
cttattgctgatttta

SEQ ID NO: 4946544 - DNA, 14 bp, Homo sapiens
cttattgcttagta

SEQ ID NO: 4946545 - DNA, 17 bp, Homo sapiens
cttatttgcttcattgt

SEQ ID NO: 4946546 - DNA, 15 bp, Homo sapiens
cttattttcaagaaa

SEQ ID NO: 4946547 - DNA, 17 bp, Homo sapiens
cttatttttgacagtgt

SEQ ID NO: 4946548 - DNA, 15 bp, Homo sapiens
cttcaaaaactgttt

SEQ ID NO: 4946549 - DNA, 23 bp, Homo sapiens
cttcaaaatgttatcttctcaag

SEQ ID NO: 4946550 - DNA, 16 bp, Homo sapiens
cttcaaatccttccaa

SEQ ID NO: 4946551 - DNA, 17 bp, Homo sapiens
cttcaacatcctgccag

SEQ ID NO: 4946552 - DNA, 16 bp, Homo sapiens
cttcaaccattcccca

SEQ ID NO: 4946553 - DNA, 20 bp, Homo sapiens
cttcaactgaccagcctcca

SEQ ID NO: 4946554 - DNA, 16 bp, Homo sapiens
cttcaaggcttccact

SEQ ID NO: 4946555 - DNA, 16 bp, Homo sapiens
cttcacagctctgtgt

SEQ ID NO: 4946556 - DNA, 19 bp, Homo sapiens
cttcacagtagagccagct

SEQ ID NO: 4946557 - DNA, 15 bp, Homo sapiens
cttcacattaaaaaa

SEQ ID NO: 4946558 - DNA, 17 bp, Homo sapiens
cttcacattaaaaaatg

SEQ ID NO: 4946559 - DNA, 19 bp, Homo sapiens
cttcaccagagcatttcca

SEQ ID NO: 4946560 - DNA, 14 bp, Homo sapiens
cttcaccccagtgg

SEQ ID NO: 4946561 - DNA, 19 bp, Homo sapiens
cttcaccccagtggccact

SEQ ID NO: 4946562 - DNA, 23 bp, Homo sapiens
cttcaccccagtggccactcagc

SEQ ID NO: 4946563 - DNA, 15 bp, Homo sapiens
cttcaccccccactc

SEQ ID NO: 4946564 - DNA, 22 bp, Homo sapiens
cttcaccccggcaggccctgca

SEQ ID NO: 4946565 - DNA, 23 bp, Homo sapiens
cttcaccccggcaggccctgcag

SEQ ID NO: 4946566 - DNA, 20 bp, Homo sapiens
cttcacctaagtctctgtga

SEQ ID NO: 4946567 - DNA, 14 bp, Homo sapiens
cttcacctcctcgc

SEQ ID NO: 4946568 - DNA, 15 bp, Homo sapiens
cttcactcactgtca

SEQ ID NO: 4946569 - DNA, 16 bp, Homo sapiens
cttcactgtataaata

SEQ ID NO: 4946570 - DNA, 23 bp, Homo sapiens
cttcactgtataaataggagagg

SEQ ID NO: 4946571 - DNA, 15 bp, Homo sapiens
cttcactgttgaaaa

SEQ ID NO: 4946572 - DNA, 19 bp, Homo sapiens
cttcactgttgaaaattat

SEQ ID NO: 4946573 - DNA, 21 bp, Homo sapiens
cttcagaattccatatcttgc

SEQ ID NO: 4946574 - DNA, 18 bp, Homo sapiens
cttcagatattattgctt

SEQ ID NO: 4946575 - DNA, 23 bp, Homo sapiens
cttcagatgggaggaaagagagc

SEQ ID NO: 4946576 - DNA, 13 bp, Homo sapiens
cttcagcattccc

SEQ ID NO: 4946577 - DNA, 15 bp, Homo sapiens
cttcagcattccctc

SEQ ID NO: 4946578 - DNA, 17 bp, Homo sapiens
cttcagcattccctccc

SEQ ID NO: 4946579 - DNA, 14 bp, Homo sapiens
cttcagcccccagc

SEQ ID NO: 4946580 - DNA, 21 bp, Homo sapiens
cttcagcccccagcccctccc

SEQ ID NO: 4946581 - DNA, 20 bp, Homo sapiens
cttcagcctcccgagtagct

SEQ ID NO: 4946582 - DNA, 13 bp, Homo sapiens
cttcagcctctcc

SEQ ID NO: 4946583 - DNA, 17 bp, Homo sapiens
cttcagcgtaaaatggt

SEQ ID NO: 4946584 - DNA, 20 bp, Homo sapiens
cttcagctagcttttaggaa

SEQ ID NO: 4946585 - DNA, 13 bp, Homo sapiens
cttcagctccagg

SEQ ID NO: 4946586 - DNA, 23 bp, Homo sapiens
cttcagctccagggaatccaagc

SEQ ID NO: 4946587 - DNA, 17 bp, Homo sapiens
cttcaggctcttctcct

SEQ ID NO: 4946588 - DNA, 21 bp, Homo sapiens
cttcaggcttcctgcaatttt

SEQ ID NO: 4946589 - DNA, 22 bp, Homo sapiens
cttcaggttatcgaaataacaa

SEQ ID NO: 4946590 - DNA, 12 bp, Homo sapiens
cttcagtcctgc

SEQ ID NO: 4946591 - DNA, 15 bp, Homo sapiens
cttcagtcctgctcc

SEQ ID NO: 4946592 - DNA, 18 bp, Homo sapiens
cttcagtcctgctccaga

SEQ ID NO: 4946593 - DNA, 19 bp, Homo sapiens
cttcagtcctgctccagaa

SEQ ID NO: 4946594 - DNA, 23 bp, Homo sapiens
cttcagtcctgctccagaatttg

SEQ ID NO: 4946595 - DNA, 14 bp, Homo sapiens
cttcagttggttgt

SEQ ID NO: 4946596 - DNA, 22 bp, Homo sapiens
cttcagttggttgtgtcttttt

SEQ ID NO: 4946597 - DNA, 14 bp, Homo sapiens
cttcataaatgaag

SEQ ID NO: 4946598 - DNA, 15 bp, Homo sapiens
cttcatccctttcca

SEQ ID NO: 4946599 - DNA, 14 bp, Homo sapiens
cttcatgccagcta

SEQ ID NO: 4946600 - DNA, 16 bp, Homo sapiens
cttcatgccagctact

SEQ ID NO: 4946601 - DNA, 14 bp, Homo sapiens
cttcatggaactca

SEQ ID NO: 4946602 - DNA, 21 bp, Homo sapiens
cttcatggaactcagctgtct

SEQ ID NO: 4946603 - DNA, 19 bp, Homo sapiens
cttcattcaatattgacat

SEQ ID NO: 4946604 - DNA, 22 bp, Homo sapiens
cttcattctccttgttgttggt

SEQ ID NO: 4946605 - DNA, 15 bp, Homo sapiens
cttcattgtccctct

SEQ ID NO: 4946606 - DNA, 16 bp, Homo sapiens
cttcattgtccctctt

SEQ ID NO: 4946607 - DNA, 20 bp, Homo sapiens
cttcattgtccctcttcact

SEQ ID NO: 4946608 - DNA, 19 bp, Homo sapiens
cttcatttaaaaaaatcac

SEQ ID NO: 4946609 - DNA, 15 bp, Homo sapiens
cttcatttcattgta

SEQ ID NO: 4946610 - DNA, 18 bp, Homo sapiens
cttcatttcattgtatga

SEQ ID NO: 4946611 - DNA, 23 bp, Homo sapiens
ctgctttgggctgccctggtgct

SEQ ID NO: 4946612 - DNA, 15 bp, Homo sapiens
ctgcttttggtctgt

SEQ ID NO: 4946613 - DNA, 17 bp, Homo sapiens
ctgcttttggtctgtgt

SEQ ID NO: 4946614 - DNA, 19 bp, Homo sapiens
ctgcttttgtctatgggac

SEQ ID NO: 4946615 - DNA, 15 bp, Homo sapiens
ctggaaccttgctgt

SEQ ID NO: 4946616 - DNA, 18 bp, Homo sapiens
ctggaaccttgctgtcct

SEQ ID NO: 4946617 - DNA, 22 bp, Homo sapiens
ctggaactctatctgggcctgg

SEQ ID NO: 4946618 - DNA, 15 bp, Homo sapiens
ctggaagcacagctt

SEQ ID NO: 4946619 - DNA, 18 bp, Homo sapiens
ctggaagctaatttgcat

SEQ ID NO: 4946620 - DNA, 19 bp, Homo sapiens
ctggaagctaatttgcatt

SEQ ID NO: 4946621 - DNA, 19 bp, Homo sapiens
ctggaaggggaagggacac

SEQ ID NO: 4946622 - DNA, 13 bp, Homo sapiens
ctggaataagaag

SEQ ID NO: 4946623 - DNA, 19 bp, Homo sapiens
ctggaataagaagcaaata

SEQ ID NO: 4946624 - DNA, 21 bp, Homo sapiens
ctggaataagaagcaaataaa

SEQ ID NO: 4946625 - DNA, 20 bp, Homo sapiens
ctggaatggaagggttctgg

SEQ ID NO: 4946626 - DNA, 18 bp, Homo sapiens
ctggacaagcagaggtgg

SEQ ID NO: 4946627 - DNA, 19 bp, Homo sapiens
ctggacagaggggactctg

SEQ ID NO: 4946628 - DNA, 14 bp, Homo sapiens
ctggacaggcatgt

SEQ ID NO: 4946629 - DNA, 13 bp, Homo sapiens
ctggacaggctct

SEQ ID NO: 4946630 - DNA, 23 bp, Homo sapiens
ctggacagtcactgccactttgc

SEQ ID NO: 4946631 - DNA, 21 bp, Homo sapiens
ctggacctgcctcctgcctgc

SEQ ID NO: 4946632 - DNA, 15 bp, Homo sapiens
ctggacctggtggct

SEQ ID NO: 4946633 - DNA, 16 bp, Homo sapiens
ctggacgtctttcttt

SEQ ID NO: 4946634 - DNA, 18 bp, Homo sapiens
ctggactcctctgtccag

SEQ ID NO: 4946635 - DNA, 22 bp, Homo sapiens
ctggactcctctgtccaggcac

SEQ ID NO: 4946636 - DNA, 14 bp, Homo sapiens
ctggactcttcaaa

SEQ ID NO: 4946637 - DNA, 15 bp, Homo sapiens
ctggactgacagcat

SEQ ID NO: 4946638 - DNA, 13 bp, Homo sapiens
ctggactgggagg

SEQ ID NO: 4946639 - DNA, 18 bp, Homo sapiens
ctggactttcctgttgtc

SEQ ID NO: 4946640 - DNA, 15 bp, Homo sapiens
ctggagaactagaga

SEQ ID NO: 4946641 - DNA, 18 bp, Homo sapiens
ctggagaagagaggagag

SEQ ID NO: 4946642 - DNA, 15 bp, Homo sapiens
ctggagacagcccca

SEQ ID NO: 4946643 - DNA, 19 bp, Homo sapiens
ctggagacagccccagagc

SEQ ID NO: 4946644 - DNA, 17 bp, Homo sapiens
ctggagaccagggagcc

SEQ ID NO: 4946645 - DNA, 17 bp, Homo sapiens
ctggagacccaccccac

SEQ ID NO: 4946646 - DNA, 23 bp, Homo sapiens
ctggagacccaccccacctgcag

SEQ ID NO: 4946647 - DNA, 22 bp, Homo sapiens
ctggagacgtggaacctctgtc

SEQ ID NO: 4946648 - DNA, 14 bp, Homo sapiens
ctggagagaaacaa

SEQ ID NO: 4946649 - DNA, 16 bp, Homo sapiens
ctggagatactggtgg

SEQ ID NO: 4946650 - DNA, 15 bp, Homo sapiens
ctggagcagaccacc

SEQ ID NO: 4946651 - DNA, 22 bp, Homo sapiens
ctggagcagaccaccccgcctg

SEQ ID NO: 4946652 - DNA, 19 bp, Homo sapiens
ctggagcctgagtcagggc

SEQ ID NO: 4946653 - DNA, 22 bp, Homo sapiens
ctggagcctgagtcagggccca

SEQ ID NO: 4946654 - DNA, 16 bp, Homo sapiens
ctggaggggtgtggct

SEQ ID NO: 4946655 - DNA, 18 bp, Homo sapiens
ctggaggtgggagcagga

SEQ ID NO: 4946656 - DNA, 19 bp, Homo sapiens
ctggaggtgggagcaggag

SEQ ID NO: 4946657 - DNA, 20 bp, Homo sapiens
ctggaggtggggcgaggcag

SEQ ID NO: 4946658 - DNA, 23 bp, Homo sapiens
ctggaggtggggcgaggcaggcc

SEQ ID NO: 4946659 - DNA, 18 bp, Homo sapiens
ctggagtctggagtgggc

SEQ ID NO: 4946660 - DNA, 16 bp, Homo sapiens
ctggagtgcagtgagc

SEQ ID NO: 4946661 - DNA, 14 bp, Homo sapiens
ctggagtgcagtgg

SEQ ID NO: 4946662 - DNA, 13 bp, Homo sapiens
ctggagtgggcag

SEQ ID NO: 4946663 - DNA, 18 bp, Homo sapiens
ctggagtgtggctgagga

SEQ ID NO: 4946664 - DNA, 19 bp, Homo sapiens
ctggagtgtggctgaggag

SEQ ID NO: 4946665 - DNA, 21 bp, Homo sapiens
ctggagtgtggctgaggaggc

SEQ ID NO: 4946666 - DNA, 13 bp, Homo sapiens
ctggataggagcc

SEQ ID NO: 4946667 - DNA, 20 bp, Homo sapiens
ctggatcacgacgctgcaga

SEQ ID NO: 4946668 - DNA, 21 bp, Homo sapiens
ctggatcacgacgctgcagag

SEQ ID NO: 4946669 - DNA, 18 bp, Homo sapiens
ctggatcccctctgtcta

SEQ ID NO: 4946670 - DNA, 23 bp, Homo sapiens
ctggatcccctctgtctacaaat

SEQ ID NO: 4946671 - DNA, 18 bp, Homo sapiens
ctggatggagcccaggcg

SEQ ID NO: 4946672 - DNA, 17 bp, Homo sapiens
ctggattcattgtctct

SEQ ID NO: 4946673 - DNA, 15 bp, Homo sapiens
ctggcaattgtctat

SEQ ID NO: 4946674 - DNA, 18 bp, Homo sapiens
ctggcaattgtctattta

SEQ ID NO: 4946675 - DNA, 12 bp, Homo sapiens
ctggcacacatc

SEQ ID NO: 4946676 - DNA, 21 bp, Homo sapiens
ctggcacacatcaggagttca

SEQ ID NO: 4946677 - DNA, 15 bp, Homo sapiens
ctggcacagggcagt

SEQ ID NO: 4946678 - DNA, 19 bp, Homo sapiens
ctggcacccggcccctgct

SEQ ID NO: 4946679 - DNA, 20 bp, Homo sapiens
ctggcacccggcccctgctg

SEQ ID NO: 4946680 - DNA, 21 bp, Homo sapiens
ctggcacccggcccctgctgg

SEQ ID NO: 4946681 - DNA, 21 bp, Homo sapiens
ctggcacggtggctcaggcct

SEQ ID NO: 4946682 - DNA, 23 bp, Homo sapiens
ctggcagaaagggaacagaaagg

SEQ ID NO: 4946683 - DNA, 16 bp, Homo sapiens
ctggcagaagggagca

SEQ ID NO: 4946684 - DNA, 15 bp, Homo sapiens
ctggcagattcaaat

SEQ ID NO: 4946685 - DNA, 12 bp, Homo sapiens
ctggcagcccag

SEQ ID NO: 4946686 - DNA, 22 bp, Homo sapiens
ctggcagcccagagactttgta

SEQ ID NO: 4946687 - DNA, 18 bp, Homo sapiens
ctggcagccgtgccttca

SEQ ID NO: 4946688 - DNA, 21 bp, Homo sapiens
ctggcagccgtgccttcagct

SEQ ID NO: 4946689 - DNA, 17 bp, Homo sapiens
ctggcagggaggtcagg

SEQ ID NO: 4946690 - DNA, 23 bp, Homo sapiens
ctggcagggctggccccagggca

SEQ ID NO: 4946691 - DNA, 15 bp, Homo sapiens
ctggcagggggcatg

SEQ ID NO: 4946692 - DNA, 23 bp, Homo sapiens
ctggcatcaagaggtgggagggc

SEQ ID NO: 4946693 - DNA, 13 bp, Homo sapiens
ctggccagaatgc

SEQ ID NO: 4946694 - DNA, 18 bp, Homo sapiens
ctggccagatgcaccagc

SEQ ID NO: 4946695 - DNA, 20 bp, Homo sapiens
ctggccagatgcaccagccc

SEQ ID NO: 4946696 - DNA, 21 bp, Homo sapiens
ctggccagatgcaccagccct

SEQ ID NO: 4946697 - DNA, 13 bp, Homo sapiens
ctggccagcctgg

SEQ ID NO: 4946698 - DNA, 15 bp, Homo sapiens
ctggccagcctgggg

SEQ ID NO: 4946699 - DNA, 20 bp, Homo sapiens
ctggccagcctggggcctgg

SEQ ID NO: 4946700 - DNA, 13 bp, Homo sapiens
ctggccaggagct

SEQ ID NO: 4946701 - DNA, 12 bp, Homo sapiens
ctacttagcatc

SEQ ID NO: 4946702 - DNA, 22 bp, Homo sapiens
ctacttagcatcctaagaaata

SEQ ID NO: 4946703 - DNA, 23 bp, Homo sapiens
ctacttagcatcctaagaaatat

SEQ ID NO: 4946704 - DNA, 22 bp, Homo sapiens
ctacttagcatgtccctaccga

SEQ ID NO: 4946705 - DNA, 19 bp, Homo sapiens
ctacttcctcctccccact

SEQ ID NO: 4946706 - DNA, 14 bp, Homo sapiens
ctacttggtttgtg

SEQ ID NO: 4946707 - DNA, 15 bp, Homo sapiens
ctacttggtttgtgt

SEQ ID NO: 4946708 - DNA, 23 bp, Homo sapiens
ctagaaaacattttttttttaaa

SEQ ID NO: 4946709 - DNA, 18 bp, Homo sapiens
ctagaaacccaagctcct

SEQ ID NO: 4946710 - DNA, 19 bp, Homo sapiens
ctagaaatgtgaatgagga

SEQ ID NO: 4946711 - DNA, 14 bp, Homo sapiens
ctagaacacaggca

SEQ ID NO: 4946712 - DNA, 10 bp, Homo sapiens
ctagaacttt

SEQ ID NO: 4946713 - DNA, 15 bp, Homo sapiens
ctagaacttttttaa

SEQ ID NO: 4946714 - DNA, 19 bp, Homo sapiens
ctagaacttttttaaataa

SEQ ID NO: 4946715 - DNA, 20 bp, Homo sapiens
ctagaacttttttaaataaa

SEQ ID NO: 4946716 - DNA, 20 bp, Homo sapiens
ctagaagggccagtcctgcc

SEQ ID NO: 4946717 - DNA, 23 bp, Homo sapiens
ctagaagggccagtcctgcctgg

SEQ ID NO: 4946718 - DNA, 20 bp, Homo sapiens
ctagaagtttcccttcctcc

SEQ ID NO: 4946719 - DNA, 12 bp, Homo sapiens
ctagaatggata

SEQ ID NO: 4946720 - DNA, 20 bp, Homo sapiens
ctagaattataagtcacaaa

SEQ ID NO: 4946721 - DNA, 19 bp, Homo sapiens
ctagacaccaaagttctaa

SEQ ID NO: 4946722 - DNA, 21 bp, Homo sapiens
ctagacaccaaagttctaata

SEQ ID NO: 4946723 - DNA, 17 bp, Homo sapiens
ctagacatggaggttct

SEQ ID NO: 4946724 - DNA, 19 bp, Homo sapiens
ctagacatggaggttctaa

SEQ ID NO: 4946725 - DNA, 20 bp, Homo sapiens
ctagacgttcatttgtgtgc

SEQ ID NO: 4946726 - DNA, 13 bp, Homo sapiens
ctagactttctgt

SEQ ID NO: 4946727 - DNA, 16 bp, Homo sapiens
ctagagaagataattg

SEQ ID NO: 4946728 - DNA, 18 bp, Homo sapiens
ctagagaagataattgtt

SEQ ID NO: 4946729 - DNA, 21 bp, Homo sapiens
ctagagaatgcacagatatac

SEQ ID NO: 4946730 - DNA, 15 bp, Homo sapiens
ctagagccagaccaa

SEQ ID NO: 4946731 - DNA, 11 bp, Homo sapiens
ctagagcctgc

SEQ ID NO: 4946732 - DNA, 16 bp, Homo sapiens
ctagagcctgcctgga

SEQ ID NO: 4946733 - DNA, 19 bp, Homo sapiens
ctagaggccagccccaccc

SEQ ID NO: 4946734 - DNA, 21 bp, Homo sapiens
ctagaggccagccccacccag

SEQ ID NO: 4946735 - DNA, 15 bp, Homo sapiens
ctagagtccaaggtt

SEQ ID NO: 4946736 - DNA, 18 bp, Homo sapiens
ctagatcagatgctccaa

SEQ ID NO: 4946737 - DNA, 15 bp, Homo sapiens
ctagatcctaagggt

SEQ ID NO: 4946738 - DNA, 16 bp, Homo sapiens
ctagatcctaagggtc

SEQ ID NO: 4946739 - DNA, 17 bp, Homo sapiens
ctagatcctaagggtcg

SEQ ID NO: 4946740 - DNA, 17 bp, Homo sapiens
ctagatgaagttttaca

SEQ ID NO: 4946741 - DNA, 15 bp, Homo sapiens
ctagattcaaaggtt

SEQ ID NO: 4946742 - DNA, 18 bp, Homo sapiens
ctagattcaaaggttcta

SEQ ID NO: 4946743 - DNA, 13 bp, Homo sapiens
ctgcctctgcctt

SEQ ID NO: 4946744 - DNA, 15 bp, Homo sapiens
ctgcctgaagtcaca

SEQ ID NO: 4946745 - DNA, 19 bp, Homo sapiens
ctgcctgaagtcacacagt

SEQ ID NO: 4946746 - DNA, 20 bp, Homo sapiens
ctgcctgcagtactttacct

SEQ ID NO: 4946747 - DNA, 17 bp, Homo sapiens
ctgcctgccatgtacct

SEQ ID NO: 4946748 - DNA, 13 bp, Homo sapiens
ctgcctgcccagg

SEQ ID NO: 4946749 - DNA, 16 bp, Homo sapiens
ctgcctgcccaggccc

SEQ ID NO: 4946750 - DNA, 19 bp, Homo sapiens
ctgcctgcccgcacagcag

SEQ ID NO: 4946751 - DNA, 14 bp, Homo sapiens
ctgcctggccactg

SEQ ID NO: 4946752 - DNA, 13 bp, Homo sapiens
ctgcctggcccct

SEQ ID NO: 4946753 - DNA, 16 bp, Homo sapiens
ctgcctgtagttagga

SEQ ID NO: 4946754 - DNA, 20 bp, Homo sapiens
ctgcctgtagttaggaaata

SEQ ID NO: 4946755 - DNA, 19 bp, Homo sapiens
ctgcctgtatactttagta

SEQ ID NO: 4946756 - DNA, 20 bp, Homo sapiens
ctgcctgtatactttagtat

SEQ ID NO: 4946757 - DNA, 17 bp, Homo sapiens
ctgcctgttcagctcca

SEQ ID NO: 4946758 - DNA, 19 bp, Homo sapiens
ctgcctgttcagctccagc

SEQ ID NO: 4946759 - DNA, 20 bp, Homo sapiens
ctgcctgttcagctccagct

SEQ ID NO: 4946760 - DNA, 15 bp, Homo sapiens
ctgccttagaggagc

SEQ ID NO: 4946761 - DNA, 16 bp, Homo sapiens
ctgccttagaggagcc

SEQ ID NO: 4946762 - DNA, 17 bp, Homo sapiens
ctgccttaggcctacct

SEQ ID NO: 4946763 - DNA, 17 bp, Homo sapiens
ctgccttgaacctgtga

SEQ ID NO: 4946764 - DNA, 19 bp, Homo sapiens
ctgccttgaacctgtgagt

SEQ ID NO: 4946765 - DNA, 16 bp, Homo sapiens
ctgccttgctgttggt

SEQ ID NO: 4946766 - DNA, 17 bp, Homo sapiens
ctgccttggcctcccaa

SEQ ID NO: 4946767 - DNA, 14 bp, Homo sapiens
ctgccttggctcag

SEQ ID NO: 4946768 - DNA, 15 bp, Homo sapiens
ctgccttggctcaga

SEQ ID NO: 4946769 - DNA, 17 bp, Homo sapiens
ctgcctttgacatttaa

SEQ ID NO: 4946770 - DNA, 18 bp, Homo sapiens
ctgcctttgatgttacag

SEQ ID NO: 4946771 - DNA, 18 bp, Homo sapiens
ctgcgcccttaccttccc

SEQ ID NO: 4946772 - DNA, 14 bp, Homo sapiens
ctgcggaaaaggaa

SEQ ID NO: 4946773 - DNA, 21 bp, Homo sapiens
ctgcggaatgaaccacatctt

SEQ ID NO: 4946774 - DNA, 13 bp, Homo sapiens
ctgcggaccccag

SEQ ID NO: 4946775 - DNA, 16 bp, Homo sapiens
ctgcggaccccagctg

SEQ ID NO: 4946776 - DNA, 20 bp, Homo sapiens
ctgcggaccccagctgtgag

SEQ ID NO: 4946777 - DNA, 18 bp, Homo sapiens
ctgcggtccacccaggag

SEQ ID NO: 4946778 - DNA, 16 bp, Homo sapiens
ctgctacacatacagg

SEQ ID NO: 4946779 - DNA, 17 bp, Homo sapiens
ctgctacccagaaatca

SEQ ID NO: 4946780 - DNA, 21 bp, Homo sapiens
ctgctaccgttgacttccagg

SEQ ID NO: 4946781 - DNA, 12 bp, Homo sapiens
ctgctagaactt

SEQ ID NO: 4946782 - DNA, 22 bp, Homo sapiens
ctgctagaacttttttaaataa

SEQ ID NO: 4946783 - DNA, 23 bp, Homo sapiens
ctgctagaacttttttaaataaa

SEQ ID NO: 4946784 - DNA, 16 bp, Homo sapiens
ctgctatcctgccaaa

SEQ ID NO: 4946785 - DNA, 13 bp, Homo sapiens
ctgctcagacaga

SEQ ID NO: 4946786 - DNA, 20 bp, Homo sapiens
ctgctcaggctgcagctgga

SEQ ID NO: 4946787 - DNA, 22 bp, Homo sapiens
ctgctcaggctgcagctggaca

SEQ ID NO: 4946788 - DNA, 23 bp, Homo sapiens
ctgctcaggctgcagctggacag

SEQ ID NO: 4946789 - DNA, 11 bp, Homo sapiens
ctgctccaccc

SEQ ID NO: 4946790 - DNA, 13 bp, Homo sapiens
ctgctccaccctt

SEQ ID NO: 4946791 - DNA, 14 bp, Homo sapiens
ctgctccacccttg

SEQ ID NO: 4946792 - DNA, 20 bp, Homo sapiens
ctgctccacccttggcctgt

SEQ ID NO: 4946793 - DNA, 21 bp, Homo sapiens
ctgctccacccttggcctgtc

SEQ ID NO: 4946794 - DNA, 12 bp, Homo sapiens
ctgctccacgcg

SEQ ID NO: 4946795 - DNA, 18 bp, Homo sapiens
ctgctccagaatttggaa

SEQ ID NO: 4946796 - DNA, 23 bp, Homo sapiens
ctgctccagaatttggaaatcct

SEQ ID NO: 4946797 - DNA, 14 bp, Homo sapiens
ctgctccaggcctg

SEQ ID NO: 4946798 - DNA, 15 bp, Homo sapiens
ctgctccaggcctgc

SEQ ID NO: 4946799 - DNA, 19 bp, Homo sapiens
ctgctccaggcctgcagca

SEQ ID NO: 4946800 - DNA, 17 bp, Homo sapiens
ctgctccccagccctgg

SEQ ID NO: 4946801 - DNA, 18 bp, Homo sapiens
ctgctccccagccctggc

SEQ ID NO: 4946802 - DNA, 19 bp, Homo sapiens
ctgctccccagccctggct

SEQ ID NO: 4946803 - DNA, 13 bp, Homo sapiens
ctgctccctaagc

SEQ ID NO: 4946804 - DNA, 19 bp, Homo sapiens
ctgctccctaagccagcct

SEQ ID NO: 4946805 - DNA, 20 bp, Homo sapiens
ctgctccctaagccagcctg

SEQ ID NO: 4946806 - DNA, 21 bp, Homo sapiens
ctgctccctaagccagcctgg

SEQ ID NO: 4946807 - DNA, 14 bp, Homo sapiens
ctgctccgctgctc

SEQ ID NO: 4946808 - DNA, 13 bp, Homo sapiens
ctgctcctcatgg

SEQ ID NO: 4946809 - DNA, 16 bp, Homo sapiens
ctgctcctctccccag

SEQ ID NO: 4946810 - DNA, 13 bp, Homo sapiens
ctgctccttggct

SEQ ID NO: 4946811 - DNA, 15 bp, Homo sapiens
ctgctcgccctcctt

SEQ ID NO: 4946812 - DNA, 23 bp, Homo sapiens
ctgctcgccctcctttctgtgcc

SEQ ID NO: 4946813 - DNA, 21 bp, Homo sapiens
ctgctctcctcttgccactgc

SEQ ID NO: 4946814 - DNA, 20 bp, Homo sapiens
ctgctgaaaaccatctggcc

SEQ ID NO: 4946815 - DNA, 22 bp, Homo sapiens
ctgctgaaaaccatctggcctg

SEQ ID NO: 4946816 - DNA, 23 bp, Homo sapiens
ctgctgaaaaccatctggcctgg

SEQ ID NO: 4946817 - DNA, 17 bp, Homo sapiens
ctgctgaaggaataaat

SEQ ID NO: 4946818 - DNA, 23 bp, Homo sapiens
ctgctgacagacacaggcccggc

SEQ ID NO: 4946819 - DNA, 9 bp, Homo sapiens
ctgctgacc

SEQ ID NO: 4946820 - DNA, 12 bp, Homo sapiens
ctgctgcagggg

SEQ ID NO: 4946821 - DNA, 13 bp, Homo sapiens
ctgctgcaggggc

SEQ ID NO: 4946822 - DNA, 16 bp, Homo sapiens
ctgctgcaggggctct

SEQ ID NO: 4946823 - DNA, 17 bp, Homo sapiens
ctgctgcaggggctctg

SEQ ID NO: 4946824 - DNA, 20 bp, Homo sapiens
ctgctgcatttgtgtcatct

SEQ ID NO: 4946825 - DNA, 14 bp, Homo sapiens
ctgctgccgcctcc

SEQ ID NO: 4946826 - DNA, 20 bp, Homo sapiens
ctgctgccgcctcccagcct

SEQ ID NO: 4946827 - DNA, 22 bp, Homo sapiens
ctgctgcctgcccgcacagcag

SEQ ID NO: 4946828 - DNA, 12 bp, Homo sapiens
ctgctgcctggc

SEQ ID NO: 4946829 - DNA, 23 bp, Homo sapiens
ctgctgccttctgacggccctgc

SEQ ID NO: 4946830 - DNA, 14 bp, Homo sapiens
ctgctgctgtccct

SEQ ID NO: 4946831 - DNA, 20 bp, Homo sapiens
ctgctggagtttcatgtaca

SEQ ID NO: 4946832 - DNA, 12 bp, Homo sapiens
ctctttctctcc

SEQ ID NO: 4946833 - DNA, 17 bp, Homo sapiens
ctctttctctcttccct

SEQ ID NO: 4946834 - DNA, 12 bp, Homo sapiens
ctctttctcttt

SEQ ID NO: 4946835 - DNA, 14 bp, Homo sapiens
ctctttctctttct

SEQ ID NO: 4946836 - DNA, 13 bp, Homo sapiens
ctctttctgtata

SEQ ID NO: 4946837 - DNA, 14 bp, Homo sapiens
ctctttctgtatat

SEQ ID NO: 4946838 - DNA, 14 bp, Homo sapiens
ctctttcttccttt

SEQ ID NO: 4946839 - DNA, 23 bp, Homo sapiens
ctctttcttcctttactttccct

SEQ ID NO: 4946840 - DNA, 22 bp, Homo sapiens
ctctttgaaatagtctgtgtga

SEQ ID NO: 4946841 - DNA, 15 bp, Homo sapiens
ctcttttctgtactt

SEQ ID NO: 4946842 - DNA, 10 bp, Homo sapiens
ctcttttctt

SEQ ID NO: 4946843 - DNA, 16 bp, Homo sapiens
ctcttttcttactcct

SEQ ID NO: 4946844 - DNA, 22 bp, Homo sapiens
ctcttttcttactcctcctctt

SEQ ID NO: 4946845 - DNA, 21 bp, Homo sapiens
ctcttttgctttattccagaa

SEQ ID NO: 4946846 - DNA, 14 bp, Homo sapiens
ctcttttgtaaatt

SEQ ID NO: 4946847 - DNA, 18 bp, Homo sapiens
ctcttttgttaaataata

SEQ ID NO: 4946848 - DNA, 21 bp, Homo sapiens
ctcttttttactcattgaaat

SEQ ID NO: 4946849 - DNA, 20 bp, Homo sapiens
ctcttttttgtttgtttctt

SEQ ID NO: 4946850 - DNA, 21 bp, Homo sapiens
ctcttttttgtttgtttcttt

SEQ ID NO: 4946851 - DNA, 21 bp, Homo sapiens
ctgaaaaaacacctagcttta

SEQ ID NO: 4946852 - DNA, 19 bp, Homo sapiens
ctgaaaaccatctggcctg

SEQ ID NO: 4946853 - DNA, 13 bp, Homo sapiens
ctgaaaactggaa

SEQ ID NO: 4946854 - DNA, 15 bp, Homo sapiens
ctgaaaatataaaac

SEQ ID NO: 4946855 - DNA, 15 bp, Homo sapiens
ctgaaaatctaatat

SEQ ID NO: 4946856 - DNA, 16 bp, Homo sapiens
ctgaaaatctaatatt

SEQ ID NO: 4946857 - DNA, 20 bp, Homo sapiens
ctgaaaatctaatattaaaa

SEQ ID NO: 4946858 - DNA, 12 bp, Homo sapiens
ctgaaaatgttg

SEQ ID NO: 4946859 - DNA, 21 bp, Homo sapiens
ctgaaaatgttgttatgctat

SEQ ID NO: 4946860 - DNA, 20 bp, Homo sapiens
ctgaaacacgaaacttgtta

SEQ ID NO: 4946861 - DNA, 17 bp, Homo sapiens
ctgaaacagatttcata

SEQ ID NO: 4946862 - DNA, 13 bp, Homo sapiens
ctgaaacttccct

SEQ ID NO: 4946863 - DNA, 17 bp, Homo sapiens
ctgaaagttacccactg

SEQ ID NO: 4946864 - DNA, 22 bp, Homo sapiens
ctgaaagttacccactgaagcc

SEQ ID NO: 4946865 - DNA, 12 bp, Homo sapiens
ctgaaagttctt

SEQ ID NO: 4946866 - DNA, 16 bp, Homo sapiens
ctgaaataggaaacaa

SEQ ID NO: 4946867 - DNA, 13 bp, Homo sapiens
ctgaaattccaaa

SEQ ID NO: 4946868 - DNA, 16 bp, Homo sapiens
ctgaaattccaaagtc

SEQ ID NO: 4946869 - DNA, 18 bp, Homo sapiens
ctgaaattccaaagtctc

SEQ ID NO: 4946870 - DNA, 20 bp, Homo sapiens
ctgaaattccaaagtctcta

SEQ ID NO: 4946871 - DNA, 16 bp, Homo sapiens
ctgaacaagaattgga

SEQ ID NO: 4946872 - DNA, 19 bp, Homo sapiens
ctgaacaataggctgttcc

SEQ ID NO: 4946873 - DNA, 22 bp, Homo sapiens
ctgaacacaggcagctttctag

SEQ ID NO: 4946874 - DNA, 17 bp, Homo sapiens
ctgaaccgcacagctca

SEQ ID NO: 4946875 - DNA, 14 bp, Homo sapiens
ctgaactttggaga

SEQ ID NO: 4946876 - DNA, 15 bp, Homo sapiens
ctgaagatgcagctc

SEQ ID NO: 4946877 - DNA, 13 bp, Homo sapiens
ctgaagcatgttt

SEQ ID NO: 4946878 - DNA, 20 bp, Homo sapiens
ctgaagcatgtttcatgttt

SEQ ID NO: 4946879 - DNA, 13 bp, Homo sapiens
ctgaagccagcct

SEQ ID NO: 4946880 - DNA, 17 bp, Homo sapiens
ctgaagccagccttctt

SEQ ID NO: 4946881 - DNA, 18 bp, Homo sapiens
ctgaagcccatttctccg

SEQ ID NO: 4946882 - DNA, 15 bp, Homo sapiens
ctgaagccctcccag

SEQ ID NO: 4946883 - DNA, 12 bp, Homo sapiens
ctgaagcctctg

SEQ ID NO: 4946884 - DNA, 13 bp, Homo sapiens
ctgaagcctctgg

SEQ ID NO: 4946885 - DNA, 20 bp, Homo sapiens
ctgaagcttgactcccaagt

SEQ ID NO: 4946886 - DNA, 21 bp, Homo sapiens
ctgaagcttgactcccaagtt

SEQ ID NO: 4946887 - DNA, 20 bp, Homo sapiens
ctgaaggacattgcggacag

SEQ ID NO: 4946888 - DNA, 17 bp, Homo sapiens
ctgaagtcactgcacag

SEQ ID NO: 4946889 - DNA, 22 bp, Homo sapiens
ctgaatcccccttgccacccca

SEQ ID NO: 4946890 - DNA, 19 bp, Homo sapiens
ctgaatcgagtgagacaaa

SEQ ID NO: 4946891 - DNA, 14 bp, Homo sapiens
ctgaatgctgccac

SEQ ID NO: 4946892 - DNA, 23 bp, Homo sapiens
ctgaatgtggtttcaatctaatt

SEQ ID NO: 4946893 - DNA, 17 bp, Homo sapiens
ctgaattaatcatctat

SEQ ID NO: 4946894 - DNA, 14 bp, Homo sapiens
ctgacaagggctga

SEQ ID NO: 4946895 - DNA, 22 bp, Homo sapiens
ctgacaagggctgacctgcctc

SEQ ID NO: 4946896 - DNA, 13 bp, Homo sapiens
ctgacacaaagga

SEQ ID NO: 4946897 - DNA, 15 bp, Homo sapiens
ctgacacaaaggaag

SEQ ID NO: 4946898 - DNA, 13 bp, Homo sapiens
ctgacacacagct

SEQ ID NO: 4946899 - DNA, 16 bp, Homo sapiens
ctgacacacagctctg

SEQ ID NO: 4946900 - DNA, 17 bp, Homo sapiens
ctgacacacagctctgt

SEQ ID NO: 4946901 - DNA, 21 bp, Homo sapiens
ctgacacacagctctgtcctg

SEQ ID NO: 4946902 - DNA, 23 bp, Homo sapiens
ctgacacacagctctgtcctggg

SEQ ID NO: 4946903 - DNA, 13 bp, Homo sapiens
ctgacacaggaaa

SEQ ID NO: 4946904 - DNA, 21 bp, Homo sapiens
ctgacacaggaaaccaacacc

SEQ ID NO: 4946905 - DNA, 21 bp, Homo sapiens
ctgacagaaggtgccacttta

SEQ ID NO: 4946906 - DNA, 14 bp, Homo sapiens
ctgacagacacagg

SEQ ID NO: 4946907 - DNA, 21 bp, Homo sapiens
ctgacagacacaggcccggct

SEQ ID NO: 4946908 - DNA, 20 bp, Homo sapiens
ctgacagcatgtgccctcct

SEQ ID NO: 4946909 - DNA, 14 bp, Homo sapiens
ctgacagcctccca

SEQ ID NO: 4946910 - DNA, 11 bp, Homo sapiens
ctgacaggcaa

SEQ ID NO: 4946911 - DNA, 17 bp, Homo sapiens
ctgacatggctctggac

SEQ ID NO: 4946912 - DNA, 18 bp, Homo sapiens
ctgacatggctctggact

SEQ ID NO: 4946913 - DNA, 14 bp, Homo sapiens
ctgaccaacaggct

SEQ ID NO: 4946914 - DNA, 15 bp, Homo sapiens
ctgaccaacaggctg

SEQ ID NO: 4946915 - DNA, 17 bp, Homo sapiens
ctgaccaattgtgctgc

SEQ ID NO: 4946916 - DNA, 18 bp, Homo sapiens
ctgaccaattgtgctgcc

SEQ ID NO: 4946917 - DNA, 17 bp, Homo sapiens
ctgaccagcctccatgc

SEQ ID NO: 4946918 - DNA, 16 bp, Homo sapiens
ctgaccatccactcta

SEQ ID NO: 4946919 - DNA, 13 bp, Homo sapiens
ctgacccagtgag

SEQ ID NO: 4946920 - DNA, 14 bp, Homo sapiens
ctgacccagtgaga

SEQ ID NO: 4946921 - DNA, 21 bp, Homo sapiens
ctgaccccaaacaccttccag

SEQ ID NO: 4946922 - DNA, 17 bp, Homo sapiens
ctgacccctcctcactg

SEQ ID NO: 4946923 - DNA, 20 bp, Homo sapiens
ctgacccctcctcactggcc

SEQ ID NO: 4946924 - DNA, 18 bp, Homo sapiens
ctgacccttccagacata

SEQ ID NO: 4946925 - DNA, 19 bp, Homo sapiens
ctgacctcttgctgtctct

SEQ ID NO: 4946926 - DNA, 18 bp, Homo sapiens
ctgacctgcctctcacac

SEQ ID NO: 4946927 - DNA, 22 bp, Homo sapiens
ctgacctgcctctcacacacat

SEQ ID NO: 4946928 - DNA, 20 bp, Homo sapiens
ctgacgaaactggccccgga

SEQ ID NO: 4946929 - DNA, 17 bp, Homo sapiens
ctgactactggctctca

SEQ ID NO: 4946930 - DNA, 23 bp, Homo sapiens
ctgactagaagggccagtcctgc

SEQ ID NO: 4946931 - DNA, 12 bp, Homo sapiens
ctgactctgccc

SEQ ID NO: 4946932 - DNA, 14 bp, Homo sapiens
ctgactctgccccc

SEQ ID NO: 4946933 - DNA, 21 bp, Homo sapiens
ctgactggattcattctcata

SEQ ID NO: 4946934 - DNA, 19 bp, Homo sapiens
ctgactgtaacatattctg

SEQ ID NO: 4946935 - DNA, 22 bp, Homo sapiens
ctgactgtcctctcccctccag

SEQ ID NO: 4946936 - DNA, 13 bp, Homo sapiens
ctgacttggggga

SEQ ID NO: 4946937 - DNA, 20 bp, Homo sapiens
ctgacttgtttgtcttccat

SEQ ID NO: 4946938 - DNA, 12 bp, Homo sapiens
ctgagaaaacaa

SEQ ID NO: 4946939 - DNA, 10 bp, Homo sapiens
ctgagaaaag

SEQ ID NO: 4946940 - DNA, 14 bp, Homo sapiens
ctgagaactcctga

SEQ ID NO: 4946941 - DNA, 16 bp, Homo sapiens
ctgagaactcctgact

SEQ ID NO: 4946942 - DNA, 20 bp, Homo sapiens
ctcccagtccaaatgtcctc

SEQ ID NO: 4946943 - DNA, 23 bp, Homo sapiens
ctcccatcatgcccggtcccacc

SEQ ID NO: 4946944 - DNA, 21 bp, Homo sapiens
ctcccatcattacccttccct

SEQ ID NO: 4946945 - DNA, 15 bp, Homo sapiens
ctcccatcccctgga

SEQ ID NO: 4946946 - DNA, 12 bp, Homo sapiens
ctcccatgaagc

SEQ ID NO: 4946947 - DNA, 14 bp, Homo sapiens
ctcccatgaagcct

SEQ ID NO: 4946948 - DNA, 17 bp, Homo sapiens
ctcccatgaagcctttt

SEQ ID NO: 4946949 - DNA, 15 bp, Homo sapiens
ctccccaacccccat

SEQ ID NO: 4946950 - DNA, 23 bp, Homo sapiens
ctccccaaccctaggttccctgt

SEQ ID NO: 4946951 - DNA, 18 bp, Homo sapiens
ctccccaaggaagagcca

SEQ ID NO: 4946952 - DNA, 21 bp, Homo sapiens
ctccccacactaacctgggtt

SEQ ID NO: 4946953 - DNA, 14 bp, Homo sapiens
ctccccacccgccc

SEQ ID NO: 4946954 - DNA, 15 bp, Homo sapiens
ctccccacgccctcc

SEQ ID NO: 4946955 - DNA, 12 bp, Homo sapiens
ctccccagcaag

SEQ ID NO: 4946956 - DNA, 22 bp, Homo sapiens
ctccccagcaagtgagagctgg

SEQ ID NO: 4946957 - DNA, 11 bp, Homo sapiens
ctccccagccc

SEQ ID NO: 4946958 - DNA, 19 bp, Homo sapiens
ctccccagcccctagccca

SEQ ID NO: 4946959 - DNA, 21 bp, Homo sapiens
ctccccagcccctagcccagg

SEQ ID NO: 4946960 - DNA, 13 bp, Homo sapiens
ctccccagccctg

SEQ ID NO: 4946961 - DNA, 16 bp, Homo sapiens
ctccccagtgtatgtc

SEQ ID NO: 4946962 - DNA, 11 bp, Homo sapiens
ctccccagttc

SEQ ID NO: 4946963 - DNA, 14 bp, Homo sapiens
ctccccatcccatg

SEQ ID NO: 4946964 - DNA, 22 bp, Homo sapiens
ctccccctaaacccctgtccca

SEQ ID NO: 4946965 - DNA, 20 bp, Homo sapiens
ctccccggcaccctctggcc

SEQ ID NO: 4946966 - DNA, 14 bp, Homo sapiens
ctccccggctcgag

SEQ ID NO: 4946967 - DNA, 14 bp, Homo sapiens
ctcccctcacagcc

SEQ ID NO: 4946968 - DNA, 16 bp, Homo sapiens
ctcccctcacagcctc

SEQ ID NO: 4946969 - DNA, 17 bp, Homo sapiens
ctcccctcacagcctct

SEQ ID NO: 4946970 - DNA, 17 bp, Homo sapiens
ctcccctcccctgctgc

SEQ ID NO: 4946971 - DNA, 14 bp, Homo sapiens
ctcccctgccctgc

SEQ ID NO: 4946972 - DNA, 15 bp, Homo sapiens
ctcccctgccctgct

SEQ ID NO: 4946973 - DNA, 12 bp, Homo sapiens
ctcccctgcctt

SEQ ID NO: 4946974 - DNA, 13 bp, Homo sapiens
ctcccctgccttg

SEQ ID NO: 4946975 - DNA, 16 bp, Homo sapiens
cgtgccgcctgcactc

SEQ ID NO: 4946976 - DNA, 16 bp, Homo sapiens
cgtgccttcagctcta

SEQ ID NO: 4946977 - DNA, 18 bp, Homo sapiens
cgtgccttcagctctaca

SEQ ID NO: 4946978 - DNA, 16 bp, Homo sapiens
cgtggaacctctgtct

SEQ ID NO: 4946979 - DNA, 18 bp, Homo sapiens
cgtggaacctctgtctca

SEQ ID NO: 4946980 - DNA, 16 bp, Homo sapiens
cgtggactctgcacat

SEQ ID NO: 4946981 - DNA, 17 bp, Homo sapiens
cgtggcaaatataaaac

SEQ ID NO: 4946982 - DNA, 23 bp, Homo sapiens
cgtggctgtgctctcaccagctg

SEQ ID NO: 4946983 - DNA, 22 bp, Homo sapiens
cgtgggagacaagaaatccctg

SEQ ID NO: 4946984 - DNA, 21 bp, Homo sapiens
cgtggtccccaacagcgacat

SEQ ID NO: 4946985 - DNA, 14 bp, Homo sapiens
cgtgtcttccactt

SEQ ID NO: 4946986 - DNA, 17 bp, Homo sapiens
cgtgtgagtgtgacagg

SEQ ID NO: 4946987 - DNA, 14 bp, Homo sapiens
cgttacagctcccc

SEQ ID NO: 4946988 - DNA, 19 bp, Homo sapiens
cgttactcagggctcctcc

SEQ ID NO: 4946989 - DNA, 23 bp, Homo sapiens
cgttactcagggctcctcccagc

SEQ ID NO: 4946990 - DNA, 11 bp, Homo sapiens
cgttcatttgt

SEQ ID NO: 4946991 - DNA, 17 bp, Homo sapiens
cgttccacagttgccac

SEQ ID NO: 4946992 - DNA, 20 bp, Homo sapiens
cgttccacagttgccaccac

SEQ ID NO: 4946993 - DNA, 19 bp, Homo sapiens
cgttcctgacatcacagca

SEQ ID NO: 4946994 - DNA, 22 bp, Homo sapiens
cgttcctgacatcacagcagcc

SEQ ID NO: 4946995 - DNA, 15 bp, Homo sapiens
cgttggtccagagcg

SEQ ID NO: 4946996 - DNA, 17 bp, Homo sapiens
cgtttacctagaagaag

SEQ ID NO: 4946997 - DNA, 20 bp, Homo sapiens
cgtttcctgagaagtgtcta

SEQ ID NO: 4946998 - DNA, 18 bp, Homo sapiens
cgtttctccacctagact

SEQ ID NO: 4946999 - DNA, 22 bp, Homo sapiens
cgtttctccacctagactgtaa

SEQ ID NO: 4947000 - DNA, 17 bp, Homo sapiens
cgtttgaccttttatgt

SEQ ID NO: 4947001 - DNA, 14 bp, Homo sapiens
cgtttgtatgtgtg

SEQ ID NO: 4947002 - DNA, 19 bp, Homo sapiens
cgttttccaaactgactca

SEQ ID NO: 4947003 - DNA, 17 bp, Homo sapiens
cgttttttaaatgtata

SEQ ID NO: 4947004 - DNA, 13 bp, Homo sapiens
ctaaaaatccaga

SEQ ID NO: 4947005 - DNA, 14 bp, Homo sapiens
ctaaaagacatttg

SEQ ID NO: 4947006 - DNA, 12 bp, Homo sapiens
ctaaaagcaaaa

SEQ ID NO: 4947007 - DNA, 23 bp, Homo sapiens
ctaaaagtgggcttgattctgca

SEQ ID NO: 4947008 - DNA, 22 bp, Homo sapiens
ctaaaatcttatagttctaggc

SEQ ID NO: 4947009 - DNA, 14 bp, Homo sapiens
ctaaaatcttggaa

SEQ ID NO: 4947010 - DNA, 19 bp, Homo sapiens
ctaaaatgtgatgttctaa

SEQ ID NO: 4947011 - DNA, 22 bp, Homo sapiens
ctaaaatgtgatgttctaaggc

SEQ ID NO: 4947012 - DNA, 21 bp, Homo sapiens
ctaaaatttgtgggttttttt

SEQ ID NO: 4947013 - DNA, 17 bp, Homo sapiens
ctaaacatatgatttca

SEQ ID NO: 4947014 - DNA, 19 bp, Homo sapiens
ctaaacccaatccaaatgg

SEQ ID NO: 4947015 - DNA, 15 bp, Homo sapiens
ctaaacccctgtccc

SEQ ID NO: 4947016 - DNA, 15 bp, Homo sapiens
ctaaagataatatta

SEQ ID NO: 4947017 - DNA, 18 bp, Homo sapiens
ctaaagattctatagttc

SEQ ID NO: 4947018 - DNA, 20 bp, Homo sapiens
ctaaagattctatagttcta

SEQ ID NO: 4947019 - DNA, 15 bp, Homo sapiens
ctaaagccagcctga

SEQ ID NO: 4947020 - DNA, 16 bp, Homo sapiens
ctaaaggtgtatttaa

SEQ ID NO: 4947021 - DNA, 17 bp, Homo sapiens
ctaaaggtgtatttaaa

SEQ ID NO: 4947022 - DNA, 20 bp, Homo sapiens
cgcccaggctggagtgcagt

SEQ ID NO: 4947023 - DNA, 11 bp, Homo sapiens
cgcccccagcc

SEQ ID NO: 4947024 - DNA, 12 bp, Homo sapiens
cgcccctgcagc

SEQ ID NO: 4947025 - DNA, 19 bp, Homo sapiens
cgcccctgcagcacggaca

SEQ ID NO: 4947026 - DNA, 18 bp, Homo sapiens
cgcccctgcctgccatgt

SEQ ID NO: 4947027 - DNA, 13 bp, Homo sapiens
cgccccttccccc

SEQ ID NO: 4947028 - DNA, 15 bp, Homo sapiens
cgcccgagctgttta

SEQ ID NO: 4947029 - DNA, 14 bp, Homo sapiens
cgccctcccctccc

SEQ ID NO: 4947030 - DNA, 22 bp, Homo sapiens
cgccctcccctcccctgctgca

SEQ ID NO: 4947031 - DNA, 17 bp, Homo sapiens
cgccggggacagaggcc

SEQ ID NO: 4947032 - DNA, 19 bp, Homo sapiens
cgccggggacagaggcctg

SEQ ID NO: 4947033 - DNA, 16 bp, Homo sapiens
cgcctgagctcactcg

SEQ ID NO: 4947034 - DNA, 23 bp, Homo sapiens
cgcctggatttctggttctgatg

SEQ ID NO: 4947035 - DNA, 17 bp, Homo sapiens
cgcctgtgatgctgggc

SEQ ID NO: 4947036 - DNA, 16 bp, Homo sapiens
cgcctgtgcacacaca

SEQ ID NO: 4947037 - DNA, 19 bp, Homo sapiens
cgcctgtggagctcagccc

SEQ ID NO: 4947038 - DNA, 13 bp, Homo sapiens
cgccttccttgac

SEQ ID NO: 4947039 - DNA, 19 bp, Homo sapiens
cgccttccttgaccttcct

SEQ ID NO: 4947040 - DNA, 19 bp, Homo sapiens
cgccttgtctcctactcct

SEQ ID NO: 4947041 - DNA, 15 bp, Homo sapiens
cgcgactaatttcaa

SEQ ID NO: 4947042 - DNA, 22 bp, Homo sapiens
cgcgactaatttcaaaatgctt

SEQ ID NO: 4947043 - DNA, 22 bp, Homo sapiens
cgcgccactcgcttcccccata

SEQ ID NO: 4947044 - DNA, 16 bp, Homo sapiens
cgcgcccgcccctgca

SEQ ID NO: 4947045 - DNA, 11 bp, Homo sapiens
cgcgcgcacac

SEQ ID NO: 4947046 - DNA, 19 bp, Homo sapiens
cgcgcgcacacacacacat

SEQ ID NO: 4947047 - DNA, 13 bp, Homo sapiens
cgcgcgcgcacac

SEQ ID NO: 4947048 - DNA, 15 bp, Homo sapiens
cgcggccagccccgg

SEQ ID NO: 4947049 - DNA, 12 bp, Homo sapiens
cgcgtctcctgt

SEQ ID NO: 4947050 - DNA, 17 bp, Homo sapiens
cgctactataaagagaa

SEQ ID NO: 4947051 - DNA, 16 bp, Homo sapiens
cgctcagccctccctg

SEQ ID NO: 4947052 - DNA, 15 bp, Homo sapiens
cgctcgccccaccgg

SEQ ID NO: 4947053 - DNA, 21 bp, Homo sapiens
cgctcgccccaccggcgcgct

SEQ ID NO: 4947054 - DNA, 14 bp, Homo sapiens
cgctctcttcctgc

SEQ ID NO: 4947055 - DNA, 15 bp, Homo sapiens
cgctctcttcctgcc

SEQ ID NO: 4947056 - DNA, 16 bp, Homo sapiens
cgctctcttcctgccc

SEQ ID NO: 4947057 - DNA, 20 bp, Homo sapiens
cgctctgtggatgccagggc

SEQ ID NO: 4947058 - DNA, 21 bp, Homo sapiens
cgctctgtggatgccagggcc

SEQ ID NO: 4947059 - DNA, 20 bp, Homo sapiens
cgctgatacataactaaatt

SEQ ID NO: 4947060 - DNA, 19 bp, Homo sapiens
cgctggaccttgaactggg

SEQ ID NO: 4947061 - DNA, 17 bp, Homo sapiens
cgctggagtgcagtgag

SEQ ID NO: 4947062 - DNA, 21 bp, Homo sapiens
cgctgtttttgttgtgtgtgc

SEQ ID NO: 4947063 - DNA, 16 bp, Homo sapiens
cgcttcccccatagcc

SEQ ID NO: 4947064 - DNA, 20 bp, Homo sapiens
cgcttcccccatagccaccc

SEQ ID NO: 4947065 - DNA, 16 bp, Homo sapiens
cgcttcgacttttctt

SEQ ID NO: 4947066 - DNA, 12 bp, Homo sapiens
cgcttctgactg

SEQ ID NO: 4947067 - DNA, 20 bp, Homo sapiens
cgcttctgtgtatctctttc

SEQ ID NO: 4947068 - DNA, 16 bp, Homo sapiens
cgcttggctccatgct

SEQ ID NO: 4947069 - DNA, 19 bp, Homo sapiens
cgcttgtggggacccaggc

SEQ ID NO: 4947070 - DNA, 20 bp, Homo sapiens
cgcttgtggggacccaggct

SEQ ID NO: 4947071 - DNA, 21 bp, Homo sapiens
cgcttgtggggacccaggctc

SEQ ID NO: 4947072 - DNA, 12 bp, Homo sapiens
cgctttgtcaca

SEQ ID NO: 4947073 - DNA, 12 bp, Homo sapiens
cggaacagcaga

SEQ ID NO: 4947074 - DNA, 21 bp, Homo sapiens
cggaaccgctcacctagagcc

SEQ ID NO: 4947075 - DNA, 21 bp, Homo sapiens
cggaatcactctgtccttgga

SEQ ID NO: 4947076 - DNA, 20 bp, Homo sapiens
cggacaataaacctccgcca

SEQ ID NO: 4947077 - DNA, 15 bp, Homo sapiens
cggacagccacggcc

SEQ ID NO: 4947078 - DNA, 22 bp, Homo sapiens
cggacagccacggccaggccag

SEQ ID NO: 4947079 - DNA, 15 bp, Homo sapiens
cggactcctcctttc

SEQ ID NO: 4947080 - DNA, 13 bp, Homo sapiens
cggagaggacagt

SEQ ID NO: 4947081 - DNA, 19 bp, Homo sapiens
cggagattggacggcctga

SEQ ID NO: 4947082 - DNA, 20 bp, Homo sapiens
ctatacttgaacaaaagggt

SEQ ID NO: 4947083 - DNA, 22 bp, Homo sapiens
ctatacttgaacaaaagggtca

SEQ ID NO: 4947084 - DNA, 21 bp, Homo sapiens
ctatagactggaaaaaatgag

SEQ ID NO: 4947085 - DNA, 19 bp, Homo sapiens
ctatagcctaggtgacaga

SEQ ID NO: 4947086 - DNA, 21 bp, Homo sapiens
ctatagcctaggtgacagagt

SEQ ID NO: 4947087 - DNA, 19 bp, Homo sapiens
ctatatacatgtgtgtata

SEQ ID NO: 4947088 - DNA, 22 bp, Homo sapiens
ctatatacatgtgtgtatatat

SEQ ID NO: 4947089 - DNA, 18 bp, Homo sapiens
ctatatagaatgctgcac

SEQ ID NO: 4947090 - DNA, 15 bp, Homo sapiens
ctatatatataaata

SEQ ID NO: 4947091 - DNA, 15 bp, Homo sapiens
ctatatatgtgtatg

SEQ ID NO: 4947092 - DNA, 15 bp, Homo sapiens
ctatatcctgtgact

SEQ ID NO: 4947093 - DNA, 15 bp, Homo sapiens
ctatatgaatttaaa

SEQ ID NO: 4947094 - DNA, 13 bp, Homo sapiens
ctatatgatttat

SEQ ID NO: 4947095 - DNA, 16 bp, Homo sapiens
ctatatgatttatagt

SEQ ID NO: 4947096 - DNA, 19 bp, Homo sapiens
ctatatgatttatagtttg

SEQ ID NO: 4947097 - DNA, 16 bp, Homo sapiens
ctatatttaacaagat

SEQ ID NO: 4947098 - DNA, 15 bp, Homo sapiens
ctatcaagcccaggt

SEQ ID NO: 4947099 - DNA, 17 bp, Homo sapiens
ctatcaagtcaatcatt

SEQ ID NO: 4947100 - DNA, 17 bp, Homo sapiens
ctatcacctatttccat

SEQ ID NO: 4947101 - DNA, 19 bp, Homo sapiens
ctatcagcagctagaaaac

SEQ ID NO: 4947102 - DNA, 16 bp, Homo sapiens
ctatcatagttaacat

SEQ ID NO: 4947103 - DNA, 23 bp, Homo sapiens
ctatcatttattggatgggtggg

SEQ ID NO: 4947104 - DNA, 14 bp, Homo sapiens
ctatccaaacatgt

SEQ ID NO: 4947105 - DNA, 18 bp, Homo sapiens
ctatcctacaaggcctat

SEQ ID NO: 4947106 - DNA, 14 bp, Homo sapiens
ctatcctcactgcc

SEQ ID NO: 4947107 - DNA, 19 bp, Homo sapiens
ctatcctgaaaattctgta

SEQ ID NO: 4947108 - DNA, 13 bp, Homo sapiens
ctatccttcgtga

SEQ ID NO: 4947109 - DNA, 15 bp, Homo sapiens
ctatctatcttccaa

SEQ ID NO: 4947110 - DNA, 19 bp, Homo sapiens
ctatctggaggccttccag

SEQ ID NO: 4947111 - DNA, 13 bp, Homo sapiens
ctatcttccaaat

SEQ ID NO: 4947112 - DNA, 17 bp, Homo sapiens
ctatgaacttctctcag

SEQ ID NO: 4947113 - DNA, 17 bp, Homo sapiens
ctatgactgctccccag

SEQ ID NO: 4947114 - DNA, 14 bp, Homo sapiens
ctatgaggaaaggt

SEQ ID NO: 4947115 - DNA, 22 bp, Homo sapiens
ctatgaggaataattatttatt

SEQ ID NO: 4947116 - DNA, 19 bp, Homo sapiens
ctatgagtctagatgttta

SEQ ID NO: 4947117 - DNA, 13 bp, Homo sapiens
ctatgcacatatg

SEQ ID NO: 4947118 - DNA, 20 bp, Homo sapiens
ctatgcacatatggactctg

SEQ ID NO: 4947119 - DNA, 18 bp, Homo sapiens
ctatgggactcaatgcac

SEQ ID NO: 4947120 - DNA, 22 bp, Homo sapiens
ctatgggactcaatgcactgac

SEQ ID NO: 4947121 - DNA, 21 bp, Homo sapiens
ctcaccttctgagtacagagt

SEQ ID NO: 4947122 - DNA, 23 bp, Homo sapiens
ctcacgcttacctcaaccatcct

SEQ ID NO: 4947123 - DNA, 20 bp, Homo sapiens
ctcactaccctattctctct

SEQ ID NO: 4947124 - DNA, 17 bp, Homo sapiens
ctcactatgttgcccag

SEQ ID NO: 4947125 - DNA, 23 bp, Homo sapiens
ctcactatgttgcccaggcaggt

SEQ ID NO: 4947126 - DNA, 19 bp, Homo sapiens
ctcactcctacctggtaat

SEQ ID NO: 4947127 - DNA, 13 bp, Homo sapiens
ctcactctgccag

SEQ ID NO: 4947128 - DNA, 15 bp, Homo sapiens
ctcactctgccaggg

SEQ ID NO: 4947129 - DNA, 15 bp, Homo sapiens
ctcactctggcctca

SEQ ID NO: 4947130 - DNA, 12 bp, Homo sapiens
ctcactctgtcg

SEQ ID NO: 4947131 - DNA, 12 bp, Homo sapiens
ctcactgaagcc

SEQ ID NO: 4947132 - DNA, 22 bp, Homo sapiens
ctcactgatatattttccaggg

SEQ ID NO: 4947133 - DNA, 16 bp, Homo sapiens
ctcactgcagcctcaa

SEQ ID NO: 4947134 - DNA, 23 bp, Homo sapiens
ctcactgctccctgaagccagcc

SEQ ID NO: 4947135 - DNA, 13 bp, Homo sapiens
ctcactggggcct

SEQ ID NO: 4947136 - DNA, 14 bp, Homo sapiens
ctcactgttgccca

SEQ ID NO: 4947137 - DNA, 18 bp, Homo sapiens
ctcactgttgcccaggct

SEQ ID NO: 4947138 - DNA, 20 bp, Homo sapiens
ctcactttcctcctgaggct

SEQ ID NO: 4947139 - DNA, 13 bp, Homo sapiens
ctcagaacccagg

SEQ ID NO: 4947140 - DNA, 23 bp, Homo sapiens
ctcagaacccagggctctgcccc

SEQ ID NO: 4947141 - DNA, 13 bp, Homo sapiens
ctcagaagacact

SEQ ID NO: 4947142 - DNA, 15 bp, Homo sapiens
ctcagaagacactga

SEQ ID NO: 4947143 - DNA, 17 bp, Homo sapiens
ctcagaagacactgatg

SEQ ID NO: 4947144 - DNA, 20 bp, Homo sapiens
ctcagaagacactgatgggc

SEQ ID NO: 4947145 - DNA, 22 bp, Homo sapiens
ctcagaagacactgatgggcaa

SEQ ID NO: 4947146 - DNA, 19 bp, Homo sapiens
ctcagaataaggcaggcat

SEQ ID NO: 4947147 - DNA, 14 bp, Homo sapiens
ctcagaattatttt

SEQ ID NO: 4947148 - DNA, 17 bp, Homo sapiens
ctcagaattatttttaa

SEQ ID NO: 4947149 - DNA, 18 bp, Homo sapiens
ctcagagggggactgctg

SEQ ID NO: 4947150 - DNA, 23 bp, Homo sapiens
ctcagaggtttacctagagaaca

SEQ ID NO: 4947151 - DNA, 17 bp, Homo sapiens
ctcagatcagtgtacca

SEQ ID NO: 4947152 - DNA, 15 bp, Homo sapiens
ctcagatctgtctga

SEQ ID NO: 4947153 - DNA, 23 bp, Homo sapiens
ctcagatgtcccttgatgcacag

SEQ ID NO: 4947154 - DNA, 13 bp, Homo sapiens
ctcagcaagccct

SEQ ID NO: 4947155 - DNA, 23 bp, Homo sapiens
ctcagcagccgccttaagctgat

SEQ ID NO: 4947156 - DNA, 13 bp, Homo sapiens
ctcagcatcctgg

SEQ ID NO: 4947157 - DNA, 16 bp, Homo sapiens
ctcagcatcctggcac

SEQ ID NO: 4947158 - DNA, 12 bp, Homo sapiens
ctcagccaagct

SEQ ID NO: 4947159 - DNA, 23 bp, Homo sapiens
ctcagcccctaggagtatatttc

SEQ ID NO: 4947160 - DNA, 15 bp, Homo sapiens
ctcagccctgaggtg

SEQ ID NO: 4947161 - DNA, 23 bp, Homo sapiens
ctcagccggcgtggcaaatataa

SEQ ID NO: 4947162 - DNA, 15 bp, Homo sapiens
ctcagcctcccaaag

SEQ ID NO: 4947163 - DNA, 21 bp, Homo sapiens
ctcagcctcccaaagtgctgg

SEQ ID NO: 4947164 - DNA, 21 bp, Homo sapiens
ctcagcctcccgaatagctgg

SEQ ID NO: 4947165 - DNA, 23 bp, Homo sapiens
ctcagcctcccgaatagctggga

SEQ ID NO: 4947166 - DNA, 20 bp, Homo sapiens
ctcagcctccggagtagctg

SEQ ID NO: 4947167 - DNA, 19 bp, Homo sapiens
ctcagcctgctgcccaggc

SEQ ID NO: 4947168 - DNA, 14 bp, Homo sapiens
ctcagcctgggaca

SEQ ID NO: 4947169 - DNA, 16 bp, Homo sapiens
ctcagccttacatttg

SEQ ID NO: 4947170 - DNA, 18 bp, Homo sapiens
ctcagccttacatttgtg

SEQ ID NO: 4947171 - DNA, 16 bp, Homo sapiens
ctcagcggggacagct

SEQ ID NO: 4947172 - DNA, 23 bp, Homo sapiens
ctcagcgtttttttgtttttaat

SEQ ID NO: 4947173 - DNA, 13 bp, Homo sapiens
ctcagctcagcgc

SEQ ID NO: 4947174 - DNA, 19 bp, Homo sapiens
ctcagctccaggtggctct

SEQ ID NO: 4947175 - DNA, 12 bp, Homo sapiens
ctcagctgcctc

SEQ ID NO: 4947176 - DNA, 14 bp, Homo sapiens
ctcagctgcctcac

SEQ ID NO: 4947177 - DNA, 14 bp, Homo sapiens
ctcagcttcctacc

SEQ ID NO: 4947178 - DNA, 22 bp, Homo sapiens
ctcagcttcctacccacacctc

SEQ ID NO: 4947179 - DNA, 12 bp, Homo sapiens
ctcagctttgag

SEQ ID NO: 4947180 - DNA, 21 bp, Homo sapiens
ctcagctttgagaagccttca

SEQ ID NO: 4947181 - DNA, 18 bp, Homo sapiens
ctcaggatccaagctaag

SEQ ID NO: 4947182 - DNA, 20 bp, Homo sapiens
ctcaggatttaaaaactgga

SEQ ID NO: 4947183 - DNA, 14 bp, Homo sapiens
ctcaggcactagcc

SEQ ID NO: 4947184 - DNA, 23 bp, Homo sapiens
ctcaggcactagcctttggctct

SEQ ID NO: 4947185 - DNA, 20 bp, Homo sapiens
ctcaggccaagaaacgtctt

SEQ ID NO: 4947186 - DNA, 21 bp, Homo sapiens
ctcaggcgatccacctgtctc

SEQ ID NO: 4947187 - DNA, 19 bp, Homo sapiens
ctcaggctgcagctggaca

SEQ ID NO: 4947188 - DNA, 21 bp, Homo sapiens
ctcaggctgcagctggacaga

SEQ ID NO: 4947189 - DNA, 23 bp, Homo sapiens
ctcaggctgcagctggacagagg

SEQ ID NO: 4947190 - DNA, 17 bp, Homo sapiens
ctcaggctggtgggagg

SEQ ID NO: 4947191 - DNA, 19 bp, Homo sapiens
ctcagggacagagccatgc

SEQ ID NO: 4947192 - DNA, 21 bp, Homo sapiens
ctcagggcagcctcccccggc

SEQ ID NO: 4947193 - DNA, 15 bp, Homo sapiens
ctcagggctcctccc

SEQ ID NO: 4947194 - DNA, 21 bp, Homo sapiens
ctcagggctcctcccagcttg

SEQ ID NO: 4947195 - DNA, 16 bp, Homo sapiens
cgggcaccagccagcg

SEQ ID NO: 4947196 - DNA, 14 bp, Homo sapiens
cgggcactcagaag

SEQ ID NO: 4947197 - DNA, 22 bp, Homo sapiens
cgggcactcagaagacactgat

SEQ ID NO: 4947198 - DNA, 14 bp, Homo sapiens
cgggccacagagaa

SEQ ID NO: 4947199 - DNA, 20 bp, Homo sapiens
cgggcctggagaactagaga

SEQ ID NO: 4947200 - DNA, 15 bp, Homo sapiens
cgggctctctgctgt

SEQ ID NO: 4947201 - DNA, 16 bp, Homo sapiens
cggggacagaggcctg

SEQ ID NO: 4947202 - DNA, 14 bp, Homo sapiens
cggggacagctcct

SEQ ID NO: 4947203 - DNA, 22 bp, Homo sapiens
cggggacagctccttctgtcct

SEQ ID NO: 4947204 - DNA, 23 bp, Homo sapiens
cggggagcggcggaaagcctgta

SEQ ID NO: 4947205 - DNA, 15 bp, Homo sapiens
cggggtatcctgggg

SEQ ID NO: 4947206 - DNA, 14 bp, Homo sapiens
cggggtatgaagag

SEQ ID NO: 4947207 - DNA, 12 bp, Homo sapiens
cggggtggagca

SEQ ID NO: 4947208 - DNA, 16 bp, Homo sapiens
cgggttccgcaggcag

SEQ ID NO: 4947209 - DNA, 16 bp, Homo sapiens
cgggttgtgtgtctgt

SEQ ID NO: 4947210 - DNA, 17 bp, Homo sapiens
cgggttgtgtgtctgtt

SEQ ID NO: 4947211 - DNA, 16 bp, Homo sapiens
cggtagggaggcagcc

SEQ ID NO: 4947212 - DNA, 16 bp, Homo sapiens
cggtcaggtttaacat

SEQ ID NO: 4947213 - DNA, 11 bp, Homo sapiens
cggtccagctg

SEQ ID NO: 4947214 - DNA, 21 bp, Homo sapiens
cggtctgttctgtttcaaggc

SEQ ID NO: 4947215 - DNA, 21 bp, Homo sapiens
cggtcttcaacatcctgccag

SEQ ID NO: 4947216 - DNA, 21 bp, Homo sapiens
cggtgacaaagatggctcaga

SEQ ID NO: 4947217 - DNA, 13 bp, Homo sapiens
cggtgcccacacc

SEQ ID NO: 4947218 - DNA, 16 bp, Homo sapiens
cggtggccctgtccct

SEQ ID NO: 4947219 - DNA, 14 bp, Homo sapiens
cggtgggcactgtt

SEQ ID NO: 4947220 - DNA, 14 bp, Homo sapiens
cggtgtccccagag

SEQ ID NO: 4947221 - DNA, 21 bp, Homo sapiens
cggttggagcgagcatccccc

SEQ ID NO: 4947222 - DNA, 19 bp, Homo sapiens
cggtttctttttaagtaat

SEQ ID NO: 4947223 - DNA, 18 bp, Homo sapiens
cggttttttattattgtg

SEQ ID NO: 4947224 - DNA, 12 bp, Homo sapiens
cgtaaaatggtg

SEQ ID NO: 4947225 - DNA, 12 bp, Homo sapiens
cgtaaccagcca

SEQ ID NO: 4947226 - DNA, 13 bp, Homo sapiens
cgtaaccagccag

SEQ ID NO: 4947227 - DNA, 13 bp, Homo sapiens
cgtaatgcttaga

SEQ ID NO: 4947228 - DNA, 21 bp, Homo sapiens
cgtaatgcttagagaatgttc

SEQ ID NO: 4947229 - DNA, 21 bp, Homo sapiens
cgtatgaaaatgagttgtgaa

SEQ ID NO: 4947230 - DNA, 12 bp, Homo sapiens
cgtattttaaaa

SEQ ID NO: 4947231 - DNA, 20 bp, Homo sapiens
cgtcagggttggtgtgctga

SEQ ID NO: 4947232 - DNA, 17 bp, Homo sapiens
cgtcagtctttttctgt

SEQ ID NO: 4947233 - DNA, 19 bp, Homo sapiens
cgtcatcacttttcagtga

SEQ ID NO: 4947234 - DNA, 19 bp, Homo sapiens
cgtccaggagcctgtgcct

SEQ ID NO: 4947235 - DNA, 15 bp, Homo sapiens
cgtccctagcagtga

SEQ ID NO: 4947236 - DNA, 16 bp, Homo sapiens
cgtccctagcagtgaa

SEQ ID NO: 4947237 - DNA, 17 bp, Homo sapiens
cgtcctcacccctgtcc

SEQ ID NO: 4947238 - DNA, 20 bp, Homo sapiens
cgtcctcacccctgtcctca

SEQ ID NO: 4947239 - DNA, 17 bp, Homo sapiens
cgtcgaggggctctcag

SEQ ID NO: 4947240 - DNA, 14 bp, Homo sapiens
cgtctgacaggcaa

SEQ ID NO: 4947241 - DNA, 20 bp, Homo sapiens
cgtctgacaggcaatgctgg

SEQ ID NO: 4947242 - DNA, 19 bp, Homo sapiens
cgtcttccgcccctgcctg

SEQ ID NO: 4947243 - DNA, 20 bp, Homo sapiens
cgtcttccgcccctgcctgc

SEQ ID NO: 4947244 - DNA, 13 bp, Homo sapiens
cgtctttcttttt

SEQ ID NO: 4947245 - DNA, 17 bp, Homo sapiens
cgtgaaaacggagctga

SEQ ID NO: 4947246 - DNA, 12 bp, Homo sapiens
cgtgaactgtgc

SEQ ID NO: 4947247 - DNA, 14 bp, Homo sapiens
cgtgacaacacttg

SEQ ID NO: 4947248 - DNA, 20 bp, Homo sapiens
cgtgagccactgcaccgggc

SEQ ID NO: 4947249 - DNA, 16 bp, Homo sapiens
cgtgagcgcctgtgca

SEQ ID NO: 4947250 - DNA, 15 bp, Homo sapiens
cgtgaggtcccagga

SEQ ID NO: 4947251 - DNA, 16 bp, Homo sapiens
cgtgagtcatttaaat

SEQ ID NO: 4947252 - DNA, 18 bp, Homo sapiens
cgtgatccacccacctcg

SEQ ID NO: 4947253 - DNA, 21 bp, Homo sapiens
cgtgcacacaccagagcccac

SEQ ID NO: 4947254 - DNA, 20 bp, Homo sapiens
cgtgcacgtggagagctggt

SEQ ID NO: 4947255 - DNA, 22 bp, Homo sapiens
cgtgcacgtggagagctggtgc

SEQ ID NO: 4947256 - DNA, 23 bp, Homo sapiens
cgtgcattagcacagattttaat

SEQ ID NO: 4947257 - DNA, 22 bp, Homo sapiens
ctaaggtccggtgttctaagat

SEQ ID NO: 4947258 - DNA, 16 bp, Homo sapiens
ctaaggttctaaggcc

SEQ ID NO: 4947259 - DNA, 22 bp, Homo sapiens
ctaagtactgtaataatacctc

SEQ ID NO: 4947260 - DNA, 18 bp, Homo sapiens
ctaagtattaaaacattg

SEQ ID NO: 4947261 - DNA, 20 bp, Homo sapiens
ctaagtattaaaacattgga

SEQ ID NO: 4947262 - DNA, 12 bp, Homo sapiens
ctaagtctctgt

SEQ ID NO: 4947263 - DNA, 13 bp, Homo sapiens
ctaagtctctgtg

SEQ ID NO: 4947264 - DNA, 16 bp, Homo sapiens
ctaagtgaaatttcta

SEQ ID NO: 4947265 - DNA, 19 bp, Homo sapiens
ctaagtgaaatttctagcc

SEQ ID NO: 4947266 - DNA, 17 bp, Homo sapiens
ctaagtgacatttgtag

SEQ ID NO: 4947267 - DNA, 18 bp, Homo sapiens
ctaagttcacattagaat

SEQ ID NO: 4947268 - DNA, 17 bp, Homo sapiens
ctaagtttctaagattc

SEQ ID NO: 4947269 - DNA, 13 bp, Homo sapiens
ctaataaatacat

SEQ ID NO: 4947270 - DNA, 12 bp, Homo sapiens
ctaataaattat

SEQ ID NO: 4947271 - DNA, 17 bp, Homo sapiens
ctaataaattatacaaa

SEQ ID NO: 4947272 - DNA, 19 bp, Homo sapiens
ctaataatgagctattaaa

SEQ ID NO: 4947273 - DNA, 22 bp, Homo sapiens
ctaataatgagctattaaaact

SEQ ID NO: 4947274 - DNA, 14 bp, Homo sapiens
ctaataatttctaa

SEQ ID NO: 4947275 - DNA, 17 bp, Homo sapiens
ctaatacctctgtgtgc

SEQ ID NO: 4947276 - DNA, 23 bp, Homo sapiens
ctaatagcgggttactttcacat

SEQ ID NO: 4947277 - DNA, 15 bp, Homo sapiens
ctaatatatatgaat

SEQ ID NO: 4947278 - DNA, 17 bp, Homo sapiens
ctaatatatatgaataa

SEQ ID NO: 4947279 - DNA, 15 bp, Homo sapiens
ctaatatatttttat

SEQ ID NO: 4947280 - DNA, 13 bp, Homo sapiens
ctaatattaaaaa

SEQ ID NO: 4947281 - DNA, 19 bp, Homo sapiens
ctaatcaaagccagggtct

SEQ ID NO: 4947282 - DNA, 21 bp, Homo sapiens
ctaatcagcattctcactcct

SEQ ID NO: 4947283 - DNA, 14 bp, Homo sapiens
ctaatgtaaaatga

SEQ ID NO: 4947284 - DNA, 13 bp, Homo sapiens
ctaatgtcttcat

SEQ ID NO: 4947285 - DNA, 21 bp, Homo sapiens
ctaatgtcttcatttcattgt

SEQ ID NO: 4947286 - DNA, 18 bp, Homo sapiens
ctaattagggtacattta

SEQ ID NO: 4947287 - DNA, 13 bp, Homo sapiens
ctaattcatttat

SEQ ID NO: 4947288 - DNA, 16 bp, Homo sapiens
ctaattctattaaagt

SEQ ID NO: 4947289 - DNA, 20 bp, Homo sapiens
ctaattctattaaagtgcta

SEQ ID NO: 4947290 - DNA, 16 bp, Homo sapiens
ctaattgcatctcaaa

SEQ ID NO: 4947291 - DNA, 19 bp, Homo sapiens
ctaattgcatctcaaaatt

SEQ ID NO: 4947292 - DNA, 19 bp, Homo sapiens
ctaattggcctctttaaga

SEQ ID NO: 4947293 - DNA, 17 bp, Homo sapiens
ctaattgggagtccagg

SEQ ID NO: 4947294 - DNA, 15 bp, Homo sapiens
ctaatttaaagagac

SEQ ID NO: 4947295 - DNA, 21 bp, Homo sapiens
ctaatttatcctgaaatttca

SEQ ID NO: 4947296 - DNA, 17 bp, Homo sapiens
ctaatttcaaaatgctt

SEQ ID NO: 4947297 - DNA, 15 bp, Homo sapiens
ctaatttcccttctt

SEQ ID NO: 4947298 - DNA, 16 bp, Homo sapiens
ctaatttgatgtttac

SEQ ID NO: 4947299 - DNA, 13 bp, Homo sapiens
ctaatttgcatta

SEQ ID NO: 4947300 - DNA, 14 bp, Homo sapiens
ctaatttgcattaa

SEQ ID NO: 4947301 - DNA, 13 bp, Homo sapiens
atgtcctatgtgt

SEQ ID NO: 4947302 - DNA, 23 bp, Homo sapiens
atgtcctccagaagcctctggct

SEQ ID NO: 4947303 - DNA, 15 bp, Homo sapiens
atgtcctgcctttta

SEQ ID NO: 4947304 - DNA, 14 bp, Homo sapiens
atgtcgcctctgca

SEQ ID NO: 4947305 - DNA, 14 bp, Homo sapiens
atgtctaaaattgt

SEQ ID NO: 4947306 - DNA, 19 bp, Homo sapiens
atgtctaaatgctgaaaaa

SEQ ID NO: 4947307 - DNA, 22 bp, Homo sapiens
atgtctataatcccagcacttt

SEQ ID NO: 4947308 - DNA, 15 bp, Homo sapiens
atgtctatttaagcc

SEQ ID NO: 4947309 - DNA, 14 bp, Homo sapiens
atgtctgtttaaga

SEQ ID NO: 4947310 - DNA, 15 bp, Homo sapiens
atgtcttcataaagt

SEQ ID NO: 4947311 - DNA, 18 bp, Homo sapiens
atgtcttccatgtatctt

SEQ ID NO: 4947312 - DNA, 13 bp, Homo sapiens
atgtcttggacac

SEQ ID NO: 4947313 - DNA, 16 bp, Homo sapiens
atgtcttggacactgt

SEQ ID NO: 4947314 - DNA, 17 bp, Homo sapiens
atgtcttgtacatgtgt

SEQ ID NO: 4947315 - DNA, 22 bp, Homo sapiens
atgtctttctccaaagttatcc

SEQ ID NO: 4947316 - DNA, 12 bp, Homo sapiens
atgtctttgtaa

SEQ ID NO: 4947317 - DNA, 13 bp, Homo sapiens
atgtctttgtaag

SEQ ID NO: 4947318 - DNA, 20 bp, Homo sapiens
atgtcttttatagtggaaaa

SEQ ID NO: 4947319 - DNA, 21 bp, Homo sapiens
atgtcttttatatttgtatcg

SEQ ID NO: 4947320 - DNA, 18 bp, Homo sapiens
atgtgaaaccttttttaa

SEQ ID NO: 4947321 - DNA, 19 bp, Homo sapiens
atgtgaaaccttttttaag

SEQ ID NO: 4947322 - DNA, 23 bp, Homo sapiens
atgtgaaaccttttttaagattt

SEQ ID NO: 4947323 - DNA, 12 bp, Homo sapiens
atgtgaacttgt

SEQ ID NO: 4947324 - DNA, 17 bp, Homo sapiens
atgtgaacttgtagctg

SEQ ID NO: 4947325 - DNA, 22 bp, Homo sapiens
atgtgaacttgtagctgtaaaa

SEQ ID NO: 4947326 - DNA, 17 bp, Homo sapiens
atgtgagaggtttgact

SEQ ID NO: 4947327 - DNA, 20 bp, Homo sapiens
atgtgagtttggtctggact

SEQ ID NO: 4947328 - DNA, 16 bp, Homo sapiens
atgtgatattctaaga

SEQ ID NO: 4947329 - DNA, 21 bp, Homo sapiens
atgtgatgatgtaattgacgg

SEQ ID NO: 4947330 - DNA, 16 bp, Homo sapiens
atgtgatgttctaagg

SEQ ID NO: 4947331 - DNA, 20 bp, Homo sapiens
atgtgatgttctaaggctct

SEQ ID NO: 4947332 - DNA, 21 bp, Homo sapiens
atgtgatgttctaaggctctg

SEQ ID NO: 4947333 - DNA, 15 bp, Homo sapiens
atgtgattctaatgt

SEQ ID NO: 4947334 - DNA, 22 bp, Homo sapiens
atgtgattgtggaatggagatt

SEQ ID NO: 4947335 - DNA, 16 bp, Homo sapiens
atgtggccgaggactt

SEQ ID NO: 4947336 - DNA, 16 bp, Homo sapiens
atgtggcttgagaaat

SEQ ID NO: 4947337 - DNA, 21 bp, Homo sapiens
atgtggcttgagaaatatgga

SEQ ID NO: 4947338 - DNA, 13 bp, Homo sapiens
atgtgggcactgg

SEQ ID NO: 4947339 - DNA, 20 bp, Homo sapiens
atgtgggctagttgggcttc

SEQ ID NO: 4947340 - DNA, 13 bp, Homo sapiens
atgtggtctcagg

SEQ ID NO: 4947341 - DNA, 18 bp, Homo sapiens
atgtggtggcacaggccc

SEQ ID NO: 4947342 - DNA, 15 bp, Homo sapiens
atgtggttacacact

SEQ ID NO: 4947343 - DNA, 19 bp, Homo sapiens
atgtggtttatagagggcc

SEQ ID NO: 4947344 - DNA, 17 bp, Homo sapiens
atgtggtttggttcctc

SEQ ID NO: 4947345 - DNA, 14 bp, Homo sapiens
atgtgtacatggca

SEQ ID NO: 4947346 - DNA, 22 bp, Homo sapiens
atgtgtacatggcagagtttgt

SEQ ID NO: 4947347 - DNA, 15 bp, Homo sapiens
atgtgtagcctatgt

SEQ ID NO: 4947348 - DNA, 14 bp, Homo sapiens
atgtgtagcctgtg

SEQ ID NO: 4947349 - DNA, 16 bp, Homo sapiens
atgtgtagcctgtgca

SEQ ID NO: 4947350 - DNA, 22 bp, Homo sapiens
atgtgtagttgtctctcttcag

SEQ ID NO: 4947351 - DNA, 23 bp, Homo sapiens
atgtgtagttgtctctcttcaga

SEQ ID NO: 4947352 - DNA, 20 bp, Homo sapiens
atgtgtatgtacgtttgtat

SEQ ID NO: 4947353 - DNA, 15 bp, Homo sapiens
atgtgtcacttgtgc

SEQ ID NO: 4947354 - DNA, 18 bp, Homo sapiens
atgtgtcctcagggagca

SEQ ID NO: 4947355 - DNA, 13 bp, Homo sapiens
atgtgtcctggtt

SEQ ID NO: 4947356 - DNA, 20 bp, Homo sapiens
atgtgtctgtatttcatgtg

SEQ ID NO: 4947357 - DNA, 21 bp, Homo sapiens
atgtgtctgtatttcatgtgg

SEQ ID NO: 4947358 - DNA, 16 bp, Homo sapiens
atgtgtgcatgtgtgt

SEQ ID NO: 4947359 - DNA, 18 bp, Homo sapiens
atgtgtgcatgtgtgtat

SEQ ID NO: 4947360 - DNA, 20 bp, Homo sapiens
atgtgtgccatagagtttaa

SEQ ID NO: 4947361 - DNA, 22 bp, Homo sapiens
atgtgtgccatagagtttaaca

SEQ ID NO: 4947362 - DNA, 14 bp, Homo sapiens
atgtgtggcctgca

SEQ ID NO: 4947363 - DNA, 16 bp, Homo sapiens
atgtgtggtggcctca

SEQ ID NO: 4947364 - DNA, 14 bp, Homo sapiens
attccaacagtgag

SEQ ID NO: 4947365 - DNA, 20 bp, Homo sapiens
attccagaatgctgtacatc

SEQ ID NO: 4947366 - DNA, 22 bp, Homo sapiens
attccatatcttgcgaatccaa

SEQ ID NO: 4947367 - DNA, 23 bp, Homo sapiens
attccatatcttgcgaatccaag

SEQ ID NO: 4947368 - DNA, 23 bp, Homo sapiens
attccatgtttggaagacccttg

SEQ ID NO: 4947369 - DNA, 16 bp, Homo sapiens
attccattggtccaag

SEQ ID NO: 4947370 - DNA, 17 bp, Homo sapiens
attccattggtccaaga

SEQ ID NO: 4947371 - DNA, 14 bp, Homo sapiens
attcccaagctctg

SEQ ID NO: 4947372 - DNA, 17 bp, Homo sapiens
attcccagagcaaaata

SEQ ID NO: 4947373 - DNA, 14 bp, Homo sapiens
attccccattcttc

SEQ ID NO: 4947374 - DNA, 22 bp, Homo sapiens
attcccctctgctgctgtccct

SEQ ID NO: 4947375 - DNA, 13 bp, Homo sapiens
attccggatccta

SEQ ID NO: 4947376 - DNA, 16 bp, Homo sapiens
attccggatcctaagc

SEQ ID NO: 4947377 - DNA, 13 bp, Homo sapiens
attcctacagcac

SEQ ID NO: 4947378 - DNA, 19 bp, Homo sapiens
attcctatatcctgtgact

SEQ ID NO: 4947379 - DNA, 20 bp, Homo sapiens
attcctatatcctgtgactg

SEQ ID NO: 4947380 - DNA, 22 bp, Homo sapiens
attcctgagatttcctcctggc

SEQ ID NO: 4947381 - DNA, 15 bp, Homo sapiens
attcctgcatttgtg

SEQ ID NO: 4947382 - DNA, 22 bp, Homo sapiens
attccttctctgaacacaggca

SEQ ID NO: 4947383 - DNA, 15 bp, Homo sapiens
attccttctttgata

SEQ ID NO: 4947384 - DNA, 21 bp, Homo sapiens
attccttctttgataatgtta

SEQ ID NO: 4947385 - DNA, 19 bp, Homo sapiens
attccttgatcattttggg

SEQ ID NO: 4947386 - DNA, 14 bp, Homo sapiens
attcctttcccttc

SEQ ID NO: 4947387 - DNA, 18 bp, Homo sapiens
attcctttcccttcctct

SEQ ID NO: 4947388 - DNA, 19 bp, Homo sapiens
attcctttcccttcctctt

SEQ ID NO: 4947389 - DNA, 16 bp, Homo sapiens
attcgaatgaaaagac

SEQ ID NO: 4947390 - DNA, 17 bp, Homo sapiens
attcgctcccacattct

SEQ ID NO: 4947391 - DNA, 20 bp, Homo sapiens
attctaaaatgtgatgttct

SEQ ID NO: 4947392 - DNA, 15 bp, Homo sapiens
attctaaagattcta

SEQ ID NO: 4947393 - DNA, 20 bp, Homo sapiens
attctaaagattctatagtt

SEQ ID NO: 4947394 - DNA, 20 bp, Homo sapiens
attctaagacttactctaag

SEQ ID NO: 4947395 - DNA, 16 bp, Homo sapiens
attctaatgtcttcat

SEQ ID NO: 4947396 - DNA, 23 bp, Homo sapiens
attctagatcagatgctccaaga

SEQ ID NO: 4947397 - DNA, 15 bp, Homo sapiens
attctagctaatgta

SEQ ID NO: 4947398 - DNA, 13 bp, Homo sapiens
attctatagttct

SEQ ID NO: 4947399 - DNA, 14 bp, Homo sapiens
attctatagttcta

SEQ ID NO: 4947400 - DNA, 16 bp, Homo sapiens
attctatatgaattta

SEQ ID NO: 4947401 - DNA, 17 bp, Homo sapiens
attctatatgaatttaa

SEQ ID NO: 4947402 - DNA, 19 bp, Homo sapiens
attctatatgaatttaaat

SEQ ID NO: 4947403 - DNA, 13 bp, Homo sapiens
attctattgcctt

SEQ ID NO: 4947404 - DNA, 20 bp, Homo sapiens
attctatttatatgtacatg

SEQ ID NO: 4947405 - DNA, 22 bp, Homo sapiens
attctatttatatgtacatgag

SEQ ID NO: 4947406 - DNA, 17 bp, Homo sapiens
attctcataattcctac

SEQ ID NO: 4947407 - DNA, 15 bp, Homo sapiens
attctcatctgcacc

SEQ ID NO: 4947408 - DNA, 21 bp, Homo sapiens
attctcatctgcacccttctt

SEQ ID NO: 4947409 - DNA, 22 bp, Homo sapiens
attctcatctgcacccttcttt

SEQ ID NO: 4947410 - DNA, 17 bp, Homo sapiens
attctcatttgtcacac

SEQ ID NO: 4947411 - DNA, 14 bp, Homo sapiens
attctcctgcctca

SEQ ID NO: 4947412 - DNA, 16 bp, Homo sapiens
attctccttttatgtg

SEQ ID NO: 4947413 - DNA, 22 bp, Homo sapiens
attctctggctgtaaggctcta

SEQ ID NO: 4947414 - DNA, 13 bp, Homo sapiens
atggctcagaggg

SEQ ID NO: 4947415 - DNA, 22 bp, Homo sapiens
atggctcagagggggactgctg

SEQ ID NO: 4947416 - DNA, 16 bp, Homo sapiens
atggctccagaaatgt

SEQ ID NO: 4947417 - DNA, 14 bp, Homo sapiens
atggctctgcaccc

SEQ ID NO: 4947418 - DNA, 22 bp, Homo sapiens
atggctctgcacccctctgccc

SEQ ID NO: 4947419 - DNA, 23 bp, Homo sapiens
atggctctgcacccctctgccct

SEQ ID NO: 4947420 - DNA, 12 bp, Homo sapiens
atggctctggac

SEQ ID NO: 4947421 - DNA, 19 bp, Homo sapiens
atggctctggactctaaag

SEQ ID NO: 4947422 - DNA, 14 bp, Homo sapiens
atggctgcagtcct

SEQ ID NO: 4947423 - DNA, 16 bp, Homo sapiens
atggctgtgcctctgc

SEQ ID NO: 4947424 - DNA, 20 bp, Homo sapiens
atggctttatttgttttttt

SEQ ID NO: 4947425 - DNA, 17 bp, Homo sapiens
atgggaataattgcttt

SEQ ID NO: 4947426 - DNA, 23 bp, Homo sapiens
atgggagagtagatggtgaaatt

SEQ ID NO: 4947427 - DNA, 13 bp, Homo sapiens
atgggagccccag

SEQ ID NO: 4947428 - DNA, 19 bp, Homo sapiens
atgggagctcctctcctgg

SEQ ID NO: 4947429 - DNA, 20 bp, Homo sapiens
atgggagctggttagaaatg

SEQ ID NO: 4947430 - DNA, 21 bp, Homo sapiens
atgggagctggttagaaatgc

SEQ ID NO: 4947431 - DNA, 18 bp, Homo sapiens
atgggcaacccccagcct

SEQ ID NO: 4947432 - DNA, 17 bp, Homo sapiens
atgggcctcctgtgtgt

SEQ ID NO: 4947433 - DNA, 18 bp, Homo sapiens
atgggcctcctgtgtgtg

SEQ ID NO: 4947434 - DNA, 16 bp, Homo sapiens
atgggtgcaaggaaaa

SEQ ID NO: 4947435 - DNA, 20 bp, Homo sapiens
atgggtgcaaggaaaattag

SEQ ID NO: 4947436 - DNA, 15 bp, Homo sapiens
atgggttatgtgtat

SEQ ID NO: 4947437 - DNA, 14 bp, Homo sapiens
atggtcacacactg

SEQ ID NO: 4947438 - DNA, 19 bp, Homo sapiens
atggtcacacactgatgct

SEQ ID NO: 4947439 - DNA, 18 bp, Homo sapiens
atggtcctaaaagcaaaa

SEQ ID NO: 4947440 - DNA, 14 bp, Homo sapiens
atggtcgcccagga

SEQ ID NO: 4947441 - DNA, 14 bp, Homo sapiens
atggtctcagaaac

SEQ ID NO: 4947442 - DNA, 16 bp, Homo sapiens
atggtgaaaatgtact

SEQ ID NO: 4947443 - DNA, 19 bp, Homo sapiens
atggtgcttaagttccagc

SEQ ID NO: 4947444 - DNA, 12 bp, Homo sapiens
atggtggctggg

SEQ ID NO: 4947445 - DNA, 13 bp, Homo sapiens
atggtggctgggt

SEQ ID NO: 4947446 - DNA, 17 bp, Homo sapiens
atggtggctgggttgga

SEQ ID NO: 4947447 - DNA, 12 bp, Homo sapiens
atggtgtaataa

SEQ ID NO: 4947448 - DNA, 18 bp, Homo sapiens
atggttaagagtccaaga

SEQ ID NO: 4947449 - DNA, 15 bp, Homo sapiens
atggttatgaaagaa

SEQ ID NO: 4947450 - DNA, 18 bp, Homo sapiens
atggttatgaaagaatat

SEQ ID NO: 4947451 - DNA, 19 bp, Homo sapiens
atggttatgaaagaatata

SEQ ID NO: 4947452 - DNA, 17 bp, Homo sapiens
atggttgccttaaagaa

SEQ ID NO: 4947453 - DNA, 23 bp, Homo sapiens
atggttggtaacacaaattttca

SEQ ID NO: 4947454 - DNA, 19 bp, Homo sapiens
atggtttattttgtattgt

SEQ ID NO: 4947455 - DNA, 13 bp, Homo sapiens
atgtaaaaaagaa

SEQ ID NO: 4947456 - DNA, 19 bp, Homo sapiens
atgtaaaagaacttactga

SEQ ID NO: 4947457 - DNA, 22 bp, Homo sapiens
atgtaaaagaacttactgatta

SEQ ID NO: 4947458 - DNA, 23 bp, Homo sapiens
atgtaaaagaacttactgattat

SEQ ID NO: 4947459 - DNA, 13 bp, Homo sapiens
atgtaaaatgatt

SEQ ID NO: 4947460 - DNA, 17 bp, Homo sapiens
atgtaaaatgttgaata

SEQ ID NO: 4947461 - DNA, 14 bp, Homo sapiens
atgtaaacaggaga

SEQ ID NO: 4947462 - DNA, 11 bp, Homo sapiens
atgtaaactgc

SEQ ID NO: 4947463 - DNA, 20 bp, Homo sapiens
atgtaaaggagtcaaaacta

SEQ ID NO: 4947464 - DNA, 13 bp, Homo sapiens
atgtaaagtatgt

SEQ ID NO: 4947465 - DNA, 18 bp, Homo sapiens
atgtaaagtatgtaaaca

SEQ ID NO: 4947466 - DNA, 14 bp, Homo sapiens
atgtaacttttgta

SEQ ID NO: 4947467 - DNA, 16 bp, Homo sapiens
atgtaacttttgtaag

SEQ ID NO: 4947468 - DNA, 18 bp, Homo sapiens
atgtaacttttgtaagac

SEQ ID NO: 4947469 - DNA, 17 bp, Homo sapiens
atgtaagattatagatt

SEQ ID NO: 4947470 - DNA, 17 bp, Homo sapiens
atgtaataactgtgaag

SEQ ID NO: 4947471 - DNA, 20 bp, Homo sapiens
atgtaatgtgtggtggcctc

SEQ ID NO: 4947472 - DNA, 23 bp, Homo sapiens
atgtacaattgtgggcataaact

SEQ ID NO: 4947473 - DNA, 17 bp, Homo sapiens
atgtacctcccctgcct

SEQ ID NO: 4947474 - DNA, 18 bp, Homo sapiens
atgtacctcccctgcctt

SEQ ID NO: 4947475 - DNA, 19 bp, Homo sapiens
atgtacctcccctgccttg

SEQ ID NO: 4947476 - DNA, 23 bp, Homo sapiens
atgtacctcccctgccttgctgt

SEQ ID NO: 4947477 - DNA, 22 bp, Homo sapiens
atgtaccttctttcactctgtc

SEQ ID NO: 4947478 - DNA, 15 bp, Homo sapiens
atgtactagtactgt

SEQ ID NO: 4947479 - DNA, 22 bp, Homo sapiens
caacactcacatttattctgct

SEQ ID NO: 4947480 - DNA, 23 bp, Homo sapiens
caacactggtgtgacctgagggc

SEQ ID NO: 4947481 - DNA, 16 bp, Homo sapiens
caacagaactaaatgt

SEQ ID NO: 4947482 - DNA, 18 bp, Homo sapiens
caacagaagcatttgtat

SEQ ID NO: 4947483 - DNA, 19 bp, Homo sapiens
caacagaagcatttgtatt

SEQ ID NO: 4947484 - DNA, 16 bp, Homo sapiens
caacagaagcttcaga

SEQ ID NO: 4947485 - DNA, 17 bp, Homo sapiens
caacagaagcttcagaa

SEQ ID NO: 4947486 - DNA, 23 bp, Homo sapiens
caacagaagtcatgaagcccaag

SEQ ID NO: 4947487 - DNA, 23 bp, Homo sapiens
caacagcgacatagcccatccct

SEQ ID NO: 4947488 - DNA, 13 bp, Homo sapiens
caacaggctgggc

SEQ ID NO: 4947489 - DNA, 14 bp, Homo sapiens
caacaggctgggct

SEQ ID NO: 4947490 - DNA, 20 bp, Homo sapiens
caacaggctgggcttcagtg

SEQ ID NO: 4947491 - DNA, 24 bp, Homo sapiens
caacaggctgggcttcagtggcag

SEQ ID NO: 4947492 - DNA, 19 bp, Homo sapiens
caacaggctgttctgcact

SEQ ID NO: 4947493 - DNA, 20 bp, Homo sapiens
caacaggctgttctgcactg

SEQ ID NO: 4947494 - DNA, 23 bp, Homo sapiens
caacaggctgttctgcactgaaa

SEQ ID NO: 4947495 - DNA, 11 bp, Homo sapiens
caacagtgagt

SEQ ID NO: 4947496 - DNA, 12 bp, Homo sapiens
caacagtgagtc

SEQ ID NO: 4947497 - DNA, 17 bp, Homo sapiens
caacataacccacttgt

SEQ ID NO: 4947498 - DNA, 16 bp, Homo sapiens
caacataatctagttt

SEQ ID NO: 4947499 - DNA, 21 bp, Homo sapiens
caacatccatgtcctatgtgt

SEQ ID NO: 4947500 - DNA, 23 bp, Homo sapiens
caacatccatgtcctatgtgtga

SEQ ID NO: 4947501 - DNA, 17 bp, Homo sapiens
caacatcctgccagccc

SEQ ID NO: 4947502 - DNA, 14 bp, Homo sapiens
caaccacacacctc

SEQ ID NO: 4947503 - DNA, 16 bp, Homo sapiens
caaccagtgccaagga

SEQ ID NO: 4947504 - DNA, 12 bp, Homo sapiens
caaccatattta

SEQ ID NO: 4947505 - DNA, 22 bp, Homo sapiens
caaccattccagactgcttcca

SEQ ID NO: 4947506 - DNA, 12 bp, Homo sapiens
caacccccaccc

SEQ ID NO: 4947507 - DNA, 23 bp, Homo sapiens
caacccccaccccacacttgttc

SEQ ID NO: 4947508 - DNA, 13 bp, Homo sapiens
caaccctcagagc

SEQ ID NO: 4947509 - DNA, 20 bp, Homo sapiens
caacccttaccccttagcct

SEQ ID NO: 4947510 - DNA, 18 bp, Homo sapiens
caaccgacaggccctggc

SEQ ID NO: 4947511 - DNA, 16 bp, Homo sapiens
caacctcccaacccag

SEQ ID NO: 4947512 - DNA, 12 bp, Homo sapiens
caacctcctgtg

SEQ ID NO: 4947513 - DNA, 17 bp, Homo sapiens
caacctctcactcccca

SEQ ID NO: 4947514 - DNA, 18 bp, Homo sapiens
caacctcttctggctcaa

SEQ ID NO: 4947515 - DNA, 21 bp, Homo sapiens
caacctgctctcctcttgcca

SEQ ID NO: 4947516 - DNA, 20 bp, Homo sapiens
caaccttctgtggctcacag

SEQ ID NO: 4947517 - DNA, 17 bp, Homo sapiens
caacctttcacctttgt

SEQ ID NO: 4947518 - DNA, 19 bp, Homo sapiens
caacgaccagggccgagga

SEQ ID NO: 4947519 - DNA, 13 bp, Homo sapiens
caacgcagccctg

SEQ ID NO: 4947520 - DNA, 15 bp, Homo sapiens
caacgcagccctgct

SEQ ID NO: 4947521 - DNA, 17 bp, Homo sapiens
caacgggaagcaacctc

SEQ ID NO: 4947522 - DNA, 13 bp, Homo sapiens
caactactattca

SEQ ID NO: 4947523 - DNA, 15 bp, Homo sapiens
caactagacattacc

SEQ ID NO: 4947524 - DNA, 19 bp, Homo sapiens
caactataagcccactgtt

SEQ ID NO: 4947525 - DNA, 20 bp, Homo sapiens
caactatttttccaaaataa

SEQ ID NO: 4947526 - DNA, 20 bp, Homo sapiens
caactccagcaacttcttct

SEQ ID NO: 4947527 - DNA, 16 bp, Homo sapiens
caactcttgattatcc

SEQ ID NO: 4947528 - DNA, 15 bp, Homo sapiens
caactgacacaggaa

SEQ ID NO: 4947529 - DNA, 23 bp, Homo sapiens
caactgcaataacttctgacctt

SEQ ID NO: 4947530 - DNA, 23 bp, Homo sapiens
caactgcctcgaaacacagaaac

SEQ ID NO: 4947531 - DNA, 15 bp, Homo sapiens
caactgtatatattc

SEQ ID NO: 4947532 - DNA, 16 bp, Homo sapiens
caactgtgttcattag

SEQ ID NO: 4947533 - DNA, 12 bp, Homo sapiens
caactgtgttgt

SEQ ID NO: 4947534 - DNA, 22 bp, Homo sapiens
caactgtgttgtattaacaaaa

SEQ ID NO: 4947535 - DNA, 14 bp, Homo sapiens
caacttaacatggg

SEQ ID NO: 4947536 - DNA, 15 bp, Homo sapiens
caacttctcttgctt

SEQ ID NO: 4947537 - DNA, 21 bp, Homo sapiens
caacttgagatgtatgaaggc

SEQ ID NO: 4947538 - DNA, 16 bp, Homo sapiens
caacttgagggcccag

SEQ ID NO: 4947539 - DNA, 20 bp, Homo sapiens
caacttgagggcccagagca

SEQ ID NO: 4947540 - DNA, 21 bp, Homo sapiens
caacttgagggcccagagcag

SEQ ID NO: 4947541 - DNA, 19 bp, Homo sapiens
caacttggttctgcttcaa

SEQ ID NO: 4947542 - DNA, 23 bp, Homo sapiens
caactttctgtaaactcaaaact

SEQ ID NO: 4947543 - DNA, 17 bp, Homo sapiens
caagaaaaaataaatgg

SEQ ID NO: 4947544 - DNA, 15 bp, Homo sapiens
caagaaaacaacttc

SEQ ID NO: 4947545 - DNA, 16 bp, Homo sapiens
atttatttaataacaa

SEQ ID NO: 4947546 - DNA, 20 bp, Homo sapiens
atttatttaataacaattgt

SEQ ID NO: 4947547 - DNA, 17 bp, Homo sapiens
atttatttaatgtgagt

SEQ ID NO: 4947548 - DNA, 13 bp, Homo sapiens
atttatttacaga

SEQ ID NO: 4947549 - DNA, 16 bp, Homo sapiens
atttatttatgtactt

SEQ ID NO: 4947550 - DNA, 13 bp, Homo sapiens
atttatttattat

SEQ ID NO: 4947551 - DNA, 14 bp, Homo sapiens
atttatttattatt

SEQ ID NO: 4947552 - DNA, 23 bp, Homo sapiens
atttattttcttttgaattgttt

SEQ ID NO: 4947553 - DNA, 18 bp, Homo sapiens
atttatttttacaagaag

SEQ ID NO: 4947554 - DNA, 15 bp, Homo sapiens
atttatttttcagtt

SEQ ID NO: 4947555 - DNA, 16 bp, Homo sapiens
atttatttttcagttc

SEQ ID NO: 4947556 - DNA, 18 bp, Homo sapiens
atttatttttcagttcca

SEQ ID NO: 4947557 - DNA, 19 bp, Homo sapiens
atttatttttcagttccaa

SEQ ID NO: 4947558 - DNA, 22 bp, Homo sapiens
atttatttttcagttccaagaa

SEQ ID NO: 4947559 - DNA, 17 bp, Homo sapiens
atttcaaaaatataact

SEQ ID NO: 4947560 - DNA, 17 bp, Homo sapiens
atttcaaaagacatgtt

SEQ ID NO: 4947561 - DNA, 19 bp, Homo sapiens
atttcaagaaaaaataaat

SEQ ID NO: 4947562 - DNA, 15 bp, Homo sapiens
atttcaaggttctaa

SEQ ID NO: 4947563 - DNA, 15 bp, Homo sapiens
atttcaattctcaaa

SEQ ID NO: 4947564 - DNA, 18 bp, Homo sapiens
atttcacattaatggtct

SEQ ID NO: 4947565 - DNA, 12 bp, Homo sapiens
atttcacttgat

SEQ ID NO: 4947566 - DNA, 19 bp, Homo sapiens
atttcacttgatgatacaa

SEQ ID NO: 4947567 - DNA, 22 bp, Homo sapiens
atttcagagaggccttttggaa

SEQ ID NO: 4947568 - DNA, 15 bp, Homo sapiens
atttcagattttgat

SEQ ID NO: 4947569 - DNA, 18 bp, Homo sapiens
atttcagattttgataac

SEQ ID NO: 4947570 - DNA, 18 bp, Homo sapiens
atttcatgctatctctgt

SEQ ID NO: 4947571 - DNA, 20 bp, Homo sapiens
atttcatgctctgcaaaagg

SEQ ID NO: 4947572 - DNA, 16 bp, Homo sapiens
atttcattccattgcc

SEQ ID NO: 4947573 - DNA, 15 bp, Homo sapiens
atttccaaataaaat

SEQ ID NO: 4947574 - DNA, 19 bp, Homo sapiens
atttccaacaccacagaca

SEQ ID NO: 4947575 - DNA, 22 bp, Homo sapiens
atttccagctttctccccgcta

SEQ ID NO: 4947576 - DNA, 14 bp, Homo sapiens
atttccagggatat

SEQ ID NO: 4947577 - DNA, 22 bp, Homo sapiens
atttcccatttgtgccagagga

SEQ ID NO: 4947578 - DNA, 21 bp, Homo sapiens
atttccctaaaatacatttaa

SEQ ID NO: 4947579 - DNA, 23 bp, Homo sapiens
atttcccttcttgcatccttcct

SEQ ID NO: 4947580 - DNA, 23 bp, Homo sapiens
atttccgcacttcagaattccat

SEQ ID NO: 4947581 - DNA, 14 bp, Homo sapiens
atttccttgaatgt

SEQ ID NO: 4947582 - DNA, 20 bp, Homo sapiens
atttctaaaaaacagaggcc

SEQ ID NO: 4947583 - DNA, 12 bp, Homo sapiens
atttctaaaaga

SEQ ID NO: 4947584 - DNA, 17 bp, Homo sapiens
atttctaccatttcaga

SEQ ID NO: 4947585 - DNA, 18 bp, Homo sapiens
atttctaccatttcagag

SEQ ID NO: 4947586 - DNA, 23 bp, Homo sapiens
atttctagcctgcactttgatgt

SEQ ID NO: 4947587 - DNA, 23 bp, Homo sapiens
atttctattcaaggtggccaaat

SEQ ID NO: 4947588 - DNA, 20 bp, Homo sapiens
atttctcaacaaagcacagt

SEQ ID NO: 4947589 - DNA, 14 bp, Homo sapiens
atttctcatcacag

SEQ ID NO: 4947590 - DNA, 17 bp, Homo sapiens
atttctctaattatgca

SEQ ID NO: 4947591 - DNA, 13 bp, Homo sapiens
atttctgcatatg

SEQ ID NO: 4947592 - DNA, 18 bp, Homo sapiens
atttctgcatatgttgaa

SEQ ID NO: 4947593 - DNA, 22 bp, Homo sapiens
atttctgcatatgttgaatact

SEQ ID NO: 4947594 - DNA, 17 bp, Homo sapiens
atttctggttctgatgc

SEQ ID NO: 4947595 - DNA, 15 bp, Homo sapiens
atttctgtcagaatg

SEQ ID NO: 4947596 - DNA, 16 bp, Homo sapiens
atttcttcaaaatgta

SEQ ID NO: 4947597 - DNA, 17 bp, Homo sapiens
atttcttcagtcagaaa

SEQ ID NO: 4947598 - DNA, 18 bp, Homo sapiens
atttcttcagtcagaaaa

SEQ ID NO: 4947599 - DNA, 21 bp, Homo sapiens
atttcttcagtcagaaaactt

SEQ ID NO: 4947600 - DNA, 19 bp, Homo sapiens
atttcttggtaagaagccg

SEQ ID NO: 4947601 - DNA, 14 bp, Homo sapiens
atttgaaaaaaact

SEQ ID NO: 4947602 - DNA, 16 bp, Homo sapiens
atttgaaaaaaacttc

SEQ ID NO: 4947603 - DNA, 22 bp, Homo sapiens
atttgaaaaaaacttcattctc

SEQ ID NO: 4947604 - DNA, 20 bp, Homo sapiens
atttgaattaaaacttctta

SEQ ID NO: 4947605 - DNA, 18 bp, Homo sapiens
atttgacttgcatgaaga

SEQ ID NO: 4947606 - DNA, 13 bp, Homo sapiens
atttgacttgtgg

SEQ ID NO: 4947607 - DNA, 16 bp, Homo sapiens
atttgacttgtggttg

SEQ ID NO: 4947608 - DNA, 16 bp, Homo sapiens
atttgagcagggctca

SEQ ID NO: 4947609 - DNA, 22 bp, Homo sapiens
atttgaggacaaccattccaga

SEQ ID NO: 4947610 - DNA, 14 bp, Homo sapiens
atttgaggctcaga

SEQ ID NO: 4947611 - DNA, 12 bp, Homo sapiens
atttgataatga

SEQ ID NO: 4947612 - DNA, 16 bp, Homo sapiens
atttgataatgataaa

SEQ ID NO: 4947613 - DNA, 20 bp, Homo sapiens
atttgataatgataaaacac

SEQ ID NO: 4947614 - DNA, 15 bp, Homo sapiens
atttgatacataata

SEQ ID NO: 4947615 - DNA, 16 bp, Homo sapiens
atttgatacccctggg

SEQ ID NO: 4947616 - DNA, 19 bp, Homo sapiens
atttgatacttatattttc

SEQ ID NO: 4947617 - DNA, 15 bp, Homo sapiens
atttgcaacatttac

SEQ ID NO: 4947618 - DNA, 21 bp, Homo sapiens
atttgcactggagttctatgc

SEQ ID NO: 4947619 - DNA, 18 bp, Homo sapiens
atttgcattaaattcaca

SEQ ID NO: 4947620 - DNA, 21 bp, Homo sapiens
atttgcattgaacacaaactg

SEQ ID NO: 4947621 - DNA, 15 bp, Homo sapiens
atttgccatgggctt

SEQ ID NO: 4947622 - DNA, 19 bp, Homo sapiens
atttgccatgggcttcact

SEQ ID NO: 4947623 - DNA, 22 bp, Homo sapiens
atttgccttgcagaactgccat

SEQ ID NO: 4947624 - DNA, 15 bp, Homo sapiens
atttgccttgctgga

SEQ ID NO: 4947625 - DNA, 23 bp, Homo sapiens
atttgcctttaaaaaaaaaagtt

SEQ ID NO: 4947626 - DNA, 23 bp, Homo sapiens
atttgcggcgtcagtctttttct

SEQ ID NO: 4947627 - DNA, 20 bp, Homo sapiens
atttgctttcttttctccca

SEQ ID NO: 4947628 - DNA, 18 bp, Homo sapiens
atttgctttttcaccaga

SEQ ID NO: 4947629 - DNA, 21 bp, Homo sapiens
atttggaagaaaaaaatcttc

SEQ ID NO: 4947630 - DNA, 14 bp, Homo sapiens
atttggcttaaata

SEQ ID NO: 4947631 - DNA, 16 bp, Homo sapiens
atttggcttaaatata

SEQ ID NO: 4947632 - DNA, 18 bp, Homo sapiens
atttgggaagtgaagact

SEQ ID NO: 4947633 - DNA, 13 bp, Homo sapiens
atttgtaaatgct

SEQ ID NO: 4947634 - DNA, 16 bp, Homo sapiens
atttgtaattaaatta

SEQ ID NO: 4947635 - DNA, 19 bp, Homo sapiens
atttgtacagaattttgga

SEQ ID NO: 4947636 - DNA, 23 bp, Homo sapiens
atttgtaggaaggtctcattctt

SEQ ID NO: 4947637 - DNA, 22 bp, Homo sapiens
atttgtatattacacatttgta

SEQ ID NO: 4947638 - DNA, 21 bp, Homo sapiens
atttgtatctctgaagcatgt

SEQ ID NO: 4947639 - DNA, 22 bp, Homo sapiens
atttgtatctctgaagcatgtt

SEQ ID NO: 4947640 - DNA, 21 bp, Homo sapiens
atttgtgtaatagaaaactga

SEQ ID NO: 4947641 - DNA, 13 bp, Homo sapiens
atttgtgttttaa

SEQ ID NO: 4947642 - DNA, 21 bp, Homo sapiens
atttgtgttttaatttaaaca

SEQ ID NO: 4947643 - DNA, 18 bp, Homo sapiens
atttgttcactgaaggtg

SEQ ID NO: 4947644 - DNA, 14 bp, Homo sapiens
atttgttcatgttt

SEQ ID NO: 4947645 - DNA, 19 bp, Homo sapiens
atttgttgacaaaattttc

SEQ ID NO: 4947646 - DNA, 15 bp, Homo sapiens
atttgttggaatgaa

SEQ ID NO: 4947647 - DNA, 14 bp, Homo sapiens
atttgttttcatgg

SEQ ID NO: 4947648 - DNA, 15 bp, Homo sapiens
atttgtttttcattc

SEQ ID NO: 4947649 - DNA, 14 bp, Homo sapiens
atttgtttttctca

SEQ ID NO: 4947650 - DNA, 16 bp, Homo sapiens
attttaaaaaatgaaa

SEQ ID NO: 4947651 - DNA, 19 bp, Homo sapiens
attttaaaaaatgaaaata

SEQ ID NO: 4947652 - DNA, 19 bp, Homo sapiens
attttaaaagccacataga

SEQ ID NO: 4947653 - DNA, 19 bp, Homo sapiens
attttaaaataaattagtt

SEQ ID NO: 4947654 - DNA, 14 bp, Homo sapiens
attttaaataaaag

SEQ ID NO: 4947655 - DNA, 19 bp, Homo sapiens
attttaaatctaaatctat

SEQ ID NO: 4947656 - DNA, 17 bp, Homo sapiens
cacagtcccactgtgca

SEQ ID NO: 4947657 - DNA, 18 bp, Homo sapiens
cacagtgagtcgaggaca

SEQ ID NO: 4947658 - DNA, 20 bp, Homo sapiens
cacagtgagtcgaggacagg

SEQ ID NO: 4947659 - DNA, 22 bp, Homo sapiens
cacagtgagtcgaggacaggga

SEQ ID NO: 4947660 - DNA, 18 bp, Homo sapiens
cacagtgcatctcagccc

SEQ ID NO: 4947661 - DNA, 19 bp, Homo sapiens
cacagtgcatctcagccca

SEQ ID NO: 4947662 - DNA, 23 bp, Homo sapiens
cacagtgttaaatgaaattgtaa

SEQ ID NO: 4947663 - DNA, 22 bp, Homo sapiens
cacagttgccaccacctctgtg

SEQ ID NO: 4947664 - DNA, 23 bp, Homo sapiens
cacagttgccaccacctctgtgg

SEQ ID NO: 4947665 - DNA, 23 bp, Homo sapiens
cacagttggccttcagaaccatc

SEQ ID NO: 4947666 - DNA, 21 bp, Homo sapiens
cacataaggggtttgccattt

SEQ ID NO: 4947667 - DNA, 17 bp, Homo sapiens
cacatacagttttatgc

SEQ ID NO: 4947668 - DNA, 23 bp, Homo sapiens
cacatacagttttatgctctttt

SEQ ID NO: 4947669 - DNA, 13 bp, Homo sapiens
cacatagattaat

SEQ ID NO: 4947670 - DNA, 20 bp, Homo sapiens
cacatagattaatggcactg

SEQ ID NO: 4947671 - DNA, 13 bp, Homo sapiens
cacatagctgtct

SEQ ID NO: 4947672 - DNA, 23 bp, Homo sapiens
cacatatacctataatgtgtgta

SEQ ID NO: 4947673 - DNA, 19 bp, Homo sapiens
cacatatgcaccttgtgtc

SEQ ID NO: 4947674 - DNA, 10 bp, Homo sapiens
cacatcagat

SEQ ID NO: 4947675 - DNA, 12 bp, Homo sapiens
cacatccaactc

SEQ ID NO: 4947676 - DNA, 16 bp, Homo sapiens
cacatccaactccagc

SEQ ID NO: 4947677 - DNA, 18 bp, Homo sapiens
cacatccaactccagcaa

SEQ ID NO: 4947678 - DNA, 21 bp, Homo sapiens
cacatccgccttttgtataca

SEQ ID NO: 4947679 - DNA, 21 bp, Homo sapiens
cacatctctgaaagcacagga

SEQ ID NO: 4947680 - DNA, 21 bp, Homo sapiens
cacatctgcattttcacccca

SEQ ID NO: 4947681 - DNA, 18 bp, Homo sapiens
cacatcttgctctgctga

SEQ ID NO: 4947682 - DNA, 15 bp, Homo sapiens
cacatctttatctgt

SEQ ID NO: 4947683 - DNA, 22 bp, Homo sapiens
cacatctttatctgttcttgct

SEQ ID NO: 4947684 - DNA, 12 bp, Homo sapiens
cacatgcacaca

SEQ ID NO: 4947685 - DNA, 13 bp, Homo sapiens
cacatgctggcca

SEQ ID NO: 4947686 - DNA, 14 bp, Homo sapiens
cacatgctggccag

SEQ ID NO: 4947687 - DNA, 21 bp, Homo sapiens
cacatgggagcagtccatgca

SEQ ID NO: 4947688 - DNA, 17 bp, Homo sapiens
cacatggggaaaaaaat

SEQ ID NO: 4947689 - DNA, 15 bp, Homo sapiens
cacatgtcttgtaca

SEQ ID NO: 4947690 - DNA, 15 bp, Homo sapiens
cacatgtgacacata

SEQ ID NO: 4947691 - DNA, 14 bp, Homo sapiens
cacatgtgcacatg

SEQ ID NO: 4947692 - DNA, 15 bp, Homo sapiens
cacattagaattagt

SEQ ID NO: 4947693 - DNA, 12 bp, Homo sapiens
caagattgaaaa

SEQ ID NO: 4947694 - DNA, 17 bp, Homo sapiens
caagcacatctgcattt

SEQ ID NO: 4947695 - DNA, 18 bp, Homo sapiens
caagcacctcctgcctcg

SEQ ID NO: 4947696 - DNA, 19 bp, Homo sapiens
caagcagagtgcacagctg

SEQ ID NO: 4947697 - DNA, 21 bp, Homo sapiens
caagcagagtgcacagctgtc

SEQ ID NO: 4947698 - DNA, 22 bp, Homo sapiens
caagcagcgaccgccccctcct

SEQ ID NO: 4947699 - DNA, 20 bp, Homo sapiens
caagcatgcttgtgaaaatg

SEQ ID NO: 4947700 - DNA, 23 bp, Homo sapiens
caagcattgcttcagaatgaatt

SEQ ID NO: 4947701 - DNA, 19 bp, Homo sapiens
caagccatgtataaatgtg

SEQ ID NO: 4947702 - DNA, 22 bp, Homo sapiens
caagcccacagcacagctccct

SEQ ID NO: 4947703 - DNA, 17 bp, Homo sapiens
caagccctacagagctg

SEQ ID NO: 4947704 - DNA, 18 bp, Homo sapiens
caagccctacagagctgt

SEQ ID NO: 4947705 - DNA, 16 bp, Homo sapiens
caagccgtggcttccc

SEQ ID NO: 4947706 - DNA, 18 bp, Homo sapiens
caagccgtggcttcccgc

SEQ ID NO: 4947707 - DNA, 19 bp, Homo sapiens
caagcgattcttctgcttc

SEQ ID NO: 4947708 - DNA, 20 bp, Homo sapiens
caagcgattcttctgcttca

SEQ ID NO: 4947709 - DNA, 13 bp, Homo sapiens
caagctaacctta

SEQ ID NO: 4947710 - DNA, 22 bp, Homo sapiens
caagctaaccttatcctgcatt

SEQ ID NO: 4947711 - DNA, 17 bp, Homo sapiens
caagctattcctttccc

SEQ ID NO: 4947712 - DNA, 23 bp, Homo sapiens
caagctattcctttcccttcctc

SEQ ID NO: 4947713 - DNA, 17 bp, Homo sapiens
caagctccatctccact

SEQ ID NO: 4947714 - DNA, 12 bp, Homo sapiens
caagctctcttg

SEQ ID NO: 4947715 - DNA, 14 bp, Homo sapiens
caagctctcttgcc

SEQ ID NO: 4947716 - DNA, 13 bp, Homo sapiens
caagctctgctcc

SEQ ID NO: 4947717 - DNA, 15 bp, Homo sapiens
caagctctgctcctc

SEQ ID NO: 4947718 - DNA, 12 bp, Homo sapiens
caagctggcctc

SEQ ID NO: 4947719 - DNA, 13 bp, Homo sapiens
caagctggcctct

SEQ ID NO: 4947720 - DNA, 16 bp, Homo sapiens
caagctgttttcttct

SEQ ID NO: 4947721 - DNA, 13 bp, Homo sapiens
caaggaaaaagaa

SEQ ID NO: 4947722 - DNA, 20 bp, Homo sapiens
caaggaaatacccttctttt

SEQ ID NO: 4947723 - DNA, 16 bp, Homo sapiens
caaggaacaaaaaaac

SEQ ID NO: 4947724 - DNA, 11 bp, Homo sapiens
caaggaagagc

SEQ ID NO: 4947725 - DNA, 15 bp, Homo sapiens
caaggaccaggactc

SEQ ID NO: 4947726 - DNA, 18 bp, Homo sapiens
caaggaccaggactccct

SEQ ID NO: 4947727 - DNA, 21 bp, Homo sapiens
caaggaccaggactccctcct

SEQ ID NO: 4947728 - DNA, 15 bp, Homo sapiens
caaggagcacaagcc

SEQ ID NO: 4947729 - DNA, 16 bp, Homo sapiens
caaggagcacaggtcc

SEQ ID NO: 4947730 - DNA, 17 bp, Homo sapiens
caaggagcacaggtccc

SEQ ID NO: 4947731 - DNA, 16 bp, Homo sapiens
caaggagtcagacatt

SEQ ID NO: 4947732 - DNA, 14 bp, Homo sapiens
caaggattgaaaat

SEQ ID NO: 4947733 - DNA, 15 bp, Homo sapiens
caaggattgctactg

SEQ ID NO: 4947734 - DNA, 14 bp, Homo sapiens
caaggcactctaga

SEQ ID NO: 4947735 - DNA, 16 bp, Homo sapiens
caaggcactgtactag

SEQ ID NO: 4947736 - DNA, 19 bp, Homo sapiens
caaggccagagtggcctgg

SEQ ID NO: 4947737 - DNA, 22 bp, Homo sapiens
caaggccagagtggcctggcca

SEQ ID NO: 4947738 - DNA, 15 bp, Homo sapiens
caaggcggcccctcc

SEQ ID NO: 4947739 - DNA, 14 bp, Homo sapiens
caaggctatgtgat

SEQ ID NO: 4947740 - DNA, 19 bp, Homo sapiens
caagggcaaaaagtctaca

SEQ ID NO: 4947741 - DNA, 23 bp, Homo sapiens
caaggggagtcaccttcccttgc

SEQ ID NO: 4947742 - DNA, 15 bp, Homo sapiens
caaggtcatttcttc

SEQ ID NO: 4947743 - DNA, 23 bp, Homo sapiens
caaggtgaagatgggaacgcaga

SEQ ID NO: 4947744 - DNA, 17 bp, Homo sapiens
caaggtggccaaattat

SEQ ID NO: 4947745 - DNA, 13 bp, Homo sapiens
caaggttctaacc

SEQ ID NO: 4947746 - DNA, 18 bp, Homo sapiens
caaggtttaaagagtcta

SEQ ID NO: 4947747 - DNA, 22 bp, Homo sapiens
caaggtttaaagagtctagatt

SEQ ID NO: 4947748 - DNA, 13 bp, Homo sapiens
caagtagataaat

SEQ ID NO: 4947749 - DNA, 18 bp, Homo sapiens
caagtagataaatatttg

SEQ ID NO: 4947750 - DNA, 16 bp, Homo sapiens
caagtagtctgctcac

SEQ ID NO: 4947751 - DNA, 22 bp, Homo sapiens
caagtatccaaccaacttggtt

SEQ ID NO: 4947752 - DNA, 19 bp, Homo sapiens
caagtatttgggaagtgaa

SEQ ID NO: 4947753 - DNA, 22 bp, Homo sapiens
caagtatttgggaagtgaagac

SEQ ID NO: 4947754 - DNA, 15 bp, Homo sapiens
caagtcaatcatttc

SEQ ID NO: 4947755 - DNA, 17 bp, Homo sapiens
caagtcaatcatttctc

SEQ ID NO: 4947756 - DNA, 19 bp, Homo sapiens
caagtccgcagaagccctg

SEQ ID NO: 4947757 - DNA, 21 bp, Homo sapiens
caagtcctcttttctgagagg

SEQ ID NO: 4947758 - DNA, 17 bp, Homo sapiens
caagtcggaacagcaga

SEQ ID NO: 4947759 - DNA, 19 bp, Homo sapiens
caagtctctgctggcccag

SEQ ID NO: 4947760 - DNA, 21 bp, Homo sapiens
caagtgactgtatctgtgtag

SEQ ID NO: 4947761 - DNA, 14 bp, Homo sapiens
attttggggtctct

SEQ ID NO: 4947762 - DNA, 20 bp, Homo sapiens
attttgtaaactcaaaatat

SEQ ID NO: 4947763 - DNA, 14 bp, Homo sapiens
attttgtatatatc

SEQ ID NO: 4947764 - DNA, 23 bp, Homo sapiens
attttgtattattgctgttgctt

SEQ ID NO: 4947765 - DNA, 20 bp, Homo sapiens
attttgtctgcttagtatct

SEQ ID NO: 4947766 - DNA, 16 bp, Homo sapiens
attttgtgctcattta

SEQ ID NO: 4947767 - DNA, 20 bp, Homo sapiens
attttgtgctcatttaagtt

SEQ ID NO: 4947768 - DNA, 14 bp, Homo sapiens
attttgtgtgacca

SEQ ID NO: 4947769 - DNA, 18 bp, Homo sapiens
attttgttcttacacata

SEQ ID NO: 4947770 - DNA, 19 bp, Homo sapiens
attttgttgctgttttgat

SEQ ID NO: 4947771 - DNA, 23 bp, Homo sapiens
attttgttgctgttttgatttgt

SEQ ID NO: 4947772 - DNA, 18 bp, Homo sapiens
attttgttgtaaaaagaa

SEQ ID NO: 4947773 - DNA, 17 bp, Homo sapiens
attttgtttaaaaaatc

SEQ ID NO: 4947774 - DNA, 20 bp, Homo sapiens
attttgtttcttttaaagca

SEQ ID NO: 4947775 - DNA, 20 bp, Homo sapiens
attttgttttattttgaatg

SEQ ID NO: 4947776 - DNA, 22 bp, Homo sapiens
atttttaaaaaatgaaatcctt

SEQ ID NO: 4947777 - DNA, 15 bp, Homo sapiens
atttttaaagataga

SEQ ID NO: 4947778 - DNA, 13 bp, Homo sapiens
atttttaaagatc

SEQ ID NO: 4947779 - DNA, 12 bp, Homo sapiens
atttttaaattg

SEQ ID NO: 4947780 - DNA, 21 bp, Homo sapiens
atttttaagcaaaatattatt

SEQ ID NO: 4947781 - DNA, 16 bp, Homo sapiens
atttttaatggcagca

SEQ ID NO: 4947782 - DNA, 20 bp, Homo sapiens
atttttacaagaagtttatt

SEQ ID NO: 4947783 - DNA, 21 bp, Homo sapiens
atttttaccctaatgtcttca

SEQ ID NO: 4947784 - DNA, 20 bp, Homo sapiens
atttttatacaaacctacca

SEQ ID NO: 4947785 - DNA, 16 bp, Homo sapiens
atttttatttatgaag

SEQ ID NO: 4947786 - DNA, 19 bp, Homo sapiens
atttttattttttagtgca

SEQ ID NO: 4947787 - DNA, 21 bp, Homo sapiens
atttttcaacaaatatcttgt

SEQ ID NO: 4947788 - DNA, 17 bp, Homo sapiens
atttttcaataataaaa

SEQ ID NO: 4947789 - DNA, 18 bp, Homo sapiens
atttttcagttccaagaa

SEQ ID NO: 4947790 - DNA, 22 bp, Homo sapiens
atttttcagttccaagaaagat

SEQ ID NO: 4947791 - DNA, 23 bp, Homo sapiens
atttttcggaggccccactgatg

SEQ ID NO: 4947792 - DNA, 15 bp, Homo sapiens
atttttgccatacat

SEQ ID NO: 4947793 - DNA, 22 bp, Homo sapiens
atttttgccctgagtccaagag

SEQ ID NO: 4947794 - DNA, 16 bp, Homo sapiens
atttttgtctcagaag

SEQ ID NO: 4947795 - DNA, 23 bp, Homo sapiens
atttttgtcttatatatatttct

SEQ ID NO: 4947796 - DNA, 14 bp, Homo sapiens
attttttaaaagaa

SEQ ID NO: 4947797 - DNA, 14 bp, Homo sapiens
attttttattgcta

SEQ ID NO: 4947798 - DNA, 23 bp, Homo sapiens
attttttgtaatgtgtgaaaaag

SEQ ID NO: 4947799 - DNA, 19 bp, Homo sapiens
atttttttcccaattgaga

SEQ ID NO: 4947800 - DNA, 14 bp, Homo sapiens
atttttttgtaatt

SEQ ID NO: 4947801 - DNA, 18 bp, Homo sapiens
attttttttaagtattta

SEQ ID NO: 4947802 - DNA, 18 bp, Homo sapiens
attttttttagtatttat

SEQ ID NO: 4947803 - DNA, 23 bp, Homo sapiens
atttttttttcatagagatttgt

SEQ ID NO: 4947804 - DNA, 20 bp, Homo sapiens
caaaaaaaaaaaaagaagac

SEQ ID NO: 4947805 - DNA, 13 bp, Homo sapiens
caaaaaaaccaca

SEQ ID NO: 4947806 - DNA, 17 bp, Homo sapiens
caaaaaaaccacaaagg

SEQ ID NO: 4947807 - DNA, 18 bp, Homo sapiens
caaaaaaatatatttaat

SEQ ID NO: 4947808 - DNA, 23 bp, Homo sapiens
caaaaaaatatatttaatgataa

SEQ ID NO: 4947809 - DNA, 22 bp, Homo sapiens
caaaaactgtctttaaaagaga

SEQ ID NO: 4947810 - DNA, 13 bp, Homo sapiens
caaaaagaaatga

SEQ ID NO: 4947811 - DNA, 11 bp, Homo sapiens
caaaaatataa

SEQ ID NO: 4947812 - DNA, 15 bp, Homo sapiens
caaaaatataaaata

SEQ ID NO: 4947813 - DNA, 12 bp, Homo sapiens
caaaaattatta

SEQ ID NO: 4947814 - DNA, 10 bp, Homo sapiens
caaaacaaaa

SEQ ID NO: 4947815 - DNA, 13 bp, Homo sapiens
caaaacaaaacaa

SEQ ID NO: 4947816 - DNA, 16 bp, Homo sapiens
caaaacccatgcattt

SEQ ID NO: 4947817 - DNA, 23 bp, Homo sapiens
caaaacccctaagagactgcgtt

SEQ ID NO: 4947818 - DNA, 13 bp, Homo sapiens
caaaacggggcag

SEQ ID NO: 4947819 - DNA, 17 bp, Homo sapiens
caaaactatacttgaac

SEQ ID NO: 4947820 - DNA, 23 bp, Homo sapiens
caaaactatacttgaacaaaagg

SEQ ID NO: 4947821 - DNA, 17 bp, Homo sapiens
caaaactccgcccccag

SEQ ID NO: 4947822 - DNA, 16 bp, Homo sapiens
cagatacatcactgct

SEQ ID NO: 4947823 - DNA, 19 bp, Homo sapiens
cagatacatcactgcttga

SEQ ID NO: 4947824 - DNA, 14 bp, Homo sapiens
cagatcactgccac

SEQ ID NO: 4947825 - DNA, 15 bp, Homo sapiens
cagatcatccagaag

SEQ ID NO: 4947826 - DNA, 13 bp, Homo sapiens
cagatcctcttgg

SEQ ID NO: 4947827 - DNA, 12 bp, Homo sapiens
cagatctgtgcc

SEQ ID NO: 4947828 - DNA, 14 bp, Homo sapiens
cagatctgtgcccc

SEQ ID NO: 4947829 - DNA, 15 bp, Homo sapiens
cagatctgtgcccca

SEQ ID NO: 4947830 - DNA, 18 bp, Homo sapiens
cagatctgtgccccatgc

SEQ ID NO: 4947831 - DNA, 21 bp, Homo sapiens
cagatctgtgccccatgcctg

SEQ ID NO: 4947832 - DNA, 23 bp, Homo sapiens
cagatgaatgtatttatttggga

SEQ ID NO: 4947833 - DNA, 16 bp, Homo sapiens
cagatgagaacaaagc

SEQ ID NO: 4947834 - DNA, 18 bp, Homo sapiens
cagatgagaacaaagctg

SEQ ID NO: 4947835 - DNA, 21 bp, Homo sapiens
cagatgagaacaaagctgtta

SEQ ID NO: 4947836 - DNA, 18 bp, Homo sapiens
cagatgatcaactcttcg

SEQ ID NO: 4947837 - DNA, 13 bp, Homo sapiens
cagatgcaccagc

SEQ ID NO: 4947838 - DNA, 16 bp, Homo sapiens
cagatgcaccagccct

SEQ ID NO: 4947839 - DNA, 22 bp, Homo sapiens
cagatgcaccagcccttagcag

SEQ ID NO: 4947840 - DNA, 18 bp, Homo sapiens
cagatgcagagagccatt

SEQ ID NO: 4947841 - DNA, 13 bp, Homo sapiens
cagatgccccaga

SEQ ID NO: 4947842 - DNA, 22 bp, Homo sapiens
cagatgcgtcccaagatgttga

SEQ ID NO: 4947843 - DNA, 23 bp, Homo sapiens
cagatgctccaagattctagatg

SEQ ID NO: 4947844 - DNA, 17 bp, Homo sapiens
cagatggaaatattttg

SEQ ID NO: 4947845 - DNA, 18 bp, Homo sapiens
cagatggaaatattttga

SEQ ID NO: 4947846 - DNA, 19 bp, Homo sapiens
cagatggaatgctgtgtta

SEQ ID NO: 4947847 - DNA, 21 bp, Homo sapiens
cagatggaatgctgtgttaaa

SEQ ID NO: 4947848 - DNA, 12 bp, Homo sapiens
cagatggcactt

SEQ ID NO: 4947849 - DNA, 14 bp, Homo sapiens
cactcacatgacac

SEQ ID NO: 4947850 - DNA, 21 bp, Homo sapiens
cactcaccagtgtcccctcca

SEQ ID NO: 4947851 - DNA, 16 bp, Homo sapiens
cactcagaagacactg

SEQ ID NO: 4947852 - DNA, 22 bp, Homo sapiens
cactcagaagacactgatgggc

SEQ ID NO: 4947853 - DNA, 13 bp, Homo sapiens
cactcagccccta

SEQ ID NO: 4947854 - DNA, 19 bp, Homo sapiens
cactcaggaggctgaggca

SEQ ID NO: 4947855 - DNA, 13 bp, Homo sapiens
cactcattcctgt

SEQ ID NO: 4947856 - DNA, 21 bp, Homo sapiens
cactcattgctgagcctctgc

SEQ ID NO: 4947857 - DNA, 16 bp, Homo sapiens
cactccagtgccagca

SEQ ID NO: 4947858 - DNA, 13 bp, Homo sapiens
cactccattccca

SEQ ID NO: 4947859 - DNA, 16 bp, Homo sapiens
cactccccatgccacg

SEQ ID NO: 4947860 - DNA, 18 bp, Homo sapiens
cactccccgaagtctttt

SEQ ID NO: 4947861 - DNA, 19 bp, Homo sapiens
cactccccgaagtcttttg

SEQ ID NO: 4947862 - DNA, 20 bp, Homo sapiens
cactcgtgtgcaacagacaa

SEQ ID NO: 4947863 - DNA, 19 bp, Homo sapiens
cactctaccctcccacccc

SEQ ID NO: 4947864 - DNA, 21 bp, Homo sapiens
cactctaccctcccaccccct

SEQ ID NO: 4947865 - DNA, 21 bp, Homo sapiens
cactctccccacactaacctg

SEQ ID NO: 4947866 - DNA, 18 bp, Homo sapiens
cactctgcagactgctag

SEQ ID NO: 4947867 - DNA, 14 bp, Homo sapiens
cactctgccagggc

SEQ ID NO: 4947868 - DNA, 19 bp, Homo sapiens
cactctgccagggcagtgc

SEQ ID NO: 4947869 - DNA, 11 bp, Homo sapiens
cactctgctgc

SEQ ID NO: 4947870 - DNA, 12 bp, Homo sapiens
cactctgctgct

SEQ ID NO: 4947871 - DNA, 21 bp, Homo sapiens
cactctgggcacactctgcca

SEQ ID NO: 4947872 - DNA, 15 bp, Homo sapiens
cactctgtcgcccag

SEQ ID NO: 4947873 - DNA, 14 bp, Homo sapiens
cactcttaaatgat

SEQ ID NO: 4947874 - DNA, 17 bp, Homo sapiens
cactcttattgcccacg

SEQ ID NO: 4947875 - DNA, 18 bp, Homo sapiens
cactcttattgcccacgc

SEQ ID NO: 4947876 - DNA, 19 bp, Homo sapiens
cactcttattgcccacgct

SEQ ID NO: 4947877 - DNA, 20 bp, Homo sapiens
cactctttatagtgcacaaa

SEQ ID NO: 4947878 - DNA, 15 bp, Homo sapiens
cactcttttgcttta

SEQ ID NO: 4947879 - DNA, 14 bp, Homo sapiens
cactgaaaaattat

SEQ ID NO: 4947880 - DNA, 20 bp, Homo sapiens
cactgaaagctctgttgcaa

SEQ ID NO: 4947881 - DNA, 15 bp, Homo sapiens
cactgaacaaactaa

SEQ ID NO: 4947882 - DNA, 14 bp, Homo sapiens
cactgaagcctgcg

SEQ ID NO: 4947883 - DNA, 14 bp, Homo sapiens
cactgaatttataa

SEQ ID NO: 4947884 - DNA, 13 bp, Homo sapiens
cactgacacaaag

SEQ ID NO: 4947885 - DNA, 23 bp, Homo sapiens
cactgacattgttggccaaagcc

SEQ ID NO: 4947886 - DNA, 16 bp, Homo sapiens
cactgaccatccactc

SEQ ID NO: 4947887 - DNA, 17 bp, Homo sapiens
cactgaccatccactct

SEQ ID NO: 4947888 - DNA, 18 bp, Homo sapiens
cactgacccttccagaca

SEQ ID NO: 4947889 - DNA, 19 bp, Homo sapiens
cactgacccttccagacat

SEQ ID NO: 4947890 - DNA, 22 bp, Homo sapiens
cactgatattttacctcttatt

SEQ ID NO: 4947891 - DNA, 14 bp, Homo sapiens
cactgatgggcaac

SEQ ID NO: 4947892 - DNA, 18 bp, Homo sapiens
cactgcaatcatatgtga

SEQ ID NO: 4947893 - DNA, 19 bp, Homo sapiens
cactgcacagtgcatctca

SEQ ID NO: 4947894 - DNA, 21 bp, Homo sapiens
cactgcacagtgcatctcagc

SEQ ID NO: 4947895 - DNA, 23 bp, Homo sapiens
cactgcacagtgcatctcagccc

SEQ ID NO: 4947896 - DNA, 15 bp, Homo sapiens
cactgcaccgggcca

SEQ ID NO: 4947897 - DNA, 18 bp, Homo sapiens
cactgcaccgggccacag

SEQ ID NO: 4947898 - DNA, 19 bp, Homo sapiens
cactgcaccgggccacaga

SEQ ID NO: 4947899 - DNA, 18 bp, Homo sapiens
cactgcactatagcctag

SEQ ID NO: 4947900 - DNA, 16 bp, Homo sapiens
cactgcactccagcct

SEQ ID NO: 4947901 - DNA, 19 bp, Homo sapiens
cactgcagcctcaacctcc

SEQ ID NO: 4947902 - DNA, 22 bp, Homo sapiens
cactgcagcctcaacctcctgg

SEQ ID NO: 4947903 - DNA, 23 bp, Homo sapiens
cactgcagcctcaacctcctggg

SEQ ID NO: 4947904 - DNA, 22 bp, Homo sapiens
cactgcatgagcttttatacta

SEQ ID NO: 4947905 - DNA, 19 bp, Homo sapiens
cactgccactttgcacatt

SEQ ID NO: 4947906 - DNA, 20 bp, Homo sapiens
cactgccactttgcacattt

SEQ ID NO: 4947907 - DNA, 20 bp, Homo sapiens
cactgccagcagcagcaggt

SEQ ID NO: 4947908 - DNA, 21 bp, Homo sapiens
cactgccagcagcagcaggtg

SEQ ID NO: 4947909 - DNA, 22 bp, Homo sapiens
cactgccagcagcagcaggtga

SEQ ID NO: 4947910 - DNA, 12 bp, Homo sapiens
cactgcctctgc

SEQ ID NO: 4947911 - DNA, 15 bp, Homo sapiens
cactgcctgtatact

SEQ ID NO: 4947912 - DNA, 19 bp, Homo sapiens
cactgcctttttatttata

SEQ ID NO: 4947913 - DNA, 17 bp, Homo sapiens
cactgctccctgaagcc

SEQ ID NO: 4947914 - DNA, 23 bp, Homo sapiens
cactgctccctgaagccagcctt

SEQ ID NO: 4947915 - DNA, 12 bp, Homo sapiens
cactgctctggt

SEQ ID NO: 4947916 - DNA, 12 bp, Homo sapiens
cactgctggctg

SEQ ID NO: 4947917 - DNA, 13 bp, Homo sapiens
cactgctggctgc

SEQ ID NO: 4947918 - DNA, 15 bp, Homo sapiens
cactgctggctgcct

SEQ ID NO: 4947919 - DNA, 16 bp, Homo sapiens
cactgctggctgcctt

SEQ ID NO: 4947920 - DNA, 18 bp, Homo sapiens
cactgcttgatgaagcaa

SEQ ID NO: 4947921 - DNA, 19 bp, Homo sapiens
cactgcttgatgaagcaag

SEQ ID NO: 4947922 - DNA, 19 bp, Homo sapiens
cactggatgcaaagaaaat

SEQ ID NO: 4947923 - DNA, 23 bp, Homo sapiens
cactggatgcaaagaaaatcaga

SEQ ID NO: 4947924 - DNA, 24 bp, Homo sapiens
cactggcccctcaaatcgtccagc

SEQ ID NO: 4947925 - DNA, 23 bp, Homo sapiens
cactgggatgagccgctgtgagc

SEQ ID NO: 4947926 - DNA, 21 bp, Homo sapiens
cactggggagcccgtctcagt

SEQ ID NO: 4947927 - DNA, 14 bp, Homo sapiens
cactggggcctaca

SEQ ID NO: 4947928 - DNA, 15 bp, Homo sapiens
ccactgacagcctcc

SEQ ID NO: 4947929 - DNA, 17 bp, Homo sapiens
ccactgacagcctccca

SEQ ID NO: 4947930 - DNA, 15 bp, Homo sapiens
ccactgccagcagca

SEQ ID NO: 4947931 - DNA, 20 bp, Homo sapiens
ccactgccagcagcagcagg

SEQ ID NO: 4947932 - DNA, 13 bp, Homo sapiens
ccactgcctctgc

SEQ ID NO: 4947933 - DNA, 16 bp, Homo sapiens
ccactgcctctgcctt

SEQ ID NO: 4947934 - DNA, 21 bp, Homo sapiens
ccactgcctctgccttagagg

SEQ ID NO: 4947935 - DNA, 13 bp, Homo sapiens
ccactgcctcttc

SEQ ID NO: 4947936 - DNA, 13 bp, Homo sapiens
ccactgctctggt

SEQ ID NO: 4947937 - DNA, 20 bp, Homo sapiens
ccactgcttttggtctgtgt

SEQ ID NO: 4947938 - DNA, 17 bp, Homo sapiens
ccactgtcaccctccac

SEQ ID NO: 4947939 - DNA, 15 bp, Homo sapiens
ccactgtgccatgtg

SEQ ID NO: 4947940 - DNA, 15 bp, Homo sapiens
ccactgtgcctttgc

SEQ ID NO: 4947941 - DNA, 22 bp, Homo sapiens
ccactgtgcctttgcaaatcag

SEQ ID NO: 4947942 - DNA, 13 bp, Homo sapiens
ccactgtggtggc

SEQ ID NO: 4947943 - DNA, 19 bp, Homo sapiens
ccactgtttctcttgagct

SEQ ID NO: 4947944 - DNA, 23 bp, Homo sapiens
ccactgtttctcttgagctggcc

SEQ ID NO: 4947945 - DNA, 18 bp, Homo sapiens
ccacttacatatattttt

SEQ ID NO: 4947946 - DNA, 21 bp, Homo sapiens
ccacttagaaattgcatttcc

SEQ ID NO: 4947947 - DNA, 21 bp, Homo sapiens
ccacttccaggggaacctgcc

SEQ ID NO: 4947948 - DNA, 23 bp, Homo sapiens
ccacttcttcctttctctttctc

SEQ ID NO: 4947949 - DNA, 17 bp, Homo sapiens
ccacttgaaatgttagt

SEQ ID NO: 4947950 - DNA, 21 bp, Homo sapiens
ccacttgtccgctgggtggta

SEQ ID NO: 4947951 - DNA, 23 bp, Homo sapiens
ccactttccttttctattccttc

SEQ ID NO: 4947952 - DNA, 20 bp, Homo sapiens
ccactttgcacagctctccg

SEQ ID NO: 4947953 - DNA, 13 bp, Homo sapiens
ccactttgtccat

SEQ ID NO: 4947954 - DNA, 19 bp, Homo sapiens
ccagaaaaaaaaaaactta

SEQ ID NO: 4947955 - DNA, 17 bp, Homo sapiens
ccagaaattagaaacct

SEQ ID NO: 4947956 - DNA, 23 bp, Homo sapiens
ccagaagaagagaagctgctgac

SEQ ID NO: 4947957 - DNA, 15 bp, Homo sapiens
ccagaagcttccata

SEQ ID NO: 4947958 - DNA, 15 bp, Homo sapiens
ccagaatcccagccg

SEQ ID NO: 4947959 - DNA, 16 bp, Homo sapiens
ccagaatttggaaatc

SEQ ID NO: 4947960 - DNA, 23 bp, Homo sapiens
ccagacactgaccatccactcta

SEQ ID NO: 4947961 - DNA, 19 bp, Homo sapiens
ccagacagacatctctgca

SEQ ID NO: 4947962 - DNA, 22 bp, Homo sapiens
ccagacagacatctctgcaccc

SEQ ID NO: 4947963 - DNA, 18 bp, Homo sapiens
ccagacatacgaaacaca

SEQ ID NO: 4947964 - DNA, 22 bp, Homo sapiens
ccagacatacgaaacacaaacc

SEQ ID NO: 4947965 - DNA, 19 bp, Homo sapiens
ccagacatcatgaatttta

SEQ ID NO: 4947966 - DNA, 23 bp, Homo sapiens
ccagaccaacgttactcagggct

SEQ ID NO: 4947967 - DNA, 14 bp, Homo sapiens
ccagacccggctgc

SEQ ID NO: 4947968 - DNA, 16 bp, Homo sapiens
ccagacccggctgcgt

SEQ ID NO: 4947969 - DNA, 13 bp, Homo sapiens
ccagactgcaggt

SEQ ID NO: 4947970 - DNA, 22 bp, Homo sapiens
ccagactgcttccaattttctg

SEQ ID NO: 4947971 - DNA, 15 bp, Homo sapiens
ccagacttccttgag

SEQ ID NO: 4947972 - DNA, 19 bp, Homo sapiens
ccagagaccgtcctcaccc

SEQ ID NO: 4947973 - DNA, 20 bp, Homo sapiens
ccagagagcaactctgagat

SEQ ID NO: 4947974 - DNA, 21 bp, Homo sapiens
ccagagagcaactctgagatc

SEQ ID NO: 4947975 - DNA, 21 bp, Homo sapiens
ccagagagggtggtgacctct

SEQ ID NO: 4947976 - DNA, 15 bp, Homo sapiens
ccagagagtggctcc

SEQ ID NO: 4947977 - DNA, 12 bp, Homo sapiens
ccagagatgtca

SEQ ID NO: 4947978 - DNA, 16 bp, Homo sapiens
ccagagcaacctctca

SEQ ID NO: 4947979 - DNA, 21 bp, Homo sapiens
ccagagcaacctctcactccc

SEQ ID NO: 4947980 - DNA, 22 bp, Homo sapiens
ccagagcaacgaccagggccga

SEQ ID NO: 4947981 - DNA, 15 bp, Homo sapiens
ccagagcagatgcag

SEQ ID NO: 4947982 - DNA, 23 bp, Homo sapiens
ccagagcagatgcagagagccat

SEQ ID NO: 4947983 - DNA, 15 bp, Homo sapiens
ccagagcaggaagca

SEQ ID NO: 4947984 - DNA, 22 bp, Homo sapiens
ccagagcatttccaacaccaca

SEQ ID NO: 4947985 - DNA, 19 bp, Homo sapiens
ccagagcggaggctgtgtg

SEQ ID NO: 4947986 - DNA, 14 bp, Homo sapiens
ccagaggaactgtc

SEQ ID NO: 4947987 - DNA, 21 bp, Homo sapiens
ccagaggaactgtccagagag

SEQ ID NO: 4947988 - DNA, 16 bp, Homo sapiens
ccagaggagccttttt

SEQ ID NO: 4947989 - DNA, 16 bp, Homo sapiens
ccagagggagtgacag

SEQ ID NO: 4947990 - DNA, 18 bp, Homo sapiens
ccagagggagtgacagag

SEQ ID NO: 4947991 - DNA, 20 bp, Homo sapiens
ccagagggagtgacagaggc

SEQ ID NO: 4947992 - DNA, 22 bp, Homo sapiens
ccagagggagtgacagaggcag

SEQ ID NO: 4947993 - DNA, 14 bp, Homo sapiens
ccagaggggaagga

SEQ ID NO: 4947994 - DNA, 23 bp, Homo sapiens
ccagaggtaacagaacagcttca

SEQ ID NO: 4947995 - DNA, 14 bp, Homo sapiens
ccagaggtccagcc

SEQ ID NO: 4947996 - DNA, 15 bp, Homo sapiens
ccagaggtccagccc

SEQ ID NO: 4947997 - DNA, 16 bp, Homo sapiens
ccagaggtccagccca

SEQ ID NO: 4947998 - DNA, 19 bp, Homo sapiens
ccagaggtccagcccatct

SEQ ID NO: 4947999 - DNA, 18 bp, Homo sapiens
ccagagtggcctggccag

SEQ ID NO: 4948000 - DNA, 22 bp, Homo sapiens
ccagagtggcctggccaggagc

SEQ ID NO: 4948001 - DNA, 14 bp, Homo sapiens
ccagatcctcttgg

SEQ ID NO: 4948002 - DNA, 13 bp, Homo sapiens
ccagatcctgggt

SEQ ID NO: 4948003 - DNA, 19 bp, Homo sapiens
ccagatctggtcccttgca

SEQ ID NO: 4948004 - DNA, 19 bp, Homo sapiens
ccagatgaggctggccaag

SEQ ID NO: 4948005 - DNA, 13 bp, Homo sapiens
ccagatgcaccag

SEQ ID NO: 4948006 - DNA, 14 bp, Homo sapiens
ccagatgcaccagc

SEQ ID NO: 4948007 - DNA, 15 bp, Homo sapiens
ccagatgcaccagcc

SEQ ID NO: 4948008 - DNA, 22 bp, Homo sapiens
ccagatggctggaaggggtcca

SEQ ID NO: 4948009 - DNA, 23 bp, Homo sapiens
ccagatgtttccagacttccttg

SEQ ID NO: 4948010 - DNA, 21 bp, Homo sapiens
ccagattgcaacaggctgggc

SEQ ID NO: 4948011 - DNA, 23 bp, Homo sapiens
ccagattgcaacaggctgggctt

SEQ ID NO: 4948012 - DNA, 18 bp, Homo sapiens
ccagatttttcggaggcc

SEQ ID NO: 4948013 - DNA, 16 bp, Homo sapiens
ccagcaagtgagagct

SEQ ID NO: 4948014 - DNA, 17 bp, Homo sapiens
ccagcaagtgagagctg

SEQ ID NO: 4948015 - DNA, 17 bp, Homo sapiens
ccagcaatatgtaaata

SEQ ID NO: 4948016 - DNA, 21 bp, Homo sapiens
ccagcaatgacatctcagggg

SEQ ID NO: 4948017 - DNA, 19 bp, Homo sapiens
ccagcaccaacaccacggt

SEQ ID NO: 4948018 - DNA, 17 bp, Homo sapiens
ccagcacctcagcctgc

SEQ ID NO: 4948019 - DNA, 22 bp, Homo sapiens
ccagcagaagacaaaaagacaa

SEQ ID NO: 4948020 - DNA, 23 bp, Homo sapiens
ccagcaggccggatcggtactgt

SEQ ID NO: 4948021 - DNA, 15 bp, Homo sapiens
ccagcagttctgtta

SEQ ID NO: 4948022 - DNA, 15 bp, Homo sapiens
ccagcatcacctgcc

SEQ ID NO: 4948023 - DNA, 18 bp, Homo sapiens
ccagcatcacctgcctgt

SEQ ID NO: 4948024 - DNA, 19 bp, Homo sapiens
ccagccagatcctcttggt

SEQ ID NO: 4948025 - DNA, 23 bp, Homo sapiens
ccagcccaaaggggacaggcctc

SEQ ID NO: 4948026 - DNA, 20 bp, Homo sapiens
ccagcccatctcggagcatc

SEQ ID NO: 4948027 - DNA, 14 bp, Homo sapiens
ccagccccacacag

SEQ ID NO: 4948028 - DNA, 21 bp, Homo sapiens
ccagccccacacagctacagc

SEQ ID NO: 4948029 - DNA, 14 bp, Homo sapiens
ccagccccacccag

SEQ ID NO: 4948030 - DNA, 15 bp, Homo sapiens
ccagccccacccagg

SEQ ID NO: 4948031 - DNA, 17 bp, Homo sapiens
ccagccccacccaggag

SEQ ID NO: 4948032 - DNA, 17 bp, Homo sapiens
ccagccccggccctggg

SEQ ID NO: 4948033 - DNA, 12 bp, Homo sapiens
ccagcccctaga

SEQ ID NO: 4948034 - DNA, 22 bp, Homo sapiens
ccagcccctagaaacccaagct

SEQ ID NO: 4948035 - DNA, 23 bp, Homo sapiens
ccagcccctagaaacccaagctc

SEQ ID NO: 4948036 - DNA, 14 bp, Homo sapiens
ccagcccctagccc

SEQ ID NO: 4948037 - DNA, 12 bp, Homo sapiens
catctctccctc

SEQ ID NO: 4948038 - DNA, 11 bp, Homo sapiens
catctctgcac

SEQ ID NO: 4948039 - DNA, 18 bp, Homo sapiens
catctctgtactttgctt

SEQ ID NO: 4948040 - DNA, 14 bp, Homo sapiens
catctctttgtaca

SEQ ID NO: 4948041 - DNA, 15 bp, Homo sapiens
catctgatttgcata

SEQ ID NO: 4948042 - DNA, 19 bp, Homo sapiens
catctgatttgcatattca

SEQ ID NO: 4948043 - DNA, 13 bp, Homo sapiens
catctgcaccctt

SEQ ID NO: 4948044 - DNA, 17 bp, Homo sapiens
catctgcacccttcttt

SEQ ID NO: 4948045 - DNA, 19 bp, Homo sapiens
catctgcacccttcttttc

SEQ ID NO: 4948046 - DNA, 20 bp, Homo sapiens
catctgcacccttcttttct

SEQ ID NO: 4948047 - DNA, 18 bp, Homo sapiens
ccaaaagattgctgaaaa

SEQ ID NO: 4948048 - DNA, 12 bp, Homo sapiens
ccaaaaggaaaa

SEQ ID NO: 4948049 - DNA, 17 bp, Homo sapiens
ccaaaaggaaaaagctc

SEQ ID NO: 4948050 - DNA, 16 bp, Homo sapiens
ccacaagaaatttgat

SEQ ID NO: 4948051 - DNA, 15 bp, Homo sapiens
ccacacagctacagc

SEQ ID NO: 4948052 - DNA, 14 bp, Homo sapiens
ccacacccagccca

SEQ ID NO: 4948053 - DNA, 21 bp, Homo sapiens
ccacacccagcccacttctgc

SEQ ID NO: 4948054 - DNA, 22 bp, Homo sapiens
ccacacccagcccacttctgcc

SEQ ID NO: 4948055 - DNA, 16 bp, Homo sapiens
ccacacccagcctcag

SEQ ID NO: 4948056 - DNA, 11 bp, Homo sapiens
ccacaccctcc

SEQ ID NO: 4948057 - DNA, 21 bp, Homo sapiens
ccacaccctcccccgccactc

SEQ ID NO: 4948058 - DNA, 16 bp, Homo sapiens
ccacaccctgtactgt

SEQ ID NO: 4948059 - DNA, 19 bp, Homo sapiens
ccacaccctgtactgttct

SEQ ID NO: 4948060 - DNA, 22 bp, Homo sapiens
ccacacctcagttcccttggcc

SEQ ID NO: 4948061 - DNA, 14 bp, Homo sapiens
ccacacctctgcca

SEQ ID NO: 4948062 - DNA, 22 bp, Homo sapiens
ccacactaacctgggttccctt

SEQ ID NO: 4948063 - DNA, 13 bp, Homo sapiens
ccacactctccat

SEQ ID NO: 4948064 - DNA, 16 bp, Homo sapiens
ccacacttcaggctct

SEQ ID NO: 4948065 - DNA, 20 bp, Homo sapiens
ccacacttcaggctcttctc

SEQ ID NO: 4948066 - DNA, 21 bp, Homo sapiens
ccacacttcaggctcttctcc

SEQ ID NO: 4948067 - DNA, 22 bp, Homo sapiens
ccacacttcaggctcttctcct

SEQ ID NO: 4948068 - DNA, 22 bp, Homo sapiens
ccacagagaaagtacttctcca

SEQ ID NO: 4948069 - DNA, 20 bp, Homo sapiens
ccacagcacagctccctgcc

SEQ ID NO: 4948070 - DNA, 17 bp, Homo sapiens
ccacagcgagggcagct

SEQ ID NO: 4948071 - DNA, 20 bp, Homo sapiens
ccacagcgagggcagctgct

SEQ ID NO: 4948072 - DNA, 21 bp, Homo sapiens
ccacagcgagggcagctgcta

SEQ ID NO: 4948073 - DNA, 14 bp, Homo sapiens
ccacaggaaagtgt

SEQ ID NO: 4948074 - DNA, 22 bp, Homo sapiens
ccacaggaggcaagcaagctct

SEQ ID NO: 4948075 - DNA, 20 bp, Homo sapiens
ccacaggagtgggaaaacac

SEQ ID NO: 4948076 - DNA, 15 bp, Homo sapiens
ccacaggcccttcct

SEQ ID NO: 4948077 - DNA, 19 bp, Homo sapiens
ccacaggcccttcctctcc

SEQ ID NO: 4948078 - DNA, 17 bp, Homo sapiens
ccacagtagtcttgatg

SEQ ID NO: 4948079 - DNA, 14 bp, Homo sapiens
ccacagtcaaagaa

SEQ ID NO: 4948080 - DNA, 16 bp, Homo sapiens
ccacagtcaaagaagg

SEQ ID NO: 4948081 - DNA, 22 bp, Homo sapiens
ccacataaggggtttgccattt

SEQ ID NO: 4948082 - DNA, 18 bp, Homo sapiens
ccacatccaactccagca

SEQ ID NO: 4948083 - DNA, 20 bp, Homo sapiens
ccacatcctccgtccagccg

SEQ ID NO: 4948084 - DNA, 20 bp, Homo sapiens
ccacatgtacagacatacat

SEQ ID NO: 4948085 - DNA, 15 bp, Homo sapiens
ccacatgtgacacat

SEQ ID NO: 4948086 - DNA, 19 bp, Homo sapiens
ccacatgtgacacatatgc

SEQ ID NO: 4948087 - DNA, 16 bp, Homo sapiens
ccacatgtgcacatgc

SEQ ID NO: 4948088 - DNA, 14 bp, Homo sapiens
ccaccaaagctgcc

SEQ ID NO: 4948089 - DNA, 14 bp, Homo sapiens
ccaccacacccagc

SEQ ID NO: 4948090 - DNA, 14 bp, Homo sapiens
ccaccacctctgtg

SEQ ID NO: 4948091 - DNA, 22 bp, Homo sapiens
ccaccagagaccgtcctcaccc

SEQ ID NO: 4948092 - DNA, 21 bp, Homo sapiens
ccaccatggccagccaacttt

SEQ ID NO: 4948093 - DNA, 16 bp, Homo sapiens
ccacccaaccctatct

SEQ ID NO: 4948094 - DNA, 19 bp, Homo sapiens
ccacccaaccctatctcct

SEQ ID NO: 4948095 - DNA, 21 bp, Homo sapiens
ccacccaggagccccgaggcc

SEQ ID NO: 4948096 - DNA, 13 bp, Homo sapiens
ccaccccacactt

SEQ ID NO: 4948097 - DNA, 13 bp, Homo sapiens
ccacccccagctc

SEQ ID NO: 4948098 - DNA, 16 bp, Homo sapiens
ccaccccgcctgccct

SEQ ID NO: 4948099 - DNA, 15 bp, Homo sapiens
ccaccccggccccct

SEQ ID NO: 4948100 - DNA, 14 bp, Homo sapiens
ccaccccgggctct

SEQ ID NO: 4948101 - DNA, 17 bp, Homo sapiens
ccaccccgggctctctg

SEQ ID NO: 4948102 - DNA, 18 bp, Homo sapiens
ccaccccgggctctctgc

SEQ ID NO: 4948103 - DNA, 21 bp, Homo sapiens
ccaccctagccaatgtctcct

SEQ ID NO: 4948104 - DNA, 16 bp, Homo sapiens
ccaccctccctggagt

SEQ ID NO: 4948105 - DNA, 12 bp, Homo sapiens
ccaccctgctct

SEQ ID NO: 4948106 - DNA, 15 bp, Homo sapiens
ccaccctgggagaca

SEQ ID NO: 4948107 - DNA, 17 bp, Homo sapiens
ccaccctgggagacaga

SEQ ID NO: 4948108 - DNA, 14 bp, Homo sapiens
ccacccttcccctc

SEQ ID NO: 4948109 - DNA, 12 bp, Homo sapiens
ccacccttggcc

SEQ ID NO: 4948110 - DNA, 17 bp, Homo sapiens
ccaccggtccagctggc

SEQ ID NO: 4948111 - DNA, 23 bp, Homo sapiens
ccacctccagcccgggagcctag

SEQ ID NO: 4948112 - DNA, 24 bp, Homo sapiens
ccacctccagtccccctatccttg

SEQ ID NO: 4948113 - DNA, 18 bp, Homo sapiens
ccacctccccacgccctc

SEQ ID NO: 4948114 - DNA, 15 bp, Homo sapiens
ccacctccctgccca

SEQ ID NO: 4948115 - DNA, 16 bp, Homo sapiens
ccacctccctgcccag

SEQ ID NO: 4948116 - DNA, 16 bp, Homo sapiens
ccacctctccatcctg

SEQ ID NO: 4948117 - DNA, 19 bp, Homo sapiens
ccacctctctcctttgctg

SEQ ID NO: 4948118 - DNA, 24 bp, Homo sapiens
ccacctctctcctttgctgaggcc

SEQ ID NO: 4948119 - DNA, 18 bp, Homo sapiens
ccacctctgcggacccca

SEQ ID NO: 4948120 - DNA, 18 bp, Homo sapiens
ccacctctgtgacctcag

SEQ ID NO: 4948121 - DNA, 14 bp, Homo sapiens
ccacctgcccatca

SEQ ID NO: 4948122 - DNA, 15 bp, Homo sapiens
ccacctgcccatcac

SEQ ID NO: 4948123 - DNA, 20 bp, Homo sapiens
ccacctgcctgcgtcttccg

SEQ ID NO: 4948124 - DNA, 22 bp, Homo sapiens
ccacctgggcatatccaccacc

SEQ ID NO: 4948125 - DNA, 21 bp, Homo sapiens
ccacctggtactccctctcag

SEQ ID NO: 4948126 - DNA, 11 bp, Homo sapiens
ccacctgtctc

SEQ ID NO: 4948127 - DNA, 16 bp, Homo sapiens
ccacctgtctcagcct

SEQ ID NO: 4948128 - DNA, 20 bp, Homo sapiens
ccacctgtctcagcctccca

SEQ ID NO: 4948129 - DNA, 11 bp, Homo sapiens
ccacctgtggg

SEQ ID NO: 4948130 - DNA, 15 bp, Homo sapiens
ccaccttggctcaag

SEQ ID NO: 4948131 - DNA, 18 bp, Homo sapiens
ccaccttggctgcaggga

SEQ ID NO: 4948132 - DNA, 15 bp, Homo sapiens
ccacgaatttgctgg

SEQ ID NO: 4948133 - DNA, 19 bp, Homo sapiens
ccacgattttctccagctc

SEQ ID NO: 4948134 - DNA, 20 bp, Homo sapiens
ccacgattttctccagctca

SEQ ID NO: 4948135 - DNA, 22 bp, Homo sapiens
ccacgattttctccagctcaga

SEQ ID NO: 4948136 - DNA, 17 bp, Homo sapiens
ccacgccctcccctccc

SEQ ID NO: 4948137 - DNA, 21 bp, Homo sapiens
ccacgccctcccctcccctgc

SEQ ID NO: 4948138 - DNA, 22 bp, Homo sapiens
ccacgccctcccctcccctgct

SEQ ID NO: 4948139 - DNA, 14 bp, Homo sapiens
ccacgctagggcgg

SEQ ID NO: 4948140 - DNA, 13 bp, Homo sapiens
ccacgctggagtg

SEQ ID NO: 4948141 - DNA, 16 bp, Homo sapiens
ccacgctggagtgcag

SEQ ID NO: 4948142 - DNA, 18 bp, Homo sapiens
ccacgctggagtgcagtg

SEQ ID NO: 4948143 - DNA, 23 bp, Homo sapiens
ccacggccaggccagagggagtg

SEQ ID NO: 4948144 - DNA, 16 bp, Homo sapiens
ccacgttccacagttg

SEQ ID NO: 4948145 - DNA, 21 bp, Homo sapiens
ccactaagaattcaaactggg

SEQ ID NO: 4948146 - DNA, 22 bp, Homo sapiens
ccactacatgcagcccatgccc

SEQ ID NO: 4948147 - DNA, 16 bp, Homo sapiens
ccactatccttcgtga

SEQ ID NO: 4948148 - DNA, 21 bp, Homo sapiens
ccactcacatgacacccgtga

SEQ ID NO: 4948149 - DNA, 11 bp, Homo sapiens
ccactcacccc

SEQ ID NO: 4948150 - DNA, 12 bp, Homo sapiens
ccactcagcccc

SEQ ID NO: 4948151 - DNA, 17 bp, Homo sapiens
ccactcagcccctagga

SEQ ID NO: 4948152 - DNA, 13 bp, Homo sapiens
ccactcagcttcc

SEQ ID NO: 4948153 - DNA, 20 bp, Homo sapiens
ccactccagacccctggctt

SEQ ID NO: 4948154 - DNA, 18 bp, Homo sapiens
ccactccagcgctgagtg

SEQ ID NO: 4948155 - DNA, 19 bp, Homo sapiens
ccactctaccctcccaccc

SEQ ID NO: 4948156 - DNA, 13 bp, Homo sapiens
ccactctccccac

SEQ ID NO: 4948157 - DNA, 17 bp, Homo sapiens
ccactctccccacacta

SEQ ID NO: 4948158 - DNA, 14 bp, Homo sapiens
ccactctcttccct

SEQ ID NO: 4948159 - DNA, 17 bp, Homo sapiens
cacttgaacaaaatctg

SEQ ID NO: 4948160 - DNA, 22 bp, Homo sapiens
cacttgcagactctacagaggc

SEQ ID NO: 4948161 - DNA, 24 bp, Homo sapiens
cacttgcagactctacagaggcca

SEQ ID NO: 4948162 - DNA, 12 bp, Homo sapiens
cacttgcatttc

SEQ ID NO: 4948163 - DNA, 19 bp, Homo sapiens
cacttgtataaatgtatat

SEQ ID NO: 4948164 - DNA, 20 bp, Homo sapiens
cacttgtataaatgtatata

SEQ ID NO: 4948165 - DNA, 15 bp, Homo sapiens
cacttgtgctttgct

SEQ ID NO: 4948166 - DNA, 19 bp, Homo sapiens
cacttgtgctttgctcttg

SEQ ID NO: 4948167 - DNA, 13 bp, Homo sapiens
cacttgttccagc

SEQ ID NO: 4948168 - DNA, 15 bp, Homo sapiens
cacttgttccagctc

SEQ ID NO: 4948169 - DNA, 17 bp, Homo sapiens
cacttgttccagctctt

SEQ ID NO: 4948170 - DNA, 22 bp, Homo sapiens
cactttacccacctagaacact

SEQ ID NO: 4948171 - DNA, 22 bp, Homo sapiens
cactttataagtcattgtatgt

SEQ ID NO: 4948172 - DNA, 16 bp, Homo sapiens
cactttgaaatacctc

SEQ ID NO: 4948173 - DNA, 18 bp, Homo sapiens
cactttgcacattttgat

SEQ ID NO: 4948174 - DNA, 21 bp, Homo sapiens
cactttgcacgacgccctctc

SEQ ID NO: 4948175 - DNA, 23 bp, Homo sapiens
cactttgcatatgagccgtgaac

SEQ ID NO: 4948176 - DNA, 16 bp, Homo sapiens
cactttgcctcctgtg

SEQ ID NO: 4948177 - DNA, 16 bp, Homo sapiens
cacttttcctccctca

SEQ ID NO: 4948178 - DNA, 21 bp, Homo sapiens
cagaaaaataacttcaagcaa

SEQ ID NO: 4948179 - DNA, 17 bp, Homo sapiens
cagaaaagggaagttgt

SEQ ID NO: 4948180 - DNA, 19 bp, Homo sapiens
cagaaaatattatgtgttt

SEQ ID NO: 4948181 - DNA, 13 bp, Homo sapiens
cagaaacactgcc

SEQ ID NO: 4948182 - DNA, 14 bp, Homo sapiens
cagaaacactgcct

SEQ ID NO: 4948183 - DNA, 17 bp, Homo sapiens
cagaaacactgcctttt

SEQ ID NO: 4948184 - DNA, 19 bp, Homo sapiens
cagaaacactgccttttta

SEQ ID NO: 4948185 - DNA, 21 bp, Homo sapiens
cagaaacctatcctcactgcc

SEQ ID NO: 4948186 - DNA, 20 bp, Homo sapiens
cagaaaggaaaacctgaaga

SEQ ID NO: 4948187 - DNA, 15 bp, Homo sapiens
cagaaaggttctgcc

SEQ ID NO: 4948188 - DNA, 17 bp, Homo sapiens
cagaaaggttctgcccg

SEQ ID NO: 4948189 - DNA, 21 bp, Homo sapiens
cagaaagtcattccttctttt

SEQ ID NO: 4948190 - DNA, 13 bp, Homo sapiens
cagaaatatatat

SEQ ID NO: 4948191 - DNA, 20 bp, Homo sapiens
cagaaatcagtaatatttat

SEQ ID NO: 4948192 - DNA, 21 bp, Homo sapiens
cagaaatggggaattctctaa

SEQ ID NO: 4948193 - DNA, 14 bp, Homo sapiens
cagaaatgtctaaa

SEQ ID NO: 4948194 - DNA, 21 bp, Homo sapiens
cagaaatgtctaaatgctgaa

SEQ ID NO: 4948195 - DNA, 23 bp, Homo sapiens
cagaaattagaaaccttaatatg

SEQ ID NO: 4948196 - DNA, 11 bp, Homo sapiens
cagaaattgga

SEQ ID NO: 4948197 - DNA, 13 bp, Homo sapiens
cagaacagggtca

SEQ ID NO: 4948198 - DNA, 16 bp, Homo sapiens
cagaacatcattagaa

SEQ ID NO: 4948199 - DNA, 16 bp, Homo sapiens
cagaaccaaagctcaa

SEQ ID NO: 4948200 - DNA, 20 bp, Homo sapiens
cagaaccaccccggccccct

SEQ ID NO: 4948201 - DNA, 14 bp, Homo sapiens
cagaacccagggct

SEQ ID NO: 4948202 - DNA, 21 bp, Homo sapiens
cagaacccagggctctgcccc

SEQ ID NO: 4948203 - DNA, 22 bp, Homo sapiens
cagaacccagggctctgcccca

SEQ ID NO: 4948204 - DNA, 23 bp, Homo sapiens
cagaacccctacatgaaacagaa

SEQ ID NO: 4948205 - DNA, 22 bp, Homo sapiens
cagaacccttggagccaatgga

SEQ ID NO: 4948206 - DNA, 18 bp, Homo sapiens
cagaacctcttccccaga

SEQ ID NO: 4948207 - DNA, 12 bp, Homo sapiens
cagaactgccat

SEQ ID NO: 4948208 - DNA, 15 bp, Homo sapiens
cagaacttccctgat

SEQ ID NO: 4948209 - DNA, 19 bp, Homo sapiens
cagaagaagagaagctgct

SEQ ID NO: 4948210 - DNA, 21 bp, Homo sapiens
cagaagaccacaaaaattgac

SEQ ID NO: 4948211 - DNA, 16 bp, Homo sapiens
cagaagagaggggaag

SEQ ID NO: 4948212 - DNA, 14 bp, Homo sapiens
cagaagcatttgta

SEQ ID NO: 4948213 - DNA, 22 bp, Homo sapiens
cagaagcatttgtattttgtgt

SEQ ID NO: 4948214 - DNA, 23 bp, Homo sapiens
cagaagccctgatgtgtcctcag

SEQ ID NO: 4948215 - DNA, 19 bp, Homo sapiens
cagaagcctctggctagag

SEQ ID NO: 4948216 - DNA, 13 bp, Homo sapiens
cagaagggagcag

SEQ ID NO: 4948217 - DNA, 22 bp, Homo sapiens
cagaaggtgccactttacccac

SEQ ID NO: 4948218 - DNA, 16 bp, Homo sapiens
cagaagtcatgaagcc

SEQ ID NO: 4948219 - DNA, 14 bp, Homo sapiens
cagaagtctcctca

SEQ ID NO: 4948220 - DNA, 15 bp, Homo sapiens
cagaagtctcctcaa

SEQ ID NO: 4948221 - DNA, 14 bp, Homo sapiens
cagaagtggagctg

SEQ ID NO: 4948222 - DNA, 15 bp, Homo sapiens
cagaagtggagctgg

SEQ ID NO: 4948223 - DNA, 16 bp, Homo sapiens
cagaagtggagctggg

SEQ ID NO: 4948224 - DNA, 16 bp, Homo sapiens
cagaagtttggcaata

SEQ ID NO: 4948225 - DNA, 18 bp, Homo sapiens
cagaataatgttctattg

SEQ ID NO: 4948226 - DNA, 18 bp, Homo sapiens
cagaatgctgcaggactt

SEQ ID NO: 4948227 - DNA, 17 bp, Homo sapiens
cagaatgtatctgtgaa

SEQ ID NO: 4948228 - DNA, 20 bp, Homo sapiens
cagaatgttttactgtgaaa

SEQ ID NO: 4948229 - DNA, 21 bp, Homo sapiens
cagaattatttttaaaaagaa

SEQ ID NO: 4948230 - DNA, 19 bp, Homo sapiens
cagaattgtgcaaatggaa

SEQ ID NO: 4948231 - DNA, 21 bp, Homo sapiens
cagaattttaggaacttcaga

SEQ ID NO: 4948232 - DNA, 16 bp, Homo sapiens
cagaattttggaagat

SEQ ID NO: 4948233 - DNA, 13 bp, Homo sapiens
cagacaacagaag

SEQ ID NO: 4948234 - DNA, 18 bp, Homo sapiens
cagacacacacacgcacg

SEQ ID NO: 4948235 - DNA, 22 bp, Homo sapiens
cagacacacacacgcacgcaca

SEQ ID NO: 4948236 - DNA, 13 bp, Homo sapiens
cagacacaggccc

SEQ ID NO: 4948237 - DNA, 22 bp, Homo sapiens
cagacacaggcccggctccagg

SEQ ID NO: 4948238 - DNA, 19 bp, Homo sapiens
cagacaccttgacagggca

SEQ ID NO: 4948239 - DNA, 21 bp, Homo sapiens
cagcccctagaaacccaagct

SEQ ID NO: 4948240 - DNA, 13 bp, Homo sapiens
cagcccctagccc

SEQ ID NO: 4948241 - DNA, 16 bp, Homo sapiens
cagcccctagcccagg

SEQ ID NO: 4948242 - DNA, 22 bp, Homo sapiens
cagcccctagcccaggagagag

SEQ ID NO: 4948243 - DNA, 17 bp, Homo sapiens
cagcccggccgctccac

SEQ ID NO: 4948244 - DNA, 16 bp, Homo sapiens
cagcccgggagcctag

SEQ ID NO: 4948245 - DNA, 21 bp, Homo sapiens
cagcccgggagcctaggacca

SEQ ID NO: 4948246 - DNA, 11 bp, Homo sapiens
cagccctgctt

SEQ ID NO: 4948247 - DNA, 13 bp, Homo sapiens
cagccctgctttg

SEQ ID NO: 4948248 - DNA, 23 bp, Homo sapiens
cagccctgctttgggctgccctg

SEQ ID NO: 4948249 - DNA, 13 bp, Homo sapiens
cagccctggggct

SEQ ID NO: 4948250 - DNA, 16 bp, Homo sapiens
cagccctgtcttccta

SEQ ID NO: 4948251 - DNA, 13 bp, Homo sapiens
cagccctgttctg

SEQ ID NO: 4948252 - DNA, 13 bp, Homo sapiens
cagcccttagcag

SEQ ID NO: 4948253 - DNA, 18 bp, Homo sapiens
cagccgccttaagctgat

SEQ ID NO: 4948254 - DNA, 19 bp, Homo sapiens
cagccgccttaagctgatc

SEQ ID NO: 4948255 - DNA, 15 bp, Homo sapiens
cagccgccttccttg

SEQ ID NO: 4948256 - DNA, 14 bp, Homo sapiens
cagccgtgccttca

SEQ ID NO: 4948257 - DNA, 16 bp, Homo sapiens
cagccgtgccttcagc

SEQ ID NO: 4948258 - DNA, 20 bp, Homo sapiens
cagccgtgccttcagctcta

SEQ ID NO: 4948259 - DNA, 15 bp, Homo sapiens
cagcctaccatgaga

SEQ ID NO: 4948260 - DNA, 21 bp, Homo sapiens
cagcctatgagcatcctgagc

SEQ ID NO: 4948261 - DNA, 17 bp, Homo sapiens
cagcctcaacctcctgg

SEQ ID NO: 4948262 - DNA, 15 bp, Homo sapiens
cagcctcacccttgc

SEQ ID NO: 4948263 - DNA, 23 bp, Homo sapiens
cagttcagtaataaactgtgttt

SEQ ID NO: 4948264 - DNA, 15 bp, Homo sapiens
cagttcattgcactt

SEQ ID NO: 4948265 - DNA, 13 bp, Homo sapiens
cagttccaagaaa

SEQ ID NO: 4948266 - DNA, 16 bp, Homo sapiens
cagttcccttggcctc

SEQ ID NO: 4948267 - DNA, 17 bp, Homo sapiens
cagttcccttggcctca

SEQ ID NO: 4948268 - DNA, 19 bp, Homo sapiens
cagttcccttggcctcaga

SEQ ID NO: 4948269 - DNA, 18 bp, Homo sapiens
cagttgccaccacctctg

SEQ ID NO: 4948270 - DNA, 17 bp, Homo sapiens
cagttggttgtgtcttt

SEQ ID NO: 4948271 - DNA, 18 bp, Homo sapiens
cagttggttgtgtctttt

SEQ ID NO: 4948272 - DNA, 23 bp, Homo sapiens
cagttgttcaataataaatattt

SEQ ID NO: 4948273 - DNA, 16 bp, Homo sapiens
cagtttatcatgaagc

SEQ ID NO: 4948274 - DNA, 20 bp, Homo sapiens
cagtttatcatgaagcctgt

SEQ ID NO: 4948275 - DNA, 22 bp, Homo sapiens
cagtttatcatgaagcctgtgg

SEQ ID NO: 4948276 - DNA, 16 bp, Homo sapiens
cagtttatgttgtaca

SEQ ID NO: 4948277 - DNA, 18 bp, Homo sapiens
cagtttatttttaaagat

SEQ ID NO: 4948278 - DNA, 18 bp, Homo sapiens
cagtttcttagcttttta

SEQ ID NO: 4948279 - DNA, 14 bp, Homo sapiens
cagtttgctttgta

SEQ ID NO: 4948280 - DNA, 15 bp, Homo sapiens
cagtttgtaaatgtt

SEQ ID NO: 4948281 - DNA, 17 bp, Homo sapiens
cagtttgtaaatgttat

SEQ ID NO: 4948282 - DNA, 23 bp, Homo sapiens
cagtttgtaaatgttatttctgc

SEQ ID NO: 4948283 - DNA, 18 bp, Homo sapiens
cagttttatgctcttttt

SEQ ID NO: 4948284 - DNA, 12 bp, Homo sapiens
cagtttttcagg

SEQ ID NO: 4948285 - DNA, 23 bp, Homo sapiens
cataaaaagcctgcaatttcata

SEQ ID NO: 4948286 - DNA, 19 bp, Homo sapiens
cataaaaaggacatcagca

SEQ ID NO: 4948287 - DNA, 12 bp, Homo sapiens
cataaaacaggt

SEQ ID NO: 4948288 - DNA, 14 bp, Homo sapiens
cataaaatcaaaac

SEQ ID NO: 4948289 - DNA, 18 bp, Homo sapiens
cataaacaatgatgccct

SEQ ID NO: 4948290 - DNA, 15 bp, Homo sapiens
cataaacattctttt

SEQ ID NO: 4948291 - DNA, 20 bp, Homo sapiens
cataaatatgcagtgatatg

SEQ ID NO: 4948292 - DNA, 14 bp, Homo sapiens
cataaatgaagcag

SEQ ID NO: 4948293 - DNA, 20 bp, Homo sapiens
cataaatttactttacacaa

SEQ ID NO: 4948294 - DNA, 15 bp, Homo sapiens
cataacaacttcata

SEQ ID NO: 4948295 - DNA, 20 bp, Homo sapiens
cataacattttcagaatagt

SEQ ID NO: 4948296 - DNA, 17 bp, Homo sapiens
cataacgtttttccttt

SEQ ID NO: 4948297 - DNA, 14 bp, Homo sapiens
cataactaaatttg

SEQ ID NO: 4948298 - DNA, 18 bp, Homo sapiens
cataactaaatttgatac

SEQ ID NO: 4948299 - DNA, 21 bp, Homo sapiens
cataactaaatttgatactta

SEQ ID NO: 4948300 - DNA, 22 bp, Homo sapiens
cataactaaatttgatacttat

SEQ ID NO: 4948301 - DNA, 18 bp, Homo sapiens
cataactctgtaaaaaca

SEQ ID NO: 4948302 - DNA, 14 bp, Homo sapiens
cataactgccttga

SEQ ID NO: 4948303 - DNA, 21 bp, Homo sapiens
cataaggtttcgtttctgtat

SEQ ID NO: 4948304 - DNA, 22 bp, Homo sapiens
cataaggtttcgtttctgtata

SEQ ID NO: 4948305 - DNA, 22 bp, Homo sapiens
cataagtaattcaagaaaacaa

SEQ ID NO: 4948306 - DNA, 16 bp, Homo sapiens
cataagtatacagttc

SEQ ID NO: 4948307 - DNA, 14 bp, Homo sapiens
cataagtgaattta

SEQ ID NO: 4948308 - DNA, 21 bp, Homo sapiens
cataataaaaaattatgacaa

SEQ ID NO: 4948309 - DNA, 19 bp, Homo sapiens
cataatctggactcctctg

SEQ ID NO: 4948310 - DNA, 23 bp, Homo sapiens
cataatctggactcctctgtcca

SEQ ID NO: 4948311 - DNA, 20 bp, Homo sapiens
cataatgctaatttaaagag

SEQ ID NO: 4948312 - DNA, 22 bp, Homo sapiens
cataatgctaatttaaagagac

SEQ ID NO: 4948313 - DNA, 19 bp, Homo sapiens
cataattcctacagcacta

SEQ ID NO: 4948314 - DNA, 21 bp, Homo sapiens
catacaggatttgaactcaga

SEQ ID NO: 4948315 - DNA, 13 bp, Homo sapiens
catacagttttat

SEQ ID NO: 4948316 - DNA, 20 bp, Homo sapiens
catacagttttatgctcttt

SEQ ID NO: 4948317 - DNA, 21 bp, Homo sapiens
catacagttttatgctctttt

SEQ ID NO: 4948318 - DNA, 22 bp, Homo sapiens
catacagttttatgctcttttt

SEQ ID NO: 4948319 - DNA, 23 bp, Homo sapiens
cataccagctcgcacccccctgt

SEQ ID NO: 4948320 - DNA, 17 bp, Homo sapiens
catacctctgaccaaca

SEQ ID NO: 4948321 - DNA, 16 bp, Homo sapiens
catacgaaacacaaac

SEQ ID NO: 4948322 - DNA, 18 bp, Homo sapiens
catactcagcctgctgcc

SEQ ID NO: 4948323 - DNA, 20 bp, Homo sapiens
catactcagcctgctgccca

SEQ ID NO: 4948324 - DNA, 13 bp, Homo sapiens
catactggcctgg

SEQ ID NO: 4948325 - DNA, 13 bp, Homo sapiens
catacttatctct

SEQ ID NO: 4948326 - DNA, 20 bp, Homo sapiens
catacttatctctctgtgct

SEQ ID NO: 4948327 - DNA, 14 bp, Homo sapiens
catactttcatcct

SEQ ID NO: 4948328 - DNA, 21 bp, Homo sapiens
catactttcatcctgactctg

SEQ ID NO: 4948329 - DNA, 12 bp, Homo sapiens
catactttgtct

SEQ ID NO: 4948330 - DNA, 14 bp, Homo sapiens
catactttgtctga

SEQ ID NO: 4948331 - DNA, 11 bp, Homo sapiens
catagaaaaat

SEQ ID NO: 4948332 - DNA, 15 bp, Homo sapiens
catagaaacatgaca

SEQ ID NO: 4948333 - DNA, 17 bp, Homo sapiens
catagaaacatgacact

SEQ ID NO: 4948334 - DNA, 16 bp, Homo sapiens
catagaactgggtaaa

SEQ ID NO: 4948335 - DNA, 19 bp, Homo sapiens
catagaactgggtaaatgc

SEQ ID NO: 4948336 - DNA, 14 bp, Homo sapiens
catagagtttaaca

SEQ ID NO: 4948337 - DNA, 13 bp, Homo sapiens
catagatcttctg

SEQ ID NO: 4948338 - DNA, 14 bp, Homo sapiens
catagatcttctga

SEQ ID NO: 4948339 - DNA, 15 bp, Homo sapiens
catagatcttctgaa

SEQ ID NO: 4948340 - DNA, 18 bp, Homo sapiens
catagatgttttggtaga

SEQ ID NO: 4948341 - DNA, 16 bp, Homo sapiens
catagattaatggcac

SEQ ID NO: 4948342 - DNA, 17 bp, Homo sapiens
catagattaatggcact

SEQ ID NO: 4948343 - DNA, 18 bp, Homo sapiens
catagattaatggcactg

SEQ ID NO: 4948344 - DNA, 20 bp, Homo sapiens
catagatttatttttcagtt

SEQ ID NO: 4948345 - DNA, 15 bp, Homo sapiens
catagcaagacacat

SEQ ID NO: 4948346 - DNA, 20 bp, Homo sapiens
catagcaagacacatcccta

SEQ ID NO: 4948347 - DNA, 22 bp, Homo sapiens
catagcagagaatgaaagggcc

SEQ ID NO: 4948348 - DNA, 15 bp, Homo sapiens
catagccaccccaga

SEQ ID NO: 4948349 - DNA, 17 bp, Homo sapiens
catagcccatccctgcc

SEQ ID NO: 4948350 - DNA, 22 bp, Homo sapiens
catagctacccaaaagagaaaa

SEQ ID NO: 4948351 - DNA, 14 bp, Homo sapiens
catagctgtctaga

SEQ ID NO: 4948352 - DNA, 16 bp, Homo sapiens
cataggtatttcaaaa

SEQ ID NO: 4948353 - DNA, 21 bp, Homo sapiens
catagtaacttcttatggaat

SEQ ID NO: 4948354 - DNA, 22 bp, Homo sapiens
catagtaacttcttatggaatt

SEQ ID NO: 4948355 - DNA, 21 bp, Homo sapiens
catagtaagttcagcacttgt

SEQ ID NO: 4948356 - DNA, 15 bp, Homo sapiens
catagtatggtggct

SEQ ID NO: 4948357 - DNA, 16 bp, Homo sapiens
catagtatggtggctg

SEQ ID NO: 4948358 - DNA, 22 bp, Homo sapiens
catagtggcttaaaacaacact

SEQ ID NO: 4948359 - DNA, 13 bp, Homo sapiens
catagtgtaatgt

SEQ ID NO: 4948360 - DNA, 12 bp, Homo sapiens
ccccatgcctgt

SEQ ID NO: 4948361 - DNA, 15 bp, Homo sapiens
ccccatgcctgtcca

SEQ ID NO: 4948362 - DNA, 19 bp, Homo sapiens
ccccatgcctgtccagcct

SEQ ID NO: 4948363 - DNA, 16 bp, Homo sapiens
ccccatgtgtcctggt

SEQ ID NO: 4948364 - DNA, 22 bp, Homo sapiens
ccccatgttgtaatgctgcact

SEQ ID NO: 4948365 - DNA, 16 bp, Homo sapiens
ccccattctcatctgc

SEQ ID NO: 4948366 - DNA, 21 bp, Homo sapiens
ccccattctgcctgcccaggc

SEQ ID NO: 4948367 - DNA, 15 bp, Homo sapiens
cccccacccccagct

SEQ ID NO: 4948368 - DNA, 17 bp, Homo sapiens
cccccacccccagctca

SEQ ID NO: 4948369 - DNA, 19 bp, Homo sapiens
cccccaccggtccagctgg

SEQ ID NO: 4948370 - DNA, 12 bp, Homo sapiens
cccccagcccaa

SEQ ID NO: 4948371 - DNA, 13 bp, Homo sapiens
cccccaggaagcc

SEQ ID NO: 4948372 - DNA, 20 bp, Homo sapiens
cccccaggttccgaagaaga

SEQ ID NO: 4948373 - DNA, 12 bp, Homo sapiens
ccccccagcctc

SEQ ID NO: 4948374 - DNA, 22 bp, Homo sapiens
ccccctgagatcccctgagccc

SEQ ID NO: 4948375 - DNA, 20 bp, Homo sapiens
ccccctgctggctcttctgc

SEQ ID NO: 4948376 - DNA, 19 bp, Homo sapiens
ccccctggcctctgtgcct

SEQ ID NO: 4948377 - DNA, 15 bp, Homo sapiens
ccccctggtctctgg

SEQ ID NO: 4948378 - DNA, 15 bp, Homo sapiens
cccccttgccacccc

SEQ ID NO: 4948379 - DNA, 17 bp, Homo sapiens
ccccgcagacctcccca

SEQ ID NO: 4948380 - DNA, 23 bp, Homo sapiens
ccccgcagacctccccagcccct

SEQ ID NO: 4948381 - DNA, 21 bp, Homo sapiens
ccccgccttccgccccttccc

SEQ ID NO: 4948382 - DNA, 14 bp, Homo sapiens
ccccggcaccctct

SEQ ID NO: 4948383 - DNA, 14 bp, Homo sapiens
ccccggcaggccct

SEQ ID NO: 4948384 - DNA, 12 bp, Homo sapiens
ccccggccacct

SEQ ID NO: 4948385 - DNA, 16 bp, Homo sapiens
ccccgggctctctgct

SEQ ID NO: 4948386 - DNA, 16 bp, Homo sapiens
ccccgttacagctccc

SEQ ID NO: 4948387 - DNA, 21 bp, Homo sapiens
ccccgttcctgacatcacagc

SEQ ID NO: 4948388 - DNA, 17 bp, Homo sapiens
cccctacccctggctgt

SEQ ID NO: 4948389 - DNA, 15 bp, Homo sapiens
cccctacgcgccttg

SEQ ID NO: 4948390 - DNA, 19 bp, Homo sapiens
cccctagaaacccaagctc

SEQ ID NO: 4948391 - DNA, 21 bp, Homo sapiens
cccctagaaacccaagctcct

SEQ ID NO: 4948392 - DNA, 18 bp, Homo sapiens
cccctagcccaggagaga

SEQ ID NO: 4948393 - DNA, 14 bp, Homo sapiens
cccctatccttggc

SEQ ID NO: 4948394 - DNA, 15 bp, Homo sapiens
cccctatccttggca

SEQ ID NO: 4948395 - DNA, 14 bp, Homo sapiens
cccctcacagcctc

SEQ ID NO: 4948396 - DNA, 12 bp, Homo sapiens
cccctcactctg

SEQ ID NO: 4948397 - DNA, 13 bp, Homo sapiens
cccctccagcctt

SEQ ID NO: 4948398 - DNA, 17 bp, Homo sapiens
cccctcccgccccttcc

SEQ ID NO: 4948399 - DNA, 19 bp, Homo sapiens
cccctcctagtttgggagg

SEQ ID NO: 4948400 - DNA, 12 bp, Homo sapiens
cccctcctcact

SEQ ID NO: 4948401 - DNA, 21 bp, Homo sapiens
cccctcctctagctgtggggg

SEQ ID NO: 4948402 - DNA, 12 bp, Homo sapiens
cccctccttctc

SEQ ID NO: 4948403 - DNA, 16 bp, Homo sapiens
cccctctttctctttc

SEQ ID NO: 4948404 - DNA, 17 bp, Homo sapiens
cccctctttctctttct

SEQ ID NO: 4948405 - DNA, 18 bp, Homo sapiens
cccctctttctctttctt

SEQ ID NO: 4948406 - DNA, 22 bp, Homo sapiens
cccctctttctctttcttcctt

SEQ ID NO: 4948407 - DNA, 18 bp, Homo sapiens
cccctgacctcactgtga

SEQ ID NO: 4948408 - DNA, 19 bp, Homo sapiens
cccctgagatcccctgagc

SEQ ID NO: 4948409 - DNA, 18 bp, Homo sapiens
cccctgccacctccctga

SEQ ID NO: 4948410 - DNA, 21 bp, Homo sapiens
cccctgccacctccctgaccc

SEQ ID NO: 4948411 - DNA, 17 bp, Homo sapiens
cccctgcccggctgcgg

SEQ ID NO: 4948412 - DNA, 10 bp, Homo sapiens
cccctgcctg

SEQ ID NO: 4948413 - DNA, 11 bp, Homo sapiens
cccctgcctgc

SEQ ID NO: 4948414 - DNA, 22 bp, Homo sapiens
cccctgctgcaggggctctgga

SEQ ID NO: 4948415 - DNA, 12 bp, Homo sapiens
cccctggcctct

SEQ ID NO: 4948416 - DNA, 14 bp, Homo sapiens
cccctggcctctgt

SEQ ID NO: 4948417 - DNA, 18 bp, Homo sapiens
cccctggcttttcactgc

SEQ ID NO: 4948418 - DNA, 22 bp, Homo sapiens
cccctggggtctctgctgcatt

SEQ ID NO: 4948419 - DNA, 20 bp, Homo sapiens
cccctgggtcagtctggtgg

SEQ ID NO: 4948420 - DNA, 11 bp, Homo sapiens
cccctgttcta

SEQ ID NO: 4948421 - DNA, 17 bp, Homo sapiens
ccccttccaaataataa

SEQ ID NO: 4948422 - DNA, 16 bp, Homo sapiens
ccccttctctccctgc

SEQ ID NO: 4948423 - DNA, 21 bp, Homo sapiens
ccccttctctccctgccagag

SEQ ID NO: 4948424 - DNA, 16 bp, Homo sapiens
ccccttctctgctcca

SEQ ID NO: 4948425 - DNA, 22 bp, Homo sapiens
ccccttgctctcccctgccctg

SEQ ID NO: 4948426 - DNA, 17 bp, Homo sapiens
ccccttggcaggtcctg

SEQ ID NO: 4948427 - DNA, 22 bp, Homo sapiens
cccctttcctggacactcagac

SEQ ID NO: 4948428 - DNA, 23 bp, Homo sapiens
cccctttcctggacactcagacc

SEQ ID NO: 4948429 - DNA, 20 bp, Homo sapiens
cccgaagaatggagaggaac

SEQ ID NO: 4948430 - DNA, 14 bp, Homo sapiens
cccgaatagctggg

SEQ ID NO: 4948431 - DNA, 17 bp, Homo sapiens
cccgaatagctgggact

SEQ ID NO: 4948432 - DNA, 18 bp, Homo sapiens
cccgacagcctggcacag

SEQ ID NO: 4948433 - DNA, 13 bp, Homo sapiens
cccgagtagctgg

SEQ ID NO: 4948434 - DNA, 16 bp, Homo sapiens
cccgagtagctgggac

SEQ ID NO: 4948435 - DNA, 14 bp, Homo sapiens
cccgagtctgggac

SEQ ID NO: 4948436 - DNA, 18 bp, Homo sapiens
cccgagtctgggacacaa

SEQ ID NO: 4948437 - DNA, 16 bp, Homo sapiens
cccgatgtggacctct

SEQ ID NO: 4948438 - DNA, 12 bp, Homo sapiens
cccgcacagcag

SEQ ID NO: 4948439 - DNA, 15 bp, Homo sapiens
cccgcacagcagcct

SEQ ID NO: 4948440 - DNA, 18 bp, Homo sapiens
cccgcagacctccccagc

SEQ ID NO: 4948441 - DNA, 14 bp, Homo sapiens
cccgcccctgcagc

SEQ ID NO: 4948442 - DNA, 15 bp, Homo sapiens
cccgccctcttcctg

SEQ ID NO: 4948443 - DNA, 14 bp, Homo sapiens
cccgcctgccctca

SEQ ID NO: 4948444 - DNA, 17 bp, Homo sapiens
cccgcctgccctcatgg

SEQ ID NO: 4948445 - DNA, 13 bp, Homo sapiens
cccgctaaggaag

SEQ ID NO: 4948446 - DNA, 21 bp, Homo sapiens
cccgctctacatcttctgcct

SEQ ID NO: 4948447 - DNA, 15 bp, Homo sapiens
cccggatcagagcag

SEQ ID NO: 4948448 - DNA, 16 bp, Homo sapiens
cccggatcagagcagg

SEQ ID NO: 4948449 - DNA, 17 bp, Homo sapiens
ccctggctcccacaggc

SEQ ID NO: 4948450 - DNA, 13 bp, Homo sapiens
ccctggctcccat

SEQ ID NO: 4948451 - DNA, 13 bp, Homo sapiens
ccctggctctgct

SEQ ID NO: 4948452 - DNA, 17 bp, Homo sapiens
ccctggctgagggcagc

SEQ ID NO: 4948453 - DNA, 15 bp, Homo sapiens
ccctggctgtactgc

SEQ ID NO: 4948454 - DNA, 22 bp, Homo sapiens
ccctggcttttcactgctggct

SEQ ID NO: 4948455 - DNA, 18 bp, Homo sapiens
ccctgggaaggcctcttg

SEQ ID NO: 4948456 - DNA, 21 bp, Homo sapiens
ccctgggaaggcctcttggag

SEQ ID NO: 4948457 - DNA, 17 bp, Homo sapiens
ccctgggctcggaggct

SEQ ID NO: 4948458 - DNA, 16 bp, Homo sapiens
ccctggtgcctggctc

SEQ ID NO: 4948459 - DNA, 14 bp, Homo sapiens
ccctggtgctgcca

SEQ ID NO: 4948460 - DNA, 15 bp, Homo sapiens
ccctggtgctgccac

SEQ ID NO: 4948461 - DNA, 16 bp, Homo sapiens
ccctggtgctgccaca

SEQ ID NO: 4948462 - DNA, 17 bp, Homo sapiens
ccctggtgctgccacac

SEQ ID NO: 4948463 - DNA, 14 bp, Homo sapiens
ccctggtggcagtg

SEQ ID NO: 4948464 - DNA, 15 bp, Homo sapiens
ccctggtggcagtgg

SEQ ID NO: 4948465 - DNA, 13 bp, Homo sapiens
ccctgtcccatgc

SEQ ID NO: 4948466 - DNA, 14 bp, Homo sapiens
ccctgtcccatgca

SEQ ID NO: 4948467 - DNA, 17 bp, Homo sapiens
ccctgtcccatgcaggc

SEQ ID NO: 4948468 - DNA, 19 bp, Homo sapiens
ccctgtccctcccacctct

SEQ ID NO: 4948469 - DNA, 15 bp, Homo sapiens
ccctgtcctcactgc

SEQ ID NO: 4948470 - DNA, 18 bp, Homo sapiens
ccctgtcctcactgctcc

SEQ ID NO: 4948471 - DNA, 23 bp, Homo sapiens
ccctgtcgagttcggctctgggt

SEQ ID NO: 4948472 - DNA, 14 bp, Homo sapiens
ccctgtctaaaaaa

SEQ ID NO: 4948473 - DNA, 16 bp, Homo sapiens
ccctgtcttgctgtca

SEQ ID NO: 4948474 - DNA, 16 bp, Homo sapiens
ccctgtggagactggg

SEQ ID NO: 4948475 - DNA, 19 bp, Homo sapiens
ccctgtgtatacagccctg

SEQ ID NO: 4948476 - DNA, 13 bp, Homo sapiens
ccctgttcactct

SEQ ID NO: 4948477 - DNA, 22 bp, Homo sapiens
ccctgttcactctacttagcat

SEQ ID NO: 4948478 - DNA, 11 bp, Homo sapiens
ccctgttctaa

SEQ ID NO: 4948479 - DNA, 23 bp, Homo sapiens
ccctgttctaagggggaggggaa

SEQ ID NO: 4948480 - DNA, 20 bp, Homo sapiens
ccctgttcttcctccagctg

SEQ ID NO: 4948481 - DNA, 18 bp, Homo sapiens
ccctgtttaatatttaaa

SEQ ID NO: 4948482 - DNA, 14 bp, Homo sapiens
cccttaaaatagaa

SEQ ID NO: 4948483 - DNA, 15 bp, Homo sapiens
cccttaacccaagga

SEQ ID NO: 4948484 - DNA, 14 bp, Homo sapiens
cccttagcctccct

SEQ ID NO: 4948485 - DNA, 17 bp, Homo sapiens
cccttagcctccctgaa

SEQ ID NO: 4948486 - DNA, 12 bp, Homo sapiens
cccttattttca

SEQ ID NO: 4948487 - DNA, 22 bp, Homo sapiens
cccttcagcccccagcccctcc

SEQ ID NO: 4948488 - DNA, 20 bp, Homo sapiens
cccttcagtaccctctcagc

SEQ ID NO: 4948489 - DNA, 11 bp, Homo sapiens
cccttcatttg

SEQ ID NO: 4948490 - DNA, 13 bp, Homo sapiens
cccttccagacat

SEQ ID NO: 4948491 - DNA, 19 bp, Homo sapiens
cccttcccaatcagcactg

SEQ ID NO: 4948492 - DNA, 16 bp, Homo sapiens
cccttcccctccctgg

SEQ ID NO: 4948493 - DNA, 14 bp, Homo sapiens
cccttcccttccac

SEQ ID NO: 4948494 - DNA, 17 bp, Homo sapiens
cccttcccttccactgc

SEQ ID NO: 4948495 - DNA, 16 bp, Homo sapiens
cccttccgaccctctg

SEQ ID NO: 4948496 - DNA, 18 bp, Homo sapiens
cccttccgaccctctggg

SEQ ID NO: 4948497 - DNA, 18 bp, Homo sapiens
cccttcgctcctgtgtct

SEQ ID NO: 4948498 - DNA, 19 bp, Homo sapiens
cccttctcacagcacatgc

SEQ ID NO: 4948499 - DNA, 21 bp, Homo sapiens
cccttctctccctgccagagg

SEQ ID NO: 4948500 - DNA, 17 bp, Homo sapiens
cccttctctgctccacc

SEQ ID NO: 4948501 - DNA, 15 bp, Homo sapiens
cccttcttttatgag

SEQ ID NO: 4948502 - DNA, 19 bp, Homo sapiens
cccttctttttcttctttt

SEQ ID NO: 4948503 - DNA, 18 bp, Homo sapiens
cccttgacatctggaaac

SEQ ID NO: 4948504 - DNA, 15 bp, Homo sapiens
cccttgatgcacaga

SEQ ID NO: 4948505 - DNA, 21 bp, Homo sapiens
cccttgatttaaacacacaga

SEQ ID NO: 4948506 - DNA, 19 bp, Homo sapiens
cccttgcagctagttttct

SEQ ID NO: 4948507 - DNA, 16 bp, Homo sapiens
cccttgccctagatag

SEQ ID NO: 4948508 - DNA, 14 bp, Homo sapiens
cccttgcttttccc

SEQ ID NO: 4948509 - DNA, 18 bp, Homo sapiens
cccttgcttttccctctt

SEQ ID NO: 4948510 - DNA, 20 bp, Homo sapiens
cccttggcaggtcctggcca

SEQ ID NO: 4948511 - DNA, 21 bp, Homo sapiens
cccttggcaggtcctggccag

SEQ ID NO: 4948512 - DNA, 22 bp, Homo sapiens
cccttggctgtgaggcccctgg

SEQ ID NO: 4948513 - DNA, 16 bp, Homo sapiens
ccctttcagagacagc

SEQ ID NO: 4948514 - DNA, 13 bp, Homo sapiens
ccctttccagtta

SEQ ID NO: 4948515 - DNA, 22 bp, Homo sapiens
ccctttccccagcatcactccc

SEQ ID NO: 4948516 - DNA, 14 bp, Homo sapiens
ccctttccttccta

SEQ ID NO: 4948517 - DNA, 17 bp, Homo sapiens
ccctttcttgacaaaac

SEQ ID NO: 4948518 - DNA, 19 bp, Homo sapiens
ccgaaagggacttggaagc

SEQ ID NO: 4948519 - DNA, 23 bp, Homo sapiens
ccgaaggtgctggaggtgggagc

SEQ ID NO: 4948520 - DNA, 17 bp, Homo sapiens
ccgaatagctgggacta

SEQ ID NO: 4948521 - DNA, 13 bp, Homo sapiens
ccgacagcctggc

SEQ ID NO: 4948522 - DNA, 15 bp, Homo sapiens
ccgaccctctgggaa

SEQ ID NO: 4948523 - DNA, 18 bp, Homo sapiens
ccgaccctctgggaacct

SEQ ID NO: 4948524 - DNA, 17 bp, Homo sapiens
ccgagctccagagcaac

SEQ ID NO: 4948525 - DNA, 14 bp, Homo sapiens
ccgaggccttctct

SEQ ID NO: 4948526 - DNA, 17 bp, Homo sapiens
ccgaggccttctctgaa

SEQ ID NO: 4948527 - DNA, 17 bp, Homo sapiens
ccgagtagctgggacta

SEQ ID NO: 4948528 - DNA, 16 bp, Homo sapiens
ccgagtctcttctcca

SEQ ID NO: 4948529 - DNA, 21 bp, Homo sapiens
ccgagtctcttctccactgga

SEQ ID NO: 4948530 - DNA, 22 bp, Homo sapiens
ccgagtctcttctccactggat

SEQ ID NO: 4948531 - DNA, 17 bp, Homo sapiens
ccgagtctgggacacaa

SEQ ID NO: 4948532 - DNA, 22 bp, Homo sapiens
ccgagtctgggacacaaaactc

SEQ ID NO: 4948533 - DNA, 18 bp, Homo sapiens
cctccagcccgggagcct

SEQ ID NO: 4948534 - DNA, 23 bp, Homo sapiens
cctccagcccgggagcctaggac

SEQ ID NO: 4948535 - DNA, 21 bp, Homo sapiens
cctccagcctgcccaagccca

SEQ ID NO: 4948536 - DNA, 23 bp, Homo sapiens
cctccagcctgcccaagcccagg

SEQ ID NO: 4948537 - DNA, 22 bp, Homo sapiens
cctccagcctttggccttggct

SEQ ID NO: 4948538 - DNA, 20 bp, Homo sapiens
cctccagcttcaggcaggcc

SEQ ID NO: 4948539 - DNA, 14 bp, Homo sapiens
cctccagtccccct

SEQ ID NO: 4948540 - DNA, 19 bp, Homo sapiens
cctccatgctgcctccaga

SEQ ID NO: 4948541 - DNA, 15 bp, Homo sapiens
cctccatgtgggcta

SEQ ID NO: 4948542 - DNA, 14 bp, Homo sapiens
cctcccaaggagaa

SEQ ID NO: 4948543 - DNA, 18 bp, Homo sapiens
cctcccaaggagaacaaa

SEQ ID NO: 4948544 - DNA, 23 bp, Homo sapiens
cctcccaaggagaacaaatattc

SEQ ID NO: 4948545 - DNA, 13 bp, Homo sapiens
cctcccaccccct

SEQ ID NO: 4948546 - DNA, 21 bp, Homo sapiens
cctcccacccccttctctgct

SEQ ID NO: 4948547 - DNA, 17 bp, Homo sapiens
cctcccacctcagcctc

SEQ ID NO: 4948548 - DNA, 13 bp, Homo sapiens
cctcccacctcca

SEQ ID NO: 4948549 - DNA, 14 bp, Homo sapiens
cctcccacctccag

SEQ ID NO: 4948550 - DNA, 12 bp, Homo sapiens
cctcccacctct

SEQ ID NO: 4948551 - DNA, 13 bp, Homo sapiens
cctcccacctctg

SEQ ID NO: 4948552 - DNA, 19 bp, Homo sapiens
cctcccacctctgtgacct

SEQ ID NO: 4948553 - DNA, 19 bp, Homo sapiens
cctcccagaggtccagccc

SEQ ID NO: 4948554 - DNA, 21 bp, Homo sapiens
cctcccagaggtccagcccat

SEQ ID NO: 4948555 - DNA, 12 bp, Homo sapiens
cctcccagcctg

SEQ ID NO: 4948556 - DNA, 14 bp, Homo sapiens
cctcccaggcgccc

SEQ ID NO: 4948557 - DNA, 23 bp, Homo sapiens
cctcccatcattacccttccctg

SEQ ID NO: 4948558 - DNA, 17 bp, Homo sapiens
cctcccatcccctggac

SEQ ID NO: 4948559 - DNA, 15 bp, Homo sapiens
cctccccacgccctc

SEQ ID NO: 4948560 - DNA, 14 bp, Homo sapiens
cctccccagcccct

SEQ ID NO: 4948561 - DNA, 23 bp, Homo sapiens
cctccccggctcgagcagtcctg

SEQ ID NO: 4948562 - DNA, 15 bp, Homo sapiens
cctcccctcacagcc

SEQ ID NO: 4948563 - DNA, 16 bp, Homo sapiens
cctcccctcacagcct

SEQ ID NO: 4948564 - DNA, 16 bp, Homo sapiens
ccagcccctagcccag

SEQ ID NO: 4948565 - DNA, 19 bp, Homo sapiens
ccagcccctagcccaggag

SEQ ID NO: 4948566 - DNA, 17 bp, Homo sapiens
ccagcccctcccccatc

SEQ ID NO: 4948567 - DNA, 14 bp, Homo sapiens
ccagcccgggagcc

SEQ ID NO: 4948568 - DNA, 16 bp, Homo sapiens
ccagcccgggagccta

SEQ ID NO: 4948569 - DNA, 22 bp, Homo sapiens
ccagcccgggagcctaggacca

SEQ ID NO: 4948570 - DNA, 14 bp, Homo sapiens
ccagccctccccat

SEQ ID NO: 4948571 - DNA, 20 bp, Homo sapiens
ccagccctccccatggagcc

SEQ ID NO: 4948572 - DNA, 17 bp, Homo sapiens
ccagcccttagcaggga

SEQ ID NO: 4948573 - DNA, 19 bp, Homo sapiens
ccagccgccatcagcccaa

SEQ ID NO: 4948574 - DNA, 20 bp, Homo sapiens
ccagccgccattgccaccag

SEQ ID NO: 4948575 - DNA, 23 bp, Homo sapiens
ccagccgccattgccaccaggag

SEQ ID NO: 4948576 - DNA, 20 bp, Homo sapiens
ccagcctcagtcctcccctc

SEQ ID NO: 4948577 - DNA, 21 bp, Homo sapiens
ccagcctccaagctccatctc

SEQ ID NO: 4948578 - DNA, 16 bp, Homo sapiens
ccagcctccatgctgc

SEQ ID NO: 4948579 - DNA, 19 bp, Homo sapiens
ccagcctcgttggaagagg

SEQ ID NO: 4948580 - DNA, 19 bp, Homo sapiens
ccagcctgcccaagcccag

SEQ ID NO: 4948581 - DNA, 19 bp, Homo sapiens
ccagcctgggcaacagagc

SEQ ID NO: 4948582 - DNA, 17 bp, Homo sapiens
ccagcctggggcctggc

SEQ ID NO: 4948583 - DNA, 18 bp, Homo sapiens
ccagccttcttccatccc

SEQ ID NO: 4948584 - DNA, 19 bp, Homo sapiens
ccagccttcttccatccca

SEQ ID NO: 4948585 - DNA, 13 bp, Homo sapiens
ccagcgagccctg

SEQ ID NO: 4948586 - DNA, 16 bp, Homo sapiens
ccagcgagccctggtg

SEQ ID NO: 4948587 - DNA, 13 bp, Homo sapiens
ccagcgctctgcc

SEQ ID NO: 4948588 - DNA, 15 bp, Homo sapiens
ccagcgctctgcctc

SEQ ID NO: 4948589 - DNA, 15 bp, Homo sapiens
ccagcgtcccagtct

SEQ ID NO: 4948590 - DNA, 16 bp, Homo sapiens
ccagctaccctttttc

SEQ ID NO: 4948591 - DNA, 15 bp, Homo sapiens
ccagctacttcctcc

SEQ ID NO: 4948592 - DNA, 22 bp, Homo sapiens
ccagctcaccagccccagtgcc

SEQ ID NO: 4948593 - DNA, 14 bp, Homo sapiens
ccagctcagaaccc

SEQ ID NO: 4948594 - DNA, 18 bp, Homo sapiens
ccagctcaggggcagctc

SEQ ID NO: 4948595 - DNA, 22 bp, Homo sapiens
ccagctcagtcccatcagagag

SEQ ID NO: 4948596 - DNA, 13 bp, Homo sapiens
ccagctgcaccag

SEQ ID NO: 4948597 - DNA, 19 bp, Homo sapiens
ccagctgcaggaatcaaaa

SEQ ID NO: 4948598 - DNA, 23 bp, Homo sapiens
ccagctgcaggaatcaaaaattg

SEQ ID NO: 4948599 - DNA, 11 bp, Homo sapiens
ccagctgctgt

SEQ ID NO: 4948600 - DNA, 14 bp, Homo sapiens
ccagctgctgtctt

SEQ ID NO: 4948601 - DNA, 12 bp, Homo sapiens
ccagctggcctg

SEQ ID NO: 4948602 - DNA, 17 bp, Homo sapiens
ccagctggcctggacag

SEQ ID NO: 4948603 - DNA, 16 bp, Homo sapiens
ccagctgggctctgca

SEQ ID NO: 4948604 - DNA, 14 bp, Homo sapiens
ccagctgtgagcct

SEQ ID NO: 4948605 - DNA, 16 bp, Homo sapiens
ccagctgtgagccttg

SEQ ID NO: 4948606 - DNA, 18 bp, Homo sapiens
ccagctgtgctctggaca

SEQ ID NO: 4948607 - DNA, 23 bp, Homo sapiens
ccagctgtgctctggacaggcat

SEQ ID NO: 4948608 - DNA, 17 bp, Homo sapiens
ccagcttgcgaataaca

SEQ ID NO: 4948609 - DNA, 16 bp, Homo sapiens
ccagcttggggccacc

SEQ ID NO: 4948610 - DNA, 16 bp, Homo sapiens
ccagcttgtaggagct

SEQ ID NO: 4948611 - DNA, 18 bp, Homo sapiens
ccaggacaccacacccag

SEQ ID NO: 4948612 - DNA, 21 bp, Homo sapiens
ccaggacaccacacccagcct

SEQ ID NO: 4948613 - DNA, 14 bp, Homo sapiens
ccaggaccaagcca

SEQ ID NO: 4948614 - DNA, 14 bp, Homo sapiens
ccaggactccctcc

SEQ ID NO: 4948615 - DNA, 18 bp, Homo sapiens
ccaggactccctcctcac

SEQ ID NO: 4948616 - DNA, 15 bp, Homo sapiens
ccaggactgagcccc

SEQ ID NO: 4948617 - DNA, 16 bp, Homo sapiens
ccaggactgagccccg

SEQ ID NO: 4948618 - DNA, 19 bp, Homo sapiens
ccaggagaaccactacatg

SEQ ID NO: 4948619 - DNA, 15 bp, Homo sapiens
ccaggagagagaaag

SEQ ID NO: 4948620 - DNA, 15 bp, Homo sapiens
ccaggagccccgagg

SEQ ID NO: 4948621 - DNA, 20 bp, Homo sapiens
ccaggagccccgaggccttc

SEQ ID NO: 4948622 - DNA, 17 bp, Homo sapiens
ccaggagcctgtgcctc

SEQ ID NO: 4948623 - DNA, 23 bp, Homo sapiens
ccaggagctcttcaggcctccct

SEQ ID NO: 4948624 - DNA, 20 bp, Homo sapiens
ccaggatcatggtgtaataa

SEQ ID NO: 4948625 - DNA, 17 bp, Homo sapiens
ccaggatcccaggggcc

SEQ ID NO: 4948626 - DNA, 18 bp, Homo sapiens
ccaggatcgttttttccc

SEQ ID NO: 4948627 - DNA, 13 bp, Homo sapiens
ccaggatttctaa

SEQ ID NO: 4948628 - DNA, 23 bp, Homo sapiens
ccaggcacagctgagttatgatg

SEQ ID NO: 4948629 - DNA, 20 bp, Homo sapiens
ccaggcagatctgtgcccca

SEQ ID NO: 4948630 - DNA, 14 bp, Homo sapiens
ccaggccagaggga

SEQ ID NO: 4948631 - DNA, 13 bp, Homo sapiens
ccaggcccctgcc

SEQ ID NO: 4948632 - DNA, 19 bp, Homo sapiens
ccaggcccctgccaccctg

SEQ ID NO: 4948633 - DNA, 15 bp, Homo sapiens
ccaggcctctgtgtc

SEQ ID NO: 4948634 - DNA, 16 bp, Homo sapiens
ccaggcctgcagcagg

SEQ ID NO: 4948635 - DNA, 12 bp, Homo sapiens
ccaggcctgcct

SEQ ID NO: 4948636 - DNA, 19 bp, Homo sapiens
ccaggcgccccttccccct

SEQ ID NO: 4948637 - DNA, 23 bp, Homo sapiens
ccaggctccgcccttagtccccc

SEQ ID NO: 4948638 - DNA, 20 bp, Homo sapiens
ccaggctcctttagcgccca

SEQ ID NO: 4948639 - DNA, 21 bp, Homo sapiens
ccaggctcctttagcgcccag

SEQ ID NO: 4948640 - DNA, 20 bp, Homo sapiens
ccaggctgccaaggccagag

SEQ ID NO: 4948641 - DNA, 17 bp, Homo sapiens
ccaggctggcgtgcagt

SEQ ID NO: 4948642 - DNA, 14 bp, Homo sapiens
ccaggctggtctca

SEQ ID NO: 4948643 - DNA, 21 bp, Homo sapiens
ccaggctggtttcgaactcct

SEQ ID NO: 4948644 - DNA, 15 bp, Homo sapiens
ccaggctgtgcagcg

SEQ ID NO: 4948645 - DNA, 18 bp, Homo sapiens
ccaggctttgtacagagt

SEQ ID NO: 4948646 - DNA, 17 bp, Homo sapiens
ccagggaagctggccga

SEQ ID NO: 4948647 - DNA, 17 bp, Homo sapiens
ccagggaagctgtccct

SEQ ID NO: 4948648 - DNA, 15 bp, Homo sapiens
ccagggaatccaagc

SEQ ID NO: 4948649 - DNA, 18 bp, Homo sapiens
ccagggaatccaagcctc

SEQ ID NO: 4948650 - DNA, 14 bp, Homo sapiens
ccagggagcctttg

SEQ ID NO: 4948651 - DNA, 22 bp, Homo sapiens
ccagggagcttgaaagttttca

SEQ ID NO: 4948652 - DNA, 12 bp, Homo sapiens
ccagggcagtgc

SEQ ID NO: 4948653 - DNA, 23 bp, Homo sapiens
ccagggcagtgctagtgagctgg

SEQ ID NO: 4948654 - DNA, 17 bp, Homo sapiens
ccagggctctgccccag

SEQ ID NO: 4948655 - DNA, 18 bp, Homo sapiens
ccagggctctgccccagt

SEQ ID NO: 4948656 - DNA, 19 bp, Homo sapiens
ccagggctctgccccagtc

SEQ ID NO: 4948657 - DNA, 23 bp, Homo sapiens
ccagggggactagcccctgtgga

SEQ ID NO: 4948658 - DNA, 14 bp, Homo sapiens
ccaggggtcccagc

SEQ ID NO: 4948659 - DNA, 16 bp, Homo sapiens
ccagggtctctccctc

SEQ ID NO: 4948660 - DNA, 18 bp, Homo sapiens
ccagggtctctccctcag

SEQ ID NO: 4948661 - DNA, 23 bp, Homo sapiens
ccagggtcttccctacctcaggc

SEQ ID NO: 4948662 - DNA, 20 bp, Homo sapiens
ccagggtggacttagaaagc

SEQ ID NO: 4948663 - DNA, 13 bp, Homo sapiens
ccaggtagaaact

SEQ ID NO: 4948664 - DNA, 14 bp, Homo sapiens
ccaggtagaaactt

SEQ ID NO: 4948665 - DNA, 15 bp, Homo sapiens
ccaggtctcacgggc

SEQ ID NO: 4948666 - DNA, 15 bp, Homo sapiens
ccaggtggaaggcag

SEQ ID NO: 4948667 - DNA, 19 bp, Homo sapiens
ccaggtggaaggcagacag

SEQ ID NO: 4948668 - DNA, 20 bp, Homo sapiens
ccaggtggaaggcagacagc

SEQ ID NO: 4948669 - DNA, 19 bp, Homo sapiens
ccaggtgttaacattccaa

SEQ ID NO: 4948670 - DNA, 15 bp, Homo sapiens
ccaggttcaacccac

SEQ ID NO: 4948671 - DNA, 18 bp, Homo sapiens
attaaatttaattcttca

SEQ ID NO: 4948672 - DNA, 18 bp, Homo sapiens
attaaattttttttacat

SEQ ID NO: 4948673 - DNA, 13 bp, Homo sapiens
attaacaaatatg

SEQ ID NO: 4948674 - DNA, 16 bp, Homo sapiens
attaacaaatatgcta

SEQ ID NO: 4948675 - DNA, 18 bp, Homo sapiens
attaacaacaataacact

SEQ ID NO: 4948676 - DNA, 14 bp, Homo sapiens
attaactacattta

SEQ ID NO: 4948677 - DNA, 18 bp, Homo sapiens
attaagattttacaaaag

SEQ ID NO: 4948678 - DNA, 15 bp, Homo sapiens
attaagtaatcaata

SEQ ID NO: 4948679 - DNA, 20 bp, Homo sapiens
attaatactaaaatatgtct

SEQ ID NO: 4948680 - DNA, 13 bp, Homo sapiens
attaatagctttt

SEQ ID NO: 4948681 - DNA, 18 bp, Homo sapiens
attaatagcttttattgt

SEQ ID NO: 4948682 - DNA, 23 bp, Homo sapiens
attaatagcttttattgtataaa

SEQ ID NO: 4948683 - DNA, 12 bp, Homo sapiens
attaatatttaa

SEQ ID NO: 4948684 - DNA, 23 bp, Homo sapiens
attaatatttaacattatttata

SEQ ID NO: 4948685 - DNA, 15 bp, Homo sapiens
attaatggcactgat

SEQ ID NO: 4948686 - DNA, 20 bp, Homo sapiens
attaatgtttctatctgatt

SEQ ID NO: 4948687 - DNA, 21 bp, Homo sapiens
attaatttgattaacaaatat

SEQ ID NO: 4948688 - DNA, 17 bp, Homo sapiens
attaattttttttcatt

SEQ ID NO: 4948689 - DNA, 15 bp, Homo sapiens
attacaatggaaaca

SEQ ID NO: 4948690 - DNA, 18 bp, Homo sapiens
attacactgtatttgtat

SEQ ID NO: 4948691 - DNA, 20 bp, Homo sapiens
attacactgtatttgtatct

SEQ ID NO: 4948692 - DNA, 15 bp, Homo sapiens
attacaggcttgagc

SEQ ID NO: 4948693 - DNA, 16 bp, Homo sapiens
attacatgtaaaacat

SEQ ID NO: 4948694 - DNA, 19 bp, Homo sapiens
attacatgtaaaacattat

SEQ ID NO: 4948695 - DNA, 23 bp, Homo sapiens
attaccagtctttaaaggcccag

SEQ ID NO: 4948696 - DNA, 13 bp, Homo sapiens
attaccccctcct

SEQ ID NO: 4948697 - DNA, 19 bp, Homo sapiens
attaccccctccttcagac

SEQ ID NO: 4948698 - DNA, 21 bp, Homo sapiens
attaccttttaccagctttta

SEQ ID NO: 4948699 - DNA, 22 bp, Homo sapiens
attaccttttaccagcttttaa

SEQ ID NO: 4948700 - DNA, 23 bp, Homo sapiens
attaccttttaccagcttttaac

SEQ ID NO: 4948701 - DNA, 19 bp, Homo sapiens
attactaattttacacatt

SEQ ID NO: 4948702 - DNA, 18 bp, Homo sapiens
attactatgactgctccc

SEQ ID NO: 4948703 - DNA, 21 bp, Homo sapiens
attactcctatttttgtaaac

SEQ ID NO: 4948704 - DNA, 13 bp, Homo sapiens
attactgggcctt

SEQ ID NO: 4948705 - DNA, 23 bp, Homo sapiens
attactgggccttagtgggccag

SEQ ID NO: 4948706 - DNA, 18 bp, Homo sapiens
attactgtctggttttaa

SEQ ID NO: 4948707 - DNA, 17 bp, Homo sapiens
attacttatttttgaca

SEQ ID NO: 4948708 - DNA, 19 bp, Homo sapiens
attacttatttttgacagt

SEQ ID NO: 4948709 - DNA, 20 bp, Homo sapiens
attacttgttgcaaaggtct

SEQ ID NO: 4948710 - DNA, 11 bp, Homo sapiens
attactttatc

SEQ ID NO: 4948711 - DNA, 15 bp, Homo sapiens
attactttatcactt

SEQ ID NO: 4948712 - DNA, 19 bp, Homo sapiens
attagagggaggagaatga

SEQ ID NO: 4948713 - DNA, 18 bp, Homo sapiens
attagcaaggtcatttct

SEQ ID NO: 4948714 - DNA, 17 bp, Homo sapiens
attagcacagattttaa

SEQ ID NO: 4948715 - DNA, 21 bp, Homo sapiens
attagccaggatcatggtgta

SEQ ID NO: 4948716 - DNA, 22 bp, Homo sapiens
attagctgtgatttttgttgat

SEQ ID NO: 4948717 - DNA, 21 bp, Homo sapiens
attagctttgtgtttggttta

SEQ ID NO: 4948718 - DNA, 14 bp, Homo sapiens
attaggatttcatg

SEQ ID NO: 4948719 - DNA, 18 bp, Homo sapiens
attagggcaattggaaca

SEQ ID NO: 4948720 - DNA, 23 bp, Homo sapiens
attagggcaattggaacaaagtg

SEQ ID NO: 4948721 - DNA, 17 bp, Homo sapiens
attagtaaatgtctttg

SEQ ID NO: 4948722 - DNA, 21 bp, Homo sapiens
attagtaaatgtctttgtaag

SEQ ID NO: 4948723 - DNA, 16 bp, Homo sapiens
attagtgccagaattt

SEQ ID NO: 4948724 - DNA, 23 bp, Homo sapiens
attataaaaagccactagactct

SEQ ID NO: 4948725 - DNA, 18 bp, Homo sapiens
attataagcattgaaatt

SEQ ID NO: 4948726 - DNA, 13 bp, Homo sapiens
attataatgaatt

SEQ ID NO: 4948727 - DNA, 19 bp, Homo sapiens
attatacaaattaaaaaga

SEQ ID NO: 4948728 - DNA, 18 bp, Homo sapiens
attatagattctaaagat

SEQ ID NO: 4948729 - DNA, 19 bp, Homo sapiens
attatagattctaaagatt

SEQ ID NO: 4948730 - DNA, 19 bp, Homo sapiens
attataggtaatcaatgaa

SEQ ID NO: 4948731 - DNA, 21 bp, Homo sapiens
attataggtaatcaatgaata

SEQ ID NO: 4948732 - DNA, 16 bp, Homo sapiens
attatagtttctgagg

SEQ ID NO: 4948733 - DNA, 12 bp, Homo sapiens
attatatatata

SEQ ID NO: 4948734 - DNA, 14 bp, Homo sapiens
attatatatataat

SEQ ID NO: 4948735 - DNA, 22 bp, Homo sapiens
attatctatagctaagtacaca

SEQ ID NO: 4948736 - DNA, 22 bp, Homo sapiens
attatcttgggatagttcccaa

SEQ ID NO: 4948737 - DNA, 19 bp, Homo sapiens
attatgtcttttatatttg

SEQ ID NO: 4948738 - DNA, 23 bp, Homo sapiens
attatgtcttttatatttgtatc

SEQ ID NO: 4948739 - DNA, 21 bp, Homo sapiens
attatgtgtgcatgtgtgtat

SEQ ID NO: 4948740 - DNA, 16 bp, Homo sapiens
attatgttttttaaaa

SEQ ID NO: 4948741 - DNA, 20 bp, Homo sapiens
attatgttttttaaaatatt

SEQ ID NO: 4948742 - DNA, 19 bp, Homo sapiens
attattataaaagggggtc

SEQ ID NO: 4948743 - DNA, 20 bp, Homo sapiens
attattataagcattgaaat

SEQ ID NO: 4948744 - DNA, 17 bp, Homo sapiens
attattattaaaaatat

SEQ ID NO: 4948745 - DNA, 15 bp, Homo sapiens
attattcatttagtg

SEQ ID NO: 4948746 - DNA, 12 bp, Homo sapiens
attattgaaatt

SEQ ID NO: 4948747 - DNA, 15 bp, Homo sapiens
attattgctgttgct

SEQ ID NO: 4948748 - DNA, 16 bp, Homo sapiens
attattgctgttgctt

SEQ ID NO: 4948749 - DNA, 11 bp, Homo sapiens
attatttaaac

SEQ ID NO: 4948750 - DNA, 12 bp, Homo sapiens
attatttaaaca

SEQ ID NO: 4948751 - DNA, 12 bp, Homo sapiens
attatttaataa

SEQ ID NO: 4948752 - DNA, 13 bp, Homo sapiens
attatttaataac

SEQ ID NO: 4948753 - DNA, 14 bp, Homo sapiens
attatttaataaca

SEQ ID NO: 4948754 - DNA, 22 bp, Homo sapiens
attatttatatggggaatatat

SEQ ID NO: 4948755 - DNA, 13 bp, Homo sapiens
attatttattatt

SEQ ID NO: 4948756 - DNA, 17 bp, Homo sapiens
attatttatttaataac

SEQ ID NO: 4948757 - DNA, 11 bp, Homo sapiens
attatttggca

SEQ ID NO: 4948758 - DNA, 20 bp, Homo sapiens
attatttgggagggaaaagg

SEQ ID NO: 4948759 - DNA, 15 bp, Homo sapiens
attatttgtgtaata

SEQ ID NO: 4948760 - DNA, 17 bp, Homo sapiens
attatttgtgtaataga

SEQ ID NO: 4948761 - DNA, 20 bp, Homo sapiens
attatttgtgtaatagaaaa

SEQ ID NO: 4948762 - DNA, 21 bp, Homo sapiens
attattttaaacaaaatagaa

SEQ ID NO: 4948763 - DNA, 14 bp, Homo sapiens
attattttctgtca

SEQ ID NO: 4948764 - DNA, 15 bp, Homo sapiens
attattttctgtcag

SEQ ID NO: 4948765 - DNA, 12 bp, Homo sapiens
attattttgggg

SEQ ID NO: 4948766 - DNA, 22 bp, Homo sapiens
attattttggggtctcttttgt

SEQ ID NO: 4948767 - DNA, 16 bp, Homo sapiens
attcaaaaagtgttta

SEQ ID NO: 4948768 - DNA, 17 bp, Homo sapiens
attcaaaaagtgtttat

SEQ ID NO: 4948769 - DNA, 16 bp, Homo sapiens
attcaaaagttccaag

SEQ ID NO: 4948770 - DNA, 15 bp, Homo sapiens
attcaaaggttctag

SEQ ID NO: 4948771 - DNA, 16 bp, Homo sapiens
attcaaaggttctagg

SEQ ID NO: 4948772 - DNA, 12 bp, Homo sapiens
attgttgtttct

SEQ ID NO: 4948773 - DNA, 16 bp, Homo sapiens
attgttgtttctttct

SEQ ID NO: 4948774 - DNA, 17 bp, Homo sapiens
attgtttcctcttccaa

SEQ ID NO: 4948775 - DNA, 20 bp, Homo sapiens
attgtttcctcttccaaagt

SEQ ID NO: 4948776 - DNA, 15 bp, Homo sapiens
attgtttgctgctat

SEQ ID NO: 4948777 - DNA, 20 bp, Homo sapiens
attgtttggcttcctcctga

SEQ ID NO: 4948778 - DNA, 13 bp, Homo sapiens
attgttttaatct

SEQ ID NO: 4948779 - DNA, 18 bp, Homo sapiens
attgttttatcatgacat

SEQ ID NO: 4948780 - DNA, 15 bp, Homo sapiens
attgttttctattta

SEQ ID NO: 4948781 - DNA, 14 bp, Homo sapiens
attgttttgaatat

SEQ ID NO: 4948782 - DNA, 15 bp, Homo sapiens
attgtttttctttct

SEQ ID NO: 4948783 - DNA, 19 bp, Homo sapiens
attgtttttctttctacaa

SEQ ID NO: 4948784 - DNA, 16 bp, Homo sapiens
atttaaaaactggaac

SEQ ID NO: 4948785 - DNA, 21 bp, Homo sapiens
atttaaaattgctatgttact

SEQ ID NO: 4948786 - DNA, 14 bp, Homo sapiens
atttaaacacacag

SEQ ID NO: 4948787 - DNA, 13 bp, Homo sapiens
atttaaagatatt

SEQ ID NO: 4948788 - DNA, 15 bp, Homo sapiens
atttaaatataattc

SEQ ID NO: 4948789 - DNA, 18 bp, Homo sapiens
atttaaatataattctgt

SEQ ID NO: 4948790 - DNA, 24 bp, Homo sapiens
atttaaatgtgtacaatgtacaca

SEQ ID NO: 4948791 - DNA, 16 bp, Homo sapiens
atttaaatttaaagat

SEQ ID NO: 4948792 - DNA, 17 bp, Homo sapiens
atttaaatttaaagata

SEQ ID NO: 4948793 - DNA, 19 bp, Homo sapiens
atttaactacccttaatta

SEQ ID NO: 4948794 - DNA, 23 bp, Homo sapiens
atttaactacccttaattactta

SEQ ID NO: 4948795 - DNA, 14 bp, Homo sapiens
atttaagtgcgtgt

SEQ ID NO: 4948796 - DNA, 20 bp, Homo sapiens
atttaagtgcgtgtgtagag

SEQ ID NO: 4948797 - DNA, 20 bp, Homo sapiens
atttaagtggggcaaaacct

SEQ ID NO: 4948798 - DNA, 14 bp, Homo sapiens
atttaataacatta

SEQ ID NO: 4948799 - DNA, 17 bp, Homo sapiens
atttaataacattacct

SEQ ID NO: 4948800 - DNA, 19 bp, Homo sapiens
atttaataacattacctta

SEQ ID NO: 4948801 - DNA, 13 bp, Homo sapiens
atttaatatttat

SEQ ID NO: 4948802 - DNA, 18 bp, Homo sapiens
atttaatgcattaaacct

SEQ ID NO: 4948803 - DNA, 19 bp, Homo sapiens
atttaatgcattaaacctg

SEQ ID NO: 4948804 - DNA, 13 bp, Homo sapiens
atttaattattaa

SEQ ID NO: 4948805 - DNA, 20 bp, Homo sapiens
atttaattattaactacatt

SEQ ID NO: 4948806 - DNA, 14 bp, Homo sapiens
atttacactgccat

SEQ ID NO: 4948807 - DNA, 19 bp, Homo sapiens
atttaccagggatgtagat

SEQ ID NO: 4948808 - DNA, 15 bp, Homo sapiens
atttacgctttgatt

SEQ ID NO: 4948809 - DNA, 17 bp, Homo sapiens
atttacgctttgattca

SEQ ID NO: 4948810 - DNA, 15 bp, Homo sapiens
atttactaaacatat

SEQ ID NO: 4948811 - DNA, 18 bp, Homo sapiens
atttactaccttatcact

SEQ ID NO: 4948812 - DNA, 21 bp, Homo sapiens
atttagaaaatagagctttta

SEQ ID NO: 4948813 - DNA, 21 bp, Homo sapiens
atttagctaaacggattccaa

SEQ ID NO: 4948814 - DNA, 23 bp, Homo sapiens
atttagctaaacggattccaaag

SEQ ID NO: 4948815 - DNA, 16 bp, Homo sapiens
atttaggaagttgact

SEQ ID NO: 4948816 - DNA, 17 bp, Homo sapiens
atttagggtactaaatt

SEQ ID NO: 4948817 - DNA, 22 bp, Homo sapiens
atttagggtactaaatttaaat

SEQ ID NO: 4948818 - DNA, 21 bp, Homo sapiens
atttagtgagttattccttga

SEQ ID NO: 4948819 - DNA, 18 bp, Homo sapiens
atttagtgatcttagcat

SEQ ID NO: 4948820 - DNA, 13 bp, Homo sapiens
atttagttattga

SEQ ID NO: 4948821 - DNA, 15 bp, Homo sapiens
atttataaaattaga

SEQ ID NO: 4948822 - DNA, 19 bp, Homo sapiens
atttataaaattagaaagc

SEQ ID NO: 4948823 - DNA, 17 bp, Homo sapiens
atttataaatgagcaaa

SEQ ID NO: 4948824 - DNA, 14 bp, Homo sapiens
atttataattccta

SEQ ID NO: 4948825 - DNA, 18 bp, Homo sapiens
atttatacctcaaactat

SEQ ID NO: 4948826 - DNA, 18 bp, Homo sapiens
atttatataaatgtaaaa

SEQ ID NO: 4948827 - DNA, 15 bp, Homo sapiens
atttatatatgaaaa

SEQ ID NO: 4948828 - DNA, 20 bp, Homo sapiens
atttatatatgaaaactata

SEQ ID NO: 4948829 - DNA, 14 bp, Homo sapiens
atttatatatttat

SEQ ID NO: 4948830 - DNA, 19 bp, Homo sapiens
atttatatggggaatatat

SEQ ID NO: 4948831 - DNA, 15 bp, Homo sapiens
atttatatgtactgt

SEQ ID NO: 4948832 - DNA, 17 bp, Homo sapiens
atttatatgtactgttt

SEQ ID NO: 4948833 - DNA, 19 bp, Homo sapiens
atttatatttttaaaatat

SEQ ID NO: 4948834 - DNA, 22 bp, Homo sapiens
atttatcaaagcatagatgttt

SEQ ID NO: 4948835 - DNA, 15 bp, Homo sapiens
atttatccatttgta

SEQ ID NO: 4948836 - DNA, 20 bp, Homo sapiens
atttatctaaattaaagcct

SEQ ID NO: 4948837 - DNA, 16 bp, Homo sapiens
atttatctctatttaa

SEQ ID NO: 4948838 - DNA, 13 bp, Homo sapiens
atttatgaagttt

SEQ ID NO: 4948839 - DNA, 13 bp, Homo sapiens
atttatgatttaa

SEQ ID NO: 4948840 - DNA, 17 bp, Homo sapiens
atttatgcacattcacg

SEQ ID NO: 4948841 - DNA, 22 bp, Homo sapiens
atttatgtttgcacttgtgatt

SEQ ID NO: 4948842 - DNA, 23 bp, Homo sapiens
atttattatgctttattggaaaa

SEQ ID NO: 4948843 - DNA, 18 bp, Homo sapiens
atttattcagcttcattt

SEQ ID NO: 4948844 - DNA, 14 bp, Homo sapiens
atttatttaaagca

SEQ ID NO: 4948845 - DNA, 14 bp, Homo sapiens
atttatttatttaa

SEQ ID NO: 4948846 - DNA, 14 bp, Homo sapiens
atttatttatttat

SEQ ID NO: 4948847 - DNA, 14 bp, Homo sapiens
atttattttaagca

SEQ ID NO: 4948848 - DNA, 16 bp, Homo sapiens
atttattttcctaaag

SEQ ID NO: 4948849 - DNA, 13 bp, Homo sapiens
atttattttgtaa

SEQ ID NO: 4948850 - DNA, 14 bp, Homo sapiens
atttattttgtaat

SEQ ID NO: 4948851 - DNA, 23 bp, Homo sapiens
atttatttttcagttccaagaaa

SEQ ID NO: 4948852 - DNA, 18 bp, Homo sapiens
atttattttttacattat

SEQ ID NO: 4948853 - DNA, 14 bp, Homo sapiens
atttcaaaaatata

SEQ ID NO: 4948854 - DNA, 18 bp, Homo sapiens
atttcaaaaatataactt

SEQ ID NO: 4948855 - DNA, 19 bp, Homo sapiens
atttcaaaaatataactta

SEQ ID NO: 4948856 - DNA, 13 bp, Homo sapiens
atttcaaaagaca

SEQ ID NO: 4948857 - DNA, 14 bp, Homo sapiens
atttcaaaagacat

SEQ ID NO: 4948858 - DNA, 21 bp, Homo sapiens
atttcaaaagacatgttgtaa

SEQ ID NO: 4948859 - DNA, 21 bp, Homo sapiens
atttcaaaatgctttttatta

SEQ ID NO: 4948860 - DNA, 23 bp, Homo sapiens
atttcaagaaaaaataaatggaa

SEQ ID NO: 4948861 - DNA, 12 bp, Homo sapiens
atttcaaggttc

SEQ ID NO: 4948862 - DNA, 13 bp, Homo sapiens
atttcaaggttct

SEQ ID NO: 4948863 - DNA, 14 bp, Homo sapiens
atttcaaggttcta

SEQ ID NO: 4948864 - DNA, 18 bp, Homo sapiens
atttcagattcccagagc

SEQ ID NO: 4948865 - DNA, 16 bp, Homo sapiens
atttcagattttgata

SEQ ID NO: 4948866 - DNA, 17 bp, Homo sapiens
atttcagattttgataa

SEQ ID NO: 4948867 - DNA, 16 bp, Homo sapiens
atttcagtgtagttaa

SEQ ID NO: 4948868 - DNA, 20 bp, Homo sapiens
atttcagtgtagttaattta

SEQ ID NO: 4948869 - DNA, 14 bp, Homo sapiens
atttcatgtggctg

SEQ ID NO: 4948870 - DNA, 11 bp, Homo sapiens
atttcattcca

SEQ ID NO: 4948871 - DNA, 13 bp, Homo sapiens
atttcattccatt

SEQ ID NO: 4948872 - DNA, 18 bp, Homo sapiens
atttcattccattgccta

SEQ ID NO: 4948873 - DNA, 17 bp, Homo sapiens
atttcattgcctgtgta

SEQ ID NO: 4948874 - DNA, 18 bp, Homo sapiens
atttcattgcctgtgtat

SEQ ID NO: 4948875 - DNA, 12 bp, Homo sapiens
atttcattgtat

SEQ ID NO: 4948876 - DNA, 19 bp, Homo sapiens
atttcattgtatgatgtgt

SEQ ID NO: 4948877 - DNA, 21 bp, Homo sapiens
atttcattgtatgatgtgttg

SEQ ID NO: 4948878 - DNA, 22 bp, Homo sapiens
atttccaacaccacagacacac

SEQ ID NO: 4948879 - DNA, 22 bp, Homo sapiens
atttccagtgttctatgaacaa

SEQ ID NO: 4948880 - DNA, 24 bp, Homo sapiens
atttccatttggggatattgtcat

SEQ ID NO: 4948881 - DNA, 13 bp, Homo sapiens
atttcccttcttg

SEQ ID NO: 4948882 - DNA, 16 bp, Homo sapiens
atttcccttcttgcat

SEQ ID NO: 4948883 - DNA, 23 bp, Homo sapiens
atttccttgaatgtggcttgaga

SEQ ID NO: 4948884 - DNA, 17 bp, Homo sapiens
caaatttcaaaagacat

SEQ ID NO: 4948885 - DNA, 11 bp, Homo sapiens
caaatttcaca

SEQ ID NO: 4948886 - DNA, 15 bp, Homo sapiens
caaatttcacttata

SEQ ID NO: 4948887 - DNA, 17 bp, Homo sapiens
caaatttgattgatttg

SEQ ID NO: 4948888 - DNA, 21 bp, Homo sapiens
caaattttgatgccaagaaag

SEQ ID NO: 4948889 - DNA, 19 bp, Homo sapiens
caaatttttattttttagt

SEQ ID NO: 4948890 - DNA, 20 bp, Homo sapiens
caaatttttctcagtttgta

SEQ ID NO: 4948891 - DNA, 13 bp, Homo sapiens
caacaaagaaata

SEQ ID NO: 4948892 - DNA, 14 bp, Homo sapiens
caacaacatccatg

SEQ ID NO: 4948893 - DNA, 22 bp, Homo sapiens
caacaacgcttgtgaatgtatt

SEQ ID NO: 4948894 - DNA, 20 bp, Homo sapiens
caacaaggtggtgtgatctt

SEQ ID NO: 4948895 - DNA, 14 bp, Homo sapiens
caacaataaaacat

SEQ ID NO: 4948896 - DNA, 14 bp, Homo sapiens
caacacacacactc

SEQ ID NO: 4948897 - DNA, 14 bp, Homo sapiens
caacacagaggaat

SEQ ID NO: 4948898 - DNA, 15 bp, Homo sapiens
caacaccacagacac

SEQ ID NO: 4948899 - DNA, 18 bp, Homo sapiens
caacaccacagacacaca

SEQ ID NO: 4948900 - DNA, 19 bp, Homo sapiens
caacaccacagacacacac

SEQ ID NO: 4948901 - DNA, 20 bp, Homo sapiens
caacaccacagacacacaca

SEQ ID NO: 4948902 - DNA, 22 bp, Homo sapiens
caacactggtgtgacctgaggg

SEQ ID NO: 4948903 - DNA, 22 bp, Homo sapiens
caacagaaacctatcctcactg

SEQ ID NO: 4948904 - DNA, 14 bp, Homo sapiens
caacagaaagtcat

SEQ ID NO: 4948905 - DNA, 15 bp, Homo sapiens
caacagaagcatttg

SEQ ID NO: 4948906 - DNA, 20 bp, Homo sapiens
caacagaagtcatgaagccc

SEQ ID NO: 4948907 - DNA, 12 bp, Homo sapiens
caacagccatgc

SEQ ID NO: 4948908 - DNA, 17 bp, Homo sapiens
caacaggctgggcttca

SEQ ID NO: 4948909 - DNA, 24 bp, Homo sapiens
caacaggctgttctgcactgaaaa

SEQ ID NO: 4948910 - DNA, 18 bp, Homo sapiens
caacataacccacttgtc

SEQ ID NO: 4948911 - DNA, 23 bp, Homo sapiens
caacatgcctgccccaaacaaat

SEQ ID NO: 4948912 - DNA, 20 bp, Homo sapiens
caacatgtagctgagtttaa

SEQ ID NO: 4948913 - DNA, 20 bp, Homo sapiens
caaccaatttacactgccat

SEQ ID NO: 4948914 - DNA, 20 bp, Homo sapiens
caaccacacacctcaccaga

SEQ ID NO: 4948915 - DNA, 21 bp, Homo sapiens
caaccactaagaattcaaact

SEQ ID NO: 4948916 - DNA, 20 bp, Homo sapiens
caaccagataacataccttt

SEQ ID NO: 4948917 - DNA, 15 bp, Homo sapiens
caaccatatttagca

SEQ ID NO: 4948918 - DNA, 17 bp, Homo sapiens
caaccccaagccagccc

SEQ ID NO: 4948919 - DNA, 11 bp, Homo sapiens
caacccccacc

SEQ ID NO: 4948920 - DNA, 13 bp, Homo sapiens
caacccccacccc

SEQ ID NO: 4948921 - DNA, 14 bp, Homo sapiens
caacccccagcctg

SEQ ID NO: 4948922 - DNA, 18 bp, Homo sapiens
caaccccttcgctcctgt

SEQ ID NO: 4948923 - DNA, 18 bp, Homo sapiens
caaccctaggttccctgt

SEQ ID NO: 4948924 - DNA, 19 bp, Homo sapiens
caaccctaggttccctgtt

SEQ ID NO: 4948925 - DNA, 21 bp, Homo sapiens
caaccctaggttccctgttct

SEQ ID NO: 4948926 - DNA, 19 bp, Homo sapiens
caaccctatctcctgacag

SEQ ID NO: 4948927 - DNA, 22 bp, Homo sapiens
caacccttaccccttagcctcc

SEQ ID NO: 4948928 - DNA, 21 bp, Homo sapiens
caaccggtggatcctcaaaca

SEQ ID NO: 4948929 - DNA, 17 bp, Homo sapiens
caacctcccaacccaga

SEQ ID NO: 4948930 - DNA, 13 bp, Homo sapiens
caacctccctctt

SEQ ID NO: 4948931 - DNA, 16 bp, Homo sapiens
caacctccctcttgtt

SEQ ID NO: 4948932 - DNA, 17 bp, Homo sapiens
caacctccctcttgttt

SEQ ID NO: 4948933 - DNA, 19 bp, Homo sapiens
caacctccctcttgttttg

SEQ ID NO: 4948934 - DNA, 14 bp, Homo sapiens
caacctcctgggct

SEQ ID NO: 4948935 - DNA, 16 bp, Homo sapiens
caacctcctgtggaac

SEQ ID NO: 4948936 - DNA, 23 bp, Homo sapiens
caacctcctgtggaacccagcag

SEQ ID NO: 4948937 - DNA, 16 bp, Homo sapiens
caacctgattgtaaac

SEQ ID NO: 4948938 - DNA, 18 bp, Homo sapiens
caacctgctctcctcttg

SEQ ID NO: 4948939 - DNA, 23 bp, Homo sapiens
caacctgctctcctcttgccact

SEQ ID NO: 4948940 - DNA, 16 bp, Homo sapiens
caaccttctgtggctc

SEQ ID NO: 4948941 - DNA, 17 bp, Homo sapiens
caaccttctgtggctca

SEQ ID NO: 4948942 - DNA, 19 bp, Homo sapiens
caaccttctgtggctcaca

SEQ ID NO: 4948943 - DNA, 18 bp, Homo sapiens
caacgcagccctgctttg

SEQ ID NO: 4948944 - DNA, 15 bp, Homo sapiens
caacgtagcttctac

SEQ ID NO: 4948945 - DNA, 16 bp, Homo sapiens
caactaagcagtccct

SEQ ID NO: 4948946 - DNA, 13 bp, Homo sapiens
caactccaaaacc

SEQ ID NO: 4948947 - DNA, 23 bp, Homo sapiens
caactccaccagatagcagaggg

SEQ ID NO: 4948948 - DNA, 14 bp, Homo sapiens
caactctgagccca

SEQ ID NO: 4948949 - DNA, 19 bp, Homo sapiens
caactcttcgaagccttgc

SEQ ID NO: 4948950 - DNA, 12 bp, Homo sapiens
caactcttgatt

SEQ ID NO: 4948951 - DNA, 11 bp, Homo sapiens
caactgacaca

SEQ ID NO: 4948952 - DNA, 15 bp, Homo sapiens
caactgaccagcctc

SEQ ID NO: 4948953 - DNA, 17 bp, Homo sapiens
caactgaccagcctcca

SEQ ID NO: 4948954 - DNA, 19 bp, Homo sapiens
caactgcaataacttctga

SEQ ID NO: 4948955 - DNA, 13 bp, Homo sapiens
caactgggcccaa

SEQ ID NO: 4948956 - DNA, 19 bp, Homo sapiens
caactgttatgaaataaag

SEQ ID NO: 4948957 - DNA, 17 bp, Homo sapiens
caacttcagtcctggga

SEQ ID NO: 4948958 - DNA, 19 bp, Homo sapiens
caacttctcttgctttcta

SEQ ID NO: 4948959 - DNA, 22 bp, Homo sapiens
caacttgagatgtatgaaggct

SEQ ID NO: 4948960 - DNA, 22 bp, Homo sapiens
caacttgagggcccagagcagg

SEQ ID NO: 4948961 - DNA, 17 bp, Homo sapiens
caacttggttctgcttc

SEQ ID NO: 4948962 - DNA, 11 bp, Homo sapiens
caactttctgt

SEQ ID NO: 4948963 - DNA, 12 bp, Homo sapiens
caactttctgta

SEQ ID NO: 4948964 - DNA, 15 bp, Homo sapiens
caagaaatccctgtt

SEQ ID NO: 4948965 - DNA, 16 bp, Homo sapiens
caagaaatttgatttc

SEQ ID NO: 4948966 - DNA, 16 bp, Homo sapiens
caagaatattgtccct

SEQ ID NO: 4948967 - DNA, 21 bp, Homo sapiens
caagaattggaagctgccctg

SEQ ID NO: 4948968 - DNA, 18 bp, Homo sapiens
caagacaaatcaacagaa

SEQ ID NO: 4948969 - DNA, 21 bp, Homo sapiens
caagacaaatcaacagaagca

SEQ ID NO: 4948970 - DNA, 22 bp, Homo sapiens
caagacagatgccccagagctg

SEQ ID NO: 4948971 - DNA, 21 bp, Homo sapiens
caagactctagagtccaaggt

SEQ ID NO: 4948972 - DNA, 20 bp, Homo sapiens
caagacttggcaacagaagc

SEQ ID NO: 4948973 - DNA, 18 bp, Homo sapiens
caagagaaaggcctgcac

SEQ ID NO: 4948974 - DNA, 14 bp, Homo sapiens
caagagcagcctgt

SEQ ID NO: 4948975 - DNA, 15 bp, Homo sapiens
caagagcagcctgtg

SEQ ID NO: 4948976 - DNA, 16 bp, Homo sapiens
caagagcagcctgtgg

SEQ ID NO: 4948977 - DNA, 20 bp, Homo sapiens
caagagcagcctgtggcatc

SEQ ID NO: 4948978 - DNA, 12 bp, Homo sapiens
caagagcctgat

SEQ ID NO: 4948979 - DNA, 20 bp, Homo sapiens
caagagcctgatctcttcct

SEQ ID NO: 4948980 - DNA, 13 bp, Homo sapiens
caagagctgccct

SEQ ID NO: 4948981 - DNA, 22 bp, Homo sapiens
caagaggaataagaatggagca

SEQ ID NO: 4948982 - DNA, 14 bp, Homo sapiens
caagagggcactgg

SEQ ID NO: 4948983 - DNA, 18 bp, Homo sapiens
caagagggcactggtggc

SEQ ID NO: 4948984 - DNA, 19 bp, Homo sapiens
caagagggcactggtggcc

SEQ ID NO: 4948985 - DNA, 16 bp, Homo sapiens
caagaggtgggagggc

SEQ ID NO: 4948986 - DNA, 18 bp, Homo sapiens
caagatagatttggaata

SEQ ID NO: 4948987 - DNA, 15 bp, Homo sapiens
caagataggaccttg

SEQ ID NO: 4948988 - DNA, 16 bp, Homo sapiens
caagatattgtacata

SEQ ID NO: 4948989 - DNA, 19 bp, Homo sapiens
caagatattgtacataaaa

SEQ ID NO: 4948990 - DNA, 22 bp, Homo sapiens
caagatcctgtctttaaggaaa

SEQ ID NO: 4948991 - DNA, 15 bp, Homo sapiens
caagatgactggggt

SEQ ID NO: 4948992 - DNA, 23 bp, Homo sapiens
caagatgagattggcatggcttt

SEQ ID NO: 4948993 - DNA, 20 bp, Homo sapiens
caagatgccatctgtgtcct

SEQ ID NO: 4948994 - DNA, 14 bp, Homo sapiens
caagattaaatgta

SEQ ID NO: 4948995 - DNA, 16 bp, Homo sapiens
caagatttagaaaaaa

SEQ ID NO: 4948996 - DNA, 16 bp, Homo sapiens
caagatttccttgtgc

SEQ ID NO: 4948997 - DNA, 18 bp, Homo sapiens
caagcaacacagaggaat

SEQ ID NO: 4948998 - DNA, 15 bp, Homo sapiens
caagcaagctctctt

SEQ ID NO: 4948999 - DNA, 20 bp, Homo sapiens
caagcacatctgcattttca

SEQ ID NO: 4949000 - DNA, 15 bp, Homo sapiens
caagcacctcctgcc

SEQ ID NO: 4949001 - DNA, 16 bp, Homo sapiens
caagcacctcctgcct

SEQ ID NO: 4949002 - DNA, 17 bp, Homo sapiens
caagcacctcctgcctc

SEQ ID NO: 4949003 - DNA, 11 bp, Homo sapiens
caagcactgat

SEQ ID NO: 4949004 - DNA, 12 bp, Homo sapiens
caagcactgata

SEQ ID NO: 4949005 - DNA, 15 bp, Homo sapiens
caagcactgatatct

SEQ ID NO: 4949006 - DNA, 17 bp, Homo sapiens
caagcagaggtggccag

SEQ ID NO: 4949007 - DNA, 18 bp, Homo sapiens
caagcagagtgcacagct

SEQ ID NO: 4949008 - DNA, 16 bp, Homo sapiens
caagcaggaagttcaa

SEQ ID NO: 4949009 - DNA, 14 bp, Homo sapiens
caagcaggagacga

SEQ ID NO: 4949010 - DNA, 19 bp, Homo sapiens
caagcaggagacgacaggc

SEQ ID NO: 4949011 - DNA, 15 bp, Homo sapiens
caagcatcaggggga

SEQ ID NO: 4949012 - DNA, 20 bp, Homo sapiens
caagccacaagtcttccaga

SEQ ID NO: 4949013 - DNA, 22 bp, Homo sapiens
caagccagcaacacagagcact

SEQ ID NO: 4949014 - DNA, 17 bp, Homo sapiens
caagccatgtataaatg

SEQ ID NO: 4949015 - DNA, 14 bp, Homo sapiens
caagcctccacagc

SEQ ID NO: 4949016 - DNA, 15 bp, Homo sapiens
caagcctccacagcg

SEQ ID NO: 4949017 - DNA, 14 bp, Homo sapiens
caagcctgtctgag

SEQ ID NO: 4949018 - DNA, 15 bp, Homo sapiens
caagcgattcttctg

SEQ ID NO: 4949019 - DNA, 17 bp, Homo sapiens
caagcgattcttctgct

SEQ ID NO: 4949020 - DNA, 16 bp, Homo sapiens
caagcgcatccaatct

SEQ ID NO: 4949021 - DNA, 23 bp, Homo sapiens
caagcgcatccaatctcaaggaa

SEQ ID NO: 4949022 - DNA, 16 bp, Homo sapiens
caagcgtgagccactg

SEQ ID NO: 4949023 - DNA, 23 bp, Homo sapiens
caagctaattgggagtccaggca

SEQ ID NO: 4949024 - DNA, 21 bp, Homo sapiens
caagctattcctttcccttcc

SEQ ID NO: 4949025 - DNA, 21 bp, Homo sapiens
caagctccatctccactccag

SEQ ID NO: 4949026 - DNA, 19 bp, Homo sapiens
caagctcctcctcggaacc

SEQ ID NO: 4949027 - DNA, 14 bp, Homo sapiens
caagctctgctcct

SEQ ID NO: 4949028 - DNA, 11 bp, Homo sapiens
caagctggcct

SEQ ID NO: 4949029 - DNA, 23 bp, Homo sapiens
caagctggtcccactcagtccat

SEQ ID NO: 4949030 - DNA, 18 bp, Homo sapiens
caagctgtccagagaaaa

SEQ ID NO: 4949031 - DNA, 20 bp, Homo sapiens
caagcttgttatcagctttc

SEQ ID NO: 4949032 - DNA, 12 bp, Homo sapiens
caaggaaaaaga

SEQ ID NO: 4949033 - DNA, 16 bp, Homo sapiens
caaggaaaaagaaaat

SEQ ID NO: 4949034 - DNA, 17 bp, Homo sapiens
caaggaaaaagaaaata

SEQ ID NO: 4949035 - DNA, 22 bp, Homo sapiens
caaggaaaccgcctagtttact

SEQ ID NO: 4949036 - DNA, 17 bp, Homo sapiens
caaggaaagccccagca

SEQ ID NO: 4949037 - DNA, 20 bp, Homo sapiens
caaggaaagccccagcacta

SEQ ID NO: 4949038 - DNA, 18 bp, Homo sapiens
caaggaaggaaagaaaga

SEQ ID NO: 4949039 - DNA, 16 bp, Homo sapiens
caaggaccaggactcc

SEQ ID NO: 4949040 - DNA, 20 bp, Homo sapiens
caaggacctcctcttccccc

SEQ ID NO: 4949041 - DNA, 14 bp, Homo sapiens
caaggactgaggga

SEQ ID NO: 4949042 - DNA, 22 bp, Homo sapiens
caaggactgagggactctgaag

SEQ ID NO: 4949043 - DNA, 14 bp, Homo sapiens
caaggagaacaaat

SEQ ID NO: 4949044 - DNA, 18 bp, Homo sapiens
caaggagcacaggtccca

SEQ ID NO: 4949045 - DNA, 22 bp, Homo sapiens
caaggagcacaggtcccacctc

SEQ ID NO: 4949046 - DNA, 19 bp, Homo sapiens
caaggattgctactgtcct

SEQ ID NO: 4949047 - DNA, 16 bp, Homo sapiens
caaggcactctagatt

SEQ ID NO: 4949048 - DNA, 17 bp, Homo sapiens
caaggcactctagattc

SEQ ID NO: 4949049 - DNA, 19 bp, Homo sapiens
caaggcactctagattcca

SEQ ID NO: 4949050 - DNA, 15 bp, Homo sapiens
caaggcactgtacta

SEQ ID NO: 4949051 - DNA, 17 bp, Homo sapiens
caaggccagagtggcct

SEQ ID NO: 4949052 - DNA, 17 bp, Homo sapiens
caaggccctgctgccca

SEQ ID NO: 4949053 - DNA, 13 bp, Homo sapiens
caaggcggcccct

SEQ ID NO: 4949054 - DNA, 15 bp, Homo sapiens
caaggctctgagcaa

SEQ ID NO: 4949055 - DNA, 14 bp, Homo sapiens
caagggcagaaagt

SEQ ID NO: 4949056 - DNA, 23 bp, Homo sapiens
caaggggaatgtttgcctctgcc

SEQ ID NO: 4949057 - DNA, 19 bp, Homo sapiens
caaggggagtcaccttccc

SEQ ID NO: 4949058 - DNA, 21 bp, Homo sapiens
caaggtctgagccacagcagc

SEQ ID NO: 4949059 - DNA, 19 bp, Homo sapiens
caaggtggccaaattattt

SEQ ID NO: 4949060 - DNA, 17 bp, Homo sapiens
caaggtggtgtgatctt

SEQ ID NO: 4949061 - DNA, 18 bp, Homo sapiens
caaggtggtgtgatctta

SEQ ID NO: 4949062 - DNA, 21 bp, Homo sapiens
caaggtttaaagagtctagat

SEQ ID NO: 4949063 - DNA, 23 bp, Homo sapiens
caagtaatataatggaagagaaa

SEQ ID NO: 4949064 - DNA, 16 bp, Homo sapiens
caagtaccaaagtttt

SEQ ID NO: 4949065 - DNA, 21 bp, Homo sapiens
caagtatgaataaagacacct

SEQ ID NO: 4949066 - DNA, 11 bp, Homo sapiens
caagtattttg

SEQ ID NO: 4949067 - DNA, 17 bp, Homo sapiens
caagtcatgtgcatttc

SEQ ID NO: 4949068 - DNA, 18 bp, Homo sapiens
caagtccaataagacact

SEQ ID NO: 4949069 - DNA, 16 bp, Homo sapiens
caagtccgcagaagcc

SEQ ID NO: 4949070 - DNA, 19 bp, Homo sapiens
caagtcctggatgttgtgt

SEQ ID NO: 4949071 - DNA, 23 bp, Homo sapiens
caagtctcagtggcttcatctgt

SEQ ID NO: 4949072 - DNA, 22 bp, Homo sapiens
caagtctctgctggcccagcca

SEQ ID NO: 4949073 - DNA, 23 bp, Homo sapiens
caagtctctgctggcccagccaa

SEQ ID NO: 4949074 - DNA, 21 bp, Homo sapiens
caagtgaaataacaaaatgga

SEQ ID NO: 4949075 - DNA, 15 bp, Homo sapiens
caagtgagagctggg

SEQ ID NO: 4949076 - DNA, 18 bp, Homo sapiens
caagtgattctcctgcct

SEQ ID NO: 4949077 - DNA, 20 bp, Homo sapiens
caagtgattctcctgcctca

SEQ ID NO: 4949078 - DNA, 14 bp, Homo sapiens
caagtgcacggggc

SEQ ID NO: 4949079 - DNA, 15 bp, Homo sapiens
caagtgccaaatgct

SEQ ID NO: 4949080 - DNA, 21 bp, Homo sapiens
caagtggaccttaggccttcc

SEQ ID NO: 4949081 - DNA, 17 bp, Homo sapiens
caagtgggatctgtcac

SEQ ID NO: 4949082 - DNA, 21 bp, Homo sapiens
caagtggtttccacatgctct

SEQ ID NO: 4949083 - DNA, 19 bp, Homo sapiens
caagtgtgaacaaaagatg

SEQ ID NO: 4949084 - DNA, 13 bp, Homo sapiens
caagttaagagaa

SEQ ID NO: 4949085 - DNA, 18 bp, Homo sapiens
caagttaagagaaacttt

SEQ ID NO: 4949086 - DNA, 21 bp, Homo sapiens
caagttaagagaaactttata

SEQ ID NO: 4949087 - DNA, 22 bp, Homo sapiens
caagttaagagaaactttatac

SEQ ID NO: 4949088 - DNA, 12 bp, Homo sapiens
caagttattgta

SEQ ID NO: 4949089 - DNA, 12 bp, Homo sapiens
caagttctaaga

SEQ ID NO: 4949090 - DNA, 13 bp, Homo sapiens
caagttctaagat

SEQ ID NO: 4949091 - DNA, 15 bp, Homo sapiens
caagttctaagattc

SEQ ID NO: 4949092 - DNA, 17 bp, Homo sapiens
caagtttccatagcaac

SEQ ID NO: 4949093 - DNA, 13 bp, Homo sapiens
caagttttgtgta

SEQ ID NO: 4949094 - DNA, 17 bp, Homo sapiens
caataaaatttctaaga

SEQ ID NO: 4949095 - DNA, 18 bp, Homo sapiens
caataaaatttctaagag

SEQ ID NO: 4949096 - DNA, 23 bp, Homo sapiens
caataaacctccgccaatgcacg

SEQ ID NO: 4949097 - DNA, 12 bp, Homo sapiens
caataaagaaaa

SEQ ID NO: 4949098 - DNA, 16 bp, Homo sapiens
caataacttctgacct

SEQ ID NO: 4949099 - DNA, 12 bp, Homo sapiens
caataagcaaaa

SEQ ID NO: 4949100 - DNA, 11 bp, Homo sapiens
caataataaaa

SEQ ID NO: 4949101 - DNA, 24 bp, Homo sapiens
caataataaaaaatattcttgtca

SEQ ID NO: 4949102 - DNA, 22 bp, Homo sapiens
caataatattgttgtataattt

SEQ ID NO: 4949103 - DNA, 16 bp, Homo sapiens
caatatattaccagca

SEQ ID NO: 4949104 - DNA, 13 bp, Homo sapiens
caatatctgaagc

SEQ ID NO: 4949105 - DNA, 23 bp, Homo sapiens
caatatctgaagccctcccaggt

SEQ ID NO: 4949106 - DNA, 15 bp, Homo sapiens
attttccccccactc

SEQ ID NO: 4949107 - DNA, 15 bp, Homo sapiens
attttcgtatgaaaa

SEQ ID NO: 4949108 - DNA, 22 bp, Homo sapiens
attttctaagcaatttcttgct

SEQ ID NO: 4949109 - DNA, 15 bp, Homo sapiens
attttctacaattaa

SEQ ID NO: 4949110 - DNA, 15 bp, Homo sapiens
attttctatgtacta

SEQ ID NO: 4949111 - DNA, 19 bp, Homo sapiens
attttctcaaaagcattta

SEQ ID NO: 4949112 - DNA, 22 bp, Homo sapiens
attttctgaaagttacccactg

SEQ ID NO: 4949113 - DNA, 22 bp, Homo sapiens
attttctgtcagatgagaacaa

SEQ ID NO: 4949114 - DNA, 20 bp, Homo sapiens
attttcttacccaatttccc

SEQ ID NO: 4949115 - DNA, 12 bp, Homo sapiens
attttcttctaa

SEQ ID NO: 4949116 - DNA, 14 bp, Homo sapiens
attttcttctaagt

SEQ ID NO: 4949117 - DNA, 20 bp, Homo sapiens
attttcttctaagtgaaatt

SEQ ID NO: 4949118 - DNA, 20 bp, Homo sapiens
attttcttttctttcaactt

SEQ ID NO: 4949119 - DNA, 14 bp, Homo sapiens
attttgaaaagctt

SEQ ID NO: 4949120 - DNA, 18 bp, Homo sapiens
attttgaagtttacattt

SEQ ID NO: 4949121 - DNA, 14 bp, Homo sapiens
attttgaataccat

SEQ ID NO: 4949122 - DNA, 24 bp, Homo sapiens
attttgacagttattttgataaca

SEQ ID NO: 4949123 - DNA, 17 bp, Homo sapiens
attttgataataaattg

SEQ ID NO: 4949124 - DNA, 19 bp, Homo sapiens
attttgataccagaaggga

SEQ ID NO: 4949125 - DNA, 18 bp, Homo sapiens
attttgatccaagctggt

SEQ ID NO: 4949126 - DNA, 12 bp, Homo sapiens
attttgatgcag

SEQ ID NO: 4949127 - DNA, 23 bp, Homo sapiens
attttgatgcagcatttgataat

SEQ ID NO: 4949128 - DNA, 19 bp, Homo sapiens
attttgatgtgacaataat

SEQ ID NO: 4949129 - DNA, 20 bp, Homo sapiens
attttgattttttttttaaa

SEQ ID NO: 4949130 - DNA, 14 bp, Homo sapiens
attttgcaaatata

SEQ ID NO: 4949131 - DNA, 18 bp, Homo sapiens
attttgcctcttttctct

SEQ ID NO: 4949132 - DNA, 17 bp, Homo sapiens
attttggaagattttca

SEQ ID NO: 4949133 - DNA, 20 bp, Homo sapiens
attttggaagattttcagtc

SEQ ID NO: 4949134 - DNA, 23 bp, Homo sapiens
attttggggaagggtttgaattg

SEQ ID NO: 4949135 - DNA, 16 bp, Homo sapiens
attttggggtctcttt

SEQ ID NO: 4949136 - DNA, 21 bp, Homo sapiens
attttggtaagagacagaatg

SEQ ID NO: 4949137 - DNA, 20 bp, Homo sapiens
attttggtattacactgtat

SEQ ID NO: 4949138 - DNA, 21 bp, Homo sapiens
attttggtattacactgtatt

SEQ ID NO: 4949139 - DNA, 19 bp, Homo sapiens
attttgtaaactcaaaata

SEQ ID NO: 4949140 - DNA, 16 bp, Homo sapiens
attttgtattattgct

SEQ ID NO: 4949141 - DNA, 19 bp, Homo sapiens
attttgtattattgctgtt

SEQ ID NO: 4949142 - DNA, 13 bp, Homo sapiens
attttgtgaatgg

SEQ ID NO: 4949143 - DNA, 15 bp, Homo sapiens
attttgtgaatggat

SEQ ID NO: 4949144 - DNA, 15 bp, Homo sapiens
attttgtgtgaccaa

SEQ ID NO: 4949145 - DNA, 18 bp, Homo sapiens
attttgtgtgaccaactg

SEQ ID NO: 4949146 - DNA, 20 bp, Homo sapiens
attttgtgtgaccaactgtg

SEQ ID NO: 4949147 - DNA, 23 bp, Homo sapiens
attttgtgtgaccaactgtgttg

SEQ ID NO: 4949148 - DNA, 14 bp, Homo sapiens
attttgttcttaca

SEQ ID NO: 4949149 - DNA, 17 bp, Homo sapiens
attttgttcttacacat

SEQ ID NO: 4949150 - DNA, 14 bp, Homo sapiens
attttgttgtaaaa

SEQ ID NO: 4949151 - DNA, 17 bp, Homo sapiens
attttgttgtaaaaaga

SEQ ID NO: 4949152 - DNA, 19 bp, Homo sapiens
attttgttgtaaaaagaaa

SEQ ID NO: 4949153 - DNA, 13 bp, Homo sapiens
atttttaaaaaga

SEQ ID NO: 4949154 - DNA, 17 bp, Homo sapiens
atttttaaaatatttat

SEQ ID NO: 4949155 - DNA, 21 bp, Homo sapiens
atttttaaacaggtggtgaga

SEQ ID NO: 4949156 - DNA, 12 bp, Homo sapiens
atttttaaagat

SEQ ID NO: 4949157 - DNA, 13 bp, Homo sapiens
atttttaaattgt

SEQ ID NO: 4949158 - DNA, 22 bp, Homo sapiens
atttttacaagaagtttattct

SEQ ID NO: 4949159 - DNA, 21 bp, Homo sapiens
atttttagatagttagaacct

SEQ ID NO: 4949160 - DNA, 15 bp, Homo sapiens
atttttatatttagt

SEQ ID NO: 4949161 - DNA, 17 bp, Homo sapiens
atttttatgatgatgaa

SEQ ID NO: 4949162 - DNA, 13 bp, Homo sapiens
atttttatttatg

SEQ ID NO: 4949163 - DNA, 15 bp, Homo sapiens
atttttcaaggaagg

SEQ ID NO: 4949164 - DNA, 20 bp, Homo sapiens
atttttcagctctctgtata

SEQ ID NO: 4949165 - DNA, 18 bp, Homo sapiens
atttttctaaccttgaat

SEQ ID NO: 4949166 - DNA, 17 bp, Homo sapiens
atttttctcaaagtttt

SEQ ID NO: 4949167 - DNA, 19 bp, Homo sapiens
atttttctcagtttgtata

SEQ ID NO: 4949168 - DNA, 17 bp, Homo sapiens
atttttgaaaaaagtac

SEQ ID NO: 4949169 - DNA, 13 bp, Homo sapiens
atttttgatttat

SEQ ID NO: 4949170 - DNA, 23 bp, Homo sapiens
atttttgatttatgcatggaaac

SEQ ID NO: 4949171 - DNA, 19 bp, Homo sapiens
atttttgcaataccaagta

SEQ ID NO: 4949172 - DNA, 18 bp, Homo sapiens
atttttgccatacatcag

SEQ ID NO: 4949173 - DNA, 19 bp, Homo sapiens
atttttgtaaactggaatt

SEQ ID NO: 4949174 - DNA, 15 bp, Homo sapiens
atttttgtagtagcg

SEQ ID NO: 4949175 - DNA, 17 bp, Homo sapiens
attttttaaaagaaatt

SEQ ID NO: 4949176 - DNA, 12 bp, Homo sapiens
attttttaaagt

SEQ ID NO: 4949177 - DNA, 16 bp, Homo sapiens
attttttaaggaaaca

SEQ ID NO: 4949178 - DNA, 17 bp, Homo sapiens
attttttaaggaaacaa

SEQ ID NO: 4949179 - DNA, 18 bp, Homo sapiens
attttttatatatacagt

SEQ ID NO: 4949180 - DNA, 13 bp, Homo sapiens
attttttattgtt

SEQ ID NO: 4949181 - DNA, 15 bp, Homo sapiens
atttttttgtaattg

SEQ ID NO: 4949182 - DNA, 18 bp, Homo sapiens
atttttttgtaattgctt

SEQ ID NO: 4949183 - DNA, 14 bp, Homo sapiens
attttttttagtat

SEQ ID NO: 4949184 - DNA, 17 bp, Homo sapiens
atttttttttcctagcc

SEQ ID NO: 4949185 - DNA, 21 bp, Homo sapiens
attttttttttttgaaaaaag

SEQ ID NO: 4949186 - DNA, 21 bp, Homo sapiens
caaaaaaaaaaaaagaagacc

SEQ ID NO: 4949187 - DNA, 18 bp, Homo sapiens
caaaaaaaccacaaaggc

SEQ ID NO: 4949188 - DNA, 15 bp, Homo sapiens
caaaaagaaatgatg

SEQ ID NO: 4949189 - DNA, 14 bp, Homo sapiens
caaaaagacaaaca

SEQ ID NO: 4949190 - DNA, 11 bp, Homo sapiens
caaaaagtgtt

SEQ ID NO: 4949191 - DNA, 12 bp, Homo sapiens
caaaaagtgttt

SEQ ID NO: 4949192 - DNA, 15 bp, Homo sapiens
caaaaatataactta

SEQ ID NO: 4949193 - DNA, 13 bp, Homo sapiens
caaaaatgttgaa

SEQ ID NO: 4949194 - DNA, 11 bp, Homo sapiens
caaaacaaaac

SEQ ID NO: 4949195 - DNA, 16 bp, Homo sapiens
caaaacaaaacaaaac

SEQ ID NO: 4949196 - DNA, 14 bp, Homo sapiens
caaaacaaaactat

SEQ ID NO: 4949197 - DNA, 15 bp, Homo sapiens
caaaacaaagtcttt

SEQ ID NO: 4949198 - DNA, 22 bp, Homo sapiens
caaaacacacgcgcgcacacac

SEQ ID NO: 4949199 - DNA, 23 bp, Homo sapiens
caaaacacacgcgcgcacacaca

SEQ ID NO: 4949200 - DNA, 12 bp, Homo sapiens
caaaacactgtg

SEQ ID NO: 4949201 - DNA, 14 bp, Homo sapiens
caaaacactgtgga

SEQ ID NO: 4949202 - DNA, 15 bp, Homo sapiens
caaaacactgtggaa

SEQ ID NO: 4949203 - DNA, 14 bp, Homo sapiens
caaaacctaacttg

SEQ ID NO: 4949204 - DNA, 23 bp, Homo sapiens
caaaaccttgctaattttctcaa

SEQ ID NO: 4949205 - DNA, 18 bp, Homo sapiens
caaaactccgcccccagc

SEQ ID NO: 4949206 - DNA, 19 bp, Homo sapiens
caaaagatgctcttctgtg

SEQ ID NO: 4949207 - DNA, 19 bp, Homo sapiens
caaaagcatttatcattct

SEQ ID NO: 4949208 - DNA, 16 bp, Homo sapiens
caaaagcttcaaatta

SEQ ID NO: 4949209 - DNA, 17 bp, Homo sapiens
caaaagcttcaaattaa

SEQ ID NO: 4949210 - DNA, 12 bp, Homo sapiens
caaaaggaaaaa

SEQ ID NO: 4949211 - DNA, 16 bp, Homo sapiens
caaaaggaaaaagctc

SEQ ID NO: 4949212 - DNA, 16 bp, Homo sapiens
caaaagggtcagagga

SEQ ID NO: 4949213 - DNA, 14 bp, Homo sapiens
caaaagttccaaga

SEQ ID NO: 4949214 - DNA, 23 bp, Homo sapiens
caaaagttccaagagtctaaaga

SEQ ID NO: 4949215 - DNA, 12 bp, Homo sapiens
caaaataaaaac

SEQ ID NO: 4949216 - DNA, 21 bp, Homo sapiens
cagcagtgttccccatctggg

SEQ ID NO: 4949217 - DNA, 13 bp, Homo sapiens
cagcagttctgtt

SEQ ID NO: 4949218 - DNA, 14 bp, Homo sapiens
cagcagttctgtta

SEQ ID NO: 4949219 - DNA, 23 bp, Homo sapiens
cagcagttgaatgacaacagaag

SEQ ID NO: 4949220 - DNA, 19 bp, Homo sapiens
cagcatagcaagacacatc

SEQ ID NO: 4949221 - DNA, 15 bp, Homo sapiens
cagcatcacctgcct

SEQ ID NO: 4949222 - DNA, 16 bp, Homo sapiens
cagcatcacctgcctg

SEQ ID NO: 4949223 - DNA, 17 bp, Homo sapiens
cagcatcacctgcctgt

SEQ ID NO: 4949224 - DNA, 19 bp, Homo sapiens
cagcatcacctgcctgtta

SEQ ID NO: 4949225 - DNA, 15 bp, Homo sapiens
cagcatcactcccca

SEQ ID NO: 4949226 - DNA, 19 bp, Homo sapiens
cagcatcactccccaagga

SEQ ID NO: 4949227 - DNA, 14 bp, Homo sapiens
cagcatcctggcac

SEQ ID NO: 4949228 - DNA, 14 bp, Homo sapiens
cagcatcttctggt

SEQ ID NO: 4949229 - DNA, 14 bp, Homo sapiens
cagcatgtgccctc

SEQ ID NO: 4949230 - DNA, 15 bp, Homo sapiens
cagcattctcactcc

SEQ ID NO: 4949231 - DNA, 17 bp, Homo sapiens
cagcatttgataatgat

SEQ ID NO: 4949232 - DNA, 22 bp, Homo sapiens
cagcatttgataatgataaaac

SEQ ID NO: 4949233 - DNA, 17 bp, Homo sapiens
cagccaaacccatgagg

SEQ ID NO: 4949234 - DNA, 19 bp, Homo sapiens
cagccaaacccatgaggca

SEQ ID NO: 4949235 - DNA, 15 bp, Homo sapiens
cagccaaaccctgtc

SEQ ID NO: 4949236 - DNA, 16 bp, Homo sapiens
cagccaaaccctgtct

SEQ ID NO: 4949237 - DNA, 20 bp, Homo sapiens
cagccaagtgccaaatgctc

SEQ ID NO: 4949238 - DNA, 11 bp, Homo sapiens
cagccaccccg

SEQ ID NO: 4949239 - DNA, 21 bp, Homo sapiens
cagccaccccgggctctctgc

SEQ ID NO: 4949240 - DNA, 15 bp, Homo sapiens
cagccacggccaggc

SEQ ID NO: 4949241 - DNA, 17 bp, Homo sapiens
cagccacggccaggcca

SEQ ID NO: 4949242 - DNA, 19 bp, Homo sapiens
cagccacggccaggccaga

SEQ ID NO: 4949243 - DNA, 21 bp, Homo sapiens
cagccacggccaggccagagg

SEQ ID NO: 4949244 - DNA, 22 bp, Homo sapiens
cagccacggccaggccagaggg

SEQ ID NO: 4949245 - DNA, 22 bp, Homo sapiens
cagccaggacagtcagctctct

SEQ ID NO: 4949246 - DNA, 19 bp, Homo sapiens
cagccaggctcaggccatg

SEQ ID NO: 4949247 - DNA, 13 bp, Homo sapiens
cagccaggctgcc

SEQ ID NO: 4949248 - DNA, 13 bp, Homo sapiens
cagccatcaaaat

SEQ ID NO: 4949249 - DNA, 17 bp, Homo sapiens
cagccatcaaaatgctt

SEQ ID NO: 4949250 - DNA, 21 bp, Homo sapiens
cagcccaaaggggacaggcct

SEQ ID NO: 4949251 - DNA, 22 bp, Homo sapiens
cagcccaaaggggacaggcctc

SEQ ID NO: 4949252 - DNA, 24 bp, Homo sapiens
cagcccacattggattcatcagca

SEQ ID NO: 4949253 - DNA, 19 bp, Homo sapiens
cagcccagaagaaaattct

SEQ ID NO: 4949254 - DNA, 12 bp, Homo sapiens
cagcccagagac

SEQ ID NO: 4949255 - DNA, 17 bp, Homo sapiens
cagcccatgcccacctg

SEQ ID NO: 4949256 - DNA, 16 bp, Homo sapiens
cagcccatggccctgt

SEQ ID NO: 4949257 - DNA, 15 bp, Homo sapiens
cagccccacacagct

SEQ ID NO: 4949258 - DNA, 11 bp, Homo sapiens
cagccccaccc

SEQ ID NO: 4949259 - DNA, 13 bp, Homo sapiens
cagccccacccag

SEQ ID NO: 4949260 - DNA, 16 bp, Homo sapiens
cagccccacccaggag

SEQ ID NO: 4949261 - DNA, 16 bp, Homo sapiens
cagccccactgccagc

SEQ ID NO: 4949262 - DNA, 15 bp, Homo sapiens
cagccccagagcagg

SEQ ID NO: 4949263 - DNA, 13 bp, Homo sapiens
cagccccagtgcc

SEQ ID NO: 4949264 - DNA, 15 bp, Homo sapiens
cagccccagtgccca

SEQ ID NO: 4949265 - DNA, 18 bp, Homo sapiens
cagccccagtgcccacag

SEQ ID NO: 4949266 - DNA, 19 bp, Homo sapiens
cagccccattctgcctgcc

SEQ ID NO: 4949267 - DNA, 23 bp, Homo sapiens
cagccccattctgcctgcccagg

SEQ ID NO: 4949268 - DNA, 17 bp, Homo sapiens
cagcccccagcccctcc

SEQ ID NO: 4949269 - DNA, 13 bp, Homo sapiens
cagcccctaggag

SEQ ID NO: 4949270 - DNA, 14 bp, Homo sapiens
cagcccctccccca

SEQ ID NO: 4949271 - DNA, 15 bp, Homo sapiens
cagagctgggaggca

SEQ ID NO: 4949272 - DNA, 20 bp, Homo sapiens
cagagctgtttatggcctca

SEQ ID NO: 4949273 - DNA, 22 bp, Homo sapiens
cagagctgtttatggcctcagc

SEQ ID NO: 4949274 - DNA, 21 bp, Homo sapiens
cagaggaactgtccagagagc

SEQ ID NO: 4949275 - DNA, 17 bp, Homo sapiens
cagaggaatcctggcag

SEQ ID NO: 4949276 - DNA, 20 bp, Homo sapiens
cagaggaatcctggcagccc

SEQ ID NO: 4949277 - DNA, 21 bp, Homo sapiens
cagaggaatcctggcagccca

SEQ ID NO: 4949278 - DNA, 21 bp, Homo sapiens
cagaggacctgtatttaagca

SEQ ID NO: 4949279 - DNA, 14 bp, Homo sapiens
cagaggagcctttt

SEQ ID NO: 4949280 - DNA, 15 bp, Homo sapiens
cagaggagccttttt

SEQ ID NO: 4949281 - DNA, 21 bp, Homo sapiens
cagaggaggcagaataagaaa

SEQ ID NO: 4949282 - DNA, 23 bp, Homo sapiens
cagaggcagccccattctgcctg

SEQ ID NO: 4949283 - DNA, 14 bp, Homo sapiens
cagaggcctgcccg

SEQ ID NO: 4949284 - DNA, 20 bp, Homo sapiens
cagagggagtgacagaggca

SEQ ID NO: 4949285 - DNA, 19 bp, Homo sapiens
cagagggcttgtgaacaga

SEQ ID NO: 4949286 - DNA, 15 bp, Homo sapiens
cagaggggactctgg

SEQ ID NO: 4949287 - DNA, 16 bp, Homo sapiens
cagaggggactctggg

SEQ ID NO: 4949288 - DNA, 17 bp, Homo sapiens
cagagggttgtgatttt

SEQ ID NO: 4949289 - DNA, 13 bp, Homo sapiens
cagaggtaacaga

SEQ ID NO: 4949290 - DNA, 23 bp, Homo sapiens
cagaggtaacagaacagcttcag

SEQ ID NO: 4949291 - DNA, 13 bp, Homo sapiens
cagaggtccagcc

SEQ ID NO: 4949292 - DNA, 14 bp, Homo sapiens
cagaggtggccaga

SEQ ID NO: 4949293 - DNA, 21 bp, Homo sapiens
cagagtatgaacacctgggct

SEQ ID NO: 4949294 - DNA, 15 bp, Homo sapiens
cagagtcctttccaa

SEQ ID NO: 4949295 - DNA, 21 bp, Homo sapiens
cagagtctcactgttgcccag

SEQ ID NO: 4949296 - DNA, 12 bp, Homo sapiens
cagagtggcctg

SEQ ID NO: 4949297 - DNA, 16 bp, Homo sapiens
cagagtggcctggcca

SEQ ID NO: 4949298 - DNA, 23 bp, Homo sapiens
cagagtggcctggccaggagctc

SEQ ID NO: 4949299 - DNA, 18 bp, Homo sapiens
cagagtgtggactctggt

SEQ ID NO: 4949300 - DNA, 19 bp, Homo sapiens
cagagtttgccttcctttc

SEQ ID NO: 4949301 - DNA, 22 bp, Homo sapiens
cagagtttgccttcctttctcc

SEQ ID NO: 4949302 - DNA, 17 bp, Homo sapiens
cagataacaatgcagca

SEQ ID NO: 4949303 - DNA, 22 bp, Homo sapiens
cagataacaatgcagcaaggcc

SEQ ID NO: 4949304 - DNA, 20 bp, Homo sapiens
cagataagacatatctctaa

SEQ ID NO: 4949305 - DNA, 21 bp, Homo sapiens
cagatacaggaaaagctgctg

SEQ ID NO: 4949306 - DNA, 22 bp, Homo sapiens
cagatacaggaaaagctgctga

SEQ ID NO: 4949307 - DNA, 14 bp, Homo sapiens
cagatacatcactg

SEQ ID NO: 4949308 - DNA, 16 bp, Homo sapiens
cagatagaatcaatca

SEQ ID NO: 4949309 - DNA, 20 bp, Homo sapiens
cagatatatatcatattggt

SEQ ID NO: 4949310 - DNA, 18 bp, Homo sapiens
cagatcactgaatttata

SEQ ID NO: 4949311 - DNA, 17 bp, Homo sapiens
cagatcagtcagagccc

SEQ ID NO: 4949312 - DNA, 16 bp, Homo sapiens
cagatcagtgtaccat

SEQ ID NO: 4949313 - DNA, 23 bp, Homo sapiens
cagatcctgggtactgaaagcct

SEQ ID NO: 4949314 - DNA, 18 bp, Homo sapiens
cagatctggtcccttgca

SEQ ID NO: 4949315 - DNA, 13 bp, Homo sapiens
cagatctgtctga

SEQ ID NO: 4949316 - DNA, 18 bp, Homo sapiens
cagatctgtctgatagga

SEQ ID NO: 4949317 - DNA, 13 bp, Homo sapiens
cagatctgtgccc

SEQ ID NO: 4949318 - DNA, 20 bp, Homo sapiens
cagatctgtgccccatgcct

SEQ ID NO: 4949319 - DNA, 15 bp, Homo sapiens
cagatgaaaatttga

SEQ ID NO: 4949320 - DNA, 20 bp, Homo sapiens
cagatgaactcttagaaatg

SEQ ID NO: 4949321 - DNA, 14 bp, Homo sapiens
cagatgagaacaaa

SEQ ID NO: 4949322 - DNA, 18 bp, Homo sapiens
cagaactcactggggcct

SEQ ID NO: 4949323 - DNA, 22 bp, Homo sapiens
cagaactgccattattttctgt

SEQ ID NO: 4949324 - DNA, 17 bp, Homo sapiens
cagaagaagagaagctg

SEQ ID NO: 4949325 - DNA, 23 bp, Homo sapiens
cagaagaagagaagctgctgacc

SEQ ID NO: 4949326 - DNA, 18 bp, Homo sapiens
cagaagacaaaaagacaa

SEQ ID NO: 4949327 - DNA, 19 bp, Homo sapiens
cagaagacaccagagcaga

SEQ ID NO: 4949328 - DNA, 21 bp, Homo sapiens
cagaagacaccagagcagatg

SEQ ID NO: 4949329 - DNA, 18 bp, Homo sapiens
cagaagatcccctcagga

SEQ ID NO: 4949330 - DNA, 23 bp, Homo sapiens
cagaagatcccctcaggactgca

SEQ ID NO: 4949331 - DNA, 23 bp, Homo sapiens
cagaagcagttgagtcgtcatca

SEQ ID NO: 4949332 - DNA, 15 bp, Homo sapiens
cagaagcatttgtat

SEQ ID NO: 4949333 - DNA, 17 bp, Homo sapiens
cagaagcatttgtattt

SEQ ID NO: 4949334 - DNA, 19 bp, Homo sapiens
cagaagcatttgtattttg

SEQ ID NO: 4949335 - DNA, 21 bp, Homo sapiens
cagaagcatttgtattttgtg

SEQ ID NO: 4949336 - DNA, 14 bp, Homo sapiens
cagaagcctctggc

SEQ ID NO: 4949337 - DNA, 14 bp, Homo sapiens
cagaagcttcagaa

SEQ ID NO: 4949338 - DNA, 20 bp, Homo sapiens
cagaaggattttttaaagtt

SEQ ID NO: 4949339 - DNA, 12 bp, Homo sapiens
cagaagggagca

SEQ ID NO: 4949340 - DNA, 23 bp, Homo sapiens
cagaaggttgctctagattgaga

SEQ ID NO: 4949341 - DNA, 13 bp, Homo sapiens
cagaagtggagct

SEQ ID NO: 4949342 - DNA, 15 bp, Homo sapiens
cagaagtttctcagc

SEQ ID NO: 4949343 - DNA, 18 bp, Homo sapiens
cagaataaggcaggcatt

SEQ ID NO: 4949344 - DNA, 21 bp, Homo sapiens
cagaatagccacatttggaat

SEQ ID NO: 4949345 - DNA, 16 bp, Homo sapiens
cagaatcagcacagat

SEQ ID NO: 4949346 - DNA, 14 bp, Homo sapiens
cagaatcccagccg

SEQ ID NO: 4949347 - DNA, 11 bp, Homo sapiens
cagaatgctgt

SEQ ID NO: 4949348 - DNA, 17 bp, Homo sapiens
cagaatgctgtacatct

SEQ ID NO: 4949349 - DNA, 18 bp, Homo sapiens
cagaatgctgtacatcta

SEQ ID NO: 4949350 - DNA, 21 bp, Homo sapiens
cagaatgctgtacatctattt

SEQ ID NO: 4949351 - DNA, 13 bp, Homo sapiens
cagaatgtatctg

SEQ ID NO: 4949352 - DNA, 14 bp, Homo sapiens
cagaatgtatctgt

SEQ ID NO: 4949353 - DNA, 18 bp, Homo sapiens
cagaatgtatctgtgaag

SEQ ID NO: 4949354 - DNA, 13 bp, Homo sapiens
cagaattgatcat

SEQ ID NO: 4949355 - DNA, 16 bp, Homo sapiens
cagaatttggaaatcc

SEQ ID NO: 4949356 - DNA, 14 bp, Homo sapiens
cagacaacagaagt

SEQ ID NO: 4949357 - DNA, 15 bp, Homo sapiens
cagacaacagaagtc

SEQ ID NO: 4949358 - DNA, 16 bp, Homo sapiens
cagacaacagaagtca

SEQ ID NO: 4949359 - DNA, 22 bp, Homo sapiens
cagacaacagaagtcatgaagc

SEQ ID NO: 4949360 - DNA, 21 bp, Homo sapiens
cagacaagtgactgtatctgt

SEQ ID NO: 4949361 - DNA, 13 bp, Homo sapiens
cagacacacacac

SEQ ID NO: 4949362 - DNA, 14 bp, Homo sapiens
cagacacacacacg

SEQ ID NO: 4949363 - DNA, 21 bp, Homo sapiens
cagacacacacacgcacgcac

SEQ ID NO: 4949364 - DNA, 15 bp, Homo sapiens
cagacacaggcccgg

SEQ ID NO: 4949365 - DNA, 14 bp, Homo sapiens
cagacaccctcaac

SEQ ID NO: 4949366 - DNA, 21 bp, Homo sapiens
cagacaccctcaacctcttct

SEQ ID NO: 4949367 - DNA, 19 bp, Homo sapiens
cagacacgccttcccctca

SEQ ID NO: 4949368 - DNA, 20 bp, Homo sapiens
cagacagaacttgaatgtgt

SEQ ID NO: 4949369 - DNA, 14 bp, Homo sapiens
cagacagcaggcag

SEQ ID NO: 4949370 - DNA, 16 bp, Homo sapiens
cagacagcaggcagcg

SEQ ID NO: 4949371 - DNA, 18 bp, Homo sapiens
caaacatgtatttatgta

SEQ ID NO: 4949372 - DNA, 18 bp, Homo sapiens
caaacattgtgttgacat

SEQ ID NO: 4949373 - DNA, 19 bp, Homo sapiens
caaacattgtgttgacatt

SEQ ID NO: 4949374 - DNA, 14 bp, Homo sapiens
caaaccaaataaaa

SEQ ID NO: 4949375 - DNA, 17 bp, Homo sapiens
caaaccaagtcggaaca

SEQ ID NO: 4949376 - DNA, 15 bp, Homo sapiens
caaaccacaactgac

SEQ ID NO: 4949377 - DNA, 21 bp, Homo sapiens
caaaccacaactgacacagga

SEQ ID NO: 4949378 - DNA, 21 bp, Homo sapiens
caaacccacgattttctccag

SEQ ID NO: 4949379 - DNA, 17 bp, Homo sapiens
caaacctaccaaaatgg

SEQ ID NO: 4949380 - DNA, 16 bp, Homo sapiens
caaactaaaagacatt

SEQ ID NO: 4949381 - DNA, 18 bp, Homo sapiens
caaactccaaggttccct

SEQ ID NO: 4949382 - DNA, 19 bp, Homo sapiens
caaactcttgacctcaggt

SEQ ID NO: 4949383 - DNA, 20 bp, Homo sapiens
caaactcttgacctcaggtg

SEQ ID NO: 4949384 - DNA, 21 bp, Homo sapiens
caaactcttgacctcaggtga

SEQ ID NO: 4949385 - DNA, 22 bp, Homo sapiens
caaactgctggacgtctttctt

SEQ ID NO: 4949386 - DNA, 12 bp, Homo sapiens
caaactggagtc

SEQ ID NO: 4949387 - DNA, 16 bp, Homo sapiens
caaactggagtctgga

SEQ ID NO: 4949388 - DNA, 23 bp, Homo sapiens
caaactggagtctggagtgggca

SEQ ID NO: 4949389 - DNA, 19 bp, Homo sapiens
caaactggggcctccagaa

SEQ ID NO: 4949390 - DNA, 13 bp, Homo sapiens
caaacttactatt

SEQ ID NO: 4949391 - DNA, 16 bp, Homo sapiens
caaacttactattttg

SEQ ID NO: 4949392 - DNA, 19 bp, Homo sapiens
caaacttttcaaggcttat

SEQ ID NO: 4949393 - DNA, 17 bp, Homo sapiens
caaagaaatgaacattc

SEQ ID NO: 4949394 - DNA, 18 bp, Homo sapiens
caaagaaatgaacattcc

SEQ ID NO: 4949395 - DNA, 20 bp, Homo sapiens
caaagaaatgaacattccaa

SEQ ID NO: 4949396 - DNA, 16 bp, Homo sapiens
caaagaggctgcccct

SEQ ID NO: 4949397 - DNA, 23 bp, Homo sapiens
caaagaggctgcccctctcacca

SEQ ID NO: 4949398 - DNA, 16 bp, Homo sapiens
caaagaggtatttatc

SEQ ID NO: 4949399 - DNA, 14 bp, Homo sapiens
caaagagtagaatt

SEQ ID NO: 4949400 - DNA, 17 bp, Homo sapiens
caaagatcaaaataaaa

SEQ ID NO: 4949401 - DNA, 18 bp, Homo sapiens
caaagatggctcagaggg

SEQ ID NO: 4949402 - DNA, 19 bp, Homo sapiens
caaagattcatgatttata

SEQ ID NO: 4949403 - DNA, 19 bp, Homo sapiens
caaagcacagtgttaaatg

SEQ ID NO: 4949404 - DNA, 20 bp, Homo sapiens
caaagccaaagctaggcctg

SEQ ID NO: 4949405 - DNA, 23 bp, Homo sapiens
caaagccccttgctctcccctgc

SEQ ID NO: 4949406 - DNA, 18 bp, Homo sapiens
caaagcccttccatgtcg

SEQ ID NO: 4949407 - DNA, 21 bp, Homo sapiens
caaagctagggtggcccttgc

SEQ ID NO: 4949408 - DNA, 22 bp, Homo sapiens
caaagctagggtggcccttgca

SEQ ID NO: 4949409 - DNA, 14 bp, Homo sapiens
caaagctgcccact

SEQ ID NO: 4949410 - DNA, 15 bp, Homo sapiens
caaagctgcccactg

SEQ ID NO: 4949411 - DNA, 20 bp, Homo sapiens
caaagctgcccactgtttct

SEQ ID NO: 4949412 - DNA, 17 bp, Homo sapiens
caaagctggctcacctt

SEQ ID NO: 4949413 - DNA, 16 bp, Homo sapiens
caaagctttttccaga

SEQ ID NO: 4949414 - DNA, 20 bp, Homo sapiens
caaaggaagtgccccctccc

SEQ ID NO: 4949415 - DNA, 17 bp, Homo sapiens
caaaggacattatgtgt

SEQ ID NO: 4949416 - DNA, 19 bp, Homo sapiens
caaaggacattatgtgtgc

SEQ ID NO: 4949417 - DNA, 23 bp, Homo sapiens
caaaggcaagttaagagaaactt

SEQ ID NO: 4949418 - DNA, 16 bp, Homo sapiens
caaaggccaaactgct

SEQ ID NO: 4949419 - DNA, 15 bp, Homo sapiens
caaaggctggtggca

SEQ ID NO: 4949420 - DNA, 18 bp, Homo sapiens
caaagggaaatatcattt

SEQ ID NO: 4949421 - DNA, 19 bp, Homo sapiens
caaaggggacaggcctcac

SEQ ID NO: 4949422 - DNA, 20 bp, Homo sapiens
caaaggggatcataaagtta

SEQ ID NO: 4949423 - DNA, 16 bp, Homo sapiens
caaagggtatcaggtg

SEQ ID NO: 4949424 - DNA, 18 bp, Homo sapiens
caaagggtatcaggtgct

SEQ ID NO: 4949425 - DNA, 20 bp, Homo sapiens
caaagggtatcaggtgctgc

SEQ ID NO: 4949426 - DNA, 23 bp, Homo sapiens
caaagggttgggagctgatgaaa

SEQ ID NO: 4949427 - DNA, 15 bp, Homo sapiens
caaaggttgagatgt

SEQ ID NO: 4949428 - DNA, 13 bp, Homo sapiens
caaagtctgtgtg

SEQ ID NO: 4949429 - DNA, 22 bp, Homo sapiens
caaagttccctacttcctgtga

SEQ ID NO: 4949430 - DNA, 20 bp, Homo sapiens
caaagttctaataatttcta

SEQ ID NO: 4949431 - DNA, 17 bp, Homo sapiens
caaagttctgtgtttaa

SEQ ID NO: 4949432 - DNA, 22 bp, Homo sapiens
caaagttctgtgtttaatttct

SEQ ID NO: 4949433 - DNA, 14 bp, Homo sapiens
caaagttttatcaa

SEQ ID NO: 4949434 - DNA, 13 bp, Homo sapiens
caaagttttgaaa

SEQ ID NO: 4949435 - DNA, 20 bp, Homo sapiens
caaagttttgaaaagctatt

SEQ ID NO: 4949436 - DNA, 21 bp, Homo sapiens
caaagttttgaaaagctatta

SEQ ID NO: 4949437 - DNA, 18 bp, Homo sapiens
caaataaaaatattgtgt

SEQ ID NO: 4949438 - DNA, 17 bp, Homo sapiens
caaataaactctaaaca

SEQ ID NO: 4949439 - DNA, 15 bp, Homo sapiens
caaataacttcagtc

SEQ ID NO: 4949440 - DNA, 23 bp, Homo sapiens
caaataacttcagtcctgctcca

SEQ ID NO: 4949441 - DNA, 16 bp, Homo sapiens
caaataagtatttata

SEQ ID NO: 4949442 - DNA, 17 bp, Homo sapiens
caaataagtatttataa

SEQ ID NO: 4949443 - DNA, 13 bp, Homo sapiens
caaatataaacat

SEQ ID NO: 4949444 - DNA, 15 bp, Homo sapiens
caaatatcttgtgtt

SEQ ID NO: 4949445 - DNA, 17 bp, Homo sapiens
caaatatcttgtgttgt

SEQ ID NO: 4949446 - DNA, 23 bp, Homo sapiens
caaatattgttgacaactgtgac

SEQ ID NO: 4949447 - DNA, 14 bp, Homo sapiens
caaatcaacagaag

SEQ ID NO: 4949448 - DNA, 15 bp, Homo sapiens
caaatcaacagaagc

SEQ ID NO: 4949449 - DNA, 17 bp, Homo sapiens
caaatcaacagaagcat

SEQ ID NO: 4949450 - DNA, 19 bp, Homo sapiens
caaatcaacagaagcattt

SEQ ID NO: 4949451 - DNA, 17 bp, Homo sapiens
caaatcaataagaaggt

SEQ ID NO: 4949452 - DNA, 16 bp, Homo sapiens
caaatcagttagtttt

SEQ ID NO: 4949453 - DNA, 19 bp, Homo sapiens
caaatccgctctcttcctg

SEQ ID NO: 4949454 - DNA, 22 bp, Homo sapiens
cactactgggtgtcatttcatt

SEQ ID NO: 4949455 - DNA, 15 bp, Homo sapiens
cactagaactctcca

SEQ ID NO: 4949456 - DNA, 13 bp, Homo sapiens
cactagaatggat

SEQ ID NO: 4949457 - DNA, 18 bp, Homo sapiens
cactagaatggataaaat

SEQ ID NO: 4949458 - DNA, 16 bp, Homo sapiens
cactagagaatgcaca

SEQ ID NO: 4949459 - DNA, 23 bp, Homo sapiens
cactagagaatgcacagatatac

SEQ ID NO: 4949460 - DNA, 17 bp, Homo sapiens
cactagcctttggctct

SEQ ID NO: 4949461 - DNA, 16 bp, Homo sapiens
cactatccatgcacca

SEQ ID NO: 4949462 - DNA, 18 bp, Homo sapiens
cactatccatgcaccaaa

SEQ ID NO: 4949463 - DNA, 19 bp, Homo sapiens
cactatccatgcaccaaac

SEQ ID NO: 4949464 - DNA, 18 bp, Homo sapiens
cactatgttgcccaggca

SEQ ID NO: 4949465 - DNA, 13 bp, Homo sapiens
cactcaagcactg

SEQ ID NO: 4949466 - DNA, 15 bp, Homo sapiens
cactcaagcactgat

SEQ ID NO: 4949467 - DNA, 19 bp, Homo sapiens
cactcacatttattctgct

SEQ ID NO: 4949468 - DNA, 12 bp, Homo sapiens
cactcagaagac

SEQ ID NO: 4949469 - DNA, 18 bp, Homo sapiens
cactcagaagacactgat

SEQ ID NO: 4949470 - DNA, 11 bp, Homo sapiens
cactcagcccc

SEQ ID NO: 4949471 - DNA, 12 bp, Homo sapiens
cactcagcccct

SEQ ID NO: 4949472 - DNA, 15 bp, Homo sapiens
cactcagcccctagg

SEQ ID NO: 4949473 - DNA, 17 bp, Homo sapiens
cactcagcccctaggag

SEQ ID NO: 4949474 - DNA, 19 bp, Homo sapiens
cactcagcttcctacccac

SEQ ID NO: 4949475 - DNA, 20 bp, Homo sapiens
cactcaggaggctgaggcag

SEQ ID NO: 4949476 - DNA, 19 bp, Homo sapiens
cactcagtgcagcaatata

SEQ ID NO: 4949477 - DNA, 16 bp, Homo sapiens
cactcattgctgagcc

SEQ ID NO: 4949478 - DNA, 16 bp, Homo sapiens
cactccagacccctgg

SEQ ID NO: 4949479 - DNA, 17 bp, Homo sapiens
cactccagacccctggc

SEQ ID NO: 4949480 - DNA, 12 bp, Homo sapiens
cactccattccc

SEQ ID NO: 4949481 - DNA, 18 bp, Homo sapiens
cactccccatgccacgtt

SEQ ID NO: 4949482 - DNA, 13 bp, Homo sapiens
cactcctacctgg

SEQ ID NO: 4949483 - DNA, 14 bp, Homo sapiens
cactcctacctggt

SEQ ID NO: 4949484 - DNA, 19 bp, Homo sapiens
cactcctagagaacgcagc

SEQ ID NO: 4949485 - DNA, 13 bp, Homo sapiens
cactcctcagggc

SEQ ID NO: 4949486 - DNA, 13 bp, Homo sapiens
cactcgcttcccc

SEQ ID NO: 4949487 - DNA, 22 bp, Homo sapiens
cactcgtgtgcaacagacaagt

SEQ ID NO: 4949488 - DNA, 17 bp, Homo sapiens
cactctaccctatacaa

SEQ ID NO: 4949489 - DNA, 17 bp, Homo sapiens
cactctaccctcccacc

SEQ ID NO: 4949490 - DNA, 18 bp, Homo sapiens
cactctaccctcccaccc

SEQ ID NO: 4949491 - DNA, 14 bp, Homo sapiens
cactctacttagca

SEQ ID NO: 4949492 - DNA, 14 bp, Homo sapiens
cactctagattcca

SEQ ID NO: 4949493 - DNA, 12 bp, Homo sapiens
cactctccccac

SEQ ID NO: 4949494 - DNA, 14 bp, Homo sapiens
cactctccccacac

SEQ ID NO: 4949495 - DNA, 15 bp, Homo sapiens
cactctgcagactgc

SEQ ID NO: 4949496 - DNA, 20 bp, Homo sapiens
cactctgccagcaaagagga

SEQ ID NO: 4949497 - DNA, 12 bp, Homo sapiens
cactctgccagg

SEQ ID NO: 4949498 - DNA, 16 bp, Homo sapiens
cactctgccagggcag

SEQ ID NO: 4949499 - DNA, 14 bp, Homo sapiens
cactctgctgctta

SEQ ID NO: 4949500 - DNA, 12 bp, Homo sapiens
cactctggcctc

SEQ ID NO: 4949501 - DNA, 19 bp, Homo sapiens
cactctgtcgcccagtctg

SEQ ID NO: 4949502 - DNA, 22 bp, Homo sapiens
cactcttaaagcaaaaaatgaa

SEQ ID NO: 4949503 - DNA, 20 bp, Homo sapiens
cactcttattgcccacgctg

SEQ ID NO: 4949504 - DNA, 16 bp, Homo sapiens
cactctttatagtgca

SEQ ID NO: 4949505 - DNA, 23 bp, Homo sapiens
cactcttttgctttattccagaa

SEQ ID NO: 4949506 - DNA, 15 bp, Homo sapiens
cactgaattaatcat

SEQ ID NO: 4949507 - DNA, 14 bp, Homo sapiens
cactgacacaaagg

SEQ ID NO: 4949508 - DNA, 15 bp, Homo sapiens
cactgacacaaagga

SEQ ID NO: 4949509 - DNA, 14 bp, Homo sapiens
cactgacagcctcc

SEQ ID NO: 4949510 - DNA, 17 bp, Homo sapiens
cactgacagcctcccac

SEQ ID NO: 4949511 - DNA, 23 bp, Homo sapiens
cactgaccatccactctaccctc

SEQ ID NO: 4949512 - DNA, 19 bp, Homo sapiens
cactgatattttacctctt

SEQ ID NO: 4949513 - DNA, 15 bp, Homo sapiens
cactgatgcttagat

SEQ ID NO: 4949514 - DNA, 18 bp, Homo sapiens
cactgatgggcaaccccc

SEQ ID NO: 4949515 - DNA, 24 bp, Homo sapiens
cactgatgggcaacccccagcctg

SEQ ID NO: 4949516 - DNA, 13 bp, Homo sapiens
cactgcaacctcc

SEQ ID NO: 4949517 - DNA, 19 bp, Homo sapiens
cactgcaatcctgtctttc

SEQ ID NO: 4949518 - DNA, 18 bp, Homo sapiens
cactgcacagtgcatctc

SEQ ID NO: 4949519 - DNA, 16 bp, Homo sapiens
cactgcaccgggccac

SEQ ID NO: 4949520 - DNA, 12 bp, Homo sapiens
cactgcagcctc

SEQ ID NO: 4949521 - DNA, 13 bp, Homo sapiens
cactgcagcctca

SEQ ID NO: 4949522 - DNA, 20 bp, Homo sapiens
cactgcagcctcaacctcct

SEQ ID NO: 4949523 - DNA, 18 bp, Homo sapiens
cactgcattattctcttt

SEQ ID NO: 4949524 - DNA, 19 bp, Homo sapiens
cactgcattattctctttt

SEQ ID NO: 4949525 - DNA, 20 bp, Homo sapiens
cactgccacactctccatca

SEQ ID NO: 4949526 - DNA, 14 bp, Homo sapiens
cactgccactttgc

SEQ ID NO: 4949527 - DNA, 22 bp, Homo sapiens
cactgccactttgcacattttg

SEQ ID NO: 4949528 - DNA, 14 bp, Homo sapiens
cactgccagcagca

SEQ ID NO: 4949529 - DNA, 16 bp, Homo sapiens
cactgccagcagcagc

SEQ ID NO: 4949530 - DNA, 22 bp, Homo sapiens
cactgccatcttagtttggatt

SEQ ID NO: 4949531 - DNA, 17 bp, Homo sapiens
cactgcccgcacaccct

SEQ ID NO: 4949532 - DNA, 19 bp, Homo sapiens
cactgcccgcacaccctca

SEQ ID NO: 4949533 - DNA, 14 bp, Homo sapiens
cactgcctctgcct

SEQ ID NO: 4949534 - DNA, 19 bp, Homo sapiens
cactgcctgggctgacccc

SEQ ID NO: 4949535 - DNA, 13 bp, Homo sapiens
cactgcctgtata

SEQ ID NO: 4949536 - DNA, 12 bp, Homo sapiens
cactgccttttt

SEQ ID NO: 4949537 - DNA, 14 bp, Homo sapiens
cactgctccctgaa

SEQ ID NO: 4949538 - DNA, 19 bp, Homo sapiens
cactgctccctgaagccag

SEQ ID NO: 4949539 - DNA, 21 bp, Homo sapiens
cactgctccctgaagccagcc

SEQ ID NO: 4949540 - DNA, 17 bp, Homo sapiens
cactgctgcccagcctc

SEQ ID NO: 4949541 - DNA, 20 bp, Homo sapiens
cactgcttttggtctgtgtg

SEQ ID NO: 4949542 - DNA, 20 bp, Homo sapiens
cactggagccatctcttcct

SEQ ID NO: 4949543 - DNA, 14 bp, Homo sapiens
cactggccatccct

SEQ ID NO: 4949544 - DNA, 15 bp, Homo sapiens
cactgggcacaactg

SEQ ID NO: 4949545 - DNA, 11 bp, Homo sapiens
cactgggccaa

SEQ ID NO: 4949546 - DNA, 16 bp, Homo sapiens
cactggggaaaactcc

SEQ ID NO: 4949547 - DNA, 20 bp, Homo sapiens
cactggtagaccaaaataaa

SEQ ID NO: 4949548 - DNA, 18 bp, Homo sapiens
cactgtagaatgatttca

SEQ ID NO: 4949549 - DNA, 14 bp, Homo sapiens
cactgtataaatag

SEQ ID NO: 4949550 - DNA, 18 bp, Homo sapiens
cactgtataaataggaga

SEQ ID NO: 4949551 - DNA, 14 bp, Homo sapiens
cactgtatttgtat

SEQ ID NO: 4949552 - DNA, 16 bp, Homo sapiens
cactgtcaccctccac

SEQ ID NO: 4949553 - DNA, 13 bp, Homo sapiens
cactgtgcaggtg

SEQ ID NO: 4949554 - DNA, 22 bp, Homo sapiens
cactgtgcaggtgctattgtta

SEQ ID NO: 4949555 - DNA, 15 bp, Homo sapiens
cactgtgccatgtgc

SEQ ID NO: 4949556 - DNA, 17 bp, Homo sapiens
cactgtgcccagcccgg

SEQ ID NO: 4949557 - DNA, 23 bp, Homo sapiens
cactgttagctttttaaaacatt

SEQ ID NO: 4949558 - DNA, 16 bp, Homo sapiens
cactgttgaaaattat

SEQ ID NO: 4949559 - DNA, 14 bp, Homo sapiens
cactgttgatgtat

SEQ ID NO: 4949560 - DNA, 15 bp, Homo sapiens
cactgttgatgtatc

SEQ ID NO: 4949561 - DNA, 18 bp, Homo sapiens
cactgttgcccaggctgg

SEQ ID NO: 4949562 - DNA, 20 bp, Homo sapiens
cactgtttctcttgagctgg

SEQ ID NO: 4949563 - DNA, 22 bp, Homo sapiens
cactgtttctcttgagctggcc

SEQ ID NO: 4949564 - DNA, 21 bp, Homo sapiens
cactgtttcttgcttgtacct

SEQ ID NO: 4949565 - DNA, 24 bp, Homo sapiens
cactgtttcttgcttgtacctctg

SEQ ID NO: 4949566 - DNA, 20 bp, Homo sapiens
cacatagttctccagttgta

SEQ ID NO: 4949567 - DNA, 22 bp, Homo sapiens
cacatatacctataatgtgtgt

SEQ ID NO: 4949568 - DNA, 14 bp, Homo sapiens
cacatatctgtcat

SEQ ID NO: 4949569 - DNA, 20 bp, Homo sapiens
cacatatgcaccttgtgtct

SEQ ID NO: 4949570 - DNA, 13 bp, Homo sapiens
cacatccattccc

SEQ ID NO: 4949571 - DNA, 22 bp, Homo sapiens
cacatccattcccaagaaatgc

SEQ ID NO: 4949572 - DNA, 14 bp, Homo sapiens
cacatcctccgtcc

SEQ ID NO: 4949573 - DNA, 14 bp, Homo sapiens
cacatcttgctctg

SEQ ID NO: 4949574 - DNA, 16 bp, Homo sapiens
cacatcttgctctgct

SEQ ID NO: 4949575 - DNA, 20 bp, Homo sapiens
cacatcttgctctgctgaca

SEQ ID NO: 4949576 - DNA, 21 bp, Homo sapiens
cacatcttgctctgctgacag

SEQ ID NO: 4949577 - DNA, 22 bp, Homo sapiens
cacatcttgctctgctgacaga

SEQ ID NO: 4949578 - DNA, 23 bp, Homo sapiens
cacatcttgctctgctgacagac

SEQ ID NO: 4949579 - DNA, 14 bp, Homo sapiens
cacatctttcctgt

SEQ ID NO: 4949580 - DNA, 23 bp, Homo sapiens
cacatgacctgatcactagcctg

SEQ ID NO: 4949581 - DNA, 13 bp, Homo sapiens
cacatgcacacac

SEQ ID NO: 4949582 - DNA, 18 bp, Homo sapiens
cacatgcacgtgtgtgca

SEQ ID NO: 4949583 - DNA, 16 bp, Homo sapiens
cacatgctggccagcc

SEQ ID NO: 4949584 - DNA, 18 bp, Homo sapiens
cacatgctggccagcctg

SEQ ID NO: 4949585 - DNA, 15 bp, Homo sapiens
cacatggcctatgca

SEQ ID NO: 4949586 - DNA, 23 bp, Homo sapiens
cacatgggagcagtccatgcatg

SEQ ID NO: 4949587 - DNA, 18 bp, Homo sapiens
cacatggtgcccctagct

SEQ ID NO: 4949588 - DNA, 20 bp, Homo sapiens
cacatgtcttgtacatgtgt

SEQ ID NO: 4949589 - DNA, 13 bp, Homo sapiens
cacatgtgacaca

SEQ ID NO: 4949590 - DNA, 15 bp, Homo sapiens
cacatgtgcacatgc

SEQ ID NO: 4949591 - DNA, 16 bp, Homo sapiens
cacattaaaaaatgaa

SEQ ID NO: 4949592 - DNA, 22 bp, Homo sapiens
cacattaagtaatcaataaaga

SEQ ID NO: 4949593 - DNA, 22 bp, Homo sapiens
cacattaatggtctaaaaataa

SEQ ID NO: 4949594 - DNA, 20 bp, Homo sapiens
cacattagattttattttac

SEQ ID NO: 4949595 - DNA, 23 bp, Homo sapiens
cacattgagctgatataaattct

SEQ ID NO: 4949596 - DNA, 19 bp, Homo sapiens
cacattgtttgctgctatt

SEQ ID NO: 4949597 - DNA, 14 bp, Homo sapiens
cacatttaaggatg

SEQ ID NO: 4949598 - DNA, 16 bp, Homo sapiens
cacatttggaatactt

SEQ ID NO: 4949599 - DNA, 17 bp, Homo sapiens
cacatttggaatacttt

SEQ ID NO: 4949600 - DNA, 19 bp, Homo sapiens
cacatttggaatacttttt

SEQ ID NO: 4949601 - DNA, 12 bp, Homo sapiens
cacattttgatt

SEQ ID NO: 4949602 - DNA, 16 bp, Homo sapiens
cacatttttaaattgt

SEQ ID NO: 4949603 - DNA, 14 bp, Homo sapiens
caccaaagctgccc

SEQ ID NO: 4949604 - DNA, 22 bp, Homo sapiens
caccaaagggagagttccagag

SEQ ID NO: 4949605 - DNA, 14 bp, Homo sapiens
caccaaagttctaa

SEQ ID NO: 4949606 - DNA, 22 bp, Homo sapiens
caccaaagttctaataatttct

SEQ ID NO: 4949607 - DNA, 15 bp, Homo sapiens
caccaacaccacggt

SEQ ID NO: 4949608 - DNA, 15 bp, Homo sapiens
caccaagaaagcagg

SEQ ID NO: 4949609 - DNA, 13 bp, Homo sapiens
caccaagcccagt

SEQ ID NO: 4949610 - DNA, 15 bp, Homo sapiens
caccaagcccagtta

SEQ ID NO: 4949611 - DNA, 24 bp, Homo sapiens
caccaattggttaatctttcctga

SEQ ID NO: 4949612 - DNA, 15 bp, Homo sapiens
caccacacccagcct

SEQ ID NO: 4949613 - DNA, 17 bp, Homo sapiens
caccacacccagcctca

SEQ ID NO: 4949614 - DNA, 12 bp, Homo sapiens
caccacagacac

SEQ ID NO: 4949615 - DNA, 18 bp, Homo sapiens
caccacatcctccgtcca

SEQ ID NO: 4949616 - DNA, 21 bp, Homo sapiens
caccacatcctccgtccagcc

SEQ ID NO: 4949617 - DNA, 15 bp, Homo sapiens
caccacatgtgcaca

SEQ ID NO: 4949618 - DNA, 19 bp, Homo sapiens
caccacatgtgcacatgca

SEQ ID NO: 4949619 - DNA, 16 bp, Homo sapiens
caccaccccaacaaac

SEQ ID NO: 4949620 - DNA, 14 bp, Homo sapiens
caccacctccctca

SEQ ID NO: 4949621 - DNA, 18 bp, Homo sapiens
caccactgcactccagcc

SEQ ID NO: 4949622 - DNA, 11 bp, Homo sapiens
caccagagacc

SEQ ID NO: 4949623 - DNA, 16 bp, Homo sapiens
caccagagaccgtcct

SEQ ID NO: 4949624 - DNA, 19 bp, Homo sapiens
caccagagaccgtcctcac

SEQ ID NO: 4949625 - DNA, 20 bp, Homo sapiens
caccagagcaacctctcact

SEQ ID NO: 4949626 - DNA, 11 bp, Homo sapiens
caccagccagc

SEQ ID NO: 4949627 - DNA, 14 bp, Homo sapiens
caccagccccactg

SEQ ID NO: 4949628 - DNA, 18 bp, Homo sapiens
caccagccccactgccag

SEQ ID NO: 4949629 - DNA, 21 bp, Homo sapiens
caccagccccactgccagcag

SEQ ID NO: 4949630 - DNA, 23 bp, Homo sapiens
caccagccccactgccagcagca

SEQ ID NO: 4949631 - DNA, 18 bp, Homo sapiens
caccagccccagtgccca

SEQ ID NO: 4949632 - DNA, 21 bp, Homo sapiens
caccagccccagtgcccacag

SEQ ID NO: 4949633 - DNA, 19 bp, Homo sapiens
caccagcccttagcaggga

SEQ ID NO: 4949634 - DNA, 16 bp, Homo sapiens
caccaggagaaccact

SEQ ID NO: 4949635 - DNA, 15 bp, Homo sapiens
cacccaaccccaagc

SEQ ID NO: 4949636 - DNA, 23 bp, Homo sapiens
cacccaaccctatctcctgacag

SEQ ID NO: 4949637 - DNA, 20 bp, Homo sapiens
cacgaaacttgttattgtga

SEQ ID NO: 4949638 - DNA, 22 bp, Homo sapiens
cacgaaacttgttattgtgaat

SEQ ID NO: 4949639 - DNA, 14 bp, Homo sapiens
cacgaccggggcca

SEQ ID NO: 4949640 - DNA, 19 bp, Homo sapiens
cacgacgccctctccccac

SEQ ID NO: 4949641 - DNA, 15 bp, Homo sapiens
cacgacgctgcagag

SEQ ID NO: 4949642 - DNA, 15 bp, Homo sapiens
cacgatcctgccacc

SEQ ID NO: 4949643 - DNA, 17 bp, Homo sapiens
cacgattttctccagct

SEQ ID NO: 4949644 - DNA, 19 bp, Homo sapiens
cacgattttctccagctca

SEQ ID NO: 4949645 - DNA, 15 bp, Homo sapiens
cacgcacacacacaa

SEQ ID NO: 4949646 - DNA, 13 bp, Homo sapiens
cacgcacgcacac

SEQ ID NO: 4949647 - DNA, 20 bp, Homo sapiens
cacgcagattagcaggccaa

SEQ ID NO: 4949648 - DNA, 13 bp, Homo sapiens
cacgccctcccct

SEQ ID NO: 4949649 - DNA, 16 bp, Homo sapiens
cacgccctcccctccc

SEQ ID NO: 4949650 - DNA, 15 bp, Homo sapiens
cacgccttcccctca

SEQ ID NO: 4949651 - DNA, 16 bp, Homo sapiens
cacgccttcccctcag

SEQ ID NO: 4949652 - DNA, 19 bp, Homo sapiens
cacgcgcttcgacttttct

SEQ ID NO: 4949653 - DNA, 20 bp, Homo sapiens
cacgctggaccttgaactgg

SEQ ID NO: 4949654 - DNA, 17 bp, Homo sapiens
cacgctggagtgcagtg

SEQ ID NO: 4949655 - DNA, 17 bp, Homo sapiens
cacggacaataaacctc

SEQ ID NO: 4949656 - DNA, 19 bp, Homo sapiens
cacggacaataaacctccg

SEQ ID NO: 4949657 - DNA, 20 bp, Homo sapiens
cacggagatatgaagagcaa

SEQ ID NO: 4949658 - DNA, 15 bp, Homo sapiens
cacggccaggccaga

SEQ ID NO: 4949659 - DNA, 14 bp, Homo sapiens
cacggctcactgca

SEQ ID NO: 4949660 - DNA, 20 bp, Homo sapiens
cacggctcactgcagcctca

SEQ ID NO: 4949661 - DNA, 14 bp, Homo sapiens
cacgtacacacaca

SEQ ID NO: 4949662 - DNA, 18 bp, Homo sapiens
cacgtacacacacataca

SEQ ID NO: 4949663 - DNA, 13 bp, Homo sapiens
cacgtggagagct

SEQ ID NO: 4949664 - DNA, 15 bp, Homo sapiens
cacgtggagagctgg

SEQ ID NO: 4949665 - DNA, 16 bp, Homo sapiens
cacgtgtcctgtagtt

SEQ ID NO: 4949666 - DNA, 14 bp, Homo sapiens
cacgtgtcttccac

SEQ ID NO: 4949667 - DNA, 14 bp, Homo sapiens
cactaaaattttag

SEQ ID NO: 4949668 - DNA, 15 bp, Homo sapiens
cactaaagccagcct

SEQ ID NO: 4949669 - DNA, 18 bp, Homo sapiens
cactaaagccagcctgac

SEQ ID NO: 4949670 - DNA, 21 bp, Homo sapiens
cactaaagccagcctgacctt

SEQ ID NO: 4949671 - DNA, 13 bp, Homo sapiens
cactaaatcagag

SEQ ID NO: 4949672 - DNA, 16 bp, Homo sapiens
cactaaatcagagaca

SEQ ID NO: 4949673 - DNA, 15 bp, Homo sapiens
cactaaccacgctgg

SEQ ID NO: 4949674 - DNA, 17 bp, Homo sapiens
cactaaggtgtgctctg

SEQ ID NO: 4949675 - DNA, 18 bp, Homo sapiens
cactaaggtgtgctctga

SEQ ID NO: 4949676 - DNA, 15 bp, Homo sapiens
cactacatgcagccc

SEQ ID NO: 4949677 - DNA, 19 bp, Homo sapiens
cactacatgtggtttatag

SEQ ID NO: 4949678 - DNA, 16 bp, Homo sapiens
cactactgggtgtcat

SEQ ID NO: 4949679 - DNA, 14 bp, Homo sapiens
atgtgaacttgtag

SEQ ID NO: 4949680 - DNA, 18 bp, Homo sapiens
atgtgaacttgtagctgt

SEQ ID NO: 4949681 - DNA, 20 bp, Homo sapiens
atgtgaacttgtagctgtaa

SEQ ID NO: 4949682 - DNA, 16 bp, Homo sapiens
atgtgacaataatatt

SEQ ID NO: 4949683 - DNA, 18 bp, Homo sapiens
atgtgacattttacatta

SEQ ID NO: 4949684 - DNA, 22 bp, Homo sapiens
atgtgagtgtgtgtttgtgctg

SEQ ID NO: 4949685 - DNA, 15 bp, Homo sapiens
atgtgatattctaag

SEQ ID NO: 4949686 - DNA, 17 bp, Homo sapiens
atgtgatctgtcttgta

SEQ ID NO: 4949687 - DNA, 19 bp, Homo sapiens
atgtgatctgtcttgtaat

SEQ ID NO: 4949688 - DNA, 20 bp, Homo sapiens
atgtgcaagcgacgacagat

SEQ ID NO: 4949689 - DNA, 22 bp, Homo sapiens
atgtgcacccatgggctctgac

SEQ ID NO: 4949690 - DNA, 13 bp, Homo sapiens
atgtgccctcctg

SEQ ID NO: 4949691 - DNA, 17 bp, Homo sapiens
atgtgccctcctgaggg

SEQ ID NO: 4949692 - DNA, 13 bp, Homo sapiens
atgtggaaaacag

SEQ ID NO: 4949693 - DNA, 18 bp, Homo sapiens
atgtgggcactggcccag

SEQ ID NO: 4949694 - DNA, 14 bp, Homo sapiens
atgtggtctcagga

SEQ ID NO: 4949695 - DNA, 15 bp, Homo sapiens
atgtggtctcaggat

SEQ ID NO: 4949696 - DNA, 15 bp, Homo sapiens
atgtggttcttcaaa

SEQ ID NO: 4949697 - DNA, 19 bp, Homo sapiens
atgtggtttggttcctctc

SEQ ID NO: 4949698 - DNA, 23 bp, Homo sapiens
atgtggtttggttcctctctggt

SEQ ID NO: 4949699 - DNA, 15 bp, Homo sapiens
atgtgtaaaatgtga

SEQ ID NO: 4949700 - DNA, 14 bp, Homo sapiens
atgtgtagcctatg

SEQ ID NO: 4949701 - DNA, 17 bp, Homo sapiens
atgtgtagcctgtgcat

SEQ ID NO: 4949702 - DNA, 23 bp, Homo sapiens
atgtgtagcctgtgcatgtatgt

SEQ ID NO: 4949703 - DNA, 15 bp, Homo sapiens
atgtgtatatataca

SEQ ID NO: 4949704 - DNA, 16 bp, Homo sapiens
atgtgtatatatacat

SEQ ID NO: 4949705 - DNA, 20 bp, Homo sapiens
atgtgtcccgaatccacagt

SEQ ID NO: 4949706 - DNA, 19 bp, Homo sapiens
atgtgtcctatctatcttc

SEQ ID NO: 4949707 - DNA, 22 bp, Homo sapiens
atgtgtcctatctatcttccaa

SEQ ID NO: 4949708 - DNA, 22 bp, Homo sapiens
atgtgtgaggagctgctggctt

SEQ ID NO: 4949709 - DNA, 20 bp, Homo sapiens
atgtgtgcatgtgtgtataa

SEQ ID NO: 4949710 - DNA, 21 bp, Homo sapiens
atgtgtgtataagtgcacaca

SEQ ID NO: 4949711 - DNA, 18 bp, Homo sapiens
atgtgttgaaaaccaaaa

SEQ ID NO: 4949712 - DNA, 14 bp, Homo sapiens
atgtgttgaaactg

SEQ ID NO: 4949713 - DNA, 12 bp, Homo sapiens
atgtgtttccat

SEQ ID NO: 4949714 - DNA, 13 bp, Homo sapiens
atgtgtttttctc

SEQ ID NO: 4949715 - DNA, 16 bp, Homo sapiens
atgtgtttttctccag

SEQ ID NO: 4949716 - DNA, 12 bp, Homo sapiens
atgttaaatttg

SEQ ID NO: 4949717 - DNA, 16 bp, Homo sapiens
atgttaaatttgtaag

SEQ ID NO: 4949718 - DNA, 16 bp, Homo sapiens
atgttaccatcttact

SEQ ID NO: 4949719 - DNA, 14 bp, Homo sapiens
atgttactattttc

SEQ ID NO: 4949720 - DNA, 15 bp, Homo sapiens
atgttagagactttt

SEQ ID NO: 4949721 - DNA, 22 bp, Homo sapiens
atgttagtgttttaagaaatgt

SEQ ID NO: 4949722 - DNA, 22 bp, Homo sapiens
atgttatatttaatgcattaaa

SEQ ID NO: 4949723 - DNA, 15 bp, Homo sapiens
atgttatcttctcaa

SEQ ID NO: 4949724 - DNA, 17 bp, Homo sapiens
atgttcacgcaacttga

SEQ ID NO: 4949725 - DNA, 23 bp, Homo sapiens
atgttcagaaggttgctctagat

SEQ ID NO: 4949726 - DNA, 12 bp, Homo sapiens
atgttctaaggc

SEQ ID NO: 4949727 - DNA, 16 bp, Homo sapiens
atgttctaaggctctg

SEQ ID NO: 4949728 - DNA, 20 bp, Homo sapiens
atgttctaaggctctgagag

SEQ ID NO: 4949729 - DNA, 12 bp, Homo sapiens
atgttctaagtt

SEQ ID NO: 4949730 - DNA, 19 bp, Homo sapiens
atgttctatggttatgaaa

SEQ ID NO: 4949731 - DNA, 14 bp, Homo sapiens
atgttctattgtgg

SEQ ID NO: 4949732 - DNA, 16 bp, Homo sapiens
atgttctgcccccagc

SEQ ID NO: 4949733 - DNA, 11 bp, Homo sapiens
atgttctggga

SEQ ID NO: 4949734 - DNA, 20 bp, Homo sapiens
atgttcttatgcaaaatgga

SEQ ID NO: 4949735 - DNA, 21 bp, Homo sapiens
atgttcttatgcaaaatggaa

SEQ ID NO: 4949736 - DNA, 18 bp, Homo sapiens
atgttgaagaatacagtt

SEQ ID NO: 4949737 - DNA, 16 bp, Homo sapiens
atgttgagaatcccaa

SEQ ID NO: 4949738 - DNA, 17 bp, Homo sapiens
atgttgatttttactgt

SEQ ID NO: 4949739 - DNA, 20 bp, Homo sapiens
atgttgatttttactgtgtt

SEQ ID NO: 4949740 - DNA, 13 bp, Homo sapiens
atgttgcccaggc

SEQ ID NO: 4949741 - DNA, 15 bp, Homo sapiens
atgttgcccaggcag

SEQ ID NO: 4949742 - DNA, 23 bp, Homo sapiens
atgttggacacctttaggttctt

SEQ ID NO: 4949743 - DNA, 17 bp, Homo sapiens
atgttggtttactttca

SEQ ID NO: 4949744 - DNA, 15 bp, Homo sapiens
atgttgtgatgtatt

SEQ ID NO: 4949745 - DNA, 19 bp, Homo sapiens
atgtttatgaaaataaata

SEQ ID NO: 4949746 - DNA, 18 bp, Homo sapiens
atgtttatgcaaggaagg

SEQ ID NO: 4949747 - DNA, 20 bp, Homo sapiens
atgtttatgcaaggaaggaa

SEQ ID NO: 4949748 - DNA, 14 bp, Homo sapiens
atgtttattccttg

SEQ ID NO: 4949749 - DNA, 16 bp, Homo sapiens
atgtttattcttctag

SEQ ID NO: 4949750 - DNA, 17 bp, Homo sapiens
atgtttattcttctaga

SEQ ID NO: 4949751 - DNA, 21 bp, Homo sapiens
atgtttattcttctagagttc

SEQ ID NO: 4949752 - DNA, 21 bp, Homo sapiens
atgtttcacataaaacctcat

SEQ ID NO: 4949753 - DNA, 13 bp, Homo sapiens
atgtttctatctg

SEQ ID NO: 4949754 - DNA, 20 bp, Homo sapiens
atgtttctgggtcctgaaga

SEQ ID NO: 4949755 - DNA, 21 bp, Homo sapiens
atgtttctgggtcctgaagaa

SEQ ID NO: 4949756 - DNA, 19 bp, Homo sapiens
atgtttgaggagcatgttt

SEQ ID NO: 4949757 - DNA, 19 bp, Homo sapiens
atgtttgcctctgcctctg

SEQ ID NO: 4949758 - DNA, 22 bp, Homo sapiens
atgtttgcctctgcctctgaca

SEQ ID NO: 4949759 - DNA, 18 bp, Homo sapiens
atgtttgcttcataaatg

SEQ ID NO: 4949760 - DNA, 14 bp, Homo sapiens
atgtttgtaaaact

SEQ ID NO: 4949761 - DNA, 21 bp, Homo sapiens
atgtttgtctcagttggaaat

SEQ ID NO: 4949762 - DNA, 13 bp, Homo sapiens
atgtttgtggcct

SEQ ID NO: 4949763 - DNA, 15 bp, Homo sapiens
atgtttgtggcctca

SEQ ID NO: 4949764 - DNA, 16 bp, Homo sapiens
atgtttgtggcctcag

SEQ ID NO: 4949765 - DNA, 18 bp, Homo sapiens
atgtttgtggcctcagaa

SEQ ID NO: 4949766 - DNA, 16 bp, Homo sapiens
atgttttaagaggcag

SEQ ID NO: 4949767 - DNA, 18 bp, Homo sapiens
atgttttaagaggcaggg

SEQ ID NO: 4949768 - DNA, 16 bp, Homo sapiens
atgttttactgtgaaa

SEQ ID NO: 4949769 - DNA, 16 bp, Homo sapiens
atgttttataagttca

SEQ ID NO: 4949770 - DNA, 15 bp, Homo sapiens
atgttttgtatacaa

SEQ ID NO: 4949771 - DNA, 16 bp, Homo sapiens
atgttttgtatacaaa

SEQ ID NO: 4949772 - DNA, 21 bp, Homo sapiens
atgttttgtgactatatagag

SEQ ID NO: 4949773 - DNA, 20 bp, Homo sapiens
atgtttttataaaaataaat

SEQ ID NO: 4949774 - DNA, 14 bp, Homo sapiens
atgtttttatacaa

SEQ ID NO: 4949775 - DNA, 22 bp, Homo sapiens
atgtttttctgccagggagctt

SEQ ID NO: 4949776 - DNA, 21 bp, Homo sapiens
atgtttttgttttctttgaat

SEQ ID NO: 4949777 - DNA, 17 bp, Homo sapiens
attaaaaagttaatctt

SEQ ID NO: 4949778 - DNA, 13 bp, Homo sapiens
attaaaacttctt

SEQ ID NO: 4949779 - DNA, 12 bp, Homo sapiens
attaaacctgtc

SEQ ID NO: 4949780 - DNA, 16 bp, Homo sapiens
attaaacctgtctcca

SEQ ID NO: 4949781 - DNA, 22 bp, Homo sapiens
attaaacctgtctccactgtgc

SEQ ID NO: 4949782 - DNA, 16 bp, Homo sapiens
attaaagtctgaatca

SEQ ID NO: 4949783 - DNA, 14 bp, Homo sapiens
atacctaagtactg

SEQ ID NO: 4949784 - DNA, 20 bp, Homo sapiens
atacctaagtactgtaataa

SEQ ID NO: 4949785 - DNA, 15 bp, Homo sapiens
atacctataatgtgt

SEQ ID NO: 4949786 - DNA, 17 bp, Homo sapiens
atacctataatgtgtgt

SEQ ID NO: 4949787 - DNA, 17 bp, Homo sapiens
atacctcatgtttatga

SEQ ID NO: 4949788 - DNA, 15 bp, Homo sapiens
atacctctgaccaac

SEQ ID NO: 4949789 - DNA, 14 bp, Homo sapiens
atacctctgtgtgc

SEQ ID NO: 4949790 - DNA, 17 bp, Homo sapiens
atacctgctatcagcag

SEQ ID NO: 4949791 - DNA, 17 bp, Homo sapiens
atacgcactacatgtgg

SEQ ID NO: 4949792 - DNA, 22 bp, Homo sapiens
atacggtcaggtttaacatttg

SEQ ID NO: 4949793 - DNA, 15 bp, Homo sapiens
atactacatctttaa

SEQ ID NO: 4949794 - DNA, 14 bp, Homo sapiens
atactaccttgaaa

SEQ ID NO: 4949795 - DNA, 19 bp, Homo sapiens
atactactgaaacagattt

SEQ ID NO: 4949796 - DNA, 17 bp, Homo sapiens
atcctgaaatttcagat

SEQ ID NO: 4949797 - DNA, 18 bp, Homo sapiens
atcctgactctgccccct

SEQ ID NO: 4949798 - DNA, 12 bp, Homo sapiens
atcctgagcccc

SEQ ID NO: 4949799 - DNA, 22 bp, Homo sapiens
atcctgagccccgccctcttcc

SEQ ID NO: 4949800 - DNA, 16 bp, Homo sapiens
atcctgccaccctgta

SEQ ID NO: 4949801 - DNA, 21 bp, Homo sapiens
atcctgccttcatggaactca

SEQ ID NO: 4949802 - DNA, 16 bp, Homo sapiens
atcctggagaagcctc

SEQ ID NO: 4949803 - DNA, 22 bp, Homo sapiens
atcctggcacccggcccctgct

SEQ ID NO: 4949804 - DNA, 18 bp, Homo sapiens
atcctggcagcccagaga

SEQ ID NO: 4949805 - DNA, 21 bp, Homo sapiens
atcctgggggacccaatgtag

SEQ ID NO: 4949806 - DNA, 12 bp, Homo sapiens
atcctgggtaat

SEQ ID NO: 4949807 - DNA, 21 bp, Homo sapiens
atcctgtgactgtctcactta

SEQ ID NO: 4949808 - DNA, 19 bp, Homo sapiens
atccttagaggtcctctgg

SEQ ID NO: 4949809 - DNA, 16 bp, Homo sapiens
atccttatcagagcta

SEQ ID NO: 4949810 - DNA, 20 bp, Homo sapiens
atccttatcagagctaaggg

SEQ ID NO: 4949811 - DNA, 19 bp, Homo sapiens
atccttccaaaaattatta

SEQ ID NO: 4949812 - DNA, 22 bp, Homo sapiens
atccttccaaagaattcttata

SEQ ID NO: 4949813 - DNA, 19 bp, Homo sapiens
atccttcgtgaacatcccc

SEQ ID NO: 4949814 - DNA, 20 bp, Homo sapiens
atccttcgtgaacatcccct

SEQ ID NO: 4949815 - DNA, 23 bp, Homo sapiens
atccttcgtgaacatcccctccc

SEQ ID NO: 4949816 - DNA, 21 bp, Homo sapiens
atccttctggcagattcaaat

SEQ ID NO: 4949817 - DNA, 15 bp, Homo sapiens
atcctttctgccgac

SEQ ID NO: 4949818 - DNA, 18 bp, Homo sapiens
atcctttgcctgcctggt

SEQ ID NO: 4949819 - DNA, 21 bp, Homo sapiens
atcctttgttttctgactaat

SEQ ID NO: 4949820 - DNA, 23 bp, Homo sapiens
atcctttgttttctgactaatta

SEQ ID NO: 4949821 - DNA, 12 bp, Homo sapiens
atcgaaaattca

SEQ ID NO: 4949822 - DNA, 13 bp, Homo sapiens
atcgaaataacaa

SEQ ID NO: 4949823 - DNA, 20 bp, Homo sapiens
atcgaaataacaatgttaag

SEQ ID NO: 4949824 - DNA, 20 bp, Homo sapiens
atcgaatctactaattccac

SEQ ID NO: 4949825 - DNA, 21 bp, Homo sapiens
atcgctcgtgtgttctatcca

SEQ ID NO: 4949826 - DNA, 23 bp, Homo sapiens
atcgctcgtgtgttctatccaaa

SEQ ID NO: 4949827 - DNA, 15 bp, Homo sapiens
atcgctgacttcatg

SEQ ID NO: 4949828 - DNA, 21 bp, Homo sapiens
atcgtgtattgagatttctta

SEQ ID NO: 4949829 - DNA, 14 bp, Homo sapiens
atctaaatgatgag

SEQ ID NO: 4949830 - DNA, 18 bp, Homo sapiens
atctaaggatgtcacagg

SEQ ID NO: 4949831 - DNA, 17 bp, Homo sapiens
atctaatatatatgaat

SEQ ID NO: 4949832 - DNA, 23 bp, Homo sapiens
atctaatatgtaacaagccaccc

SEQ ID NO: 4949833 - DNA, 21 bp, Homo sapiens
atctacccaagggcagaaagt

SEQ ID NO: 4949834 - DNA, 21 bp, Homo sapiens
atctagaacacaggcaaaatc

SEQ ID NO: 4949835 - DNA, 20 bp, Homo sapiens
atctaggcatgaagagcaaa

SEQ ID NO: 4949836 - DNA, 16 bp, Homo sapiens
atctaggtaattttta

SEQ ID NO: 4949837 - DNA, 22 bp, Homo sapiens
atctagtaagacgtaaggggaa

SEQ ID NO: 4949838 - DNA, 17 bp, Homo sapiens
atctagtttacagaaaa

SEQ ID NO: 4949839 - DNA, 20 bp, Homo sapiens
atctagtttacagaaaaatc

SEQ ID NO: 4949840 - DNA, 16 bp, Homo sapiens
atctataaagaagaac

SEQ ID NO: 4949841 - DNA, 12 bp, Homo sapiens
atctataaagcg

SEQ ID NO: 4949842 - DNA, 16 bp, Homo sapiens
atctatatatgtgtat

SEQ ID NO: 4949843 - DNA, 17 bp, Homo sapiens
atctatatatgtgtatg

SEQ ID NO: 4949844 - DNA, 13 bp, Homo sapiens
atctattttctat

SEQ ID NO: 4949845 - DNA, 18 bp, Homo sapiens
atctattttctatgtact

SEQ ID NO: 4949846 - DNA, 22 bp, Homo sapiens
atctattttctatgtactagta

SEQ ID NO: 4949847 - DNA, 12 bp, Homo sapiens
atctattttgat

SEQ ID NO: 4949848 - DNA, 21 bp, Homo sapiens
atctattttgatgcagcattt

SEQ ID NO: 4949849 - DNA, 14 bp, Homo sapiens
atctattttggatt

SEQ ID NO: 4949850 - DNA, 23 bp, Homo sapiens
atctcaccccatcccacaccctg

SEQ ID NO: 4949851 - DNA, 11 bp, Homo sapiens
atctcagccca

SEQ ID NO: 4949852 - DNA, 18 bp, Homo sapiens
atctcaggagatttcatg

SEQ ID NO: 4949853 - DNA, 15 bp, Homo sapiens
atctcaggggccaga

SEQ ID NO: 4949854 - DNA, 16 bp, Homo sapiens
atctcaggggccagag

SEQ ID NO: 4949855 - DNA, 17 bp, Homo sapiens
atctcaggggccagagg

SEQ ID NO: 4949856 - DNA, 15 bp, Homo sapiens
atctcagtcatgcat

SEQ ID NO: 4949857 - DNA, 16 bp, Homo sapiens
atctcagtcatgcata

SEQ ID NO: 4949858 - DNA, 18 bp, Homo sapiens
atctcatacctctgacca

SEQ ID NO: 4949859 - DNA, 23 bp, Homo sapiens
atctcataggttgccaataatac

SEQ ID NO: 4949860 - DNA, 19 bp, Homo sapiens
atctcatgtatcatctgga

SEQ ID NO: 4949861 - DNA, 15 bp, Homo sapiens
atctccactccagat

SEQ ID NO: 4949862 - DNA, 15 bp, Homo sapiens
atctccagtattctt

SEQ ID NO: 4949863 - DNA, 18 bp, Homo sapiens
atctccagtattcttgtc

SEQ ID NO: 4949864 - DNA, 21 bp, Homo sapiens
atctcctgtccatcagccagg

SEQ ID NO: 4949865 - DNA, 22 bp, Homo sapiens
atctcgtttttcttcttaagac

SEQ ID NO: 4949866 - DNA, 22 bp, Homo sapiens
atctctaatatggcaaaaatgg

SEQ ID NO: 4949867 - DNA, 13 bp, Homo sapiens
atctctatttaat

SEQ ID NO: 4949868 - DNA, 16 bp, Homo sapiens
atctctatttaatatt

SEQ ID NO: 4949869 - DNA, 19 bp, Homo sapiens
atctctatttaatatttat

SEQ ID NO: 4949870 - DNA, 15 bp, Homo sapiens
atctctcaaatctgt

SEQ ID NO: 4949871 - DNA, 19 bp, Homo sapiens
atctctcaaatctgttatc

SEQ ID NO: 4949872 - DNA, 11 bp, Homo sapiens
atctctccctc

SEQ ID NO: 4949873 - DNA, 14 bp, Homo sapiens
atctctctgcagct

SEQ ID NO: 4949874 - DNA, 16 bp, Homo sapiens
atctctctgcagctgc

SEQ ID NO: 4949875 - DNA, 18 bp, Homo sapiens
atctctctgtgctgtgga

SEQ ID NO: 4949876 - DNA, 23 bp, Homo sapiens
atctctctgtgctgtggaagcaa

SEQ ID NO: 4949877 - DNA, 13 bp, Homo sapiens
atctctgaaagca

SEQ ID NO: 4949878 - DNA, 13 bp, Homo sapiens
atctctgaagcat

SEQ ID NO: 4949879 - DNA, 19 bp, Homo sapiens
atctctgaagcatgtttca

SEQ ID NO: 4949880 - DNA, 20 bp, Homo sapiens
atctctgaagcatgtttcat

SEQ ID NO: 4949881 - DNA, 23 bp, Homo sapiens
atctctgcaccctggggcctgga

SEQ ID NO: 4949882 - DNA, 17 bp, Homo sapiens
atctctgtgtgcacaaa

SEQ ID NO: 4949883 - DNA, 15 bp, Homo sapiens
atctcttaaattggg

SEQ ID NO: 4949884 - DNA, 11 bp, Homo sapiens
atctcttcctg

SEQ ID NO: 4949885 - DNA, 12 bp, Homo sapiens
atctcttcctgt

SEQ ID NO: 4949886 - DNA, 15 bp, Homo sapiens
atctcttgaggccag

SEQ ID NO: 4949887 - DNA, 17 bp, Homo sapiens
atctctttcacattgtt

SEQ ID NO: 4949888 - DNA, 20 bp, Homo sapiens
atctctttgtacaggaactg

SEQ ID NO: 4949889 - DNA, 13 bp, Homo sapiens
atctgaaattcta

SEQ ID NO: 4949890 - DNA, 18 bp, Homo sapiens
atctgaagccctcccagg

SEQ ID NO: 4949891 - DNA, 23 bp, Homo sapiens
atctgaagcttcactcactgtca

SEQ ID NO: 4949892 - DNA, 17 bp, Homo sapiens
atctgatctgagtgaga

SEQ ID NO: 4949893 - DNA, 19 bp, Homo sapiens
atctgatttgcatattcat

SEQ ID NO: 4949894 - DNA, 23 bp, Homo sapiens
atctgcattttcaccccaccctt

SEQ ID NO: 4949895 - DNA, 12 bp, Homo sapiens
atctgcccctcc

SEQ ID NO: 4949896 - DNA, 17 bp, Homo sapiens
atctgcccctcccccaa

SEQ ID NO: 4949897 - DNA, 14 bp, Homo sapiens
atctgcttttatta

SEQ ID NO: 4949898 - DNA, 16 bp, Homo sapiens
atctgcttttattaaa

SEQ ID NO: 4949899 - DNA, 21 bp, Homo sapiens
atctggaaacctctacatatt

SEQ ID NO: 4949900 - DNA, 22 bp, Homo sapiens
atctggactcctctgtccaggc

SEQ ID NO: 4949901 - DNA, 21 bp, Homo sapiens
atctggagaccagggagcctt

SEQ ID NO: 4949902 - DNA, 17 bp, Homo sapiens
atctggaggccttccag

SEQ ID NO: 4949903 - DNA, 21 bp, Homo sapiens
atctggaggccttccagctgc

SEQ ID NO: 4949904 - DNA, 21 bp, Homo sapiens
atctggcctaaaatcttggaa

SEQ ID NO: 4949905 - DNA, 20 bp, Homo sapiens
atgacatctttttaaagctt

SEQ ID NO: 4949906 - DNA, 19 bp, Homo sapiens
atgccgatatactctagat

SEQ ID NO: 4949907 - DNA, 22 bp, Homo sapiens
atgcctctgatatgggactgag

SEQ ID NO: 4949908 - DNA, 12 bp, Homo sapiens
atgcctggtggc

SEQ ID NO: 4949909 - DNA, 13 bp, Homo sapiens
atgcctggtggca

SEQ ID NO: 4949910 - DNA, 14 bp, Homo sapiens
atgcctggtggcag

SEQ ID NO: 4949911 - DNA, 16 bp, Homo sapiens
atgcctggtggcagct

SEQ ID NO: 4949912 - DNA, 18 bp, Homo sapiens
atgcctgtccagcctggg

SEQ ID NO: 4949913 - DNA, 22 bp, Homo sapiens
atgcctgtggaagagtgtgtgt

SEQ ID NO: 4949914 - DNA, 14 bp, Homo sapiens
atgccttcttattg

SEQ ID NO: 4949915 - DNA, 20 bp, Homo sapiens
atgccttcttattgctttta

SEQ ID NO: 4949916 - DNA, 12 bp, Homo sapiens
atgccttgtgct

SEQ ID NO: 4949917 - DNA, 19 bp, Homo sapiens
atgccttgtgctgttaata

SEQ ID NO: 4949918 - DNA, 12 bp, Homo sapiens
atgcctttgaga

SEQ ID NO: 4949919 - DNA, 13 bp, Homo sapiens
atgcctttgagac

SEQ ID NO: 4949920 - DNA, 14 bp, Homo sapiens
atgcctttgagaca

SEQ ID NO: 4949921 - DNA, 21 bp, Homo sapiens
atgcctttgagacagtttctt

SEQ ID NO: 4949922 - DNA, 22 bp, Homo sapiens
atgcctttgagacagtttctta

SEQ ID NO: 4949923 - DNA, 16 bp, Homo sapiens
atgcgtaaacgacact

SEQ ID NO: 4949924 - DNA, 13 bp, Homo sapiens
atgcgtcccaaga

SEQ ID NO: 4949925 - DNA, 14 bp, Homo sapiens
atgcgttcactcca

SEQ ID NO: 4949926 - DNA, 16 bp, Homo sapiens
atgctaatttaaagag

SEQ ID NO: 4949927 - DNA, 15 bp, Homo sapiens
atgctaggtctcgga

SEQ ID NO: 4949928 - DNA, 18 bp, Homo sapiens
atgctatttttgttttta

SEQ ID NO: 4949929 - DNA, 22 bp, Homo sapiens
atgctatttttgtttttagaat

SEQ ID NO: 4949930 - DNA, 18 bp, Homo sapiens
atgctccaagattctaga

SEQ ID NO: 4949931 - DNA, 21 bp, Homo sapiens
atgctccagcaacacagcctg

SEQ ID NO: 4949932 - DNA, 18 bp, Homo sapiens
atgctccctcccctgccc

SEQ ID NO: 4949933 - DNA, 19 bp, Homo sapiens
atgctccctcccctgccct

SEQ ID NO: 4949934 - DNA, 17 bp, Homo sapiens
atgctctctcaaattgt

SEQ ID NO: 4949935 - DNA, 19 bp, Homo sapiens
atgctctctcaaattgtca

SEQ ID NO: 4949936 - DNA, 23 bp, Homo sapiens
atgctgaatatacagcaggtgct

SEQ ID NO: 4949937 - DNA, 19 bp, Homo sapiens
atgctgactgtactcctcc

SEQ ID NO: 4949938 - DNA, 20 bp, Homo sapiens
atgctgactgtactcctccc

SEQ ID NO: 4949939 - DNA, 12 bp, Homo sapiens
atgctgcctcca

SEQ ID NO: 4949940 - DNA, 23 bp, Homo sapiens
atgctgccttcccatgaatctgt

SEQ ID NO: 4949941 - DNA, 18 bp, Homo sapiens
atgctgccttttctttaa

SEQ ID NO: 4949942 - DNA, 12 bp, Homo sapiens
atgctggagaag

SEQ ID NO: 4949943 - DNA, 23 bp, Homo sapiens
atgctggccagcctggggcctgg

SEQ ID NO: 4949944 - DNA, 20 bp, Homo sapiens
atgctggctgttggctgggg

SEQ ID NO: 4949945 - DNA, 12 bp, Homo sapiens
atgctgtacatc

SEQ ID NO: 4949946 - DNA, 18 bp, Homo sapiens
atgctgtgctaaatatca

SEQ ID NO: 4949947 - DNA, 18 bp, Homo sapiens
atgctgttctcttcttca

SEQ ID NO: 4949948 - DNA, 14 bp, Homo sapiens
atgcttaatttcta

SEQ ID NO: 4949949 - DNA, 19 bp, Homo sapiens
atgcttatcatctaaagat

SEQ ID NO: 4949950 - DNA, 19 bp, Homo sapiens
atgcttcatatgaggagga

SEQ ID NO: 4949951 - DNA, 22 bp, Homo sapiens
atgcttctcatcttgtgaaatg

SEQ ID NO: 4949952 - DNA, 19 bp, Homo sapiens
atgcttgtgaaaatgtgtt

SEQ ID NO: 4949953 - DNA, 16 bp, Homo sapiens
atgctttttatttctg

SEQ ID NO: 4949954 - DNA, 16 bp, Homo sapiens
atgctttttgaatgtt

SEQ ID NO: 4949955 - DNA, 13 bp, Homo sapiens
atggaaacctcac

SEQ ID NO: 4949956 - DNA, 16 bp, Homo sapiens
atggaaacctgaaaaa

SEQ ID NO: 4949957 - DNA, 23 bp, Homo sapiens
atggaaacctgaaaaaaagttta

SEQ ID NO: 4949958 - DNA, 22 bp, Homo sapiens
atggaactcagctgtctgtggc

SEQ ID NO: 4949959 - DNA, 18 bp, Homo sapiens
atggaacttctaatatat

SEQ ID NO: 4949960 - DNA, 13 bp, Homo sapiens
atggaagagaaat

SEQ ID NO: 4949961 - DNA, 16 bp, Homo sapiens
atggaataactctgtg

SEQ ID NO: 4949962 - DNA, 17 bp, Homo sapiens
atggaatgctgtgttaa

SEQ ID NO: 4949963 - DNA, 15 bp, Homo sapiens
atggaattgatttgc

SEQ ID NO: 4949964 - DNA, 20 bp, Homo sapiens
atggacatcctgtataagca

SEQ ID NO: 4949965 - DNA, 14 bp, Homo sapiens
atggacatggtggc

SEQ ID NO: 4949966 - DNA, 15 bp, Homo sapiens
atggaccactgtttc

SEQ ID NO: 4949967 - DNA, 21 bp, Homo sapiens
atggaccactgtttcttgctt

SEQ ID NO: 4949968 - DNA, 15 bp, Homo sapiens
atggaccttctagaa

SEQ ID NO: 4949969 - DNA, 21 bp, Homo sapiens
atggactaaccccaacgcaca

SEQ ID NO: 4949970 - DNA, 20 bp, Homo sapiens
atggacttatttcttcaaat

SEQ ID NO: 4949971 - DNA, 17 bp, Homo sapiens
atggactttataagcca

SEQ ID NO: 4949972 - DNA, 15 bp, Homo sapiens
atggactttggaagc

SEQ ID NO: 4949973 - DNA, 17 bp, Homo sapiens
atggagaattgctgaag

SEQ ID NO: 4949974 - DNA, 21 bp, Homo sapiens
atggagactggtcctgtgtgc

SEQ ID NO: 4949975 - DNA, 23 bp, Homo sapiens
atggagccagctccctctattta

SEQ ID NO: 4949976 - DNA, 16 bp, Homo sapiens
atggaggaaaaccaag

SEQ ID NO: 4949977 - DNA, 20 bp, Homo sapiens
atggaggccctcctgtgctg

SEQ ID NO: 4949978 - DNA, 15 bp, Homo sapiens
atggaggttctaagg

SEQ ID NO: 4949979 - DNA, 21 bp, Homo sapiens
atggataaaataatgctgcaa

SEQ ID NO: 4949980 - DNA, 19 bp, Homo sapiens
atggatactacatctttaa

SEQ ID NO: 4949981 - DNA, 16 bp, Homo sapiens
atggatagagaagaaa

SEQ ID NO: 4949982 - DNA, 18 bp, Homo sapiens
atggatattattagaaat

SEQ ID NO: 4949983 - DNA, 21 bp, Homo sapiens
atggatgaatctcccactcca

SEQ ID NO: 4949984 - DNA, 13 bp, Homo sapiens
atggatgattcag

SEQ ID NO: 4949985 - DNA, 21 bp, Homo sapiens
atggatgattcagaaattgga

SEQ ID NO: 4949986 - DNA, 13 bp, Homo sapiens
atggatgccaata

SEQ ID NO: 4949987 - DNA, 23 bp, Homo sapiens
atggatgccaatattaaatctgc

SEQ ID NO: 4949988 - DNA, 20 bp, Homo sapiens
atggattggattatttaata

SEQ ID NO: 4949989 - DNA, 22 bp, Homo sapiens
atggattggattatttaataac

SEQ ID NO: 4949990 - DNA, 16 bp, Homo sapiens
atggattgttaatttc

SEQ ID NO: 4949991 - DNA, 21 bp, Homo sapiens
atggcagaaaaaatgtctgta

SEQ ID NO: 4949992 - DNA, 22 bp, Homo sapiens
atggcagaagacaccagagcag

SEQ ID NO: 4949993 - DNA, 24 bp, Homo sapiens
atggcagaagacaccagagcagat

SEQ ID NO: 4949994 - DNA, 20 bp, Homo sapiens
atggcagagtttgtgtgttg

SEQ ID NO: 4949995 - DNA, 22 bp, Homo sapiens
atggcagagtttgtgtgttgtc

SEQ ID NO: 4949996 - DNA, 18 bp, Homo sapiens
atggccaggatcctctcc

SEQ ID NO: 4949997 - DNA, 18 bp, Homo sapiens
atggcccctctgacctgc

SEQ ID NO: 4949998 - DNA, 18 bp, Homo sapiens
atggctactttggtttct

SEQ ID NO: 4949999 - DNA, 22 bp, Homo sapiens
atggctactttggtttctgtct

SEQ ID NO: 4950000 - DNA, 14 bp, Homo sapiens
atggctatgcttaa

SEQ ID NO: 4950001 - DNA, 17 bp, Homo sapiens
atggctccagaaatgtc

SEQ ID NO: 4950002 - DNA, 17 bp, Homo sapiens
atggctcccacaggagt

SEQ ID NO: 4950003 - DNA, 23 bp, Homo sapiens
atggctcccctttttcttcctca

SEQ ID NO: 4950004 - DNA, 23 bp, Homo sapiens
atggctccgaacaccctcgaagc

SEQ ID NO: 4950005 - DNA, 17 bp, Homo sapiens
atggctctggactctaa

SEQ ID NO: 4950006 - DNA, 15 bp, Homo sapiens
atggctgcagtcctc

SEQ ID NO: 4950007 - DNA, 15 bp, Homo sapiens
atggctgtgcctctg

SEQ ID NO: 4950008 - DNA, 18 bp, Homo sapiens
atggctgtgcctctgcct

SEQ ID NO: 4950009 - DNA, 19 bp, Homo sapiens
atggctgtgcctctgcctg

SEQ ID NO: 4950010 - DNA, 15 bp, Homo sapiens
atggctttcagaaaa

SEQ ID NO: 4950011 - DNA, 21 bp, Homo sapiens
atggctttcagaaaacgggaa

SEQ ID NO: 4950012 - DNA, 16 bp, Homo sapiens
atgggaataattgctt

SEQ ID NO: 4950013 - DNA, 22 bp, Homo sapiens
atgggagccccagggtcttccc

SEQ ID NO: 4950014 - DNA, 15 bp, Homo sapiens
atgggagctcctctc

SEQ ID NO: 4950015 - DNA, 20 bp, Homo sapiens
atgggagctcctctcctgga

SEQ ID NO: 4950016 - DNA, 21 bp, Homo sapiens
atgggagctcctctcctggag

SEQ ID NO: 4950017 - DNA, 22 bp, Homo sapiens
atgggagctcctctcctggagg

SEQ ID NO: 4950018 - DNA, 23 bp, Homo sapiens
atgggagctcctctcctggagga

SEQ ID NO: 4950019 - DNA, 24 bp, Homo sapiens
atgggagctcctctcctggaggat

SEQ ID NO: 4950020 - DNA, 19 bp, Homo sapiens
atgggcaacccccagcctg

SEQ ID NO: 4950021 - DNA, 14 bp, Homo sapiens
atgggcattgacaa

SEQ ID NO: 4950022 - DNA, 15 bp, Homo sapiens
atgggcctcctgtgt

SEQ ID NO: 4950023 - DNA, 15 bp, Homo sapiens
atgggctcttccaac

SEQ ID NO: 4950024 - DNA, 15 bp, Homo sapiens
atgggcttcactgta

SEQ ID NO: 4950025 - DNA, 17 bp, Homo sapiens
atggggaggcaagtgtg

SEQ ID NO: 4950026 - DNA, 22 bp, Homo sapiens
atggggataaaatgactactta

SEQ ID NO: 4950027 - DNA, 17 bp, Homo sapiens
atgggggcactgaggac

SEQ ID NO: 4950028 - DNA, 19 bp, Homo sapiens
atggggtggggtagggctg

SEQ ID NO: 4950029 - DNA, 16 bp, Homo sapiens
atgggttggtgcttct

SEQ ID NO: 4950030 - DNA, 18 bp, Homo sapiens
atggtaggcatttcctat

SEQ ID NO: 4950031 - DNA, 18 bp, Homo sapiens
atggtcacacactgatgc

SEQ ID NO: 4950032 - DNA, 20 bp, Homo sapiens
atggtcacacactgatgctt

SEQ ID NO: 4950033 - DNA, 15 bp, Homo sapiens
atggtcgcccaggag

SEQ ID NO: 4950034 - DNA, 16 bp, Homo sapiens
atggtcgcccaggaga

SEQ ID NO: 4950035 - DNA, 14 bp, Homo sapiens
atggtctaaaaata

SEQ ID NO: 4950036 - DNA, 12 bp, Homo sapiens
atggtgaaaatg

SEQ ID NO: 4950037 - DNA, 14 bp, Homo sapiens
atggtgaaaatgta

SEQ ID NO: 4950038 - DNA, 18 bp, Homo sapiens
atggtgtaataagacata

SEQ ID NO: 4950039 - DNA, 23 bp, Homo sapiens
atggttaagagtccaagaatcca

SEQ ID NO: 4950040 - DNA, 17 bp, Homo sapiens
atggttacaaactacag

SEQ ID NO: 4950041 - DNA, 16 bp, Homo sapiens
atggttatgaaagaat

SEQ ID NO: 4950042 - DNA, 20 bp, Homo sapiens
atggttcccctgttcactct

SEQ ID NO: 4950043 - DNA, 18 bp, Homo sapiens
atggttgccttaaagaaa

SEQ ID NO: 4950044 - DNA, 11 bp, Homo sapiens
atgtaaaaaag

SEQ ID NO: 4950045 - DNA, 21 bp, Homo sapiens
atgtaaaaggtattaaattga

SEQ ID NO: 4950046 - DNA, 12 bp, Homo sapiens
atgtaaaatgat

SEQ ID NO: 4950047 - DNA, 16 bp, Homo sapiens
atgtaaagaaatgtct

SEQ ID NO: 4950048 - DNA, 17 bp, Homo sapiens
atgtaaatagtgcagaa

SEQ ID NO: 4950049 - DNA, 15 bp, Homo sapiens
atgtaaatattctat

SEQ ID NO: 4950050 - DNA, 17 bp, Homo sapiens
atgtaacttttgtaaga

SEQ ID NO: 4950051 - DNA, 19 bp, Homo sapiens
atgtaagattatagattct

SEQ ID NO: 4950052 - DNA, 20 bp, Homo sapiens
atgtaatctctctgcagctg

SEQ ID NO: 4950053 - DNA, 21 bp, Homo sapiens
atgtaatctctctgcagctgc

SEQ ID NO: 4950054 - DNA, 22 bp, Homo sapiens
atgtaatctctctgcagctgcc

SEQ ID NO: 4950055 - DNA, 23 bp, Homo sapiens
atgtaatctctctgcagctgccg

SEQ ID NO: 4950056 - DNA, 17 bp, Homo sapiens
atgtaatgaagtaaagc

SEQ ID NO: 4950057 - DNA, 22 bp, Homo sapiens
atgtaatgaagtaaagccatta

SEQ ID NO: 4950058 - DNA, 21 bp, Homo sapiens
atgtaatgtgtggtggcctca

SEQ ID NO: 4950059 - DNA, 22 bp, Homo sapiens
atgtaatgtgtggtggcctcag

SEQ ID NO: 4950060 - DNA, 22 bp, Homo sapiens
atgtaatttagggtactaaatt

SEQ ID NO: 4950061 - DNA, 15 bp, Homo sapiens
atgtaccatttgcat

SEQ ID NO: 4950062 - DNA, 16 bp, Homo sapiens
atgtaccgtaggcttt

SEQ ID NO: 4950063 - DNA, 21 bp, Homo sapiens
atgtacgtttgtatgtgtgta

SEQ ID NO: 4950064 - DNA, 22 bp, Homo sapiens
atgtactagtactgtgtactgt

SEQ ID NO: 4950065 - DNA, 16 bp, Homo sapiens
atgtactgtactaatt

SEQ ID NO: 4950066 - DNA, 20 bp, Homo sapiens
atgtactgtactaattctta

SEQ ID NO: 4950067 - DNA, 16 bp, Homo sapiens
atgtagatatttggct

SEQ ID NO: 4950068 - DNA, 18 bp, Homo sapiens
atgtagccccctggcctc

SEQ ID NO: 4950069 - DNA, 21 bp, Homo sapiens
atgtagccccctggcctctgt

SEQ ID NO: 4950070 - DNA, 23 bp, Homo sapiens
atgtagccccctggcctctgtgc

SEQ ID NO: 4950071 - DNA, 23 bp, Homo sapiens
atgtaggagctgccttggctcag

SEQ ID NO: 4950072 - DNA, 19 bp, Homo sapiens
atgtagtataaagaaaagt

SEQ ID NO: 4950073 - DNA, 17 bp, Homo sapiens
atgtagttgatgtatcc

SEQ ID NO: 4950074 - DNA, 22 bp, Homo sapiens
atgtagttgatgtatccaacaa

SEQ ID NO: 4950075 - DNA, 14 bp, Homo sapiens
atgtataaatgtga

SEQ ID NO: 4950076 - DNA, 12 bp, Homo sapiens
atgtatatacac

SEQ ID NO: 4950077 - DNA, 13 bp, Homo sapiens
atgtatatacaca

SEQ ID NO: 4950078 - DNA, 16 bp, Homo sapiens
atgtatatacacatat

SEQ ID NO: 4950079 - DNA, 14 bp, Homo sapiens
atgtatatatttag

SEQ ID NO: 4950080 - DNA, 16 bp, Homo sapiens
atgtatatgtgttcat

SEQ ID NO: 4950081 - DNA, 21 bp, Homo sapiens
atgtatatttttttaatttaa

SEQ ID NO: 4950082 - DNA, 12 bp, Homo sapiens
atgtatcatctg

SEQ ID NO: 4950083 - DNA, 21 bp, Homo sapiens
atgtatcccttctcacagcac

SEQ ID NO: 4950084 - DNA, 13 bp, Homo sapiens
atgtatgaaggct

SEQ ID NO: 4950085 - DNA, 15 bp, Homo sapiens
atgtattatttataa

SEQ ID NO: 4950086 - DNA, 16 bp, Homo sapiens
atgtattatttataat

SEQ ID NO: 4950087 - DNA, 17 bp, Homo sapiens
atgtattatttataatt

SEQ ID NO: 4950088 - DNA, 19 bp, Homo sapiens
atgtattgtaaacatgtgt

SEQ ID NO: 4950089 - DNA, 23 bp, Homo sapiens
atgtatttttctacattattgct

SEQ ID NO: 4950090 - DNA, 21 bp, Homo sapiens
atgtcaaacatgagatgtgtg

SEQ ID NO: 4950091 - DNA, 14 bp, Homo sapiens
atgtcacaggcagg

SEQ ID NO: 4950092 - DNA, 17 bp, Homo sapiens
atgtcacaggcaggtcc

SEQ ID NO: 4950093 - DNA, 23 bp, Homo sapiens
atgtcagacatccatgtttgtaa

SEQ ID NO: 4950094 - DNA, 24 bp, Homo sapiens
atgtcagtatttcagtgtagttaa

SEQ ID NO: 4950095 - DNA, 15 bp, Homo sapiens
atgtccaaagaggct

SEQ ID NO: 4950096 - DNA, 16 bp, Homo sapiens
atgtccaaagaggctg

SEQ ID NO: 4950097 - DNA, 18 bp, Homo sapiens
atgtccaaagaggctgcc

SEQ ID NO: 4950098 - DNA, 16 bp, Homo sapiens
atgtccactgtgtata

SEQ ID NO: 4950099 - DNA, 23 bp, Homo sapiens
atgtcccttgatgcacagagaag

SEQ ID NO: 4950100 - DNA, 20 bp, Homo sapiens
atgtcccttttcctaagtca

SEQ ID NO: 4950101 - DNA, 15 bp, Homo sapiens
atgtcctatgtgtga

SEQ ID NO: 4950102 - DNA, 21 bp, Homo sapiens
atgtcctcagcatttcttttc

SEQ ID NO: 4950103 - DNA, 22 bp, Homo sapiens
atgtcctccagaagcctctggc

SEQ ID NO: 4950104 - DNA, 12 bp, Homo sapiens
atgtctaaaatt

SEQ ID NO: 4950105 - DNA, 14 bp, Homo sapiens
atgtctatttaagc

SEQ ID NO: 4950106 - DNA, 23 bp, Homo sapiens
atgtctatttaagcctcatattt

SEQ ID NO: 4950107 - DNA, 17 bp, Homo sapiens
atgtctcaggtccctgc

SEQ ID NO: 4950108 - DNA, 15 bp, Homo sapiens
atgtctcgctagtga

SEQ ID NO: 4950109 - DNA, 15 bp, Homo sapiens
atgtctctaaagcac

SEQ ID NO: 4950110 - DNA, 12 bp, Homo sapiens
atgtctgtaaat

SEQ ID NO: 4950111 - DNA, 16 bp, Homo sapiens
atgtctgttgatgact

SEQ ID NO: 4950112 - DNA, 19 bp, Homo sapiens
atgtctgtttaagaaaagt

SEQ ID NO: 4950113 - DNA, 17 bp, Homo sapiens
atgtcttaatttttgaa

SEQ ID NO: 4950114 - DNA, 22 bp, Homo sapiens
atgtcttccatgtatcttttga

SEQ ID NO: 4950115 - DNA, 20 bp, Homo sapiens
atgtcttggacactgtacaa

SEQ ID NO: 4950116 - DNA, 15 bp, Homo sapiens
atgtctttgtaagtc

SEQ ID NO: 4950117 - DNA, 21 bp, Homo sapiens
atgtctttgtaagtcagtgtt

SEQ ID NO: 4950118 - DNA, 18 bp, Homo sapiens
atgtcttttagaagatag

SEQ ID NO: 4950119 - DNA, 14 bp, Homo sapiens
atgtcttttatagt

SEQ ID NO: 4950120 - DNA, 16 bp, Homo sapiens
atgtcttttatatttg

SEQ ID NO: 4950121 - DNA, 17 bp, Homo sapiens
atgtcttttatatttgt

SEQ ID NO: 4950122 - DNA, 22 bp, Homo sapiens
atgtcttttatatttgtatcga

SEQ ID NO: 4950123 - DNA, 13 bp, Homo sapiens
atgtgaaaccttt

SEQ ID NO: 4950124 - DNA, 15 bp, Homo sapiens
atgtgaaaccttttt

SEQ ID NO: 4950125 - DNA, 20 bp, Homo sapiens
atgtgaaaccttttttaaga

SEQ ID NO: 4950126 - DNA, 16 bp, Homo sapiens
agttggttgtgtcttt

SEQ ID NO: 4950127 - DNA, 17 bp, Homo sapiens
agttgtaacttatattg

SEQ ID NO: 4950128 - DNA, 16 bp, Homo sapiens
agttgtagcagattgt

SEQ ID NO: 4950129 - DNA, 14 bp, Homo sapiens
agttgtgaaagttt

SEQ ID NO: 4950130 - DNA, 13 bp, Homo sapiens
agttgtgatcatc

SEQ ID NO: 4950131 - DNA, 15 bp, Homo sapiens
agttgtgcacgcaga

SEQ ID NO: 4950132 - DNA, 21 bp, Homo sapiens
agttgtgccttttatagctat

SEQ ID NO: 4950133 - DNA, 15 bp, Homo sapiens
agtttaaaacacatt

SEQ ID NO: 4950134 - DNA, 16 bp, Homo sapiens
agtttacaagtgtata

SEQ ID NO: 4950135 - DNA, 19 bp, Homo sapiens
agtttacaagtgtatatca

SEQ ID NO: 4950136 - DNA, 13 bp, Homo sapiens
agtttacagaaaa

SEQ ID NO: 4950137 - DNA, 18 bp, Homo sapiens
agtttacagaaaaatctt

SEQ ID NO: 4950138 - DNA, 15 bp, Homo sapiens
agtttacattgtaaa

SEQ ID NO: 4950139 - DNA, 20 bp, Homo sapiens
agtttacctctttaaaaaca

SEQ ID NO: 4950140 - DNA, 21 bp, Homo sapiens
agtttagatttcaagaaaaaa

SEQ ID NO: 4950141 - DNA, 16 bp, Homo sapiens
agtttatttttaaaga

SEQ ID NO: 4950142 - DNA, 21 bp, Homo sapiens
agtttcaaacttactattttg

SEQ ID NO: 4950143 - DNA, 14 bp, Homo sapiens
agtttcagatatat

SEQ ID NO: 4950144 - DNA, 22 bp, Homo sapiens
agtttcagcttaaaataaacag

SEQ ID NO: 4950145 - DNA, 16 bp, Homo sapiens
agtttcaggtgacatg

SEQ ID NO: 4950146 - DNA, 22 bp, Homo sapiens
agtttcaggtgacatgtgaaac

SEQ ID NO: 4950147 - DNA, 18 bp, Homo sapiens
agtttcatgtacaagatg

SEQ ID NO: 4950148 - DNA, 21 bp, Homo sapiens
agtttcatgtacaagatgaag

SEQ ID NO: 4950149 - DNA, 17 bp, Homo sapiens
agtttcattctcctgcc

SEQ ID NO: 4950150 - DNA, 20 bp, Homo sapiens
agtttccatagcaacaggaa

SEQ ID NO: 4950151 - DNA, 20 bp, Homo sapiens
agtttcgtttctgtttttta

SEQ ID NO: 4950152 - DNA, 12 bp, Homo sapiens
agtttctaaggt

SEQ ID NO: 4950153 - DNA, 23 bp, Homo sapiens
agtttctaaggtccggtgttcta

SEQ ID NO: 4950154 - DNA, 14 bp, Homo sapiens
agtttcttagcttt

SEQ ID NO: 4950155 - DNA, 17 bp, Homo sapiens
agtttcttagcttttta

SEQ ID NO: 4950156 - DNA, 21 bp, Homo sapiens
agtttcttctgcgcctcaggc

SEQ ID NO: 4950157 - DNA, 13 bp, Homo sapiens
agtttctttggga

SEQ ID NO: 4950158 - DNA, 20 bp, Homo sapiens
agtttgatgtcattaatgtg

SEQ ID NO: 4950159 - DNA, 12 bp, Homo sapiens
agtttgccctgg

SEQ ID NO: 4950160 - DNA, 11 bp, Homo sapiens
agtttgcttag

SEQ ID NO: 4950161 - DNA, 14 bp, Homo sapiens
agtttgcttagaaa

SEQ ID NO: 4950162 - DNA, 18 bp, Homo sapiens
agtttgtacatgcattca

SEQ ID NO: 4950163 - DNA, 20 bp, Homo sapiens
agtttgtaggtaaaatgtat

SEQ ID NO: 4950164 - DNA, 16 bp, Homo sapiens
agtttgtcctgtagag

SEQ ID NO: 4950165 - DNA, 16 bp, Homo sapiens
agtttgtctattttaa

SEQ ID NO: 4950166 - DNA, 15 bp, Homo sapiens
agtttgtgtgtctta

SEQ ID NO: 4950167 - DNA, 16 bp, Homo sapiens
agtttgtgtgtcttaa

SEQ ID NO: 4950168 - DNA, 16 bp, Homo sapiens
agtttgtgtgttgtct

SEQ ID NO: 4950169 - DNA, 21 bp, Homo sapiens
agttttatgctcttttttact

SEQ ID NO: 4950170 - DNA, 24 bp, Homo sapiens
agttttatgctcttttttactcat

SEQ ID NO: 4950171 - DNA, 13 bp, Homo sapiens
agttttctccttt

SEQ ID NO: 4950172 - DNA, 17 bp, Homo sapiens
agttttctccttttact

SEQ ID NO: 4950173 - DNA, 16 bp, Homo sapiens
agttttgaaaagctat

SEQ ID NO: 4950174 - DNA, 18 bp, Homo sapiens
agttttgagtagatatta

SEQ ID NO: 4950175 - DNA, 21 bp, Homo sapiens
agttttgagtagatattactt

SEQ ID NO: 4950176 - DNA, 22 bp, Homo sapiens
agttttgagtagatattacttt

SEQ ID NO: 4950177 - DNA, 23 bp, Homo sapiens
agtttttcaggagcgcaagatag

SEQ ID NO: 4950178 - DNA, 13 bp, Homo sapiens
agtttttctgtca

SEQ ID NO: 4950179 - DNA, 11 bp, Homo sapiens
ataaaaaataa

SEQ ID NO: 4950180 - DNA, 12 bp, Homo sapiens
ataaaaaatgga

SEQ ID NO: 4950181 - DNA, 13 bp, Homo sapiens
ataaaaacttgaa

SEQ ID NO: 4950182 - DNA, 20 bp, Homo sapiens
ataaaaagacattcttccaa

SEQ ID NO: 4950183 - DNA, 20 bp, Homo sapiens
ataaaaagcctgcaatttca

SEQ ID NO: 4950184 - DNA, 22 bp, Homo sapiens
ataaaaagcctgcaatttcata

SEQ ID NO: 4950185 - DNA, 19 bp, Homo sapiens
ataaaaaggacatcagcaa

SEQ ID NO: 4950186 - DNA, 20 bp, Homo sapiens
ataaaaagtggaatttcttg

SEQ ID NO: 4950187 - DNA, 16 bp, Homo sapiens
ataaaaatatgtacaa

SEQ ID NO: 4950188 - DNA, 14 bp, Homo sapiens
ataaaaatattgtg

SEQ ID NO: 4950189 - DNA, 14 bp, Homo sapiens
ataaaacagctttg

SEQ ID NO: 4950190 - DNA, 11 bp, Homo sapiens
ataaaaccttt

SEQ ID NO: 4950191 - DNA, 15 bp, Homo sapiens
ataaaagattcacct

SEQ ID NO: 4950192 - DNA, 19 bp, Homo sapiens
ataaaagctgaagttactt

SEQ ID NO: 4950193 - DNA, 19 bp, Homo sapiens
ataaaaggcaaatgtgtac

SEQ ID NO: 4950194 - DNA, 20 bp, Homo sapiens
ataaaagggggtccgtggaa

SEQ ID NO: 4950195 - DNA, 17 bp, Homo sapiens
ataaaataattctaaag

SEQ ID NO: 4950196 - DNA, 18 bp, Homo sapiens
ataaaataattctaaagg

SEQ ID NO: 4950197 - DNA, 16 bp, Homo sapiens
ataaaatcaattttta

SEQ ID NO: 4950198 - DNA, 16 bp, Homo sapiens
ataaaatgactactta

SEQ ID NO: 4950199 - DNA, 13 bp, Homo sapiens
ataaaattagaaa

SEQ ID NO: 4950200 - DNA, 16 bp, Homo sapiens
ataaaattagaaagca

SEQ ID NO: 4950201 - DNA, 16 bp, Homo sapiens
ataaaattttgctttt

SEQ ID NO: 4950202 - DNA, 20 bp, Homo sapiens
ataaacagactgttaattat

SEQ ID NO: 4950203 - DNA, 15 bp, Homo sapiens
ataaacagatgaata

SEQ ID NO: 4950204 - DNA, 21 bp, Homo sapiens
ataaacatccttcaagaactc

SEQ ID NO: 4950205 - DNA, 15 bp, Homo sapiens
ataaacattaaatgt

SEQ ID NO: 4950206 - DNA, 17 bp, Homo sapiens
ataaacattaaatgtct

SEQ ID NO: 4950207 - DNA, 16 bp, Homo sapiens
ataaactgtgtttact

SEQ ID NO: 4950208 - DNA, 21 bp, Homo sapiens
ataaactgtttcagatttttt

SEQ ID NO: 4950209 - DNA, 12 bp, Homo sapiens
ataaacttcagc

SEQ ID NO: 4950210 - DNA, 16 bp, Homo sapiens
ataaactttttttcaa

SEQ ID NO: 4950211 - DNA, 17 bp, Homo sapiens
ataaactttttttcaat

SEQ ID NO: 4950212 - DNA, 14 bp, Homo sapiens
ataaagacaaccat

SEQ ID NO: 4950213 - DNA, 12 bp, Homo sapiens
ataaagacacct

SEQ ID NO: 4950214 - DNA, 14 bp, Homo sapiens
ataaagcacagctg

SEQ ID NO: 4950215 - DNA, 14 bp, Homo sapiens
ataaagcataagta

SEQ ID NO: 4950216 - DNA, 20 bp, Homo sapiens
ataaagcataagtatacagt

SEQ ID NO: 4950217 - DNA, 22 bp, Homo sapiens
ataaagcctcaaggttttaggt

SEQ ID NO: 4950218 - DNA, 17 bp, Homo sapiens
ataaagcgatatacaga

SEQ ID NO: 4950219 - DNA, 19 bp, Homo sapiens
ataaagcgatatacagatg

SEQ ID NO: 4950220 - DNA, 14 bp, Homo sapiens
ataaaggactgtaa

SEQ ID NO: 4950221 - DNA, 13 bp, Homo sapiens
ataaaggatgtga

SEQ ID NO: 4950222 - DNA, 21 bp, Homo sapiens
ataaaggatgtgattgtggaa

SEQ ID NO: 4950223 - DNA, 13 bp, Homo sapiens
ataaagtacttga

SEQ ID NO: 4950224 - DNA, 11 bp, Homo sapiens
ataaagtatag

SEQ ID NO: 4950225 - DNA, 16 bp, Homo sapiens
ataaataggagaggat

SEQ ID NO: 4950226 - DNA, 14 bp, Homo sapiens
ataaatatgcagtg

SEQ ID NO: 4950227 - DNA, 20 bp, Homo sapiens
ataaatatttgacttgcatg

SEQ ID NO: 4950228 - DNA, 18 bp, Homo sapiens
ataaatatttttgccata

SEQ ID NO: 4950229 - DNA, 14 bp, Homo sapiens
ataaatcatattga

SEQ ID NO: 4950230 - DNA, 21 bp, Homo sapiens
ataaatcatattgatgaaaag

SEQ ID NO: 4950231 - DNA, 11 bp, Homo sapiens
ataaatgaagc

SEQ ID NO: 4950232 - DNA, 18 bp, Homo sapiens
ataaatgaagcagcttta

SEQ ID NO: 4950233 - DNA, 12 bp, Homo sapiens
ataaatgagcaa

SEQ ID NO: 4950234 - DNA, 14 bp, Homo sapiens
ataaatggaaatca

SEQ ID NO: 4950235 - DNA, 15 bp, Homo sapiens
ataaatggaaatcat

SEQ ID NO: 4950236 - DNA, 19 bp, Homo sapiens
ataaatgtaaaaataataa

SEQ ID NO: 4950237 - DNA, 14 bp, Homo sapiens
ataaatgtatatac

SEQ ID NO: 4950238 - DNA, 17 bp, Homo sapiens
ataaattgcataaagca

SEQ ID NO: 4950239 - DNA, 14 bp, Homo sapiens
ataacaaaatggac

SEQ ID NO: 4950240 - DNA, 14 bp, Homo sapiens
ataacaacttcata

SEQ ID NO: 4950241 - DNA, 16 bp, Homo sapiens
ataacaatgtgctctc

SEQ ID NO: 4950242 - DNA, 11 bp, Homo sapiens
ataacacacat

SEQ ID NO: 4950243 - DNA, 16 bp, Homo sapiens
ataacagatacatttc

SEQ ID NO: 4950244 - DNA, 16 bp, Homo sapiens
ataacagtaaatgtgc

SEQ ID NO: 4950245 - DNA, 16 bp, Homo sapiens
ataacgtgatacattt

SEQ ID NO: 4950246 - DNA, 17 bp, Homo sapiens
ataacgtttttccttta

SEQ ID NO: 4950247 - DNA, 21 bp, Homo sapiens
ataactctgtaaaaacactga

SEQ ID NO: 4950248 - DNA, 16 bp, Homo sapiens
ataactgtttatatgt

SEQ ID NO: 4950249 - DNA, 21 bp, Homo sapiens
ataactgtttatatgtgttga

SEQ ID NO: 4950250 - DNA, 15 bp, Homo sapiens
ataacttattgctga

SEQ ID NO: 4950251 - DNA, 12 bp, Homo sapiens
ataacttcagtc

SEQ ID NO: 4950252 - DNA, 22 bp, Homo sapiens
ataacttcagtcctgctccaga

SEQ ID NO: 4950253 - DNA, 17 bp, Homo sapiens
ataacttcttaaaagtt

SEQ ID NO: 4950254 - DNA, 22 bp, Homo sapiens
agtgggccagggctgccctgag

SEQ ID NO: 4950255 - DNA, 22 bp, Homo sapiens
agtgggcttgattctgcagtaa

SEQ ID NO: 4950256 - DNA, 13 bp, Homo sapiens
agtggggcctgtg

SEQ ID NO: 4950257 - DNA, 15 bp, Homo sapiens
agtggggcctgtgga

SEQ ID NO: 4950258 - DNA, 19 bp, Homo sapiens
agtggggttatctctgtgt

SEQ ID NO: 4950259 - DNA, 21 bp, Homo sapiens
agtggggttatctctgtgtta

SEQ ID NO: 4950260 - DNA, 19 bp, Homo sapiens
agtgggtgagatgctggag

SEQ ID NO: 4950261 - DNA, 13 bp, Homo sapiens
agtggtctttgta

SEQ ID NO: 4950262 - DNA, 24 bp, Homo sapiens
agtggtctttgtaagagtgtagaa

SEQ ID NO: 4950263 - DNA, 19 bp, Homo sapiens
agtggttgttagttataga

SEQ ID NO: 4950264 - DNA, 22 bp, Homo sapiens
agtggtttccacatgctctgag

SEQ ID NO: 4950265 - DNA, 11 bp, Homo sapiens
agtgtaaaata

SEQ ID NO: 4950266 - DNA, 13 bp, Homo sapiens
agtgtaataagac

SEQ ID NO: 4950267 - DNA, 16 bp, Homo sapiens
agtgtacatagtgtaa

SEQ ID NO: 4950268 - DNA, 17 bp, Homo sapiens
agtgtacttaactattc

SEQ ID NO: 4950269 - DNA, 13 bp, Homo sapiens
agtgtagaagcat

SEQ ID NO: 4950270 - DNA, 15 bp, Homo sapiens
agtgtagttaattta

SEQ ID NO: 4950271 - DNA, 16 bp, Homo sapiens
agtgtagttaatttat

SEQ ID NO: 4950272 - DNA, 21 bp, Homo sapiens
agtgtatggaaataaatgtat

SEQ ID NO: 4950273 - DNA, 22 bp, Homo sapiens
agtgtatggaaataaatgtatc

SEQ ID NO: 4950274 - DNA, 16 bp, Homo sapiens
agtgtatgtcttgtat

SEQ ID NO: 4950275 - DNA, 22 bp, Homo sapiens
agtgtcccccaggttccgaaga

SEQ ID NO: 4950276 - DNA, 16 bp, Homo sapiens
agtgtgaagtacaata

SEQ ID NO: 4950277 - DNA, 17 bp, Homo sapiens
agtgtgaagtacaataa

SEQ ID NO: 4950278 - DNA, 17 bp, Homo sapiens
agtgtgacagggccagt

SEQ ID NO: 4950279 - DNA, 22 bp, Homo sapiens
agtgtgacagggccagtggggc

SEQ ID NO: 4950280 - DNA, 17 bp, Homo sapiens
agtgtggagtgggtaat

SEQ ID NO: 4950281 - DNA, 16 bp, Homo sapiens
agtgtgtatgccaaga

SEQ ID NO: 4950282 - DNA, 14 bp, Homo sapiens
agtgtgtctaaatt

SEQ ID NO: 4950283 - DNA, 17 bp, Homo sapiens
agtgttactttttgtaa

SEQ ID NO: 4950284 - DNA, 20 bp, Homo sapiens
agtgttatttttcaaggaag

SEQ ID NO: 4950285 - DNA, 13 bp, Homo sapiens
agtgttctgtcta

SEQ ID NO: 4950286 - DNA, 17 bp, Homo sapiens
agtgttgaaaatgttca

SEQ ID NO: 4950287 - DNA, 21 bp, Homo sapiens
agtgtttatttttcatattgt

SEQ ID NO: 4950288 - DNA, 21 bp, Homo sapiens
agtgtttcagctaagggaaga

SEQ ID NO: 4950289 - DNA, 12 bp, Homo sapiens
agtgtttctgtt

SEQ ID NO: 4950290 - DNA, 15 bp, Homo sapiens
agtgtttctgttatt

SEQ ID NO: 4950291 - DNA, 21 bp, Homo sapiens
agtgtttctgttattaacaaa

SEQ ID NO: 4950292 - DNA, 21 bp, Homo sapiens
agttaaatagagtatatgcac

SEQ ID NO: 4950293 - DNA, 15 bp, Homo sapiens
agttaactattgcat

SEQ ID NO: 4950294 - DNA, 17 bp, Homo sapiens
agttaactattgcattt

SEQ ID NO: 4950295 - DNA, 24 bp, Homo sapiens
agttaactattgcatttatatgta

SEQ ID NO: 4950296 - DNA, 12 bp, Homo sapiens
agttaagaagct

SEQ ID NO: 4950297 - DNA, 17 bp, Homo sapiens
agttaagaagctgttgt

SEQ ID NO: 4950298 - DNA, 19 bp, Homo sapiens
agttaagacatgatttcct

SEQ ID NO: 4950299 - DNA, 13 bp, Homo sapiens
agttaagagaaac

SEQ ID NO: 4950300 - DNA, 14 bp, Homo sapiens
agttaagagaaact

SEQ ID NO: 4950301 - DNA, 16 bp, Homo sapiens
agttaagagaaacttt

SEQ ID NO: 4950302 - DNA, 21 bp, Homo sapiens
agttaagagaaactttataca

SEQ ID NO: 4950303 - DNA, 18 bp, Homo sapiens
agttaatttatctaaatt

SEQ ID NO: 4950304 - DNA, 13 bp, Homo sapiens
agttacccactga

SEQ ID NO: 4950305 - DNA, 18 bp, Homo sapiens
agttactgattcactgca

SEQ ID NO: 4950306 - DNA, 14 bp, Homo sapiens
agttactttatgtt

SEQ ID NO: 4950307 - DNA, 17 bp, Homo sapiens
agttagtttctttggga

SEQ ID NO: 4950308 - DNA, 17 bp, Homo sapiens
agttatagatgtctagg

SEQ ID NO: 4950309 - DNA, 13 bp, Homo sapiens
agttatagtttca

SEQ ID NO: 4950310 - DNA, 15 bp, Homo sapiens
agttatagtttcaga

SEQ ID NO: 4950311 - DNA, 21 bp, Homo sapiens
agttatccagagggttgtgat

SEQ ID NO: 4950312 - DNA, 12 bp, Homo sapiens
agttatgatgta

SEQ ID NO: 4950313 - DNA, 14 bp, Homo sapiens
agttatgatgtaat

SEQ ID NO: 4950314 - DNA, 18 bp, Homo sapiens
agttatggcctatacact

SEQ ID NO: 4950315 - DNA, 13 bp, Homo sapiens
agttcaaacaaga

SEQ ID NO: 4950316 - DNA, 18 bp, Homo sapiens
agttcaaacataaggaaa

SEQ ID NO: 4950317 - DNA, 18 bp, Homo sapiens
agttcaataaatgtctgt

SEQ ID NO: 4950318 - DNA, 19 bp, Homo sapiens
agttcaataaatgtctgtt

SEQ ID NO: 4950319 - DNA, 15 bp, Homo sapiens
agttcacaccctgca

SEQ ID NO: 4950320 - DNA, 18 bp, Homo sapiens
agttcagcaccaccctag

SEQ ID NO: 4950321 - DNA, 20 bp, Homo sapiens
agttcaggagtcccaaggaa

SEQ ID NO: 4950322 - DNA, 21 bp, Homo sapiens
agttcaggagtcccaaggaaa

SEQ ID NO: 4950323 - DNA, 18 bp, Homo sapiens
agttcaggtaacaggcag

SEQ ID NO: 4950324 - DNA, 22 bp, Homo sapiens
agttcatacctaagtactgtaa

SEQ ID NO: 4950325 - DNA, 19 bp, Homo sapiens
agttcatcccagccccaat

SEQ ID NO: 4950326 - DNA, 20 bp, Homo sapiens
agttcatcccagccccaatt

SEQ ID NO: 4950327 - DNA, 21 bp, Homo sapiens
agttcatgagaatctatattt

SEQ ID NO: 4950328 - DNA, 23 bp, Homo sapiens
agttcatgtttgcttcataaatg

SEQ ID NO: 4950329 - DNA, 14 bp, Homo sapiens
agttccaagagtct

SEQ ID NO: 4950330 - DNA, 15 bp, Homo sapiens
agttccctacttcct

SEQ ID NO: 4950331 - DNA, 17 bp, Homo sapiens
agttccctacttcctgt

SEQ ID NO: 4950332 - DNA, 17 bp, Homo sapiens
agttccctctgctcagc

SEQ ID NO: 4950333 - DNA, 15 bp, Homo sapiens
agttccctgaaacac

SEQ ID NO: 4950334 - DNA, 20 bp, Homo sapiens
agttccctgtctcttgaaaa

SEQ ID NO: 4950335 - DNA, 13 bp, Homo sapiens
agttcccttggcc

SEQ ID NO: 4950336 - DNA, 17 bp, Homo sapiens
agttcccttggcctcag

SEQ ID NO: 4950337 - DNA, 18 bp, Homo sapiens
agttcccttggcctcaga

SEQ ID NO: 4950338 - DNA, 13 bp, Homo sapiens
agttcctaagaag

SEQ ID NO: 4950339 - DNA, 20 bp, Homo sapiens
agttcctaagaagcttctaa

SEQ ID NO: 4950340 - DNA, 19 bp, Homo sapiens
agttcctttccttttcttt

SEQ ID NO: 4950341 - DNA, 17 bp, Homo sapiens
agttcggctctgggtgg

SEQ ID NO: 4950342 - DNA, 18 bp, Homo sapiens
agttctaagactcaaatg

SEQ ID NO: 4950343 - DNA, 14 bp, Homo sapiens
agttctaagattct

SEQ ID NO: 4950344 - DNA, 16 bp, Homo sapiens
agttctaagattctga

SEQ ID NO: 4950345 - DNA, 17 bp, Homo sapiens
agttctaataatttcta

SEQ ID NO: 4950346 - DNA, 18 bp, Homo sapiens
agttctaataatttctaa

SEQ ID NO: 4950347 - DNA, 19 bp, Homo sapiens
agttctaataatttctaat

SEQ ID NO: 4950348 - DNA, 15 bp, Homo sapiens
agttctacataagta

SEQ ID NO: 4950349 - DNA, 23 bp, Homo sapiens
agttctagacatggaggttctaa

SEQ ID NO: 4950350 - DNA, 19 bp, Homo sapiens
agttctgtgtttaatttct

SEQ ID NO: 4950351 - DNA, 20 bp, Homo sapiens
agttctgttatatcccctgc

SEQ ID NO: 4950352 - DNA, 21 bp, Homo sapiens
agttctgttatatcccctgct

SEQ ID NO: 4950353 - DNA, 21 bp, Homo sapiens
agttctgtttggtgtgtccca

SEQ ID NO: 4950354 - DNA, 13 bp, Homo sapiens
agttcttctccaa

SEQ ID NO: 4950355 - DNA, 19 bp, Homo sapiens
agttgaatgacaacagaag

SEQ ID NO: 4950356 - DNA, 15 bp, Homo sapiens
agttgacttatagta

SEQ ID NO: 4950357 - DNA, 18 bp, Homo sapiens
agttgacttatagtacat

SEQ ID NO: 4950358 - DNA, 21 bp, Homo sapiens
agttgacttatagtacatgat

SEQ ID NO: 4950359 - DNA, 16 bp, Homo sapiens
agttgatgttgcattt

SEQ ID NO: 4950360 - DNA, 14 bp, Homo sapiens
agttgattgagaag

SEQ ID NO: 4950361 - DNA, 19 bp, Homo sapiens
agttgccaccacctctgtg

SEQ ID NO: 4950362 - DNA, 20 bp, Homo sapiens
agttggactaaatgcctagt

SEQ ID NO: 4950363 - DNA, 13 bp, Homo sapiens
agttgggcttcct

SEQ ID NO: 4950364 - DNA, 13 bp, Homo sapiens
agttggtgtcttt

SEQ ID NO: 4950365 - DNA, 18 bp, Homo sapiens
aacattctgatttggaaa

SEQ ID NO: 4950366 - DNA, 19 bp, Homo sapiens
aacattgttgctccctgtg

SEQ ID NO: 4950367 - DNA, 15 bp, Homo sapiens
aacatttacagtcct

SEQ ID NO: 4950368 - DNA, 18 bp, Homo sapiens
aacatttctgtaaatacc

SEQ ID NO: 4950369 - DNA, 13 bp, Homo sapiens
aacatttgccttg

SEQ ID NO: 4950370 - DNA, 14 bp, Homo sapiens
aacatttgccttgc

SEQ ID NO: 4950371 - DNA, 18 bp, Homo sapiens
aacatttgccttgcagaa

SEQ ID NO: 4950372 - DNA, 22 bp, Homo sapiens
aacatttgccttgcagaactgc

SEQ ID NO: 4950373 - DNA, 15 bp, Homo sapiens
aacattttaaataaa

SEQ ID NO: 4950374 - DNA, 23 bp, Homo sapiens
aacattttagctctattgatact

SEQ ID NO: 4950375 - DNA, 22 bp, Homo sapiens
agtatgacgctgatacataact

SEQ ID NO: 4950376 - DNA, 14 bp, Homo sapiens
agtatggtggctgg

SEQ ID NO: 4950377 - DNA, 15 bp, Homo sapiens
agtatggtggctggg

SEQ ID NO: 4950378 - DNA, 16 bp, Homo sapiens
agtatggtggctgggt

SEQ ID NO: 4950379 - DNA, 17 bp, Homo sapiens
agtatggtggctgggtt

SEQ ID NO: 4950380 - DNA, 14 bp, Homo sapiens
agtatgtgtaaaat

SEQ ID NO: 4950381 - DNA, 14 bp, Homo sapiens
agtattaaaacatt

SEQ ID NO: 4950382 - DNA, 16 bp, Homo sapiens
agtattaaaacattgg

SEQ ID NO: 4950383 - DNA, 18 bp, Homo sapiens
agtattaatactaaaata

SEQ ID NO: 4950384 - DNA, 15 bp, Homo sapiens
agtattacttctgct

SEQ ID NO: 4950385 - DNA, 16 bp, Homo sapiens
agtatttataatagca

SEQ ID NO: 4950386 - DNA, 13 bp, Homo sapiens
agtatttatttat

SEQ ID NO: 4950387 - DNA, 15 bp, Homo sapiens
agtatttatttatgt

SEQ ID NO: 4950388 - DNA, 21 bp, Homo sapiens
agtatttattttgtaattatg

SEQ ID NO: 4950389 - DNA, 17 bp, Homo sapiens
agtatttcagtgtagtt

SEQ ID NO: 4950390 - DNA, 20 bp, Homo sapiens
agtatttcagtgtagttaat

SEQ ID NO: 4950391 - DNA, 13 bp, Homo sapiens
agtatttcattgc

SEQ ID NO: 4950392 - DNA, 15 bp, Homo sapiens
agtatttcattgcct

SEQ ID NO: 4950393 - DNA, 19 bp, Homo sapiens
agtatttcattgcctgtgt

SEQ ID NO: 4950394 - DNA, 13 bp, Homo sapiens
agtatttgaatta

SEQ ID NO: 4950395 - DNA, 17 bp, Homo sapiens
agtatttgaattaaaac

SEQ ID NO: 4950396 - DNA, 13 bp, Homo sapiens
agtattttgaagt

SEQ ID NO: 4950397 - DNA, 15 bp, Homo sapiens
agtattttgaagttt

SEQ ID NO: 4950398 - DNA, 18 bp, Homo sapiens
agtattttgaagtttaca

SEQ ID NO: 4950399 - DNA, 13 bp, Homo sapiens
agtatttttataa

SEQ ID NO: 4950400 - DNA, 22 bp, Homo sapiens
agtatttttataaatataagcc

SEQ ID NO: 4950401 - DNA, 17 bp, Homo sapiens
agtcaaaactacaaatc

SEQ ID NO: 4950402 - DNA, 15 bp, Homo sapiens
agtcaaccaacccca

SEQ ID NO: 4950403 - DNA, 17 bp, Homo sapiens
agtcaatatttttagat

SEQ ID NO: 4950404 - DNA, 23 bp, Homo sapiens
agtcacacagtattacttctgct

SEQ ID NO: 4950405 - DNA, 15 bp, Homo sapiens
agtcacacagtgagt

SEQ ID NO: 4950406 - DNA, 19 bp, Homo sapiens
agtcacactgctagcaaat

SEQ ID NO: 4950407 - DNA, 20 bp, Homo sapiens
agtcaccttccaggacccct

SEQ ID NO: 4950408 - DNA, 14 bp, Homo sapiens
agtcaccttccctt

SEQ ID NO: 4950409 - DNA, 17 bp, Homo sapiens
agtcaccttcccttgcc

SEQ ID NO: 4950410 - DNA, 17 bp, Homo sapiens
agtcactgccactttgc

SEQ ID NO: 4950411 - DNA, 21 bp, Homo sapiens
agtcactgccactttgcacat

SEQ ID NO: 4950412 - DNA, 21 bp, Homo sapiens
agtcagtcatgatggcaccac

SEQ ID NO: 4950413 - DNA, 14 bp, Homo sapiens
agtcagtttgcagt

SEQ ID NO: 4950414 - DNA, 19 bp, Homo sapiens
agtcatcatcagggcctgg

SEQ ID NO: 4950415 - DNA, 21 bp, Homo sapiens
agtcatcatcagggcctgggg

SEQ ID NO: 4950416 - DNA, 13 bp, Homo sapiens
agtcatgcataaa

SEQ ID NO: 4950417 - DNA, 14 bp, Homo sapiens
agtcatgcataaat

SEQ ID NO: 4950418 - DNA, 16 bp, Homo sapiens
agtcatgcataaatat

SEQ ID NO: 4950419 - DNA, 19 bp, Homo sapiens
agtcatgcataaatatgca

SEQ ID NO: 4950420 - DNA, 20 bp, Homo sapiens
agtcatgcataaatatgcag

SEQ ID NO: 4950421 - DNA, 13 bp, Homo sapiens
agtcatgtgcatt

SEQ ID NO: 4950422 - DNA, 14 bp, Homo sapiens
agtcattagactcc

SEQ ID NO: 4950423 - DNA, 15 bp, Homo sapiens
agtcattagactcct

SEQ ID NO: 4950424 - DNA, 16 bp, Homo sapiens
agtcattagactcctc

SEQ ID NO: 4950425 - DNA, 19 bp, Homo sapiens
agtcattagactcctcctc

SEQ ID NO: 4950426 - DNA, 12 bp, Homo sapiens
agtcattccttc

SEQ ID NO: 4950427 - DNA, 20 bp, Homo sapiens
agtcattccttctttttaaa

SEQ ID NO: 4950428 - DNA, 14 bp, Homo sapiens
agtcatttactaaa

SEQ ID NO: 4950429 - DNA, 17 bp, Homo sapiens
agtcatttactaaacat

SEQ ID NO: 4950430 - DNA, 16 bp, Homo sapiens
agtcatttattttaaa

SEQ ID NO: 4950431 - DNA, 16 bp, Homo sapiens
agtccaaatgtcctcc

SEQ ID NO: 4950432 - DNA, 19 bp, Homo sapiens
agtccaagagggtccttta

SEQ ID NO: 4950433 - DNA, 13 bp, Homo sapiens
agtccaaggttta

SEQ ID NO: 4950434 - DNA, 19 bp, Homo sapiens
agtccaggcacaggatgct

SEQ ID NO: 4950435 - DNA, 20 bp, Homo sapiens
agtccatgcatgacagcctc

SEQ ID NO: 4950436 - DNA, 18 bp, Homo sapiens
agtccatttatatatgaa

SEQ ID NO: 4950437 - DNA, 17 bp, Homo sapiens
agtcccaaggaaagccc

SEQ ID NO: 4950438 - DNA, 20 bp, Homo sapiens
agtcccaccttggctgcagg

SEQ ID NO: 4950439 - DNA, 13 bp, Homo sapiens
agtcccactgtgc

SEQ ID NO: 4950440 - DNA, 19 bp, Homo sapiens
agtcccccaactctgagcc

SEQ ID NO: 4950441 - DNA, 22 bp, Homo sapiens
agtcccccaactctgagcccat

SEQ ID NO: 4950442 - DNA, 20 bp, Homo sapiens
agtcccccctcccacctcca

SEQ ID NO: 4950443 - DNA, 21 bp, Homo sapiens
agtcccccctcccacctccag

SEQ ID NO: 4950444 - DNA, 19 bp, Homo sapiens
agtccccctatccttggca

SEQ ID NO: 4950445 - DNA, 22 bp, Homo sapiens
agtccccgtggccatccctgtg

SEQ ID NO: 4950446 - DNA, 15 bp, Homo sapiens
agtccctatgtattt

SEQ ID NO: 4950447 - DNA, 15 bp, Homo sapiens
agtcccttcccctcc

SEQ ID NO: 4950448 - DNA, 17 bp, Homo sapiens
agtcccttcccctccct

SEQ ID NO: 4950449 - DNA, 17 bp, Homo sapiens
agtccggacccacctca

SEQ ID NO: 4950450 - DNA, 22 bp, Homo sapiens
agtccgtgtggatccaatgtta

SEQ ID NO: 4950451 - DNA, 17 bp, Homo sapiens
agtcctagccactcagg

SEQ ID NO: 4950452 - DNA, 18 bp, Homo sapiens
agtcctcccctcacagcc

SEQ ID NO: 4950453 - DNA, 21 bp, Homo sapiens
agtcctcccctcacagcctct

SEQ ID NO: 4950454 - DNA, 20 bp, Homo sapiens
agtcctctcccaagtccaca

SEQ ID NO: 4950455 - DNA, 14 bp, Homo sapiens
agtcctcttttctg

SEQ ID NO: 4950456 - DNA, 19 bp, Homo sapiens
agtcctcttttctgagagg

SEQ ID NO: 4950457 - DNA, 20 bp, Homo sapiens
agtcctgcctggccaggcag

SEQ ID NO: 4950458 - DNA, 21 bp, Homo sapiens
agtcctgcctggccaggcaga

SEQ ID NO: 4950459 - DNA, 18 bp, Homo sapiens
agtcctgctccagaattt

SEQ ID NO: 4950460 - DNA, 21 bp, Homo sapiens
agtcctgtagttttattttat

SEQ ID NO: 4950461 - DNA, 24 bp, Homo sapiens
agtccttaaaatgtaagattatag

SEQ ID NO: 4950462 - DNA, 22 bp, Homo sapiens
agtccttgaaaatattttttat

SEQ ID NO: 4950463 - DNA, 18 bp, Homo sapiens
agtcctttaattaagact

SEQ ID NO: 4950464 - DNA, 14 bp, Homo sapiens
agtcctttatgtgg

SEQ ID NO: 4950465 - DNA, 21 bp, Homo sapiens
agtcgaattaatagcttttat

SEQ ID NO: 4950466 - DNA, 15 bp, Homo sapiens
agtcggaacagcaga

SEQ ID NO: 4950467 - DNA, 22 bp, Homo sapiens
agtcgtcatcacttttcagtga

SEQ ID NO: 4950468 - DNA, 14 bp, Homo sapiens
agtcgttttccaaa

SEQ ID NO: 4950469 - DNA, 22 bp, Homo sapiens
agtctaaagatggagtttctaa

SEQ ID NO: 4950470 - DNA, 23 bp, Homo sapiens
agtctaaagatggagtttctaag

SEQ ID NO: 4950471 - DNA, 15 bp, Homo sapiens
agtctagattcaaag

SEQ ID NO: 4950472 - DNA, 20 bp, Homo sapiens
agtctagattcaaaggttct

SEQ ID NO: 4950473 - DNA, 22 bp, Homo sapiens
agtctagattcaaaggttctag

SEQ ID NO: 4950474 - DNA, 19 bp, Homo sapiens
agtctcaaaaatacaaaat

SEQ ID NO: 4950475 - DNA, 20 bp, Homo sapiens
agtctcaaaaatacaaaata

SEQ ID NO: 4950476 - DNA, 19 bp, Homo sapiens
agtctcactgttgcccagg

SEQ ID NO: 4950477 - DNA, 23 bp, Homo sapiens
agtctcactgttgcccaggctgg

SEQ ID NO: 4950478 - DNA, 23 bp, Homo sapiens
agtctcctcaatttttgtctcag

SEQ ID NO: 4950479 - DNA, 15 bp, Homo sapiens
agtctcctctttaaa

SEQ ID NO: 4950480 - DNA, 16 bp, Homo sapiens
agtctcctctttaaaa

SEQ ID NO: 4950481 - DNA, 21 bp, Homo sapiens
agtctcctctttaaaacaaaa

SEQ ID NO: 4950482 - DNA, 22 bp, Homo sapiens
agtctcctctttaaaacaaaac

SEQ ID NO: 4950483 - DNA, 22 bp, Homo sapiens
agtctctcctgtaagccaaaga

SEQ ID NO: 4950484 - DNA, 16 bp, Homo sapiens
agtctctgctggccca

SEQ ID NO: 4950485 - DNA, 17 bp, Homo sapiens
agtctctgctggcccag

SEQ ID NO: 4950486 - DNA, 21 bp, Homo sapiens
agtctctggggcaggctgctt

SEQ ID NO: 4950487 - DNA, 11 bp, Homo sapiens
agtctctgtga

SEQ ID NO: 4950488 - DNA, 18 bp, Homo sapiens
agtctcttctccactgga

SEQ ID NO: 4950489 - DNA, 16 bp, Homo sapiens
agtctgaatgctgcca

SEQ ID NO: 4950490 - DNA, 18 bp, Homo sapiens
agtctgattcccaagctc

SEQ ID NO: 4950491 - DNA, 19 bp, Homo sapiens
agtctggagtgggcagagc

SEQ ID NO: 4950492 - DNA, 17 bp, Homo sapiens
agtctggtgggaggacg

SEQ ID NO: 4950493 - DNA, 21 bp, Homo sapiens
agtctgtatcaaacccacgat

SEQ ID NO: 4950494 - DNA, 19 bp, Homo sapiens
agtctgtgtgatgaacttt

SEQ ID NO: 4950495 - DNA, 22 bp, Homo sapiens
agtcttagggatttattttcaa

SEQ ID NO: 4950496 - DNA, 15 bp, Homo sapiens
agtcttccaattaat

SEQ ID NO: 4950497 - DNA, 19 bp, Homo sapiens
agtctttaaaggcccagcc

SEQ ID NO: 4950498 - DNA, 23 bp, Homo sapiens
agtctttaaaggcccagccccta

SEQ ID NO: 4950499 - DNA, 17 bp, Homo sapiens
agtctttgaagctgaaa

SEQ ID NO: 4950500 - DNA, 21 bp, Homo sapiens
agtctttgaagctgaaaatat

SEQ ID NO: 4950501 - DNA, 16 bp, Homo sapiens
agtctttggttctaag

SEQ ID NO: 4950502 - DNA, 18 bp, Homo sapiens
agtctttggttctaagga

SEQ ID NO: 4950503 - DNA, 13 bp, Homo sapiens
agtctttttctgt

SEQ ID NO: 4950504 - DNA, 17 bp, Homo sapiens
agtctttttctgttgta

SEQ ID NO: 4950505 - DNA, 12 bp, Homo sapiens
agtgaaataaca

SEQ ID NO: 4950506 - DNA, 15 bp, Homo sapiens
agtgaaatggatact

SEQ ID NO: 4950507 - DNA, 14 bp, Homo sapiens
agtgaaatttctag

SEQ ID NO: 4950508 - DNA, 19 bp, Homo sapiens
agtgaagagggagaaggga

SEQ ID NO: 4950509 - DNA, 21 bp, Homo sapiens
agtgaagtcatgacctccagg

SEQ ID NO: 4950510 - DNA, 19 bp, Homo sapiens
agtgaataaacttcagcac

SEQ ID NO: 4950511 - DNA, 14 bp, Homo sapiens
agtgaatgaaagat

SEQ ID NO: 4950512 - DNA, 20 bp, Homo sapiens
agtgacataatatattctat

SEQ ID NO: 4950513 - DNA, 21 bp, Homo sapiens
agtgacccttcccaatcagca

SEQ ID NO: 4950514 - DNA, 15 bp, Homo sapiens
agtgactgtatctgt

SEQ ID NO: 4950515 - DNA, 18 bp, Homo sapiens
agtgactgtatctgtgta

SEQ ID NO: 4950516 - DNA, 20 bp, Homo sapiens
agtgactgtatctgtgtaga

SEQ ID NO: 4950517 - DNA, 22 bp, Homo sapiens
agtgagactctgtctcaaaaaa

SEQ ID NO: 4950518 - DNA, 22 bp, Homo sapiens
agtgagatgagggatgggcctg

SEQ ID NO: 4950519 - DNA, 23 bp, Homo sapiens
agtgagatgagggatgggcctgg

SEQ ID NO: 4950520 - DNA, 11 bp, Homo sapiens
agtgagcctga

SEQ ID NO: 4950521 - DNA, 14 bp, Homo sapiens
agtgagctacagag

SEQ ID NO: 4950522 - DNA, 21 bp, Homo sapiens
agtgagctgggcatggtacca

SEQ ID NO: 4950523 - DNA, 16 bp, Homo sapiens
agtgagtcgaggacag

SEQ ID NO: 4950524 - DNA, 13 bp, Homo sapiens
agtgagtgagcct

SEQ ID NO: 4950525 - DNA, 14 bp, Homo sapiens
agtgagtgagcctg

SEQ ID NO: 4950526 - DNA, 16 bp, Homo sapiens
agtgagtgagcctggc

SEQ ID NO: 4950527 - DNA, 13 bp, Homo sapiens
agtgatcctccca

SEQ ID NO: 4950528 - DNA, 14 bp, Homo sapiens
agtgatcctcccac

SEQ ID NO: 4950529 - DNA, 20 bp, Homo sapiens
agtgatcctcccacctcagc

SEQ ID NO: 4950530 - DNA, 22 bp, Homo sapiens
agtgatctacatgaggaactgt

SEQ ID NO: 4950531 - DNA, 14 bp, Homo sapiens
agtgattctcctgc

SEQ ID NO: 4950532 - DNA, 19 bp, Homo sapiens
agtgattctcctgcctcag

SEQ ID NO: 4950533 - DNA, 13 bp, Homo sapiens
agtgattgcagct

SEQ ID NO: 4950534 - DNA, 14 bp, Homo sapiens
agtgattgcagctt

SEQ ID NO: 4950535 - DNA, 13 bp, Homo sapiens
agtgcacaaaatg

SEQ ID NO: 4950536 - DNA, 11 bp, Homo sapiens
agtgcacacct

SEQ ID NO: 4950537 - DNA, 14 bp, Homo sapiens
agtgcacagctgtc

SEQ ID NO: 4950538 - DNA, 15 bp, Homo sapiens
agtgcacagctgtcc

SEQ ID NO: 4950539 - DNA, 14 bp, Homo sapiens
agtgcatctcagcc

SEQ ID NO: 4950540 - DNA, 22 bp, Homo sapiens
agtgcatttctgaatagaaatg

SEQ ID NO: 4950541 - DNA, 20 bp, Homo sapiens
agtgccagaattttaggaac

SEQ ID NO: 4950542 - DNA, 14 bp, Homo sapiens
agtgcccacaggat

SEQ ID NO: 4950543 - DNA, 20 bp, Homo sapiens
agtgcccaccctgggagaca

SEQ ID NO: 4950544 - DNA, 22 bp, Homo sapiens
agtgcccaccctgggagacaga

SEQ ID NO: 4950545 - DNA, 23 bp, Homo sapiens
agtgcccaccctgggagacagac

SEQ ID NO: 4950546 - DNA, 23 bp, Homo sapiens
agtgcctggatcccctctgtcta

SEQ ID NO: 4950547 - DNA, 22 bp, Homo sapiens
agtgcctttctgcagtttttca

SEQ ID NO: 4950548 - DNA, 13 bp, Homo sapiens
agtgcgtgaatgt

SEQ ID NO: 4950549 - DNA, 17 bp, Homo sapiens
agtgcgtgaatgtatgt

SEQ ID NO: 4950550 - DNA, 16 bp, Homo sapiens
agtgcgtgccgtgtga

SEQ ID NO: 4950551 - DNA, 15 bp, Homo sapiens
agtgctaaggttcta

SEQ ID NO: 4950552 - DNA, 16 bp, Homo sapiens
agtgctaaggttctaa

SEQ ID NO: 4950553 - DNA, 18 bp, Homo sapiens
agtgctaaggttctaagg

SEQ ID NO: 4950554 - DNA, 13 bp, Homo sapiens
agtgctatatata

SEQ ID NO: 4950555 - DNA, 13 bp, Homo sapiens
agtgctggctcac

SEQ ID NO: 4950556 - DNA, 16 bp, Homo sapiens
agtgctggctcacagt

SEQ ID NO: 4950557 - DNA, 18 bp, Homo sapiens
agtgctggctcacagtac

SEQ ID NO: 4950558 - DNA, 20 bp, Homo sapiens
agtgctggctcacagtacag

SEQ ID NO: 4950559 - DNA, 21 bp, Homo sapiens
agtgctgggatggaggggagt

SEQ ID NO: 4950560 - DNA, 20 bp, Homo sapiens
agtgctgggattacaagcgt

SEQ ID NO: 4950561 - DNA, 14 bp, Homo sapiens
agtggaaattcagg

SEQ ID NO: 4950562 - DNA, 22 bp, Homo sapiens
agtggaaattcaggtgaaaatg

SEQ ID NO: 4950563 - DNA, 20 bp, Homo sapiens
agtggaccttaggccttcct

SEQ ID NO: 4950564 - DNA, 22 bp, Homo sapiens
agtggctatttctttatattta

SEQ ID NO: 4950565 - DNA, 13 bp, Homo sapiens
agtggctcctccc

SEQ ID NO: 4950566 - DNA, 23 bp, Homo sapiens
agtggcttaaaacaacactcaca

SEQ ID NO: 4950567 - DNA, 18 bp, Homo sapiens
agtgggaactctgacaag

SEQ ID NO: 4950568 - DNA, 21 bp, Homo sapiens
agtgggacagggcatggccag

SEQ ID NO: 4950569 - DNA, 23 bp, Homo sapiens
agtgggacccatagatcttctga

SEQ ID NO: 4950570 - DNA, 14 bp, Homo sapiens
agtgggagctgcct

SEQ ID NO: 4950571 - DNA, 15 bp, Homo sapiens
agtgggagctgcctg

SEQ ID NO: 4950572 - DNA, 14 bp, Homo sapiens
gccttcgtgccccc

SEQ ID NO: 4950573 - DNA, 13 bp, Homo sapiens
gccttctcctccc

SEQ ID NO: 4950574 - DNA, 17 bp, Homo sapiens
gccttctgacggccctg

SEQ ID NO: 4950575 - DNA, 23 bp, Homo sapiens
gccttctgatgtctctaaagcac

SEQ ID NO: 4950576 - DNA, 17 bp, Homo sapiens
gccttcttccatcccag

SEQ ID NO: 4950577 - DNA, 15 bp, Homo sapiens
gccttcttttgatta

SEQ ID NO: 4950578 - DNA, 17 bp, Homo sapiens
gccttgaacctgtgagt

SEQ ID NO: 4950579 - DNA, 13 bp, Homo sapiens
gccttgcagaact

SEQ ID NO: 4950580 - DNA, 15 bp, Homo sapiens
gccttgcagaactgc

SEQ ID NO: 4950581 - DNA, 17 bp, Homo sapiens
gccttgcagaactgcca

SEQ ID NO: 4950582 - DNA, 21 bp, Homo sapiens
gctccttctgtcctactctgt

SEQ ID NO: 4950583 - DNA, 17 bp, Homo sapiens
gctcctttagcgcccag

SEQ ID NO: 4950584 - DNA, 21 bp, Homo sapiens
gctcgagcagtcctgcctcag

SEQ ID NO: 4950585 - DNA, 16 bp, Homo sapiens
gctcgcacccccctgt

SEQ ID NO: 4950586 - DNA, 21 bp, Homo sapiens
gctcgcacccccctgttctaa

SEQ ID NO: 4950587 - DNA, 14 bp, Homo sapiens
gctcggaggctgcc

SEQ ID NO: 4950588 - DNA, 16 bp, Homo sapiens
gctcggaggctgcccc

SEQ ID NO: 4950589 - DNA, 20 bp, Homo sapiens
gctctacagctaatcagcat

SEQ ID NO: 4950590 - DNA, 16 bp, Homo sapiens
gctctacatcttctgc

SEQ ID NO: 4950591 - DNA, 18 bp, Homo sapiens
gctctacatcttctgcct

SEQ ID NO: 4950592 - DNA, 21 bp, Homo sapiens
gctctactggtcttgtggaat

SEQ ID NO: 4950593 - DNA, 19 bp, Homo sapiens
gctctagggttgctggagc

SEQ ID NO: 4950594 - DNA, 13 bp, Homo sapiens
gctctatgagtct

SEQ ID NO: 4950595 - DNA, 18 bp, Homo sapiens
gctctatgagtctagatg

SEQ ID NO: 4950596 - DNA, 16 bp, Homo sapiens
gctctcagctcagcgc

SEQ ID NO: 4950597 - DNA, 18 bp, Homo sapiens
gctctccaagtctcagtg

SEQ ID NO: 4950598 - DNA, 22 bp, Homo sapiens
gctctccaagtctcagtggctt

SEQ ID NO: 4950599 - DNA, 19 bp, Homo sapiens
gctctccgaccagacacct

SEQ ID NO: 4950600 - DNA, 15 bp, Homo sapiens
gctctcctcttgcca

SEQ ID NO: 4950601 - DNA, 22 bp, Homo sapiens
gctctcctcttgccactgcctc

SEQ ID NO: 4950602 - DNA, 19 bp, Homo sapiens
gctctcgggttgtgtgtct

SEQ ID NO: 4950603 - DNA, 13 bp, Homo sapiens
gctctctgctgta

SEQ ID NO: 4950604 - DNA, 18 bp, Homo sapiens
gctctctgtataaacatt

SEQ ID NO: 4950605 - DNA, 23 bp, Homo sapiens
gctctctgtataaacattaaatg

SEQ ID NO: 4950606 - DNA, 12 bp, Homo sapiens
gctctcttcctg

SEQ ID NO: 4950607 - DNA, 13 bp, Homo sapiens
gctctcttcctgc

SEQ ID NO: 4950608 - DNA, 22 bp, Homo sapiens
gctctcttcctgcccctctttc

SEQ ID NO: 4950609 - DNA, 17 bp, Homo sapiens
gctctgaaatctccttt

SEQ ID NO: 4950610 - DNA, 20 bp, Homo sapiens
gctctgacagaaagcagata

SEQ ID NO: 4950611 - DNA, 17 bp, Homo sapiens
gctctgatcatccactg

SEQ ID NO: 4950612 - DNA, 23 bp, Homo sapiens
gctctgcaatgggcactgggatg

SEQ ID NO: 4950613 - DNA, 18 bp, Homo sapiens
gctctgcaattcccctct

SEQ ID NO: 4950614 - DNA, 13 bp, Homo sapiens
gctctgccccagt

SEQ ID NO: 4950615 - DNA, 13 bp, Homo sapiens
gctctgctgacag

SEQ ID NO: 4950616 - DNA, 14 bp, Homo sapiens
gctctgctgacaga

SEQ ID NO: 4950617 - DNA, 23 bp, Homo sapiens
gctctgctgacagacacaggccc

SEQ ID NO: 4950618 - DNA, 14 bp, Homo sapiens
gctctggacaggca

SEQ ID NO: 4950619 - DNA, 16 bp, Homo sapiens
gctctggactctaaag

SEQ ID NO: 4950620 - DNA, 18 bp, Homo sapiens
gctctggagacagcccca

SEQ ID NO: 4950621 - DNA, 19 bp, Homo sapiens
gctctggagacagccccag

SEQ ID NO: 4950622 - DNA, 15 bp, Homo sapiens
gctctggagagaaac

SEQ ID NO: 4950623 - DNA, 14 bp, Homo sapiens
gctctgtccccctg

SEQ ID NO: 4950624 - DNA, 14 bp, Homo sapiens
gctctgtcctggga

SEQ ID NO: 4950625 - DNA, 16 bp, Homo sapiens
gctctgtcctgggagt

SEQ ID NO: 4950626 - DNA, 17 bp, Homo sapiens
gctctgtgttgccatgt

SEQ ID NO: 4950627 - DNA, 13 bp, Homo sapiens
gctcttcgcgccc

SEQ ID NO: 4950628 - DNA, 17 bp, Homo sapiens
gctcttctcctttcaca

SEQ ID NO: 4950629 - DNA, 23 bp, Homo sapiens
gctcttctgcccaattggaggaa

SEQ ID NO: 4950630 - DNA, 19 bp, Homo sapiens
gctcttgatacccccctct

SEQ ID NO: 4950631 - DNA, 15 bp, Homo sapiens
gctcttgtcccacgt

SEQ ID NO: 4950632 - DNA, 21 bp, Homo sapiens
gctctttatgaatgaaaaaac

SEQ ID NO: 4950633 - DNA, 13 bp, Homo sapiens
gctctttggtaga

SEQ ID NO: 4950634 - DNA, 14 bp, Homo sapiens
gctcttttttactc

SEQ ID NO: 4950635 - DNA, 21 bp, Homo sapiens
gctcttttttgtttgtttctt

SEQ ID NO: 4950636 - DNA, 19 bp, Homo sapiens
gctgaaaaccatctggcct

SEQ ID NO: 4950637 - DNA, 22 bp, Homo sapiens
gctgaaaaccatctggcctggc

SEQ ID NO: 4950638 - DNA, 15 bp, Homo sapiens
gctgaaaatataaaa

SEQ ID NO: 4950639 - DNA, 19 bp, Homo sapiens
gctgaatgcctcctgtggg

SEQ ID NO: 4950640 - DNA, 19 bp, Homo sapiens
gctgaccaattgtgctgcc

SEQ ID NO: 4950641 - DNA, 23 bp, Homo sapiens
gctgacctgcctctcacacacat

SEQ ID NO: 4950642 - DNA, 14 bp, Homo sapiens
gctgactaaatttg

SEQ ID NO: 4950643 - DNA, 21 bp, Homo sapiens
gctgactccacgatcctgcca

SEQ ID NO: 4950644 - DNA, 19 bp, Homo sapiens
gctgactgtactcctccca

SEQ ID NO: 4950645 - DNA, 18 bp, Homo sapiens
gctgactgtcctctcccc

SEQ ID NO: 4950646 - DNA, 20 bp, Homo sapiens
gctgacttcacttattagtc

SEQ ID NO: 4950647 - DNA, 16 bp, Homo sapiens
gctgagaatgtggaat

SEQ ID NO: 4950648 - DNA, 13 bp, Homo sapiens
gctgagcctctgc

SEQ ID NO: 4950649 - DNA, 16 bp, Homo sapiens
gctgaggaggcctcca

SEQ ID NO: 4950650 - DNA, 13 bp, Homo sapiens
gctgagggcagct

SEQ ID NO: 4950651 - DNA, 21 bp, Homo sapiens
gctgatacataactaaatttg

SEQ ID NO: 4950652 - DNA, 13 bp, Homo sapiens
gctgatataaatt

SEQ ID NO: 4950653 - DNA, 22 bp, Homo sapiens
gctgatctgcggatctcagctt

SEQ ID NO: 4950654 - DNA, 23 bp, Homo sapiens
gctgatggataacctatatgatt

SEQ ID NO: 4950655 - DNA, 19 bp, Homo sapiens
gctgatgtccctagaaaac

SEQ ID NO: 4950656 - DNA, 20 bp, Homo sapiens
gctgatgttggaagagaaag

SEQ ID NO: 4950657 - DNA, 15 bp, Homo sapiens
gctgatttcccctct

SEQ ID NO: 4950658 - DNA, 22 bp, Homo sapiens
gctgcaccagagcaacctctca

SEQ ID NO: 4950659 - DNA, 16 bp, Homo sapiens
gctgcagctggacaga

SEQ ID NO: 4950660 - DNA, 12 bp, Homo sapiens
gctgcagcttgg

SEQ ID NO: 4950661 - DNA, 22 bp, Homo sapiens
gctgcagcttgggagagcccct

SEQ ID NO: 4950662 - DNA, 23 bp, Homo sapiens
gctgcagcttgggagagcccctg

SEQ ID NO: 4950663 - DNA, 21 bp, Homo sapiens
gctgcaggaatcaaaaattga

SEQ ID NO: 4950664 - DNA, 16 bp, Homo sapiens
gctgcaggggctctgg

SEQ ID NO: 4950665 - DNA, 18 bp, Homo sapiens
gctgcatgcctggtcttt

SEQ ID NO: 4950666 - DNA, 15 bp, Homo sapiens
gctgccaaggccaga

SEQ ID NO: 4950667 - DNA, 21 bp, Homo sapiens
gctgccacacttcaggctctt

SEQ ID NO: 4950668 - DNA, 21 bp, Homo sapiens
gctgccatccaggttcagctt

SEQ ID NO: 4950669 - DNA, 23 bp, Homo sapiens
gctgccatccaggttcagcttgt

SEQ ID NO: 4950670 - DNA, 22 bp, Homo sapiens
gctgcccactgtttctcttgag

SEQ ID NO: 4950671 - DNA, 23 bp, Homo sapiens
gctgcccactgtttctcttgagc

SEQ ID NO: 4950672 - DNA, 14 bp, Homo sapiens
gctgcccccggccc

SEQ ID NO: 4950673 - DNA, 15 bp, Homo sapiens
gctgcccctctcacc

SEQ ID NO: 4950674 - DNA, 18 bp, Homo sapiens
gctgccctgagaagctgc

SEQ ID NO: 4950675 - DNA, 13 bp, Homo sapiens
gctgccctggtgc

SEQ ID NO: 4950676 - DNA, 18 bp, Homo sapiens
gctgccctggtgctgcca

SEQ ID NO: 4950677 - DNA, 19 bp, Homo sapiens
gctgccctggtgctgccac

SEQ ID NO: 4950678 - DNA, 13 bp, Homo sapiens
gctgccgcctccc

SEQ ID NO: 4950679 - DNA, 18 bp, Homo sapiens
gctgccgcctcccagcct

SEQ ID NO: 4950680 - DNA, 20 bp, Homo sapiens
gctgccgcctcccagcctgg

SEQ ID NO: 4950681 - DNA, 19 bp, Homo sapiens
gctgcctagcaagctggcc

SEQ ID NO: 4950682 - DNA, 19 bp, Homo sapiens
gctgcctgcccgcacagca

SEQ ID NO: 4950683 - DNA, 20 bp, Homo sapiens
gctgcctgcccgcacagcag

SEQ ID NO: 4950684 - DNA, 18 bp, Homo sapiens
gctgcctgttcagctcca

SEQ ID NO: 4950685 - DNA, 15 bp, Homo sapiens
gctgccttagaacct

SEQ ID NO: 4950686 - DNA, 16 bp, Homo sapiens
gctgccttggctcaga

SEQ ID NO: 4950687 - DNA, 17 bp, Homo sapiens
gctgccttggctcagac

SEQ ID NO: 4950688 - DNA, 19 bp, Homo sapiens
gctgccttggctcagacat

SEQ ID NO: 4950689 - DNA, 21 bp, Homo sapiens
gctgccttggctcagacatgt

SEQ ID NO: 4950690 - DNA, 19 bp, Homo sapiens
gctgcggtccacccaggag

SEQ ID NO: 4950691 - DNA, 22 bp, Homo sapiens
ggaactcctaaacctttgcccc

SEQ ID NO: 4950692 - DNA, 15 bp, Homo sapiens
ggaactccttggcct

SEQ ID NO: 4950693 - DNA, 16 bp, Homo sapiens
ggaactccttggccta

SEQ ID NO: 4950694 - DNA, 14 bp, Homo sapiens
ggaactctgacaag

SEQ ID NO: 4950695 - DNA, 19 bp, Homo sapiens
ggaactctgacaagggctg

SEQ ID NO: 4950696 - DNA, 21 bp, Homo sapiens
ggaactctgacaagggctgac

SEQ ID NO: 4950697 - DNA, 18 bp, Homo sapiens
ggaactgtccagagagca

SEQ ID NO: 4950698 - DNA, 17 bp, Homo sapiens
ggaagacaaaatgtttt

SEQ ID NO: 4950699 - DNA, 19 bp, Homo sapiens
ggaagacatttcttttctt

SEQ ID NO: 4950700 - DNA, 14 bp, Homo sapiens
ggaagaggaaaatt

SEQ ID NO: 4950701 - DNA, 13 bp, Homo sapiens
ggaagcaccccat

SEQ ID NO: 4950702 - DNA, 18 bp, Homo sapiens
ggaagcattcagagagca

SEQ ID NO: 4950703 - DNA, 15 bp, Homo sapiens
ggaagccctggagac

SEQ ID NO: 4950704 - DNA, 23 bp, Homo sapiens
ggaagctccactgtcaccctcca

SEQ ID NO: 4950705 - DNA, 11 bp, Homo sapiens
ggaagctccgc

SEQ ID NO: 4950706 - DNA, 18 bp, Homo sapiens
ggaagctctgaagtcaca

SEQ ID NO: 4950707 - DNA, 11 bp, Homo sapiens
ggaagctgcag

SEQ ID NO: 4950708 - DNA, 17 bp, Homo sapiens
ggaagctgccctgccca

SEQ ID NO: 4950709 - DNA, 18 bp, Homo sapiens
ggaagctggccgagggtc

SEQ ID NO: 4950710 - DNA, 13 bp, Homo sapiens
ggaaggagagcct

SEQ ID NO: 4950711 - DNA, 14 bp, Homo sapiens
ggaaggagagcctg

SEQ ID NO: 4950712 - DNA, 17 bp, Homo sapiens
ggaaggagagcctgctg

SEQ ID NO: 4950713 - DNA, 13 bp, Homo sapiens
ggaaggcagacag

SEQ ID NO: 4950714 - DNA, 15 bp, Homo sapiens
ggaagggcaggaagg

SEQ ID NO: 4950715 - DNA, 18 bp, Homo sapiens
ggaagtagtccttggcat

SEQ ID NO: 4950716 - DNA, 17 bp, Homo sapiens
ggaagtccaatgtggca

SEQ ID NO: 4950717 - DNA, 18 bp, Homo sapiens
ggaagtttcatatattgt

SEQ ID NO: 4950718 - DNA, 21 bp, Homo sapiens
ggaataaaatcctaagacaca

SEQ ID NO: 4950719 - DNA, 22 bp, Homo sapiens
ggaataaccttccatacatttt

SEQ ID NO: 4950720 - DNA, 21 bp, Homo sapiens
ggaataagaagcaaataaata

SEQ ID NO: 4950721 - DNA, 17 bp, Homo sapiens
ggaatactttttgttat

SEQ ID NO: 4950722 - DNA, 19 bp, Homo sapiens
ggaatcaagagctgccctc

SEQ ID NO: 4950723 - DNA, 20 bp, Homo sapiens
ggaatccaagcctccacagc

SEQ ID NO: 4950724 - DNA, 21 bp, Homo sapiens
ggaatccaagcctccacagcg

SEQ ID NO: 4950725 - DNA, 17 bp, Homo sapiens
ggaatcctatatagaat

SEQ ID NO: 4950726 - DNA, 21 bp, Homo sapiens
ggaatcctggcagcccagaga

SEQ ID NO: 4950727 - DNA, 17 bp, Homo sapiens
ggaatgagcccagagaa

SEQ ID NO: 4950728 - DNA, 20 bp, Homo sapiens
ggaatgagcccagagaacag

SEQ ID NO: 4950729 - DNA, 21 bp, Homo sapiens
ggaatgagcccagagaacagc

SEQ ID NO: 4950730 - DNA, 12 bp, Homo sapiens
ggaatgcagtgg

SEQ ID NO: 4950731 - DNA, 19 bp, Homo sapiens
ggaatgtttgcctctgcct

SEQ ID NO: 4950732 - DNA, 22 bp, Homo sapiens
ggaattaagttatctttaaaat

SEQ ID NO: 4950733 - DNA, 16 bp, Homo sapiens
ggaatttcttgtttct

SEQ ID NO: 4950734 - DNA, 14 bp, Homo sapiens
ggacaaaacttctt

SEQ ID NO: 4950735 - DNA, 17 bp, Homo sapiens
ggacacaaaactccgcc

SEQ ID NO: 4950736 - DNA, 22 bp, Homo sapiens
ggacacaaaactccgcccccag

SEQ ID NO: 4950737 - DNA, 23 bp, Homo sapiens
ggacacaaaactccgcccccagc

SEQ ID NO: 4950738 - DNA, 13 bp, Homo sapiens
ggacacacaaggt

SEQ ID NO: 4950739 - DNA, 18 bp, Homo sapiens
ggacaccacacccagcct

SEQ ID NO: 4950740 - DNA, 15 bp, Homo sapiens
ggacaccgggccagt

SEQ ID NO: 4950741 - DNA, 14 bp, Homo sapiens
ggacacctgccctg

SEQ ID NO: 4950742 - DNA, 22 bp, Homo sapiens
ggacacggggcagtggcaacct

SEQ ID NO: 4950743 - DNA, 17 bp, Homo sapiens
ggacactaaccacgctg

SEQ ID NO: 4950744 - DNA, 22 bp, Homo sapiens
ggacactaaccacgctggacct

SEQ ID NO: 4950745 - DNA, 17 bp, Homo sapiens
ggacagaggcctgcccg

SEQ ID NO: 4950746 - DNA, 23 bp, Homo sapiens
ggacagaggggactctgggctat

SEQ ID NO: 4950747 - DNA, 15 bp, Homo sapiens
ggacagccacggcca

SEQ ID NO: 4950748 - DNA, 19 bp, Homo sapiens
ggacagccacggccaggcc

SEQ ID NO: 4950749 - DNA, 20 bp, Homo sapiens
ggacagccacggccaggcca

SEQ ID NO: 4950750 - DNA, 22 bp, Homo sapiens
ggacagccacggccaggccaga

SEQ ID NO: 4950751 - DNA, 18 bp, Homo sapiens
ggacagtatcccacatcc

SEQ ID NO: 4950752 - DNA, 15 bp, Homo sapiens
ggacagttcacaccc

SEQ ID NO: 4950753 - DNA, 19 bp, Homo sapiens
ggacagttcacaccctgca

SEQ ID NO: 4950754 - DNA, 19 bp, Homo sapiens
ggacagtttatcatgaagc

SEQ ID NO: 4950755 - DNA, 23 bp, Homo sapiens
ggacatagaggtatattggaaga

SEQ ID NO: 4950756 - DNA, 14 bp, Homo sapiens
ggacatcagcaaac

SEQ ID NO: 4950757 - DNA, 15 bp, Homo sapiens
ggacatcagcaaaca

SEQ ID NO: 4950758 - DNA, 21 bp, Homo sapiens
ggacatgtttttgttttcttt

SEQ ID NO: 4950759 - DNA, 20 bp, Homo sapiens
ggacattgcggacagccacg

SEQ ID NO: 4950760 - DNA, 23 bp, Homo sapiens
ggacatttattagtatcttccat

SEQ ID NO: 4950761 - DNA, 21 bp, Homo sapiens
ggaccaataaaatttctaaga

SEQ ID NO: 4950762 - DNA, 17 bp, Homo sapiens
ggaccactcagccccta

SEQ ID NO: 4950763 - DNA, 21 bp, Homo sapiens
ggaccactgtttcttgcttgt

SEQ ID NO: 4950764 - DNA, 22 bp, Homo sapiens
ggaccagtggtttccagtcatg

SEQ ID NO: 4950765 - DNA, 23 bp, Homo sapiens
ggacccagccgccatcagcccaa

SEQ ID NO: 4950766 - DNA, 20 bp, Homo sapiens
ggacccatagatcttctgaa

SEQ ID NO: 4950767 - DNA, 11 bp, Homo sapiens
ggaccccagct

SEQ ID NO: 4950768 - DNA, 18 bp, Homo sapiens
ggaccccagctgtgagcc

SEQ ID NO: 4950769 - DNA, 20 bp, Homo sapiens
ggacccggaggggcctggca

SEQ ID NO: 4950770 - DNA, 21 bp, Homo sapiens
ggacccggaggggcctggcag

SEQ ID NO: 4950771 - DNA, 17 bp, Homo sapiens
ggacctcccttccgacc

SEQ ID NO: 4950772 - DNA, 15 bp, Homo sapiens
ggacctcctcttccc

SEQ ID NO: 4950773 - DNA, 22 bp, Homo sapiens
ggacctgcctcctgcctgcccc

SEQ ID NO: 4950774 - DNA, 13 bp, Homo sapiens
ggacctggggcac

SEQ ID NO: 4950775 - DNA, 21 bp, Homo sapiens
ggacctggggcacagtccagg

SEQ ID NO: 4950776 - DNA, 15 bp, Homo sapiens
ggaccttttaaagtg

SEQ ID NO: 4950777 - DNA, 21 bp, Homo sapiens
ggaccttttaaagtgtttcag

SEQ ID NO: 4950778 - DNA, 22 bp, Homo sapiens
ggaccttttaaagtgtttcagc

SEQ ID NO: 4950779 - DNA, 13 bp, Homo sapiens
ggacgtctttctt

SEQ ID NO: 4950780 - DNA, 12 bp, Homo sapiens
ggacgtttctca

SEQ ID NO: 4950781 - DNA, 22 bp, Homo sapiens
ggactaaccccaacgcacagga

SEQ ID NO: 4950782 - DNA, 21 bp, Homo sapiens
ggactaagcctacctgctctc

SEQ ID NO: 4950783 - DNA, 14 bp, Homo sapiens
ggactacaggtgtg

SEQ ID NO: 4950784 - DNA, 20 bp, Homo sapiens
ggactacaggtgtgagtcac

SEQ ID NO: 4950785 - DNA, 22 bp, Homo sapiens
ggactagcccctgtggagactg

SEQ ID NO: 4950786 - DNA, 15 bp, Homo sapiens
ggactcaatgcactg

SEQ ID NO: 4950787 - DNA, 20 bp, Homo sapiens
ggactcacaggttggaagag

SEQ ID NO: 4950788 - DNA, 21 bp, Homo sapiens
ggactcacaggttggaagaga

SEQ ID NO: 4950789 - DNA, 23 bp, Homo sapiens
ggactcacaggttggaagagaat

SEQ ID NO: 4950790 - DNA, 16 bp, Homo sapiens
ggactcagccctgagg

SEQ ID NO: 4950791 - DNA, 22 bp, Homo sapiens
ggactccctcctcacctctgga

SEQ ID NO: 4950792 - DNA, 15 bp, Homo sapiens
ggactctgcacatga

SEQ ID NO: 4950793 - DNA, 11 bp, Homo sapiens
ggactctgcct

SEQ ID NO: 4950794 - DNA, 20 bp, Homo sapiens
ggactctgggctatggacac

SEQ ID NO: 4950795 - DNA, 18 bp, Homo sapiens
ggactctggtgcctccag

SEQ ID NO: 4950796 - DNA, 13 bp, Homo sapiens
ggactgacagcat

SEQ ID NO: 4950797 - DNA, 20 bp, Homo sapiens
ggactgacagcatgtgccct

SEQ ID NO: 4950798 - DNA, 15 bp, Homo sapiens
ggactgagccccgca

SEQ ID NO: 4950799 - DNA, 13 bp, Homo sapiens
ggactgagcctgg

SEQ ID NO: 4950800 - DNA, 23 bp, Homo sapiens
ggccaagacttggcaacagaagc

SEQ ID NO: 4950801 - DNA, 23 bp, Homo sapiens
ggccaagagaaaggcctgcacac

SEQ ID NO: 4950802 - DNA, 19 bp, Homo sapiens
ggccaaggccttctcctcc

SEQ ID NO: 4950803 - DNA, 20 bp, Homo sapiens
ggccacagtagtcttgatga

SEQ ID NO: 4950804 - DNA, 14 bp, Homo sapiens
ggccacatttaata

SEQ ID NO: 4950805 - DNA, 13 bp, Homo sapiens
ggccaccaaagct

SEQ ID NO: 4950806 - DNA, 15 bp, Homo sapiens
ggccaccaaagctgc

SEQ ID NO: 4950807 - DNA, 17 bp, Homo sapiens
ggccaccaaagctgccc

SEQ ID NO: 4950808 - DNA, 12 bp, Homo sapiens
ggccacctctgc

SEQ ID NO: 4950809 - DNA, 23 bp, Homo sapiens
ggccacctctgcggaccccagct

SEQ ID NO: 4950810 - DNA, 11 bp, Homo sapiens
ggccacctgcc

SEQ ID NO: 4950811 - DNA, 15 bp, Homo sapiens
ggccacctgcctgcg

SEQ ID NO: 4950812 - DNA, 22 bp, Homo sapiens
ggccactgctccctaagccagc

SEQ ID NO: 4950813 - DNA, 17 bp, Homo sapiens
ggccagagggagtgaca

SEQ ID NO: 4950814 - DNA, 15 bp, Homo sapiens
ggccagagtggcctg

SEQ ID NO: 4950815 - DNA, 15 bp, Homo sapiens
ggccagccccggccc

SEQ ID NO: 4950816 - DNA, 19 bp, Homo sapiens
ggccagccccggccctggg

SEQ ID NO: 4950817 - DNA, 14 bp, Homo sapiens
ggccagcctcaccc

SEQ ID NO: 4950818 - DNA, 19 bp, Homo sapiens
ggccaggagtttgagacca

SEQ ID NO: 4950819 - DNA, 20 bp, Homo sapiens
ggccaggagtttgagaccag

SEQ ID NO: 4950820 - DNA, 11 bp, Homo sapiens
ggccaggcagg

SEQ ID NO: 4950821 - DNA, 12 bp, Homo sapiens
ggccaggctggt

SEQ ID NO: 4950822 - DNA, 16 bp, Homo sapiens
ggccaggctggtctca

SEQ ID NO: 4950823 - DNA, 19 bp, Homo sapiens
ggccagggtctgtgtgaat

SEQ ID NO: 4950824 - DNA, 20 bp, Homo sapiens
ggccagtcctgcctggccag

SEQ ID NO: 4950825 - DNA, 22 bp, Homo sapiens
ggccagtcctgcctggccaggc

SEQ ID NO: 4950826 - DNA, 15 bp, Homo sapiens
ggccagtggggcctg

SEQ ID NO: 4950827 - DNA, 19 bp, Homo sapiens
ggccatgcaattcatccca

SEQ ID NO: 4950828 - DNA, 13 bp, Homo sapiens
ggccatggcagaa

SEQ ID NO: 4950829 - DNA, 16 bp, Homo sapiens
ggccatgtccaaagag

SEQ ID NO: 4950830 - DNA, 22 bp, Homo sapiens
ggccatgtccaaagaggctgcc

SEQ ID NO: 4950831 - DNA, 14 bp, Homo sapiens
ggccattctgccgc

SEQ ID NO: 4950832 - DNA, 14 bp, Homo sapiens
ggcccaaggcggcc

SEQ ID NO: 4950833 - DNA, 24 bp, Homo sapiens
ggcccagcccctagaaacccaagc

SEQ ID NO: 4950834 - DNA, 19 bp, Homo sapiens
ggcccatagaaacatgaca

SEQ ID NO: 4950835 - DNA, 23 bp, Homo sapiens
ggcccatagaaacatgacactga

SEQ ID NO: 4950836 - DNA, 24 bp, Homo sapiens
ggcccatatctgtgaaatgctggc

SEQ ID NO: 4950837 - DNA, 13 bp, Homo sapiens
ggccccactgatg

SEQ ID NO: 4950838 - DNA, 21 bp, Homo sapiens
ggccccccagctcaggggcag

SEQ ID NO: 4950839 - DNA, 18 bp, Homo sapiens
ggccccctggtctctggt

SEQ ID NO: 4950840 - DNA, 23 bp, Homo sapiens
ggccccggatcagagcaggacct

SEQ ID NO: 4950841 - DNA, 14 bp, Homo sapiens
ggcccctctgacct

SEQ ID NO: 4950842 - DNA, 13 bp, Homo sapiens
ggcccctgccacc

SEQ ID NO: 4950843 - DNA, 13 bp, Homo sapiens
ggcccctgcccgg

SEQ ID NO: 4950844 - DNA, 13 bp, Homo sapiens
ggcccctgctggt

SEQ ID NO: 4950845 - DNA, 14 bp, Homo sapiens
ggcccctgctggtt

SEQ ID NO: 4950846 - DNA, 22 bp, Homo sapiens
ggccctcatctatgaggaaagg

SEQ ID NO: 4950847 - DNA, 20 bp, Homo sapiens
ggccctcctgtgctggggga

SEQ ID NO: 4950848 - DNA, 22 bp, Homo sapiens
ggccctgcagtgttcgcttggc

SEQ ID NO: 4950849 - DNA, 17 bp, Homo sapiens
ggccctgccctggcagg

SEQ ID NO: 4950850 - DNA, 15 bp, Homo sapiens
ggccctgctcctgca

SEQ ID NO: 4950851 - DNA, 17 bp, Homo sapiens
ggccctgctcctgcagc

SEQ ID NO: 4950852 - DNA, 21 bp, Homo sapiens
ggccctgctcctgcagcatgg

SEQ ID NO: 4950853 - DNA, 13 bp, Homo sapiens
ggccctggctccc

SEQ ID NO: 4950854 - DNA, 19 bp, Homo sapiens
ggccctggctgagggcagc

SEQ ID NO: 4950855 - DNA, 16 bp, Homo sapiens
ggccctgggctcggag

SEQ ID NO: 4950856 - DNA, 15 bp, Homo sapiens
ggccctggggtccca

SEQ ID NO: 4950857 - DNA, 22 bp, Homo sapiens
ggccctgtccctcccacctctg

SEQ ID NO: 4950858 - DNA, 23 bp, Homo sapiens
ggccctgtccctcccacctctgt

SEQ ID NO: 4950859 - DNA, 19 bp, Homo sapiens
ggccgaatcccctccctgt

SEQ ID NO: 4950860 - DNA, 21 bp, Homo sapiens
ggccgaatcccctccctgtca

SEQ ID NO: 4950861 - DNA, 18 bp, Homo sapiens
ggccgagggtcctggctc

SEQ ID NO: 4950862 - DNA, 22 bp, Homo sapiens
ggccgatttgggaaccaagcta

SEQ ID NO: 4950863 - DNA, 14 bp, Homo sapiens
ggccgctccaccag

SEQ ID NO: 4950864 - DNA, 13 bp, Homo sapiens
ggccggccagcct

SEQ ID NO: 4950865 - DNA, 20 bp, Homo sapiens
ggcctaaaactggcctgact

SEQ ID NO: 4950866 - DNA, 23 bp, Homo sapiens
ggcctacagctttgatccctgac

SEQ ID NO: 4950867 - DNA, 20 bp, Homo sapiens
ggcctcaaaggcccgctcta

SEQ ID NO: 4950868 - DNA, 17 bp, Homo sapiens
ggcctcagctgaatgcc

SEQ ID NO: 4950869 - DNA, 22 bp, Homo sapiens
ggcctcagctgcctcacttcct

SEQ ID NO: 4950870 - DNA, 21 bp, Homo sapiens
ggcctccgtccaggagcctgg

SEQ ID NO: 4950871 - DNA, 23 bp, Homo sapiens
ggcctcgggacacctgccctgcc

SEQ ID NO: 4950872 - DNA, 13 bp, Homo sapiens
ggcctctctagca

SEQ ID NO: 4950873 - DNA, 21 bp, Homo sapiens
ggcctgagagaattggctcaa

SEQ ID NO: 4950874 - DNA, 23 bp, Homo sapiens
ggcctgcctggcccctcgcctgt

SEQ ID NO: 4950875 - DNA, 11 bp, Homo sapiens
ggcctgcctgt

SEQ ID NO: 4950876 - DNA, 13 bp, Homo sapiens
ggcctggacctgc

SEQ ID NO: 4950877 - DNA, 21 bp, Homo sapiens
ggcctggacctgcctcctgcc

SEQ ID NO: 4950878 - DNA, 22 bp, Homo sapiens
ggcctggacctgcctcctgcct

SEQ ID NO: 4950879 - DNA, 15 bp, Homo sapiens
ggcctggcagccgtg

SEQ ID NO: 4950880 - DNA, 15 bp, Homo sapiens
ggcctggccagatgc

SEQ ID NO: 4950881 - DNA, 18 bp, Homo sapiens
ggcctggccaggagctct

SEQ ID NO: 4950882 - DNA, 23 bp, Homo sapiens
ggcctgtctcatccccaggggtc

SEQ ID NO: 4950883 - DNA, 16 bp, Homo sapiens
ggcctgtggaatgagt

SEQ ID NO: 4950884 - DNA, 19 bp, Homo sapiens
ggcctgtggaatgagtgtg

SEQ ID NO: 4950885 - DNA, 22 bp, Homo sapiens
ggcctgtggaatgagtgtgcat

SEQ ID NO: 4950886 - DNA, 15 bp, Homo sapiens
ggccttccagctgct

SEQ ID NO: 4950887 - DNA, 16 bp, Homo sapiens
ggccttccagctgctg

SEQ ID NO: 4950888 - DNA, 14 bp, Homo sapiens
ggcctttcctctct

SEQ ID NO: 4950889 - DNA, 17 bp, Homo sapiens
ggccttttaacattttg

SEQ ID NO: 4950890 - DNA, 16 bp, Homo sapiens
ggcgagagaggagcca

SEQ ID NO: 4950891 - DNA, 22 bp, Homo sapiens
ggcgatccacctgtctcagcct

SEQ ID NO: 4950892 - DNA, 13 bp, Homo sapiens
ggcgcccacctcc

SEQ ID NO: 4950893 - DNA, 15 bp, Homo sapiens
ggcgcccacctcccc

SEQ ID NO: 4950894 - DNA, 24 bp, Homo sapiens
ggcgcccacctccccacgccctcc

SEQ ID NO: 4950895 - DNA, 15 bp, Homo sapiens
ggcgcccctgccacc

SEQ ID NO: 4950896 - DNA, 14 bp, Homo sapiens
ggcgcggccagccc

SEQ ID NO: 4950897 - DNA, 13 bp, Homo sapiens
ggcggccccagca

SEQ ID NO: 4950898 - DNA, 23 bp, Homo sapiens
ggcggtgcccacaccggggacag

SEQ ID NO: 4950899 - DNA, 14 bp, Homo sapiens
ggcgtgcagtggtg

SEQ ID NO: 4950900 - DNA, 19 bp, Homo sapiens
ggcgtgcagtggtgcgatc

SEQ ID NO: 4950901 - DNA, 20 bp, Homo sapiens
ggcgtggagagcccggcgcc

SEQ ID NO: 4950902 - DNA, 14 bp, Homo sapiens
ggctaagaggctgc

SEQ ID NO: 4950903 - DNA, 20 bp, Homo sapiens
ggctaagtgatcctcccacc

SEQ ID NO: 4950904 - DNA, 15 bp, Homo sapiens
ggctaattaaataaa

SEQ ID NO: 4950905 - DNA, 15 bp, Homo sapiens
ggctacgaatcttcc

SEQ ID NO: 4950906 - DNA, 16 bp, Homo sapiens
ggctagaggccagccc

SEQ ID NO: 4950907 - DNA, 20 bp, Homo sapiens
ggctagaggccagccccacc

SEQ ID NO: 4950908 - DNA, 16 bp, Homo sapiens
ggctaggacccctcca

SEQ ID NO: 4950909 - DNA, 13 bp, Homo sapiens
ggctaggtacaca

SEQ ID NO: 4950910 - DNA, 21 bp, Homo sapiens
ggctaggtagaaaaagggtca

SEQ ID NO: 4950911 - DNA, 16 bp, Homo sapiens
ggctagttgggcttcc

SEQ ID NO: 4950912 - DNA, 19 bp, Homo sapiens
ggctcaagcgattctcctg

SEQ ID NO: 4950913 - DNA, 15 bp, Homo sapiens
ggctcaagtcctctt

SEQ ID NO: 4950914 - DNA, 16 bp, Homo sapiens
ggctcactgcagcctc

SEQ ID NO: 4950915 - DNA, 17 bp, Homo sapiens
ggctcactggctttgaa

SEQ ID NO: 4950916 - DNA, 13 bp, Homo sapiens
ggctcagagatgt

SEQ ID NO: 4950917 - DNA, 12 bp, Homo sapiens
ggctcagagggg

SEQ ID NO: 4950918 - DNA, 20 bp, Homo sapiens
ggctcagctcggggagcctt

SEQ ID NO: 4950919 - DNA, 14 bp, Homo sapiens
ggctccaggctcct

SEQ ID NO: 4950920 - DNA, 16 bp, Homo sapiens
ggctccaggctccttt

SEQ ID NO: 4950921 - DNA, 17 bp, Homo sapiens
ggctccccatgtgtcct

SEQ ID NO: 4950922 - DNA, 21 bp, Homo sapiens
ggctccccatgtgtcctggtt

SEQ ID NO: 4950923 - DNA, 20 bp, Homo sapiens
ggctcccctttttcttcctc

SEQ ID NO: 4950924 - DNA, 21 bp, Homo sapiens
ggctccgcccttagtccccca

SEQ ID NO: 4950925 - DNA, 14 bp, Homo sapiens
ggctcctcacatag

SEQ ID NO: 4950926 - DNA, 12 bp, Homo sapiens
ggctcctgccag

SEQ ID NO: 4950927 - DNA, 11 bp, Homo sapiens
ggctcctgtcc

SEQ ID NO: 4950928 - DNA, 22 bp, Homo sapiens
ggctctagggttgctggagcct

SEQ ID NO: 4950929 - DNA, 18 bp, Homo sapiens
ggctctatgagtctagat

SEQ ID NO: 4950930 - DNA, 14 bp, Homo sapiens
ggctctcagctcag

SEQ ID NO: 4950931 - DNA, 22 bp, Homo sapiens
ggctctgagagtctagattctc

SEQ ID NO: 4950932 - DNA, 19 bp, Homo sapiens
ggctctgaggtgcctgtcc

SEQ ID NO: 4950933 - DNA, 20 bp, Homo sapiens
ggctctgcaattcccctctg

SEQ ID NO: 4950934 - DNA, 15 bp, Homo sapiens
ggctctggagacagc

SEQ ID NO: 4950935 - DNA, 21 bp, Homo sapiens
ggctctggagacagccccaga

SEQ ID NO: 4950936 - DNA, 14 bp, Homo sapiens
ggctctggagagaa

SEQ ID NO: 4950937 - DNA, 15 bp, Homo sapiens
ggctctgtccccctg

SEQ ID NO: 4950938 - DNA, 11 bp, Homo sapiens
ggctcttccaa

SEQ ID NO: 4950939 - DNA, 13 bp, Homo sapiens
ggctcttctcctt

SEQ ID NO: 4950940 - DNA, 14 bp, Homo sapiens
ggctcttctccttt

SEQ ID NO: 4950941 - DNA, 20 bp, Homo sapiens
ggctcttgtgctggatggag

SEQ ID NO: 4950942 - DNA, 15 bp, Homo sapiens
ggctctttgggctgg

SEQ ID NO: 4950943 - DNA, 15 bp, Homo sapiens
ggctgacgtgtgagg

SEQ ID NO: 4950944 - DNA, 15 bp, Homo sapiens
ggctgaggaggcctc

SEQ ID NO: 4950945 - DNA, 21 bp, Homo sapiens
ggctgagttctggtcaaagaa

SEQ ID NO: 4950946 - DNA, 22 bp, Homo sapiens
ggctgcaaagggtatcaggtgc

SEQ ID NO: 4950947 - DNA, 15 bp, Homo sapiens
ggctgcagctggaca

SEQ ID NO: 4950948 - DNA, 21 bp, Homo sapiens
ggctgcccccggccccctggt

SEQ ID NO: 4950949 - DNA, 15 bp, Homo sapiens
ggctgcccctctcac

SEQ ID NO: 4950950 - DNA, 13 bp, Homo sapiens
ggctgccctgaga

SEQ ID NO: 4950951 - DNA, 18 bp, Homo sapiens
ggctgccctgagaagctg

SEQ ID NO: 4950952 - DNA, 19 bp, Homo sapiens
ggctgccctggtgctgcca

SEQ ID NO: 4950953 - DNA, 18 bp, Homo sapiens
ggctgcccttgggccacc

SEQ ID NO: 4950954 - DNA, 22 bp, Homo sapiens
ggctgcggaatgaaccacatct

SEQ ID NO: 4950955 - DNA, 15 bp, Homo sapiens
ggctgctacccagaa

SEQ ID NO: 4950956 - DNA, 14 bp, Homo sapiens
ggctggcaggtatg

SEQ ID NO: 4950957 - DNA, 16 bp, Homo sapiens
ggctggccccagggca

SEQ ID NO: 4950958 - DNA, 14 bp, Homo sapiens
ggctggcgtgcagt

SEQ ID NO: 4950959 - DNA, 20 bp, Homo sapiens
ggctggcgtgcagtggtgcg

SEQ ID NO: 4950960 - DNA, 23 bp, Homo sapiens
ggctgggagtagttgtctttcct

SEQ ID NO: 4950961 - DNA, 19 bp, Homo sapiens
ggctgggcaaggaaaaaga

SEQ ID NO: 4950962 - DNA, 22 bp, Homo sapiens
ggctgggccccccagctcaggg

SEQ ID NO: 4950963 - DNA, 11 bp, Homo sapiens
ggctgggcttc

SEQ ID NO: 4950964 - DNA, 17 bp, Homo sapiens
ggctgggcttcagtggc

SEQ ID NO: 4950965 - DNA, 17 bp, Homo sapiens
ggctgggggcaggaggg

SEQ ID NO: 4950966 - DNA, 14 bp, Homo sapiens
ggctgggggcctca

SEQ ID NO: 4950967 - DNA, 17 bp, Homo sapiens
ggctgggggcctcagtg

SEQ ID NO: 4950968 - DNA, 19 bp, Homo sapiens
ggctgggggcctcagtgcc

SEQ ID NO: 4950969 - DNA, 19 bp, Homo sapiens
ggctggtaacagttcatgt

SEQ ID NO: 4950970 - DNA, 16 bp, Homo sapiens
ggctggtgtcacctga

SEQ ID NO: 4950971 - DNA, 19 bp, Homo sapiens
ggctgtatcccatgagcct

SEQ ID NO: 4950972 - DNA, 23 bp, Homo sapiens
ggctgtatcccatgagcctcagc

SEQ ID NO: 4950973 - DNA, 13 bp, Homo sapiens
ggctgtgaggccc

SEQ ID NO: 4950974 - DNA, 15 bp, Homo sapiens
ggctgtgctcagaga

SEQ ID NO: 4950975 - DNA, 13 bp, Homo sapiens
ggctgttctgcac

SEQ ID NO: 4950976 - DNA, 19 bp, Homo sapiens
ggctgttctgcactgaaaa

SEQ ID NO: 4950977 - DNA, 22 bp, Homo sapiens
ggcttacctgacctcttgctgt

SEQ ID NO: 4950978 - DNA, 22 bp, Homo sapiens
ggcttatattcaaccatggact

SEQ ID NO: 4950979 - DNA, 20 bp, Homo sapiens
ggcttatttattaacaggat

SEQ ID NO: 4950980 - DNA, 18 bp, Homo sapiens
ggcttattttaatgtgat

SEQ ID NO: 4950981 - DNA, 15 bp, Homo sapiens
ggcttcactgtataa

SEQ ID NO: 4950982 - DNA, 15 bp, Homo sapiens
ggcttcagtggcagc

SEQ ID NO: 4950983 - DNA, 17 bp, Homo sapiens
ggcttcagtggcagctg

SEQ ID NO: 4950984 - DNA, 19 bp, Homo sapiens
ggcttcagtggcagctgct

SEQ ID NO: 4950985 - DNA, 20 bp, Homo sapiens
ggcttcagtggcagctgctt

SEQ ID NO: 4950986 - DNA, 18 bp, Homo sapiens
ggcttcccgctcagccct

SEQ ID NO: 4950987 - DNA, 19 bp, Homo sapiens
ggcttcccgctcagccctc

SEQ ID NO: 4950988 - DNA, 21 bp, Homo sapiens
ggcttcccgctcagccctccc

SEQ ID NO: 4950989 - DNA, 18 bp, Homo sapiens
ggcttctgtgatgagctg

SEQ ID NO: 4950990 - DNA, 21 bp, Homo sapiens
ggcttctgtgatgagctgatc

SEQ ID NO: 4950991 - DNA, 21 bp, Homo sapiens
ggcttgagaaatatggacact

SEQ ID NO: 4950992 - DNA, 18 bp, Homo sapiens
ggcttggcgtggagcagg

SEQ ID NO: 4950993 - DNA, 16 bp, Homo sapiens
ggcttgtagaattgtt

SEQ ID NO: 4950994 - DNA, 22 bp, Homo sapiens
ggctttcattattagtactgct

SEQ ID NO: 4950995 - DNA, 19 bp, Homo sapiens
ggcttttcactgctggctg

SEQ ID NO: 4950996 - DNA, 22 bp, Homo sapiens
gggaaccaagctattcctttcc

SEQ ID NO: 4950997 - DNA, 14 bp, Homo sapiens
gggaacctcccaga

SEQ ID NO: 4950998 - DNA, 17 bp, Homo sapiens
gggaacctcccagaggt

SEQ ID NO: 4950999 - DNA, 19 bp, Homo sapiens
gggaactctgacaagggct

SEQ ID NO: 4951000 - DNA, 20 bp, Homo sapiens
gggaagaaacactttctctt

SEQ ID NO: 4951001 - DNA, 17 bp, Homo sapiens
gggaagaagcagagaga

SEQ ID NO: 4951002 - DNA, 19 bp, Homo sapiens
gggaagctgcagcttggga

SEQ ID NO: 4951003 - DNA, 15 bp, Homo sapiens
gggaagctggcctga

SEQ ID NO: 4951004 - DNA, 21 bp, Homo sapiens
gggaaggagggtacagctggg

SEQ ID NO: 4951005 - DNA, 11 bp, Homo sapiens
gggaaggcctc

SEQ ID NO: 4951006 - DNA, 21 bp, Homo sapiens
gggaagggggggctacattat

SEQ ID NO: 4951007 - DNA, 14 bp, Homo sapiens
gggaagtcctccct

SEQ ID NO: 4951008 - DNA, 22 bp, Homo sapiens
gggaagttgcattcctttgtct

SEQ ID NO: 4951009 - DNA, 12 bp, Homo sapiens
gggaatatttta

SEQ ID NO: 4951010 - DNA, 18 bp, Homo sapiens
gggaatccaagcctccac

SEQ ID NO: 4951011 - DNA, 19 bp, Homo sapiens
gggaatccccgaaggtgct

SEQ ID NO: 4951012 - DNA, 21 bp, Homo sapiens
gggaatctaatatccccaaat

SEQ ID NO: 4951013 - DNA, 16 bp, Homo sapiens
gggaatgagcccagag

SEQ ID NO: 4951014 - DNA, 21 bp, Homo sapiens
gggaatgtttgcctctgcctc

SEQ ID NO: 4951015 - DNA, 18 bp, Homo sapiens
gggacacaaaactccgcc

SEQ ID NO: 4951016 - DNA, 13 bp, Homo sapiens
gggacaggcctca

SEQ ID NO: 4951017 - DNA, 16 bp, Homo sapiens
gggaccaactgggccc

SEQ ID NO: 4951018 - DNA, 19 bp, Homo sapiens
gggacccaggctccgccct

SEQ ID NO: 4951019 - DNA, 21 bp, Homo sapiens
gggacctggtaccctcctggc

SEQ ID NO: 4951020 - DNA, 16 bp, Homo sapiens
gggactcaatgcactg

SEQ ID NO: 4951021 - DNA, 17 bp, Homo sapiens
gggactcaatgcactga

SEQ ID NO: 4951022 - DNA, 15 bp, Homo sapiens
gggactgcctctgcc

SEQ ID NO: 4951023 - DNA, 21 bp, Homo sapiens
gggactgctgctgcctggcca

SEQ ID NO: 4951024 - DNA, 20 bp, Homo sapiens
gggactggggatgtgggagg

SEQ ID NO: 4951025 - DNA, 15 bp, Homo sapiens
gggacttggaagctc

SEQ ID NO: 4951026 - DNA, 17 bp, Homo sapiens
gggacttggaagctccg

SEQ ID NO: 4951027 - DNA, 14 bp, Homo sapiens
gggagagcccctgg

SEQ ID NO: 4951028 - DNA, 14 bp, Homo sapiens
gagtgagactctgt

SEQ ID NO: 4951029 - DNA, 15 bp, Homo sapiens
gagtgagctacagag

SEQ ID NO: 4951030 - DNA, 22 bp, Homo sapiens
gagtgagctacagagccgagca

SEQ ID NO: 4951031 - DNA, 13 bp, Homo sapiens
gagtgcacagctg

SEQ ID NO: 4951032 - DNA, 11 bp, Homo sapiens
gagtgcagtga

SEQ ID NO: 4951033 - DNA, 14 bp, Homo sapiens
gagtgctggctcac

SEQ ID NO: 4951034 - DNA, 10 bp, Homo sapiens
gagtggcctg

SEQ ID NO: 4951035 - DNA, 12 bp, Homo sapiens
gagtggcctggc

SEQ ID NO: 4951036 - DNA, 19 bp, Homo sapiens
gagtggcctggccaggagc

SEQ ID NO: 4951037 - DNA, 19 bp, Homo sapiens
gagtgggagaaggcagtga

SEQ ID NO: 4951038 - DNA, 15 bp, Homo sapiens
gagtgggtgacaaga

SEQ ID NO: 4951039 - DNA, 17 bp, Homo sapiens
gagtgtaatgtttgtta

SEQ ID NO: 4951040 - DNA, 13 bp, Homo sapiens
gagtgtagaagca

SEQ ID NO: 4951041 - DNA, 16 bp, Homo sapiens
gagtgtagaagcattc

SEQ ID NO: 4951042 - DNA, 14 bp, Homo sapiens
gagtgtgacagggc

SEQ ID NO: 4951043 - DNA, 17 bp, Homo sapiens
gagtgtgtatgccaaga

SEQ ID NO: 4951044 - DNA, 14 bp, Homo sapiens
gagtgtgtgtgtgt

SEQ ID NO: 4951045 - DNA, 14 bp, Homo sapiens
gagttaagaagctg

SEQ ID NO: 4951046 - DNA, 20 bp, Homo sapiens
gagttcataccctgttacca

SEQ ID NO: 4951047 - DNA, 13 bp, Homo sapiens
gagttcatcccag

SEQ ID NO: 4951048 - DNA, 18 bp, Homo sapiens
gagttcggctctgggtgg

SEQ ID NO: 4951049 - DNA, 11 bp, Homo sapiens
gagttctacat

SEQ ID NO: 4951050 - DNA, 20 bp, Homo sapiens
gagttgccaagacaaatcaa

SEQ ID NO: 4951051 - DNA, 15 bp, Homo sapiens
gagtttcatgtacaa

SEQ ID NO: 4951052 - DNA, 16 bp, Homo sapiens
gagtttctaaggtccg

SEQ ID NO: 4951053 - DNA, 18 bp, Homo sapiens
gagtttgtgtgttgtctt

SEQ ID NO: 4951054 - DNA, 20 bp, Homo sapiens
gataaaaatatcatcatagt

SEQ ID NO: 4951055 - DNA, 21 bp, Homo sapiens
gataaaataatgctgcaaact

SEQ ID NO: 4951056 - DNA, 16 bp, Homo sapiens
gataaaatgactactt

SEQ ID NO: 4951057 - DNA, 18 bp, Homo sapiens
gataaacaacaaggtggt

SEQ ID NO: 4951058 - DNA, 22 bp, Homo sapiens
gataaagatgcaaggaccagga

SEQ ID NO: 4951059 - DNA, 14 bp, Homo sapiens
gataaagcacagct

SEQ ID NO: 4951060 - DNA, 17 bp, Homo sapiens
gataaagcctcaaggtt

SEQ ID NO: 4951061 - DNA, 17 bp, Homo sapiens
gataacctatatgattt

SEQ ID NO: 4951062 - DNA, 21 bp, Homo sapiens
gataacgcttaaaggaagtca

SEQ ID NO: 4951063 - DNA, 22 bp, Homo sapiens
gataataaattgaaattgtgaa

SEQ ID NO: 4951064 - DNA, 18 bp, Homo sapiens
gataataatattgttttt

SEQ ID NO: 4951065 - DNA, 20 bp, Homo sapiens
gataataatattgtttttct

SEQ ID NO: 4951066 - DNA, 12 bp, Homo sapiens
gataatagattc

SEQ ID NO: 4951067 - DNA, 23 bp, Homo sapiens
gataatattactgtttatttctg

SEQ ID NO: 4951068 - DNA, 21 bp, Homo sapiens
gataatcagtgtgtctaaatt

SEQ ID NO: 4951069 - DNA, 11 bp, Homo sapiens
gataatgttaa

SEQ ID NO: 4951070 - DNA, 21 bp, Homo sapiens
gataatgttaaatttgtaagt

SEQ ID NO: 4951071 - DNA, 11 bp, Homo sapiens
gataattgcta

SEQ ID NO: 4951072 - DNA, 16 bp, Homo sapiens
gataattgctatttat

SEQ ID NO: 4951073 - DNA, 16 bp, Homo sapiens
gatacaacctccctct

SEQ ID NO: 4951074 - DNA, 16 bp, Homo sapiens
gatacaagattagaag

SEQ ID NO: 4951075 - DNA, 23 bp, Homo sapiens
gatacaggaaaagctgctgacag

SEQ ID NO: 4951076 - DNA, 15 bp, Homo sapiens
gatacataataaaaa

SEQ ID NO: 4951077 - DNA, 21 bp, Homo sapiens
gatacatcactgcttgatgaa

SEQ ID NO: 4951078 - DNA, 14 bp, Homo sapiens
gataccagaaggga

SEQ ID NO: 4951079 - DNA, 18 bp, Homo sapiens
gatacccaggaccaagcc

SEQ ID NO: 4951080 - DNA, 22 bp, Homo sapiens
gatacgctactataaagagaag

SEQ ID NO: 4951081 - DNA, 19 bp, Homo sapiens
gatacttatattttcgtat

SEQ ID NO: 4951082 - DNA, 18 bp, Homo sapiens
gatacttcatttaaaaaa

SEQ ID NO: 4951083 - DNA, 16 bp, Homo sapiens
gatagatttggaatag

SEQ ID NO: 4951084 - DNA, 13 bp, Homo sapiens
gatagcattgctt

SEQ ID NO: 4951085 - DNA, 23 bp, Homo sapiens
gatagcatttttgatttatgcat

SEQ ID NO: 4951086 - DNA, 18 bp, Homo sapiens
gatagctaacattttaaa

SEQ ID NO: 4951087 - DNA, 15 bp, Homo sapiens
gataggaccttgggc

SEQ ID NO: 4951088 - DNA, 14 bp, Homo sapiens
gatagtctttcagt

SEQ ID NO: 4951089 - DNA, 22 bp, Homo sapiens
gatagtctttcagttaaggaga

SEQ ID NO: 4951090 - DNA, 14 bp, Homo sapiens
gatataaattctgt

SEQ ID NO: 4951091 - DNA, 21 bp, Homo sapiens
gatatacagatgaaaatttga

SEQ ID NO: 4951092 - DNA, 16 bp, Homo sapiens
gatatactttgtggac

SEQ ID NO: 4951093 - DNA, 14 bp, Homo sapiens
gatatatctgaaaa

SEQ ID NO: 4951094 - DNA, 15 bp, Homo sapiens
gatatggcagaagac

SEQ ID NO: 4951095 - DNA, 20 bp, Homo sapiens
gatatgggactgagcctggc

SEQ ID NO: 4951096 - DNA, 14 bp, Homo sapiens
gatattgtacataa

SEQ ID NO: 4951097 - DNA, 21 bp, Homo sapiens
gatattttcaacgcagccctg

SEQ ID NO: 4951098 - DNA, 20 bp, Homo sapiens
gatcaaaataaaaagtgaca

SEQ ID NO: 4951099 - DNA, 21 bp, Homo sapiens
gatcaaccccttcgctcctgt

SEQ ID NO: 4951100 - DNA, 16 bp, Homo sapiens
gatcaattatagtttc

SEQ ID NO: 4951101 - DNA, 21 bp, Homo sapiens
gatcaattatagtttctgagg

SEQ ID NO: 4951102 - DNA, 17 bp, Homo sapiens
gatcacgacgctgcaga

SEQ ID NO: 4951103 - DNA, 15 bp, Homo sapiens
gatcacgccactgca

SEQ ID NO: 4951104 - DNA, 23 bp, Homo sapiens
ctgctgaccaattgtgctgccat

SEQ ID NO: 4951105 - DNA, 14 bp, Homo sapiens
ctgctgcaggggct

SEQ ID NO: 4951106 - DNA, 18 bp, Homo sapiens
ctgctgcaggggctctgg

SEQ ID NO: 4951107 - DNA, 15 bp, Homo sapiens
ctgctgcccagcctc

SEQ ID NO: 4951108 - DNA, 22 bp, Homo sapiens
ctgctgcccagcctccaagctc

SEQ ID NO: 4951109 - DNA, 19 bp, Homo sapiens
ctgctgcccaggctgtgca

SEQ ID NO: 4951110 - DNA, 23 bp, Homo sapiens
ctgctgcccttaggccacatggg

SEQ ID NO: 4951111 - DNA, 19 bp, Homo sapiens
ctgctgccgcctcccagcc

SEQ ID NO: 4951112 - DNA, 21 bp, Homo sapiens
ctgctgccgcctcccagcctg

SEQ ID NO: 4951113 - DNA, 14 bp, Homo sapiens
ctgctgcctggcca

SEQ ID NO: 4951114 - DNA, 21 bp, Homo sapiens
ctgctgcctggccactgctcc

SEQ ID NO: 4951115 - DNA, 21 bp, Homo sapiens
ctgctgcgcccttaccttccc

SEQ ID NO: 4951116 - DNA, 14 bp, Homo sapiens
ctgctgctgcctgg

SEQ ID NO: 4951117 - DNA, 15 bp, Homo sapiens
ctgctgctgcctggc

SEQ ID NO: 4951118 - DNA, 17 bp, Homo sapiens
ctgctgctgcctggcca

SEQ ID NO: 4951119 - DNA, 16 bp, Homo sapiens
ctgctgctgcgccctt

SEQ ID NO: 4951120 - DNA, 16 bp, Homo sapiens
ctgctggcccagccaa

SEQ ID NO: 4951121 - DNA, 19 bp, Homo sapiens
ctgctggctcttctgccca

SEQ ID NO: 4951122 - DNA, 13 bp, Homo sapiens
ctgctggctgcct

SEQ ID NO: 4951123 - DNA, 15 bp, Homo sapiens
ctgctggtcacagcc

SEQ ID NO: 4951124 - DNA, 14 bp, Homo sapiens
ctgctgtcttctgg

SEQ ID NO: 4951125 - DNA, 12 bp, Homo sapiens
ctgcttagcttg

SEQ ID NO: 4951126 - DNA, 19 bp, Homo sapiens
ctgcttcaatcccagccta

SEQ ID NO: 4951127 - DNA, 23 bp, Homo sapiens
ctgcttcagcctcccgagtagct

SEQ ID NO: 4951128 - DNA, 19 bp, Homo sapiens
ctgcttcagtgtatggaaa

SEQ ID NO: 4951129 - DNA, 24 bp, Homo sapiens
ctgcttccaattttctggaataca

SEQ ID NO: 4951130 - DNA, 19 bp, Homo sapiens
ctgcttcccacctccctgc

SEQ ID NO: 4951131 - DNA, 19 bp, Homo sapiens
ctgcttccggtagggaggc

SEQ ID NO: 4951132 - DNA, 19 bp, Homo sapiens
ctgcttctgaatgtgctga

SEQ ID NO: 4951133 - DNA, 17 bp, Homo sapiens
ctgcttgatgaagcaag

SEQ ID NO: 4951134 - DNA, 23 bp, Homo sapiens
ctgctttgggatttaatttccag

SEQ ID NO: 4951135 - DNA, 20 bp, Homo sapiens
ctgctttgggctgccctggt

SEQ ID NO: 4951136 - DNA, 22 bp, Homo sapiens
ctgctttgggctgccctggtgc

SEQ ID NO: 4951137 - DNA, 16 bp, Homo sapiens
gaatatccatgtactt

SEQ ID NO: 4951138 - DNA, 17 bp, Homo sapiens
gaatatctattaatata

SEQ ID NO: 4951139 - DNA, 22 bp, Homo sapiens
gaatattgctttggtcatatga

SEQ ID NO: 4951140 - DNA, 14 bp, Homo sapiens
gaatcaagagctgc

SEQ ID NO: 4951141 - DNA, 15 bp, Homo sapiens
gaatcaagagctgcc

SEQ ID NO: 4951142 - DNA, 18 bp, Homo sapiens
gaatcaagagctgccctc

SEQ ID NO: 4951143 - DNA, 15 bp, Homo sapiens
gaatccaagcctcca

SEQ ID NO: 4951144 - DNA, 17 bp, Homo sapiens
gaatccaagctccctgc

SEQ ID NO: 4951145 - DNA, 20 bp, Homo sapiens
gaatccaagctccctgcccc

SEQ ID NO: 4951146 - DNA, 18 bp, Homo sapiens
gaatccacatttctaaaa

SEQ ID NO: 4951147 - DNA, 18 bp, Homo sapiens
gaatccagacccggctgc

SEQ ID NO: 4951148 - DNA, 19 bp, Homo sapiens
gaatcccaaatttgattga

SEQ ID NO: 4951149 - DNA, 22 bp, Homo sapiens
gaatcccacccacatgtgacac

SEQ ID NO: 4951150 - DNA, 15 bp, Homo sapiens
gaatcccagccggcc

SEQ ID NO: 4951151 - DNA, 17 bp, Homo sapiens
gaatcccccttgccacc

SEQ ID NO: 4951152 - DNA, 23 bp, Homo sapiens
gaatcccccttgccaccccaccc

SEQ ID NO: 4951153 - DNA, 22 bp, Homo sapiens
gaatcctatatagaatgctgca

SEQ ID NO: 4951154 - DNA, 16 bp, Homo sapiens
gaatcctggcagccca

SEQ ID NO: 4951155 - DNA, 19 bp, Homo sapiens
gaatcctttggtgccaact

SEQ ID NO: 4951156 - DNA, 17 bp, Homo sapiens
gaatctgatttttatga

SEQ ID NO: 4951157 - DNA, 21 bp, Homo sapiens
gaatctgcaattcaaaagttc

SEQ ID NO: 4951158 - DNA, 12 bp, Homo sapiens
gaatctggagac

SEQ ID NO: 4951159 - DNA, 23 bp, Homo sapiens
gaatctgtctcccagttatgaat

SEQ ID NO: 4951160 - DNA, 20 bp, Homo sapiens
gaatgaaaagacaagaaaat

SEQ ID NO: 4951161 - DNA, 19 bp, Homo sapiens
gaatgaaagggcccagaga

SEQ ID NO: 4951162 - DNA, 23 bp, Homo sapiens
gaatgaaatcctgcttcagtgta

SEQ ID NO: 4951163 - DNA, 16 bp, Homo sapiens
gaatgagcccagagaa

SEQ ID NO: 4951164 - DNA, 22 bp, Homo sapiens
gaatgaggtcccaggcagagaa

SEQ ID NO: 4951165 - DNA, 17 bp, Homo sapiens
gaatgcacagatatact

SEQ ID NO: 4951166 - DNA, 11 bp, Homo sapiens
gaatgcagtgg

SEQ ID NO: 4951167 - DNA, 14 bp, Homo sapiens
gaatgcctcctgtg

SEQ ID NO: 4951168 - DNA, 12 bp, Homo sapiens
gaatgctgccag

SEQ ID NO: 4951169 - DNA, 13 bp, Homo sapiens
gaatgctgccagt

SEQ ID NO: 4951170 - DNA, 14 bp, Homo sapiens
gaatgctgtacatc

SEQ ID NO: 4951171 - DNA, 15 bp, Homo sapiens
gaatgctgtacatct

SEQ ID NO: 4951172 - DNA, 13 bp, Homo sapiens
gaatgctgtgtta

SEQ ID NO: 4951173 - DNA, 18 bp, Homo sapiens
gaatgctttttgaatgtt

SEQ ID NO: 4951174 - DNA, 22 bp, Homo sapiens
gaatggaagggttctggctgcc

SEQ ID NO: 4951175 - DNA, 16 bp, Homo sapiens
gaatggactttggaag

SEQ ID NO: 4951176 - DNA, 19 bp, Homo sapiens
gaatggactttggaagcag

SEQ ID NO: 4951177 - DNA, 17 bp, Homo sapiens
gaatgtatctgtgaagt

SEQ ID NO: 4951178 - DNA, 16 bp, Homo sapiens
gaatgtcttttgaata

SEQ ID NO: 4951179 - DNA, 20 bp, Homo sapiens
gaatgtgggcactggcccag

SEQ ID NO: 4951180 - DNA, 13 bp, Homo sapiens
gaatgtggtctca

SEQ ID NO: 4951181 - DNA, 15 bp, Homo sapiens
gaatgtggtctcagg

SEQ ID NO: 4951182 - DNA, 14 bp, Homo sapiens
gaatgttaagcaga

SEQ ID NO: 4951183 - DNA, 18 bp, Homo sapiens
gaatgttggtttactttc

SEQ ID NO: 4951184 - DNA, 21 bp, Homo sapiens
gaatgtttaaagatcatgaca

SEQ ID NO: 4951185 - DNA, 17 bp, Homo sapiens
gaatgtttgcctctgcc

SEQ ID NO: 4951186 - DNA, 18 bp, Homo sapiens
gaatgtttgcctctgcct

SEQ ID NO: 4951187 - DNA, 21 bp, Homo sapiens
gaattaaaaggatagtatttt

SEQ ID NO: 4951188 - DNA, 15 bp, Homo sapiens
gaattaagttatctt

SEQ ID NO: 4951189 - DNA, 16 bp, Homo sapiens
gaattcaaactggggc

SEQ ID NO: 4951190 - DNA, 21 bp, Homo sapiens
gaattcttatgcttataatat

SEQ ID NO: 4951191 - DNA, 17 bp, Homo sapiens
gaattgaccatctgctt

SEQ ID NO: 4951192 - DNA, 20 bp, Homo sapiens
gaattgatcattttcccccc

SEQ ID NO: 4951193 - DNA, 12 bp, Homo sapiens
gaattgatttgc

SEQ ID NO: 4951194 - DNA, 15 bp, Homo sapiens
gaattgatttgcatt

SEQ ID NO: 4951195 - DNA, 20 bp, Homo sapiens
gaattgttttctttaaagat

SEQ ID NO: 4951196 - DNA, 22 bp, Homo sapiens
gaatttaaatataattctgtaa

SEQ ID NO: 4951197 - DNA, 22 bp, Homo sapiens
gaattttcctgagacaaatttt

SEQ ID NO: 4951198 - DNA, 21 bp, Homo sapiens
gaattttctttgtgtagcttt

SEQ ID NO: 4951199 - DNA, 17 bp, Homo sapiens
gaatttttttgtcttta

SEQ ID NO: 4951200 - DNA, 17 bp, Homo sapiens
gacaaaacctaacttgc

SEQ ID NO: 4951201 - DNA, 14 bp, Homo sapiens
gacaaaacttcttg

SEQ ID NO: 4951202 - DNA, 16 bp, Homo sapiens
gacaaacacctcccag

SEQ ID NO: 4951203 - DNA, 19 bp, Homo sapiens
gacaaacacctcccaggag

SEQ ID NO: 4951204 - DNA, 22 bp, Homo sapiens
gacaaacacctcccaggagaca

SEQ ID NO: 4951205 - DNA, 18 bp, Homo sapiens
gacaaactggagtctgga

SEQ ID NO: 4951206 - DNA, 17 bp, Homo sapiens
gacaaagatggctcaga

SEQ ID NO: 4951207 - DNA, 17 bp, Homo sapiens
gacaaaggacatttgtt

SEQ ID NO: 4951208 - DNA, 18 bp, Homo sapiens
gacaaaggttttcctctt

SEQ ID NO: 4951209 - DNA, 19 bp, Homo sapiens
gacaaagtggaggagggcc

SEQ ID NO: 4951210 - DNA, 17 bp, Homo sapiens
gacaaatcaacagaagc

SEQ ID NO: 4951211 - DNA, 18 bp, Homo sapiens
gacaaatcaacagaagca

SEQ ID NO: 4951212 - DNA, 19 bp, Homo sapiens
gacaaatcaacagaagcat

SEQ ID NO: 4951213 - DNA, 21 bp, Homo sapiens
gacaaatcaacagaagcattt

SEQ ID NO: 4951214 - DNA, 12 bp, Homo sapiens
gacaaatctgtg

SEQ ID NO: 4951215 - DNA, 12 bp, Homo sapiens
gacaacagaagt

SEQ ID NO: 4951216 - DNA, 14 bp, Homo sapiens
gacaacagaagtca

SEQ ID NO: 4951217 - DNA, 17 bp, Homo sapiens
gacaacagaagtcatga

SEQ ID NO: 4951218 - DNA, 22 bp, Homo sapiens
gacaacagaagtcatgaagccc

SEQ ID NO: 4951219 - DNA, 19 bp, Homo sapiens
gacaaccatatttagcagt

SEQ ID NO: 4951220 - DNA, 13 bp, Homo sapiens
gacaagaaaatca

SEQ ID NO: 4951221 - DNA, 16 bp, Homo sapiens
gacaagaaatccctgt

SEQ ID NO: 4951222 - DNA, 21 bp, Homo sapiens
gacaagacaaaccaagtcgga

SEQ ID NO: 4951223 - DNA, 14 bp, Homo sapiens
gacaagatattgta

SEQ ID NO: 4951224 - DNA, 12 bp, Homo sapiens
gacaagcagagg

SEQ ID NO: 4951225 - DNA, 22 bp, Homo sapiens
gacaaggattgctactgtccta

SEQ ID NO: 4951226 - DNA, 21 bp, Homo sapiens
gacaataaacctccgccaatg

SEQ ID NO: 4951227 - DNA, 22 bp, Homo sapiens
gacaatgcacctagctgtgcaa

SEQ ID NO: 4951228 - DNA, 16 bp, Homo sapiens
gacaatttgatacata

SEQ ID NO: 4951229 - DNA, 18 bp, Homo sapiens
gacacaaaactccgcccc

SEQ ID NO: 4951230 - DNA, 21 bp, Homo sapiens
gacacaaaactccgcccccag

SEQ ID NO: 4951231 - DNA, 13 bp, Homo sapiens
gacacaaatgcat

SEQ ID NO: 4951232 - DNA, 14 bp, Homo sapiens
gacacaaatgcatg

SEQ ID NO: 4951233 - DNA, 12 bp, Homo sapiens
gacacacacacg

SEQ ID NO: 4951234 - DNA, 14 bp, Homo sapiens
gacacacacacgca

SEQ ID NO: 4951235 - DNA, 19 bp, Homo sapiens
gacacacacacgcacgcac

SEQ ID NO: 4951236 - DNA, 20 bp, Homo sapiens
gacacacacacgcacgcaca

SEQ ID NO: 4951237 - DNA, 22 bp, Homo sapiens
gacacactatcatagttaacat

SEQ ID NO: 4951238 - DNA, 16 bp, Homo sapiens
gacacagaaaatgttg

SEQ ID NO: 4951239 - DNA, 19 bp, Homo sapiens
gacacagcagcttcaccag

SEQ ID NO: 4951240 - DNA, 21 bp, Homo sapiens
gacacagcagcttcaccagag

SEQ ID NO: 4951241 - DNA, 22 bp, Homo sapiens
gacacagcagcttcaccagagc

SEQ ID NO: 4951242 - DNA, 13 bp, Homo sapiens
gacacagcgtccc

SEQ ID NO: 4951243 - DNA, 14 bp, Homo sapiens
gacacagctcttct

SEQ ID NO: 4951244 - DNA, 19 bp, Homo sapiens
gacacagctcttctccagg

SEQ ID NO: 4951245 - DNA, 20 bp, Homo sapiens
gacacagctcttctccaggc

SEQ ID NO: 4951246 - DNA, 19 bp, Homo sapiens
gacacaggcccggctccag

SEQ ID NO: 4951247 - DNA, 23 bp, Homo sapiens
gagaatggcccagtcctctccca

SEQ ID NO: 4951248 - DNA, 21 bp, Homo sapiens
gagaattgctgaagggcattc

SEQ ID NO: 4951249 - DNA, 21 bp, Homo sapiens
gagaatttctaccatttcaga

SEQ ID NO: 4951250 - DNA, 16 bp, Homo sapiens
gagacaaaattttagt

SEQ ID NO: 4951251 - DNA, 15 bp, Homo sapiens
gagacactggcccct

SEQ ID NO: 4951252 - DNA, 16 bp, Homo sapiens
gagacagaatgtatct

SEQ ID NO: 4951253 - DNA, 18 bp, Homo sapiens
gagacagaatgtatctgt

SEQ ID NO: 4951254 - DNA, 20 bp, Homo sapiens
gagacagaatgtatctgtga

SEQ ID NO: 4951255 - DNA, 14 bp, Homo sapiens
gagacagccccaga

SEQ ID NO: 4951256 - DNA, 18 bp, Homo sapiens
gagacagccccagagcag

SEQ ID NO: 4951257 - DNA, 21 bp, Homo sapiens
gagacagctgatacttcattt

SEQ ID NO: 4951258 - DNA, 16 bp, Homo sapiens
gagacagttcaagaaa

SEQ ID NO: 4951259 - DNA, 17 bp, Homo sapiens
gagaccaggctgtgtcc

SEQ ID NO: 4951260 - DNA, 13 bp, Homo sapiens
gagacccccacac

SEQ ID NO: 4951261 - DNA, 15 bp, Homo sapiens
gagaccctctgccac

SEQ ID NO: 4951262 - DNA, 20 bp, Homo sapiens
gagaccggggtatcctgggg

SEQ ID NO: 4951263 - DNA, 13 bp, Homo sapiens
gagaccgtcctca

SEQ ID NO: 4951264 - DNA, 14 bp, Homo sapiens
gagaccgtcctcac

SEQ ID NO: 4951265 - DNA, 15 bp, Homo sapiens
gagaccgtcctcacc

SEQ ID NO: 4951266 - DNA, 15 bp, Homo sapiens
gagacctgaagtgtg

SEQ ID NO: 4951267 - DNA, 14 bp, Homo sapiens
gagacggagtccca

SEQ ID NO: 4951268 - DNA, 20 bp, Homo sapiens
gagacgtggaacctctgtct

SEQ ID NO: 4951269 - DNA, 15 bp, Homo sapiens
gagactcacaggaag

SEQ ID NO: 4951270 - DNA, 16 bp, Homo sapiens
gagactcccatgaagc

SEQ ID NO: 4951271 - DNA, 14 bp, Homo sapiens
gagactctgtctca

SEQ ID NO: 4951272 - DNA, 17 bp, Homo sapiens
gagactgcgttctgcaa

SEQ ID NO: 4951273 - DNA, 23 bp, Homo sapiens
gagactgcgttctgcaagcatca

SEQ ID NO: 4951274 - DNA, 16 bp, Homo sapiens
gagactggggggcttg

SEQ ID NO: 4951275 - DNA, 22 bp, Homo sapiens
gagactgtctcaagagggcact

SEQ ID NO: 4951276 - DNA, 23 bp, Homo sapiens
gagactgtctcaagagggcactg

SEQ ID NO: 4951277 - DNA, 13 bp, Homo sapiens
gagactttgtaga

SEQ ID NO: 4951278 - DNA, 15 bp, Homo sapiens
gagagaaagtgggtg

SEQ ID NO: 4951279 - DNA, 22 bp, Homo sapiens
gagagaaagtgggtgagatgct

SEQ ID NO: 4951280 - DNA, 13 bp, Homo sapiens
gagagaaattctg

SEQ ID NO: 4951281 - DNA, 16 bp, Homo sapiens
gagagaattggctcaa

SEQ ID NO: 4951282 - DNA, 11 bp, Homo sapiens
gagagagaaat

SEQ ID NO: 4951283 - DNA, 20 bp, Homo sapiens
gagagagaaattctgttaaa

SEQ ID NO: 4951284 - DNA, 9 bp, Homo sapiens
gagagagag

SEQ ID NO: 4951285 - DNA, 11 bp, Homo sapiens
gagagagagag

SEQ ID NO: 4951286 - DNA, 13 bp, Homo sapiens
gagagagagagag

SEQ ID NO: 4951287 - DNA, 17 bp, Homo sapiens
gagagatatatctgaaa

SEQ ID NO: 4951288 - DNA, 15 bp, Homo sapiens
gagagattctgtgat

SEQ ID NO: 4951289 - DNA, 17 bp, Homo sapiens
gagagccattttgtgaa

SEQ ID NO: 4951290 - DNA, 15 bp, Homo sapiens
gagagcccctggggc

SEQ ID NO: 4951291 - DNA, 20 bp, Homo sapiens
gagagcccctggggcctaga

SEQ ID NO: 4951292 - DNA, 14 bp, Homo sapiens
gagagcggtctcag

SEQ ID NO: 4951293 - DNA, 20 bp, Homo sapiens
gagagctgggtgtcaagagg

SEQ ID NO: 4951294 - DNA, 14 bp, Homo sapiens
gagagctggtgccc

SEQ ID NO: 4951295 - DNA, 16 bp, Homo sapiens
gagaggatgagagccc

SEQ ID NO: 4951296 - DNA, 18 bp, Homo sapiens
gagaggatgagagcccag

SEQ ID NO: 4951297 - DNA, 19 bp, Homo sapiens
gagaggatgagagcccaga

SEQ ID NO: 4951298 - DNA, 14 bp, Homo sapiens
gagaggatgtgcaa

SEQ ID NO: 4951299 - DNA, 12 bp, Homo sapiens
gagaggcagaga

SEQ ID NO: 4951300 - DNA, 17 bp, Homo sapiens
gagaggccaaaggctgg

SEQ ID NO: 4951301 - DNA, 18 bp, Homo sapiens
gagaggccttttggaatg

SEQ ID NO: 4951302 - DNA, 13 bp, Homo sapiens
gagaggggaacag

SEQ ID NO: 4951303 - DNA, 16 bp, Homo sapiens
gagagtctagattctc

SEQ ID NO: 4951304 - DNA, 21 bp, Homo sapiens
gagagtggctcctcccggtgc

SEQ ID NO: 4951305 - DNA, 21 bp, Homo sapiens
gagataccaagatgccatctg

SEQ ID NO: 4951306 - DNA, 18 bp, Homo sapiens
gagatactttttcttttg

SEQ ID NO: 4951307 - DNA, 18 bp, Homo sapiens
gagatatatctgaaaact

SEQ ID NO: 4951308 - DNA, 18 bp, Homo sapiens
gagatcacgccactgcac

SEQ ID NO: 4951309 - DNA, 19 bp, Homo sapiens
gagatcacgccactgcact

SEQ ID NO: 4951310 - DNA, 15 bp, Homo sapiens
gagatcccctgagcc

SEQ ID NO: 4951311 - DNA, 15 bp, Homo sapiens
gagatgctggagaag

SEQ ID NO: 4951312 - DNA, 18 bp, Homo sapiens
gagatgctggagaagaga

SEQ ID NO: 4951313 - DNA, 17 bp, Homo sapiens
gagatgctgtaacttaa

SEQ ID NO: 4951314 - DNA, 22 bp, Homo sapiens
gagatggacagttcacaccctg

SEQ ID NO: 4951315 - DNA, 17 bp, Homo sapiens
gagatgtaaaaggtatt

SEQ ID NO: 4951316 - DNA, 14 bp, Homo sapiens
gagatgtttttaaa

SEQ ID NO: 4951317 - DNA, 23 bp, Homo sapiens
cttttaatgcttcattcaatatt

SEQ ID NO: 4951318 - DNA, 22 bp, Homo sapiens
cttttaattaaataaaagctgg

SEQ ID NO: 4951319 - DNA, 18 bp, Homo sapiens
cttttaccagcttttaac

SEQ ID NO: 4951320 - DNA, 14 bp, Homo sapiens
cttttaggaaaatc

SEQ ID NO: 4951321 - DNA, 18 bp, Homo sapiens
cttttatagctattactg

SEQ ID NO: 4951322 - DNA, 19 bp, Homo sapiens
cttttatagctattactgt

SEQ ID NO: 4951323 - DNA, 21 bp, Homo sapiens
cttttatagtggaaaaacaca

SEQ ID NO: 4951324 - DNA, 24 bp, Homo sapiens
cttttatctattctgagaaaacaa

SEQ ID NO: 4951325 - DNA, 16 bp, Homo sapiens
cttttatgagcagaag

SEQ ID NO: 4951326 - DNA, 21 bp, Homo sapiens
cttttatgcagatagaatcaa

SEQ ID NO: 4951327 - DNA, 13 bp, Homo sapiens
cttttatgtagca

SEQ ID NO: 4951328 - DNA, 13 bp, Homo sapiens
cttttatgtttga

SEQ ID NO: 4951329 - DNA, 23 bp, Homo sapiens
cttttatgtttgaatatggacaa

SEQ ID NO: 4951330 - DNA, 18 bp, Homo sapiens
cttttattcattagctgt

SEQ ID NO: 4951331 - DNA, 21 bp, Homo sapiens
cttttattgtataaactatca

SEQ ID NO: 4951332 - DNA, 15 bp, Homo sapiens
cttttcaaaacattt

SEQ ID NO: 4951333 - DNA, 18 bp, Homo sapiens
cttttcaaacaagaatgt

SEQ ID NO: 4951334 - DNA, 16 bp, Homo sapiens
cttttcaaggcttata

SEQ ID NO: 4951335 - DNA, 20 bp, Homo sapiens
cttttcacatagctgtctag

SEQ ID NO: 4951336 - DNA, 17 bp, Homo sapiens
cttttcactgctggctg

SEQ ID NO: 4951337 - DNA, 20 bp, Homo sapiens
cttttcactgctggctgcct

SEQ ID NO: 4951338 - DNA, 22 bp, Homo sapiens
cttttcataacctagccttaga

SEQ ID NO: 4951339 - DNA, 22 bp, Homo sapiens
cttttccctctttggctcccct

SEQ ID NO: 4951340 - DNA, 16 bp, Homo sapiens
cttttccctcttttct

SEQ ID NO: 4951341 - DNA, 16 bp, Homo sapiens
cttttcctatttgttt

SEQ ID NO: 4951342 - DNA, 16 bp, Homo sapiens
cttttcctctctcccg

SEQ ID NO: 4951343 - DNA, 19 bp, Homo sapiens
cttttcctgataaagcaca

SEQ ID NO: 4951344 - DNA, 14 bp, Homo sapiens
cttttctcccatat

SEQ ID NO: 4951345 - DNA, 16 bp, Homo sapiens
cttttctctttttagt

SEQ ID NO: 4951346 - DNA, 23 bp, Homo sapiens
cttttctggggaaagacactgcc

SEQ ID NO: 4951347 - DNA, 13 bp, Homo sapiens
cttttcttaacaa

SEQ ID NO: 4951348 - DNA, 18 bp, Homo sapiens
cttttcttaacaacctgg

SEQ ID NO: 4951349 - DNA, 15 bp, Homo sapiens
cttttcttactcctc

SEQ ID NO: 4951350 - DNA, 11 bp, Homo sapiens
cttttcttggc

SEQ ID NO: 4951351 - DNA, 18 bp, Homo sapiens
cttttctttaaagaagtt

SEQ ID NO: 4951352 - DNA, 15 bp, Homo sapiens
cttttctttaacttt

SEQ ID NO: 4951353 - DNA, 14 bp, Homo sapiens
cttttcttttgtta

SEQ ID NO: 4951354 - DNA, 22 bp, Homo sapiens
cttttcttttgttactgttctt

SEQ ID NO: 4951355 - DNA, 15 bp, Homo sapiens
cttttctttttacat

SEQ ID NO: 4951356 - DNA, 14 bp, Homo sapiens
cttttctttttctc

SEQ ID NO: 4951357 - DNA, 22 bp, Homo sapiens
cttttgaagtagtttgtataac

SEQ ID NO: 4951358 - DNA, 14 bp, Homo sapiens
cttttgaattgttt

SEQ ID NO: 4951359 - DNA, 23 bp, Homo sapiens
cttttgagtgtgtgtgtgcatgt

SEQ ID NO: 4951360 - DNA, 15 bp, Homo sapiens
cttttgctactaagt

SEQ ID NO: 4951361 - DNA, 23 bp, Homo sapiens
cttttgctactaagttcacatta

SEQ ID NO: 4951362 - DNA, 14 bp, Homo sapiens
cttttgctttattc

SEQ ID NO: 4951363 - DNA, 14 bp, Homo sapiens
cttttggtctccct

SEQ ID NO: 4951364 - DNA, 18 bp, Homo sapiens
cttttggtgtgttggaca

SEQ ID NO: 4951365 - DNA, 15 bp, Homo sapiens
cttttgtaaagaaat

SEQ ID NO: 4951366 - DNA, 22 bp, Homo sapiens
cttttgtaaagaaatttactat

SEQ ID NO: 4951367 - DNA, 10 bp, Homo sapiens
cttttgtaag

SEQ ID NO: 4951368 - DNA, 13 bp, Homo sapiens
cttttgtaagaca

SEQ ID NO: 4951369 - DNA, 12 bp, Homo sapiens
cttttgtacatc

SEQ ID NO: 4951370 - DNA, 17 bp, Homo sapiens
cttttgtacatctggct

SEQ ID NO: 4951371 - DNA, 18 bp, Homo sapiens
cttttgtgcctggcttct

SEQ ID NO: 4951372 - DNA, 18 bp, Homo sapiens
cttttgttaaataatatg

SEQ ID NO: 4951373 - DNA, 11 bp, Homo sapiens
cttttgttact

SEQ ID NO: 4951374 - DNA, 15 bp, Homo sapiens
cttttgttactgttc

SEQ ID NO: 4951375 - DNA, 17 bp, Homo sapiens
cttttgttactgttctt

SEQ ID NO: 4951376 - DNA, 19 bp, Homo sapiens
cttttgttactgttcttgc

SEQ ID NO: 4951377 - DNA, 13 bp, Homo sapiens
cttttgttcgcat

SEQ ID NO: 4951378 - DNA, 14 bp, Homo sapiens
ctttttaaaacaca

SEQ ID NO: 4951379 - DNA, 17 bp, Homo sapiens
ctttttaaaacacatgt

SEQ ID NO: 4951380 - DNA, 22 bp, Homo sapiens
ctttttaaaatggtgcttaagt

SEQ ID NO: 4951381 - DNA, 23 bp, Homo sapiens
ctttttaaagtgtttctgttatt

SEQ ID NO: 4951382 - DNA, 14 bp, Homo sapiens
ctttttaattgttg

SEQ ID NO: 4951383 - DNA, 11 bp, Homo sapiens
ctttttacata

SEQ ID NO: 4951384 - DNA, 19 bp, Homo sapiens
ctttttacataactgcctt

SEQ ID NO: 4951385 - DNA, 19 bp, Homo sapiens
ctttttagggccaggcagg

SEQ ID NO: 4951386 - DNA, 21 bp, Homo sapiens
ctttttagtttacccggtttc

SEQ ID NO: 4951387 - DNA, 13 bp, Homo sapiens
ctttttatttata

SEQ ID NO: 4951388 - DNA, 15 bp, Homo sapiens
ctttttcattttcca

SEQ ID NO: 4951389 - DNA, 18 bp, Homo sapiens
ctttttcattttccaata

SEQ ID NO: 4951390 - DNA, 13 bp, Homo sapiens
ctttttctgatta

SEQ ID NO: 4951391 - DNA, 19 bp, Homo sapiens
ctttttctgattagctttg

SEQ ID NO: 4951392 - DNA, 22 bp, Homo sapiens
ctttttctgattagctttgtgt

SEQ ID NO: 4951393 - DNA, 13 bp, Homo sapiens
ctttttcttcctc

SEQ ID NO: 4951394 - DNA, 15 bp, Homo sapiens
ctttttcttttgtaa

SEQ ID NO: 4951395 - DNA, 18 bp, Homo sapiens
ctttttgaaatgaaattt

SEQ ID NO: 4951396 - DNA, 22 bp, Homo sapiens
ctttttgaaatgaaatttaaac

SEQ ID NO: 4951397 - DNA, 23 bp, Homo sapiens
ctttttgaaatgaaatttaaaca

SEQ ID NO: 4951398 - DNA, 11 bp, Homo sapiens
ctttttgaatg

SEQ ID NO: 4951399 - DNA, 19 bp, Homo sapiens
ctttttgaatgttatttgt

SEQ ID NO: 4951400 - DNA, 12 bp, Homo sapiens
cttttttcaaaa

SEQ ID NO: 4951401 - DNA, 13 bp, Homo sapiens
cttttttcaaaat

SEQ ID NO: 4951402 - DNA, 22 bp, Homo sapiens
cttttttcaaaatccaaaaaga

SEQ ID NO: 4951403 - DNA, 18 bp, Homo sapiens
gaaaaaaaccacacaaag

SEQ ID NO: 4951404 - DNA, 13 bp, Homo sapiens
gaaaaaaatcatc

SEQ ID NO: 4951405 - DNA, 13 bp, Homo sapiens
gaaaaaaatcttc

SEQ ID NO: 4951406 - DNA, 19 bp, Homo sapiens
gaaaaaacacctagcttta

SEQ ID NO: 4951407 - DNA, 13 bp, Homo sapiens
gaaaaaagctcat

SEQ ID NO: 4951408 - DNA, 20 bp, Homo sapiens
gaaaaacaacaacacaataa

SEQ ID NO: 4951409 - DNA, 12 bp, Homo sapiens
gaaaaagggtca

SEQ ID NO: 4951410 - DNA, 22 bp, Homo sapiens
gaaaaatcttgtgctagaatac

SEQ ID NO: 4951411 - DNA, 20 bp, Homo sapiens
gaaaaatgcccttaaatcat

SEQ ID NO: 4951412 - DNA, 20 bp, Homo sapiens
gaaaacattctgatttggaa

SEQ ID NO: 4951413 - DNA, 16 bp, Homo sapiens
gaaaaccatctggcct

SEQ ID NO: 4951414 - DNA, 13 bp, Homo sapiens
gaaaactatacaa

SEQ ID NO: 4951415 - DNA, 18 bp, Homo sapiens
gaaaactccaccttccca

SEQ ID NO: 4951416 - DNA, 18 bp, Homo sapiens
gaaaactcccatttacgt

SEQ ID NO: 4951417 - DNA, 13 bp, Homo sapiens
gaaaactttaaaa

SEQ ID NO: 4951418 - DNA, 20 bp, Homo sapiens
gaaaactttaaaaaatattt

SEQ ID NO: 4951419 - DNA, 22 bp, Homo sapiens
gaaaactttaaaaaatatttat

SEQ ID NO: 4951420 - DNA, 12 bp, Homo sapiens
gaaaagaaaaaa

SEQ ID NO: 4951421 - DNA, 18 bp, Homo sapiens
gaaaagaaaaaaaaaaga

SEQ ID NO: 4951422 - DNA, 21 bp, Homo sapiens
gaaaagaaaatttttgtagta

SEQ ID NO: 4951423 - DNA, 14 bp, Homo sapiens
gaaaagagaagaag

SEQ ID NO: 4951424 - DNA, 15 bp, Homo sapiens
gaaaagagaagaaga

SEQ ID NO: 4951425 - DNA, 19 bp, Homo sapiens
gaaaagagaagaagaaaaa

SEQ ID NO: 4951426 - DNA, 20 bp, Homo sapiens
gaaaagatgtacctggtgga

SEQ ID NO: 4951427 - DNA, 14 bp, Homo sapiens
gaaatgaacattcc

SEQ ID NO: 4951428 - DNA, 16 bp, Homo sapiens
gaaatgaacattccaa

SEQ ID NO: 4951429 - DNA, 15 bp, Homo sapiens
gaaatgagaaggcag

SEQ ID NO: 4951430 - DNA, 22 bp, Homo sapiens
gaaatgagcacctccattaaag

SEQ ID NO: 4951431 - DNA, 16 bp, Homo sapiens
gaaatgaggtctgttt

SEQ ID NO: 4951432 - DNA, 23 bp, Homo sapiens
gaaatgaggtctgtttaaagtgg

SEQ ID NO: 4951433 - DNA, 17 bp, Homo sapiens
gaaatggatgcaaagta

SEQ ID NO: 4951434 - DNA, 22 bp, Homo sapiens
gaaatgtaggcatcatgcatgt

SEQ ID NO: 4951435 - DNA, 18 bp, Homo sapiens
gaaatgtagttgatgtat

SEQ ID NO: 4951436 - DNA, 17 bp, Homo sapiens
gaaattaagaaggcaaa

SEQ ID NO: 4951437 - DNA, 18 bp, Homo sapiens
gaaattaagaaggcaaaa

SEQ ID NO: 4951438 - DNA, 22 bp, Homo sapiens
gaaattaagaaggcaaaaatgt

SEQ ID NO: 4951439 - DNA, 17 bp, Homo sapiens
gaaattacacccaaaga

SEQ ID NO: 4951440 - DNA, 13 bp, Homo sapiens
gaaattatatctg

SEQ ID NO: 4951441 - DNA, 15 bp, Homo sapiens
gaaattatttaataa

SEQ ID NO: 4951442 - DNA, 16 bp, Homo sapiens
gaaattctaaagagca

SEQ ID NO: 4951443 - DNA, 24 bp, Homo sapiens
gaaattctgttaaaatctattctg

SEQ ID NO: 4951444 - DNA, 17 bp, Homo sapiens
gaaattggaacagaatg

SEQ ID NO: 4951445 - DNA, 15 bp, Homo sapiens
gaaattggctggatg

SEQ ID NO: 4951446 - DNA, 18 bp, Homo sapiens
gaaattgtacatatttgt

SEQ ID NO: 4951447 - DNA, 11 bp, Homo sapiens
gaaatttcaga

SEQ ID NO: 4951448 - DNA, 14 bp, Homo sapiens
gaaatttctgtgaa

SEQ ID NO: 4951449 - DNA, 14 bp, Homo sapiens
gaaatttgatttct

SEQ ID NO: 4951450 - DNA, 13 bp, Homo sapiens
gaaattttgcaaa

SEQ ID NO: 4951451 - DNA, 21 bp, Homo sapiens
gaaattttgcaaatataaaca

SEQ ID NO: 4951452 - DNA, 22 bp, Homo sapiens
gaaattttgcaaatataaacat

SEQ ID NO: 4951453 - DNA, 18 bp, Homo sapiens
gaacaaaaaaaccacaaa

SEQ ID NO: 4951454 - DNA, 20 bp, Homo sapiens
gaacaaaaaaaccacaaagg

SEQ ID NO: 4951455 - DNA, 14 bp, Homo sapiens
gaacaaaagggtca

SEQ ID NO: 4951456 - DNA, 19 bp, Homo sapiens
gaacaaagctgttaaactg

SEQ ID NO: 4951457 - DNA, 22 bp, Homo sapiens
gaacaaagctgttaaactgtta

SEQ ID NO: 4951458 - DNA, 22 bp, Homo sapiens
gaacaaaggacagagtatgaac

SEQ ID NO: 4951459 - DNA, 13 bp, Homo sapiens
gaacaactgatac

SEQ ID NO: 4951460 - DNA, 22 bp, Homo sapiens
gaacactaactcaccagcccca

SEQ ID NO: 4951461 - DNA, 12 bp, Homo sapiens
gaacagaaggat

SEQ ID NO: 4951462 - DNA, 15 bp, Homo sapiens
gaacagaatgtttta

SEQ ID NO: 4951463 - DNA, 15 bp, Homo sapiens
gaacagactggaagc

SEQ ID NO: 4951464 - DNA, 18 bp, Homo sapiens
gaacagataatcagtgtg

SEQ ID NO: 4951465 - DNA, 21 bp, Homo sapiens
gaacagctatgggagccccag

SEQ ID NO: 4951466 - DNA, 23 bp, Homo sapiens
gaacagctatgggagccccaggg

SEQ ID NO: 4951467 - DNA, 16 bp, Homo sapiens
gaacagcttcaggtta

SEQ ID NO: 4951468 - DNA, 16 bp, Homo sapiens
gaacataaaaaggaca

SEQ ID NO: 4951469 - DNA, 18 bp, Homo sapiens
gaacataaaaaggacatc

SEQ ID NO: 4951470 - DNA, 23 bp, Homo sapiens
gaacatcaccgacgcgtctcctg

SEQ ID NO: 4951471 - DNA, 15 bp, Homo sapiens
gaacatcattagaac

SEQ ID NO: 4951472 - DNA, 21 bp, Homo sapiens
gaacatcctttgcagggcagc

SEQ ID NO: 4951473 - DNA, 20 bp, Homo sapiens
gaacattccaaggagttgga

SEQ ID NO: 4951474 - DNA, 20 bp, Homo sapiens
gaacatttctgtaaatacca

SEQ ID NO: 4951475 - DNA, 17 bp, Homo sapiens
gaaccaagcaggagacg

SEQ ID NO: 4951476 - DNA, 20 bp, Homo sapiens
gaaccaagcaggagacgaca

SEQ ID NO: 4951477 - DNA, 17 bp, Homo sapiens
gaaccaccacacccagc

SEQ ID NO: 4951478 - DNA, 22 bp, Homo sapiens
gaaccaccacacccagcccact

SEQ ID NO: 4951479 - DNA, 23 bp, Homo sapiens
gaaccaccacacccagcccactt

SEQ ID NO: 4951480 - DNA, 18 bp, Homo sapiens
gaacccagcagttctgtt

SEQ ID NO: 4951481 - DNA, 13 bp, Homo sapiens
gaacccagggctc

SEQ ID NO: 4951482 - DNA, 17 bp, Homo sapiens
gaacccagggctctgcc

SEQ ID NO: 4951483 - DNA, 21 bp, Homo sapiens
gaacccagggctctgccccag

SEQ ID NO: 4951484 - DNA, 22 bp, Homo sapiens
ccagccaccccgggctctctgc

SEQ ID NO: 4951485 - DNA, 22 bp, Homo sapiens
ccagccatacttatctctctgt

SEQ ID NO: 4951486 - DNA, 22 bp, Homo sapiens
ccagcccaaaggggacaggcct

SEQ ID NO: 4951487 - DNA, 14 bp, Homo sapiens
ccagcccagggtgg

SEQ ID NO: 4951488 - DNA, 17 bp, Homo sapiens
ccagcccatctcggagc

SEQ ID NO: 4951489 - DNA, 16 bp, Homo sapiens
ccagccccacacagct

SEQ ID NO: 4951490 - DNA, 16 bp, Homo sapiens
ccagccccagtgccca

SEQ ID NO: 4951491 - DNA, 18 bp, Homo sapiens
ccagccccggccctgggc

SEQ ID NO: 4951492 - DNA, 13 bp, Homo sapiens
ccagcccgggagc

SEQ ID NO: 4951493 - DNA, 13 bp, Homo sapiens
ccagccctggctc

SEQ ID NO: 4951494 - DNA, 13 bp, Homo sapiens
ccagccctgttct

SEQ ID NO: 4951495 - DNA, 17 bp, Homo sapiens
ccagccggccaatggaa

SEQ ID NO: 4951496 - DNA, 19 bp, Homo sapiens
ccagcctatgagcatcctg

SEQ ID NO: 4951497 - DNA, 20 bp, Homo sapiens
ccagcctatgagcatcctga

SEQ ID NO: 4951498 - DNA, 21 bp, Homo sapiens
ccagcctatgagcatcctgag

SEQ ID NO: 4951499 - DNA, 10 bp, Homo sapiens
ccagcctcag

SEQ ID NO: 4951500 - DNA, 12 bp, Homo sapiens
ccagcctcagtc

SEQ ID NO: 4951501 - DNA, 15 bp, Homo sapiens
ccagcctcagtcctc

SEQ ID NO: 4951502 - DNA, 21 bp, Homo sapiens
ccagcctcagtcctcccctca

SEQ ID NO: 4951503 - DNA, 22 bp, Homo sapiens
ccagcctcagtcctcccctcac

SEQ ID NO: 4951504 - DNA, 22 bp, Homo sapiens
ccagcctcgttggaagaggaac

SEQ ID NO: 4951505 - DNA, 20 bp, Homo sapiens
ccagcctgcccaagcccagg

SEQ ID NO: 4951506 - DNA, 22 bp, Homo sapiens
ccagcctgcccaagcccaggcc

SEQ ID NO: 4951507 - DNA, 22 bp, Homo sapiens
ccagcctgggcagccaggctgc

SEQ ID NO: 4951508 - DNA, 18 bp, Homo sapiens
ccagcctggggcctggca

SEQ ID NO: 4951509 - DNA, 20 bp, Homo sapiens
ccagcctggggcctggcagg

SEQ ID NO: 4951510 - DNA, 22 bp, Homo sapiens
cccaacggccctgcagccagct

SEQ ID NO: 4951511 - DNA, 14 bp, Homo sapiens
cccaacgggaagca

SEQ ID NO: 4951512 - DNA, 15 bp, Homo sapiens
cccaactctgagccc

SEQ ID NO: 4951513 - DNA, 17 bp, Homo sapiens
cccaactctgagcccat

SEQ ID NO: 4951514 - DNA, 17 bp, Homo sapiens
cccaactgtgagcaagg

SEQ ID NO: 4951515 - DNA, 22 bp, Homo sapiens
cccaagccttcgggcgtctgtg

SEQ ID NO: 4951516 - DNA, 12 bp, Homo sapiens
cccaagctctgc

SEQ ID NO: 4951517 - DNA, 13 bp, Homo sapiens
cccaagctctgct

SEQ ID NO: 4951518 - DNA, 17 bp, Homo sapiens
cccaagctctgctcctc

SEQ ID NO: 4951519 - DNA, 16 bp, Homo sapiens
cccaaggactgaggga

SEQ ID NO: 4951520 - DNA, 21 bp, Homo sapiens
cccaaggactgagggactctg

SEQ ID NO: 4951521 - DNA, 20 bp, Homo sapiens
cccaaggagcacaggtccca

SEQ ID NO: 4951522 - DNA, 20 bp, Homo sapiens
cccaagtagtctgctcacag

SEQ ID NO: 4951523 - DNA, 20 bp, Homo sapiens
cccaagtggtttccacatgc

SEQ ID NO: 4951524 - DNA, 21 bp, Homo sapiens
cccaagtggtttccacatgct

SEQ ID NO: 4951525 - DNA, 16 bp, Homo sapiens
cccaagtgtgaacaaa

SEQ ID NO: 4951526 - DNA, 21 bp, Homo sapiens
cccaagtttccatagcaacag

SEQ ID NO: 4951527 - DNA, 17 bp, Homo sapiens
cccaatccctttattac

SEQ ID NO: 4951528 - DNA, 19 bp, Homo sapiens
cccacacttgttccagctc

SEQ ID NO: 4951529 - DNA, 22 bp, Homo sapiens
cccacaggaagcctgcagtcct

SEQ ID NO: 4951530 - DNA, 23 bp, Homo sapiens
cccacaggaagcctgcagtcctg

SEQ ID NO: 4951531 - DNA, 13 bp, Homo sapiens
cccacaggatcag

SEQ ID NO: 4951532 - DNA, 17 bp, Homo sapiens
cccacaggatcagtctg

SEQ ID NO: 4951533 - DNA, 19 bp, Homo sapiens
cccacatccaactccagca

SEQ ID NO: 4951534 - DNA, 16 bp, Homo sapiens
cccacatgtgacacat

SEQ ID NO: 4951535 - DNA, 13 bp, Homo sapiens
cccacccaggagg

SEQ ID NO: 4951536 - DNA, 15 bp, Homo sapiens
cccaccccacctgca

SEQ ID NO: 4951537 - DNA, 16 bp, Homo sapiens
cccacccccttctctg

SEQ ID NO: 4951538 - DNA, 22 bp, Homo sapiens
cccacccccttctctgctccac

SEQ ID NO: 4951539 - DNA, 15 bp, Homo sapiens
cccaccctccctgga

SEQ ID NO: 4951540 - DNA, 16 bp, Homo sapiens
cccaccctgctgcctt

SEQ ID NO: 4951541 - DNA, 18 bp, Homo sapiens
cccaccggtccagctggc

SEQ ID NO: 4951542 - DNA, 18 bp, Homo sapiens
cccacctcagcctcccaa

SEQ ID NO: 4951543 - DNA, 13 bp, Homo sapiens
cccacctccagcc

SEQ ID NO: 4951544 - DNA, 18 bp, Homo sapiens
cccacctccctgcccagg

SEQ ID NO: 4951545 - DNA, 14 bp, Homo sapiens
cccacctgcagggc

SEQ ID NO: 4951546 - DNA, 20 bp, Homo sapiens
cccacctgcccatcacaggg

SEQ ID NO: 4951547 - DNA, 12 bp, Homo sapiens
cccaccttggct

SEQ ID NO: 4951548 - DNA, 20 bp, Homo sapiens
cccaccttggctgcagggag

SEQ ID NO: 4951549 - DNA, 16 bp, Homo sapiens
cccacgagggtcagga

SEQ ID NO: 4951550 - DNA, 18 bp, Homo sapiens
cccacgattttctccagc

SEQ ID NO: 4951551 - DNA, 22 bp, Homo sapiens
cccacgattttctccagctcag

SEQ ID NO: 4951552 - DNA, 19 bp, Homo sapiens
cccacgctggagtgcagtg

SEQ ID NO: 4951553 - DNA, 19 bp, Homo sapiens
cccacggctaagaggctgc

SEQ ID NO: 4951554 - DNA, 12 bp, Homo sapiens
cccacgtgggag

SEQ ID NO: 4951555 - DNA, 16 bp, Homo sapiens
cccactgacagcctcc

SEQ ID NO: 4951556 - DNA, 14 bp, Homo sapiens
cccactgccagcag

SEQ ID NO: 4951557 - DNA, 16 bp, Homo sapiens
cccactgccagcagca

SEQ ID NO: 4951558 - DNA, 17 bp, Homo sapiens
cccactgccagcagcag

SEQ ID NO: 4951559 - DNA, 19 bp, Homo sapiens
cccactgcttttggtctgt

SEQ ID NO: 4951560 - DNA, 21 bp, Homo sapiens
cccactggttccttcttcctg

SEQ ID NO: 4951561 - DNA, 22 bp, Homo sapiens
cccactgtttctcttgagctgg

SEQ ID NO: 4951562 - DNA, 15 bp, Homo sapiens
cccagaacttccctg

SEQ ID NO: 4951563 - DNA, 16 bp, Homo sapiens
cccagaacttccctga

SEQ ID NO: 4951564 - DNA, 16 bp, Homo sapiens
cccagaagaaaattct

SEQ ID NO: 4951565 - DNA, 14 bp, Homo sapiens
cccagaatcccagc

SEQ ID NO: 4951566 - DNA, 19 bp, Homo sapiens
cccagaatcccagccggcc

SEQ ID NO: 4951567 - DNA, 20 bp, Homo sapiens
cccagacagacatctctgca

SEQ ID NO: 4951568 - DNA, 17 bp, Homo sapiens
cccagactactattttc

SEQ ID NO: 4951569 - DNA, 19 bp, Homo sapiens
cccagagactttgtagatc

SEQ ID NO: 4951570 - DNA, 17 bp, Homo sapiens
cccagagattcccaagc

SEQ ID NO: 4951571 - DNA, 14 bp, Homo sapiens
cccagagcagggtg

SEQ ID NO: 4951572 - DNA, 21 bp, Homo sapiens
cccagagctgtttatggcctc

SEQ ID NO: 4951573 - DNA, 22 bp, Homo sapiens
cccagagctgtttatggcctca

SEQ ID NO: 4951574 - DNA, 13 bp, Homo sapiens
cccagaggtaaca

SEQ ID NO: 4951575 - DNA, 23 bp, Homo sapiens
cccagaggtaacagaacagcttc

SEQ ID NO: 4951576 - DNA, 13 bp, Homo sapiens
cccagaggtccag

SEQ ID NO: 4951577 - DNA, 19 bp, Homo sapiens
cccagaggtccagcccatc

SEQ ID NO: 4951578 - DNA, 18 bp, Homo sapiens
cccagatctggtcccttg

SEQ ID NO: 4951579 - DNA, 20 bp, Homo sapiens
cccagattgcaacaggctgg

SEQ ID NO: 4951580 - DNA, 22 bp, Homo sapiens
cccagattgcaacaggctgggc

SEQ ID NO: 4951581 - DNA, 23 bp, Homo sapiens
cccagattgcaacaggctgggct

SEQ ID NO: 4951582 - DNA, 20 bp, Homo sapiens
cccagcaagtgagagctggg

SEQ ID NO: 4951583 - DNA, 21 bp, Homo sapiens
cccagcaagtgagagctgggt

SEQ ID NO: 4951584 - DNA, 22 bp, Homo sapiens
cccagcacctcagcctgcacag

SEQ ID NO: 4951585 - DNA, 14 bp, Homo sapiens
cccagccaccccgg

SEQ ID NO: 4951586 - DNA, 22 bp, Homo sapiens
cccagccaccccgggctctctg

SEQ ID NO: 4951587 - DNA, 14 bp, Homo sapiens
cccagcccacttct

SEQ ID NO: 4951588 - DNA, 13 bp, Homo sapiens
cccagcccctaga

SEQ ID NO: 4951589 - DNA, 14 bp, Homo sapiens
cccagcccctagaa

SEQ ID NO: 4951590 - DNA, 17 bp, Homo sapiens
cccagcccctagcccag

SEQ ID NO: 4951591 - DNA, 18 bp, Homo sapiens
cccagcccctagcccagg

SEQ ID NO: 4951592 - DNA, 20 bp, Homo sapiens
cccagcccctagcccaggag

SEQ ID NO: 4951593 - DNA, 14 bp, Homo sapiens
cccagccctggctc

SEQ ID NO: 4951594 - DNA, 12 bp, Homo sapiens
cccagcctatga

SEQ ID NO: 4951595 - DNA, 22 bp, Homo sapiens
cccagcctcagtcctcccctca

SEQ ID NO: 4951596 - DNA, 18 bp, Homo sapiens
cccagcctccaagctcca

SEQ ID NO: 4951597 - DNA, 14 bp, Homo sapiens
cccagcgagccctg

SEQ ID NO: 4951598 - DNA, 16 bp, Homo sapiens
cccagctcaggggcag

SEQ ID NO: 4951599 - DNA, 22 bp, Homo sapiens
ctgcttttattaaatttgttga

SEQ ID NO: 4951600 - DNA, 14 bp, Homo sapiens
ctgctttttgaaat

SEQ ID NO: 4951601 - DNA, 16 bp, Homo sapiens
ctgctttttgaaatga

SEQ ID NO: 4951602 - DNA, 17 bp, Homo sapiens
ctgcttttttttttcca

SEQ ID NO: 4951603 - DNA, 19 bp, Homo sapiens
ctgcttttttttttccagc

SEQ ID NO: 4951604 - DNA, 15 bp, Homo sapiens
ctggaaaaaatgagc

SEQ ID NO: 4951605 - DNA, 22 bp, Homo sapiens
ctggaacatcctttgcagggca

SEQ ID NO: 4951606 - DNA, 23 bp, Homo sapiens
ctggaacatcctttgcagggcag

SEQ ID NO: 4951607 - DNA, 24 bp, Homo sapiens
ctggaacatcctttgcagggcagc

SEQ ID NO: 4951608 - DNA, 16 bp, Homo sapiens
ctggaaccttgctgtc

SEQ ID NO: 4951609 - DNA, 20 bp, Homo sapiens
ctggaaccttgctgtcctga

SEQ ID NO: 4951610 - DNA, 19 bp, Homo sapiens
ctggaactcctaaaccttt

SEQ ID NO: 4951611 - DNA, 19 bp, Homo sapiens
ctggaactctatctgggcc

SEQ ID NO: 4951612 - DNA, 16 bp, Homo sapiens
ctggaagccctggaga

SEQ ID NO: 4951613 - DNA, 17 bp, Homo sapiens
ctggaagccctggagac

SEQ ID NO: 4951614 - DNA, 15 bp, Homo sapiens
ctggaatacatgaaa

SEQ ID NO: 4951615 - DNA, 18 bp, Homo sapiens
ctggaatacatgaaatat

SEQ ID NO: 4951616 - DNA, 15 bp, Homo sapiens
ctggaatgcagtggt

SEQ ID NO: 4951617 - DNA, 15 bp, Homo sapiens
ctggacaagcagagg

SEQ ID NO: 4951618 - DNA, 15 bp, Homo sapiens
ctggacactcagacc

SEQ ID NO: 4951619 - DNA, 18 bp, Homo sapiens
ctggacactcagacctga

SEQ ID NO: 4951620 - DNA, 21 bp, Homo sapiens
ctggacagaggggactctggg

SEQ ID NO: 4951621 - DNA, 17 bp, Homo sapiens
ctggacaggcatgttct

SEQ ID NO: 4951622 - DNA, 19 bp, Homo sapiens
ctggacaggctctgcttct

SEQ ID NO: 4951623 - DNA, 20 bp, Homo sapiens
ctggacaggctctgcttctc

SEQ ID NO: 4951624 - DNA, 16 bp, Homo sapiens
ctggacagtatcccac

SEQ ID NO: 4951625 - DNA, 18 bp, Homo sapiens
ctggacagtatcccacat

SEQ ID NO: 4951626 - DNA, 18 bp, Homo sapiens
ctggacataacattttca

SEQ ID NO: 4951627 - DNA, 15 bp, Homo sapiens
ctggacatgctgact

SEQ ID NO: 4951628 - DNA, 14 bp, Homo sapiens
ctggaccactgggc

SEQ ID NO: 4951629 - DNA, 17 bp, Homo sapiens
ctggacctgcctcctgc

SEQ ID NO: 4951630 - DNA, 20 bp, Homo sapiens
ctggacctgcctcctgcctg

SEQ ID NO: 4951631 - DNA, 16 bp, Homo sapiens
ctggaccttgaactgg

SEQ ID NO: 4951632 - DNA, 21 bp, Homo sapiens
ctggaccttgaactgggtact

SEQ ID NO: 4951633 - DNA, 14 bp, Homo sapiens
ctggacggaagtgg

SEQ ID NO: 4951634 - DNA, 15 bp, Homo sapiens
ctggacggggactgg

SEQ ID NO: 4951635 - DNA, 21 bp, Homo sapiens
ctggactctaaagaccaaact

SEQ ID NO: 4951636 - DNA, 15 bp, Homo sapiens
ctggactctgcatcc

SEQ ID NO: 4951637 - DNA, 18 bp, Homo sapiens
ctggactctgcatcccag

SEQ ID NO: 4951638 - DNA, 24 bp, Homo sapiens
ctggactctgcatcccagcacctg

SEQ ID NO: 4951639 - DNA, 17 bp, Homo sapiens
ctggactgacagcatgt

SEQ ID NO: 4951640 - DNA, 21 bp, Homo sapiens
ctggactgacagcatgtgccc

SEQ ID NO: 4951641 - DNA, 18 bp, Homo sapiens
ctggactgtcatagaaat

SEQ ID NO: 4951642 - DNA, 19 bp, Homo sapiens
ctggactgtcatagaaatt

SEQ ID NO: 4951643 - DNA, 20 bp, Homo sapiens
ctggactgtcatagaaatta

SEQ ID NO: 4951644 - DNA, 14 bp, Homo sapiens
ctggagaagagagg

SEQ ID NO: 4951645 - DNA, 16 bp, Homo sapiens
ctggagaagagaggag

SEQ ID NO: 4951646 - DNA, 17 bp, Homo sapiens
ctggagacagccccaga

SEQ ID NO: 4951647 - DNA, 18 bp, Homo sapiens
ctggagaccagggagcct

SEQ ID NO: 4951648 - DNA, 22 bp, Homo sapiens
ctggagagaaacaataaagaga

SEQ ID NO: 4951649 - DNA, 22 bp, Homo sapiens
ctggagatactggtggaagttc

SEQ ID NO: 4951650 - DNA, 18 bp, Homo sapiens
ctggagcagaccaccccg

SEQ ID NO: 4951651 - DNA, 22 bp, Homo sapiens
ctggagccctaaccccttccag

SEQ ID NO: 4951652 - DNA, 16 bp, Homo sapiens
ctggagcctgagtcag

SEQ ID NO: 4951653 - DNA, 16 bp, Homo sapiens
ctggaggccttccagc

SEQ ID NO: 4951654 - DNA, 18 bp, Homo sapiens
ctggaggccttccagctg

SEQ ID NO: 4951655 - DNA, 14 bp, Homo sapiens
ctggaggtgggagc

SEQ ID NO: 4951656 - DNA, 16 bp, Homo sapiens
ctggaggtgggagcag

SEQ ID NO: 4951657 - DNA, 17 bp, Homo sapiens
ctggaggtgggagcagg

SEQ ID NO: 4951658 - DNA, 22 bp, Homo sapiens
ctggaggtgggagcaggagatt

SEQ ID NO: 4951659 - DNA, 21 bp, Homo sapiens
ctggaggtggggcgaggcagg

SEQ ID NO: 4951660 - DNA, 20 bp, Homo sapiens
ctggagtgcagtgagccgag

SEQ ID NO: 4951661 - DNA, 20 bp, Homo sapiens
ctggagtgtggctgaggagg

SEQ ID NO: 4951662 - DNA, 22 bp, Homo sapiens
ctggagtgtggctgaggaggcc

SEQ ID NO: 4951663 - DNA, 15 bp, Homo sapiens
ctggataacttaggt

SEQ ID NO: 4951664 - DNA, 18 bp, Homo sapiens
ctggataggagcctgctg

SEQ ID NO: 4951665 - DNA, 20 bp, Homo sapiens
ctggataggagcctgctggt

SEQ ID NO: 4951666 - DNA, 24 bp, Homo sapiens
ctggatcacgacgctgcagagcac

SEQ ID NO: 4951667 - DNA, 17 bp, Homo sapiens
ctggatccatcaggcca

SEQ ID NO: 4951668 - DNA, 19 bp, Homo sapiens
ctggatccatcaggccact

SEQ ID NO: 4951669 - DNA, 13 bp, Homo sapiens
ctggatgaaattt

SEQ ID NO: 4951670 - DNA, 17 bp, Homo sapiens
ctggatggagcccaggc

SEQ ID NO: 4951671 - DNA, 14 bp, Homo sapiens
ctggcacaggactg

SEQ ID NO: 4951672 - DNA, 16 bp, Homo sapiens
ctggcacagggcagtg

SEQ ID NO: 4951673 - DNA, 22 bp, Homo sapiens
ctggcacccggcccctgctggt

SEQ ID NO: 4951674 - DNA, 14 bp, Homo sapiens
ctggcacttggaga

SEQ ID NO: 4951675 - DNA, 17 bp, Homo sapiens
ctggcagaagggagcag

SEQ ID NO: 4951676 - DNA, 17 bp, Homo sapiens
ctggcagccgtgccttc

SEQ ID NO: 4951677 - DNA, 22 bp, Homo sapiens
ctggcagggaggtcaggccctg

SEQ ID NO: 4951678 - DNA, 23 bp, Homo sapiens
ctggcagggaggtcaggccctgg

SEQ ID NO: 4951679 - DNA, 13 bp, Homo sapiens
ctggcagggctgg

SEQ ID NO: 4951680 - DNA, 20 bp, Homo sapiens
ctggcatgttcaaagccaca

SEQ ID NO: 4951681 - DNA, 15 bp, Homo sapiens
ctggcattacagctg

SEQ ID NO: 4951682 - DNA, 21 bp, Homo sapiens
ctggcattatgtccactgtgt

SEQ ID NO: 4951683 - DNA, 16 bp, Homo sapiens
ctggccacctctctcc

SEQ ID NO: 4951684 - DNA, 17 bp, Homo sapiens
ctggccactgctcccta

SEQ ID NO: 4951685 - DNA, 16 bp, Homo sapiens
ctggccagatgcacca

SEQ ID NO: 4951686 - DNA, 12 bp, Homo sapiens
ctggccagcctg

SEQ ID NO: 4951687 - DNA, 22 bp, Homo sapiens
ctggccagcctggggcctggca

SEQ ID NO: 4951688 - DNA, 15 bp, Homo sapiens
ctggccaggagctct

SEQ ID NO: 4951689 - DNA, 20 bp, Homo sapiens
ctggccaggagctcttcagg

SEQ ID NO: 4951690 - DNA, 14 bp, Homo sapiens
ctggccaggcagat

SEQ ID NO: 4951691 - DNA, 23 bp, Homo sapiens
ctggccatccctcgtggtcccca

SEQ ID NO: 4951692 - DNA, 23 bp, Homo sapiens
ctggcccatagaaacatgacact

SEQ ID NO: 4951693 - DNA, 14 bp, Homo sapiens
ctggccccagggca

SEQ ID NO: 4951694 - DNA, 16 bp, Homo sapiens
ctggccccagggcacc

SEQ ID NO: 4951695 - DNA, 18 bp, Homo sapiens
ctggccccagggcaccct

SEQ ID NO: 4951696 - DNA, 19 bp, Homo sapiens
ctggccccggatcagagca

SEQ ID NO: 4951697 - DNA, 23 bp, Homo sapiens
ctggccccggatcagagcaggac

SEQ ID NO: 4951698 - DNA, 15 bp, Homo sapiens
ctggcccctcgcctg

SEQ ID NO: 4951699 - DNA, 13 bp, Homo sapiens
ctggcccctgggt

SEQ ID NO: 4951700 - DNA, 20 bp, Homo sapiens
ctggccgagggtcctggctc

SEQ ID NO: 4951701 - DNA, 21 bp, Homo sapiens
ctggccgagggtcctggctcc

SEQ ID NO: 4951702 - DNA, 21 bp, Homo sapiens
ctggcctaaaatcttggaagt

SEQ ID NO: 4951703 - DNA, 23 bp, Homo sapiens
ctggcctcaagtgattctcctgc

SEQ ID NO: 4951704 - DNA, 23 bp, Homo sapiens
ctggcctggacagtatcccacat

SEQ ID NO: 4951705 - DNA, 18 bp, Homo sapiens
ctggcctggactgttttc

SEQ ID NO: 4951706 - DNA, 17 bp, Homo sapiens
ctggcctggcacacatc

SEQ ID NO: 4951707 - DNA, 13 bp, Homo sapiens
ctggcctggcctg

SEQ ID NO: 4951708 - DNA, 17 bp, Homo sapiens
ctggcctggcctggccc

SEQ ID NO: 4951709 - DNA, 14 bp, Homo sapiens
ctggcgtgcagtgg

SEQ ID NO: 4951710 - DNA, 15 bp, Homo sapiens
ctggcgtgcagtggt

SEQ ID NO: 4951711 - DNA, 21 bp, Homo sapiens
ctggctagaggccagccccac

SEQ ID NO: 4951712 - DNA, 22 bp, Homo sapiens
ctggctagaggccagccccacc

SEQ ID NO: 4951713 - DNA, 18 bp, Homo sapiens
ctggctagagtcctcact

SEQ ID NO: 4951714 - DNA, 22 bp, Homo sapiens
ctggctagagtcctcactccca

SEQ ID NO: 4951715 - DNA, 17 bp, Homo sapiens
ctggctcacagtacagc

SEQ ID NO: 4951716 - DNA, 15 bp, Homo sapiens
ctggctcctgagggg

SEQ ID NO: 4951717 - DNA, 22 bp, Homo sapiens
ctggctcctttacaaaagaaat

SEQ ID NO: 4951718 - DNA, 17 bp, Homo sapiens
ctggctctcatggggtc

SEQ ID NO: 4951719 - DNA, 23 bp, Homo sapiens
ctggctcttgatacccccctctg

SEQ ID NO: 4951720 - DNA, 18 bp, Homo sapiens
ctggctgccccaacctgc

SEQ ID NO: 4951721 - DNA, 14 bp, Homo sapiens
ctggctgccttaga

SEQ ID NO: 4951722 - DNA, 19 bp, Homo sapiens
ctggctgtaaggctctaga

SEQ ID NO: 4951723 - DNA, 18 bp, Homo sapiens
ctggctgtactgctcagg

SEQ ID NO: 4951724 - DNA, 17 bp, Homo sapiens
ctggctgttggctgggg

SEQ ID NO: 4951725 - DNA, 14 bp, Homo sapiens
ctggcttattttaa

SEQ ID NO: 4951726 - DNA, 16 bp, Homo sapiens
ctggcttattttaatg

SEQ ID NO: 4951727 - DNA, 19 bp, Homo sapiens
ctggcttttcactgctggc

SEQ ID NO: 4951728 - DNA, 23 bp, Homo sapiens
ctggcttttcactgctggctgcc

SEQ ID NO: 4951729 - DNA, 20 bp, Homo sapiens
ctgggaaatgagaaggcagc

SEQ ID NO: 4951730 - DNA, 16 bp, Homo sapiens
ctgggaacctcccaga

SEQ ID NO: 4951731 - DNA, 17 bp, Homo sapiens
ctgggaacctcccagag

SEQ ID NO: 4951732 - DNA, 21 bp, Homo sapiens
ctgggaacctcccagaggtcc

SEQ ID NO: 4951733 - DNA, 19 bp, Homo sapiens
ctgggaagacgcctgagct

SEQ ID NO: 4951734 - DNA, 16 bp, Homo sapiens
ctgggacacaaaactc

SEQ ID NO: 4951735 - DNA, 21 bp, Homo sapiens
ctgggacacaaaactccgccc

SEQ ID NO: 4951736 - DNA, 11 bp, Homo sapiens
ctgggacacag

SEQ ID NO: 4951737 - DNA, 12 bp, Homo sapiens
ctgggacacagt

SEQ ID NO: 4951738 - DNA, 16 bp, Homo sapiens
ctgggactacaggcac

SEQ ID NO: 4951739 - DNA, 12 bp, Homo sapiens
ctgggagacaga

SEQ ID NO: 4951740 - DNA, 13 bp, Homo sapiens
ctgggagctctgc

SEQ ID NO: 4951741 - DNA, 13 bp, Homo sapiens
ctgggagtgagct

SEQ ID NO: 4951742 - DNA, 17 bp, Homo sapiens
ctgggatggaggggagt

SEQ ID NO: 4951743 - DNA, 21 bp, Homo sapiens
ctgggattacaagcgtgagcc

SEQ ID NO: 4951744 - DNA, 14 bp, Homo sapiens
ctgggcaaggaaaa

SEQ ID NO: 4951745 - DNA, 22 bp, Homo sapiens
ctgggcaaggaaaaagaaaata

SEQ ID NO: 4951746 - DNA, 18 bp, Homo sapiens
ctgggcagcatagcaaga

SEQ ID NO: 4951747 - DNA, 22 bp, Homo sapiens
ctgggcatggtaccagccctgg

SEQ ID NO: 4951748 - DNA, 20 bp, Homo sapiens
ctgggccaattcaatacaaa

SEQ ID NO: 4951749 - DNA, 19 bp, Homo sapiens
ctgggccagggtctgtgtg

SEQ ID NO: 4951750 - DNA, 22 bp, Homo sapiens
ctgggccatgtccaaagaggct

SEQ ID NO: 4951751 - DNA, 18 bp, Homo sapiens
ctgggccccccagctcag

SEQ ID NO: 4951752 - DNA, 19 bp, Homo sapiens
ctgggccccccagctcagg

SEQ ID NO: 4951753 - DNA, 20 bp, Homo sapiens
ctgggccccccagctcaggg

SEQ ID NO: 4951754 - DNA, 13 bp, Homo sapiens
ctgggcctgggct

SEQ ID NO: 4951755 - DNA, 22 bp, Homo sapiens
ctgggcggcgggcggctgggtc

SEQ ID NO: 4951756 - DNA, 22 bp, Homo sapiens
ctgggctaggtagaaaaagggt

SEQ ID NO: 4951757 - DNA, 20 bp, Homo sapiens
ctgggctatggacacagggt

SEQ ID NO: 4951758 - DNA, 22 bp, Homo sapiens
ctgggctctgcaattcccctct

SEQ ID NO: 4951759 - DNA, 12 bp, Homo sapiens
ctgggctctgtc

SEQ ID NO: 4951760 - DNA, 15 bp, Homo sapiens
ctgggctgctggagg

SEQ ID NO: 4951761 - DNA, 15 bp, Homo sapiens
ctgggcttcagtggc

SEQ ID NO: 4951762 - DNA, 18 bp, Homo sapiens
ctgggcttcagtggcagc

SEQ ID NO: 4951763 - DNA, 21 bp, Homo sapiens
ctgggcttcagtggcagctgc

SEQ ID NO: 4951764 - DNA, 22 bp, Homo sapiens
ctgggcttcagtggcagctgct

SEQ ID NO: 4951765 - DNA, 23 bp, Homo sapiens
ctgggcttcagtggcagctgctt

SEQ ID NO: 4951766 - DNA, 20 bp, Homo sapiens
ctggggaaaactccaccttc

SEQ ID NO: 4951767 - DNA, 16 bp, Homo sapiens
ctggggaaagacactg

SEQ ID NO: 4951768 - DNA, 19 bp, Homo sapiens
ctggggaaagacactgcct

SEQ ID NO: 4951769 - DNA, 23 bp, Homo sapiens
ctggggaaagacactgcctgggc

SEQ ID NO: 4951770 - DNA, 20 bp, Homo sapiens
ctggggacctggtaccctcc

SEQ ID NO: 4951771 - DNA, 21 bp, Homo sapiens
ctggggacgctccgctgccgt

SEQ ID NO: 4951772 - DNA, 13 bp, Homo sapiens
ctggggagaaagt

SEQ ID NO: 4951773 - DNA, 14 bp, Homo sapiens
ctggggagaaagta

SEQ ID NO: 4951774 - DNA, 16 bp, Homo sapiens
ctggggagaggaaaga

SEQ ID NO: 4951775 - DNA, 15 bp, Homo sapiens
ctggggagcccgtct

SEQ ID NO: 4951776 - DNA, 15 bp, Homo sapiens
ctggggatgtgggag

SEQ ID NO: 4951777 - DNA, 12 bp, Homo sapiens
ctggggcacagt

SEQ ID NO: 4951778 - DNA, 17 bp, Homo sapiens
ctggggcacagtccagg

SEQ ID NO: 4951779 - DNA, 18 bp, Homo sapiens
ctggggcaggctgcttca

SEQ ID NO: 4951780 - DNA, 12 bp, Homo sapiens
ctggggcctcca

SEQ ID NO: 4951781 - DNA, 12 bp, Homo sapiens
ctggggcctgag

SEQ ID NO: 4951782 - DNA, 13 bp, Homo sapiens
ctggggcctgaga

SEQ ID NO: 4951783 - DNA, 14 bp, Homo sapiens
ctggggcctgagag

SEQ ID NO: 4951784 - DNA, 13 bp, Homo sapiens
ctggggcctggca

SEQ ID NO: 4951785 - DNA, 18 bp, Homo sapiens
ctggggcctggcagggag

SEQ ID NO: 4951786 - DNA, 12 bp, Homo sapiens
ctggggctgggc

SEQ ID NO: 4951787 - DNA, 17 bp, Homo sapiens
ctgggggcctcagtgcc

SEQ ID NO: 4951788 - DNA, 18 bp, Homo sapiens
ctgggggcctcagtgcca

SEQ ID NO: 4951789 - DNA, 20 bp, Homo sapiens
ctgggggttctttcttcctc

SEQ ID NO: 4951790 - DNA, 20 bp, Homo sapiens
ctggggtgctgcctgaatcc

SEQ ID NO: 4951791 - DNA, 19 bp, Homo sapiens
ctgggtacttgtggacaca

SEQ ID NO: 4951792 - DNA, 19 bp, Homo sapiens
ctgggtattggaaatggat

SEQ ID NO: 4951793 - DNA, 18 bp, Homo sapiens
ctgggtccttgcacccct

SEQ ID NO: 4951794 - DNA, 23 bp, Homo sapiens
ctgggtccttgcacccctcactc

SEQ ID NO: 4951795 - DNA, 17 bp, Homo sapiens
ctgggtcttttgctact

SEQ ID NO: 4951796 - DNA, 15 bp, Homo sapiens
ctgggtgcagctgag

SEQ ID NO: 4951797 - DNA, 16 bp, Homo sapiens
ctgggtggcctcggga

SEQ ID NO: 4951798 - DNA, 23 bp, Homo sapiens
ctgggtggcctcgggacacctgc

SEQ ID NO: 4951799 - DNA, 16 bp, Homo sapiens
ctgggtggtaccctct

SEQ ID NO: 4951800 - DNA, 19 bp, Homo sapiens
ctgggtggtaccctctgga

SEQ ID NO: 4951801 - DNA, 20 bp, Homo sapiens
ctgggtgtcatttcattcca

SEQ ID NO: 4951802 - DNA, 14 bp, Homo sapiens
ctgggttcactgca

SEQ ID NO: 4951803 - DNA, 17 bp, Homo sapiens
ctgggttccaatcctgg

SEQ ID NO: 4951804 - DNA, 20 bp, Homo sapiens
ctgggttccctttccttcca

SEQ ID NO: 4951805 - DNA, 21 bp, Homo sapiens
ctgggttccctttccttccat

SEQ ID NO: 4951806 - DNA, 15 bp, Homo sapiens
ctggtaccctcctgg

SEQ ID NO: 4951807 - DNA, 21 bp, Homo sapiens
ctggtactccctctcaggatc

SEQ ID NO: 4951808 - DNA, 15 bp, Homo sapiens
ctggtatggctgcag

SEQ ID NO: 4951809 - DNA, 18 bp, Homo sapiens
ctggtatggctgcagtcc

SEQ ID NO: 4951810 - DNA, 18 bp, Homo sapiens
ctggtcacagcctcctct

SEQ ID NO: 4951811 - DNA, 19 bp, Homo sapiens
ctggtcacagcctcctctg

SEQ ID NO: 4951812 - DNA, 18 bp, Homo sapiens
ctggtcacaggactctgc

SEQ ID NO: 4951813 - DNA, 15 bp, Homo sapiens
ctggtccagggaagc

SEQ ID NO: 4951814 - DNA, 17 bp, Homo sapiens
ctggtccagggaagctg

SEQ ID NO: 4951815 - DNA, 22 bp, Homo sapiens
ctggtccagggaagctggccga

SEQ ID NO: 4951816 - DNA, 18 bp, Homo sapiens
ctggtccatgcagggggc

SEQ ID NO: 4951817 - DNA, 14 bp, Homo sapiens
ctggtcccactcag

SEQ ID NO: 4951818 - DNA, 17 bp, Homo sapiens
ctggtcccttgcagcta

SEQ ID NO: 4951819 - DNA, 21 bp, Homo sapiens
ctggtccggacactcctagag

SEQ ID NO: 4951820 - DNA, 22 bp, Homo sapiens
ctggtccggacactcctagaga

SEQ ID NO: 4951821 - DNA, 19 bp, Homo sapiens
ctggtcctgagggtcccca

SEQ ID NO: 4951822 - DNA, 14 bp, Homo sapiens
ctggtgcccggaga

SEQ ID NO: 4951823 - DNA, 16 bp, Homo sapiens
ctggtgcctccagagg

SEQ ID NO: 4951824 - DNA, 16 bp, Homo sapiens
ctggtgcctggctctt

SEQ ID NO: 4951825 - DNA, 17 bp, Homo sapiens
ctggtgcgaatggactt

SEQ ID NO: 4951826 - DNA, 12 bp, Homo sapiens
ctggtgctgcca

SEQ ID NO: 4951827 - DNA, 13 bp, Homo sapiens
ctggtgctgccac

SEQ ID NO: 4951828 - DNA, 20 bp, Homo sapiens
ctggtgctgccacacttcag

SEQ ID NO: 4951829 - DNA, 14 bp, Homo sapiens
ctggtggcagctgc

SEQ ID NO: 4951830 - DNA, 15 bp, Homo sapiens
ctggtggcagctgcg

SEQ ID NO: 4951831 - DNA, 23 bp, Homo sapiens
ctggtggcagtgggagctgcctg

SEQ ID NO: 4951832 - DNA, 23 bp, Homo sapiens
ctggtgggaggggcgcccacctc

SEQ ID NO: 4951833 - DNA, 22 bp, Homo sapiens
ctggttcttcatttattgagca

SEQ ID NO: 4951834 - DNA, 17 bp, Homo sapiens
ctggtttacaggccctg

SEQ ID NO: 4951835 - DNA, 13 bp, Homo sapiens
ctggtttcactgg

SEQ ID NO: 4951836 - DNA, 17 bp, Homo sapiens
ctggtttcactggccca

SEQ ID NO: 4951837 - DNA, 18 bp, Homo sapiens
ctggtttctcattcttgt

SEQ ID NO: 4951838 - DNA, 20 bp, Homo sapiens
ctgtaaaaacactgaaaaat

SEQ ID NO: 4951839 - DNA, 13 bp, Homo sapiens
ctgtaaaacgctg

SEQ ID NO: 4951840 - DNA, 19 bp, Homo sapiens
ctgtaaactcaaaacttaa

SEQ ID NO: 4951841 - DNA, 15 bp, Homo sapiens
ctgtaaagtgcctta

SEQ ID NO: 4951842 - DNA, 14 bp, Homo sapiens
ctgtaaatatgttt

SEQ ID NO: 4951843 - DNA, 21 bp, Homo sapiens
ctgtaacacagctgagagact

SEQ ID NO: 4951844 - DNA, 17 bp, Homo sapiens
ctgtaacaggtattttg

SEQ ID NO: 4951845 - DNA, 18 bp, Homo sapiens
ctgtaacaggtattttgt

SEQ ID NO: 4951846 - DNA, 16 bp, Homo sapiens
ctgtaacttaaaatag

SEQ ID NO: 4951847 - DNA, 23 bp, Homo sapiens
ctgtaagccaaagaaatgaacat

SEQ ID NO: 4951848 - DNA, 13 bp, Homo sapiens
ctgtaaggctcta

SEQ ID NO: 4951849 - DNA, 22 bp, Homo sapiens
ctgtaaggctctagatcataag

SEQ ID NO: 4951850 - DNA, 22 bp, Homo sapiens
ctgtaataatacctcaatgttt

SEQ ID NO: 4951851 - DNA, 23 bp, Homo sapiens
ctgtaataatacctcaatgtttg

SEQ ID NO: 4951852 - DNA, 20 bp, Homo sapiens
ctgtaatcgccctactattc

SEQ ID NO: 4951853 - DNA, 16 bp, Homo sapiens
ctgtaatttagttatt

SEQ ID NO: 4951854 - DNA, 19 bp, Homo sapiens
ctgtaatttagttattgat

SEQ ID NO: 4951855 - DNA, 15 bp, Homo sapiens
ctgtacactgacttg

SEQ ID NO: 4951856 - DNA, 17 bp, Homo sapiens
ctgtacactgacttgag

SEQ ID NO: 4951857 - DNA, 17 bp, Homo sapiens
ctgtacataaacaatga

SEQ ID NO: 4951858 - DNA, 16 bp, Homo sapiens
ctgtacattttgttgt

SEQ ID NO: 4951859 - DNA, 17 bp, Homo sapiens
ctgtacattttgttgta

SEQ ID NO: 4951860 - DNA, 19 bp, Homo sapiens
ctgtacattttgttgtaaa

SEQ ID NO: 4951861 - DNA, 13 bp, Homo sapiens
ctgtacctcatcc

SEQ ID NO: 4951862 - DNA, 15 bp, Homo sapiens
ctgtacctcatccca

SEQ ID NO: 4951863 - DNA, 20 bp, Homo sapiens
ctgtaccttttgaggagccc

SEQ ID NO: 4951864 - DNA, 22 bp, Homo sapiens
ctgtaccttttgaggagcccca

SEQ ID NO: 4951865 - DNA, 14 bp, Homo sapiens
ctgtacgtctgaca

SEQ ID NO: 4951866 - DNA, 17 bp, Homo sapiens
ctgtactaattcttaca

SEQ ID NO: 4951867 - DNA, 16 bp, Homo sapiens
ctgtactgacttgagg

SEQ ID NO: 4951868 - DNA, 21 bp, Homo sapiens
ctgtactgctcaggctgcagc

SEQ ID NO: 4951869 - DNA, 16 bp, Homo sapiens
ctgtagatgatgtatt

SEQ ID NO: 4951870 - DNA, 15 bp, Homo sapiens
ctgtagattctgtgg

SEQ ID NO: 4951871 - DNA, 21 bp, Homo sapiens
ctgtagcagtgagaaaaagct

SEQ ID NO: 4951872 - DNA, 15 bp, Homo sapiens
ctgtagccagcacct

SEQ ID NO: 4951873 - DNA, 20 bp, Homo sapiens
ctgtagtcctagccactcag

SEQ ID NO: 4951874 - DNA, 13 bp, Homo sapiens
ctgtagttctaag

SEQ ID NO: 4951875 - DNA, 18 bp, Homo sapiens
ctgtagttttattttatg

SEQ ID NO: 4951876 - DNA, 24 bp, Homo sapiens
ctgtagttttattttatgtttaga

SEQ ID NO: 4951877 - DNA, 20 bp, Homo sapiens
ctgtataaacattaaatgtc

SEQ ID NO: 4951878 - DNA, 21 bp, Homo sapiens
ctgtataaacattaaatgtct

SEQ ID NO: 4951879 - DNA, 15 bp, Homo sapiens
ctgtataaataggag

SEQ ID NO: 4951880 - DNA, 13 bp, Homo sapiens
ctgtatactttag

SEQ ID NO: 4951881 - DNA, 20 bp, Homo sapiens
ctgtatagacagtttgtaaa

SEQ ID NO: 4951882 - DNA, 13 bp, Homo sapiens
ctgtatatacttt

SEQ ID NO: 4951883 - DNA, 15 bp, Homo sapiens
ctgtatgttgtccaa

SEQ ID NO: 4951884 - DNA, 14 bp, Homo sapiens
ctgtatttaagcaa

SEQ ID NO: 4951885 - DNA, 16 bp, Homo sapiens
ctgtatttaagcaaat

SEQ ID NO: 4951886 - DNA, 17 bp, Homo sapiens
ctgtatttaagcaaata

SEQ ID NO: 4951887 - DNA, 17 bp, Homo sapiens
ctgtatttatgtgtgag

SEQ ID NO: 4951888 - DNA, 18 bp, Homo sapiens
ctgtatttatgtgtgagg

SEQ ID NO: 4951889 - DNA, 21 bp, Homo sapiens
ctgtcaaaagttggactaaat

SEQ ID NO: 4951890 - DNA, 12 bp, Homo sapiens
ctgtcaagaaga

SEQ ID NO: 4951891 - DNA, 19 bp, Homo sapiens
ctgtcaagttcctttgggt

SEQ ID NO: 4951892 - DNA, 19 bp, Homo sapiens
ctgtcaatgattattttca

SEQ ID NO: 4951893 - DNA, 20 bp, Homo sapiens
ctgtcaatgattattttcat

SEQ ID NO: 4951894 - DNA, 15 bp, Homo sapiens
ctgtcacaccagcca

SEQ ID NO: 4951895 - DNA, 14 bp, Homo sapiens
ctgtcaccctccac

SEQ ID NO: 4951896 - DNA, 18 bp, Homo sapiens
ctgtcaccctccacctct

SEQ ID NO: 4951897 - DNA, 14 bp, Homo sapiens
ctgtcactcattgc

SEQ ID NO: 4951898 - DNA, 12 bp, Homo sapiens
ctgtcagaatgc

SEQ ID NO: 4951899 - DNA, 17 bp, Homo sapiens
ctgtcagcgcaggttta

SEQ ID NO: 4951900 - DNA, 14 bp, Homo sapiens
ctgtcattcaaatg

SEQ ID NO: 4951901 - DNA, 17 bp, Homo sapiens
ctgtcatttgagcaggg

SEQ ID NO: 4951902 - DNA, 18 bp, Homo sapiens
ctgtcatttgagcagggc

SEQ ID NO: 4951903 - DNA, 21 bp, Homo sapiens
ctgtcatttgagcagggctca

SEQ ID NO: 4951904 - DNA, 23 bp, Homo sapiens
ctgtcatttgagcagggctcagc

SEQ ID NO: 4951905 - DNA, 16 bp, Homo sapiens
ctgtcatttgttgtga

SEQ ID NO: 4951906 - DNA, 17 bp, Homo sapiens
ctgtccaaaggaggctg

SEQ ID NO: 4951907 - DNA, 19 bp, Homo sapiens
ctgtccaaaggaggctggc

SEQ ID NO: 4951908 - DNA, 11 bp, Homo sapiens
ctgtccagaga

SEQ ID NO: 4951909 - DNA, 18 bp, Homo sapiens
ctgtccagcctgggcagc

SEQ ID NO: 4951910 - DNA, 22 bp, Homo sapiens
ctgtccaggcactgctgcccag

SEQ ID NO: 4951911 - DNA, 19 bp, Homo sapiens
ctgtcccatggacactcca

SEQ ID NO: 4951912 - DNA, 21 bp, Homo sapiens
ctgtccctcccacctctgtga

SEQ ID NO: 4951913 - DNA, 15 bp, Homo sapiens
ctgtccctgaaacct

SEQ ID NO: 4951914 - DNA, 16 bp, Homo sapiens
ctgtcctactctgtgt

SEQ ID NO: 4951915 - DNA, 18 bp, Homo sapiens
ctgtcctactctgtgtca

SEQ ID NO: 4951916 - DNA, 13 bp, Homo sapiens
ctgtcctcactgc

SEQ ID NO: 4951917 - DNA, 21 bp, Homo sapiens
ctgtcctcccatcccctggac

SEQ ID NO: 4951918 - DNA, 14 bp, Homo sapiens
ctgtcctccctctg

SEQ ID NO: 4951919 - DNA, 12 bp, Homo sapiens
ctgtcctgatct

SEQ ID NO: 4951920 - DNA, 17 bp, Homo sapiens
ctgtcctgatctgtgat

SEQ ID NO: 4951921 - DNA, 13 bp, Homo sapiens
ctgtcctgggagt

SEQ ID NO: 4951922 - DNA, 12 bp, Homo sapiens
ctgtcctgtgac

SEQ ID NO: 4951923 - DNA, 13 bp, Homo sapiens
ctgtccttgccct

SEQ ID NO: 4951924 - DNA, 13 bp, Homo sapiens
ctgtctaacttta

SEQ ID NO: 4951925 - DNA, 13 bp, Homo sapiens
ctgtctacaaata

SEQ ID NO: 4951926 - DNA, 12 bp, Homo sapiens
ctgtctagagta

SEQ ID NO: 4951927 - DNA, 16 bp, Homo sapiens
ctgtctagtctctcct

SEQ ID NO: 4951928 - DNA, 19 bp, Homo sapiens
ctgtctagtctctcctgta

SEQ ID NO: 4951929 - DNA, 21 bp, Homo sapiens
ctgtctcaagagggcactggt

SEQ ID NO: 4951930 - DNA, 23 bp, Homo sapiens
ctgtctcaagagggcactggtgg

SEQ ID NO: 4951931 - DNA, 20 bp, Homo sapiens
ctgtctcagacttttgtaca

SEQ ID NO: 4951932 - DNA, 14 bp, Homo sapiens
ctaaggttctaagg

SEQ ID NO: 4951933 - DNA, 17 bp, Homo sapiens
ctaaggttctaaggcct

SEQ ID NO: 4951934 - DNA, 13 bp, Homo sapiens
ctaagtactgtaa

SEQ ID NO: 4951935 - DNA, 12 bp, Homo sapiens
ctaagtattaaa

SEQ ID NO: 4951936 - DNA, 15 bp, Homo sapiens
ctaagtcctttatgt

SEQ ID NO: 4951937 - DNA, 23 bp, Homo sapiens
ctaagtgatcctcccacctcagc

SEQ ID NO: 4951938 - DNA, 14 bp, Homo sapiens
ctaagttcacatta

SEQ ID NO: 4951939 - DNA, 14 bp, Homo sapiens
ctaagtttctaaga

SEQ ID NO: 4951940 - DNA, 15 bp, Homo sapiens
ctaagtttctaagat

SEQ ID NO: 4951941 - DNA, 21 bp, Homo sapiens
ctaagtttctaagattctaaa

SEQ ID NO: 4951942 - DNA, 16 bp, Homo sapiens
ctaataatttctaatg

SEQ ID NO: 4951943 - DNA, 18 bp, Homo sapiens
ctaataatttctaatgtt

SEQ ID NO: 4951944 - DNA, 15 bp, Homo sapiens
ctaatacctctgtgt

SEQ ID NO: 4951945 - DNA, 11 bp, Homo sapiens
ctaatatattt

SEQ ID NO: 4951946 - DNA, 17 bp, Homo sapiens
ctaatatccccaaatta

SEQ ID NO: 4951947 - DNA, 22 bp, Homo sapiens
ctaatatccccaaattagggca

SEQ ID NO: 4951948 - DNA, 13 bp, Homo sapiens
ctaatatggcaaa

SEQ ID NO: 4951949 - DNA, 14 bp, Homo sapiens
ctaatattaaaaat

SEQ ID NO: 4951950 - DNA, 16 bp, Homo sapiens
ctaatattaaaaatat

SEQ ID NO: 4951951 - DNA, 16 bp, Homo sapiens
ctaatcaaagccaggg

SEQ ID NO: 4951952 - DNA, 22 bp, Homo sapiens
ctaatcagaaatttttatcagt

SEQ ID NO: 4951953 - DNA, 23 bp, Homo sapiens
ctaatcagaaatttttatcagtt

SEQ ID NO: 4951954 - DNA, 17 bp, Homo sapiens
ctaatcagcattctcac

SEQ ID NO: 4951955 - DNA, 19 bp, Homo sapiens
ctaatcagcattctcactc

SEQ ID NO: 4951956 - DNA, 20 bp, Homo sapiens
ctaatcagcattctcactcc

SEQ ID NO: 4951957 - DNA, 18 bp, Homo sapiens
ctaatctcatacctctga

SEQ ID NO: 4951958 - DNA, 22 bp, Homo sapiens
ctaatctcatacctctgaccaa

SEQ ID NO: 4951959 - DNA, 12 bp, Homo sapiens
ctaatgggacac

SEQ ID NO: 4951960 - DNA, 16 bp, Homo sapiens
ctaatgtaaaatgatt

SEQ ID NO: 4951961 - DNA, 15 bp, Homo sapiens
ctaatgtcttcataa

SEQ ID NO: 4951962 - DNA, 16 bp, Homo sapiens
ctaatgtcttcataaa

SEQ ID NO: 4951963 - DNA, 19 bp, Homo sapiens
ctaattagggtacatttat

SEQ ID NO: 4951964 - DNA, 15 bp, Homo sapiens
ctaattcctttctat

SEQ ID NO: 4951965 - DNA, 20 bp, Homo sapiens
ctaattgcatctcaaaatta

SEQ ID NO: 4951966 - DNA, 23 bp, Homo sapiens
ctaattgggagtccaggcacagg

SEQ ID NO: 4951967 - DNA, 12 bp, Homo sapiens
ctaatttaaaaa

SEQ ID NO: 4951968 - DNA, 14 bp, Homo sapiens
ctaatttaaaaaat

SEQ ID NO: 4951969 - DNA, 21 bp, Homo sapiens
ctaatttcaaaaatataactt

SEQ ID NO: 4951970 - DNA, 22 bp, Homo sapiens
ctaatttcaaaatgctttttat

SEQ ID NO: 4951971 - DNA, 22 bp, Homo sapiens
ctaatttgcattaaattcacaa

SEQ ID NO: 4951972 - DNA, 10 bp, Homo sapiens
ctacaaatca

SEQ ID NO: 4951973 - DNA, 15 bp, Homo sapiens
ctacaagatttagaa

SEQ ID NO: 4951974 - DNA, 22 bp, Homo sapiens
ctacaattaatagtttgtctat

SEQ ID NO: 4951975 - DNA, 20 bp, Homo sapiens
ctacacagtgggaactctga

SEQ ID NO: 4951976 - DNA, 23 bp, Homo sapiens
ctacacagtgggaactctgacaa

SEQ ID NO: 4951977 - DNA, 13 bp, Homo sapiens
ctacacattttta

SEQ ID NO: 4951978 - DNA, 14 bp, Homo sapiens
ctacacatttttaa

SEQ ID NO: 4951979 - DNA, 15 bp, Homo sapiens
ctacagacctgcttt

SEQ ID NO: 4951980 - DNA, 21 bp, Homo sapiens
ctacagagccgagcaatattt

SEQ ID NO: 4951981 - DNA, 13 bp, Homo sapiens
ctacagagctgtg

SEQ ID NO: 4951982 - DNA, 18 bp, Homo sapiens
ctacagaggccatgggcc

SEQ ID NO: 4951983 - DNA, 20 bp, Homo sapiens
ctacagaggccatgggcctc

SEQ ID NO: 4951984 - DNA, 22 bp, Homo sapiens
ctacagaggccatgggcctcct

SEQ ID NO: 4951985 - DNA, 23 bp, Homo sapiens
ctacagatgatagaggattttat

SEQ ID NO: 4951986 - DNA, 21 bp, Homo sapiens
ctacagcactactgggtgtca

SEQ ID NO: 4951987 - DNA, 19 bp, Homo sapiens
ctacagctaatcagcattc

SEQ ID NO: 4951988 - DNA, 11 bp, Homo sapiens
ctacagctctt

SEQ ID NO: 4951989 - DNA, 17 bp, Homo sapiens
ctacagctttcttgctc

SEQ ID NO: 4951990 - DNA, 19 bp, Homo sapiens
ctacagctttgatccctga

SEQ ID NO: 4951991 - DNA, 15 bp, Homo sapiens
ctacaggagtgagca

SEQ ID NO: 4951992 - DNA, 16 bp, Homo sapiens
ctacaggtgtgagtca

SEQ ID NO: 4951993 - DNA, 19 bp, Homo sapiens
ctacagtgccaactcctca

SEQ ID NO: 4951994 - DNA, 23 bp, Homo sapiens
ctacatactttcatcctgactct

SEQ ID NO: 4951995 - DNA, 15 bp, Homo sapiens
ctacatcttctgcct

SEQ ID NO: 4951996 - DNA, 21 bp, Homo sapiens
ctacatgaggaactgtagatg

SEQ ID NO: 4951997 - DNA, 17 bp, Homo sapiens
ctacatgcagcccatgc

SEQ ID NO: 4951998 - DNA, 22 bp, Homo sapiens
ctacattataaatgtctcttta

SEQ ID NO: 4951999 - DNA, 23 bp, Homo sapiens
ctacattattgcttattgcttag

SEQ ID NO: 4952000 - DNA, 14 bp, Homo sapiens
ctaccatcagggac

SEQ ID NO: 4952001 - DNA, 15 bp, Homo sapiens
ctaccatcagggaca

SEQ ID NO: 4952002 - DNA, 18 bp, Homo sapiens
ctaccatcagggacagga

SEQ ID NO: 4952003 - DNA, 12 bp, Homo sapiens
ctaccatttcag

SEQ ID NO: 4952004 - DNA, 16 bp, Homo sapiens
ctacccaaaccctagg

SEQ ID NO: 4952005 - DNA, 16 bp, Homo sapiens
ctacccacacctctgc

SEQ ID NO: 4952006 - DNA, 13 bp, Homo sapiens
ctacccaccctcc

SEQ ID NO: 4952007 - DNA, 22 bp, Homo sapiens
ctacccacttctaaatagcaat

SEQ ID NO: 4952008 - DNA, 15 bp, Homo sapiens
ctacccagcgagccc

SEQ ID NO: 4952009 - DNA, 19 bp, Homo sapiens
ctacccagcgagccctggt

SEQ ID NO: 4952010 - DNA, 20 bp, Homo sapiens
ctacccagcgagccctggtg

SEQ ID NO: 4952011 - DNA, 16 bp, Homo sapiens
ctaccctcccaccccc

SEQ ID NO: 4952012 - DNA, 19 bp, Homo sapiens
ctaccctttttctccagct

SEQ ID NO: 4952013 - DNA, 14 bp, Homo sapiens
ctaccgagttcaag

SEQ ID NO: 4952014 - DNA, 14 bp, Homo sapiens
ctacctgccctgga

SEQ ID NO: 4952015 - DNA, 18 bp, Homo sapiens
ctacctgtgtggtactct

SEQ ID NO: 4952016 - DNA, 22 bp, Homo sapiens
ctaccttatcactgcattattc

SEQ ID NO: 4952017 - DNA, 20 bp, Homo sapiens
ctactaagttcacattagaa

SEQ ID NO: 4952018 - DNA, 17 bp, Homo sapiens
ctactaattccacacct

SEQ ID NO: 4952019 - DNA, 18 bp, Homo sapiens
ctactccctgcagatgcc

SEQ ID NO: 4952020 - DNA, 11 bp, Homo sapiens
ctactcctgac

SEQ ID NO: 4952021 - DNA, 12 bp, Homo sapiens
ctactcctgact

SEQ ID NO: 4952022 - DNA, 12 bp, Homo sapiens
ctactctgtgtc

SEQ ID NO: 4952023 - DNA, 12 bp, Homo sapiens
ctactctttgat

SEQ ID NO: 4952024 - DNA, 18 bp, Homo sapiens
ctactgaaacagatttca

SEQ ID NO: 4952025 - DNA, 19 bp, Homo sapiens
ctactgggtgtcatttcat

SEQ ID NO: 4952026 - DNA, 13 bp, Homo sapiens
ctactgtacataa

SEQ ID NO: 4952027 - DNA, 20 bp, Homo sapiens
ctactgtctcactgaaacat

SEQ ID NO: 4952028 - DNA, 12 bp, Homo sapiens
ctactgttctaa

SEQ ID NO: 4952029 - DNA, 13 bp, Homo sapiens
ctacttaagagaa

SEQ ID NO: 4952030 - DNA, 17 bp, Homo sapiens
ctacttcctcctcccca

SEQ ID NO: 4952031 - DNA, 20 bp, Homo sapiens
ctactttggtttctgtctgt

SEQ ID NO: 4952032 - DNA, 22 bp, Homo sapiens
ctagaaaacttgactccatttc

SEQ ID NO: 4952033 - DNA, 14 bp, Homo sapiens
ctagaaacccaagc

SEQ ID NO: 4952034 - DNA, 17 bp, Homo sapiens
ctagaaacccaagctcc

SEQ ID NO: 4952035 - DNA, 18 bp, Homo sapiens
ctagaactctccatctta

SEQ ID NO: 4952036 - DNA, 13 bp, Homo sapiens
ctagaactttttt

SEQ ID NO: 4952037 - DNA, 17 bp, Homo sapiens
ctagaacttttttaaat

SEQ ID NO: 4952038 - DNA, 21 bp, Homo sapiens
ctagaacttttttaaataaac

SEQ ID NO: 4952039 - DNA, 13 bp, Homo sapiens
ctagaagaagcta

SEQ ID NO: 4952040 - DNA, 12 bp, Homo sapiens
ctagaatacttt

SEQ ID NO: 4952041 - DNA, 18 bp, Homo sapiens
ctagaatactttttaaaa

SEQ ID NO: 4952042 - DNA, 14 bp, Homo sapiens
ctcacagtcccact

SEQ ID NO: 4952043 - DNA, 18 bp, Homo sapiens
ctcacagtcccactgtgc

SEQ ID NO: 4952044 - DNA, 18 bp, Homo sapiens
ctcacagtgacccttccc

SEQ ID NO: 4952045 - DNA, 19 bp, Homo sapiens
ctcacagtgacccttccca

SEQ ID NO: 4952046 - DNA, 17 bp, Homo sapiens
ctcacagtgttgcccag

SEQ ID NO: 4952047 - DNA, 22 bp, Homo sapiens
ctcacatttattctgctcacat

SEQ ID NO: 4952048 - DNA, 17 bp, Homo sapiens
ctcaccagccccactgc

SEQ ID NO: 4952049 - DNA, 21 bp, Homo sapiens
ctcaccagccccactgccagc

SEQ ID NO: 4952050 - DNA, 22 bp, Homo sapiens
ctcaccagccccactgccagca

SEQ ID NO: 4952051 - DNA, 18 bp, Homo sapiens
ctcaccagccccagtgcc

SEQ ID NO: 4952052 - DNA, 20 bp, Homo sapiens
ctcaccagccccagtgccca

SEQ ID NO: 4952053 - DNA, 19 bp, Homo sapiens
ctcaccagctgctgctctg

SEQ ID NO: 4952054 - DNA, 23 bp, Homo sapiens
ctcaccagtgtcccctccactgt

SEQ ID NO: 4952055 - DNA, 12 bp, Homo sapiens
ctcaccccatcc

SEQ ID NO: 4952056 - DNA, 18 bp, Homo sapiens
ctcacccccagctttgct

SEQ ID NO: 4952057 - DNA, 13 bp, Homo sapiens
ctcacccctgtcc

SEQ ID NO: 4952058 - DNA, 15 bp, Homo sapiens
ctcacccctgtcctc

SEQ ID NO: 4952059 - DNA, 21 bp, Homo sapiens
ctcacccctgtcctcactgct

SEQ ID NO: 4952060 - DNA, 12 bp, Homo sapiens
ctcacctagagc

SEQ ID NO: 4952061 - DNA, 13 bp, Homo sapiens
ctcacctagagcc

SEQ ID NO: 4952062 - DNA, 13 bp, Homo sapiens
ctcacctctaccc

SEQ ID NO: 4952063 - DNA, 15 bp, Homo sapiens
ctcacctctacccaa

SEQ ID NO: 4952064 - DNA, 19 bp, Homo sapiens
ctcacctctacccaaaccc

SEQ ID NO: 4952065 - DNA, 14 bp, Homo sapiens
ctcacctctggact

SEQ ID NO: 4952066 - DNA, 15 bp, Homo sapiens
ctcacctctggactg

SEQ ID NO: 4952067 - DNA, 21 bp, Homo sapiens
ctcacctctggactggctaga

SEQ ID NO: 4952068 - DNA, 14 bp, Homo sapiens
ctcaccttctgagt

SEQ ID NO: 4952069 - DNA, 17 bp, Homo sapiens
ctcacgggcatgggcac

SEQ ID NO: 4952070 - DNA, 16 bp, Homo sapiens
ctcactatgttgccca

SEQ ID NO: 4952071 - DNA, 19 bp, Homo sapiens
ctcactatgttgcccaggc

SEQ ID NO: 4952072 - DNA, 20 bp, Homo sapiens
ctcactatgttgcccaggca

SEQ ID NO: 4952073 - DNA, 21 bp, Homo sapiens
ctcactatgttgcccaggcag

SEQ ID NO: 4952074 - DNA, 12 bp, Homo sapiens
ctcactccccat

SEQ ID NO: 4952075 - DNA, 13 bp, Homo sapiens
ctcactcctacct

SEQ ID NO: 4952076 - DNA, 15 bp, Homo sapiens
ctcactcctacctgg

SEQ ID NO: 4952077 - DNA, 12 bp, Homo sapiens
ctcactctgcca

SEQ ID NO: 4952078 - DNA, 18 bp, Homo sapiens
ctcactctgccagggcag

SEQ ID NO: 4952079 - DNA, 13 bp, Homo sapiens
ctcactctgtcgc

SEQ ID NO: 4952080 - DNA, 21 bp, Homo sapiens
ctcactctgtcgcccagtctg

SEQ ID NO: 4952081 - DNA, 15 bp, Homo sapiens
ctcactgatatattt

SEQ ID NO: 4952082 - DNA, 12 bp, Homo sapiens
ctcactgcccgc

SEQ ID NO: 4952083 - DNA, 15 bp, Homo sapiens
ctcactgctccctga

SEQ ID NO: 4952084 - DNA, 17 bp, Homo sapiens
ctcactgctccctgaag

SEQ ID NO: 4952085 - DNA, 19 bp, Homo sapiens
ctcactgctccctgaagcc

SEQ ID NO: 4952086 - DNA, 20 bp, Homo sapiens
ctcactgctccctgaagcca

SEQ ID NO: 4952087 - DNA, 16 bp, Homo sapiens
ctcactggggcctaca

SEQ ID NO: 4952088 - DNA, 18 bp, Homo sapiens
ctcactggggcctacagc

SEQ ID NO: 4952089 - DNA, 15 bp, Homo sapiens
ctcactgttgcccag

SEQ ID NO: 4952090 - DNA, 17 bp, Homo sapiens
ctcactgttgcccaggc

SEQ ID NO: 4952091 - DNA, 14 bp, Homo sapiens
ctcagaacccaggg

SEQ ID NO: 4952092 - DNA, 16 bp, Homo sapiens
ctcagaacccagggct

SEQ ID NO: 4952093 - DNA, 23 bp, Homo sapiens
ctcagaagacactgatgggcaac

SEQ ID NO: 4952094 - DNA, 22 bp, Homo sapiens
ctcagaagtgaaaatcttggag

SEQ ID NO: 4952095 - DNA, 12 bp, Homo sapiens
ctcagaatattg

SEQ ID NO: 4952096 - DNA, 19 bp, Homo sapiens
ctcagacatgttttccgtg

SEQ ID NO: 4952097 - DNA, 20 bp, Homo sapiens
ctcagacatgttttccgtga

SEQ ID NO: 4952098 - DNA, 23 bp, Homo sapiens
ctcagagaatttctaccatttca

SEQ ID NO: 4952099 - DNA, 22 bp, Homo sapiens
ctcagagatgtgcacccatggg

SEQ ID NO: 4952100 - DNA, 15 bp, Homo sapiens
ctcagagccacccct

SEQ ID NO: 4952101 - DNA, 13 bp, Homo sapiens
ctcagagggggac

SEQ ID NO: 4952102 - DNA, 19 bp, Homo sapiens
ctcagagggggactgctgc

SEQ ID NO: 4952103 - DNA, 21 bp, Homo sapiens
ctcagatcagtgtaccatttg

SEQ ID NO: 4952104 - DNA, 18 bp, Homo sapiens
ctcagatgcagtttggag

SEQ ID NO: 4952105 - DNA, 22 bp, Homo sapiens
ctcagcagccgccttaagctga

SEQ ID NO: 4952106 - DNA, 21 bp, Homo sapiens
ctcagcatcctggcacccggc

SEQ ID NO: 4952107 - DNA, 19 bp, Homo sapiens
ctcagccacacccaggcac

SEQ ID NO: 4952108 - DNA, 20 bp, Homo sapiens
ctcagcccagaagaaaattc

SEQ ID NO: 4952109 - DNA, 12 bp, Homo sapiens
ctcagcccctag

SEQ ID NO: 4952110 - DNA, 19 bp, Homo sapiens
ctcagccctccctgcccct

SEQ ID NO: 4952111 - DNA, 20 bp, Homo sapiens
ctcagccctccctgcccctc

SEQ ID NO: 4952112 - DNA, 21 bp, Homo sapiens
ctcagccctccctgcccctcc

SEQ ID NO: 4952113 - DNA, 11 bp, Homo sapiens
ctcagccctga

SEQ ID NO: 4952114 - DNA, 13 bp, Homo sapiens
ctcagccctgagg

SEQ ID NO: 4952115 - DNA, 14 bp, Homo sapiens
ctcagccctgaggt

SEQ ID NO: 4952116 - DNA, 17 bp, Homo sapiens
ctcagcctcccaaagtg

SEQ ID NO: 4952117 - DNA, 13 bp, Homo sapiens
ctcagcctcccag

SEQ ID NO: 4952118 - DNA, 13 bp, Homo sapiens
ctcagcctcccga

SEQ ID NO: 4952119 - DNA, 11 bp, Homo sapiens
ctcagcctgca

SEQ ID NO: 4952120 - DNA, 14 bp, Homo sapiens
ctcagcggggacag

SEQ ID NO: 4952121 - DNA, 20 bp, Homo sapiens
ctcagcggggacagctcctt

SEQ ID NO: 4952122 - DNA, 19 bp, Homo sapiens
ctcagctacccactatcct

SEQ ID NO: 4952123 - DNA, 19 bp, Homo sapiens
ctcagctcccaaggctctg

SEQ ID NO: 4952124 - DNA, 15 bp, Homo sapiens
ctcagctcggggagc

SEQ ID NO: 4952125 - DNA, 18 bp, Homo sapiens
ctcagctcggggagcctt

SEQ ID NO: 4952126 - DNA, 19 bp, Homo sapiens
ctcagctcggggagcctta

SEQ ID NO: 4952127 - DNA, 16 bp, Homo sapiens
ctcagctgcctcactt

SEQ ID NO: 4952128 - DNA, 18 bp, Homo sapiens
ctcagctgcctcacttcc

SEQ ID NO: 4952129 - DNA, 15 bp, Homo sapiens
ctcaggcactagcct

SEQ ID NO: 4952130 - DNA, 23 bp, Homo sapiens
ctcaggcctataaccccagctcc

SEQ ID NO: 4952131 - DNA, 20 bp, Homo sapiens
ctcaggcgatccacctgtct

SEQ ID NO: 4952132 - DNA, 24 bp, Homo sapiens
ctcaggctgctggggcctcagacg

SEQ ID NO: 4952133 - DNA, 18 bp, Homo sapiens
ctcagggagcagggaagg

SEQ ID NO: 4952134 - DNA, 19 bp, Homo sapiens
ctcagggagcagggaaggc

SEQ ID NO: 4952135 - DNA, 14 bp, Homo sapiens
ctcagggcagcctc

SEQ ID NO: 4952136 - DNA, 20 bp, Homo sapiens
ctcagggccatgcctgcccc

SEQ ID NO: 4952137 - DNA, 17 bp, Homo sapiens
ctcagggctcctcccag

SEQ ID NO: 4952138 - DNA, 18 bp, Homo sapiens
ctcagggctcctcccagc

SEQ ID NO: 4952139 - DNA, 19 bp, Homo sapiens
ctcagggctcctcccagct

SEQ ID NO: 4952140 - DNA, 19 bp, Homo sapiens
ctcaggggaaaactgttac

SEQ ID NO: 4952141 - DNA, 14 bp, Homo sapiens
ctcaggggcagctc

SEQ ID NO: 4952142 - DNA, 16 bp, Homo sapiens
ctcagggtgcagaggt

SEQ ID NO: 4952143 - DNA, 18 bp, Homo sapiens
ctcaggtccctgcagggc

SEQ ID NO: 4952144 - DNA, 22 bp, Homo sapiens
ctcaggtgatccacccacctca

SEQ ID NO: 4952145 - DNA, 15 bp, Homo sapiens
ctcaggtgtccctgc

SEQ ID NO: 4952146 - DNA, 20 bp, Homo sapiens
ctcagtaaatgtacaactgc

SEQ ID NO: 4952147 - DNA, 18 bp, Homo sapiens
ctcagtatgctgcccctg

SEQ ID NO: 4952148 - DNA, 18 bp, Homo sapiens
ctcagtcatgcataaata

SEQ ID NO: 4952149 - DNA, 18 bp, Homo sapiens
ctcagtcattagactcct

SEQ ID NO: 4952150 - DNA, 23 bp, Homo sapiens
ctcagtccatttatatatgaaaa

SEQ ID NO: 4952151 - DNA, 14 bp, Homo sapiens
ctcagtcctcccct

SEQ ID NO: 4952152 - DNA, 22 bp, Homo sapiens
ctccttcgtatcccgagtctgg

SEQ ID NO: 4952153 - DNA, 14 bp, Homo sapiens
ctccttctgtccta

SEQ ID NO: 4952154 - DNA, 15 bp, Homo sapiens
ctccttctgtcctac

SEQ ID NO: 4952155 - DNA, 12 bp, Homo sapiens
ctccttggccta

SEQ ID NO: 4952156 - DNA, 17 bp, Homo sapiens
ctccttggcctagccca

SEQ ID NO: 4952157 - DNA, 22 bp, Homo sapiens
ctccttggcctagcccaccctg

SEQ ID NO: 4952158 - DNA, 19 bp, Homo sapiens
ctccttggcttacctgacc

SEQ ID NO: 4952159 - DNA, 19 bp, Homo sapiens
ctccttggtgcctggcctg

SEQ ID NO: 4952160 - DNA, 13 bp, Homo sapiens
ctcctttcacaac

SEQ ID NO: 4952161 - DNA, 16 bp, Homo sapiens
ctcctttcacaacctt

SEQ ID NO: 4952162 - DNA, 14 bp, Homo sapiens
ctcctttctgtgcc

SEQ ID NO: 4952163 - DNA, 15 bp, Homo sapiens
ctccttttatgtgta

SEQ ID NO: 4952164 - DNA, 10 bp, Homo sapiens
ctccttttct

SEQ ID NO: 4952165 - DNA, 20 bp, Homo sapiens
ctcgaaacacagaaaccttt

SEQ ID NO: 4952166 - DNA, 16 bp, Homo sapiens
ctcgaactggctgcaa

SEQ ID NO: 4952167 - DNA, 12 bp, Homo sapiens
ctcgaagcgcgc

SEQ ID NO: 4952168 - DNA, 17 bp, Homo sapiens
ctcgaagcgcgccactc

SEQ ID NO: 4952169 - DNA, 23 bp, Homo sapiens
ctcgagcagtcctgcctcagcct

SEQ ID NO: 4952170 - DNA, 21 bp, Homo sapiens
ctcgatccaaattgtgcttct

SEQ ID NO: 4952171 - DNA, 23 bp, Homo sapiens
ctcgcaaaaacgtatctcctaat

SEQ ID NO: 4952172 - DNA, 23 bp, Homo sapiens
ctcgcacccccctgttctaaggg

SEQ ID NO: 4952173 - DNA, 14 bp, Homo sapiens
ctcgcacctttcca

SEQ ID NO: 4952174 - DNA, 16 bp, Homo sapiens
ctcgcttcccccatag

SEQ ID NO: 4952175 - DNA, 13 bp, Homo sapiens
ctcgcttgtaaat

SEQ ID NO: 4952176 - DNA, 21 bp, Homo sapiens
ctcggaaccgctcacctagag

SEQ ID NO: 4952177 - DNA, 22 bp, Homo sapiens
ctcggactaagcctacctgctc

SEQ ID NO: 4952178 - DNA, 13 bp, Homo sapiens
ctcggaggctgcc

SEQ ID NO: 4952179 - DNA, 16 bp, Homo sapiens
ctcggaggctgccccc

SEQ ID NO: 4952180 - DNA, 22 bp, Homo sapiens
ctcggctccccatgtgtcctgg

SEQ ID NO: 4952181 - DNA, 20 bp, Homo sapiens
ctcgggacacctgccctgcc

SEQ ID NO: 4952182 - DNA, 16 bp, Homo sapiens
ctcgtggtccccaaca

SEQ ID NO: 4952183 - DNA, 20 bp, Homo sapiens
ctctaaagaccaaacttcac

SEQ ID NO: 4952184 - DNA, 19 bp, Homo sapiens
ctctaaattctttatttct

SEQ ID NO: 4952185 - DNA, 16 bp, Homo sapiens
ctctaagatcttagat

SEQ ID NO: 4952186 - DNA, 13 bp, Homo sapiens
ctctaataaaaca

SEQ ID NO: 4952187 - DNA, 18 bp, Homo sapiens
ctctaattctattaaagt

SEQ ID NO: 4952188 - DNA, 16 bp, Homo sapiens
ctctacaaactcccac

SEQ ID NO: 4952189 - DNA, 13 bp, Homo sapiens
ctctacagaggcc

SEQ ID NO: 4952190 - DNA, 19 bp, Homo sapiens
ctctacagaggccatgggc

SEQ ID NO: 4952191 - DNA, 21 bp, Homo sapiens
ctctacagctaatcagcattc

SEQ ID NO: 4952192 - DNA, 13 bp, Homo sapiens
ctctacagtgcca

SEQ ID NO: 4952193 - DNA, 20 bp, Homo sapiens
ctctacagtgccaactcctc

SEQ ID NO: 4952194 - DNA, 17 bp, Homo sapiens
ctctacccaaaccctag

SEQ ID NO: 4952195 - DNA, 17 bp, Homo sapiens
ctctaccctcccacccc

SEQ ID NO: 4952196 - DNA, 18 bp, Homo sapiens
ctctaccctcccaccccc

SEQ ID NO: 4952197 - DNA, 22 bp, Homo sapiens
ctctaccctcccacccccttct

SEQ ID NO: 4952198 - DNA, 16 bp, Homo sapiens
ctctagacaagatatt

SEQ ID NO: 4952199 - DNA, 21 bp, Homo sapiens
ctctagacaagatattgtaca

SEQ ID NO: 4952200 - DNA, 16 bp, Homo sapiens
ctctagacactgccac

SEQ ID NO: 4952201 - DNA, 21 bp, Homo sapiens
ctctagacactgccacacagg

SEQ ID NO: 4952202 - DNA, 19 bp, Homo sapiens
ctctagggttgctggagcc

SEQ ID NO: 4952203 - DNA, 18 bp, Homo sapiens
ctctatacatctctcccc

SEQ ID NO: 4952204 - DNA, 12 bp, Homo sapiens
ctctatttaata

SEQ ID NO: 4952205 - DNA, 14 bp, Homo sapiens
ctctatttaatatt

SEQ ID NO: 4952206 - DNA, 17 bp, Homo sapiens
ctctatttaatatttat

SEQ ID NO: 4952207 - DNA, 23 bp, Homo sapiens
ctctcaaaagagaaaaacaaaac

SEQ ID NO: 4952208 - DNA, 16 bp, Homo sapiens
ctctcaatatgcttac

SEQ ID NO: 4952209 - DNA, 15 bp, Homo sapiens
ctctcagcccagaag

SEQ ID NO: 4952210 - DNA, 13 bp, Homo sapiens
ctctcagctccag

SEQ ID NO: 4952211 - DNA, 15 bp, Homo sapiens
ctctcagctccaggt

SEQ ID NO: 4952212 - DNA, 14 bp, Homo sapiens
ctctcaggatccaa

SEQ ID NO: 4952213 - DNA, 11 bp, Homo sapiens
ctctccactgc

SEQ ID NO: 4952214 - DNA, 20 bp, Homo sapiens
ctctccagatgtttccagac

SEQ ID NO: 4952215 - DNA, 14 bp, Homo sapiens
ctctccagcctgac

SEQ ID NO: 4952216 - DNA, 15 bp, Homo sapiens
ctctcccaagtccac

SEQ ID NO: 4952217 - DNA, 14 bp, Homo sapiens
ctctcccatttcct

SEQ ID NO: 4952218 - DNA, 20 bp, Homo sapiens
ctctccccaacccccattct

SEQ ID NO: 4952219 - DNA, 15 bp, Homo sapiens
ctctccccacactaa

SEQ ID NO: 4952220 - DNA, 13 bp, Homo sapiens
ctctccccagcaa

SEQ ID NO: 4952221 - DNA, 13 bp, Homo sapiens
ctctcccctccag

SEQ ID NO: 4952222 - DNA, 18 bp, Homo sapiens
ctctcccctccagccttt

SEQ ID NO: 4952223 - DNA, 17 bp, Homo sapiens
ctctccctcccctgcca

SEQ ID NO: 4952224 - DNA, 12 bp, Homo sapiens
ctctccctgttg

SEQ ID NO: 4952225 - DNA, 14 bp, Homo sapiens
ctctcctcttgcca

SEQ ID NO: 4952226 - DNA, 17 bp, Homo sapiens
ctctcctcttgccactg

SEQ ID NO: 4952227 - DNA, 22 bp, Homo sapiens
ctctcctcttgccactgcctct

SEQ ID NO: 4952228 - DNA, 20 bp, Homo sapiens
ctctcctgtttcccttccct

SEQ ID NO: 4952229 - DNA, 10 bp, Homo sapiens
ctctcctttt

SEQ ID NO: 4952230 - DNA, 12 bp, Homo sapiens
ctctccttttct

SEQ ID NO: 4952231 - DNA, 17 bp, Homo sapiens
ctctccttttcttttgt

SEQ ID NO: 4952232 - DNA, 22 bp, Homo sapiens
ctctccttttcttttgttactg

SEQ ID NO: 4952233 - DNA, 16 bp, Homo sapiens
ctctcggctccccatg

SEQ ID NO: 4952234 - DNA, 14 bp, Homo sapiens
ctctctccagatgt

SEQ ID NO: 4952235 - DNA, 12 bp, Homo sapiens
ctctctccctct

SEQ ID NO: 4952236 - DNA, 22 bp, Homo sapiens
ctctctcctgtttcccttccct

SEQ ID NO: 4952237 - DNA, 12 bp, Homo sapiens
ctctctcttctg

SEQ ID NO: 4952238 - DNA, 13 bp, Homo sapiens
ctctctgcagctg

SEQ ID NO: 4952239 - DNA, 14 bp, Homo sapiens
ctctctgcagctgc

SEQ ID NO: 4952240 - DNA, 15 bp, Homo sapiens
ctctctgcagctgcc

SEQ ID NO: 4952241 - DNA, 15 bp, Homo sapiens
ctctctggtggctct

SEQ ID NO: 4952242 - DNA, 16 bp, Homo sapiens
ctctctgtgctgtgga

SEQ ID NO: 4952243 - DNA, 20 bp, Homo sapiens
ctctcttaaagttggaattt

SEQ ID NO: 4952244 - DNA, 23 bp, Homo sapiens
ctctcttcagactctcagcccag

SEQ ID NO: 4952245 - DNA, 22 bp, Homo sapiens
ctctcttccctttccccagcat

SEQ ID NO: 4952246 - DNA, 20 bp, Homo sapiens
ctctcttcctgcccctcttt

SEQ ID NO: 4952247 - DNA, 15 bp, Homo sapiens
ctctcttctgctcca

SEQ ID NO: 4952248 - DNA, 18 bp, Homo sapiens
ctctcttctgctccaccc

SEQ ID NO: 4952249 - DNA, 17 bp, Homo sapiens
ctctcttttctgtactt

SEQ ID NO: 4952250 - DNA, 19 bp, Homo sapiens
ctctcttttctgtacttcc

SEQ ID NO: 4952251 - DNA, 14 bp, Homo sapiens
ctctgaacacaggc

SEQ ID NO: 4952252 - DNA, 16 bp, Homo sapiens
ctctgaacacaggcag

SEQ ID NO: 4952253 - DNA, 17 bp, Homo sapiens
ctctgaacacaggcagc

SEQ ID NO: 4952254 - DNA, 19 bp, Homo sapiens
ctctgaacacaggcagctt

SEQ ID NO: 4952255 - DNA, 13 bp, Homo sapiens
ctctgaactttgg

SEQ ID NO: 4952256 - DNA, 14 bp, Homo sapiens
ctctgaagcatgtt

SEQ ID NO: 4952257 - DNA, 17 bp, Homo sapiens
ctctgaagcctctggga

SEQ ID NO: 4952258 - DNA, 17 bp, Homo sapiens
ctctgacaagggctgac

SEQ ID NO: 4952259 - DNA, 15 bp, Homo sapiens
ctctgacacacagct

SEQ ID NO: 4952260 - DNA, 16 bp, Homo sapiens
ctctgaccaacaggct

SEQ ID NO: 4952261 - DNA, 14 bp, Homo sapiens
ctctgacccctcct

SEQ ID NO: 4952262 - DNA, 15 bp, Homo sapiens
ctctgagaagaggag

SEQ ID NO: 4952263 - DNA, 19 bp, Homo sapiens
ctcttgatacccccctctg

SEQ ID NO: 4952264 - DNA, 21 bp, Homo sapiens
ctcttgatacccccctctgtc

SEQ ID NO: 4952265 - DNA, 17 bp, Homo sapiens
ctcttgccactgcctct

SEQ ID NO: 4952266 - DNA, 19 bp, Homo sapiens
ctcttgccactgcctcttc

SEQ ID NO: 4952267 - DNA, 13 bp, Homo sapiens
ctcttgctgtctc

SEQ ID NO: 4952268 - DNA, 17 bp, Homo sapiens
ctcttgctgtctctgct

SEQ ID NO: 4952269 - DNA, 14 bp, Homo sapiens
ctcttgctttctat

SEQ ID NO: 4952270 - DNA, 21 bp, Homo sapiens
ctcttgggaactgaactcact

SEQ ID NO: 4952271 - DNA, 14 bp, Homo sapiens
ctcttgtcccacgt

SEQ ID NO: 4952272 - DNA, 21 bp, Homo sapiens
ctcttgtcccacgtgtcttcc

SEQ ID NO: 4952273 - DNA, 21 bp, Homo sapiens
ctcttgtcctcagtccattta

SEQ ID NO: 4952274 - DNA, 13 bp, Homo sapiens
ctcttgttttgtt

SEQ ID NO: 4952275 - DNA, 18 bp, Homo sapiens
ctcttgttttgtttgtct

SEQ ID NO: 4952276 - DNA, 20 bp, Homo sapiens
ctcttgttttgtttgtctct

SEQ ID NO: 4952277 - DNA, 19 bp, Homo sapiens
ctcttgtttttattaattt

SEQ ID NO: 4952278 - DNA, 23 bp, Homo sapiens
ctcttgtttttattaatttatat

SEQ ID NO: 4952279 - DNA, 20 bp, Homo sapiens
ctctttaagggcatgccttg

SEQ ID NO: 4952280 - DNA, 13 bp, Homo sapiens
ctctttattttcc

SEQ ID NO: 4952281 - DNA, 14 bp, Homo sapiens
ctctttcacattgt

SEQ ID NO: 4952282 - DNA, 19 bp, Homo sapiens
ctctttcgtcacccttgga

SEQ ID NO: 4952283 - DNA, 13 bp, Homo sapiens
ctctttctctctt

SEQ ID NO: 4952284 - DNA, 18 bp, Homo sapiens
ctctttctctttcttcct

SEQ ID NO: 4952285 - DNA, 15 bp, Homo sapiens
ctctttctgtatata

SEQ ID NO: 4952286 - DNA, 21 bp, Homo sapiens
ctctttcttataatactctgt

SEQ ID NO: 4952287 - DNA, 17 bp, Homo sapiens
ctctttcttcctttact

SEQ ID NO: 4952288 - DNA, 22 bp, Homo sapiens
ccccatgcctgtccagcctggg

SEQ ID NO: 4952289 - DNA, 18 bp, Homo sapiens
ccccatgtgtcctggttc

SEQ ID NO: 4952290 - DNA, 19 bp, Homo sapiens
ccccatgttgtaatgctgc

SEQ ID NO: 4952291 - DNA, 20 bp, Homo sapiens
ccccatgttgtaatgctgca

SEQ ID NO: 4952292 - DNA, 13 bp, Homo sapiens
ccccattctgcct

SEQ ID NO: 4952293 - DNA, 14 bp, Homo sapiens
ccccattctgcctg

SEQ ID NO: 4952294 - DNA, 23 bp, Homo sapiens
cccccaaccaagtggctcccaca

SEQ ID NO: 4952295 - DNA, 19 bp, Homo sapiens
cccccaagctgttttcttc

SEQ ID NO: 4952296 - DNA, 16 bp, Homo sapiens
cccccaccggtccagc

SEQ ID NO: 4952297 - DNA, 18 bp, Homo sapiens
cccccaccggtccagctg

SEQ ID NO: 4952298 - DNA, 20 bp, Homo sapiens
cccccaccggtccagctggc

SEQ ID NO: 4952299 - DNA, 15 bp, Homo sapiens
cccccagcccaaagg

SEQ ID NO: 4952300 - DNA, 12 bp, Homo sapiens
cccccagcctat

SEQ ID NO: 4952301 - DNA, 20 bp, Homo sapiens
cccccagcctatgagcatcc

SEQ ID NO: 4952302 - DNA, 23 bp, Homo sapiens
cccccagcctatgagcatcctga

SEQ ID NO: 4952303 - DNA, 23 bp, Homo sapiens
cccccatgttgtaatgctgcact

SEQ ID NO: 4952304 - DNA, 16 bp, Homo sapiens
ccgccattgccaccag

SEQ ID NO: 4952305 - DNA, 14 bp, Homo sapiens
ccgcccccagccta

SEQ ID NO: 4952306 - DNA, 12 bp, Homo sapiens
ccgccccctcct

SEQ ID NO: 4952307 - DNA, 15 bp, Homo sapiens
ccgccctcttcctga

SEQ ID NO: 4952308 - DNA, 18 bp, Homo sapiens
ccgcctagtttactgttt

SEQ ID NO: 4952309 - DNA, 14 bp, Homo sapiens
ccgcctcaaaatgt

SEQ ID NO: 4952310 - DNA, 16 bp, Homo sapiens
ccgccttaagctgatc

SEQ ID NO: 4952311 - DNA, 20 bp, Homo sapiens
ccgcgctcgccccaccggcg

SEQ ID NO: 4952312 - DNA, 17 bp, Homo sapiens
ccgctcacctagagcca

SEQ ID NO: 4952313 - DNA, 11 bp, Homo sapiens
ccgctcagccc

SEQ ID NO: 4952314 - DNA, 13 bp, Homo sapiens
ccgctcagccctc

SEQ ID NO: 4952315 - DNA, 15 bp, Homo sapiens
ccgctcagccctccc

SEQ ID NO: 4952316 - DNA, 13 bp, Homo sapiens
ccgctctcttcct

SEQ ID NO: 4952317 - DNA, 17 bp, Homo sapiens
ccgctctcttcctgccc

SEQ ID NO: 4952318 - DNA, 21 bp, Homo sapiens
ccgctctcttttctgtacttc

SEQ ID NO: 4952319 - DNA, 15 bp, Homo sapiens
ccgctgctccacgcg

SEQ ID NO: 4952320 - DNA, 16 bp, Homo sapiens
ccgctgctgctgctgc

SEQ ID NO: 4952321 - DNA, 20 bp, Homo sapiens
ccgcttgtggggacccaggc

SEQ ID NO: 4952322 - DNA, 17 bp, Homo sapiens
ccggacactcctagaga

SEQ ID NO: 4952323 - DNA, 17 bp, Homo sapiens
ccggagattggacggcc

SEQ ID NO: 4952324 - DNA, 13 bp, Homo sapiens
ccggatcagagca

SEQ ID NO: 4952325 - DNA, 12 bp, Homo sapiens
ccggcaggccct

SEQ ID NO: 4952326 - DNA, 15 bp, Homo sapiens
ccggcaggccctgca

SEQ ID NO: 4952327 - DNA, 20 bp, Homo sapiens
ccggcaggccctgcagtgtt

SEQ ID NO: 4952328 - DNA, 18 bp, Homo sapiens
ccggcatgtttccagcag

SEQ ID NO: 4952329 - DNA, 15 bp, Homo sapiens
ccggccaatggaaac

SEQ ID NO: 4952330 - DNA, 16 bp, Homo sapiens
ccggccaatggaaacc

SEQ ID NO: 4952331 - DNA, 14 bp, Homo sapiens
ccggccccctgccc

SEQ ID NO: 4952332 - DNA, 22 bp, Homo sapiens
ccggccctgggctcggaggctg

SEQ ID NO: 4952333 - DNA, 23 bp, Homo sapiens
ccggctatgggggcactgaggac

SEQ ID NO: 4952334 - DNA, 13 bp, Homo sapiens
ccggctccaggct

SEQ ID NO: 4952335 - DNA, 18 bp, Homo sapiens
ccgggagcctaggaccac

SEQ ID NO: 4952336 - DNA, 20 bp, Homo sapiens
ccgggcactcagaagacact

SEQ ID NO: 4952337 - DNA, 22 bp, Homo sapiens
ccgggcactcagaagacactga

SEQ ID NO: 4952338 - DNA, 15 bp, Homo sapiens
ccgggcgcggccagc

SEQ ID NO: 4952339 - DNA, 13 bp, Homo sapiens
ccgggctgggagc

SEQ ID NO: 4952340 - DNA, 18 bp, Homo sapiens
ccgggctgggagctctgc

SEQ ID NO: 4952341 - DNA, 19 bp, Homo sapiens
ccgggctgggagctctgca

SEQ ID NO: 4952342 - DNA, 16 bp, Homo sapiens
ccggggccagcaccac

SEQ ID NO: 4952343 - DNA, 14 bp, Homo sapiens
ccggtccagctggc

SEQ ID NO: 4952344 - DNA, 20 bp, Homo sapiens
ccggtcccacccctccctct

SEQ ID NO: 4952345 - DNA, 23 bp, Homo sapiens
ccggtcccacccctccctctgtc

SEQ ID NO: 4952346 - DNA, 14 bp, Homo sapiens
ccggtgttctaaga

SEQ ID NO: 4952347 - DNA, 15 bp, Homo sapiens
ccggtgttctaagat

SEQ ID NO: 4952348 - DNA, 20 bp, Homo sapiens
ccgtaataacacccttcctt

SEQ ID NO: 4952349 - DNA, 22 bp, Homo sapiens
ccgtccagccgccattgccacc

SEQ ID NO: 4952350 - DNA, 11 bp, Homo sapiens
ccgtcctcacc

SEQ ID NO: 4952351 - DNA, 20 bp, Homo sapiens
ccgtcctcacccctgtcctc

SEQ ID NO: 4952352 - DNA, 21 bp, Homo sapiens
ccgtcgaggggctctcagctc

SEQ ID NO: 4952353 - DNA, 22 bp, Homo sapiens
ccgtcgaggggctctcagctca

SEQ ID NO: 4952354 - DNA, 21 bp, Homo sapiens
ccgtgagcaggaaggcctggg

SEQ ID NO: 4952355 - DNA, 22 bp, Homo sapiens
ccgtgagcaggaaggcctgggt

SEQ ID NO: 4952356 - DNA, 22 bp, Homo sapiens
ccgtgagccaatccctcacctt

SEQ ID NO: 4952357 - DNA, 20 bp, Homo sapiens
ccgtgagcgcctgtgcacac

SEQ ID NO: 4952358 - DNA, 22 bp, Homo sapiens
ccgtgagcgcctgtgcacacac

SEQ ID NO: 4952359 - DNA, 17 bp, Homo sapiens
ccgtgccgcctgcactc

SEQ ID NO: 4952360 - DNA, 15 bp, Homo sapiens
ccgtgccttcagctc

SEQ ID NO: 4952361 - DNA, 17 bp, Homo sapiens
ccgtggccatccctgtg

SEQ ID NO: 4952362 - DNA, 15 bp, Homo sapiens
ccgtggccctgccct

SEQ ID NO: 4952363 - DNA, 11 bp, Homo sapiens
ccgtggcttcc

SEQ ID NO: 4952364 - DNA, 14 bp, Homo sapiens
ccgtggcttcccgc

SEQ ID NO: 4952365 - DNA, 18 bp, Homo sapiens
ccgtgtgagtgtgacagg

SEQ ID NO: 4952366 - DNA, 22 bp, Homo sapiens
ccgtgtgagtgtgacagggcca

SEQ ID NO: 4952367 - DNA, 19 bp, Homo sapiens
ccgttcctgacatcacagc

SEQ ID NO: 4952368 - DNA, 24 bp, Homo sapiens
ccgttcctgacatcacagcagcct

SEQ ID NO: 4952369 - DNA, 15 bp, Homo sapiens
cctaaaactggcctg

SEQ ID NO: 4952370 - DNA, 14 bp, Homo sapiens
cctaaaagcaaaat

SEQ ID NO: 4952371 - DNA, 23 bp, Homo sapiens
cctaaaaggaaatctcaccccat

SEQ ID NO: 4952372 - DNA, 15 bp, Homo sapiens
cctaaacccctgtcc

SEQ ID NO: 4952373 - DNA, 15 bp, Homo sapiens
cctaaacctttgccc

SEQ ID NO: 4952374 - DNA, 23 bp, Homo sapiens
cctaaagagagtatttttataca

SEQ ID NO: 4952375 - DNA, 19 bp, Homo sapiens
cctaagaaatatgtgagat

SEQ ID NO: 4952376 - DNA, 15 bp, Homo sapiens
cctaagccagcctgg

SEQ ID NO: 4952377 - DNA, 17 bp, Homo sapiens
cctaagccagcctggtc

SEQ ID NO: 4952378 - DNA, 14 bp, Homo sapiens
cctaagtactgtaa

SEQ ID NO: 4952379 - DNA, 18 bp, Homo sapiens
cctaagtattaaaacatt

SEQ ID NO: 4952380 - DNA, 16 bp, Homo sapiens
cctaagtcctttatgt

SEQ ID NO: 4952381 - DNA, 14 bp, Homo sapiens
cctaagtctctgtg

SEQ ID NO: 4952382 - DNA, 18 bp, Homo sapiens
cctaataaacatccttca

SEQ ID NO: 4952383 - DNA, 14 bp, Homo sapiens
cctaatctcatacc

SEQ ID NO: 4952384 - DNA, 21 bp, Homo sapiens
cctacaagagcagcctgtggc

SEQ ID NO: 4952385 - DNA, 13 bp, Homo sapiens
cctacaaggccta

SEQ ID NO: 4952386 - DNA, 18 bp, Homo sapiens
cctacagcactactgggt

SEQ ID NO: 4952387 - DNA, 22 bp, Homo sapiens
cctacagcactactgggtgtca

SEQ ID NO: 4952388 - DNA, 12 bp, Homo sapiens
cctacagcattg

SEQ ID NO: 4952389 - DNA, 18 bp, Homo sapiens
cctacccacacctctgcc

SEQ ID NO: 4952390 - DNA, 13 bp, Homo sapiens
cctacccaccctc

SEQ ID NO: 4952391 - DNA, 18 bp, Homo sapiens
cctacccaccctcctttc

SEQ ID NO: 4952392 - DNA, 22 bp, Homo sapiens
cctacccagagattgcttctca

SEQ ID NO: 4952393 - DNA, 15 bp, Homo sapiens
cctacccctggctgt

SEQ ID NO: 4952394 - DNA, 16 bp, Homo sapiens
cctactatcactgaac

SEQ ID NO: 4952395 - DNA, 17 bp, Homo sapiens
cctactcattggggttc

SEQ ID NO: 4952396 - DNA, 15 bp, Homo sapiens
cctactccctgcaga

SEQ ID NO: 4952397 - DNA, 11 bp, Homo sapiens
cctactcctga

SEQ ID NO: 4952398 - DNA, 13 bp, Homo sapiens
cctactcctgact

SEQ ID NO: 4952399 - DNA, 15 bp, Homo sapiens
cctactgttctaaag

SEQ ID NO: 4952400 - DNA, 22 bp, Homo sapiens
cctactgttctaaagctctgac

SEQ ID NO: 4952401 - DNA, 23 bp, Homo sapiens
cctactgttctaaagctctgaca

SEQ ID NO: 4952402 - DNA, 17 bp, Homo sapiens
cctagaaacccaagctc

SEQ ID NO: 4952403 - DNA, 23 bp, Homo sapiens
cctagaaacccaagctcctcctc

SEQ ID NO: 4952404 - DNA, 21 bp, Homo sapiens
cctagaacactaactcaccag

SEQ ID NO: 4952405 - DNA, 19 bp, Homo sapiens
cctagactgtaaacctctc

SEQ ID NO: 4952406 - DNA, 13 bp, Homo sapiens
cctagagcctgcc

SEQ ID NO: 4952407 - DNA, 14 bp, Homo sapiens
cctagatcctaagg

SEQ ID NO: 4952408 - DNA, 16 bp, Homo sapiens
cctagatcctaagggt

SEQ ID NO: 4952409 - DNA, 17 bp, Homo sapiens
cctagcaagctggcctc

SEQ ID NO: 4952410 - DNA, 18 bp, Homo sapiens
cctagcaagctggcctct

SEQ ID NO: 4952411 - DNA, 13 bp, Homo sapiens
cctagcagtgaac

SEQ ID NO: 4952412 - DNA, 16 bp, Homo sapiens
cctagcagtgaactat

SEQ ID NO: 4952413 - DNA, 14 bp, Homo sapiens
cctagcccaccctg

SEQ ID NO: 4952414 - DNA, 18 bp, Homo sapiens
cctcttccgtgacgtcac

SEQ ID NO: 4952415 - DNA, 15 bp, Homo sapiens
cctcttcctccctca

SEQ ID NO: 4952416 - DNA, 16 bp, Homo sapiens
cctcttcctccctcat

SEQ ID NO: 4952417 - DNA, 11 bp, Homo sapiens
cctcttcctga

SEQ ID NO: 4952418 - DNA, 14 bp, Homo sapiens
cctcttgccactgc

SEQ ID NO: 4952419 - DNA, 22 bp, Homo sapiens
cctcttgccactgcctcttcct

SEQ ID NO: 4952420 - DNA, 23 bp, Homo sapiens
cctcttgccactgcctcttcctc

SEQ ID NO: 4952421 - DNA, 12 bp, Homo sapiens
cctcttgctgtc

SEQ ID NO: 4952422 - DNA, 23 bp, Homo sapiens
cctcttgctgtctctgctcgccc

SEQ ID NO: 4952423 - DNA, 12 bp, Homo sapiens
cctcttgttttg

SEQ ID NO: 4952424 - DNA, 15 bp, Homo sapiens
cctcttgttttgttt

SEQ ID NO: 4952425 - DNA, 15 bp, Homo sapiens
cctctttaaaacaaa

SEQ ID NO: 4952426 - DNA, 21 bp, Homo sapiens
cctctttctctccccaacccc

SEQ ID NO: 4952427 - DNA, 12 bp, Homo sapiens
cctctttctctt

SEQ ID NO: 4952428 - DNA, 21 bp, Homo sapiens
cctctttctctttcttccttt

SEQ ID NO: 4952429 - DNA, 20 bp, Homo sapiens
cctctttggctcccctgtac

SEQ ID NO: 4952430 - DNA, 15 bp, Homo sapiens
cctcttttcttactc

SEQ ID NO: 4952431 - DNA, 22 bp, Homo sapiens
cctcttttcttactcctcctct

SEQ ID NO: 4952432 - DNA, 19 bp, Homo sapiens
cctcttttgttaaataata

SEQ ID NO: 4952433 - DNA, 22 bp, Homo sapiens
cctgaaaagtaacttggctttc

SEQ ID NO: 4952434 - DNA, 22 bp, Homo sapiens
cctgaaaatgtttttctgccag

SEQ ID NO: 4952435 - DNA, 16 bp, Homo sapiens
cctgaaattccaaagt

SEQ ID NO: 4952436 - DNA, 14 bp, Homo sapiens
cctgaaatttcacc

SEQ ID NO: 4952437 - DNA, 13 bp, Homo sapiens
cctgaacaagaat

SEQ ID NO: 4952438 - DNA, 15 bp, Homo sapiens
cctgaaccgcacagc

SEQ ID NO: 4952439 - DNA, 22 bp, Homo sapiens
cctgaaccgcacagctcaggag

SEQ ID NO: 4952440 - DNA, 18 bp, Homo sapiens
cctgaagaattaagatac

SEQ ID NO: 4952441 - DNA, 12 bp, Homo sapiens
cctgaagactga

SEQ ID NO: 4952442 - DNA, 12 bp, Homo sapiens
cctgaagccagc

SEQ ID NO: 4952443 - DNA, 18 bp, Homo sapiens
cctgaagccagccttctt

SEQ ID NO: 4952444 - DNA, 17 bp, Homo sapiens
cctgaagtcacacagtg

SEQ ID NO: 4952445 - DNA, 16 bp, Homo sapiens
cctgacagaaggactc

SEQ ID NO: 4952446 - DNA, 14 bp, Homo sapiens
cctgacagaaggtg

SEQ ID NO: 4952447 - DNA, 15 bp, Homo sapiens
cctgacagaaggtgc

SEQ ID NO: 4952448 - DNA, 16 bp, Homo sapiens
cctgacagaaggtgcc

SEQ ID NO: 4952449 - DNA, 17 bp, Homo sapiens
cctgacagaaggtgcca

SEQ ID NO: 4952450 - DNA, 13 bp, Homo sapiens
cctgacatcacag

SEQ ID NO: 4952451 - DNA, 17 bp, Homo sapiens
cctgacatcacagcagc

SEQ ID NO: 4952452 - DNA, 22 bp, Homo sapiens
cctgacccgtctaatatataaa

SEQ ID NO: 4952453 - DNA, 16 bp, Homo sapiens
cctgacctcactgtga

SEQ ID NO: 4952454 - DNA, 14 bp, Homo sapiens
cctgacctcttgct

SEQ ID NO: 4952455 - DNA, 17 bp, Homo sapiens
cctgacctcttgctgtc

SEQ ID NO: 4952456 - DNA, 20 bp, Homo sapiens
cctgacctcttgctgtctct

SEQ ID NO: 4952457 - DNA, 17 bp, Homo sapiens
cctgactctgccccctg

SEQ ID NO: 4952458 - DNA, 19 bp, Homo sapiens
cctgacttggggagatgga

SEQ ID NO: 4952459 - DNA, 14 bp, Homo sapiens
cctgagaaatgtta

SEQ ID NO: 4952460 - DNA, 15 bp, Homo sapiens
cctgagaagctgctc

SEQ ID NO: 4952461 - DNA, 16 bp, Homo sapiens
cctgagaagctgctcc

SEQ ID NO: 4952462 - DNA, 18 bp, Homo sapiens
cctgagagaattggctca

SEQ ID NO: 4952463 - DNA, 18 bp, Homo sapiens
cctgagagacatggcttt

SEQ ID NO: 4952464 - DNA, 21 bp, Homo sapiens
cctgagccccgccctcttcct

SEQ ID NO: 4952465 - DNA, 19 bp, Homo sapiens
cctgagccctactccctgc

SEQ ID NO: 4952466 - DNA, 14 bp, Homo sapiens
cctgagctttatgg

SEQ ID NO: 4952467 - DNA, 17 bp, Homo sapiens
cctgagggaggacctgg

SEQ ID NO: 4952468 - DNA, 19 bp, Homo sapiens
cctgaggggcatctgcccc

SEQ ID NO: 4952469 - DNA, 13 bp, Homo sapiens
cctgagggtcccc

SEQ ID NO: 4952470 - DNA, 19 bp, Homo sapiens
cctgagggtccccacctgg

SEQ ID NO: 4952471 - DNA, 23 bp, Homo sapiens
cctgagtcaccctacctgtgcct

SEQ ID NO: 4952472 - DNA, 17 bp, Homo sapiens
cctgagtcagggcccag

SEQ ID NO: 4952473 - DNA, 20 bp, Homo sapiens
cctgagtcagggcccagagg

SEQ ID NO: 4952474 - DNA, 20 bp, Homo sapiens
cctgataaaacaacagctcg

SEQ ID NO: 4952475 - DNA, 17 bp, Homo sapiens
cctgatctcttcctgtt

SEQ ID NO: 4952476 - DNA, 20 bp, Homo sapiens
cctgatctcttcctgttttg

SEQ ID NO: 4952477 - DNA, 14 bp, Homo sapiens
cctgatctgtgata

SEQ ID NO: 4952478 - DNA, 13 bp, Homo sapiens
cctgatgctccct

SEQ ID NO: 4952479 - DNA, 19 bp, Homo sapiens
cctgatgtgtcctcaggga

SEQ ID NO: 4952480 - DNA, 13 bp, Homo sapiens
cctgattgtaaac

SEQ ID NO: 4952481 - DNA, 18 bp, Homo sapiens
cctgatttggtacttttg

SEQ ID NO: 4952482 - DNA, 19 bp, Homo sapiens
cctgcaaacagaacagggt

SEQ ID NO: 4952483 - DNA, 13 bp, Homo sapiens
cctgcaaggccca

SEQ ID NO: 4952484 - DNA, 14 bp, Homo sapiens
cctgcaaggcccac

SEQ ID NO: 4952485 - DNA, 16 bp, Homo sapiens
cctgcaaggcccacag

SEQ ID NO: 4952486 - DNA, 16 bp, Homo sapiens
cctgcaatatttgaat

SEQ ID NO: 4952487 - DNA, 20 bp, Homo sapiens
cctgcacagtgtcccccagg

SEQ ID NO: 4952488 - DNA, 12 bp, Homo sapiens
cctgcactcctc

SEQ ID NO: 4952489 - DNA, 14 bp, Homo sapiens
cctgcactggggag

SEQ ID NO: 4952490 - DNA, 19 bp, Homo sapiens
cctgcacttgcagactcta

SEQ ID NO: 4952491 - DNA, 22 bp, Homo sapiens
cctgcactttgatgtcatgtgt

SEQ ID NO: 4952492 - DNA, 13 bp, Homo sapiens
cctgcagatgcca

SEQ ID NO: 4952493 - DNA, 17 bp, Homo sapiens
cctgcagcatggtccct

SEQ ID NO: 4952494 - DNA, 23 bp, Homo sapiens
cctgcagcatggtccctgcctta

SEQ ID NO: 4952495 - DNA, 15 bp, Homo sapiens
cctgcaggctgagcc

SEQ ID NO: 4952496 - DNA, 16 bp, Homo sapiens
cctgcaggctgagcca

SEQ ID NO: 4952497 - DNA, 18 bp, Homo sapiens
cctgcagtactttacctc

SEQ ID NO: 4952498 - DNA, 12 bp, Homo sapiens
cctgcagtgttc

SEQ ID NO: 4952499 - DNA, 18 bp, Homo sapiens
cctgcatccccttggctg

SEQ ID NO: 4952500 - DNA, 12 bp, Homo sapiens
cctgcattgtta

SEQ ID NO: 4952501 - DNA, 16 bp, Homo sapiens
cctgcatttctgagtt

SEQ ID NO: 4952502 - DNA, 23 bp, Homo sapiens
cctgcatttgtgaaatgatggtg

SEQ ID NO: 4952503 - DNA, 12 bp, Homo sapiens
cctgccaccctg

SEQ ID NO: 4952504 - DNA, 16 bp, Homo sapiens
cctgccaccctgtagc

SEQ ID NO: 4952505 - DNA, 14 bp, Homo sapiens
cctgccatttaaaa

SEQ ID NO: 4952506 - DNA, 13 bp, Homo sapiens
cctgcccaggccc

SEQ ID NO: 4952507 - DNA, 22 bp, Homo sapiens
cctgcccaggccggccagcctc

SEQ ID NO: 4952508 - DNA, 16 bp, Homo sapiens
cctgcccatgggagct

SEQ ID NO: 4952509 - DNA, 17 bp, Homo sapiens
cctgccccccagcctct

SEQ ID NO: 4952510 - DNA, 16 bp, Homo sapiens
cctgcccctcccttca

SEQ ID NO: 4952511 - DNA, 23 bp, Homo sapiens
cctgcccctctttctctttcttc

SEQ ID NO: 4952512 - DNA, 16 bp, Homo sapiens
cctgcccgcacagcag

SEQ ID NO: 4952513 - DNA, 22 bp, Homo sapiens
cctgcccgcacagcagcctgct

SEQ ID NO: 4952514 - DNA, 16 bp, Homo sapiens
cctgcccggctgcgga

SEQ ID NO: 4952515 - DNA, 22 bp, Homo sapiens
cctgcccgggcgcggccagccc

SEQ ID NO: 4952516 - DNA, 13 bp, Homo sapiens
cctgccctgagga

SEQ ID NO: 4952517 - DNA, 13 bp, Homo sapiens
cctgccctgctgc

SEQ ID NO: 4952518 - DNA, 20 bp, Homo sapiens
cctgccctgctgccgcctcc

SEQ ID NO: 4952519 - DNA, 12 bp, Homo sapiens
cctgccctggaa

SEQ ID NO: 4952520 - DNA, 11 bp, Homo sapiens
cctgcctcagc

SEQ ID NO: 4952521 - DNA, 20 bp, Homo sapiens
cctgcctcctgcctgcccct

SEQ ID NO: 4952522 - DNA, 19 bp, Homo sapiens
cctgcctcgaactggctgc

SEQ ID NO: 4952523 - DNA, 21 bp, Homo sapiens
cctgcctcgaactggctgcaa

SEQ ID NO: 4952524 - DNA, 18 bp, Homo sapiens
cctgcctgcgtcttccgc

SEQ ID NO: 4952525 - DNA, 19 bp, Homo sapiens
ccaatgcacatccattccc

SEQ ID NO: 4952526 - DNA, 12 bp, Homo sapiens
ccaatggaaacc

SEQ ID NO: 4952527 - DNA, 14 bp, Homo sapiens
ccaatggaaacctc

SEQ ID NO: 4952528 - DNA, 15 bp, Homo sapiens
ccaatggaaacctca

SEQ ID NO: 4952529 - DNA, 20 bp, Homo sapiens
ccaatgtaggagctgccttg

SEQ ID NO: 4952530 - DNA, 19 bp, Homo sapiens
ccaatgttagagacttttt

SEQ ID NO: 4952531 - DNA, 18 bp, Homo sapiens
ccaatgttttccacccat

SEQ ID NO: 4952532 - DNA, 15 bp, Homo sapiens
ccaattattgatata

SEQ ID NO: 4952533 - DNA, 14 bp, Homo sapiens
ccaattgtgctgcc

SEQ ID NO: 4952534 - DNA, 20 bp, Homo sapiens
ccaattgttgacagttctga

SEQ ID NO: 4952535 - DNA, 21 bp, Homo sapiens
ccaattgttgacagttctgaa

SEQ ID NO: 4952536 - DNA, 22 bp, Homo sapiens
ccaatttcccacccccacccac

SEQ ID NO: 4952537 - DNA, 13 bp, Homo sapiens
ccacaaaaattga

SEQ ID NO: 4952538 - DNA, 9 bp, Homo sapiens
ccacaaagg

SEQ ID NO: 4952539 - DNA, 16 bp, Homo sapiens
ccacaactgacacagg

SEQ ID NO: 4952540 - DNA, 17 bp, Homo sapiens
ccacaactgacacagga

SEQ ID NO: 4952541 - DNA, 19 bp, Homo sapiens
ccacaactgacacaggaaa

SEQ ID NO: 4952542 - DNA, 15 bp, Homo sapiens
ccacaagaaatttga

SEQ ID NO: 4952543 - DNA, 14 bp, Homo sapiens
ccacacaggctggc

SEQ ID NO: 4952544 - DNA, 13 bp, Homo sapiens
ccacacccagcct

SEQ ID NO: 4952545 - DNA, 15 bp, Homo sapiens
ccacacccagcctca

SEQ ID NO: 4952546 - DNA, 16 bp, Homo sapiens
ccacacctctgccaga

SEQ ID NO: 4952547 - DNA, 11 bp, Homo sapiens
ccacagacaca

SEQ ID NO: 4952548 - DNA, 12 bp, Homo sapiens
ccacagacacac

SEQ ID NO: 4952549 - DNA, 13 bp, Homo sapiens
ccacagacacaca

SEQ ID NO: 4952550 - DNA, 14 bp, Homo sapiens
ccacagacacacac

SEQ ID NO: 4952551 - DNA, 20 bp, Homo sapiens
ccacagacacacacacgcac

SEQ ID NO: 4952552 - DNA, 16 bp, Homo sapiens
ccacagactggttttg

SEQ ID NO: 4952553 - DNA, 14 bp, Homo sapiens
ccacagcaggtcct

SEQ ID NO: 4952554 - DNA, 18 bp, Homo sapiens
ccacagcgagggcagctg

SEQ ID NO: 4952555 - DNA, 23 bp, Homo sapiens
ccacaggaagcctgcagtcctgg

SEQ ID NO: 4952556 - DNA, 21 bp, Homo sapiens
ccacaggaggcaagcaagctc

SEQ ID NO: 4952557 - DNA, 18 bp, Homo sapiens
ccacaggcccttcctctc

SEQ ID NO: 4952558 - DNA, 22 bp, Homo sapiens
ccacaggcccttcctctccact

SEQ ID NO: 4952559 - DNA, 14 bp, Homo sapiens
ccacaggtctagac

SEQ ID NO: 4952560 - DNA, 15 bp, Homo sapiens
ccacaggtctagact

SEQ ID NO: 4952561 - DNA, 21 bp, Homo sapiens
ccacatagtgatggttcccct

SEQ ID NO: 4952562 - DNA, 23 bp, Homo sapiens
ccacatagtgatggttcccctgt

SEQ ID NO: 4952563 - DNA, 16 bp, Homo sapiens
ccacatctctgaaagc

SEQ ID NO: 4952564 - DNA, 22 bp, Homo sapiens
ccacatcttgctctgctgacag

SEQ ID NO: 4952565 - DNA, 23 bp, Homo sapiens
ccacatcttgctctgctgacaga

SEQ ID NO: 4952566 - DNA, 18 bp, Homo sapiens
ccacatgggagcagtcca

SEQ ID NO: 4952567 - DNA, 24 bp, Homo sapiens
ccacatgggagcagtccatgcatg

SEQ ID NO: 4952568 - DNA, 17 bp, Homo sapiens
ccaccacacccagccca

SEQ ID NO: 4952569 - DNA, 12 bp, Homo sapiens
ccaccacctccc

SEQ ID NO: 4952570 - DNA, 17 bp, Homo sapiens
ccaccacctccctcacc

SEQ ID NO: 4952571 - DNA, 18 bp, Homo sapiens
ccaccagatagcagaggg

SEQ ID NO: 4952572 - DNA, 18 bp, Homo sapiens
ccaccagcatcacctgcc

SEQ ID NO: 4952573 - DNA, 14 bp, Homo sapiens
ccaccaggagaacc

SEQ ID NO: 4952574 - DNA, 17 bp, Homo sapiens
ccaccatggccagccaa

SEQ ID NO: 4952575 - DNA, 12 bp, Homo sapiens
ccacccaggagc

SEQ ID NO: 4952576 - DNA, 23 bp, Homo sapiens
ccacccaggagggagggggctat

SEQ ID NO: 4952577 - DNA, 23 bp, Homo sapiens
ccacccataatcctttctgccga

SEQ ID NO: 4952578 - DNA, 19 bp, Homo sapiens
ccaccccagaaatggtgaa

SEQ ID NO: 4952579 - DNA, 18 bp, Homo sapiens
ccaccccatccagttcat

SEQ ID NO: 4952580 - DNA, 18 bp, Homo sapiens
ccacccccttctctgctc

SEQ ID NO: 4952581 - DNA, 19 bp, Homo sapiens
ccaccccggccccctgccc

SEQ ID NO: 4952582 - DNA, 15 bp, Homo sapiens
ccaccctgctgcctt

SEQ ID NO: 4952583 - DNA, 21 bp, Homo sapiens
ccaccctgtacctcatcccat

SEQ ID NO: 4952584 - DNA, 13 bp, Homo sapiens
ccacccttggcct

SEQ ID NO: 4952585 - DNA, 16 bp, Homo sapiens
ccacccttggcctgtc

SEQ ID NO: 4952586 - DNA, 17 bp, Homo sapiens
ccacccttggcctgtct

SEQ ID NO: 4952587 - DNA, 19 bp, Homo sapiens
ccacccttggcctgtctca

SEQ ID NO: 4952588 - DNA, 22 bp, Homo sapiens
ccaccgaagtggactggcccct

SEQ ID NO: 4952589 - DNA, 19 bp, Homo sapiens
ccaccgctgctccacgcgc

SEQ ID NO: 4952590 - DNA, 16 bp, Homo sapiens
ccacctagaacactaa

SEQ ID NO: 4952591 - DNA, 19 bp, Homo sapiens
ccacctagaacactaactc

SEQ ID NO: 4952592 - DNA, 15 bp, Homo sapiens
ccacctcagcctccc

SEQ ID NO: 4952593 - DNA, 13 bp, Homo sapiens
ccacctccagccc

SEQ ID NO: 4952594 - DNA, 18 bp, Homo sapiens
ccacctccagcccgggag

SEQ ID NO: 4952595 - DNA, 19 bp, Homo sapiens
ccacctccagcccgggagc

SEQ ID NO: 4952596 - DNA, 20 bp, Homo sapiens
ccacctccagcccgggagcc

SEQ ID NO: 4952597 - DNA, 12 bp, Homo sapiens
ccacctccccac

SEQ ID NO: 4952598 - DNA, 13 bp, Homo sapiens
ccacctccccacg

SEQ ID NO: 4952599 - DNA, 13 bp, Homo sapiens
ccacctccctgcc

SEQ ID NO: 4952600 - DNA, 17 bp, Homo sapiens
ccacctccctgcccagg

SEQ ID NO: 4952601 - DNA, 18 bp, Homo sapiens
ccacctccctgcccaggc

SEQ ID NO: 4952602 - DNA, 10 bp, Homo sapiens
ccacctctgc

SEQ ID NO: 4952603 - DNA, 13 bp, Homo sapiens
ccacctctgcgga

SEQ ID NO: 4952604 - DNA, 19 bp, Homo sapiens
ccacctctgcggaccccag

SEQ ID NO: 4952605 - DNA, 22 bp, Homo sapiens
ccacctctgcggaccccagctg

SEQ ID NO: 4952606 - DNA, 17 bp, Homo sapiens
ccacctctgtgacctca

SEQ ID NO: 4952607 - DNA, 19 bp, Homo sapiens
ccacctctgtgacctcagg

SEQ ID NO: 4952608 - DNA, 19 bp, Homo sapiens
ccacctgcagggctgccct

SEQ ID NO: 4952609 - DNA, 16 bp, Homo sapiens
ccacctgcccatcaca

SEQ ID NO: 4952610 - DNA, 23 bp, Homo sapiens
ccacctgcctgcgtcttccgccc

SEQ ID NO: 4952611 - DNA, 23 bp, Homo sapiens
ccacctggtactccctctcagga

SEQ ID NO: 4952612 - DNA, 15 bp, Homo sapiens
ccacctgtctcagcc

SEQ ID NO: 4952613 - DNA, 16 bp, Homo sapiens
ccaccttggctcaagt

SEQ ID NO: 4952614 - DNA, 16 bp, Homo sapiens
ccaccttggctgcagg

SEQ ID NO: 4952615 - DNA, 19 bp, Homo sapiens
ccacgaatttgctggggaa

SEQ ID NO: 4952616 - DNA, 16 bp, Homo sapiens
ccacgatcctgccacc

SEQ ID NO: 4952617 - DNA, 19 bp, Homo sapiens
ccacgatcctgccaccctg

SEQ ID NO: 4952618 - DNA, 17 bp, Homo sapiens
ccacgattttctccagc

SEQ ID NO: 4952619 - DNA, 14 bp, Homo sapiens
ccacgccctcccct

SEQ ID NO: 4952620 - DNA, 16 bp, Homo sapiens
ccacggccaggccaga

SEQ ID NO: 4952621 - DNA, 18 bp, Homo sapiens
ccacggccaggccagagg

SEQ ID NO: 4952622 - DNA, 20 bp, Homo sapiens
ccacggcgttgtacctgtag

SEQ ID NO: 4952623 - DNA, 12 bp, Homo sapiens
ccacgtgtcttc

SEQ ID NO: 4952624 - DNA, 16 bp, Homo sapiens
ccacgtgtcttccact

SEQ ID NO: 4952625 - DNA, 22 bp, Homo sapiens
ccactacggaatagttggctag

SEQ ID NO: 4952626 - DNA, 21 bp, Homo sapiens
ccactagaactctccatctta

SEQ ID NO: 4952627 - DNA, 16 bp, Homo sapiens
ccactagactcttcac

SEQ ID NO: 4952628 - DNA, 22 bp, Homo sapiens
ccactagtaagtaattatgcac

SEQ ID NO: 4952629 - DNA, 23 bp, Homo sapiens
ccactagtaagtaattatgcact

SEQ ID NO: 4952630 - DNA, 12 bp, Homo sapiens
ccactcaccccg

SEQ ID NO: 4952631 - DNA, 16 bp, Homo sapiens
ccactcagcccctagg

SEQ ID NO: 4952632 - DNA, 18 bp, Homo sapiens
ccactcagcccctaggag

SEQ ID NO: 4952633 - DNA, 13 bp, Homo sapiens
ccactcaggaggc

SEQ ID NO: 4952634 - DNA, 22 bp, Homo sapiens
ccactccagacccctggctttt

SEQ ID NO: 4952635 - DNA, 14 bp, Homo sapiens
ccactcccagtccc

SEQ ID NO: 4952636 - DNA, 16 bp, Homo sapiens
ccactcgcttccccca

SEQ ID NO: 4952637 - DNA, 20 bp, Homo sapiens
ccactctaccctcccacccc

SEQ ID NO: 4952638 - DNA, 23 bp, Homo sapiens
ccactctcttccctttccccagc

SEQ ID NO: 4952639 - DNA, 19 bp, Homo sapiens
ccactgacagcctcccacc

SEQ ID NO: 4952640 - DNA, 13 bp, Homo sapiens
ccactgcaccggg

SEQ ID NO: 4952641 - DNA, 19 bp, Homo sapiens
ccactgcaccgggccacag

SEQ ID NO: 4952642 - DNA, 19 bp, Homo sapiens
ccactgcactatagcctag

SEQ ID NO: 4952643 - DNA, 17 bp, Homo sapiens
ccactgcctctgcctta

SEQ ID NO: 4952644 - DNA, 16 bp, Homo sapiens
ccactgcctcttcctc

SEQ ID NO: 4952645 - DNA, 20 bp, Homo sapiens
ccactgctccctaagccagc

SEQ ID NO: 4952646 - DNA, 11 bp, Homo sapiens
ccactgctctg

SEQ ID NO: 4952647 - DNA, 16 bp, Homo sapiens
ccactggttccttctt

SEQ ID NO: 4952648 - DNA, 20 bp, Homo sapiens
ccactgtgcaggtgctattg

SEQ ID NO: 4952649 - DNA, 16 bp, Homo sapiens
ccactgtgccatgtgc

SEQ ID NO: 4952650 - DNA, 12 bp, Homo sapiens
ccactgtgtata

SEQ ID NO: 4952651 - DNA, 17 bp, Homo sapiens
ccactgtttctcttgag

SEQ ID NO: 4952652 - DNA, 21 bp, Homo sapiens
ccactgtttctcttgagctgg

SEQ ID NO: 4952653 - DNA, 22 bp, Homo sapiens
ccactgtttctcttgagctggc

SEQ ID NO: 4952654 - DNA, 17 bp, Homo sapiens
ccactgtttcttgcttg

SEQ ID NO: 4952655 - DNA, 19 bp, Homo sapiens
ccacttagaaattgcattt

SEQ ID NO: 4952656 - DNA, 18 bp, Homo sapiens
ccacttcggccaggtcac

SEQ ID NO: 4952657 - DNA, 13 bp, Homo sapiens
ccacttcttcctt

SEQ ID NO: 4952658 - DNA, 20 bp, Homo sapiens
ccacttcttgttccccactg

SEQ ID NO: 4952659 - DNA, 18 bp, Homo sapiens
ccacttgtcactgacaca

SEQ ID NO: 4952660 - DNA, 14 bp, Homo sapiens
ccactttgcacatt

SEQ ID NO: 4952661 - DNA, 15 bp, Homo sapiens
ccactttgcacattt

SEQ ID NO: 4952662 - DNA, 19 bp, Homo sapiens
ccactttgcacattttgat

SEQ ID NO: 4952663 - DNA, 23 bp, Homo sapiens
ccactttgcacgacgccctctcc

SEQ ID NO: 4952664 - DNA, 16 bp, Homo sapiens
ccagaaaggagactag

SEQ ID NO: 4952665 - DNA, 22 bp, Homo sapiens
cattgctgttatgtctgtttaa

SEQ ID NO: 4952666 - DNA, 18 bp, Homo sapiens
cattgctttgaagcagtt

SEQ ID NO: 4952667 - DNA, 23 bp, Homo sapiens
cattgctttgaagcagttgtgtc

SEQ ID NO: 4952668 - DNA, 15 bp, Homo sapiens
cattgcttttatttt

SEQ ID NO: 4952669 - DNA, 17 bp, Homo sapiens
cattgcttttattttga

SEQ ID NO: 4952670 - DNA, 16 bp, Homo sapiens
cattggattatcctga

SEQ ID NO: 4952671 - DNA, 15 bp, Homo sapiens
cattgtaaacaaact

SEQ ID NO: 4952672 - DNA, 16 bp, Homo sapiens
cattgtagagcttctg

SEQ ID NO: 4952673 - DNA, 21 bp, Homo sapiens
cattgtagagcttctggcact

SEQ ID NO: 4952674 - DNA, 15 bp, Homo sapiens
cattgtatgatgtgt

SEQ ID NO: 4952675 - DNA, 16 bp, Homo sapiens
cattgtatgatgtgtt

SEQ ID NO: 4952676 - DNA, 17 bp, Homo sapiens
cattgtatgatgtgttg

SEQ ID NO: 4952677 - DNA, 15 bp, Homo sapiens
cattgtatgtatcta

SEQ ID NO: 4952678 - DNA, 16 bp, Homo sapiens
cattgtatgtatctat

SEQ ID NO: 4952679 - DNA, 14 bp, Homo sapiens
cattgttagcacta

SEQ ID NO: 4952680 - DNA, 20 bp, Homo sapiens
cattgttgagctattgctgt

SEQ ID NO: 4952681 - DNA, 19 bp, Homo sapiens
cattgttgtttttttaata

SEQ ID NO: 4952682 - DNA, 16 bp, Homo sapiens
cattgtttgctgctat

SEQ ID NO: 4952683 - DNA, 12 bp, Homo sapiens
cattgttttgaa

SEQ ID NO: 4952684 - DNA, 13 bp, Homo sapiens
cattgttttgaat

SEQ ID NO: 4952685 - DNA, 15 bp, Homo sapiens
catttaaaattgcta

SEQ ID NO: 4952686 - DNA, 16 bp, Homo sapiens
catttaaaattgctat

SEQ ID NO: 4952687 - DNA, 22 bp, Homo sapiens
catttaaaattgctatgttact

SEQ ID NO: 4952688 - DNA, 19 bp, Homo sapiens
catttactaaacatatgat

SEQ ID NO: 4952689 - DNA, 20 bp, Homo sapiens
catttactaaacatatgatt

SEQ ID NO: 4952690 - DNA, 21 bp, Homo sapiens
catttactttgtgttcacctt

SEQ ID NO: 4952691 - DNA, 23 bp, Homo sapiens
catttagagaactgtggccgtta

SEQ ID NO: 4952692 - DNA, 19 bp, Homo sapiens
catttagtgagttattcct

SEQ ID NO: 4952693 - DNA, 15 bp, Homo sapiens
catttataattgcat

SEQ ID NO: 4952694 - DNA, 16 bp, Homo sapiens
catttatatatgaaaa

SEQ ID NO: 4952695 - DNA, 20 bp, Homo sapiens
catttatatatgaaaactat

SEQ ID NO: 4952696 - DNA, 15 bp, Homo sapiens
catttatatttttat

SEQ ID NO: 4952697 - DNA, 22 bp, Homo sapiens
catttatccacaggaaagtgtt

SEQ ID NO: 4952698 - DNA, 23 bp, Homo sapiens
catttatctacccaagggcagaa

SEQ ID NO: 4952699 - DNA, 19 bp, Homo sapiens
catttatgagtaactatta

SEQ ID NO: 4952700 - DNA, 15 bp, Homo sapiens
catttatgatttaat

SEQ ID NO: 4952701 - DNA, 17 bp, Homo sapiens
catttatgatttaataa

SEQ ID NO: 4952702 - DNA, 20 bp, Homo sapiens
catttatgatttaataaaat

SEQ ID NO: 4952703 - DNA, 21 bp, Homo sapiens
catttatgatttaataaaata

SEQ ID NO: 4952704 - DNA, 23 bp, Homo sapiens
catttatgatttaataaaataat

SEQ ID NO: 4952705 - DNA, 14 bp, Homo sapiens
catttatgcacatt

SEQ ID NO: 4952706 - DNA, 16 bp, Homo sapiens
catttcacaggctaat

SEQ ID NO: 4952707 - DNA, 16 bp, Homo sapiens
catttcatcattgttt

SEQ ID NO: 4952708 - DNA, 14 bp, Homo sapiens
catttcatgctctg

SEQ ID NO: 4952709 - DNA, 18 bp, Homo sapiens
catttcattgtatgatgt

SEQ ID NO: 4952710 - DNA, 12 bp, Homo sapiens
catttctccgtt

SEQ ID NO: 4952711 - DNA, 22 bp, Homo sapiens
catttctgagtttcattctcct

SEQ ID NO: 4952712 - DNA, 17 bp, Homo sapiens
catttctgtaaatacca

SEQ ID NO: 4952713 - DNA, 15 bp, Homo sapiens
catttcttttctttt

SEQ ID NO: 4952714 - DNA, 18 bp, Homo sapiens
catttgaagtgtacctgt

SEQ ID NO: 4952715 - DNA, 16 bp, Homo sapiens
catttgatacccctgg

SEQ ID NO: 4952716 - DNA, 20 bp, Homo sapiens
catttgcactggagttctat

SEQ ID NO: 4952717 - DNA, 16 bp, Homo sapiens
catttgccttgcagaa

SEQ ID NO: 4952718 - DNA, 20 bp, Homo sapiens
catttggttcattaattcta

SEQ ID NO: 4952719 - DNA, 13 bp, Homo sapiens
catttgtaaaact

SEQ ID NO: 4952720 - DNA, 19 bp, Homo sapiens
catttgtaattaaattatg

SEQ ID NO: 4952721 - DNA, 22 bp, Homo sapiens
catttgtacagaattttggaag

SEQ ID NO: 4952722 - DNA, 17 bp, Homo sapiens
catttgtattttgtgtg

SEQ ID NO: 4952723 - DNA, 17 bp, Homo sapiens
catttgtcacacacttt

SEQ ID NO: 4952724 - DNA, 15 bp, Homo sapiens
catttgtgccagagg

SEQ ID NO: 4952725 - DNA, 14 bp, Homo sapiens
catttgtgtcaatg

SEQ ID NO: 4952726 - DNA, 22 bp, Homo sapiens
catttgttaaaattatcaatat

SEQ ID NO: 4952727 - DNA, 22 bp, Homo sapiens
catttgttcactgaaggtgatt

SEQ ID NO: 4952728 - DNA, 18 bp, Homo sapiens
catttgttgtgatgtctt

SEQ ID NO: 4952729 - DNA, 21 bp, Homo sapiens
cattttaaaaacatagaaaaa

SEQ ID NO: 4952730 - DNA, 13 bp, Homo sapiens
cattttaaataaa

SEQ ID NO: 4952731 - DNA, 13 bp, Homo sapiens
cattttaatgtaa

SEQ ID NO: 4952732 - DNA, 14 bp, Homo sapiens
cattttccccccac

SEQ ID NO: 4952733 - DNA, 15 bp, Homo sapiens
cattttccccccact

SEQ ID NO: 4952734 - DNA, 22 bp, Homo sapiens
cattttccccccactctcccca

SEQ ID NO: 4952735 - DNA, 17 bp, Homo sapiens
cattttcctacaggcag

SEQ ID NO: 4952736 - DNA, 15 bp, Homo sapiens
cattttgtgaatgga

SEQ ID NO: 4952737 - DNA, 16 bp, Homo sapiens
cattttgtgaatggat

SEQ ID NO: 4952738 - DNA, 21 bp, Homo sapiens
cattttgttcttacacataca

SEQ ID NO: 4952739 - DNA, 12 bp, Homo sapiens
cattttgttgta

SEQ ID NO: 4952740 - DNA, 14 bp, Homo sapiens
cattttgttgtaaa

SEQ ID NO: 4952741 - DNA, 16 bp, Homo sapiens
cattttgttgtaaaaa

SEQ ID NO: 4952742 - DNA, 23 bp, Homo sapiens
catttttaaagtagaagagggtt

SEQ ID NO: 4952743 - DNA, 18 bp, Homo sapiens
catttttagtagagacag

SEQ ID NO: 4952744 - DNA, 21 bp, Homo sapiens
cattttttatgggcattgaca

SEQ ID NO: 4952745 - DNA, 22 bp, Homo sapiens
cattttttgggcagcaatttaa

SEQ ID NO: 4952746 - DNA, 13 bp, Homo sapiens
ccaaaaggaaaaa

SEQ ID NO: 4952747 - DNA, 18 bp, Homo sapiens
ccaaaaggaaaaagctcc

SEQ ID NO: 4952748 - DNA, 22 bp, Homo sapiens
ccaaacaccttccagctcctgt

SEQ ID NO: 4952749 - DNA, 15 bp, Homo sapiens
ccaaacatgtattta

SEQ ID NO: 4952750 - DNA, 17 bp, Homo sapiens
ccaaacatgtatttatg

SEQ ID NO: 4952751 - DNA, 23 bp, Homo sapiens
ccaaaccctaggttcccggtccc

SEQ ID NO: 4952752 - DNA, 14 bp, Homo sapiens
ccaaagaaatgaac

SEQ ID NO: 4952753 - DNA, 18 bp, Homo sapiens
ccaaagatgcagccgcct

SEQ ID NO: 4952754 - DNA, 19 bp, Homo sapiens
ccaaagatgcagccgcctt

SEQ ID NO: 4952755 - DNA, 20 bp, Homo sapiens
ccaaagccacctctgtcatt

SEQ ID NO: 4952756 - DNA, 18 bp, Homo sapiens
ccaaagctagggtggccc

SEQ ID NO: 4952757 - DNA, 18 bp, Homo sapiens
ccaaagctgcccactgtt

SEQ ID NO: 4952758 - DNA, 16 bp, Homo sapiens
ccaaaggaggctggca

SEQ ID NO: 4952759 - DNA, 14 bp, Homo sapiens
ccaaaggcccccta

SEQ ID NO: 4952760 - DNA, 15 bp, Homo sapiens
ccaaaggctggtggc

SEQ ID NO: 4952761 - DNA, 21 bp, Homo sapiens
ccaaaggctggtggcaagtgc

SEQ ID NO: 4952762 - DNA, 14 bp, Homo sapiens
ccaaagtctccctt

SEQ ID NO: 4952763 - DNA, 14 bp, Homo sapiens
ccaaagtctctaat

SEQ ID NO: 4952764 - DNA, 23 bp, Homo sapiens
ccaaagtgccactcattcctgta

SEQ ID NO: 4952765 - DNA, 11 bp, Homo sapiens
ccaaagttcta

SEQ ID NO: 4952766 - DNA, 16 bp, Homo sapiens
ccaaataacttcagtc

SEQ ID NO: 4952767 - DNA, 18 bp, Homo sapiens
ccaaatccgctctcttcc

SEQ ID NO: 4952768 - DNA, 19 bp, Homo sapiens
ccaaatccgctctcttcct

SEQ ID NO: 4952769 - DNA, 18 bp, Homo sapiens
ccaaatctcttccacaag

SEQ ID NO: 4952770 - DNA, 15 bp, Homo sapiens
ccaaatgcaatttga

SEQ ID NO: 4952771 - DNA, 14 bp, Homo sapiens
ccaaattgtgcttc

SEQ ID NO: 4952772 - DNA, 16 bp, Homo sapiens
ccaaattgtgcttctc

SEQ ID NO: 4952773 - DNA, 17 bp, Homo sapiens
ccaaattgtgcttctcc

SEQ ID NO: 4952774 - DNA, 23 bp, Homo sapiens
ccaaattgtgcttctccccagaa

SEQ ID NO: 4952775 - DNA, 17 bp, Homo sapiens
tttggcctgcactaatt

SEQ ID NO: 4952776 - DNA, 16 bp, Homo sapiens
tttgggagggaaaagg

SEQ ID NO: 4952777 - DNA, 18 bp, Homo sapiens
tttgggatttaatttcca

SEQ ID NO: 4952778 - DNA, 17 bp, Homo sapiens
tttggggaaacctagag

SEQ ID NO: 4952779 - DNA, 18 bp, Homo sapiens
tttggggtgcccctctcc

SEQ ID NO: 4952780 - DNA, 23 bp, Homo sapiens
tttggtacttttgagtgtgtgtg

SEQ ID NO: 4952781 - DNA, 12 bp, Homo sapiens
tttggtatttgc

SEQ ID NO: 4952782 - DNA, 15 bp, Homo sapiens
tttggtctccctggg

SEQ ID NO: 4952783 - DNA, 19 bp, Homo sapiens
tttggtctggactgacagc

SEQ ID NO: 4952784 - DNA, 22 bp, Homo sapiens
tttggtctggactgacagcatg

SEQ ID NO: 4952785 - DNA, 13 bp, Homo sapiens
tttggttcctctc

SEQ ID NO: 4952786 - DNA, 14 bp, Homo sapiens
tttggtttacattt

SEQ ID NO: 4952787 - DNA, 17 bp, Homo sapiens
tttgtaaactcaaaata

SEQ ID NO: 4952788 - DNA, 13 bp, Homo sapiens
tttactatatata

SEQ ID NO: 4952789 - DNA, 15 bp, Homo sapiens
tttactcattgaaat

SEQ ID NO: 4952790 - DNA, 21 bp, Homo sapiens
tttactctatgccccaaatat

SEQ ID NO: 4952791 - DNA, 22 bp, Homo sapiens
tttactctatgccccaaatata

SEQ ID NO: 4952792 - DNA, 20 bp, Homo sapiens
tttactgttttgaaatcaat

SEQ ID NO: 4952793 - DNA, 23 bp, Homo sapiens
tttacttcaatgggctcttccaa

SEQ ID NO: 4952794 - DNA, 16 bp, Homo sapiens
tttactttaaacttgt

SEQ ID NO: 4952795 - DNA, 15 bp, Homo sapiens
tttactttgtgttca

SEQ ID NO: 4952796 - DNA, 23 bp, Homo sapiens
tttagaaaaaagtttacaacata

SEQ ID NO: 4952797 - DNA, 19 bp, Homo sapiens
tttagaagtgcatttctga

SEQ ID NO: 4952798 - DNA, 13 bp, Homo sapiens
tttagaccaagga

SEQ ID NO: 4952799 - DNA, 14 bp, Homo sapiens
tttagaccaaggaa

SEQ ID NO: 4952800 - DNA, 15 bp, Homo sapiens
tttagaccaaggaac

SEQ ID NO: 4952801 - DNA, 16 bp, Homo sapiens
tttaggaacttcagag

SEQ ID NO: 4952802 - DNA, 17 bp, Homo sapiens
tttaggaacttcagaga

SEQ ID NO: 4952803 - DNA, 22 bp, Homo sapiens
tttaggaagttgacttatagta

SEQ ID NO: 4952804 - DNA, 18 bp, Homo sapiens
tttaggaatcctttggtg

SEQ ID NO: 4952805 - DNA, 20 bp, Homo sapiens
tttaggcactcttaaatgat

SEQ ID NO: 4952806 - DNA, 14 bp, Homo sapiens
tttagggccaggca

SEQ ID NO: 4952807 - DNA, 16 bp, Homo sapiens
tttagggccaggcagg

SEQ ID NO: 4952808 - DNA, 11 bp, Homo sapiens
tttaggttcta

SEQ ID NO: 4952809 - DNA, 16 bp, Homo sapiens
tttcagatatatatca

SEQ ID NO: 4952810 - DNA, 18 bp, Homo sapiens
tttcagattttgataact

SEQ ID NO: 4952811 - DNA, 20 bp, Homo sapiens
tttcagctaagggaagacat

SEQ ID NO: 4952812 - DNA, 11 bp, Homo sapiens
tttcagctctc

SEQ ID NO: 4952813 - DNA, 16 bp, Homo sapiens
tttcagctctctgtat

SEQ ID NO: 4952814 - DNA, 21 bp, Homo sapiens
tttcagctctctgtataaaca

SEQ ID NO: 4952815 - DNA, 16 bp, Homo sapiens
tttcaggtgacatgtg

SEQ ID NO: 4952816 - DNA, 17 bp, Homo sapiens
tttcagtcctgtagttt

SEQ ID NO: 4952817 - DNA, 12 bp, Homo sapiens
tttcatattgtg

SEQ ID NO: 4952818 - DNA, 21 bp, Homo sapiens
tttcatggtgaaaatgtactg

SEQ ID NO: 4952819 - DNA, 22 bp, Homo sapiens
tttcatggtgaaaatgtactga

SEQ ID NO: 4952820 - DNA, 17 bp, Homo sapiens
tttcatgttttgtgact

SEQ ID NO: 4952821 - DNA, 11 bp, Homo sapiens
tttcattccat

SEQ ID NO: 4952822 - DNA, 12 bp, Homo sapiens
tttcattccatt

SEQ ID NO: 4952823 - DNA, 16 bp, Homo sapiens
tttcattccattgcct

SEQ ID NO: 4952824 - DNA, 23 bp, Homo sapiens
tttcattgcctgtgtatggaaaa

SEQ ID NO: 4952825 - DNA, 20 bp, Homo sapiens
tttcattgtatgatgtgttg

SEQ ID NO: 4952826 - DNA, 16 bp, Homo sapiens
tttccaaacaacagaa

SEQ ID NO: 4952827 - DNA, 15 bp, Homo sapiens
tttccaacaccacag

SEQ ID NO: 4952828 - DNA, 22 bp, Homo sapiens
tttccaacaccacagacacaca

SEQ ID NO: 4952829 - DNA, 19 bp, Homo sapiens
tttccacaaaatctgtcca

SEQ ID NO: 4952830 - DNA, 18 bp, Homo sapiens
tttccagacttccttgag

SEQ ID NO: 4952831 - DNA, 14 bp, Homo sapiens
tttccagtctcttg

SEQ ID NO: 4952832 - DNA, 19 bp, Homo sapiens
tttccatagcaacaggaaa

SEQ ID NO: 4952833 - DNA, 21 bp, Homo sapiens
tttcccatttgtgccagagga

SEQ ID NO: 4952834 - DNA, 22 bp, Homo sapiens
tttcccatttgtgccagaggaa

SEQ ID NO: 4952835 - DNA, 15 bp, Homo sapiens
tttccccataactca

SEQ ID NO: 4952836 - DNA, 12 bp, Homo sapiens
tttccccccact

SEQ ID NO: 4952837 - DNA, 13 bp, Homo sapiens
tttccccccactc

SEQ ID NO: 4952838 - DNA, 19 bp, Homo sapiens
tttcccccctttttttcct

SEQ ID NO: 4952839 - DNA, 18 bp, Homo sapiens
tttcccctatcatttatt

SEQ ID NO: 4952840 - DNA, 13 bp, Homo sapiens
tttccctaaaata

SEQ ID NO: 4952841 - DNA, 20 bp, Homo sapiens
tttcccttcagtaccctctc

SEQ ID NO: 4952842 - DNA, 19 bp, Homo sapiens
tttcccttcctcttcggcc

SEQ ID NO: 4952843 - DNA, 20 bp, Homo sapiens
tttcccttgcttttccctct

SEQ ID NO: 4952844 - DNA, 22 bp, Homo sapiens
tttccgtaataacacccttcct

SEQ ID NO: 4952845 - DNA, 22 bp, Homo sapiens
tttcctaatcagaaatttttat

SEQ ID NO: 4952846 - DNA, 17 bp, Homo sapiens
tttcctagccctctcac

SEQ ID NO: 4952847 - DNA, 13 bp, Homo sapiens
tttcctccctcag

SEQ ID NO: 4952848 - DNA, 16 bp, Homo sapiens
tttcctcctttatcac

SEQ ID NO: 4952849 - DNA, 17 bp, Homo sapiens
tttcctcctttatcaca

SEQ ID NO: 4952850 - DNA, 21 bp, Homo sapiens
tttcctcttctattttgtaaa

SEQ ID NO: 4952851 - DNA, 19 bp, Homo sapiens
tttccttcaagccagcaac

SEQ ID NO: 4952852 - DNA, 14 bp, Homo sapiens
tttccttccatccc

SEQ ID NO: 4952853 - DNA, 19 bp, Homo sapiens
tttccttccatccctaccc

SEQ ID NO: 4952854 - DNA, 13 bp, Homo sapiens
tttccttgtgcaa

SEQ ID NO: 4952855 - DNA, 21 bp, Homo sapiens
tttccttgtggcagaggatgt

SEQ ID NO: 4952856 - DNA, 16 bp, Homo sapiens
tttccttgtttatcag

SEQ ID NO: 4952857 - DNA, 19 bp, Homo sapiens
tttccttgtttatcagata

SEQ ID NO: 4952858 - DNA, 17 bp, Homo sapiens
tttcctttccccagccc

SEQ ID NO: 4952859 - DNA, 9 bp, Homo sapiens
tttcctttg

SEQ ID NO: 4952860 - DNA, 21 bp, Homo sapiens
tttccttttaaaacacttcca

SEQ ID NO: 4952861 - DNA, 16 bp, Homo sapiens
tttcctttttctgatt

SEQ ID NO: 4952862 - DNA, 16 bp, Homo sapiens
tttccttttttgttat

SEQ ID NO: 4952863 - DNA, 17 bp, Homo sapiens
tttccttttttgttatt

SEQ ID NO: 4952864 - DNA, 20 bp, Homo sapiens
tttcgataaacaacaaggtg

SEQ ID NO: 4952865 - DNA, 19 bp, Homo sapiens
tttcgccgttgaagaggaa

SEQ ID NO: 4952866 - DNA, 14 bp, Homo sapiens
tttcgtttctgtat

SEQ ID NO: 4952867 - DNA, 15 bp, Homo sapiens
tttctaaaagaatat

SEQ ID NO: 4952868 - DNA, 20 bp, Homo sapiens
tttctaaaagaatattcaga

SEQ ID NO: 4952869 - DNA, 12 bp, Homo sapiens
tttctaaaatct

SEQ ID NO: 4952870 - DNA, 15 bp, Homo sapiens
tttctaaccttgaat

SEQ ID NO: 4952871 - DNA, 19 bp, Homo sapiens
tttctaaccttgaatgctg

SEQ ID NO: 4952872 - DNA, 22 bp, Homo sapiens
tttctaaccttgaatgctgcca

SEQ ID NO: 4952873 - DNA, 14 bp, Homo sapiens
tttctaagattcta

SEQ ID NO: 4952874 - DNA, 17 bp, Homo sapiens
tttctaagattctaaag

SEQ ID NO: 4952875 - DNA, 20 bp, Homo sapiens
tttctaatggaatggtttgg

SEQ ID NO: 4952876 - DNA, 20 bp, Homo sapiens
tttctacaaataattttagt

SEQ ID NO: 4952877 - DNA, 17 bp, Homo sapiens
tttctacattattgctt

SEQ ID NO: 4952878 - DNA, 22 bp, Homo sapiens
tttctacccagcgagccctggt

SEQ ID NO: 4952879 - DNA, 19 bp, Homo sapiens
tttctagaagtttcccttc

SEQ ID NO: 4952880 - DNA, 15 bp, Homo sapiens
tttctagactttctg

SEQ ID NO: 4952881 - DNA, 19 bp, Homo sapiens
tttctagtttgctcatact

SEQ ID NO: 4952882 - DNA, 19 bp, Homo sapiens
tttctattccttctggcct

SEQ ID NO: 4952883 - DNA, 13 bp, Homo sapiens
tttctcaaagttt

SEQ ID NO: 4952884 - DNA, 23 bp, Homo sapiens
tttctcagccgcttctgactgct

SEQ ID NO: 4952885 - DNA, 11 bp, Homo sapiens
tttctccagct

SEQ ID NO: 4952886 - DNA, 15 bp, Homo sapiens
tttctccagtgctgt

SEQ ID NO: 4952887 - DNA, 22 bp, Homo sapiens
tttctctaacttcaaggcccat

SEQ ID NO: 4952888 - DNA, 21 bp, Homo sapiens
tttctcttagaacattgtatt

SEQ ID NO: 4952889 - DNA, 16 bp, Homo sapiens
tttctcttgagctggc

SEQ ID NO: 4952890 - DNA, 15 bp, Homo sapiens
tttctctttcttcct

SEQ ID NO: 4952891 - DNA, 20 bp, Homo sapiens
tttctctttcttcctttact

SEQ ID NO: 4952892 - DNA, 23 bp, Homo sapiens
tttctctttgtggggcttggcgt

SEQ ID NO: 4952893 - DNA, 12 bp, Homo sapiens
tttctgagaaaa

SEQ ID NO: 4952894 - DNA, 14 bp, Homo sapiens
tttctgattagctt

SEQ ID NO: 4952895 - DNA, 16 bp, Homo sapiens
tttctgattagctttg

SEQ ID NO: 4952896 - DNA, 19 bp, Homo sapiens
tttctgcaaacaaacacct

SEQ ID NO: 4952897 - DNA, 20 bp, Homo sapiens
tttctggaatacatgaaata

SEQ ID NO: 4952898 - DNA, 11 bp, Homo sapiens
tttctggagtc

SEQ ID NO: 4952899 - DNA, 17 bp, Homo sapiens
tttctggccaaaagcag

SEQ ID NO: 4952900 - DNA, 22 bp, Homo sapiens
tttctggggaaagacactgcct

SEQ ID NO: 4952901 - DNA, 11 bp, Homo sapiens
tttctgtactt

SEQ ID NO: 4952902 - DNA, 17 bp, Homo sapiens
tttctgtatatactttt

SEQ ID NO: 4952903 - DNA, 19 bp, Homo sapiens
tttctgtcagatgagaaca

SEQ ID NO: 4952904 - DNA, 23 bp, Homo sapiens
tttctgtcagatgagaacaaagc

SEQ ID NO: 4952905 - DNA, 18 bp, Homo sapiens
tttctgtgccctactcat

SEQ ID NO: 4952906 - DNA, 20 bp, Homo sapiens
tttctgtgtgcaccttacca

SEQ ID NO: 4952907 - DNA, 15 bp, Homo sapiens
tttctgttggattcc

SEQ ID NO: 4952908 - DNA, 13 bp, Homo sapiens
tttctgtttctca

SEQ ID NO: 4952909 - DNA, 16 bp, Homo sapiens
tttctgtttgattctt

SEQ ID NO: 4952910 - DNA, 12 bp, Homo sapiens
tttcttagcttt

SEQ ID NO: 4952911 - DNA, 13 bp, Homo sapiens
tttcttagctttt

SEQ ID NO: 4952912 - DNA, 22 bp, Homo sapiens
tttcttagctttttaattgttg

SEQ ID NO: 4952913 - DNA, 16 bp, Homo sapiens
tttcttcaaaatgtat

SEQ ID NO: 4952914 - DNA, 21 bp, Homo sapiens
tttcttcaaaatgtatatatt

SEQ ID NO: 4952915 - DNA, 21 bp, Homo sapiens
tttcttcactgttgaaaatta

SEQ ID NO: 4952916 - DNA, 21 bp, Homo sapiens
tttcttgacaaaacctaactt

SEQ ID NO: 4952917 - DNA, 16 bp, Homo sapiens
tttcttgctcccttca

SEQ ID NO: 4952918 - DNA, 14 bp, Homo sapiens
tttcttgcttgtac

SEQ ID NO: 4952919 - DNA, 13 bp, Homo sapiens
tgttagagacttt

SEQ ID NO: 4952920 - DNA, 18 bp, Homo sapiens
tgttagagacttttttct

SEQ ID NO: 4952921 - DNA, 21 bp, Homo sapiens
tgttagagacttttttctagt

SEQ ID NO: 4952922 - DNA, 12 bp, Homo sapiens
tgttagcactgt

SEQ ID NO: 4952923 - DNA, 14 bp, Homo sapiens
tgttagcactgttg

SEQ ID NO: 4952924 - DNA, 17 bp, Homo sapiens
tgttagcactgttgatg

SEQ ID NO: 4952925 - DNA, 20 bp, Homo sapiens
tgttagctttttaaaacatt

SEQ ID NO: 4952926 - DNA, 21 bp, Homo sapiens
tgttagtgttttaagaaatgt

SEQ ID NO: 4952927 - DNA, 22 bp, Homo sapiens
tgttagtgttttaagaaatgta

SEQ ID NO: 4952928 - DNA, 16 bp, Homo sapiens
tgttatattaagcaga

SEQ ID NO: 4952929 - DNA, 19 bp, Homo sapiens
tgttatatttaatgcatta

SEQ ID NO: 4952930 - DNA, 21 bp, Homo sapiens
tgttatcagtcaatattttta

SEQ ID NO: 4952931 - DNA, 15 bp, Homo sapiens
tgttatcttctcaag

SEQ ID NO: 4952932 - DNA, 16 bp, Homo sapiens
tgttatgaaataaaga

SEQ ID NO: 4952933 - DNA, 21 bp, Homo sapiens
tgttatgaaataaagaaattg

SEQ ID NO: 4952934 - DNA, 16 bp, Homo sapiens
tgttatgactatgtaa

SEQ ID NO: 4952935 - DNA, 15 bp, Homo sapiens
tgttatgtactgtac

SEQ ID NO: 4952936 - DNA, 13 bp, Homo sapiens
tgttatttctgca

SEQ ID NO: 4952937 - DNA, 14 bp, Homo sapiens
tgttatttctgcaa

SEQ ID NO: 4952938 - DNA, 17 bp, Homo sapiens
tgttatttttcaaggaa

SEQ ID NO: 4952939 - DNA, 19 bp, Homo sapiens
tgttatttttcaaggaagg

SEQ ID NO: 4952940 - DNA, 18 bp, Homo sapiens
tgttcaaagccacattat

SEQ ID NO: 4952941 - DNA, 16 bp, Homo sapiens
tgttcacttttcctcc

SEQ ID NO: 4952942 - DNA, 19 bp, Homo sapiens
tgttcacttttcctccctc

SEQ ID NO: 4952943 - DNA, 22 bp, Homo sapiens
tgttcagaaggttgctctagat

SEQ ID NO: 4952944 - DNA, 20 bp, Homo sapiens
tgttcagctccagctcacca

SEQ ID NO: 4952945 - DNA, 21 bp, Homo sapiens
tgttcagctgtcctccctcca

SEQ ID NO: 4952946 - DNA, 13 bp, Homo sapiens
tgttcatgtttgg

SEQ ID NO: 4952947 - DNA, 17 bp, Homo sapiens
tgttcatgtttggtgca

SEQ ID NO: 4952948 - DNA, 16 bp, Homo sapiens
tgttcccattcttgca

SEQ ID NO: 4952949 - DNA, 22 bp, Homo sapiens
tgttccccactgacagcctccc

SEQ ID NO: 4952950 - DNA, 20 bp, Homo sapiens
tgttcgcatggtcacacact

SEQ ID NO: 4952951 - DNA, 22 bp, Homo sapiens
tgttcgcatggtcacacactga

SEQ ID NO: 4952952 - DNA, 14 bp, Homo sapiens
tgttcgcttggctc

SEQ ID NO: 4952953 - DNA, 19 bp, Homo sapiens
tgttcgttggttatacaag

SEQ ID NO: 4952954 - DNA, 14 bp, Homo sapiens
tgttctaaagctct

SEQ ID NO: 4952955 - DNA, 19 bp, Homo sapiens
tgttctaaagctctgacat

SEQ ID NO: 4952956 - DNA, 13 bp, Homo sapiens
tgttctaagatgt

SEQ ID NO: 4952957 - DNA, 14 bp, Homo sapiens
tgttctaagatgtg

SEQ ID NO: 4952958 - DNA, 16 bp, Homo sapiens
tgttctaagatgtgat

SEQ ID NO: 4952959 - DNA, 22 bp, Homo sapiens
tgttctaagatgtgatattcta

SEQ ID NO: 4952960 - DNA, 22 bp, Homo sapiens
tgttctaagtttctaagattct

SEQ ID NO: 4952961 - DNA, 18 bp, Homo sapiens
tgttctatccaaacatgt

SEQ ID NO: 4952962 - DNA, 14 bp, Homo sapiens
tgttctatgaacaa

SEQ ID NO: 4952963 - DNA, 18 bp, Homo sapiens
tgttctatggttatgaaa

SEQ ID NO: 4952964 - DNA, 12 bp, Homo sapiens
tgttctgcactg

SEQ ID NO: 4952965 - DNA, 14 bp, Homo sapiens
tgttctgcccccag

SEQ ID NO: 4952966 - DNA, 18 bp, Homo sapiens
tgttctgcccccagccca

SEQ ID NO: 4952967 - DNA, 22 bp, Homo sapiens
tgttctgcccccagcccaaagg

SEQ ID NO: 4952968 - DNA, 13 bp, Homo sapiens
tgttctgggacac

SEQ ID NO: 4952969 - DNA, 16 bp, Homo sapiens
tgttctgggacacagt

SEQ ID NO: 4952970 - DNA, 15 bp, Homo sapiens
tgttctgggctcttt

SEQ ID NO: 4952971 - DNA, 14 bp, Homo sapiens
tgttctgtttcaag

SEQ ID NO: 4952972 - DNA, 23 bp, Homo sapiens
tgtgctttgctcttgtcccacgt

SEQ ID NO: 4952973 - DNA, 14 bp, Homo sapiens
tgtgcttttcctat

SEQ ID NO: 4952974 - DNA, 16 bp, Homo sapiens
tgtgcttttcctattt

SEQ ID NO: 4952975 - DNA, 14 bp, Homo sapiens
tgtgcttttcctga

SEQ ID NO: 4952976 - DNA, 21 bp, Homo sapiens
tgtgcttttcctgataaagca

SEQ ID NO: 4952977 - DNA, 15 bp, Homo sapiens
tgtggaacccagcag

SEQ ID NO: 4952978 - DNA, 23 bp, Homo sapiens
tgtggaactaataaatacatacg

SEQ ID NO: 4952979 - DNA, 22 bp, Homo sapiens
tgtggaagaaaatggtttattt

SEQ ID NO: 4952980 - DNA, 13 bp, Homo sapiens
tgtggaatgagtg

SEQ ID NO: 4952981 - DNA, 16 bp, Homo sapiens
tgtggacacagctctt

SEQ ID NO: 4952982 - DNA, 19 bp, Homo sapiens
tgtggacacagctcttctc

SEQ ID NO: 4952983 - DNA, 23 bp, Homo sapiens
tgtggactctggtgcctccagag

SEQ ID NO: 4952984 - DNA, 15 bp, Homo sapiens
tgtggagctcagccc

SEQ ID NO: 4952985 - DNA, 21 bp, Homo sapiens
tgtggaggaaggattgtaaaa

SEQ ID NO: 4952986 - DNA, 19 bp, Homo sapiens
tgtggatcttttcattctc

SEQ ID NO: 4952987 - DNA, 19 bp, Homo sapiens
tgtggatgatcaatccttt

SEQ ID NO: 4952988 - DNA, 17 bp, Homo sapiens
tgtggattctgaggccc

SEQ ID NO: 4952989 - DNA, 14 bp, Homo sapiens
tgtggcagagagag

SEQ ID NO: 4952990 - DNA, 22 bp, Homo sapiens
tgtggcagagagagagaaagag

SEQ ID NO: 4952991 - DNA, 20 bp, Homo sapiens
tgtggccctctcccttaccc

SEQ ID NO: 4952992 - DNA, 15 bp, Homo sapiens
tgtggccgaggactt

SEQ ID NO: 4952993 - DNA, 11 bp, Homo sapiens
tgtggcctcag

SEQ ID NO: 4952994 - DNA, 16 bp, Homo sapiens
tgtggcgggcagtggg

SEQ ID NO: 4952995 - DNA, 21 bp, Homo sapiens
tgtggctaaatgcctaataaa

SEQ ID NO: 4952996 - DNA, 21 bp, Homo sapiens
tgtggctcctgggggttcttt

SEQ ID NO: 4952997 - DNA, 14 bp, Homo sapiens
tgtggctccttccc

SEQ ID NO: 4952998 - DNA, 15 bp, Homo sapiens
tgtggctccttccca

SEQ ID NO: 4952999 - DNA, 21 bp, Homo sapiens
tgtggctgaggaggcctccat

SEQ ID NO: 4953000 - DNA, 13 bp, Homo sapiens
tgtgggagggagc

SEQ ID NO: 4953001 - DNA, 16 bp, Homo sapiens
tgtgggcactggccca

SEQ ID NO: 4953002 - DNA, 18 bp, Homo sapiens
tgtgggcactggcccagg

SEQ ID NO: 4953003 - DNA, 19 bp, Homo sapiens
tgtggtaggccttttaaca

SEQ ID NO: 4953004 - DNA, 13 bp, Homo sapiens
tgtggtctcagga

SEQ ID NO: 4953005 - DNA, 14 bp, Homo sapiens
tgtggtgtaattta

SEQ ID NO: 4953006 - DNA, 20 bp, Homo sapiens
tgtggtgtaatttataaaat

SEQ ID NO: 4953007 - DNA, 21 bp, Homo sapiens
tgtggtttggttcctctctgg

SEQ ID NO: 4953008 - DNA, 16 bp, Homo sapiens
tgtgtaatagaaaact

SEQ ID NO: 4953009 - DNA, 18 bp, Homo sapiens
tgtgtaatagaaaactga

SEQ ID NO: 4953010 - DNA, 22 bp, Homo sapiens
tgtgtactcactgaagcctgcg

SEQ ID NO: 4953011 - DNA, 20 bp, Homo sapiens
tgtgtactgtatagacagtt

SEQ ID NO: 4953012 - DNA, 21 bp, Homo sapiens
tgtgtactgtatagacagttt

SEQ ID NO: 4953013 - DNA, 16 bp, Homo sapiens
tgtgtagacaaatatt

SEQ ID NO: 4953014 - DNA, 19 bp, Homo sapiens
tgtgtagagttaagaagct

SEQ ID NO: 4953015 - DNA, 13 bp, Homo sapiens
tgtgtagcctatg

SEQ ID NO: 4953016 - DNA, 15 bp, Homo sapiens
tgtgtagcctgtgca

SEQ ID NO: 4953017 - DNA, 16 bp, Homo sapiens
tgtgtagcctgtgcat

SEQ ID NO: 4953018 - DNA, 14 bp, Homo sapiens
tgtgtagctttgct

SEQ ID NO: 4953019 - DNA, 22 bp, Homo sapiens
tgtgtatacagccctgacgcaa

SEQ ID NO: 4953020 - DNA, 16 bp, Homo sapiens
tgtgtatatatacata

SEQ ID NO: 4953021 - DNA, 18 bp, Homo sapiens
tgtgtatattatttggca

SEQ ID NO: 4953022 - DNA, 14 bp, Homo sapiens
tgtgtatgccaaga

SEQ ID NO: 4953023 - DNA, 16 bp, Homo sapiens
tgtgtcacttgtgctt

SEQ ID NO: 4953024 - DNA, 21 bp, Homo sapiens
tgtgtcacttgtgctttgctc

SEQ ID NO: 4953025 - DNA, 17 bp, Homo sapiens
tgtgtccttccctgcat

SEQ ID NO: 4953026 - DNA, 20 bp, Homo sapiens
tgtgtctaagattctagatc

SEQ ID NO: 4953027 - DNA, 22 bp, Homo sapiens
tgtgtctgctttaaagggcctg

SEQ ID NO: 4953028 - DNA, 24 bp, Homo sapiens
tgtgtctgtatttcatgtggctgt

SEQ ID NO: 4953029 - DNA, 14 bp, Homo sapiens
tgtgtcttaattat

SEQ ID NO: 4953030 - DNA, 17 bp, Homo sapiens
tgtgtgaatgaacactc

SEQ ID NO: 4953031 - DNA, 19 bp, Homo sapiens
tgtgtgaccaactgtgttg

SEQ ID NO: 4953032 - DNA, 17 bp, Homo sapiens
tgtgtgcaccttaccaa

SEQ ID NO: 4953033 - DNA, 21 bp, Homo sapiens
tgtgtgccatagagtttaaca

SEQ ID NO: 4953034 - DNA, 23 bp, Homo sapiens
tgtgtgccatagagtttaacaca

SEQ ID NO: 4953035 - DNA, 23 bp, Homo sapiens
tgtgtggactgtggcacttgcct

SEQ ID NO: 4953036 - DNA, 11 bp, Homo sapiens
tgtgtggcctg

SEQ ID NO: 4953037 - DNA, 15 bp, Homo sapiens
tgtgtgtatatatgt

SEQ ID NO: 4953038 - DNA, 22 bp, Homo sapiens
tgtgtgtatatatgtgtatata

SEQ ID NO: 4953039 - DNA, 16 bp, Homo sapiens
tgtgtgtcttaattat

SEQ ID NO: 4953040 - DNA, 16 bp, Homo sapiens
tgtgtgtgaatgaaca

SEQ ID NO: 4953041 - DNA, 14 bp, Homo sapiens
tgtgtgtgtatgtg

SEQ ID NO: 4953042 - DNA, 13 bp, Homo sapiens
tgtgtgtgtgaat

SEQ ID NO: 4953043 - DNA, 11 bp, Homo sapiens
tgtgtgtgtgt

SEQ ID NO: 4953044 - DNA, 12 bp, Homo sapiens
tgtgtgtgtgta

SEQ ID NO: 4953045 - DNA, 19 bp, Homo sapiens
tgtgttaagtatgtgtaaa

SEQ ID NO: 4953046 - DNA, 14 bp, Homo sapiens
tgtgttatgaagca

SEQ ID NO: 4953047 - DNA, 19 bp, Homo sapiens
tgtgttccaagtttccaaa

SEQ ID NO: 4953048 - DNA, 20 bp, Homo sapiens
tgtgttctatccaaacatgt

SEQ ID NO: 4953049 - DNA, 13 bp, Homo sapiens
tgtgttgaaactg

SEQ ID NO: 4953050 - DNA, 16 bp, Homo sapiens
tgtgtttaatttcttc

SEQ ID NO: 4953051 - DNA, 14 bp, Homo sapiens
tgtgtttataaaat

SEQ ID NO: 4953052 - DNA, 16 bp, Homo sapiens
tgtgtttggtttacat

SEQ ID NO: 4953053 - DNA, 23 bp, Homo sapiens
tgtgtttggtttacatttaaagc

SEQ ID NO: 4953054 - DNA, 14 bp, Homo sapiens
tgtgtttttctcca

SEQ ID NO: 4953055 - DNA, 18 bp, Homo sapiens
tgtgtttttctccagtgc

SEQ ID NO: 4953056 - DNA, 20 bp, Homo sapiens
tgtgtttttctccagtgctg

SEQ ID NO: 4953057 - DNA, 17 bp, Homo sapiens
tgttaaaattatgaatc

SEQ ID NO: 4953058 - DNA, 20 bp, Homo sapiens
tgttaaaattatgaatctga

SEQ ID NO: 4953059 - DNA, 12 bp, Homo sapiens
tgttaaactgtt

SEQ ID NO: 4953060 - DNA, 14 bp, Homo sapiens
tgttaaactgttag

SEQ ID NO: 4953061 - DNA, 21 bp, Homo sapiens
tgttaaactgttagcactgtt

SEQ ID NO: 4953062 - DNA, 22 bp, Homo sapiens
tgttaaactgttagcactgttg

SEQ ID NO: 4953063 - DNA, 19 bp, Homo sapiens
tgttaaatgaaattgtaaa

SEQ ID NO: 4953064 - DNA, 17 bp, Homo sapiens
tgttaaatttgtaagtt

SEQ ID NO: 4953065 - DNA, 21 bp, Homo sapiens
tgttaaatttgtaagtttcag

SEQ ID NO: 4953066 - DNA, 23 bp, Homo sapiens
tgttaagcagatggaatgctgtg

SEQ ID NO: 4953067 - DNA, 15 bp, Homo sapiens
tgttaaggaaactct

SEQ ID NO: 4953068 - DNA, 20 bp, Homo sapiens
tgttaaggaaactcttatct

SEQ ID NO: 4953069 - DNA, 23 bp, Homo sapiens
tgttaaggaaactcttatctcag

SEQ ID NO: 4953070 - DNA, 16 bp, Homo sapiens
tgttaagtatgtgtaa

SEQ ID NO: 4953071 - DNA, 19 bp, Homo sapiens
tgttaatctctgttatgta

SEQ ID NO: 4953072 - DNA, 23 bp, Homo sapiens
tgttaatctctgttatgtactgt

SEQ ID NO: 4953073 - DNA, 23 bp, Homo sapiens
tgttacagccaagtgccaaatgc

SEQ ID NO: 4953074 - DNA, 22 bp, Homo sapiens
tgttacataacaagaaaatcaa

SEQ ID NO: 4953075 - DNA, 18 bp, Homo sapiens
tgttactattttctacaa

SEQ ID NO: 4953076 - DNA, 12 bp, Homo sapiens
tgttactgtaat

SEQ ID NO: 4953077 - DNA, 15 bp, Homo sapiens
tgttactgtaattcc

SEQ ID NO: 4953078 - DNA, 10 bp, Homo sapiens
tgttactgtt

SEQ ID NO: 4953079 - DNA, 18 bp, Homo sapiens
tgttactgttaaccattt

SEQ ID NO: 4953080 - DNA, 11 bp, Homo sapiens
tgttactgttc

SEQ ID NO: 4953081 - DNA, 13 bp, Homo sapiens
tgttactgttctt

SEQ ID NO: 4953082 - DNA, 21 bp, Homo sapiens
tgttactgttcttgctgctag

SEQ ID NO: 4953083 - DNA, 14 bp, Homo sapiens
tgtcattaatgtgt

SEQ ID NO: 4953084 - DNA, 15 bp, Homo sapiens
tgtcattaatgtgtt

SEQ ID NO: 4953085 - DNA, 20 bp, Homo sapiens
tgtcatttcattccattgcc

SEQ ID NO: 4953086 - DNA, 19 bp, Homo sapiens
tgtcatttgagcagggctc

SEQ ID NO: 4953087 - DNA, 21 bp, Homo sapiens
tgtcatttgagcagggctcag

SEQ ID NO: 4953088 - DNA, 15 bp, Homo sapiens
tgtccacctgtgggt

SEQ ID NO: 4953089 - DNA, 12 bp, Homo sapiens
tgtccagcctgg

SEQ ID NO: 4953090 - DNA, 17 bp, Homo sapiens
tgtccatgcttctcatc

SEQ ID NO: 4953091 - DNA, 13 bp, Homo sapiens
tgtccatttgtaa

SEQ ID NO: 4953092 - DNA, 23 bp, Homo sapiens
tgtcccaaaaagaaaggagggga

SEQ ID NO: 4953093 - DNA, 18 bp, Homo sapiens
tgtcccacccccaccccc

SEQ ID NO: 4953094 - DNA, 17 bp, Homo sapiens
tgtcccacgtgtcttcc

SEQ ID NO: 4953095 - DNA, 21 bp, Homo sapiens
tgtcccacgtgtcttccactt

SEQ ID NO: 4953096 - DNA, 22 bp, Homo sapiens
tgtcccacgtgtcttccacttt

SEQ ID NO: 4953097 - DNA, 14 bp, Homo sapiens
tgtcccaggtcctc

SEQ ID NO: 4953098 - DNA, 13 bp, Homo sapiens
tgtccctcccacc

SEQ ID NO: 4953099 - DNA, 20 bp, Homo sapiens
tgtccctgcacttgcagact

SEQ ID NO: 4953100 - DNA, 15 bp, Homo sapiens
tgtccctttcagaga

SEQ ID NO: 4953101 - DNA, 16 bp, Homo sapiens
tgtcctaaggaacctt

SEQ ID NO: 4953102 - DNA, 20 bp, Homo sapiens
tgtcctacccaccctccttt

SEQ ID NO: 4953103 - DNA, 12 bp, Homo sapiens
tgtcctactctg

SEQ ID NO: 4953104 - DNA, 20 bp, Homo sapiens
tgtcctatctatcttccaaa

SEQ ID NO: 4953105 - DNA, 22 bp, Homo sapiens
tgtcctatgtgtgactctaaat

SEQ ID NO: 4953106 - DNA, 15 bp, Homo sapiens
tgtcctcactgctcc

SEQ ID NO: 4953107 - DNA, 19 bp, Homo sapiens
tgtcctcagggagcaggga

SEQ ID NO: 4953108 - DNA, 20 bp, Homo sapiens
tgtcctcagtccatttatat

SEQ ID NO: 4953109 - DNA, 20 bp, Homo sapiens
tgtcctccagaagcctctgg

SEQ ID NO: 4953110 - DNA, 23 bp, Homo sapiens
tgtcctccagaagcctctggcta

SEQ ID NO: 4953111 - DNA, 20 bp, Homo sapiens
tgtcctctcccctccagcct

SEQ ID NO: 4953112 - DNA, 22 bp, Homo sapiens
tgtcctgcctgcaatatttgaa

SEQ ID NO: 4953113 - DNA, 19 bp, Homo sapiens
tgtcctgggagtgagctgg

SEQ ID NO: 4953114 - DNA, 18 bp, Homo sapiens
tgtccttggaagtttcat

SEQ ID NO: 4953115 - DNA, 20 bp, Homo sapiens
tgtcgaaaagagtcttccaa

SEQ ID NO: 4953116 - DNA, 14 bp, Homo sapiens
tgtcgcctctgcat

SEQ ID NO: 4953117 - DNA, 18 bp, Homo sapiens
tgtctaaatttgaatgtt

SEQ ID NO: 4953118 - DNA, 12 bp, Homo sapiens
tgtctacaaata

SEQ ID NO: 4953119 - DNA, 15 bp, Homo sapiens
tgtctacaaatataa

SEQ ID NO: 4953120 - DNA, 21 bp, Homo sapiens
tgtctacaaatataagatttt

SEQ ID NO: 4953121 - DNA, 14 bp, Homo sapiens
tgtctagagtagct

SEQ ID NO: 4953122 - DNA, 17 bp, Homo sapiens
tgtctatagttgtcagt

SEQ ID NO: 4953123 - DNA, 18 bp, Homo sapiens
tgtctatagttgtcagta

SEQ ID NO: 4953124 - DNA, 11 bp, Homo sapiens
tgtctatttta

SEQ ID NO: 4953125 - DNA, 18 bp, Homo sapiens
tgtctcaagagggcactg

SEQ ID NO: 4953126 - DNA, 19 bp, Homo sapiens
tgtctcaagagggcactgg

SEQ ID NO: 4953127 - DNA, 20 bp, Homo sapiens
tgtctcaagagggcactggt

SEQ ID NO: 4953128 - DNA, 14 bp, Homo sapiens
tgtctcagactttt

SEQ ID NO: 4953129 - DNA, 22 bp, Homo sapiens
tgtctcagacttttgtacatct

SEQ ID NO: 4953130 - DNA, 14 bp, Homo sapiens
tgtctcagcctccc

SEQ ID NO: 4953131 - DNA, 15 bp, Homo sapiens
tgtctcagttggaaa

SEQ ID NO: 4953132 - DNA, 18 bp, Homo sapiens
tctcatcctcctggaacc

SEQ ID NO: 4953133 - DNA, 16 bp, Homo sapiens
tctcatctgcaccctt

SEQ ID NO: 4953134 - DNA, 23 bp, Homo sapiens
tctcatctgcacccttcttttct

SEQ ID NO: 4953135 - DNA, 17 bp, Homo sapiens
tctcatgtgtttgcata

SEQ ID NO: 4953136 - DNA, 12 bp, Homo sapiens
tctcattcttgt

SEQ ID NO: 4953137 - DNA, 22 bp, Homo sapiens
tctcattttaatgtaaagattt

SEQ ID NO: 4953138 - DNA, 15 bp, Homo sapiens
tgggaacctcccaga

SEQ ID NO: 4953139 - DNA, 22 bp, Homo sapiens
tgggaacctcccagaggtccag

SEQ ID NO: 4953140 - DNA, 13 bp, Homo sapiens
tgggaactctgac

SEQ ID NO: 4953141 - DNA, 20 bp, Homo sapiens
tgggaagctgagggcaaatc

SEQ ID NO: 4953142 - DNA, 23 bp, Homo sapiens
tgggaagttgcattcctttgtct

SEQ ID NO: 4953143 - DNA, 17 bp, Homo sapiens
tgggacaattgttttaa

SEQ ID NO: 4953144 - DNA, 20 bp, Homo sapiens
tgggacacaaaactccgccc

SEQ ID NO: 4953145 - DNA, 16 bp, Homo sapiens
tgggacagggcatggc

SEQ ID NO: 4953146 - DNA, 20 bp, Homo sapiens
tgggacagtttatcatgaag

SEQ ID NO: 4953147 - DNA, 21 bp, Homo sapiens
tgggacccatagatcttctga

SEQ ID NO: 4953148 - DNA, 14 bp, Homo sapiens
tgggactacaggca

SEQ ID NO: 4953149 - DNA, 16 bp, Homo sapiens
tgggactacaggcacc

SEQ ID NO: 4953150 - DNA, 20 bp, Homo sapiens
tgggactcaatgcactgaca

SEQ ID NO: 4953151 - DNA, 15 bp, Homo sapiens
tgggacttattacaa

SEQ ID NO: 4953152 - DNA, 12 bp, Homo sapiens
tgggagacagac

SEQ ID NO: 4953153 - DNA, 13 bp, Homo sapiens
tgggagacagacc

SEQ ID NO: 4953154 - DNA, 18 bp, Homo sapiens
tgggagagcccctggggc

SEQ ID NO: 4953155 - DNA, 23 bp, Homo sapiens
tgggagagcccctggggcctaga

SEQ ID NO: 4953156 - DNA, 14 bp, Homo sapiens
tgggagcaggagat

SEQ ID NO: 4953157 - DNA, 13 bp, Homo sapiens
tgggagccccagg

SEQ ID NO: 4953158 - DNA, 23 bp, Homo sapiens
tgggagccccagggtcttcccta

SEQ ID NO: 4953159 - DNA, 15 bp, Homo sapiens
tgggagctcctctcc

SEQ ID NO: 4953160 - DNA, 23 bp, Homo sapiens
tgggagctcctctcctggaggat

SEQ ID NO: 4953161 - DNA, 13 bp, Homo sapiens
tgggagctgcctg

SEQ ID NO: 4953162 - DNA, 14 bp, Homo sapiens
tgggagctgcctgt

SEQ ID NO: 4953163 - DNA, 23 bp, Homo sapiens
tgggagctgcctgttcagctcca

SEQ ID NO: 4953164 - DNA, 16 bp, Homo sapiens
tgggaggaaagagagc

SEQ ID NO: 4953165 - DNA, 19 bp, Homo sapiens
tgggaggacggtgcaaccc

SEQ ID NO: 4953166 - DNA, 20 bp, Homo sapiens
tgggaggacggtgcaaccca

SEQ ID NO: 4953167 - DNA, 18 bp, Homo sapiens
tgggaggagcagattttt

SEQ ID NO: 4953168 - DNA, 16 bp, Homo sapiens
tgggaggcatggccct

SEQ ID NO: 4953169 - DNA, 20 bp, Homo sapiens
tgggaggccccttctctccc

SEQ ID NO: 4953170 - DNA, 18 bp, Homo sapiens
tgggagggaaaagggaag

SEQ ID NO: 4953171 - DNA, 19 bp, Homo sapiens
tgggagggagcagacagga

SEQ ID NO: 4953172 - DNA, 23 bp, Homo sapiens
tgggaggggcgcccacctcccca

SEQ ID NO: 4953173 - DNA, 20 bp, Homo sapiens
tgggatacaacctccctctt

SEQ ID NO: 4953174 - DNA, 16 bp, Homo sapiens
tgggatgagccgctgt

SEQ ID NO: 4953175 - DNA, 23 bp, Homo sapiens
tgggattgacagaagcttctgcc

SEQ ID NO: 4953176 - DNA, 12 bp, Homo sapiens
tgggcaacagag

SEQ ID NO: 4953177 - DNA, 20 bp, Homo sapiens
tgggcaacccccagcctgct

SEQ ID NO: 4953178 - DNA, 13 bp, Homo sapiens
tgggcaaggaaaa

SEQ ID NO: 4953179 - DNA, 15 bp, Homo sapiens
tgggcactggcccag

SEQ ID NO: 4953180 - DNA, 13 bp, Homo sapiens
tgggcacttgaga

SEQ ID NO: 4953181 - DNA, 17 bp, Homo sapiens
tgggcagcaatttaaat

SEQ ID NO: 4953182 - DNA, 14 bp, Homo sapiens
tgggcagccaggct

SEQ ID NO: 4953183 - DNA, 21 bp, Homo sapiens
tgggcatggtaccagccctgg

SEQ ID NO: 4953184 - DNA, 16 bp, Homo sapiens
tgggccaactcacctg

SEQ ID NO: 4953185 - DNA, 13 bp, Homo sapiens
tgggccagggctg

SEQ ID NO: 4953186 - DNA, 18 bp, Homo sapiens
tgggccatgtccaaagag

SEQ ID NO: 4953187 - DNA, 24 bp, Homo sapiens
tgggccatgtccaaagaggctgcc

SEQ ID NO: 4953188 - DNA, 13 bp, Homo sapiens
tgggcccagatct

SEQ ID NO: 4953189 - DNA, 21 bp, Homo sapiens
tgggccggcttcatgccagct

SEQ ID NO: 4953190 - DNA, 16 bp, Homo sapiens
tgggcctcctgtgtgt

SEQ ID NO: 4953191 - DNA, 17 bp, Homo sapiens
tgggcctggcattcttg

SEQ ID NO: 4953192 - DNA, 16 bp, Homo sapiens
tgggccttagtgggcc

SEQ ID NO: 4953193 - DNA, 18 bp, Homo sapiens
tgggccttagtgggccag

SEQ ID NO: 4953194 - DNA, 23 bp, Homo sapiens
tgggccttagtgggccagggctg

SEQ ID NO: 4953195 - DNA, 14 bp, Homo sapiens
tgggctatggacac

SEQ ID NO: 4953196 - DNA, 17 bp, Homo sapiens
tgggctatggacacagg

SEQ ID NO: 4953197 - DNA, 19 bp, Homo sapiens
tgggctcccgtgttttgta

SEQ ID NO: 4953198 - DNA, 15 bp, Homo sapiens
tgggctcctggcaga

SEQ ID NO: 4953199 - DNA, 17 bp, Homo sapiens
tgggctcggaggctgcc

SEQ ID NO: 4953200 - DNA, 13 bp, Homo sapiens
tgggctcttccaa

SEQ ID NO: 4953201 - DNA, 14 bp, Homo sapiens
tgggctgccctggt

SEQ ID NO: 4953202 - DNA, 16 bp, Homo sapiens
tgggcttcactgtata

SEQ ID NO: 4953203 - DNA, 17 bp, Homo sapiens
tgggcttcactgtataa

SEQ ID NO: 4953204 - DNA, 18 bp, Homo sapiens
tgggcttcactgtataaa

SEQ ID NO: 4953205 - DNA, 13 bp, Homo sapiens
tgggcttgattct

SEQ ID NO: 4953206 - DNA, 21 bp, Homo sapiens
tggggaaagacactgcctggg

SEQ ID NO: 4953207 - DNA, 21 bp, Homo sapiens
tggggacccaggctccgccct

SEQ ID NO: 4953208 - DNA, 12 bp, Homo sapiens
tggggagaaagt

SEQ ID NO: 4953209 - DNA, 15 bp, Homo sapiens
tggggagaggaaaga

SEQ ID NO: 4953210 - DNA, 20 bp, Homo sapiens
tggggagaggaactccttgg

SEQ ID NO: 4953211 - DNA, 20 bp, Homo sapiens
tgtagccactagtaagtaat

SEQ ID NO: 4953212 - DNA, 19 bp, Homo sapiens
tgtagccccctggcctctg

SEQ ID NO: 4953213 - DNA, 13 bp, Homo sapiens
tgtagcctgtgca

SEQ ID NO: 4953214 - DNA, 22 bp, Homo sapiens
tgtagcctgtgcatgtatgtct

SEQ ID NO: 4953215 - DNA, 16 bp, Homo sapiens
tgtagcgtgtttacat

SEQ ID NO: 4953216 - DNA, 18 bp, Homo sapiens
tgtagctgtaaaacgctg

SEQ ID NO: 4953217 - DNA, 22 bp, Homo sapiens
tgtaggagacttgccagagccg

SEQ ID NO: 4953218 - DNA, 17 bp, Homo sapiens
tgtaggcatcatgcatg

SEQ ID NO: 4953219 - DNA, 19 bp, Homo sapiens
tgtaggtaaaatgtatttt

SEQ ID NO: 4953220 - DNA, 15 bp, Homo sapiens
tgtagtcatttacta

SEQ ID NO: 4953221 - DNA, 19 bp, Homo sapiens
tgtagtcatttactaaaca

SEQ ID NO: 4953222 - DNA, 20 bp, Homo sapiens
tgtagtcatttactaaacat

SEQ ID NO: 4953223 - DNA, 24 bp, Homo sapiens
tgtagtcatttactaaacatatga

SEQ ID NO: 4953224 - DNA, 12 bp, Homo sapiens
tgtagttaggaa

SEQ ID NO: 4953225 - DNA, 13 bp, Homo sapiens
tgtagttaggaaa

SEQ ID NO: 4953226 - DNA, 15 bp, Homo sapiens
tgtagttaggaaata

SEQ ID NO: 4953227 - DNA, 16 bp, Homo sapiens
tgtagttgatgtatcc

SEQ ID NO: 4953228 - DNA, 15 bp, Homo sapiens
tgtagttgcgtggac

SEQ ID NO: 4953229 - DNA, 21 bp, Homo sapiens
tgtagttgcgtggactctgca

SEQ ID NO: 4953230 - DNA, 18 bp, Homo sapiens
tgtataaataggagagga

SEQ ID NO: 4953231 - DNA, 15 bp, Homo sapiens
tgtataaatgtatat

SEQ ID NO: 4953232 - DNA, 16 bp, Homo sapiens
tgtataaatgtatata

SEQ ID NO: 4953233 - DNA, 18 bp, Homo sapiens
tgtataagcactgaaaaa

SEQ ID NO: 4953234 - DNA, 18 bp, Homo sapiens
tgtataagtgcacacaga

SEQ ID NO: 4953235 - DNA, 21 bp, Homo sapiens
tgtataagtgcacacagaaat

SEQ ID NO: 4953236 - DNA, 18 bp, Homo sapiens
tgtatacaaatatattgt

SEQ ID NO: 4953237 - DNA, 17 bp, Homo sapiens
tgtatacatcctgggta

SEQ ID NO: 4953238 - DNA, 12 bp, Homo sapiens
tgtatactttag

SEQ ID NO: 4953239 - DNA, 14 bp, Homo sapiens
tgtatactttagta

SEQ ID NO: 4953240 - DNA, 17 bp, Homo sapiens
tgtatactttagtatga

SEQ ID NO: 4953241 - DNA, 19 bp, Homo sapiens
tgtatactttagtatgacg

SEQ ID NO: 4953242 - DNA, 17 bp, Homo sapiens
tgtatagacagtttgta

SEQ ID NO: 4953243 - DNA, 13 bp, Homo sapiens
tgtatatacacat

SEQ ID NO: 4953244 - DNA, 14 bp, Homo sapiens
tgtatatacacata

SEQ ID NO: 4953245 - DNA, 13 bp, Homo sapiens
tgtatatactttt

SEQ ID NO: 4953246 - DNA, 11 bp, Homo sapiens
tgtatatatac

SEQ ID NO: 4953247 - DNA, 14 bp, Homo sapiens
tgtatatatacata

SEQ ID NO: 4953248 - DNA, 17 bp, Homo sapiens
tgtatatatacatacac

SEQ ID NO: 4953249 - DNA, 15 bp, Homo sapiens
tgtatatatgtgtat

SEQ ID NO: 4953250 - DNA, 21 bp, Homo sapiens
tgtatatatgtgtatatatac

SEQ ID NO: 4953251 - DNA, 22 bp, Homo sapiens
tgtatatatgtgtatatataca

SEQ ID NO: 4953252 - DNA, 16 bp, Homo sapiens
tgtatatatttagtgc

SEQ ID NO: 4953253 - DNA, 14 bp, Homo sapiens
tgtatatcagaaaa

SEQ ID NO: 4953254 - DNA, 18 bp, Homo sapiens
tgtatattatttggcagt

SEQ ID NO: 4953255 - DNA, 22 bp, Homo sapiens
tgtatattatttggcagtttgg

SEQ ID NO: 4953256 - DNA, 15 bp, Homo sapiens
tgtatatttgtatat

SEQ ID NO: 4953257 - DNA, 15 bp, Homo sapiens
tgcgcccttaccttc

SEQ ID NO: 4953258 - DNA, 16 bp, Homo sapiens
tgcgcctacaggagtg

SEQ ID NO: 4953259 - DNA, 22 bp, Homo sapiens
tgcgcctacaggagtgagcact

SEQ ID NO: 4953260 - DNA, 17 bp, Homo sapiens
tgcgcctcaggctgctg

SEQ ID NO: 4953261 - DNA, 22 bp, Homo sapiens
tgcggacagccacggccaggcc

SEQ ID NO: 4953262 - DNA, 22 bp, Homo sapiens
tgcggaccccagctgtgagcct

SEQ ID NO: 4953263 - DNA, 15 bp, Homo sapiens
tgcggatctcagctt

SEQ ID NO: 4953264 - DNA, 14 bp, Homo sapiens
tgcggtccacccag

SEQ ID NO: 4953265 - DNA, 17 bp, Homo sapiens
tgcggtccacccaggag

SEQ ID NO: 4953266 - DNA, 20 bp, Homo sapiens
tgcgtacgtttcctgagaag

SEQ ID NO: 4953267 - DNA, 12 bp, Homo sapiens
tgcgtcccaaga

SEQ ID NO: 4953268 - DNA, 21 bp, Homo sapiens
tgcgtcttccgcccctgcctg

SEQ ID NO: 4953269 - DNA, 19 bp, Homo sapiens
tgcgtgccgtgtgagtgtg

SEQ ID NO: 4953270 - DNA, 23 bp, Homo sapiens
tgcgtgccgtgtgagtgtgacag

SEQ ID NO: 4953271 - DNA, 18 bp, Homo sapiens
tgcgtggactctgcacat

SEQ ID NO: 4953272 - DNA, 12 bp, Homo sapiens
tgcgtgtgtaga

SEQ ID NO: 4953273 - DNA, 23 bp, Homo sapiens
tgctaaccacgtctgtcttcaca

SEQ ID NO: 4953274 - DNA, 20 bp, Homo sapiens
tgctaatcaaagccagggtc

SEQ ID NO: 4953275 - DNA, 22 bp, Homo sapiens
tgctaatcttcttatgcaattt

SEQ ID NO: 4953276 - DNA, 13 bp, Homo sapiens
tgctaccaaagca

SEQ ID NO: 4953277 - DNA, 21 bp, Homo sapiens
tgctactgtcctacccaccct

SEQ ID NO: 4953278 - DNA, 22 bp, Homo sapiens
tgctactgtcctacccaccctc

SEQ ID NO: 4953279 - DNA, 11 bp, Homo sapiens
tgctagaactt

SEQ ID NO: 4953280 - DNA, 21 bp, Homo sapiens
tgctagaacttttttaaataa

SEQ ID NO: 4953281 - DNA, 23 bp, Homo sapiens
tgctagaacttttttaaataaac

SEQ ID NO: 4953282 - DNA, 19 bp, Homo sapiens
tgctagactctagacaaga

SEQ ID NO: 4953283 - DNA, 20 bp, Homo sapiens
tgctagcaaatggcagaacc

SEQ ID NO: 4953284 - DNA, 22 bp, Homo sapiens
tgctaggtctcggactaagcct

SEQ ID NO: 4953285 - DNA, 14 bp, Homo sapiens
tgctagtatttgaa

SEQ ID NO: 4953286 - DNA, 16 bp, Homo sapiens
tgctagtgagctgggc

SEQ ID NO: 4953287 - DNA, 19 bp, Homo sapiens
tgctagtgagctgggcatg

SEQ ID NO: 4953288 - DNA, 16 bp, Homo sapiens
tgctatatatataaat

SEQ ID NO: 4953289 - DNA, 16 bp, Homo sapiens
tgctatctctgtgtgc

SEQ ID NO: 4953290 - DNA, 21 bp, Homo sapiens
tgctatctctgtgtgcacaaa

SEQ ID NO: 4953291 - DNA, 16 bp, Homo sapiens
tgctatttattttcct

SEQ ID NO: 4953292 - DNA, 15 bp, Homo sapiens
tgctcacagtaaccc

SEQ ID NO: 4953293 - DNA, 17 bp, Homo sapiens
tgctcacatatctgtca

SEQ ID NO: 4953294 - DNA, 13 bp, Homo sapiens
tgctcagacagaa

SEQ ID NO: 4953295 - DNA, 20 bp, Homo sapiens
tgctcagagacctgaagtgt

SEQ ID NO: 4953296 - DNA, 12 bp, Homo sapiens
tgctcagccaag

SEQ ID NO: 4953297 - DNA, 14 bp, Homo sapiens
tgctcagccaagct

SEQ ID NO: 4953298 - DNA, 20 bp, Homo sapiens
tgctcaggctgcagctggac

SEQ ID NO: 4953299 - DNA, 22 bp, Homo sapiens
tgctcaggctgcagctggacag

SEQ ID NO: 4953300 - DNA, 20 bp, Homo sapiens
tgctcagggtcaatttcttt

SEQ ID NO: 4953301 - DNA, 17 bp, Homo sapiens
tgctcagtaatttgagg

SEQ ID NO: 4953302 - DNA, 16 bp, Homo sapiens
tgctcatctgttgtag

SEQ ID NO: 4953303 - DNA, 15 bp, Homo sapiens
tgctccaagattcta

SEQ ID NO: 4953304 - DNA, 15 bp, Homo sapiens
tgctccaccacatcc

SEQ ID NO: 4953305 - DNA, 16 bp, Homo sapiens
tgctccacccttggcc

SEQ ID NO: 4953306 - DNA, 22 bp, Homo sapiens
tgctccacccttggcctgtctc

SEQ ID NO: 4953307 - DNA, 23 bp, Homo sapiens
tgctccacccttggcctgtctca

SEQ ID NO: 4953308 - DNA, 18 bp, Homo sapiens
tgctccacgcgcttcgac

SEQ ID NO: 4953309 - DNA, 16 bp, Homo sapiens
tgctccaggcctgcag

SEQ ID NO: 4953310 - DNA, 18 bp, Homo sapiens
tgctccccagccctggct

SEQ ID NO: 4953311 - DNA, 21 bp, Homo sapiens
tgctccctaagccagcctggt

SEQ ID NO: 4953312 - DNA, 15 bp, Homo sapiens
tgctccctcccctgc

SEQ ID NO: 4953313 - DNA, 18 bp, Homo sapiens
tgctccctcccctgccct

SEQ ID NO: 4953314 - DNA, 15 bp, Homo sapiens
tgctccgctgctcct

SEQ ID NO: 4953315 - DNA, 21 bp, Homo sapiens
tgctccgctgctccttggctt

SEQ ID NO: 4953316 - DNA, 18 bp, Homo sapiens
tgctcctagtttgacctc

SEQ ID NO: 4953317 - DNA, 20 bp, Homo sapiens
tgctcctagtttgacctcac

SEQ ID NO: 4953318 - DNA, 18 bp, Homo sapiens
tgctcctctccccagcaa

SEQ ID NO: 4953319 - DNA, 19 bp, Homo sapiens
tgctcctctccccagcaag

SEQ ID NO: 4953320 - DNA, 22 bp, Homo sapiens
tgctccttggcttacctgacct

SEQ ID NO: 4953321 - DNA, 22 bp, Homo sapiens
tgctctcaccagctgctgctct

SEQ ID NO: 4953322 - DNA, 13 bp, Homo sapiens
tgctctcccctgc

SEQ ID NO: 4953323 - DNA, 14 bp, Homo sapiens
tgctctcccctgcc

SEQ ID NO: 4953324 - DNA, 20 bp, Homo sapiens
tgctctcccctgccctgctg

SEQ ID NO: 4953325 - DNA, 22 bp, Homo sapiens
tgctctcctcttgccactgcct

SEQ ID NO: 4953326 - DNA, 18 bp, Homo sapiens
tgctctgagaagaggagc

SEQ ID NO: 4953327 - DNA, 22 bp, Homo sapiens
tgctctgagaagaggagccctc

SEQ ID NO: 4953328 - DNA, 15 bp, Homo sapiens
tgctctgcaaaagga

SEQ ID NO: 4953329 - DNA, 15 bp, Homo sapiens
tgctctgctgacaga

SEQ ID NO: 4953330 - DNA, 16 bp, Homo sapiens
tgctctgctgacagac

SEQ ID NO: 4953331 - DNA, 15 bp, Homo sapiens
tgctcttaagcctaa

SEQ ID NO: 4953332 - DNA, 21 bp, Homo sapiens
tgctcttactacactgaggag

SEQ ID NO: 4953333 - DNA, 12 bp, Homo sapiens
tgctcttagctg

SEQ ID NO: 4953334 - DNA, 14 bp, Homo sapiens
tgctcttgtcccac

SEQ ID NO: 4953335 - DNA, 21 bp, Homo sapiens
tgctcttgtcccacgtgtctt

SEQ ID NO: 4953336 - DNA, 18 bp, Homo sapiens
tgctcttgtttttattaa

SEQ ID NO: 4953337 - DNA, 20 bp, Homo sapiens
tgctgaaaaccatctggcct

SEQ ID NO: 4953338 - DNA, 23 bp, Homo sapiens
tgctgaaaaccatctggcctggc

SEQ ID NO: 4953339 - DNA, 20 bp, Homo sapiens
tgctgaacaaaaaataaaaa

SEQ ID NO: 4953340 - DNA, 13 bp, Homo sapiens
tgctgaagggcat

SEQ ID NO: 4953341 - DNA, 15 bp, Homo sapiens
tgctgacagacacag

SEQ ID NO: 4953342 - DNA, 22 bp, Homo sapiens
tgctgacagacacaggcccggc

SEQ ID NO: 4953343 - DNA, 16 bp, Homo sapiens
tgctgagcctctgctc

SEQ ID NO: 4953344 - DNA, 17 bp, Homo sapiens
tgctgattctcccgttc

SEQ ID NO: 4953345 - DNA, 13 bp, Homo sapiens
tgctgattttaat

SEQ ID NO: 4953346 - DNA, 16 bp, Homo sapiens
tgctgattttaatgga

SEQ ID NO: 4953347 - DNA, 15 bp, Homo sapiens
tgctgcacttcctgt

SEQ ID NO: 4953348 - DNA, 15 bp, Homo sapiens
tgctgcatgcctggt

SEQ ID NO: 4953349 - DNA, 15 bp, Homo sapiens
tgctgccacacttca

SEQ ID NO: 4953350 - DNA, 19 bp, Homo sapiens
tgctgccacacttcaggct

SEQ ID NO: 4953351 - DNA, 11 bp, Homo sapiens
tgctgccatcc

SEQ ID NO: 4953352 - DNA, 20 bp, Homo sapiens
tgctgccgcctcccagcctg

SEQ ID NO: 4953353 - DNA, 21 bp, Homo sapiens
tgctgccgcctcccagcctgg

SEQ ID NO: 4953354 - DNA, 21 bp, Homo sapiens
tgctgcctgcccgcacagcag

SEQ ID NO: 4953355 - DNA, 13 bp, Homo sapiens
tgctgcctggcca

SEQ ID NO: 4953356 - DNA, 22 bp, Homo sapiens
tgctgccttctgacggccctgc

SEQ ID NO: 4953357 - DNA, 21 bp, Homo sapiens
tgctgccttttctttaacttt

SEQ ID NO: 4953358 - DNA, 20 bp, Homo sapiens
tgctgcgcccttaccttccc

SEQ ID NO: 4953359 - DNA, 12 bp, Homo sapiens
tgctgctagaac

SEQ ID NO: 4953360 - DNA, 15 bp, Homo sapiens
tgctgctagaacttt

SEQ ID NO: 4953361 - DNA, 17 bp, Homo sapiens
tgctgctagaacttttt

SEQ ID NO: 4953362 - DNA, 13 bp, Homo sapiens
tgctgctgcctgg

SEQ ID NO: 4953363 - DNA, 15 bp, Homo sapiens
tgctgctgcgccctt

SEQ ID NO: 4953364 - DNA, 20 bp, Homo sapiens
tgctgcttagacataacaaa

SEQ ID NO: 4953365 - DNA, 18 bp, Homo sapiens
tgctggaggtgggagcag

SEQ ID NO: 4953366 - DNA, 20 bp, Homo sapiens
tgctggatggagcccaggcg

SEQ ID NO: 4953367 - DNA, 21 bp, Homo sapiens
tgctggccagcctggggcctg

SEQ ID NO: 4953368 - DNA, 19 bp, Homo sapiens
tgctggctcacagtacagc

SEQ ID NO: 4953369 - DNA, 17 bp, Homo sapiens
tgctgggattacaggtg

SEQ ID NO: 4953370 - DNA, 20 bp, Homo sapiens
tgctgggattacaggtgtga

SEQ ID NO: 4953371 - DNA, 14 bp, Homo sapiens
tgctgggggaatga

SEQ ID NO: 4953372 - DNA, 20 bp, Homo sapiens
tgctgggggaatgagcccag

SEQ ID NO: 4953373 - DNA, 23 bp, Homo sapiens
tgctgggggaatgagcccagaga

SEQ ID NO: 4953374 - DNA, 16 bp, Homo sapiens
tgctggtcacagcctc

SEQ ID NO: 4953375 - DNA, 17 bp, Homo sapiens
tgctggtcacagcctcc

SEQ ID NO: 4953376 - DNA, 13 bp, Homo sapiens
tgctggttttcta

SEQ ID NO: 4953377 - DNA, 16 bp, Homo sapiens
tgctgtacatctattt

SEQ ID NO: 4953378 - DNA, 17 bp, Homo sapiens
tgctgtacatctatttt

SEQ ID NO: 4953379 - DNA, 17 bp, Homo sapiens
tgctgtccatgcttctc

SEQ ID NO: 4953380 - DNA, 16 bp, Homo sapiens
tgctgtccctccccct

SEQ ID NO: 4953381 - DNA, 14 bp, Homo sapiens
tgctgtctctgctc

SEQ ID NO: 4953382 - DNA, 15 bp, Homo sapiens
tgctgtctctgctcg

SEQ ID NO: 4953383 - DNA, 23 bp, Homo sapiens
tgctgtgagtctttggttctaag

SEQ ID NO: 4953384 - DNA, 13 bp, Homo sapiens
tgctgtggaagca

SEQ ID NO: 4953385 - DNA, 19 bp, Homo sapiens
tgctgttatgtctgtttaa

SEQ ID NO: 4953386 - DNA, 20 bp, Homo sapiens
tgctgttatgtctgtttaag

SEQ ID NO: 4953387 - DNA, 14 bp, Homo sapiens
tgctgttggtcatg

SEQ ID NO: 4953388 - DNA, 14 bp, Homo sapiens
tgcttagaaaagaa

SEQ ID NO: 4953389 - DNA, 17 bp, Homo sapiens
tgcttagagactatcaa

SEQ ID NO: 4953390 - DNA, 13 bp, Homo sapiens
tgcttagtaaaat

SEQ ID NO: 4953391 - DNA, 14 bp, Homo sapiens
tgcttagtaaaatt

SEQ ID NO: 4953392 - DNA, 20 bp, Homo sapiens
tgcttagtgtacttggagta

SEQ ID NO: 4953393 - DNA, 21 bp, Homo sapiens
tgcttatgacatcacttgtac

SEQ ID NO: 4953394 - DNA, 14 bp, Homo sapiens
tgcttattgcttag

SEQ ID NO: 4953395 - DNA, 16 bp, Homo sapiens
tgcttcaataaatctt

SEQ ID NO: 4953396 - DNA, 21 bp, Homo sapiens
tgcttcacagtagagccagct

SEQ ID NO: 4953397 - DNA, 20 bp, Homo sapiens
tgcttcagatattattgctt

SEQ ID NO: 4953398 - DNA, 13 bp, Homo sapiens
tgcttcagcctcc

SEQ ID NO: 4953399 - DNA, 15 bp, Homo sapiens
tgcttccaattttct

SEQ ID NO: 4953400 - DNA, 21 bp, Homo sapiens
tgcttcccacctccctgccca

SEQ ID NO: 4953401 - DNA, 19 bp, Homo sapiens
tgcttctcatcttgtgaaa

SEQ ID NO: 4953402 - DNA, 16 bp, Homo sapiens
tgcttctccccagaat

SEQ ID NO: 4953403 - DNA, 19 bp, Homo sapiens
tgcttctccccagaattca

SEQ ID NO: 4953404 - DNA, 16 bp, Homo sapiens
tgcttgagcccaggag

SEQ ID NO: 4953405 - DNA, 21 bp, Homo sapiens
tgcttgataggaattcatctt

SEQ ID NO: 4953406 - DNA, 14 bp, Homo sapiens
tgcttgatgaagca

SEQ ID NO: 4953407 - DNA, 18 bp, Homo sapiens
tgcttgatgaagcaagga

SEQ ID NO: 4953408 - DNA, 16 bp, Homo sapiens
tgcttgttccctctcc

SEQ ID NO: 4953409 - DNA, 19 bp, Homo sapiens
tgctttaaagggcctgcct

SEQ ID NO: 4953410 - DNA, 21 bp, Homo sapiens
tgctttaaagggcctgcctgg

SEQ ID NO: 4953411 - DNA, 16 bp, Homo sapiens
tgctttattgcttttt

SEQ ID NO: 4953412 - DNA, 19 bp, Homo sapiens
tgctttcgtgtaaattatg

SEQ ID NO: 4953413 - DNA, 19 bp, Homo sapiens
tgctttctatgctgtttgt

SEQ ID NO: 4953414 - DNA, 14 bp, Homo sapiens
tgctttgaagcagt

SEQ ID NO: 4953415 - DNA, 18 bp, Homo sapiens
tgctttgatttacagcaa

SEQ ID NO: 4953416 - DNA, 21 bp, Homo sapiens
tgctttgggctgccctggtgc

SEQ ID NO: 4953417 - DNA, 15 bp, Homo sapiens
tgctttttgaaatga

SEQ ID NO: 4953418 - DNA, 19 bp, Homo sapiens
tgcttttttttttccagca

SEQ ID NO: 4953419 - DNA, 13 bp, Homo sapiens
tggaaaaatcaca

SEQ ID NO: 4953420 - DNA, 19 bp, Homo sapiens
tggaaacctctacatattt

SEQ ID NO: 4953421 - DNA, 17 bp, Homo sapiens
tggaaacctgaaaaaaa

SEQ ID NO: 4953422 - DNA, 19 bp, Homo sapiens
tggaaagtaactcatttgt

SEQ ID NO: 4953423 - DNA, 13 bp, Homo sapiens
tggaaataaatgt

SEQ ID NO: 4953424 - DNA, 23 bp, Homo sapiens
tggaaatattcatgcttcttcct

SEQ ID NO: 4953425 - DNA, 21 bp, Homo sapiens
tggaaatattttgataataaa

SEQ ID NO: 4953426 - DNA, 17 bp, Homo sapiens
tggaaatggatgcaaag

SEQ ID NO: 4953427 - DNA, 19 bp, Homo sapiens
tggaaatggatgcaaagta

SEQ ID NO: 4953428 - DNA, 21 bp, Homo sapiens
tggaaattcaggtgaaaatgt

SEQ ID NO: 4953429 - DNA, 16 bp, Homo sapiens
tggaacagaatgtttt

SEQ ID NO: 4953430 - DNA, 21 bp, Homo sapiens
tggaacagaatgttttactgt

SEQ ID NO: 4953431 - DNA, 16 bp, Homo sapiens
tggaacctctgtctca

SEQ ID NO: 4953432 - DNA, 15 bp, Homo sapiens
tggaaccttgctgtc

SEQ ID NO: 4953433 - DNA, 18 bp, Homo sapiens
tggaaccttgctgtcctg

SEQ ID NO: 4953434 - DNA, 23 bp, Homo sapiens
tggaaccttgctgtcctgatctg

SEQ ID NO: 4953435 - DNA, 17 bp, Homo sapiens
tggaactaataaataca

SEQ ID NO: 4953436 - DNA, 23 bp, Homo sapiens
tggaactcagctgtctgtggctt

SEQ ID NO: 4953437 - DNA, 14 bp, Homo sapiens
tggaacttctaata

SEQ ID NO: 4953438 - DNA, 15 bp, Homo sapiens
tggaacttctaatat

SEQ ID NO: 4953439 - DNA, 18 bp, Homo sapiens
tggaacttctaatatatt

SEQ ID NO: 4953440 - DNA, 21 bp, Homo sapiens
tggaacttttattagataaca

SEQ ID NO: 4953441 - DNA, 21 bp, Homo sapiens
tggaagaaaaaaaccacacaa

SEQ ID NO: 4953442 - DNA, 15 bp, Homo sapiens
tggaagaaaatggtt

SEQ ID NO: 4953443 - DNA, 22 bp, Homo sapiens
tggaagaaaatggtttattttg

SEQ ID NO: 4953444 - DNA, 13 bp, Homo sapiens
tggaagagaaatc

SEQ ID NO: 4953445 - DNA, 14 bp, Homo sapiens
tggaagagaatcac

SEQ ID NO: 4953446 - DNA, 16 bp, Homo sapiens
tggaagagtgtgtgtg

SEQ ID NO: 4953447 - DNA, 13 bp, Homo sapiens
tggcaagagcccc

SEQ ID NO: 4953448 - DNA, 16 bp, Homo sapiens
tggcaaggaaaaacag

SEQ ID NO: 4953449 - DNA, 15 bp, Homo sapiens
tggcacaggactgat

SEQ ID NO: 4953450 - DNA, 15 bp, Homo sapiens
tggcacagggcagtg

SEQ ID NO: 4953451 - DNA, 18 bp, Homo sapiens
tggcacagggcagtggga

SEQ ID NO: 4953452 - DNA, 16 bp, Homo sapiens
tggcacccggcccctg

SEQ ID NO: 4953453 - DNA, 14 bp, Homo sapiens
tggcacttgcctgg

SEQ ID NO: 4953454 - DNA, 20 bp, Homo sapiens
tggcagaaaaaatgtctgta

SEQ ID NO: 4953455 - DNA, 19 bp, Homo sapiens
tggcagaataatctttggg

SEQ ID NO: 4953456 - DNA, 22 bp, Homo sapiens
tggcagagtttgtgtgttgtct

SEQ ID NO: 4953457 - DNA, 19 bp, Homo sapiens
tggcagataatcagcctct

SEQ ID NO: 4953458 - DNA, 20 bp, Homo sapiens
tggcagataatcagcctctt

SEQ ID NO: 4953459 - DNA, 20 bp, Homo sapiens
tggcagcagaaaacttgtgt

SEQ ID NO: 4953460 - DNA, 18 bp, Homo sapiens
tggcagccgtgccttcag

SEQ ID NO: 4953461 - DNA, 23 bp, Homo sapiens
tggcagccgtgccttcagctcta

SEQ ID NO: 4953462 - DNA, 17 bp, Homo sapiens
tggcagccttggcaaac

SEQ ID NO: 4953463 - DNA, 17 bp, Homo sapiens
tggcagctgcggtccac

SEQ ID NO: 4953464 - DNA, 22 bp, Homo sapiens
tggcagctgcggtccacccagg

SEQ ID NO: 4953465 - DNA, 19 bp, Homo sapiens
tggcagggaggtcaggccc

SEQ ID NO: 4953466 - DNA, 20 bp, Homo sapiens
tggcagggaggtcaggccct

SEQ ID NO: 4953467 - DNA, 17 bp, Homo sapiens
tggcagtgagtgagcct

SEQ ID NO: 4953468 - DNA, 14 bp, Homo sapiens
tggcagtgggagct

SEQ ID NO: 4953469 - DNA, 15 bp, Homo sapiens
tggcagtgggagctg

SEQ ID NO: 4953470 - DNA, 22 bp, Homo sapiens
tggcatcaagaggtgggagggc

SEQ ID NO: 4953471 - DNA, 20 bp, Homo sapiens
tggcatctttgccttgggct

SEQ ID NO: 4953472 - DNA, 21 bp, Homo sapiens
tggcatctttgccttgggctg

SEQ ID NO: 4953473 - DNA, 16 bp, Homo sapiens
tggcatggatttctgt

SEQ ID NO: 4953474 - DNA, 17 bp, Homo sapiens
tggcattagaattattt

SEQ ID NO: 4953475 - DNA, 23 bp, Homo sapiens
tggcattatgtccactgtgtata

SEQ ID NO: 4953476 - DNA, 18 bp, Homo sapiens
tggccaaaagcagtaaat

SEQ ID NO: 4953477 - DNA, 21 bp, Homo sapiens
tggccaaagccaaagctaggc

SEQ ID NO: 4953478 - DNA, 23 bp, Homo sapiens
tggccaaagccaaagctaggcct

SEQ ID NO: 4953479 - DNA, 15 bp, Homo sapiens
tggccacctctctcc

SEQ ID NO: 4953480 - DNA, 22 bp, Homo sapiens
tggccactcagcttcctaccca

SEQ ID NO: 4953481 - DNA, 22 bp, Homo sapiens
tggccactttaagagagaaatc

SEQ ID NO: 4953482 - DNA, 15 bp, Homo sapiens
tggccagagctggga

SEQ ID NO: 4953483 - DNA, 17 bp, Homo sapiens
tggccagagctgggagg

SEQ ID NO: 4953484 - DNA, 21 bp, Homo sapiens
tggccagccaacttttgcatg

SEQ ID NO: 4953485 - DNA, 15 bp, Homo sapiens
tggccagcctggggc

SEQ ID NO: 4953486 - DNA, 16 bp, Homo sapiens
tggccaggagctcttc

SEQ ID NO: 4953487 - DNA, 20 bp, Homo sapiens
tggccaggagctcttcaggc

SEQ ID NO: 4953488 - DNA, 22 bp, Homo sapiens
tggccaggagctcttcaggcct

SEQ ID NO: 4953489 - DNA, 16 bp, Homo sapiens
tggccaggcagatctg

SEQ ID NO: 4953490 - DNA, 23 bp, Homo sapiens
tggccaggcagatctgtgcccca

SEQ ID NO: 4953491 - DNA, 15 bp, Homo sapiens
tggccaggctggtct

SEQ ID NO: 4953492 - DNA, 11 bp, Homo sapiens
tggccaggtgg

SEQ ID NO: 4953493 - DNA, 17 bp, Homo sapiens
tggccaggtggccactc

SEQ ID NO: 4953494 - DNA, 19 bp, Homo sapiens
tggccaggtggccactcca

SEQ ID NO: 4953495 - DNA, 16 bp, Homo sapiens
tggccagttggaacca

SEQ ID NO: 4953496 - DNA, 15 bp, Homo sapiens
tggccatccctgtga

SEQ ID NO: 4953497 - DNA, 22 bp, Homo sapiens
tggcccagccaaaccctgtctg

SEQ ID NO: 4953498 - DNA, 20 bp, Homo sapiens
tggcccatagaaacatgaca

SEQ ID NO: 4953499 - DNA, 21 bp, Homo sapiens
tggcccctcaaatcgtccagc

SEQ ID NO: 4953500 - DNA, 12 bp, Homo sapiens
tggcccctcaac

SEQ ID NO: 4953501 - DNA, 13 bp, Homo sapiens
tggcccctcgcct

SEQ ID NO: 4953502 - DNA, 17 bp, Homo sapiens
tggcccctcgcctgtgg

SEQ ID NO: 4953503 - DNA, 10 bp, Homo sapiens
tggcccctct

SEQ ID NO: 4953504 - DNA, 20 bp, Homo sapiens
tggcccctgaacaagaattg

SEQ ID NO: 4953505 - DNA, 14 bp, Homo sapiens
tggcccctgcccgg

SEQ ID NO: 4953506 - DNA, 12 bp, Homo sapiens
tggcccctgggt

SEQ ID NO: 4953507 - DNA, 14 bp, Homo sapiens
tggcccgacagcct

SEQ ID NO: 4953508 - DNA, 15 bp, Homo sapiens
tggcccgacagcctg

SEQ ID NO: 4953509 - DNA, 16 bp, Homo sapiens
tggcccgacagcctgg

SEQ ID NO: 4953510 - DNA, 17 bp, Homo sapiens
tggcccgacagcctggc

SEQ ID NO: 4953511 - DNA, 18 bp, Homo sapiens
tggccctctcccttaccc

SEQ ID NO: 4953512 - DNA, 17 bp, Homo sapiens
tggccctggctctgctg

SEQ ID NO: 4953513 - DNA, 17 bp, Homo sapiens
tggccctgtccctccca

SEQ ID NO: 4953514 - DNA, 21 bp, Homo sapiens
tggccctgtccctcccacctc

SEQ ID NO: 4953515 - DNA, 22 bp, Homo sapiens
tggccctgtccctcccacctct

SEQ ID NO: 4953516 - DNA, 23 bp, Homo sapiens
tggcccttgcagttcagcaccac

SEQ ID NO: 4953517 - DNA, 18 bp, Homo sapiens
tggccgagggtcctggct

SEQ ID NO: 4953518 - DNA, 20 bp, Homo sapiens
tggccgagggtcctggctcc

SEQ ID NO: 4953519 - DNA, 13 bp, Homo sapiens
tggccgccccctg

SEQ ID NO: 4953520 - DNA, 21 bp, Homo sapiens
tggccgccccctgccccccag

SEQ ID NO: 4953521 - DNA, 23 bp, Homo sapiens
tggccgccccctgccccccagcc

SEQ ID NO: 4953522 - DNA, 17 bp, Homo sapiens
tggccggctgtgctcag

SEQ ID NO: 4953523 - DNA, 17 bp, Homo sapiens
tggcctaaaatcttgga

SEQ ID NO: 4953524 - DNA, 17 bp, Homo sapiens
tggcctagcccaccctg

SEQ ID NO: 4953525 - DNA, 14 bp, Homo sapiens
tggcctatgcacat

SEQ ID NO: 4953526 - DNA, 15 bp, Homo sapiens
tggcctatgcacata

SEQ ID NO: 4953527 - DNA, 17 bp, Homo sapiens
tggcctatgcacatatg

SEQ ID NO: 4953528 - DNA, 22 bp, Homo sapiens
tggcctcagctgaatgcctcct

SEQ ID NO: 4953529 - DNA, 13 bp, Homo sapiens
tggcctctctagc

SEQ ID NO: 4953530 - DNA, 16 bp, Homo sapiens
tggcctctggctctca

SEQ ID NO: 4953531 - DNA, 12 bp, Homo sapiens
tggcctggcaca

SEQ ID NO: 4953532 - DNA, 18 bp, Homo sapiens
tggcctggccaggagctc

SEQ ID NO: 4953533 - DNA, 18 bp, Homo sapiens
tggcctgtctcatcccca

SEQ ID NO: 4953534 - DNA, 20 bp, Homo sapiens
tggcctgtctcatccccagg

SEQ ID NO: 4953535 - DNA, 18 bp, Homo sapiens
tggccttccatttatatg

SEQ ID NO: 4953536 - DNA, 15 bp, Homo sapiens
tggcgtggagcaggc

SEQ ID NO: 4953537 - DNA, 22 bp, Homo sapiens
tggctaaagataattgctattt

SEQ ID NO: 4953538 - DNA, 23 bp, Homo sapiens
tggctactttggtttctgtctgt

SEQ ID NO: 4953539 - DNA, 15 bp, Homo sapiens
tggctagagtcctca

SEQ ID NO: 4953540 - DNA, 16 bp, Homo sapiens
tggctcaatcctctaa

SEQ ID NO: 4953541 - DNA, 24 bp, Homo sapiens
tggctcagctcggggagccttagc

SEQ ID NO: 4953542 - DNA, 15 bp, Homo sapiens
tggctccatgctcct

SEQ ID NO: 4953543 - DNA, 23 bp, Homo sapiens
tggctcccatgaccatactgagg

SEQ ID NO: 4953544 - DNA, 19 bp, Homo sapiens
tggctcctcccggtgccca

SEQ ID NO: 4953545 - DNA, 14 bp, Homo sapiens
tggctcctgagggg

SEQ ID NO: 4953546 - DNA, 19 bp, Homo sapiens
tggctccttcccatcgctg

SEQ ID NO: 4953547 - DNA, 21 bp, Homo sapiens
tggctctcagttaaaatgtga

SEQ ID NO: 4953548 - DNA, 19 bp, Homo sapiens
tggctctcattgacttcct

SEQ ID NO: 4953549 - DNA, 17 bp, Homo sapiens
tggctctcccatttcct

SEQ ID NO: 4953550 - DNA, 20 bp, Homo sapiens
tggctctgaggtgcctgtcc

SEQ ID NO: 4953551 - DNA, 21 bp, Homo sapiens
tggctctgaggtgcctgtccc

SEQ ID NO: 4953552 - DNA, 14 bp, Homo sapiens
tggctctgcaatgg

SEQ ID NO: 4953553 - DNA, 19 bp, Homo sapiens
tggctctgctgtccccttg

SEQ ID NO: 4953554 - DNA, 21 bp, Homo sapiens
tggctctggagacagccccag

SEQ ID NO: 4953555 - DNA, 22 bp, Homo sapiens
tggctctggagacagccccaga

SEQ ID NO: 4953556 - DNA, 13 bp, Homo sapiens
tgccccggccacc

SEQ ID NO: 4953557 - DNA, 14 bp, Homo sapiens
tgccccggccacct

SEQ ID NO: 4953558 - DNA, 15 bp, Homo sapiens
tgccccggccacctc

SEQ ID NO: 4953559 - DNA, 16 bp, Homo sapiens
tgccccggccacctct

SEQ ID NO: 4953560 - DNA, 21 bp, Homo sapiens
tgcccctcccccaacccccac

SEQ ID NO: 4953561 - DNA, 12 bp, Homo sapiens
tgcccctctcac

SEQ ID NO: 4953562 - DNA, 20 bp, Homo sapiens
tgcccctctccttcttagct

SEQ ID NO: 4953563 - DNA, 17 bp, Homo sapiens
tgcccctctttctcttt

SEQ ID NO: 4953564 - DNA, 22 bp, Homo sapiens
tgcccctctttctctttcttcc

SEQ ID NO: 4953565 - DNA, 22 bp, Homo sapiens
tgcccgcacaccctcactctgc

SEQ ID NO: 4953566 - DNA, 14 bp, Homo sapiens
tgcccgcacagcag

SEQ ID NO: 4953567 - DNA, 20 bp, Homo sapiens
tgcccggctaatttttgtaa

SEQ ID NO: 4953568 - DNA, 12 bp, Homo sapiens
tgcccggctgcg

SEQ ID NO: 4953569 - DNA, 17 bp, Homo sapiens
tgcccgttcttgaaatg

SEQ ID NO: 4953570 - DNA, 17 bp, Homo sapiens
tgccctcatggcccctc

SEQ ID NO: 4953571 - DNA, 19 bp, Homo sapiens
tgccctcatggcccctctg

SEQ ID NO: 4953572 - DNA, 16 bp, Homo sapiens
tgccctctccttcctt

SEQ ID NO: 4953573 - DNA, 15 bp, Homo sapiens
tgccctgagaagctg

SEQ ID NO: 4953574 - DNA, 20 bp, Homo sapiens
tgccctgagaagctgctcca

SEQ ID NO: 4953575 - DNA, 14 bp, Homo sapiens
tgccctgaggaagg

SEQ ID NO: 4953576 - DNA, 22 bp, Homo sapiens
tgccctggcagggtcatcctgt

SEQ ID NO: 4953577 - DNA, 13 bp, Homo sapiens
tgccctgggccac

SEQ ID NO: 4953578 - DNA, 18 bp, Homo sapiens
tgccctggtccagggaag

SEQ ID NO: 4953579 - DNA, 17 bp, Homo sapiens
tgccctggtgctgccac

SEQ ID NO: 4953580 - DNA, 18 bp, Homo sapiens
tgccctggtgctgccaca

SEQ ID NO: 4953581 - DNA, 15 bp, Homo sapiens
tgcccttcaccccag

SEQ ID NO: 4953582 - DNA, 13 bp, Homo sapiens
tgcccttgggcca

SEQ ID NO: 4953583 - DNA, 19 bp, Homo sapiens
tgccgacccctagttccct

SEQ ID NO: 4953584 - DNA, 14 bp, Homo sapiens
tgccgcctcccagc

SEQ ID NO: 4953585 - DNA, 17 bp, Homo sapiens
tgccgcctcccagcctg

SEQ ID NO: 4953586 - DNA, 20 bp, Homo sapiens
tgccgcctgcactcctcagg

SEQ ID NO: 4953587 - DNA, 20 bp, Homo sapiens
tgcctaaatttaatgctgcc

SEQ ID NO: 4953588 - DNA, 21 bp, Homo sapiens
tgcctaaatttaatgctgcct

SEQ ID NO: 4953589 - DNA, 22 bp, Homo sapiens
tgcctaagcattgcctggcctt

SEQ ID NO: 4953590 - DNA, 13 bp, Homo sapiens
tgcctaagtatta

SEQ ID NO: 4953591 - DNA, 15 bp, Homo sapiens
tgcctaagtattaaa

SEQ ID NO: 4953592 - DNA, 17 bp, Homo sapiens
tgcctaagtattaaaac

SEQ ID NO: 4953593 - DNA, 21 bp, Homo sapiens
tgcctaataaacatccttcaa

SEQ ID NO: 4953594 - DNA, 22 bp, Homo sapiens
tgcctcaccgcttccctcctgc

SEQ ID NO: 4953595 - DNA, 12 bp, Homo sapiens
tgcctcctcacc

SEQ ID NO: 4953596 - DNA, 18 bp, Homo sapiens
tgcctcctgtggggaaag

SEQ ID NO: 4953597 - DNA, 17 bp, Homo sapiens
tgcctcctgtgtactgt

SEQ ID NO: 4953598 - DNA, 18 bp, Homo sapiens
tgcctcctgtgtactgtg

SEQ ID NO: 4953599 - DNA, 21 bp, Homo sapiens
tgcctcctgtgtactgtgtca

SEQ ID NO: 4953600 - DNA, 21 bp, Homo sapiens
tgcctcgaaacacagaaacct

SEQ ID NO: 4953601 - DNA, 20 bp, Homo sapiens
tgcctcgaactggctgcaaa

SEQ ID NO: 4953602 - DNA, 15 bp, Homo sapiens
tgcctctcacacaca

SEQ ID NO: 4953603 - DNA, 12 bp, Homo sapiens
tgcctctctagg

SEQ ID NO: 4953604 - DNA, 21 bp, Homo sapiens
tgcctctgacacacagctctg

SEQ ID NO: 4953605 - DNA, 20 bp, Homo sapiens
tgcctctgatatgggactga

SEQ ID NO: 4953606 - DNA, 16 bp, Homo sapiens
tgcctctgccacactc

SEQ ID NO: 4953607 - DNA, 11 bp, Homo sapiens
tgcctctgcct

SEQ ID NO: 4953608 - DNA, 15 bp, Homo sapiens
tgcctctgcctctga

SEQ ID NO: 4953609 - DNA, 18 bp, Homo sapiens
tgcctctgcctgtctccc

SEQ ID NO: 4953610 - DNA, 14 bp, Homo sapiens
tgcctctgccttag

SEQ ID NO: 4953611 - DNA, 17 bp, Homo sapiens
tgcctgaagtcacacag

SEQ ID NO: 4953612 - DNA, 18 bp, Homo sapiens
tgcctgaagtcacacagt

SEQ ID NO: 4953613 - DNA, 21 bp, Homo sapiens
tgcctgccatgtacctcccct

SEQ ID NO: 4953614 - DNA, 19 bp, Homo sapiens
tgcctgcccaggcccctgc

SEQ ID NO: 4953615 - DNA, 22 bp, Homo sapiens
tgcctgcccaggcccctgccac

SEQ ID NO: 4953616 - DNA, 23 bp, Homo sapiens
tgcctgcccaggcccctgccacc

SEQ ID NO: 4953617 - DNA, 15 bp, Homo sapiens
tgcctgcgtcttccg

SEQ ID NO: 4953618 - DNA, 16 bp, Homo sapiens
tgcctgcgtcttccgc

SEQ ID NO: 4953619 - DNA, 19 bp, Homo sapiens
tgcctgcgtcttccgcccc

SEQ ID NO: 4953620 - DNA, 14 bp, Homo sapiens
tgcctggccaggca

SEQ ID NO: 4953621 - DNA, 22 bp, Homo sapiens
tgcctggcctggcacacatcag

SEQ ID NO: 4953622 - DNA, 22 bp, Homo sapiens
tgcctgggttccaatcctggct

SEQ ID NO: 4953623 - DNA, 17 bp, Homo sapiens
tgcctggtcacagggca

SEQ ID NO: 4953624 - DNA, 22 bp, Homo sapiens
tgcctggtcacagggcatgccc

SEQ ID NO: 4953625 - DNA, 20 bp, Homo sapiens
tgcctggtgcttccaaatat

SEQ ID NO: 4953626 - DNA, 16 bp, Homo sapiens
tgcctggtggcagctg

SEQ ID NO: 4953627 - DNA, 15 bp, Homo sapiens
tgcctgtaaacatag

SEQ ID NO: 4953628 - DNA, 15 bp, Homo sapiens
tgcctgtagttagga

SEQ ID NO: 4953629 - DNA, 16 bp, Homo sapiens
tgcctgtagttaggaa

SEQ ID NO: 4953630 - DNA, 18 bp, Homo sapiens
tgcctgtagttaggaaat

SEQ ID NO: 4953631 - DNA, 23 bp, Homo sapiens
tgcctgtagttaggaaataaaac

SEQ ID NO: 4953632 - DNA, 15 bp, Homo sapiens
tgcctgtccagcctg

SEQ ID NO: 4953633 - DNA, 15 bp, Homo sapiens
tgcctgtgtatggaa

SEQ ID NO: 4953634 - DNA, 14 bp, Homo sapiens
tgccttaaaatgga

SEQ ID NO: 4953635 - DNA, 15 bp, Homo sapiens
tgccttaaagaaagt

SEQ ID NO: 4953636 - DNA, 23 bp, Homo sapiens
tgccttaataagaatggttgcct

SEQ ID NO: 4953637 - DNA, 14 bp, Homo sapiens
tgccttagaacctt

SEQ ID NO: 4953638 - DNA, 17 bp, Homo sapiens
tgccttaggcctacctg

SEQ ID NO: 4953639 - DNA, 20 bp, Homo sapiens
tgccttagtctcagtttgtg

SEQ ID NO: 4953640 - DNA, 20 bp, Homo sapiens
tgccttcctttctccaggac

SEQ ID NO: 4953641 - DNA, 18 bp, Homo sapiens
tgccttctgacggccctg

SEQ ID NO: 4953642 - DNA, 20 bp, Homo sapiens
tgccttctgacggccctgca

SEQ ID NO: 4953643 - DNA, 12 bp, Homo sapiens
tgccttctttga

SEQ ID NO: 4953644 - DNA, 17 bp, Homo sapiens
tgccttctttgaagaag

SEQ ID NO: 4953645 - DNA, 17 bp, Homo sapiens
tgccttgaacctgtgag

SEQ ID NO: 4953646 - DNA, 18 bp, Homo sapiens
tgccttgaacctgtgagt

SEQ ID NO: 4953647 - DNA, 14 bp, Homo sapiens
tgccttgcagaact

SEQ ID NO: 4953648 - DNA, 15 bp, Homo sapiens
tgccttgcagaactg

SEQ ID NO: 4953649 - DNA, 22 bp, Homo sapiens
tgccttgctgttggtcatgtgg

SEQ ID NO: 4953650 - DNA, 17 bp, Homo sapiens
tgccttggctcagacat

SEQ ID NO: 4953651 - DNA, 19 bp, Homo sapiens
tgccttggctcagacatgt

SEQ ID NO: 4953652 - DNA, 16 bp, Homo sapiens
tgccttgggctgctcc

SEQ ID NO: 4953653 - DNA, 15 bp, Homo sapiens
tgcctttctgcagtt

SEQ ID NO: 4953654 - DNA, 22 bp, Homo sapiens
tgcctttctgcagtttttcagg

SEQ ID NO: 4953655 - DNA, 12 bp, Homo sapiens
tgcctttgagac

SEQ ID NO: 4953656 - DNA, 17 bp, Homo sapiens
tgcctttgagacagttt

SEQ ID NO: 4953657 - DNA, 16 bp, Homo sapiens
tgcctttgcaaatcag

SEQ ID NO: 4953658 - DNA, 17 bp, Homo sapiens
tgccttttatagctatt

SEQ ID NO: 4953659 - DNA, 22 bp, Homo sapiens
tgccttttatagctattactgt

SEQ ID NO: 4953660 - DNA, 19 bp, Homo sapiens
tgcctttttatttatatgt

SEQ ID NO: 4953661 - DNA, 21 bp, Homo sapiens
tgcctttttcattttccaata

SEQ ID NO: 4953662 - DNA, 19 bp, Homo sapiens
tgccttttttgtagttttt

SEQ ID NO: 4953663 - DNA, 21 bp, Homo sapiens
tgcgaatggactttggaagca

SEQ ID NO: 4953664 - DNA, 14 bp, Homo sapiens
tgcgatagagtctc

SEQ ID NO: 4953665 - DNA, 14 bp, Homo sapiens
tgcgatctgggttc

SEQ ID NO: 4953666 - DNA, 16 bp, Homo sapiens
tgcgcagaaaacaaga

SEQ ID NO: 4953667 - DNA, 13 bp, Homo sapiens
tcctctccactgc

SEQ ID NO: 4953668 - DNA, 18 bp, Homo sapiens
tcctctccactgccttcg

SEQ ID NO: 4953669 - DNA, 14 bp, Homo sapiens
tcctctcccctcca

SEQ ID NO: 4953670 - DNA, 16 bp, Homo sapiens
tcctctcccctccagc

SEQ ID NO: 4953671 - DNA, 17 bp, Homo sapiens
tcctctcccctccagcc

SEQ ID NO: 4953672 - DNA, 18 bp, Homo sapiens
tcctctcccctccagcct

SEQ ID NO: 4953673 - DNA, 13 bp, Homo sapiens
tcctctcctggag

SEQ ID NO: 4953674 - DNA, 17 bp, Homo sapiens
tcctctcctttgaaacc

SEQ ID NO: 4953675 - DNA, 17 bp, Homo sapiens
tcctctctggtggctct

SEQ ID NO: 4953676 - DNA, 17 bp, Homo sapiens
tcctctgtcctgcttct

SEQ ID NO: 4953677 - DNA, 16 bp, Homo sapiens
tcctcttcggccctca

SEQ ID NO: 4953678 - DNA, 18 bp, Homo sapiens
tcctcttcggccctcaga

SEQ ID NO: 4953679 - DNA, 16 bp, Homo sapiens
tctggctgtaaggctc

SEQ ID NO: 4953680 - DNA, 21 bp, Homo sapiens
tcttgttttttttttccactt

SEQ ID NO: 4953681 - DNA, 14 bp, Homo sapiens
tctttaaaacaaaa

SEQ ID NO: 4953682 - DNA, 13 bp, Homo sapiens
tctttaaagatgt

SEQ ID NO: 4953683 - DNA, 15 bp, Homo sapiens
tctttaaaggcccag

SEQ ID NO: 4953684 - DNA, 18 bp, Homo sapiens
tctttaaaggcccagccc

SEQ ID NO: 4953685 - DNA, 12 bp, Homo sapiens
tctttaaatgtt

SEQ ID NO: 4953686 - DNA, 19 bp, Homo sapiens
tctttaatgtcacaggcag

SEQ ID NO: 4953687 - DNA, 18 bp, Homo sapiens
tctttcaacttgcatcca

SEQ ID NO: 4953688 - DNA, 14 bp, Homo sapiens
tctttcacagctcc

SEQ ID NO: 4953689 - DNA, 15 bp, Homo sapiens
tctttcacagctcct

SEQ ID NO: 4953690 - DNA, 22 bp, Homo sapiens
tctttcacattgtttgctgcta

SEQ ID NO: 4953691 - DNA, 17 bp, Homo sapiens
tctttcagctatcagta

SEQ ID NO: 4953692 - DNA, 22 bp, Homo sapiens
tctttcccaccctgttcccagt

SEQ ID NO: 4953693 - DNA, 11 bp, Homo sapiens
tctttcctgtc

SEQ ID NO: 4953694 - DNA, 14 bp, Homo sapiens
tctttcgtcaccct

SEQ ID NO: 4953695 - DNA, 15 bp, Homo sapiens
tctttctagtggtct

SEQ ID NO: 4953696 - DNA, 20 bp, Homo sapiens
tctttctagtggtctttgta

SEQ ID NO: 4953697 - DNA, 14 bp, Homo sapiens
tctttctctcagcc

SEQ ID NO: 4953698 - DNA, 12 bp, Homo sapiens
tctttctctttt

SEQ ID NO: 4953699 - DNA, 19 bp, Homo sapiens
tctttctgagcacacttta

SEQ ID NO: 4953700 - DNA, 15 bp, Homo sapiens
tctttcttcctttac

SEQ ID NO: 4953701 - DNA, 13 bp, Homo sapiens
tctttctttaaat

SEQ ID NO: 4953702 - DNA, 23 bp, Homo sapiens
tctttgaagaaggtggacctttt

SEQ ID NO: 4953703 - DNA, 21 bp, Homo sapiens
tctttgagggactgcctctgc

SEQ ID NO: 4953704 - DNA, 14 bp, Homo sapiens
tctttgataatgtt

SEQ ID NO: 4953705 - DNA, 21 bp, Homo sapiens
tctttgattctccttttatgt

SEQ ID NO: 4953706 - DNA, 14 bp, Homo sapiens
tctttgcagacagg

SEQ ID NO: 4953707 - DNA, 12 bp, Homo sapiens
tctttgcctggt

SEQ ID NO: 4953708 - DNA, 22 bp, Homo sapiens
tctttggctcccctgtaccttt

SEQ ID NO: 4953709 - DNA, 23 bp, Homo sapiens
tctttggggtctacactgcaatc

SEQ ID NO: 4953710 - DNA, 15 bp, Homo sapiens
tctttggttctaagg

SEQ ID NO: 4953711 - DNA, 16 bp, Homo sapiens
tctttggttctaagga

SEQ ID NO: 4953712 - DNA, 22 bp, Homo sapiens
tctttgtaagagtgtagaagca

SEQ ID NO: 4953713 - DNA, 23 bp, Homo sapiens
tctttgtaagagtgtagaagcat

SEQ ID NO: 4953714 - DNA, 12 bp, Homo sapiens
tctttgtaagtc

SEQ ID NO: 4953715 - DNA, 16 bp, Homo sapiens
tctttgtatcttccat

SEQ ID NO: 4953716 - DNA, 22 bp, Homo sapiens
tctttgtggggcttggcgtgga

SEQ ID NO: 4953717 - DNA, 15 bp, Homo sapiens
tctttgtgtagcttt

SEQ ID NO: 4953718 - DNA, 12 bp, Homo sapiens
tcttttatctgt

SEQ ID NO: 4953719 - DNA, 15 bp, Homo sapiens
tcttttatgtttgaa

SEQ ID NO: 4953720 - DNA, 16 bp, Homo sapiens
tcttttcattctcatt

SEQ ID NO: 4953721 - DNA, 14 bp, Homo sapiens
tcttttctagtttg

SEQ ID NO: 4953722 - DNA, 14 bp, Homo sapiens
tcttttctcatgtg

SEQ ID NO: 4953723 - DNA, 18 bp, Homo sapiens
tcttttctgtacttcctg

SEQ ID NO: 4953724 - DNA, 17 bp, Homo sapiens
tcttttcttactcctcc

SEQ ID NO: 4953725 - DNA, 18 bp, Homo sapiens
tcttttcttactcctcct

SEQ ID NO: 4953726 - DNA, 23 bp, Homo sapiens
tcttttgaatattcccaagccca

SEQ ID NO: 4953727 - DNA, 16 bp, Homo sapiens
tcttttgattatgttt

SEQ ID NO: 4953728 - DNA, 19 bp, Homo sapiens
tcttttgctactaagttca

SEQ ID NO: 4953729 - DNA, 18 bp, Homo sapiens
tcttttgtaagtgctaca

SEQ ID NO: 4953730 - DNA, 11 bp, Homo sapiens
tcttttgttac

SEQ ID NO: 4953731 - DNA, 15 bp, Homo sapiens
tcttttgttactgtt

SEQ ID NO: 4953732 - DNA, 23 bp, Homo sapiens
tctttttaaagtgtttctgttat

SEQ ID NO: 4953733 - DNA, 15 bp, Homo sapiens
tctttttaagtaatg

SEQ ID NO: 4953734 - DNA, 19 bp, Homo sapiens
tcttttttaataaactact

SEQ ID NO: 4953735 - DNA, 13 bp, Homo sapiens
tcttttttcaaaa

SEQ ID NO: 4953736 - DNA, 22 bp, Homo sapiens
tcttttttgtttgtttctttgt

SEQ ID NO: 4953737 - DNA, 23 bp, Homo sapiens
tcttttttgtttgtttctttgtg

SEQ ID NO: 4953738 - DNA, 15 bp, Homo sapiens
tgaaaaaaacttcat

SEQ ID NO: 4953739 - DNA, 17 bp, Homo sapiens
tgaaaaaaagtttacaa

SEQ ID NO: 4953740 - DNA, 11 bp, Homo sapiens
tgaaaaaagct

SEQ ID NO: 4953741 - DNA, 20 bp, Homo sapiens
tgaaaaaagctcatttcatg

SEQ ID NO: 4953742 - DNA, 15 bp, Homo sapiens
tgaaaaagatgccaa

SEQ ID NO: 4953743 - DNA, 20 bp, Homo sapiens
tgaaaaccatctggcctggc

SEQ ID NO: 4953744 - DNA, 22 bp, Homo sapiens
tgaaaaccatctggcctggcct

SEQ ID NO: 4953745 - DNA, 12 bp, Homo sapiens
tgaaaagatgta

SEQ ID NO: 4953746 - DNA, 13 bp, Homo sapiens
tgaaaagatgtac

SEQ ID NO: 4953747 - DNA, 17 bp, Homo sapiens
tgaaaagctattagcca

SEQ ID NO: 4953748 - DNA, 20 bp, Homo sapiens
tgaaaagctattagccagga

SEQ ID NO: 4953749 - DNA, 23 bp, Homo sapiens
tgaaaagctattagccaggatca

SEQ ID NO: 4953750 - DNA, 15 bp, Homo sapiens
tgaaaagcttcttaa

SEQ ID NO: 4953751 - DNA, 19 bp, Homo sapiens
tgaaaagcttcttaattaa

SEQ ID NO: 4953752 - DNA, 16 bp, Homo sapiens
tgaaaatcgtgacaac

SEQ ID NO: 4953753 - DNA, 14 bp, Homo sapiens
tgaaaatctaatat

SEQ ID NO: 4953754 - DNA, 19 bp, Homo sapiens
tgaaaatgaatatctatta

SEQ ID NO: 4953755 - DNA, 17 bp, Homo sapiens
tgaaaattcaaaaagtg

SEQ ID NO: 4953756 - DNA, 20 bp, Homo sapiens
tgaaaattcgcccgagctgt

SEQ ID NO: 4953757 - DNA, 20 bp, Homo sapiens
tgaaaattttaaaaatacat

SEQ ID NO: 4953758 - DNA, 14 bp, Homo sapiens
tgaaacacagctgt

SEQ ID NO: 4953759 - DNA, 18 bp, Homo sapiens
tgaaacacagctgttctt

SEQ ID NO: 4953760 - DNA, 21 bp, Homo sapiens
tgaaacacagctgttcttctg

SEQ ID NO: 4953761 - DNA, 19 bp, Homo sapiens
tgaaacacgaaacttgtta

SEQ ID NO: 4953762 - DNA, 15 bp, Homo sapiens
tgaaacactttgcct

SEQ ID NO: 4953763 - DNA, 16 bp, Homo sapiens
tgaaacagaaacaaaa

SEQ ID NO: 4953764 - DNA, 17 bp, Homo sapiens
tgaaaccttttttaaga

SEQ ID NO: 4953765 - DNA, 18 bp, Homo sapiens
tgaaaccttttttaagat

SEQ ID NO: 4953766 - DNA, 19 bp, Homo sapiens
tgaaaccttttttaagatt

SEQ ID NO: 4953767 - DNA, 17 bp, Homo sapiens
tgaaactcacaaatgat

SEQ ID NO: 4953768 - DNA, 22 bp, Homo sapiens
tgaaagaatatatttatttaaa

SEQ ID NO: 4953769 - DNA, 18 bp, Homo sapiens
tgaaagatggctgtgcct

SEQ ID NO: 4953770 - DNA, 21 bp, Homo sapiens
tgaaagatggctgtgcctctg

SEQ ID NO: 4953771 - DNA, 22 bp, Homo sapiens
tgaaagatggctgtgcctctgc

SEQ ID NO: 4953772 - DNA, 12 bp, Homo sapiens
tgaaagattaaa

SEQ ID NO: 4953773 - DNA, 13 bp, Homo sapiens
tgaaagattaaac

SEQ ID NO: 4953774 - DNA, 15 bp, Homo sapiens
tgaaagattaaacag

SEQ ID NO: 4953775 - DNA, 22 bp, Homo sapiens
tgaaagattgtgggggaaaaat

SEQ ID NO: 4953776 - DNA, 19 bp, Homo sapiens
tgaaagcagggaatttcta

SEQ ID NO: 4953777 - DNA, 19 bp, Homo sapiens
tgaaagctgagaactcctg

SEQ ID NO: 4953778 - DNA, 21 bp, Homo sapiens
tgaaagctgagaactcctgac

SEQ ID NO: 4953779 - DNA, 20 bp, Homo sapiens
tgaaagggagctatcaggaa

SEQ ID NO: 4953780 - DNA, 22 bp, Homo sapiens
tgaaagggagctatcaggaaca

SEQ ID NO: 4953781 - DNA, 18 bp, Homo sapiens
tgaaaggtactatatttg

SEQ ID NO: 4953782 - DNA, 15 bp, Homo sapiens
tgaaaggtttacatt

SEQ ID NO: 4953783 - DNA, 18 bp, Homo sapiens
tgaaagtgaataaacttc

SEQ ID NO: 4953784 - DNA, 22 bp, Homo sapiens
tgaaagttacccactgaagccc

SEQ ID NO: 4953785 - DNA, 18 bp, Homo sapiens
tgaaagttttcagaacct

SEQ ID NO: 4953786 - DNA, 20 bp, Homo sapiens
tgaaataaagaaattgcaat

SEQ ID NO: 4953787 - DNA, 18 bp, Homo sapiens
tgaaataacaaaatggac

SEQ ID NO: 4953788 - DNA, 20 bp, Homo sapiens
tgaaataacaaaatggacat

SEQ ID NO: 4953789 - DNA, 12 bp, Homo sapiens
tgaaatacctca

SEQ ID NO: 4953790 - DNA, 22 bp, Homo sapiens
tgaatggattggattatttaat

SEQ ID NO: 4953791 - DNA, 17 bp, Homo sapiens
tgaatgtatttatttgg

SEQ ID NO: 4953792 - DNA, 23 bp, Homo sapiens
tgaatgtatttatttgggagacc

SEQ ID NO: 4953793 - DNA, 18 bp, Homo sapiens
tgaatgtctaaaattgtt

SEQ ID NO: 4953794 - DNA, 15 bp, Homo sapiens
tgaatgtgggcactg

SEQ ID NO: 4953795 - DNA, 15 bp, Homo sapiens
tgaatgttatttgtt

SEQ ID NO: 4953796 - DNA, 19 bp, Homo sapiens
tgaatgtttattccttgat

SEQ ID NO: 4953797 - DNA, 14 bp, Homo sapiens
tgaattaaaacttc

SEQ ID NO: 4953798 - DNA, 23 bp, Homo sapiens
tgaattaaaattgtcccatttgc

SEQ ID NO: 4953799 - DNA, 13 bp, Homo sapiens
tgaattgactacc

SEQ ID NO: 4953800 - DNA, 12 bp, Homo sapiens
tgaatttaaata

SEQ ID NO: 4953801 - DNA, 23 bp, Homo sapiens
tgaatttcttcactgttgaaaat

SEQ ID NO: 4953802 - DNA, 20 bp, Homo sapiens
tgaatttggcctgcactaat

SEQ ID NO: 4953803 - DNA, 17 bp, Homo sapiens
tgaattttaaatctaaa

SEQ ID NO: 4953804 - DNA, 16 bp, Homo sapiens
tgaattttgttgctgt

SEQ ID NO: 4953805 - DNA, 20 bp, Homo sapiens
tgaatttttttttcctagcc

SEQ ID NO: 4953806 - DNA, 10 bp, Homo sapiens
tgacaaaatt

SEQ ID NO: 4953807 - DNA, 22 bp, Homo sapiens
tgacaaactgtgtacatagcgg

SEQ ID NO: 4953808 - DNA, 18 bp, Homo sapiens
tgacaaagatggctcaga

SEQ ID NO: 4953809 - DNA, 15 bp, Homo sapiens
tgacaaatctgtgta

SEQ ID NO: 4953810 - DNA, 13 bp, Homo sapiens
tgacaacagaagc

SEQ ID NO: 4953811 - DNA, 22 bp, Homo sapiens
tgacaacagaagcttcagaagt

SEQ ID NO: 4953812 - DNA, 21 bp, Homo sapiens
tgacaacctccattctatttt

SEQ ID NO: 4953813 - DNA, 13 bp, Homo sapiens
tgacaactgtgac

SEQ ID NO: 4953814 - DNA, 15 bp, Homo sapiens
tgacaactgtgactg

SEQ ID NO: 4953815 - DNA, 16 bp, Homo sapiens
tgacaactgtgactgt

SEQ ID NO: 4953816 - DNA, 11 bp, Homo sapiens
tgacaagagcc

SEQ ID NO: 4953817 - DNA, 14 bp, Homo sapiens
tgacaagagcctga

SEQ ID NO: 4953818 - DNA, 23 bp, Homo sapiens
tgacaagagcctgatctcttcct

SEQ ID NO: 4953819 - DNA, 19 bp, Homo sapiens
tgacaataatattgttgta

SEQ ID NO: 4953820 - DNA, 20 bp, Homo sapiens
tgacacaagaggaataagaa

SEQ ID NO: 4953821 - DNA, 16 bp, Homo sapiens
tgacacaagtggacct

SEQ ID NO: 4953822 - DNA, 15 bp, Homo sapiens
tgacacacagctctg

SEQ ID NO: 4953823 - DNA, 18 bp, Homo sapiens
tgacacacagctctgtcc

SEQ ID NO: 4953824 - DNA, 20 bp, Homo sapiens
tgacacacagctctgtcctg

SEQ ID NO: 4953825 - DNA, 21 bp, Homo sapiens
tgacacacagctctgtcctgg

SEQ ID NO: 4953826 - DNA, 19 bp, Homo sapiens
tgacacagaaaatgttgag

SEQ ID NO: 4953827 - DNA, 22 bp, Homo sapiens
tgacacagcagcttcaccagag

SEQ ID NO: 4953828 - DNA, 21 bp, Homo sapiens
tgacacatatgcaccttgtgt

SEQ ID NO: 4953829 - DNA, 16 bp, Homo sapiens
tgacaccaaagccacc

SEQ ID NO: 4953830 - DNA, 20 bp, Homo sapiens
tgacaccaaagccacctctg

SEQ ID NO: 4953831 - DNA, 18 bp, Homo sapiens
tgacactatagtttaaaa

SEQ ID NO: 4953832 - DNA, 16 bp, Homo sapiens
tgacagacacaggccc

SEQ ID NO: 4953833 - DNA, 14 bp, Homo sapiens
tgacagaggcagcc

SEQ ID NO: 4953834 - DNA, 14 bp, Homo sapiens
tgacagagtgagac

SEQ ID NO: 4953835 - DNA, 18 bp, Homo sapiens
tgacagcatgtgccctcc

SEQ ID NO: 4953836 - DNA, 20 bp, Homo sapiens
tgacagcatgtgccctcctg

SEQ ID NO: 4953837 - DNA, 11 bp, Homo sapiens
tgacagcctcc

SEQ ID NO: 4953838 - DNA, 17 bp, Homo sapiens
tgacagcctcccacccc

SEQ ID NO: 4953839 - DNA, 19 bp, Homo sapiens
tgacagcctcccaccccca

SEQ ID NO: 4953840 - DNA, 21 bp, Homo sapiens
tgacagggcacaccgggcact

SEQ ID NO: 4953841 - DNA, 12 bp, Homo sapiens
tgacagggccag

SEQ ID NO: 4953842 - DNA, 22 bp, Homo sapiens
tgacagggccagtggggcctgt

SEQ ID NO: 4953843 - DNA, 19 bp, Homo sapiens
tgacagtgttgaaaatgtt

SEQ ID NO: 4953844 - DNA, 13 bp, Homo sapiens
tgacatcacttgt

SEQ ID NO: 4953845 - DNA, 17 bp, Homo sapiens
tgacatcacttgtacaa

SEQ ID NO: 4953846 - DNA, 19 bp, Homo sapiens
tgacatcacttgtacaaaa

SEQ ID NO: 4953847 - DNA, 21 bp, Homo sapiens
tgacatcacttgtacaaaata

SEQ ID NO: 4953848 - DNA, 23 bp, Homo sapiens
tgacatcagttcctttgtgtgta

SEQ ID NO: 4953849 - DNA, 21 bp, Homo sapiens
tgacatctcaggggccagagg

SEQ ID NO: 4953850 - DNA, 11 bp, Homo sapiens
tgacatgcact

SEQ ID NO: 4953851 - DNA, 14 bp, Homo sapiens
tgacatgcactgac

SEQ ID NO: 4953852 - DNA, 15 bp, Homo sapiens
tgacatgcactgacc

SEQ ID NO: 4953853 - DNA, 19 bp, Homo sapiens
tgacattaagaatgttggt

SEQ ID NO: 4953854 - DNA, 15 bp, Homo sapiens
tgacattgcgtttga

SEQ ID NO: 4953855 - DNA, 21 bp, Homo sapiens
tgacattgttggccaaagcca

SEQ ID NO: 4953856 - DNA, 18 bp, Homo sapiens
tgacatttaatttagtga

SEQ ID NO: 4953857 - DNA, 15 bp, Homo sapiens
tgacattttacatta

SEQ ID NO: 4953858 - DNA, 18 bp, Homo sapiens
tgaccaacaggctgttct

SEQ ID NO: 4953859 - DNA, 23 bp, Homo sapiens
tgaccaactgtgttgtattaaca

SEQ ID NO: 4953860 - DNA, 21 bp, Homo sapiens
tgaccagcctccatgctgcct

SEQ ID NO: 4953861 - DNA, 19 bp, Homo sapiens
tgaccatccactctaccct

SEQ ID NO: 4953862 - DNA, 15 bp, Homo sapiens
tgaccatctgctttt

SEQ ID NO: 4953863 - DNA, 21 bp, Homo sapiens
tgacccaaatctcttccacaa

SEQ ID NO: 4953864 - DNA, 17 bp, Homo sapiens
tgacccactggttcctt

SEQ ID NO: 4953865 - DNA, 15 bp, Homo sapiens
tgaccccttccctgt

SEQ ID NO: 4953866 - DNA, 21 bp, Homo sapiens
tgacccttccagacatacgaa

SEQ ID NO: 4953867 - DNA, 21 bp, Homo sapiens
tgacccttcccaatcagcact

SEQ ID NO: 4953868 - DNA, 19 bp, Homo sapiens
tgaccgcgactaatttcaa

SEQ ID NO: 4953869 - DNA, 22 bp, Homo sapiens
tgacctcaggtgatccacccac

SEQ ID NO: 4953870 - DNA, 22 bp, Homo sapiens
tgacctcttgctgtctctgctc

SEQ ID NO: 4953871 - DNA, 23 bp, Homo sapiens
tgacctcttgctgtctctgctcg

SEQ ID NO: 4953872 - DNA, 12 bp, Homo sapiens
tgacctgagggc

SEQ ID NO: 4953873 - DNA, 20 bp, Homo sapiens
tgacctgcctctcacacaca

SEQ ID NO: 4953874 - DNA, 12 bp, Homo sapiens
tgacctgctccg

SEQ ID NO: 4953875 - DNA, 19 bp, Homo sapiens
tgacctgctccgctgctcc

SEQ ID NO: 4953876 - DNA, 23 bp, Homo sapiens
tgacctgctccgctgctccttgg

SEQ ID NO: 4953877 - DNA, 14 bp, Homo sapiens
tgaccttcctctgg

SEQ ID NO: 4953878 - DNA, 15 bp, Homo sapiens
tgaccttcctctggg

SEQ ID NO: 4953879 - DNA, 24 bp, Homo sapiens
tgaccttcctctggggctctaggg

SEQ ID NO: 4953880 - DNA, 18 bp, Homo sapiens
tgaccttttatgtagtaa

SEQ ID NO: 4953881 - DNA, 19 bp, Homo sapiens
tgacgaaactggccccgga

SEQ ID NO: 4953882 - DNA, 17 bp, Homo sapiens
tgacgattccttctctg

SEQ ID NO: 4953883 - DNA, 14 bp, Homo sapiens
tgacgcaatgaaaa

SEQ ID NO: 4953884 - DNA, 23 bp, Homo sapiens
tgacgctgatacataactaaatt

SEQ ID NO: 4953885 - DNA, 14 bp, Homo sapiens
tgacggccctcatc

SEQ ID NO: 4953886 - DNA, 12 bp, Homo sapiens
tgacggccctgc

SEQ ID NO: 4953887 - DNA, 13 bp, Homo sapiens
tgacggccctgca

SEQ ID NO: 4953888 - DNA, 19 bp, Homo sapiens
tgactaaattcgtgatttt

SEQ ID NO: 4953889 - DNA, 23 bp, Homo sapiens
tgactaactagacaccaaagttc

SEQ ID NO: 4953890 - DNA, 22 bp, Homo sapiens
tgactaattagggtacatttat

SEQ ID NO: 4953891 - DNA, 22 bp, Homo sapiens
tgactacttagcatcctaagaa

SEQ ID NO: 4953892 - DNA, 19 bp, Homo sapiens
tgactagacgttcatttgt

SEQ ID NO: 4953893 - DNA, 15 bp, Homo sapiens
tgactagtacaaatt

SEQ ID NO: 4953894 - DNA, 23 bp, Homo sapiens
tgactagtacaaattataaaaag

SEQ ID NO: 4953895 - DNA, 14 bp, Homo sapiens
tgactatatagaga

SEQ ID NO: 4953896 - DNA, 18 bp, Homo sapiens
tgactattctgtatcttt

SEQ ID NO: 4953897 - DNA, 17 bp, Homo sapiens
tgactattttcgttcat

SEQ ID NO: 4953898 - DNA, 23 bp, Homo sapiens
tgactcaggatttaaaaactgga

SEQ ID NO: 4953899 - DNA, 13 bp, Homo sapiens
tgaggaattttct

SEQ ID NO: 4953900 - DNA, 18 bp, Homo sapiens
tgaggaattttctttgtg

SEQ ID NO: 4953901 - DNA, 19 bp, Homo sapiens
tgaggagcatgttttgtat

SEQ ID NO: 4953902 - DNA, 23 bp, Homo sapiens
tgaggagcatgttttgtatacaa

SEQ ID NO: 4953903 - DNA, 21 bp, Homo sapiens
tgaggagcccatactcagcct

SEQ ID NO: 4953904 - DNA, 14 bp, Homo sapiens
tgaggagccccagc

SEQ ID NO: 4953905 - DNA, 16 bp, Homo sapiens
tgaggagccccagcta

SEQ ID NO: 4953906 - DNA, 16 bp, Homo sapiens
tgaggagctgctggct

SEQ ID NO: 4953907 - DNA, 13 bp, Homo sapiens
tgaggaggaggct

SEQ ID NO: 4953908 - DNA, 20 bp, Homo sapiens
tgaggcaatgtcaggaacag

SEQ ID NO: 4953909 - DNA, 13 bp, Homo sapiens
tgaggcagggcaa

SEQ ID NO: 4953910 - DNA, 15 bp, Homo sapiens
tcagtcagaaaactt

SEQ ID NO: 4953911 - DNA, 15 bp, Homo sapiens
tcagtccatagcaga

SEQ ID NO: 4953912 - DNA, 15 bp, Homo sapiens
tcagtccatttatat

SEQ ID NO: 4953913 - DNA, 16 bp, Homo sapiens
tcagtccatttatata

SEQ ID NO: 4953914 - DNA, 23 bp, Homo sapiens
tcagtccatttatatatgaaaac

SEQ ID NO: 4953915 - DNA, 13 bp, Homo sapiens
tcagtcctcccct

SEQ ID NO: 4953916 - DNA, 12 bp, Homo sapiens
tcagtcttgcct

SEQ ID NO: 4953917 - DNA, 22 bp, Homo sapiens
tcagtctttcttagtgcctgtg

SEQ ID NO: 4953918 - DNA, 15 bp, Homo sapiens
tcagtggcagctgct

SEQ ID NO: 4953919 - DNA, 14 bp, Homo sapiens
tcagtgtagttaat

SEQ ID NO: 4953920 - DNA, 22 bp, Homo sapiens
tcagtgtttgggtcacccctcc

SEQ ID NO: 4953921 - DNA, 20 bp, Homo sapiens
tcagttaactattgcattta

SEQ ID NO: 4953922 - DNA, 12 bp, Homo sapiens
tcagttccaaga

SEQ ID NO: 4953923 - DNA, 17 bp, Homo sapiens
tcagttcccttggcctc

SEQ ID NO: 4953924 - DNA, 19 bp, Homo sapiens
tcagttctacggatcatca

SEQ ID NO: 4953925 - DNA, 16 bp, Homo sapiens
tcagttggttgtgtct

SEQ ID NO: 4953926 - DNA, 17 bp, Homo sapiens
tcagttggttgtgtctt

SEQ ID NO: 4953927 - DNA, 16 bp, Homo sapiens
tcagtttatgttgtac

SEQ ID NO: 4953928 - DNA, 17 bp, Homo sapiens
tcagtttgtgtgtctta

SEQ ID NO: 4953929 - DNA, 17 bp, Homo sapiens
tcagttttttgttttac

SEQ ID NO: 4953930 - DNA, 18 bp, Homo sapiens
tcataacttattgctgat

SEQ ID NO: 4953931 - DNA, 14 bp, Homo sapiens
tcataaggcttcaa

SEQ ID NO: 4953932 - DNA, 20 bp, Homo sapiens
tcataattcctacagcacta

SEQ ID NO: 4953933 - DNA, 23 bp, Homo sapiens
tcataattcctacagcactactg

SEQ ID NO: 4953934 - DNA, 19 bp, Homo sapiens
tcatacactaaccaaatct

SEQ ID NO: 4953935 - DNA, 23 bp, Homo sapiens
tcattgtatgatgtgttgtgata

SEQ ID NO: 4953936 - DNA, 13 bp, Homo sapiens
tcattgttttgaa

SEQ ID NO: 4953937 - DNA, 16 bp, Homo sapiens
tcatttactaaacata

SEQ ID NO: 4953938 - DNA, 20 bp, Homo sapiens
tcatttattttaaaaaatga

SEQ ID NO: 4953939 - DNA, 19 bp, Homo sapiens
tcatttcacattaatggtc

SEQ ID NO: 4953940 - DNA, 14 bp, Homo sapiens
tcatttcattgtat

SEQ ID NO: 4953941 - DNA, 13 bp, Homo sapiens
tcatttctaaaag

SEQ ID NO: 4953942 - DNA, 15 bp, Homo sapiens
tcatttctaaaagaa

SEQ ID NO: 4953943 - DNA, 17 bp, Homo sapiens
tcatttctcactgtgta

SEQ ID NO: 4953944 - DNA, 19 bp, Homo sapiens
tcatttgagcagggctcag

SEQ ID NO: 4953945 - DNA, 16 bp, Homo sapiens
tcatttgtcacacact

SEQ ID NO: 4953946 - DNA, 15 bp, Homo sapiens
tcattttaatgtaaa

SEQ ID NO: 4953947 - DNA, 18 bp, Homo sapiens
tcattttacccttggctc

SEQ ID NO: 4953948 - DNA, 19 bp, Homo sapiens
tcatttttagtagagacag

SEQ ID NO: 4953949 - DNA, 17 bp, Homo sapiens
tcatttttgccatacat

SEQ ID NO: 4953950 - DNA, 13 bp, Homo sapiens
tcattttttctta

SEQ ID NO: 4953951 - DNA, 17 bp, Homo sapiens
tcatttttttaatttat

SEQ ID NO: 4953952 - DNA, 13 bp, Homo sapiens
tccaaaaattatt

SEQ ID NO: 4953953 - DNA, 15 bp, Homo sapiens
tccaaagaggctgcc

SEQ ID NO: 4953954 - DNA, 16 bp, Homo sapiens
tccaaagaggctgccc

SEQ ID NO: 4953955 - DNA, 22 bp, Homo sapiens
tccaaagagtagaattgcattg

SEQ ID NO: 4953956 - DNA, 13 bp, Homo sapiens
tccaaagctttat

SEQ ID NO: 4953957 - DNA, 15 bp, Homo sapiens
tccaaaggaggctgg

SEQ ID NO: 4953958 - DNA, 15 bp, Homo sapiens
tccaaagtaaaattg

SEQ ID NO: 4953959 - DNA, 14 bp, Homo sapiens
tccaaagtctctaa

SEQ ID NO: 4953960 - DNA, 14 bp, Homo sapiens
tccaaataataaag

SEQ ID NO: 4953961 - DNA, 16 bp, Homo sapiens
tccaaatgcaatttga

SEQ ID NO: 4953962 - DNA, 18 bp, Homo sapiens
tccaaatggcgtctggaa

SEQ ID NO: 4953963 - DNA, 22 bp, Homo sapiens
tccaaattgtgcttctccccag

SEQ ID NO: 4953964 - DNA, 15 bp, Homo sapiens
tccaacacaaggctc

SEQ ID NO: 4953965 - DNA, 22 bp, Homo sapiens
tccaacaccacagacacacaca

SEQ ID NO: 4953966 - DNA, 17 bp, Homo sapiens
tccaacagaactaaatg

SEQ ID NO: 4953967 - DNA, 14 bp, Homo sapiens
tccaactccagcaa

SEQ ID NO: 4953968 - DNA, 13 bp, Homo sapiens
tccaactccagga

SEQ ID NO: 4953969 - DNA, 14 bp, Homo sapiens
tccaagactctaga

SEQ ID NO: 4953970 - DNA, 16 bp, Homo sapiens
tccaagagtctaaaga

SEQ ID NO: 4953971 - DNA, 18 bp, Homo sapiens
tccaagagtctaaagatg

SEQ ID NO: 4953972 - DNA, 12 bp, Homo sapiens
tccaagattcta

SEQ ID NO: 4953973 - DNA, 16 bp, Homo sapiens
tccaagattctagatg

SEQ ID NO: 4953974 - DNA, 15 bp, Homo sapiens
tccaagcctccacag

SEQ ID NO: 4953975 - DNA, 16 bp, Homo sapiens
tccaagcctccacagc

SEQ ID NO: 4953976 - DNA, 17 bp, Homo sapiens
tccaagcctccacagcg

SEQ ID NO: 4953977 - DNA, 12 bp, Homo sapiens
tccaagctccct

SEQ ID NO: 4953978 - DNA, 17 bp, Homo sapiens
tccaagctgagagtcta

SEQ ID NO: 4953979 - DNA, 20 bp, Homo sapiens
tccaagctggtcccactcag

SEQ ID NO: 4953980 - DNA, 19 bp, Homo sapiens
tccaaggtttaaagagtct

SEQ ID NO: 4953981 - DNA, 17 bp, Homo sapiens
tccaagtctcagtggct

SEQ ID NO: 4953982 - DNA, 13 bp, Homo sapiens
tccaatatttctg

SEQ ID NO: 4953983 - DNA, 18 bp, Homo sapiens
tccaatgtggcaaggaaa

SEQ ID NO: 4953984 - DNA, 18 bp, Homo sapiens
tccaattttctggaatac

SEQ ID NO: 4953985 - DNA, 21 bp, Homo sapiens
tccacaccttttattgacaca

SEQ ID NO: 4953986 - DNA, 19 bp, Homo sapiens
tccacagcgagggcagctg

SEQ ID NO: 4953987 - DNA, 22 bp, Homo sapiens
tccacagcgagggcagctgcta

SEQ ID NO: 4953988 - DNA, 15 bp, Homo sapiens
tccacaggtctagac

SEQ ID NO: 4953989 - DNA, 16 bp, Homo sapiens
tccacaggtctagact

SEQ ID NO: 4953990 - DNA, 16 bp, Homo sapiens
tccacatttctaaaat

SEQ ID NO: 4953991 - DNA, 16 bp, Homo sapiens
tccaccacctccctca

SEQ ID NO: 4953992 - DNA, 22 bp, Homo sapiens
tccaccagcccatggccctgtg

SEQ ID NO: 4953993 - DNA, 15 bp, Homo sapiens
tccacccaggagccc

SEQ ID NO: 4953994 - DNA, 20 bp, Homo sapiens
tccaccccatccctccccag

SEQ ID NO: 4953995 - DNA, 18 bp, Homo sapiens
tccacctcttcacccccc

SEQ ID NO: 4953996 - DNA, 16 bp, Homo sapiens
tccacctgtctcagcc

SEQ ID NO: 4953997 - DNA, 20 bp, Homo sapiens
tccacctgtctcagcctccc

SEQ ID NO: 4953998 - DNA, 12 bp, Homo sapiens
tccaccttccca

SEQ ID NO: 4953999 - DNA, 21 bp, Homo sapiens
tccacgcgcttcgacttttct

SEQ ID NO: 4954000 - DNA, 18 bp, Homo sapiens
tccactctaccctcccac

SEQ ID NO: 4954001 - DNA, 21 bp, Homo sapiens
tccactctaccctcccacccc

SEQ ID NO: 4954002 - DNA, 12 bp, Homo sapiens
tccactgtcacc

SEQ ID NO: 4954003 - DNA, 22 bp, Homo sapiens
tccactgtgccatgtgccaggt

SEQ ID NO: 4954004 - DNA, 21 bp, Homo sapiens
tccacttagaaattgcatttc

SEQ ID NO: 4954005 - DNA, 23 bp, Homo sapiens
tccacttagaaattgcatttcct

SEQ ID NO: 4954006 - DNA, 14 bp, Homo sapiens
tccacttcaatgca

SEQ ID NO: 4954007 - DNA, 14 bp, Homo sapiens
tccacttcttcctt

SEQ ID NO: 4954008 - DNA, 11 bp, Homo sapiens
tccagaaatgg

SEQ ID NO: 4954009 - DNA, 20 bp, Homo sapiens
tccagaacacggctcacgct

SEQ ID NO: 4954010 - DNA, 17 bp, Homo sapiens
tccagaagaagagaagc

SEQ ID NO: 4954011 - DNA, 18 bp, Homo sapiens
tccagaagaagagaagct

SEQ ID NO: 4954012 - DNA, 18 bp, Homo sapiens
tccagaagcctctggcta

SEQ ID NO: 4954013 - DNA, 13 bp, Homo sapiens
tccagaatgctgt

SEQ ID NO: 4954014 - DNA, 21 bp, Homo sapiens
tccagaatgctgtacatctat

SEQ ID NO: 4954015 - DNA, 22 bp, Homo sapiens
tccagacagtgtgctgtttgaa

SEQ ID NO: 4954016 - DNA, 21 bp, Homo sapiens
tccagacatcatgaattttac

SEQ ID NO: 4954017 - DNA, 15 bp, Homo sapiens
tccagacccggctgc

SEQ ID NO: 4954018 - DNA, 22 bp, Homo sapiens
tccagactgcttccaattttct

SEQ ID NO: 4954019 - DNA, 23 bp, Homo sapiens
tccagactgcttccaattttctg

SEQ ID NO: 4954020 - DNA, 20 bp, Homo sapiens
tccagacttccttgagacac

SEQ ID NO: 4954021 - DNA, 17 bp, Homo sapiens
tccagagagtggctcct

SEQ ID NO: 4954022 - DNA, 19 bp, Homo sapiens
tccagagagtggctcctcc

SEQ ID NO: 4954023 - DNA, 22 bp, Homo sapiens
tccagagagtggctcctcccgg

SEQ ID NO: 4954024 - DNA, 20 bp, Homo sapiens
taattattaactacatttat

SEQ ID NO: 4954025 - DNA, 21 bp, Homo sapiens
taattcactcaagcactgata

SEQ ID NO: 4954026 - DNA, 11 bp, Homo sapiens
taattctaaag

SEQ ID NO: 4954027 - DNA, 12 bp, Homo sapiens
taattctaaagg

SEQ ID NO: 4954028 - DNA, 17 bp, Homo sapiens
taattctggagatactg

SEQ ID NO: 4954029 - DNA, 22 bp, Homo sapiens
taattcttcagcgtaaaatggt

SEQ ID NO: 4954030 - DNA, 23 bp, Homo sapiens
taattgacggttttttattattg

SEQ ID NO: 4954031 - DNA, 12 bp, Homo sapiens
taattgtcatgg

SEQ ID NO: 4954032 - DNA, 22 bp, Homo sapiens
taattgttgaaattttgcaaat

SEQ ID NO: 4954033 - DNA, 14 bp, Homo sapiens
taattgttgtttct

SEQ ID NO: 4954034 - DNA, 22 bp, Homo sapiens
taattgttgtttctttctagtg

SEQ ID NO: 4954035 - DNA, 15 bp, Homo sapiens
taatttaaaaaataa

SEQ ID NO: 4954036 - DNA, 11 bp, Homo sapiens
taatttaaaca

SEQ ID NO: 4954037 - DNA, 14 bp, Homo sapiens
taatttaaagagac

SEQ ID NO: 4954038 - DNA, 18 bp, Homo sapiens
taatttagggtactaaat

SEQ ID NO: 4954039 - DNA, 16 bp, Homo sapiens
taatttagttattgat

SEQ ID NO: 4954040 - DNA, 13 bp, Homo sapiens
taatttataaaat

SEQ ID NO: 4954041 - DNA, 15 bp, Homo sapiens
taatttatctaaatt

SEQ ID NO: 4954042 - DNA, 18 bp, Homo sapiens
taatttatctaaattaaa

SEQ ID NO: 4954043 - DNA, 18 bp, Homo sapiens
taatttcaaaaatataac

SEQ ID NO: 4954044 - DNA, 20 bp, Homo sapiens
taatttcaaaaatataactt

SEQ ID NO: 4954045 - DNA, 15 bp, Homo sapiens
taatttcaaaatgct

SEQ ID NO: 4954046 - DNA, 20 bp, Homo sapiens
taatttcaaaatgcttttta

SEQ ID NO: 4954047 - DNA, 23 bp, Homo sapiens
taatttcagtcctgtagttttat

SEQ ID NO: 4954048 - DNA, 11 bp, Homo sapiens
taatttcttca

SEQ ID NO: 4954049 - DNA, 20 bp, Homo sapiens
taatttcttcaaaatgtata

SEQ ID NO: 4954050 - DNA, 21 bp, Homo sapiens
taatttcttcaaaatgtatat

SEQ ID NO: 4954051 - DNA, 23 bp, Homo sapiens
taatttcttcaaaatgtatatat

SEQ ID NO: 4954052 - DNA, 14 bp, Homo sapiens
taatttgattaaca

SEQ ID NO: 4954053 - DNA, 18 bp, Homo sapiens
taatttgattaacaaata

SEQ ID NO: 4954054 - DNA, 17 bp, Homo sapiens
taatttgcattaaattc

SEQ ID NO: 4954055 - DNA, 15 bp, Homo sapiens
taattttacacatta

SEQ ID NO: 4954056 - DNA, 12 bp, Homo sapiens
taattttctgaa

SEQ ID NO: 4954057 - DNA, 17 bp, Homo sapiens
taattttgaaaagatgt

SEQ ID NO: 4954058 - DNA, 20 bp, Homo sapiens
taatttttaccctaatgtct

SEQ ID NO: 4954059 - DNA, 21 bp, Homo sapiens
taatttttttcacctagattt

SEQ ID NO: 4954060 - DNA, 18 bp, Homo sapiens
taatttttttgagacaga

SEQ ID NO: 4954061 - DNA, 23 bp, Homo sapiens
tacaaaagaggagcacttccaaa

SEQ ID NO: 4954062 - DNA, 15 bp, Homo sapiens
tacaaacaatctctt

SEQ ID NO: 4954063 - DNA, 18 bp, Homo sapiens
tacaaagcactagagaat

SEQ ID NO: 4954064 - DNA, 16 bp, Homo sapiens
tacaaagcgtgcacaa

SEQ ID NO: 4954065 - DNA, 17 bp, Homo sapiens
tacaaagcgtgcacaag

SEQ ID NO: 4954066 - DNA, 13 bp, Homo sapiens
tacaaatatattg

SEQ ID NO: 4954067 - DNA, 14 bp, Homo sapiens
tacaaatatattgt

SEQ ID NO: 4954068 - DNA, 16 bp, Homo sapiens
tacaaatcaagtattt

SEQ ID NO: 4954069 - DNA, 19 bp, Homo sapiens
tacaaatgccttaaaatgg

SEQ ID NO: 4954070 - DNA, 22 bp, Homo sapiens
tacaaatgccttaaaatggaat

SEQ ID NO: 4954071 - DNA, 14 bp, Homo sapiens
tacaaattaaaaag

SEQ ID NO: 4954072 - DNA, 16 bp, Homo sapiens
tacaaattaaaaagat

SEQ ID NO: 4954073 - DNA, 19 bp, Homo sapiens
tacaaattataaaaagcca

SEQ ID NO: 4954074 - DNA, 19 bp, Homo sapiens
tacaacaagagtttatttc

SEQ ID NO: 4954075 - DNA, 22 bp, Homo sapiens
tacaacaagagtttatttccaa

SEQ ID NO: 4954076 - DNA, 15 bp, Homo sapiens
tacaagaagtttatt

SEQ ID NO: 4954077 - DNA, 19 bp, Homo sapiens
tacaagagcagcctgtggc

SEQ ID NO: 4954078 - DNA, 13 bp, Homo sapiens
tacaagattagaa

SEQ ID NO: 4954079 - DNA, 19 bp, Homo sapiens
tacaagcgtgagccactgc

SEQ ID NO: 4954080 - DNA, 20 bp, Homo sapiens
tacaagcgtgagccactgca

SEQ ID NO: 4954081 - DNA, 20 bp, Homo sapiens
tagccttagaagtcacacag

SEQ ID NO: 4954082 - DNA, 20 bp, Homo sapiens
tagctaacattttaaataaa

SEQ ID NO: 4954083 - DNA, 22 bp, Homo sapiens
tagctaagtacacaataagcaa

SEQ ID NO: 4954084 - DNA, 16 bp, Homo sapiens
tagctatcagaagacc

SEQ ID NO: 4954085 - DNA, 11 bp, Homo sapiens
tagctgggact

SEQ ID NO: 4954086 - DNA, 19 bp, Homo sapiens
tagctgggactacaggcac

SEQ ID NO: 4954087 - DNA, 20 bp, Homo sapiens
tagctgggactacaggcacc

SEQ ID NO: 4954088 - DNA, 15 bp, Homo sapiens
tagctgtctagagta

SEQ ID NO: 4954089 - DNA, 17 bp, Homo sapiens
tagctgtctagagtagc

SEQ ID NO: 4954090 - DNA, 16 bp, Homo sapiens
tagcttaccagaagct

SEQ ID NO: 4954091 - DNA, 15 bp, Homo sapiens
tagcttacctgacac

SEQ ID NO: 4954092 - DNA, 15 bp, Homo sapiens
tagcttattattgaa

SEQ ID NO: 4954093 - DNA, 13 bp, Homo sapiens
tagctttattctt

SEQ ID NO: 4954094 - DNA, 14 bp, Homo sapiens
tagcttttaggaaa

SEQ ID NO: 4954095 - DNA, 13 bp, Homo sapiens
tagcttttcaaac

SEQ ID NO: 4954096 - DNA, 14 bp, Homo sapiens
tagctttttaattg

SEQ ID NO: 4954097 - DNA, 16 bp, Homo sapiens
tagctttttaattgtt

SEQ ID NO: 4954098 - DNA, 21 bp, Homo sapiens
taggaaaatcactttgtctaa

SEQ ID NO: 4954099 - DNA, 19 bp, Homo sapiens
taggaaagcctcactgata

SEQ ID NO: 4954100 - DNA, 20 bp, Homo sapiens
taggaaataaaacctttcaa

SEQ ID NO: 4954101 - DNA, 15 bp, Homo sapiens
taggaacttcagaga

SEQ ID NO: 4954102 - DNA, 17 bp, Homo sapiens
taggaagttttctgtag

SEQ ID NO: 4954103 - DNA, 17 bp, Homo sapiens
taggaatgtgaaagcac

SEQ ID NO: 4954104 - DNA, 18 bp, Homo sapiens
taggaattcatcttttga

SEQ ID NO: 4954105 - DNA, 15 bp, Homo sapiens
taggaccactcagcc

SEQ ID NO: 4954106 - DNA, 16 bp, Homo sapiens
taggaccactcagccc

SEQ ID NO: 4954107 - DNA, 17 bp, Homo sapiens
taggaccactcagcccc

SEQ ID NO: 4954108 - DNA, 14 bp, Homo sapiens
taggaccttgggcc

SEQ ID NO: 4954109 - DNA, 14 bp, Homo sapiens
taggagaggatgag

SEQ ID NO: 4954110 - DNA, 15 bp, Homo sapiens
taggagcctgctggt

SEQ ID NO: 4954111 - DNA, 17 bp, Homo sapiens
taggagctaaggctcta

SEQ ID NO: 4954112 - DNA, 13 bp, Homo sapiens
taggatagcattt

SEQ ID NO: 4954113 - DNA, 12 bp, Homo sapiens
taggattctaaa

SEQ ID NO: 4954114 - DNA, 18 bp, Homo sapiens
taggcaacctttattttt

SEQ ID NO: 4954115 - DNA, 19 bp, Homo sapiens
taggcaaggctatgtgatt

SEQ ID NO: 4954116 - DNA, 18 bp, Homo sapiens
taggcactgtagttctaa

SEQ ID NO: 4954117 - DNA, 20 bp, Homo sapiens
taggcactgtagttctaaga

SEQ ID NO: 4954118 - DNA, 21 bp, Homo sapiens
taggcactgtagttctaagac

SEQ ID NO: 4954119 - DNA, 17 bp, Homo sapiens
taggcatctctgtactt

SEQ ID NO: 4954120 - DNA, 14 bp, Homo sapiens
taggcctggccaga

SEQ ID NO: 4954121 - DNA, 23 bp, Homo sapiens
taggccttcctctctccagatgt

SEQ ID NO: 4954122 - DNA, 13 bp, Homo sapiens
taggctaatgtca

SEQ ID NO: 4954123 - DNA, 22 bp, Homo sapiens
taggctcctgccagtgtggaac

SEQ ID NO: 4954124 - DNA, 19 bp, Homo sapiens
tagggaagctggcctgaga

SEQ ID NO: 4954125 - DNA, 22 bp, Homo sapiens
tagggaataaaatcctaagaca

SEQ ID NO: 4954126 - DNA, 13 bp, Homo sapiens
tagggaggcagcc

SEQ ID NO: 4954127 - DNA, 15 bp, Homo sapiens
tagggatgcctcctt

SEQ ID NO: 4954128 - DNA, 16 bp, Homo sapiens
tagggatgcctccttt

SEQ ID NO: 4954129 - DNA, 16 bp, Homo sapiens
tagggattcaggctgc

SEQ ID NO: 4954130 - DNA, 14 bp, Homo sapiens
taggggtcactgta

SEQ ID NO: 4954131 - DNA, 14 bp, Homo sapiens
tagggtactaaatt

SEQ ID NO: 4954132 - DNA, 16 bp, Homo sapiens
tagggtactaaattta

SEQ ID NO: 4954133 - DNA, 22 bp, Homo sapiens
tagggtgaaccacttcattctg

SEQ ID NO: 4954134 - DNA, 14 bp, Homo sapiens
taggtatttcaaaa

SEQ ID NO: 4954135 - DNA, 19 bp, Homo sapiens
taggtctcggactaagcct

SEQ ID NO: 4954136 - DNA, 15 bp, Homo sapiens
taggtgagaaaaaaa

SEQ ID NO: 4954137 - DNA, 21 bp, Homo sapiens
taggttctaaagttctaagat

SEQ ID NO: 4954138 - DNA, 14 bp, Homo sapiens
taggtttcaaagat

SEQ ID NO: 4954139 - DNA, 15 bp, Homo sapiens
taggtttttgtttgt

SEQ ID NO: 4954140 - DNA, 15 bp, Homo sapiens
tagtaaaatttattt

SEQ ID NO: 4954141 - DNA, 11 bp, Homo sapiens
tagtaaatgtc

SEQ ID NO: 4954142 - DNA, 20 bp, Homo sapiens
tagtaaatgtctttgtaagt

SEQ ID NO: 4954143 - DNA, 20 bp, Homo sapiens
tagtaactcccatcacctct

SEQ ID NO: 4954144 - DNA, 18 bp, Homo sapiens
tagtaacttcttatggaa

SEQ ID NO: 4954145 - DNA, 21 bp, Homo sapiens
tagtaagtaattatgcactaa

SEQ ID NO: 4954146 - DNA, 18 bp, Homo sapiens
tagtacctgaaaagtaac

SEQ ID NO: 4954147 - DNA, 13 bp, Homo sapiens
tagtactgctctt

SEQ ID NO: 4954148 - DNA, 15 bp, Homo sapiens
tagtactgctcttgt

SEQ ID NO: 4954149 - DNA, 14 bp, Homo sapiens
tagtactgtgtact

SEQ ID NO: 4954150 - DNA, 14 bp, Homo sapiens
tagtagagacaggg

SEQ ID NO: 4954151 - DNA, 19 bp, Homo sapiens
tagtagccctttctgtgtg

SEQ ID NO: 4954152 - DNA, 21 bp, Homo sapiens
tagtagcgttttttaaatgta

SEQ ID NO: 4954153 - DNA, 18 bp, Homo sapiens
tagtagtatgatgataca

SEQ ID NO: 4954154 - DNA, 19 bp, Homo sapiens
tagtatcagtgttttaaat

SEQ ID NO: 4954155 - DNA, 20 bp, Homo sapiens
tagtatgacgctgatacata

SEQ ID NO: 4954156 - DNA, 17 bp, Homo sapiens
tagtattcattctgcat

SEQ ID NO: 4954157 - DNA, 18 bp, Homo sapiens
tagtatttatttatgtac

SEQ ID NO: 4954158 - DNA, 13 bp, Homo sapiens
tagtatttgaatt

SEQ ID NO: 4954159 - DNA, 14 bp, Homo sapiens
tagtatttgaatta

SEQ ID NO: 4954160 - DNA, 18 bp, Homo sapiens
tagtatttgaattaaaac

SEQ ID NO: 4954161 - DNA, 15 bp, Homo sapiens
tagtatttttatcca

SEQ ID NO: 4954162 - DNA, 23 bp, Homo sapiens
tagtcacatggcctatgcacata

SEQ ID NO: 4954163 - DNA, 13 bp, Homo sapiens
tagtcatttacta

SEQ ID NO: 4954164 - DNA, 14 bp, Homo sapiens
tagtcatttactaa

SEQ ID NO: 4954165 - DNA, 22 bp, Homo sapiens
tagtcccccaactctgagccca

SEQ ID NO: 4954166 - DNA, 13 bp, Homo sapiens
tagtccttggcat

SEQ ID NO: 4954167 - DNA, 11 bp, Homo sapiens
tagtctcagtt

SEQ ID NO: 4954168 - DNA, 19 bp, Homo sapiens
tagtctcagtttgtgtgtc

SEQ ID NO: 4954169 - DNA, 22 bp, Homo sapiens
tagtctcagtttgtgtgtctta

SEQ ID NO: 4954170 - DNA, 18 bp, Homo sapiens
tagtctgtgtgaaggtga

SEQ ID NO: 4954171 - DNA, 15 bp, Homo sapiens
tagtgcacaaaatga

SEQ ID NO: 4954172 - DNA, 14 bp, Homo sapiens
tagtgctatatata

SEQ ID NO: 4954173 - DNA, 14 bp, Homo sapiens
tagtggaaaaacac

SEQ ID NO: 4954174 - DNA, 17 bp, Homo sapiens
tagtggaaacatttata

SEQ ID NO: 4954175 - DNA, 18 bp, Homo sapiens
tagtgggcaccccactgc

SEQ ID NO: 4954176 - DNA, 14 bp, Homo sapiens
tagtgggccagggc

SEQ ID NO: 4954177 - DNA, 14 bp, Homo sapiens
tagtggtctttgta

SEQ ID NO: 4954178 - DNA, 19 bp, Homo sapiens
tagtggtctttgtaagagt

SEQ ID NO: 4954179 - DNA, 21 bp, Homo sapiens
tagtggtctttgtaagagtgt

SEQ ID NO: 4954180 - DNA, 23 bp, Homo sapiens
tagtggtctttgtaagagtgtag

SEQ ID NO: 4954181 - DNA, 22 bp, Homo sapiens
tagtgtaaaataagaatgattt

SEQ ID NO: 4954182 - DNA, 15 bp, Homo sapiens
tagtgtaatatacca

SEQ ID NO: 4954183 - DNA, 15 bp, Homo sapiens
tagtgttctgtttgt

SEQ ID NO: 4954184 - DNA, 14 bp, Homo sapiens
tagttaagacatga

SEQ ID NO: 4954185 - DNA, 18 bp, Homo sapiens
tagttaatttatctaaat

SEQ ID NO: 4954186 - DNA, 18 bp, Homo sapiens
tagttaggaaataaaacc

SEQ ID NO: 4954187 - DNA, 21 bp, Homo sapiens
tagttaggaaataaaaccttt

SEQ ID NO: 4954188 - DNA, 18 bp, Homo sapiens
tagttccctctgctcagc

SEQ ID NO: 4954189 - DNA, 14 bp, Homo sapiens
tagttcctaagaag

SEQ ID NO: 4954190 - DNA, 19 bp, Homo sapiens
tagttcctaagaagcttct

SEQ ID NO: 4954191 - DNA, 15 bp, Homo sapiens
tagttcgtagctttc

SEQ ID NO: 4954192 - DNA, 23 bp, Homo sapiens
tatacaaattaaaaagattcttt

SEQ ID NO: 4954193 - DNA, 22 bp, Homo sapiens
tatacaaccctggcattatgtc

SEQ ID NO: 4954194 - DNA, 17 bp, Homo sapiens
tatacacatatacctat

SEQ ID NO: 4954195 - DNA, 13 bp, Homo sapiens
tatacagaggaaa

SEQ ID NO: 4954196 - DNA, 20 bp, Homo sapiens
tatacagaggaaatctgtaa

SEQ ID NO: 4954197 - DNA, 13 bp, Homo sapiens
tatacagatgaaa

SEQ ID NO: 4954198 - DNA, 18 bp, Homo sapiens
tatacaggcataaaatag

SEQ ID NO: 4954199 - DNA, 20 bp, Homo sapiens
tatacagttcaataaactta

SEQ ID NO: 4954200 - DNA, 19 bp, Homo sapiens
tatacatatgtagactata

SEQ ID NO: 4954201 - DNA, 21 bp, Homo sapiens
tatacatcctgggtaatgaga

SEQ ID NO: 4954202 - DNA, 19 bp, Homo sapiens
tatacatgaaaattttaaa

SEQ ID NO: 4954203 - DNA, 13 bp, Homo sapiens
tatacatgtgtgt

SEQ ID NO: 4954204 - DNA, 20 bp, Homo sapiens
tatacatgtgtgtatatatg

SEQ ID NO: 4954205 - DNA, 16 bp, Homo sapiens
tatacattagtaaatg

SEQ ID NO: 4954206 - DNA, 15 bp, Homo sapiens
tatacctcaaactat

SEQ ID NO: 4954207 - DNA, 20 bp, Homo sapiens
tatactatagtaccagtagg

SEQ ID NO: 4954208 - DNA, 22 bp, Homo sapiens
tatactccagtgtacatagtgt

SEQ ID NO: 4954209 - DNA, 19 bp, Homo sapiens
tatactctttctgtatata

SEQ ID NO: 4954210 - DNA, 22 bp, Homo sapiens
tatactctttctgtatatactt

SEQ ID NO: 4954211 - DNA, 18 bp, Homo sapiens
tatactgtgtgcttgttt

SEQ ID NO: 4954212 - DNA, 21 bp, Homo sapiens
tatacttgaacaaaagggtca

SEQ ID NO: 4954213 - DNA, 18 bp, Homo sapiens
tatacttgtggttttcaa

SEQ ID NO: 4954214 - DNA, 21 bp, Homo sapiens
tatactttaaataatttaact

SEQ ID NO: 4954215 - DNA, 14 bp, Homo sapiens
tatactttgtggac

SEQ ID NO: 4954216 - DNA, 17 bp, Homo sapiens
tatagacagtttgtaaa

SEQ ID NO: 4954217 - DNA, 21 bp, Homo sapiens
tatagattagaaaaattccta

SEQ ID NO: 4954218 - DNA, 13 bp, Homo sapiens
tatagattctaaa

SEQ ID NO: 4954219 - DNA, 17 bp, Homo sapiens
tatagattctaaagatt

SEQ ID NO: 4954220 - DNA, 13 bp, Homo sapiens
tatagcactttga

SEQ ID NO: 4954221 - DNA, 22 bp, Homo sapiens
tatagcactttgaaatacctca

SEQ ID NO: 4954222 - DNA, 23 bp, Homo sapiens
tatagcactttgaaatacctcat

SEQ ID NO: 4954223 - DNA, 20 bp, Homo sapiens
tatagcagcaaaaatataaa

SEQ ID NO: 4954224 - DNA, 21 bp, Homo sapiens
tatagcagcaaaaatataaaa

SEQ ID NO: 4954225 - DNA, 18 bp, Homo sapiens
tatagcctaggtgacaga

SEQ ID NO: 4954226 - DNA, 22 bp, Homo sapiens
tatagctattactgtctggttt

SEQ ID NO: 4954227 - DNA, 22 bp, Homo sapiens
tataggtctcttctcccagaat

SEQ ID NO: 4954228 - DNA, 21 bp, Homo sapiens
tataggtgttggttttggggg

SEQ ID NO: 4954229 - DNA, 15 bp, Homo sapiens
tataggttgtgcaaa

SEQ ID NO: 4954230 - DNA, 22 bp, Homo sapiens
tatagtcatttattttaaaaaa

SEQ ID NO: 4954231 - DNA, 17 bp, Homo sapiens
tatagtgcacaaaatga

SEQ ID NO: 4954232 - DNA, 20 bp, Homo sapiens
tatagtgctatatatataaa

SEQ ID NO: 4954233 - DNA, 21 bp, Homo sapiens
tatagtgtaaaataagaatga

SEQ ID NO: 4954234 - DNA, 17 bp, Homo sapiens
tatagttaggatagcat

SEQ ID NO: 4954235 - DNA, 18 bp, Homo sapiens
tatagttaggatagcatt

SEQ ID NO: 4954236 - DNA, 21 bp, Homo sapiens
tatcgaaataacaatgttaag

SEQ ID NO: 4954237 - DNA, 17 bp, Homo sapiens
tatcggctcacaaagag

SEQ ID NO: 4954238 - DNA, 15 bp, Homo sapiens
tatctaaagtttgtt

SEQ ID NO: 4954239 - DNA, 20 bp, Homo sapiens
tatctaatatatatgaataa

SEQ ID NO: 4954240 - DNA, 13 bp, Homo sapiens
tatctatagctaa

SEQ ID NO: 4954241 - DNA, 13 bp, Homo sapiens
tatctattaatat

SEQ ID NO: 4954242 - DNA, 15 bp, Homo sapiens
tatctattaatatat

SEQ ID NO: 4954243 - DNA, 18 bp, Homo sapiens
tatctattaatatatgta

SEQ ID NO: 4954244 - DNA, 13 bp, Homo sapiens
tatctcctgacag

SEQ ID NO: 4954245 - DNA, 21 bp, Homo sapiens
tatctcctgacagaaggtgcc

SEQ ID NO: 4954246 - DNA, 23 bp, Homo sapiens
tatctctgaagcatgtttcatgt

SEQ ID NO: 4954247 - DNA, 11 bp, Homo sapiens
tatctctgtgt

SEQ ID NO: 4954248 - DNA, 18 bp, Homo sapiens
tatctctgtgtgcacaaa

SEQ ID NO: 4954249 - DNA, 12 bp, Homo sapiens
tatctctgtgtt

SEQ ID NO: 4954250 - DNA, 15 bp, Homo sapiens
tatctgaaaactgga

SEQ ID NO: 4954251 - DNA, 17 bp, Homo sapiens
tatctgagttgccaaga

SEQ ID NO: 4954252 - DNA, 16 bp, Homo sapiens
tatctgattttgtgca

SEQ ID NO: 4954253 - DNA, 23 bp, Homo sapiens
tatctggaggccttccagctgct

SEQ ID NO: 4954254 - DNA, 19 bp, Homo sapiens
tatctggccatatttacta

SEQ ID NO: 4954255 - DNA, 13 bp, Homo sapiens
tatctgtggtctt

SEQ ID NO: 4954256 - DNA, 18 bp, Homo sapiens
tatctgtttaaagcatat

SEQ ID NO: 4954257 - DNA, 18 bp, Homo sapiens
tatcttaaagaaacagct

SEQ ID NO: 4954258 - DNA, 12 bp, Homo sapiens
tatcttcacata

SEQ ID NO: 4954259 - DNA, 22 bp, Homo sapiens
tatcttctcaagttctaagatt

SEQ ID NO: 4954260 - DNA, 22 bp, Homo sapiens
tatgaaagatggctgtgcctct

SEQ ID NO: 4954261 - DNA, 17 bp, Homo sapiens
tatgaaagattgtgggg

SEQ ID NO: 4954262 - DNA, 13 bp, Homo sapiens
tatgaaataaaga

SEQ ID NO: 4954263 - DNA, 14 bp, Homo sapiens
tatgaaataaagaa

SEQ ID NO: 4954264 - DNA, 19 bp, Homo sapiens
tatgaaataaagaaattgc

SEQ ID NO: 4954265 - DNA, 14 bp, Homo sapiens
tatgaacaactcca

SEQ ID NO: 4954266 - DNA, 16 bp, Homo sapiens
tatgaaccctttgttt

SEQ ID NO: 4954267 - DNA, 20 bp, Homo sapiens
tatgaaccctttgtttcttg

SEQ ID NO: 4954268 - DNA, 19 bp, Homo sapiens
tatgaagtgcgtgaatgta

SEQ ID NO: 4954269 - DNA, 22 bp, Homo sapiens
tatgaagtttaaaacagtattt

SEQ ID NO: 4954270 - DNA, 12 bp, Homo sapiens
tatgaataaagt

SEQ ID NO: 4954271 - DNA, 20 bp, Homo sapiens
tatgaatgtactgcatgtta

SEQ ID NO: 4954272 - DNA, 19 bp, Homo sapiens
tatgaatttaaatataatt

SEQ ID NO: 4954273 - DNA, 16 bp, Homo sapiens
tatgacgctgatacat

SEQ ID NO: 4954274 - DNA, 18 bp, Homo sapiens
tatgacgctgatacataa

SEQ ID NO: 4954275 - DNA, 16 bp, Homo sapiens
tatgactatgtaaact

SEQ ID NO: 4954276 - DNA, 17 bp, Homo sapiens
tatgactatgtaaacta

SEQ ID NO: 4954277 - DNA, 17 bp, Homo sapiens
tatgactgctccccagc

SEQ ID NO: 4954278 - DNA, 22 bp, Homo sapiens
tatgactgctccccagccctgg

SEQ ID NO: 4954279 - DNA, 13 bp, Homo sapiens
tatgagcatcctg

SEQ ID NO: 4954280 - DNA, 20 bp, Homo sapiens
tatgagcatcctgagccccg

SEQ ID NO: 4954281 - DNA, 18 bp, Homo sapiens
tatgagcttccttctgtg

SEQ ID NO: 4954282 - DNA, 23 bp, Homo sapiens
tatgaggacttgtgtctctgtgc

SEQ ID NO: 4954283 - DNA, 15 bp, Homo sapiens
tatgataatagattc

SEQ ID NO: 4954284 - DNA, 20 bp, Homo sapiens
tatgatctgttttgtatctt

SEQ ID NO: 4954285 - DNA, 21 bp, Homo sapiens
tatgatgaaaacctacatatt

SEQ ID NO: 4954286 - DNA, 21 bp, Homo sapiens
tatgatgactcccttaaaata

SEQ ID NO: 4954287 - DNA, 22 bp, Homo sapiens
tatgatgtaatctctctgcagc

SEQ ID NO: 4954288 - DNA, 17 bp, Homo sapiens
tatgatgtgttgtgata

SEQ ID NO: 4954289 - DNA, 18 bp, Homo sapiens
tatgatgtgttgtgatag

SEQ ID NO: 4954290 - DNA, 21 bp, Homo sapiens
tatgattcagattgttatcta

SEQ ID NO: 4954291 - DNA, 14 bp, Homo sapiens
tatgattttcataa

SEQ ID NO: 4954292 - DNA, 22 bp, Homo sapiens
tatgcaatggattttcaaccag

SEQ ID NO: 4954293 - DNA, 13 bp, Homo sapiens
tatgcacatatgg

SEQ ID NO: 4954294 - DNA, 14 bp, Homo sapiens
tatgcaccttgtgt

SEQ ID NO: 4954295 - DNA, 16 bp, Homo sapiens
tatgcactaaatatga

SEQ ID NO: 4954296 - DNA, 14 bp, Homo sapiens
tatgcagaatgttt

SEQ ID NO: 4954297 - DNA, 14 bp, Homo sapiens
tatgccagctcagt

SEQ ID NO: 4954298 - DNA, 13 bp, Homo sapiens
tatgccatagaaa

SEQ ID NO: 4954299 - DNA, 16 bp, Homo sapiens
tatgctcttttttact

SEQ ID NO: 4954300 - DNA, 13 bp, Homo sapiens
tatggaactctct

SEQ ID NO: 4954301 - DNA, 19 bp, Homo sapiens
tatggaagggtttgtggct

SEQ ID NO: 4954302 - DNA, 22 bp, Homo sapiens
tatggaagggtttgtggctggg

SEQ ID NO: 4954303 - DNA, 14 bp, Homo sapiens
tatggaattacatg

SEQ ID NO: 4954304 - DNA, 11 bp, Homo sapiens
tatggaattga

SEQ ID NO: 4954305 - DNA, 15 bp, Homo sapiens
tatggactctgcaca

SEQ ID NO: 4954306 - DNA, 18 bp, Homo sapiens
tatggagaattgctgaag

SEQ ID NO: 4954307 - DNA, 21 bp, Homo sapiens
tatggagcagcctggagaccc

SEQ ID NO: 4954308 - DNA, 18 bp, Homo sapiens
tatggaggaacaactctc

SEQ ID NO: 4954309 - DNA, 15 bp, Homo sapiens
tatggatttgttaca

SEQ ID NO: 4954310 - DNA, 14 bp, Homo sapiens
tatggcaaaaatgg

SEQ ID NO: 4954311 - DNA, 16 bp, Homo sapiens
tatggcagaagacacc

SEQ ID NO: 4954312 - DNA, 12 bp, Homo sapiens
tatggcctcagc

SEQ ID NO: 4954313 - DNA, 19 bp, Homo sapiens
tatggcctcagctgcctca

SEQ ID NO: 4954314 - DNA, 23 bp, Homo sapiens
tatggcctcagctgcctcacttc

SEQ ID NO: 4954315 - DNA, 16 bp, Homo sapiens
tatggctgcagtcctc

SEQ ID NO: 4954316 - DNA, 18 bp, Homo sapiens
tatgggactgagcctggc

SEQ ID NO: 4954317 - DNA, 23 bp, Homo sapiens
tatggggagaggaactccttggc

SEQ ID NO: 4954318 - DNA, 21 bp, Homo sapiens
tatggtcaatcccaaaagtca

SEQ ID NO: 4954319 - DNA, 19 bp, Homo sapiens
tatggtcctaaaagcaaaa

SEQ ID NO: 4954320 - DNA, 13 bp, Homo sapiens
tatggttatgaaa

SEQ ID NO: 4954321 - DNA, 23 bp, Homo sapiens
tatgtaatgaagtaaagccatta

SEQ ID NO: 4954322 - DNA, 14 bp, Homo sapiens
tatgtaatgcaaaa

SEQ ID NO: 4954323 - DNA, 17 bp, Homo sapiens
tatgtaatgcaaaattt

SEQ ID NO: 4954324 - DNA, 15 bp, Homo sapiens
tatgtacatgagaag

SEQ ID NO: 4954325 - DNA, 16 bp, Homo sapiens
tatgtacgtttgtatg

SEQ ID NO: 4954326 - DNA, 21 bp, Homo sapiens
tatgtacgtttgtatgtgtgt

SEQ ID NO: 4954327 - DNA, 14 bp, Homo sapiens
tatgtactagtgtt

SEQ ID NO: 4954328 - DNA, 15 bp, Homo sapiens
tatgtagatatttgg

SEQ ID NO: 4954329 - DNA, 23 bp, Homo sapiens
tatgtagatatttggcttaaata

SEQ ID NO: 4954330 - DNA, 23 bp, Homo sapiens
tatgtatatttttttaatttaac

SEQ ID NO: 4954331 - DNA, 18 bp, Homo sapiens
tatgtattgtaaacatgt

SEQ ID NO: 4954332 - DNA, 20 bp, Homo sapiens
tatgtattgtaaacatgtgt

SEQ ID NO: 4954333 - DNA, 23 bp, Homo sapiens
tatgtccactgtgtatagaagta

SEQ ID NO: 4954334 - DNA, 18 bp, Homo sapiens
tatgtctgtttaagaaaa

SEQ ID NO: 4954335 - DNA, 14 bp, Homo sapiens
tatgtgacatttta

SEQ ID NO: 4954336 - DNA, 22 bp, Homo sapiens
tatgtgagagattctgtgatct

SEQ ID NO: 4954337 - DNA, 21 bp, Homo sapiens
tatgtgagattttttattgct

SEQ ID NO: 4954338 - DNA, 23 bp, Homo sapiens
tatgtgagtgtgtgtttgtgctg

SEQ ID NO: 4954339 - DNA, 13 bp, Homo sapiens
tatgtgattacaa

SEQ ID NO: 4954340 - DNA, 14 bp, Homo sapiens
tatgtgtaaaatgt

SEQ ID NO: 4954341 - DNA, 14 bp, Homo sapiens
tatgtgtatatata

SEQ ID NO: 4954342 - DNA, 13 bp, Homo sapiens
tatgtgtatgtac

SEQ ID NO: 4954343 - DNA, 16 bp, Homo sapiens
tatgtgtgaggagctg

SEQ ID NO: 4954344 - DNA, 21 bp, Homo sapiens
tatgtgtgaggagctgctggc

SEQ ID NO: 4954345 - DNA, 13 bp, Homo sapiens
tatgtgtgcatgt
